United States Patent 7,888,497 (BIOINFORMATICALLY DETECTABLE GROUP OF NOVEL REGULATORY OLIGONUCLEOTIDES AND USES THEREOF) - sequence listing, part 113

SEQ ID NO: 4783656 - DNA, 19 bp, Homo sapiens
tcaacctgaattaaagtct

SEQ ID NO: 4783657 - DNA, 21 bp, Homo sapiens
tcaacctggtggcaccagatg

SEQ ID NO: 4783658 - DNA, 17 bp, Homo sapiens
tcaactccaaggcaaat

SEQ ID NO: 4783659 - DNA, 20 bp, Homo sapiens
tcaactgcatcaagatgtga

SEQ ID NO: 4783660 - DNA, 14 bp, Homo sapiens
tcaacttcaggaaa

SEQ ID NO: 4783661 - DNA, 18 bp, Homo sapiens
tcaagaagatagttgtaa

SEQ ID NO: 4783662 - DNA, 17 bp, Homo sapiens
tcaagacggatccacag

SEQ ID NO: 4783663 - DNA, 23 bp, Homo sapiens
tcaagacggatccacagtaatct

SEQ ID NO: 4783664 - DNA, 19 bp, Homo sapiens
tcaagatctaaatcatata

SEQ ID NO: 4783665 - DNA, 13 bp, Homo sapiens
tcaagatgggtga

SEQ ID NO: 4783666 - DNA, 23 bp, Homo sapiens
tcaagattaattaaaatttggga

SEQ ID NO: 4783667 - DNA, 19 bp, Homo sapiens
tcaaggcacattgaaatac

SEQ ID NO: 4783668 - DNA, 20 bp, Homo sapiens
tcaaggcacattgaaatact

SEQ ID NO: 4783669 - DNA, 21 bp, Homo sapiens
tcaagtcccgccctggctctt

SEQ ID NO: 4783670 - DNA, 22 bp, Homo sapiens
tcaagtgtgcctgctatccagc

SEQ ID NO: 4783671 - DNA, 14 bp, Homo sapiens
tcaagttgtgtgct

SEQ ID NO: 4783672 - DNA, 23 bp, Homo sapiens
tcaataacaacagtttttatgtt

SEQ ID NO: 4783673 - DNA, 22 bp, Homo sapiens
tcaatagccccatctctcctgc

SEQ ID NO: 4783674 - DNA, 16 bp, Homo sapiens
tcaatagcgtgtgtag

SEQ ID NO: 4783675 - DNA, 17 bp, Homo sapiens
tcaatagcgtgtgtaga

SEQ ID NO: 4783676 - DNA, 22 bp, Homo sapiens
tcaatatatagagacttctaaa

SEQ ID NO: 4783677 - DNA, 15 bp, Homo sapiens
tcaatcattgtacag

SEQ ID NO: 4783678 - DNA, 21 bp, Homo sapiens
tcaatcattttgggaaattct

SEQ ID NO: 4783679 - DNA, 13 bp, Homo sapiens
tcaatccacagta

SEQ ID NO: 4783680 - DNA, 17 bp, Homo sapiens
tcaatctggcttctgca

SEQ ID NO: 4783681 - DNA, 22 bp, Homo sapiens
tcaatctggcttctgcattact

SEQ ID NO: 4783682 - DNA, 19 bp, Homo sapiens
tcaatgaaatatttgctta

SEQ ID NO: 4783683 - DNA, 16 bp, Homo sapiens
tcaatgctctaacaaa

SEQ ID NO: 4783684 - DNA, 14 bp, Homo sapiens
tcatcaatcattgt

SEQ ID NO: 4783685 - DNA, 22 bp, Homo sapiens
tcatcaccgattcttccttgcc

SEQ ID NO: 4783686 - DNA, 13 bp, Homo sapiens
tcatcatgtctat

SEQ ID NO: 4783687 - DNA, 16 bp, Homo sapiens
tcatcatgtctattgt

SEQ ID NO: 4783688 - DNA, 18 bp, Homo sapiens
tcatcatgtctattgtcc

SEQ ID NO: 4783689 - DNA, 15 bp, Homo sapiens
tcatcatgttttgat

SEQ ID NO: 4783690 - DNA, 20 bp, Homo sapiens
tcatccaaaagtgaccagca

SEQ ID NO: 4783691 - DNA, 21 bp, Homo sapiens
tcatccagtttgttctccggg

SEQ ID NO: 4783692 - DNA, 16 bp, Homo sapiens
tcatccatagacacag

SEQ ID NO: 4783693 - DNA, 18 bp, Homo sapiens
tcatccatagacacagta

SEQ ID NO: 4783694 - DNA, 19 bp, Homo sapiens
tcatccatagacacagtat

SEQ ID NO: 4783695 - DNA, 14 bp, Homo sapiens
tcatcctcacatgt

SEQ ID NO: 4783696 - DNA, 15 bp, Homo sapiens
tcatcctcacatgtg

SEQ ID NO: 4783697 - DNA, 13 bp, Homo sapiens
tcatcctcagcaa

SEQ ID NO: 4783698 - DNA, 13 bp, Homo sapiens
tcatcctcctcag

SEQ ID NO: 4783699 - DNA, 22 bp, Homo sapiens
tcatccttctggaataaggaga

SEQ ID NO: 4783700 - DNA, 17 bp, Homo sapiens
tcatctacacatataaa

SEQ ID NO: 4783701 - DNA, 19 bp, Homo sapiens
tcatctacacatataaaca

SEQ ID NO: 4783702 - DNA, 22 bp, Homo sapiens
tcatctacacatataaacacag

SEQ ID NO: 4783703 - DNA, 21 bp, Homo sapiens
tcatctcaggtggcatttgca

SEQ ID NO: 4783704 - DNA, 15 bp, Homo sapiens
tcatctccatgctct

SEQ ID NO: 4783705 - DNA, 15 bp, Homo sapiens
tcatctctctggggc

SEQ ID NO: 4783706 - DNA, 21 bp, Homo sapiens
tcatctctctggggccctggg

SEQ ID NO: 4783707 - DNA, 22 bp, Homo sapiens
tcatctctctggggccctgggc

SEQ ID NO: 4783708 - DNA, 20 bp, Homo sapiens
tcatctggagtccctcctcc

SEQ ID NO: 4783709 - DNA, 21 bp, Homo sapiens
tcatctggagtccctcctccc

SEQ ID NO: 4783710 - DNA, 17 bp, Homo sapiens
tcatctggattccagag

SEQ ID NO: 4783711 - DNA, 19 bp, Homo sapiens
tcatctgtaaaaccaggct

SEQ ID NO: 4783712 - DNA, 14 bp, Homo sapiens
tcatctgtaaaata

SEQ ID NO: 4783713 - DNA, 20 bp, Homo sapiens
tcatcttccttctcagcctt

SEQ ID NO: 4783714 - DNA, 18 bp, Homo sapiens
tcatcttgaagggcccag

SEQ ID NO: 4783715 - DNA, 19 bp, Homo sapiens
tcatcttgaattgtaagga

SEQ ID NO: 4783716 - DNA, 13 bp, Homo sapiens
tcatcttgtaaat

SEQ ID NO: 4783717 - DNA, 17 bp, Homo sapiens
tcatgaatgttgcatga

SEQ ID NO: 4783718 - DNA, 22 bp, Homo sapiens
tcatgaattagaagaaaatgga

SEQ ID NO: 4783719 - DNA, 20 bp, Homo sapiens
tcatgacaaccgacgaagaa

SEQ ID NO: 4783720 - DNA, 13 bp, Homo sapiens
tcatgaccttaca

SEQ ID NO: 4783721 - DNA, 12 bp, Homo sapiens
tcatgactttca

SEQ ID NO: 4783722 - DNA, 20 bp, Homo sapiens
tcatgactttcagattgtat

SEQ ID NO: 4783723 - DNA, 21 bp, Homo sapiens
tcatgcccagcttggagtgcc

SEQ ID NO: 4783724 - DNA, 22 bp, Homo sapiens
tcatgcccagcttggagtgcca

SEQ ID NO: 4783725 - DNA, 14 bp, Homo sapiens
tcatgctgcctgcc

SEQ ID NO: 4783726 - DNA, 19 bp, Homo sapiens
tcatgctgcctgccatgtg

SEQ ID NO: 4783727 - DNA, 18 bp, Homo sapiens
tcatgcttgatttgacca

SEQ ID NO: 4783728 - DNA, 18 bp, Homo sapiens
tcatggatttattttttg

SEQ ID NO: 4783729 - DNA, 13 bp, Homo sapiens
tcatggctgtccc

SEQ ID NO: 4783730 - DNA, 19 bp, Homo sapiens
tcatggctgtcccctgcaa

SEQ ID NO: 4783731 - DNA, 20 bp, Homo sapiens
tcatggctgttatctgtctt

SEQ ID NO: 4783732 - DNA, 18 bp, Homo sapiens
tcatgggcattgctggac

SEQ ID NO: 4783733 - DNA, 15 bp, Homo sapiens
tcatgtaaataaata

SEQ ID NO: 4783734 - DNA, 22 bp, Homo sapiens
tcatgtaaattgactgtactag

SEQ ID NO: 4783735 - DNA, 16 bp, Homo sapiens
tcatgttctgtgtcac

SEQ ID NO: 4783736 - DNA, 13 bp, Homo sapiens
tcatgtttaagaa

SEQ ID NO: 4783737 - DNA, 23 bp, Homo sapiens
tcatgtttaagaaatgagaaatt

SEQ ID NO: 4783738 - DNA, 15 bp, Homo sapiens
tcatgttttgctaat

SEQ ID NO: 4783739 - DNA, 17 bp, Homo sapiens
tcatgttttgctaatgc

SEQ ID NO: 4783740 - DNA, 20 bp, Homo sapiens
tcattaaaacaagagaccac

SEQ ID NO: 4783741 - DNA, 14 bp, Homo sapiens
tcattaaacaaaca

SEQ ID NO: 4783742 - DNA, 13 bp, Homo sapiens
tcattaaattact

SEQ ID NO: 4783743 - DNA, 17 bp, Homo sapiens
tcattagaattaccatt

SEQ ID NO: 4783744 - DNA, 23 bp, Homo sapiens
tcattcagaatgtgcaaagcagt

SEQ ID NO: 4783745 - DNA, 19 bp, Homo sapiens
tcattcatacttaaaaatt

SEQ ID NO: 4783746 - DNA, 11 bp, Homo sapiens
tcattccaaac

SEQ ID NO: 4783747 - DNA, 16 bp, Homo sapiens
tcattccatttgctga

SEQ ID NO: 4783748 - DNA, 15 bp, Homo sapiens
tcattctcatccaaa

SEQ ID NO: 4783749 - DNA, 16 bp, Homo sapiens
tcattctcatccaaaa

SEQ ID NO: 4783750 - DNA, 23 bp, Homo sapiens
tcattctcatccaaaagtgacca

SEQ ID NO: 4783751 - DNA, 20 bp, Homo sapiens
tcattctgctaatttatgaa

SEQ ID NO: 4783752 - DNA, 20 bp, Homo sapiens
tcattcttctaaaactactg

SEQ ID NO: 4783753 - DNA, 21 bp, Homo sapiens
tcattcttctaaaactactgc

SEQ ID NO: 4783754 - DNA, 18 bp, Homo sapiens
tcattgagaaataaagca

SEQ ID NO: 4783755 - DNA, 14 bp, Homo sapiens
tcattgcactgcag

SEQ ID NO: 4783756 - DNA, 16 bp, Homo sapiens
tcattgcactgcagtt

SEQ ID NO: 4783757 - DNA, 22 bp, Homo sapiens
tcattgccaaggcatccccagt

SEQ ID NO: 4783758 - DNA, 19 bp, Homo sapiens
tcattgtgttttcttcgtg

SEQ ID NO: 4783759 - DNA, 21 bp, Homo sapiens
tcattgtgttttcttcgtgga

SEQ ID NO: 4783760 - DNA, 11 bp, Homo sapiens
tcattgttaca

SEQ ID NO: 4783761 - DNA, 21 bp, Homo sapiens
tcattgttacaggtgtactat

SEQ ID NO: 4783762 - DNA, 22 bp, Homo sapiens
tcatttaaaaaggtttaaaact

SEQ ID NO: 4783763 - DNA, 22 bp, Homo sapiens
tcatttatttccatattaaaat

SEQ ID NO: 4783764 - DNA, 16 bp, Homo sapiens
tcatttccagcaaaat

SEQ ID NO: 4783765 - DNA, 14 bp, Homo sapiens
tcatttgctaatga

SEQ ID NO: 4783766 - DNA, 22 bp, Homo sapiens
tcattttatatatgaaaactaa

SEQ ID NO: 4783767 - DNA, 21 bp, Homo sapiens
tcattttattctgtcaatgaa

SEQ ID NO: 4783768 - DNA, 18 bp, Homo sapiens
tcattttcagatccttcc

SEQ ID NO: 4783769 - DNA, 14 bp, Homo sapiens
tcattttcctggga

SEQ ID NO: 4783770 - DNA, 16 bp, Homo sapiens
tcattttcctgggagt

SEQ ID NO: 4783771 - DNA, 20 bp, Homo sapiens
tcattttctagccctctccc

SEQ ID NO: 4783772 - DNA, 13 bp, Homo sapiens
tcattttctgtta

SEQ ID NO: 4783773 - DNA, 15 bp, Homo sapiens
tcattttgatgtatt

SEQ ID NO: 4783774 - DNA, 15 bp, Homo sapiens
tcattttgcttccca

SEQ ID NO: 4783775 - DNA, 18 bp, Homo sapiens
tcattttgcttcccatct

SEQ ID NO: 4783776 - DNA, 20 bp, Homo sapiens
tccaaaactgtattgaaaaa

SEQ ID NO: 4783777 - DNA, 19 bp, Homo sapiens
tccaaaagtactagcaata

SEQ ID NO: 4783778 - DNA, 23 bp, Homo sapiens
tccaaaatagtcatgtttctgca

SEQ ID NO: 4783779 - DNA, 13 bp, Homo sapiens
tccaaacctacct

SEQ ID NO: 4783780 - DNA, 21 bp, Homo sapiens
tccaaacctaccttatagagc

SEQ ID NO: 4783781 - DNA, 18 bp, Homo sapiens
tccaaacttaacagatca

SEQ ID NO: 4783782 - DNA, 17 bp, Homo sapiens
tccaaagcctgggcaga

SEQ ID NO: 4783783 - DNA, 18 bp, Homo sapiens
tccaacctggaggctgga

SEQ ID NO: 4783784 - DNA, 17 bp, Homo sapiens
tccaacttttcatccag

SEQ ID NO: 4783785 - DNA, 16 bp, Homo sapiens
tccaagagggactcca

SEQ ID NO: 4783786 - DNA, 20 bp, Homo sapiens
tccaagcactagccttccca

SEQ ID NO: 4783787 - DNA, 21 bp, Homo sapiens
tccaagcactagccttcccag

SEQ ID NO: 4783788 - DNA, 17 bp, Homo sapiens
tccaagcatcagcaaga

SEQ ID NO: 4783789 - DNA, 18 bp, Homo sapiens
tccaaggaacttcatgct

SEQ ID NO: 4783790 - DNA, 20 bp, Homo sapiens
tccaaggaacttcatgcttg

SEQ ID NO: 4783791 - DNA, 21 bp, Homo sapiens
tccaaggaagggatgtatttg

SEQ ID NO: 4783792 - DNA, 13 bp, Homo sapiens
tccaaggcaaatg

SEQ ID NO: 4783793 - DNA, 21 bp, Homo sapiens
tccaaggcaaatgtccaagca

SEQ ID NO: 4783794 - DNA, 17 bp, Homo sapiens
tccaagtattttatctg

SEQ ID NO: 4783795 - DNA, 18 bp, Homo sapiens
tccaagtcatgggagaag

SEQ ID NO: 4783796 - DNA, 14 bp, Homo sapiens
tccaagtgtgtgtg

SEQ ID NO: 4783797 - DNA, 15 bp, Homo sapiens
tccaataattgactg

SEQ ID NO: 4783798 - DNA, 21 bp, Homo sapiens
tccaatgccaattcatctcag

SEQ ID NO: 4783799 - DNA, 20 bp, Homo sapiens
tccaatgtggtggcaataaa

SEQ ID NO: 4783800 - DNA, 15 bp, Homo sapiens
tccaattttcctaag

SEQ ID NO: 4783801 - DNA, 14 bp, Homo sapiens
tccacaagagccca

SEQ ID NO: 4783802 - DNA, 17 bp, Homo sapiens
tccacaagagcccaggc

SEQ ID NO: 4783803 - DNA, 20 bp, Homo sapiens
tccacaagagcccaggcctc

SEQ ID NO: 4783804 - DNA, 17 bp, Homo sapiens
tccacaattttgtctct

SEQ ID NO: 4783805 - DNA, 18 bp, Homo sapiens
tccctcagccctcattaa

SEQ ID NO: 4783806 - DNA, 17 bp, Homo sapiens
tccctccactcctccca

SEQ ID NO: 4783807 - DNA, 15 bp, Homo sapiens
tccctccctcctggc

SEQ ID NO: 4783808 - DNA, 15 bp, Homo sapiens
tccctccctgctccc

SEQ ID NO: 4783809 - DNA, 22 bp, Homo sapiens
tccctcccttctttccttcctt

SEQ ID NO: 4783810 - DNA, 15 bp, Homo sapiens
tccctcctcccccac

SEQ ID NO: 4783811 - DNA, 13 bp, Homo sapiens
tccctcctggctc

SEQ ID NO: 4783812 - DNA, 15 bp, Homo sapiens
tccctcctggctcac

SEQ ID NO: 4783813 - DNA, 22 bp, Homo sapiens
tccctcctggctcacagccacc

SEQ ID NO: 4783814 - DNA, 14 bp, Homo sapiens
tccctcgagctctg

SEQ ID NO: 4783815 - DNA, 19 bp, Homo sapiens
tccctcgagctctgtagcc

SEQ ID NO: 4783816 - DNA, 21 bp, Homo sapiens
tccctcgagctctgtagcctg

SEQ ID NO: 4783817 - DNA, 22 bp, Homo sapiens
tccctcgagctctgtagcctgg

SEQ ID NO: 4783818 - DNA, 23 bp, Homo sapiens
tccctcgagctctgtagcctggt

SEQ ID NO: 4783819 - DNA, 14 bp, Homo sapiens
tccctcgctgtatg

SEQ ID NO: 4783820 - DNA, 16 bp, Homo sapiens
tccctcgctgtatgat

SEQ ID NO: 4783821 - DNA, 12 bp, Homo sapiens
tccctcggtcag

SEQ ID NO: 4783822 - DNA, 15 bp, Homo sapiens
tccctctcgctcccc

SEQ ID NO: 4783823 - DNA, 22 bp, Homo sapiens
tccctgacactgtctgctgccc

SEQ ID NO: 4783824 - DNA, 16 bp, Homo sapiens
tccctgactccctgtg

SEQ ID NO: 4783825 - DNA, 18 bp, Homo sapiens
tccctgacttcccagctg

SEQ ID NO: 4783826 - DNA, 18 bp, Homo sapiens
tccctgagggcccttccc

SEQ ID NO: 4783827 - DNA, 23 bp, Homo sapiens
tccctgagggcccttcccaacct

SEQ ID NO: 4783828 - DNA, 20 bp, Homo sapiens
tccctgcaaggtgcacctgc

SEQ ID NO: 4783829 - DNA, 21 bp, Homo sapiens
tccctgcatcccttggcccct

SEQ ID NO: 4783830 - DNA, 19 bp, Homo sapiens
tccctgcccaggccggcca

SEQ ID NO: 4783831 - DNA, 24 bp, Homo sapiens
tccctgcgacggaggcaggaccag

SEQ ID NO: 4783832 - DNA, 15 bp, Homo sapiens
tccctgctgccaggc

SEQ ID NO: 4783833 - DNA, 17 bp, Homo sapiens
tccctgctgccaggctc

SEQ ID NO: 4783834 - DNA, 22 bp, Homo sapiens
tccctggacgcatgcagggccc

SEQ ID NO: 4783835 - DNA, 20 bp, Homo sapiens
tccctgtctgtctgtctctc

SEQ ID NO: 4783836 - DNA, 20 bp, Homo sapiens
tccctgtgggggtggccatc

SEQ ID NO: 4783837 - DNA, 18 bp, Homo sapiens
tcccttcatcccagggta

SEQ ID NO: 4783838 - DNA, 20 bp, Homo sapiens
tcccttccactgcctctgcc

SEQ ID NO: 4783839 - DNA, 14 bp, Homo sapiens
tcccttcctgtcct

SEQ ID NO: 4783840 - DNA, 15 bp, Homo sapiens
tcccttcctgtcctg

SEQ ID NO: 4783841 - DNA, 19 bp, Homo sapiens
tcccttcctgtcctgctca

SEQ ID NO: 4783842 - DNA, 15 bp, Homo sapiens
tcccttctcacagca

SEQ ID NO: 4783843 - DNA, 14 bp, Homo sapiens
tccctttccctgca

SEQ ID NO: 4783844 - DNA, 19 bp, Homo sapiens
tccctttttaaacaaatgg

SEQ ID NO: 4783845 - DNA, 13 bp, Homo sapiens
tccctttttgaat

SEQ ID NO: 4783846 - DNA, 19 bp, Homo sapiens
tccctttttgaattgtgtg

SEQ ID NO: 4783847 - DNA, 14 bp, Homo sapiens
tccgagcccctgtt

SEQ ID NO: 4783848 - DNA, 23 bp, Homo sapiens
tccgagcccctgtttctcctcca

SEQ ID NO: 4783849 - DNA, 19 bp, Homo sapiens
tccgaggcctggctctgga

SEQ ID NO: 4783850 - DNA, 21 bp, Homo sapiens
tccgaggcctggctctggagc

SEQ ID NO: 4783851 - DNA, 22 bp, Homo sapiens
tccgcacgcggccgctctccgc

SEQ ID NO: 4783852 - DNA, 15 bp, Homo sapiens
tccgccagccctgtt

SEQ ID NO: 4783853 - DNA, 20 bp, Homo sapiens
tccgccccccggcctggccc

SEQ ID NO: 4783854 - DNA, 12 bp, Homo sapiens
tccgcccgccca

SEQ ID NO: 4783855 - DNA, 16 bp, Homo sapiens
tccgcccgcccacccc

SEQ ID NO: 4783856 - DNA, 17 bp, Homo sapiens
tccgcccgcccaccccg

SEQ ID NO: 4783857 - DNA, 20 bp, Homo sapiens
tccgcccgcccaccccgctg

SEQ ID NO: 4783858 - DNA, 13 bp, Homo sapiens
tccgcccttccct

SEQ ID NO: 4783859 - DNA, 15 bp, Homo sapiens
tccgcggaggcccct

SEQ ID NO: 4783860 - DNA, 17 bp, Homo sapiens
tccgcgtggttctgcca

SEQ ID NO: 4783861 - DNA, 18 bp, Homo sapiens
tccgctgtcgccccaggc

SEQ ID NO: 4783862 - DNA, 21 bp, Homo sapiens
tccgctgtcgccccaggccct

SEQ ID NO: 4783863 - DNA, 19 bp, Homo sapiens
tccggatggaatcacagcc

SEQ ID NO: 4783864 - DNA, 20 bp, Homo sapiens
tccggatggaatcacagcca

SEQ ID NO: 4783865 - DNA, 12 bp, Homo sapiens
tccggcagaggc

SEQ ID NO: 4783866 - DNA, 19 bp, Homo sapiens
tccggcagaggcagggccc

SEQ ID NO: 4783867 - DNA, 14 bp, Homo sapiens
tccggccctgcccc

SEQ ID NO: 4783868 - DNA, 23 bp, Homo sapiens
tccggccctgccccacacaggcc

SEQ ID NO: 4783869 - DNA, 14 bp, Homo sapiens
tccggcctgcagcc

SEQ ID NO: 4783870 - DNA, 20 bp, Homo sapiens
tccggcttggctagtcacat

SEQ ID NO: 4783871 - DNA, 21 bp, Homo sapiens
tccgggcctcggcctggcttc

SEQ ID NO: 4783872 - DNA, 22 bp, Homo sapiens
tccgggcctcggcctggcttca

SEQ ID NO: 4783873 - DNA, 18 bp, Homo sapiens
tccgggtgtggcctcagc

SEQ ID NO: 4783874 - DNA, 22 bp, Homo sapiens
tccggtgccttccaccctgccc

SEQ ID NO: 4783875 - DNA, 20 bp, Homo sapiens
tccgtaccatcggtcagcag

SEQ ID NO: 4783876 - DNA, 16 bp, Homo sapiens
tccgtcctgctcgccc

SEQ ID NO: 4783877 - DNA, 17 bp, Homo sapiens
tccgtcctgctcgccct

SEQ ID NO: 4783878 - DNA, 14 bp, Homo sapiens
tccgtctctgtccg

SEQ ID NO: 4783879 - DNA, 13 bp, Homo sapiens
tccgtctgtcctg

SEQ ID NO: 4783880 - DNA, 15 bp, Homo sapiens
tccgtgaaagttgtg

SEQ ID NO: 4783881 - DNA, 19 bp, Homo sapiens
tccgtgaaagttgtgatct

SEQ ID NO: 4783882 - DNA, 17 bp, Homo sapiens
tcctaaagaaaaagata

SEQ ID NO: 4783883 - DNA, 19 bp, Homo sapiens
tcctaacattatattccca

SEQ ID NO: 4783884 - DNA, 12 bp, Homo sapiens
tcctaagctgcc

SEQ ID NO: 4783885 - DNA, 21 bp, Homo sapiens
tcctaagctgccagccttccc

SEQ ID NO: 4783886 - DNA, 22 bp, Homo sapiens
tcctaagctggagtgcagtggc

SEQ ID NO: 4783887 - DNA, 16 bp, Homo sapiens
tcctaatcttctgaac

SEQ ID NO: 4783888 - DNA, 13 bp, Homo sapiens
tcctaattcctgt

SEQ ID NO: 4783889 - DNA, 14 bp, Homo sapiens
tcctaattcctgta

SEQ ID NO: 4783890 - DNA, 22 bp, Homo sapiens
tcctaggggccgagggaaatgc

SEQ ID NO: 4783891 - DNA, 16 bp, Homo sapiens
tcctagtttgacctca

SEQ ID NO: 4783892 - DNA, 18 bp, Homo sapiens
tcctagtttgacctcaca

SEQ ID NO: 4783893 - DNA, 21 bp, Homo sapiens
tcctagtttgacctcacagtg

SEQ ID NO: 4783894 - DNA, 19 bp, Homo sapiens
tcctataccggagctccag

SEQ ID NO: 4783895 - DNA, 20 bp, Homo sapiens
tcctataccggagctccagt

SEQ ID NO: 4783896 - DNA, 13 bp, Homo sapiens
tcctatccctgga

SEQ ID NO: 4783897 - DNA, 19 bp, Homo sapiens
tcctatcgatctggaaaga

SEQ ID NO: 4783898 - DNA, 15 bp, Homo sapiens
tcctcaaaaatcatc

SEQ ID NO: 4783899 - DNA, 17 bp, Homo sapiens
tcctcaagttgtgtgct

SEQ ID NO: 4783900 - DNA, 18 bp, Homo sapiens
tcctcaccttctgtttta

SEQ ID NO: 4783901 - DNA, 20 bp, Homo sapiens
tcctcactgagaaggcccca

SEQ ID NO: 4783902 - DNA, 15 bp, Homo sapiens
tcctcactgccacta

SEQ ID NO: 4783903 - DNA, 14 bp, Homo sapiens
tcctcagccccagg

SEQ ID NO: 4783904 - DNA, 19 bp, Homo sapiens
tcctcatctccatgctctt

SEQ ID NO: 4783905 - DNA, 14 bp, Homo sapiens
tcctcatgaaagca

SEQ ID NO: 4783906 - DNA, 21 bp, Homo sapiens
tcctcatgtgagaaagcagat

SEQ ID NO: 4783907 - DNA, 17 bp, Homo sapiens
tcctcattgttcagaaa

SEQ ID NO: 4783908 - DNA, 20 bp, Homo sapiens
tcctccaaagcctgggcaga

SEQ ID NO: 4783909 - DNA, 14 bp, Homo sapiens
tcctccaaatgctg

SEQ ID NO: 4783910 - DNA, 22 bp, Homo sapiens
tcctccagactcgagagggctg

SEQ ID NO: 4783911 - DNA, 19 bp, Homo sapiens
tcctccagagcctgggcgc

SEQ ID NO: 4783912 - DNA, 14 bp, Homo sapiens
tcctccagccctgg

SEQ ID NO: 4783913 - DNA, 17 bp, Homo sapiens
tcctccagccctgggca

SEQ ID NO: 4783914 - DNA, 20 bp, Homo sapiens
tcctccaggaggactgttct

SEQ ID NO: 4783915 - DNA, 16 bp, Homo sapiens
tcctccattgtatctt

SEQ ID NO: 4783916 - DNA, 15 bp, Homo sapiens
tcctccccctcctcc

SEQ ID NO: 4783917 - DNA, 18 bp, Homo sapiens
tcctccccctcctccatg

SEQ ID NO: 4783918 - DNA, 14 bp, Homo sapiens
tcctcccctggaag

SEQ ID NO: 4783919 - DNA, 14 bp, Homo sapiens
tcctccgtgggcag

SEQ ID NO: 4783920 - DNA, 12 bp, Homo sapiens
tcctcctcagat

SEQ ID NO: 4783921 - DNA, 20 bp, Homo sapiens
tcctcctcagtcttctcagt

SEQ ID NO: 4783922 - DNA, 22 bp, Homo sapiens
tcctcctctcaaacctggcaga

SEQ ID NO: 4783923 - DNA, 22 bp, Homo sapiens
tcctcgccccccgcccggcctc

SEQ ID NO: 4783924 - DNA, 13 bp, Homo sapiens
tcctcggccctgt

SEQ ID NO: 4783925 - DNA, 19 bp, Homo sapiens
tcctcggccctgtagccct

SEQ ID NO: 4783926 - DNA, 14 bp, Homo sapiens
tgcacatgtattct

SEQ ID NO: 4783927 - DNA, 16 bp, Homo sapiens
tgcacattcatcctca

SEQ ID NO: 4783928 - DNA, 22 bp, Homo sapiens
tgcacattcatcctcacatgtg

SEQ ID NO: 4783929 - DNA, 17 bp, Homo sapiens
tgcacccacccctgccc

SEQ ID NO: 4783930 - DNA, 19 bp, Homo sapiens
tgcaccctccacaggagcc

SEQ ID NO: 4783931 - DNA, 20 bp, Homo sapiens
tgcaccctctgctatgtctg

SEQ ID NO: 4783932 - DNA, 14 bp, Homo sapiens
tgcacctgccccag

SEQ ID NO: 4783933 - DNA, 15 bp, Homo sapiens
tgcacctgccccagg

SEQ ID NO: 4783934 - DNA, 17 bp, Homo sapiens
tgcacctgccccaggct

SEQ ID NO: 4783935 - DNA, 13 bp, Homo sapiens
tgcacctgcttct

SEQ ID NO: 4783936 - DNA, 23 bp, Homo sapiens
tgcacgtgctcttctgttctcaa

SEQ ID NO: 4783937 - DNA, 22 bp, Homo sapiens
tgcactaaaagtgatgtgattt

SEQ ID NO: 4783938 - DNA, 13 bp, Homo sapiens
tgcactcctgtct

SEQ ID NO: 4783939 - DNA, 14 bp, Homo sapiens
tgcactctactctg

SEQ ID NO: 4783940 - DNA, 17 bp, Homo sapiens
tgcactgacccttccag

SEQ ID NO: 4783941 - DNA, 20 bp, Homo sapiens
tgcactgacccttccagaca

SEQ ID NO: 4783942 - DNA, 22 bp, Homo sapiens
tgcactgtcccggagctcaggc

SEQ ID NO: 4783943 - DNA, 13 bp, Homo sapiens
tgcacttctgtta

SEQ ID NO: 4783944 - DNA, 18 bp, Homo sapiens
tgcacttctgttatcagg

SEQ ID NO: 4783945 - DNA, 20 bp, Homo sapiens
tgcagaccacactctgcctg

SEQ ID NO: 4783946 - DNA, 12 bp, Homo sapiens
tgcagaccctgc

SEQ ID NO: 4783947 - DNA, 13 bp, Homo sapiens
tgcagagtaaatc

SEQ ID NO: 4783948 - DNA, 14 bp, Homo sapiens
tgcagatctagcca

SEQ ID NO: 4783949 - DNA, 21 bp, Homo sapiens
tgcagcagtaccatcccactg

SEQ ID NO: 4783950 - DNA, 11 bp, Homo sapiens
tgcagcccaga

SEQ ID NO: 4783951 - DNA, 23 bp, Homo sapiens
tgcagcccagaacgggcctcccc

SEQ ID NO: 4783952 - DNA, 19 bp, Homo sapiens
tgcagcctgagctccaccc

SEQ ID NO: 4783953 - DNA, 21 bp, Homo sapiens
tgcagcctgagctccaccctc

SEQ ID NO: 4783954 - DNA, 16 bp, Homo sapiens
tgcagcttgggagagc

SEQ ID NO: 4783955 - DNA, 14 bp, Homo sapiens
tgcaggaaaaggct

SEQ ID NO: 4783956 - DNA, 19 bp, Homo sapiens
tgcaggaagagatgctcta

SEQ ID NO: 4783957 - DNA, 19 bp, Homo sapiens
tgcaggaatcaaaaattga

SEQ ID NO: 4783958 - DNA, 20 bp, Homo sapiens
tgcaggaatcaaaaattgaa

SEQ ID NO: 4783959 - DNA, 21 bp, Homo sapiens
tgcaggaatcaaaaattgaag

SEQ ID NO: 4783960 - DNA, 15 bp, Homo sapiens
tgcaggacagatcag

SEQ ID NO: 4783961 - DNA, 19 bp, Homo sapiens
tgcaggatgattgtacaga

SEQ ID NO: 4783962 - DNA, 16 bp, Homo sapiens
tgcaggcaagacacct

SEQ ID NO: 4783963 - DNA, 17 bp, Homo sapiens
tgcagggacagcctgca

SEQ ID NO: 4783964 - DNA, 23 bp, Homo sapiens
tgcagggacagttgggtgtgaga

SEQ ID NO: 4783965 - DNA, 13 bp, Homo sapiens
tgcagtataaaat

SEQ ID NO: 4783966 - DNA, 16 bp, Homo sapiens
tgcagtataaaatgta

SEQ ID NO: 4783967 - DNA, 17 bp, Homo sapiens
tgcagtcagaagatctt

SEQ ID NO: 4783968 - DNA, 17 bp, Homo sapiens
tgcagtcagcacagaga

SEQ ID NO: 4783969 - DNA, 19 bp, Homo sapiens
tgcagtcctcggcagctcc

SEQ ID NO: 4783970 - DNA, 22 bp, Homo sapiens
tgcagtggcgtgatctcagctc

SEQ ID NO: 4783971 - DNA, 16 bp, Homo sapiens
tgcagtgttcgcttgg

SEQ ID NO: 4783972 - DNA, 16 bp, Homo sapiens
tgcagttagcacagag

SEQ ID NO: 4783973 - DNA, 17 bp, Homo sapiens
tgcagttagcacagagg

SEQ ID NO: 4783974 - DNA, 21 bp, Homo sapiens
tgcagtttggtatgaaacaaa

SEQ ID NO: 4783975 - DNA, 15 bp, Homo sapiens
tgcataaatgttata

SEQ ID NO: 4783976 - DNA, 14 bp, Homo sapiens
tgcatagacaaagg

SEQ ID NO: 4783977 - DNA, 19 bp, Homo sapiens
tgcatagacaaaggcctta

SEQ ID NO: 4783978 - DNA, 17 bp, Homo sapiens
tgcatagacaagtgttt

SEQ ID NO: 4783979 - DNA, 21 bp, Homo sapiens
tgcatattagcatcatgtctt

SEQ ID NO: 4783980 - DNA, 22 bp, Homo sapiens
tgcatcccttggcccctctctg

SEQ ID NO: 4783981 - DNA, 12 bp, Homo sapiens
tgcatcctcagc

SEQ ID NO: 4783982 - DNA, 20 bp, Homo sapiens
tgcatcctcagccccagggc

SEQ ID NO: 4783983 - DNA, 15 bp, Homo sapiens
tgcatctggcctggg

SEQ ID NO: 4783984 - DNA, 18 bp, Homo sapiens
tgcatgaaggtctacctg

SEQ ID NO: 4783985 - DNA, 14 bp, Homo sapiens
tgcatgacaacagt

SEQ ID NO: 4783986 - DNA, 18 bp, Homo sapiens
tgcatgagaatgtcattt

SEQ ID NO: 4783987 - DNA, 13 bp, Homo sapiens
tgcatgagcacct

SEQ ID NO: 4783988 - DNA, 13 bp, Homo sapiens
tgcatgagctccc

SEQ ID NO: 4783989 - DNA, 15 bp, Homo sapiens
tgcatgcaaaaatga

SEQ ID NO: 4783990 - DNA, 14 bp, Homo sapiens
tgcatgcagggccc

SEQ ID NO: 4783991 - DNA, 19 bp, Homo sapiens
tgcatgctgtcccttacgt

SEQ ID NO: 4783992 - DNA, 15 bp, Homo sapiens
tgcatggcctcccag

SEQ ID NO: 4783993 - DNA, 18 bp, Homo sapiens
tgcatggcctcccagcca

SEQ ID NO: 4783994 - DNA, 21 bp, Homo sapiens
tgcatggcctcccagccaccc

SEQ ID NO: 4783995 - DNA, 15 bp, Homo sapiens
tgcatgtagcatata

SEQ ID NO: 4783996 - DNA, 12 bp, Homo sapiens
tgcatgtctgca

SEQ ID NO: 4783997 - DNA, 14 bp, Homo sapiens
tgcatgtctgcatg

SEQ ID NO: 4783998 - DNA, 14 bp, Homo sapiens
tgcatgttaaaata

SEQ ID NO: 4783999 - DNA, 12 bp, Homo sapiens
tgcattcagatc

SEQ ID NO: 4784000 - DNA, 13 bp, Homo sapiens
tgcattcagatct

SEQ ID NO: 4784001 - DNA, 18 bp, Homo sapiens
tgcattcagatctgaagt

SEQ ID NO: 4784002 - DNA, 19 bp, Homo sapiens
tgcattcagatctgaagta

SEQ ID NO: 4784003 - DNA, 22 bp, Homo sapiens
tgcattcattcatcctcttata

SEQ ID NO: 4784004 - DNA, 12 bp, Homo sapiens
tgcatttagcat

SEQ ID NO: 4784005 - DNA, 16 bp, Homo sapiens
tgcatttagcatgagt

SEQ ID NO: 4784006 - DNA, 20 bp, Homo sapiens
tgcatttagcatgagttctg

SEQ ID NO: 4784007 - DNA, 21 bp, Homo sapiens
tgcatttagcatgagttctgc

SEQ ID NO: 4784008 - DNA, 17 bp, Homo sapiens
tgcatttgagagaagcc

SEQ ID NO: 4784009 - DNA, 22 bp, Homo sapiens
tgcatttgagagaagccacgct

SEQ ID NO: 4784010 - DNA, 18 bp, Homo sapiens
tgcattttaaatgtctat

SEQ ID NO: 4784011 - DNA, 16 bp, Homo sapiens
tgccaaaaggcccctt

SEQ ID NO: 4784012 - DNA, 19 bp, Homo sapiens
tgccaaaaggccccttccc

SEQ ID NO: 4784013 - DNA, 14 bp, Homo sapiens
tgccaaagatagca

SEQ ID NO: 4784014 - DNA, 17 bp, Homo sapiens
tgccaaagatagcagaa

SEQ ID NO: 4784015 - DNA, 14 bp, Homo sapiens
tgccaagactctat

SEQ ID NO: 4784016 - DNA, 14 bp, Homo sapiens
tgccaatgggagct

SEQ ID NO: 4784017 - DNA, 21 bp, Homo sapiens
tgccaatggtgtagctgtcct

SEQ ID NO: 4784018 - DNA, 22 bp, Homo sapiens
tgccaatggtgtagctgtcctc

SEQ ID NO: 4784019 - DNA, 21 bp, Homo sapiens
tgccaatgtccaggtcacagg

SEQ ID NO: 4784020 - DNA, 23 bp, Homo sapiens
tgccaatgtccaggtcacaggca

SEQ ID NO: 4784021 - DNA, 13 bp, Homo sapiens
tgccacaagcaca

SEQ ID NO: 4784022 - DNA, 15 bp, Homo sapiens
tgccacaagcacaat

SEQ ID NO: 4784023 - DNA, 18 bp, Homo sapiens
tgccacaatgtgatatgt

SEQ ID NO: 4784024 - DNA, 15 bp, Homo sapiens
tgccacatggccgct

SEQ ID NO: 4784025 - DNA, 17 bp, Homo sapiens
tgccacatggccgctgc

SEQ ID NO: 4784026 - DNA, 19 bp, Homo sapiens
tgccacatggccgctgccc

SEQ ID NO: 4784027 - DNA, 13 bp, Homo sapiens
tgccaccacccac

SEQ ID NO: 4784028 - DNA, 16 bp, Homo sapiens
tgccaccacccacccc

SEQ ID NO: 4784029 - DNA, 13 bp, Homo sapiens
tgccacccacccc

SEQ ID NO: 4784030 - DNA, 15 bp, Homo sapiens
tgccacccaccccaa

SEQ ID NO: 4784031 - DNA, 13 bp, Homo sapiens
tgccaccctctgc

SEQ ID NO: 4784032 - DNA, 17 bp, Homo sapiens
tgccacgtggccgctgc

SEQ ID NO: 4784033 - DNA, 15 bp, Homo sapiens
tgccactaaaatcca

SEQ ID NO: 4784034 - DNA, 17 bp, Homo sapiens
tgccactcatactcaga

SEQ ID NO: 4784035 - DNA, 20 bp, Homo sapiens
tgccacttagggagtgtgcc

SEQ ID NO: 4784036 - DNA, 16 bp, Homo sapiens
tgccagacagagatca

SEQ ID NO: 4784037 - DNA, 21 bp, Homo sapiens
tgccagacgtgctcctgctga

SEQ ID NO: 4784038 - DNA, 19 bp, Homo sapiens
tgccagacttctaaaataa

SEQ ID NO: 4784039 - DNA, 19 bp, Homo sapiens
tgccagccttcccttcttt

SEQ ID NO: 4784040 - DNA, 23 bp, Homo sapiens
tgccagcttcccttttctcccaa

SEQ ID NO: 4784041 - DNA, 16 bp, Homo sapiens
tgccaggaagccagca

SEQ ID NO: 4784042 - DNA, 12 bp, Homo sapiens
tgccaggctgca

SEQ ID NO: 4784043 - DNA, 13 bp, Homo sapiens
tgccaggctgcag

SEQ ID NO: 4784044 - DNA, 15 bp, Homo sapiens
tgccaggctgcaggg

SEQ ID NO: 4784045 - DNA, 17 bp, Homo sapiens
tgccaggctgcagggac

SEQ ID NO: 4784046 - DNA, 17 bp, Homo sapiens
tgccaggctggagtgca

SEQ ID NO: 4784047 - DNA, 15 bp, Homo sapiens
tgccagtggtggagg

SEQ ID NO: 4784048 - DNA, 19 bp, Homo sapiens
tgccagtggtggaggtggg

SEQ ID NO: 4784049 - DNA, 15 bp, Homo sapiens
tgcttctccacctcc

SEQ ID NO: 4784050 - DNA, 17 bp, Homo sapiens
tgcttctccacctcccc

SEQ ID NO: 4784051 - DNA, 20 bp, Homo sapiens
tgcttctcccgccattggcc

SEQ ID NO: 4784052 - DNA, 21 bp, Homo sapiens
tgcttctcccgccattggcct

SEQ ID NO: 4784053 - DNA, 22 bp, Homo sapiens
tgcttctcccgccattggcctt

SEQ ID NO: 4784054 - DNA, 13 bp, Homo sapiens
tgcttctccctgg

SEQ ID NO: 4784055 - DNA, 14 bp, Homo sapiens
tgcttctgctgccc

SEQ ID NO: 4784056 - DNA, 17 bp, Homo sapiens
tgcttctttcctcttaa

SEQ ID NO: 4784057 - DNA, 23 bp, Homo sapiens
tgcttgagtggacagcagctgga

SEQ ID NO: 4784058 - DNA, 17 bp, Homo sapiens
tgcttgatatcccaagt

SEQ ID NO: 4784059 - DNA, 20 bp, Homo sapiens
tgcttgctggaaaactgcca

SEQ ID NO: 4784060 - DNA, 20 bp, Homo sapiens
tgcttggtttagctgtgcag

SEQ ID NO: 4784061 - DNA, 18 bp, Homo sapiens
tgcttgtcattctgctaa

SEQ ID NO: 4784062 - DNA, 15 bp, Homo sapiens
tgcttgtgtgtatgt

SEQ ID NO: 4784063 - DNA, 16 bp, Homo sapiens
tgctttatccacattg

SEQ ID NO: 4784064 - DNA, 17 bp, Homo sapiens
tgctttatccacattgt

SEQ ID NO: 4784065 - DNA, 17 bp, Homo sapiens
tgctttcatgtttaaga

SEQ ID NO: 4784066 - DNA, 20 bp, Homo sapiens
tgctttcatgtttaagaaat

SEQ ID NO: 4784067 - DNA, 15 bp, Homo sapiens
tgctttctatctaat

SEQ ID NO: 4784068 - DNA, 12 bp, Homo sapiens
tgctttctgata

SEQ ID NO: 4784069 - DNA, 16 bp, Homo sapiens
tgctttctgatacatc

SEQ ID NO: 4784070 - DNA, 16 bp, Homo sapiens
tgctttctgcatgctt

SEQ ID NO: 4784071 - DNA, 18 bp, Homo sapiens
tgctttgagcccacagga

SEQ ID NO: 4784072 - DNA, 20 bp, Homo sapiens
tgctttgttttggctgctct

SEQ ID NO: 4784073 - DNA, 23 bp, Homo sapiens
tgctttgttttggctgctctcca

SEQ ID NO: 4784074 - DNA, 19 bp, Homo sapiens
tgcttttgatggctatgtt

SEQ ID NO: 4784075 - DNA, 17 bp, Homo sapiens
tgcttttttgcaataag

SEQ ID NO: 4784076 - DNA, 21 bp, Homo sapiens
tgcttttttgcaataaggatt

SEQ ID NO: 4784077 - DNA, 19 bp, Homo sapiens
tggaaaaatgccatcaaat

SEQ ID NO: 4784078 - DNA, 21 bp, Homo sapiens
tggaaaacctgaggccaaata

SEQ ID NO: 4784079 - DNA, 14 bp, Homo sapiens
tggaaaactcacag

SEQ ID NO: 4784080 - DNA, 14 bp, Homo sapiens
tggaaaactgccac

SEQ ID NO: 4784081 - DNA, 19 bp, Homo sapiens
tggaaaactgccacaagca

SEQ ID NO: 4784082 - DNA, 14 bp, Homo sapiens
tggaaaactgttaa

SEQ ID NO: 4784083 - DNA, 13 bp, Homo sapiens
tggaaaataataa

SEQ ID NO: 4784084 - DNA, 20 bp, Homo sapiens
tggaaacaaggaaggacatt

SEQ ID NO: 4784085 - DNA, 14 bp, Homo sapiens
tggaaacatctgat

SEQ ID NO: 4784086 - DNA, 17 bp, Homo sapiens
tggaaacatctgatttc

SEQ ID NO: 4784087 - DNA, 21 bp, Homo sapiens
tggaaagggtgtggcttggaa

SEQ ID NO: 4784088 - DNA, 18 bp, Homo sapiens
tggaaaggtcctgctgtg

SEQ ID NO: 4784089 - DNA, 15 bp, Homo sapiens
tggaaatttgtgtgc

SEQ ID NO: 4784090 - DNA, 13 bp, Homo sapiens
tggaaccttccct

SEQ ID NO: 4784091 - DNA, 15 bp, Homo sapiens
tggaacgttctctac

SEQ ID NO: 4784092 - DNA, 21 bp, Homo sapiens
tggaactctatctgggcctgg

SEQ ID NO: 4784093 - DNA, 22 bp, Homo sapiens
tggaactctatctgggcctggg

SEQ ID NO: 4784094 - DNA, 21 bp, Homo sapiens
tggaagacagagatggcagag

SEQ ID NO: 4784095 - DNA, 15 bp, Homo sapiens
tggaagacagctctt

SEQ ID NO: 4784096 - DNA, 14 bp, Homo sapiens
tggaagagagaaag

SEQ ID NO: 4784097 - DNA, 16 bp, Homo sapiens
tggaagagggaggggc

SEQ ID NO: 4784098 - DNA, 12 bp, Homo sapiens
tggaagggcagg

SEQ ID NO: 4784099 - DNA, 17 bp, Homo sapiens
tggaagggcaggagctc

SEQ ID NO: 4784100 - DNA, 18 bp, Homo sapiens
tggaagtactataattta

SEQ ID NO: 4784101 - DNA, 14 bp, Homo sapiens
tggaagttgtcctt

SEQ ID NO: 4784102 - DNA, 13 bp, Homo sapiens
tggaatcacagcc

SEQ ID NO: 4784103 - DNA, 15 bp, Homo sapiens
tggaatcacagccaa

SEQ ID NO: 4784104 - DNA, 13 bp, Homo sapiens
tggaattacataa

SEQ ID NO: 4784105 - DNA, 19 bp, Homo sapiens
tggaattattagcaccagc

SEQ ID NO: 4784106 - DNA, 22 bp, Homo sapiens
tggaattcaatgggtaaataaa

SEQ ID NO: 4784107 - DNA, 21 bp, Homo sapiens
tggacagaatgtggtctgtca

SEQ ID NO: 4784108 - DNA, 15 bp, Homo sapiens
tggacagacacagag

SEQ ID NO: 4784109 - DNA, 23 bp, Homo sapiens
tggacagatgggtgtcccctggt

SEQ ID NO: 4784110 - DNA, 17 bp, Homo sapiens
tggacagcaaaaccatt

SEQ ID NO: 4784111 - DNA, 19 bp, Homo sapiens
tggacagttcacaccctgc

SEQ ID NO: 4784112 - DNA, 20 bp, Homo sapiens
tggacagttcacaccctgca

SEQ ID NO: 4784113 - DNA, 22 bp, Homo sapiens
tggacagttcacaccctgcaag

SEQ ID NO: 4784114 - DNA, 13 bp, Homo sapiens
tggacatgagagt

SEQ ID NO: 4784115 - DNA, 23 bp, Homo sapiens
tggacatgagagtagggccctga

SEQ ID NO: 4784116 - DNA, 14 bp, Homo sapiens
tggaccagttccct

SEQ ID NO: 4784117 - DNA, 22 bp, Homo sapiens
tggaccagttccctcagccctc

SEQ ID NO: 4784118 - DNA, 14 bp, Homo sapiens
tggacctgaccaga

SEQ ID NO: 4784119 - DNA, 15 bp, Homo sapiens
tggacctggcccagt

SEQ ID NO: 4784120 - DNA, 14 bp, Homo sapiens
tggacgtgtgagga

SEQ ID NO: 4784121 - DNA, 21 bp, Homo sapiens
tggactaaccccaacgcacag

SEQ ID NO: 4784122 - DNA, 15 bp, Homo sapiens
tggactgatggttgc

SEQ ID NO: 4784123 - DNA, 20 bp, Homo sapiens
tggactgggtgggccccaca

SEQ ID NO: 4784124 - DNA, 11 bp, Homo sapiens
tggagaaggaa

SEQ ID NO: 4784125 - DNA, 18 bp, Homo sapiens
tggagaagtgtgttctga

SEQ ID NO: 4784126 - DNA, 22 bp, Homo sapiens
tggagaccctgcgcccctgccc

SEQ ID NO: 4784127 - DNA, 23 bp, Homo sapiens
tggagaccctgcgcccctgccca

SEQ ID NO: 4784128 - DNA, 15 bp, Homo sapiens
tggagactaacttat

SEQ ID NO: 4784129 - DNA, 18 bp, Homo sapiens
tggagactaacttatttt

SEQ ID NO: 4784130 - DNA, 23 bp, Homo sapiens
tggagaggaggtgtggagtggag

SEQ ID NO: 4784131 - DNA, 14 bp, Homo sapiens
tggagaggcggcct

SEQ ID NO: 4784132 - DNA, 18 bp, Homo sapiens
tggagcaggcggtgggga

SEQ ID NO: 4784133 - DNA, 22 bp, Homo sapiens
tggagcaggcggtggggagaga

SEQ ID NO: 4784134 - DNA, 15 bp, Homo sapiens
tggagcccctatcct

SEQ ID NO: 4784135 - DNA, 22 bp, Homo sapiens
tggagcccgcctgcgcccccca

SEQ ID NO: 4784136 - DNA, 21 bp, Homo sapiens
tggagcctgagtcagggccca

SEQ ID NO: 4784137 - DNA, 19 bp, Homo sapiens
tggagcctggcacaggact

SEQ ID NO: 4784138 - DNA, 19 bp, Homo sapiens
tggagcgtccttgtccccg

SEQ ID NO: 4784139 - DNA, 20 bp, Homo sapiens
tggaggagaaggaggaaccc

SEQ ID NO: 4784140 - DNA, 20 bp, Homo sapiens
tggaggatggacgagtgagc

SEQ ID NO: 4784141 - DNA, 15 bp, Homo sapiens
tggaggcatttcttt

SEQ ID NO: 4784142 - DNA, 23 bp, Homo sapiens
tggaggccaccaagctgctctcc

SEQ ID NO: 4784143 - DNA, 11 bp, Homo sapiens
tggaggctgga

SEQ ID NO: 4784144 - DNA, 20 bp, Homo sapiens
tggaggtacgaaaagagggg

SEQ ID NO: 4784145 - DNA, 22 bp, Homo sapiens
tggaggtggggagggcctctgg

SEQ ID NO: 4784146 - DNA, 16 bp, Homo sapiens
tggagtccctcctccc

SEQ ID NO: 4784147 - DNA, 19 bp, Homo sapiens
tggagtctgaaggagagga

SEQ ID NO: 4784148 - DNA, 21 bp, Homo sapiens
tggagtctgaaggagaggagt

SEQ ID NO: 4784149 - DNA, 23 bp, Homo sapiens
tggagtctgaaggagaggagtgc

SEQ ID NO: 4784150 - DNA, 21 bp, Homo sapiens
tggagtgccacatggccgctg

SEQ ID NO: 4784151 - DNA, 11 bp, Homo sapiens
tggagtggagg

SEQ ID NO: 4784152 - DNA, 13 bp, Homo sapiens
tggagtggagggg

SEQ ID NO: 4784153 - DNA, 16 bp, Homo sapiens
tggagttggcagacag

SEQ ID NO: 4784154 - DNA, 21 bp, Homo sapiens
tggatacgtgtcaatgtgtgc

SEQ ID NO: 4784155 - DNA, 21 bp, Homo sapiens
tggatactggggggcaggcct

SEQ ID NO: 4784156 - DNA, 14 bp, Homo sapiens
tggatctcttaaga

SEQ ID NO: 4784157 - DNA, 20 bp, Homo sapiens
tggatgactcggtctgagaa

SEQ ID NO: 4784158 - DNA, 17 bp, Homo sapiens
tggatggaggtgatgaa

SEQ ID NO: 4784159 - DNA, 13 bp, Homo sapiens
tggatggatctgc

SEQ ID NO: 4784160 - DNA, 14 bp, Homo sapiens
tggatgtcccttcc

SEQ ID NO: 4784161 - DNA, 19 bp, Homo sapiens
tggatgtgcatctggccta

SEQ ID NO: 4784162 - DNA, 15 bp, Homo sapiens
tggatgtgctttcat

SEQ ID NO: 4784163 - DNA, 17 bp, Homo sapiens
tggattataatcagaat

SEQ ID NO: 4784164 - DNA, 12 bp, Homo sapiens
tggattccagag

SEQ ID NO: 4784165 - DNA, 23 bp, Homo sapiens
tggatttattttttgtaactctt

SEQ ID NO: 4784166 - DNA, 17 bp, Homo sapiens
tggatttgacacactca

SEQ ID NO: 4784167 - DNA, 18 bp, Homo sapiens
tggattttaaacaaaatt

SEQ ID NO: 4784168 - DNA, 13 bp, Homo sapiens
tggcaaacattta

SEQ ID NO: 4784169 - DNA, 15 bp, Homo sapiens
tggcaacgttcatgt

SEQ ID NO: 4784170 - DNA, 14 bp, Homo sapiens
tggcaactgtggaa

SEQ ID NO: 4784171 - DNA, 16 bp, Homo sapiens
tgggggtggggctgca

SEQ ID NO: 4784172 - DNA, 14 bp, Homo sapiens
tggggtagagagga

SEQ ID NO: 4784173 - DNA, 21 bp, Homo sapiens
tggggtgagaagtacagggca

SEQ ID NO: 4784174 - DNA, 14 bp, Homo sapiens
tggggtgctggggc

SEQ ID NO: 4784175 - DNA, 18 bp, Homo sapiens
tggggtgggagccacagg

SEQ ID NO: 4784176 - DNA, 19 bp, Homo sapiens
tggggtggggcttggaagg

SEQ ID NO: 4784177 - DNA, 19 bp, Homo sapiens
tggggttttcacttcctag

SEQ ID NO: 4784178 - DNA, 17 bp, Homo sapiens
tgggtaaataaatgctg

SEQ ID NO: 4784179 - DNA, 21 bp, Homo sapiens
tgggtaaataaatgctgcttt

SEQ ID NO: 4784180 - DNA, 23 bp, Homo sapiens
tgggtaaataaatgctgctttgg

SEQ ID NO: 4784181 - DNA, 21 bp, Homo sapiens
tgggtagtgccatggccagga

SEQ ID NO: 4784182 - DNA, 13 bp, Homo sapiens
tgggtccaggaga

SEQ ID NO: 4784183 - DNA, 14 bp, Homo sapiens
tgggtccaggagat

SEQ ID NO: 4784184 - DNA, 16 bp, Homo sapiens
tgggtccccctcctgc

SEQ ID NO: 4784185 - DNA, 23 bp, Homo sapiens
tgggtccctaagcacaataaaag

SEQ ID NO: 4784186 - DNA, 21 bp, Homo sapiens
tgggtcctcccagctgacggc

SEQ ID NO: 4784187 - DNA, 11 bp, Homo sapiens
tgggtcctgct

SEQ ID NO: 4784188 - DNA, 14 bp, Homo sapiens
tgggtcctgctgct

SEQ ID NO: 4784189 - DNA, 15 bp, Homo sapiens
tgggtcgcccctcct

SEQ ID NO: 4784190 - DNA, 11 bp, Homo sapiens
tgggtgccctg

SEQ ID NO: 4784191 - DNA, 16 bp, Homo sapiens
tgggtgctcagggcat

SEQ ID NO: 4784192 - DNA, 19 bp, Homo sapiens
tgggtgctgtcatgcccag

SEQ ID NO: 4784193 - DNA, 22 bp, Homo sapiens
tgggtgggccccacagtggtca

SEQ ID NO: 4784194 - DNA, 22 bp, Homo sapiens
tgggtgtttgggaaaggcaggg

SEQ ID NO: 4784195 - DNA, 13 bp, Homo sapiens
tgggttaacagta

SEQ ID NO: 4784196 - DNA, 16 bp, Homo sapiens
tgggttaacagtaaat

SEQ ID NO: 4784197 - DNA, 20 bp, Homo sapiens
tgggttaacagtaaatatac

SEQ ID NO: 4784198 - DNA, 12 bp, Homo sapiens
tgggttccagac

SEQ ID NO: 4784199 - DNA, 13 bp, Homo sapiens
tgggttccagaca

SEQ ID NO: 4784200 - DNA, 14 bp, Homo sapiens
tgggttccagacag

SEQ ID NO: 4784201 - DNA, 15 bp, Homo sapiens
tgggtttactctgtg

SEQ ID NO: 4784202 - DNA, 17 bp, Homo sapiens
tgggtttctaaagctgc

SEQ ID NO: 4784203 - DNA, 21 bp, Homo sapiens
tgggtttctaaagctgccagc

SEQ ID NO: 4784204 - DNA, 20 bp, Homo sapiens
tgggtttgggcagtggagag

SEQ ID NO: 4784205 - DNA, 13 bp, Homo sapiens
tggtaaataactg

SEQ ID NO: 4784206 - DNA, 15 bp, Homo sapiens
tggtaaataactgtg

SEQ ID NO: 4784207 - DNA, 10 bp, Homo sapiens
tggtaacatt

SEQ ID NO: 4784208 - DNA, 18 bp, Homo sapiens
tggtaagattgttattaa

SEQ ID NO: 4784209 - DNA, 19 bp, Homo sapiens
tggtaagattgttattaaa

SEQ ID NO: 4784210 - DNA, 13 bp, Homo sapiens
tggtaccagccct

SEQ ID NO: 4784211 - DNA, 16 bp, Homo sapiens
tggtaccagccctggg

SEQ ID NO: 4784212 - DNA, 15 bp, Homo sapiens
tggtaccggatgcag

SEQ ID NO: 4784213 - DNA, 19 bp, Homo sapiens
tggtagatattcaggaaat

SEQ ID NO: 4784214 - DNA, 19 bp, Homo sapiens
tggtaggtctggattttca

SEQ ID NO: 4784215 - DNA, 15 bp, Homo sapiens
tggtatgaaacaaat

SEQ ID NO: 4784216 - DNA, 22 bp, Homo sapiens
tggtatgaaacaaatatactca

SEQ ID NO: 4784217 - DNA, 14 bp, Homo sapiens
tggtatgctggcca

SEQ ID NO: 4784218 - DNA, 15 bp, Homo sapiens
tggtatgctggccag

SEQ ID NO: 4784219 - DNA, 18 bp, Homo sapiens
tggtatgctggccagcac

SEQ ID NO: 4784220 - DNA, 12 bp, Homo sapiens
tggtatttactg

SEQ ID NO: 4784221 - DNA, 13 bp, Homo sapiens
tggtatttactgc

SEQ ID NO: 4784222 - DNA, 14 bp, Homo sapiens
tggtattttaacat

SEQ ID NO: 4784223 - DNA, 17 bp, Homo sapiens
tggtattttcgtgcatt

SEQ ID NO: 4784224 - DNA, 17 bp, Homo sapiens
tggtattttttgtgaat

SEQ ID NO: 4784225 - DNA, 18 bp, Homo sapiens
tggtcaataaaccactgt

SEQ ID NO: 4784226 - DNA, 19 bp, Homo sapiens
tggtcacagacccctgggg

SEQ ID NO: 4784227 - DNA, 20 bp, Homo sapiens
tggtcacagacccctggggg

SEQ ID NO: 4784228 - DNA, 19 bp, Homo sapiens
tggtcagcgattcctgcca

SEQ ID NO: 4784229 - DNA, 19 bp, Homo sapiens
tggtcatttggtggctcta

SEQ ID NO: 4784230 - DNA, 14 bp, Homo sapiens
tggtccacacacca

SEQ ID NO: 4784231 - DNA, 20 bp, Homo sapiens
tggtcccacttccccatctg

SEQ ID NO: 4784232 - DNA, 17 bp, Homo sapiens
tggtcccccatgggctg

SEQ ID NO: 4784233 - DNA, 15 bp, Homo sapiens
tggtccttagtaaat

SEQ ID NO: 4784234 - DNA, 15 bp, Homo sapiens
tggtctctttctttc

SEQ ID NO: 4784235 - DNA, 18 bp, Homo sapiens
tggtctctttctttccaa

SEQ ID NO: 4784236 - DNA, 13 bp, Homo sapiens
tggtctgtgcatt

SEQ ID NO: 4784237 - DNA, 16 bp, Homo sapiens
tggtctgtgcattgtg

SEQ ID NO: 4784238 - DNA, 15 bp, Homo sapiens
tggtctgtgtgtgac

SEQ ID NO: 4784239 - DNA, 20 bp, Homo sapiens
tggtcttaactaatgtaaat

SEQ ID NO: 4784240 - DNA, 13 bp, Homo sapiens
tggtcttatcctg

SEQ ID NO: 4784241 - DNA, 14 bp, Homo sapiens
tggtcttggagagg

SEQ ID NO: 4784242 - DNA, 15 bp, Homo sapiens
tggtcttggagagga

SEQ ID NO: 4784243 - DNA, 16 bp, Homo sapiens
tggtcttggagaggag

SEQ ID NO: 4784244 - DNA, 12 bp, Homo sapiens
tggtgaaggggc

SEQ ID NO: 4784245 - DNA, 13 bp, Homo sapiens
tggtgaaggggct

SEQ ID NO: 4784246 - DNA, 14 bp, Homo sapiens
tggtgaaggggctg

SEQ ID NO: 4784247 - DNA, 15 bp, Homo sapiens
tggtgaaggggctgg

SEQ ID NO: 4784248 - DNA, 16 bp, Homo sapiens
tggtgactttgcttca

SEQ ID NO: 4784249 - DNA, 18 bp, Homo sapiens
tggtgatgcctaaaggaa

SEQ ID NO: 4784250 - DNA, 22 bp, Homo sapiens
tggtgcccagactcaaggcctc

SEQ ID NO: 4784251 - DNA, 14 bp, Homo sapiens
tggtgccccctggg

SEQ ID NO: 4784252 - DNA, 14 bp, Homo sapiens
tggtgcgtgtggcc

SEQ ID NO: 4784253 - DNA, 19 bp, Homo sapiens
tggtgcgtgtggccctgtg

SEQ ID NO: 4784254 - DNA, 21 bp, Homo sapiens
tggtgcgtgtggccctgtggg

SEQ ID NO: 4784255 - DNA, 14 bp, Homo sapiens
tggtggccctgcgg

SEQ ID NO: 4784256 - DNA, 17 bp, Homo sapiens
tggtggccgtcacgctt

SEQ ID NO: 4784257 - DNA, 14 bp, Homo sapiens
tggtgggctccaga

SEQ ID NO: 4784258 - DNA, 19 bp, Homo sapiens
tggtgggctccagagtagg

SEQ ID NO: 4784259 - DNA, 18 bp, Homo sapiens
tggtggtgaaggggctgg

SEQ ID NO: 4784260 - DNA, 18 bp, Homo sapiens
tggtggttatgtcccatg

SEQ ID NO: 4784261 - DNA, 18 bp, Homo sapiens
tggtggtttcagaaaggg

SEQ ID NO: 4784262 - DNA, 13 bp, Homo sapiens
tggtgtagctgtc

SEQ ID NO: 4784263 - DNA, 15 bp, Homo sapiens
tggtgtcataactag

SEQ ID NO: 4784264 - DNA, 16 bp, Homo sapiens
tggtgtcataactaga

SEQ ID NO: 4784265 - DNA, 21 bp, Homo sapiens
tggtgtctaataaacacagat

SEQ ID NO: 4784266 - DNA, 21 bp, Homo sapiens
tggtgttctcaatgcttttct

SEQ ID NO: 4784267 - DNA, 19 bp, Homo sapiens
tggtgttgttatggcaagt

SEQ ID NO: 4784268 - DNA, 21 bp, Homo sapiens
tggttaaccgggactacagaa

SEQ ID NO: 4784269 - DNA, 15 bp, Homo sapiens
tggttagtgcatgtc

SEQ ID NO: 4784270 - DNA, 19 bp, Homo sapiens
tggttatgtcccatgacct

SEQ ID NO: 4784271 - DNA, 22 bp, Homo sapiens
tggttccacaatcatctattga

SEQ ID NO: 4784272 - DNA, 16 bp, Homo sapiens
tggttcctcatggctg

SEQ ID NO: 4784273 - DNA, 14 bp, Homo sapiens
tggttcctccagca

SEQ ID NO: 4784274 - DNA, 20 bp, Homo sapiens
tggttgcaaagtgttgtctt

SEQ ID NO: 4784275 - DNA, 20 bp, Homo sapiens
tggttgttttttcattgtgt

SEQ ID NO: 4784276 - DNA, 23 bp, Homo sapiens
tggtttagcgttgttttgtggat

SEQ ID NO: 4784277 - DNA, 21 bp, Homo sapiens
tggtttccatcaaagccctcc

SEQ ID NO: 4784278 - DNA, 13 bp, Homo sapiens
tggttttctctga

SEQ ID NO: 4784279 - DNA, 21 bp, Homo sapiens
tggtttttctgttccctgctg

SEQ ID NO: 4784280 - DNA, 20 bp, Homo sapiens
tgtaaaaaggaatatgaaag

SEQ ID NO: 4784281 - DNA, 14 bp, Homo sapiens
tgtaaaacagtggt

SEQ ID NO: 4784282 - DNA, 15 bp, Homo sapiens
tgtaaaaccaggctg

SEQ ID NO: 4784283 - DNA, 16 bp, Homo sapiens
tgtaaaactgtgacat

SEQ ID NO: 4784284 - DNA, 19 bp, Homo sapiens
tgtaaaactgtgacattcc

SEQ ID NO: 4784285 - DNA, 13 bp, Homo sapiens
tgtaaaatactat

SEQ ID NO: 4784286 - DNA, 19 bp, Homo sapiens
tgtaaaatatttataaatg

SEQ ID NO: 4784287 - DNA, 17 bp, Homo sapiens
tgtaaaggtgatgaatt

SEQ ID NO: 4784288 - DNA, 19 bp, Homo sapiens
tgtaaataaaaatagctat

SEQ ID NO: 4784289 - DNA, 20 bp, Homo sapiens
tgtaaataccagactgcagg

SEQ ID NO: 4784290 - DNA, 16 bp, Homo sapiens
tgtaaatctaacatta

SEQ ID NO: 4784291 - DNA, 20 bp, Homo sapiens
tgtaaattttataaggctga

SEQ ID NO: 4784292 - DNA, 15 bp, Homo sapiens
tgtaactctttggct

SEQ ID NO: 4784293 - DNA, 14 bp, Homo sapiens
tgtaacttaattat

SEQ ID NO: 4784294 - DNA, 22 bp, Homo sapiens
tgtcttgcactggccttctgat

SEQ ID NO: 4784295 - DNA, 16 bp, Homo sapiens
tgtcttgtgttgctgt

SEQ ID NO: 4784296 - DNA, 17 bp, Homo sapiens
tgtctttctccaaagtt

SEQ ID NO: 4784297 - DNA, 20 bp, Homo sapiens
tgtctttggcttcagaattg

SEQ ID NO: 4784298 - DNA, 22 bp, Homo sapiens
tgtgaaacagtgtggatgtaaa

SEQ ID NO: 4784299 - DNA, 18 bp, Homo sapiens
tgtgaaaggaaagaggct

SEQ ID NO: 4784300 - DNA, 15 bp, Homo sapiens
tgtgaataaagccac

SEQ ID NO: 4784301 - DNA, 18 bp, Homo sapiens
tgtgaatataaatgtgtg

SEQ ID NO: 4784302 - DNA, 20 bp, Homo sapiens
tgtgaatataaatgtgtgta

SEQ ID NO: 4784303 - DNA, 15 bp, Homo sapiens
tgtgaatatgtgtaa

SEQ ID NO: 4784304 - DNA, 23 bp, Homo sapiens
tgtgaatgttgtcctgtgtcatc

SEQ ID NO: 4784305 - DNA, 20 bp, Homo sapiens
tgtgaattttaaaatgcaaa

SEQ ID NO: 4784306 - DNA, 22 bp, Homo sapiens
tgtgacaccaccactgtgtccc

SEQ ID NO: 4784307 - DNA, 19 bp, Homo sapiens
tgtgacaggaaagccctcc

SEQ ID NO: 4784308 - DNA, 23 bp, Homo sapiens
tgtgacaggaaagccctccccct

SEQ ID NO: 4784309 - DNA, 15 bp, Homo sapiens
tgtgacatgttttat

SEQ ID NO: 4784310 - DNA, 15 bp, Homo sapiens
tgtgaccaagtataa

SEQ ID NO: 4784311 - DNA, 22 bp, Homo sapiens
tgtgagaaagcagatcatctcc

SEQ ID NO: 4784312 - DNA, 14 bp, Homo sapiens
tgtgagaactgtga

SEQ ID NO: 4784313 - DNA, 18 bp, Homo sapiens
tgtgagaattactgtttg

SEQ ID NO: 4784314 - DNA, 13 bp, Homo sapiens
tgtgagatgtgta

SEQ ID NO: 4784315 - DNA, 18 bp, Homo sapiens
tgtgagatgtgtatcagt

SEQ ID NO: 4784316 - DNA, 23 bp, Homo sapiens
tgtgaggatagagacttgcagtt

SEQ ID NO: 4784317 - DNA, 15 bp, Homo sapiens
tgtgagtcacttcta

SEQ ID NO: 4784318 - DNA, 20 bp, Homo sapiens
tgtgagtctgtcctttccca

SEQ ID NO: 4784319 - DNA, 19 bp, Homo sapiens
tgtgagtgtatgtatacac

SEQ ID NO: 4784320 - DNA, 13 bp, Homo sapiens
tgtgagtgtgaat

SEQ ID NO: 4784321 - DNA, 20 bp, Homo sapiens
tgtgagtgtgaatataaatg

SEQ ID NO: 4784322 - DNA, 18 bp, Homo sapiens
tgtgataacagagtgatt

SEQ ID NO: 4784323 - DNA, 18 bp, Homo sapiens
tgtgataattgtaaaggt

SEQ ID NO: 4784324 - DNA, 14 bp, Homo sapiens
tgtgatatgtgtaa

SEQ ID NO: 4784325 - DNA, 17 bp, Homo sapiens
tgtgatgcaggaagacc

SEQ ID NO: 4784326 - DNA, 19 bp, Homo sapiens
tgtgatgcatgagctccct

SEQ ID NO: 4784327 - DNA, 15 bp, Homo sapiens
tgtgatgtgttgctc

SEQ ID NO: 4784328 - DNA, 16 bp, Homo sapiens
tgtgatgtgttgctct

SEQ ID NO: 4784329 - DNA, 14 bp, Homo sapiens
tgtgatttatgcat

SEQ ID NO: 4784330 - DNA, 16 bp, Homo sapiens
tgtgcactctactctg

SEQ ID NO: 4784331 - DNA, 20 bp, Homo sapiens
tgtgcagagtatacaagtgt

SEQ ID NO: 4784332 - DNA, 13 bp, Homo sapiens
tgtgcagatgaag

SEQ ID NO: 4784333 - DNA, 17 bp, Homo sapiens
tgtgcagtcatcaacaa

SEQ ID NO: 4784334 - DNA, 20 bp, Homo sapiens
tgtgcagtttggtatgaaac

SEQ ID NO: 4784335 - DNA, 16 bp, Homo sapiens
tgtgcatctggcctgg

SEQ ID NO: 4784336 - DNA, 20 bp, Homo sapiens
tgtgcatctggcctgggggc

SEQ ID NO: 4784337 - DNA, 21 bp, Homo sapiens
tgtgcatctggcctgggggct

SEQ ID NO: 4784338 - DNA, 13 bp, Homo sapiens
tgtgcatgagaat

SEQ ID NO: 4784339 - DNA, 18 bp, Homo sapiens
tgtgcatgagaatgtcat

SEQ ID NO: 4784340 - DNA, 21 bp, Homo sapiens
tgtgcatgagaatgtcatttg

SEQ ID NO: 4784341 - DNA, 22 bp, Homo sapiens
tgtgcatgagaatgtcatttgc

SEQ ID NO: 4784342 - DNA, 23 bp, Homo sapiens
tgtgcatgagaatgtcatttgct

SEQ ID NO: 4784343 - DNA, 19 bp, Homo sapiens
tgtgcatgcaaaaatgaat

SEQ ID NO: 4784344 - DNA, 17 bp, Homo sapiens
tgtgccaaaatgtcaat

SEQ ID NO: 4784345 - DNA, 21 bp, Homo sapiens
tgtgccaaaatgtcaattttt

SEQ ID NO: 4784346 - DNA, 18 bp, Homo sapiens
tgtgccaaagatagcaga

SEQ ID NO: 4784347 - DNA, 19 bp, Homo sapiens
tgtgccaaagatagcagaa

SEQ ID NO: 4784348 - DNA, 20 bp, Homo sapiens
tgtgcccacccgtgttctcc

SEQ ID NO: 4784349 - DNA, 22 bp, Homo sapiens
tgtgccccgcctcccggggtgc

SEQ ID NO: 4784350 - DNA, 13 bp, Homo sapiens
tgtgccccttccc

SEQ ID NO: 4784351 - DNA, 18 bp, Homo sapiens
tgtgccccttccccatgc

SEQ ID NO: 4784352 - DNA, 16 bp, Homo sapiens
tgtgcccgtggtgagg

SEQ ID NO: 4784353 - DNA, 13 bp, Homo sapiens
tgtgcctctctct

SEQ ID NO: 4784354 - DNA, 17 bp, Homo sapiens
tgtgcctgctatccagc

SEQ ID NO: 4784355 - DNA, 20 bp, Homo sapiens
tgtgcgtgcatgtgtgttca

SEQ ID NO: 4784356 - DNA, 16 bp, Homo sapiens
tgtgctaagttgtctt

SEQ ID NO: 4784357 - DNA, 16 bp, Homo sapiens
tgtgctcagccccaga

SEQ ID NO: 4784358 - DNA, 18 bp, Homo sapiens
tgtgctgctgtggcatca

SEQ ID NO: 4784359 - DNA, 13 bp, Homo sapiens
tgtgctgtgggca

SEQ ID NO: 4784360 - DNA, 17 bp, Homo sapiens
tgtgctgtgggcagcac

SEQ ID NO: 4784361 - DNA, 21 bp, Homo sapiens
tgtgctgtgggcagcaccctc

SEQ ID NO: 4784362 - DNA, 16 bp, Homo sapiens
tgtgcttatgtcattt

SEQ ID NO: 4784363 - DNA, 18 bp, Homo sapiens
tgtgcttatgtcatttct

SEQ ID NO: 4784364 - DNA, 13 bp, Homo sapiens
tgtgctttcaaga

SEQ ID NO: 4784365 - DNA, 14 bp, Homo sapiens
tgtgctttcaagat

SEQ ID NO: 4784366 - DNA, 12 bp, Homo sapiens
tgtgctttcatc

SEQ ID NO: 4784367 - DNA, 19 bp, Homo sapiens
tgtgctttctgcatgctta

SEQ ID NO: 4784368 - DNA, 23 bp, Homo sapiens
tgtggaaggcacccgccctttcc

SEQ ID NO: 4784369 - DNA, 23 bp, Homo sapiens
tgtggaatcaccgggaacgcccc

SEQ ID NO: 4784370 - DNA, 17 bp, Homo sapiens
tgtggaattacataaca

SEQ ID NO: 4784371 - DNA, 16 bp, Homo sapiens
tgtggagtggaggggt

SEQ ID NO: 4784372 - DNA, 18 bp, Homo sapiens
tgtggataaattttggaa

SEQ ID NO: 4784373 - DNA, 21 bp, Homo sapiens
tgtggatgaaaaaaagggaaa

SEQ ID NO: 4784374 - DNA, 13 bp, Homo sapiens
tgtggatgctctt

SEQ ID NO: 4784375 - DNA, 17 bp, Homo sapiens
tgtggcatcaggaaagg

SEQ ID NO: 4784376 - DNA, 14 bp, Homo sapiens
tgtggcattggggg

SEQ ID NO: 4784377 - DNA, 15 bp, Homo sapiens
tgtggcccctccttc

SEQ ID NO: 4784378 - DNA, 19 bp, Homo sapiens
tgtggcctaatccacctgg

SEQ ID NO: 4784379 - DNA, 16 bp, Homo sapiens
tgtggcctcagccctc

SEQ ID NO: 4784380 - DNA, 11 bp, Homo sapiens
tgtggcctggg

SEQ ID NO: 4784381 - DNA, 13 bp, Homo sapiens
tgtggcctggggc

SEQ ID NO: 4784382 - DNA, 13 bp, Homo sapiens
tgtggcctgggtc

SEQ ID NO: 4784383 - DNA, 19 bp, Homo sapiens
tgtggctgtcaaatccatg

SEQ ID NO: 4784384 - DNA, 16 bp, Homo sapiens
tgtggcttaaacattt

SEQ ID NO: 4784385 - DNA, 16 bp, Homo sapiens
tgtgggactggcccac

SEQ ID NO: 4784386 - DNA, 13 bp, Homo sapiens
tgtgggagtccac

SEQ ID NO: 4784387 - DNA, 14 bp, Homo sapiens
tgtggggtaagttg

SEQ ID NO: 4784388 - DNA, 19 bp, Homo sapiens
tgtgggtttactctgtgct

SEQ ID NO: 4784389 - DNA, 23 bp, Homo sapiens
tgtgggtttctaaagctgccagc

SEQ ID NO: 4784390 - DNA, 21 bp, Homo sapiens
tgtgtaacttttttttagtat

SEQ ID NO: 4784391 - DNA, 14 bp, Homo sapiens
tgtgtatacatatg

SEQ ID NO: 4784392 - DNA, 15 bp, Homo sapiens
tgtgtatacatatgt

SEQ ID NO: 4784393 - DNA, 17 bp, Homo sapiens
tgtgtatacatatgtat

SEQ ID NO: 4784394 - DNA, 19 bp, Homo sapiens
tgtgtatatattatatata

SEQ ID NO: 4784395 - DNA, 22 bp, Homo sapiens
tgtgtatatattatatatacat

SEQ ID NO: 4784396 - DNA, 16 bp, Homo sapiens
tgtgtatgtctatgtg

SEQ ID NO: 4784397 - DNA, 17 bp, Homo sapiens
tgtgtatgtctatgtgt

SEQ ID NO: 4784398 - DNA, 13 bp, Homo sapiens
tgtgtatgtgtgt

SEQ ID NO: 4784399 - DNA, 22 bp, Homo sapiens
tgtgtcacgtgaccctgtgccc

SEQ ID NO: 4784400 - DNA, 19 bp, Homo sapiens
tgtgtccacactaccagtt

SEQ ID NO: 4784401 - DNA, 12 bp, Homo sapiens
tgtgtcccagtg

SEQ ID NO: 4784402 - DNA, 16 bp, Homo sapiens
tgtgtcccagtgtctg

SEQ ID NO: 4784403 - DNA, 16 bp, Homo sapiens
tgtgtcccccctgtgg

SEQ ID NO: 4784404 - DNA, 19 bp, Homo sapiens
tgtgtcccccctgtggtct

SEQ ID NO: 4784405 - DNA, 23 bp, Homo sapiens
tgtgtcccccctgtggtctgtgt

SEQ ID NO: 4784406 - DNA, 12 bp, Homo sapiens
tgtgtcccctca

SEQ ID NO: 4784407 - DNA, 18 bp, Homo sapiens
tgtgtcccctcactctgt

SEQ ID NO: 4784408 - DNA, 22 bp, Homo sapiens
tgtgtcccctcactctgtcagc

SEQ ID NO: 4784409 - DNA, 23 bp, Homo sapiens
tgtgtccgtgaaagttgtgatct

SEQ ID NO: 4784410 - DNA, 16 bp, Homo sapiens
tgtgtctcatggtccc

SEQ ID NO: 4784411 - DNA, 19 bp, Homo sapiens
tgtgtgacaccaccactgt

SEQ ID NO: 4784412 - DNA, 19 bp, Homo sapiens
tgtgtgagtgtatgtatac

SEQ ID NO: 4784413 - DNA, 20 bp, Homo sapiens
tgtgtgagtgtatgtataca

SEQ ID NO: 4784414 - DNA, 16 bp, Homo sapiens
tgtgtgcaatgttccg

SEQ ID NO: 4784415 - DNA, 15 bp, Homo sapiens
ttacaagttatagta

SEQ ID NO: 4784416 - DNA, 17 bp, Homo sapiens
ttacactgaaatccaaa

SEQ ID NO: 4784417 - DNA, 18 bp, Homo sapiens
ttacactgaaatccaaaa

SEQ ID NO: 4784418 - DNA, 21 bp, Homo sapiens
ttacactgaaatccaaaatag

SEQ ID NO: 4784419 - DNA, 15 bp, Homo sapiens
ttacagaaacacgga

SEQ ID NO: 4784420 - DNA, 15 bp, Homo sapiens
ttacaggaagtactg

SEQ ID NO: 4784421 - DNA, 16 bp, Homo sapiens
ttacaggaagtactgg

SEQ ID NO: 4784422 - DNA, 14 bp, Homo sapiens
ttacagtaatgtca

SEQ ID NO: 4784423 - DNA, 22 bp, Homo sapiens
ttacagtaatgtcataaagtga

SEQ ID NO: 4784424 - DNA, 14 bp, Homo sapiens
ttacataaataaat

SEQ ID NO: 4784425 - DNA, 21 bp, Homo sapiens
ttacataacaggcattgcact

SEQ ID NO: 4784426 - DNA, 16 bp, Homo sapiens
ttaccagaagtttaaa

SEQ ID NO: 4784427 - DNA, 22 bp, Homo sapiens
ttaccatcaaacaaatcatttt

SEQ ID NO: 4784428 - DNA, 22 bp, Homo sapiens
ttaccccgtccctttccctgca

SEQ ID NO: 4784429 - DNA, 16 bp, Homo sapiens
ttaccctccctgtccc

SEQ ID NO: 4784430 - DNA, 18 bp, Homo sapiens
ttaccgcccacccagcag

SEQ ID NO: 4784431 - DNA, 21 bp, Homo sapiens
ttacctaagagccacaataag

SEQ ID NO: 4784432 - DNA, 17 bp, Homo sapiens
ttacctattgctgtaaa

SEQ ID NO: 4784433 - DNA, 20 bp, Homo sapiens
ttacctgtaatagcctcacc

SEQ ID NO: 4784434 - DNA, 13 bp, Homo sapiens
ttacgtgagtcct

SEQ ID NO: 4784435 - DNA, 14 bp, Homo sapiens
ttacgtgagtcctg

SEQ ID NO: 4784436 - DNA, 12 bp, Homo sapiens
ttactaaatcta

SEQ ID NO: 4784437 - DNA, 18 bp, Homo sapiens
ttactagtatcactgctt

SEQ ID NO: 4784438 - DNA, 17 bp, Homo sapiens
ttactatagcaaagtag

SEQ ID NO: 4784439 - DNA, 21 bp, Homo sapiens
ttactatgcctgttgatctat

SEQ ID NO: 4784440 - DNA, 12 bp, Homo sapiens
ttactattaact

SEQ ID NO: 4784441 - DNA, 18 bp, Homo sapiens
ttactattcggtgtgttt

SEQ ID NO: 4784442 - DNA, 18 bp, Homo sapiens
ttactcaaaatgcaggac

SEQ ID NO: 4784443 - DNA, 16 bp, Homo sapiens
ttactcaggctttcta

SEQ ID NO: 4784444 - DNA, 17 bp, Homo sapiens
ttactcattatcgcctt

SEQ ID NO: 4784445 - DNA, 13 bp, Homo sapiens
ttactgcaatgtc

SEQ ID NO: 4784446 - DNA, 20 bp, Homo sapiens
ttactgcaatgtctgtccct

SEQ ID NO: 4784447 - DNA, 23 bp, Homo sapiens
ttactgccgaaacccttgactgt

SEQ ID NO: 4784448 - DNA, 22 bp, Homo sapiens
ttactggatctcttaagacagc

SEQ ID NO: 4784449 - DNA, 18 bp, Homo sapiens
ttactgtctgtaagagaa

SEQ ID NO: 4784450 - DNA, 20 bp, Homo sapiens
ttactgtgagaactgtgaat

SEQ ID NO: 4784451 - DNA, 14 bp, Homo sapiens
ttactgtttgaaac

SEQ ID NO: 4784452 - DNA, 14 bp, Homo sapiens
ttacttaaatagca

SEQ ID NO: 4784453 - DNA, 15 bp, Homo sapiens
ttactttaaattata

SEQ ID NO: 4784454 - DNA, 13 bp, Homo sapiens
ttactttgcccat

SEQ ID NO: 4784455 - DNA, 17 bp, Homo sapiens
ttagaaaaaactggaaa

SEQ ID NO: 4784456 - DNA, 22 bp, Homo sapiens
ttagaaaaaactggaaacatct

SEQ ID NO: 4784457 - DNA, 13 bp, Homo sapiens
ttagaatgctgcg

SEQ ID NO: 4784458 - DNA, 13 bp, Homo sapiens
ttagaatgtcagt

SEQ ID NO: 4784459 - DNA, 13 bp, Homo sapiens
ttagaatgttgaa

SEQ ID NO: 4784460 - DNA, 17 bp, Homo sapiens
ttagaattaccatttgt

SEQ ID NO: 4784461 - DNA, 12 bp, Homo sapiens
ttagacaatgtg

SEQ ID NO: 4784462 - DNA, 20 bp, Homo sapiens
ttagactcaaagaagtactg

SEQ ID NO: 4784463 - DNA, 14 bp, Homo sapiens
ttagagaagccata

SEQ ID NO: 4784464 - DNA, 21 bp, Homo sapiens
ttagagtatgcaagaagaata

SEQ ID NO: 4784465 - DNA, 14 bp, Homo sapiens
ttagatccattaat

SEQ ID NO: 4784466 - DNA, 15 bp, Homo sapiens
ttagatccattaatt

SEQ ID NO: 4784467 - DNA, 20 bp, Homo sapiens
ttagattcctacttaaacaa

SEQ ID NO: 4784468 - DNA, 13 bp, Homo sapiens
ttagcacagtatt

SEQ ID NO: 4784469 - DNA, 15 bp, Homo sapiens
ttagcacagtattta

SEQ ID NO: 4784470 - DNA, 21 bp, Homo sapiens
ttagcacagtatttaacattc

SEQ ID NO: 4784471 - DNA, 19 bp, Homo sapiens
ttagcaccagcttgcttct

SEQ ID NO: 4784472 - DNA, 15 bp, Homo sapiens
ttagcagctgggttg

SEQ ID NO: 4784473 - DNA, 16 bp, Homo sapiens
ttagcagttctgcaaa

SEQ ID NO: 4784474 - DNA, 21 bp, Homo sapiens
ttagcagttctgcaaatagaa

SEQ ID NO: 4784475 - DNA, 21 bp, Homo sapiens
ttagcatgagttctgcacata

SEQ ID NO: 4784476 - DNA, 15 bp, Homo sapiens
ttagccatcagatga

SEQ ID NO: 4784477 - DNA, 19 bp, Homo sapiens
ttagcgttgttttgtggat

SEQ ID NO: 4784478 - DNA, 21 bp, Homo sapiens
ttagctagttagagactcgcc

SEQ ID NO: 4784479 - DNA, 16 bp, Homo sapiens
ttagctccctcccgca

SEQ ID NO: 4784480 - DNA, 18 bp, Homo sapiens
ttagctgcctgaaaatca

SEQ ID NO: 4784481 - DNA, 17 bp, Homo sapiens
ttaggaacagagtatat

SEQ ID NO: 4784482 - DNA, 20 bp, Homo sapiens
ttaggaatgctcaatgtgct

SEQ ID NO: 4784483 - DNA, 15 bp, Homo sapiens
ttaggagttttgaga

SEQ ID NO: 4784484 - DNA, 14 bp, Homo sapiens
ttaggctctgagac

SEQ ID NO: 4784485 - DNA, 15 bp, Homo sapiens
ttagggctctaattt

SEQ ID NO: 4784486 - DNA, 16 bp, Homo sapiens
ttaggggaaaatagta

SEQ ID NO: 4784487 - DNA, 23 bp, Homo sapiens
ttaggtagatgagaaaacaggct

SEQ ID NO: 4784488 - DNA, 23 bp, Homo sapiens
ttaggtagtagaatctcagcact

SEQ ID NO: 4784489 - DNA, 23 bp, Homo sapiens
ttagtaaaattatctgttctatg

SEQ ID NO: 4784490 - DNA, 15 bp, Homo sapiens
ttagtatcctgttag

SEQ ID NO: 4784491 - DNA, 21 bp, Homo sapiens
ttagtattttgagccttatta

SEQ ID NO: 4784492 - DNA, 23 bp, Homo sapiens
ttagtcagtgtactctgagtcct

SEQ ID NO: 4784493 - DNA, 13 bp, Homo sapiens
ttagtcctcacct

SEQ ID NO: 4784494 - DNA, 13 bp, Homo sapiens
ttagtgagatttg

SEQ ID NO: 4784495 - DNA, 17 bp, Homo sapiens
ttagtgagatttgtatt

SEQ ID NO: 4784496 - DNA, 17 bp, Homo sapiens
ttagtgcatgtcacatg

SEQ ID NO: 4784497 - DNA, 21 bp, Homo sapiens
ttagtgcatgtcacatgacat

SEQ ID NO: 4784498 - DNA, 15 bp, Homo sapiens
ttagtgcttggctca

SEQ ID NO: 4784499 - DNA, 18 bp, Homo sapiens
ttagtgttttcattctgg

SEQ ID NO: 4784500 - DNA, 15 bp, Homo sapiens
ttataaaccagcagc

SEQ ID NO: 4784501 - DNA, 15 bp, Homo sapiens
ttataaatgttttaa

SEQ ID NO: 4784502 - DNA, 16 bp, Homo sapiens
ttataaatgttttaaa

SEQ ID NO: 4784503 - DNA, 12 bp, Homo sapiens
ttataaattaaa

SEQ ID NO: 4784504 - DNA, 16 bp, Homo sapiens
ttataaattataatgc

SEQ ID NO: 4784505 - DNA, 16 bp, Homo sapiens
ttataacaattgattt

SEQ ID NO: 4784506 - DNA, 20 bp, Homo sapiens
ttataagaaaaatgtgaatt

SEQ ID NO: 4784507 - DNA, 17 bp, Homo sapiens
ttataaggctgactctt

SEQ ID NO: 4784508 - DNA, 16 bp, Homo sapiens
ttataatgcatctaaa

SEQ ID NO: 4784509 - DNA, 14 bp, Homo sapiens
ttataattgtcatg

SEQ ID NO: 4784510 - DNA, 19 bp, Homo sapiens
ttatacaaccttcatttaa

SEQ ID NO: 4784511 - DNA, 19 bp, Homo sapiens
ttataccaggttacctcac

SEQ ID NO: 4784512 - DNA, 19 bp, Homo sapiens
ttatactatttattaaaac

SEQ ID NO: 4784513 - DNA, 11 bp, Homo sapiens
ttatagagcac

SEQ ID NO: 4784514 - DNA, 13 bp, Homo sapiens
ttatagagcacaa

SEQ ID NO: 4784515 - DNA, 19 bp, Homo sapiens
ttatagcatgtaatattaa

SEQ ID NO: 4784516 - DNA, 17 bp, Homo sapiens
ttataggaaataaatct

SEQ ID NO: 4784517 - DNA, 16 bp, Homo sapiens
ttatagtctgtacttc

SEQ ID NO: 4784518 - DNA, 14 bp, Homo sapiens
ttatatataaatat

SEQ ID NO: 4784519 - DNA, 13 bp, Homo sapiens
ttatatatacatt

SEQ ID NO: 4784520 - DNA, 12 bp, Homo sapiens
ttatatatgaag

SEQ ID NO: 4784521 - DNA, 14 bp, Homo sapiens
ttatatatgaagta

SEQ ID NO: 4784522 - DNA, 16 bp, Homo sapiens
ttatatattataagtt

SEQ ID NO: 4784523 - DNA, 23 bp, Homo sapiens
ttatatattataagttgaccttt

SEQ ID NO: 4784524 - DNA, 17 bp, Homo sapiens
ttatatcagactgcttt

SEQ ID NO: 4784525 - DNA, 22 bp, Homo sapiens
ttatatctgtggtcttcaaatt

SEQ ID NO: 4784526 - DNA, 18 bp, Homo sapiens
ttatattcccaaatctca

SEQ ID NO: 4784527 - DNA, 17 bp, Homo sapiens
ttatattgttttataaa

SEQ ID NO: 4784528 - DNA, 14 bp, Homo sapiens
ttatattttataag

SEQ ID NO: 4784529 - DNA, 15 bp, Homo sapiens
ttatcaaaaaacaga

SEQ ID NO: 4784530 - DNA, 21 bp, Homo sapiens
ttatcagggcccaaataacag

SEQ ID NO: 4784531 - DNA, 14 bp, Homo sapiens
ttatcagtgaatat

SEQ ID NO: 4784532 - DNA, 22 bp, Homo sapiens
ttatctagtaggtctgcacaca

SEQ ID NO: 4784533 - DNA, 23 bp, Homo sapiens
ttatctagtaggtctgcacacat

SEQ ID NO: 4784534 - DNA, 22 bp, Homo sapiens
ttatctccagccaatttcaaag

SEQ ID NO: 4784535 - DNA, 20 bp, Homo sapiens
ttatctgtctgagccctgcc

SEQ ID NO: 4784536 - DNA, 14 bp, Homo sapiens
ttatcttaaaccca

SEQ ID NO: 4784537 - DNA, 12 bp, Homo sapiens
ttccttgccaca

SEQ ID NO: 4784538 - DNA, 16 bp, Homo sapiens
ttccttgccacaatca

SEQ ID NO: 4784539 - DNA, 17 bp, Homo sapiens
ttccttgccacaatcac

SEQ ID NO: 4784540 - DNA, 13 bp, Homo sapiens
ttccttggcccag

SEQ ID NO: 4784541 - DNA, 16 bp, Homo sapiens
ttccttggcccagcag

SEQ ID NO: 4784542 - DNA, 17 bp, Homo sapiens
ttcctttcatcctcagc

SEQ ID NO: 4784543 - DNA, 15 bp, Homo sapiens
ttcctttctggaatt

SEQ ID NO: 4784544 - DNA, 14 bp, Homo sapiens
ttcctttcttcctt

SEQ ID NO: 4784545 - DNA, 22 bp, Homo sapiens
ttcctttgacctctcacttttt

SEQ ID NO: 4784546 - DNA, 20 bp, Homo sapiens
ttccttttctattccttctg

SEQ ID NO: 4784547 - DNA, 15 bp, Homo sapiens
ttcgctattcccagg

SEQ ID NO: 4784548 - DNA, 18 bp, Homo sapiens
ttcgctattcccaggcag

SEQ ID NO: 4784549 - DNA, 20 bp, Homo sapiens
ttcgctattcccaggcaggg

SEQ ID NO: 4784550 - DNA, 16 bp, Homo sapiens
ttcggtggccttgagt

SEQ ID NO: 4784551 - DNA, 13 bp, Homo sapiens
ttcgtaagttctg

SEQ ID NO: 4784552 - DNA, 18 bp, Homo sapiens
ttcgtaagttctgtgcag

SEQ ID NO: 4784553 - DNA, 17 bp, Homo sapiens
ttcgtgcatttgtgagc

SEQ ID NO: 4784554 - DNA, 15 bp, Homo sapiens
ttcgtgggcctgctg

SEQ ID NO: 4784555 - DNA, 16 bp, Homo sapiens
ttcgtttgcctccaga

SEQ ID NO: 4784556 - DNA, 14 bp, Homo sapiens
ttctaaaaagtcag

SEQ ID NO: 4784557 - DNA, 14 bp, Homo sapiens
ttctaaaccatgaa

SEQ ID NO: 4784558 - DNA, 22 bp, Homo sapiens
ttctaaaccatgaaaagttttc

SEQ ID NO: 4784559 - DNA, 13 bp, Homo sapiens
ttctaaagacagg

SEQ ID NO: 4784560 - DNA, 19 bp, Homo sapiens
ttctaagaaatatctgtga

SEQ ID NO: 4784561 - DNA, 16 bp, Homo sapiens
ttctaagattgtacat

SEQ ID NO: 4784562 - DNA, 17 bp, Homo sapiens
ttctaagggatccagag

SEQ ID NO: 4784563 - DNA, 21 bp, Homo sapiens
ttctaatatttattgctttat

SEQ ID NO: 4784564 - DNA, 19 bp, Homo sapiens
ttctacacagtgggaactc

SEQ ID NO: 4784565 - DNA, 14 bp, Homo sapiens
ttctacatgcaaat

SEQ ID NO: 4784566 - DNA, 20 bp, Homo sapiens
ttctacatgcaaatctggct

SEQ ID NO: 4784567 - DNA, 12 bp, Homo sapiens
ttctactgagca

SEQ ID NO: 4784568 - DNA, 20 bp, Homo sapiens
ttctacttcttgtgctttac

SEQ ID NO: 4784569 - DNA, 17 bp, Homo sapiens
ttctactttaaattgtg

SEQ ID NO: 4784570 - DNA, 16 bp, Homo sapiens
ttctagatatgagaaa

SEQ ID NO: 4784571 - DNA, 21 bp, Homo sapiens
ttctagtggccttagaaaaca

SEQ ID NO: 4784572 - DNA, 15 bp, Homo sapiens
ttctatctactgatt

SEQ ID NO: 4784573 - DNA, 17 bp, Homo sapiens
ttctatggaccaaatgt

SEQ ID NO: 4784574 - DNA, 22 bp, Homo sapiens
ttctatggaccaaatgtaaaat

SEQ ID NO: 4784575 - DNA, 13 bp, Homo sapiens
ttctattatctgg

SEQ ID NO: 4784576 - DNA, 18 bp, Homo sapiens
ttctattttagttaacta

SEQ ID NO: 4784577 - DNA, 16 bp, Homo sapiens
ttctcaaatgctactc

SEQ ID NO: 4784578 - DNA, 13 bp, Homo sapiens
ttctcaacacaca

SEQ ID NO: 4784579 - DNA, 22 bp, Homo sapiens
ttctcaagcgctatccacagaa

SEQ ID NO: 4784580 - DNA, 12 bp, Homo sapiens
ttctcaatcatt

SEQ ID NO: 4784581 - DNA, 14 bp, Homo sapiens
ttctcaatcattgt

SEQ ID NO: 4784582 - DNA, 20 bp, Homo sapiens
ttctcacactctaactgtat

SEQ ID NO: 4784583 - DNA, 19 bp, Homo sapiens
ttctcaccctctgtccttc

SEQ ID NO: 4784584 - DNA, 22 bp, Homo sapiens
ttctcagccttggttcctgatg

SEQ ID NO: 4784585 - DNA, 14 bp, Homo sapiens
ttctcagctccact

SEQ ID NO: 4784586 - DNA, 16 bp, Homo sapiens
ttctcatccaaaagtg

SEQ ID NO: 4784587 - DNA, 16 bp, Homo sapiens
ttctcatttatgttat

SEQ ID NO: 4784588 - DNA, 18 bp, Homo sapiens
ttctcatttatgttattt

SEQ ID NO: 4784589 - DNA, 19 bp, Homo sapiens
ttctcatttatgttattta

SEQ ID NO: 4784590 - DNA, 19 bp, Homo sapiens
ttctccagaaaaatcaatc

SEQ ID NO: 4784591 - DNA, 22 bp, Homo sapiens
ttctccagaaaaatcaatcatt

SEQ ID NO: 4784592 - DNA, 14 bp, Homo sapiens
ttctcccctccaga

SEQ ID NO: 4784593 - DNA, 16 bp, Homo sapiens
ttctcccctccagacc

SEQ ID NO: 4784594 - DNA, 19 bp, Homo sapiens
ttctcccgccattggcctt

SEQ ID NO: 4784595 - DNA, 17 bp, Homo sapiens
ttctccgggtgtggcct

SEQ ID NO: 4784596 - DNA, 13 bp, Homo sapiens
ttctcctccaaat

SEQ ID NO: 4784597 - DNA, 15 bp, Homo sapiens
ttctcctccaaatgc

SEQ ID NO: 4784598 - DNA, 17 bp, Homo sapiens
ttctcctccaaatgctg

SEQ ID NO: 4784599 - DNA, 18 bp, Homo sapiens
ttctcctccaaatgctgt

SEQ ID NO: 4784600 - DNA, 17 bp, Homo sapiens
ttctcctctttctcagt

SEQ ID NO: 4784601 - DNA, 12 bp, Homo sapiens
ttctccttaacc

SEQ ID NO: 4784602 - DNA, 20 bp, Homo sapiens
ttctccttcccaaggcagct

SEQ ID NO: 4784603 - DNA, 16 bp, Homo sapiens
ttctccttgtacttga

SEQ ID NO: 4784604 - DNA, 15 bp, Homo sapiens
ttctcctttgtcaaa

SEQ ID NO: 4784605 - DNA, 17 bp, Homo sapiens
ttctctaacccctagtg

SEQ ID NO: 4784606 - DNA, 20 bp, Homo sapiens
ttctctcctgattatttatc

SEQ ID NO: 4784607 - DNA, 14 bp, Homo sapiens
ttctctctgtgtgg

SEQ ID NO: 4784608 - DNA, 15 bp, Homo sapiens
ttctctgatggcact

SEQ ID NO: 4784609 - DNA, 19 bp, Homo sapiens
ttctctgatggcacttttg

SEQ ID NO: 4784610 - DNA, 17 bp, Homo sapiens
ttctcttaagctgccca

SEQ ID NO: 4784611 - DNA, 18 bp, Homo sapiens
ttctcttctacttcttgt

SEQ ID NO: 4784612 - DNA, 13 bp, Homo sapiens
ttctcttctcaga

SEQ ID NO: 4784613 - DNA, 19 bp, Homo sapiens
ttctctttgcctgaagaaa

SEQ ID NO: 4784614 - DNA, 12 bp, Homo sapiens
ttctctttgggt

SEQ ID NO: 4784615 - DNA, 17 bp, Homo sapiens
ttctgaaaactgtttat

SEQ ID NO: 4784616 - DNA, 16 bp, Homo sapiens
ttctgaactttggaag

SEQ ID NO: 4784617 - DNA, 22 bp, Homo sapiens
ttctgaaggggaaaacctcagt

SEQ ID NO: 4784618 - DNA, 13 bp, Homo sapiens
ttctgacggccct

SEQ ID NO: 4784619 - DNA, 20 bp, Homo sapiens
ttctgagcaccgaatattga

SEQ ID NO: 4784620 - DNA, 20 bp, Homo sapiens
ttctgattggacctggccca

SEQ ID NO: 4784621 - DNA, 22 bp, Homo sapiens
ttctgattggacctggcccagt

SEQ ID NO: 4784622 - DNA, 15 bp, Homo sapiens
ttctgcaaatagaaa

SEQ ID NO: 4784623 - DNA, 14 bp, Homo sapiens
ttctgcaataacag

SEQ ID NO: 4784624 - DNA, 16 bp, Homo sapiens
ttctgcaataacagtt

SEQ ID NO: 4784625 - DNA, 15 bp, Homo sapiens
ttctgcacatacaga

SEQ ID NO: 4784626 - DNA, 19 bp, Homo sapiens
ttctgcagccactattgtt

SEQ ID NO: 4784627 - DNA, 20 bp, Homo sapiens
ttctgcagcccgatgtccct

SEQ ID NO: 4784628 - DNA, 14 bp, Homo sapiens
ttctgcagtattct

SEQ ID NO: 4784629 - DNA, 16 bp, Homo sapiens
ttctgcagtattctgt

SEQ ID NO: 4784630 - DNA, 18 bp, Homo sapiens
ttctgcagtattctgtag

SEQ ID NO: 4784631 - DNA, 12 bp, Homo sapiens
ttctgcattact

SEQ ID NO: 4784632 - DNA, 16 bp, Homo sapiens
ttctgccgcagccctg

SEQ ID NO: 4784633 - DNA, 23 bp, Homo sapiens
ttctgccgcagccctgcagaggg

SEQ ID NO: 4784634 - DNA, 17 bp, Homo sapiens
ttctgctgtacagatat

SEQ ID NO: 4784635 - DNA, 21 bp, Homo sapiens
ttctggaggtggggagggcct

SEQ ID NO: 4784636 - DNA, 20 bp, Homo sapiens
ttctggcagagttgaagaca

SEQ ID NO: 4784637 - DNA, 20 bp, Homo sapiens
ttctggcctttcctctctcc

SEQ ID NO: 4784638 - DNA, 21 bp, Homo sapiens
ttctggcctttcctctctcct

SEQ ID NO: 4784639 - DNA, 21 bp, Homo sapiens
ttctgtaatatttacaatgta

SEQ ID NO: 4784640 - DNA, 17 bp, Homo sapiens
ttctgtacagtttgtga

SEQ ID NO: 4784641 - DNA, 18 bp, Homo sapiens
ttctgtatatagatgtct

SEQ ID NO: 4784642 - DNA, 21 bp, Homo sapiens
ttctgtatatagatgtctgtg

SEQ ID NO: 4784643 - DNA, 23 bp, Homo sapiens
ttctgtcaaagtcagaacaaatt

SEQ ID NO: 4784644 - DNA, 15 bp, Homo sapiens
ttctgtcctgtaact

SEQ ID NO: 4784645 - DNA, 18 bp, Homo sapiens
ttctgtggctgatttact

SEQ ID NO: 4784646 - DNA, 14 bp, Homo sapiens
ttctgtgtcacgtg

SEQ ID NO: 4784647 - DNA, 19 bp, Homo sapiens
ttctgtgtcacgtgaccct

SEQ ID NO: 4784648 - DNA, 23 bp, Homo sapiens
ttctgtgtcacgtgaccctgtgc

SEQ ID NO: 4784649 - DNA, 11 bp, Homo sapiens
ttctgtttgaa

SEQ ID NO: 4784650 - DNA, 18 bp, Homo sapiens
ttctgtttgaattttcaa

SEQ ID NO: 4784651 - DNA, 12 bp, Homo sapiens
ttcttaattatg

SEQ ID NO: 4784652 - DNA, 17 bp, Homo sapiens
ttcttacctcatttgca

SEQ ID NO: 4784653 - DNA, 17 bp, Homo sapiens
ttcttatacagataaaa

SEQ ID NO: 4784654 - DNA, 11 bp, Homo sapiens
ttcttcaaaat

SEQ ID NO: 4784655 - DNA, 21 bp, Homo sapiens
ttcttcaaaatataaaatgcc

SEQ ID NO: 4784656 - DNA, 17 bp, Homo sapiens
ttcttcaatgtgaaact

SEQ ID NO: 4784657 - DNA, 18 bp, Homo sapiens
ttcttcaattaatggaaa

SEQ ID NO: 4784658 - DNA, 14 bp, Homo sapiens
ttcttccaacatgt

SEQ ID NO: 4784659 - DNA, 16 bp, Homo sapiens
ttcttcccccagggtc

SEQ ID NO: 4784660 - DNA, 17 bp, Homo sapiens
ttgctattgtttatagg

SEQ ID NO: 4784661 - DNA, 19 bp, Homo sapiens
ttgctcagtccctctgggt

SEQ ID NO: 4784662 - DNA, 20 bp, Homo sapiens
ttgctccagtataaattaca

SEQ ID NO: 4784663 - DNA, 22 bp, Homo sapiens
ttgctccagtataaattacatg

SEQ ID NO: 4784664 - DNA, 16 bp, Homo sapiens
ttgctccttgaataag

SEQ ID NO: 4784665 - DNA, 14 bp, Homo sapiens
ttgctcctttccat

SEQ ID NO: 4784666 - DNA, 16 bp, Homo sapiens
ttgctcctttccatca

SEQ ID NO: 4784667 - DNA, 21 bp, Homo sapiens
ttgctctccctcccttctttc

SEQ ID NO: 4784668 - DNA, 11 bp, Homo sapiens
ttgctctctca

SEQ ID NO: 4784669 - DNA, 14 bp, Homo sapiens
ttgctgaataacaa

SEQ ID NO: 4784670 - DNA, 21 bp, Homo sapiens
ttgctggaaaactgccacaag

SEQ ID NO: 4784671 - DNA, 19 bp, Homo sapiens
ttgctggaatctactagaa

SEQ ID NO: 4784672 - DNA, 16 bp, Homo sapiens
ttgctgtcccttttcc

SEQ ID NO: 4784673 - DNA, 18 bp, Homo sapiens
ttgctgtcccttttcctt

SEQ ID NO: 4784674 - DNA, 14 bp, Homo sapiens
ttgctgtctgaaaa

SEQ ID NO: 4784675 - DNA, 14 bp, Homo sapiens
ttgctgtgaaacag

SEQ ID NO: 4784676 - DNA, 17 bp, Homo sapiens
ttgctgtgaaacagtgt

SEQ ID NO: 4784677 - DNA, 12 bp, Homo sapiens
ttgctgtgaaat

SEQ ID NO: 4784678 - DNA, 17 bp, Homo sapiens
ttgctgtgaaatgactg

SEQ ID NO: 4784679 - DNA, 20 bp, Homo sapiens
ttgctgtttaccgcccaccc

SEQ ID NO: 4784680 - DNA, 18 bp, Homo sapiens
ttgcttaatctagagcta

SEQ ID NO: 4784681 - DNA, 14 bp, Homo sapiens
ttgcttcccatctg

SEQ ID NO: 4784682 - DNA, 15 bp, Homo sapiens
ttgcttgagcatgcc

SEQ ID NO: 4784683 - DNA, 17 bp, Homo sapiens
ttgctttgagcccacag

SEQ ID NO: 4784684 - DNA, 17 bp, Homo sapiens
ttggaaaataataaaag

SEQ ID NO: 4784685 - DNA, 18 bp, Homo sapiens
ttggaaaataataaaaga

SEQ ID NO: 4784686 - DNA, 18 bp, Homo sapiens
ttggaagggaccccagat

SEQ ID NO: 4784687 - DNA, 22 bp, Homo sapiens
ttggaagttttacttgattaag

SEQ ID NO: 4784688 - DNA, 18 bp, Homo sapiens
ttggacagcaaaaccatt

SEQ ID NO: 4784689 - DNA, 14 bp, Homo sapiens
ttggaccccagaga

SEQ ID NO: 4784690 - DNA, 13 bp, Homo sapiens
ttggagacataca

SEQ ID NO: 4784691 - DNA, 12 bp, Homo sapiens
ttggagaggagg

SEQ ID NO: 4784692 - DNA, 17 bp, Homo sapiens
ttggagcgtttttgctg

SEQ ID NO: 4784693 - DNA, 12 bp, Homo sapiens
ttggagggatgg

SEQ ID NO: 4784694 - DNA, 15 bp, Homo sapiens
ttggagtcttccaaa

SEQ ID NO: 4784695 - DNA, 23 bp, Homo sapiens
ttggagtgccacgtggccgctgc

SEQ ID NO: 4784696 - DNA, 19 bp, Homo sapiens
ttggataggagcttccaga

SEQ ID NO: 4784697 - DNA, 19 bp, Homo sapiens
ttggcagacaggatgttca

SEQ ID NO: 4784698 - DNA, 15 bp, Homo sapiens
ttggcagcacagcta

SEQ ID NO: 4784699 - DNA, 23 bp, Homo sapiens
ttggcagcacagctactcagatc

SEQ ID NO: 4784700 - DNA, 21 bp, Homo sapiens
ttggcatggatttcctttgac

SEQ ID NO: 4784701 - DNA, 17 bp, Homo sapiens
ttggccatcatttcatt

SEQ ID NO: 4784702 - DNA, 18 bp, Homo sapiens
ttggccatcatttcattc

SEQ ID NO: 4784703 - DNA, 14 bp, Homo sapiens
ttggcctctgcccc

SEQ ID NO: 4784704 - DNA, 22 bp, Homo sapiens
ttggcgctgcccctggcagccc

SEQ ID NO: 4784705 - DNA, 13 bp, Homo sapiens
ttggcgtggagca

SEQ ID NO: 4784706 - DNA, 21 bp, Homo sapiens
ttggctattgtccttgtgtat

SEQ ID NO: 4784707 - DNA, 20 bp, Homo sapiens
ttggctcagacacctagact

SEQ ID NO: 4784708 - DNA, 15 bp, Homo sapiens
ttgggaaaggcaggg

SEQ ID NO: 4784709 - DNA, 16 bp, Homo sapiens
ttgggaaaggcagggc

SEQ ID NO: 4784710 - DNA, 18 bp, Homo sapiens
ttgggaaaggcagggccc

SEQ ID NO: 4784711 - DNA, 20 bp, Homo sapiens
ttgggaaaggcagggccctg

SEQ ID NO: 4784712 - DNA, 15 bp, Homo sapiens
ttgggaaattcttgc

SEQ ID NO: 4784713 - DNA, 16 bp, Homo sapiens
ttgggaaattcttgca

SEQ ID NO: 4784714 - DNA, 20 bp, Homo sapiens
ttgggaaattcttgcactgt

SEQ ID NO: 4784715 - DNA, 21 bp, Homo sapiens
ttgggaaattcttgcactgta

SEQ ID NO: 4784716 - DNA, 20 bp, Homo sapiens
ttgggaagcagtttcagata

SEQ ID NO: 4784717 - DNA, 16 bp, Homo sapiens
ttgggagagcccctgg

SEQ ID NO: 4784718 - DNA, 16 bp, Homo sapiens
ttgggaggccatttgt

SEQ ID NO: 4784719 - DNA, 11 bp, Homo sapiens
ttgggaggctg

SEQ ID NO: 4784720 - DNA, 12 bp, Homo sapiens
ttgggaggctga

SEQ ID NO: 4784721 - DNA, 20 bp, Homo sapiens
ttgggattcctcccctggaa

SEQ ID NO: 4784722 - DNA, 20 bp, Homo sapiens
ttgggcacgggagagcgcca

SEQ ID NO: 4784723 - DNA, 21 bp, Homo sapiens
ttggggaaggggcctgggctg

SEQ ID NO: 4784724 - DNA, 18 bp, Homo sapiens
ttggggaccagagctgcc

SEQ ID NO: 4784725 - DNA, 19 bp, Homo sapiens
ttggggctacttatattct

SEQ ID NO: 4784726 - DNA, 15 bp, Homo sapiens
ttggggcttatcaga

SEQ ID NO: 4784727 - DNA, 17 bp, Homo sapiens
ttgggggacgcccagcc

SEQ ID NO: 4784728 - DNA, 20 bp, Homo sapiens
ttgggggacgcccagccccc

SEQ ID NO: 4784729 - DNA, 12 bp, Homo sapiens
ttgggggcagac

SEQ ID NO: 4784730 - DNA, 13 bp, Homo sapiens
ttggggggccggg

SEQ ID NO: 4784731 - DNA, 12 bp, Homo sapiens
ttgggttccaga

SEQ ID NO: 4784732 - DNA, 13 bp, Homo sapiens
ttgggttccagac

SEQ ID NO: 4784733 - DNA, 20 bp, Homo sapiens
ttgggtttgccttaattctt

SEQ ID NO: 4784734 - DNA, 17 bp, Homo sapiens
ttggtaacttgctgtga

SEQ ID NO: 4784735 - DNA, 19 bp, Homo sapiens
ttggtaatgatgattcaat

SEQ ID NO: 4784736 - DNA, 16 bp, Homo sapiens
ttggtatgaaacaaat

SEQ ID NO: 4784737 - DNA, 17 bp, Homo sapiens
ttggtcacaaagctatt

SEQ ID NO: 4784738 - DNA, 20 bp, Homo sapiens
ttggtcacaaagctatttaa

SEQ ID NO: 4784739 - DNA, 14 bp, Homo sapiens
ttggtctctttctt

SEQ ID NO: 4784740 - DNA, 15 bp, Homo sapiens
ttggtgactgtccca

SEQ ID NO: 4784741 - DNA, 21 bp, Homo sapiens
ttggtgtttgagtgttcatca

SEQ ID NO: 4784742 - DNA, 15 bp, Homo sapiens
ttggttaatgaaaaa

SEQ ID NO: 4784743 - DNA, 15 bp, Homo sapiens
ttggttcctcatggc

SEQ ID NO: 4784744 - DNA, 16 bp, Homo sapiens
ttggtttctgtttgaa

SEQ ID NO: 4784745 - DNA, 16 bp, Homo sapiens
ttggttttctccttcc

SEQ ID NO: 4784746 - DNA, 19 bp, Homo sapiens
ttggttttgtaaaattcca

SEQ ID NO: 4784747 - DNA, 13 bp, Homo sapiens
ttgtaaaaatgta

SEQ ID NO: 4784748 - DNA, 15 bp, Homo sapiens
ttgtaaaacagtggt

SEQ ID NO: 4784749 - DNA, 17 bp, Homo sapiens
ttgtaaaggtaggtgca

SEQ ID NO: 4784750 - DNA, 17 bp, Homo sapiens
ttgtaaaggtgatgaat

SEQ ID NO: 4784751 - DNA, 21 bp, Homo sapiens
ttgtaacattctatttcaact

SEQ ID NO: 4784752 - DNA, 13 bp, Homo sapiens
ttgtaactctttg

SEQ ID NO: 4784753 - DNA, 17 bp, Homo sapiens
ttgtaactctttggcta

SEQ ID NO: 4784754 - DNA, 19 bp, Homo sapiens
ttgtaactctttggctatt

SEQ ID NO: 4784755 - DNA, 18 bp, Homo sapiens
ttgtaagcaattctaagt

SEQ ID NO: 4784756 - DNA, 13 bp, Homo sapiens
ttgtaatataaga

SEQ ID NO: 4784757 - DNA, 15 bp, Homo sapiens
ttgtaatattttgct

SEQ ID NO: 4784758 - DNA, 20 bp, Homo sapiens
ttgtacaattactgtgagaa

SEQ ID NO: 4784759 - DNA, 20 bp, Homo sapiens
ttgtacagaatcattgctta

SEQ ID NO: 4784760 - DNA, 12 bp, Homo sapiens
ttgtacagacaa

SEQ ID NO: 4784761 - DNA, 13 bp, Homo sapiens
ttgtacagacaac

SEQ ID NO: 4784762 - DNA, 11 bp, Homo sapiens
ttgtacagttt

SEQ ID NO: 4784763 - DNA, 20 bp, Homo sapiens
ttgtacccttcttgtctctc

SEQ ID NO: 4784764 - DNA, 19 bp, Homo sapiens
ttgtacttacactgaaatc

SEQ ID NO: 4784765 - DNA, 21 bp, Homo sapiens
ttgtagcctaatattcatgct

SEQ ID NO: 4784766 - DNA, 20 bp, Homo sapiens
ttgtagctagtttaaaatta

SEQ ID NO: 4784767 - DNA, 21 bp, Homo sapiens
ttgtagctagtttaaaattat

SEQ ID NO: 4784768 - DNA, 17 bp, Homo sapiens
ttgtataaaacagtgtt

SEQ ID NO: 4784769 - DNA, 18 bp, Homo sapiens
ttgtataagatgctgctg

SEQ ID NO: 4784770 - DNA, 16 bp, Homo sapiens
ttgtatacaagtactg

SEQ ID NO: 4784771 - DNA, 15 bp, Homo sapiens
ttgtatacttttggt

SEQ ID NO: 4784772 - DNA, 15 bp, Homo sapiens
ttgtatctcctttaa

SEQ ID NO: 4784773 - DNA, 15 bp, Homo sapiens
ttgtattatcagtga

SEQ ID NO: 4784774 - DNA, 22 bp, Homo sapiens
ttgtattatcagtgaatataaa

SEQ ID NO: 4784775 - DNA, 18 bp, Homo sapiens
ttgtattatcatatatgc

SEQ ID NO: 4784776 - DNA, 15 bp, Homo sapiens
ttgtattcctgcctt

SEQ ID NO: 4784777 - DNA, 13 bp, Homo sapiens
ttgtattggaagt

SEQ ID NO: 4784778 - DNA, 18 bp, Homo sapiens
ttgtattttcttcccatt

SEQ ID NO: 4784779 - DNA, 22 bp, Homo sapiens
ttgtattttcttcccatttgta

SEQ ID NO: 4784780 - DNA, 23 bp, Homo sapiens
ttgtattttcttcccatttgtaa

SEQ ID NO: 4784781 - DNA, 22 bp, Homo sapiens
ttgtcaaagtggtgagaggcat

SEQ ID NO: 4784782 - DNA, 14 bp, Homo sapiens
tttactgtctgtaa

SEQ ID NO: 4784783 - DNA, 17 bp, Homo sapiens
tttacttgattaaggac

SEQ ID NO: 4784784 - DNA, 20 bp, Homo sapiens
tttagaaataaaccttaata

SEQ ID NO: 4784785 - DNA, 15 bp, Homo sapiens
tttagaatgacagga

SEQ ID NO: 4784786 - DNA, 18 bp, Homo sapiens
tttagagattaatttgtg

SEQ ID NO: 4784787 - DNA, 22 bp, Homo sapiens
tttagagattaatttgtgtaga

SEQ ID NO: 4784788 - DNA, 22 bp, Homo sapiens
tttagagtatgcaagaagaata

SEQ ID NO: 4784789 - DNA, 17 bp, Homo sapiens
tttagcacagtatttaa

SEQ ID NO: 4784790 - DNA, 20 bp, Homo sapiens
tttagcacagtatttaacat

SEQ ID NO: 4784791 - DNA, 16 bp, Homo sapiens
tttagcagtccatttt

SEQ ID NO: 4784792 - DNA, 15 bp, Homo sapiens
tttagcagttctgca

SEQ ID NO: 4784793 - DNA, 21 bp, Homo sapiens
tttaggaatgctcaatgtgct

SEQ ID NO: 4784794 - DNA, 10 bp, Homo sapiens
tttaggcagg

SEQ ID NO: 4784795 - DNA, 14 bp, Homo sapiens
tttaggcaggaagt

SEQ ID NO: 4784796 - DNA, 22 bp, Homo sapiens
tttaggcaggaagtcaggagcc

SEQ ID NO: 4784797 - DNA, 12 bp, Homo sapiens
tttaggcttcta

SEQ ID NO: 4784798 - DNA, 13 bp, Homo sapiens
tttagtagctgat

SEQ ID NO: 4784799 - DNA, 16 bp, Homo sapiens
tttagtagctgataaa

SEQ ID NO: 4784800 - DNA, 21 bp, Homo sapiens
tttataaaccataaaataaat

SEQ ID NO: 4784801 - DNA, 12 bp, Homo sapiens
tttataaatgtt

SEQ ID NO: 4784802 - DNA, 15 bp, Homo sapiens
tttataaattaaata

SEQ ID NO: 4784803 - DNA, 21 bp, Homo sapiens
tttataagagggaacaaattt

SEQ ID NO: 4784804 - DNA, 17 bp, Homo sapiens
tttataaggctgactct

SEQ ID NO: 4784805 - DNA, 16 bp, Homo sapiens
tttataataaactgtt

SEQ ID NO: 4784806 - DNA, 17 bp, Homo sapiens
tttataataaactgttt

SEQ ID NO: 4784807 - DNA, 15 bp, Homo sapiens
tttatacgagaacag

SEQ ID NO: 4784808 - DNA, 17 bp, Homo sapiens
tttatataataaagtat

SEQ ID NO: 4784809 - DNA, 20 bp, Homo sapiens
tttatataataaagtattcc

SEQ ID NO: 4784810 - DNA, 21 bp, Homo sapiens
tttatataataaagtattcca

SEQ ID NO: 4784811 - DNA, 22 bp, Homo sapiens
tttatataatggtatgcttgca

SEQ ID NO: 4784812 - DNA, 19 bp, Homo sapiens
tttatatatgaagtaagtt

SEQ ID NO: 4784813 - DNA, 20 bp, Homo sapiens
tttatattgtttttatatat

SEQ ID NO: 4784814 - DNA, 13 bp, Homo sapiens
tttatccacattg

SEQ ID NO: 4784815 - DNA, 22 bp, Homo sapiens
tttatctgtgaatcctttgtac

SEQ ID NO: 4784816 - DNA, 15 bp, Homo sapiens
tttatgactaatcct

SEQ ID NO: 4784817 - DNA, 16 bp, Homo sapiens
tttatgcatttatgca

SEQ ID NO: 4784818 - DNA, 12 bp, Homo sapiens
tttatgtattct

SEQ ID NO: 4784819 - DNA, 15 bp, Homo sapiens
tttatgtcattttca

SEQ ID NO: 4784820 - DNA, 16 bp, Homo sapiens
tttatgtgctattaat

SEQ ID NO: 4784821 - DNA, 18 bp, Homo sapiens
tttatgtttaaaatggca

SEQ ID NO: 4784822 - DNA, 19 bp, Homo sapiens
tttatgtttaaaatggcat

SEQ ID NO: 4784823 - DNA, 17 bp, Homo sapiens
tttattaaaaccattct

SEQ ID NO: 4784824 - DNA, 21 bp, Homo sapiens
tttattaaatttattaaatgt

SEQ ID NO: 4784825 - DNA, 15 bp, Homo sapiens
tttattaggttaagt

SEQ ID NO: 4784826 - DNA, 18 bp, Homo sapiens
tttattcattagctgtga

SEQ ID NO: 4784827 - DNA, 12 bp, Homo sapiens
tttattctcaga

SEQ ID NO: 4784828 - DNA, 12 bp, Homo sapiens
tttattgtctgt

SEQ ID NO: 4784829 - DNA, 14 bp, Homo sapiens
tttattgtctgtaa

SEQ ID NO: 4784830 - DNA, 19 bp, Homo sapiens
tttattttagcagttctgc

SEQ ID NO: 4784831 - DNA, 23 bp, Homo sapiens
tttattttagcagttctgcaaat

SEQ ID NO: 4784832 - DNA, 18 bp, Homo sapiens
tttattttttgtaactct

SEQ ID NO: 4784833 - DNA, 20 bp, Homo sapiens
tttcaatagcgtgtgtagat

SEQ ID NO: 4784834 - DNA, 18 bp, Homo sapiens
tttcaatccacagtattg

SEQ ID NO: 4784835 - DNA, 12 bp, Homo sapiens
tttcaatgcaat

SEQ ID NO: 4784836 - DNA, 21 bp, Homo sapiens
tttcaatgcaatgcatctgaa

SEQ ID NO: 4784837 - DNA, 17 bp, Homo sapiens
tttcacagctatgaaga

SEQ ID NO: 4784838 - DNA, 23 bp, Homo sapiens
tttcacagtgggcggcttccctg

SEQ ID NO: 4784839 - DNA, 13 bp, Homo sapiens
tttcacatctgta

SEQ ID NO: 4784840 - DNA, 14 bp, Homo sapiens
tttcacattcctga

SEQ ID NO: 4784841 - DNA, 19 bp, Homo sapiens
tttcacattcctgaccctc

SEQ ID NO: 4784842 - DNA, 19 bp, Homo sapiens
tttcaccctgccaccctct

SEQ ID NO: 4784843 - DNA, 22 bp, Homo sapiens
tttcacctcttcccacaagaaa

SEQ ID NO: 4784844 - DNA, 13 bp, Homo sapiens
tttcacttcttaa

SEQ ID NO: 4784845 - DNA, 16 bp, Homo sapiens
tttcacttcttaagga

SEQ ID NO: 4784846 - DNA, 17 bp, Homo sapiens
tttcacttcttaaggac

SEQ ID NO: 4784847 - DNA, 18 bp, Homo sapiens
tttcacttcttaaggaca

SEQ ID NO: 4784848 - DNA, 22 bp, Homo sapiens
tttcagaaagggcagcccctcc

SEQ ID NO: 4784849 - DNA, 15 bp, Homo sapiens
tttcagatgctttag

SEQ ID NO: 4784850 - DNA, 18 bp, Homo sapiens
tttcagattgtaaaggta

SEQ ID NO: 4784851 - DNA, 15 bp, Homo sapiens
tttcagccaagaatt

SEQ ID NO: 4784852 - DNA, 17 bp, Homo sapiens
tttcagccaagaattct

SEQ ID NO: 4784853 - DNA, 16 bp, Homo sapiens
tttcagtaagatcaag

SEQ ID NO: 4784854 - DNA, 21 bp, Homo sapiens
tttcatagataccattttgaa

SEQ ID NO: 4784855 - DNA, 21 bp, Homo sapiens
tttcatataggaatagaaaca

SEQ ID NO: 4784856 - DNA, 13 bp, Homo sapiens
tttcatcaagtag

SEQ ID NO: 4784857 - DNA, 22 bp, Homo sapiens
tttcatccagtttgttctccgg

SEQ ID NO: 4784858 - DNA, 20 bp, Homo sapiens
tttcatgaccactgggcctg

SEQ ID NO: 4784859 - DNA, 16 bp, Homo sapiens
tttcatgattagacaa

SEQ ID NO: 4784860 - DNA, 18 bp, Homo sapiens
tttcatgattagacaatg

SEQ ID NO: 4784861 - DNA, 14 bp, Homo sapiens
tttcatgtttaaga

SEQ ID NO: 4784862 - DNA, 16 bp, Homo sapiens
tttcattgagggaaaa

SEQ ID NO: 4784863 - DNA, 13 bp, Homo sapiens
tttcattttctct

SEQ ID NO: 4784864 - DNA, 15 bp, Homo sapiens
tttcattttctctcc

SEQ ID NO: 4784865 - DNA, 13 bp, Homo sapiens
tttccaaaggttg

SEQ ID NO: 4784866 - DNA, 18 bp, Homo sapiens
tttccaaaggttgtacat

SEQ ID NO: 4784867 - DNA, 14 bp, Homo sapiens
tttccaacacacaa

SEQ ID NO: 4784868 - DNA, 19 bp, Homo sapiens
tttccatccaaacctacct

SEQ ID NO: 4784869 - DNA, 14 bp, Homo sapiens
tttccatgacagta

SEQ ID NO: 4784870 - DNA, 23 bp, Homo sapiens
tttccatgacagtagcatactga

SEQ ID NO: 4784871 - DNA, 13 bp, Homo sapiens
tttccatttggat

SEQ ID NO: 4784872 - DNA, 19 bp, Homo sapiens
tttccatttggattttaaa

SEQ ID NO: 4784873 - DNA, 22 bp, Homo sapiens
tttcccacccactagccctctt

SEQ ID NO: 4784874 - DNA, 16 bp, Homo sapiens
tttcccatcaccagaa

SEQ ID NO: 4784875 - DNA, 19 bp, Homo sapiens
tttccccaattatcctcct

SEQ ID NO: 4784876 - DNA, 18 bp, Homo sapiens
tttccccctagcctgcct

SEQ ID NO: 4784877 - DNA, 12 bp, Homo sapiens
tttccctgctga

SEQ ID NO: 4784878 - DNA, 13 bp, Homo sapiens
tttcctctcctct

SEQ ID NO: 4784879 - DNA, 17 bp, Homo sapiens
tttcctcttagaagaat

SEQ ID NO: 4784880 - DNA, 15 bp, Homo sapiens
tttcctgggtgctca

SEQ ID NO: 4784881 - DNA, 15 bp, Homo sapiens
tttcctgtcaatata

SEQ ID NO: 4784882 - DNA, 16 bp, Homo sapiens
tttcctgtcaatatat

SEQ ID NO: 4784883 - DNA, 16 bp, Homo sapiens
tttcgtgcatttgtga

SEQ ID NO: 4784884 - DNA, 22 bp, Homo sapiens
tttcgttaagcagtacatcttg

SEQ ID NO: 4784885 - DNA, 18 bp, Homo sapiens
tttctaaaacattaattg

SEQ ID NO: 4784886 - DNA, 17 bp, Homo sapiens
tttctaaagctgccagc

SEQ ID NO: 4784887 - DNA, 14 bp, Homo sapiens
tttctacatgcaaa

SEQ ID NO: 4784888 - DNA, 15 bp, Homo sapiens
tttctagcaattgct

SEQ ID NO: 4784889 - DNA, 19 bp, Homo sapiens
tttctagccctctccctca

SEQ ID NO: 4784890 - DNA, 15 bp, Homo sapiens
tttctagtaacagta

SEQ ID NO: 4784891 - DNA, 21 bp, Homo sapiens
tttctagtaacagtatttcca

SEQ ID NO: 4784892 - DNA, 17 bp, Homo sapiens
tttctatggcatattga

SEQ ID NO: 4784893 - DNA, 13 bp, Homo sapiens
tttctcatctgta

SEQ ID NO: 4784894 - DNA, 14 bp, Homo sapiens
tttctcattcttgc

SEQ ID NO: 4784895 - DNA, 21 bp, Homo sapiens
tttctccattaaacttctact

SEQ ID NO: 4784896 - DNA, 11 bp, Homo sapiens
tttctccttcc

SEQ ID NO: 4784897 - DNA, 13 bp, Homo sapiens
tttctctctgtgt

SEQ ID NO: 4784898 - DNA, 23 bp, Homo sapiens
tttctctctgtgtggcaaacatt

SEQ ID NO: 4784899 - DNA, 23 bp, Homo sapiens
tttctctttgtggggcttggcgt

SEQ ID NO: 4784900 - DNA, 13 bp, Homo sapiens
tttctcttttaag

SEQ ID NO: 4784901 - DNA, 11 bp, Homo sapiens
tttctgaggag

SEQ ID NO: 4784902 - DNA, 21 bp, Homo sapiens
tttctgagtagcatatataat

SEQ ID NO: 4784903 - DNA, 19 bp, Homo sapiens
tttctgcagccactattgt

SEQ ID NO: 4784904 - DNA, 16 bp, Homo sapiens
tttctgccgcagccct

SEQ ID NO: 4784905 - DNA, 13 bp, Homo sapiens
aaaaccattgctt

SEQ ID NO: 4784906 - DNA, 14 bp, Homo sapiens
aaaaccattgcttc

SEQ ID NO: 4784907 - DNA, 21 bp, Homo sapiens
aaaaccctgctaaatgactta

SEQ ID NO: 4784908 - DNA, 11 bp, Homo sapiens
aaaacctcagt

SEQ ID NO: 4784909 - DNA, 21 bp, Homo sapiens
aaaacctcagttggcctctgc

SEQ ID NO: 4784910 - DNA, 23 bp, Homo sapiens
aaaacctcagttggcctctgccc

SEQ ID NO: 4784911 - DNA, 17 bp, Homo sapiens
aaaacgatttaatttat

SEQ ID NO: 4784912 - DNA, 11 bp, Homo sapiens
aaaactactgc

SEQ ID NO: 4784913 - DNA, 15 bp, Homo sapiens
aaaactactgccttt

SEQ ID NO: 4784914 - DNA, 23 bp, Homo sapiens
aaaactcccttccttatgcatac

SEQ ID NO: 4784915 - DNA, 19 bp, Homo sapiens
aaaactgccacaagcacaa

SEQ ID NO: 4784916 - DNA, 17 bp, Homo sapiens
aaaactggaataagaag

SEQ ID NO: 4784917 - DNA, 11 bp, Homo sapiens
aaaactgtgac

SEQ ID NO: 4784918 - DNA, 12 bp, Homo sapiens
aaaactgtgaca

SEQ ID NO: 4784919 - DNA, 21 bp, Homo sapiens
aaaactgttaagggaagctga

SEQ ID NO: 4784920 - DNA, 14 bp, Homo sapiens
aaaacttctcattt

SEQ ID NO: 4784921 - DNA, 11 bp, Homo sapiens
aaggagaggag

SEQ ID NO: 4784922 - DNA, 12 bp, Homo sapiens
aaggagaggagt

SEQ ID NO: 4784923 - DNA, 23 bp, Homo sapiens
aaggagaggagtgcgctagagca

SEQ ID NO: 4784924 - DNA, 22 bp, Homo sapiens
aaggagatggggagggcgcttt

SEQ ID NO: 4784925 - DNA, 22 bp, Homo sapiens
aaggagcactagaatgagaaat

SEQ ID NO: 4784926 - DNA, 17 bp, Homo sapiens
aaggatacccggtggct

SEQ ID NO: 4784927 - DNA, 14 bp, Homo sapiens
aaggatgcccaaag

SEQ ID NO: 4784928 - DNA, 22 bp, Homo sapiens
aaggattcttttttcaatgtac

SEQ ID NO: 4784929 - DNA, 16 bp, Homo sapiens
aaggatttattctcag

SEQ ID NO: 4784930 - DNA, 12 bp, Homo sapiens
aaggcaaatgtc

SEQ ID NO: 4784931 - DNA, 18 bp, Homo sapiens
aaggcacattgaaatact

SEQ ID NO: 4784932 - DNA, 16 bp, Homo sapiens
aaggcactgagcgcct

SEQ ID NO: 4784933 - DNA, 10 bp, Homo sapiens
aaggcagctg

SEQ ID NO: 4784934 - DNA, 13 bp, Homo sapiens
aaggcagggccct

SEQ ID NO: 4784935 - DNA, 14 bp, Homo sapiens
aaggcatctaagac

SEQ ID NO: 4784936 - DNA, 16 bp, Homo sapiens
aaggccaaaggaagca

SEQ ID NO: 4784937 - DNA, 16 bp, Homo sapiens
aaggcccccacctctg

SEQ ID NO: 4784938 - DNA, 14 bp, Homo sapiens
aaggccccttccca

SEQ ID NO: 4784939 - DNA, 18 bp, Homo sapiens
aaggccggtgggaagagg

SEQ ID NO: 4784940 - DNA, 12 bp, Homo sapiens
aaggcctgaggg

SEQ ID NO: 4784941 - DNA, 19 bp, Homo sapiens
aaggcctgagggaagccca

SEQ ID NO: 4784942 - DNA, 23 bp, Homo sapiens
aaggcctgagggaagcccacccg

SEQ ID NO: 4784943 - DNA, 20 bp, Homo sapiens
aaggcctgccccccttccca

SEQ ID NO: 4784944 - DNA, 12 bp, Homo sapiens
aaggcctgggtg

SEQ ID NO: 4784945 - DNA, 23 bp, Homo sapiens
aagggaaaacaaatatttcactt

SEQ ID NO: 4784946 - DNA, 17 bp, Homo sapiens
aagggaaatcaatttaa

SEQ ID NO: 4784947 - DNA, 13 bp, Homo sapiens
aagggaagccctg

SEQ ID NO: 4784948 - DNA, 13 bp, Homo sapiens
aagggaccccaga

SEQ ID NO: 4784949 - DNA, 17 bp, Homo sapiens
aagggactccagaagca

SEQ ID NO: 4784950 - DNA, 17 bp, Homo sapiens
aagggagccatgctctt

SEQ ID NO: 4784951 - DNA, 13 bp, Homo sapiens
aagggaggggaag

SEQ ID NO: 4784952 - DNA, 20 bp, Homo sapiens
aagggaggggaagagagagg

SEQ ID NO: 4784953 - DNA, 14 bp, Homo sapiens
aagggatccagaga

SEQ ID NO: 4784954 - DNA, 22 bp, Homo sapiens
aagggatccagagacctgctcc

SEQ ID NO: 4784955 - DNA, 18 bp, Homo sapiens
aagggcaagatgtaaagc

SEQ ID NO: 4784956 - DNA, 18 bp, Homo sapiens
aagggcagcaagataaac

SEQ ID NO: 4784957 - DNA, 15 bp, Homo sapiens
aagggcagcccctcc

SEQ ID NO: 4784958 - DNA, 18 bp, Homo sapiens
aagggcagcccctcccca

SEQ ID NO: 4784959 - DNA, 22 bp, Homo sapiens
aagggcaggaagacttccagct

SEQ ID NO: 4784960 - DNA, 22 bp, Homo sapiens
aagggcccccggctcggcctct

SEQ ID NO: 4784961 - DNA, 14 bp, Homo sapiens
aagggccttctcca

SEQ ID NO: 4784962 - DNA, 14 bp, Homo sapiens
aaggggaaaacctc

SEQ ID NO: 4784963 - DNA, 16 bp, Homo sapiens
aaggggaaaacctcag

SEQ ID NO: 4784964 - DNA, 15 bp, Homo sapiens
aaggggaattaacaa

SEQ ID NO: 4784965 - DNA, 21 bp, Homo sapiens
aaggggcctgggctgtgagga

SEQ ID NO: 4784966 - DNA, 20 bp, Homo sapiens
aaggggtggaagggcaggag

SEQ ID NO: 4784967 - DNA, 19 bp, Homo sapiens
aagggtccggcttggctag

SEQ ID NO: 4784968 - DNA, 18 bp, Homo sapiens
aaggtcagtgttataaaa

SEQ ID NO: 4784969 - DNA, 21 bp, Homo sapiens
aaggtctcatttgatattgtg

SEQ ID NO: 4784970 - DNA, 12 bp, Homo sapiens
aaggtctgcttt

SEQ ID NO: 4784971 - DNA, 17 bp, Homo sapiens
aaggtgatgaatttacc

SEQ ID NO: 4784972 - DNA, 21 bp, Homo sapiens
aaggtgatgaatttaccatca

SEQ ID NO: 4784973 - DNA, 23 bp, Homo sapiens
aaggtgctcttctcattttttcc

SEQ ID NO: 4784974 - DNA, 20 bp, Homo sapiens
aaggtggtcttggagaggag

SEQ ID NO: 4784975 - DNA, 19 bp, Homo sapiens
aaggttctatgatatacaa

SEQ ID NO: 4784976 - DNA, 22 bp, Homo sapiens
aaggtttagaatgacaggaacc

SEQ ID NO: 4784977 - DNA, 22 bp, Homo sapiens
aagtaaaacagatttgttcatt

SEQ ID NO: 4784978 - DNA, 13 bp, Homo sapiens
aagtaaatctatc

SEQ ID NO: 4784979 - DNA, 17 bp, Homo sapiens
aagtaaatctatctcta

SEQ ID NO: 4784980 - DNA, 18 bp, Homo sapiens
aagtaaattttctttaag

SEQ ID NO: 4784981 - DNA, 15 bp, Homo sapiens
aagtaattaaaaaga

SEQ ID NO: 4784982 - DNA, 21 bp, Homo sapiens
aagtacatctgtacatgactg

SEQ ID NO: 4784983 - DNA, 17 bp, Homo sapiens
aagtactataatttacc

SEQ ID NO: 4784984 - DNA, 20 bp, Homo sapiens
aagtagtacttcttctgtaa

SEQ ID NO: 4784985 - DNA, 17 bp, Homo sapiens
aagtagtgtgagtgtta

SEQ ID NO: 4784986 - DNA, 18 bp, Homo sapiens
aagtataactaatttgct

SEQ ID NO: 4784987 - DNA, 17 bp, Homo sapiens
aagtatatacagagcct

SEQ ID NO: 4784988 - DNA, 15 bp, Homo sapiens
aagtattccacctta

SEQ ID NO: 4784989 - DNA, 20 bp, Homo sapiens
aagtattttatctgtgttgt

SEQ ID NO: 4784990 - DNA, 18 bp, Homo sapiens
aagtcaaacagtgtggct

SEQ ID NO: 4784991 - DNA, 13 bp, Homo sapiens
aagtcagatgttt

SEQ ID NO: 4784992 - DNA, 14 bp, Homo sapiens
aagtcagatgtttg

SEQ ID NO: 4784993 - DNA, 12 bp, Homo sapiens
aagtcaggagcc

SEQ ID NO: 4784994 - DNA, 13 bp, Homo sapiens
aagtcaggagcca

SEQ ID NO: 4784995 - DNA, 18 bp, Homo sapiens
aagtcaggagccagcagg

SEQ ID NO: 4784996 - DNA, 18 bp, Homo sapiens
aagtcaggccattcagtc

SEQ ID NO: 4784997 - DNA, 19 bp, Homo sapiens
aagtcatgggagaagaggg

SEQ ID NO: 4784998 - DNA, 14 bp, Homo sapiens
aagtccatgtgata

SEQ ID NO: 4784999 - DNA, 21 bp, Homo sapiens
aagtccatgtgataattgtaa

SEQ ID NO: 4785000 - DNA, 19 bp, Homo sapiens
aagtcccgaggcagcaaca

SEQ ID NO: 4785001 - DNA, 20 bp, Homo sapiens
aagtcccgccctggctcttt

SEQ ID NO: 4785002 - DNA, 13 bp, Homo sapiens
aagtcccttcctg

SEQ ID NO: 4785003 - DNA, 22 bp, Homo sapiens
aagtcctttcccgatgcgtggc

SEQ ID NO: 4785004 - DNA, 18 bp, Homo sapiens
aagtctacactgcctttg

SEQ ID NO: 4785005 - DNA, 21 bp, Homo sapiens
aagtctacctgccttgcctgt

SEQ ID NO: 4785006 - DNA, 23 bp, Homo sapiens
aagtctacctgccttgcctgtta

SEQ ID NO: 4785007 - DNA, 18 bp, Homo sapiens
aagtctatctggtattaa

SEQ ID NO: 4785008 - DNA, 17 bp, Homo sapiens
aagtctcaatgaaatag

SEQ ID NO: 4785009 - DNA, 13 bp, Homo sapiens
aagtctctctaag

SEQ ID NO: 4785010 - DNA, 21 bp, Homo sapiens
aagtctgttttgggaaacact

SEQ ID NO: 4785011 - DNA, 17 bp, Homo sapiens
aagtgaaattagtattt

SEQ ID NO: 4785012 - DNA, 14 bp, Homo sapiens
aagtgaccaaggtg

SEQ ID NO: 4785013 - DNA, 12 bp, Homo sapiens
aagtgacttatt

SEQ ID NO: 4785014 - DNA, 15 bp, Homo sapiens
aagtgatgtgattta

SEQ ID NO: 4785015 - DNA, 19 bp, Homo sapiens
aagtgatgtgatttatgca

SEQ ID NO: 4785016 - DNA, 20 bp, Homo sapiens
aagtgatgtgatttatgcat

SEQ ID NO: 4785017 - DNA, 21 bp, Homo sapiens
aagtgattccttcttgctcag

SEQ ID NO: 4785018 - DNA, 13 bp, Homo sapiens
aagtgattgacat

SEQ ID NO: 4785019 - DNA, 14 bp, Homo sapiens
aagtgattgacatt

SEQ ID NO: 4785020 - DNA, 13 bp, Homo sapiens
aagtgcacacaca

SEQ ID NO: 4785021 - DNA, 12 bp, Homo sapiens
aagtgctcagta

SEQ ID NO: 4785022 - DNA, 16 bp, Homo sapiens
aagtggaacgttctct

SEQ ID NO: 4785023 - DNA, 18 bp, Homo sapiens
aagtggaagacagagatg

SEQ ID NO: 4785024 - DNA, 13 bp, Homo sapiens
aagtggactgtat

SEQ ID NO: 4785025 - DNA, 18 bp, Homo sapiens
aagtggcctgagaagagt

SEQ ID NO: 4785026 - DNA, 21 bp, Homo sapiens
aagtggcctgagaagagtcga

SEQ ID NO: 4785027 - DNA, 17 bp, Homo sapiens
aagtggggtctttcaga

SEQ ID NO: 4785028 - DNA, 19 bp, Homo sapiens
aagtgggtcaattccttag

SEQ ID NO: 4785029 - DNA, 14 bp, Homo sapiens
aagtgtacatttga

SEQ ID NO: 4785030 - DNA, 21 bp, Homo sapiens
aagtgtacatttgatttgata

SEQ ID NO: 4785031 - DNA, 22 bp, Homo sapiens
aagtgttggccatcatttcatt

SEQ ID NO: 4785032 - DNA, 22 bp, Homo sapiens
aagtgttgtacaattactgtga

SEQ ID NO: 4785033 - DNA, 15 bp, Homo sapiens
aagtgttgtcttatt

SEQ ID NO: 4785034 - DNA, 14 bp, Homo sapiens
aagtgtttttacat

SEQ ID NO: 4785035 - DNA, 24 bp, Homo sapiens
aagttcattcatactcaaagaggc

SEQ ID NO: 4785036 - DNA, 18 bp, Homo sapiens
aagttctattatctgggt

SEQ ID NO: 4785037 - DNA, 21 bp, Homo sapiens
aagttctgtgcagtttggtat

SEQ ID NO: 4785038 - DNA, 21 bp, Homo sapiens
aagttggaagggaccccagat

SEQ ID NO: 4785039 - DNA, 17 bp, Homo sapiens
aagttggagtgcagtgg

SEQ ID NO: 4785040 - DNA, 15 bp, Homo sapiens
aagttgtgatctgtt

SEQ ID NO: 4785041 - DNA, 18 bp, Homo sapiens
aagttgtgatctgttgta

SEQ ID NO: 4785042 - DNA, 19 bp, Homo sapiens
aagttgtgatctgttgtaa

SEQ ID NO: 4785043 - DNA, 12 bp, Homo sapiens
aagtttcattta

SEQ ID NO: 4785044 - DNA, 22 bp, Homo sapiens
aagtttcgagagaaaggagggc

SEQ ID NO: 4785045 - DNA, 12 bp, Homo sapiens
aagtttctaaga

SEQ ID NO: 4785046 - DNA, 21 bp, Homo sapiens
aaacctaccttatagagcaca

SEQ ID NO: 4785047 - DNA, 22 bp, Homo sapiens
aaacctaccttatagagcacaa

SEQ ID NO: 4785048 - DNA, 23 bp, Homo sapiens
aaacctaccttatagagcacaat

SEQ ID NO: 4785049 - DNA, 22 bp, Homo sapiens
aaacctatctgtattggcagca

SEQ ID NO: 4785050 - DNA, 23 bp, Homo sapiens
aaacctcagttggcctctgcccc

SEQ ID NO: 4785051 - DNA, 15 bp, Homo sapiens
aaacctctatatgtt

SEQ ID NO: 4785052 - DNA, 12 bp, Homo sapiens
aaacctggcaga

SEQ ID NO: 4785053 - DNA, 15 bp, Homo sapiens
aaacctgtgctttca

SEQ ID NO: 4785054 - DNA, 22 bp, Homo sapiens
aaacctgttcctgactgttctc

SEQ ID NO: 4785055 - DNA, 19 bp, Homo sapiens
aaaccttaatatttcttca

SEQ ID NO: 4785056 - DNA, 21 bp, Homo sapiens
aaaccttaatatttcttcaaa

SEQ ID NO: 4785057 - DNA, 11 bp, Homo sapiens
aaaccttcttt

SEQ ID NO: 4785058 - DNA, 20 bp, Homo sapiens
aaaccttcttttcaatgcaa

SEQ ID NO: 4785059 - DNA, 16 bp, Homo sapiens
aacctgaattaaagtc

SEQ ID NO: 4785060 - DNA, 12 bp, Homo sapiens
accggccactgc

SEQ ID NO: 4785061 - DNA, 15 bp, Homo sapiens
accgggagcctcccc

SEQ ID NO: 4785062 - DNA, 19 bp, Homo sapiens
accgggagcctccccctca

SEQ ID NO: 4785063 - DNA, 23 bp, Homo sapiens
accgtaaaggtttatttttctgt

SEQ ID NO: 4785064 - DNA, 15 bp, Homo sapiens
accgtcaatgtgaaa

SEQ ID NO: 4785065 - DNA, 20 bp, Homo sapiens
accgtgagcaggaaggcctg

SEQ ID NO: 4785066 - DNA, 16 bp, Homo sapiens
accgtgaggccagaga

SEQ ID NO: 4785067 - DNA, 17 bp, Homo sapiens
accgtgaggccagagac

SEQ ID NO: 4785068 - DNA, 19 bp, Homo sapiens
accgtggtgtcctctgtcc

SEQ ID NO: 4785069 - DNA, 20 bp, Homo sapiens
accgtggtgtgaggcccccg

SEQ ID NO: 4785070 - DNA, 22 bp, Homo sapiens
accgtggtgtgaggcccccgga

SEQ ID NO: 4785071 - DNA, 15 bp, Homo sapiens
acctaaacagctgct

SEQ ID NO: 4785072 - DNA, 12 bp, Homo sapiens
acctacagcctc

SEQ ID NO: 4785073 - DNA, 14 bp, Homo sapiens
acctacatctgaaa

SEQ ID NO: 4785074 - DNA, 20 bp, Homo sapiens
acctaccttatagagcacaa

SEQ ID NO: 4785075 - DNA, 22 bp, Homo sapiens
acctactcctccccctcctcca

SEQ ID NO: 4785076 - DNA, 20 bp, Homo sapiens
acctatctgtattggcagca

SEQ ID NO: 4785077 - DNA, 23 bp, Homo sapiens
acctattcaagaagatagttgta

SEQ ID NO: 4785078 - DNA, 14 bp, Homo sapiens
acctcaaactgggt

SEQ ID NO: 4785079 - DNA, 19 bp, Homo sapiens
acctcacagtgacccttcc

SEQ ID NO: 4785080 - DNA, 20 bp, Homo sapiens
acctcaccccgttacagctc

SEQ ID NO: 4785081 - DNA, 14 bp, Homo sapiens
acctcaggcctggg

SEQ ID NO: 4785082 - DNA, 19 bp, Homo sapiens
acctcagttggcctctgcc

SEQ ID NO: 4785083 - DNA, 21 bp, Homo sapiens
acctcagttggcctctgcccc

SEQ ID NO: 4785084 - DNA, 22 bp, Homo sapiens
acctcagttggcctctgcccct

SEQ ID NO: 4785085 - DNA, 18 bp, Homo sapiens
acctccagtccccctatc

SEQ ID NO: 4785086 - DNA, 19 bp, Homo sapiens
acctcccccaaaccctgct

SEQ ID NO: 4785087 - DNA, 13 bp, Homo sapiens
acctcccccaggg

SEQ ID NO: 4785088 - DNA, 13 bp, Homo sapiens
acctccctgcagc

SEQ ID NO: 4785089 - DNA, 20 bp, Homo sapiens
acctccctgtctctacaaaa

SEQ ID NO: 4785090 - DNA, 16 bp, Homo sapiens
acctcccttcatccca

SEQ ID NO: 4785091 - DNA, 12 bp, Homo sapiens
acctcgccgtgt

SEQ ID NO: 4785092 - DNA, 15 bp, Homo sapiens
acctcgccgtgtctt

SEQ ID NO: 4785093 - DNA, 16 bp, Homo sapiens
acctcggacaccatct

SEQ ID NO: 4785094 - DNA, 17 bp, Homo sapiens
acctcgggatggttggt

SEQ ID NO: 4785095 - DNA, 23 bp, Homo sapiens
acctcgtccatttaaacccggct

SEQ ID NO: 4785096 - DNA, 17 bp, Homo sapiens
acctctacaggcattta

SEQ ID NO: 4785097 - DNA, 20 bp, Homo sapiens
acctctatatgttgctgaaa

SEQ ID NO: 4785098 - DNA, 17 bp, Homo sapiens
acctctcagatccctcg

SEQ ID NO: 4785099 - DNA, 15 bp, Homo sapiens
acctctctactagca

SEQ ID NO: 4785100 - DNA, 16 bp, Homo sapiens
acctgaaaattcaaca

SEQ ID NO: 4785101 - DNA, 15 bp, Homo sapiens
acctgaagtctttgt

SEQ ID NO: 4785102 - DNA, 22 bp, Homo sapiens
acctgaagtctttgtacagaca

SEQ ID NO: 4785103 - DNA, 12 bp, Homo sapiens
acctgaattaaa

SEQ ID NO: 4785104 - DNA, 14 bp, Homo sapiens
acctgaattaaagt

SEQ ID NO: 4785105 - DNA, 15 bp, Homo sapiens
acctgaattaaagtc

SEQ ID NO: 4785106 - DNA, 14 bp, Homo sapiens
acctgaattattaa

SEQ ID NO: 4785107 - DNA, 15 bp, Homo sapiens
acctgacacaagagg

SEQ ID NO: 4785108 - DNA, 16 bp, Homo sapiens
acctgacacaagagga

SEQ ID NO: 4785109 - DNA, 12 bp, Homo sapiens
acctgacacctg

SEQ ID NO: 4785110 - DNA, 15 bp, Homo sapiens
acctgacacctgccg

SEQ ID NO: 4785111 - DNA, 15 bp, Homo sapiens
acctgaggccaaata

SEQ ID NO: 4785112 - DNA, 14 bp, Homo sapiens
acctgccacaatgt

SEQ ID NO: 4785113 - DNA, 13 bp, Homo sapiens
acctgccaggctg

SEQ ID NO: 4785114 - DNA, 20 bp, Homo sapiens
acctgcccagttagcccggc

SEQ ID NO: 4785115 - DNA, 13 bp, Homo sapiens
acctgccccaggc

SEQ ID NO: 4785116 - DNA, 14 bp, Homo sapiens
acctgccccaggct

SEQ ID NO: 4785117 - DNA, 16 bp, Homo sapiens
acctgccccaggctca

SEQ ID NO: 4785118 - DNA, 14 bp, Homo sapiens
acctgccgcctggg

SEQ ID NO: 4785119 - DNA, 21 bp, Homo sapiens
acctgccgctgcttgagtgga

SEQ ID NO: 4785120 - DNA, 22 bp, Homo sapiens
acctgcctctcacacacataga

SEQ ID NO: 4785121 - DNA, 23 bp, Homo sapiens
acctgcctctcacacacatagat

SEQ ID NO: 4785122 - DNA, 20 bp, Homo sapiens
acctgcctgggacagccact

SEQ ID NO: 4785123 - DNA, 22 bp, Homo sapiens
acctgcctgggacagccactgg

SEQ ID NO: 4785124 - DNA, 14 bp, Homo sapiens
acctgctccagatc

SEQ ID NO: 4785125 - DNA, 16 bp, Homo sapiens
acctgctccagatcct

SEQ ID NO: 4785126 - DNA, 21 bp, Homo sapiens
acctgcttcattcaagcttca

SEQ ID NO: 4785127 - DNA, 21 bp, Homo sapiens
acctggaggctggaccaactg

SEQ ID NO: 4785128 - DNA, 15 bp, Homo sapiens
acctggatggatctg

SEQ ID NO: 4785129 - DNA, 17 bp, Homo sapiens
acctggatggatctgct

SEQ ID NO: 4785130 - DNA, 18 bp, Homo sapiens
acctggatggatctgctc

SEQ ID NO: 4785131 - DNA, 20 bp, Homo sapiens
acctggatggatctgctcca

SEQ ID NO: 4785132 - DNA, 13 bp, Homo sapiens
acctggcccagtg

SEQ ID NO: 4785133 - DNA, 14 bp, Homo sapiens
acctggcgggctgg

SEQ ID NO: 4785134 - DNA, 14 bp, Homo sapiens
acctggcttcccag

SEQ ID NO: 4785135 - DNA, 18 bp, Homo sapiens
acctggcttcccaggacc

SEQ ID NO: 4785136 - DNA, 21 bp, Homo sapiens
acctggcttcccaggaccctg

SEQ ID NO: 4785137 - DNA, 15 bp, Homo sapiens
acctgggccctaggc

SEQ ID NO: 4785138 - DNA, 20 bp, Homo sapiens
acctggtggcaccagatgca

SEQ ID NO: 4785139 - DNA, 17 bp, Homo sapiens
acctggtggccctgcgg

SEQ ID NO: 4785140 - DNA, 11 bp, Homo sapiens
acctgtaaaac

SEQ ID NO: 4785141 - DNA, 21 bp, Homo sapiens
acctgtaaaactttattttat

SEQ ID NO: 4785142 - DNA, 20 bp, Homo sapiens
acctgtaatagcctcacctt

SEQ ID NO: 4785143 - DNA, 21 bp, Homo sapiens
acctgtcaacctgaattaaag

SEQ ID NO: 4785144 - DNA, 23 bp, Homo sapiens
acctgtcaacctgaattaaagtc

SEQ ID NO: 4785145 - DNA, 19 bp, Homo sapiens
acctgtttctgcagccact

SEQ ID NO: 4785146 - DNA, 15 bp, Homo sapiens
agacagagctacaca

SEQ ID NO: 4785147 - DNA, 19 bp, Homo sapiens
agacagagtcttactctgt

SEQ ID NO: 4785148 - DNA, 20 bp, Homo sapiens
agacagagtcttcctctgtc

SEQ ID NO: 4785149 - DNA, 18 bp, Homo sapiens
agacagagtggatctgga

SEQ ID NO: 4785150 - DNA, 12 bp, Homo sapiens
agacagctctta

SEQ ID NO: 4785151 - DNA, 20 bp, Homo sapiens
agacagttggttttgcatgt

SEQ ID NO: 4785152 - DNA, 16 bp, Homo sapiens
agacatacgaaacaca

SEQ ID NO: 4785153 - DNA, 18 bp, Homo sapiens
agacatacgaaacacaaa

SEQ ID NO: 4785154 - DNA, 14 bp, Homo sapiens
agacattaaataat

SEQ ID NO: 4785155 - DNA, 19 bp, Homo sapiens
agacattcaccaacaacag

SEQ ID NO: 4785156 - DNA, 23 bp, Homo sapiens
agaccaagtctctctaagacaaa

SEQ ID NO: 4785157 - DNA, 17 bp, Homo sapiens
agaccacccatatcatg

SEQ ID NO: 4785158 - DNA, 16 bp, Homo sapiens
agaccaccgcgcccct

SEQ ID NO: 4785159 - DNA, 17 bp, Homo sapiens
agaccacgcccctgcct

SEQ ID NO: 4785160 - DNA, 19 bp, Homo sapiens
agaccacttccttaacagc

SEQ ID NO: 4785161 - DNA, 23 bp, Homo sapiens
agaccagcatagttctgcaataa

SEQ ID NO: 4785162 - DNA, 19 bp, Homo sapiens
agaccaggcaggcaaaggc

SEQ ID NO: 4785163 - DNA, 16 bp, Homo sapiens
agaccagtgcttagca

SEQ ID NO: 4785164 - DNA, 21 bp, Homo sapiens
agaccatttagtcctcacctt

SEQ ID NO: 4785165 - DNA, 21 bp, Homo sapiens
agaccccaccctgtctgcagg

SEQ ID NO: 4785166 - DNA, 12 bp, Homo sapiens
agacccctgggg

SEQ ID NO: 4785167 - DNA, 17 bp, Homo sapiens
agacccctgggtgggcc

SEQ ID NO: 4785168 - DNA, 15 bp, Homo sapiens
agaccctaggtgctc

SEQ ID NO: 4785169 - DNA, 14 bp, Homo sapiens
agaccctatctccc

SEQ ID NO: 4785170 - DNA, 13 bp, Homo sapiens
agaccctgccagg

SEQ ID NO: 4785171 - DNA, 14 bp, Homo sapiens
agaccctgccaggg

SEQ ID NO: 4785172 - DNA, 16 bp, Homo sapiens
agaccctgcgcccctg

SEQ ID NO: 4785173 - DNA, 17 bp, Homo sapiens
agaccctgcgcccctgc

SEQ ID NO: 4785174 - DNA, 12 bp, Homo sapiens
agaccctgtctt

SEQ ID NO: 4785175 - DNA, 21 bp, Homo sapiens
agacctccagattattttcta

SEQ ID NO: 4785176 - DNA, 15 bp, Homo sapiens
agacctcccccaggg

SEQ ID NO: 4785177 - DNA, 18 bp, Homo sapiens
agacctgccgcctgggaa

SEQ ID NO: 4785178 - DNA, 13 bp, Homo sapiens
agacctgctccag

SEQ ID NO: 4785179 - DNA, 20 bp, Homo sapiens
agacggacgggacagcggcc

SEQ ID NO: 4785180 - DNA, 18 bp, Homo sapiens
agacgggggcagagaggg

SEQ ID NO: 4785181 - DNA, 21 bp, Homo sapiens
agacgtttttgtgctgtgggc

SEQ ID NO: 4785182 - DNA, 14 bp, Homo sapiens
agactaacttattt

SEQ ID NO: 4785183 - DNA, 16 bp, Homo sapiens
agactaagggcaggaa

SEQ ID NO: 4785184 - DNA, 23 bp, Homo sapiens
agactacaggcacacaccaccac

SEQ ID NO: 4785185 - DNA, 18 bp, Homo sapiens
agactagtttacaaagga

SEQ ID NO: 4785186 - DNA, 20 bp, Homo sapiens
agactatggagcctggcaca

SEQ ID NO: 4785187 - DNA, 23 bp, Homo sapiens
agactatgtgtcatgatttcaat

SEQ ID NO: 4785188 - DNA, 16 bp, Homo sapiens
agactcaaagaagtac

SEQ ID NO: 4785189 - DNA, 18 bp, Homo sapiens
agactcctctcttctgac

SEQ ID NO: 4785190 - DNA, 15 bp, Homo sapiens
agactcgagagggct

SEQ ID NO: 4785191 - DNA, 18 bp, Homo sapiens
agactcgagagggctgag

SEQ ID NO: 4785192 - DNA, 19 bp, Homo sapiens
agactcgagagggctgagc

SEQ ID NO: 4785193 - DNA, 21 bp, Homo sapiens
agactcgagagggctgagccc

SEQ ID NO: 4785194 - DNA, 22 bp, Homo sapiens
agactctaaaactatcagcagc

SEQ ID NO: 4785195 - DNA, 23 bp, Homo sapiens
agactctaaaactatcagcagcg

SEQ ID NO: 4785196 - DNA, 15 bp, Homo sapiens
agactctatgctctg

SEQ ID NO: 4785197 - DNA, 22 bp, Homo sapiens
agactctctcctctctctccct

SEQ ID NO: 4785198 - DNA, 18 bp, Homo sapiens
agactctgtgagattcta

SEQ ID NO: 4785199 - DNA, 20 bp, Homo sapiens
agactctgtgagattctaaa

SEQ ID NO: 4785200 - DNA, 21 bp, Homo sapiens
agactgcaggttggaccccag

SEQ ID NO: 4785201 - DNA, 14 bp, Homo sapiens
agactgcccaccct

SEQ ID NO: 4785202 - DNA, 16 bp, Homo sapiens
agactgcccaccctgg

SEQ ID NO: 4785203 - DNA, 20 bp, Homo sapiens
agactgcccaccctgggcct

SEQ ID NO: 4785204 - DNA, 22 bp, Homo sapiens
agactgcccaccctgggcctcc

SEQ ID NO: 4785205 - DNA, 23 bp, Homo sapiens
agactgcccaccctgggcctccc

SEQ ID NO: 4785206 - DNA, 19 bp, Homo sapiens
agactgccttatattattt

SEQ ID NO: 4785207 - DNA, 21 bp, Homo sapiens
agactggcatggacatcagca

SEQ ID NO: 4785208 - DNA, 14 bp, Homo sapiens
agacttcatccctc

SEQ ID NO: 4785209 - DNA, 19 bp, Homo sapiens
agacttcctattaatttat

SEQ ID NO: 4785210 - DNA, 17 bp, Homo sapiens
agacttctaaaataaat

SEQ ID NO: 4785211 - DNA, 16 bp, Homo sapiens
agacttgcagttagac

SEQ ID NO: 4785212 - DNA, 15 bp, Homo sapiens
agagaaaaaaaaata

SEQ ID NO: 4785213 - DNA, 20 bp, Homo sapiens
agagaaaaaaaaatatgtgt

SEQ ID NO: 4785214 - DNA, 21 bp, Homo sapiens
agagaaaaaaaaatatgtgta

SEQ ID NO: 4785215 - DNA, 14 bp, Homo sapiens
agagaaaaagccct

SEQ ID NO: 4785216 - DNA, 16 bp, Homo sapiens
agagaaaaagccctct

SEQ ID NO: 4785217 - DNA, 22 bp, Homo sapiens
agagaaaagattaaaattagtg

SEQ ID NO: 4785218 - DNA, 20 bp, Homo sapiens
agagaaacactaatggccaa

SEQ ID NO: 4785219 - DNA, 14 bp, Homo sapiens
agagaagcacccca

SEQ ID NO: 4785220 - DNA, 17 bp, Homo sapiens
agagaagccacgctgtc

SEQ ID NO: 4785221 - DNA, 12 bp, Homo sapiens
agagaagccata

SEQ ID NO: 4785222 - DNA, 16 bp, Homo sapiens
agagaattcactttac

SEQ ID NO: 4785223 - DNA, 14 bp, Homo sapiens
agagaattctaaga

SEQ ID NO: 4785224 - DNA, 20 bp, Homo sapiens
agagaattctaagattgtac

SEQ ID NO: 4785225 - DNA, 21 bp, Homo sapiens
agagaattctaagattgtaca

SEQ ID NO: 4785226 - DNA, 19 bp, Homo sapiens
agagaccaccgcgcccctc

SEQ ID NO: 4785227 - DNA, 14 bp, Homo sapiens
agagaccacttcct

SEQ ID NO: 4785228 - DNA, 13 bp, Homo sapiens
agagacggcagcc

SEQ ID NO: 4785229 - DNA, 16 bp, Homo sapiens
agagacggcagcccca

SEQ ID NO: 4785230 - DNA, 15 bp, Homo sapiens
agagactcgcctggg

SEQ ID NO: 4785231 - DNA, 20 bp, Homo sapiens
agagactgcccaccctgggc

SEQ ID NO: 4785232 - DNA, 15 bp, Homo sapiens
agagagaaagcatat

SEQ ID NO: 4785233 - DNA, 13 bp, Homo sapiens
agagagaggcctg

SEQ ID NO: 4785234 - DNA, 16 bp, Homo sapiens
agagagcaatcttgct

SEQ ID NO: 4785235 - DNA, 12 bp, Homo sapiens
agagaggacagt

SEQ ID NO: 4785236 - DNA, 18 bp, Homo sapiens
agagaggacagtttagga

SEQ ID NO: 4785237 - DNA, 21 bp, Homo sapiens
agagaggcctgggtgtgacct

SEQ ID NO: 4785238 - DNA, 15 bp, Homo sapiens
agagatatatctgaa

SEQ ID NO: 4785239 - DNA, 23 bp, Homo sapiens
agagatatatctgaaaactggaa

SEQ ID NO: 4785240 - DNA, 14 bp, Homo sapiens
agagatcaggaaga

SEQ ID NO: 4785241 - DNA, 19 bp, Homo sapiens
agagatcaggaagagaagg

SEQ ID NO: 4785242 - DNA, 14 bp, Homo sapiens
agagatggcagagc

SEQ ID NO: 4785243 - DNA, 16 bp, Homo sapiens
agagatggcagagcca

SEQ ID NO: 4785244 - DNA, 14 bp, Homo sapiens
agagattaatttgt

SEQ ID NO: 4785245 - DNA, 16 bp, Homo sapiens
agagattaatttgtgt

SEQ ID NO: 4785246 - DNA, 20 bp, Homo sapiens
agagattggatcaagtatta

SEQ ID NO: 4785247 - DNA, 21 bp, Homo sapiens
agagattggatcaagtattac

SEQ ID NO: 4785248 - DNA, 17 bp, Homo sapiens
agagcaaagatggcttc

SEQ ID NO: 4785249 - DNA, 20 bp, Homo sapiens
agagcaaagatggcttccgt

SEQ ID NO: 4785250 - DNA, 19 bp, Homo sapiens
agagcacgggcgttatgta

SEQ ID NO: 4785251 - DNA, 20 bp, Homo sapiens
agagcacgggcgttatgtaa

SEQ ID NO: 4785252 - DNA, 13 bp, Homo sapiens
agagcagcctctt

SEQ ID NO: 4785253 - DNA, 16 bp, Homo sapiens
agagcattctggggtg

SEQ ID NO: 4785254 - DNA, 20 bp, Homo sapiens
agagcattctggggtggggc

SEQ ID NO: 4785255 - DNA, 13 bp, Homo sapiens
agagccatccacc

SEQ ID NO: 4785256 - DNA, 19 bp, Homo sapiens
agagccatccaccctgagg

SEQ ID NO: 4785257 - DNA, 13 bp, Homo sapiens
agagcccaggcct

SEQ ID NO: 4785258 - DNA, 18 bp, Homo sapiens
agagcccgcccacctggg

SEQ ID NO: 4785259 - DNA, 21 bp, Homo sapiens
agagcctatggaaagggtgtg

SEQ ID NO: 4785260 - DNA, 18 bp, Homo sapiens
agagcctccaggttcctc

SEQ ID NO: 4785261 - DNA, 11 bp, Homo sapiens
agagcctgggc

SEQ ID NO: 4785262 - DNA, 16 bp, Homo sapiens
agagcctgggcgcaag

SEQ ID NO: 4785263 - DNA, 17 bp, Homo sapiens
agagcgatgtgttcttt

SEQ ID NO: 4785264 - DNA, 15 bp, Homo sapiens
agagcgccacccgcc

SEQ ID NO: 4785265 - DNA, 19 bp, Homo sapiens
agagcgccacccgcccgcc

SEQ ID NO: 4785266 - DNA, 20 bp, Homo sapiens
agagcgccacccgcccgccc

SEQ ID NO: 4785267 - DNA, 20 bp, Homo sapiens
agagctatgcacaccaaatt

SEQ ID NO: 4785268 - DNA, 13 bp, Homo sapiens
agcaaaaggatga

SEQ ID NO: 4785269 - DNA, 13 bp, Homo sapiens
agcaaaatatatg

SEQ ID NO: 4785270 - DNA, 19 bp, Homo sapiens
agcaaatatctaaataatg

SEQ ID NO: 4785271 - DNA, 21 bp, Homo sapiens
agcaaatttctagatatgaga

SEQ ID NO: 4785272 - DNA, 15 bp, Homo sapiens
agcaacaggaccagg

SEQ ID NO: 4785273 - DNA, 18 bp, Homo sapiens
agcaacaggaccaggagc

SEQ ID NO: 4785274 - DNA, 12 bp, Homo sapiens
agcaactgttgg

SEQ ID NO: 4785275 - DNA, 17 bp, Homo sapiens
agcaagaccccatctca

SEQ ID NO: 4785276 - DNA, 17 bp, Homo sapiens
agcaaggcaagaagtgg

SEQ ID NO: 4785277 - DNA, 15 bp, Homo sapiens
agcaaggctgctaag

SEQ ID NO: 4785278 - DNA, 17 bp, Homo sapiens
agcaataagttgaatga

SEQ ID NO: 4785279 - DNA, 16 bp, Homo sapiens
agcaatccttaaaaag

SEQ ID NO: 4785280 - DNA, 13 bp, Homo sapiens
agcaatcttgctg

SEQ ID NO: 4785281 - DNA, 15 bp, Homo sapiens
agcaatcttgctgtg

SEQ ID NO: 4785282 - DNA, 23 bp, Homo sapiens
agcaatcttgctgtgaaacagtg

SEQ ID NO: 4785283 - DNA, 19 bp, Homo sapiens
agcaatcttggcagactaa

SEQ ID NO: 4785284 - DNA, 20 bp, Homo sapiens
agcacacatccaagagggac

SEQ ID NO: 4785285 - DNA, 23 bp, Homo sapiens
agcacacctcggccgaggcctgc

SEQ ID NO: 4785286 - DNA, 11 bp, Homo sapiens
agcacagccat

SEQ ID NO: 4785287 - DNA, 12 bp, Homo sapiens
agcacagccata

SEQ ID NO: 4785288 - DNA, 13 bp, Homo sapiens
agcacatgcctct

SEQ ID NO: 4785289 - DNA, 18 bp, Homo sapiens
agcacatgcctctctcag

SEQ ID NO: 4785290 - DNA, 19 bp, Homo sapiens
agcacatgcctctctcagg

SEQ ID NO: 4785291 - DNA, 20 bp, Homo sapiens
agcacatgcctctctcaggc

SEQ ID NO: 4785292 - DNA, 22 bp, Homo sapiens
agcacatgcctctctcaggcca

SEQ ID NO: 4785293 - DNA, 21 bp, Homo sapiens
agcacatgctggccagcctgg

SEQ ID NO: 4785294 - DNA, 13 bp, Homo sapiens
agcacatgtttta

SEQ ID NO: 4785295 - DNA, 13 bp, Homo sapiens
agcacattattgt

SEQ ID NO: 4785296 - DNA, 16 bp, Homo sapiens
agcaccacggggtcgg

SEQ ID NO: 4785297 - DNA, 22 bp, Homo sapiens
agcaccacggggtcgggggagg

SEQ ID NO: 4785298 - DNA, 13 bp, Homo sapiens
agcaccagcctga

SEQ ID NO: 4785299 - DNA, 15 bp, Homo sapiens
agcaccagcctgagc

SEQ ID NO: 4785300 - DNA, 17 bp, Homo sapiens
agcaccccaccacacac

SEQ ID NO: 4785301 - DNA, 21 bp, Homo sapiens
agcaccccaccacacacaccc

SEQ ID NO: 4785302 - DNA, 11 bp, Homo sapiens
agcacccccag

SEQ ID NO: 4785303 - DNA, 16 bp, Homo sapiens
agcacccccagcctcc

SEQ ID NO: 4785304 - DNA, 21 bp, Homo sapiens
agcacccccagcctcccccag

SEQ ID NO: 4785305 - DNA, 16 bp, Homo sapiens
agcaccctctcctggg

SEQ ID NO: 4785306 - DNA, 13 bp, Homo sapiens
agcacctcctccg

SEQ ID NO: 4785307 - DNA, 14 bp, Homo sapiens
agcacctcctccgt

SEQ ID NO: 4785308 - DNA, 20 bp, Homo sapiens
agcacgggcgttatgtaagt

SEQ ID NO: 4785309 - DNA, 18 bp, Homo sapiens
agcactcccagggcccga

SEQ ID NO: 4785310 - DNA, 10 bp, Homo sapiens
agcactgaaa

SEQ ID NO: 4785311 - DNA, 12 bp, Homo sapiens
agcactgctcca

SEQ ID NO: 4785312 - DNA, 15 bp, Homo sapiens
agcagaatgagatga

SEQ ID NO: 4785313 - DNA, 22 bp, Homo sapiens
agcagaatgagatgatttaatt

SEQ ID NO: 4785314 - DNA, 14 bp, Homo sapiens
agcagaattcattc

SEQ ID NO: 4785315 - DNA, 17 bp, Homo sapiens
agcagagacggcagccc

SEQ ID NO: 4785316 - DNA, 14 bp, Homo sapiens
agcagagcgcagcc

SEQ ID NO: 4785317 - DNA, 17 bp, Homo sapiens
agcagagctgatggaga

SEQ ID NO: 4785318 - DNA, 19 bp, Homo sapiens
agcagagctgatggagaag

SEQ ID NO: 4785319 - DNA, 21 bp, Homo sapiens
agcagagctgatggagaagga

SEQ ID NO: 4785320 - DNA, 19 bp, Homo sapiens
agcagatggagaccccttg

SEQ ID NO: 4785321 - DNA, 12 bp, Homo sapiens
agcagcctctga

SEQ ID NO: 4785322 - DNA, 14 bp, Homo sapiens
agcagcgcccgagg

SEQ ID NO: 4785323 - DNA, 15 bp, Homo sapiens
agcagcgcccgaggc

SEQ ID NO: 4785324 - DNA, 16 bp, Homo sapiens
agcagcgcccgaggcc

SEQ ID NO: 4785325 - DNA, 21 bp, Homo sapiens
agcagcgcccgaggccagggc

SEQ ID NO: 4785326 - DNA, 22 bp, Homo sapiens
agcagcgcccgaggccagggcc

SEQ ID NO: 4785327 - DNA, 15 bp, Homo sapiens
agcagctagaaagag

SEQ ID NO: 4785328 - DNA, 21 bp, Homo sapiens
agcagctagaaagagaaaaag

SEQ ID NO: 4785329 - DNA, 19 bp, Homo sapiens
agcagctccaacctggagg

SEQ ID NO: 4785330 - DNA, 20 bp, Homo sapiens
agcagctccaacctggaggc

SEQ ID NO: 4785331 - DNA, 12 bp, Homo sapiens
agcagctggact

SEQ ID NO: 4785332 - DNA, 16 bp, Homo sapiens
agcaggagcatggccg

SEQ ID NO: 4785333 - DNA, 16 bp, Homo sapiens
agcaggctctcaggcc

SEQ ID NO: 4785334 - DNA, 16 bp, Homo sapiens
aggagctagtgttaat

SEQ ID NO: 4785335 - DNA, 14 bp, Homo sapiens
aggagcttccagat

SEQ ID NO: 4785336 - DNA, 11 bp, Homo sapiens
aggaggacagg

SEQ ID NO: 4785337 - DNA, 15 bp, Homo sapiens
aggaggatccgggct

SEQ ID NO: 4785338 - DNA, 14 bp, Homo sapiens
aggaggggaagctg

SEQ ID NO: 4785339 - DNA, 12 bp, Homo sapiens
aggaggggagca

SEQ ID NO: 4785340 - DNA, 18 bp, Homo sapiens
aggaggggagcaaggctg

SEQ ID NO: 4785341 - DNA, 23 bp, Homo sapiens
aggaggtgtggagtggaggggtc

SEQ ID NO: 4785342 - DNA, 23 bp, Homo sapiens
aggagtgactctggctgccaaga

SEQ ID NO: 4785343 - DNA, 22 bp, Homo sapiens
aggagtgatgggcaaggggcca

SEQ ID NO: 4785344 - DNA, 18 bp, Homo sapiens
aggagtgggctctgagca

SEQ ID NO: 4785345 - DNA, 22 bp, Homo sapiens
aggagtgggtttccctgcgtct

SEQ ID NO: 4785346 - DNA, 16 bp, Homo sapiens
aggataaataataaag

SEQ ID NO: 4785347 - DNA, 15 bp, Homo sapiens
aggataatgagatgt

SEQ ID NO: 4785348 - DNA, 15 bp, Homo sapiens
aggatagagacttgc

SEQ ID NO: 4785349 - DNA, 21 bp, Homo sapiens
aggatccgggctttggactcc

SEQ ID NO: 4785350 - DNA, 14 bp, Homo sapiens
aggatcctggcctg

SEQ ID NO: 4785351 - DNA, 18 bp, Homo sapiens
aggatcctggcctgagaa

SEQ ID NO: 4785352 - DNA, 15 bp, Homo sapiens
aggatgattgtacag

SEQ ID NO: 4785353 - DNA, 20 bp, Homo sapiens
aggatgattgtacagaatca

SEQ ID NO: 4785354 - DNA, 22 bp, Homo sapiens
aggatgtggatggaggtgatga

SEQ ID NO: 4785355 - DNA, 18 bp, Homo sapiens
aggattccttcttcccca

SEQ ID NO: 4785356 - DNA, 23 bp, Homo sapiens
aggattgtccaccttctgccaag

SEQ ID NO: 4785357 - DNA, 15 bp, Homo sapiens
aggatttattctcag

SEQ ID NO: 4785358 - DNA, 20 bp, Homo sapiens
aggcaaaccaatttgttctg

SEQ ID NO: 4785359 - DNA, 14 bp, Homo sapiens
aggcaaaggccccc

SEQ ID NO: 4785360 - DNA, 21 bp, Homo sapiens
aggcaaatgtccaagcatcag

SEQ ID NO: 4785361 - DNA, 22 bp, Homo sapiens
aggcaacttcagtcctgggaga

SEQ ID NO: 4785362 - DNA, 18 bp, Homo sapiens
aggcaagcaagctctctt

SEQ ID NO: 4785363 - DNA, 18 bp, Homo sapiens
aggcaatagtgttgagga

SEQ ID NO: 4785364 - DNA, 20 bp, Homo sapiens
aggcaatagtgttgaggagg

SEQ ID NO: 4785365 - DNA, 23 bp, Homo sapiens
aggcacacaccaccacgcctggc

SEQ ID NO: 4785366 - DNA, 21 bp, Homo sapiens
aggcacacagcagccccccag

SEQ ID NO: 4785367 - DNA, 19 bp, Homo sapiens
aggcacactgagcaagttt

SEQ ID NO: 4785368 - DNA, 18 bp, Homo sapiens
aggcaccatgctgggccg

SEQ ID NO: 4785369 - DNA, 22 bp, Homo sapiens
aggcacccgccctttccttgcc

SEQ ID NO: 4785370 - DNA, 23 bp, Homo sapiens
aggcaccggacgctggagaccct

SEQ ID NO: 4785371 - DNA, 20 bp, Homo sapiens
aggcagaatggtgggctcca

SEQ ID NO: 4785372 - DNA, 21 bp, Homo sapiens
aggcagaatggtgggctccag

SEQ ID NO: 4785373 - DNA, 14 bp, Homo sapiens
aggcagagaagaaa

SEQ ID NO: 4785374 - DNA, 15 bp, Homo sapiens
aggcagagaagaaag

SEQ ID NO: 4785375 - DNA, 22 bp, Homo sapiens
aggcagagattgggggggcttg

SEQ ID NO: 4785376 - DNA, 16 bp, Homo sapiens
aggcagattcaatttt

SEQ ID NO: 4785377 - DNA, 17 bp, Homo sapiens
agggagggaaacccggg

SEQ ID NO: 4785378 - DNA, 16 bp, Homo sapiens
agggaggggccctgtc

SEQ ID NO: 4785379 - DNA, 17 bp, Homo sapiens
agggaggggccctgtca

SEQ ID NO: 4785380 - DNA, 13 bp, Homo sapiens
agggagtgtgcct

SEQ ID NO: 4785381 - DNA, 13 bp, Homo sapiens
agggatccagaga

SEQ ID NO: 4785382 - DNA, 15 bp, Homo sapiens
agggatccagagacc

SEQ ID NO: 4785383 - DNA, 16 bp, Homo sapiens
agggatccagagacct

SEQ ID NO: 4785384 - DNA, 19 bp, Homo sapiens
agggatccagagacctgct

SEQ ID NO: 4785385 - DNA, 12 bp, Homo sapiens
agggatgaaatg

SEQ ID NO: 4785386 - DNA, 22 bp, Homo sapiens
agggatgctatctcgctagcca

SEQ ID NO: 4785387 - DNA, 17 bp, Homo sapiens
agggatggagaggcggc

SEQ ID NO: 4785388 - DNA, 18 bp, Homo sapiens
agggatggagaggcggcc

SEQ ID NO: 4785389 - DNA, 15 bp, Homo sapiens
agggcaaaccaggct

SEQ ID NO: 4785390 - DNA, 16 bp, Homo sapiens
agggcaaaccaggctg

SEQ ID NO: 4785391 - DNA, 17 bp, Homo sapiens
agggcaaaccaggctgc

SEQ ID NO: 4785392 - DNA, 21 bp, Homo sapiens
agggcaaaccaggctgcaggt

SEQ ID NO: 4785393 - DNA, 20 bp, Homo sapiens
agggcaaatgacatgcactg

SEQ ID NO: 4785394 - DNA, 18 bp, Homo sapiens
agggcaagctcatagcac

SEQ ID NO: 4785395 - DNA, 13 bp, Homo sapiens
agggcagccccgc

SEQ ID NO: 4785396 - DNA, 22 bp, Homo sapiens
agggcagccccgcgaccacccc

SEQ ID NO: 4785397 - DNA, 23 bp, Homo sapiens
agggcagccccgcgaccacccct

SEQ ID NO: 4785398 - DNA, 16 bp, Homo sapiens
agggcaggaagacttc

SEQ ID NO: 4785399 - DNA, 19 bp, Homo sapiens
agggcaggagctcacaccg

SEQ ID NO: 4785400 - DNA, 23 bp, Homo sapiens
agggcaggggccgtgcagggcca

SEQ ID NO: 4785401 - DNA, 21 bp, Homo sapiens
agggcagtgctagtgagctgg

SEQ ID NO: 4785402 - DNA, 19 bp, Homo sapiens
agggccagtcatggctgtc

SEQ ID NO: 4785403 - DNA, 24 bp, Homo sapiens
agggccagtcatggctgtcccctg

SEQ ID NO: 4785404 - DNA, 15 bp, Homo sapiens
agggcccagaggctg

SEQ ID NO: 4785405 - DNA, 19 bp, Homo sapiens
agggcccgagcgcgtgcct

SEQ ID NO: 4785406 - DNA, 19 bp, Homo sapiens
agggccctgaaatggcctg

SEQ ID NO: 4785407 - DNA, 23 bp, Homo sapiens
agggcccttcccaacctcccctg

SEQ ID NO: 4785408 - DNA, 22 bp, Homo sapiens
agggccgccgaagggcagcccc

SEQ ID NO: 4785409 - DNA, 16 bp, Homo sapiens
agggccgcttctcctg

SEQ ID NO: 4785410 - DNA, 14 bp, Homo sapiens
agggcctctggaca

SEQ ID NO: 4785411 - DNA, 15 bp, Homo sapiens
agggccttggcccag

SEQ ID NO: 4785412 - DNA, 21 bp, Homo sapiens
agggcgcaggaaccgaggact

SEQ ID NO: 4785413 - DNA, 13 bp, Homo sapiens
agggcgcctgggt

SEQ ID NO: 4785414 - DNA, 21 bp, Homo sapiens
agggcgcctgggtcctcccag

SEQ ID NO: 4785415 - DNA, 22 bp, Homo sapiens
agggcgcctgggtcctcccagc

SEQ ID NO: 4785416 - DNA, 17 bp, Homo sapiens
agggcgctccggcagag

SEQ ID NO: 4785417 - DNA, 16 bp, Homo sapiens
agggcggcggggcctg

SEQ ID NO: 4785418 - DNA, 17 bp, Homo sapiens
agggcggcggggcctgg

SEQ ID NO: 4785419 - DNA, 16 bp, Homo sapiens
agggcgggccaggaga

SEQ ID NO: 4785420 - DNA, 13 bp, Homo sapiens
agggcgtcctctc

SEQ ID NO: 4785421 - DNA, 19 bp, Homo sapiens
agggctctccaagcactag

SEQ ID NO: 4785422 - DNA, 16 bp, Homo sapiens
agggctgacaaggcgt

SEQ ID NO: 4785423 - DNA, 17 bp, Homo sapiens
agggctgagcccctcct

SEQ ID NO: 4785424 - DNA, 18 bp, Homo sapiens
agggctgagcccctcctc

SEQ ID NO: 4785425 - DNA, 19 bp, Homo sapiens
agggctgagcccctcctct

SEQ ID NO: 4785426 - DNA, 19 bp, Homo sapiens
agggctgggcgcctctgtc

SEQ ID NO: 4785427 - DNA, 13 bp, Homo sapiens
aggggaaaagagg

SEQ ID NO: 4785428 - DNA, 14 bp, Homo sapiens
aggggaaatcaagg

SEQ ID NO: 4785429 - DNA, 21 bp, Homo sapiens
aggggaagagagaggcctggg

SEQ ID NO: 4785430 - DNA, 18 bp, Homo sapiens
aggggacaagccaggccc

SEQ ID NO: 4785431 - DNA, 15 bp, Homo sapiens
aggggacagatcttg

SEQ ID NO: 4785432 - DNA, 21 bp, Homo sapiens
aggggacagatcttgagcaag

SEQ ID NO: 4785433 - DNA, 21 bp, Homo sapiens
aggggaccgccccaggcaccg

SEQ ID NO: 4785434 - DNA, 21 bp, Homo sapiens
aggggacttggataggagctt

SEQ ID NO: 4785435 - DNA, 19 bp, Homo sapiens
aggggaggtggccagcccg

SEQ ID NO: 4785436 - DNA, 21 bp, Homo sapiens
aggggaggtggccagcccgca

SEQ ID NO: 4785437 - DNA, 21 bp, Homo sapiens
aggggatctaaaaggaggaca

SEQ ID NO: 4785438 - DNA, 23 bp, Homo sapiens
aggggatctaaaaggaggacagg

SEQ ID NO: 4785439 - DNA, 16 bp, Homo sapiens
aggggcaaaaatttga

SEQ ID NO: 4785440 - DNA, 19 bp, Homo sapiens
aggggcaaaaatttgacat

SEQ ID NO: 4785441 - DNA, 23 bp, Homo sapiens
aggggcaaaaatttgacattgtc

SEQ ID NO: 4785442 - DNA, 17 bp, Homo sapiens
aggggcactgtgttctc

SEQ ID NO: 4785443 - DNA, 12 bp, Homo sapiens
aggggccagacc

SEQ ID NO: 4785444 - DNA, 16 bp, Homo sapiens
aggggcctgggctgtg

SEQ ID NO: 4785445 - DNA, 19 bp, Homo sapiens
aggggcctgggctgtgagg

SEQ ID NO: 4785446 - DNA, 20 bp, Homo sapiens
aggggcctgggctgtgagga

SEQ ID NO: 4785447 - DNA, 22 bp, Homo sapiens
aggggcctgggctgtgaggaca

SEQ ID NO: 4785448 - DNA, 15 bp, Homo sapiens
aggggcgcgcgcccc

SEQ ID NO: 4785449 - DNA, 20 bp, Homo sapiens
aggggcgctcctcccagctg

SEQ ID NO: 4785450 - DNA, 21 bp, Homo sapiens
aggggcgctcctcccagctgt

SEQ ID NO: 4785451 - DNA, 23 bp, Homo sapiens
aggggcgctcctcccagctgtac

SEQ ID NO: 4785452 - DNA, 17 bp, Homo sapiens
aggggctgcagccccct

SEQ ID NO: 4785453 - DNA, 21 bp, Homo sapiens
aggggctgcatcctcagcccc

SEQ ID NO: 4785454 - DNA, 23 bp, Homo sapiens
aggggctgcatcctcagccccag

SEQ ID NO: 4785455 - DNA, 15 bp, Homo sapiens
aggggctggtggaga

SEQ ID NO: 4785456 - DNA, 21 bp, Homo sapiens
aggggctggtggagatgtagg

SEQ ID NO: 4785457 - DNA, 14 bp, Homo sapiens
aggggcttctcccc

SEQ ID NO: 4785458 - DNA, 20 bp, Homo sapiens
aggggcttctccccctcagc

SEQ ID NO: 4785459 - DNA, 17 bp, Homo sapiens
aggggcttggagcagag

SEQ ID NO: 4785460 - DNA, 20 bp, Homo sapiens
aggggcttggagcagagacg

SEQ ID NO: 4785461 - DNA, 21 bp, Homo sapiens
agcccgatgtccctgtcccct

SEQ ID NO: 4785462 - DNA, 13 bp, Homo sapiens
agcccgcagaggt

SEQ ID NO: 4785463 - DNA, 16 bp, Homo sapiens
agcccgcagaggtggg

SEQ ID NO: 4785464 - DNA, 22 bp, Homo sapiens
agcccgcagaggtggggtgctg

SEQ ID NO: 4785465 - DNA, 14 bp, Homo sapiens
agcccgcccacctg

SEQ ID NO: 4785466 - DNA, 22 bp, Homo sapiens
agcccgcccacctgggccctag

SEQ ID NO: 4785467 - DNA, 14 bp, Homo sapiens
agcccggccaagga

SEQ ID NO: 4785468 - DNA, 18 bp, Homo sapiens
agccctctttctctctgt

SEQ ID NO: 4785469 - DNA, 20 bp, Homo sapiens
agccctctttctctctgtgt

SEQ ID NO: 4785470 - DNA, 22 bp, Homo sapiens
agccctctttctctctgtgtgg

SEQ ID NO: 4785471 - DNA, 13 bp, Homo sapiens
agccctgcacgcc

SEQ ID NO: 4785472 - DNA, 16 bp, Homo sapiens
agccctgcattttcat

SEQ ID NO: 4785473 - DNA, 14 bp, Homo sapiens
agccctgccctcac

SEQ ID NO: 4785474 - DNA, 16 bp, Homo sapiens
agccctgccctcactc

SEQ ID NO: 4785475 - DNA, 17 bp, Homo sapiens
agccctgccctcactcc

SEQ ID NO: 4785476 - DNA, 12 bp, Homo sapiens
agccctggcccg

SEQ ID NO: 4785477 - DNA, 22 bp, Homo sapiens
agccctggcccggtcccagtcc

SEQ ID NO: 4785478 - DNA, 14 bp, Homo sapiens
agccctggggcagg

SEQ ID NO: 4785479 - DNA, 13 bp, Homo sapiens
agccgccctgggc

SEQ ID NO: 4785480 - DNA, 15 bp, Homo sapiens
agccgcgctctgccc

SEQ ID NO: 4785481 - DNA, 16 bp, Homo sapiens
agccgcgctctgcccc

SEQ ID NO: 4785482 - DNA, 18 bp, Homo sapiens
agccgcgctctgcccctc

SEQ ID NO: 4785483 - DNA, 20 bp, Homo sapiens
agccgcgctctgcccctccg

SEQ ID NO: 4785484 - DNA, 20 bp, Homo sapiens
agccggcggagctctggctt

SEQ ID NO: 4785485 - DNA, 21 bp, Homo sapiens
agccggcggagctctggcttt

SEQ ID NO: 4785486 - DNA, 22 bp, Homo sapiens
agccgggccccatggtcacaga

SEQ ID NO: 4785487 - DNA, 23 bp, Homo sapiens
agccgtgttttatgactaatcct

SEQ ID NO: 4785488 - DNA, 18 bp, Homo sapiens
agcctatctctcttctgc

SEQ ID NO: 4785489 - DNA, 19 bp, Homo sapiens
agcctccaccttgagcact

SEQ ID NO: 4785490 - DNA, 16 bp, Homo sapiens
agcctccaggttcctc

SEQ ID NO: 4785491 - DNA, 13 bp, Homo sapiens
agcctcccccagg

SEQ ID NO: 4785492 - DNA, 13 bp, Homo sapiens
agcctcctgccct

SEQ ID NO: 4785493 - DNA, 17 bp, Homo sapiens
agcctctccgcccacgc

SEQ ID NO: 4785494 - DNA, 22 bp, Homo sapiens
agcctcttgaatgcttaaatga

SEQ ID NO: 4785495 - DNA, 11 bp, Homo sapiens
agcctgagcca

SEQ ID NO: 4785496 - DNA, 13 bp, Homo sapiens
agcctgagccaca

SEQ ID NO: 4785497 - DNA, 20 bp, Homo sapiens
agcctgagccacagtggggc

SEQ ID NO: 4785498 - DNA, 16 bp, Homo sapiens
agcctgagctccaccc

SEQ ID NO: 4785499 - DNA, 19 bp, Homo sapiens
agcctgagtcagggcccag

SEQ ID NO: 4785500 - DNA, 15 bp, Homo sapiens
agcctgcacacacct

SEQ ID NO: 4785501 - DNA, 20 bp, Homo sapiens
agcctgcacacacctgcctg

SEQ ID NO: 4785502 - DNA, 14 bp, Homo sapiens
agcctgcttcccac

SEQ ID NO: 4785503 - DNA, 15 bp, Homo sapiens
agcctgcttcccacc

SEQ ID NO: 4785504 - DNA, 13 bp, Homo sapiens
agcctggcacagg

SEQ ID NO: 4785505 - DNA, 19 bp, Homo sapiens
agcctggcccatagaaaca

SEQ ID NO: 4785506 - DNA, 18 bp, Homo sapiens
agcctggccccaaatgtt

SEQ ID NO: 4785507 - DNA, 17 bp, Homo sapiens
agcctgggcagaaatgt

SEQ ID NO: 4785508 - DNA, 21 bp, Homo sapiens
agcctgggcagaaatgtgctg

SEQ ID NO: 4785509 - DNA, 13 bp, Homo sapiens
agcctggggcctg

SEQ ID NO: 4785510 - DNA, 14 bp, Homo sapiens
agcctggggcctgg

SEQ ID NO: 4785511 - DNA, 17 bp, Homo sapiens
agcctggggcctggcag

SEQ ID NO: 4785512 - DNA, 18 bp, Homo sapiens
agcctggggcctggcagg

SEQ ID NO: 4785513 - DNA, 19 bp, Homo sapiens
ataatgatttaagcatttt

SEQ ID NO: 4785514 - DNA, 19 bp, Homo sapiens
ataatggcctggtaggtct

SEQ ID NO: 4785515 - DNA, 15 bp, Homo sapiens
ataatgtgaaatgta

SEQ ID NO: 4785516 - DNA, 21 bp, Homo sapiens
ataatgtgggaagaaacaaac

SEQ ID NO: 4785517 - DNA, 20 bp, Homo sapiens
ataatgttagtagcactgag

SEQ ID NO: 4785518 - DNA, 14 bp, Homo sapiens
ataattaaaacaaa

SEQ ID NO: 4785519 - DNA, 14 bp, Homo sapiens
ataattaaatgaaa

SEQ ID NO: 4785520 - DNA, 16 bp, Homo sapiens
ataattaaatgaaata

SEQ ID NO: 4785521 - DNA, 21 bp, Homo sapiens
ataattatatgaagcagaatg

SEQ ID NO: 4785522 - DNA, 20 bp, Homo sapiens
ataattgactggtggaagga

SEQ ID NO: 4785523 - DNA, 19 bp, Homo sapiens
ataattgtcatgactttca

SEQ ID NO: 4785524 - DNA, 23 bp, Homo sapiens
ataatttgccagacagagatcag

SEQ ID NO: 4785525 - DNA, 17 bp, Homo sapiens
ataattttattgctgga

SEQ ID NO: 4785526 - DNA, 13 bp, Homo sapiens
atacaaagctgtc

SEQ ID NO: 4785527 - DNA, 14 bp, Homo sapiens
atacaaagctgtca

SEQ ID NO: 4785528 - DNA, 22 bp, Homo sapiens
atacaaagctgtcactcacaaa

SEQ ID NO: 4785529 - DNA, 21 bp, Homo sapiens
atacaaatctcactgtattaa

SEQ ID NO: 4785530 - DNA, 23 bp, Homo sapiens
atacaacacattgaaactgtatt

SEQ ID NO: 4785531 - DNA, 18 bp, Homo sapiens
atacaaccttcatttaaa

SEQ ID NO: 4785532 - DNA, 19 bp, Homo sapiens
atacaagtgtttctagtaa

SEQ ID NO: 4785533 - DNA, 18 bp, Homo sapiens
atacacaaagatattatt

SEQ ID NO: 4785534 - DNA, 14 bp, Homo sapiens
atacacacacacac

SEQ ID NO: 4785535 - DNA, 21 bp, Homo sapiens
atacacctcaactaaatccaa

SEQ ID NO: 4785536 - DNA, 14 bp, Homo sapiens
atacactgcattcg

SEQ ID NO: 4785537 - DNA, 20 bp, Homo sapiens
atacactttacattcttgct

SEQ ID NO: 4785538 - DNA, 16 bp, Homo sapiens
atacagagcctgtttt

SEQ ID NO: 4785539 - DNA, 17 bp, Homo sapiens
atacagagcctgtttta

SEQ ID NO: 4785540 - DNA, 22 bp, Homo sapiens
atacagagcctgttttaaaaaa

SEQ ID NO: 4785541 - DNA, 18 bp, Homo sapiens
atacagtattatttagta

SEQ ID NO: 4785542 - DNA, 23 bp, Homo sapiens
atacagtattatttagtaaaatt

SEQ ID NO: 4785543 - DNA, 20 bp, Homo sapiens
atacagtctctatttgattt

SEQ ID NO: 4785544 - DNA, 17 bp, Homo sapiens
atacatacctctctcta

SEQ ID NO: 4785545 - DNA, 15 bp, Homo sapiens
atacatatgtatgtg

SEQ ID NO: 4785546 - DNA, 16 bp, Homo sapiens
atacatatgtatgtgt

SEQ ID NO: 4785547 - DNA, 17 bp, Homo sapiens
atacatatgtatgtgtg

SEQ ID NO: 4785548 - DNA, 18 bp, Homo sapiens
atacatcacgttaaagta

SEQ ID NO: 4785549 - DNA, 13 bp, Homo sapiens
atacatgtatagt

SEQ ID NO: 4785550 - DNA, 18 bp, Homo sapiens
atacattattgaaaagca

SEQ ID NO: 4785551 - DNA, 16 bp, Homo sapiens
atacattatttctgta

SEQ ID NO: 4785552 - DNA, 17 bp, Homo sapiens
ataccagcaaaagtgca

SEQ ID NO: 4785553 - DNA, 21 bp, Homo sapiens
ataccatccatccctggtgaa

SEQ ID NO: 4785554 - DNA, 17 bp, Homo sapiens
ataccattttgaaatat

SEQ ID NO: 4785555 - DNA, 14 bp, Homo sapiens
ataccccctgcccc

SEQ ID NO: 4785556 - DNA, 16 bp, Homo sapiens
ataccccctgccccag

SEQ ID NO: 4785557 - DNA, 19 bp, Homo sapiens
ataccccctgccccagaga

SEQ ID NO: 4785558 - DNA, 23 bp, Homo sapiens
ataccctaggtctccacccctca

SEQ ID NO: 4785559 - DNA, 22 bp, Homo sapiens
atacctattcaagaagatagtt

SEQ ID NO: 4785560 - DNA, 20 bp, Homo sapiens
atacctctctctatatatac

SEQ ID NO: 4785561 - DNA, 21 bp, Homo sapiens
atacctctctctatatataca

SEQ ID NO: 4785562 - DNA, 12 bp, Homo sapiens
atacctgtgagg

SEQ ID NO: 4785563 - DNA, 17 bp, Homo sapiens
atacctgtgaggactgg

SEQ ID NO: 4785564 - DNA, 14 bp, Homo sapiens
ataccttccatctc

SEQ ID NO: 4785565 - DNA, 20 bp, Homo sapiens
atacgtattgttaaatgata

SEQ ID NO: 4785566 - DNA, 18 bp, Homo sapiens
atacgtgtcaatgtgtgc

SEQ ID NO: 4785567 - DNA, 19 bp, Homo sapiens
atactaataaaatacatac

SEQ ID NO: 4785568 - DNA, 17 bp, Homo sapiens
atactatttattaaaac

SEQ ID NO: 4785569 - DNA, 19 bp, Homo sapiens
atactatttattaaaacca

SEQ ID NO: 4785570 - DNA, 23 bp, Homo sapiens
atactcaagagcataatggtaaa

SEQ ID NO: 4785571 - DNA, 13 bp, Homo sapiens
atactcatttgga

SEQ ID NO: 4785572 - DNA, 17 bp, Homo sapiens
atactccaaggtggcat

SEQ ID NO: 4785573 - DNA, 14 bp, Homo sapiens
atactctccaggat

SEQ ID NO: 4785574 - DNA, 19 bp, Homo sapiens
atactgaattgttatgtaa

SEQ ID NO: 4785575 - DNA, 19 bp, Homo sapiens
atactgagatagcttagtg

SEQ ID NO: 4785576 - DNA, 18 bp, Homo sapiens
atactgatgagacaacac

SEQ ID NO: 4785577 - DNA, 18 bp, Homo sapiens
atactggggggcaggcct

SEQ ID NO: 4785578 - DNA, 20 bp, Homo sapiens
atacttatttataacattgt

SEQ ID NO: 4785579 - DNA, 19 bp, Homo sapiens
atacttgaaaacttctcat

SEQ ID NO: 4785580 - DNA, 18 bp, Homo sapiens
atacttgacaacattttt

SEQ ID NO: 4785581 - DNA, 13 bp, Homo sapiens
atacttggtcctt

SEQ ID NO: 4785582 - DNA, 13 bp, Homo sapiens
atacttgtaactt

SEQ ID NO: 4785583 - DNA, 21 bp, Homo sapiens
atactttctaaatgcctttga

SEQ ID NO: 4785584 - DNA, 20 bp, Homo sapiens
atactttctgagatggtggt

SEQ ID NO: 4785585 - DNA, 13 bp, Homo sapiens
atagaaaaacaaa

SEQ ID NO: 4785586 - DNA, 21 bp, Homo sapiens
atagaaaacaggaaaaaaact

SEQ ID NO: 4785587 - DNA, 15 bp, Homo sapiens
atagaaacatgacac

SEQ ID NO: 4785588 - DNA, 21 bp, Homo sapiens
atagaaacatgacactgacct

SEQ ID NO: 4785589 - DNA, 14 bp, Homo sapiens
atagataacagaga

SEQ ID NO: 4785590 - DNA, 14 bp, Homo sapiens
atagatataaatat

SEQ ID NO: 4785591 - DNA, 13 bp, Homo sapiens
atagatgtctgtg

SEQ ID NO: 4785592 - DNA, 15 bp, Homo sapiens
atagatgtctgtgta

SEQ ID NO: 4785593 - DNA, 16 bp, Homo sapiens
atagatgtctgtgtat

SEQ ID NO: 4785594 - DNA, 17 bp, Homo sapiens
atagattaatggcactg

SEQ ID NO: 4785595 - DNA, 18 bp, Homo sapiens
atagattaatggcactga

SEQ ID NO: 4785596 - DNA, 19 bp, Homo sapiens
atagattaatggcactgat

SEQ ID NO: 4785597 - DNA, 15 bp, Homo sapiens
atagattcacctgta

SEQ ID NO: 4785598 - DNA, 21 bp, Homo sapiens
atagattcacctgtaaaactt

SEQ ID NO: 4785599 - DNA, 14 bp, Homo sapiens
atagcaaagtagta

SEQ ID NO: 4785600 - DNA, 19 bp, Homo sapiens
atagcactggtttgtttct

SEQ ID NO: 4785601 - DNA, 14 bp, Homo sapiens
atagcatctgctct

SEQ ID NO: 4785602 - DNA, 15 bp, Homo sapiens
atagccccaggcccg

SEQ ID NO: 4785603 - DNA, 12 bp, Homo sapiens
atagcgtgtgta

SEQ ID NO: 4785604 - DNA, 23 bp, Homo sapiens
atagctccttcatgcttttctca

SEQ ID NO: 4785605 - DNA, 17 bp, Homo sapiens
atagctgatagaagaag

SEQ ID NO: 4785606 - DNA, 22 bp, Homo sapiens
atagctgatagaagaaggactg

SEQ ID NO: 4785607 - DNA, 12 bp, Homo sapiens
atagctttgcaa

SEQ ID NO: 4785608 - DNA, 20 bp, Homo sapiens
ataggaaataaatctaaata

SEQ ID NO: 4785609 - DNA, 13 bp, Homo sapiens
ataggactctttg

SEQ ID NO: 4785610 - DNA, 18 bp, Homo sapiens
ataggagcttccagatgg

SEQ ID NO: 4785611 - DNA, 13 bp, Homo sapiens
ataggaggacaga

SEQ ID NO: 4785612 - DNA, 17 bp, Homo sapiens
ataggagggaaaccttt

SEQ ID NO: 4785613 - DNA, 23 bp, Homo sapiens
ataggcccaaccaccagatgaga

SEQ ID NO: 4785614 - DNA, 17 bp, Homo sapiens
atagggtttggaagaaa

SEQ ID NO: 4785615 - DNA, 14 bp, Homo sapiens
ataggttctgcttt

SEQ ID NO: 4785616 - DNA, 18 bp, Homo sapiens
ataggttctgctttctga

SEQ ID NO: 4785617 - DNA, 16 bp, Homo sapiens
atagtagcagagtcat

SEQ ID NO: 4785618 - DNA, 23 bp, Homo sapiens
atagtagcagagtcattgttaca

SEQ ID NO: 4785619 - DNA, 21 bp, Homo sapiens
aagaatcacctaattaatttc

SEQ ID NO: 4785620 - DNA, 14 bp, Homo sapiens
aagaatcatggatt

SEQ ID NO: 4785621 - DNA, 12 bp, Homo sapiens
aagaatctactt

SEQ ID NO: 4785622 - DNA, 14 bp, Homo sapiens
aagaattaatgaca

SEQ ID NO: 4785623 - DNA, 19 bp, Homo sapiens
aagaattctccaaaacaat

SEQ ID NO: 4785624 - DNA, 15 bp, Homo sapiens
aagaatttagaggat

SEQ ID NO: 4785625 - DNA, 17 bp, Homo sapiens
aagaatttgaagacttc

SEQ ID NO: 4785626 - DNA, 19 bp, Homo sapiens
aagacaaatatttctttct

SEQ ID NO: 4785627 - DNA, 14 bp, Homo sapiens
aagacaagtctgag

SEQ ID NO: 4785628 - DNA, 20 bp, Homo sapiens
aagacaccagagtgtatgca

SEQ ID NO: 4785629 - DNA, 17 bp, Homo sapiens
aagacaccttcccagct

SEQ ID NO: 4785630 - DNA, 23 bp, Homo sapiens
aagacagagcagatcagtctttg

SEQ ID NO: 4785631 - DNA, 22 bp, Homo sapiens
aagacaggagagattatttaca

SEQ ID NO: 4785632 - DNA, 22 bp, Homo sapiens
aagaccatttagtcctcacctt

SEQ ID NO: 4785633 - DNA, 19 bp, Homo sapiens
aagaccctaggtgctcata

SEQ ID NO: 4785634 - DNA, 15 bp, Homo sapiens
aagaccttctgaaga

SEQ ID NO: 4785635 - DNA, 12 bp, Homo sapiens
aagacgtttttg

SEQ ID NO: 4785636 - DNA, 16 bp, Homo sapiens
aagactctatgctctg

SEQ ID NO: 4785637 - DNA, 21 bp, Homo sapiens
aagacttcaaaatattgagca

SEQ ID NO: 4785638 - DNA, 13 bp, Homo sapiens
aagacttcaaatg

SEQ ID NO: 4785639 - DNA, 19 bp, Homo sapiens
aagacttttctttcagcca

SEQ ID NO: 4785640 - DNA, 18 bp, Homo sapiens
aagagaaaacatctcatc

SEQ ID NO: 4785641 - DNA, 12 bp, Homo sapiens
aagagaaaagat

SEQ ID NO: 4785642 - DNA, 18 bp, Homo sapiens
aagagaaacactaatggc

SEQ ID NO: 4785643 - DNA, 11 bp, Homo sapiens
aagagaattca

SEQ ID NO: 4785644 - DNA, 21 bp, Homo sapiens
aagagaattctaagattgtac

SEQ ID NO: 4785645 - DNA, 17 bp, Homo sapiens
aagagaccacttcctta

SEQ ID NO: 4785646 - DNA, 20 bp, Homo sapiens
aagagaccacttccttaaca

SEQ ID NO: 4785647 - DNA, 16 bp, Homo sapiens
aagagagatatatctg

SEQ ID NO: 4785648 - DNA, 16 bp, Homo sapiens
aagagatcaggaagag

SEQ ID NO: 4785649 - DNA, 16 bp, Homo sapiens
aagagcccaggcctcc

SEQ ID NO: 4785650 - DNA, 19 bp, Homo sapiens
aagagctcaggagaaggcc

SEQ ID NO: 4785651 - DNA, 19 bp, Homo sapiens
aagagctgctgtatttgag

SEQ ID NO: 4785652 - DNA, 22 bp, Homo sapiens
aagagctgttttggatgaatgc

SEQ ID NO: 4785653 - DNA, 19 bp, Homo sapiens
aagaggaaaatattgacaa

SEQ ID NO: 4785654 - DNA, 19 bp, Homo sapiens
aagaggggcgctgccccca

SEQ ID NO: 4785655 - DNA, 17 bp, Homo sapiens
aagaggggtataggaca

SEQ ID NO: 4785656 - DNA, 14 bp, Homo sapiens
aagagtaaaaccaa

SEQ ID NO: 4785657 - DNA, 15 bp, Homo sapiens
aagagtctattgtct

SEQ ID NO: 4785658 - DNA, 16 bp, Homo sapiens
aagagtctattgtctc

SEQ ID NO: 4785659 - DNA, 15 bp, Homo sapiens
aagagttatatgact

SEQ ID NO: 4785660 - DNA, 17 bp, Homo sapiens
aagatactggactaagt

SEQ ID NO: 4785661 - DNA, 18 bp, Homo sapiens
aagatagttgtaaagata

SEQ ID NO: 4785662 - DNA, 20 bp, Homo sapiens
aagatattgtattatcatat

SEQ ID NO: 4785663 - DNA, 21 bp, Homo sapiens
aagatattgtattatcatata

SEQ ID NO: 4785664 - DNA, 18 bp, Homo sapiens
aagatctcagataaagtg

SEQ ID NO: 4785665 - DNA, 22 bp, Homo sapiens
aagatctttttttaagtgttct

SEQ ID NO: 4785666 - DNA, 17 bp, Homo sapiens
aagatgcaggttttcta

SEQ ID NO: 4785667 - DNA, 22 bp, Homo sapiens
aagatgcattttaaatgtctat

SEQ ID NO: 4785668 - DNA, 23 bp, Homo sapiens
aagatgcattttaaatgtctata

SEQ ID NO: 4785669 - DNA, 23 bp, Homo sapiens
aagatggcttccgtgagacacaa

SEQ ID NO: 4785670 - DNA, 22 bp, Homo sapiens
aagatgggtgattatgaaatgc

SEQ ID NO: 4785671 - DNA, 15 bp, Homo sapiens
aagatgtaagaagct

SEQ ID NO: 4785672 - DNA, 18 bp, Homo sapiens
aagattaaaattagtgag

SEQ ID NO: 4785673 - DNA, 15 bp, Homo sapiens
aagattatatacaaa

SEQ ID NO: 4785674 - DNA, 11 bp, Homo sapiens
aagattatatt

SEQ ID NO: 4785675 - DNA, 13 bp, Homo sapiens
aagattcaattta

SEQ ID NO: 4785676 - DNA, 12 bp, Homo sapiens
aagattccatgg

SEQ ID NO: 4785677 - DNA, 19 bp, Homo sapiens
aagattgttattaaatgta

SEQ ID NO: 4785678 - DNA, 19 bp, Homo sapiens
aagattgttggcagtttcc

SEQ ID NO: 4785679 - DNA, 22 bp, Homo sapiens
aagcaaactgaaattagtgttt

SEQ ID NO: 4785680 - DNA, 13 bp, Homo sapiens
aagcaaataaata

SEQ ID NO: 4785681 - DNA, 15 bp, Homo sapiens
aagcaactgtaaaaa

SEQ ID NO: 4785682 - DNA, 15 bp, Homo sapiens
aagcacatgcctctc

SEQ ID NO: 4785683 - DNA, 21 bp, Homo sapiens
aagcacatgcctctctcaggc

SEQ ID NO: 4785684 - DNA, 19 bp, Homo sapiens
aagcacctcttgaagaact

SEQ ID NO: 4785685 - DNA, 20 bp, Homo sapiens
aagcacctttagaatattaa

SEQ ID NO: 4785686 - DNA, 14 bp, Homo sapiens
aagcactggccttg

SEQ ID NO: 4785687 - DNA, 22 bp, Homo sapiens
aagcactggccttgcctccagg

SEQ ID NO: 4785688 - DNA, 19 bp, Homo sapiens
aagcagagtcaagctgatg

SEQ ID NO: 4785689 - DNA, 18 bp, Homo sapiens
aagcagcacacattgtgt

SEQ ID NO: 4785690 - DNA, 13 bp, Homo sapiens
aagcagcagctag

SEQ ID NO: 4785691 - DNA, 21 bp, Homo sapiens
aagcaggaaagatcccaagtc

SEQ ID NO: 4785692 - DNA, 15 bp, Homo sapiens
aagcagtacatcttg

SEQ ID NO: 4785693 - DNA, 19 bp, Homo sapiens
aagcagtacatcttgtgca

SEQ ID NO: 4785694 - DNA, 14 bp, Homo sapiens
aagcagtgcatgct

SEQ ID NO: 4785695 - DNA, 13 bp, Homo sapiens
aagcatcagcaag

SEQ ID NO: 4785696 - DNA, 17 bp, Homo sapiens
aagcatcagcaagacaa

SEQ ID NO: 4785697 - DNA, 17 bp, Homo sapiens
aagcatgctcagtattg

SEQ ID NO: 4785698 - DNA, 18 bp, Homo sapiens
aagcatgctcagtattga

SEQ ID NO: 4785699 - DNA, 20 bp, Homo sapiens
aagcatgctcagtattgaga

SEQ ID NO: 4785700 - DNA, 18 bp, Homo sapiens
aagcattttactgtctgt

SEQ ID NO: 4785701 - DNA, 20 bp, Homo sapiens
aagcattttactgtctgtaa

SEQ ID NO: 4785702 - DNA, 21 bp, Homo sapiens
aagcattttactgtctgtaag

SEQ ID NO: 4785703 - DNA, 21 bp, Homo sapiens
aagccaaaaaccttagctccc

SEQ ID NO: 4785704 - DNA, 16 bp, Homo sapiens
aagccacgctgtcctc

SEQ ID NO: 4785705 - DNA, 15 bp, Homo sapiens
aagccacgttgcaga

SEQ ID NO: 4785706 - DNA, 18 bp, Homo sapiens
aagccagcaggctctcag

SEQ ID NO: 4785707 - DNA, 19 bp, Homo sapiens
aagccagcaggctctcagg

SEQ ID NO: 4785708 - DNA, 20 bp, Homo sapiens
aagccaggagaccctgtctt

SEQ ID NO: 4785709 - DNA, 15 bp, Homo sapiens
aagccaggccctctc

SEQ ID NO: 4785710 - DNA, 19 bp, Homo sapiens
aagccaggccctctctgca

SEQ ID NO: 4785711 - DNA, 18 bp, Homo sapiens
aagccagggttccagaca

SEQ ID NO: 4785712 - DNA, 16 bp, Homo sapiens
aagccatagccccagg

SEQ ID NO: 4785713 - DNA, 19 bp, Homo sapiens
aagccatagccccaggccc

SEQ ID NO: 4785714 - DNA, 20 bp, Homo sapiens
aagccattgcttctccctca

SEQ ID NO: 4785715 - DNA, 14 bp, Homo sapiens
aagcccacccgccc

SEQ ID NO: 4785716 - DNA, 22 bp, Homo sapiens
aagcccagcctatctctcttct

SEQ ID NO: 4785717 - DNA, 12 bp, Homo sapiens
aagcccaggagg

SEQ ID NO: 4785718 - DNA, 19 bp, Homo sapiens
aagccctgcttgctggaaa

SEQ ID NO: 4785719 - DNA, 18 bp, Homo sapiens
aagccggcggagctctgg

SEQ ID NO: 4785720 - DNA, 21 bp, Homo sapiens
aagccggcggagctctggctt

SEQ ID NO: 4785721 - DNA, 22 bp, Homo sapiens
aagcctcagtccctccctcctg

SEQ ID NO: 4785722 - DNA, 18 bp, Homo sapiens
aagcctgttgtttaagtg

SEQ ID NO: 4785723 - DNA, 22 bp, Homo sapiens
aagcgacctaaacagctgcttt

SEQ ID NO: 4785724 - DNA, 15 bp, Homo sapiens
aagctagaaaaatta

SEQ ID NO: 4785725 - DNA, 22 bp, Homo sapiens
aagctagacgagcaggcttctt

SEQ ID NO: 4785726 - DNA, 22 bp, Homo sapiens
aagctatcttcatgtaaattga

SEQ ID NO: 4785727 - DNA, 14 bp, Homo sapiens
aagctatgtcacta

SEQ ID NO: 4785728 - DNA, 13 bp, Homo sapiens
aagctatttaagt

SEQ ID NO: 4785729 - DNA, 22 bp, Homo sapiens
aagctatttaagtggactgtat

SEQ ID NO: 4785730 - DNA, 19 bp, Homo sapiens
aagctcaaggctgcagtga

SEQ ID NO: 4785731 - DNA, 16 bp, Homo sapiens
aagctccatcttattt

SEQ ID NO: 4785732 - DNA, 14 bp, Homo sapiens
aagctgaataaagt

SEQ ID NO: 4785733 - DNA, 11 bp, Homo sapiens
aagctgccagc

SEQ ID NO: 4785734 - DNA, 12 bp, Homo sapiens
aagctgccagcc

SEQ ID NO: 4785735 - DNA, 22 bp, Homo sapiens
aagctgcccaatttcacagagt

SEQ ID NO: 4785736 - DNA, 19 bp, Homo sapiens
aagctgctgccgcctcacc

SEQ ID NO: 4785737 - DNA, 20 bp, Homo sapiens
aagctttcttacaatgtgga

SEQ ID NO: 4785738 - DNA, 12 bp, Homo sapiens
aggggggttggg

SEQ ID NO: 4785739 - DNA, 19 bp, Homo sapiens
aggggggttgggttccaga

SEQ ID NO: 4785740 - DNA, 19 bp, Homo sapiens
agggggtcagttgggcccc

SEQ ID NO: 4785741 - DNA, 23 bp, Homo sapiens
aggggtataggacaaggggtgga

SEQ ID NO: 4785742 - DNA, 22 bp, Homo sapiens
aggggtcagcaggggggttggg

SEQ ID NO: 4785743 - DNA, 17 bp, Homo sapiens
aggggtggaagggcagg

SEQ ID NO: 4785744 - DNA, 23 bp, Homo sapiens
aggggtgggggagaatggctctg

SEQ ID NO: 4785745 - DNA, 14 bp, Homo sapiens
aggggtttacagtg

SEQ ID NO: 4785746 - DNA, 15 bp, Homo sapiens
agggtaaggctgtgg

SEQ ID NO: 4785747 - DNA, 22 bp, Homo sapiens
agggtagtttaattttaaaata

SEQ ID NO: 4785748 - DNA, 21 bp, Homo sapiens
agggtcaggttagggctcctg

SEQ ID NO: 4785749 - DNA, 14 bp, Homo sapiens
agggtccagccctc

SEQ ID NO: 4785750 - DNA, 15 bp, Homo sapiens
agggtgaggcgtggg

SEQ ID NO: 4785751 - DNA, 16 bp, Homo sapiens
agggtgaggcgtggga

SEQ ID NO: 4785752 - DNA, 22 bp, Homo sapiens
agggtgaggcgtgggatccaga

SEQ ID NO: 4785753 - DNA, 12 bp, Homo sapiens
agggtgccgcgg

SEQ ID NO: 4785754 - DNA, 21 bp, Homo sapiens
agggtggcacccaccactctc

SEQ ID NO: 4785755 - DNA, 12 bp, Homo sapiens
agggtgggcgtg

SEQ ID NO: 4785756 - DNA, 22 bp, Homo sapiens
agggtgggcgtgacttcagact

SEQ ID NO: 4785757 - DNA, 15 bp, Homo sapiens
agggtgtggcttgga

SEQ ID NO: 4785758 - DNA, 20 bp, Homo sapiens
agggtgtggcttggaacatt

SEQ ID NO: 4785759 - DNA, 15 bp, Homo sapiens
agggttaaagaaagg

SEQ ID NO: 4785760 - DNA, 16 bp, Homo sapiens
agggttaaagaaaggc

SEQ ID NO: 4785761 - DNA, 15 bp, Homo sapiens
agggttctagaaggg

SEQ ID NO: 4785762 - DNA, 18 bp, Homo sapiens
agggtttacccagtggga

SEQ ID NO: 4785763 - DNA, 23 bp, Homo sapiens
agggtttggaagaaagggagaag

SEQ ID NO: 4785764 - DNA, 21 bp, Homo sapiens
agggtttgtttgctgcttttg

SEQ ID NO: 4785765 - DNA, 19 bp, Homo sapiens
aggtaaactgatgctttca

SEQ ID NO: 4785766 - DNA, 16 bp, Homo sapiens
aggtaaataatcatac

SEQ ID NO: 4785767 - DNA, 14 bp, Homo sapiens
aggtaataaaactc

SEQ ID NO: 4785768 - DNA, 19 bp, Homo sapiens
aggtagtagaatctcagca

SEQ ID NO: 4785769 - DNA, 17 bp, Homo sapiens
aggtatctgatgatgtt

SEQ ID NO: 4785770 - DNA, 21 bp, Homo sapiens
aggtatctgatgatgttctga

SEQ ID NO: 4785771 - DNA, 14 bp, Homo sapiens
aggtcagagcccag

SEQ ID NO: 4785772 - DNA, 22 bp, Homo sapiens
agtttctttgagggttccatgg

SEQ ID NO: 4785773 - DNA, 21 bp, Homo sapiens
agtttgctgtatacaaacagg

SEQ ID NO: 4785774 - DNA, 21 bp, Homo sapiens
agtttgttctccgggtgtggc

SEQ ID NO: 4785775 - DNA, 19 bp, Homo sapiens
agttttgatacttgtaact

SEQ ID NO: 4785776 - DNA, 23 bp, Homo sapiens
agtttttggtaatgatgattcaa

SEQ ID NO: 4785777 - DNA, 21 bp, Homo sapiens
agtttttgttcaccttctgtg

SEQ ID NO: 4785778 - DNA, 13 bp, Homo sapiens
ataaaaaagaaaa

SEQ ID NO: 4785779 - DNA, 16 bp, Homo sapiens
ataaaaaatatatgta

SEQ ID NO: 4785780 - DNA, 18 bp, Homo sapiens
ataaaacaaaacaaacaa

SEQ ID NO: 4785781 - DNA, 18 bp, Homo sapiens
ataaaaccagaaagagga

SEQ ID NO: 4785782 - DNA, 12 bp, Homo sapiens
ataaaaggaagg

SEQ ID NO: 4785783 - DNA, 18 bp, Homo sapiens
ataaaagttttttaataa

SEQ ID NO: 4785784 - DNA, 13 bp, Homo sapiens
ataaaataaataa

SEQ ID NO: 4785785 - DNA, 12 bp, Homo sapiens
ataaaatgtaaa

SEQ ID NO: 4785786 - DNA, 20 bp, Homo sapiens
ataaaatgtttatttttgct

SEQ ID NO: 4785787 - DNA, 12 bp, Homo sapiens
ataaaattcatt

SEQ ID NO: 4785788 - DNA, 23 bp, Homo sapiens
ataaacacagctgctttcttctt

SEQ ID NO: 4785789 - DNA, 14 bp, Homo sapiens
ataaacacagtaag

SEQ ID NO: 4785790 - DNA, 20 bp, Homo sapiens
ataaacacatagattcacct

SEQ ID NO: 4785791 - DNA, 24 bp, Homo sapiens
ataaacacatagattcacctgtaa

SEQ ID NO: 4785792 - DNA, 19 bp, Homo sapiens
ataaaccggatcctgttgc

SEQ ID NO: 4785793 - DNA, 11 bp, Homo sapiens
ataaactgtga

SEQ ID NO: 4785794 - DNA, 12 bp, Homo sapiens
ataaactgtgag

SEQ ID NO: 4785795 - DNA, 17 bp, Homo sapiens
ataaactgtgagataaa

SEQ ID NO: 4785796 - DNA, 22 bp, Homo sapiens
ataaactgtgagataaatatca

SEQ ID NO: 4785797 - DNA, 13 bp, Homo sapiens
ataaacttgtact

SEQ ID NO: 4785798 - DNA, 14 bp, Homo sapiens
ataaacttgtactt

SEQ ID NO: 4785799 - DNA, 22 bp, Homo sapiens
ataaagagttctccttgtactt

SEQ ID NO: 4785800 - DNA, 14 bp, Homo sapiens
ataaagctcacact

SEQ ID NO: 4785801 - DNA, 16 bp, Homo sapiens
ataaagctcacacttg

SEQ ID NO: 4785802 - DNA, 14 bp, Homo sapiens
ataaaggagcatat

SEQ ID NO: 4785803 - DNA, 14 bp, Homo sapiens
ataaaggttctatg

SEQ ID NO: 4785804 - DNA, 17 bp, Homo sapiens
ataaaggttctatgata

SEQ ID NO: 4785805 - DNA, 18 bp, Homo sapiens
ataaagtaataactgtta

SEQ ID NO: 4785806 - DNA, 16 bp, Homo sapiens
ataaagtattccacct

SEQ ID NO: 4785807 - DNA, 17 bp, Homo sapiens
ataaataagtaaataca

SEQ ID NO: 4785808 - DNA, 16 bp, Homo sapiens
ataaataataaaggtt

SEQ ID NO: 4785809 - DNA, 13 bp, Homo sapiens
ataaataatctca

SEQ ID NO: 4785810 - DNA, 13 bp, Homo sapiens
ataaatatcatta

SEQ ID NO: 4785811 - DNA, 15 bp, Homo sapiens
ataaatatctattta

SEQ ID NO: 4785812 - DNA, 16 bp, Homo sapiens
ataaatatctatttat

SEQ ID NO: 4785813 - DNA, 24 bp, Homo sapiens
ataaatatctatttatctgtctga

SEQ ID NO: 4785814 - DNA, 14 bp, Homo sapiens
ataaatcacagatt

SEQ ID NO: 4785815 - DNA, 20 bp, Homo sapiens
ataaatcacagatttccaaa

SEQ ID NO: 4785816 - DNA, 11 bp, Homo sapiens
ataaatcatgg

SEQ ID NO: 4785817 - DNA, 22 bp, Homo sapiens
ataaatcatgggcattgctgga

SEQ ID NO: 4785818 - DNA, 22 bp, Homo sapiens
ataaatcttacccttcaatgtt

SEQ ID NO: 4785819 - DNA, 18 bp, Homo sapiens
ataaatcttccaaagttt

SEQ ID NO: 4785820 - DNA, 16 bp, Homo sapiens
ataaatgaagatgcat

SEQ ID NO: 4785821 - DNA, 14 bp, Homo sapiens
ataaatgctgcttt

SEQ ID NO: 4785822 - DNA, 23 bp, Homo sapiens
ataaatgctgctttggggatatt

SEQ ID NO: 4785823 - DNA, 15 bp, Homo sapiens
ataaatggtgtcata

SEQ ID NO: 4785824 - DNA, 17 bp, Homo sapiens
ataaatggtgtcataac

SEQ ID NO: 4785825 - DNA, 22 bp, Homo sapiens
ataaatggtgtcataactagag

SEQ ID NO: 4785826 - DNA, 17 bp, Homo sapiens
ataaatgtcccaaataa

SEQ ID NO: 4785827 - DNA, 14 bp, Homo sapiens
ataaatgtgaaatt

SEQ ID NO: 4785828 - DNA, 15 bp, Homo sapiens
ataaatgtgtaaatg

SEQ ID NO: 4785829 - DNA, 19 bp, Homo sapiens
ataaatgtgtaaatgtgga

SEQ ID NO: 4785830 - DNA, 21 bp, Homo sapiens
ataaatgtgtaaatgtggaca

SEQ ID NO: 4785831 - DNA, 17 bp, Homo sapiens
ataaatgtgtgtatgtg

SEQ ID NO: 4785832 - DNA, 17 bp, Homo sapiens
ataaatgttttggaatt

SEQ ID NO: 4785833 - DNA, 14 bp, Homo sapiens
ataaattattactt

SEQ ID NO: 4785834 - DNA, 16 bp, Homo sapiens
ataaattattacttta

SEQ ID NO: 4785835 - DNA, 16 bp, Homo sapiens
ataaattatttctaaa

SEQ ID NO: 4785836 - DNA, 20 bp, Homo sapiens
ataaattatttctaaaacat

SEQ ID NO: 4785837 - DNA, 20 bp, Homo sapiens
ataaattgtttggcttcctc

SEQ ID NO: 4785838 - DNA, 13 bp, Homo sapiens
ataaattttggaa

SEQ ID NO: 4785839 - DNA, 14 bp, Homo sapiens
ataaattttggaag

SEQ ID NO: 4785840 - DNA, 15 bp, Homo sapiens
ataaattttggaaga

SEQ ID NO: 4785841 - DNA, 19 bp, Homo sapiens
ataacagagtgatttgtaa

SEQ ID NO: 4785842 - DNA, 20 bp, Homo sapiens
ataacagagtgatttgtaaa

SEQ ID NO: 4785843 - DNA, 15 bp, Homo sapiens
ataacaggcattgca

SEQ ID NO: 4785844 - DNA, 19 bp, Homo sapiens
ataacaggcattgcactaa

SEQ ID NO: 4785845 - DNA, 21 bp, Homo sapiens
ataacaggcattgcactaaaa

SEQ ID NO: 4785846 - DNA, 23 bp, Homo sapiens
ataacaggcattgcactaaaagt

SEQ ID NO: 4785847 - DNA, 16 bp, Homo sapiens
ataacagttttaagat

SEQ ID NO: 4785848 - DNA, 12 bp, Homo sapiens
ataacatgaaag

SEQ ID NO: 4785849 - DNA, 13 bp, Homo sapiens
ataacattgtaaa

SEQ ID NO: 4785850 - DNA, 17 bp, Homo sapiens
ataacattgtaaatgat

SEQ ID NO: 4785851 - DNA, 24 bp, Homo sapiens
ataaccctgaatcagaggcagaga

SEQ ID NO: 4785852 - DNA, 14 bp, Homo sapiens
ataactagagcacg

SEQ ID NO: 4785853 - DNA, 14 bp, Homo sapiens
ataactagatctcc

SEQ ID NO: 4785854 - DNA, 22 bp, Homo sapiens
ataactatggtaaataactgtg

SEQ ID NO: 4785855 - DNA, 13 bp, Homo sapiens
ataactattgctg

SEQ ID NO: 4785856 - DNA, 16 bp, Homo sapiens
ataactgtgactgtgg

SEQ ID NO: 4785857 - DNA, 17 bp, Homo sapiens
ataacttccagtatcat

SEQ ID NO: 4785858 - DNA, 22 bp, Homo sapiens
ataagaaacagtttaacagaaa

SEQ ID NO: 4785859 - DNA, 14 bp, Homo sapiens
ataagaagcaaata

SEQ ID NO: 4785860 - DNA, 18 bp, Homo sapiens
ataagaatggagcagtac

SEQ ID NO: 4785861 - DNA, 15 bp, Homo sapiens
ataagacaagtctga

SEQ ID NO: 4785862 - DNA, 23 bp, Homo sapiens
ataagatattaccctcagaatat

SEQ ID NO: 4785863 - DNA, 16 bp, Homo sapiens
ataagattatatacaa

SEQ ID NO: 4785864 - DNA, 18 bp, Homo sapiens
ataagattatatacaaag

SEQ ID NO: 4785865 - DNA, 17 bp, Homo sapiens
ataagctagaaaaatta

SEQ ID NO: 4785866 - DNA, 15 bp, Homo sapiens
ataagctatgtcact

SEQ ID NO: 4785867 - DNA, 16 bp, Homo sapiens
ataagctgaataaagt

SEQ ID NO: 4785868 - DNA, 21 bp, Homo sapiens
ataagctggtatcagtggttc

SEQ ID NO: 4785869 - DNA, 20 bp, Homo sapiens
ataaggatttattctcagaa

SEQ ID NO: 4785870 - DNA, 14 bp, Homo sapiens
ataagtcaaaataa

SEQ ID NO: 4785871 - DNA, 18 bp, Homo sapiens
ataagtgctcagtattga

SEQ ID NO: 4785872 - DNA, 13 bp, Homo sapiens
ataagttgaatga

SEQ ID NO: 4785873 - DNA, 15 bp, Homo sapiens
ataagttgaccttta

SEQ ID NO: 4785874 - DNA, 13 bp, Homo sapiens
ataagttttctct

SEQ ID NO: 4785875 - DNA, 23 bp, Homo sapiens
caaagtgaaattagtattttgag

SEQ ID NO: 4785876 - DNA, 17 bp, Homo sapiens
caaagtggtgagaggca

SEQ ID NO: 4785877 - DNA, 17 bp, Homo sapiens
caaagtgttgtcttatt

SEQ ID NO: 4785878 - DNA, 13 bp, Homo sapiens
caaagtgtttaat

SEQ ID NO: 4785879 - DNA, 15 bp, Homo sapiens
caaagttttcagatt

SEQ ID NO: 4785880 - DNA, 20 bp, Homo sapiens
caaagttttcagattgtaaa

SEQ ID NO: 4785881 - DNA, 19 bp, Homo sapiens
caaataaatttataacaat

SEQ ID NO: 4785882 - DNA, 20 bp, Homo sapiens
caaataaccctgaatcagag

SEQ ID NO: 4785883 - DNA, 14 bp, Homo sapiens
caaatacatgcctt

SEQ ID NO: 4785884 - DNA, 15 bp, Homo sapiens
caaatacattccagt

SEQ ID NO: 4785885 - DNA, 14 bp, Homo sapiens
caaatagaaaacag

SEQ ID NO: 4785886 - DNA, 17 bp, Homo sapiens
caaatagaaaacaggaa

SEQ ID NO: 4785887 - DNA, 14 bp, Homo sapiens
caaatataaacttg

SEQ ID NO: 4785888 - DNA, 17 bp, Homo sapiens
caaatatactcatttgg

SEQ ID NO: 4785889 - DNA, 17 bp, Homo sapiens
caaatatctctatttaa

SEQ ID NO: 4785890 - DNA, 14 bp, Homo sapiens
caaatattgatctg

SEQ ID NO: 4785891 - DNA, 18 bp, Homo sapiens
caaatattgatctgtatt

SEQ ID NO: 4785892 - DNA, 17 bp, Homo sapiens
caaatattgcttggact

SEQ ID NO: 4785893 - DNA, 14 bp, Homo sapiens
caaatatttcactt

SEQ ID NO: 4785894 - DNA, 15 bp, Homo sapiens
caaatatttcactta

SEQ ID NO: 4785895 - DNA, 14 bp, Homo sapiens
caaatcattttgat

SEQ ID NO: 4785896 - DNA, 16 bp, Homo sapiens
atattctttatatact

SEQ ID NO: 4785897 - DNA, 16 bp, Homo sapiens
atattgagcagaattc

SEQ ID NO: 4785898 - DNA, 15 bp, Homo sapiens
atattgataataaaa

SEQ ID NO: 4785899 - DNA, 16 bp, Homo sapiens
atattgataataaaat

SEQ ID NO: 4785900 - DNA, 20 bp, Homo sapiens
atattgatctgtattaagct

SEQ ID NO: 4785901 - DNA, 14 bp, Homo sapiens
atattgatgtaact

SEQ ID NO: 4785902 - DNA, 21 bp, Homo sapiens
atattgctattgtttatagga

SEQ ID NO: 4785903 - DNA, 19 bp, Homo sapiens
atattgctgaagaatctac

SEQ ID NO: 4785904 - DNA, 21 bp, Homo sapiens
atattgctgaagaatctactt

SEQ ID NO: 4785905 - DNA, 14 bp, Homo sapiens
atattgcttggact

SEQ ID NO: 4785906 - DNA, 15 bp, Homo sapiens
atattgtattatcat

SEQ ID NO: 4785907 - DNA, 22 bp, Homo sapiens
atattgtattatcatatatgct

SEQ ID NO: 4785908 - DNA, 22 bp, Homo sapiens
atattgtattgttagatgtttg

SEQ ID NO: 4785909 - DNA, 17 bp, Homo sapiens
atattgtttaatgcaaa

SEQ ID NO: 4785910 - DNA, 14 bp, Homo sapiens
atattgttttataa

SEQ ID NO: 4785911 - DNA, 20 bp, Homo sapiens
atatttaataggataaatta

SEQ ID NO: 4785912 - DNA, 22 bp, Homo sapiens
atatttaataggataaattaat

SEQ ID NO: 4785913 - DNA, 16 bp, Homo sapiens
atatttacaatgtatt

SEQ ID NO: 4785914 - DNA, 14 bp, Homo sapiens
atatttactgttta

SEQ ID NO: 4785915 - DNA, 15 bp, Homo sapiens
atatttactgtttat

SEQ ID NO: 4785916 - DNA, 17 bp, Homo sapiens
atatttactgtttataa

SEQ ID NO: 4785917 - DNA, 13 bp, Homo sapiens
atatttataaatg

SEQ ID NO: 4785918 - DNA, 14 bp, Homo sapiens
atatttcttcaaat

SEQ ID NO: 4785919 - DNA, 15 bp, Homo sapiens
atatttcttcaaata

SEQ ID NO: 4785920 - DNA, 17 bp, Homo sapiens
atatttgcttatttata

SEQ ID NO: 4785921 - DNA, 14 bp, Homo sapiens
atatttgtttagtt

SEQ ID NO: 4785922 - DNA, 20 bp, Homo sapiens
atattttaaaatctcctaaa

SEQ ID NO: 4785923 - DNA, 20 bp, Homo sapiens
atattttatttcaatgtaat

SEQ ID NO: 4785924 - DNA, 16 bp, Homo sapiens
atattttcccatggaa

SEQ ID NO: 4785925 - DNA, 19 bp, Homo sapiens
atattttctgagtagcata

SEQ ID NO: 4785926 - DNA, 20 bp, Homo sapiens
atattttgtaaaatgtatta

SEQ ID NO: 4785927 - DNA, 17 bp, Homo sapiens
atatttttaatttatga

SEQ ID NO: 4785928 - DNA, 17 bp, Homo sapiens
atatttttttaacttta

SEQ ID NO: 4785929 - DNA, 21 bp, Homo sapiens
atcaaaaaacagaaaaacaaa

SEQ ID NO: 4785930 - DNA, 22 bp, Homo sapiens
atcaaaatgcatacgtattgtt

SEQ ID NO: 4785931 - DNA, 22 bp, Homo sapiens
atcaaacaaatcattttgatgt

SEQ ID NO: 4785932 - DNA, 15 bp, Homo sapiens
atcaaagtgtttaat

SEQ ID NO: 4785933 - DNA, 17 bp, Homo sapiens
atcaaataaaaattcta

SEQ ID NO: 4785934 - DNA, 21 bp, Homo sapiens
atcaaataaaaattctagatt

SEQ ID NO: 4785935 - DNA, 20 bp, Homo sapiens
atcaacaaaagggagaacat

SEQ ID NO: 4785936 - DNA, 20 bp, Homo sapiens
atcaacagtgaacagcttca

SEQ ID NO: 4785937 - DNA, 18 bp, Homo sapiens
atcaaggtgaaggatctg

SEQ ID NO: 4785938 - DNA, 13 bp, Homo sapiens
atcaaggtgctct

SEQ ID NO: 4785939 - DNA, 21 bp, Homo sapiens
atcaaggtgctcttctcattt

SEQ ID NO: 4785940 - DNA, 23 bp, Homo sapiens
atcaagtagtagtacttaatagt

SEQ ID NO: 4785941 - DNA, 23 bp, Homo sapiens
atcaagtcccgaggcagcaacag

SEQ ID NO: 4785942 - DNA, 13 bp, Homo sapiens
atcaatactttga

SEQ ID NO: 4785943 - DNA, 14 bp, Homo sapiens
atcaatcattgtac

SEQ ID NO: 4785944 - DNA, 17 bp, Homo sapiens
atcaatcattgtacagt

SEQ ID NO: 4785945 - DNA, 21 bp, Homo sapiens
atcaatcattgtacagtttgt

SEQ ID NO: 4785946 - DNA, 15 bp, Homo sapiens
atcaatctggcttct

SEQ ID NO: 4785947 - DNA, 23 bp, Homo sapiens
atcaatgttcacgcaacttgaaa

SEQ ID NO: 4785948 - DNA, 18 bp, Homo sapiens
atcaattgggttttgatc

SEQ ID NO: 4785949 - DNA, 16 bp, Homo sapiens
atcacacatgttcaga

SEQ ID NO: 4785950 - DNA, 17 bp, Homo sapiens
atcaccgattcttcctt

SEQ ID NO: 4785951 - DNA, 18 bp, Homo sapiens
atcaccgattcttccttg

SEQ ID NO: 4785952 - DNA, 18 bp, Homo sapiens
atcaccgggaacgccccc

SEQ ID NO: 4785953 - DNA, 17 bp, Homo sapiens
atcacctaattaatttc

SEQ ID NO: 4785954 - DNA, 14 bp, Homo sapiens
atcacggcatgttt

SEQ ID NO: 4785955 - DNA, 14 bp, Homo sapiens
atcacgggcccgct

SEQ ID NO: 4785956 - DNA, 20 bp, Homo sapiens
atcacgggcccgctcaacct

SEQ ID NO: 4785957 - DNA, 21 bp, Homo sapiens
atcactatccatgcaccaaac

SEQ ID NO: 4785958 - DNA, 15 bp, Homo sapiens
atcactcattaatta

SEQ ID NO: 4785959 - DNA, 16 bp, Homo sapiens
atcactcattaattaa

SEQ ID NO: 4785960 - DNA, 17 bp, Homo sapiens
atcactgctttttcctt

SEQ ID NO: 4785961 - DNA, 18 bp, Homo sapiens
atcagaactcctttctaa

SEQ ID NO: 4785962 - DNA, 20 bp, Homo sapiens
atcagaataaccttcaaata

SEQ ID NO: 4785963 - DNA, 14 bp, Homo sapiens
atcagcactgaaaa

SEQ ID NO: 4785964 - DNA, 17 bp, Homo sapiens
atcagctttataataaa

SEQ ID NO: 4785965 - DNA, 21 bp, Homo sapiens
atcagtaaaattatactgtgt

SEQ ID NO: 4785966 - DNA, 13 bp, Homo sapiens
atcagtacaattc

SEQ ID NO: 4785967 - DNA, 21 bp, Homo sapiens
atcagtcctagaatgtttcat

SEQ ID NO: 4785968 - DNA, 23 bp, Homo sapiens
atcagtcctagaatgtttcattt

SEQ ID NO: 4785969 - DNA, 15 bp, Homo sapiens
atcagtctttgtcaa

SEQ ID NO: 4785970 - DNA, 21 bp, Homo sapiens
atcagtggttcgggggaaata

SEQ ID NO: 4785971 - DNA, 20 bp, Homo sapiens
atcagtgtcattttctgtta

SEQ ID NO: 4785972 - DNA, 21 bp, Homo sapiens
atcagttacagtggcagtatt

SEQ ID NO: 4785973 - DNA, 12 bp, Homo sapiens
atcatatatgct

SEQ ID NO: 4785974 - DNA, 15 bp, Homo sapiens
atcatatatgctttt

SEQ ID NO: 4785975 - DNA, 15 bp, Homo sapiens
atcatcaaagtgttt

SEQ ID NO: 4785976 - DNA, 16 bp, Homo sapiens
atcatcaaagtgttta

SEQ ID NO: 4785977 - DNA, 23 bp, Homo sapiens
atcatcaaagtgtttaattgtat

SEQ ID NO: 4785978 - DNA, 17 bp, Homo sapiens
atcatcacgtatgttat

SEQ ID NO: 4785979 - DNA, 14 bp, Homo sapiens
atcatctcagctca

SEQ ID NO: 4785980 - DNA, 19 bp, Homo sapiens
atcatctcagctcactgca

SEQ ID NO: 4785981 - DNA, 21 bp, Homo sapiens
atcatcttgaacattaatcca

SEQ ID NO: 4785982 - DNA, 18 bp, Homo sapiens
atcatgcacacaattaga

SEQ ID NO: 4785983 - DNA, 12 bp, Homo sapiens
atcatgcttcta

SEQ ID NO: 4785984 - DNA, 22 bp, Homo sapiens
atcatggatttattttttgtaa

SEQ ID NO: 4785985 - DNA, 13 bp, Homo sapiens
atcatgtgtttct

SEQ ID NO: 4785986 - DNA, 17 bp, Homo sapiens
atcatgtgtttctgtgt

SEQ ID NO: 4785987 - DNA, 18 bp, Homo sapiens
atcattgtacagtttgtt

SEQ ID NO: 4785988 - DNA, 22 bp, Homo sapiens
atcattgtacagtttgtttaca

SEQ ID NO: 4785989 - DNA, 19 bp, Homo sapiens
atcattgtttgtcctttat

SEQ ID NO: 4785990 - DNA, 19 bp, Homo sapiens
atcatttccagcaaaatat

SEQ ID NO: 4785991 - DNA, 20 bp, Homo sapiens
atcatttccagcaaaatata

SEQ ID NO: 4785992 - DNA, 22 bp, Homo sapiens
atcattttctagccctctccct

SEQ ID NO: 4785993 - DNA, 20 bp, Homo sapiens
atcattttgatgtattatta

SEQ ID NO: 4785994 - DNA, 21 bp, Homo sapiens
atcattttgatgtattattat

SEQ ID NO: 4785995 - DNA, 22 bp, Homo sapiens
atcattttgggaaattcttgca

SEQ ID NO: 4785996 - DNA, 17 bp, Homo sapiens
atccaaaatagtcatgt

SEQ ID NO: 4785997 - DNA, 22 bp, Homo sapiens
atccaaacctaccttatagagc

SEQ ID NO: 4785998 - DNA, 14 bp, Homo sapiens
atccaactggaagg

SEQ ID NO: 4785999 - DNA, 16 bp, Homo sapiens
atccaactggaaggct

SEQ ID NO: 4786000 - DNA, 14 bp, Homo sapiens
atccacagtaatct

SEQ ID NO: 4786001 - DNA, 16 bp, Homo sapiens
atccacagtaatcttt

SEQ ID NO: 4786002 - DNA, 18 bp, Homo sapiens
atccacatgcacatgtat

SEQ ID NO: 4786003 - DNA, 18 bp, Homo sapiens
atccacatgtttcagagc

SEQ ID NO: 4786004 - DNA, 14 bp, Homo sapiens
atccaccaccttgc

SEQ ID NO: 4786005 - DNA, 20 bp, Homo sapiens
atccacccgcctcagcctcc

SEQ ID NO: 4786006 - DNA, 12 bp, Homo sapiens
atccactacagg

SEQ ID NO: 4786007 - DNA, 23 bp, Homo sapiens
atccactaggtgcccagtcttga

SEQ ID NO: 4786008 - DNA, 18 bp, Homo sapiens
atccagagacctgctcca

SEQ ID NO: 4786009 - DNA, 18 bp, Homo sapiens
attccagtccaattttcc

SEQ ID NO: 4786010 - DNA, 18 bp, Homo sapiens
attccagtgtattttctg

SEQ ID NO: 4786011 - DNA, 17 bp, Homo sapiens
attcccaaatctcaaaa

SEQ ID NO: 4786012 - DNA, 20 bp, Homo sapiens
attcccaattatcaaaaaac

SEQ ID NO: 4786013 - DNA, 13 bp, Homo sapiens
attcccaggcagg

SEQ ID NO: 4786014 - DNA, 17 bp, Homo sapiens
attcccaggcagggagg

SEQ ID NO: 4786015 - DNA, 15 bp, Homo sapiens
attcccagggccgct

SEQ ID NO: 4786016 - DNA, 20 bp, Homo sapiens
attcccatggtagactgtga

SEQ ID NO: 4786017 - DNA, 14 bp, Homo sapiens
attcctacttaaac

SEQ ID NO: 4786018 - DNA, 22 bp, Homo sapiens
attcctacttaaacaaaaactt

SEQ ID NO: 4786019 - DNA, 12 bp, Homo sapiens
attcctcctgtc

SEQ ID NO: 4786020 - DNA, 18 bp, Homo sapiens
cgggtgcgtgaccggccc

SEQ ID NO: 4786021 - DNA, 20 bp, Homo sapiens
cgggtggcagcgcccagcct

SEQ ID NO: 4786022 - DNA, 17 bp, Homo sapiens
cgggtggctggagcccc

SEQ ID NO: 4786023 - DNA, 14 bp, Homo sapiens
cgggtgtggcctca

SEQ ID NO: 4786024 - DNA, 17 bp, Homo sapiens
cggtattatgcttcttg

SEQ ID NO: 4786025 - DNA, 12 bp, Homo sapiens
cggtccaccccg

SEQ ID NO: 4786026 - DNA, 15 bp, Homo sapiens
cggtccaccccgtcc

SEQ ID NO: 4786027 - DNA, 19 bp, Homo sapiens
cggtcccagtccggtgcct

SEQ ID NO: 4786028 - DNA, 21 bp, Homo sapiens
cggtcctttgagtgtcaggct

SEQ ID NO: 4786029 - DNA, 13 bp, Homo sapiens
cggtgagactctg

SEQ ID NO: 4786030 - DNA, 13 bp, Homo sapiens
cggtgccttccac

SEQ ID NO: 4786031 - DNA, 18 bp, Homo sapiens
cggtgccttccaccctgc

SEQ ID NO: 4786032 - DNA, 23 bp, Homo sapiens
cggtgccttccaccctgccctgg

SEQ ID NO: 4786033 - DNA, 16 bp, Homo sapiens
cggtggcatttgctga

SEQ ID NO: 4786034 - DNA, 21 bp, Homo sapiens
cggtgtagggaacggcctgag

SEQ ID NO: 4786035 - DNA, 16 bp, Homo sapiens
cggtgtatgcagtggt

SEQ ID NO: 4786036 - DNA, 21 bp, Homo sapiens
cggtgtccatttatagaataa

SEQ ID NO: 4786037 - DNA, 18 bp, Homo sapiens
cggtttctttgttacttt

SEQ ID NO: 4786038 - DNA, 14 bp, Homo sapiens
cgtaagttctgtgc

SEQ ID NO: 4786039 - DNA, 22 bp, Homo sapiens
cgtagaacctgcgcaccccgtt

SEQ ID NO: 4786040 - DNA, 20 bp, Homo sapiens
cgtagggcttctaccagaga

SEQ ID NO: 4786041 - DNA, 13 bp, Homo sapiens
cgtcaatgtgaaa

SEQ ID NO: 4786042 - DNA, 19 bp, Homo sapiens
cgtcacgctttcatgacca

SEQ ID NO: 4786043 - DNA, 14 bp, Homo sapiens
cgtcagcctgtgaa

SEQ ID NO: 4786044 - DNA, 13 bp, Homo sapiens
cgtccacatacac

SEQ ID NO: 4786045 - DNA, 14 bp, Homo sapiens
cgtccacatacact

SEQ ID NO: 4786046 - DNA, 12 bp, Homo sapiens
cgtccaggtgat

SEQ ID NO: 4786047 - DNA, 12 bp, Homo sapiens
cgtccccagggt

SEQ ID NO: 4786048 - DNA, 13 bp, Homo sapiens
cgtccccagggtg

SEQ ID NO: 4786049 - DNA, 11 bp, Homo sapiens
cgtcccctgtc

SEQ ID NO: 4786050 - DNA, 17 bp, Homo sapiens
cgtccctgacttcccag

SEQ ID NO: 4786051 - DNA, 18 bp, Homo sapiens
cgtccctgacttcccagc

SEQ ID NO: 4786052 - DNA, 20 bp, Homo sapiens
cgtccctgacttcccagctg

SEQ ID NO: 4786053 - DNA, 22 bp, Homo sapiens
cgtccctgacttcccagctggc

SEQ ID NO: 4786054 - DNA, 21 bp, Homo sapiens
cgtccctgagggcccttccca

SEQ ID NO: 4786055 - DNA, 22 bp, Homo sapiens
cgtccctgagggcccttcccaa

SEQ ID NO: 4786056 - DNA, 23 bp, Homo sapiens
cgtccctgagggcccttcccaac

SEQ ID NO: 4786057 - DNA, 14 bp, Homo sapiens
cgtccgcccgccca

SEQ ID NO: 4786058 - DNA, 10 bp, Homo sapiens
cgtccggcct

SEQ ID NO: 4786059 - DNA, 15 bp, Homo sapiens
cgtccggcctgcagc

SEQ ID NO: 4786060 - DNA, 23 bp, Homo sapiens
cgtcctctcgtagaacctgcgca

SEQ ID NO: 4786061 - DNA, 19 bp, Homo sapiens
cgtcctgctcgccctgtgc

SEQ ID NO: 4786062 - DNA, 24 bp, Homo sapiens
cgtcctgggtgctgtcatgcccag

SEQ ID NO: 4786063 - DNA, 14 bp, Homo sapiens
cgtcgctgtccgtc

SEQ ID NO: 4786064 - DNA, 20 bp, Homo sapiens
cgtcgctgtccgtcctgctc

SEQ ID NO: 4786065 - DNA, 22 bp, Homo sapiens
cgtctctgtccgcgtcctttcc

SEQ ID NO: 4786066 - DNA, 12 bp, Homo sapiens
cgtctgcccctt

SEQ ID NO: 4786067 - DNA, 15 bp, Homo sapiens
cgtctgtcctgcgcc

SEQ ID NO: 4786068 - DNA, 16 bp, Homo sapiens
cgtcttccctgcttca

SEQ ID NO: 4786069 - DNA, 18 bp, Homo sapiens
cgtctttggttcctcatg

SEQ ID NO: 4786070 - DNA, 16 bp, Homo sapiens
cgtgacttcagactct

SEQ ID NO: 4786071 - DNA, 15 bp, Homo sapiens
cgtgagagtcatctc

SEQ ID NO: 4786072 - DNA, 20 bp, Homo sapiens
cgtgagcaggaaggcctggg

SEQ ID NO: 4786073 - DNA, 16 bp, Homo sapiens
cgtgagcgccccgccc

SEQ ID NO: 4786074 - DNA, 14 bp, Homo sapiens
cgtgaggccagaga

SEQ ID NO: 4786075 - DNA, 14 bp, Homo sapiens
cgtgatctcagctc

SEQ ID NO: 4786076 - DNA, 15 bp, Homo sapiens
cgtgatctcagctca

SEQ ID NO: 4786077 - DNA, 20 bp, Homo sapiens
cgtgcaatttgtttgtgctt

SEQ ID NO: 4786078 - DNA, 22 bp, Homo sapiens
cgtgcacaaaccttcttttcaa

SEQ ID NO: 4786079 - DNA, 13 bp, Homo sapiens
cgtgccttccccg

SEQ ID NO: 4786080 - DNA, 20 bp, Homo sapiens
cgtgcgcagccgcgctctgc

SEQ ID NO: 4786081 - DNA, 19 bp, Homo sapiens
cgtgcggcccgtgcgcagc

SEQ ID NO: 4786082 - DNA, 13 bp, Homo sapiens
cgtgctcctctgc

SEQ ID NO: 4786083 - DNA, 14 bp, Homo sapiens
cgtgctcctctgcc

SEQ ID NO: 4786084 - DNA, 16 bp, Homo sapiens
cgtgctcctctgcccg

SEQ ID NO: 4786085 - DNA, 14 bp, Homo sapiens
cgtggccgctgccc

SEQ ID NO: 4786086 - DNA, 21 bp, Homo sapiens
cgtggccgctgcccacgtccc

SEQ ID NO: 4786087 - DNA, 15 bp, Homo sapiens
cgtggctcccagcag

SEQ ID NO: 4786088 - DNA, 20 bp, Homo sapiens
cgtggctcccagcagaggcc

SEQ ID NO: 4786089 - DNA, 16 bp, Homo sapiens
cgtggctttgtgctta

SEQ ID NO: 4786090 - DNA, 21 bp, Homo sapiens
cgtgggatccagagagaagca

SEQ ID NO: 4786091 - DNA, 16 bp, Homo sapiens
cgtgtgcatgagaatg

SEQ ID NO: 4786092 - DNA, 19 bp, Homo sapiens
cgtgttatgactccagaat

SEQ ID NO: 4786093 - DNA, 14 bp, Homo sapiens
cgtgtttcacagtg

SEQ ID NO: 4786094 - DNA, 14 bp, Homo sapiens
cgttaagcagtaca

SEQ ID NO: 4786095 - DNA, 14 bp, Homo sapiens
cgttaattaaacaa

SEQ ID NO: 4786096 - DNA, 20 bp, Homo sapiens
cgttatgtaagtttctaaga

SEQ ID NO: 4786097 - DNA, 21 bp, Homo sapiens
cgttcatgttcatctcaggtg

SEQ ID NO: 4786098 - DNA, 16 bp, Homo sapiens
cgttgttttgtggata

SEQ ID NO: 4786099 - DNA, 18 bp, Homo sapiens
cgttgttttgtggataag

SEQ ID NO: 4786100 - DNA, 17 bp, Homo sapiens
cgtttgcctccagaacc

SEQ ID NO: 4786101 - DNA, 13 bp, Homo sapiens
cgtttttgtgctg

SEQ ID NO: 4786102 - DNA, 18 bp, Homo sapiens
cgtttttgtgctgtgggc

SEQ ID NO: 4786103 - DNA, 18 bp, Homo sapiens
ctaaaacattaattgagg

SEQ ID NO: 4786104 - DNA, 14 bp, Homo sapiens
ctaaaactactgcc

SEQ ID NO: 4786105 - DNA, 15 bp, Homo sapiens
ctaaaactactgcct

SEQ ID NO: 4786106 - DNA, 16 bp, Homo sapiens
ctaaaaggaggacagg

SEQ ID NO: 4786107 - DNA, 18 bp, Homo sapiens
ctaaaaggaggacaggga

SEQ ID NO: 4786108 - DNA, 17 bp, Homo sapiens
ctaaaagtgatgtgatt

SEQ ID NO: 4786109 - DNA, 19 bp, Homo sapiens
ctaaaatccacccagccca

SEQ ID NO: 4786110 - DNA, 19 bp, Homo sapiens
ctaaaattgagttcttcct

SEQ ID NO: 4786111 - DNA, 17 bp, Homo sapiens
ctaaacatagtggtatt

SEQ ID NO: 4786112 - DNA, 14 bp, Homo sapiens
ctaaacctatctgt

SEQ ID NO: 4786113 - DNA, 19 bp, Homo sapiens
ctaaaggaaacaaagcaat

SEQ ID NO: 4786114 - DNA, 22 bp, Homo sapiens
ctaaaggggacagatcttgagc

SEQ ID NO: 4786115 - DNA, 16 bp, Homo sapiens
ctaaatatctagtgct

SEQ ID NO: 4786116 - DNA, 13 bp, Homo sapiens
ctaaatcataatc

SEQ ID NO: 4786117 - DNA, 14 bp, Homo sapiens
ctaaatgacttatt

SEQ ID NO: 4786118 - DNA, 17 bp, Homo sapiens
ctagcatggctgccaat

SEQ ID NO: 4786119 - DNA, 13 bp, Homo sapiens
ctagccaggcctc

SEQ ID NO: 4786120 - DNA, 14 bp, Homo sapiens
ctagcccaccctgc

SEQ ID NO: 4786121 - DNA, 15 bp, Homo sapiens
ctagcccaccctgct

SEQ ID NO: 4786122 - DNA, 15 bp, Homo sapiens
ctagccctctccctc

SEQ ID NO: 4786123 - DNA, 18 bp, Homo sapiens
ctagccctctttctctct

SEQ ID NO: 4786124 - DNA, 12 bp, Homo sapiens
ctagcctctccg

SEQ ID NO: 4786125 - DNA, 14 bp, Homo sapiens
ctagccttcccagc

SEQ ID NO: 4786126 - DNA, 19 bp, Homo sapiens
ctagctatgctgtatctgt

SEQ ID NO: 4786127 - DNA, 17 bp, Homo sapiens
ctaggaggtctctaaga

SEQ ID NO: 4786128 - DNA, 18 bp, Homo sapiens
ctaggatcttcactgtct

SEQ ID NO: 4786129 - DNA, 15 bp, Homo sapiens
ctaggtctccacccc

SEQ ID NO: 4786130 - DNA, 24 bp, Homo sapiens
ctagtaggtctgcacacataacac

SEQ ID NO: 4786131 - DNA, 18 bp, Homo sapiens
ctagtcacatatcaagtc

SEQ ID NO: 4786132 - DNA, 15 bp, Homo sapiens
ctagtccggacccac

SEQ ID NO: 4786133 - DNA, 16 bp, Homo sapiens
ctagtgagctgggcat

SEQ ID NO: 4786134 - DNA, 13 bp, Homo sapiens
ctagtgtagaatt

SEQ ID NO: 4786135 - DNA, 19 bp, Homo sapiens
ctagtgtttggctcacctt

SEQ ID NO: 4786136 - DNA, 21 bp, Homo sapiens
ctagttagagactcgcctggg

SEQ ID NO: 4786137 - DNA, 23 bp, Homo sapiens
ctagttagctcacaagccgtgtt

SEQ ID NO: 4786138 - DNA, 21 bp, Homo sapiens
ctagtttaaaattattaaaaa

SEQ ID NO: 4786139 - DNA, 14 bp, Homo sapiens
ctataaaagtgata

SEQ ID NO: 4786140 - DNA, 19 bp, Homo sapiens
ctataaatggacttgcttc

SEQ ID NO: 4786141 - DNA, 18 bp, Homo sapiens
ctataagagacaaagttt

SEQ ID NO: 4786142 - DNA, 22 bp, Homo sapiens
ctataagagacaaagtttggaa

SEQ ID NO: 4786143 - DNA, 13 bp, Homo sapiens
ctataatgtgaaa

SEQ ID NO: 4786144 - DNA, 13 bp, Homo sapiens
ctatagttactgt

SEQ ID NO: 4786145 - DNA, 16 bp, Homo sapiens
ctatagttactgtcct

SEQ ID NO: 4786146 - DNA, 20 bp, Homo sapiens
ctatataaaaaatatatgta

SEQ ID NO: 4786147 - DNA, 13 bp, Homo sapiens
ctatatatacatg

SEQ ID NO: 4786148 - DNA, 20 bp, Homo sapiens
ctatatgcctatatttataa

SEQ ID NO: 4786149 - DNA, 21 bp, Homo sapiens
ctatatgcctatatttataaa

SEQ ID NO: 4786150 - DNA, 15 bp, Homo sapiens
ctatatttactgttt

SEQ ID NO: 4786151 - DNA, 17 bp, Homo sapiens
ctatatttactgtttat

SEQ ID NO: 4786152 - DNA, 15 bp, Homo sapiens
cgagtgagctaccag

SEQ ID NO: 4786153 - DNA, 21 bp, Homo sapiens
cgagtgagctaccaggaagag

SEQ ID NO: 4786154 - DNA, 18 bp, Homo sapiens
cgagtggcgagtccagac

SEQ ID NO: 4786155 - DNA, 17 bp, Homo sapiens
cgagttacagacaaagc

SEQ ID NO: 4786156 - DNA, 13 bp, Homo sapiens
cgatattcccagg

SEQ ID NO: 4786157 - DNA, 22 bp, Homo sapiens
cgatccccatggaacagccctg

SEQ ID NO: 4786158 - DNA, 23 bp, Homo sapiens
cgatccccatggaacagccctgc

SEQ ID NO: 4786159 - DNA, 23 bp, Homo sapiens
cgatctggaaagagctgttttgg

SEQ ID NO: 4786160 - DNA, 13 bp, Homo sapiens
cgatgtgttcttt

SEQ ID NO: 4786161 - DNA, 13 bp, Homo sapiens
cgattcctgccaa

SEQ ID NO: 4786162 - DNA, 13 bp, Homo sapiens
cgatttctccatt

SEQ ID NO: 4786163 - DNA, 16 bp, Homo sapiens
cgcaacttcccaggcc

SEQ ID NO: 4786164 - DNA, 17 bp, Homo sapiens
cgcaagcgacacaggct

SEQ ID NO: 4786165 - DNA, 22 bp, Homo sapiens
cgcaaggatcacttgagcccag

SEQ ID NO: 4786166 - DNA, 12 bp, Homo sapiens
cgcacagcagcc

SEQ ID NO: 4786167 - DNA, 18 bp, Homo sapiens
cgcaccccgttcccagcg

SEQ ID NO: 4786168 - DNA, 22 bp, Homo sapiens
ctccaaggcaaatgtccaagca

SEQ ID NO: 4786169 - DNA, 22 bp, Homo sapiens
ctccaagtcatgggagaagagg

SEQ ID NO: 4786170 - DNA, 21 bp, Homo sapiens
ctccaagtgggtcaattcctt

SEQ ID NO: 4786171 - DNA, 23 bp, Homo sapiens
ctccaagtgggtcaattccttag

SEQ ID NO: 4786172 - DNA, 13 bp, Homo sapiens
ctccacacctcca

SEQ ID NO: 4786173 - DNA, 23 bp, Homo sapiens
ctccacagggacacagtctggtg

SEQ ID NO: 4786174 - DNA, 15 bp, Homo sapiens
ctccaccccagtccc

SEQ ID NO: 4786175 - DNA, 17 bp, Homo sapiens
ctccaccgcagaaggaa

SEQ ID NO: 4786176 - DNA, 18 bp, Homo sapiens
ctccaccgcagaaggaag

SEQ ID NO: 4786177 - DNA, 22 bp, Homo sapiens
ctccacctcccccaaaccctgc

SEQ ID NO: 4786178 - DNA, 19 bp, Homo sapiens
ctccaccttgagcactatt

SEQ ID NO: 4786179 - DNA, 19 bp, Homo sapiens
ctccacgcctcctggccag

SEQ ID NO: 4786180 - DNA, 20 bp, Homo sapiens
ctccacgcctcctggccaga

SEQ ID NO: 4786181 - DNA, 22 bp, Homo sapiens
ctccacgtgtttcgggccaggg

SEQ ID NO: 4786182 - DNA, 14 bp, Homo sapiens
ctccactcccctca

SEQ ID NO: 4786183 - DNA, 16 bp, Homo sapiens
ctccactcccctcatc

SEQ ID NO: 4786184 - DNA, 14 bp, Homo sapiens
ctccactcctccca

SEQ ID NO: 4786185 - DNA, 14 bp, Homo sapiens
ctccactctgaagt

SEQ ID NO: 4786186 - DNA, 18 bp, Homo sapiens
ctccactctgaagtccct

SEQ ID NO: 4786187 - DNA, 19 bp, Homo sapiens
ctccagaaaaatcaatcat

SEQ ID NO: 4786188 - DNA, 23 bp, Homo sapiens
ctccagaaaaatcaatcattttc

SEQ ID NO: 4786189 - DNA, 11 bp, Homo sapiens
ctccagaacct

SEQ ID NO: 4786190 - DNA, 16 bp, Homo sapiens
ctccagaagcagcagc

SEQ ID NO: 4786191 - DNA, 17 bp, Homo sapiens
ctccagaagcagcagct

SEQ ID NO: 4786192 - DNA, 9 bp, Homo sapiens
ctccagacc

SEQ ID NO: 4786193 - DNA, 18 bp, Homo sapiens
ctccagactcgagagggc

SEQ ID NO: 4786194 - DNA, 23 bp, Homo sapiens
ctccagactcgagagggctgagc

SEQ ID NO: 4786195 - DNA, 15 bp, Homo sapiens
ctccagagtaggtgg

SEQ ID NO: 4786196 - DNA, 23 bp, Homo sapiens
ctccagagtaggtgggtcttgga

SEQ ID NO: 4786197 - DNA, 16 bp, Homo sapiens
ctccagagtcagaagt

SEQ ID NO: 4786198 - DNA, 23 bp, Homo sapiens
ctccagatcctctttccccactg

SEQ ID NO: 4786199 - DNA, 14 bp, Homo sapiens
ctccagattatttt

SEQ ID NO: 4786200 - DNA, 15 bp, Homo sapiens
ctccagattattttc

SEQ ID NO: 4786201 - DNA, 17 bp, Homo sapiens
ctccagattattttcta

SEQ ID NO: 4786202 - DNA, 19 bp, Homo sapiens
ctccagattattttctata

SEQ ID NO: 4786203 - DNA, 14 bp, Homo sapiens
ctccagccctgggc

SEQ ID NO: 4786204 - DNA, 17 bp, Homo sapiens
ctccagcctcagcctcc

SEQ ID NO: 4786205 - DNA, 17 bp, Homo sapiens
ctccaggattgtccaca

SEQ ID NO: 4786206 - DNA, 23 bp, Homo sapiens
ctccaggattgtccacaaatgtc

SEQ ID NO: 4786207 - DNA, 13 bp, Homo sapiens
ctccaggcccagc

SEQ ID NO: 4786208 - DNA, 14 bp, Homo sapiens
ctccaggcccagcc

SEQ ID NO: 4786209 - DNA, 13 bp, Homo sapiens
cgctcctctgcag

SEQ ID NO: 4786210 - DNA, 14 bp, Homo sapiens
cgctcctctgcagc

SEQ ID NO: 4786211 - DNA, 15 bp, Homo sapiens
cgctcctctgcagcc

SEQ ID NO: 4786212 - DNA, 11 bp, Homo sapiens
cgctcctggct

SEQ ID NO: 4786213 - DNA, 12 bp, Homo sapiens
cgctcctggctt

SEQ ID NO: 4786214 - DNA, 13 bp, Homo sapiens
cgctcttcaccag

SEQ ID NO: 4786215 - DNA, 17 bp, Homo sapiens
cgctcttcaccaggaag

SEQ ID NO: 4786216 - DNA, 23 bp, Homo sapiens
cgctgagggcagggttctagaag

SEQ ID NO: 4786217 - DNA, 16 bp, Homo sapiens
cgctgcagtcagcaca

SEQ ID NO: 4786218 - DNA, 20 bp, Homo sapiens
cgctgcagtcagcacagaga

SEQ ID NO: 4786219 - DNA, 15 bp, Homo sapiens
cgctgcccccacaga

SEQ ID NO: 4786220 - DNA, 13 bp, Homo sapiens
cgctgcccctggc

SEQ ID NO: 4786221 - DNA, 19 bp, Homo sapiens
cgctgcctggcgggcagcc

SEQ ID NO: 4786222 - DNA, 22 bp, Homo sapiens
cgctgcctggcgggcagcccct

SEQ ID NO: 4786223 - DNA, 16 bp, Homo sapiens
cgctgctccatgcaca

SEQ ID NO: 4786224 - DNA, 17 bp, Homo sapiens
cgctggagaccctgcgc

SEQ ID NO: 4786225 - DNA, 23 bp, Homo sapiens
cgctggagaccctgcgcccctgc

SEQ ID NO: 4786226 - DNA, 17 bp, Homo sapiens
cgctgggagaaaagcca

SEQ ID NO: 4786227 - DNA, 23 bp, Homo sapiens
cgctgggagaaaagccagatgac

SEQ ID NO: 4786228 - DNA, 17 bp, Homo sapiens
cgctgtccgtcctgctc

SEQ ID NO: 4786229 - DNA, 16 bp, Homo sapiens
cgctgtcgccccaggc

SEQ ID NO: 4786230 - DNA, 14 bp, Homo sapiens
cgcttctcctgcag

SEQ ID NO: 4786231 - DNA, 12 bp, Homo sapiens
cgcttggctcca

SEQ ID NO: 4786232 - DNA, 23 bp, Homo sapiens
cggaaagcagtcagcggagagga

SEQ ID NO: 4786233 - DNA, 21 bp, Homo sapiens
cggaagaagagatcaggaaga

SEQ ID NO: 4786234 - DNA, 17 bp, Homo sapiens
cggaaggacacagtcag

SEQ ID NO: 4786235 - DNA, 14 bp, Homo sapiens
cggaagtggcctga

SEQ ID NO: 4786236 - DNA, 20 bp, Homo sapiens
cggaagtggcctgagaagag

SEQ ID NO: 4786237 - DNA, 21 bp, Homo sapiens
cggaagtggcctgagaagagt

SEQ ID NO: 4786238 - DNA, 15 bp, Homo sapiens
cggacgcatgcaggg

SEQ ID NO: 4786239 - DNA, 16 bp, Homo sapiens
cggacgctggagaccc

SEQ ID NO: 4786240 - DNA, 17 bp, Homo sapiens
cggacgggacagcggcc

SEQ ID NO: 4786241 - DNA, 18 bp, Homo sapiens
cggacgggacagcggccc

SEQ ID NO: 4786242 - DNA, 12 bp, Homo sapiens
cggagaggaccc

SEQ ID NO: 4786243 - DNA, 18 bp, Homo sapiens
cggagcccccgcccctcc

SEQ ID NO: 4786244 - DNA, 14 bp, Homo sapiens
cggagctctggctt

SEQ ID NO: 4786245 - DNA, 15 bp, Homo sapiens
cggagctctggcttt

SEQ ID NO: 4786246 - DNA, 18 bp, Homo sapiens
cggaggctgggcccctgg

SEQ ID NO: 4786247 - DNA, 22 bp, Homo sapiens
cggaggctgggcccctgggatg

SEQ ID NO: 4786248 - DNA, 15 bp, Homo sapiens
cggaggggcttggag

SEQ ID NO: 4786249 - DNA, 17 bp, Homo sapiens
cggaggggcttggagca

SEQ ID NO: 4786250 - DNA, 20 bp, Homo sapiens
cggaggggcttggagcagag

SEQ ID NO: 4786251 - DNA, 16 bp, Homo sapiens
cggatctccaggccca

SEQ ID NO: 4786252 - DNA, 18 bp, Homo sapiens
cggatggaatcacagcca

SEQ ID NO: 4786253 - DNA, 20 bp, Homo sapiens
cggcaaggggcgcgcgcccc

SEQ ID NO: 4786254 - DNA, 16 bp, Homo sapiens
cggcagaggcagggcc

SEQ ID NO: 4786255 - DNA, 22 bp, Homo sapiens
cggcagaggcagggccctgggg

SEQ ID NO: 4786256 - DNA, 12 bp, Homo sapiens
cggcagccccat

SEQ ID NO: 4786257 - DNA, 17 bp, Homo sapiens
cggcaggccctgcagtg

SEQ ID NO: 4786258 - DNA, 17 bp, Homo sapiens
cggcatccgagcccctg

SEQ ID NO: 4786259 - DNA, 19 bp, Homo sapiens
cggcatccgagcccctgtt

SEQ ID NO: 4786260 - DNA, 21 bp, Homo sapiens
cggccattgaacactgcaccc

SEQ ID NO: 4786261 - DNA, 19 bp, Homo sapiens
cggcccacgcagagccccg

SEQ ID NO: 4786262 - DNA, 17 bp, Homo sapiens
cggcccacgtcctgggt

SEQ ID NO: 4786263 - DNA, 18 bp, Homo sapiens
cggcccacgtcctgggtg

SEQ ID NO: 4786264 - DNA, 17 bp, Homo sapiens
cggccccgcgcgtgccc

SEQ ID NO: 4786265 - DNA, 17 bp, Homo sapiens
cggccccgcggagcccc

SEQ ID NO: 4786266 - DNA, 18 bp, Homo sapiens
cggccccgcggagccccc

SEQ ID NO: 4786267 - DNA, 14 bp, Homo sapiens
cggcccggcccacg

SEQ ID NO: 4786268 - DNA, 18 bp, Homo sapiens
cggcccggcccacgcaga

SEQ ID NO: 4786269 - DNA, 20 bp, Homo sapiens
cggcccggcccacgcagagc

SEQ ID NO: 4786270 - DNA, 12 bp, Homo sapiens
cggccctgcaat

SEQ ID NO: 4786271 - DNA, 14 bp, Homo sapiens
cggccctgccccac

SEQ ID NO: 4786272 - DNA, 13 bp, Homo sapiens
cggcctcttgaga

SEQ ID NO: 4786273 - DNA, 17 bp, Homo sapiens
cggcctcttgagagccc

SEQ ID NO: 4786274 - DNA, 23 bp, Homo sapiens
cggcctgagaggagcgtgtccta

SEQ ID NO: 4786275 - DNA, 14 bp, Homo sapiens
cggcctgcagaccc

SEQ ID NO: 4786276 - DNA, 22 bp, Homo sapiens
cggcctgcagaccctgccaggg

SEQ ID NO: 4786277 - DNA, 14 bp, Homo sapiens
cggcctggccccct

SEQ ID NO: 4786278 - DNA, 15 bp, Homo sapiens
cggcctggccccctc

SEQ ID NO: 4786279 - DNA, 13 bp, Homo sapiens
cggcctggcttca

SEQ ID NO: 4786280 - DNA, 16 bp, Homo sapiens
cggcctggcttcaccg

SEQ ID NO: 4786281 - DNA, 16 bp, Homo sapiens
cggcggggcctgggtc

SEQ ID NO: 4786282 - DNA, 16 bp, Homo sapiens
cggctgaggacggggc

SEQ ID NO: 4786283 - DNA, 23 bp, Homo sapiens
cggctgaggacggggcagagctg

SEQ ID NO: 4786284 - DNA, 18 bp, Homo sapiens
cggctggccggtccaccc

SEQ ID NO: 4786285 - DNA, 14 bp, Homo sapiens
cggctgggcagggc

SEQ ID NO: 4786286 - DNA, 16 bp, Homo sapiens
cggctgggcagggccg

SEQ ID NO: 4786287 - DNA, 23 bp, Homo sapiens
cggctgggcagggccgcagggcg

SEQ ID NO: 4786288 - DNA, 21 bp, Homo sapiens
cggcttccccatcgccttctg

SEQ ID NO: 4786289 - DNA, 21 bp, Homo sapiens
cggcttccccattgccttctg

SEQ ID NO: 4786290 - DNA, 12 bp, Homo sapiens
cggcttccctgc

SEQ ID NO: 4786291 - DNA, 18 bp, Homo sapiens
cgggagagcgccacccgc

SEQ ID NO: 4786292 - DNA, 19 bp, Homo sapiens
cgggagagcgccacccgcc

SEQ ID NO: 4786293 - DNA, 12 bp, Homo sapiens
cgggagcctccc

SEQ ID NO: 4786294 - DNA, 18 bp, Homo sapiens
cgggagcctccccctcag

SEQ ID NO: 4786295 - DNA, 21 bp, Homo sapiens
cgggagtctcctcactgccac

SEQ ID NO: 4786296 - DNA, 21 bp, Homo sapiens
cgggcactgtcatgcccagct

SEQ ID NO: 4786297 - DNA, 21 bp, Homo sapiens
cgggcaggtcctgcccatgtg

SEQ ID NO: 4786298 - DNA, 23 bp, Homo sapiens
cgggcaggtcctgcccatgtgtc

SEQ ID NO: 4786299 - DNA, 23 bp, Homo sapiens
cgggcccgcactcaggagcacag

SEQ ID NO: 4786300 - DNA, 18 bp, Homo sapiens
cgggcccgctcaacctct

SEQ ID NO: 4786301 - DNA, 18 bp, Homo sapiens
cgggccctctctccgccc

SEQ ID NO: 4786302 - DNA, 12 bp, Homo sapiens
cgggccgcctcc

SEQ ID NO: 4786303 - DNA, 13 bp, Homo sapiens
cgggccgcctcct

SEQ ID NO: 4786304 - DNA, 14 bp, Homo sapiens
cgggccgcctcctc

SEQ ID NO: 4786305 - DNA, 19 bp, Homo sapiens
cgggccgcctcctccagac

SEQ ID NO: 4786306 - DNA, 21 bp, Homo sapiens
cgggccgcctcctccagactc

SEQ ID NO: 4786307 - DNA, 15 bp, Homo sapiens
cgggcctcggcctgg

SEQ ID NO: 4786308 - DNA, 12 bp, Homo sapiens
cgggcgagaagg

SEQ ID NO: 4786309 - DNA, 12 bp, Homo sapiens
cgggcgcccgga

SEQ ID NO: 4786310 - DNA, 14 bp, Homo sapiens
ctcctccattcatg

SEQ ID NO: 4786311 - DNA, 21 bp, Homo sapiens
ctcctcccaacagttttacct

SEQ ID NO: 4786312 - DNA, 13 bp, Homo sapiens
ctcctcccccacg

SEQ ID NO: 4786313 - DNA, 17 bp, Homo sapiens
ctcctccccctcctcca

SEQ ID NO: 4786314 - DNA, 20 bp, Homo sapiens
ctcctccccctcctccatgc

SEQ ID NO: 4786315 - DNA, 21 bp, Homo sapiens
ctcctccgtgggcagctcctc

SEQ ID NO: 4786316 - DNA, 13 bp, Homo sapiens
ctcctcctccagt

SEQ ID NO: 4786317 - DNA, 10 bp, Homo sapiens
ctcctcctgc

SEQ ID NO: 4786318 - DNA, 16 bp, Homo sapiens
ctcctcgggcgcctgc

SEQ ID NO: 4786319 - DNA, 21 bp, Homo sapiens
ctcctcgtcccgagggcgcct

SEQ ID NO: 4786320 - DNA, 17 bp, Homo sapiens
ctcctcgtccggcctgc

SEQ ID NO: 4786321 - DNA, 18 bp, Homo sapiens
ctcctcgtccggcctgca

SEQ ID NO: 4786322 - DNA, 19 bp, Homo sapiens
ctcctcgtccggcctgcag

SEQ ID NO: 4786323 - DNA, 22 bp, Homo sapiens
ctcctcgtccggcctgcagccc

SEQ ID NO: 4786324 - DNA, 15 bp, Homo sapiens
ctcctctctctccct

SEQ ID NO: 4786325 - DNA, 16 bp, Homo sapiens
ctcctctctctccctc

SEQ ID NO: 4786326 - DNA, 18 bp, Homo sapiens
ctcctctctctccctcca

SEQ ID NO: 4786327 - DNA, 16 bp, Homo sapiens
ctcctctgcagcctga

SEQ ID NO: 4786328 - DNA, 21 bp, Homo sapiens
ctcctctgtcagtttgtgaag

SEQ ID NO: 4786329 - DNA, 19 bp, Homo sapiens
ctcctcttcaccccggcag

SEQ ID NO: 4786330 - DNA, 20 bp, Homo sapiens
ctcctcttcaccccggcagg

SEQ ID NO: 4786331 - DNA, 14 bp, Homo sapiens
ctcctgcagtctgt

SEQ ID NO: 4786332 - DNA, 17 bp, Homo sapiens
ctcctgcatccctccac

SEQ ID NO: 4786333 - DNA, 22 bp, Homo sapiens
ctcctgcatgtcggggcccctg

SEQ ID NO: 4786334 - DNA, 13 bp, Homo sapiens
ctcctgcccactc

SEQ ID NO: 4786335 - DNA, 15 bp, Homo sapiens
ctcctgcccactctg

SEQ ID NO: 4786336 - DNA, 16 bp, Homo sapiens
ctcctgctgaccttct

SEQ ID NO: 4786337 - DNA, 15 bp, Homo sapiens
ctcctggctcacagc

SEQ ID NO: 4786338 - DNA, 21 bp, Homo sapiens
ctcctggctcacagccaccac

SEQ ID NO: 4786339 - DNA, 15 bp, Homo sapiens
ctcctggcttttaaa

SEQ ID NO: 4786340 - DNA, 15 bp, Homo sapiens
ctcctgggggtggca

SEQ ID NO: 4786341 - DNA, 19 bp, Homo sapiens
ctcctgggggtggcaggca

SEQ ID NO: 4786342 - DNA, 21 bp, Homo sapiens
ctcctgggggtggcaggcaca

SEQ ID NO: 4786343 - DNA, 18 bp, Homo sapiens
ctcctgtaattttgtagt

SEQ ID NO: 4786344 - DNA, 13 bp, Homo sapiens
ctcctgtctcctc

SEQ ID NO: 4786345 - DNA, 15 bp, Homo sapiens
ctcctgtgagctccc

SEQ ID NO: 4786346 - DNA, 17 bp, Homo sapiens
ctcctgtgagctcccca

SEQ ID NO: 4786347 - DNA, 18 bp, Homo sapiens
ctccttaaccacctagtc

SEQ ID NO: 4786348 - DNA, 22 bp, Homo sapiens
ctccttacagaagggagtgaaa

SEQ ID NO: 4786349 - DNA, 14 bp, Homo sapiens
ctccttcatgcttt

SEQ ID NO: 4786350 - DNA, 16 bp, Homo sapiens
ctccttcatgcttttc

SEQ ID NO: 4786351 - DNA, 13 bp, Homo sapiens
ctccttcccaagg

SEQ ID NO: 4786352 - DNA, 14 bp, Homo sapiens
ctccttcccaaggc

SEQ ID NO: 4786353 - DNA, 23 bp, Homo sapiens
ctccttccttacccaaactgttc

SEQ ID NO: 4786354 - DNA, 15 bp, Homo sapiens
ctccttctcccctcc

SEQ ID NO: 4786355 - DNA, 22 bp, Homo sapiens
ctccttggttttgcctctttaa

SEQ ID NO: 4786356 - DNA, 18 bp, Homo sapiens
ctcctttccatcagcttt

SEQ ID NO: 4786357 - DNA, 13 bp, Homo sapiens
ctcctttctaagg

SEQ ID NO: 4786358 - DNA, 23 bp, Homo sapiens
ctccttttctctttgggtttctt

SEQ ID NO: 4786359 - DNA, 17 bp, Homo sapiens
ctcgagagggctgagcc

SEQ ID NO: 4786360 - DNA, 19 bp, Homo sapiens
ctcgagagggctgagcccc

SEQ ID NO: 4786361 - DNA, 21 bp, Homo sapiens
ctcgagagggctgagcccctc

SEQ ID NO: 4786362 - DNA, 15 bp, Homo sapiens
ctcgagcccagatgg

SEQ ID NO: 4786363 - DNA, 16 bp, Homo sapiens
ctcgagctctgtagcc

SEQ ID NO: 4786364 - DNA, 19 bp, Homo sapiens
ctcgagctctgtagcctgg

SEQ ID NO: 4786365 - DNA, 23 bp, Homo sapiens
ctcgcactacatctgatatcagg

SEQ ID NO: 4786366 - DNA, 16 bp, Homo sapiens
ctcgcccccgggccct

SEQ ID NO: 4786367 - DNA, 19 bp, Homo sapiens
ctcgcccccgggccctttc

SEQ ID NO: 4786368 - DNA, 15 bp, Homo sapiens
ctcgccctgtgccct

SEQ ID NO: 4786369 - DNA, 16 bp, Homo sapiens
ctcgccctgtgccctc

SEQ ID NO: 4786370 - DNA, 13 bp, Homo sapiens
ctcgcgcccctgt

SEQ ID NO: 4786371 - DNA, 12 bp, Homo sapiens
ctcgctgccacc

SEQ ID NO: 4786372 - DNA, 13 bp, Homo sapiens
ctcgctgccaccc

SEQ ID NO: 4786373 - DNA, 14 bp, Homo sapiens
ctcgctgccaccca

SEQ ID NO: 4786374 - DNA, 15 bp, Homo sapiens
ctcgcttcataggca

SEQ ID NO: 4786375 - DNA, 17 bp, Homo sapiens
ctcgcttcataggcaga

SEQ ID NO: 4786376 - DNA, 21 bp, Homo sapiens
ctcgcttcataggcagagccc

SEQ ID NO: 4786377 - DNA, 22 bp, Homo sapiens
ctcggaatttctatgagacctc

SEQ ID NO: 4786378 - DNA, 13 bp, Homo sapiens
ctcggacacagtt

SEQ ID NO: 4786379 - DNA, 19 bp, Homo sapiens
ctcggccctgtagccctgg

SEQ ID NO: 4786380 - DNA, 21 bp, Homo sapiens
ctcggccctgtagccctggcc

SEQ ID NO: 4786381 - DNA, 20 bp, Homo sapiens
ctcggccgaggcctgcgccc

SEQ ID NO: 4786382 - DNA, 18 bp, Homo sapiens
ctcggcctcttgagagcc

SEQ ID NO: 4786383 - DNA, 21 bp, Homo sapiens
ctcggcctggcttcaccgcat

SEQ ID NO: 4786384 - DNA, 23 bp, Homo sapiens
gaccaagtctctctaagacaaat

SEQ ID NO: 4786385 - DNA, 14 bp, Homo sapiens
gaccaatctctgtg

SEQ ID NO: 4786386 - DNA, 21 bp, Homo sapiens
gaccacatgcgctcctggctt

SEQ ID NO: 4786387 - DNA, 16 bp, Homo sapiens
gaccacccatatcatg

SEQ ID NO: 4786388 - DNA, 14 bp, Homo sapiens
gaccacccctgtgc

SEQ ID NO: 4786389 - DNA, 14 bp, Homo sapiens
gaccaccctgccaa

SEQ ID NO: 4786390 - DNA, 18 bp, Homo sapiens
gaccacgacctcgtccat

SEQ ID NO: 4786391 - DNA, 21 bp, Homo sapiens
gaccacggtccaatccagcct

SEQ ID NO: 4786392 - DNA, 20 bp, Homo sapiens
gaccagactgtgggtccctg

SEQ ID NO: 4786393 - DNA, 18 bp, Homo sapiens
gaccagcatagttctgca

SEQ ID NO: 4786394 - DNA, 15 bp, Homo sapiens
gaccaggagccaggt

SEQ ID NO: 4786395 - DNA, 22 bp, Homo sapiens
gaccatgcattcagatctgaag

SEQ ID NO: 4786396 - DNA, 18 bp, Homo sapiens
gaccatttagtcctcacc

SEQ ID NO: 4786397 - DNA, 21 bp, Homo sapiens
gacccagacgtggtgcttctc

SEQ ID NO: 4786398 - DNA, 15 bp, Homo sapiens
gacccaggaaccgat

SEQ ID NO: 4786399 - DNA, 15 bp, Homo sapiens
gacccagggaatgcc

SEQ ID NO: 4786400 - DNA, 21 bp, Homo sapiens
gaccccacacgccggggctgg

SEQ ID NO: 4786401 - DNA, 19 bp, Homo sapiens
gaccccaccctgtctgcag

SEQ ID NO: 4786402 - DNA, 19 bp, Homo sapiens
gaccccagatacctgtgag

SEQ ID NO: 4786403 - DNA, 20 bp, Homo sapiens
gaccccagatacctgtgagg

SEQ ID NO: 4786404 - DNA, 13 bp, Homo sapiens
gacccccccagtc

SEQ ID NO: 4786405 - DNA, 18 bp, Homo sapiens
gacccccccagtccgccc

SEQ ID NO: 4786406 - DNA, 14 bp, Homo sapiens
gacccctgccctcg

SEQ ID NO: 4786407 - DNA, 23 bp, Homo sapiens
gacccctgggggaggcttccagc

SEQ ID NO: 4786408 - DNA, 18 bp, Homo sapiens
gacccctgggtgggccct

SEQ ID NO: 4786409 - DNA, 16 bp, Homo sapiens
gacccgacactctcac

SEQ ID NO: 4786410 - DNA, 16 bp, Homo sapiens
gaccctaggtgctcat

SEQ ID NO: 4786411 - DNA, 17 bp, Homo sapiens
gaccctatctcccacaa

SEQ ID NO: 4786412 - DNA, 11 bp, Homo sapiens
gaccctcactt

SEQ ID NO: 4786413 - DNA, 13 bp, Homo sapiens
gaccctcagttat

SEQ ID NO: 4786414 - DNA, 19 bp, Homo sapiens
gaccctccaccgcagaagg

SEQ ID NO: 4786415 - DNA, 12 bp, Homo sapiens
gaccctcccagg

SEQ ID NO: 4786416 - DNA, 19 bp, Homo sapiens
gaccctgccaactttccag

SEQ ID NO: 4786417 - DNA, 23 bp, Homo sapiens
gaccctgccaactttccagactt

SEQ ID NO: 4786418 - DNA, 17 bp, Homo sapiens
gaccctgcgcccctgcc

SEQ ID NO: 4786419 - DNA, 12 bp, Homo sapiens
gaccctgtgccc

SEQ ID NO: 4786420 - DNA, 14 bp, Homo sapiens
gaccctgtgccccg

SEQ ID NO: 4786421 - DNA, 12 bp, Homo sapiens
gaccctgtgcct

SEQ ID NO: 4786422 - DNA, 14 bp, Homo sapiens
gaccctgtgcctgt

SEQ ID NO: 4786423 - DNA, 20 bp, Homo sapiens
gacccttccagacatacgaa

SEQ ID NO: 4786424 - DNA, 21 bp, Homo sapiens
gacccttcccaatcagcactg

SEQ ID NO: 4786425 - DNA, 14 bp, Homo sapiens
gaccgacgcccctc

SEQ ID NO: 4786426 - DNA, 16 bp, Homo sapiens
gaccgacgcccctccg

SEQ ID NO: 4786427 - DNA, 17 bp, Homo sapiens
gaccgacgcccctccgg

SEQ ID NO: 4786428 - DNA, 15 bp, Homo sapiens
gaccggggtggagtc

SEQ ID NO: 4786429 - DNA, 16 bp, Homo sapiens
gaccgtgaggccagag

SEQ ID NO: 4786430 - DNA, 18 bp, Homo sapiens
gaccgtgaggccagagac

SEQ ID NO: 4786431 - DNA, 13 bp, Homo sapiens
gaccgtggccctg

SEQ ID NO: 4786432 - DNA, 18 bp, Homo sapiens
gacctaaacagctgcttt

SEQ ID NO: 4786433 - DNA, 16 bp, Homo sapiens
gacctcacagtgaccc

SEQ ID NO: 4786434 - DNA, 11 bp, Homo sapiens
gacctcaggcc

SEQ ID NO: 4786435 - DNA, 13 bp, Homo sapiens
gacctcaggcctg

SEQ ID NO: 4786436 - DNA, 13 bp, Homo sapiens
gacctcccccagg

SEQ ID NO: 4786437 - DNA, 17 bp, Homo sapiens
gacctcccccagggagg

SEQ ID NO: 4786438 - DNA, 14 bp, Homo sapiens
gacctcctgatgtc

SEQ ID NO: 4786439 - DNA, 17 bp, Homo sapiens
gacctcctgatgtcttg

SEQ ID NO: 4786440 - DNA, 22 bp, Homo sapiens
gacctcggctgtgtggggaggg

SEQ ID NO: 4786441 - DNA, 18 bp, Homo sapiens
gacctctactttccaggc

SEQ ID NO: 4786442 - DNA, 21 bp, Homo sapiens
gacctctactttccaggctag

SEQ ID NO: 4786443 - DNA, 11 bp, Homo sapiens
gacctgacacc

SEQ ID NO: 4786444 - DNA, 16 bp, Homo sapiens
gacctgacacctgccg

SEQ ID NO: 4786445 - DNA, 21 bp, Homo sapiens
gacctgacacctgccgctgct

SEQ ID NO: 4786446 - DNA, 21 bp, Homo sapiens
gacctgccgcctgggaatcag

SEQ ID NO: 4786447 - DNA, 16 bp, Homo sapiens
gacctgcttcattcaa

SEQ ID NO: 4786448 - DNA, 16 bp, Homo sapiens
gacctggcccagtgca

SEQ ID NO: 4786449 - DNA, 21 bp, Homo sapiens
gacctggcccagtgcaatctg

SEQ ID NO: 4786450 - DNA, 16 bp, Homo sapiens
gaccttacaaccacat

SEQ ID NO: 4786451 - DNA, 22 bp, Homo sapiens
gaccttacaaccacatttctgg

SEQ ID NO: 4786452 - DNA, 18 bp, Homo sapiens
gaccttcctctggggctc

SEQ ID NO: 4786453 - DNA, 15 bp, Homo sapiens
gaccttctgaagatc

SEQ ID NO: 4786454 - DNA, 16 bp, Homo sapiens
gaccttgaaaagcagt

SEQ ID NO: 4786455 - DNA, 13 bp, Homo sapiens
gaccttgcttcct

SEQ ID NO: 4786456 - DNA, 16 bp, Homo sapiens
gaccttggagagacac

SEQ ID NO: 4786457 - DNA, 20 bp, Homo sapiens
gacctttttaatccaggccc

SEQ ID NO: 4786458 - DNA, 13 bp, Homo sapiens
gacgacccggggc

SEQ ID NO: 4786459 - DNA, 18 bp, Homo sapiens
gacgactttctttaacat

SEQ ID NO: 4786460 - DNA, 14 bp, Homo sapiens
gacgagtgagctac

SEQ ID NO: 4786461 - DNA, 20 bp, Homo sapiens
gacgagtgagctaccaggaa

SEQ ID NO: 4786462 - DNA, 12 bp, Homo sapiens
gacgcatgcagg

SEQ ID NO: 4786463 - DNA, 13 bp, Homo sapiens
gacgcatgcaggg

SEQ ID NO: 4786464 - DNA, 11 bp, Homo sapiens
gacgcccagcc

SEQ ID NO: 4786465 - DNA, 16 bp, Homo sapiens
gacgcccctccgggca

SEQ ID NO: 4786466 - DNA, 15 bp, Homo sapiens
gacggacgggacagc

SEQ ID NO: 4786467 - DNA, 13 bp, Homo sapiens
gacggcagcccca

SEQ ID NO: 4786468 - DNA, 16 bp, Homo sapiens
gacggcagccccatcc

SEQ ID NO: 4786469 - DNA, 11 bp, Homo sapiens
gacggccctgc

SEQ ID NO: 4786470 - DNA, 12 bp, Homo sapiens
gacggccctgca

SEQ ID NO: 4786471 - DNA, 12 bp, Homo sapiens
gacgggacagcg

SEQ ID NO: 4786472 - DNA, 22 bp, Homo sapiens
gacgggacagcggcccggccca

SEQ ID NO: 4786473 - DNA, 18 bp, Homo sapiens
gacggggcccgccccagg

SEQ ID NO: 4786474 - DNA, 16 bp, Homo sapiens
gacgggggctgcttct

SEQ ID NO: 4786475 - DNA, 17 bp, Homo sapiens
gacgggggctgcttctc

SEQ ID NO: 4786476 - DNA, 21 bp, Homo sapiens
gacggtattatgcttcttgga

SEQ ID NO: 4786477 - DNA, 22 bp, Homo sapiens
gacgtcatcggaggctgggccc

SEQ ID NO: 4786478 - DNA, 22 bp, Homo sapiens
gacgtcgctgtccgtcctgctc

SEQ ID NO: 4786479 - DNA, 21 bp, Homo sapiens
gacgtgcacaaaccttctttt

SEQ ID NO: 4786480 - DNA, 12 bp, Homo sapiens
gacgtgtgtggt

SEQ ID NO: 4786481 - DNA, 15 bp, Homo sapiens
gacgtgttatgactc

SEQ ID NO: 4786482 - DNA, 19 bp, Homo sapiens
gacgtttttgtgctgtggg

SEQ ID NO: 4786483 - DNA, 21 bp, Homo sapiens
gacgtttttgtgctgtgggca

SEQ ID NO: 4786484 - DNA, 18 bp, Homo sapiens
gactaagaaatgccagtg

SEQ ID NO: 4786485 - DNA, 16 bp, Homo sapiens
gactaatccttaataa

SEQ ID NO: 4786486 - DNA, 15 bp, Homo sapiens
gactacctataaatg

SEQ ID NO: 4786487 - DNA, 19 bp, Homo sapiens
gactatgtgtcatgatttc

SEQ ID NO: 4786488 - DNA, 16 bp, Homo sapiens
gactccaagccctggg

SEQ ID NO: 4786489 - DNA, 20 bp, Homo sapiens
gactccaagccctggggcag

SEQ ID NO: 4786490 - DNA, 17 bp, Homo sapiens
gactccagaagcagcag

SEQ ID NO: 4786491 - DNA, 13 bp, Homo sapiens
gactccaggggct

SEQ ID NO: 4786492 - DNA, 18 bp, Homo sapiens
gactccaggggctgggga

SEQ ID NO: 4786493 - DNA, 15 bp, Homo sapiens
gactcgagagggctg

SEQ ID NO: 4786494 - DNA, 16 bp, Homo sapiens
gactcgagagggctga

SEQ ID NO: 4786495 - DNA, 17 bp, Homo sapiens
gactcgagagggctgag

SEQ ID NO: 4786496 - DNA, 18 bp, Homo sapiens
gactcgagagggctgagc

SEQ ID NO: 4786497 - DNA, 13 bp, Homo sapiens
gaaaatgctttct

SEQ ID NO: 4786498 - DNA, 14 bp, Homo sapiens
gaaaatgctttctc

SEQ ID NO: 4786499 - DNA, 19 bp, Homo sapiens
gaaaatggaagtggcaata

SEQ ID NO: 4786500 - DNA, 20 bp, Homo sapiens
gaaaatggctgaagaaacac

SEQ ID NO: 4786501 - DNA, 16 bp, Homo sapiens
gaaacaaaatataaat

SEQ ID NO: 4786502 - DNA, 22 bp, Homo sapiens
gaaacaaatatactcatttgga

SEQ ID NO: 4786503 - DNA, 14 bp, Homo sapiens
gaaacaatttctgt

SEQ ID NO: 4786504 - DNA, 19 bp, Homo sapiens
gaaacacacagtgaccaag

SEQ ID NO: 4786505 - DNA, 15 bp, Homo sapiens
gaaacacagcatgca

SEQ ID NO: 4786506 - DNA, 23 bp, Homo sapiens
gaaacacggagtttccatttgga

SEQ ID NO: 4786507 - DNA, 19 bp, Homo sapiens
gaaacactcgtgtgcatga

SEQ ID NO: 4786508 - DNA, 14 bp, Homo sapiens
gaaacagtttaaca

SEQ ID NO: 4786509 - DNA, 16 bp, Homo sapiens
gaaacagtttaacaga

SEQ ID NO: 4786510 - DNA, 16 bp, Homo sapiens
gaaacatgacactgac

SEQ ID NO: 4786511 - DNA, 17 bp, Homo sapiens
gaaacatgacactgacc

SEQ ID NO: 4786512 - DNA, 21 bp, Homo sapiens
gaaaccctgcacccattagca

SEQ ID NO: 4786513 - DNA, 17 bp, Homo sapiens
gaaacccttgactgtta

SEQ ID NO: 4786514 - DNA, 20 bp, Homo sapiens
gaaacccttgactgttatct

SEQ ID NO: 4786515 - DNA, 12 bp, Homo sapiens
gaaactgtattt

SEQ ID NO: 4786516 - DNA, 16 bp, Homo sapiens
gaaagaacggaagaag

SEQ ID NO: 4786517 - DNA, 16 bp, Homo sapiens
gaaagaattagccaac

SEQ ID NO: 4786518 - DNA, 15 bp, Homo sapiens
gaaagaccctaggtg

SEQ ID NO: 4786519 - DNA, 22 bp, Homo sapiens
gaaagcagcacacattgtgtta

SEQ ID NO: 4786520 - DNA, 11 bp, Homo sapiens
gaaagccaggt

SEQ ID NO: 4786521 - DNA, 15 bp, Homo sapiens
gaaaggaaacctttt

SEQ ID NO: 4786522 - DNA, 20 bp, Homo sapiens
gaaaggaggcatgcctctga

SEQ ID NO: 4786523 - DNA, 20 bp, Homo sapiens
gaaaggcagagattgggggg

SEQ ID NO: 4786524 - DNA, 16 bp, Homo sapiens
gaaaggcagggccctg

SEQ ID NO: 4786525 - DNA, 17 bp, Homo sapiens
gaaaggcagggccctga

SEQ ID NO: 4786526 - DNA, 11 bp, Homo sapiens
gaaaggcatct

SEQ ID NO: 4786527 - DNA, 23 bp, Homo sapiens
gaaaggcatctaagacattcacc

SEQ ID NO: 4786528 - DNA, 17 bp, Homo sapiens
gaaagggcagcccctcc

SEQ ID NO: 4786529 - DNA, 13 bp, Homo sapiens
gaaagttctatta

SEQ ID NO: 4786530 - DNA, 23 bp, Homo sapiens
gaaagttttgatacttgtaactt

SEQ ID NO: 4786531 - DNA, 22 bp, Homo sapiens
gaaataaaccttaatatttctt

SEQ ID NO: 4786532 - DNA, 20 bp, Homo sapiens
gaaataacagccttaaatcc

SEQ ID NO: 4786533 - DNA, 23 bp, Homo sapiens
gaaatacagctaaggccttgcca

SEQ ID NO: 4786534 - DNA, 16 bp, Homo sapiens
gaaatataaaaataat

SEQ ID NO: 4786535 - DNA, 19 bp, Homo sapiens
gaaatataaaaataattaa

SEQ ID NO: 4786536 - DNA, 14 bp, Homo sapiens
gaaatataaactgt

SEQ ID NO: 4786537 - DNA, 16 bp, Homo sapiens
gaaatataaactgtga

SEQ ID NO: 4786538 - DNA, 21 bp, Homo sapiens
gaaatatcatcacgtatgtta

SEQ ID NO: 4786539 - DNA, 20 bp, Homo sapiens
gaaatatctgtgaaatatca

SEQ ID NO: 4786540 - DNA, 19 bp, Homo sapiens
gaaatattttctactttaa

SEQ ID NO: 4786541 - DNA, 13 bp, Homo sapiens
gaaatcctgttac

SEQ ID NO: 4786542 - DNA, 20 bp, Homo sapiens
gaaatctaagtttcgagaga

SEQ ID NO: 4786543 - DNA, 19 bp, Homo sapiens
gaaatctgaagccttttcc

SEQ ID NO: 4786544 - DNA, 21 bp, Homo sapiens
gaaatgaaaatggctgaagaa

SEQ ID NO: 4786545 - DNA, 22 bp, Homo sapiens
gaaatgaaaatggctgaagaaa

SEQ ID NO: 4786546 - DNA, 21 bp, Homo sapiens
gaaatgattgagagcagcctc

SEQ ID NO: 4786547 - DNA, 18 bp, Homo sapiens
gaaatgccaagactctat

SEQ ID NO: 4786548 - DNA, 16 bp, Homo sapiens
gaaatggcctgtccct

SEQ ID NO: 4786549 - DNA, 21 bp, Homo sapiens
gaaatggggaactcccccaga

SEQ ID NO: 4786550 - DNA, 16 bp, Homo sapiens
gaaatgtgctgcaaag

SEQ ID NO: 4786551 - DNA, 17 bp, Homo sapiens
gaaattagtgttttcat

SEQ ID NO: 4786552 - DNA, 19 bp, Homo sapiens
gaaattatatctgtggtct

SEQ ID NO: 4786553 - DNA, 13 bp, Homo sapiens
gaaattatgtcaa

SEQ ID NO: 4786554 - DNA, 21 bp, Homo sapiens
gaaattatgtcaaatggatgt

SEQ ID NO: 4786555 - DNA, 12 bp, Homo sapiens
gaaattctataa

SEQ ID NO: 4786556 - DNA, 17 bp, Homo sapiens
gaaattctataagagac

SEQ ID NO: 4786557 - DNA, 17 bp, Homo sapiens
gaaattcttgcactgta

SEQ ID NO: 4786558 - DNA, 18 bp, Homo sapiens
gaaattcttgttatggta

SEQ ID NO: 4786559 - DNA, 22 bp, Homo sapiens
gaaattcttgttatggtagaaa

SEQ ID NO: 4786560 - DNA, 14 bp, Homo sapiens
gaaattgtgccaaa

SEQ ID NO: 4786561 - DNA, 17 bp, Homo sapiens
gaaattgtgccaaagat

SEQ ID NO: 4786562 - DNA, 20 bp, Homo sapiens
gaaattgtgccaaagatagc

SEQ ID NO: 4786563 - DNA, 24 bp, Homo sapiens
gaaatttcaaagtatgtttcatta

SEQ ID NO: 4786564 - DNA, 14 bp, Homo sapiens
gaaatttgtgtgct

SEQ ID NO: 4786565 - DNA, 12 bp, Homo sapiens
gaacaaagacaa

SEQ ID NO: 4786566 - DNA, 13 bp, Homo sapiens
gaacaaagacaac

SEQ ID NO: 4786567 - DNA, 17 bp, Homo sapiens
gaacaaattttcacaat

SEQ ID NO: 4786568 - DNA, 22 bp, Homo sapiens
gaacaacaacaaagcatgctca

SEQ ID NO: 4786569 - DNA, 13 bp, Homo sapiens
gaacaactcgaat

SEQ ID NO: 4786570 - DNA, 17 bp, Homo sapiens
gaacaaggcaaggctgt

SEQ ID NO: 4786571 - DNA, 17 bp, Homo sapiens
gaacactcatcccccat

SEQ ID NO: 4786572 - DNA, 18 bp, Homo sapiens
gaacactgcaccctccac

SEQ ID NO: 4786573 - DNA, 22 bp, Homo sapiens
gaacactgcaccctccacagga

SEQ ID NO: 4786574 - DNA, 13 bp, Homo sapiens
gaacagagtatat

SEQ ID NO: 4786575 - DNA, 14 bp, Homo sapiens
gaacagccctgcac

SEQ ID NO: 4786576 - DNA, 15 bp, Homo sapiens
gaacagccctgcacg

SEQ ID NO: 4786577 - DNA, 19 bp, Homo sapiens
gaacagctaacaataaagt

SEQ ID NO: 4786578 - DNA, 19 bp, Homo sapiens
gaacaggagtgactctggc

SEQ ID NO: 4786579 - DNA, 17 bp, Homo sapiens
gaacatggaattttata

SEQ ID NO: 4786580 - DNA, 20 bp, Homo sapiens
gaacatggcatgtgaaaagt

SEQ ID NO: 4786581 - DNA, 14 bp, Homo sapiens
gaacatggccaata

SEQ ID NO: 4786582 - DNA, 18 bp, Homo sapiens
gaacatttgggagactga

SEQ ID NO: 4786583 - DNA, 21 bp, Homo sapiens
gaaccaagctataaaagccca

SEQ ID NO: 4786584 - DNA, 13 bp, Homo sapiens
gaaccagcactcc

SEQ ID NO: 4786585 - DNA, 14 bp, Homo sapiens
gaaccagcactccc

SEQ ID NO: 4786586 - DNA, 18 bp, Homo sapiens
gaaccagcactcccaggg

SEQ ID NO: 4786587 - DNA, 18 bp, Homo sapiens
gaaccaggaggcctggga

SEQ ID NO: 4786588 - DNA, 21 bp, Homo sapiens
gaaccatggaggaggaagacc

SEQ ID NO: 4786589 - DNA, 15 bp, Homo sapiens
gaacccatcactgtg

SEQ ID NO: 4786590 - DNA, 16 bp, Homo sapiens
gaacccatcactgtgt

SEQ ID NO: 4786591 - DNA, 13 bp, Homo sapiens
gaaccgtcaatgt

SEQ ID NO: 4786592 - DNA, 18 bp, Homo sapiens
gaaccttttgagtgcctt

SEQ ID NO: 4786593 - DNA, 22 bp, Homo sapiens
gaaccttttgagtgccttacac

SEQ ID NO: 4786594 - DNA, 16 bp, Homo sapiens
gaacgatccttcaaag

SEQ ID NO: 4786595 - DNA, 19 bp, Homo sapiens
ctgtgtgtgacaccaccac

SEQ ID NO: 4786596 - DNA, 20 bp, Homo sapiens
ctgtgtgtgacaccaccact

SEQ ID NO: 4786597 - DNA, 16 bp, Homo sapiens
ctgtgtgtgagtgtga

SEQ ID NO: 4786598 - DNA, 13 bp, Homo sapiens
ctgtgttctcaac

SEQ ID NO: 4786599 - DNA, 21 bp, Homo sapiens
ctgtgttctcaacacacagta

SEQ ID NO: 4786600 - DNA, 21 bp, Homo sapiens
ctgtgtttcatgttctgtgtc

SEQ ID NO: 4786601 - DNA, 17 bp, Homo sapiens
ctgttaacccagtgttc

SEQ ID NO: 4786602 - DNA, 19 bp, Homo sapiens
ctgttaacttattcaaaga

SEQ ID NO: 4786603 - DNA, 21 bp, Homo sapiens
ctgttacctcaacaagaagaa

SEQ ID NO: 4786604 - DNA, 22 bp, Homo sapiens
ctgttacctcaacaagaagaat

SEQ ID NO: 4786605 - DNA, 15 bp, Homo sapiens
ctgttacttaaatag

SEQ ID NO: 4786606 - DNA, 17 bp, Homo sapiens
ctgttagctcagaggag

SEQ ID NO: 4786607 - DNA, 14 bp, Homo sapiens
ctgttatctgtctt

SEQ ID NO: 4786608 - DNA, 20 bp, Homo sapiens
ctgttatctgtctttatgat

SEQ ID NO: 4786609 - DNA, 20 bp, Homo sapiens
ctgttcacgtgactcctcaa

SEQ ID NO: 4786610 - DNA, 12 bp, Homo sapiens
ctgttcattgta

SEQ ID NO: 4786611 - DNA, 13 bp, Homo sapiens
ctgttcattgtaa

SEQ ID NO: 4786612 - DNA, 10 bp, Homo sapiens
ctgttccaag

SEQ ID NO: 4786613 - DNA, 19 bp, Homo sapiens
ctgttccaagtgtgtgtgc

SEQ ID NO: 4786614 - DNA, 17 bp, Homo sapiens
ctgttccacttctctag

SEQ ID NO: 4786615 - DNA, 12 bp, Homo sapiens
ctgttccctgct

SEQ ID NO: 4786616 - DNA, 15 bp, Homo sapiens
ctgttccgcctcact

SEQ ID NO: 4786617 - DNA, 16 bp, Homo sapiens
ctgttcctgactgttc

SEQ ID NO: 4786618 - DNA, 18 bp, Homo sapiens
ctgttcctgactgttctc

SEQ ID NO: 4786619 - DNA, 23 bp, Homo sapiens
ctgttcctgactgttctcttact

SEQ ID NO: 4786620 - DNA, 14 bp, Homo sapiens
ctgttctcaaatgc

SEQ ID NO: 4786621 - DNA, 13 bp, Homo sapiens
ctgttctgcactg

SEQ ID NO: 4786622 - DNA, 17 bp, Homo sapiens
ctgttctgcactgaaaa

SEQ ID NO: 4786623 - DNA, 22 bp, Homo sapiens
ctgttctttttgactgattgtt

SEQ ID NO: 4786624 - DNA, 14 bp, Homo sapiens
ctgttgaagtgcat

SEQ ID NO: 4786625 - DNA, 19 bp, Homo sapiens
ctgttgattaatttctgcc

SEQ ID NO: 4786626 - DNA, 15 bp, Homo sapiens
ctgttgattctttca

SEQ ID NO: 4786627 - DNA, 23 bp, Homo sapiens
ctgttgattctttcaatccacag

SEQ ID NO: 4786628 - DNA, 20 bp, Homo sapiens
ctgttggctgattggaaaat

SEQ ID NO: 4786629 - DNA, 17 bp, Homo sapiens
ctgttgggccaggagcc

SEQ ID NO: 4786630 - DNA, 20 bp, Homo sapiens
ctgttgggccaggagcctcc

SEQ ID NO: 4786631 - DNA, 18 bp, Homo sapiens
ctgttggtcttaactaat

SEQ ID NO: 4786632 - DNA, 21 bp, Homo sapiens
ctgttgtaatatcagttacag

SEQ ID NO: 4786633 - DNA, 22 bp, Homo sapiens
ctgtttaacgtgaggtttcagt

SEQ ID NO: 4786634 - DNA, 17 bp, Homo sapiens
ctgtttaccctccctgt

SEQ ID NO: 4786635 - DNA, 22 bp, Homo sapiens
ctgtttaccctccctgtcccct

SEQ ID NO: 4786636 - DNA, 16 bp, Homo sapiens
ctgtttaccgcccacc

SEQ ID NO: 4786637 - DNA, 19 bp, Homo sapiens
ctgtttaccgcccacccag

SEQ ID NO: 4786638 - DNA, 20 bp, Homo sapiens
cttcataggcagagcccgcc

SEQ ID NO: 4786639 - DNA, 14 bp, Homo sapiens
cttcatccatagac

SEQ ID NO: 4786640 - DNA, 14 bp, Homo sapiens
cttcatcccagggt

SEQ ID NO: 4786641 - DNA, 14 bp, Homo sapiens
cttcatccctttcc

SEQ ID NO: 4786642 - DNA, 19 bp, Homo sapiens
cttcatctggagtccctcc

SEQ ID NO: 4786643 - DNA, 15 bp, Homo sapiens
cttcatgaccttaca

SEQ ID NO: 4786644 - DNA, 14 bp, Homo sapiens
cttcatgctgtctg

SEQ ID NO: 4786645 - DNA, 19 bp, Homo sapiens
cttcatgctgtctgtgtga

SEQ ID NO: 4786646 - DNA, 22 bp, Homo sapiens
cttcatgcttgatttgaccact

SEQ ID NO: 4786647 - DNA, 16 bp, Homo sapiens
cttcatgcttttctca

SEQ ID NO: 4786648 - DNA, 20 bp, Homo sapiens
cttcatgcttttctcatggt

SEQ ID NO: 4786649 - DNA, 14 bp, Homo sapiens
cttcattaaaacaa

SEQ ID NO: 4786650 - DNA, 21 bp, Homo sapiens
cttcattaaaacaagagacca

SEQ ID NO: 4786651 - DNA, 14 bp, Homo sapiens
cttcattcaagctt

SEQ ID NO: 4786652 - DNA, 20 bp, Homo sapiens
cttcattgggaagtatgatt

SEQ ID NO: 4786653 - DNA, 12 bp, Homo sapiens
cttcatttaaaa

SEQ ID NO: 4786654 - DNA, 14 bp, Homo sapiens
cttccacaagagcc

SEQ ID NO: 4786655 - DNA, 23 bp, Homo sapiens
cttccacaagagcccaggcctcc

SEQ ID NO: 4786656 - DNA, 17 bp, Homo sapiens
cttccaccctgccctgg

SEQ ID NO: 4786657 - DNA, 19 bp, Homo sapiens
cttccactgcctctgcctt

SEQ ID NO: 4786658 - DNA, 23 bp, Homo sapiens
cttccagatttgagctgcctgga

SEQ ID NO: 4786659 - DNA, 12 bp, Homo sapiens
cttccagctcag

SEQ ID NO: 4786660 - DNA, 20 bp, Homo sapiens
cttccagctcagtcccacag

SEQ ID NO: 4786661 - DNA, 21 bp, Homo sapiens
cttccagctcagtcccacagc

SEQ ID NO: 4786662 - DNA, 22 bp, Homo sapiens
cttccagctcagtcccacagcc

SEQ ID NO: 4786663 - DNA, 23 bp, Homo sapiens
cttccagctcagtcccacagccc

SEQ ID NO: 4786664 - DNA, 16 bp, Homo sapiens
cttccagctttctctt

SEQ ID NO: 4786665 - DNA, 20 bp, Homo sapiens
cttccaggttccatccacca

SEQ ID NO: 4786666 - DNA, 13 bp, Homo sapiens
cttccatggtggt

SEQ ID NO: 4786667 - DNA, 20 bp, Homo sapiens
cttccatggtggtttcagaa

SEQ ID NO: 4786668 - DNA, 19 bp, Homo sapiens
cttcccaacaatactttgt

SEQ ID NO: 4786669 - DNA, 16 bp, Homo sapiens
cttcccaaggcagctg

SEQ ID NO: 4786670 - DNA, 16 bp, Homo sapiens
cttcccaagtcctcgc

SEQ ID NO: 4786671 - DNA, 19 bp, Homo sapiens
cttcccaagtcctcgcccc

SEQ ID NO: 4786672 - DNA, 21 bp, Homo sapiens
cttcccaagtcctcgcccccc

SEQ ID NO: 4786673 - DNA, 15 bp, Homo sapiens
cttcccaatcagcac

SEQ ID NO: 4786674 - DNA, 18 bp, Homo sapiens
cttcccaatcagcactga

SEQ ID NO: 4786675 - DNA, 21 bp, Homo sapiens
cttcccaatcagcactgaaaa

SEQ ID NO: 4786676 - DNA, 22 bp, Homo sapiens
cttcccaatcagcactgaaaat

SEQ ID NO: 4786677 - DNA, 13 bp, Homo sapiens
cttcccaccccta

SEQ ID NO: 4786678 - DNA, 17 bp, Homo sapiens
cttcccacctgtcaacc

SEQ ID NO: 4786679 - DNA, 21 bp, Homo sapiens
cttcccagctggcagcgcctc

SEQ ID NO: 4786680 - DNA, 15 bp, Homo sapiens
cttcccatctgaaga

SEQ ID NO: 4786681 - DNA, 20 bp, Homo sapiens
cttcccatctgaagagtgga

SEQ ID NO: 4786682 - DNA, 14 bp, Homo sapiens
cttcccatttgtaa

SEQ ID NO: 4786683 - DNA, 17 bp, Homo sapiens
cttccccaaggcactga

SEQ ID NO: 4786684 - DNA, 19 bp, Homo sapiens
cttccccaaggcactgagc

SEQ ID NO: 4786685 - DNA, 18 bp, Homo sapiens
cttccccacaataggctt

SEQ ID NO: 4786686 - DNA, 13 bp, Homo sapiens
cttcccccttccc

SEQ ID NO: 4786687 - DNA, 20 bp, Homo sapiens
cttcccccttcccctgcgcc

SEQ ID NO: 4786688 - DNA, 19 bp, Homo sapiens
cttccccgtgcggcccgtg

SEQ ID NO: 4786689 - DNA, 20 bp, Homo sapiens
cttcccctgaggacctttct

SEQ ID NO: 4786690 - DNA, 18 bp, Homo sapiens
cttccccttctgtgtcac

SEQ ID NO: 4786691 - DNA, 13 bp, Homo sapiens
cttcccgcagcac

SEQ ID NO: 4786692 - DNA, 17 bp, Homo sapiens
cttcccgtctgattgtt

SEQ ID NO: 4786693 - DNA, 18 bp, Homo sapiens
cttccctctcgctcccct

SEQ ID NO: 4786694 - DNA, 21 bp, Homo sapiens
cttccctgcaaggtgcacctg

SEQ ID NO: 4786695 - DNA, 16 bp, Homo sapiens
cttcccttccactgcc

SEQ ID NO: 4786696 - DNA, 19 bp, Homo sapiens
cttccgagattcagactgc

SEQ ID NO: 4786697 - DNA, 22 bp, Homo sapiens
cttccgagattcagactgcttc

SEQ ID NO: 4786698 - DNA, 22 bp, Homo sapiens
cttcctaccaaatataaacttg

SEQ ID NO: 4786699 - DNA, 20 bp, Homo sapiens
cttcctataccggagctcca

SEQ ID NO: 4786700 - DNA, 13 bp, Homo sapiens
cttcctcctctca

SEQ ID NO: 4786701 - DNA, 18 bp, Homo sapiens
cttcctgaactcccagtc

SEQ ID NO: 4786702 - DNA, 17 bp, Homo sapiens
cttcctgggcagcccag

SEQ ID NO: 4786703 - DNA, 19 bp, Homo sapiens
cttcctgggcagcccagag

SEQ ID NO: 4786704 - DNA, 20 bp, Homo sapiens
cttcctgggcagcccagaga

SEQ ID NO: 4786705 - DNA, 21 bp, Homo sapiens
cttcctgggcagcccagagag

SEQ ID NO: 4786706 - DNA, 15 bp, Homo sapiens
cttcctgtcctgctc

SEQ ID NO: 4786707 - DNA, 10 bp, Homo sapiens
cttccttaac

SEQ ID NO: 4786708 - DNA, 13 bp, Homo sapiens
cttccttaacagc

SEQ ID NO: 4786709 - DNA, 16 bp, Homo sapiens
cttccttaacagctgt

SEQ ID NO: 4786710 - DNA, 20 bp, Homo sapiens
cttccttaacagctgtatta

SEQ ID NO: 4786711 - DNA, 17 bp, Homo sapiens
cttccttcacccaccac

SEQ ID NO: 4786712 - DNA, 19 bp, Homo sapiens
cttccttctcatcttgcct

SEQ ID NO: 4786713 - DNA, 17 bp, Homo sapiens
cttccttgaccttcctc

SEQ ID NO: 4786714 - DNA, 18 bp, Homo sapiens
cttccttgaccttcctct

SEQ ID NO: 4786715 - DNA, 15 bp, Homo sapiens
cttcgctattcccag

SEQ ID NO: 4786716 - DNA, 16 bp, Homo sapiens
cttcgctattcccagg

SEQ ID NO: 4786717 - DNA, 18 bp, Homo sapiens
cttcgctattcccaggca

SEQ ID NO: 4786718 - DNA, 16 bp, Homo sapiens
cttcggtggccttgag

SEQ ID NO: 4786719 - DNA, 14 bp, Homo sapiens
cttctaacacctct

SEQ ID NO: 4786720 - DNA, 22 bp, Homo sapiens
cttctaagggatccagagacct

SEQ ID NO: 4786721 - DNA, 17 bp, Homo sapiens
cttctaggggcaggtga

SEQ ID NO: 4786722 - DNA, 16 bp, Homo sapiens
cttctagtggccttag

SEQ ID NO: 4786723 - DNA, 20 bp, Homo sapiens
ctgggagccagagcctctgt

SEQ ID NO: 4786724 - DNA, 16 bp, Homo sapiens
ctgggatgggaccagg

SEQ ID NO: 4786725 - DNA, 17 bp, Homo sapiens
ctgggatgggaccaggg

SEQ ID NO: 4786726 - DNA, 20 bp, Homo sapiens
ctgggatgggaccagggatg

SEQ ID NO: 4786727 - DNA, 12 bp, Homo sapiens
ctgggcagaagg

SEQ ID NO: 4786728 - DNA, 15 bp, Homo sapiens
ctgggcagaaggaag

SEQ ID NO: 4786729 - DNA, 12 bp, Homo sapiens
ctgggcagagga

SEQ ID NO: 4786730 - DNA, 14 bp, Homo sapiens
ctgggcagcccaga

SEQ ID NO: 4786731 - DNA, 15 bp, Homo sapiens
ctgggcagcccagag

SEQ ID NO: 4786732 - DNA, 12 bp, Homo sapiens
ctgggcagggcc

SEQ ID NO: 4786733 - DNA, 15 bp, Homo sapiens
ctgggcagggccgca

SEQ ID NO: 4786734 - DNA, 22 bp, Homo sapiens
ctgggcatggtaccagccctgg

SEQ ID NO: 4786735 - DNA, 18 bp, Homo sapiens
ctgggccccccagctcag

SEQ ID NO: 4786736 - DNA, 19 bp, Homo sapiens
ctgggccccccagctcagg

SEQ ID NO: 4786737 - DNA, 15 bp, Homo sapiens
ctgggcccctccacg

SEQ ID NO: 4786738 - DNA, 21 bp, Homo sapiens
ctgggcccctccacgcctcct

SEQ ID NO: 4786739 - DNA, 22 bp, Homo sapiens
ctgggcccctccacgcctcctg

SEQ ID NO: 4786740 - DNA, 23 bp, Homo sapiens
ctgggccctaggcatactctcca

SEQ ID NO: 4786741 - DNA, 21 bp, Homo sapiens
ctgggcctcagttcaacctgg

SEQ ID NO: 4786742 - DNA, 11 bp, Homo sapiens
ctgggcctgct

SEQ ID NO: 4786743 - DNA, 12 bp, Homo sapiens
ctgggcctgggc

SEQ ID NO: 4786744 - DNA, 18 bp, Homo sapiens
ctgggcgccggttccacg

SEQ ID NO: 4786745 - DNA, 16 bp, Homo sapiens
ctgggcgcctctgtcc

SEQ ID NO: 4786746 - DNA, 15 bp, Homo sapiens
ctgggctaggggaca

SEQ ID NO: 4786747 - DNA, 13 bp, Homo sapiens
ctgggctgtctgt

SEQ ID NO: 4786748 - DNA, 13 bp, Homo sapiens
ctgggctgtgagg

SEQ ID NO: 4786749 - DNA, 14 bp, Homo sapiens
ctggggaggacccc

SEQ ID NO: 4786750 - DNA, 15 bp, Homo sapiens
ctggggaggacccct

SEQ ID NO: 4786751 - DNA, 21 bp, Homo sapiens
ctggggaggacccctgccctc

SEQ ID NO: 4786752 - DNA, 15 bp, Homo sapiens
ctggggaggcctgcc

SEQ ID NO: 4786753 - DNA, 19 bp, Homo sapiens
ctggggagggacacagagg

SEQ ID NO: 4786754 - DNA, 21 bp, Homo sapiens
ctggggagggacacagaggac

SEQ ID NO: 4786755 - DNA, 13 bp, Homo sapiens
ctggggccctggg

SEQ ID NO: 4786756 - DNA, 19 bp, Homo sapiens
ctggggccctgggcctcag

SEQ ID NO: 4786757 - DNA, 13 bp, Homo sapiens
ctggggcctggca

SEQ ID NO: 4786758 - DNA, 11 bp, Homo sapiens
ctggggctgca

SEQ ID NO: 4786759 - DNA, 12 bp, Homo sapiens
ctggggctgggc

SEQ ID NO: 4786760 - DNA, 23 bp, Homo sapiens
ctgggggaggcttccagctcagt

SEQ ID NO: 4786761 - DNA, 16 bp, Homo sapiens
ctggggggcacagcca

SEQ ID NO: 4786762 - DNA, 16 bp, Homo sapiens
ctggggggcaggcctc

SEQ ID NO: 4786763 - DNA, 21 bp, Homo sapiens
ctggggggcaggcctcccaag

SEQ ID NO: 4786764 - DNA, 22 bp, Homo sapiens
ctggggggcaggcctcccaagc

SEQ ID NO: 4786765 - DNA, 16 bp, Homo sapiens
ctggggggctgtcctg

SEQ ID NO: 4786766 - DNA, 19 bp, Homo sapiens
ctggggggggcaagagctc

SEQ ID NO: 4786767 - DNA, 13 bp, Homo sapiens
ctgggggtggcag

SEQ ID NO: 4786768 - DNA, 18 bp, Homo sapiens
ctggggtctctgagcagt

SEQ ID NO: 4786769 - DNA, 23 bp, Homo sapiens
ctggggtctctgagcagtgggga

SEQ ID NO: 4786770 - DNA, 13 bp, Homo sapiens
ctggggtctgtga

SEQ ID NO: 4786771 - DNA, 21 bp, Homo sapiens
ctggggtggggacctcaggcc

SEQ ID NO: 4786772 - DNA, 20 bp, Homo sapiens
ctggggtggttggaggcctg

SEQ ID NO: 4786773 - DNA, 22 bp, Homo sapiens
ctggggtggttggaggcctggt

SEQ ID NO: 4786774 - DNA, 18 bp, Homo sapiens
ctctttgaaaattcttgt

SEQ ID NO: 4786775 - DNA, 13 bp, Homo sapiens
ctctttggctatt

SEQ ID NO: 4786776 - DNA, 16 bp, Homo sapiens
ctctttggctattgtc

SEQ ID NO: 4786777 - DNA, 18 bp, Homo sapiens
ctctttgttcttcaatgt

SEQ ID NO: 4786778 - DNA, 12 bp, Homo sapiens
ctcttttccctt

SEQ ID NO: 4786779 - DNA, 14 bp, Homo sapiens
ctcttttgctctct

SEQ ID NO: 4786780 - DNA, 17 bp, Homo sapiens
ctcttttgctctctcat

SEQ ID NO: 4786781 - DNA, 15 bp, Homo sapiens
ctctttttatcgcca

SEQ ID NO: 4786782 - DNA, 16 bp, Homo sapiens
ctcttttttgggggga

SEQ ID NO: 4786783 - DNA, 16 bp, Homo sapiens
ctgaaaaagtgttttt

SEQ ID NO: 4786784 - DNA, 17 bp, Homo sapiens
ctgaaaaagtgttttta

SEQ ID NO: 4786785 - DNA, 23 bp, Homo sapiens
ctgaaaaagtgtttttacatata

SEQ ID NO: 4786786 - DNA, 19 bp, Homo sapiens
ctgaaaacacaaacaacaa

SEQ ID NO: 4786787 - DNA, 19 bp, Homo sapiens
ctgaaaactggaataagaa

SEQ ID NO: 4786788 - DNA, 13 bp, Homo sapiens
ctgaaaactgttt

SEQ ID NO: 4786789 - DNA, 13 bp, Homo sapiens
ctgaaagttttga

SEQ ID NO: 4786790 - DNA, 19 bp, Homo sapiens
ctgaaagttttgatacttg

SEQ ID NO: 4786791 - DNA, 15 bp, Homo sapiens
ctgaaattagtgttt

SEQ ID NO: 4786792 - DNA, 19 bp, Homo sapiens
ctgaaattagtgttttcat

SEQ ID NO: 4786793 - DNA, 17 bp, Homo sapiens
ctgaaattatgtcaaat

SEQ ID NO: 4786794 - DNA, 13 bp, Homo sapiens
ctgaaattttcta

SEQ ID NO: 4786795 - DNA, 20 bp, Homo sapiens
ctgaacgatccttcaaagtc

SEQ ID NO: 4786796 - DNA, 19 bp, Homo sapiens
ctgaactggccccagctcc

SEQ ID NO: 4786797 - DNA, 15 bp, Homo sapiens
ctgaacttggcgctg

SEQ ID NO: 4786798 - DNA, 16 bp, Homo sapiens
ctgaacttggcgctgc

SEQ ID NO: 4786799 - DNA, 18 bp, Homo sapiens
ctgaagaaacacagcatg

SEQ ID NO: 4786800 - DNA, 19 bp, Homo sapiens
ctgaagaattgaaaaacca

SEQ ID NO: 4786801 - DNA, 12 bp, Homo sapiens
ctgaagcagagt

SEQ ID NO: 4786802 - DNA, 14 bp, Homo sapiens
ctgaagcagagtca

SEQ ID NO: 4786803 - DNA, 20 bp, Homo sapiens
ctgaagcagagtcaagctga

SEQ ID NO: 4786804 - DNA, 17 bp, Homo sapiens
ctgaagccttttcctga

SEQ ID NO: 4786805 - DNA, 15 bp, Homo sapiens
ctgaaggagaggagt

SEQ ID NO: 4786806 - DNA, 23 bp, Homo sapiens
ctgaagtagtgtgagtgttagaa

SEQ ID NO: 4786807 - DNA, 18 bp, Homo sapiens
ctgaagtcccttcctgtc

SEQ ID NO: 4786808 - DNA, 21 bp, Homo sapiens
ctgaagtcccttcctgtcctg

SEQ ID NO: 4786809 - DNA, 20 bp, Homo sapiens
ctgaagtctttgtacagaca

SEQ ID NO: 4786810 - DNA, 23 bp, Homo sapiens
ctgaagtgatgatggatgagaaa

SEQ ID NO: 4786811 - DNA, 15 bp, Homo sapiens
ctgaagtttcattta

SEQ ID NO: 4786812 - DNA, 15 bp, Homo sapiens
ctgaataacaacaat

SEQ ID NO: 4786813 - DNA, 22 bp, Homo sapiens
ctgaataacaacaatttaggaa

SEQ ID NO: 4786814 - DNA, 18 bp, Homo sapiens
ctgaatctctcaaaatgt

SEQ ID NO: 4786815 - DNA, 19 bp, Homo sapiens
ctgaatctctcaaaatgtg

SEQ ID NO: 4786816 - DNA, 14 bp, Homo sapiens
ctgaatgagaagta

SEQ ID NO: 4786817 - DNA, 18 bp, Homo sapiens
ctgaatgagaagtaaatt

SEQ ID NO: 4786818 - DNA, 19 bp, Homo sapiens
ctgaatgagaagtaaatta

SEQ ID NO: 4786819 - DNA, 21 bp, Homo sapiens
ctgaatgagaagtaaattatt

SEQ ID NO: 4786820 - DNA, 22 bp, Homo sapiens
ctgaatgagaagtaaattattt

SEQ ID NO: 4786821 - DNA, 23 bp, Homo sapiens
ctgaatgctatttgtgtaactga

SEQ ID NO: 4786822 - DNA, 21 bp, Homo sapiens
ctgaattaaagtctacactgc

SEQ ID NO: 4786823 - DNA, 23 bp, Homo sapiens
ctgaattgttatgtaaacatcat

SEQ ID NO: 4786824 - DNA, 18 bp, Homo sapiens
ctgaatttctatggcata

SEQ ID NO: 4786825 - DNA, 23 bp, Homo sapiens
ctgaatttctatggcatattgat

SEQ ID NO: 4786826 - DNA, 17 bp, Homo sapiens
ctgacaaattttaatta

SEQ ID NO: 4786827 - DNA, 13 bp, Homo sapiens
ctgacaagggctg

SEQ ID NO: 4786828 - DNA, 22 bp, Homo sapiens
ctgacaagggctgacctgcctc

SEQ ID NO: 4786829 - DNA, 23 bp, Homo sapiens
ctgacacaatggtagctctgaag

SEQ ID NO: 4786830 - DNA, 14 bp, Homo sapiens
ctgacacctgccgc

SEQ ID NO: 4786831 - DNA, 13 bp, Homo sapiens
ctgacaggccttc

SEQ ID NO: 4786832 - DNA, 16 bp, Homo sapiens
ctgacaggccttcctc

SEQ ID NO: 4786833 - DNA, 12 bp, Homo sapiens
ctgaccaacagg

SEQ ID NO: 4786834 - DNA, 14 bp, Homo sapiens
ctgaccaacaggct

SEQ ID NO: 4786835 - DNA, 18 bp, Homo sapiens
ctgaccaacaggctgttc

SEQ ID NO: 4786836 - DNA, 15 bp, Homo sapiens
ctgaccatgcatttt

SEQ ID NO: 4786837 - DNA, 24 bp, Homo sapiens
ctgaccctcacttttctcatctgt

SEQ ID NO: 4786838 - DNA, 14 bp, Homo sapiens
ctgacccttccaga

SEQ ID NO: 4786839 - DNA, 17 bp, Homo sapiens
ctgacccttccagacat

SEQ ID NO: 4786840 - DNA, 16 bp, Homo sapiens
gctgcgcctgcccgcc

SEQ ID NO: 4786841 - DNA, 18 bp, Homo sapiens
gctgcgcctgcccgcccg

SEQ ID NO: 4786842 - DNA, 22 bp, Homo sapiens
gctgcgcctgcccgcccgccgg

SEQ ID NO: 4786843 - DNA, 20 bp, Homo sapiens
gctgcgctcccacctcggac

SEQ ID NO: 4786844 - DNA, 19 bp, Homo sapiens
gctgctaagtggaagacag

SEQ ID NO: 4786845 - DNA, 20 bp, Homo sapiens
gctgctaagtggaagacaga

SEQ ID NO: 4786846 - DNA, 22 bp, Homo sapiens
gctgctaagtggaagacagaga

SEQ ID NO: 4786847 - DNA, 23 bp, Homo sapiens
gctgctaagtggaagacagagat

SEQ ID NO: 4786848 - DNA, 15 bp, Homo sapiens
gctgctcatttcact

SEQ ID NO: 4786849 - DNA, 18 bp, Homo sapiens
gctgctcgggaaggcctg

SEQ ID NO: 4786850 - DNA, 21 bp, Homo sapiens
gctgctcgggaaggcctgagg

SEQ ID NO: 4786851 - DNA, 14 bp, Homo sapiens
gctgctctccatct

SEQ ID NO: 4786852 - DNA, 13 bp, Homo sapiens
gctgctctcccag

SEQ ID NO: 4786853 - DNA, 17 bp, Homo sapiens
gctgctgcactgccctc

SEQ ID NO: 4786854 - DNA, 23 bp, Homo sapiens
gctgctgcagtcagcacagagag

SEQ ID NO: 4786855 - DNA, 15 bp, Homo sapiens
gctgctgtggcatca

SEQ ID NO: 4786856 - DNA, 17 bp, Homo sapiens
gctgcttaaaatgcaag

SEQ ID NO: 4786857 - DNA, 15 bp, Homo sapiens
gctgcttctccacct

SEQ ID NO: 4786858 - DNA, 16 bp, Homo sapiens
gctgcttctccacctc

SEQ ID NO: 4786859 - DNA, 17 bp, Homo sapiens
gctgcttctccacctcc

SEQ ID NO: 4786860 - DNA, 15 bp, Homo sapiens
gctgcttctccctgg

SEQ ID NO: 4786861 - DNA, 16 bp, Homo sapiens
gctgcttctccctggg

SEQ ID NO: 4786862 - DNA, 17 bp, Homo sapiens
gctgcttctccctgggg

SEQ ID NO: 4786863 - DNA, 17 bp, Homo sapiens
gctgcttgagtggacag

SEQ ID NO: 4786864 - DNA, 21 bp, Homo sapiens
gctgcttgagtggacagcagc

SEQ ID NO: 4786865 - DNA, 23 bp, Homo sapiens
gctgcttgagtggacagcagctg

SEQ ID NO: 4786866 - DNA, 13 bp, Homo sapiens
gctgctttcttct

SEQ ID NO: 4786867 - DNA, 19 bp, Homo sapiens
gctgcttttgatggctatg

SEQ ID NO: 4786868 - DNA, 23 bp, Homo sapiens
gctggaccacgtctccctggccc

SEQ ID NO: 4786869 - DNA, 24 bp, Homo sapiens
gctggactgatggttgctttgagc

SEQ ID NO: 4786870 - DNA, 14 bp, Homo sapiens
gctggagaccctgc

SEQ ID NO: 4786871 - DNA, 18 bp, Homo sapiens
gctggagaccctgcgccc

SEQ ID NO: 4786872 - DNA, 21 bp, Homo sapiens
gctggagccccatcgcctggg

SEQ ID NO: 4786873 - DNA, 14 bp, Homo sapiens
gctggagtgggctc

SEQ ID NO: 4786874 - DNA, 17 bp, Homo sapiens
gctggcaaactgtgaat

SEQ ID NO: 4786875 - DNA, 16 bp, Homo sapiens
gctggcagcgcctccc

SEQ ID NO: 4786876 - DNA, 18 bp, Homo sapiens
gctggcagcgcctcccgc

SEQ ID NO: 4786877 - DNA, 23 bp, Homo sapiens
gctggcagcgcctcccgccgcct

SEQ ID NO: 4786878 - DNA, 16 bp, Homo sapiens
gctggcattacaggtg

SEQ ID NO: 4786879 - DNA, 12 bp, Homo sapiens
gctggccagcac

SEQ ID NO: 4786880 - DNA, 13 bp, Homo sapiens
gctggccagcacc

SEQ ID NO: 4786881 - DNA, 14 bp, Homo sapiens
gctggccagcaccc

SEQ ID NO: 4786882 - DNA, 18 bp, Homo sapiens
gctggccagcaccctctc

SEQ ID NO: 4786883 - DNA, 22 bp, Homo sapiens
gctggccagcctggggcctggc

SEQ ID NO: 4786884 - DNA, 14 bp, Homo sapiens
gctggccctgccct

SEQ ID NO: 4786885 - DNA, 18 bp, Homo sapiens
gctggccctgccctcccc

SEQ ID NO: 4786886 - DNA, 21 bp, Homo sapiens
gctggccctgccctcccccac

SEQ ID NO: 4786887 - DNA, 19 bp, Homo sapiens
gctggccggtccaccccgt

SEQ ID NO: 4786888 - DNA, 20 bp, Homo sapiens
gctggccggtccaccccgtc

SEQ ID NO: 4786889 - DNA, 14 bp, Homo sapiens
gctggcctgacaca

SEQ ID NO: 4786890 - DNA, 14 bp, Homo sapiens
gctggcggggtctg

SEQ ID NO: 4786891 - DNA, 21 bp, Homo sapiens
gctggctgggtcgcccctcct

SEQ ID NO: 4786892 - DNA, 15 bp, Homo sapiens
gctgggaagaatgta

SEQ ID NO: 4786893 - DNA, 19 bp, Homo sapiens
gctgggagaaaagccagat

SEQ ID NO: 4786894 - DNA, 17 bp, Homo sapiens
gctgggcagggccgcag

SEQ ID NO: 4786895 - DNA, 18 bp, Homo sapiens
gctgggcagggccgcagg

SEQ ID NO: 4786896 - DNA, 23 bp, Homo sapiens
gctgggcagggccgcagggcgct

SEQ ID NO: 4786897 - DNA, 17 bp, Homo sapiens
gctgggccccccagctc

SEQ ID NO: 4786898 - DNA, 21 bp, Homo sapiens
gctgggccccccagctcaggg

SEQ ID NO: 4786899 - DNA, 14 bp, Homo sapiens
gctgggcccctggg

SEQ ID NO: 4786900 - DNA, 16 bp, Homo sapiens
gctgggcgcctctgtc

SEQ ID NO: 4786901 - DNA, 20 bp, Homo sapiens
gctggggaatcccctcgctt

SEQ ID NO: 4786902 - DNA, 17 bp, Homo sapiens
gctggggggctgtcctg

SEQ ID NO: 4786903 - DNA, 23 bp, Homo sapiens
gctggggtggggacctcaggcct

SEQ ID NO: 4786904 - DNA, 15 bp, Homo sapiens
gctgggtcgcccctc

SEQ ID NO: 4786905 - DNA, 17 bp, Homo sapiens
gctgggtttgggcagtg

SEQ ID NO: 4786906 - DNA, 21 bp, Homo sapiens
gctgggtttgggcagtggaga

SEQ ID NO: 4786907 - DNA, 15 bp, Homo sapiens
gctggtaactgttaa

SEQ ID NO: 4786908 - DNA, 13 bp, Homo sapiens
gctggtgaatcca

SEQ ID NO: 4786909 - DNA, 19 bp, Homo sapiens
gctgtaaataaaaatagct

SEQ ID NO: 4786910 - DNA, 17 bp, Homo sapiens
gctgtaccggccactgc

SEQ ID NO: 4786911 - DNA, 14 bp, Homo sapiens
gctgtatacaaaca

SEQ ID NO: 4786912 - DNA, 15 bp, Homo sapiens
gctgtatttgaggaa

SEQ ID NO: 4786913 - DNA, 16 bp, Homo sapiens
gctgtatttgaggaaa

SEQ ID NO: 4786914 - DNA, 15 bp, Homo sapiens
gctattaatatttgt

SEQ ID NO: 4786915 - DNA, 12 bp, Homo sapiens
gctattcccagg

SEQ ID NO: 4786916 - DNA, 17 bp, Homo sapiens
gctattcccaggcaggg

SEQ ID NO: 4786917 - DNA, 22 bp, Homo sapiens
gctattgtttataggaaataaa

SEQ ID NO: 4786918 - DNA, 21 bp, Homo sapiens
gctatttaagtggactgtatt

SEQ ID NO: 4786919 - DNA, 23 bp, Homo sapiens
gctatttttaatttcctgtgagg

SEQ ID NO: 4786920 - DNA, 20 bp, Homo sapiens
gctcaacctctcagatccct

SEQ ID NO: 4786921 - DNA, 19 bp, Homo sapiens
gctcaatgtgctgttgatt

SEQ ID NO: 4786922 - DNA, 14 bp, Homo sapiens
gctcacaactgttt

SEQ ID NO: 4786923 - DNA, 15 bp, Homo sapiens
gctcacaagccgtgt

SEQ ID NO: 4786924 - DNA, 23 bp, Homo sapiens
gctcacaccgcaccgggctggcc

SEQ ID NO: 4786925 - DNA, 13 bp, Homo sapiens
gctcacacttggg

SEQ ID NO: 4786926 - DNA, 14 bp, Homo sapiens
gctcacacttgggc

SEQ ID NO: 4786927 - DNA, 16 bp, Homo sapiens
gctcacacttgggctg

SEQ ID NO: 4786928 - DNA, 20 bp, Homo sapiens
gctcacacttgggctggcac

SEQ ID NO: 4786929 - DNA, 12 bp, Homo sapiens
gctcacagccac

SEQ ID NO: 4786930 - DNA, 15 bp, Homo sapiens
gctcacagccaccac

SEQ ID NO: 4786931 - DNA, 19 bp, Homo sapiens
gctcacagccaccacctgg

SEQ ID NO: 4786932 - DNA, 16 bp, Homo sapiens
gctcacgtctgtgagt

SEQ ID NO: 4786933 - DNA, 22 bp, Homo sapiens
gctcacgtctgtgagtctgtcc

SEQ ID NO: 4786934 - DNA, 20 bp, Homo sapiens
gctcactgcaacctctgcct

SEQ ID NO: 4786935 - DNA, 13 bp, Homo sapiens
gctcagaggagag

SEQ ID NO: 4786936 - DNA, 15 bp, Homo sapiens
gctcagccccagacc

SEQ ID NO: 4786937 - DNA, 17 bp, Homo sapiens
gctcaggcctcacctgg

SEQ ID NO: 4786938 - DNA, 18 bp, Homo sapiens
gctcaggcctcacctggc

SEQ ID NO: 4786939 - DNA, 16 bp, Homo sapiens
gctcaggctgcccagc

SEQ ID NO: 4786940 - DNA, 22 bp, Homo sapiens
gctcagggtgctagaggattag

SEQ ID NO: 4786941 - DNA, 22 bp, Homo sapiens
gctcagtaacacagtgcagtgc

SEQ ID NO: 4786942 - DNA, 23 bp, Homo sapiens
gctcagtattgagacactgtcaa

SEQ ID NO: 4786943 - DNA, 16 bp, Homo sapiens
gctcagtcccacagcc

SEQ ID NO: 4786944 - DNA, 12 bp, Homo sapiens
gctcatagcaca

SEQ ID NO: 4786945 - DNA, 17 bp, Homo sapiens
gctcatagcacatgttt

SEQ ID NO: 4786946 - DNA, 19 bp, Homo sapiens
gctcatctacacatataaa

SEQ ID NO: 4786947 - DNA, 13 bp, Homo sapiens
gctccaagagaat

SEQ ID NO: 4786948 - DNA, 14 bp, Homo sapiens
gctccaccctcccc

SEQ ID NO: 4786949 - DNA, 20 bp, Homo sapiens
gctccaccctcccctcttct

SEQ ID NO: 4786950 - DNA, 12 bp, Homo sapiens
gctccactctga

SEQ ID NO: 4786951 - DNA, 13 bp, Homo sapiens
gctccactctgaa

SEQ ID NO: 4786952 - DNA, 12 bp, Homo sapiens
gctccagggact

SEQ ID NO: 4786953 - DNA, 14 bp, Homo sapiens
gctccagtagctcc

SEQ ID NO: 4786954 - DNA, 14 bp, Homo sapiens
gctccagtataaat

SEQ ID NO: 4786955 - DNA, 23 bp, Homo sapiens
gctccagtataaattacatgcat

SEQ ID NO: 4786956 - DNA, 18 bp, Homo sapiens
gctccagtgctttatcca

SEQ ID NO: 4786957 - DNA, 17 bp, Homo sapiens
ggaggaggcagagaaga

SEQ ID NO: 4786958 - DNA, 12 bp, Homo sapiens
ggaggcaagcaa

SEQ ID NO: 4786959 - DNA, 15 bp, Homo sapiens
ggaggcagagaagaa

SEQ ID NO: 4786960 - DNA, 14 bp, Homo sapiens
ggaggcccctgagg

SEQ ID NO: 4786961 - DNA, 14 bp, Homo sapiens
ggaggcctggtctg

SEQ ID NO: 4786962 - DNA, 17 bp, Homo sapiens
ggaggcctggtctggag

SEQ ID NO: 4786963 - DNA, 13 bp, Homo sapiens
ggaggcgcccacc

SEQ ID NO: 4786964 - DNA, 15 bp, Homo sapiens
ggaggcgcccacctg

SEQ ID NO: 4786965 - DNA, 16 bp, Homo sapiens
ggaggcgcccacctgc

SEQ ID NO: 4786966 - DNA, 17 bp, Homo sapiens
ggaggcgcccacctgcc

SEQ ID NO: 4786967 - DNA, 20 bp, Homo sapiens
ggaggcgcccacctgcccag

SEQ ID NO: 4786968 - DNA, 12 bp, Homo sapiens
ggaggctggacc

SEQ ID NO: 4786969 - DNA, 13 bp, Homo sapiens
ggaggctggacca

SEQ ID NO: 4786970 - DNA, 22 bp, Homo sapiens
ggaggctggaccaactgctttg

SEQ ID NO: 4786971 - DNA, 23 bp, Homo sapiens
ggaggctgggcccctgggatggg

SEQ ID NO: 4786972 - DNA, 12 bp, Homo sapiens
ggaggcttccag

SEQ ID NO: 4786973 - DNA, 17 bp, Homo sapiens
ggaggcttccagctcag

SEQ ID NO: 4786974 - DNA, 18 bp, Homo sapiens
ggaggcttccagctcagt

SEQ ID NO: 4786975 - DNA, 17 bp, Homo sapiens
ggaggggaagctgcagc

SEQ ID NO: 4786976 - DNA, 24 bp, Homo sapiens
ggaggtggccagcccgcagaggtg

SEQ ID NO: 4786977 - DNA, 18 bp, Homo sapiens
ggaggtggggagggcctc

SEQ ID NO: 4786978 - DNA, 17 bp, Homo sapiens
ggaggtgtggagtggag

SEQ ID NO: 4786979 - DNA, 22 bp, Homo sapiens
ggagtccactttcctctctctc

SEQ ID NO: 4786980 - DNA, 19 bp, Homo sapiens
ggagtctcctcactgccac

SEQ ID NO: 4786981 - DNA, 19 bp, Homo sapiens
ggagtctgaaggagaggag

SEQ ID NO: 4786982 - DNA, 20 bp, Homo sapiens
ggagtgactctggctgccaa

SEQ ID NO: 4786983 - DNA, 22 bp, Homo sapiens
ggagtgactctggctgccaaga

SEQ ID NO: 4786984 - DNA, 12 bp, Homo sapiens
ggagtgcagtgg

SEQ ID NO: 4786985 - DNA, 20 bp, Homo sapiens
ggagtgccacatggccgctg

SEQ ID NO: 4786986 - DNA, 16 bp, Homo sapiens
ggagtgccacgtggcc

SEQ ID NO: 4786987 - DNA, 14 bp, Homo sapiens
ggagtggccacaga

SEQ ID NO: 4786988 - DNA, 18 bp, Homo sapiens
ggagtgggctctgagcag

SEQ ID NO: 4786989 - DNA, 15 bp, Homo sapiens
ggagttctggttcct

SEQ ID NO: 4786990 - DNA, 15 bp, Homo sapiens
ggataagaaaaatgc

SEQ ID NO: 4786991 - DNA, 14 bp, Homo sapiens
ggataatgagatgt

SEQ ID NO: 4786992 - DNA, 16 bp, Homo sapiens
ggatactggggggcag

SEQ ID NO: 4786993 - DNA, 15 bp, Homo sapiens
ggatatgaaaaatga

SEQ ID NO: 4786994 - DNA, 18 bp, Homo sapiens
ggatccagagacctgctc

SEQ ID NO: 4786995 - DNA, 12 bp, Homo sapiens
ggatccagagag

SEQ ID NO: 4786996 - DNA, 13 bp, Homo sapiens
ggatcctggcctg

SEQ ID NO: 4786997 - DNA, 19 bp, Homo sapiens
ggatctaaaaggaggacag

SEQ ID NO: 4786998 - DNA, 17 bp, Homo sapiens
ggatctccaggcccagc

SEQ ID NO: 4786999 - DNA, 19 bp, Homo sapiens
ggatctccaggcccagcct

SEQ ID NO: 4787000 - DNA, 22 bp, Homo sapiens
ggatctccaggcccagcctggc

SEQ ID NO: 4787001 - DNA, 17 bp, Homo sapiens
ggatctcttaagacagc

SEQ ID NO: 4787002 - DNA, 16 bp, Homo sapiens
ggatctgctccatgca

SEQ ID NO: 4787003 - DNA, 18 bp, Homo sapiens
ggatctgctccatgcaga

SEQ ID NO: 4787004 - DNA, 22 bp, Homo sapiens
ggatctggagtctgaaggagag

SEQ ID NO: 4787005 - DNA, 20 bp, Homo sapiens
ggatctgttgggaaccagag

SEQ ID NO: 4787006 - DNA, 16 bp, Homo sapiens
ggatgacaaagaaaat

SEQ ID NO: 4787007 - DNA, 15 bp, Homo sapiens
ggatgattgtacaga

SEQ ID NO: 4787008 - DNA, 11 bp, Homo sapiens
ggatgcttcat

SEQ ID NO: 4787009 - DNA, 21 bp, Homo sapiens
ggatgggggatgggccagggt

SEQ ID NO: 4787010 - DNA, 16 bp, Homo sapiens
ggatgtgcatctggcc

SEQ ID NO: 4787011 - DNA, 11 bp, Homo sapiens
ggattacagaa

SEQ ID NO: 4787012 - DNA, 22 bp, Homo sapiens
ggattcccgtggctttgtgctt

SEQ ID NO: 4787013 - DNA, 17 bp, Homo sapiens
ggattcctcccctggaa

SEQ ID NO: 4787014 - DNA, 16 bp, Homo sapiens
ggattcttatggacaa

SEQ ID NO: 4787015 - DNA, 14 bp, Homo sapiens
ggattgaggatgaa

SEQ ID NO: 4787016 - DNA, 15 bp, Homo sapiens
ggattgtccacaaat

SEQ ID NO: 4787017 - DNA, 20 bp, Homo sapiens
ggattgtccacaaatgtcct

SEQ ID NO: 4787018 - DNA, 21 bp, Homo sapiens
ggattgtccaccttctgccaa

SEQ ID NO: 4787019 - DNA, 23 bp, Homo sapiens
ggattgtccaccttctgccaagg

SEQ ID NO: 4787020 - DNA, 20 bp, Homo sapiens
ggattgtctgctgcctccaa

SEQ ID NO: 4787021 - DNA, 10 bp, Homo sapiens
ggattgtttt

SEQ ID NO: 4787022 - DNA, 18 bp, Homo sapiens
ggatttattctcagaaca

SEQ ID NO: 4787023 - DNA, 22 bp, Homo sapiens
ggatttattttttgtaactctt

SEQ ID NO: 4787024 - DNA, 13 bp, Homo sapiens
ggattttaaacaa

SEQ ID NO: 4787025 - DNA, 12 bp, Homo sapiens
ggattttcaaag

SEQ ID NO: 4787026 - DNA, 13 bp, Homo sapiens
ggcaaaccaggct

SEQ ID NO: 4787027 - DNA, 16 bp, Homo sapiens
ggcaaaccaggctgca

SEQ ID NO: 4787028 - DNA, 17 bp, Homo sapiens
ggcaaatgtccaagcat

SEQ ID NO: 4787029 - DNA, 16 bp, Homo sapiens
ggcaaggctgtcaatt

SEQ ID NO: 4787030 - DNA, 16 bp, Homo sapiens
ggcaaggggccaggaa

SEQ ID NO: 4787031 - DNA, 17 bp, Homo sapiens
ggcaaggggccaggaag

SEQ ID NO: 4787032 - DNA, 18 bp, Homo sapiens
ggcaaggggccaggaagg

SEQ ID NO: 4787033 - DNA, 22 bp, Homo sapiens
ggcaataaatgtcccaaataaa

SEQ ID NO: 4787034 - DNA, 15 bp, Homo sapiens
ggcaatcaatgttca

SEQ ID NO: 4787035 - DNA, 15 bp, Homo sapiens
ggcaatcttgccctt

SEQ ID NO: 4787036 - DNA, 17 bp, Homo sapiens
ggcacacagcagccccc

SEQ ID NO: 4787037 - DNA, 19 bp, Homo sapiens
ggcacagaaaatggaagac

SEQ ID NO: 4787038 - DNA, 20 bp, Homo sapiens
ggcacagaaaatggaagaca

SEQ ID NO: 4787039 - DNA, 12 bp, Homo sapiens
ggcacagccaga

SEQ ID NO: 4787040 - DNA, 16 bp, Homo sapiens
ggcacaggtgtaaata

SEQ ID NO: 4787041 - DNA, 21 bp, Homo sapiens
ggcacatagcataggctgggg

SEQ ID NO: 4787042 - DNA, 18 bp, Homo sapiens
ggcacatgacagtggtta

SEQ ID NO: 4787043 - DNA, 10 bp, Homo sapiens
ggcaccaaag

SEQ ID NO: 4787044 - DNA, 20 bp, Homo sapiens
ggcaccaaagatgcagccgc

SEQ ID NO: 4787045 - DNA, 14 bp, Homo sapiens
ggcacccaccactc

SEQ ID NO: 4787046 - DNA, 15 bp, Homo sapiens
ggcacccaccactct

SEQ ID NO: 4787047 - DNA, 15 bp, Homo sapiens
ggcaccgcccaccca

SEQ ID NO: 4787048 - DNA, 17 bp, Homo sapiens
ggcaccgcccacccaca

SEQ ID NO: 4787049 - DNA, 23 bp, Homo sapiens
ggcaccggacgctggagaccctg

SEQ ID NO: 4787050 - DNA, 19 bp, Homo sapiens
ggcacgggagagcgccacc

SEQ ID NO: 4787051 - DNA, 22 bp, Homo sapiens
ggcactgattgttttagagact

SEQ ID NO: 4787052 - DNA, 19 bp, Homo sapiens
ggcactgtcatgcccagct

SEQ ID NO: 4787053 - DNA, 16 bp, Homo sapiens
ggcactgtgcactcta

SEQ ID NO: 4787054 - DNA, 21 bp, Homo sapiens
ggcagaatggtgggctccaga

SEQ ID NO: 4787055 - DNA, 15 bp, Homo sapiens
ggcagaccagagagc

SEQ ID NO: 4787056 - DNA, 19 bp, Homo sapiens
ggcagagaccaccgcgccc

SEQ ID NO: 4787057 - DNA, 23 bp, Homo sapiens
ggcagagaccaccgcgcccctct

SEQ ID NO: 4787058 - DNA, 23 bp, Homo sapiens
ggcagagattgggggggcttggg

SEQ ID NO: 4787059 - DNA, 21 bp, Homo sapiens
ggcagagcccgcccacctggg

SEQ ID NO: 4787060 - DNA, 14 bp, Homo sapiens
ggcagaggcagggc

SEQ ID NO: 4787061 - DNA, 16 bp, Homo sapiens
ggcagaggcagggccc

SEQ ID NO: 4787062 - DNA, 19 bp, Homo sapiens
ggcagagttgaagacagag

SEQ ID NO: 4787063 - DNA, 14 bp, Homo sapiens
ggcagatgggggcc

SEQ ID NO: 4787064 - DNA, 23 bp, Homo sapiens
ggcagatgggggcctctctggaa

SEQ ID NO: 4787065 - DNA, 17 bp, Homo sapiens
ggcagcaacaggaccag

SEQ ID NO: 4787066 - DNA, 12 bp, Homo sapiens
ggcagcccagag

SEQ ID NO: 4787067 - DNA, 13 bp, Homo sapiens
ggcagcccagaga

SEQ ID NO: 4787068 - DNA, 13 bp, Homo sapiens
ggcagccccatcc

SEQ ID NO: 4787069 - DNA, 21 bp, Homo sapiens
ggcagccccatccttcccgca

SEQ ID NO: 4787070 - DNA, 23 bp, Homo sapiens
ggcagccccatccttcccgcagc

SEQ ID NO: 4787071 - DNA, 20 bp, Homo sapiens
ggcagccccgcgaccacccc

SEQ ID NO: 4787072 - DNA, 22 bp, Homo sapiens
ggcagccccgcgaccacccctg

SEQ ID NO: 4787073 - DNA, 11 bp, Homo sapiens
ggcagcccctc

SEQ ID NO: 4787074 - DNA, 14 bp, Homo sapiens
ggcagcccctgctg

SEQ ID NO: 4787075 - DNA, 21 bp, Homo sapiens
ggcagcccctgctggaccaag

SEQ ID NO: 4787076 - DNA, 18 bp, Homo sapiens
ggcagcctgtgggtcctt

SEQ ID NO: 4787077 - DNA, 15 bp, Homo sapiens
ggcagcgcccagcct

SEQ ID NO: 4787078 - DNA, 13 bp, Homo sapiens
ggcagcttccctg

SEQ ID NO: 4787079 - DNA, 16 bp, Homo sapiens
ggcaggaagtcaggag

SEQ ID NO: 4787080 - DNA, 19 bp, Homo sapiens
ggcaggaagtcaggagcca

SEQ ID NO: 4787081 - DNA, 23 bp, Homo sapiens
ggcaggaagtcaggagccagcag

SEQ ID NO: 4787082 - DNA, 17 bp, Homo sapiens
ggcaggcaaaggccccc

SEQ ID NO: 4787083 - DNA, 17 bp, Homo sapiens
ggcaggcacacagcagc

SEQ ID NO: 4787084 - DNA, 13 bp, Homo sapiens
ggcaggccctgca

SEQ ID NO: 4787085 - DNA, 14 bp, Homo sapiens
ggcaggccctgcag

SEQ ID NO: 4787086 - DNA, 16 bp, Homo sapiens
ggcaggcctcccaagc

SEQ ID NO: 4787087 - DNA, 17 bp, Homo sapiens
ggcaggcctcccaagct

SEQ ID NO: 4787088 - DNA, 19 bp, Homo sapiens
ggcaggcctcccaagctga

SEQ ID NO: 4787089 - DNA, 17 bp, Homo sapiens
ggcagggaggtcaggcc

SEQ ID NO: 4787090 - DNA, 22 bp, Homo sapiens
ggcagggaggtcaggccctgga

SEQ ID NO: 4787091 - DNA, 23 bp, Homo sapiens
ggcagggcaaatgacatgcactg

SEQ ID NO: 4787092 - DNA, 13 bp, Homo sapiens
ggcagggccctga

SEQ ID NO: 4787093 - DNA, 17 bp, Homo sapiens
ggcagggccctgaaatg

SEQ ID NO: 4787094 - DNA, 22 bp, Homo sapiens
ggcagggccctgaaatggcctg

SEQ ID NO: 4787095 - DNA, 17 bp, Homo sapiens
ggcagggccgcagggcg

SEQ ID NO: 4787096 - DNA, 16 bp, Homo sapiens
ggcaggggctgcatcc

SEQ ID NO: 4787097 - DNA, 22 bp, Homo sapiens
ggcaggggctgcatcctcagcc

SEQ ID NO: 4787098 - DNA, 17 bp, Homo sapiens
ggcagggttctagaagg

SEQ ID NO: 4787099 - DNA, 18 bp, Homo sapiens
ggcagggttctagaaggg

SEQ ID NO: 4787100 - DNA, 14 bp, Homo sapiens
ggcagtggagaggg

SEQ ID NO: 4787101 - DNA, 10 bp, Homo sapiens
ggcatctaag

SEQ ID NO: 4787102 - DNA, 13 bp, Homo sapiens
ggcatgagctctt

SEQ ID NO: 4787103 - DNA, 16 bp, Homo sapiens
ggcatggtaccagccc

SEQ ID NO: 4787104 - DNA, 16 bp, Homo sapiens
ggcatgtgaaaagtaa

SEQ ID NO: 4787105 - DNA, 18 bp, Homo sapiens
ggcatgtgaaaagtaaaa

SEQ ID NO: 4787106 - DNA, 22 bp, Homo sapiens
ggcatttagcacagtatttaac

SEQ ID NO: 4787107 - DNA, 13 bp, Homo sapiens
ggccaaaggaagc

SEQ ID NO: 4787108 - DNA, 22 bp, Homo sapiens
ggccaagccagggttccagaca

SEQ ID NO: 4787109 - DNA, 12 bp, Homo sapiens
ggccaaggacac

SEQ ID NO: 4787110 - DNA, 22 bp, Homo sapiens
ggccacagaaaattcttctcca

SEQ ID NO: 4787111 - DNA, 14 bp, Homo sapiens
ggccacagccccaa

SEQ ID NO: 4787112 - DNA, 20 bp, Homo sapiens
ggccactgcaacccatgagc

SEQ ID NO: 4787113 - DNA, 22 bp, Homo sapiens
ggccagaccacgcccctgcctg

SEQ ID NO: 4787114 - DNA, 16 bp, Homo sapiens
ggccagacgctgccgc

SEQ ID NO: 4787115 - DNA, 18 bp, Homo sapiens
ggccagagacacaagcct

SEQ ID NO: 4787116 - DNA, 12 bp, Homo sapiens
ggccagcaccct

SEQ ID NO: 4787117 - DNA, 16 bp, Homo sapiens
ggccagcaccctctcc

SEQ ID NO: 4787118 - DNA, 17 bp, Homo sapiens
ggccagcaccctctcct

SEQ ID NO: 4787119 - DNA, 17 bp, Homo sapiens
ggccagcccgcagaggt

SEQ ID NO: 4787120 - DNA, 16 bp, Homo sapiens
ggccagcctcaccctt

SEQ ID NO: 4787121 - DNA, 18 bp, Homo sapiens
ggccagcctcacccttgc

SEQ ID NO: 4787122 - DNA, 22 bp, Homo sapiens
ggccagcctggggcctggcagg

SEQ ID NO: 4787123 - DNA, 17 bp, Homo sapiens
ggccagctgcttgggct

SEQ ID NO: 4787124 - DNA, 14 bp, Homo sapiens
ggccaggaagggga

SEQ ID NO: 4787125 - DNA, 15 bp, Homo sapiens
ggccaggaaggggac

SEQ ID NO: 4787126 - DNA, 11 bp, Homo sapiens
ggccaggagcc

SEQ ID NO: 4787127 - DNA, 17 bp, Homo sapiens
ggccaggagtgggtttc

SEQ ID NO: 4787128 - DNA, 14 bp, Homo sapiens
ggccatccctgggc

SEQ ID NO: 4787129 - DNA, 15 bp, Homo sapiens
ggccatgttcccaga

SEQ ID NO: 4787130 - DNA, 17 bp, Homo sapiens
ggccatgttcccagaac

SEQ ID NO: 4787131 - DNA, 20 bp, Homo sapiens
ggccattgaacactgcaccc

SEQ ID NO: 4787132 - DNA, 20 bp, Homo sapiens
ggcccaaccaccagatgaga

SEQ ID NO: 4787133 - DNA, 18 bp, Homo sapiens
ggcccacaggaggcaagc

SEQ ID NO: 4787134 - DNA, 22 bp, Homo sapiens
ggcccaccagggactgcagctg

SEQ ID NO: 4787135 - DNA, 12 bp, Homo sapiens
ggcccacccctc

SEQ ID NO: 4787136 - DNA, 16 bp, Homo sapiens
ggcccacgcagagccc

SEQ ID NO: 4787137 - DNA, 21 bp, Homo sapiens
ggcccacgcagagccccggag

SEQ ID NO: 4787138 - DNA, 22 bp, Homo sapiens
ggcccacgcagagccccggagc

SEQ ID NO: 4787139 - DNA, 17 bp, Homo sapiens
ggcccacgtcctgggtg

SEQ ID NO: 4787140 - DNA, 13 bp, Homo sapiens
ggcccagaggctg

SEQ ID NO: 4787141 - DNA, 14 bp, Homo sapiens
ggcccagaggctga

SEQ ID NO: 4787142 - DNA, 12 bp, Homo sapiens
ggcccagccagc

SEQ ID NO: 4787143 - DNA, 14 bp, Homo sapiens
ggcccagccagcag

SEQ ID NO: 4787144 - DNA, 19 bp, Homo sapiens
gggtcgggggaggagcacc

SEQ ID NO: 4787145 - DNA, 13 bp, Homo sapiens
gggtctctgagca

SEQ ID NO: 4787146 - DNA, 14 bp, Homo sapiens
gggtctctgagcag

SEQ ID NO: 4787147 - DNA, 19 bp, Homo sapiens
gggtcttagggtacagccc

SEQ ID NO: 4787148 - DNA, 22 bp, Homo sapiens
gggtgagaagtacagggcagaa

SEQ ID NO: 4787149 - DNA, 16 bp, Homo sapiens
gggtgcccgtgtggcc

SEQ ID NO: 4787150 - DNA, 18 bp, Homo sapiens
gggtgcgtgaccggcccg

SEQ ID NO: 4787151 - DNA, 9 bp, Homo sapiens
gggtgctca

SEQ ID NO: 4787152 - DNA, 15 bp, Homo sapiens
gggtggaagggcagg

SEQ ID NO: 4787153 - DNA, 16 bp, Homo sapiens
gggtggaagggcagga

SEQ ID NO: 4787154 - DNA, 18 bp, Homo sapiens
gggtggaggatggacgag

SEQ ID NO: 4787155 - DNA, 22 bp, Homo sapiens
gggtggcagcgcccagcctggc

SEQ ID NO: 4787156 - DNA, 15 bp, Homo sapiens
gggtggctggagccc

SEQ ID NO: 4787157 - DNA, 17 bp, Homo sapiens
gggtggctggagcccca

SEQ ID NO: 4787158 - DNA, 14 bp, Homo sapiens
gggtggggcttgga

SEQ ID NO: 4787159 - DNA, 18 bp, Homo sapiens
gggtgtcccctggtgccc

SEQ ID NO: 4787160 - DNA, 21 bp, Homo sapiens
gggtgtcccctggtgcccctc

SEQ ID NO: 4787161 - DNA, 12 bp, Homo sapiens
gggtgtggcctc

SEQ ID NO: 4787162 - DNA, 18 bp, Homo sapiens
gggtgtggcctcagccct

SEQ ID NO: 4787163 - DNA, 18 bp, Homo sapiens
gggttaacagtaaatata

SEQ ID NO: 4787164 - DNA, 16 bp, Homo sapiens
gggttccagacagagt

SEQ ID NO: 4787165 - DNA, 20 bp, Homo sapiens
gggttccagacagagtggat

SEQ ID NO: 4787166 - DNA, 16 bp, Homo sapiens
gggttctatatttact

SEQ ID NO: 4787167 - DNA, 14 bp, Homo sapiens
gggttgctggagcc

SEQ ID NO: 4787168 - DNA, 19 bp, Homo sapiens
gggtttacagtgaagaaag

SEQ ID NO: 4787169 - DNA, 20 bp, Homo sapiens
gggtttcaccatgttggcca

SEQ ID NO: 4787170 - DNA, 21 bp, Homo sapiens
gggtttgaggaccctcccagg

SEQ ID NO: 4787171 - DNA, 20 bp, Homo sapiens
gggttttcacttcctagggt

SEQ ID NO: 4787172 - DNA, 18 bp, Homo sapiens
gggttttgttaggggtgg

SEQ ID NO: 4787173 - DNA, 13 bp, Homo sapiens
ggtaaataaatgc

SEQ ID NO: 4787174 - DNA, 18 bp, Homo sapiens
ggtaagattgttattaaa

SEQ ID NO: 4787175 - DNA, 16 bp, Homo sapiens
ggtaagggactccaga

SEQ ID NO: 4787176 - DNA, 20 bp, Homo sapiens
ggtaagggactccagaagca

SEQ ID NO: 4787177 - DNA, 17 bp, Homo sapiens
ggtaagttgaagggaaa

SEQ ID NO: 4787178 - DNA, 13 bp, Homo sapiens
ggtaataaaactc

SEQ ID NO: 4787179 - DNA, 19 bp, Homo sapiens
ggtaccagagcctatggaa

SEQ ID NO: 4787180 - DNA, 18 bp, Homo sapiens
ggtaccagccctggggct

SEQ ID NO: 4787181 - DNA, 16 bp, Homo sapiens
ggtagaaactttggaa

SEQ ID NO: 4787182 - DNA, 12 bp, Homo sapiens
ggtagagaggac

SEQ ID NO: 4787183 - DNA, 18 bp, Homo sapiens
ggtagatgagaaaacagg

SEQ ID NO: 4787184 - DNA, 15 bp, Homo sapiens
ggtagctctgaaggg

SEQ ID NO: 4787185 - DNA, 20 bp, Homo sapiens
ggtagggtaagtgagagagg

SEQ ID NO: 4787186 - DNA, 19 bp, Homo sapiens
ggtagtgccatggccagga

SEQ ID NO: 4787187 - DNA, 20 bp, Homo sapiens
ggtagtgccatggccaggag

SEQ ID NO: 4787188 - DNA, 20 bp, Homo sapiens
ggtatctgatgatgttctga

SEQ ID NO: 4787189 - DNA, 15 bp, Homo sapiens
ggtatgctggccagc

SEQ ID NO: 4787190 - DNA, 20 bp, Homo sapiens
ggtatgctggccagcaccct

SEQ ID NO: 4787191 - DNA, 18 bp, Homo sapiens
ggtattatgcttcttgga

SEQ ID NO: 4787192 - DNA, 11 bp, Homo sapiens
ggtatttactg

SEQ ID NO: 4787193 - DNA, 21 bp, Homo sapiens
ggtatttactgcaatgtctgt

SEQ ID NO: 4787194 - DNA, 23 bp, Homo sapiens
ggtatttggttaaaggtctccca

SEQ ID NO: 4787195 - DNA, 18 bp, Homo sapiens
ggtattttcgtgcatttg

SEQ ID NO: 4787196 - DNA, 21 bp, Homo sapiens
ggtattttcgtgcatttgtga

SEQ ID NO: 4787197 - DNA, 22 bp, Homo sapiens
ggtcaccttcctgggcagccca

SEQ ID NO: 4787198 - DNA, 23 bp, Homo sapiens
ggtcaccttcctgggcagcccag

SEQ ID NO: 4787199 - DNA, 24 bp, Homo sapiens
ggtcaccttcctgggcagcccaga

SEQ ID NO: 4787200 - DNA, 14 bp, Homo sapiens
ggtcacgctgaatg

SEQ ID NO: 4787201 - DNA, 13 bp, Homo sapiens
ggtcactgcccac

SEQ ID NO: 4787202 - DNA, 15 bp, Homo sapiens
ggtcagcgattcctg

SEQ ID NO: 4787203 - DNA, 23 bp, Homo sapiens
ggtcagcgattcctgccaagtag

SEQ ID NO: 4787204 - DNA, 17 bp, Homo sapiens
ggtcaggccctggaact

SEQ ID NO: 4787205 - DNA, 22 bp, Homo sapiens
ggtcaggtgcctcccagccctg

SEQ ID NO: 4787206 - DNA, 18 bp, Homo sapiens
ggtcagttgggcccccat

SEQ ID NO: 4787207 - DNA, 17 bp, Homo sapiens
ggtcatttggtggctct

SEQ ID NO: 4787208 - DNA, 12 bp, Homo sapiens
ggtccacacacc

SEQ ID NO: 4787209 - DNA, 12 bp, Homo sapiens
ggtccagccctc

SEQ ID NO: 4787210 - DNA, 14 bp, Homo sapiens
ggtccagccctccg

SEQ ID NO: 4787211 - DNA, 19 bp, Homo sapiens
ggtccagccctccgccagc

SEQ ID NO: 4787212 - DNA, 24 bp, Homo sapiens
ggtccagccctccgccagccctgt

SEQ ID NO: 4787213 - DNA, 13 bp, Homo sapiens
ggtcccagtccgg

SEQ ID NO: 4787214 - DNA, 23 bp, Homo sapiens
ggtcccagtccggtgccttccac

SEQ ID NO: 4787215 - DNA, 20 bp, Homo sapiens
ggtccccggacgctggctcg

SEQ ID NO: 4787216 - DNA, 21 bp, Homo sapiens
ggtccccggacgctggctcgg

SEQ ID NO: 4787217 - DNA, 20 bp, Homo sapiens
ggtcccctggcccttccttc

SEQ ID NO: 4787218 - DNA, 20 bp, Homo sapiens
ggtccctaattctcttcgct

SEQ ID NO: 4787219 - DNA, 24 bp, Homo sapiens
ggtccctaattctcttcgctgtga

SEQ ID NO: 4787220 - DNA, 18 bp, Homo sapiens
ggtccctgcgtctcctgc

SEQ ID NO: 4787221 - DNA, 22 bp, Homo sapiens
ggtcctcggccctgtagccctg

SEQ ID NO: 4787222 - DNA, 18 bp, Homo sapiens
ggtcctgaggccaagaaa

SEQ ID NO: 4787223 - DNA, 20 bp, Homo sapiens
ggtcctgcccatgtgtcccc

SEQ ID NO: 4787224 - DNA, 13 bp, Homo sapiens
ggtcctgctgctc

SEQ ID NO: 4787225 - DNA, 13 bp, Homo sapiens
gggcctggcaggg

SEQ ID NO: 4787226 - DNA, 18 bp, Homo sapiens
gggccttggcccaggggt

SEQ ID NO: 4787227 - DNA, 23 bp, Homo sapiens
gggcgcaagcgacacaggctgcc

SEQ ID NO: 4787228 - DNA, 19 bp, Homo sapiens
gggcgcaggaaccgaggac

SEQ ID NO: 4787229 - DNA, 16 bp, Homo sapiens
gggcgcctctgtcctg

SEQ ID NO: 4787230 - DNA, 16 bp, Homo sapiens
gggcgcctgtcgggcc

SEQ ID NO: 4787231 - DNA, 20 bp, Homo sapiens
gggcgcctgtcgggcccgca

SEQ ID NO: 4787232 - DNA, 14 bp, Homo sapiens
gggcgcgcgccccc

SEQ ID NO: 4787233 - DNA, 21 bp, Homo sapiens
gggcgcgcgcccccaggaccc

SEQ ID NO: 4787234 - DNA, 23 bp, Homo sapiens
gggcgctccggcagaggcagggc

SEQ ID NO: 4787235 - DNA, 15 bp, Homo sapiens
gggcgctgagggcag

SEQ ID NO: 4787236 - DNA, 16 bp, Homo sapiens
gggcgctgcccccaca

SEQ ID NO: 4787237 - DNA, 20 bp, Homo sapiens
gggcgctgcccccacagatc

SEQ ID NO: 4787238 - DNA, 22 bp, Homo sapiens
gggcgctgcccccacagatcca

SEQ ID NO: 4787239 - DNA, 16 bp, Homo sapiens
gggcgctgcctgctct

SEQ ID NO: 4787240 - DNA, 15 bp, Homo sapiens
gggcggcctgcagac

SEQ ID NO: 4787241 - DNA, 13 bp, Homo sapiens
gggcgggccagga

SEQ ID NO: 4787242 - DNA, 14 bp, Homo sapiens
gggcgggccaggag

SEQ ID NO: 4787243 - DNA, 16 bp, Homo sapiens
gggctaacgggcgcct

SEQ ID NO: 4787244 - DNA, 13 bp, Homo sapiens
gggctaactggcc

SEQ ID NO: 4787245 - DNA, 17 bp, Homo sapiens
gggctaactggccccag

SEQ ID NO: 4787246 - DNA, 12 bp, Homo sapiens
gggctccagagt

SEQ ID NO: 4787247 - DNA, 20 bp, Homo sapiens
gggctccagagtaggtgggt

SEQ ID NO: 4787248 - DNA, 15 bp, Homo sapiens
gggctctccaagcac

SEQ ID NO: 4787249 - DNA, 21 bp, Homo sapiens
gggctctctcacccagcctgg

SEQ ID NO: 4787250 - DNA, 15 bp, Homo sapiens
gggctctctggacct

SEQ ID NO: 4787251 - DNA, 17 bp, Homo sapiens
gggctgagaggatgaac

SEQ ID NO: 4787252 - DNA, 18 bp, Homo sapiens
gggctgcatgcgggcttc

SEQ ID NO: 4787253 - DNA, 14 bp, Homo sapiens
gggctgctgcactg

SEQ ID NO: 4787254 - DNA, 11 bp, Homo sapiens
gggctggccct

SEQ ID NO: 4787255 - DNA, 23 bp, Homo sapiens
gggctggccctgccctcccccac

SEQ ID NO: 4787256 - DNA, 12 bp, Homo sapiens
gggctgggcaga

SEQ ID NO: 4787257 - DNA, 18 bp, Homo sapiens
gggctgttagctcagagg

SEQ ID NO: 4787258 - DNA, 18 bp, Homo sapiens
gggcttctccccctcagc

SEQ ID NO: 4787259 - DNA, 20 bp, Homo sapiens
gggcttctccccctcagctc

SEQ ID NO: 4787260 - DNA, 14 bp, Homo sapiens
gggcttggaagggc

SEQ ID NO: 4787261 - DNA, 14 bp, Homo sapiens
gggcttggagcaga

SEQ ID NO: 4787262 - DNA, 14 bp, Homo sapiens
gggcttggcgtgga

SEQ ID NO: 4787263 - DNA, 20 bp, Homo sapiens
gggcttggcgtggagcaggc

SEQ ID NO: 4787264 - DNA, 20 bp, Homo sapiens
gggcttggggaccagagctg

SEQ ID NO: 4787265 - DNA, 22 bp, Homo sapiens
gggcttggggaccagagctgcc

SEQ ID NO: 4787266 - DNA, 18 bp, Homo sapiens
gggcttggggtagagagg

SEQ ID NO: 4787267 - DNA, 20 bp, Homo sapiens
gggcttggggtagagaggac

SEQ ID NO: 4787268 - DNA, 19 bp, Homo sapiens
ggggaactcccccagaggt

SEQ ID NO: 4787269 - DNA, 19 bp, Homo sapiens
ggggaagctgcagcttggg

SEQ ID NO: 4787270 - DNA, 22 bp, Homo sapiens
ggggacaggattgtctgctgcc

SEQ ID NO: 4787271 - DNA, 20 bp, Homo sapiens
ggggaccgccccaggcaccg

SEQ ID NO: 4787272 - DNA, 15 bp, Homo sapiens
ggggacctcaggcct

SEQ ID NO: 4787273 - DNA, 16 bp, Homo sapiens
ggggacctcaggcctg

SEQ ID NO: 4787274 - DNA, 17 bp, Homo sapiens
ggggacctcaggcctgg

SEQ ID NO: 4787275 - DNA, 22 bp, Homo sapiens
ggggacgcccagcccccacccc

SEQ ID NO: 4787276 - DNA, 13 bp, Homo sapiens
ggggagcaaggct

SEQ ID NO: 4787277 - DNA, 14 bp, Homo sapiens
ggggagcaaggctg

SEQ ID NO: 4787278 - DNA, 22 bp, Homo sapiens
ggggaggagcacccccagcctc

SEQ ID NO: 4787279 - DNA, 12 bp, Homo sapiens
ggggaggctgag

SEQ ID NO: 4787280 - DNA, 15 bp, Homo sapiens
ggggagggcctctgg

SEQ ID NO: 4787281 - DNA, 13 bp, Homo sapiens
ggggaggtggcca

SEQ ID NO: 4787282 - DNA, 22 bp, Homo sapiens
ggggatctaaaaggaggacagg

SEQ ID NO: 4787283 - DNA, 23 bp, Homo sapiens
ggggatctaaaaggaggacaggg

SEQ ID NO: 4787284 - DNA, 14 bp, Homo sapiens
ggggatgggccagg

SEQ ID NO: 4787285 - DNA, 13 bp, Homo sapiens
ggggcaagagctc

SEQ ID NO: 4787286 - DNA, 19 bp, Homo sapiens
ggggcaagagctcaggaga

SEQ ID NO: 4787287 - DNA, 20 bp, Homo sapiens
ggggcaagagctcaggagaa

SEQ ID NO: 4787288 - DNA, 14 bp, Homo sapiens
ggggcacccagccc

SEQ ID NO: 4787289 - DNA, 12 bp, Homo sapiens
ggggcaggcctc

SEQ ID NO: 4787290 - DNA, 13 bp, Homo sapiens
ggggcaggcctcc

SEQ ID NO: 4787291 - DNA, 11 bp, Homo sapiens
ggggcagggtg

SEQ ID NO: 4787292 - DNA, 12 bp, Homo sapiens
ggggccagacca

SEQ ID NO: 4787293 - DNA, 14 bp, Homo sapiens
ggggccctgggcct

SEQ ID NO: 4787294 - DNA, 16 bp, Homo sapiens
ggggccgggcaggtcc

SEQ ID NO: 4787295 - DNA, 21 bp, Homo sapiens
ggggccgggcaggtcctgccc

SEQ ID NO: 4787296 - DNA, 19 bp, Homo sapiens
ggggcctgggtccccctcc

SEQ ID NO: 4787297 - DNA, 20 bp, Homo sapiens
ggggctacttatattctgca

SEQ ID NO: 4787298 - DNA, 22 bp, Homo sapiens
ggggctctagggttgctggagc

SEQ ID NO: 4787299 - DNA, 22 bp, Homo sapiens
ggggctgcagccccctgcttct

SEQ ID NO: 4787300 - DNA, 21 bp, Homo sapiens
ggggctgcttctccacctccc

SEQ ID NO: 4787301 - DNA, 16 bp, Homo sapiens
ggggctggccctgccc

SEQ ID NO: 4787302 - DNA, 11 bp, Homo sapiens
ggggctgggcc

SEQ ID NO: 4787303 - DNA, 14 bp, Homo sapiens
ggctttgggtagtg

SEQ ID NO: 4787304 - DNA, 18 bp, Homo sapiens
gggaaagaccctaggtgc

SEQ ID NO: 4787305 - DNA, 23 bp, Homo sapiens
gggaaaggaggcatgcctctgat

SEQ ID NO: 4787306 - DNA, 12 bp, Homo sapiens
gggaaaggccgg

SEQ ID NO: 4787307 - DNA, 19 bp, Homo sapiens
gggaaaggccggtgggaag

SEQ ID NO: 4787308 - DNA, 18 bp, Homo sapiens
gggaaatccaactccagg

SEQ ID NO: 4787309 - DNA, 18 bp, Homo sapiens
gggaaatgctgatttaaa

SEQ ID NO: 4787310 - DNA, 15 bp, Homo sapiens
gggaacaaattttca

SEQ ID NO: 4787311 - DNA, 13 bp, Homo sapiens
gggaactctgaca

SEQ ID NO: 4787312 - DNA, 19 bp, Homo sapiens
gggaactctgacaagggct

SEQ ID NO: 4787313 - DNA, 21 bp, Homo sapiens
gggaagagagaggcctgggtg

SEQ ID NO: 4787314 - DNA, 19 bp, Homo sapiens
gggaagcccacccgcccca

SEQ ID NO: 4787315 - DNA, 20 bp, Homo sapiens
gggaagcccacccgccccag

SEQ ID NO: 4787316 - DNA, 19 bp, Homo sapiens
gggaagctgagcccctccc

SEQ ID NO: 4787317 - DNA, 16 bp, Homo sapiens
gggaagctgcagcttg

SEQ ID NO: 4787318 - DNA, 19 bp, Homo sapiens
gggaagctgcagcttggga

SEQ ID NO: 4787319 - DNA, 12 bp, Homo sapiens
gggaaggcctga

SEQ ID NO: 4787320 - DNA, 19 bp, Homo sapiens
gggaaggcctgagggaagc

SEQ ID NO: 4787321 - DNA, 13 bp, Homo sapiens
gggaaggggcctg

SEQ ID NO: 4787322 - DNA, 21 bp, Homo sapiens
gggaaggggcctgggctgtga

SEQ ID NO: 4787323 - DNA, 14 bp, Homo sapiens
gggacaagccaggc

SEQ ID NO: 4787324 - DNA, 20 bp, Homo sapiens
gggacaagccaggccctctc

SEQ ID NO: 4787325 - DNA, 21 bp, Homo sapiens
gggacacaggatcctggcctg

SEQ ID NO: 4787326 - DNA, 22 bp, Homo sapiens
gggacacaggatcctggcctga

SEQ ID NO: 4787327 - DNA, 12 bp, Homo sapiens
gggacagcctgc

SEQ ID NO: 4787328 - DNA, 21 bp, Homo sapiens
gggacagcggccccgcggagc

SEQ ID NO: 4787329 - DNA, 15 bp, Homo sapiens
gggacagcggcccgg

SEQ ID NO: 4787330 - DNA, 18 bp, Homo sapiens
gggacagcggcccggccc

SEQ ID NO: 4787331 - DNA, 22 bp, Homo sapiens
gggacgagcagagcgcagcccc

SEQ ID NO: 4787332 - DNA, 16 bp, Homo sapiens
gggacgcccagccccc

SEQ ID NO: 4787333 - DNA, 18 bp, Homo sapiens
gggacgcccagcccccac

SEQ ID NO: 4787334 - DNA, 21 bp, Homo sapiens
gggacgcccagcccccacccc

SEQ ID NO: 4787335 - DNA, 14 bp, Homo sapiens
gggacgcccctttc

SEQ ID NO: 4787336 - DNA, 16 bp, Homo sapiens
gggactccaagccctg

SEQ ID NO: 4787337 - DNA, 17 bp, Homo sapiens
gggactgcctctgccac

SEQ ID NO: 4787338 - DNA, 19 bp, Homo sapiens
gggactggcccacccctct

SEQ ID NO: 4787339 - DNA, 18 bp, Homo sapiens
gggacttcgggggcggct

SEQ ID NO: 4787340 - DNA, 23 bp, Homo sapiens
gggacttcgggggcggctctggg

SEQ ID NO: 4787341 - DNA, 14 bp, Homo sapiens
gggagaaaagccag

SEQ ID NO: 4787342 - DNA, 15 bp, Homo sapiens
gggagaatggctctg

SEQ ID NO: 4787343 - DNA, 13 bp, Homo sapiens
gggagactgagct

SEQ ID NO: 4787344 - DNA, 14 bp, Homo sapiens
gggagagcccctgg

SEQ ID NO: 4787345 - DNA, 15 bp, Homo sapiens
gggagagcccctggg

SEQ ID NO: 4787346 - DNA, 22 bp, Homo sapiens
gggagagcgccacccgcccgcc

SEQ ID NO: 4787347 - DNA, 17 bp, Homo sapiens
gggagaggagaggctgc

SEQ ID NO: 4787348 - DNA, 13 bp, Homo sapiens
gggagccacaggg

SEQ ID NO: 4787349 - DNA, 23 bp, Homo sapiens
gggagccacagggacgacccggg

SEQ ID NO: 4787350 - DNA, 16 bp, Homo sapiens
gggaggacccctgccc

SEQ ID NO: 4787351 - DNA, 11 bp, Homo sapiens
gggaggctgag

SEQ ID NO: 4787352 - DNA, 19 bp, Homo sapiens
gggaggcttccagctcagt

SEQ ID NO: 4787353 - DNA, 12 bp, Homo sapiens
gggaggggaaga

SEQ ID NO: 4787354 - DNA, 19 bp, Homo sapiens
gggaggtggccagcccgca

SEQ ID NO: 4787355 - DNA, 20 bp, Homo sapiens
gggatccaccgccacactgg

SEQ ID NO: 4787356 - DNA, 14 bp, Homo sapiens
gggatccagagacc

SEQ ID NO: 4787357 - DNA, 21 bp, Homo sapiens
gggatccagagacctgctcca

SEQ ID NO: 4787358 - DNA, 17 bp, Homo sapiens
gggatctaaaaggagga

SEQ ID NO: 4787359 - DNA, 20 bp, Homo sapiens
gggatctaaaaggaggacag

SEQ ID NO: 4787360 - DNA, 14 bp, Homo sapiens
gggcaaaggccccc

SEQ ID NO: 4787361 - DNA, 21 bp, Homo sapiens
gggcaaatgacatgcactgac

SEQ ID NO: 4787362 - DNA, 23 bp, Homo sapiens
gggcaagagctcaggagaaggcc

SEQ ID NO: 4787363 - DNA, 18 bp, Homo sapiens
gggcacagaaaatggaag

SEQ ID NO: 4787364 - DNA, 20 bp, Homo sapiens
gggcacagaaaatggaagac

SEQ ID NO: 4787365 - DNA, 12 bp, Homo sapiens
gggcacagccag

SEQ ID NO: 4787366 - DNA, 13 bp, Homo sapiens
gggcacagccaga

SEQ ID NO: 4787367 - DNA, 14 bp, Homo sapiens
gggcacagccagaa

SEQ ID NO: 4787368 - DNA, 18 bp, Homo sapiens
gggcacgggagagcgcca

SEQ ID NO: 4787369 - DNA, 21 bp, Homo sapiens
gggcactgtcatgcccagctt

SEQ ID NO: 4787370 - DNA, 22 bp, Homo sapiens
gggcactgtcatgcccagcttg

SEQ ID NO: 4787371 - DNA, 22 bp, Homo sapiens
gggcagaaatgtgctgcaaaga

SEQ ID NO: 4787372 - DNA, 18 bp, Homo sapiens
gggcagaccagagagctc

SEQ ID NO: 4787373 - DNA, 19 bp, Homo sapiens
gggcagaccagagagctca

SEQ ID NO: 4787374 - DNA, 16 bp, Homo sapiens
gggcagagaccaccgc

SEQ ID NO: 4787375 - DNA, 21 bp, Homo sapiens
gggcagagctgagtcggctgg

SEQ ID NO: 4787376 - DNA, 14 bp, Homo sapiens
gctccattcctgag

SEQ ID NO: 4787377 - DNA, 16 bp, Homo sapiens
gctccattcctgagta

SEQ ID NO: 4787378 - DNA, 12 bp, Homo sapiens
gctcccactgcc

SEQ ID NO: 4787379 - DNA, 14 bp, Homo sapiens
gctcccagggtcct

SEQ ID NO: 4787380 - DNA, 23 bp, Homo sapiens
gctccccaatccaacccatgcat

SEQ ID NO: 4787381 - DNA, 14 bp, Homo sapiens
gctccccagcccca

SEQ ID NO: 4787382 - DNA, 22 bp, Homo sapiens
gctccccatggctcctcaccac

SEQ ID NO: 4787383 - DNA, 13 bp, Homo sapiens
gctcccctctgcc

SEQ ID NO: 4787384 - DNA, 17 bp, Homo sapiens
gctccctcgctgtatga

SEQ ID NO: 4787385 - DNA, 10 bp, Homo sapiens
gctccctgct

SEQ ID NO: 4787386 - DNA, 15 bp, Homo sapiens
gctccctttttgaat

SEQ ID NO: 4787387 - DNA, 18 bp, Homo sapiens
gctccctttttgaattgt

SEQ ID NO: 4787388 - DNA, 20 bp, Homo sapiens
gctccgagtggctcccgtgt

SEQ ID NO: 4787389 - DNA, 14 bp, Homo sapiens
gctccggcagaggc

SEQ ID NO: 4787390 - DNA, 15 bp, Homo sapiens
gctccggcagaggca

SEQ ID NO: 4787391 - DNA, 14 bp, Homo sapiens
gctcctcactgccc

SEQ ID NO: 4787392 - DNA, 16 bp, Homo sapiens
gctcctcactgcccgc

SEQ ID NO: 4787393 - DNA, 15 bp, Homo sapiens
gctcctcccagctgt

SEQ ID NO: 4787394 - DNA, 20 bp, Homo sapiens
gctcctcgggtggggcctgc

SEQ ID NO: 4787395 - DNA, 13 bp, Homo sapiens
gctcctctgcagc

SEQ ID NO: 4787396 - DNA, 17 bp, Homo sapiens
gctcctctgcagcctga

SEQ ID NO: 4787397 - DNA, 18 bp, Homo sapiens
gctcctctgcagcctgag

SEQ ID NO: 4787398 - DNA, 19 bp, Homo sapiens
gctcctctgcagcctgagc

SEQ ID NO: 4787399 - DNA, 20 bp, Homo sapiens
gctcctctgttatttgtcct

SEQ ID NO: 4787400 - DNA, 14 bp, Homo sapiens
gctcctcttcctgc

SEQ ID NO: 4787401 - DNA, 12 bp, Homo sapiens
gctcctggcttt

SEQ ID NO: 4787402 - DNA, 22 bp, Homo sapiens
gctccttagctagttagctcac

SEQ ID NO: 4787403 - DNA, 20 bp, Homo sapiens
gctccttcatgcttttctca

SEQ ID NO: 4787404 - DNA, 12 bp, Homo sapiens
gctcctttcccc

SEQ ID NO: 4787405 - DNA, 15 bp, Homo sapiens
gctccttttctcttt

SEQ ID NO: 4787406 - DNA, 14 bp, Homo sapiens
gctcgccctgtgcc

SEQ ID NO: 4787407 - DNA, 19 bp, Homo sapiens
gctcgccctgtgccctctc

SEQ ID NO: 4787408 - DNA, 13 bp, Homo sapiens
gctcggacacagt

SEQ ID NO: 4787409 - DNA, 16 bp, Homo sapiens
gctcgggaaggcctga

SEQ ID NO: 4787410 - DNA, 14 bp, Homo sapiens
gctcgggactgtct

SEQ ID NO: 4787411 - DNA, 13 bp, Homo sapiens
gctcgtgcatgta

SEQ ID NO: 4787412 - DNA, 14 bp, Homo sapiens
gctcgtgcatgtaa

SEQ ID NO: 4787413 - DNA, 21 bp, Homo sapiens
gctctagggaagcagtgcgtg

SEQ ID NO: 4787414 - DNA, 23 bp, Homo sapiens
gctctagggttgctggagcctga

SEQ ID NO: 4787415 - DNA, 13 bp, Homo sapiens
gctctcaggccag

SEQ ID NO: 4787416 - DNA, 12 bp, Homo sapiens
gctctcccaggt

SEQ ID NO: 4787417 - DNA, 22 bp, Homo sapiens
gctctccgccccccggcctggc

SEQ ID NO: 4787418 - DNA, 18 bp, Homo sapiens
gctctcctccagccctgg

SEQ ID NO: 4787419 - DNA, 19 bp, Homo sapiens
gctctcctccagccctggg

SEQ ID NO: 4787420 - DNA, 21 bp, Homo sapiens
gctctcctccagccctgggca

SEQ ID NO: 4787421 - DNA, 16 bp, Homo sapiens
gctctctaagaattca

SEQ ID NO: 4787422 - DNA, 16 bp, Homo sapiens
gctctctcacccagcc

SEQ ID NO: 4787423 - DNA, 19 bp, Homo sapiens
gctctctcacccagcctgg

SEQ ID NO: 4787424 - DNA, 20 bp, Homo sapiens
gctctgaagggaggggaaga

SEQ ID NO: 4787425 - DNA, 22 bp, Homo sapiens
gctctgaatctctcaaaatgtg

SEQ ID NO: 4787426 - DNA, 16 bp, Homo sapiens
gctctgagactaaatg

SEQ ID NO: 4787427 - DNA, 22 bp, Homo sapiens
gctctgcccctccgtccccagg

SEQ ID NO: 4787428 - DNA, 21 bp, Homo sapiens
gctctggaaaacctgaggcca

SEQ ID NO: 4787429 - DNA, 18 bp, Homo sapiens
gctctgtagcctggtctg

SEQ ID NO: 4787430 - DNA, 21 bp, Homo sapiens
gctctgtagcctggtctgtgc

SEQ ID NO: 4787431 - DNA, 14 bp, Homo sapiens
gctcttcaccagga

SEQ ID NO: 4787432 - DNA, 19 bp, Homo sapiens
gctcttcccaagtcctcgc

SEQ ID NO: 4787433 - DNA, 21 bp, Homo sapiens
gctcttcccaagtcctcgccc

SEQ ID NO: 4787434 - DNA, 19 bp, Homo sapiens
gctcttctcattttttcct

SEQ ID NO: 4787435 - DNA, 21 bp, Homo sapiens
gctgaaaaccatctggcctgg

SEQ ID NO: 4787436 - DNA, 22 bp, Homo sapiens
gctgaaaaccatctggcctggc

SEQ ID NO: 4787437 - DNA, 23 bp, Homo sapiens
gctgaaaaccatctggcctggcc

SEQ ID NO: 4787438 - DNA, 20 bp, Homo sapiens
gctgaaattatgtcaaatgg

SEQ ID NO: 4787439 - DNA, 18 bp, Homo sapiens
gctgaataacaacaattt

SEQ ID NO: 4787440 - DNA, 16 bp, Homo sapiens
gctgacctgcctctca

SEQ ID NO: 4787441 - DNA, 22 bp, Homo sapiens
gctgacctgcctctcacacaca

SEQ ID NO: 4787442 - DNA, 13 bp, Homo sapiens
gctgacttgcaga

SEQ ID NO: 4787443 - DNA, 17 bp, Homo sapiens
gctgagacacagcccag

SEQ ID NO: 4787444 - DNA, 23 bp, Homo sapiens
gctgagacgcaaggatcacttga

SEQ ID NO: 4787445 - DNA, 19 bp, Homo sapiens
gctgagagggtgtgggtgc

SEQ ID NO: 4787446 - DNA, 19 bp, Homo sapiens
gctgagatgggaggatcac

SEQ ID NO: 4787447 - DNA, 21 bp, Homo sapiens
gctgagcacccagctctgtct

SEQ ID NO: 4787448 - DNA, 14 bp, Homo sapiens
gctgagctggccta

SEQ ID NO: 4787449 - DNA, 16 bp, Homo sapiens
gctgaggacggggcag

SEQ ID NO: 4787450 - DNA, 20 bp, Homo sapiens
gctgaggacggggcagagct

SEQ ID NO: 4787451 - DNA, 23 bp, Homo sapiens
gctgaggacggggcagagctgag

SEQ ID NO: 4787452 - DNA, 22 bp, Homo sapiens
gctgagggcagggttctagaag

SEQ ID NO: 4787453 - DNA, 21 bp, Homo sapiens
gcgccccgcccccacccctac

SEQ ID NO: 4787454 - DNA, 14 bp, Homo sapiens
gcgcccctctgcgc

SEQ ID NO: 4787455 - DNA, 17 bp, Homo sapiens
gcgcccctctgcgcccc

SEQ ID NO: 4787456 - DNA, 21 bp, Homo sapiens
gcgcccctctgcgccccagcg

SEQ ID NO: 4787457 - DNA, 16 bp, Homo sapiens
gcgcccctgcccagca

SEQ ID NO: 4787458 - DNA, 18 bp, Homo sapiens
gcgcccgaggccagggcc

SEQ ID NO: 4787459 - DNA, 22 bp, Homo sapiens
gcgcccggactgaccgaaggga

SEQ ID NO: 4787460 - DNA, 20 bp, Homo sapiens
gcgccctccctccctccaca

SEQ ID NO: 4787461 - DNA, 20 bp, Homo sapiens
gcgccgcctcgcccccgggc

SEQ ID NO: 4787462 - DNA, 21 bp, Homo sapiens
gcgccggcgccccggacgccg

SEQ ID NO: 4787463 - DNA, 15 bp, Homo sapiens
gcgccggttccacgt

SEQ ID NO: 4787464 - DNA, 18 bp, Homo sapiens
gcgccggttccacgtggg

SEQ ID NO: 4787465 - DNA, 17 bp, Homo sapiens
gcgcctcccgccgcctc

SEQ ID NO: 4787466 - DNA, 17 bp, Homo sapiens
gcgcctcctcctgcatg

SEQ ID NO: 4787467 - DNA, 22 bp, Homo sapiens
gcgcctgcgctcctctgcagcc

SEQ ID NO: 4787468 - DNA, 11 bp, Homo sapiens
gcgcctgggtc

SEQ ID NO: 4787469 - DNA, 19 bp, Homo sapiens
gcgcctgggtcctcccagc

SEQ ID NO: 4787470 - DNA, 13 bp, Homo sapiens
gcgcctgtcgggc

SEQ ID NO: 4787471 - DNA, 16 bp, Homo sapiens
gcgcctgtcgggcccg

SEQ ID NO: 4787472 - DNA, 15 bp, Homo sapiens
gcgcgatctcagctc

SEQ ID NO: 4787473 - DNA, 17 bp, Homo sapiens
gcgcgcaccgcccaacc

SEQ ID NO: 4787474 - DNA, 12 bp, Homo sapiens
gcgcgcccccag

SEQ ID NO: 4787475 - DNA, 16 bp, Homo sapiens
gcgcgggacagcggcc

SEQ ID NO: 4787476 - DNA, 16 bp, Homo sapiens
gcgctccggcagaggc

SEQ ID NO: 4787477 - DNA, 21 bp, Homo sapiens
gcgctccggcagaggcagggc

SEQ ID NO: 4787478 - DNA, 13 bp, Homo sapiens
gcgctcctctgca

SEQ ID NO: 4787479 - DNA, 15 bp, Homo sapiens
gcgctcctggctttt

SEQ ID NO: 4787480 - DNA, 13 bp, Homo sapiens
gcgctctgcccct

SEQ ID NO: 4787481 - DNA, 14 bp, Homo sapiens
gcgctctgcccctc

SEQ ID NO: 4787482 - DNA, 15 bp, Homo sapiens
gcgctctgcccctcc

SEQ ID NO: 4787483 - DNA, 20 bp, Homo sapiens
gcgctctgcccctccgtccc

SEQ ID NO: 4787484 - DNA, 13 bp, Homo sapiens
gcgctctgggttt

SEQ ID NO: 4787485 - DNA, 16 bp, Homo sapiens
gcgctcttcaccagga

SEQ ID NO: 4787486 - DNA, 18 bp, Homo sapiens
gcgctcttcaccaggaag

SEQ ID NO: 4787487 - DNA, 19 bp, Homo sapiens
gcgctcttcaccaggaaga

SEQ ID NO: 4787488 - DNA, 23 bp, Homo sapiens
gcgctgagggcagggttctagaa

SEQ ID NO: 4787489 - DNA, 15 bp, Homo sapiens
gcgctgcccccacag

SEQ ID NO: 4787490 - DNA, 17 bp, Homo sapiens
gcgctgcccccacagat

SEQ ID NO: 4787491 - DNA, 20 bp, Homo sapiens
gcgctgcccccacagatcca

SEQ ID NO: 4787492 - DNA, 22 bp, Homo sapiens
gcgctggacgatagcttggagg

SEQ ID NO: 4787493 - DNA, 13 bp, Homo sapiens
gccccccctatct

SEQ ID NO: 4787494 - DNA, 17 bp, Homo sapiens
gccccccggcctgatgg

SEQ ID NO: 4787495 - DNA, 14 bp, Homo sapiens
gccccccttcccac

SEQ ID NO: 4787496 - DNA, 15 bp, Homo sapiens
gcccccgcccaggcc

SEQ ID NO: 4787497 - DNA, 14 bp, Homo sapiens
gcccccgcccctcc

SEQ ID NO: 4787498 - DNA, 18 bp, Homo sapiens
gcccccgccctcgctccg

SEQ ID NO: 4787499 - DNA, 17 bp, Homo sapiens
gcccccggaggcgccca

SEQ ID NO: 4787500 - DNA, 19 bp, Homo sapiens
gcccccggaggcgcccacc

SEQ ID NO: 4787501 - DNA, 20 bp, Homo sapiens
gcccccggaggcgcccacct

SEQ ID NO: 4787502 - DNA, 23 bp, Homo sapiens
gcccccggaggcgcccacctgcc

SEQ ID NO: 4787503 - DNA, 12 bp, Homo sapiens
gccccctccccc

SEQ ID NO: 4787504 - DNA, 13 bp, Homo sapiens
gccccctcccccg

SEQ ID NO: 4787505 - DNA, 18 bp, Homo sapiens
gccccctcgcgcccctgt

SEQ ID NO: 4787506 - DNA, 11 bp, Homo sapiens
gccccctctct

SEQ ID NO: 4787507 - DNA, 15 bp, Homo sapiens
gccccctgcacccac

SEQ ID NO: 4787508 - DNA, 17 bp, Homo sapiens
gccccctgcacccaccc

SEQ ID NO: 4787509 - DNA, 20 bp, Homo sapiens
gccccctgcacccacccctg

SEQ ID NO: 4787510 - DNA, 15 bp, Homo sapiens
gccccctgcttctcc

SEQ ID NO: 4787511 - DNA, 23 bp, Homo sapiens
gccccctggggggcacagccaga

SEQ ID NO: 4787512 - DNA, 14 bp, Homo sapiens
gccccgcccccacc

SEQ ID NO: 4787513 - DNA, 15 bp, Homo sapiens
gccccgcccccaccc

SEQ ID NO: 4787514 - DNA, 21 bp, Homo sapiens
gccccgcccccacccctacag

SEQ ID NO: 4787515 - DNA, 20 bp, Homo sapiens
gccccgcgcgtgcccccagc

SEQ ID NO: 4787516 - DNA, 15 bp, Homo sapiens
gccccggacagggtg

SEQ ID NO: 4787517 - DNA, 17 bp, Homo sapiens
gccccggacagggtggc

SEQ ID NO: 4787518 - DNA, 14 bp, Homo sapiens
gccccggagcacca

SEQ ID NO: 4787519 - DNA, 14 bp, Homo sapiens
gccccgtgctcctc

SEQ ID NO: 4787520 - DNA, 16 bp, Homo sapiens
gccccgtgctcctctg

SEQ ID NO: 4787521 - DNA, 15 bp, Homo sapiens
gaacttggcgctgcc

SEQ ID NO: 4787522 - DNA, 17 bp, Homo sapiens
gaacttggcgctgcccc

SEQ ID NO: 4787523 - DNA, 12 bp, Homo sapiens
gaacttggttcc

SEQ ID NO: 4787524 - DNA, 22 bp, Homo sapiens
gaagaaaactatcctgcgggtt

SEQ ID NO: 4787525 - DNA, 16 bp, Homo sapiens
gaagaaaatgagatgg

SEQ ID NO: 4787526 - DNA, 19 bp, Homo sapiens
gaagaaacacagcatgcat

SEQ ID NO: 4787527 - DNA, 20 bp, Homo sapiens
gaagaaacacagcatgcatt

SEQ ID NO: 4787528 - DNA, 21 bp, Homo sapiens
gaagaaacacagcatgcattt

SEQ ID NO: 4787529 - DNA, 20 bp, Homo sapiens
gaagaaagaacggaagaaga

SEQ ID NO: 4787530 - DNA, 11 bp, Homo sapiens
gaagaaataca

SEQ ID NO: 4787531 - DNA, 16 bp, Homo sapiens
gaagaaggactgaaga

SEQ ID NO: 4787532 - DNA, 21 bp, Homo sapiens
gaagaaggactgaagaaaatc

SEQ ID NO: 4787533 - DNA, 16 bp, Homo sapiens
gaagaaggcccgggag

SEQ ID NO: 4787534 - DNA, 14 bp, Homo sapiens
gaagaagggaaatt

SEQ ID NO: 4787535 - DNA, 14 bp, Homo sapiens
gaagaattcatgat

SEQ ID NO: 4787536 - DNA, 13 bp, Homo sapiens
gaagacagagatg

SEQ ID NO: 4787537 - DNA, 14 bp, Homo sapiens
gaagacagctctta

SEQ ID NO: 4787538 - DNA, 15 bp, Homo sapiens
gaagaccctatctcc

SEQ ID NO: 4787539 - DNA, 20 bp, Homo sapiens
gaagaccctatctcccacaa

SEQ ID NO: 4787540 - DNA, 16 bp, Homo sapiens
gaagaccctcagttat

SEQ ID NO: 4787541 - DNA, 13 bp, Homo sapiens
gaagacttcaaaa

SEQ ID NO: 4787542 - DNA, 15 bp, Homo sapiens
gaagacttcatccct

SEQ ID NO: 4787543 - DNA, 17 bp, Homo sapiens
gaagacttcatccctct

SEQ ID NO: 4787544 - DNA, 19 bp, Homo sapiens
gaagacttcatccctctgg

SEQ ID NO: 4787545 - DNA, 19 bp, Homo sapiens
gaagacttccagctttctc

SEQ ID NO: 4787546 - DNA, 23 bp, Homo sapiens
gaagacttccagctttctctttg

SEQ ID NO: 4787547 - DNA, 14 bp, Homo sapiens
gaagagaaggagca

SEQ ID NO: 4787548 - DNA, 17 bp, Homo sapiens
gaagagagaggcctggg

SEQ ID NO: 4787549 - DNA, 19 bp, Homo sapiens
gaagagagatatatctgaa

SEQ ID NO: 4787550 - DNA, 23 bp, Homo sapiens
gaagagagatatatctgaaaact

SEQ ID NO: 4787551 - DNA, 19 bp, Homo sapiens
gaagagctgctgtatttga

SEQ ID NO: 4787552 - DNA, 23 bp, Homo sapiens
gaagaggggcgctgcccccacag

SEQ ID NO: 4787553 - DNA, 16 bp, Homo sapiens
gaagagtagataagtg

SEQ ID NO: 4787554 - DNA, 21 bp, Homo sapiens
gaagagtctttgattcaccaa

SEQ ID NO: 4787555 - DNA, 16 bp, Homo sapiens
gaagatagttgtaaag

SEQ ID NO: 4787556 - DNA, 19 bp, Homo sapiens
gaagatgcattttaaatgt

SEQ ID NO: 4787557 - DNA, 23 bp, Homo sapiens
gaagatgcattttaaatgtctat

SEQ ID NO: 4787558 - DNA, 14 bp, Homo sapiens
gaagatgccaaggg

SEQ ID NO: 4787559 - DNA, 15 bp, Homo sapiens
gaagcaaacacacag

SEQ ID NO: 4787560 - DNA, 18 bp, Homo sapiens
gaagcaaacacacagact

SEQ ID NO: 4787561 - DNA, 17 bp, Homo sapiens
gaagcacatgcctctct

SEQ ID NO: 4787562 - DNA, 13 bp, Homo sapiens
gaagcaccccacc

SEQ ID NO: 4787563 - DNA, 14 bp, Homo sapiens
gaagcagtttcaga

SEQ ID NO: 4787564 - DNA, 16 bp, Homo sapiens
gaagcagtttcagata

SEQ ID NO: 4787565 - DNA, 22 bp, Homo sapiens
gaagcagtttcagataaatcat

SEQ ID NO: 4787566 - DNA, 13 bp, Homo sapiens
gaagcatgaggtg

SEQ ID NO: 4787567 - DNA, 16 bp, Homo sapiens
gaagccacgctgtcct

SEQ ID NO: 4787568 - DNA, 16 bp, Homo sapiens
gaagccagcaggctct

SEQ ID NO: 4787569 - DNA, 23 bp, Homo sapiens
gaagccagcaggctctcaggcca

SEQ ID NO: 4787570 - DNA, 12 bp, Homo sapiens
gaagcccacccg

SEQ ID NO: 4787571 - DNA, 15 bp, Homo sapiens
gaagcccacccgccc

SEQ ID NO: 4787572 - DNA, 23 bp, Homo sapiens
gaagcccacccgccccagagact

SEQ ID NO: 4787573 - DNA, 16 bp, Homo sapiens
gaagccggcggagctc

SEQ ID NO: 4787574 - DNA, 23 bp, Homo sapiens
gaagccttttcctgaggtcatct

SEQ ID NO: 4787575 - DNA, 12 bp, Homo sapiens
gaagctgcagct

SEQ ID NO: 4787576 - DNA, 18 bp, Homo sapiens
gaagctgcagcttgggag

SEQ ID NO: 4787577 - DNA, 18 bp, Homo sapiens
gaaggaaggcagggagga

SEQ ID NO: 4787578 - DNA, 13 bp, Homo sapiens
gaaggaatgcaat

SEQ ID NO: 4787579 - DNA, 19 bp, Homo sapiens
gaaggacacagtcaggggc

SEQ ID NO: 4787580 - DNA, 16 bp, Homo sapiens
gaaggagaggagtgcg

SEQ ID NO: 4787581 - DNA, 17 bp, Homo sapiens
gaaggaggggaagctgc

SEQ ID NO: 4787582 - DNA, 18 bp, Homo sapiens
gaaggaggggaagctgca

SEQ ID NO: 4787583 - DNA, 22 bp, Homo sapiens
gaaggattcttttttcaatgta

SEQ ID NO: 4787584 - DNA, 16 bp, Homo sapiens
gaaggcacactgagca

SEQ ID NO: 4787585 - DNA, 21 bp, Homo sapiens
gaaggcacaggtgtaaatata

SEQ ID NO: 4787586 - DNA, 18 bp, Homo sapiens
gaaggcagggaggaggca

SEQ ID NO: 4787587 - DNA, 18 bp, Homo sapiens
gaaggcatgcctggacaa

SEQ ID NO: 4787588 - DNA, 11 bp, Homo sapiens
gaaggccccag

SEQ ID NO: 4787589 - DNA, 21 bp, Homo sapiens
gaaggcctgagggaagcccac

SEQ ID NO: 4787590 - DNA, 22 bp, Homo sapiens
gaaggcctgagggaagcccacc

SEQ ID NO: 4787591 - DNA, 14 bp, Homo sapiens
gaaggcctgccccc

SEQ ID NO: 4787592 - DNA, 17 bp, Homo sapiens
gaaggcctgcccccctt

SEQ ID NO: 4787593 - DNA, 15 bp, Homo sapiens
gaagggaccccagat

SEQ ID NO: 4787594 - DNA, 16 bp, Homo sapiens
gaagggcaggagctca

SEQ ID NO: 4787595 - DNA, 13 bp, Homo sapiens
gaagggcccagga

SEQ ID NO: 4787596 - DNA, 15 bp, Homo sapiens
gaagggcccccggct

SEQ ID NO: 4787597 - DNA, 15 bp, Homo sapiens
gaaggggcctgggct

SEQ ID NO: 4787598 - DNA, 16 bp, Homo sapiens
gaaggggcctgggctg

SEQ ID NO: 4787599 - DNA, 21 bp, Homo sapiens
gaaggggcctgggctgtgagg

SEQ ID NO: 4787600 - DNA, 14 bp, Homo sapiens
gaagggtccggctt

SEQ ID NO: 4787601 - DNA, 22 bp, Homo sapiens
gaagtaagttctgaaaactgtt

SEQ ID NO: 4787602 - DNA, 23 bp, Homo sapiens
gaagtaagttctgaaaactgttt

SEQ ID NO: 4787603 - DNA, 14 bp, Homo sapiens
gaagtacagggcag

SEQ ID NO: 4787604 - DNA, 18 bp, Homo sapiens
gaagtactataatttacc

SEQ ID NO: 4787605 - DNA, 22 bp, Homo sapiens
gaagtatagatggtagaaactt

SEQ ID NO: 4787606 - DNA, 12 bp, Homo sapiens
gaagtcaggagc

SEQ ID NO: 4787607 - DNA, 17 bp, Homo sapiens
gaagtcaggagccagca

SEQ ID NO: 4787608 - DNA, 18 bp, Homo sapiens
gaagtctttgtacagaca

SEQ ID NO: 4787609 - DNA, 20 bp, Homo sapiens
gaagtctttgtacagacaac

SEQ ID NO: 4787610 - DNA, 17 bp, Homo sapiens
gaagtgaccaaggtgaa

SEQ ID NO: 4787611 - DNA, 14 bp, Homo sapiens
gaagtggcctgaga

SEQ ID NO: 4787612 - DNA, 16 bp, Homo sapiens
gaagttggacagcaaa

SEQ ID NO: 4787613 - DNA, 13 bp, Homo sapiens
gaagtttaaatct

SEQ ID NO: 4787614 - DNA, 14 bp, Homo sapiens
gaagtttcatttat

SEQ ID NO: 4787615 - DNA, 15 bp, Homo sapiens
gaagtttcatttatg

SEQ ID NO: 4787616 - DNA, 17 bp, Homo sapiens
gaataatgtgggaagaa

SEQ ID NO: 4787617 - DNA, 20 bp, Homo sapiens
gaataatgtgggaagaaaca

SEQ ID NO: 4787618 - DNA, 13 bp, Homo sapiens
gaatactgtattg

SEQ ID NO: 4787619 - DNA, 22 bp, Homo sapiens
gaataggaaattgaacctgggg

SEQ ID NO: 4787620 - DNA, 17 bp, Homo sapiens
gaatagtacatgcagaa

SEQ ID NO: 4787621 - DNA, 13 bp, Homo sapiens
gaatatggacaaa

SEQ ID NO: 4787622 - DNA, 16 bp, Homo sapiens
gaatattaaaaattaa

SEQ ID NO: 4787623 - DNA, 21 bp, Homo sapiens
gaatcaaaaattgaagagaga

SEQ ID NO: 4787624 - DNA, 16 bp, Homo sapiens
gaatcaagtctgtgaa

SEQ ID NO: 4787625 - DNA, 15 bp, Homo sapiens
gagagtatggtgctg

SEQ ID NO: 4787626 - DNA, 20 bp, Homo sapiens
gagatagccaaggccaaagg

SEQ ID NO: 4787627 - DNA, 18 bp, Homo sapiens
gagatagcttagtgtctc

SEQ ID NO: 4787628 - DNA, 20 bp, Homo sapiens
gagatcaggaagagaaggag

SEQ ID NO: 4787629 - DNA, 17 bp, Homo sapiens
gagatcctgtgattcct

SEQ ID NO: 4787630 - DNA, 14 bp, Homo sapiens
gcatctgtggcctg

SEQ ID NO: 4787631 - DNA, 18 bp, Homo sapiens
gcatctgtggcctggggc

SEQ ID NO: 4787632 - DNA, 19 bp, Homo sapiens
gcatctgtggcctggggcc

SEQ ID NO: 4787633 - DNA, 18 bp, Homo sapiens
gcatgagaactaaataga

SEQ ID NO: 4787634 - DNA, 14 bp, Homo sapiens
gcatgcaaaaatga

SEQ ID NO: 4787635 - DNA, 22 bp, Homo sapiens
gcatgcagggcccccatgcagg

SEQ ID NO: 4787636 - DNA, 19 bp, Homo sapiens
gcatgcctctgatatggga

SEQ ID NO: 4787637 - DNA, 15 bp, Homo sapiens
gcatgctccctcatg

SEQ ID NO: 4787638 - DNA, 19 bp, Homo sapiens
gcatgctccctcatgcaga

SEQ ID NO: 4787639 - DNA, 15 bp, Homo sapiens
gcatgctgcctgcct

SEQ ID NO: 4787640 - DNA, 16 bp, Homo sapiens
gcatgctgcctgcctc

SEQ ID NO: 4787641 - DNA, 17 bp, Homo sapiens
gcatgctgcctgcctcc

SEQ ID NO: 4787642 - DNA, 16 bp, Homo sapiens
gcatgcttattagcag

SEQ ID NO: 4787643 - DNA, 22 bp, Homo sapiens
gcatgcttattagcagctgggt

SEQ ID NO: 4787644 - DNA, 21 bp, Homo sapiens
gcatggccgcaacttcccagg

SEQ ID NO: 4787645 - DNA, 15 bp, Homo sapiens
gcatggcctcccagc

SEQ ID NO: 4787646 - DNA, 18 bp, Homo sapiens
gcatggcctcccagccac

SEQ ID NO: 4787647 - DNA, 15 bp, Homo sapiens
gcatggcgccccggg

SEQ ID NO: 4787648 - DNA, 19 bp, Homo sapiens
gcatggcgccccgggccgc

SEQ ID NO: 4787649 - DNA, 21 bp, Homo sapiens
gcatggctgccaatgggagct

SEQ ID NO: 4787650 - DNA, 14 bp, Homo sapiens
tcaactccaaggca

SEQ ID NO: 4787651 - DNA, 15 bp, Homo sapiens
tcaactccaaggcaa

SEQ ID NO: 4787652 - DNA, 20 bp, Homo sapiens
tcaactccaaggcaaatgtc

SEQ ID NO: 4787653 - DNA, 21 bp, Homo sapiens
tcaactccaaggcaaatgtcc

SEQ ID NO: 4787654 - DNA, 22 bp, Homo sapiens
tcaactccaaggcaaatgtcca

SEQ ID NO: 4787655 - DNA, 20 bp, Homo sapiens
tcaactctcctccagagtca

SEQ ID NO: 4787656 - DNA, 20 bp, Homo sapiens
tcaacttcagttgaaaagag

SEQ ID NO: 4787657 - DNA, 21 bp, Homo sapiens
tcaactttagtatttttacta

SEQ ID NO: 4787658 - DNA, 13 bp, Homo sapiens
tcaactttttcct

SEQ ID NO: 4787659 - DNA, 18 bp, Homo sapiens
tcaagacggatccacagt

SEQ ID NO: 4787660 - DNA, 22 bp, Homo sapiens
tcaagatgggtgattatgaaat

SEQ ID NO: 4787661 - DNA, 23 bp, Homo sapiens
tcaagatgggtgattatgaaatg

SEQ ID NO: 4787662 - DNA, 22 bp, Homo sapiens
tcaagattaagttataccagca

SEQ ID NO: 4787663 - DNA, 15 bp, Homo sapiens
tcaagcaaagacagt

SEQ ID NO: 4787664 - DNA, 12 bp, Homo sapiens
tcaagcatgaag

SEQ ID NO: 4787665 - DNA, 16 bp, Homo sapiens
tcaagcatgaagataa

SEQ ID NO: 4787666 - DNA, 14 bp, Homo sapiens
tcaagccaggagac

SEQ ID NO: 4787667 - DNA, 15 bp, Homo sapiens
tcaagccaggagacc

SEQ ID NO: 4787668 - DNA, 21 bp, Homo sapiens
tcaagccaggagaccctgtct

SEQ ID NO: 4787669 - DNA, 19 bp, Homo sapiens
tcaaggcccttacaccctt

SEQ ID NO: 4787670 - DNA, 14 bp, Homo sapiens
tcaaggtctgcttt

SEQ ID NO: 4787671 - DNA, 15 bp, Homo sapiens
tcaaggtctgctttt

SEQ ID NO: 4787672 - DNA, 20 bp, Homo sapiens
tcaaggtgaaggatctgtcc

SEQ ID NO: 4787673 - DNA, 22 bp, Homo sapiens
tcaagtagtagtacttaatagt

SEQ ID NO: 4787674 - DNA, 21 bp, Homo sapiens
tcaagtcccgaggcagcaaca

SEQ ID NO: 4787675 - DNA, 16 bp, Homo sapiens
tcaagtctacctgcct

SEQ ID NO: 4787676 - DNA, 14 bp, Homo sapiens
tcaagtctgtgaaa

SEQ ID NO: 4787677 - DNA, 17 bp, Homo sapiens
tcaagtctgttttggga

SEQ ID NO: 4787678 - DNA, 15 bp, Homo sapiens
tcaataactattgct

SEQ ID NO: 4787679 - DNA, 18 bp, Homo sapiens
tcaatactttgaacacaa

SEQ ID NO: 4787680 - DNA, 20 bp, Homo sapiens
tcaatactttgaacacaaag

SEQ ID NO: 4787681 - DNA, 17 bp, Homo sapiens
tcaatcaagatgggtga

SEQ ID NO: 4787682 - DNA, 18 bp, Homo sapiens
tcaatcattgtacagttt

SEQ ID NO: 4787683 - DNA, 18 bp, Homo sapiens
tcaatcattgtcagagat

SEQ ID NO: 4787684 - DNA, 21 bp, Homo sapiens
tcaatcattgtcagagatgtt

SEQ ID NO: 4787685 - DNA, 17 bp, Homo sapiens
tcaatccacagtattgt

SEQ ID NO: 4787686 - DNA, 20 bp, Homo sapiens
tcaatccacagtattgttct

SEQ ID NO: 4787687 - DNA, 21 bp, Homo sapiens
tcaatccacagtattgttctt

SEQ ID NO: 4787688 - DNA, 12 bp, Homo sapiens
tcaatccccata

SEQ ID NO: 4787689 - DNA, 16 bp, Homo sapiens
tcaatgaaatatttgc

SEQ ID NO: 4787690 - DNA, 18 bp, Homo sapiens
tcaatgaaatatttgctt

SEQ ID NO: 4787691 - DNA, 23 bp, Homo sapiens
tcaatgaaatatttgcttattta

SEQ ID NO: 4787692 - DNA, 15 bp, Homo sapiens
tcaatgcaatgcatc

SEQ ID NO: 4787693 - DNA, 16 bp, Homo sapiens
tcaatgcaatgcatct

SEQ ID NO: 4787694 - DNA, 18 bp, Homo sapiens
tcaatgcaatgcatctga

SEQ ID NO: 4787695 - DNA, 15 bp, Homo sapiens
tcaatgctacaaaat

SEQ ID NO: 4787696 - DNA, 17 bp, Homo sapiens
tcaatgctatggactgc

SEQ ID NO: 4787697 - DNA, 11 bp, Homo sapiens
tcaatgggtaa

SEQ ID NO: 4787698 - DNA, 16 bp, Homo sapiens
tcaatgggtaaataaa

SEQ ID NO: 4787699 - DNA, 22 bp, Homo sapiens
tcaatgggtaaataaatgctgc

SEQ ID NO: 4787700 - DNA, 15 bp, Homo sapiens
tcaatgtactgtatt

SEQ ID NO: 4787701 - DNA, 12 bp, Homo sapiens
tcaatgtgaaac

SEQ ID NO: 4787702 - DNA, 14 bp, Homo sapiens
tcaatgtgaaataa

SEQ ID NO: 4787703 - DNA, 16 bp, Homo sapiens
tcaatgttaaatctac

SEQ ID NO: 4787704 - DNA, 21 bp, Homo sapiens
tcaattaatggaaaactgtta

SEQ ID NO: 4787705 - DNA, 19 bp, Homo sapiens
tcaattacaggaagtactg

SEQ ID NO: 4787706 - DNA, 20 bp, Homo sapiens
tcaattacaggaagtactgg

SEQ ID NO: 4787707 - DNA, 19 bp, Homo sapiens
tcaattctgaaggggaaaa

SEQ ID NO: 4787708 - DNA, 17 bp, Homo sapiens
tcaattgagttaaatca

SEQ ID NO: 4787709 - DNA, 19 bp, Homo sapiens
tcaattgggttttgatctc

SEQ ID NO: 4787710 - DNA, 21 bp, Homo sapiens
tcaatttggtttagaatgctg

SEQ ID NO: 4787711 - DNA, 16 bp, Homo sapiens
tcaatttgtataaaat

SEQ ID NO: 4787712 - DNA, 18 bp, Homo sapiens
tcacaaaagtatattcaa

SEQ ID NO: 4787713 - DNA, 20 bp, Homo sapiens
tcacaaaagtatattcaaaa

SEQ ID NO: 4787714 - DNA, 12 bp, Homo sapiens
tcacaaaatgca

SEQ ID NO: 4787715 - DNA, 13 bp, Homo sapiens
tcacaaaatgcaa

SEQ ID NO: 4787716 - DNA, 17 bp, Homo sapiens
tcacaaagctatttaag

SEQ ID NO: 4787717 - DNA, 19 bp, Homo sapiens
tcacaaagctatttaagtg

SEQ ID NO: 4787718 - DNA, 17 bp, Homo sapiens
tcacaaaggatgcccaa

SEQ ID NO: 4787719 - DNA, 13 bp, Homo sapiens
tcacaactgtttt

SEQ ID NO: 4787720 - DNA, 20 bp, Homo sapiens
tcacaactgtttttgaagaa

SEQ ID NO: 4787721 - DNA, 21 bp, Homo sapiens
tcacaactgtttttgaagaag

SEQ ID NO: 4787722 - DNA, 17 bp, Homo sapiens
tcacaagccgtgtttta

SEQ ID NO: 4787723 - DNA, 17 bp, Homo sapiens
tcacacaaagtgaaatt

SEQ ID NO: 4787724 - DNA, 22 bp, Homo sapiens
tcacacacacacaatggcaagc

SEQ ID NO: 4787725 - DNA, 20 bp, Homo sapiens
tcacacagctaacaagtagc

SEQ ID NO: 4787726 - DNA, 12 bp, Homo sapiens
tcacaccctgca

SEQ ID NO: 4787727 - DNA, 20 bp, Homo sapiens
tcacaccctgcaaggcccac

SEQ ID NO: 4787728 - DNA, 14 bp, Homo sapiens
tcacaccggcactg

SEQ ID NO: 4787729 - DNA, 17 bp, Homo sapiens
tcacaccggcactgtgc

SEQ ID NO: 4787730 - DNA, 19 bp, Homo sapiens
tcacaccggcactgtgcac

SEQ ID NO: 4787731 - DNA, 20 bp, Homo sapiens
tcacaccggcactgtgcact

SEQ ID NO: 4787732 - DNA, 20 bp, Homo sapiens
tcacacctcccttcatccca

SEQ ID NO: 4787733 - DNA, 19 bp, Homo sapiens
tcacaccttacaaagccag

SEQ ID NO: 4787734 - DNA, 21 bp, Homo sapiens
tcacactctaactgtatattt

SEQ ID NO: 4787735 - DNA, 16 bp, Homo sapiens
tcacactctcttctta

SEQ ID NO: 4787736 - DNA, 19 bp, Homo sapiens
tcacactctcttcttactg

SEQ ID NO: 4787737 - DNA, 11 bp, Homo sapiens
tcacactgtgc

SEQ ID NO: 4787738 - DNA, 12 bp, Homo sapiens
tcacacttgggc

SEQ ID NO: 4787739 - DNA, 19 bp, Homo sapiens
tcacacttgggctggcacc

SEQ ID NO: 4787740 - DNA, 19 bp, Homo sapiens
tcacagcacatttgttaat

SEQ ID NO: 4787741 - DNA, 22 bp, Homo sapiens
tcacagcctttgcgctctgggt

SEQ ID NO: 4787742 - DNA, 21 bp, Homo sapiens
tcacagtgggcggcttccctg

SEQ ID NO: 4787743 - DNA, 21 bp, Homo sapiens
tcagcttcccaacaatacttt

SEQ ID NO: 4787744 - DNA, 18 bp, Homo sapiens
tcagctttataataaact

SEQ ID NO: 4787745 - DNA, 20 bp, Homo sapiens
tcagctttataataaactgt

SEQ ID NO: 4787746 - DNA, 22 bp, Homo sapiens
tcagctttataataaactgttt

SEQ ID NO: 4787747 - DNA, 20 bp, Homo sapiens
tcaggaagagaaggagcaga

SEQ ID NO: 4787748 - DNA, 13 bp, Homo sapiens
tcaggaccaccct

SEQ ID NO: 4787749 - DNA, 14 bp, Homo sapiens
tcaggaccaccctg

SEQ ID NO: 4787750 - DNA, 22 bp, Homo sapiens
tcaggagaaggcctgcccccct

SEQ ID NO: 4787751 - DNA, 14 bp, Homo sapiens
tcaggagcacagcc

SEQ ID NO: 4787752 - DNA, 15 bp, Homo sapiens
tcaggagcacagcca

SEQ ID NO: 4787753 - DNA, 18 bp, Homo sapiens
tcaggagcacagccatag

SEQ ID NO: 4787754 - DNA, 13 bp, Homo sapiens
tcaggagccagca

SEQ ID NO: 4787755 - DNA, 14 bp, Homo sapiens
tcaggattccttct

SEQ ID NO: 4787756 - DNA, 18 bp, Homo sapiens
tcaggattccttcttccc

SEQ ID NO: 4787757 - DNA, 15 bp, Homo sapiens
tcaggccagctgctt

SEQ ID NO: 4787758 - DNA, 20 bp, Homo sapiens
tcaggccagctgcttgggct

SEQ ID NO: 4787759 - DNA, 14 bp, Homo sapiens
tcaggcctcacctg

SEQ ID NO: 4787760 - DNA, 21 bp, Homo sapiens
tcaggctctgaatctctcaaa

SEQ ID NO: 4787761 - DNA, 13 bp, Homo sapiens
tcaggctgcccag

SEQ ID NO: 4787762 - DNA, 23 bp, Homo sapiens
tcagggcatgcttattagcagct

SEQ ID NO: 4787763 - DNA, 16 bp, Homo sapiens
tcaggtcagagcccag

SEQ ID NO: 4787764 - DNA, 17 bp, Homo sapiens
tcaggtcagagcccagg

SEQ ID NO: 4787765 - DNA, 16 bp, Homo sapiens
tcaggtcccctggccc

SEQ ID NO: 4787766 - DNA, 13 bp, Homo sapiens
tcaggtgaataac

SEQ ID NO: 4787767 - DNA, 22 bp, Homo sapiens
tcagtacaattctttgttgctt

SEQ ID NO: 4787768 - DNA, 20 bp, Homo sapiens
tcagtagcattttaatagtt

SEQ ID NO: 4787769 - DNA, 21 bp, Homo sapiens
tcagtattgagacactgtcaa

SEQ ID NO: 4787770 - DNA, 22 bp, Homo sapiens
tcagtattgagacactgtcaag

SEQ ID NO: 4787771 - DNA, 22 bp, Homo sapiens
tcagtccacccccattgtgaat

SEQ ID NO: 4787772 - DNA, 15 bp, Homo sapiens
tcagtcccacagccc

SEQ ID NO: 4787773 - DNA, 19 bp, Homo sapiens
tcagtcgatattcccaggg

SEQ ID NO: 4787774 - DNA, 15 bp, Homo sapiens
tcagtctatgctgtg

SEQ ID NO: 4787775 - DNA, 21 bp, Homo sapiens
tcagtctatgctgtgtgcaga

SEQ ID NO: 4787776 - DNA, 18 bp, Homo sapiens
tcagtgaagcccaggagg

SEQ ID NO: 4787777 - DNA, 20 bp, Homo sapiens
tatcttcgttagtaatctgt

SEQ ID NO: 4787778 - DNA, 14 bp, Homo sapiens
tatgaaacaaatat

SEQ ID NO: 4787779 - DNA, 20 bp, Homo sapiens
tatgaaacaaatatactcat

SEQ ID NO: 4787780 - DNA, 22 bp, Homo sapiens
tatgaaacaaatatactcattt

SEQ ID NO: 4787781 - DNA, 16 bp, Homo sapiens
tatgaaatatatgtga

SEQ ID NO: 4787782 - DNA, 19 bp, Homo sapiens
tatgaagcagaatgagatg

SEQ ID NO: 4787783 - DNA, 23 bp, Homo sapiens
tatgaagccctaagtaaatctaa

SEQ ID NO: 4787784 - DNA, 16 bp, Homo sapiens
tatgaccctgtgcctg

SEQ ID NO: 4787785 - DNA, 18 bp, Homo sapiens
tatgaccctgtgcctgtg

SEQ ID NO: 4787786 - DNA, 18 bp, Homo sapiens
tatgacgtgcacaaacct

SEQ ID NO: 4787787 - DNA, 17 bp, Homo sapiens
tatgacttcttgttcat

SEQ ID NO: 4787788 - DNA, 16 bp, Homo sapiens
tatgagacttcctatt

SEQ ID NO: 4787789 - DNA, 22 bp, Homo sapiens
tatgagacttcctattaattta

SEQ ID NO: 4787790 - DNA, 22 bp, Homo sapiens
tatgagatgtagcaaattccaa

SEQ ID NO: 4787791 - DNA, 22 bp, Homo sapiens
tatgagattggaaaaaattaga

SEQ ID NO: 4787792 - DNA, 23 bp, Homo sapiens
tatgagattggaaaaaattagac

SEQ ID NO: 4787793 - DNA, 16 bp, Homo sapiens
tatgagcatgctccct

SEQ ID NO: 4787794 - DNA, 19 bp, Homo sapiens
tatgagtacatactcaaga

SEQ ID NO: 4787795 - DNA, 19 bp, Homo sapiens
tatgatataataaatatat

SEQ ID NO: 4787796 - DNA, 13 bp, Homo sapiens
tatgatatgcatg

SEQ ID NO: 4787797 - DNA, 13 bp, Homo sapiens
tatgatccaagta

SEQ ID NO: 4787798 - DNA, 18 bp, Homo sapiens
tatgatgtccaaacttaa

SEQ ID NO: 4787799 - DNA, 22 bp, Homo sapiens
tatgattaaattatcattgttt

SEQ ID NO: 4787800 - DNA, 21 bp, Homo sapiens
tatgatttcatgattagacaa

SEQ ID NO: 4787801 - DNA, 14 bp, Homo sapiens
tatgatttgttcct

SEQ ID NO: 4787802 - DNA, 16 bp, Homo sapiens
tatgcaagaagaatat

SEQ ID NO: 4787803 - DNA, 22 bp, Homo sapiens
tatgcacaccaaattgctgaga

SEQ ID NO: 4787804 - DNA, 23 bp, Homo sapiens
tatgcacaccaaattgctgagat

SEQ ID NO: 4787805 - DNA, 17 bp, Homo sapiens
tatgcactaatcaatac

SEQ ID NO: 4787806 - DNA, 18 bp, Homo sapiens
tatgcatgagaactaaat

SEQ ID NO: 4787807 - DNA, 18 bp, Homo sapiens
tatgcatttatgcatgag

SEQ ID NO: 4787808 - DNA, 15 bp, Homo sapiens
tatgccatgtatgtt

SEQ ID NO: 4787809 - DNA, 12 bp, Homo sapiens
tatgctggccag

SEQ ID NO: 4787810 - DNA, 22 bp, Homo sapiens
tatgctggccagcaccctctcc

SEQ ID NO: 4787811 - DNA, 16 bp, Homo sapiens
tatgcttttttgcaat

SEQ ID NO: 4787812 - DNA, 17 bp, Homo sapiens
tatgcttttttgcaata

SEQ ID NO: 4787813 - DNA, 15 bp, Homo sapiens
tatggaccaaatgta

SEQ ID NO: 4787814 - DNA, 13 bp, Homo sapiens
tatggagcctggc

SEQ ID NO: 4787815 - DNA, 23 bp, Homo sapiens
tatggaggagagtgtttaactga

SEQ ID NO: 4787816 - DNA, 20 bp, Homo sapiens
tatggatatttttaatttat

SEQ ID NO: 4787817 - DNA, 13 bp, Homo sapiens
tatggattcactt

SEQ ID NO: 4787818 - DNA, 15 bp, Homo sapiens
tatggctgtattttt

SEQ ID NO: 4787819 - DNA, 18 bp, Homo sapiens
tatggcttgtagggtgag

SEQ ID NO: 4787820 - DNA, 17 bp, Homo sapiens
tatggctttgtgcttgt

SEQ ID NO: 4787821 - DNA, 18 bp, Homo sapiens
tatgggactgagcctggc

SEQ ID NO: 4787822 - DNA, 18 bp, Homo sapiens
tatgggaggaacaaagac

SEQ ID NO: 4787823 - DNA, 17 bp, Homo sapiens
tatggtacctctgtcta

SEQ ID NO: 4787824 - DNA, 16 bp, Homo sapiens
tatggtagaaaaattt

SEQ ID NO: 4787825 - DNA, 17 bp, Homo sapiens
tatggtatgctggccag

SEQ ID NO: 4787826 - DNA, 10 bp, Homo sapiens
tatgtaaaaa

SEQ ID NO: 4787827 - DNA, 13 bp, Homo sapiens
tatgtaaacatca

SEQ ID NO: 4787828 - DNA, 20 bp, Homo sapiens
tatgtaaataggtttctaaa

SEQ ID NO: 4787829 - DNA, 14 bp, Homo sapiens
tatgtaagtttcta

SEQ ID NO: 4787830 - DNA, 22 bp, Homo sapiens
tatgtacaggctgagacacagc

SEQ ID NO: 4787831 - DNA, 18 bp, Homo sapiens
tatgtacagttatacata

SEQ ID NO: 4787832 - DNA, 12 bp, Homo sapiens
tatgtacttaca

SEQ ID NO: 4787833 - DNA, 12 bp, Homo sapiens
tatgtatacaca

SEQ ID NO: 4787834 - DNA, 16 bp, Homo sapiens
tatgtatacacacaca

SEQ ID NO: 4787835 - DNA, 12 bp, Homo sapiens
tatgtatgtgtg

SEQ ID NO: 4787836 - DNA, 21 bp, Homo sapiens
tatgtatgtgtgagtgtatgt

SEQ ID NO: 4787837 - DNA, 16 bp, Homo sapiens
tatgtcagtcactaaa

SEQ ID NO: 4787838 - DNA, 17 bp, Homo sapiens
tatgtcattttcagatc

SEQ ID NO: 4787839 - DNA, 23 bp, Homo sapiens
tatgtcattttcagatccttcca

SEQ ID NO: 4787840 - DNA, 20 bp, Homo sapiens
tatgtcctgtgagatgtgta

SEQ ID NO: 4787841 - DNA, 13 bp, Homo sapiens
tatgtctatgtgt

SEQ ID NO: 4787842 - DNA, 18 bp, Homo sapiens
tatgtctatgtgtatata

SEQ ID NO: 4787843 - DNA, 11 bp, Homo sapiens
tatgtctgtga

SEQ ID NO: 4787844 - DNA, 21 bp, Homo sapiens
tatgtgcttgtgtgtatgtct

SEQ ID NO: 4787845 - DNA, 14 bp, Homo sapiens
tatgtgtaatatca

SEQ ID NO: 4787846 - DNA, 17 bp, Homo sapiens
tatgtgtatatattata

SEQ ID NO: 4787847 - DNA, 20 bp, Homo sapiens
tatgttatacaaccttcatt

SEQ ID NO: 4787848 - DNA, 21 bp, Homo sapiens
tatgttatacaaccttcattt

SEQ ID NO: 4787849 - DNA, 22 bp, Homo sapiens
tatgttatacaaccttcattta

SEQ ID NO: 4787850 - DNA, 16 bp, Homo sapiens
tatgttgctgaaacac

SEQ ID NO: 4787851 - DNA, 17 bp, Homo sapiens
tatgtttggctgaaatt

SEQ ID NO: 4787852 - DNA, 11 bp, Homo sapiens
tatgttttgga

SEQ ID NO: 4787853 - DNA, 16 bp, Homo sapiens
tattaaagatgcaggt

SEQ ID NO: 4787854 - DNA, 22 bp, Homo sapiens
tattaaagatgcaggttttcta

SEQ ID NO: 4787855 - DNA, 23 bp, Homo sapiens
tattaaagatgcaggttttctaa

SEQ ID NO: 4787856 - DNA, 16 bp, Homo sapiens
tattaaagtaatttac

SEQ ID NO: 4787857 - DNA, 15 bp, Homo sapiens
tattaaattcctcct

SEQ ID NO: 4787858 - DNA, 19 bp, Homo sapiens
tattaagcacattattgta

SEQ ID NO: 4787859 - DNA, 21 bp, Homo sapiens
tattaagcacattattgtaga

SEQ ID NO: 4787860 - DNA, 15 bp, Homo sapiens
tattaagtgttgtac

SEQ ID NO: 4787861 - DNA, 17 bp, Homo sapiens
tattaatcagaagaaaa

SEQ ID NO: 4787862 - DNA, 15 bp, Homo sapiens
tattaatttattaaa

SEQ ID NO: 4787863 - DNA, 13 bp, Homo sapiens
tattacataaata

SEQ ID NO: 4787864 - DNA, 14 bp, Homo sapiens
tattacataaataa

SEQ ID NO: 4787865 - DNA, 19 bp, Homo sapiens
tattaccacttagaagatg

SEQ ID NO: 4787866 - DNA, 16 bp, Homo sapiens
tattaccctcagaata

SEQ ID NO: 4787867 - DNA, 17 bp, Homo sapiens
tattaccctcagaatat

SEQ ID NO: 4787868 - DNA, 14 bp, Homo sapiens
tattactaaattga

SEQ ID NO: 4787869 - DNA, 15 bp, Homo sapiens
tattactttaaatta

SEQ ID NO: 4787870 - DNA, 21 bp, Homo sapiens
tattagttaggtgtgccaaac

SEQ ID NO: 4787871 - DNA, 12 bp, Homo sapiens
tattataagttg

SEQ ID NO: 4787872 - DNA, 12 bp, Homo sapiens
tattataattgt

SEQ ID NO: 4787873 - DNA, 18 bp, Homo sapiens
tattataattgtcatgac

SEQ ID NO: 4787874 - DNA, 21 bp, Homo sapiens
tattatagtctgtacttcagt

SEQ ID NO: 4787875 - DNA, 20 bp, Homo sapiens
tattatatatgtatatctgt

SEQ ID NO: 4787876 - DNA, 19 bp, Homo sapiens
tattatcagtgaatataaa

SEQ ID NO: 4787877 - DNA, 14 bp, Homo sapiens
tattatgttgttca

SEQ ID NO: 4787878 - DNA, 17 bp, Homo sapiens
taggaaatctgaagcct

SEQ ID NO: 4787879 - DNA, 21 bp, Homo sapiens
taggaagacacattatcttct

SEQ ID NO: 4787880 - DNA, 13 bp, Homo sapiens
taggaatgctcaa

SEQ ID NO: 4787881 - DNA, 18 bp, Homo sapiens
taggaatgctcaatgtgc

SEQ ID NO: 4787882 - DNA, 23 bp, Homo sapiens
taggacatctctgtaaaaagcag

SEQ ID NO: 4787883 - DNA, 17 bp, Homo sapiens
taggagcttccagatgg

SEQ ID NO: 4787884 - DNA, 19 bp, Homo sapiens
taggagcttccagatgggt

SEQ ID NO: 4787885 - DNA, 21 bp, Homo sapiens
taggcagagcccgcccacctg

SEQ ID NO: 4787886 - DNA, 23 bp, Homo sapiens
taggcagagcccgcccacctggg

SEQ ID NO: 4787887 - DNA, 18 bp, Homo sapiens
taggcaggaagtcaggag

SEQ ID NO: 4787888 - DNA, 19 bp, Homo sapiens
taggcaggaagtcaggagc

SEQ ID NO: 4787889 - DNA, 16 bp, Homo sapiens
taggcatactctccag

SEQ ID NO: 4787890 - DNA, 19 bp, Homo sapiens
taggcatactctccaggat

SEQ ID NO: 4787891 - DNA, 14 bp, Homo sapiens
taggctctgagact

SEQ ID NO: 4787892 - DNA, 17 bp, Homo sapiens
tagggccctgacaggcc

SEQ ID NO: 4787893 - DNA, 15 bp, Homo sapiens
tagggctctccaagc

SEQ ID NO: 4787894 - DNA, 16 bp, Homo sapiens
taggggcaaaaatttg

SEQ ID NO: 4787895 - DNA, 18 bp, Homo sapiens
tagggtacagcccaggcg

SEQ ID NO: 4787896 - DNA, 18 bp, Homo sapiens
tagggtttggaagaaagg

SEQ ID NO: 4787897 - DNA, 19 bp, Homo sapiens
tagggtttgtttgctgctt

SEQ ID NO: 4787898 - DNA, 23 bp, Homo sapiens
taggtctccacccctcaagccag

SEQ ID NO: 4787899 - DNA, 19 bp, Homo sapiens
taggtgcccagtcttgagt

SEQ ID NO: 4787900 - DNA, 16 bp, Homo sapiens
taggtgctcataacta

SEQ ID NO: 4787901 - DNA, 22 bp, Homo sapiens
taggtgggtcaactccaaggca

SEQ ID NO: 4787902 - DNA, 17 bp, Homo sapiens
taggttctgctttctga

SEQ ID NO: 4787903 - DNA, 21 bp, Homo sapiens
taggtttgggggacgcccagc

SEQ ID NO: 4787904 - DNA, 21 bp, Homo sapiens
tagtaaaattatctgttctat

SEQ ID NO: 4787905 - DNA, 18 bp, Homo sapiens
tagtaacagtatttccat

SEQ ID NO: 4787906 - DNA, 15 bp, Homo sapiens
tagtaataaaacatt

SEQ ID NO: 4787907 - DNA, 17 bp, Homo sapiens
tagtaataaaacattag

SEQ ID NO: 4787908 - DNA, 14 bp, Homo sapiens
tagtaattgttaca

SEQ ID NO: 4787909 - DNA, 22 bp, Homo sapiens
tagtactagagatattttgtaa

SEQ ID NO: 4787910 - DNA, 16 bp, Homo sapiens
tagtacttcttctgta

SEQ ID NO: 4787911 - DNA, 18 bp, Homo sapiens
tagtacttcttctgtaat

SEQ ID NO: 4787912 - DNA, 19 bp, Homo sapiens
tagtacttcttctgtaata

SEQ ID NO: 4787913 - DNA, 22 bp, Homo sapiens
tagtagaatctcagcactttgt

SEQ ID NO: 4787914 - DNA, 23 bp, Homo sapiens
tagtatcactgctttttccttag

SEQ ID NO: 4787915 - DNA, 21 bp, Homo sapiens
tagtatttttactattataat

SEQ ID NO: 4787916 - DNA, 13 bp, Homo sapiens
tagtcatatgtga

SEQ ID NO: 4787917 - DNA, 20 bp, Homo sapiens
tagtcatatgtgaagacaga

SEQ ID NO: 4787918 - DNA, 17 bp, Homo sapiens
tagtcatgtttctgcag

SEQ ID NO: 4787919 - DNA, 20 bp, Homo sapiens
tagtcccggaggccttccct

SEQ ID NO: 4787920 - DNA, 13 bp, Homo sapiens
tagtctgtacttc

SEQ ID NO: 4787921 - DNA, 18 bp, Homo sapiens
tagtctttagctattact

SEQ ID NO: 4787922 - DNA, 18 bp, Homo sapiens
tagtgaaaattttattga

SEQ ID NO: 4787923 - DNA, 13 bp, Homo sapiens
tagtgcatgtcac

SEQ ID NO: 4787924 - DNA, 22 bp, Homo sapiens
tagtgcctgtgatcgtgtgttg

SEQ ID NO: 4787925 - DNA, 18 bp, Homo sapiens
tagtgctaaacctatctg

SEQ ID NO: 4787926 - DNA, 20 bp, Homo sapiens
tagtgctaaacctatctgta

SEQ ID NO: 4787927 - DNA, 18 bp, Homo sapiens
tagtgtcacttttttcct

SEQ ID NO: 4787928 - DNA, 22 bp, Homo sapiens
tagtgtcacttttttcctgtca

SEQ ID NO: 4787929 - DNA, 23 bp, Homo sapiens
tagtgtcacttttttcctgtcaa

SEQ ID NO: 4787930 - DNA, 15 bp, Homo sapiens
tagtgtcccttacct

SEQ ID NO: 4787931 - DNA, 21 bp, Homo sapiens
tagtgtctggatcagtaaaat

SEQ ID NO: 4787932 - DNA, 19 bp, Homo sapiens
tagtgtgctcggacacagt

SEQ ID NO: 4787933 - DNA, 12 bp, Homo sapiens
tagtgtgttgtg

SEQ ID NO: 4787934 - DNA, 20 bp, Homo sapiens
tagtgtgttgtgctttcaag

SEQ ID NO: 4787935 - DNA, 14 bp, Homo sapiens
tagtgttaatccag

SEQ ID NO: 4787936 - DNA, 15 bp, Homo sapiens
tagtgttaatccaga

SEQ ID NO: 4787937 - DNA, 15 bp, Homo sapiens
tagtgttgaggaggg

SEQ ID NO: 4787938 - DNA, 18 bp, Homo sapiens
tagtgtttcgttaagcag

SEQ ID NO: 4787939 - DNA, 19 bp, Homo sapiens
tagtgttttcattctggtc

SEQ ID NO: 4787940 - DNA, 18 bp, Homo sapiens
tagttagcaggaaatagt

SEQ ID NO: 4787941 - DNA, 21 bp, Homo sapiens
tagttaggtgtgccaaactac

SEQ ID NO: 4787942 - DNA, 16 bp, Homo sapiens
tagttccattctatga

SEQ ID NO: 4787943 - DNA, 12 bp, Homo sapiens
tagttctgcaat

SEQ ID NO: 4787944 - DNA, 19 bp, Homo sapiens
tagttgacttcaaatgtgt

SEQ ID NO: 4787945 - DNA, 21 bp, Homo sapiens
tagttgacttcaaatgtgtaa

SEQ ID NO: 4787946 - DNA, 14 bp, Homo sapiens
tagttgatgaccaa

SEQ ID NO: 4787947 - DNA, 20 bp, Homo sapiens
tagttgatgaccaatctctg

SEQ ID NO: 4787948 - DNA, 21 bp, Homo sapiens
tagttgatgaccaatctctgt

SEQ ID NO: 4787949 - DNA, 22 bp, Homo sapiens
tagttgatgaccaatctctgtg

SEQ ID NO: 4787950 - DNA, 14 bp, Homo sapiens
tagttgttaagttt

SEQ ID NO: 4787951 - DNA, 22 bp, Homo sapiens
tagtttattatagtctgtactt

SEQ ID NO: 4787952 - DNA, 16 bp, Homo sapiens
tagtttctaaaccatg

SEQ ID NO: 4787953 - DNA, 22 bp, Homo sapiens
tagtttttgttcaccttctgtg

SEQ ID NO: 4787954 - DNA, 21 bp, Homo sapiens
tataaaaaagaaaacttgtgt

SEQ ID NO: 4787955 - DNA, 15 bp, Homo sapiens
tataaaaaatatatg

SEQ ID NO: 4787956 - DNA, 15 bp, Homo sapiens
tataaaccataaaat

SEQ ID NO: 4787957 - DNA, 20 bp, Homo sapiens
tataaaccataaaataaata

SEQ ID NO: 4787958 - DNA, 15 bp, Homo sapiens
tataaactgtgagat

SEQ ID NO: 4787959 - DNA, 20 bp, Homo sapiens
tataaataaataaaaatatt

SEQ ID NO: 4787960 - DNA, 22 bp, Homo sapiens
tataaatcttacccttcaatgt

SEQ ID NO: 4787961 - DNA, 14 bp, Homo sapiens
tataaatgaagatg

SEQ ID NO: 4787962 - DNA, 16 bp, Homo sapiens
tataaatgaatgaaat

SEQ ID NO: 4787963 - DNA, 19 bp, Homo sapiens
tataaatgtactacatttg

SEQ ID NO: 4787964 - DNA, 17 bp, Homo sapiens
tataaatgtttatattg

SEQ ID NO: 4787965 - DNA, 18 bp, Homo sapiens
tataaatgtttatattgt

SEQ ID NO: 4787966 - DNA, 19 bp, Homo sapiens
tataaatgtttatattgtt

SEQ ID NO: 4787967 - DNA, 14 bp, Homo sapiens
tataaatgttttaa

SEQ ID NO: 4787968 - DNA, 15 bp, Homo sapiens
tataaatgttttaaa

SEQ ID NO: 4787969 - DNA, 13 bp, Homo sapiens
tataaattaaata

SEQ ID NO: 4787970 - DNA, 22 bp, Homo sapiens
tataaattaaatatatgtatgt

SEQ ID NO: 4787971 - DNA, 12 bp, Homo sapiens
tataacatgaaa

SEQ ID NO: 4787972 - DNA, 15 bp, Homo sapiens
tataactaatttgct

SEQ ID NO: 4787973 - DNA, 20 bp, Homo sapiens
tataagagacaaagtttgga

SEQ ID NO: 4787974 - DNA, 22 bp, Homo sapiens
tataagagggaacaaattttca

SEQ ID NO: 4787975 - DNA, 11 bp, Homo sapiens
tataagccata

SEQ ID NO: 4787976 - DNA, 21 bp, Homo sapiens
tataagccatagccccaggcc

SEQ ID NO: 4787977 - DNA, 14 bp, Homo sapiens
tataagctgaataa

SEQ ID NO: 4787978 - DNA, 15 bp, Homo sapiens
tataaggctaaatgt

SEQ ID NO: 4787979 - DNA, 22 bp, Homo sapiens
tataagttgacctttatttatt

SEQ ID NO: 4787980 - DNA, 16 bp, Homo sapiens
tataataaactgttta

SEQ ID NO: 4787981 - DNA, 15 bp, Homo sapiens
tataatactttgtat

SEQ ID NO: 4787982 - DNA, 20 bp, Homo sapiens
tataatactttgtatacaag

SEQ ID NO: 4787983 - DNA, 15 bp, Homo sapiens
tataatctcttctta

SEQ ID NO: 4787984 - DNA, 18 bp, Homo sapiens
tataatgggattgggttt

SEQ ID NO: 4787985 - DNA, 13 bp, Homo sapiens
tatctctttctct

SEQ ID NO: 4787986 - DNA, 12 bp, Homo sapiens
tatctgaaaact

SEQ ID NO: 4787987 - DNA, 13 bp, Homo sapiens
tatctgaaaactg

SEQ ID NO: 4787988 - DNA, 22 bp, Homo sapiens
tatctggaaaaaaaaaaatatg

SEQ ID NO: 4787989 - DNA, 16 bp, Homo sapiens
tatctggattcaaatt

SEQ ID NO: 4787990 - DNA, 14 bp, Homo sapiens
tatctgggcctggg

SEQ ID NO: 4787991 - DNA, 16 bp, Homo sapiens
tatctgggcttaataa

SEQ ID NO: 4787992 - DNA, 22 bp, Homo sapiens
tatctgggttttagaaattcta

SEQ ID NO: 4787993 - DNA, 15 bp, Homo sapiens
tatctgtcatctctc

SEQ ID NO: 4787994 - DNA, 21 bp, Homo sapiens
tatctgtcatctctctggggc

SEQ ID NO: 4787995 - DNA, 14 bp, Homo sapiens
tatctgtctgagcc

SEQ ID NO: 4787996 - DNA, 15 bp, Homo sapiens
tatctgtctgagccc

SEQ ID NO: 4787997 - DNA, 14 bp, Homo sapiens
tatctgtctttatg

SEQ ID NO: 4787998 - DNA, 16 bp, Homo sapiens
tatctgtgaaatatca

SEQ ID NO: 4787999 - DNA, 13 bp, Homo sapiens
tatctgtgtaaga

SEQ ID NO: 4788000 - DNA, 14 bp, Homo sapiens
tatctgttctatgg

SEQ ID NO: 4788001 - DNA, 18 bp, Homo sapiens
tatctgttctatggacca

SEQ ID NO: 4788002 - DNA, 13 bp, Homo sapiens
tatcttaaaattg

SEQ ID NO: 4788003 - DNA, 18 bp, Homo sapiens
tatcttaaaattggttaa

SEQ ID NO: 4788004 - DNA, 14 bp, Homo sapiens
tatcttatttatat

SEQ ID NO: 4788005 - DNA, 14 bp, Homo sapiens
tatcttcatgtaaa

SEQ ID NO: 4788006 - DNA, 15 bp, Homo sapiens
tactggactaagtgg

SEQ ID NO: 4788007 - DNA, 18 bp, Homo sapiens
tactggggggcaggcctc

SEQ ID NO: 4788008 - DNA, 22 bp, Homo sapiens
tactggggggcaggcctcccaa

SEQ ID NO: 4788009 - DNA, 13 bp, Homo sapiens
tactggtaagatt

SEQ ID NO: 4788010 - DNA, 18 bp, Homo sapiens
tactgtactttcccaggt

SEQ ID NO: 4788011 - DNA, 17 bp, Homo sapiens
tactgtgagaactgtga

SEQ ID NO: 4788012 - DNA, 10 bp, Homo sapiens
tactgttctt

SEQ ID NO: 4788013 - DNA, 17 bp, Homo sapiens
tacttaaacaaaaactt

SEQ ID NO: 4788014 - DNA, 18 bp, Homo sapiens
tacttaaacaaaaacttt

SEQ ID NO: 4788015 - DNA, 20 bp, Homo sapiens
tacttaaacaaaaactttcc

SEQ ID NO: 4788016 - DNA, 23 bp, Homo sapiens
tacttaaacaaaaactttccatg

SEQ ID NO: 4788017 - DNA, 16 bp, Homo sapiens
tacttcagttctcatc

SEQ ID NO: 4788018 - DNA, 18 bp, Homo sapiens
tacttcatgtaatccaaa

SEQ ID NO: 4788019 - DNA, 17 bp, Homo sapiens
tacttgaaaacttctca

SEQ ID NO: 4788020 - DNA, 15 bp, Homo sapiens
tacttgaatagtatt

SEQ ID NO: 4788021 - DNA, 22 bp, Homo sapiens
tacttgccctgaccatgcattt

SEQ ID NO: 4788022 - DNA, 17 bp, Homo sapiens
tactttaaattatatga

SEQ ID NO: 4788023 - DNA, 15 bp, Homo sapiens
tactttaaattgtgg

SEQ ID NO: 4788024 - DNA, 17 bp, Homo sapiens
tactttacatatgcttt

SEQ ID NO: 4788025 - DNA, 22 bp, Homo sapiens
tactttaggtagtagaatctca

SEQ ID NO: 4788026 - DNA, 12 bp, Homo sapiens
tactttcccagg

SEQ ID NO: 4788027 - DNA, 23 bp, Homo sapiens
tactttcgttaatcttgctgctt

SEQ ID NO: 4788028 - DNA, 14 bp, Homo sapiens
tagaaaaacaaatc

SEQ ID NO: 4788029 - DNA, 17 bp, Homo sapiens
tagaaaaatttcacgat

SEQ ID NO: 4788030 - DNA, 22 bp, Homo sapiens
tagaaaacaggaaaaaaacttt

SEQ ID NO: 4788031 - DNA, 23 bp, Homo sapiens
tagaaaacaggaaaaaaactttt

SEQ ID NO: 4788032 - DNA, 14 bp, Homo sapiens
tagaaacatgacac

SEQ ID NO: 4788033 - DNA, 17 bp, Homo sapiens
tagaaacatgacactga

SEQ ID NO: 4788034 - DNA, 19 bp, Homo sapiens
tagaaacatgacactgacc

SEQ ID NO: 4788035 - DNA, 18 bp, Homo sapiens
tagaaagaattagccaac

SEQ ID NO: 4788036 - DNA, 14 bp, Homo sapiens
tagaaattctataa

SEQ ID NO: 4788037 - DNA, 16 bp, Homo sapiens
tagaactttaaaagaa

SEQ ID NO: 4788038 - DNA, 16 bp, Homo sapiens
tagaagaatattgtat

SEQ ID NO: 4788039 - DNA, 21 bp, Homo sapiens
tagaagttaaaggttactgtt

SEQ ID NO: 4788040 - DNA, 22 bp, Homo sapiens
tagaatattaaaaattaattct

SEQ ID NO: 4788041 - DNA, 15 bp, Homo sapiens
tagaatcaagtctgt

SEQ ID NO: 4788042 - DNA, 17 bp, Homo sapiens
tagaatcaagtctgtga

SEQ ID NO: 4788043 - DNA, 13 bp, Homo sapiens
tagaatgtgaaaa

SEQ ID NO: 4788044 - DNA, 14 bp, Homo sapiens
tagaatgtgaaaaa

SEQ ID NO: 4788045 - DNA, 15 bp, Homo sapiens
tagaattaccatttg

SEQ ID NO: 4788046 - DNA, 16 bp, Homo sapiens
tagaattaccatttgt

SEQ ID NO: 4788047 - DNA, 17 bp, Homo sapiens
tagaattaccatttgtt

SEQ ID NO: 4788048 - DNA, 19 bp, Homo sapiens
tagaattaccatttgttaa

SEQ ID NO: 4788049 - DNA, 13 bp, Homo sapiens
tagacaaaggcct

SEQ ID NO: 4788050 - DNA, 12 bp, Homo sapiens
tagacaagtgtt

SEQ ID NO: 4788051 - DNA, 23 bp, Homo sapiens
tagacaatgtggaattacataac

SEQ ID NO: 4788052 - DNA, 11 bp, Homo sapiens
tagacacacat

SEQ ID NO: 4788053 - DNA, 21 bp, Homo sapiens
tagacccctgggtgggccctg

SEQ ID NO: 4788054 - DNA, 21 bp, Homo sapiens
tagactaagggcaggaagact

SEQ ID NO: 4788055 - DNA, 19 bp, Homo sapiens
tagactctgtaacatcact

SEQ ID NO: 4788056 - DNA, 20 bp, Homo sapiens
tagagaaaaaaaaatatgtg

SEQ ID NO: 4788057 - DNA, 13 bp, Homo sapiens
tagagaagccata

SEQ ID NO: 4788058 - DNA, 19 bp, Homo sapiens
tagagacttctaaatcata

SEQ ID NO: 4788059 - DNA, 20 bp, Homo sapiens
tagagacttgcagttagact

SEQ ID NO: 4788060 - DNA, 14 bp, Homo sapiens
tagagattaatttg

SEQ ID NO: 4788061 - DNA, 23 bp, Homo sapiens
tagagcattctggggtggggctt

SEQ ID NO: 4788062 - DNA, 19 bp, Homo sapiens
tagaggattgtccaccttc

SEQ ID NO: 4788063 - DNA, 18 bp, Homo sapiens
tagagtatgcaagaagaa

SEQ ID NO: 4788064 - DNA, 14 bp, Homo sapiens
tagagtatgtgtat

SEQ ID NO: 4788065 - DNA, 15 bp, Homo sapiens
tagagtatgtgtatg

SEQ ID NO: 4788066 - DNA, 18 bp, Homo sapiens
tagagtatgtgtatgtac

SEQ ID NO: 4788067 - DNA, 22 bp, Homo sapiens
tagagtgagtttccagctgctc

SEQ ID NO: 4788068 - DNA, 17 bp, Homo sapiens
tagataccattttgaaa

SEQ ID NO: 4788069 - DNA, 19 bp, Homo sapiens
tagatattcaggaaatgtt

SEQ ID NO: 4788070 - DNA, 12 bp, Homo sapiens
tagatctcctgt

SEQ ID NO: 4788071 - DNA, 19 bp, Homo sapiens
tagatgactgaatttctat

SEQ ID NO: 4788072 - DNA, 18 bp, Homo sapiens
tagatgtctgtgtataca

SEQ ID NO: 4788073 - DNA, 19 bp, Homo sapiens
tagatgtctgtgtatacat

SEQ ID NO: 4788074 - DNA, 20 bp, Homo sapiens
tagatgtctgtgtatacata

SEQ ID NO: 4788075 - DNA, 16 bp, Homo sapiens
tagattaatggcactg

SEQ ID NO: 4788076 - DNA, 18 bp, Homo sapiens
tagattaatggcactgat

SEQ ID NO: 4788077 - DNA, 22 bp, Homo sapiens
tagattcacctgtaaaacttta

SEQ ID NO: 4788078 - DNA, 21 bp, Homo sapiens
tagattcctacttaaacaaaa

SEQ ID NO: 4788079 - DNA, 14 bp, Homo sapiens
tagattctttatta

SEQ ID NO: 4788080 - DNA, 23 bp, Homo sapiens
tagatttctcacactctaactgt

SEQ ID NO: 4788081 - DNA, 14 bp, Homo sapiens
tagattttcatgtt

SEQ ID NO: 4788082 - DNA, 20 bp, Homo sapiens
tagcaataagttgaatgata

SEQ ID NO: 4788083 - DNA, 16 bp, Homo sapiens
tagcacagaggatggc

SEQ ID NO: 4788084 - DNA, 20 bp, Homo sapiens
tagcacagaggatggcttcc

SEQ ID NO: 4788085 - DNA, 21 bp, Homo sapiens
tagcacagaggatggcttccc

SEQ ID NO: 4788086 - DNA, 21 bp, Homo sapiens
tagcacagtatttaacattct

SEQ ID NO: 4788087 - DNA, 13 bp, Homo sapiens
tagcaccagcttg

SEQ ID NO: 4788088 - DNA, 19 bp, Homo sapiens
tagcagagtcattgttaca

SEQ ID NO: 4788089 - DNA, 15 bp, Homo sapiens
tagcaggaaatagtg

SEQ ID NO: 4788090 - DNA, 17 bp, Homo sapiens
tagcaggaatttaatta

SEQ ID NO: 4788091 - DNA, 19 bp, Homo sapiens
tagcaggaatttaattagg

SEQ ID NO: 4788092 - DNA, 17 bp, Homo sapiens
tagcagttctgcaaata

SEQ ID NO: 4788093 - DNA, 20 bp, Homo sapiens
tagcagttctgcaaatagaa

SEQ ID NO: 4788094 - DNA, 16 bp, Homo sapiens
tagcatactgatgaga

SEQ ID NO: 4788095 - DNA, 23 bp, Homo sapiens
tagcatactgatgagacaacaca

SEQ ID NO: 4788096 - DNA, 14 bp, Homo sapiens
tagcataggctggg

SEQ ID NO: 4788097 - DNA, 15 bp, Homo sapiens
tagcataggctgggg

SEQ ID NO: 4788098 - DNA, 22 bp, Homo sapiens
tagcatataaatgtttatattg

SEQ ID NO: 4788099 - DNA, 15 bp, Homo sapiens
tagcatctgctcttc

SEQ ID NO: 4788100 - DNA, 20 bp, Homo sapiens
tagcatgagttctgcacata

SEQ ID NO: 4788101 - DNA, 18 bp, Homo sapiens
tagcatgtaatattaaat

SEQ ID NO: 4788102 - DNA, 21 bp, Homo sapiens
tagcatgtaatattaaattcc

SEQ ID NO: 4788103 - DNA, 12 bp, Homo sapiens
tagccaaggcca

SEQ ID NO: 4788104 - DNA, 13 bp, Homo sapiens
tagccaaggccaa

SEQ ID NO: 4788105 - DNA, 21 bp, Homo sapiens
tagccaaggccaaaggaagca

SEQ ID NO: 4788106 - DNA, 14 bp, Homo sapiens
tagccaagtgcagg

SEQ ID NO: 4788107 - DNA, 15 bp, Homo sapiens
tagccagaggagaga

SEQ ID NO: 4788108 - DNA, 17 bp, Homo sapiens
tagccagaggctctaat

SEQ ID NO: 4788109 - DNA, 14 bp, Homo sapiens
tagccatcagatga

SEQ ID NO: 4788110 - DNA, 13 bp, Homo sapiens
tagcccaccctgc

SEQ ID NO: 4788111 - DNA, 18 bp, Homo sapiens
tagcccaccctgctgcct

SEQ ID NO: 4788112 - DNA, 24 bp, Homo sapiens
tagccctctttctctctgtgtggc

SEQ ID NO: 4788113 - DNA, 16 bp, Homo sapiens
tagccctggcccggtc

SEQ ID NO: 4788114 - DNA, 15 bp, Homo sapiens
tagcctaatattcat

SEQ ID NO: 4788115 - DNA, 13 bp, Homo sapiens
tagcctggtctgt

SEQ ID NO: 4788116 - DNA, 13 bp, Homo sapiens
tagccttcccagc

SEQ ID NO: 4788117 - DNA, 23 bp, Homo sapiens
tctgagaagaggagccctcatct

SEQ ID NO: 4788118 - DNA, 13 bp, Homo sapiens
tctgaggagtcca

SEQ ID NO: 4788119 - DNA, 20 bp, Homo sapiens
tctgatatcaggaaatatct

SEQ ID NO: 4788120 - DNA, 22 bp, Homo sapiens
tctgatatcaggaaatatctgt

SEQ ID NO: 4788121 - DNA, 15 bp, Homo sapiens
tctgatatgggactg

SEQ ID NO: 4788122 - DNA, 20 bp, Homo sapiens
tctgatgaaatgttaacaat

SEQ ID NO: 4788123 - DNA, 20 bp, Homo sapiens
tctgatggcacttttgagct

SEQ ID NO: 4788124 - DNA, 16 bp, Homo sapiens
tctgatttattttgta

SEQ ID NO: 4788125 - DNA, 20 bp, Homo sapiens
tctgatttattttgtatgaa

SEQ ID NO: 4788126 - DNA, 12 bp, Homo sapiens
tctgatttctga

SEQ ID NO: 4788127 - DNA, 16 bp, Homo sapiens
tctgcaaatagaaaac

SEQ ID NO: 4788128 - DNA, 19 bp, Homo sapiens
tctgcacacataacacaca

SEQ ID NO: 4788129 - DNA, 12 bp, Homo sapiens
tctgcactgaaa

SEQ ID NO: 4788130 - DNA, 13 bp, Homo sapiens
tctgcactgaaaa

SEQ ID NO: 4788131 - DNA, 14 bp, Homo sapiens
tctgcagcctgagc

SEQ ID NO: 4788132 - DNA, 23 bp, Homo sapiens
tctgcagcctgagctccaccctc

SEQ ID NO: 4788133 - DNA, 16 bp, Homo sapiens
tctgcagtcagactga

SEQ ID NO: 4788134 - DNA, 12 bp, Homo sapiens
tctgcatagaca

SEQ ID NO: 4788135 - DNA, 13 bp, Homo sapiens
tctgcatgattag

SEQ ID NO: 4788136 - DNA, 19 bp, Homo sapiens
tctgcatgattagtgcaat

SEQ ID NO: 4788137 - DNA, 21 bp, Homo sapiens
tctgcatgattagtgcaataa

SEQ ID NO: 4788138 - DNA, 16 bp, Homo sapiens
tctgcatgcttagagc

SEQ ID NO: 4788139 - DNA, 23 bp, Homo sapiens
tctgcattactattaactctgca

SEQ ID NO: 4788140 - DNA, 15 bp, Homo sapiens
tctgccacactctga

SEQ ID NO: 4788141 - DNA, 12 bp, Homo sapiens
tctgccagggca

SEQ ID NO: 4788142 - DNA, 14 bp, Homo sapiens
tctgccatttcatg

SEQ ID NO: 4788143 - DNA, 17 bp, Homo sapiens
tctgcccaccttggcct

SEQ ID NO: 4788144 - DNA, 15 bp, Homo sapiens
tctgccccctccccc

SEQ ID NO: 4788145 - DNA, 19 bp, Homo sapiens
tctgccccctcccccgcag

SEQ ID NO: 4788146 - DNA, 21 bp, Homo sapiens
tctgcccctccgtccccaggg

SEQ ID NO: 4788147 - DNA, 22 bp, Homo sapiens
tctgcccctccgtccccagggt

SEQ ID NO: 4788148 - DNA, 22 bp, Homo sapiens
tctgccggtggggccagcgctg

SEQ ID NO: 4788149 - DNA, 13 bp, Homo sapiens
tctgctatgtctg

SEQ ID NO: 4788150 - DNA, 18 bp, Homo sapiens
tctgctcatctacacata

SEQ ID NO: 4788151 - DNA, 22 bp, Homo sapiens
tctgctccatgcagatctagcc

SEQ ID NO: 4788152 - DNA, 13 bp, Homo sapiens
tctgctcctggga

SEQ ID NO: 4788153 - DNA, 21 bp, Homo sapiens
tctgctctgttttgcatggag

SEQ ID NO: 4788154 - DNA, 15 bp, Homo sapiens
tctgctgcctccaag

SEQ ID NO: 4788155 - DNA, 16 bp, Homo sapiens
tctgctgcctccaagt

SEQ ID NO: 4788156 - DNA, 22 bp, Homo sapiens
tctgctgcctccaagtcatggg

SEQ ID NO: 4788157 - DNA, 17 bp, Homo sapiens
tctgctgcctgcccgca

SEQ ID NO: 4788158 - DNA, 23 bp, Homo sapiens
tctgctgcctgcccgcacagcag

SEQ ID NO: 4788159 - DNA, 13 bp, Homo sapiens
tctgctggtcact

SEQ ID NO: 4788160 - DNA, 21 bp, Homo sapiens
tctgcttaggcccctcaggac

SEQ ID NO: 4788161 - DNA, 18 bp, Homo sapiens
tctgcttgatatcccaag

SEQ ID NO: 4788162 - DNA, 19 bp, Homo sapiens
tctgcttgtcattctgcta

SEQ ID NO: 4788163 - DNA, 22 bp, Homo sapiens
tctggaaggtcacgctgaatga

SEQ ID NO: 4788164 - DNA, 19 bp, Homo sapiens
tctggaataaggagaatga

SEQ ID NO: 4788165 - DNA, 14 bp, Homo sapiens
tctggagtccctcc

SEQ ID NO: 4788166 - DNA, 15 bp, Homo sapiens
tctggagtctgaagg

SEQ ID NO: 4788167 - DNA, 22 bp, Homo sapiens
tctggataatttgtataagatg

SEQ ID NO: 4788168 - DNA, 13 bp, Homo sapiens
tctggatcagtaa

SEQ ID NO: 4788169 - DNA, 15 bp, Homo sapiens
tctggatcagtaaaa

SEQ ID NO: 4788170 - DNA, 22 bp, Homo sapiens
tctggattccagagcactgctc

SEQ ID NO: 4788171 - DNA, 18 bp, Homo sapiens
tctggcccagccatggct

SEQ ID NO: 4788172 - DNA, 18 bp, Homo sapiens
tctggcctatgaccctgt

SEQ ID NO: 4788173 - DNA, 19 bp, Homo sapiens
tctggcctatgaccctgtg

SEQ ID NO: 4788174 - DNA, 20 bp, Homo sapiens
tctggcctatgaccctgtgc

SEQ ID NO: 4788175 - DNA, 23 bp, Homo sapiens
tctggcctatgaccctgtgcctg

SEQ ID NO: 4788176 - DNA, 13 bp, Homo sapiens
tctggcctggcct

SEQ ID NO: 4788177 - DNA, 14 bp, Homo sapiens
tctggcctggcctg

SEQ ID NO: 4788178 - DNA, 21 bp, Homo sapiens
tctggcctttcctctctcctg

SEQ ID NO: 4788179 - DNA, 21 bp, Homo sapiens
tctggctacgacttgggacgg

SEQ ID NO: 4788180 - DNA, 18 bp, Homo sapiens
tctggctgctgcagtcag

SEQ ID NO: 4788181 - DNA, 19 bp, Homo sapiens
tctgggacaggcaccatgc

SEQ ID NO: 4788182 - DNA, 21 bp, Homo sapiens
tctgggagccagagcctctgt

SEQ ID NO: 4788183 - DNA, 17 bp, Homo sapiens
tctgggcctgggctagg

SEQ ID NO: 4788184 - DNA, 21 bp, Homo sapiens
tctgggcgccggttccacgtg

SEQ ID NO: 4788185 - DNA, 19 bp, Homo sapiens
tctggggccctgggcctca

SEQ ID NO: 4788186 - DNA, 15 bp, Homo sapiens
tctggtattaaatgc

SEQ ID NO: 4788187 - DNA, 23 bp, Homo sapiens
tctggtcagtgaagcccaggagg

SEQ ID NO: 4788188 - DNA, 19 bp, Homo sapiens
tctggtgcgtgtggccctg

SEQ ID NO: 4788189 - DNA, 17 bp, Homo sapiens
tctggtgtctaataaac

SEQ ID NO: 4788190 - DNA, 14 bp, Homo sapiens
tctgtaaaaccagg

SEQ ID NO: 4788191 - DNA, 13 bp, Homo sapiens
tctgtaatattta

SEQ ID NO: 4788192 - DNA, 19 bp, Homo sapiens
tctgtaatatttacaatgt

SEQ ID NO: 4788193 - DNA, 23 bp, Homo sapiens
tctgtaatatttacaatgtatta

SEQ ID NO: 4788194 - DNA, 13 bp, Homo sapiens
tctgtagcctggt

SEQ ID NO: 4788195 - DNA, 20 bp, Homo sapiens
tctgtatatagatgtctgtg

SEQ ID NO: 4788196 - DNA, 18 bp, Homo sapiens
tctgtattggcagcacag

SEQ ID NO: 4788197 - DNA, 20 bp, Homo sapiens
tctgtattggcagcacagct

SEQ ID NO: 4788198 - DNA, 18 bp, Homo sapiens
tctgtatttaatggtttt

SEQ ID NO: 4788199 - DNA, 19 bp, Homo sapiens
tctgtcaccagctatctgt

SEQ ID NO: 4788200 - DNA, 20 bp, Homo sapiens
tctgtcaccagctatctgtc

SEQ ID NO: 4788201 - DNA, 20 bp, Homo sapiens
tctgtcagccagccgccctg

SEQ ID NO: 4788202 - DNA, 22 bp, Homo sapiens
tctgtcagccagccgccctggg

SEQ ID NO: 4788203 - DNA, 15 bp, Homo sapiens
tctgtcagcttccca

SEQ ID NO: 4788204 - DNA, 18 bp, Homo sapiens
tctgtcagtgagtcagag

SEQ ID NO: 4788205 - DNA, 22 bp, Homo sapiens
tctgtcatctctctggggccct

SEQ ID NO: 4788206 - DNA, 16 bp, Homo sapiens
tctgtccctaaacata

SEQ ID NO: 4788207 - DNA, 17 bp, Homo sapiens
tctgtccctaaacatag

SEQ ID NO: 4788208 - DNA, 17 bp, Homo sapiens
tctgtccgtctgtcctg

SEQ ID NO: 4788209 - DNA, 18 bp, Homo sapiens
tctgtccgtctgtcctgc

SEQ ID NO: 4788210 - DNA, 15 bp, Homo sapiens
tctgtccttccccca

SEQ ID NO: 4788211 - DNA, 16 bp, Homo sapiens
tctgtccttcccccag

SEQ ID NO: 4788212 - DNA, 18 bp, Homo sapiens
tctgtccttcccccagca

SEQ ID NO: 4788213 - DNA, 19 bp, Homo sapiens
tctgtccttcccccagcac

SEQ ID NO: 4788214 - DNA, 12 bp, Homo sapiens
tctgtcctttcc

SEQ ID NO: 4788215 - DNA, 13 bp, Homo sapiens
tctgtctaggaat

SEQ ID NO: 4788216 - DNA, 22 bp, Homo sapiens
tctgtctataggacttaattta

SEQ ID NO: 4788217 - DNA, 16 bp, Homo sapiens
tctgtctgagccctgc

SEQ ID NO: 4788218 - DNA, 19 bp, Homo sapiens
tctgtctgagccctgccct

SEQ ID NO: 4788219 - DNA, 18 bp, Homo sapiens
tctgtctggctgtacgtc

SEQ ID NO: 4788220 - DNA, 16 bp, Homo sapiens
tctgtctttatgattt

SEQ ID NO: 4788221 - DNA, 21 bp, Homo sapiens
tctgtgaaagtctcctgtatc

SEQ ID NO: 4788222 - DNA, 23 bp, Homo sapiens
tctgtgaaagtctcctgtatcat

SEQ ID NO: 4788223 - DNA, 19 bp, Homo sapiens
tctgtgaagcctttatcta

SEQ ID NO: 4788224 - DNA, 20 bp, Homo sapiens
tctgtgaagcctttatctat

SEQ ID NO: 4788225 - DNA, 17 bp, Homo sapiens
tctgtgcagtcatcaac

SEQ ID NO: 4788226 - DNA, 18 bp, Homo sapiens
tctgtgcatctggcctgg

SEQ ID NO: 4788227 - DNA, 16 bp, Homo sapiens
tctgtgcattgtggct

SEQ ID NO: 4788228 - DNA, 20 bp, Homo sapiens
tctgtgcattgtggctgtca

SEQ ID NO: 4788229 - DNA, 17 bp, Homo sapiens
tctgtgcctcagtgaga

SEQ ID NO: 4788230 - DNA, 17 bp, Homo sapiens
tctgtgggactggccca

SEQ ID NO: 4788231 - DNA, 21 bp, Homo sapiens
tctgtgggactggcccacccc

SEQ ID NO: 4788232 - DNA, 19 bp, Homo sapiens
tctgtgtaagacacgtgca

SEQ ID NO: 4788233 - DNA, 23 bp, Homo sapiens
tctgtgtagtagctcgtgtgctt

SEQ ID NO: 4788234 - DNA, 19 bp, Homo sapiens
tctgtgtcacgtgaccctg

SEQ ID NO: 4788235 - DNA, 13 bp, Homo sapiens
tctgtgtgtgaat

SEQ ID NO: 4788236 - DNA, 16 bp, Homo sapiens
tctgtgtgtgacacca

SEQ ID NO: 4788237 - DNA, 12 bp, Homo sapiens
tctgttccctgc

SEQ ID NO: 4788238 - DNA, 20 bp, Homo sapiens
tctttgataaagaaaagaat

SEQ ID NO: 4788239 - DNA, 16 bp, Homo sapiens
tctttgctcagtggat

SEQ ID NO: 4788240 - DNA, 13 bp, Homo sapiens
tctttggcttcag

SEQ ID NO: 4788241 - DNA, 18 bp, Homo sapiens
tctttggttcctcatggc

SEQ ID NO: 4788242 - DNA, 14 bp, Homo sapiens
tctttgtacagaca

SEQ ID NO: 4788243 - DNA, 15 bp, Homo sapiens
tctttgtacagacaa

SEQ ID NO: 4788244 - DNA, 15 bp, Homo sapiens
tctttgtcaatgctc

SEQ ID NO: 4788245 - DNA, 22 bp, Homo sapiens
tctttgtcaatgctctaacaaa

SEQ ID NO: 4788246 - DNA, 20 bp, Homo sapiens
tctttgttcttcaatgtgaa

SEQ ID NO: 4788247 - DNA, 21 bp, Homo sapiens
tctttgttcttcaatgtgaaa

SEQ ID NO: 4788248 - DNA, 22 bp, Homo sapiens
tctttgttcttcaatgtgaaac

SEQ ID NO: 4788249 - DNA, 12 bp, Homo sapiens
tctttgttgctt

SEQ ID NO: 4788250 - DNA, 15 bp, Homo sapiens
tctttgttgcttaat

SEQ ID NO: 4788251 - DNA, 19 bp, Homo sapiens
tcttttaaaaactcctgtt

SEQ ID NO: 4788252 - DNA, 21 bp, Homo sapiens
tcttttaaggtagaatcttgt

SEQ ID NO: 4788253 - DNA, 16 bp, Homo sapiens
tcttttcaatgcaatg

SEQ ID NO: 4788254 - DNA, 21 bp, Homo sapiens
tcttttcatggagtagagtca

SEQ ID NO: 4788255 - DNA, 21 bp, Homo sapiens
tcttttgtcctgcatcatctt

SEQ ID NO: 4788256 - DNA, 13 bp, Homo sapiens
tcttttgttctct

SEQ ID NO: 4788257 - DNA, 16 bp, Homo sapiens
tcttttgttctctctt

SEQ ID NO: 4788258 - DNA, 18 bp, Homo sapiens
tctttttaaaaagttgca

SEQ ID NO: 4788259 - DNA, 15 bp, Homo sapiens
tcttttttttcttca

SEQ ID NO: 4788260 - DNA, 19 bp, Homo sapiens
tgaaaaaaaaaagtaatta

SEQ ID NO: 4788261 - DNA, 14 bp, Homo sapiens
tgaaaaatctgaat

SEQ ID NO: 4788262 - DNA, 19 bp, Homo sapiens
tgaaaaatgagattgaatg

SEQ ID NO: 4788263 - DNA, 18 bp, Homo sapiens
tgaaaaccatctggcctg

SEQ ID NO: 4788264 - DNA, 22 bp, Homo sapiens
tgaaaaccatctggcctggcct

SEQ ID NO: 4788265 - DNA, 14 bp, Homo sapiens
tgaaaactggaata

SEQ ID NO: 4788266 - DNA, 13 bp, Homo sapiens
tgaaaacttctca

SEQ ID NO: 4788267 - DNA, 22 bp, Homo sapiens
tgaaaacttctcatttatgtta

SEQ ID NO: 4788268 - DNA, 21 bp, Homo sapiens
tgaaaaggttcttcatccctt

SEQ ID NO: 4788269 - DNA, 18 bp, Homo sapiens
tgaaaagttttcaagcat

SEQ ID NO: 4788270 - DNA, 14 bp, Homo sapiens
tgaaacaaatatac

SEQ ID NO: 4788271 - DNA, 18 bp, Homo sapiens
tgaaacaaatatactcat

SEQ ID NO: 4788272 - DNA, 21 bp, Homo sapiens
tgaaacaaatatactcatttg

SEQ ID NO: 4788273 - DNA, 21 bp, Homo sapiens
tgaaacacacagtgaccaagg

SEQ ID NO: 4788274 - DNA, 18 bp, Homo sapiens
tgaaacactcgtgtgcat

SEQ ID NO: 4788275 - DNA, 22 bp, Homo sapiens
tgaaacactcgtgtgcatgaga

SEQ ID NO: 4788276 - DNA, 20 bp, Homo sapiens
tgaaacagtgtggatgtaaa

SEQ ID NO: 4788277 - DNA, 11 bp, Homo sapiens
tgaaactgtat

SEQ ID NO: 4788278 - DNA, 12 bp, Homo sapiens
tgaaactgtatt

SEQ ID NO: 4788279 - DNA, 13 bp, Homo sapiens
tgaaactgtattt

SEQ ID NO: 4788280 - DNA, 14 bp, Homo sapiens
tgaaacttttcaag

SEQ ID NO: 4788281 - DNA, 13 bp, Homo sapiens
tgaaagagaaaat

SEQ ID NO: 4788282 - DNA, 14 bp, Homo sapiens
tgaaagagtaaaac

SEQ ID NO: 4788283 - DNA, 15 bp, Homo sapiens
tgaaaggtagacttt

SEQ ID NO: 4788284 - DNA, 21 bp, Homo sapiens
tgaaagtcagtttaagaggct

SEQ ID NO: 4788285 - DNA, 20 bp, Homo sapiens
tgaaagtctcctgtatcatt

SEQ ID NO: 4788286 - DNA, 21 bp, Homo sapiens
tgaaataaagagttctccttg

SEQ ID NO: 4788287 - DNA, 22 bp, Homo sapiens
tgaaatacatatgataaatttg

SEQ ID NO: 4788288 - DNA, 10 bp, Homo sapiens
tgaaatataa

SEQ ID NO: 4788289 - DNA, 13 bp, Homo sapiens
tgaaatataaact

SEQ ID NO: 4788290 - DNA, 18 bp, Homo sapiens
tgaaatataaactgtgag

SEQ ID NO: 4788291 - DNA, 19 bp, Homo sapiens
tgaaatataaactgtgaga

SEQ ID NO: 4788292 - DNA, 19 bp, Homo sapiens
tgaaatatatgtgaaagga

SEQ ID NO: 4788293 - DNA, 18 bp, Homo sapiens
tgaaatatttgcttattt

SEQ ID NO: 4788294 - DNA, 16 bp, Homo sapiens
tgaaatattttctact

SEQ ID NO: 4788295 - DNA, 21 bp, Homo sapiens
tgaaatattttctactttaaa

SEQ ID NO: 4788296 - DNA, 20 bp, Homo sapiens
tgaaatctacaacataatga

SEQ ID NO: 4788297 - DNA, 23 bp, Homo sapiens
tgaaatctacaacataatgatac

SEQ ID NO: 4788298 - DNA, 15 bp, Homo sapiens
tgaaatgttaacaat

SEQ ID NO: 4788299 - DNA, 21 bp, Homo sapiens
tgaaatgttaacaatgcctat

SEQ ID NO: 4788300 - DNA, 23 bp, Homo sapiens
tgaaattagtgttttcattctgg

SEQ ID NO: 4788301 - DNA, 14 bp, Homo sapiens
tgaaattatgtcaa

SEQ ID NO: 4788302 - DNA, 16 bp, Homo sapiens
tgaaatttaagcacaa

SEQ ID NO: 4788303 - DNA, 13 bp, Homo sapiens
tgaaattttctag

SEQ ID NO: 4788304 - DNA, 20 bp, Homo sapiens
tgaaattttctagaatacta

SEQ ID NO: 4788305 - DNA, 19 bp, Homo sapiens
tgaacaccactttgtctct

SEQ ID NO: 4788306 - DNA, 14 bp, Homo sapiens
tgaacactgcaccc

SEQ ID NO: 4788307 - DNA, 17 bp, Homo sapiens
tgaacactgcaccctcc

SEQ ID NO: 4788308 - DNA, 15 bp, Homo sapiens
tgaacagcttcactt

SEQ ID NO: 4788309 - DNA, 16 bp, Homo sapiens
tgaacagcttcactta

SEQ ID NO: 4788310 - DNA, 18 bp, Homo sapiens
tgaacatcttttaactgc

SEQ ID NO: 4788311 - DNA, 22 bp, Homo sapiens
tgaacattaatccacatgtttc

SEQ ID NO: 4788312 - DNA, 15 bp, Homo sapiens
tgaaccgtcaatgtg

SEQ ID NO: 4788313 - DNA, 17 bp, Homo sapiens
tgaaccgtcaatgtgaa

SEQ ID NO: 4788314 - DNA, 21 bp, Homo sapiens
tgaacgcacaacatgcacatt

SEQ ID NO: 4788315 - DNA, 16 bp, Homo sapiens
tgaactaactgccatg

SEQ ID NO: 4788316 - DNA, 15 bp, Homo sapiens
tcctcagccccaggg

SEQ ID NO: 4788317 - DNA, 16 bp, Homo sapiens
tcctcagccccagggc

SEQ ID NO: 4788318 - DNA, 17 bp, Homo sapiens
tcctcagccccagggcc

SEQ ID NO: 4788319 - DNA, 16 bp, Homo sapiens
tcctcaggtgaataac

SEQ ID NO: 4788320 - DNA, 22 bp, Homo sapiens
tcctcatcagtgtcattttctg

SEQ ID NO: 4788321 - DNA, 23 bp, Homo sapiens
tcctcatcagtgtcattttctgt

SEQ ID NO: 4788322 - DNA, 22 bp, Homo sapiens
tcctcatggctgttatctgtct

SEQ ID NO: 4788323 - DNA, 19 bp, Homo sapiens
tcctcatgtgagaaagcag

SEQ ID NO: 4788324 - DNA, 14 bp, Homo sapiens
tcctccaaagcctg

SEQ ID NO: 4788325 - DNA, 16 bp, Homo sapiens
tcctccaaatgctgtc

SEQ ID NO: 4788326 - DNA, 15 bp, Homo sapiens
tcctccagtacaata

SEQ ID NO: 4788327 - DNA, 20 bp, Homo sapiens
tcctccatgctgtccctgtg

SEQ ID NO: 4788328 - DNA, 17 bp, Homo sapiens
tcctcccaacagtttta

SEQ ID NO: 4788329 - DNA, 13 bp, Homo sapiens
tcctcccagctgt

SEQ ID NO: 4788330 - DNA, 21 bp, Homo sapiens
tcctccccctcctccatgctg

SEQ ID NO: 4788331 - DNA, 19 bp, Homo sapiens
tcctccgcggaggcccctg

SEQ ID NO: 4788332 - DNA, 20 bp, Homo sapiens
tcctccgcggaggcccctga

SEQ ID NO: 4788333 - DNA, 12 bp, Homo sapiens
tcctcctcatga

SEQ ID NO: 4788334 - DNA, 21 bp, Homo sapiens
tcctcctgcatgtcggggccc

SEQ ID NO: 4788335 - DNA, 19 bp, Homo sapiens
tcctcctgtctcctctgtc

SEQ ID NO: 4788336 - DNA, 19 bp, Homo sapiens
tcctccttcactccctgtc

SEQ ID NO: 4788337 - DNA, 19 bp, Homo sapiens
tcctccttttcacagttct

SEQ ID NO: 4788338 - DNA, 22 bp, Homo sapiens
tcctcgccgggccattctgatt

SEQ ID NO: 4788339 - DNA, 15 bp, Homo sapiens
tcctcggcagctccg

SEQ ID NO: 4788340 - DNA, 16 bp, Homo sapiens
tcctcggccctgtagc

SEQ ID NO: 4788341 - DNA, 20 bp, Homo sapiens
tcctcggccctgtagccctg

SEQ ID NO: 4788342 - DNA, 21 bp, Homo sapiens
tcctcggtggcatttgctgaa

SEQ ID NO: 4788343 - DNA, 22 bp, Homo sapiens
tcctcgtccggcctgcagccca

SEQ ID NO: 4788344 - DNA, 15 bp, Homo sapiens
tcctctagctaccat

SEQ ID NO: 4788345 - DNA, 19 bp, Homo sapiens
tcctctatccttttttcct

SEQ ID NO: 4788346 - DNA, 18 bp, Homo sapiens
tcctctcaaacctggcag

SEQ ID NO: 4788347 - DNA, 21 bp, Homo sapiens
tcctctcagaactcctgtgtg

SEQ ID NO: 4788348 - DNA, 14 bp, Homo sapiens
tcctctcctcgtcc

SEQ ID NO: 4788349 - DNA, 23 bp, Homo sapiens
tcctctcctcgtccggcctgcag

SEQ ID NO: 4788350 - DNA, 15 bp, Homo sapiens
tcctctcgagcccag

SEQ ID NO: 4788351 - DNA, 21 bp, Homo sapiens
tcctctcgtagaacctgcgca

SEQ ID NO: 4788352 - DNA, 13 bp, Homo sapiens
tcctctctctccc

SEQ ID NO: 4788353 - DNA, 16 bp, Homo sapiens
tcctctctctccctcc

SEQ ID NO: 4788354 - DNA, 19 bp, Homo sapiens
tcctctctctccctccact

SEQ ID NO: 4788355 - DNA, 12 bp, Homo sapiens
tcctctgccccc

SEQ ID NO: 4788356 - DNA, 16 bp, Homo sapiens
tcctctgccccctccc

SEQ ID NO: 4788357 - DNA, 18 bp, Homo sapiens
tcctctgccccctccccc

SEQ ID NO: 4788358 - DNA, 20 bp, Homo sapiens
tcctctgccccctcccccgc

SEQ ID NO: 4788359 - DNA, 21 bp, Homo sapiens
tcctctgccccctcccccgca

SEQ ID NO: 4788360 - DNA, 16 bp, Homo sapiens
tcctctgcttgtcatt

SEQ ID NO: 4788361 - DNA, 17 bp, Homo sapiens
tcctctggggctctagg

SEQ ID NO: 4788362 - DNA, 23 bp, Homo sapiens
tcctcttacctgtaatagcctca

SEQ ID NO: 4788363 - DNA, 20 bp, Homo sapiens
tcctcttagaagaatattgt

SEQ ID NO: 4788364 - DNA, 20 bp, Homo sapiens
tcctcttatatgtgcccctt

SEQ ID NO: 4788365 - DNA, 15 bp, Homo sapiens
tcctgactgttctct

SEQ ID NO: 4788366 - DNA, 13 bp, Homo sapiens
tcctgcaccctct

SEQ ID NO: 4788367 - DNA, 15 bp, Homo sapiens
tcctgcactgtcccg

SEQ ID NO: 4788368 - DNA, 22 bp, Homo sapiens
tcctgcccactctgaccgggct

SEQ ID NO: 4788369 - DNA, 21 bp, Homo sapiens
tcctgccccagcctactccac

SEQ ID NO: 4788370 - DNA, 17 bp, Homo sapiens
tcctgcccttacctgcc

SEQ ID NO: 4788371 - DNA, 17 bp, Homo sapiens
tcctgcctcagcctccc

SEQ ID NO: 4788372 - DNA, 21 bp, Homo sapiens
tcctgcgcctgcgcctcctcc

SEQ ID NO: 4788373 - DNA, 14 bp, Homo sapiens
tcctgcgggtttta

SEQ ID NO: 4788374 - DNA, 17 bp, Homo sapiens
tcctgctacctttgtct

SEQ ID NO: 4788375 - DNA, 18 bp, Homo sapiens
tcctgctacctttgtctc

SEQ ID NO: 4788376 - DNA, 19 bp, Homo sapiens
tcctgctacctttgtctca

SEQ ID NO: 4788377 - DNA, 20 bp, Homo sapiens
tcctgctcacgtctgtgagt

SEQ ID NO: 4788378 - DNA, 18 bp, Homo sapiens
tcctgctcgccctgtgcc

SEQ ID NO: 4788379 - DNA, 22 bp, Homo sapiens
tctcattttttcctgagaacct

SEQ ID NO: 4788380 - DNA, 16 bp, Homo sapiens
tctccacaacctcctc

SEQ ID NO: 4788381 - DNA, 21 bp, Homo sapiens
tctccacccctcaagccagga

SEQ ID NO: 4788382 - DNA, 12 bp, Homo sapiens
tctccacctccc

SEQ ID NO: 4788383 - DNA, 22 bp, Homo sapiens
tctccacctcccccaaaccctg

SEQ ID NO: 4788384 - DNA, 12 bp, Homo sapiens
tctccagactct

SEQ ID NO: 4788385 - DNA, 20 bp, Homo sapiens
tctccagccaatttcaaaga

SEQ ID NO: 4788386 - DNA, 22 bp, Homo sapiens
tctccaggcccagcctggcccc

SEQ ID NO: 4788387 - DNA, 14 bp, Homo sapiens
tctccatctccgct

SEQ ID NO: 4788388 - DNA, 13 bp, Homo sapiens
tctccatgctctt

SEQ ID NO: 4788389 - DNA, 11 bp, Homo sapiens
tctccattaaa

SEQ ID NO: 4788390 - DNA, 16 bp, Homo sapiens
tctccattaaacttct

SEQ ID NO: 4788391 - DNA, 22 bp, Homo sapiens
tctccattaaacttctactgag

SEQ ID NO: 4788392 - DNA, 13 bp, Homo sapiens
tctcccaggtgaa

SEQ ID NO: 4788393 - DNA, 23 bp, Homo sapiens
tctccccctcagctctccctcac

SEQ ID NO: 4788394 - DNA, 15 bp, Homo sapiens
tctcccctccagacc

SEQ ID NO: 4788395 - DNA, 19 bp, Homo sapiens
tctcccgccattggcctta

SEQ ID NO: 4788396 - DNA, 20 bp, Homo sapiens
tctccctaccctcttctcag

SEQ ID NO: 4788397 - DNA, 21 bp, Homo sapiens
tctccctaccctcttctcagc

SEQ ID NO: 4788398 - DNA, 21 bp, Homo sapiens
tctccctcacacctcccttca

SEQ ID NO: 4788399 - DNA, 12 bp, Homo sapiens
tctccctccact

SEQ ID NO: 4788400 - DNA, 12 bp, Homo sapiens
tctccgcccccc

SEQ ID NO: 4788401 - DNA, 23 bp, Homo sapiens
tctccgccccggacagggtggca

SEQ ID NO: 4788402 - DNA, 21 bp, Homo sapiens
tctccggatggaatcacagcc

SEQ ID NO: 4788403 - DNA, 16 bp, Homo sapiens
tctccgggtgtggcct

SEQ ID NO: 4788404 - DNA, 14 bp, Homo sapiens
tctcctccaaatgc

SEQ ID NO: 4788405 - DNA, 15 bp, Homo sapiens
tctcctcgtccggcc

SEQ ID NO: 4788406 - DNA, 18 bp, Homo sapiens
tctcctcgtccggcctgc

SEQ ID NO: 4788407 - DNA, 21 bp, Homo sapiens
tctcctcgtccggcctgcagc

SEQ ID NO: 4788408 - DNA, 12 bp, Homo sapiens
tctcctctccca

SEQ ID NO: 4788409 - DNA, 15 bp, Homo sapiens
tctcctctctctccc

SEQ ID NO: 4788410 - DNA, 22 bp, Homo sapiens
tctcctctctctccctccactc

SEQ ID NO: 4788411 - DNA, 12 bp, Homo sapiens
tctcctctgtca

SEQ ID NO: 4788412 - DNA, 22 bp, Homo sapiens
tctcctctgtcagtttgtgaag

SEQ ID NO: 4788413 - DNA, 16 bp, Homo sapiens
tctcctgattatttat

SEQ ID NO: 4788414 - DNA, 14 bp, Homo sapiens
tctcctgcatccct

SEQ ID NO: 4788415 - DNA, 16 bp, Homo sapiens
tctcctgcccactctg

SEQ ID NO: 4788416 - DNA, 22 bp, Homo sapiens
tctcctgggggtggcaggcaca

SEQ ID NO: 4788417 - DNA, 14 bp, Homo sapiens
tctcctgtatcatt

SEQ ID NO: 4788418 - DNA, 18 bp, Homo sapiens
tctcctgtttcccttccc

SEQ ID NO: 4788419 - DNA, 21 bp, Homo sapiens
tctccttaaactaccaccctc

SEQ ID NO: 4788420 - DNA, 11 bp, Homo sapiens
tctccttaacc

SEQ ID NO: 4788421 - DNA, 17 bp, Homo sapiens
tctccttggttatattt

SEQ ID NO: 4788422 - DNA, 14 bp, Homo sapiens
tctccttgtacttg

SEQ ID NO: 4788423 - DNA, 23 bp, Homo sapiens
tctcctttaatatactccttaaa

SEQ ID NO: 4788424 - DNA, 19 bp, Homo sapiens
tctcctttgtcaaatggta

SEQ ID NO: 4788425 - DNA, 23 bp, Homo sapiens
tctcctttgtcaaatggtatttt

SEQ ID NO: 4788426 - DNA, 21 bp, Homo sapiens
tctcgggtgcatttgagagaa

SEQ ID NO: 4788427 - DNA, 23 bp, Homo sapiens
tctctaagacaaatgcagtgtat

SEQ ID NO: 4788428 - DNA, 12 bp, Homo sapiens
tctctagagaac

SEQ ID NO: 4788429 - DNA, 14 bp, Homo sapiens
tctctagagaacat

SEQ ID NO: 4788430 - DNA, 19 bp, Homo sapiens
tctctatatatacatgtat

SEQ ID NO: 4788431 - DNA, 15 bp, Homo sapiens
tctctatttgatttg

SEQ ID NO: 4788432 - DNA, 17 bp, Homo sapiens
tctctatttgatttgca

SEQ ID NO: 4788433 - DNA, 23 bp, Homo sapiens
tctctcatggcttgggctggagt

SEQ ID NO: 4788434 - DNA, 20 bp, Homo sapiens
tctctccccatatataaatt

SEQ ID NO: 4788435 - DNA, 15 bp, Homo sapiens
tctctccgccccgga

SEQ ID NO: 4788436 - DNA, 17 bp, Homo sapiens
tctctccgccccggaca

SEQ ID NO: 4788437 - DNA, 16 bp, Homo sapiens
tctctcctctctctcc

SEQ ID NO: 4788438 - DNA, 14 bp, Homo sapiens
tctctcctgctcac

SEQ ID NO: 4788439 - DNA, 17 bp, Homo sapiens
tctctcctgtgagctcc

SEQ ID NO: 4788440 - DNA, 20 bp, Homo sapiens
tctctctaagacaaatgcag

SEQ ID NO: 4788441 - DNA, 15 bp, Homo sapiens
tctctctctctgttc

SEQ ID NO: 4788442 - DNA, 11 bp, Homo sapiens
tctctctctgt

SEQ ID NO: 4788443 - DNA, 9 bp, Homo sapiens
tctctctgt

SEQ ID NO: 4788444 - DNA, 15 bp, Homo sapiens
tctctctgtgctggt

SEQ ID NO: 4788445 - DNA, 14 bp, Homo sapiens
tctctctgtgtggc

SEQ ID NO: 4788446 - DNA, 17 bp, Homo sapiens
tctctctgtgtggcaaa

SEQ ID NO: 4788447 - DNA, 22 bp, Homo sapiens
tctctcttggtctctttctttc

SEQ ID NO: 4788448 - DNA, 15 bp, Homo sapiens
tctctctttccatct

SEQ ID NO: 4788449 - DNA, 20 bp, Homo sapiens
tcatgtttaagaaatgagaa

SEQ ID NO: 4788450 - DNA, 23 bp, Homo sapiens
tcatgtttctgcagtattctgta

SEQ ID NO: 4788451 - DNA, 13 bp, Homo sapiens
tcatgttttgcta

SEQ ID NO: 4788452 - DNA, 22 bp, Homo sapiens
tcattaaaacaagagaccactt

SEQ ID NO: 4788453 - DNA, 23 bp, Homo sapiens
tcattaaactaattaaactgatg

SEQ ID NO: 4788454 - DNA, 18 bp, Homo sapiens
tcattacatcctctgctt

SEQ ID NO: 4788455 - DNA, 15 bp, Homo sapiens
tcattagaattgaat

SEQ ID NO: 4788456 - DNA, 22 bp, Homo sapiens
tcattagaattgaattattggg

SEQ ID NO: 4788457 - DNA, 18 bp, Homo sapiens
tcattagctgtgattttt

SEQ ID NO: 4788458 - DNA, 14 bp, Homo sapiens
tcattatagcatgt

SEQ ID NO: 4788459 - DNA, 22 bp, Homo sapiens
tcattcagaatgtgcaaagcag

SEQ ID NO: 4788460 - DNA, 15 bp, Homo sapiens
tcattcatactcaaa

SEQ ID NO: 4788461 - DNA, 22 bp, Homo sapiens
tcattccgaaaaaaaaatgttc

SEQ ID NO: 4788462 - DNA, 18 bp, Homo sapiens
tcattctatgacaataaa

SEQ ID NO: 4788463 - DNA, 19 bp, Homo sapiens
tcattctgctaatttatga

SEQ ID NO: 4788464 - DNA, 21 bp, Homo sapiens
tcattctgctaatttatgaag

SEQ ID NO: 4788465 - DNA, 21 bp, Homo sapiens
tcattctggtccttagtaaat

SEQ ID NO: 4788466 - DNA, 13 bp, Homo sapiens
tcattcttctaaa

SEQ ID NO: 4788467 - DNA, 18 bp, Homo sapiens
tcattcttctaaaactac

SEQ ID NO: 4788468 - DNA, 20 bp, Homo sapiens
tcattcttgccctttgagaa

SEQ ID NO: 4788469 - DNA, 22 bp, Homo sapiens
tcattctttataaaccataaaa

SEQ ID NO: 4788470 - DNA, 23 bp, Homo sapiens
tcattgagggaaaacataatatc

SEQ ID NO: 4788471 - DNA, 13 bp, Homo sapiens
tcattgccaaggc

SEQ ID NO: 4788472 - DNA, 17 bp, Homo sapiens
tcattgccaaggcatcc

SEQ ID NO: 4788473 - DNA, 16 bp, Homo sapiens
tcattgggaagtatga

SEQ ID NO: 4788474 - DNA, 15 bp, Homo sapiens
tcattggttacaaat

SEQ ID NO: 4788475 - DNA, 20 bp, Homo sapiens
tcattggttacaaattttta

SEQ ID NO: 4788476 - DNA, 14 bp, Homo sapiens
tcattgtcagagat

SEQ ID NO: 4788477 - DNA, 14 bp, Homo sapiens
tcattgtgttttct

SEQ ID NO: 4788478 - DNA, 15 bp, Homo sapiens
tcattgttaaagtaa

SEQ ID NO: 4788479 - DNA, 19 bp, Homo sapiens
tcatttacaacttccagat

SEQ ID NO: 4788480 - DNA, 11 bp, Homo sapiens
tcatttatgat

SEQ ID NO: 4788481 - DNA, 13 bp, Homo sapiens
tcatttcataaaa

SEQ ID NO: 4788482 - DNA, 23 bp, Homo sapiens
tcatttccagcaaaatatatgtt

SEQ ID NO: 4788483 - DNA, 12 bp, Homo sapiens
tcatttgcatat

SEQ ID NO: 4788484 - DNA, 16 bp, Homo sapiens
tcatttgcatcctatc

SEQ ID NO: 4788485 - DNA, 12 bp, Homo sapiens
tcatttgctaat

SEQ ID NO: 4788486 - DNA, 12 bp, Homo sapiens
tccctgtggggg

SEQ ID NO: 4788487 - DNA, 16 bp, Homo sapiens
tccctgtgggggtggc

SEQ ID NO: 4788488 - DNA, 19 bp, Homo sapiens
tccctgtgggggtggccat

SEQ ID NO: 4788489 - DNA, 23 bp, Homo sapiens
tccctgtgggggtggccatccct

SEQ ID NO: 4788490 - DNA, 13 bp, Homo sapiens
tcccttcatccca

SEQ ID NO: 4788491 - DNA, 14 bp, Homo sapiens
tcccttccactgcc

SEQ ID NO: 4788492 - DNA, 22 bp, Homo sapiens
tcccttccactgcctctgcctt

SEQ ID NO: 4788493 - DNA, 17 bp, Homo sapiens
tcccttcccattggcct

SEQ ID NO: 4788494 - DNA, 14 bp, Homo sapiens
tcccttcttttcct

SEQ ID NO: 4788495 - DNA, 15 bp, Homo sapiens
tcccttcttttcctg

SEQ ID NO: 4788496 - DNA, 22 bp, Homo sapiens
tcccttgagctggttttctctg

SEQ ID NO: 4788497 - DNA, 23 bp, Homo sapiens
tccctttatcatgtgtttctgtg

SEQ ID NO: 4788498 - DNA, 20 bp, Homo sapiens
tccctttccctgcatccctt

SEQ ID NO: 4788499 - DNA, 16 bp, Homo sapiens
tccctttttgaattgt

SEQ ID NO: 4788500 - DNA, 14 bp, Homo sapiens
tccgaaaaaaaaat

SEQ ID NO: 4788501 - DNA, 22 bp, Homo sapiens
tccgaacgctgctccatgcaca

SEQ ID NO: 4788502 - DNA, 21 bp, Homo sapiens
tccgagattcagactgcttca

SEQ ID NO: 4788503 - DNA, 12 bp, Homo sapiens
tccgagcccctg

SEQ ID NO: 4788504 - DNA, 22 bp, Homo sapiens
tccgaggcctggctctggagcc

SEQ ID NO: 4788505 - DNA, 19 bp, Homo sapiens
tccgcacgcggccgctctc

SEQ ID NO: 4788506 - DNA, 19 bp, Homo sapiens
tccgccccggacagggtgg

SEQ ID NO: 4788507 - DNA, 17 bp, Homo sapiens
tccgccccgtgctcctc

SEQ ID NO: 4788508 - DNA, 15 bp, Homo sapiens
tccgcccgcccaccc

SEQ ID NO: 4788509 - DNA, 13 bp, Homo sapiens
tccgcgagcctgc

SEQ ID NO: 4788510 - DNA, 13 bp, Homo sapiens
tccggcagaggca

SEQ ID NO: 4788511 - DNA, 18 bp, Homo sapiens
tccggcctgcagcccaga

SEQ ID NO: 4788512 - DNA, 20 bp, Homo sapiens
tccggcctgcagcccagaac

SEQ ID NO: 4788513 - DNA, 15 bp, Homo sapiens
tccgggcctcggcct

SEQ ID NO: 4788514 - DNA, 17 bp, Homo sapiens
tccgggcctcggcctgg

SEQ ID NO: 4788515 - DNA, 18 bp, Homo sapiens
tccgggcctcggcctggc

SEQ ID NO: 4788516 - DNA, 16 bp, Homo sapiens
tccgggtgtggcctca

SEQ ID NO: 4788517 - DNA, 15 bp, Homo sapiens
tccggtgccttccac

SEQ ID NO: 4788518 - DNA, 17 bp, Homo sapiens
tccggtgccttccaccc

SEQ ID NO: 4788519 - DNA, 13 bp, Homo sapiens
tccgtccccaggg

SEQ ID NO: 4788520 - DNA, 14 bp, Homo sapiens
tccgtccccagggt

SEQ ID NO: 4788521 - DNA, 22 bp, Homo sapiens
tccgtccccagggtgcaggcgc

SEQ ID NO: 4788522 - DNA, 14 bp, Homo sapiens
tccgtctgtcctgc

SEQ ID NO: 4788523 - DNA, 15 bp, Homo sapiens
tccgtctgtcctgcg

SEQ ID NO: 4788524 - DNA, 16 bp, Homo sapiens
tccgtgagacacaaga

SEQ ID NO: 4788525 - DNA, 16 bp, Homo sapiens
tccgtgggcagctcct

SEQ ID NO: 4788526 - DNA, 22 bp, Homo sapiens
tccgttcatctgaggagtccaa

SEQ ID NO: 4788527 - DNA, 13 bp, Homo sapiens
tcctaagctgcca

SEQ ID NO: 4788528 - DNA, 23 bp, Homo sapiens
tcctacaatatcattttcctggg

SEQ ID NO: 4788529 - DNA, 16 bp, Homo sapiens
tcctaccaaatataaa

SEQ ID NO: 4788530 - DNA, 15 bp, Homo sapiens
tcctaccattatggc

SEQ ID NO: 4788531 - DNA, 18 bp, Homo sapiens
tcctagaatgtttcattt

SEQ ID NO: 4788532 - DNA, 14 bp, Homo sapiens
tcctagagaactgt

SEQ ID NO: 4788533 - DNA, 22 bp, Homo sapiens
tcctagaggggacaagccaggc

SEQ ID NO: 4788534 - DNA, 22 bp, Homo sapiens
tcctagcactttgggaggctga

SEQ ID NO: 4788535 - DNA, 23 bp, Homo sapiens
tcctagtttgacctcacagtgac

SEQ ID NO: 4788536 - DNA, 14 bp, Homo sapiens
tcctcaaaaatcat

SEQ ID NO: 4788537 - DNA, 17 bp, Homo sapiens
tcctcaaaaatcatcaa

SEQ ID NO: 4788538 - DNA, 13 bp, Homo sapiens
tcctcacatgtgg

SEQ ID NO: 4788539 - DNA, 22 bp, Homo sapiens
tcctcactgagaaggccccagg

SEQ ID NO: 4788540 - DNA, 15 bp, Homo sapiens
tcctcactgcccgca

SEQ ID NO: 4788541 - DNA, 20 bp, Homo sapiens
ttgcaataagatattaccct

SEQ ID NO: 4788542 - DNA, 21 bp, Homo sapiens
ttgcaattgtttaagaatcat

SEQ ID NO: 4788543 - DNA, 14 bp, Homo sapiens
ttgcacatggattc

SEQ ID NO: 4788544 - DNA, 15 bp, Homo sapiens
ttgcactaaaagtga

SEQ ID NO: 4788545 - DNA, 22 bp, Homo sapiens
ttgcactaaaagtgatgtgatt

SEQ ID NO: 4788546 - DNA, 21 bp, Homo sapiens
ttgcactgcagttatttacca

SEQ ID NO: 4788547 - DNA, 14 bp, Homo sapiens
ttgcagcagtacca

SEQ ID NO: 4788548 - DNA, 20 bp, Homo sapiens
ttgcaggagttcctttccct

SEQ ID NO: 4788549 - DNA, 13 bp, Homo sapiens
ttgcagtcagaag

SEQ ID NO: 4788550 - DNA, 21 bp, Homo sapiens
ttgcatcctatcgatctggaa

SEQ ID NO: 4788551 - DNA, 22 bp, Homo sapiens
ttgccaatggtgtagctgtcct

SEQ ID NO: 4788552 - DNA, 23 bp, Homo sapiens
ttgccaatggtgtagctgtcctc

SEQ ID NO: 4788553 - DNA, 15 bp, Homo sapiens
ttgccacaatcacta

SEQ ID NO: 4788554 - DNA, 23 bp, Homo sapiens
ttgccatccttgcacttctgtta

SEQ ID NO: 4788555 - DNA, 15 bp, Homo sapiens
ttgcccatgatataa

SEQ ID NO: 4788556 - DNA, 13 bp, Homo sapiens
ttgccctgcgtcc

SEQ ID NO: 4788557 - DNA, 18 bp, Homo sapiens
ttgcctaagtattccttt

SEQ ID NO: 4788558 - DNA, 19 bp, Homo sapiens
ttgcctcattttgcttccc

SEQ ID NO: 4788559 - DNA, 11 bp, Homo sapiens
ttgcctccagg

SEQ ID NO: 4788560 - DNA, 22 bp, Homo sapiens
ttgcctccaggaccttgcttcc

SEQ ID NO: 4788561 - DNA, 14 bp, Homo sapiens
ttgcctctttaaat

SEQ ID NO: 4788562 - DNA, 22 bp, Homo sapiens
ttgcctgcctggaaacagcctg

SEQ ID NO: 4788563 - DNA, 19 bp, Homo sapiens
ttgcctttaggcaggaagt

SEQ ID NO: 4788564 - DNA, 16 bp, Homo sapiens
ttgctacatcagagtg

SEQ ID NO: 4788565 - DNA, 13 bp, Homo sapiens
ttgctatcattgt

SEQ ID NO: 4788566 - DNA, 20 bp, Homo sapiens
ttgctcaccaagctgttcca

SEQ ID NO: 4788567 - DNA, 16 bp, Homo sapiens
ttgctccattcctgag

SEQ ID NO: 4788568 - DNA, 17 bp, Homo sapiens
ttgctcctttccatcag

SEQ ID NO: 4788569 - DNA, 20 bp, Homo sapiens
ttgctcctttccatcagctt

SEQ ID NO: 4788570 - DNA, 23 bp, Homo sapiens
ttctgtgggtttctaaagctgcc

SEQ ID NO: 4788571 - DNA, 22 bp, Homo sapiens
ttctgtgtcacagttcttggtg

SEQ ID NO: 4788572 - DNA, 14 bp, Homo sapiens
ttctgttccctgct

SEQ ID NO: 4788573 - DNA, 18 bp, Homo sapiens
ttctgttggccagcacgt

SEQ ID NO: 4788574 - DNA, 16 bp, Homo sapiens
ttctgttggtcttaac

SEQ ID NO: 4788575 - DNA, 22 bp, Homo sapiens
ttctgttggtcttaactaatgt

SEQ ID NO: 4788576 - DNA, 23 bp, Homo sapiens
ttctgttggtcttaactaatgta

SEQ ID NO: 4788577 - DNA, 17 bp, Homo sapiens
ttctgtttgaattttca

SEQ ID NO: 4788578 - DNA, 20 bp, Homo sapiens
ttctgtttgaattttcaaag

SEQ ID NO: 4788579 - DNA, 15 bp, Homo sapiens
ttctgttttagagtt

SEQ ID NO: 4788580 - DNA, 22 bp, Homo sapiens
ttcttaaggacagtgttcaaat

SEQ ID NO: 4788581 - DNA, 23 bp, Homo sapiens
ttcttaaggacagtgttcaaatt

SEQ ID NO: 4788582 - DNA, 22 bp, Homo sapiens
ttcttaatagaaagtcagatga

SEQ ID NO: 4788583 - DNA, 15 bp, Homo sapiens
ttcttaccgaaatga

SEQ ID NO: 4788584 - DNA, 18 bp, Homo sapiens
ttcttacctcatttgcat

SEQ ID NO: 4788585 - DNA, 20 bp, Homo sapiens
ttcttatacagataaaacat

SEQ ID NO: 4788586 - DNA, 17 bp, Homo sapiens
ttcttcaattaatggaa

SEQ ID NO: 4788587 - DNA, 21 bp, Homo sapiens
ttcttcatccatagacacagt

SEQ ID NO: 4788588 - DNA, 18 bp, Homo sapiens
ttcttccaaaaggaagca

SEQ ID NO: 4788589 - DNA, 15 bp, Homo sapiens
ttcttcccatttgta

SEQ ID NO: 4788590 - DNA, 21 bp, Homo sapiens
ttcttcccatttgtaatgtat

SEQ ID NO: 4788591 - DNA, 18 bp, Homo sapiens
ttcttcctcttacctgta

SEQ ID NO: 4788592 - DNA, 15 bp, Homo sapiens
ttcttccttgccaca

SEQ ID NO: 4788593 - DNA, 20 bp, Homo sapiens
ttcttctttaatttttctgt

SEQ ID NO: 4788594 - DNA, 12 bp, Homo sapiens
ttcttgaataaa

SEQ ID NO: 4788595 - DNA, 14 bp, Homo sapiens
ttacctcatttgca

SEQ ID NO: 4788596 - DNA, 15 bp, Homo sapiens
ttacctcatttgcat

SEQ ID NO: 4788597 - DNA, 21 bp, Homo sapiens
ttacctcgggatggttggtta

SEQ ID NO: 4788598 - DNA, 11 bp, Homo sapiens
ttacctgaaag

SEQ ID NO: 4788599 - DNA, 13 bp, Homo sapiens
ttacctgacacaa

SEQ ID NO: 4788600 - DNA, 16 bp, Homo sapiens
ttacctggaatcaaat

SEQ ID NO: 4788601 - DNA, 13 bp, Homo sapiens
ttacgctctctgt

SEQ ID NO: 4788602 - DNA, 23 bp, Homo sapiens
ttactaaatctactcttaaatat

SEQ ID NO: 4788603 - DNA, 20 bp, Homo sapiens
ttactaacagtaactgccat

SEQ ID NO: 4788604 - DNA, 22 bp, Homo sapiens
ttactatgcctgttgatctatg

SEQ ID NO: 4788605 - DNA, 21 bp, Homo sapiens
ttactattaactctgcataga

SEQ ID NO: 4788606 - DNA, 20 bp, Homo sapiens
ttactcaaaatgcaggacag

SEQ ID NO: 4788607 - DNA, 23 bp, Homo sapiens
ttactgtatttgggatatgagtt

SEQ ID NO: 4788608 - DNA, 20 bp, Homo sapiens
ttactgtcctgttgattaat

SEQ ID NO: 4788609 - DNA, 18 bp, Homo sapiens
ttactgtgagaactgtga

SEQ ID NO: 4788610 - DNA, 19 bp, Homo sapiens
ttactgtgagaactgtgaa

SEQ ID NO: 4788611 - DNA, 14 bp, Homo sapiens
ttactgttcttatt

SEQ ID NO: 4788612 - DNA, 22 bp, Homo sapiens
ttactgtttgaaacttttcaag

SEQ ID NO: 4788613 - DNA, 14 bp, Homo sapiens
ttacttacacacct

SEQ ID NO: 4788614 - DNA, 15 bp, Homo sapiens
ttacttgattaagga

SEQ ID NO: 4788615 - DNA, 18 bp, Homo sapiens
ttacttttcctcttagaa

SEQ ID NO: 4788616 - DNA, 19 bp, Homo sapiens
ttagaaagaattagccaac

SEQ ID NO: 4788617 - DNA, 17 bp, Homo sapiens
ttagaagaaatatgagc

SEQ ID NO: 4788618 - DNA, 17 bp, Homo sapiens
ttagaatgacaggaacc

SEQ ID NO: 4788619 - DNA, 13 bp, Homo sapiens
ttagaatgtgaaa

SEQ ID NO: 4788620 - DNA, 23 bp, Homo sapiens
ttagacaatgtggaattacataa

SEQ ID NO: 4788621 - DNA, 17 bp, Homo sapiens
ttagacccctgggtggg

SEQ ID NO: 4788622 - DNA, 23 bp, Homo sapiens
ttagacccctgggtgggccctgc

SEQ ID NO: 4788623 - DNA, 20 bp, Homo sapiens
ttagaccgtggtgtcctctg

SEQ ID NO: 4788624 - DNA, 13 bp, Homo sapiens
ttagactcaaaga

SEQ ID NO: 4788625 - DNA, 15 bp, Homo sapiens
ttagagaagccataa

SEQ ID NO: 4788626 - DNA, 22 bp, Homo sapiens
ttagagtatgcaagaagaatat

SEQ ID NO: 4788627 - DNA, 20 bp, Homo sapiens
ttagagttattttgtgtcct

SEQ ID NO: 4788628 - DNA, 23 bp, Homo sapiens
ttagatccattaatttaaatgat

SEQ ID NO: 4788629 - DNA, 14 bp, Homo sapiens
ttagatgactgaat

SEQ ID NO: 4788630 - DNA, 17 bp, Homo sapiens
ttagattcctacttaaa

SEQ ID NO: 4788631 - DNA, 22 bp, Homo sapiens
ttagattcctacttaaacaaaa

SEQ ID NO: 4788632 - DNA, 18 bp, Homo sapiens
ttagcacagtatttaaca

SEQ ID NO: 4788633 - DNA, 14 bp, Homo sapiens
ttagcaccagcttg

SEQ ID NO: 4788634 - DNA, 15 bp, Homo sapiens
ttagcagtccatttt

SEQ ID NO: 4788635 - DNA, 12 bp, Homo sapiens
ttagcagttctg

SEQ ID NO: 4788636 - DNA, 16 bp, Homo sapiens
ttagcattgaaataat

SEQ ID NO: 4788637 - DNA, 20 bp, Homo sapiens
ttagcgttgttttgtggata

SEQ ID NO: 4788638 - DNA, 19 bp, Homo sapiens
ttagctagttagagactcg

SEQ ID NO: 4788639 - DNA, 22 bp, Homo sapiens
ttagctgggaagaatgtattcg

SEQ ID NO: 4788640 - DNA, 14 bp, Homo sapiens
ttagcttttctgca

SEQ ID NO: 4788641 - DNA, 14 bp, Homo sapiens
ttaggaatgctcaa

SEQ ID NO: 4788642 - DNA, 17 bp, Homo sapiens
ttaggaatgctcaatgt

SEQ ID NO: 4788643 - DNA, 23 bp, Homo sapiens
ttaggcaggaagtcaggagccag

SEQ ID NO: 4788644 - DNA, 19 bp, Homo sapiens
ttagggtacagcccaggcg

SEQ ID NO: 4788645 - DNA, 16 bp, Homo sapiens
ttagggttctatattt

SEQ ID NO: 4788646 - DNA, 15 bp, Homo sapiens
ttaggtctgttgaag

SEQ ID NO: 4788647 - DNA, 21 bp, Homo sapiens
ttaggtctgttgaagtgcatg

SEQ ID NO: 4788648 - DNA, 16 bp, Homo sapiens
ttaggtgaggaagcaa

SEQ ID NO: 4788649 - DNA, 19 bp, Homo sapiens
ttagtaaaattatctgttc

SEQ ID NO: 4788650 - DNA, 20 bp, Homo sapiens
ttagtaaaattatctgttct

SEQ ID NO: 4788651 - DNA, 22 bp, Homo sapiens
ttagtaaaattatctgttctat

SEQ ID NO: 4788652 - DNA, 11 bp, Homo sapiens
ttagtaaattc

SEQ ID NO: 4788653 - DNA, 15 bp, Homo sapiens
ttagtaatctgtata

SEQ ID NO: 4788654 - DNA, 17 bp, Homo sapiens
ttagtaatctgtataat

SEQ ID NO: 4788655 - DNA, 15 bp, Homo sapiens
ttagtagctgataaa

SEQ ID NO: 4788656 - DNA, 14 bp, Homo sapiens
ttagtcataccatc

SEQ ID NO: 4788657 - DNA, 19 bp, Homo sapiens
ttagtcctcaccttctgtt

SEQ ID NO: 4788658 - DNA, 23 bp, Homo sapiens
ttagtgaagtatgcactaatcaa

SEQ ID NO: 4788659 - DNA, 14 bp, Homo sapiens
ttagtgagatttgt

SEQ ID NO: 4788660 - DNA, 12 bp, Homo sapiens
ttagtgtgattg

SEQ ID NO: 4788661 - DNA, 13 bp, Homo sapiens
ttagtgttttcat

SEQ ID NO: 4788662 - DNA, 14 bp, Homo sapiens
ttagtttgcattta

SEQ ID NO: 4788663 - DNA, 22 bp, Homo sapiens
ttataaaacgtgtttgtattgt

SEQ ID NO: 4788664 - DNA, 12 bp, Homo sapiens
ttataaaatctg

SEQ ID NO: 4788665 - DNA, 15 bp, Homo sapiens
ttataaaatctgtat

SEQ ID NO: 4788666 - DNA, 21 bp, Homo sapiens
ttataaattggtgatgcttgt

SEQ ID NO: 4788667 - DNA, 17 bp, Homo sapiens
ttataacattgtaaatg

SEQ ID NO: 4788668 - DNA, 13 bp, Homo sapiens
ttataagaaaaat

SEQ ID NO: 4788669 - DNA, 16 bp, Homo sapiens
ttataataaactgttt

SEQ ID NO: 4788670 - DNA, 21 bp, Homo sapiens
ttataatataatatggaacct

SEQ ID NO: 4788671 - DNA, 19 bp, Homo sapiens
ttataattgtcatgacttt

SEQ ID NO: 4788672 - DNA, 14 bp, Homo sapiens
ttatacacagttcc

SEQ ID NO: 4788673 - DNA, 18 bp, Homo sapiens
ttataggaaataaatcta

SEQ ID NO: 4788674 - DNA, 21 bp, Homo sapiens
ttataggaaataaatctaaat

SEQ ID NO: 4788675 - DNA, 17 bp, Homo sapiens
ttatagtactagagata

SEQ ID NO: 4788676 - DNA, 14 bp, Homo sapiens
ttatagtctgtact

SEQ ID NO: 4788677 - DNA, 18 bp, Homo sapiens
ttatagtctgtacttcag

SEQ ID NO: 4788678 - DNA, 12 bp, Homo sapiens
ttatatatacat

SEQ ID NO: 4788679 - DNA, 23 bp, Homo sapiens
ttatatatacattagacacacat

SEQ ID NO: 4788680 - DNA, 20 bp, Homo sapiens
ttatatatgtatatctgtgt

SEQ ID NO: 4788681 - DNA, 13 bp, Homo sapiens
ttatatattataa

SEQ ID NO: 4788682 - DNA, 21 bp, Homo sapiens
ttatatgacttcttgttcatg

SEQ ID NO: 4788683 - DNA, 18 bp, Homo sapiens
ttatattagagtgccctt

SEQ ID NO: 4788684 - DNA, 17 bp, Homo sapiens
ttatattattttctgta

SEQ ID NO: 4788685 - DNA, 21 bp, Homo sapiens
ttatattctgcagaaaattaa

SEQ ID NO: 4788686 - DNA, 20 bp, Homo sapiens
ttatattgtttttatatatt

SEQ ID NO: 4788687 - DNA, 23 bp, Homo sapiens
ttatattgtttttatatattata

SEQ ID NO: 4788688 - DNA, 17 bp, Homo sapiens
ttatcaaaaaacagaaa

SEQ ID NO: 4788689 - DNA, 21 bp, Homo sapiens
ttatcagaactcctttctaag

SEQ ID NO: 4788690 - DNA, 22 bp, Homo sapiens
ttatcagggcccaaataacagt

SEQ ID NO: 4788691 - DNA, 20 bp, Homo sapiens
ttatcagtacaattctttgt

SEQ ID NO: 4788692 - DNA, 13 bp, Homo sapiens
ttatcatatatgc

SEQ ID NO: 4788693 - DNA, 14 bp, Homo sapiens
ttatcatatatgct

SEQ ID NO: 4788694 - DNA, 13 bp, Homo sapiens
ttatccacattgt

SEQ ID NO: 4788695 - DNA, 20 bp, Homo sapiens
ttatcctcaagttgtgtgct

SEQ ID NO: 4788696 - DNA, 21 bp, Homo sapiens
ttatcgccttttgacagctgt

SEQ ID NO: 4788697 - DNA, 16 bp, Homo sapiens
ttatctctttctctct

SEQ ID NO: 4788698 - DNA, 20 bp, Homo sapiens
ttatctgggttttagaaatt

SEQ ID NO: 4788699 - DNA, 17 bp, Homo sapiens
ttatctgtctgagccct

SEQ ID NO: 4788700 - DNA, 16 bp, Homo sapiens
ttatctgtctttatga

SEQ ID NO: 4788701 - DNA, 20 bp, Homo sapiens
ttatctgtctttatgatttc

SEQ ID NO: 4788702 - DNA, 16 bp, Homo sapiens
ttcctgatgggaacag

SEQ ID NO: 4788703 - DNA, 13 bp, Homo sapiens
ttcctgcctttga

SEQ ID NO: 4788704 - DNA, 17 bp, Homo sapiens
ttcctggacagtgagag

SEQ ID NO: 4788705 - DNA, 15 bp, Homo sapiens
ttcctgggcagccca

SEQ ID NO: 4788706 - DNA, 20 bp, Homo sapiens
ttcctgggcagcccagagag

SEQ ID NO: 4788707 - DNA, 14 bp, Homo sapiens
ttcctgggtgctca

SEQ ID NO: 4788708 - DNA, 16 bp, Homo sapiens
ttcctgtcctgctcac

SEQ ID NO: 4788709 - DNA, 11 bp, Homo sapiens
ttcctgtgagg

SEQ ID NO: 4788710 - DNA, 14 bp, Homo sapiens
ttcctgttgtctga

SEQ ID NO: 4788711 - DNA, 11 bp, Homo sapiens
ttccttccttt

SEQ ID NO: 4788712 - DNA, 19 bp, Homo sapiens
ttccttctcatcttgcctc

SEQ ID NO: 4788713 - DNA, 16 bp, Homo sapiens
ttccttcttgctcagt

SEQ ID NO: 4788714 - DNA, 19 bp, Homo sapiens
ttccttgaaatttctcagc

SEQ ID NO: 4788715 - DNA, 17 bp, Homo sapiens
ttccttgctttctcttc

SEQ ID NO: 4788716 - DNA, 17 bp, Homo sapiens
ttccttggcccagcagc

SEQ ID NO: 4788717 - DNA, 16 bp, Homo sapiens
ttcctttcatcctcag

SEQ ID NO: 4788718 - DNA, 11 bp, Homo sapiens
ttcctttctgg

SEQ ID NO: 4788719 - DNA, 15 bp, Homo sapiens
ttcctttcttccttc

SEQ ID NO: 4788720 - DNA, 16 bp, Homo sapiens
ttcctttcttccttcc

SEQ ID NO: 4788721 - DNA, 22 bp, Homo sapiens
ttcgatcgtttcacatctgtat

SEQ ID NO: 4788722 - DNA, 17 bp, Homo sapiens
ttcgcttggctccatgc

SEQ ID NO: 4788723 - DNA, 14 bp, Homo sapiens
ttcggcaccttccc

SEQ ID NO: 4788724 - DNA, 22 bp, Homo sapiens
ttcggcaccttcccctgaggac

SEQ ID NO: 4788725 - DNA, 15 bp, Homo sapiens
tgtgacattccacag

SEQ ID NO: 4788726 - DNA, 19 bp, Homo sapiens
tgtgaccaagtataaactt

SEQ ID NO: 4788727 - DNA, 15 bp, Homo sapiens
tgtgacctgacacct

SEQ ID NO: 4788728 - DNA, 13 bp, Homo sapiens
tgtgacttcccct

SEQ ID NO: 4788729 - DNA, 21 bp, Homo sapiens
tgtgagaaagcagatcatctc

SEQ ID NO: 4788730 - DNA, 17 bp, Homo sapiens
tgtgagaactgtgaata

SEQ ID NO: 4788731 - DNA, 22 bp, Homo sapiens
tgtgagaactgtgaatatgtgt

SEQ ID NO: 4788732 - DNA, 19 bp, Homo sapiens
tgtgagcacaaaggtagct

SEQ ID NO: 4788733 - DNA, 22 bp, Homo sapiens
tgtgagccaaagagaaaagatt

SEQ ID NO: 4788734 - DNA, 17 bp, Homo sapiens
tgtgaggatagagactt

SEQ ID NO: 4788735 - DNA, 19 bp, Homo sapiens
tgtgaggatgtggatggag

SEQ ID NO: 4788736 - DNA, 14 bp, Homo sapiens
tgtgagtgtatgta

SEQ ID NO: 4788737 - DNA, 15 bp, Homo sapiens
tgtgagtgtatgtat

SEQ ID NO: 4788738 - DNA, 21 bp, Homo sapiens
tgtgatatgtgtaatatcatt

SEQ ID NO: 4788739 - DNA, 16 bp, Homo sapiens
tgtgatgatagcactg

SEQ ID NO: 4788740 - DNA, 15 bp, Homo sapiens
tgtgatgcatgagct

SEQ ID NO: 4788741 - DNA, 19 bp, Homo sapiens
tgtgatttatgcatttatg

SEQ ID NO: 4788742 - DNA, 13 bp, Homo sapiens
tgtgcacctgact

SEQ ID NO: 4788743 - DNA, 20 bp, Homo sapiens
tgtgcactttttttctatat

SEQ ID NO: 4788744 - DNA, 21 bp, Homo sapiens
tgtgcagagtatacaagtgtt

SEQ ID NO: 4788745 - DNA, 15 bp, Homo sapiens
tgtgcagtttggtat

SEQ ID NO: 4788746 - DNA, 13 bp, Homo sapiens
tgtgcatctggcc

SEQ ID NO: 4788747 - DNA, 15 bp, Homo sapiens
tgtgcatctggccta

SEQ ID NO: 4788748 - DNA, 14 bp, Homo sapiens
tgtgcattgtggct

SEQ ID NO: 4788749 - DNA, 22 bp, Homo sapiens
tgtgcccacccgtgttctcctc

SEQ ID NO: 4788750 - DNA, 14 bp, Homo sapiens
tgtgccccttcccc

SEQ ID NO: 4788751 - DNA, 21 bp, Homo sapiens
tgtgccccttccccatgctca

SEQ ID NO: 4788752 - DNA, 14 bp, Homo sapiens
tgtgccctgtagct

SEQ ID NO: 4788753 - DNA, 18 bp, Homo sapiens
tgtgccctgtagctcctt

SEQ ID NO: 4788754 - DNA, 20 bp, Homo sapiens
tgtgccctgtagctccttag

SEQ ID NO: 4788755 - DNA, 19 bp, Homo sapiens
tgtgccgtctttggttcct

SEQ ID NO: 4788756 - DNA, 17 bp, Homo sapiens
tgtgcctctctctccca

SEQ ID NO: 4788757 - DNA, 18 bp, Homo sapiens
tgtgcctgctatccagcc

SEQ ID NO: 4788758 - DNA, 20 bp, Homo sapiens
tgtgcctgctatccagccgc

SEQ ID NO: 4788759 - DNA, 15 bp, Homo sapiens
tgtgcctgtgtttca

SEQ ID NO: 4788760 - DNA, 12 bp, Homo sapiens
tgtgccttgggc

SEQ ID NO: 4788761 - DNA, 14 bp, Homo sapiens
tgtgctcggacaca

SEQ ID NO: 4788762 - DNA, 16 bp, Homo sapiens
tgtgctcggacacagt

SEQ ID NO: 4788763 - DNA, 15 bp, Homo sapiens
tgtgctgctgtggca

SEQ ID NO: 4788764 - DNA, 12 bp, Homo sapiens
tgtgctgtgggc

SEQ ID NO: 4788765 - DNA, 14 bp, Homo sapiens
tgtgctgtgggcag

SEQ ID NO: 4788766 - DNA, 19 bp, Homo sapiens
tgtgctgtgggcagcaccc

SEQ ID NO: 4788767 - DNA, 19 bp, Homo sapiens
tgtgctgttgattctttca

SEQ ID NO: 4788768 - DNA, 13 bp, Homo sapiens
tgtgcttcacaca

SEQ ID NO: 4788769 - DNA, 19 bp, Homo sapiens
tgtgcttcacacaaagtga

SEQ ID NO: 4788770 - DNA, 23 bp, Homo sapiens
tgtgcttcacacaaagtgaaatt

SEQ ID NO: 4788771 - DNA, 17 bp, Homo sapiens
tgtgcttgtgtgtatgt

SEQ ID NO: 4788772 - DNA, 18 bp, Homo sapiens
tgtgcttgtgtgtatgtc

SEQ ID NO: 4788773 - DNA, 22 bp, Homo sapiens
tgtgctttctatctaattttta

SEQ ID NO: 4788774 - DNA, 23 bp, Homo sapiens
tgtggaattacataacaggcatt

SEQ ID NO: 4788775 - DNA, 14 bp, Homo sapiens
tgtggagaagtgtg

SEQ ID NO: 4788776 - DNA, 16 bp, Homo sapiens
tgtggagaagtgtgtt

SEQ ID NO: 4788777 - DNA, 19 bp, Homo sapiens
tgtggagaagtgtgttctg

SEQ ID NO: 4788778 - DNA, 22 bp, Homo sapiens
tgtggagaagtgtgttctgatg

SEQ ID NO: 4788779 - DNA, 22 bp, Homo sapiens
tgtggagcgtccttgtccccgc

SEQ ID NO: 4788780 - DNA, 19 bp, Homo sapiens
tgtggagtggaggggtcag

SEQ ID NO: 4788781 - DNA, 13 bp, Homo sapiens
tgtggataaattt

SEQ ID NO: 4788782 - DNA, 19 bp, Homo sapiens
tgtggataaattttggaag

SEQ ID NO: 4788783 - DNA, 13 bp, Homo sapiens
tgtggataagaaa

SEQ ID NO: 4788784 - DNA, 20 bp, Homo sapiens
tgtggataagaaaaatgctt

SEQ ID NO: 4788785 - DNA, 23 bp, Homo sapiens
tgtggatggaggtgatgaaaacc

SEQ ID NO: 4788786 - DNA, 13 bp, Homo sapiens
tgtggcaaacatt

SEQ ID NO: 4788787 - DNA, 15 bp, Homo sapiens
tgtggcaaacattta

SEQ ID NO: 4788788 - DNA, 14 bp, Homo sapiens
tgtggccacagtgg

SEQ ID NO: 4788789 - DNA, 17 bp, Homo sapiens
tgtggccctgtgggagt

SEQ ID NO: 4788790 - DNA, 11 bp, Homo sapiens
tgtggcctcag

SEQ ID NO: 4788791 - DNA, 12 bp, Homo sapiens
tgtggcctcagc

SEQ ID NO: 4788792 - DNA, 17 bp, Homo sapiens
tgtggcctcagccctca

SEQ ID NO: 4788793 - DNA, 22 bp, Homo sapiens
tgtggcctgggtcctcggccct

SEQ ID NO: 4788794 - DNA, 21 bp, Homo sapiens
tgtggctaaatgcctaataaa

SEQ ID NO: 4788795 - DNA, 16 bp, Homo sapiens
tgtggctgatttacta

SEQ ID NO: 4788796 - DNA, 21 bp, Homo sapiens
tgtggctgtcaaatccatgtg

SEQ ID NO: 4788797 - DNA, 20 bp, Homo sapiens
tgtgggactggcccacccct

SEQ ID NO: 4788798 - DNA, 14 bp, Homo sapiens
tgtgggcagcaccc

SEQ ID NO: 4788799 - DNA, 15 bp, Homo sapiens
tgtgggcccaaggcc

SEQ ID NO: 4788800 - DNA, 21 bp, Homo sapiens
tgtgggtttctaaagctgcca

SEQ ID NO: 4788801 - DNA, 13 bp, Homo sapiens
tgtggtctgtgtg

SEQ ID NO: 4788802 - DNA, 22 bp, Homo sapiens
tgtggtgaggtcctgtcctggc

SEQ ID NO: 4788803 - DNA, 23 bp, Homo sapiens
tgtggtgaggtcctgtcctggct

SEQ ID NO: 4788804 - DNA, 10 bp, Homo sapiens
tgtgtaaatg

SEQ ID NO: 4788805 - DNA, 15 bp, Homo sapiens
tgtgtaactgaaagg

SEQ ID NO: 4788806 - DNA, 17 bp, Homo sapiens
tgtgtaatatcatttca

SEQ ID NO: 4788807 - DNA, 21 bp, Homo sapiens
tgtgtacttcttcatccatag

SEQ ID NO: 4788808 - DNA, 20 bp, Homo sapiens
tgtgtatacatatgtatgtg

SEQ ID NO: 4788809 - DNA, 18 bp, Homo sapiens
tgtgtatgtctatgtgta

SEQ ID NO: 4788810 - DNA, 13 bp, Homo sapiens
tgtgtcacgtgac

SEQ ID NO: 4788811 - DNA, 17 bp, Homo sapiens
tgtgtcacgtgaccctg

SEQ ID NO: 4788812 - DNA, 16 bp, Homo sapiens
tgtgtcatctgtcagc

SEQ ID NO: 4788813 - DNA, 14 bp, Homo sapiens
tgtgtcatgatttc

SEQ ID NO: 4788814 - DNA, 17 bp, Homo sapiens
tgtgtcccagtgtctgg

SEQ ID NO: 4788815 - DNA, 20 bp, Homo sapiens
tgtgtcccagtgtctggccc

SEQ ID NO: 4788816 - DNA, 22 bp, Homo sapiens
tgtgtcccatgcataacacact

SEQ ID NO: 4788817 - DNA, 15 bp, Homo sapiens
tgtgtcccccctgtg

SEQ ID NO: 4788818 - DNA, 18 bp, Homo sapiens
tgtgtcccccctgtggtc

SEQ ID NO: 4788819 - DNA, 22 bp, Homo sapiens
tgtgtcccccctgtggtctgtg

SEQ ID NO: 4788820 - DNA, 13 bp, Homo sapiens
tgtgtcccctcac

SEQ ID NO: 4788821 - DNA, 19 bp, Homo sapiens
tgtgtcccctcactctgtc

SEQ ID NO: 4788822 - DNA, 22 bp, Homo sapiens
tgtgtccgtgaaagttgtgatc

SEQ ID NO: 4788823 - DNA, 10 bp, Homo sapiens
tgtgtccttt

SEQ ID NO: 4788824 - DNA, 16 bp, Homo sapiens
tgtgtctccagctgat

SEQ ID NO: 4788825 - DNA, 18 bp, Homo sapiens
tgtgtcttttgttctctc

SEQ ID NO: 4788826 - DNA, 23 bp, Homo sapiens
tgtgtgagggcaaaccaggctgc

SEQ ID NO: 4788827 - DNA, 17 bp, Homo sapiens
tgtgtgagtgtgaatat

SEQ ID NO: 4788828 - DNA, 15 bp, Homo sapiens
tgtgtgcttcacaca

SEQ ID NO: 4788829 - DNA, 17 bp, Homo sapiens
tgtgtggagaagtgtgt

SEQ ID NO: 4788830 - DNA, 9 bp, Homo sapiens
tgtgtggca

SEQ ID NO: 4788831 - DNA, 14 bp, Homo sapiens
tgtgtggcaaacat

SEQ ID NO: 4788832 - DNA, 16 bp, Homo sapiens
tgtgtggcaaacattt

SEQ ID NO: 4788833 - DNA, 21 bp, Homo sapiens
tgtgtggcaaacatttaaaaa

SEQ ID NO: 4788834 - DNA, 17 bp, Homo sapiens
tgtgtgggcccaaggcc

SEQ ID NO: 4788835 - DNA, 23 bp, Homo sapiens
tgtgtgtcagcccatgtcaatca

SEQ ID NO: 4788836 - DNA, 12 bp, Homo sapiens
tgtgtgtggaag

SEQ ID NO: 4788837 - DNA, 15 bp, Homo sapiens
tgtgttctcaacaca

SEQ ID NO: 4788838 - DNA, 18 bp, Homo sapiens
tgtgttctcaacacacag

SEQ ID NO: 4788839 - DNA, 20 bp, Homo sapiens
tgtgttgctctccattcttt

SEQ ID NO: 4788840 - DNA, 23 bp, Homo sapiens
tgtgtttcatgttctgtgtcacg

SEQ ID NO: 4788841 - DNA, 18 bp, Homo sapiens
tgtgtttgaattgatttt

SEQ ID NO: 4788842 - DNA, 23 bp, Homo sapiens
ttaaaagctatcttcatgtaaat

SEQ ID NO: 4788843 - DNA, 15 bp, Homo sapiens
ttaaaataattatat

SEQ ID NO: 4788844 - DNA, 19 bp, Homo sapiens
ttaaaataattatatgaag

SEQ ID NO: 4788845 - DNA, 18 bp, Homo sapiens
ttaaaatattttcttaat

SEQ ID NO: 4788846 - DNA, 17 bp, Homo sapiens
ttaaaatcacaaactca

SEQ ID NO: 4788847 - DNA, 22 bp, Homo sapiens
ttaaaatcacaaactcatccat

SEQ ID NO: 4788848 - DNA, 18 bp, Homo sapiens
ttaaaatcagactcttta

SEQ ID NO: 4788849 - DNA, 12 bp, Homo sapiens
ttaaaatgcaag

SEQ ID NO: 4788850 - DNA, 22 bp, Homo sapiens
ttaaaattggttaatgaaaaat

SEQ ID NO: 4788851 - DNA, 17 bp, Homo sapiens
ttaaacaaaatttatgt

SEQ ID NO: 4788852 - DNA, 12 bp, Homo sapiens
ttaaacaaatgg

SEQ ID NO: 4788853 - DNA, 18 bp, Homo sapiens
ttaaacaatttattttat

SEQ ID NO: 4788854 - DNA, 18 bp, Homo sapiens
ttaaacccacataaacac

SEQ ID NO: 4788855 - DNA, 18 bp, Homo sapiens
ttaaactaattaaactga

SEQ ID NO: 4788856 - DNA, 14 bp, Homo sapiens
ttaaactttgtcac

SEQ ID NO: 4788857 - DNA, 19 bp, Homo sapiens
ttaaactttgtcacttctg

SEQ ID NO: 4788858 - DNA, 20 bp, Homo sapiens
ttaaagaagtccatgtgata

SEQ ID NO: 4788859 - DNA, 20 bp, Homo sapiens
ttaaagtaatttacaaacct

SEQ ID NO: 4788860 - DNA, 20 bp, Homo sapiens
ttaaatagcatctgctcttc

SEQ ID NO: 4788861 - DNA, 12 bp, Homo sapiens
ttaaatatacaa

SEQ ID NO: 4788862 - DNA, 16 bp, Homo sapiens
ttaaatctttgttaaa

SEQ ID NO: 4788863 - DNA, 21 bp, Homo sapiens
ttaaatctttgttaaaatata

SEQ ID NO: 4788864 - DNA, 20 bp, Homo sapiens
ttaaatgagcttaatgtctt

SEQ ID NO: 4788865 - DNA, 17 bp, Homo sapiens
ttaaatgatctgtacta

SEQ ID NO: 4788866 - DNA, 19 bp, Homo sapiens
ttaaatgtagcttcagtca

SEQ ID NO: 4788867 - DNA, 16 bp, Homo sapiens
ttaaatgtctataaat

SEQ ID NO: 4788868 - DNA, 12 bp, Homo sapiens
ttaaattaaaca

SEQ ID NO: 4788869 - DNA, 14 bp, Homo sapiens
ttaaattaaacaat

SEQ ID NO: 4788870 - DNA, 13 bp, Homo sapiens
ttaaattatatga

SEQ ID NO: 4788871 - DNA, 17 bp, Homo sapiens
ttaaattggcttgttta

SEQ ID NO: 4788872 - DNA, 21 bp, Homo sapiens
ttaacaaacgtaatttgttat

SEQ ID NO: 4788873 - DNA, 13 bp, Homo sapiens
ttaacagtaaata

SEQ ID NO: 4788874 - DNA, 19 bp, Homo sapiens
ttaacataaacttgtactt

SEQ ID NO: 4788875 - DNA, 11 bp, Homo sapiens
ttaacatagca

SEQ ID NO: 4788876 - DNA, 23 bp, Homo sapiens
ttaacatcaaagactccgagaag

SEQ ID NO: 4788877 - DNA, 16 bp, Homo sapiens
ttaaccagtctgaagt

SEQ ID NO: 4788878 - DNA, 21 bp, Homo sapiens
ttaaccgggactacagaagtg

SEQ ID NO: 4788879 - DNA, 17 bp, Homo sapiens
ttaacctttccgctgtc

SEQ ID NO: 4788880 - DNA, 19 bp, Homo sapiens
ttaacctttccgctgtcgc

SEQ ID NO: 4788881 - DNA, 14 bp, Homo sapiens
ttaactaatgtaaa

SEQ ID NO: 4788882 - DNA, 16 bp, Homo sapiens
ttaactaatgtaaata

SEQ ID NO: 4788883 - DNA, 19 bp, Homo sapiens
ttaactatgattccaatta

SEQ ID NO: 4788884 - DNA, 17 bp, Homo sapiens
ttaacttctattttcaa

SEQ ID NO: 4788885 - DNA, 14 bp, Homo sapiens
ttaagaaatgagaa

SEQ ID NO: 4788886 - DNA, 14 bp, Homo sapiens
ttaagaatcatgga

SEQ ID NO: 4788887 - DNA, 17 bp, Homo sapiens
ttaagaatcatggattt

SEQ ID NO: 4788888 - DNA, 16 bp, Homo sapiens
ttaagagattttatgt

SEQ ID NO: 4788889 - DNA, 17 bp, Homo sapiens
ttaagcacaaaaaattt

SEQ ID NO: 4788890 - DNA, 22 bp, Homo sapiens
ttaagcacaaaaaatttaagag

SEQ ID NO: 4788891 - DNA, 18 bp, Homo sapiens
ttaagcattttactgtct

SEQ ID NO: 4788892 - DNA, 21 bp, Homo sapiens
ttaagcattttactgtctgta

SEQ ID NO: 4788893 - DNA, 15 bp, Homo sapiens
ttaagccaatataat

SEQ ID NO: 4788894 - DNA, 19 bp, Homo sapiens
ttaagcccacagtatattt

SEQ ID NO: 4788895 - DNA, 13 bp, Homo sapiens
ttaagctccagtg

SEQ ID NO: 4788896 - DNA, 17 bp, Homo sapiens
ttaaggacagtgttcaa

SEQ ID NO: 4788897 - DNA, 17 bp, Homo sapiens
ttaaggacttctgcagc

SEQ ID NO: 4788898 - DNA, 14 bp, Homo sapiens
ttaagggaagctga

SEQ ID NO: 4788899 - DNA, 16 bp, Homo sapiens
ttaagggaagctgata

SEQ ID NO: 4788900 - DNA, 16 bp, Homo sapiens
ttaaggggatctaaaa

SEQ ID NO: 4788901 - DNA, 13 bp, Homo sapiens
ttaagtaccagaa

SEQ ID NO: 4788902 - DNA, 12 bp, Homo sapiens
ttaagtagattt

SEQ ID NO: 4788903 - DNA, 14 bp, Homo sapiens
ttaagtatatctat

SEQ ID NO: 4788904 - DNA, 21 bp, Homo sapiens
ttaagtgcttgaggccaaatg

SEQ ID NO: 4788905 - DNA, 19 bp, Homo sapiens
ttaataactatggtaaata

SEQ ID NO: 4788906 - DNA, 17 bp, Homo sapiens
ttaataggataaattaa

SEQ ID NO: 4788907 - DNA, 16 bp, Homo sapiens
ttaatatactccttaa

SEQ ID NO: 4788908 - DNA, 16 bp, Homo sapiens
ttaatatcactcatta

SEQ ID NO: 4788909 - DNA, 18 bp, Homo sapiens
ttaatatcactcattaat

SEQ ID NO: 4788910 - DNA, 16 bp, Homo sapiens
ttaatcatttccagca

SEQ ID NO: 4788911 - DNA, 21 bp, Homo sapiens
ttaatctcttgtcattctcat

SEQ ID NO: 4788912 - DNA, 22 bp, Homo sapiens
ttaatctcttgtcattctcatc

SEQ ID NO: 4788913 - DNA, 17 bp, Homo sapiens
ttaatcttaatgtatat

SEQ ID NO: 4788914 - DNA, 14 bp, Homo sapiens
ttaatgaagaaata

SEQ ID NO: 4788915 - DNA, 14 bp, Homo sapiens
ttaatgacaacaaa

SEQ ID NO: 4788916 - DNA, 13 bp, Homo sapiens
ttaatgattcttg

SEQ ID NO: 4788917 - DNA, 16 bp, Homo sapiens
ttaatgattcttgtgt

SEQ ID NO: 4788918 - DNA, 15 bp, Homo sapiens
ttaatggaaaactgt

SEQ ID NO: 4788919 - DNA, 16 bp, Homo sapiens
ttaatggaaaactgtt

SEQ ID NO: 4788920 - DNA, 18 bp, Homo sapiens
ttaatgtagataaagcac

SEQ ID NO: 4788921 - DNA, 20 bp, Homo sapiens
ttaatgtagataaagcactg

SEQ ID NO: 4788922 - DNA, 13 bp, Homo sapiens
ttaatgtctcaaa

SEQ ID NO: 4788923 - DNA, 11 bp, Homo sapiens
ttaatgtgcca

SEQ ID NO: 4788924 - DNA, 21 bp, Homo sapiens
ttaatgtttagtcagtgtact

SEQ ID NO: 4788925 - DNA, 21 bp, Homo sapiens
ttaattcttaccgaaatgaaa

SEQ ID NO: 4788926 - DNA, 14 bp, Homo sapiens
ttaattcttacctc

SEQ ID NO: 4788927 - DNA, 17 bp, Homo sapiens
ttaattcttacctcatt

SEQ ID NO: 4788928 - DNA, 22 bp, Homo sapiens
ttaattcttacctcatttgcat

SEQ ID NO: 4788929 - DNA, 23 bp, Homo sapiens
ttaattgtaggtcaatgaaatat

SEQ ID NO: 4788930 - DNA, 13 bp, Homo sapiens
ttaattgtataaa

SEQ ID NO: 4788931 - DNA, 23 bp, Homo sapiens
ttaatttaaatgatttaaattta

SEQ ID NO: 4788932 - DNA, 14 bp, Homo sapiens
ttaatttcagtaag

SEQ ID NO: 4788933 - DNA, 13 bp, Homo sapiens
ttaatttctgcca

SEQ ID NO: 4788934 - DNA, 19 bp, Homo sapiens
ttaattttgacactgaaat

SEQ ID NO: 4788935 - DNA, 14 bp, Homo sapiens
ttacaaagaaacaa

SEQ ID NO: 4788936 - DNA, 21 bp, Homo sapiens
ttacaaagaaacaaaatataa

SEQ ID NO: 4788937 - DNA, 15 bp, Homo sapiens
ttacaaatttttact

SEQ ID NO: 4788938 - DNA, 16 bp, Homo sapiens
ttacaaatttttactc

SEQ ID NO: 4788939 - DNA, 19 bp, Homo sapiens
ttacaacaagcaaactgaa

SEQ ID NO: 4788940 - DNA, 13 bp, Homo sapiens
ttacaagaagaac

SEQ ID NO: 4788941 - DNA, 16 bp, Homo sapiens
ttacaagaagaactca

SEQ ID NO: 4788942 - DNA, 17 bp, Homo sapiens
ttacaatcatgcctaca

SEQ ID NO: 4788943 - DNA, 13 bp, Homo sapiens
ttacaatgtatta

SEQ ID NO: 4788944 - DNA, 18 bp, Homo sapiens
ttacacacctgagaatgt

SEQ ID NO: 4788945 - DNA, 19 bp, Homo sapiens
ttacacacgtgcaatttgt

SEQ ID NO: 4788946 - DNA, 13 bp, Homo sapiens
ttacacccttgtc

SEQ ID NO: 4788947 - DNA, 13 bp, Homo sapiens
ttacactgaaatc

SEQ ID NO: 4788948 - DNA, 18 bp, Homo sapiens
ttacaggaagtactggag

SEQ ID NO: 4788949 - DNA, 15 bp, Homo sapiens
ttacaggtgtactat

SEQ ID NO: 4788950 - DNA, 17 bp, Homo sapiens
ttacagtaatgtcataa

SEQ ID NO: 4788951 - DNA, 18 bp, Homo sapiens
ttacagtaatgtcataaa

SEQ ID NO: 4788952 - DNA, 14 bp, Homo sapiens
ttacagtggcagta

SEQ ID NO: 4788953 - DNA, 16 bp, Homo sapiens
ttacagtggcagtatt

SEQ ID NO: 4788954 - DNA, 16 bp, Homo sapiens
tgaatctctaaaatgc

SEQ ID NO: 4788955 - DNA, 19 bp, Homo sapiens
tgaatctctcaaaatgtgc

SEQ ID NO: 4788956 - DNA, 20 bp, Homo sapiens
tgaatctctcaaaatgtgcc

SEQ ID NO: 4788957 - DNA, 18 bp, Homo sapiens
tgaatctgttgatggaga

SEQ ID NO: 4788958 - DNA, 13 bp, Homo sapiens
tgaatgagaagta

SEQ ID NO: 4788959 - DNA, 21 bp, Homo sapiens
tgaatgagcattctgcagccc

SEQ ID NO: 4788960 - DNA, 21 bp, Homo sapiens
tgaatgataatagctcacagc

SEQ ID NO: 4788961 - DNA, 18 bp, Homo sapiens
tgaatgcagtataaaatg

SEQ ID NO: 4788962 - DNA, 19 bp, Homo sapiens
tgaatgcttaaatgatcaa

SEQ ID NO: 4788963 - DNA, 14 bp, Homo sapiens
tgaatgtatgtaaa

SEQ ID NO: 4788964 - DNA, 18 bp, Homo sapiens
tgaatgtcagtgtgactg

SEQ ID NO: 4788965 - DNA, 19 bp, Homo sapiens
tgaatgtcagtgtgactga

SEQ ID NO: 4788966 - DNA, 12 bp, Homo sapiens
tgaattaaagtc

SEQ ID NO: 4788967 - DNA, 20 bp, Homo sapiens
tgaattaaagtctacactgc

SEQ ID NO: 4788968 - DNA, 11 bp, Homo sapiens
tgaattattaa

SEQ ID NO: 4788969 - DNA, 16 bp, Homo sapiens
tgaattattaatgaat

SEQ ID NO: 4788970 - DNA, 20 bp, Homo sapiens
tgaattgtgtggagaagtgt

SEQ ID NO: 4788971 - DNA, 18 bp, Homo sapiens
tgaatttaccatcaaaca

SEQ ID NO: 4788972 - DNA, 21 bp, Homo sapiens
tgaatttctatggcatattga

SEQ ID NO: 4788973 - DNA, 18 bp, Homo sapiens
tgaatttggggctactta

SEQ ID NO: 4788974 - DNA, 22 bp, Homo sapiens
tgaatttggggctacttatatt

SEQ ID NO: 4788975 - DNA, 18 bp, Homo sapiens
tgaattttaaaatgcaaa

SEQ ID NO: 4788976 - DNA, 23 bp, Homo sapiens
tgaattttcaaaggcttccaatg

SEQ ID NO: 4788977 - DNA, 13 bp, Homo sapiens
tgacaaagaaaat

SEQ ID NO: 4788978 - DNA, 14 bp, Homo sapiens
tgacaaagaaaatg

SEQ ID NO: 4788979 - DNA, 15 bp, Homo sapiens
tgacaaagaaaatga

SEQ ID NO: 4788980 - DNA, 18 bp, Homo sapiens
tgacaaagaaaatgagaa

SEQ ID NO: 4788981 - DNA, 17 bp, Homo sapiens
tgacaaattttaattat

SEQ ID NO: 4788982 - DNA, 23 bp, Homo sapiens
tgacaacaaaagggaaaaaagca

SEQ ID NO: 4788983 - DNA, 17 bp, Homo sapiens
tgacacaactcatccag

SEQ ID NO: 4788984 - DNA, 13 bp, Homo sapiens
tgacacaatggta

SEQ ID NO: 4788985 - DNA, 17 bp, Homo sapiens
tgacacaatggtagctc

SEQ ID NO: 4788986 - DNA, 18 bp, Homo sapiens
tgacacactcaccattta

SEQ ID NO: 4788987 - DNA, 16 bp, Homo sapiens
tgacacaggaaaccaa

SEQ ID NO: 4788988 - DNA, 20 bp, Homo sapiens
tgacaccaccactgtgtccc

SEQ ID NO: 4788989 - DNA, 16 bp, Homo sapiens
tgacaccttttcaggt

SEQ ID NO: 4788990 - DNA, 18 bp, Homo sapiens
tgacactcatcaggtaaa

SEQ ID NO: 4788991 - DNA, 23 bp, Homo sapiens
tgacactgaccttggagagacac

SEQ ID NO: 4788992 - DNA, 16 bp, Homo sapiens
tgacactgtctgctgc

SEQ ID NO: 4788993 - DNA, 21 bp, Homo sapiens
tgacagcatttcagctgtgag

SEQ ID NO: 4788994 - DNA, 13 bp, Homo sapiens
tgacagctgtgct

SEQ ID NO: 4788995 - DNA, 17 bp, Homo sapiens
tgacaggaaagccctcc

SEQ ID NO: 4788996 - DNA, 20 bp, Homo sapiens
tgacaggcagtgttcttggg

SEQ ID NO: 4788997 - DNA, 13 bp, Homo sapiens
tgacaggccttcc

SEQ ID NO: 4788998 - DNA, 18 bp, Homo sapiens
tgacagggagctggggaa

SEQ ID NO: 4788999 - DNA, 16 bp, Homo sapiens
tgacagtagcatactg

SEQ ID NO: 4789000 - DNA, 23 bp, Homo sapiens
tgacagtattaacatcaaagact

SEQ ID NO: 4789001 - DNA, 20 bp, Homo sapiens
tgacagtggttatatttcaa

SEQ ID NO: 4789002 - DNA, 23 bp, Homo sapiens
tgacatcaactgcatcaagatgt

SEQ ID NO: 4789003 - DNA, 23 bp, Homo sapiens
tgacattccagcattgtctgact

SEQ ID NO: 4789004 - DNA, 18 bp, Homo sapiens
tgacattgtcagaatgtt

SEQ ID NO: 4789005 - DNA, 20 bp, Homo sapiens
tgacattgtcagaatgttgt

SEQ ID NO: 4789006 - DNA, 18 bp, Homo sapiens
tgacattttgtagctagt

SEQ ID NO: 4789007 - DNA, 20 bp, Homo sapiens
tgacattttgtagctagttt

SEQ ID NO: 4789008 - DNA, 18 bp, Homo sapiens
tgaccaacaggctgttct

SEQ ID NO: 4789009 - DNA, 23 bp, Homo sapiens
tgaccaacaggctgttctgcact

SEQ ID NO: 4789010 - DNA, 20 bp, Homo sapiens
tgaccaagggaagtgaccaa

SEQ ID NO: 4789011 - DNA, 13 bp, Homo sapiens
tgaccaaggtgaa

SEQ ID NO: 4789012 - DNA, 17 bp, Homo sapiens
tgaccaaggtgaagatg

SEQ ID NO: 4789013 - DNA, 20 bp, Homo sapiens
tgaccaaggtgaagatggcc

SEQ ID NO: 4789014 - DNA, 22 bp, Homo sapiens
tgaccagactgtgggtccctgc

SEQ ID NO: 4789015 - DNA, 13 bp, Homo sapiens
tgaccataaaatt

SEQ ID NO: 4789016 - DNA, 15 bp, Homo sapiens
tgaccatgcatttta

SEQ ID NO: 4789017 - DNA, 22 bp, Homo sapiens
tgaccccacacgccggggctgg

SEQ ID NO: 4789018 - DNA, 22 bp, Homo sapiens
tgaccctccaccgcagaaggaa

SEQ ID NO: 4789019 - DNA, 23 bp, Homo sapiens
tgaccctccaccgcagaaggaag

SEQ ID NO: 4789020 - DNA, 12 bp, Homo sapiens
tgaccctgtgcc

SEQ ID NO: 4789021 - DNA, 17 bp, Homo sapiens
tgaccctgtgcctgtgt

SEQ ID NO: 4789022 - DNA, 20 bp, Homo sapiens
tgacccttccagacatacga

SEQ ID NO: 4789023 - DNA, 21 bp, Homo sapiens
tgacccttcccaatcagcact

SEQ ID NO: 4789024 - DNA, 17 bp, Homo sapiens
tgaccggcccgccacct

SEQ ID NO: 4789025 - DNA, 19 bp, Homo sapiens
tgaccggcccgccaccttg

SEQ ID NO: 4789026 - DNA, 21 bp, Homo sapiens
tgaccggcccgccaccttgta

SEQ ID NO: 4789027 - DNA, 18 bp, Homo sapiens
tgacctcacagtgaccct

SEQ ID NO: 4789028 - DNA, 17 bp, Homo sapiens
tgacctgacacctgccg

SEQ ID NO: 4789029 - DNA, 15 bp, Homo sapiens
tgacctgcctctcac

SEQ ID NO: 4789030 - DNA, 20 bp, Homo sapiens
tgacctgcctctcacacaca

SEQ ID NO: 4789031 - DNA, 21 bp, Homo sapiens
tgacctgcctctcacacacat

SEQ ID NO: 4789032 - DNA, 18 bp, Homo sapiens
tgaccttcctctggggct

SEQ ID NO: 4789033 - DNA, 23 bp, Homo sapiens
tgaccttcctctggggctctagg

SEQ ID NO: 4789034 - DNA, 17 bp, Homo sapiens
tgaccttctgcggctcc

SEQ ID NO: 4789035 - DNA, 17 bp, Homo sapiens
tgaccttgacgtgtgtg

SEQ ID NO: 4789036 - DNA, 14 bp, Homo sapiens
tttgtatacaagta

SEQ ID NO: 4789037 - DNA, 20 bp, Homo sapiens
tttgtatgaaatatatgtga

SEQ ID NO: 4789038 - DNA, 23 bp, Homo sapiens
tttgtcagtgtagatcaactcat

SEQ ID NO: 4789039 - DNA, 18 bp, Homo sapiens
tttgtcctcatgtgagaa

SEQ ID NO: 4789040 - DNA, 18 bp, Homo sapiens
tttgtcctgcatcatctt

SEQ ID NO: 4789041 - DNA, 16 bp, Homo sapiens
tttgtcctttatgtat

SEQ ID NO: 4789042 - DNA, 19 bp, Homo sapiens
tttgtcgggttctcccatg

SEQ ID NO: 4789043 - DNA, 17 bp, Homo sapiens
tttgtgaaagtggcaag

SEQ ID NO: 4789044 - DNA, 19 bp, Homo sapiens
tttgtgaagtgattgacat

SEQ ID NO: 4789045 - DNA, 16 bp, Homo sapiens
tttgtgaggacctttg

SEQ ID NO: 4789046 - DNA, 20 bp, Homo sapiens
tttgtgatctgtccttccaa

SEQ ID NO: 4789047 - DNA, 17 bp, Homo sapiens
tttgtgctgtgggcagc

SEQ ID NO: 4789048 - DNA, 12 bp, Homo sapiens
tttgtgcttcta

SEQ ID NO: 4789049 - DNA, 14 bp, Homo sapiens
tttgtgcttctaat

SEQ ID NO: 4789050 - DNA, 15 bp, Homo sapiens
tttgtgcttgttctt

SEQ ID NO: 4789051 - DNA, 16 bp, Homo sapiens
tttgtgcttgttcttc

SEQ ID NO: 4789052 - DNA, 15 bp, Homo sapiens
tttgtggataagaaa

SEQ ID NO: 4789053 - DNA, 17 bp, Homo sapiens
tttgttaataaagtgca

SEQ ID NO: 4789054 - DNA, 16 bp, Homo sapiens
tttgttaatatcactc

SEQ ID NO: 4789055 - DNA, 18 bp, Homo sapiens
tttgttatcagtacaatt

SEQ ID NO: 4789056 - DNA, 20 bp, Homo sapiens
tttgttcaccttctgtgcat

SEQ ID NO: 4789057 - DNA, 18 bp, Homo sapiens
ttttaaaaaaataatata

SEQ ID NO: 4789058 - DNA, 13 bp, Homo sapiens
ttttaaaagcata

SEQ ID NO: 4789059 - DNA, 23 bp, Homo sapiens
ttttaaaattgtacatgaacatg

SEQ ID NO: 4789060 - DNA, 20 bp, Homo sapiens
ttttaaagaagtccatgtga

SEQ ID NO: 4789061 - DNA, 22 bp, Homo sapiens
ttttaaagaagtccatgtgata

SEQ ID NO: 4789062 - DNA, 22 bp, Homo sapiens
ttttaaagggagccatgctctt

SEQ ID NO: 4789063 - DNA, 14 bp, Homo sapiens
ttttaaatgtctat

SEQ ID NO: 4789064 - DNA, 19 bp, Homo sapiens
ttttaatgtaattgattgt

SEQ ID NO: 4789065 - DNA, 21 bp, Homo sapiens
ttttaatttatttcatccagt

SEQ ID NO: 4789066 - DNA, 13 bp, Homo sapiens
ttttacaaagaaa

SEQ ID NO: 4789067 - DNA, 21 bp, Homo sapiens
ttttacaaagaaacaaaatat

SEQ ID NO: 4789068 - DNA, 17 bp, Homo sapiens
ttttacataattgccaa

SEQ ID NO: 4789069 - DNA, 23 bp, Homo sapiens
ttttactatgcctgttgatctat

SEQ ID NO: 4789070 - DNA, 13 bp, Homo sapiens
ttttactgtctgt

SEQ ID NO: 4789071 - DNA, 17 bp, Homo sapiens
ttttagagactatggag

SEQ ID NO: 4789072 - DNA, 18 bp, Homo sapiens
ttttagagattaatttgt

SEQ ID NO: 4789073 - DNA, 23 bp, Homo sapiens
ttttagattcctacttaaacaaa

SEQ ID NO: 4789074 - DNA, 12 bp, Homo sapiens
ttttataaatta

SEQ ID NO: 4789075 - DNA, 13 bp, Homo sapiens
ttttatagaggtt

SEQ ID NO: 4789076 - DNA, 14 bp, Homo sapiens
ttttatatgattaa

SEQ ID NO: 4789077 - DNA, 16 bp, Homo sapiens
ttttatgactaatcct

SEQ ID NO: 4789078 - DNA, 18 bp, Homo sapiens
ttttatgtttaaaatggc

SEQ ID NO: 4789079 - DNA, 21 bp, Homo sapiens
ttttatgtttaaaatggcatt

SEQ ID NO: 4789080 - DNA, 13 bp, Homo sapiens
ttttattgttgaa

SEQ ID NO: 4789081 - DNA, 17 bp, Homo sapiens
ttttcaaggcacattga

SEQ ID NO: 4789082 - DNA, 22 bp, Homo sapiens
ttttcaagttgcagtcagaaga

SEQ ID NO: 4789083 - DNA, 20 bp, Homo sapiens
ttttcaatgcaatgcatctg

SEQ ID NO: 4789084 - DNA, 14 bp, Homo sapiens
ttttcattgtgttt

SEQ ID NO: 4789085 - DNA, 19 bp, Homo sapiens
ttttccccaattatcctcc

SEQ ID NO: 4789086 - DNA, 16 bp, Homo sapiens
ttttccctcagaaaat

SEQ ID NO: 4789087 - DNA, 12 bp, Homo sapiens
ttttcctgtcaa

SEQ ID NO: 4789088 - DNA, 14 bp, Homo sapiens
ttttcctttcttcc

SEQ ID NO: 4789089 - DNA, 14 bp, Homo sapiens
ttttcgtgcatttg

SEQ ID NO: 4789090 - DNA, 13 bp, Homo sapiens
ttttctacagctt

SEQ ID NO: 4789091 - DNA, 20 bp, Homo sapiens
ttttctactcgagttacaga

SEQ ID NO: 4789092 - DNA, 22 bp, Homo sapiens
ttttctactttaaattgtggat

SEQ ID NO: 4789093 - DNA, 22 bp, Homo sapiens
ttttctgttacctcaacaagaa

SEQ ID NO: 4789094 - DNA, 20 bp, Homo sapiens
ttttcttcacctcacttgtg

SEQ ID NO: 4789095 - DNA, 15 bp, Homo sapiens
ttttcttcccatttg

SEQ ID NO: 4789096 - DNA, 20 bp, Homo sapiens
ttttcttcccatttgtaatg

SEQ ID NO: 4789097 - DNA, 23 bp, Homo sapiens
ttttcttctttaatttttctgtt

SEQ ID NO: 4789098 - DNA, 19 bp, Homo sapiens
ttttcttgtatctggattc

SEQ ID NO: 4789099 - DNA, 22 bp, Homo sapiens
ttttcttgtgtgtttattgtca

SEQ ID NO: 4789100 - DNA, 15 bp, Homo sapiens
ttttcttttaatttt

SEQ ID NO: 4789101 - DNA, 15 bp, Homo sapiens
ttttgaaactgcatt

SEQ ID NO: 4789102 - DNA, 18 bp, Homo sapiens
ttttgaagaagggaaatt

SEQ ID NO: 4789103 - DNA, 20 bp, Homo sapiens
ttttgaagaagggaaattca

SEQ ID NO: 4789104 - DNA, 20 bp, Homo sapiens
ttttgaatcaatctggcttc

SEQ ID NO: 4789105 - DNA, 21 bp, Homo sapiens
ttttgacactgaaataaccgt

SEQ ID NO: 4789106 - DNA, 16 bp, Homo sapiens
ttttgagccttattaa

SEQ ID NO: 4789107 - DNA, 19 bp, Homo sapiens
ttttgatgtattattatat

SEQ ID NO: 4789108 - DNA, 16 bp, Homo sapiens
ttttgctgctgaattt

SEQ ID NO: 4789109 - DNA, 16 bp, Homo sapiens
ttttgcttcatctgga

SEQ ID NO: 4789110 - DNA, 22 bp, Homo sapiens
ttttggaaaacgatttaattta

SEQ ID NO: 4789111 - DNA, 22 bp, Homo sapiens
ttttggatgaatgcagtataaa

SEQ ID NO: 4789112 - DNA, 22 bp, Homo sapiens
ttttggcattatctctttctct

SEQ ID NO: 4789113 - DNA, 21 bp, Homo sapiens
ttttgggaaatgctgatttaa

SEQ ID NO: 4789114 - DNA, 22 bp, Homo sapiens
ttttgggaaattcttgcactgt

SEQ ID NO: 4789115 - DNA, 20 bp, Homo sapiens
ttttggggctgacctgtctt

SEQ ID NO: 4789116 - DNA, 16 bp, Homo sapiens
ttgtcattctgctaat

SEQ ID NO: 4789117 - DNA, 20 bp, Homo sapiens
ttgtccaacaactccaggaa

SEQ ID NO: 4789118 - DNA, 14 bp, Homo sapiens
ttgtccacaaatgt

SEQ ID NO: 4789119 - DNA, 22 bp, Homo sapiens
ttgtcctcatgtgagaaagcag

SEQ ID NO: 4789120 - DNA, 15 bp, Homo sapiens
ttgtcctttatgtat

SEQ ID NO: 4789121 - DNA, 18 bp, Homo sapiens
ttgtcctttatgtattct

SEQ ID NO: 4789122 - DNA, 14 bp, Homo sapiens
ttgtctaaagatct

SEQ ID NO: 4789123 - DNA, 16 bp, Homo sapiens
ttgtctaaagatcttt

SEQ ID NO: 4789124 - DNA, 19 bp, Homo sapiens
ttgtctcacgattccagtg

SEQ ID NO: 4789125 - DNA, 20 bp, Homo sapiens
ttgtgaagtgattgacattt

SEQ ID NO: 4789126 - DNA, 15 bp, Homo sapiens
ttgtgagaattactg

SEQ ID NO: 4789127 - DNA, 17 bp, Homo sapiens
ttgtgagaattactgtt

SEQ ID NO: 4789128 - DNA, 14 bp, Homo sapiens
ttgtgatctgtcct

SEQ ID NO: 4789129 - DNA, 18 bp, Homo sapiens
ttgtgatctgttgtaata

SEQ ID NO: 4789130 - DNA, 21 bp, Homo sapiens
ttgtgcatgcaaaaatgaatt

SEQ ID NO: 4789131 - DNA, 15 bp, Homo sapiens
ttgtgcggtgtgtct

SEQ ID NO: 4789132 - DNA, 22 bp, Homo sapiens
ttgtgctgtgggcagcaccctc

SEQ ID NO: 4789133 - DNA, 11 bp, Homo sapiens
ttgtgcttcta

SEQ ID NO: 4789134 - DNA, 20 bp, Homo sapiens
ttgtgtaatttcctgctcct

SEQ ID NO: 4789135 - DNA, 15 bp, Homo sapiens
ttgtgtagattgtgt

SEQ ID NO: 4789136 - DNA, 18 bp, Homo sapiens
ttgtgtagattgtgtaaa

SEQ ID NO: 4789137 - DNA, 20 bp, Homo sapiens
ttgtgtagattgtgtaaatt

SEQ ID NO: 4789138 - DNA, 14 bp, Homo sapiens
ttgtgtaggaaatc

SEQ ID NO: 4789139 - DNA, 21 bp, Homo sapiens
ttgtgtaggaaatctgaagcc

SEQ ID NO: 4789140 - DNA, 17 bp, Homo sapiens
ttgtgtgtttattgtca

SEQ ID NO: 4789141 - DNA, 14 bp, Homo sapiens
ttgtgttcaatctg

SEQ ID NO: 4789142 - DNA, 15 bp, Homo sapiens
ttgtgttggtattta

SEQ ID NO: 4789143 - DNA, 19 bp, Homo sapiens
ttgtgttggtatttactgc

SEQ ID NO: 4789144 - DNA, 14 bp, Homo sapiens
ttgtgtttgaaaca

SEQ ID NO: 4789145 - DNA, 22 bp, Homo sapiens
ttgttaaaaacatgtgaaagat

SEQ ID NO: 4789146 - DNA, 18 bp, Homo sapiens
ttgttaaaaccttactta

SEQ ID NO: 4789147 - DNA, 18 bp, Homo sapiens
ttgttaatatcactcatt

SEQ ID NO: 4789148 - DNA, 14 bp, Homo sapiens
tttcacatctgtat

SEQ ID NO: 4789149 - DNA, 21 bp, Homo sapiens
tttcaccccatccctccttaa

SEQ ID NO: 4789150 - DNA, 16 bp, Homo sapiens
tttcacctatctggaa

SEQ ID NO: 4789151 - DNA, 16 bp, Homo sapiens
tttcacgattcatttt

SEQ ID NO: 4789152 - DNA, 16 bp, Homo sapiens
tttcactataatgtga

SEQ ID NO: 4789153 - DNA, 17 bp, Homo sapiens
tttcacttaaactttgt

SEQ ID NO: 4789154 - DNA, 20 bp, Homo sapiens
tttcagaaagggcagcccct

SEQ ID NO: 4789155 - DNA, 13 bp, Homo sapiens
tttcagattgtat

SEQ ID NO: 4789156 - DNA, 18 bp, Homo sapiens
tttcagattgtatctgaa

SEQ ID NO: 4789157 - DNA, 19 bp, Homo sapiens
tttcaggtgctcaaaatgc

SEQ ID NO: 4789158 - DNA, 22 bp, Homo sapiens
tttcaggtgctcaaaatgcaaa

SEQ ID NO: 4789159 - DNA, 17 bp, Homo sapiens
tttcaggttaaattaaa

SEQ ID NO: 4789160 - DNA, 18 bp, Homo sapiens
tttcatataaatggaatt

SEQ ID NO: 4789161 - DNA, 12 bp, Homo sapiens
tttcatatcatt

SEQ ID NO: 4789162 - DNA, 19 bp, Homo sapiens
tttcatcaatcattgtaca

SEQ ID NO: 4789163 - DNA, 14 bp, Homo sapiens
tttcatgattagac

SEQ ID NO: 4789164 - DNA, 18 bp, Homo sapiens
tttcatggagtagagtca

SEQ ID NO: 4789165 - DNA, 15 bp, Homo sapiens
tttcatgtccataaa

SEQ ID NO: 4789166 - DNA, 15 bp, Homo sapiens
tttcatgtttaagaa

SEQ ID NO: 4789167 - DNA, 11 bp, Homo sapiens
tttcattgtgt

SEQ ID NO: 4789168 - DNA, 14 bp, Homo sapiens
tttcatttaggtga

SEQ ID NO: 4789169 - DNA, 19 bp, Homo sapiens
tttccaagcctctctggca

SEQ ID NO: 4789170 - DNA, 20 bp, Homo sapiens
tttccaagtttattgccctc

SEQ ID NO: 4789171 - DNA, 18 bp, Homo sapiens
tttccacatccccaccct

SEQ ID NO: 4789172 - DNA, 19 bp, Homo sapiens
tttccacatccccaccctc

SEQ ID NO: 4789173 - DNA, 20 bp, Homo sapiens
tttccagctaagcctgatga

SEQ ID NO: 4789174 - DNA, 13 bp, Homo sapiens
tttccaggaaggc

SEQ ID NO: 4789175 - DNA, 12 bp, Homo sapiens
tttccatccaaa

SEQ ID NO: 4789176 - DNA, 13 bp, Homo sapiens
tttccatccaaac

SEQ ID NO: 4789177 - DNA, 16 bp, Homo sapiens
tttccatttggatttt

SEQ ID NO: 4789178 - DNA, 13 bp, Homo sapiens
tttcccacactgt

SEQ ID NO: 4789179 - DNA, 15 bp, Homo sapiens
tttccctgcatccct

SEQ ID NO: 4789180 - DNA, 22 bp, Homo sapiens
tttccgctgtcgccccaggccc

SEQ ID NO: 4789181 - DNA, 24 bp, Homo sapiens
tttccgctgtcgccccaggccctc

SEQ ID NO: 4789182 - DNA, 13 bp, Homo sapiens
tttcctctctctc

SEQ ID NO: 4789183 - DNA, 23 bp, Homo sapiens
tttcctcttaatgtctcaaaata

SEQ ID NO: 4789184 - DNA, 24 bp, Homo sapiens
tttcctcttaatgtctcaaaataa

SEQ ID NO: 4789185 - DNA, 23 bp, Homo sapiens
tttcctgaggtcatctgtaaaat

SEQ ID NO: 4789186 - DNA, 22 bp, Homo sapiens
tttcctgctcctccagtacaat

SEQ ID NO: 4789187 - DNA, 14 bp, Homo sapiens
tttcctgtgaggat

SEQ ID NO: 4789188 - DNA, 17 bp, Homo sapiens
tttcctttcttccttcc

SEQ ID NO: 4789189 - DNA, 15 bp, Homo sapiens
tttcggtctccttaa

SEQ ID NO: 4789190 - DNA, 14 bp, Homo sapiens
tttctaaagctgcc

SEQ ID NO: 4789191 - DNA, 16 bp, Homo sapiens
tttctaagaatttaga

SEQ ID NO: 4789192 - DNA, 18 bp, Homo sapiens
tttctaagctttcttaca

SEQ ID NO: 4789193 - DNA, 23 bp, Homo sapiens
tttctacatgcaaatctggctta

SEQ ID NO: 4789194 - DNA, 23 bp, Homo sapiens
tttctactcgagttacagacaaa

SEQ ID NO: 4789195 - DNA, 14 bp, Homo sapiens
tttctagaatacta

SEQ ID NO: 4789196 - DNA, 16 bp, Homo sapiens
tttctagcaattgctt

SEQ ID NO: 4789197 - DNA, 15 bp, Homo sapiens
tttctagccagagga

SEQ ID NO: 4789198 - DNA, 18 bp, Homo sapiens
tttctattccttctggcc

SEQ ID NO: 4789199 - DNA, 19 bp, Homo sapiens
tttctcacactctaactgt

SEQ ID NO: 4789200 - DNA, 22 bp, Homo sapiens
tttctcagcgggagtctcctca

SEQ ID NO: 4789201 - DNA, 15 bp, Homo sapiens
tttctcatgcataga

SEQ ID NO: 4789202 - DNA, 17 bp, Homo sapiens
tttctccgtatgcacat

SEQ ID NO: 4789203 - DNA, 18 bp, Homo sapiens
tttctcctccccaaggac

SEQ ID NO: 4789204 - DNA, 10 bp, Homo sapiens
tttctccttc

SEQ ID NO: 4789205 - DNA, 21 bp, Homo sapiens
tttctctctttcttttgtgca

SEQ ID NO: 4789206 - DNA, 17 bp, Homo sapiens
tttctcttaagctgccc

SEQ ID NO: 4789207 - DNA, 19 bp, Homo sapiens
tttctcttaagctgcccaa

SEQ ID NO: 4789208 - DNA, 22 bp, Homo sapiens
tttctgagtagcatatataatt

SEQ ID NO: 4789209 - DNA, 21 bp, Homo sapiens
tttctgcagccactattgtta

SEQ ID NO: 4789210 - DNA, 17 bp, Homo sapiens
tttctgcagtattctgt

SEQ ID NO: 4789211 - DNA, 14 bp, Homo sapiens
tttctgccgcagcc

SEQ ID NO: 4789212 - DNA, 15 bp, Homo sapiens
tttctggcttttaag

SEQ ID NO: 4789213 - DNA, 13 bp, Homo sapiens
tttctgtatatag

SEQ ID NO: 4789214 - DNA, 15 bp, Homo sapiens
tttctgttccctgct

SEQ ID NO: 4789215 - DNA, 23 bp, Homo sapiens
tttcttaatagaaagtcagatga

SEQ ID NO: 4789216 - DNA, 19 bp, Homo sapiens
tttcttaattatggtacct

SEQ ID NO: 4789217 - DNA, 15 bp, Homo sapiens
tttcttccaacatgt

SEQ ID NO: 4789218 - DNA, 22 bp, Homo sapiens
tttcttcccatttgtaatgtat

SEQ ID NO: 4789219 - DNA, 11 bp, Homo sapiens
tttcttccttc

SEQ ID NO: 4789220 - DNA, 14 bp, Homo sapiens
tttcttctttaatt

SEQ ID NO: 4789221 - DNA, 10 bp, Homo sapiens
tttcttgcaa

SEQ ID NO: 4789222 - DNA, 17 bp, Homo sapiens
tttcttggtatgatcat

SEQ ID NO: 4789223 - DNA, 19 bp, Homo sapiens
tttcttgtgtgtttattgt

SEQ ID NO: 4789224 - DNA, 18 bp, Homo sapiens
tttcttttgaatcaatct

SEQ ID NO: 4789225 - DNA, 23 bp, Homo sapiens
tttctttttattaggttaagtct

SEQ ID NO: 4789226 - DNA, 19 bp, Homo sapiens
tttcttttttttttcgtct

SEQ ID NO: 4789227 - DNA, 21 bp, Homo sapiens
tttgaaacacacagtgaccaa

SEQ ID NO: 4789228 - DNA, 14 bp, Homo sapiens
tttgaacagggcaa

SEQ ID NO: 4789229 - DNA, 14 bp, Homo sapiens
tttgaatcaatctg

SEQ ID NO: 4789230 - DNA, 22 bp, Homo sapiens
tttgaattgtgtggagaagtgt

SEQ ID NO: 4789231 - DNA, 13 bp, Homo sapiens
tttgacacactca

SEQ ID NO: 4789232 - DNA, 23 bp, Homo sapiens
tttgagagcctttggtgaataac

SEQ ID NO: 4789233 - DNA, 19 bp, Homo sapiens
actcctccccctcctccat

SEQ ID NO: 4789234 - DNA, 23 bp, Homo sapiens
actcctgttttcacaccttacaa

SEQ ID NO: 4789235 - DNA, 14 bp, Homo sapiens
actccttaaaaatg

SEQ ID NO: 4789236 - DNA, 19 bp, Homo sapiens
actccttaaccacctagtc

SEQ ID NO: 4789237 - DNA, 21 bp, Homo sapiens
actccttgaaaccagctcagg

SEQ ID NO: 4789238 - DNA, 14 bp, Homo sapiens
actccttggcctag

SEQ ID NO: 4789239 - DNA, 22 bp, Homo sapiens
actcgagagggctgagcccctc

SEQ ID NO: 4789240 - DNA, 22 bp, Homo sapiens
actcgcctgggaaattgctcca

SEQ ID NO: 4789241 - DNA, 18 bp, Homo sapiens
actcggtctgagaagatt

SEQ ID NO: 4789242 - DNA, 13 bp, Homo sapiens
actcgtgtgcatg

SEQ ID NO: 4789243 - DNA, 21 bp, Homo sapiens
actctaactgtatatttgtat

SEQ ID NO: 4789244 - DNA, 12 bp, Homo sapiens
actctcaccccc

SEQ ID NO: 4789245 - DNA, 22 bp, Homo sapiens
actctcaccccccgacctggct

SEQ ID NO: 4789246 - DNA, 21 bp, Homo sapiens
actctcagtcagtgtcatgaa

SEQ ID NO: 4789247 - DNA, 20 bp, Homo sapiens
actctccaggattgtccaca

SEQ ID NO: 4789248 - DNA, 18 bp, Homo sapiens
actctctagtgcaggaaa

SEQ ID NO: 4789249 - DNA, 18 bp, Homo sapiens
actctctcctctctctcc

SEQ ID NO: 4789250 - DNA, 22 bp, Homo sapiens
actctctcctctctctccctcc

SEQ ID NO: 4789251 - DNA, 18 bp, Homo sapiens
actctgaagtcccttcct

SEQ ID NO: 4789252 - DNA, 19 bp, Homo sapiens
actctgacaagggctgacc

SEQ ID NO: 4789253 - DNA, 14 bp, Homo sapiens
actctgaccgggct

SEQ ID NO: 4789254 - DNA, 16 bp, Homo sapiens
actctgaccgggcttc

SEQ ID NO: 4789255 - DNA, 17 bp, Homo sapiens
actctgagtcctcattg

SEQ ID NO: 4789256 - DNA, 22 bp, Homo sapiens
actctgcatagacaaaggcctt

SEQ ID NO: 4789257 - DNA, 22 bp, Homo sapiens
actctgcgacgatccccatgga

SEQ ID NO: 4789258 - DNA, 11 bp, Homo sapiens
actctggcctt

SEQ ID NO: 4789259 - DNA, 23 bp, Homo sapiens
actctggccttggttcctccagc

SEQ ID NO: 4789260 - DNA, 15 bp, Homo sapiens
actctggctgccaag

SEQ ID NO: 4789261 - DNA, 16 bp, Homo sapiens
actctgtcagccagcc

SEQ ID NO: 4789262 - DNA, 18 bp, Homo sapiens
actcttaaatatacaact

SEQ ID NO: 4789263 - DNA, 19 bp, Homo sapiens
actcttcaaggtctgcttt

SEQ ID NO: 4789264 - DNA, 20 bp, Homo sapiens
actcttgtctcctcctccag

SEQ ID NO: 4789265 - DNA, 18 bp, Homo sapiens
actctttagttgatttaa

SEQ ID NO: 4789266 - DNA, 19 bp, Homo sapiens
actctttctattgtttctt

SEQ ID NO: 4789267 - DNA, 19 bp, Homo sapiens
actctttggctattgtcct

SEQ ID NO: 4789268 - DNA, 19 bp, Homo sapiens
actgaaaggtagactttta

SEQ ID NO: 4789269 - DNA, 21 bp, Homo sapiens
actgaaattagtgttttcatt

SEQ ID NO: 4789270 - DNA, 20 bp, Homo sapiens
actgaacgatccttcaaagt

SEQ ID NO: 4789271 - DNA, 10 bp, Homo sapiens
actgaagaaa

SEQ ID NO: 4789272 - DNA, 18 bp, Homo sapiens
actgaataaataagtaaa

SEQ ID NO: 4789273 - DNA, 21 bp, Homo sapiens
actgaattgttatgtaaacat

SEQ ID NO: 4789274 - DNA, 13 bp, Homo sapiens
actgacacaggaa

SEQ ID NO: 4789275 - DNA, 21 bp, Homo sapiens
actgacacaggaaaccaacac

SEQ ID NO: 4789276 - DNA, 17 bp, Homo sapiens
actgagaccaagtctct

SEQ ID NO: 4789277 - DNA, 19 bp, Homo sapiens
actgagaccaagtctctct

SEQ ID NO: 4789278 - DNA, 15 bp, Homo sapiens
actgagcgcctgcag

SEQ ID NO: 4789279 - DNA, 19 bp, Homo sapiens
actgatatcacgggcccgc

SEQ ID NO: 4789280 - DNA, 19 bp, Homo sapiens
actgatgagacaacacaca

SEQ ID NO: 4789281 - DNA, 20 bp, Homo sapiens
actgatgagacaacacacac

SEQ ID NO: 4789282 - DNA, 17 bp, Homo sapiens
actgatggttgctttga

SEQ ID NO: 4789283 - DNA, 20 bp, Homo sapiens
actgattgttttagagacta

SEQ ID NO: 4789284 - DNA, 21 bp, Homo sapiens
actgattgttttagagactat

SEQ ID NO: 4789285 - DNA, 15 bp, Homo sapiens
actgcaccctccaca

SEQ ID NO: 4789286 - DNA, 18 bp, Homo sapiens
actgcaccctccacagga

SEQ ID NO: 4789287 - DNA, 13 bp, Homo sapiens
actgcactgtttt

SEQ ID NO: 4789288 - DNA, 16 bp, Homo sapiens
actgcagctgcaccag

SEQ ID NO: 4789289 - DNA, 20 bp, Homo sapiens
actgcaggttggaccccaga

SEQ ID NO: 4789290 - DNA, 21 bp, Homo sapiens
actgcaggttggaccccagag

SEQ ID NO: 4789291 - DNA, 15 bp, Homo sapiens
actgcattcgttgct

SEQ ID NO: 4789292 - DNA, 12 bp, Homo sapiens
actgcatttgtg

SEQ ID NO: 4789293 - DNA, 13 bp, Homo sapiens
actgccaaacatc

SEQ ID NO: 4789294 - DNA, 17 bp, Homo sapiens
actgccacaagcacaat

SEQ ID NO: 4789295 - DNA, 16 bp, Homo sapiens
actgccataacttgtt

SEQ ID NO: 4789296 - DNA, 22 bp, Homo sapiens
actgccattttttgtctgtgat

SEQ ID NO: 4789297 - DNA, 16 bp, Homo sapiens
actgcccaccctgggc

SEQ ID NO: 4789298 - DNA, 16 bp, Homo sapiens
actgcccacctgccag

SEQ ID NO: 4789299 - DNA, 21 bp, Homo sapiens
actgcccctgcacctgcttct

SEQ ID NO: 4789300 - DNA, 18 bp, Homo sapiens
actgccctccgcccttcc

SEQ ID NO: 4789301 - DNA, 10 bp, Homo sapiens
actgcctctg

SEQ ID NO: 4789302 - DNA, 17 bp, Homo sapiens
actgccttatattattt

SEQ ID NO: 4789303 - DNA, 22 bp, Homo sapiens
actgcctttcaaagtgcacaca

SEQ ID NO: 4789304 - DNA, 16 bp, Homo sapiens
actgcggaacaggagt

SEQ ID NO: 4789305 - DNA, 15 bp, Homo sapiens
actgctgtcttacta

SEQ ID NO: 4789306 - DNA, 21 bp, Homo sapiens
actgcttaaggaaaagagaaa

SEQ ID NO: 4789307 - DNA, 21 bp, Homo sapiens
actgcttgtgaaaggaaagag

SEQ ID NO: 4789308 - DNA, 21 bp, Homo sapiens
actgctttgttttggctgctc

SEQ ID NO: 4789309 - DNA, 16 bp, Homo sapiens
actggaaacaaggaag

SEQ ID NO: 4789310 - DNA, 12 bp, Homo sapiens
actggaaacatc

SEQ ID NO: 4789311 - DNA, 22 bp, Homo sapiens
actggagataccagagactctg

SEQ ID NO: 4789312 - DNA, 13 bp, Homo sapiens
actggagtagttg

SEQ ID NO: 4789313 - DNA, 16 bp, Homo sapiens
actggcccacccctct

SEQ ID NO: 4789314 - DNA, 19 bp, Homo sapiens
actggcccacccctcttcc

SEQ ID NO: 4789315 - DNA, 23 bp, Homo sapiens
actggcccacccctcttccccct

SEQ ID NO: 4789316 - DNA, 11 bp, Homo sapiens
actggccccag

SEQ ID NO: 4789317 - DNA, 14 bp, Homo sapiens
actggccccaggcg

SEQ ID NO: 4789318 - DNA, 22 bp, Homo sapiens
actggccccaggcggaggggct

SEQ ID NO: 4789319 - DNA, 15 bp, Homo sapiens
actggccctcgggcc

SEQ ID NO: 4789320 - DNA, 22 bp, Homo sapiens
actggccggcccacgtcctggg

SEQ ID NO: 4789321 - DNA, 18 bp, Homo sapiens
actggccttgcctccagg

SEQ ID NO: 4789322 - DNA, 19 bp, Homo sapiens
actggccttgcctccagga

SEQ ID NO: 4789323 - DNA, 21 bp, Homo sapiens
actggctttgggtagtgccat

SEQ ID NO: 4789324 - DNA, 21 bp, Homo sapiens
actgggcttggggaccagagc

SEQ ID NO: 4789325 - DNA, 14 bp, Homo sapiens
actggggggcaggc

SEQ ID NO: 4789326 - DNA, 16 bp, Homo sapiens
actggggggcaggcct

SEQ ID NO: 4789327 - DNA, 21 bp, Homo sapiens
actggggggcaggcctcccaa

SEQ ID NO: 4789328 - DNA, 18 bp, Homo sapiens
actgggtgggccccacag

SEQ ID NO: 4789329 - DNA, 24 bp, Homo sapiens
actgggtgtggcctggcttctggg

SEQ ID NO: 4789330 - DNA, 15 bp, Homo sapiens
actgtactttcccag

SEQ ID NO: 4789331 - DNA, 20 bp, Homo sapiens
actgtattacataaataaat

SEQ ID NO: 4789332 - DNA, 23 bp, Homo sapiens
actgtattgggacgctggtaact

SEQ ID NO: 4789333 - DNA, 22 bp, Homo sapiens
actgtatttcggctatgtctca

SEQ ID NO: 4789334 - DNA, 16 bp, Homo sapiens
actgtcatgcccagct

SEQ ID NO: 4789335 - DNA, 19 bp, Homo sapiens
actgtcccggagctcaggc

SEQ ID NO: 4789336 - DNA, 17 bp, Homo sapiens
actgtcttcaaccctgc

SEQ ID NO: 4789337 - DNA, 18 bp, Homo sapiens
actgtcttcaaccctgcc

SEQ ID NO: 4789338 - DNA, 17 bp, Homo sapiens
actgtgacattccacag

SEQ ID NO: 4789339 - DNA, 18 bp, Homo sapiens
actgtgacattccacaga

SEQ ID NO: 4789340 - DNA, 22 bp, Homo sapiens
actgtgaccaagtataaacttt

SEQ ID NO: 4789341 - DNA, 15 bp, Homo sapiens
actgtgagaactgtg

SEQ ID NO: 4789342 - DNA, 17 bp, Homo sapiens
actgtgagaactgtgaa

SEQ ID NO: 4789343 - DNA, 15 bp, Homo sapiens
actgtgagataaata

SEQ ID NO: 4789344 - DNA, 16 bp, Homo sapiens
actgtgagataaatat

SEQ ID NO: 4789345 - DNA, 17 bp, Homo sapiens
actgtggataaattttg

SEQ ID NO: 4789346 - DNA, 18 bp, Homo sapiens
actgtggggtttttaatc

SEQ ID NO: 4789347 - DNA, 20 bp, Homo sapiens
actgtgtcccagtgtctggc

SEQ ID NO: 4789348 - DNA, 22 bp, Homo sapiens
actgtgtcccagtgtctggccc

SEQ ID NO: 4789349 - DNA, 13 bp, Homo sapiens
actgtgtctcatg

SEQ ID NO: 4789350 - DNA, 19 bp, Homo sapiens
actgttaacccagtgttca

SEQ ID NO: 4789351 - DNA, 12 bp, Homo sapiens
actgttacagta

SEQ ID NO: 4789352 - DNA, 17 bp, Homo sapiens
actgttctcttactgcc

SEQ ID NO: 4789353 - DNA, 14 bp, Homo sapiens
actgtttataatag

SEQ ID NO: 4789354 - DNA, 21 bp, Homo sapiens
actgttttgtgcggtgtgtct

SEQ ID NO: 4789355 - DNA, 21 bp, Homo sapiens
acttaaaatcaaatttttctg

SEQ ID NO: 4789356 - DNA, 16 bp, Homo sapiens
acttaaacaaaaactt

SEQ ID NO: 4789357 - DNA, 17 bp, Homo sapiens
acttaaacaaaaacttt

SEQ ID NO: 4789358 - DNA, 18 bp, Homo sapiens
acttaaactttgtcactt

SEQ ID NO: 4789359 - DNA, 22 bp, Homo sapiens
acttaaactttgtcacttctgc

SEQ ID NO: 4789360 - DNA, 20 bp, Homo sapiens
acttaaatagcatctgctct

SEQ ID NO: 4789361 - DNA, 17 bp, Homo sapiens
acttacacacctgagaa

SEQ ID NO: 4789362 - DNA, 22 bp, Homo sapiens
acttacacacctgagaatgtgc

SEQ ID NO: 4789363 - DNA, 19 bp, Homo sapiens
acttacatgggtgttttga

SEQ ID NO: 4789364 - DNA, 22 bp, Homo sapiens
acttagggagtgtgccttgggc

SEQ ID NO: 4789365 - DNA, 21 bp, Homo sapiens
acttatcagtttgctaatgtt

SEQ ID NO: 4789366 - DNA, 13 bp, Homo sapiens
acttattcaaaga

SEQ ID NO: 4789367 - DNA, 16 bp, Homo sapiens
acttatttcactttag

SEQ ID NO: 4789368 - DNA, 13 bp, Homo sapiens
acttatttccatg

SEQ ID NO: 4789369 - DNA, 15 bp, Homo sapiens
acttattttgattgt

SEQ ID NO: 4789370 - DNA, 16 bp, Homo sapiens
acttcacctccttctg

SEQ ID NO: 4789371 - DNA, 13 bp, Homo sapiens
acttcagactctc

SEQ ID NO: 4789372 - DNA, 20 bp, Homo sapiens
acttcagactctctcctctc

SEQ ID NO: 4789373 - DNA, 22 bp, Homo sapiens
acttcagcaaccctacagtata

SEQ ID NO: 4789374 - DNA, 15 bp, Homo sapiens
acttcagtcctggga

SEQ ID NO: 4789375 - DNA, 14 bp, Homo sapiens
acttcagttctcat

SEQ ID NO: 4789376 - DNA, 17 bp, Homo sapiens
acttcattgaaaatata

SEQ ID NO: 4789377 - DNA, 13 bp, Homo sapiens
acttccagatttg

SEQ ID NO: 4789378 - DNA, 21 bp, Homo sapiens
acttccagatttgagctgcct

SEQ ID NO: 4789379 - DNA, 19 bp, Homo sapiens
acttccagctttctctttg

SEQ ID NO: 4789380 - DNA, 23 bp, Homo sapiens
acttccaggttccatccaccacc

SEQ ID NO: 4789381 - DNA, 20 bp, Homo sapiens
acttcccagctggcagcgcc

SEQ ID NO: 4789382 - DNA, 15 bp, Homo sapiens
acttccccatctgtg

SEQ ID NO: 4789383 - DNA, 18 bp, Homo sapiens
acttcctataccggagct

SEQ ID NO: 4789384 - DNA, 21 bp, Homo sapiens
acttcctattaatttattaaa

SEQ ID NO: 4789385 - DNA, 14 bp, Homo sapiens
acttccttaacagc

SEQ ID NO: 4789386 - DNA, 16 bp, Homo sapiens
acttcgctattcccag

SEQ ID NO: 4789387 - DNA, 17 bp, Homo sapiens
acttctaaaataaatgt

SEQ ID NO: 4789388 - DNA, 13 bp, Homo sapiens
acttctcatttat

SEQ ID NO: 4789389 - DNA, 18 bp, Homo sapiens
acttctcatttatgttat

SEQ ID NO: 4789390 - DNA, 23 bp, Homo sapiens
acttctcatttatgttatttatg

SEQ ID NO: 4789391 - DNA, 23 bp, Homo sapiens
acttcttaaggacagtgttcaaa

SEQ ID NO: 4789392 - DNA, 24 bp, Homo sapiens
acttcttaaggacagtgttcaaat

SEQ ID NO: 4789393 - DNA, 23 bp, Homo sapiens
acttcttcatccatagacacagt

SEQ ID NO: 4789394 - DNA, 16 bp, Homo sapiens
acttctttagtattat

SEQ ID NO: 4789395 - DNA, 18 bp, Homo sapiens
acttgaaaacttctcatt

SEQ ID NO: 4789396 - DNA, 23 bp, Homo sapiens
acttgaaattatatctgtggtct

SEQ ID NO: 4789397 - DNA, 15 bp, Homo sapiens
acttgaatagtattg

SEQ ID NO: 4789398 - DNA, 16 bp, Homo sapiens
acttgccctgaccatg

SEQ ID NO: 4789399 - DNA, 20 bp, Homo sapiens
acttgcttcttgtgtttgaa

SEQ ID NO: 4789400 - DNA, 14 bp, Homo sapiens
acttgtaacttttt

SEQ ID NO: 4789401 - DNA, 17 bp, Homo sapiens
acttgtgtatgatccaa

SEQ ID NO: 4789402 - DNA, 21 bp, Homo sapiens
acttgtgttcaatctgtgaag

SEQ ID NO: 4789403 - DNA, 16 bp, Homo sapiens
acttgttatgttgtaa

SEQ ID NO: 4789404 - DNA, 14 bp, Homo sapiens
actttaaattatat

SEQ ID NO: 4789405 - DNA, 18 bp, Homo sapiens
actttaaattgtggatga

SEQ ID NO: 4789406 - DNA, 13 bp, Homo sapiens
actttacaatcat

SEQ ID NO: 4789407 - DNA, 14 bp, Homo sapiens
actttacaatcatg

SEQ ID NO: 4789408 - DNA, 17 bp, Homo sapiens
actttagtatttttact

SEQ ID NO: 4789409 - DNA, 13 bp, Homo sapiens
actttattggtct

SEQ ID NO: 4789410 - DNA, 20 bp, Homo sapiens
actttattttatataataaa

SEQ ID NO: 4789411 - DNA, 23 bp, Homo sapiens
actttcactataatgtgaaatgt

SEQ ID NO: 4789412 - DNA, 17 bp, Homo sapiens
actttcagattgtatct

SEQ ID NO: 4789413 - DNA, 20 bp, Homo sapiens
actttccatgacagtagcat

SEQ ID NO: 4789414 - DNA, 21 bp, Homo sapiens
actttccatgacagtagcata

SEQ ID NO: 4789415 - DNA, 18 bp, Homo sapiens
actttcccacactgtgaa

SEQ ID NO: 4789416 - DNA, 15 bp, Homo sapiens
acaccaaattgctga

SEQ ID NO: 4789417 - DNA, 21 bp, Homo sapiens
acaccaaattgctgagatgtt

SEQ ID NO: 4789418 - DNA, 17 bp, Homo sapiens
acaccaccactgtgtcc

SEQ ID NO: 4789419 - DNA, 18 bp, Homo sapiens
acaccaccactgtgtccc

SEQ ID NO: 4789420 - DNA, 17 bp, Homo sapiens
acaccactttcccacac

SEQ ID NO: 4789421 - DNA, 18 bp, Homo sapiens
acaccactttcccacact

SEQ ID NO: 4789422 - DNA, 18 bp, Homo sapiens
acaccactttgtctctga

SEQ ID NO: 4789423 - DNA, 20 bp, Homo sapiens
acacccaaagcatggactaa

SEQ ID NO: 4789424 - DNA, 15 bp, Homo sapiens
acaccccgtctgccc

SEQ ID NO: 4789425 - DNA, 16 bp, Homo sapiens
acaccccgtctgcccc

SEQ ID NO: 4789426 - DNA, 19 bp, Homo sapiens
acaccctcactctgccagg

SEQ ID NO: 4789427 - DNA, 15 bp, Homo sapiens
acacccttccccact

SEQ ID NO: 4789428 - DNA, 15 bp, Homo sapiens
acaccggcactgtgc

SEQ ID NO: 4789429 - DNA, 18 bp, Homo sapiens
acacctaaattaacaaat

SEQ ID NO: 4789430 - DNA, 19 bp, Homo sapiens
acacctaaattaacaaatt

SEQ ID NO: 4789431 - DNA, 15 bp, Homo sapiens
acacctgagaatgtg

SEQ ID NO: 4789432 - DNA, 15 bp, Homo sapiens
acacctgccgctgct

SEQ ID NO: 4789433 - DNA, 19 bp, Homo sapiens
acaccttacaaagccagct

SEQ ID NO: 4789434 - DNA, 22 bp, Homo sapiens
acaccttcccagctgctcctag

SEQ ID NO: 4789435 - DNA, 15 bp, Homo sapiens
acacgccggggctgg

SEQ ID NO: 4789436 - DNA, 21 bp, Homo sapiens
acacgccggggctggccctgc

SEQ ID NO: 4789437 - DNA, 15 bp, Homo sapiens
acacgcgtccacata

SEQ ID NO: 4789438 - DNA, 21 bp, Homo sapiens
acacgcgtccacatacactgc

SEQ ID NO: 4789439 - DNA, 15 bp, Homo sapiens
acacggagtttccat

SEQ ID NO: 4789440 - DNA, 19 bp, Homo sapiens
acacggctgatatctttga

SEQ ID NO: 4789441 - DNA, 13 bp, Homo sapiens
acactacaaacat

SEQ ID NO: 4789442 - DNA, 13 bp, Homo sapiens
acactattctcca

SEQ ID NO: 4789443 - DNA, 23 bp, Homo sapiens
acactattctccagaaaaatcaa

SEQ ID NO: 4789444 - DNA, 17 bp, Homo sapiens
acactctaactgtatat

SEQ ID NO: 4789445 - DNA, 12 bp, Homo sapiens
acactgaaataa

SEQ ID NO: 4789446 - DNA, 13 bp, Homo sapiens
acactgaaatcca

SEQ ID NO: 4789447 - DNA, 22 bp, Homo sapiens
acactgaccttggagagacaca

SEQ ID NO: 4789448 - DNA, 14 bp, Homo sapiens
acactgcttaagga

SEQ ID NO: 4789449 - DNA, 13 bp, Homo sapiens
acactggaatcca

SEQ ID NO: 4789450 - DNA, 15 bp, Homo sapiens
acactggctttacat

SEQ ID NO: 4789451 - DNA, 23 bp, Homo sapiens
acactggctttgggtagtgccat

SEQ ID NO: 4789452 - DNA, 16 bp, Homo sapiens
acactgtcaagattaa

SEQ ID NO: 4789453 - DNA, 18 bp, Homo sapiens
acactgtcaagattaagt

SEQ ID NO: 4789454 - DNA, 22 bp, Homo sapiens
acactgtcaagattaagttata

SEQ ID NO: 4789455 - DNA, 19 bp, Homo sapiens
acactgtgaactaatgaca

SEQ ID NO: 4789456 - DNA, 22 bp, Homo sapiens
acactgtgcgttttagagtatg

SEQ ID NO: 4789457 - DNA, 16 bp, Homo sapiens
acacttcacctccttc

SEQ ID NO: 4789458 - DNA, 16 bp, Homo sapiens
acacttctccttaacc

SEQ ID NO: 4789459 - DNA, 14 bp, Homo sapiens
acacttcttccaaa

SEQ ID NO: 4789460 - DNA, 16 bp, Homo sapiens
acacttgagatgattt

SEQ ID NO: 4789461 - DNA, 18 bp, Homo sapiens
acacttgggctggcaccc

SEQ ID NO: 4789462 - DNA, 15 bp, Homo sapiens
acactttacattctt

SEQ ID NO: 4789463 - DNA, 16 bp, Homo sapiens
acacttttcatatcat

SEQ ID NO: 4789464 - DNA, 15 bp, Homo sapiens
acagaacaacaacaa

SEQ ID NO: 4789465 - DNA, 15 bp, Homo sapiens
acagaacctttgtca

SEQ ID NO: 4789466 - DNA, 16 bp, Homo sapiens
acagaacctttgtcaa

SEQ ID NO: 4789467 - DNA, 22 bp, Homo sapiens
acagaattgggcccttagaatg

SEQ ID NO: 4789468 - DNA, 23 bp, Homo sapiens
acagaattgggcccttagaatgt

SEQ ID NO: 4789469 - DNA, 14 bp, Homo sapiens
acagacaaagcgtg

SEQ ID NO: 4789470 - DNA, 22 bp, Homo sapiens
acagaccagcatagttctgcaa

SEQ ID NO: 4789471 - DNA, 15 bp, Homo sapiens
acagacccctggggg

SEQ ID NO: 4789472 - DNA, 13 bp, Homo sapiens
acagaccggggtg

SEQ ID NO: 4789473 - DNA, 13 bp, Homo sapiens
acagacctcggct

SEQ ID NO: 4789474 - DNA, 23 bp, Homo sapiens
acagacggacgggacagcggccc

SEQ ID NO: 4789475 - DNA, 16 bp, Homo sapiens
acagactgctgtctta

SEQ ID NO: 4789476 - DNA, 18 bp, Homo sapiens
acagagatggcagagcca

SEQ ID NO: 4789477 - DNA, 13 bp, Homo sapiens
acagagcagatca

SEQ ID NO: 4789478 - DNA, 17 bp, Homo sapiens
acagagcctgttttaaa

SEQ ID NO: 4789479 - DNA, 22 bp, Homo sapiens
acagagcctgttttaaaaaata

SEQ ID NO: 4789480 - DNA, 18 bp, Homo sapiens
acagagtatatatgtaca

SEQ ID NO: 4789481 - DNA, 14 bp, Homo sapiens
acagagtcttcctc

SEQ ID NO: 4789482 - DNA, 19 bp, Homo sapiens
acagagtcttcctctgtct

SEQ ID NO: 4789483 - DNA, 12 bp, Homo sapiens
acagagtggact

SEQ ID NO: 4789484 - DNA, 18 bp, Homo sapiens
acagagtggactcttccc

SEQ ID NO: 4789485 - DNA, 17 bp, Homo sapiens
acagagtggatctggag

SEQ ID NO: 4789486 - DNA, 12 bp, Homo sapiens
acagatccatcc

SEQ ID NO: 4789487 - DNA, 23 bp, Homo sapiens
acagatcctccgcggaggcccct

SEQ ID NO: 4789488 - DNA, 20 bp, Homo sapiens
acagatggtgtcctgcatgt

SEQ ID NO: 4789489 - DNA, 21 bp, Homo sapiens
acagatggtgtcctgcatgta

SEQ ID NO: 4789490 - DNA, 13 bp, Homo sapiens
acagattgctgct

SEQ ID NO: 4789491 - DNA, 13 bp, Homo sapiens
acagatttccaaa

SEQ ID NO: 4789492 - DNA, 15 bp, Homo sapiens
acagatttgttcatt

SEQ ID NO: 4789493 - DNA, 17 bp, Homo sapiens
acagatttgttcattcc

SEQ ID NO: 4789494 - DNA, 21 bp, Homo sapiens
acagcaaaaccattgcttcac

SEQ ID NO: 4789495 - DNA, 12 bp, Homo sapiens
acagcacatgct

SEQ ID NO: 4789496 - DNA, 21 bp, Homo sapiens
acagcacatgctggccagcct

SEQ ID NO: 4789497 - DNA, 13 bp, Homo sapiens
acagcacatttgt

SEQ ID NO: 4789498 - DNA, 17 bp, Homo sapiens
acagcagcctctgaagt

SEQ ID NO: 4789499 - DNA, 19 bp, Homo sapiens
acagcagctccaacctgga

SEQ ID NO: 4789500 - DNA, 13 bp, Homo sapiens
acagcagctggac

SEQ ID NO: 4789501 - DNA, 14 bp, Homo sapiens
acagcatgtgttaa

SEQ ID NO: 4789502 - DNA, 22 bp, Homo sapiens
acatcagagtgtatttttgtaa

SEQ ID NO: 4789503 - DNA, 15 bp, Homo sapiens
acatctgatatcagg

SEQ ID NO: 4789504 - DNA, 22 bp, Homo sapiens
acatctgatatcaggaaatatc

SEQ ID NO: 4789505 - DNA, 13 bp, Homo sapiens
acatctgatttct

SEQ ID NO: 4789506 - DNA, 15 bp, Homo sapiens
acatctgatttctga

SEQ ID NO: 4789507 - DNA, 20 bp, Homo sapiens
acatctgtcagtgagtcaga

SEQ ID NO: 4789508 - DNA, 17 bp, Homo sapiens
acatcttgtgcatgcaa

SEQ ID NO: 4789509 - DNA, 23 bp, Homo sapiens
acatcttgtgcatgcaaaaatga

SEQ ID NO: 4789510 - DNA, 17 bp, Homo sapiens
acatgaaagtcaagtct

SEQ ID NO: 4789511 - DNA, 19 bp, Homo sapiens
acatgaaagtcaagtctac

SEQ ID NO: 4789512 - DNA, 15 bp, Homo sapiens
acatgacactgacct

SEQ ID NO: 4789513 - DNA, 19 bp, Homo sapiens
acatgacatccacatgcac

SEQ ID NO: 4789514 - DNA, 15 bp, Homo sapiens
acatgactctttatt

SEQ ID NO: 4789515 - DNA, 17 bp, Homo sapiens
acatgactctttattgt

SEQ ID NO: 4789516 - DNA, 19 bp, Homo sapiens
acatgactctttattgtct

SEQ ID NO: 4789517 - DNA, 20 bp, Homo sapiens
acatgactctttattgtctg

SEQ ID NO: 4789518 - DNA, 22 bp, Homo sapiens
acatgactctttattgtctgta

SEQ ID NO: 4789519 - DNA, 18 bp, Homo sapiens
acatgagagtagggccct

SEQ ID NO: 4789520 - DNA, 20 bp, Homo sapiens
acatgagagtagggccctga

SEQ ID NO: 4789521 - DNA, 20 bp, Homo sapiens
acatgcacagctaacatgga

SEQ ID NO: 4789522 - DNA, 23 bp, Homo sapiens
acatgcacagctaacatggaagt

SEQ ID NO: 4789523 - DNA, 12 bp, Homo sapiens
acatgcacatgt

SEQ ID NO: 4789524 - DNA, 21 bp, Homo sapiens
acatgcacattcatcctcaca

SEQ ID NO: 4789525 - DNA, 18 bp, Homo sapiens
acatgcactgacccttcc

SEQ ID NO: 4789526 - DNA, 21 bp, Homo sapiens
acatgcagaaattgacctgat

SEQ ID NO: 4789527 - DNA, 15 bp, Homo sapiens
acatgcccctcttag

SEQ ID NO: 4789528 - DNA, 16 bp, Homo sapiens
acatgcctctctcagg

SEQ ID NO: 4789529 - DNA, 17 bp, Homo sapiens
acatgcctctctcaggc

SEQ ID NO: 4789530 - DNA, 21 bp, Homo sapiens
acatgcctttccagtgctgct

SEQ ID NO: 4789531 - DNA, 22 bp, Homo sapiens
acatgcgctcctggcttttaaa

SEQ ID NO: 4789532 - DNA, 20 bp, Homo sapiens
acatgctaacctctctgaac

SEQ ID NO: 4789533 - DNA, 22 bp, Homo sapiens
acatgctcatcccaaaagctag

SEQ ID NO: 4789534 - DNA, 21 bp, Homo sapiens
acatgctgtcttagatcagga

SEQ ID NO: 4789535 - DNA, 23 bp, Homo sapiens
acatggccaatagtcatatgtga

SEQ ID NO: 4789536 - DNA, 22 bp, Homo sapiens
acatgggaaaggaggcatgcct

SEQ ID NO: 4789537 - DNA, 13 bp, Homo sapiens
acatgggttcaat

SEQ ID NO: 4789538 - DNA, 13 bp, Homo sapiens
acatgtatagtga

SEQ ID NO: 4789539 - DNA, 13 bp, Homo sapiens
acatgtattctgt

SEQ ID NO: 4789540 - DNA, 17 bp, Homo sapiens
acatgtattctgttggc

SEQ ID NO: 4789541 - DNA, 21 bp, Homo sapiens
acatgtctttggcttcagaat

SEQ ID NO: 4789542 - DNA, 13 bp, Homo sapiens
acatgtgaaagat

SEQ ID NO: 4789543 - DNA, 22 bp, Homo sapiens
acatgtgctcgctctgcatgat

SEQ ID NO: 4789544 - DNA, 13 bp, Homo sapiens
acatgttttacaa

SEQ ID NO: 4789545 - DNA, 19 bp, Homo sapiens
acattaagtattccttggc

SEQ ID NO: 4789546 - DNA, 23 bp, Homo sapiens
acattaagtattccttggcccag

SEQ ID NO: 4789547 - DNA, 19 bp, Homo sapiens
acattaatccacatgtttc

SEQ ID NO: 4789548 - DNA, 22 bp, Homo sapiens
acattaattgaggcttacagta

SEQ ID NO: 4789549 - DNA, 17 bp, Homo sapiens
acattagacacacatat

SEQ ID NO: 4789550 - DNA, 20 bp, Homo sapiens
acattattggacttccattt

SEQ ID NO: 4789551 - DNA, 19 bp, Homo sapiens
acattcctgaccctcactt

SEQ ID NO: 4789552 - DNA, 18 bp, Homo sapiens
acattgaaactgtattta

SEQ ID NO: 4789553 - DNA, 12 bp, Homo sapiens
acattgaaatac

SEQ ID NO: 4789554 - DNA, 19 bp, Homo sapiens
acattgccgtggcatctta

SEQ ID NO: 4789555 - DNA, 21 bp, Homo sapiens
acattgtagcctaatattcat

SEQ ID NO: 4789556 - DNA, 22 bp, Homo sapiens
acatttcctttaccctccacac

SEQ ID NO: 4789557 - DNA, 22 bp, Homo sapiens
acatttgaacagggcaaaatga

SEQ ID NO: 4789558 - DNA, 13 bp, Homo sapiens
acatttgcatgcc

SEQ ID NO: 4789559 - DNA, 19 bp, Homo sapiens
acatttgttaatgattctt

SEQ ID NO: 4789560 - DNA, 12 bp, Homo sapiens
acattttgtagc

SEQ ID NO: 4789561 - DNA, 19 bp, Homo sapiens
acatttttgtatgttttat

SEQ ID NO: 4789562 - DNA, 12 bp, Homo sapiens
accaaatataaa

SEQ ID NO: 4789563 - DNA, 16 bp, Homo sapiens
accaaatgtaaaatat

SEQ ID NO: 4789564 - DNA, 19 bp, Homo sapiens
accaaatgtaaaatattta

SEQ ID NO: 4789565 - DNA, 21 bp, Homo sapiens
accaaatgtaaaatatttata

SEQ ID NO: 4789566 - DNA, 14 bp, Homo sapiens
accaaattgctgag

SEQ ID NO: 4789567 - DNA, 16 bp, Homo sapiens
accaaattgctgagat

SEQ ID NO: 4789568 - DNA, 22 bp, Homo sapiens
accaacacccaaagcatggact

SEQ ID NO: 4789569 - DNA, 14 bp, Homo sapiens
accaaccaatgaaa

SEQ ID NO: 4789570 - DNA, 14 bp, Homo sapiens
accaacgggtctgt

SEQ ID NO: 4789571 - DNA, 16 bp, Homo sapiens
accaacgggtctgtgg

SEQ ID NO: 4789572 - DNA, 19 bp, Homo sapiens
accaactgctttgttttgg

SEQ ID NO: 4789573 - DNA, 15 bp, Homo sapiens
accaagaacataaac

SEQ ID NO: 4789574 - DNA, 21 bp, Homo sapiens
accaagctgctctccttcact

SEQ ID NO: 4789575 - DNA, 23 bp, Homo sapiens
accaagctgttccacttctctag

SEQ ID NO: 4789576 - DNA, 17 bp, Homo sapiens
accaagtctctctaaga

SEQ ID NO: 4789577 - DNA, 15 bp, Homo sapiens
accaatctctgtgac

SEQ ID NO: 4789578 - DNA, 17 bp, Homo sapiens
accacaaccctgttgct

SEQ ID NO: 4789579 - DNA, 20 bp, Homo sapiens
accacacacacccttcccca

SEQ ID NO: 4789580 - DNA, 21 bp, Homo sapiens
accacacacacccttccccac

SEQ ID NO: 4789581 - DNA, 16 bp, Homo sapiens
accacactctgcctgg

SEQ ID NO: 4789582 - DNA, 15 bp, Homo sapiens
accacagctgcctcc

SEQ ID NO: 4789583 - DNA, 13 bp, Homo sapiens
accaccaaatgac

SEQ ID NO: 4789584 - DNA, 16 bp, Homo sapiens
accaccacgcctggct

SEQ ID NO: 4789585 - DNA, 13 bp, Homo sapiens
accacccacccca

SEQ ID NO: 4789586 - DNA, 14 bp, Homo sapiens
accacccatatcat

SEQ ID NO: 4789587 - DNA, 15 bp, Homo sapiens
accacccatatcatg

SEQ ID NO: 4789588 - DNA, 17 bp, Homo sapiens
accacccatatcatgca

SEQ ID NO: 4789589 - DNA, 23 bp, Homo sapiens
accaccctatcatcagttaggat

SEQ ID NO: 4789590 - DNA, 16 bp, Homo sapiens
accaccctcgctgcca

SEQ ID NO: 4789591 - DNA, 12 bp, Homo sapiens
accaccctgcca

SEQ ID NO: 4789592 - DNA, 21 bp, Homo sapiens
accaccgcgcccagccttttt

SEQ ID NO: 4789593 - DNA, 14 bp, Homo sapiens
accaccgcgcccct

SEQ ID NO: 4789594 - DNA, 16 bp, Homo sapiens
accaccgcgcccctct

SEQ ID NO: 4789595 - DNA, 19 bp, Homo sapiens
accaccgcgcccctctgcg

SEQ ID NO: 4789596 - DNA, 23 bp, Homo sapiens
accacctggatggatctgctcca

SEQ ID NO: 4789597 - DNA, 23 bp, Homo sapiens
accacgattccaacccaggtctg

SEQ ID NO: 4789598 - DNA, 18 bp, Homo sapiens
accacggcgtttttttac

SEQ ID NO: 4789599 - DNA, 19 bp, Homo sapiens
accacggcgtttttttaca

SEQ ID NO: 4789600 - DNA, 20 bp, Homo sapiens
accacggtccaatccagcct

SEQ ID NO: 4789601 - DNA, 16 bp, Homo sapiens
accacgtctccctggc

SEQ ID NO: 4789602 - DNA, 21 bp, Homo sapiens
accacgtctccctggccccag

SEQ ID NO: 4789603 - DNA, 21 bp, Homo sapiens
accactgacagcctccacctt

SEQ ID NO: 4789604 - DNA, 14 bp, Homo sapiens
accactgtgtccca

SEQ ID NO: 4789605 - DNA, 15 bp, Homo sapiens
accactgtgtcccag

SEQ ID NO: 4789606 - DNA, 13 bp, Homo sapiens
accacttagaaga

SEQ ID NO: 4789607 - DNA, 16 bp, Homo sapiens
accacttccttaacag

SEQ ID NO: 4789608 - DNA, 18 bp, Homo sapiens
accacttccttaacagct

SEQ ID NO: 4789609 - DNA, 15 bp, Homo sapiens
accactttcccacac

SEQ ID NO: 4789610 - DNA, 13 bp, Homo sapiens
accagaaagagga

SEQ ID NO: 4789611 - DNA, 21 bp, Homo sapiens
accagaaagaggaataaaatg

SEQ ID NO: 4789612 - DNA, 22 bp, Homo sapiens
accagaagccggcggagctctg

SEQ ID NO: 4789613 - DNA, 17 bp, Homo sapiens
accagaagtttaaatct

SEQ ID NO: 4789614 - DNA, 14 bp, Homo sapiens
accagactgcaggt

SEQ ID NO: 4789615 - DNA, 18 bp, Homo sapiens
accagactgtgggtccct

SEQ ID NO: 4789616 - DNA, 16 bp, Homo sapiens
accagagctgccacct

SEQ ID NO: 4789617 - DNA, 19 bp, Homo sapiens
accagagctgccacctgcc

SEQ ID NO: 4789618 - DNA, 15 bp, Homo sapiens
accagagtgtatgca

SEQ ID NO: 4789619 - DNA, 19 bp, Homo sapiens
accagcataccagttcttg

SEQ ID NO: 4789620 - DNA, 18 bp, Homo sapiens
accagcatagttctgcaa

SEQ ID NO: 4789621 - DNA, 12 bp, Homo sapiens
accagcccaggc

SEQ ID NO: 4789622 - DNA, 12 bp, Homo sapiens
accagccctggg

SEQ ID NO: 4789623 - DNA, 20 bp, Homo sapiens
accctgccaactttccagac

SEQ ID NO: 4789624 - DNA, 14 bp, Homo sapiens
accctgccaccctc

SEQ ID NO: 4789625 - DNA, 11 bp, Homo sapiens
accctgccagg

SEQ ID NO: 4789626 - DNA, 13 bp, Homo sapiens
accctgccagggg

SEQ ID NO: 4789627 - DNA, 14 bp, Homo sapiens
accctgccctgcac

SEQ ID NO: 4789628 - DNA, 15 bp, Homo sapiens
accctgccctgcacc

SEQ ID NO: 4789629 - DNA, 12 bp, Homo sapiens
accctgccctgg

SEQ ID NO: 4789630 - DNA, 12 bp, Homo sapiens
accctgcgcccc

SEQ ID NO: 4789631 - DNA, 15 bp, Homo sapiens
accctgcgcccctgc

SEQ ID NO: 4789632 - DNA, 14 bp, Homo sapiens
accctgtctgcagg

SEQ ID NO: 4789633 - DNA, 16 bp, Homo sapiens
accctgtgccccgcct

SEQ ID NO: 4789634 - DNA, 15 bp, Homo sapiens
accctgtgcctgtgt

SEQ ID NO: 4789635 - DNA, 19 bp, Homo sapiens
accctgtgcctgtgtttca

SEQ ID NO: 4789636 - DNA, 20 bp, Homo sapiens
acccttcccaatcagcactg

SEQ ID NO: 4789637 - DNA, 23 bp, Homo sapiens
acccttcccaatcagcactgaaa

SEQ ID NO: 4789638 - DNA, 16 bp, Homo sapiens
acccttcttgtctctc

SEQ ID NO: 4789639 - DNA, 22 bp, Homo sapiens
acccttcttgtctctctggcaa

SEQ ID NO: 4789640 - DNA, 12 bp, Homo sapiens
acccttgactgt

SEQ ID NO: 4789641 - DNA, 16 bp, Homo sapiens
acccttgactgttatc

SEQ ID NO: 4789642 - DNA, 10 bp, Homo sapiens
acccttttct

SEQ ID NO: 4789643 - DNA, 14 bp, Homo sapiens
accgaaatgaaaat

SEQ ID NO: 4789644 - DNA, 20 bp, Homo sapiens
accgaagggacggggcccgc

SEQ ID NO: 4789645 - DNA, 15 bp, Homo sapiens
accgacgcccctccg

SEQ ID NO: 4789646 - DNA, 21 bp, Homo sapiens
accgagaggaaaaaggcttct

SEQ ID NO: 4789647 - DNA, 15 bp, Homo sapiens
accgattcttccttg

SEQ ID NO: 4789648 - DNA, 16 bp, Homo sapiens
accgattcttccttgc

SEQ ID NO: 4789649 - DNA, 19 bp, Homo sapiens
accgattcttccttgccac

SEQ ID NO: 4789650 - DNA, 20 bp, Homo sapiens
accgattcttccttgccaca

SEQ ID NO: 4789651 - DNA, 14 bp, Homo sapiens
accgcattccaggg

SEQ ID NO: 4789652 - DNA, 17 bp, Homo sapiens
accgccagagtgtcctg

SEQ ID NO: 4789653 - DNA, 20 bp, Homo sapiens
accgcccaacccccacctcc

SEQ ID NO: 4789654 - DNA, 11 bp, Homo sapiens
accgcccaccc

SEQ ID NO: 4789655 - DNA, 18 bp, Homo sapiens
accgcccacccagcagcg

SEQ ID NO: 4789656 - DNA, 20 bp, Homo sapiens
accgcccacccagcagcgcc

SEQ ID NO: 4789657 - DNA, 18 bp, Homo sapiens
accgcgcccctctgcgcc

SEQ ID NO: 4789658 - DNA, 18 bp, Homo sapiens
accggacgcatgcagggc

SEQ ID NO: 4789659 - DNA, 19 bp, Homo sapiens
accggacgcatgcagggcc

SEQ ID NO: 4789660 - DNA, 13 bp, Homo sapiens
accggcactgtgc

SEQ ID NO: 4789661 - DNA, 13 bp, Homo sapiens
accggccactgca

SEQ ID NO: 4789662 - DNA, 20 bp, Homo sapiens
accgggagcctccccctcag

SEQ ID NO: 4789663 - DNA, 22 bp, Homo sapiens
accggggtggagtcagggctgt

SEQ ID NO: 4789664 - DNA, 18 bp, Homo sapiens
accgggtggcagcgccca

SEQ ID NO: 4789665 - DNA, 14 bp, Homo sapiens
accgtcaatgtgaa

SEQ ID NO: 4789666 - DNA, 17 bp, Homo sapiens
accgtcaatgtgaaata

SEQ ID NO: 4789667 - DNA, 21 bp, Homo sapiens
accgtgagcaggaaggcctgg

SEQ ID NO: 4789668 - DNA, 22 bp, Homo sapiens
accgtgagcgccccgcccccac

SEQ ID NO: 4789669 - DNA, 23 bp, Homo sapiens
accgtgaggccagagacacaagc

SEQ ID NO: 4789670 - DNA, 15 bp, Homo sapiens
accgtggccctgccc

SEQ ID NO: 4789671 - DNA, 14 bp, Homo sapiens
accgtggtgtcctc

SEQ ID NO: 4789672 - DNA, 18 bp, Homo sapiens
accgtggtgtgaggcccc

SEQ ID NO: 4789673 - DNA, 17 bp, Homo sapiens
acctaaattaacaaatt

SEQ ID NO: 4789674 - DNA, 14 bp, Homo sapiens
acctaattaatttc

SEQ ID NO: 4789675 - DNA, 12 bp, Homo sapiens
acctacatctga

SEQ ID NO: 4789676 - DNA, 16 bp, Homo sapiens
acctacatctgaaatc

SEQ ID NO: 4789677 - DNA, 21 bp, Homo sapiens
acctaccttatagagcacaat

SEQ ID NO: 4789678 - DNA, 16 bp, Homo sapiens
acctataaatggactt

SEQ ID NO: 4789679 - DNA, 20 bp, Homo sapiens
acctataaatggacttgctt

SEQ ID NO: 4789680 - DNA, 15 bp, Homo sapiens
acctcacagtgaccc

SEQ ID NO: 4789681 - DNA, 16 bp, Homo sapiens
acctcactatggtatg

SEQ ID NO: 4789682 - DNA, 23 bp, Homo sapiens
acctcactatggtatgctggcca

SEQ ID NO: 4789683 - DNA, 18 bp, Homo sapiens
acctcagttggcctctgc

SEQ ID NO: 4789684 - DNA, 10 bp, Homo sapiens
acctccaccc

SEQ ID NO: 4789685 - DNA, 14 bp, Homo sapiens
acctccagattatt

SEQ ID NO: 4789686 - DNA, 19 bp, Homo sapiens
acctccagattattttcta

SEQ ID NO: 4789687 - DNA, 22 bp, Homo sapiens
acctccagattattttctatat

SEQ ID NO: 4789688 - DNA, 23 bp, Homo sapiens
acctcccccaaaccctgcttctg

SEQ ID NO: 4789689 - DNA, 17 bp, Homo sapiens
acctcccctggtcctgc

SEQ ID NO: 4789690 - DNA, 18 bp, Homo sapiens
acctccctgcccaggccg

SEQ ID NO: 4789691 - DNA, 21 bp, Homo sapiens
acctccctgcccaggccggcc

SEQ ID NO: 4789692 - DNA, 22 bp, Homo sapiens
acctcctccgtgggcagctcct

SEQ ID NO: 4789693 - DNA, 22 bp, Homo sapiens
acctccttctgcagtcagactg

SEQ ID NO: 4789694 - DNA, 19 bp, Homo sapiens
acctcggaatttctatgag

SEQ ID NO: 4789695 - DNA, 13 bp, Homo sapiens
acctcggctgtgt

SEQ ID NO: 4789696 - DNA, 17 bp, Homo sapiens
acctcgtgatccacccg

SEQ ID NO: 4789697 - DNA, 19 bp, Homo sapiens
acctctctgaactgcaaca

SEQ ID NO: 4789698 - DNA, 14 bp, Homo sapiens
acctctctgtcatg

SEQ ID NO: 4789699 - DNA, 18 bp, Homo sapiens
acctctgatttattttgt

SEQ ID NO: 4789700 - DNA, 17 bp, Homo sapiens
acctcttagcttttctg

SEQ ID NO: 4789701 - DNA, 17 bp, Homo sapiens
acctcttcccacaagaa

SEQ ID NO: 4789702 - DNA, 23 bp, Homo sapiens
acctctttcttcaattaatggaa

SEQ ID NO: 4789703 - DNA, 20 bp, Homo sapiens
acctgaataagggactttgg

SEQ ID NO: 4789704 - DNA, 13 bp, Homo sapiens
acctgaattaaag

SEQ ID NO: 4789705 - DNA, 16 bp, Homo sapiens
acctgaattaaagtct

SEQ ID NO: 4789706 - DNA, 19 bp, Homo sapiens
acctgaattaaagtctaca

SEQ ID NO: 4789707 - DNA, 23 bp, Homo sapiens
acctgaattaaagtctacactgc

SEQ ID NO: 4789708 - DNA, 13 bp, Homo sapiens
acctgacacctgc

SEQ ID NO: 4789709 - DNA, 19 bp, Homo sapiens
acctgacacctgccgctgc

SEQ ID NO: 4789710 - DNA, 14 bp, Homo sapiens
acctgaccagactg

SEQ ID NO: 4789711 - DNA, 12 bp, Homo sapiens
acctgccaggaa

SEQ ID NO: 4789712 - DNA, 15 bp, Homo sapiens
acctgccaggctgca

SEQ ID NO: 4789713 - DNA, 16 bp, Homo sapiens
acctgccaggctgcag

SEQ ID NO: 4789714 - DNA, 17 bp, Homo sapiens
acctgccaggctgcagg

SEQ ID NO: 4789715 - DNA, 18 bp, Homo sapiens
acctgccaggctgcaggg

SEQ ID NO: 4789716 - DNA, 10 bp, Homo sapiens
acctgcccag

SEQ ID NO: 4789717 - DNA, 19 bp, Homo sapiens
acctgcccagttagcccgg

SEQ ID NO: 4789718 - DNA, 15 bp, Homo sapiens
acctgccccaggctc

SEQ ID NO: 4789719 - DNA, 12 bp, Homo sapiens
acctgcccctca

SEQ ID NO: 4789720 - DNA, 20 bp, Homo sapiens
acctgcccctcaactctcct

SEQ ID NO: 4789721 - DNA, 23 bp, Homo sapiens
acctgcctgttgggccaggagcc

SEQ ID NO: 4789722 - DNA, 16 bp, Homo sapiens
acctgccttgcctgtt

SEQ ID NO: 4789723 - DNA, 14 bp, Homo sapiens
acctgcgcaccccg

SEQ ID NO: 4789724 - DNA, 15 bp, Homo sapiens
acctgctccagatcc

SEQ ID NO: 4789725 - DNA, 15 bp, Homo sapiens
acctgcttcattcaa

SEQ ID NO: 4789726 - DNA, 14 bp, Homo sapiens
acctggaaagccag

SEQ ID NO: 4789727 - DNA, 13 bp, Homo sapiens
acctggaggctgg

SEQ ID NO: 4789728 - DNA, 18 bp, Homo sapiens
acctggaggctggaccaa

SEQ ID NO: 4789729 - DNA, 19 bp, Homo sapiens
acctggatggatctgctcc

SEQ ID NO: 4789730 - DNA, 23 bp, Homo sapiens
acctggatggatctgctccatgc

SEQ ID NO: 4789731 - DNA, 17 bp, Homo sapiens
acctggcagatgggggc

SEQ ID NO: 4789732 - DNA, 18 bp, Homo sapiens
acctggcagatgggggcc

SEQ ID NO: 4789733 - DNA, 21 bp, Homo sapiens
acctggcccagtgcaatctgt

SEQ ID NO: 4789734 - DNA, 23 bp, Homo sapiens
acctggcccagtgcaatctgtcc

SEQ ID NO: 4789735 - DNA, 13 bp, Homo sapiens
acctggctgagtg

SEQ ID NO: 4789736 - DNA, 20 bp, Homo sapiens
acctggcttcccaggaccct

SEQ ID NO: 4789737 - DNA, 13 bp, Homo sapiens
acctgggccctag

SEQ ID NO: 4789738 - DNA, 16 bp, Homo sapiens
acctggtggccctgcg

SEQ ID NO: 4789739 - DNA, 15 bp, Homo sapiens
acctgtaaaacttta

SEQ ID NO: 4789740 - DNA, 16 bp, Homo sapiens
acctgtaaaactttat

SEQ ID NO: 4789741 - DNA, 17 bp, Homo sapiens
acctgtaaaactttatt

SEQ ID NO: 4789742 - DNA, 11 bp, Homo sapiens
acctgtcaacc

SEQ ID NO: 4789743 - DNA, 22 bp, Homo sapiens
acctgtcaacctgaattaaagt

SEQ ID NO: 4789744 - DNA, 15 bp, Homo sapiens
acctgtgaggactgg

SEQ ID NO: 4789745 - DNA, 13 bp, Homo sapiens
acctgtggaaagt

SEQ ID NO: 4789746 - DNA, 21 bp, Homo sapiens
acctgttcctgactgttctct

SEQ ID NO: 4789747 - DNA, 12 bp, Homo sapiens
accttaaattaa

SEQ ID NO: 4789748 - DNA, 22 bp, Homo sapiens
accttaaattaaacaatttatt

SEQ ID NO: 4789749 - DNA, 20 bp, Homo sapiens
accttacaaccacatttctg

SEQ ID NO: 4789750 - DNA, 14 bp, Homo sapiens
accttagccatcag

SEQ ID NO: 4789751 - DNA, 20 bp, Homo sapiens
accttagctccctcccgcac

SEQ ID NO: 4789752 - DNA, 15 bp, Homo sapiens
accttatagagcaca

SEQ ID NO: 4789753 - DNA, 18 bp, Homo sapiens
accttcatgaccttacat

SEQ ID NO: 4789754 - DNA, 19 bp, Homo sapiens
accttcatgaccttacata

SEQ ID NO: 4789755 - DNA, 14 bp, Homo sapiens
accttccaggaccc

SEQ ID NO: 4789756 - DNA, 12 bp, Homo sapiens
accttcccagct

SEQ ID NO: 4789757 - DNA, 21 bp, Homo sapiens
accttcccagctgctcctaga

SEQ ID NO: 4789758 - DNA, 16 bp, Homo sapiens
accttcccgtctgatt

SEQ ID NO: 4789759 - DNA, 17 bp, Homo sapiens
accttccctagttcttt

SEQ ID NO: 4789760 - DNA, 18 bp, Homo sapiens
accttcctgggcagccca

SEQ ID NO: 4789761 - DNA, 20 bp, Homo sapiens
accttcctgggcagcccaga

SEQ ID NO: 4789762 - DNA, 23 bp, Homo sapiens
accttcctgggcagcccagagag

SEQ ID NO: 4789763 - DNA, 22 bp, Homo sapiens
accttctgtgcatctggcctgg

SEQ ID NO: 4789764 - DNA, 23 bp, Homo sapiens
accttctgtgcatctggcctggg

SEQ ID NO: 4789765 - DNA, 19 bp, Homo sapiens
accttcttttcaatgcaat

SEQ ID NO: 4789766 - DNA, 22 bp, Homo sapiens
accttcttttcaatgcaatgca

SEQ ID NO: 4789767 - DNA, 21 bp, Homo sapiens
accttgcattttagctaattt

SEQ ID NO: 4789768 - DNA, 17 bp, Homo sapiens
accttgcttccttctca

SEQ ID NO: 4789769 - DNA, 19 bp, Homo sapiens
accttgggcacgggagagc

SEQ ID NO: 4789770 - DNA, 19 bp, Homo sapiens
acctttatttattaaactt

SEQ ID NO: 4789771 - DNA, 22 bp, Homo sapiens
acctttatttattaaacttcag

SEQ ID NO: 4789772 - DNA, 23 bp, Homo sapiens
acctttatttattaaacttcagc

SEQ ID NO: 4789773 - DNA, 19 bp, Homo sapiens
acctttccgctgtcgcccc

SEQ ID NO: 4789774 - DNA, 22 bp, Homo sapiens
acctttctaacccactaagtaa

SEQ ID NO: 4789775 - DNA, 15 bp, Homo sapiens
acctttggcttaatt

SEQ ID NO: 4789776 - DNA, 18 bp, Homo sapiens
acctttggcttaattcca

SEQ ID NO: 4789777 - DNA, 19 bp, Homo sapiens
acctttgtctcacgattcc

SEQ ID NO: 4789778 - DNA, 22 bp, Homo sapiens
acctttgtctcacgattccagt

SEQ ID NO: 4789779 - DNA, 16 bp, Homo sapiens
accttttaaaaaaata

SEQ ID NO: 4789780 - DNA, 10 bp, Homo sapiens
acctttttaa

SEQ ID NO: 4789781 - DNA, 14 bp, Homo sapiens
acctttttaatcca

SEQ ID NO: 4789782 - DNA, 16 bp, Homo sapiens
accttttttcacccca

SEQ ID NO: 4789783 - DNA, 18 bp, Homo sapiens
acgaacatggcatgtgaa

SEQ ID NO: 4789784 - DNA, 14 bp, Homo sapiens
acgacataagctgg

SEQ ID NO: 4789785 - DNA, 21 bp, Homo sapiens
acgacctacatctgaaatcta

SEQ ID NO: 4789786 - DNA, 18 bp, Homo sapiens
acgagcagagcgcagccc

SEQ ID NO: 4789787 - DNA, 19 bp, Homo sapiens
acgagcagagcgcagcccc

SEQ ID NO: 4789788 - DNA, 16 bp, Homo sapiens
acgagcaggcttcttc

SEQ ID NO: 4789789 - DNA, 20 bp, Homo sapiens
acgattcatttttgaaactg

SEQ ID NO: 4789790 - DNA, 13 bp, Homo sapiens
acgattccagtgc

SEQ ID NO: 4789791 - DNA, 22 bp, Homo sapiens
acgatttctccattaaacttct

SEQ ID NO: 4789792 - DNA, 14 bp, Homo sapiens
acgcagagccccgg

SEQ ID NO: 4789793 - DNA, 16 bp, Homo sapiens
acgcagagccccggag

SEQ ID NO: 4789794 - DNA, 19 bp, Homo sapiens
acgcccagcccccaccccc

SEQ ID NO: 4789795 - DNA, 23 bp, Homo sapiens
acgcccagcccccacccccgtca

SEQ ID NO: 4789796 - DNA, 22 bp, Homo sapiens
acgcccaggatgaaggggccag

SEQ ID NO: 4789797 - DNA, 18 bp, Homo sapiens
acgccccccggcctgatg

SEQ ID NO: 4789798 - DNA, 16 bp, Homo sapiens
acgcccctttctcttg

SEQ ID NO: 4789799 - DNA, 23 bp, Homo sapiens
acgccggggctggccctgccctc

SEQ ID NO: 4789800 - DNA, 18 bp, Homo sapiens
acgccgggtcgcctgccc

SEQ ID NO: 4789801 - DNA, 22 bp, Homo sapiens
acgcgtccacatacactgcatt

SEQ ID NO: 4789802 - DNA, 22 bp, Homo sapiens
acgctctaaggcaggatgtggc

SEQ ID NO: 4789803 - DNA, 13 bp, Homo sapiens
acgctctctgtct

SEQ ID NO: 4789804 - DNA, 18 bp, Homo sapiens
acgctgctccatgcacag

SEQ ID NO: 4789805 - DNA, 14 bp, Homo sapiens
acgctggagaccct

SEQ ID NO: 4789806 - DNA, 17 bp, Homo sapiens
acgctggagaccctgcg

SEQ ID NO: 4789807 - DNA, 11 bp, Homo sapiens
acgctggctcg

SEQ ID NO: 4789808 - DNA, 20 bp, Homo sapiens
acgctgtcctctcgagccca

SEQ ID NO: 4789809 - DNA, 21 bp, Homo sapiens
acgctgtcctctcgagcccag

SEQ ID NO: 4789810 - DNA, 22 bp, Homo sapiens
acgcttctggaggtggggaggg

SEQ ID NO: 4789811 - DNA, 23 bp, Homo sapiens
acgcttctggaggtggggagggc

SEQ ID NO: 4789812 - DNA, 16 bp, Homo sapiens
acgcttgacagttact

SEQ ID NO: 4789813 - DNA, 14 bp, Homo sapiens
acggaagtggcctg

SEQ ID NO: 4789814 - DNA, 21 bp, Homo sapiens
acggaagtggcctgagaagag

SEQ ID NO: 4789815 - DNA, 22 bp, Homo sapiens
acggaagtggcctgagaagagt

SEQ ID NO: 4789816 - DNA, 12 bp, Homo sapiens
acggcagcccca

SEQ ID NO: 4789817 - DNA, 15 bp, Homo sapiens
acggcagccccatcc

SEQ ID NO: 4789818 - DNA, 21 bp, Homo sapiens
acgggagagcgccacccgccc

SEQ ID NO: 4789819 - DNA, 12 bp, Homo sapiens
acggggcagagc

SEQ ID NO: 4789820 - DNA, 21 bp, Homo sapiens
acgtagcaaatcgtacattgt

SEQ ID NO: 4789821 - DNA, 18 bp, Homo sapiens
acgtattgttaaatgata

SEQ ID NO: 4789822 - DNA, 18 bp, Homo sapiens
acgtccctcgagctctgt

SEQ ID NO: 4789823 - DNA, 19 bp, Homo sapiens
acgtcctgggtgctgtcat

SEQ ID NO: 4789824 - DNA, 13 bp, Homo sapiens
acgtcgctgtccg

SEQ ID NO: 4789825 - DNA, 12 bp, Homo sapiens
acgtctgtgagt

SEQ ID NO: 4789826 - DNA, 20 bp, Homo sapiens
acgtctgtgagtctgtcctt

SEQ ID NO: 4789827 - DNA, 15 bp, Homo sapiens
acgtgaccctgtgcc

SEQ ID NO: 4789828 - DNA, 16 bp, Homo sapiens
acgtgaccctgtgccc

SEQ ID NO: 4789829 - DNA, 21 bp, Homo sapiens
acgtgatgtgctcatcagaaa

SEQ ID NO: 4789830 - DNA, 19 bp, Homo sapiens
acgtgcaatttgtttgtgc

SEQ ID NO: 4789831 - DNA, 22 bp, Homo sapiens
acgtgcaatttgtttgtgcttc

SEQ ID NO: 4789832 - DNA, 14 bp, Homo sapiens
acgtgcccatttca

SEQ ID NO: 4789833 - DNA, 15 bp, Homo sapiens
acgtggccgctgccc

SEQ ID NO: 4789834 - DNA, 12 bp, Homo sapiens
acgtgtgtggtc

SEQ ID NO: 4789835 - DNA, 15 bp, Homo sapiens
acgtgttattattat

SEQ ID NO: 4789836 - DNA, 15 bp, Homo sapiens
acgtgtttcgggcca

SEQ ID NO: 4789837 - DNA, 17 bp, Homo sapiens
acgtgtttcgggccagg

SEQ ID NO: 4789838 - DNA, 13 bp, Homo sapiens
acgttaaagtagg

SEQ ID NO: 4789839 - DNA, 14 bp, Homo sapiens
acgttcatgttcat

SEQ ID NO: 4789840 - DNA, 13 bp, Homo sapiens
actaaaagtgatg

SEQ ID NO: 4789841 - DNA, 21 bp, Homo sapiens
actaaaagtgatgtgatttat

SEQ ID NO: 4789842 - DNA, 16 bp, Homo sapiens
actaaaatccacccag

SEQ ID NO: 4789843 - DNA, 14 bp, Homo sapiens
actaaatagatttt

SEQ ID NO: 4789844 - DNA, 19 bp, Homo sapiens
actaaatagatttttagat

SEQ ID NO: 4789845 - DNA, 20 bp, Homo sapiens
actaacgaccgacgcccctc

SEQ ID NO: 4789846 - DNA, 22 bp, Homo sapiens
actaacgaccgacgcccctccg

SEQ ID NO: 4789847 - DNA, 13 bp, Homo sapiens
actaactgaggag

SEQ ID NO: 4789848 - DNA, 17 bp, Homo sapiens
actaacttattttgatt

SEQ ID NO: 4789849 - DNA, 23 bp, Homo sapiens
actaagtaacctctacaggcatt

SEQ ID NO: 4789850 - DNA, 16 bp, Homo sapiens
actaataaaatacata

SEQ ID NO: 4789851 - DNA, 21 bp, Homo sapiens
actaatgaatgcaaaaagata

SEQ ID NO: 4789852 - DNA, 21 bp, Homo sapiens
actaatgacaagtgacttatt

SEQ ID NO: 4789853 - DNA, 23 bp, Homo sapiens
actaatgtaaatattgctgtctg

SEQ ID NO: 4789854 - DNA, 18 bp, Homo sapiens
actacagacattaaataa

SEQ ID NO: 4789855 - DNA, 16 bp, Homo sapiens
actacatctgatatca

SEQ ID NO: 4789856 - DNA, 13 bp, Homo sapiens
actacatttgcat

SEQ ID NO: 4789857 - DNA, 20 bp, Homo sapiens
actaccaccctcgctgccac

SEQ ID NO: 4789858 - DNA, 20 bp, Homo sapiens
actacccatcggtgtccatt

SEQ ID NO: 4789859 - DNA, 14 bp, Homo sapiens
actacctataaatg

SEQ ID NO: 4789860 - DNA, 11 bp, Homo sapiens
actactgcctt

SEQ ID NO: 4789861 - DNA, 18 bp, Homo sapiens
actactgcctttcaaagt

SEQ ID NO: 4789862 - DNA, 14 bp, Homo sapiens
actagaatgagaaa

SEQ ID NO: 4789863 - DNA, 15 bp, Homo sapiens
actagaatgagaaat

SEQ ID NO: 4789864 - DNA, 18 bp, Homo sapiens
actagagatattttgtaa

SEQ ID NO: 4789865 - DNA, 19 bp, Homo sapiens
actagagatattttgtaaa

SEQ ID NO: 4789866 - DNA, 14 bp, Homo sapiens
actagagtatgtgt

SEQ ID NO: 4789867 - DNA, 13 bp, Homo sapiens
actagatctcctg

SEQ ID NO: 4789868 - DNA, 17 bp, Homo sapiens
actagatctcctgtaat

SEQ ID NO: 4789869 - DNA, 13 bp, Homo sapiens
actagcaataagt

SEQ ID NO: 4789870 - DNA, 14 bp, Homo sapiens
actagcaataagtt

SEQ ID NO: 4789871 - DNA, 20 bp, Homo sapiens
actagcaataagttgaatga

SEQ ID NO: 4789872 - DNA, 21 bp, Homo sapiens
actagcactttataagccaat

SEQ ID NO: 4789873 - DNA, 23 bp, Homo sapiens
actagccctctttctctctgtgt

SEQ ID NO: 4789874 - DNA, 20 bp, Homo sapiens
actaggtgcccagtcttgag

SEQ ID NO: 4789875 - DNA, 22 bp, Homo sapiens
actagtatcactgctttttcct

SEQ ID NO: 4789876 - DNA, 18 bp, Homo sapiens
actatagattctttatta

SEQ ID NO: 4789877 - DNA, 13 bp, Homo sapiens
actatcagcagcg

SEQ ID NO: 4789878 - DNA, 16 bp, Homo sapiens
actatcagggcaagct

SEQ ID NO: 4789879 - DNA, 19 bp, Homo sapiens
actatcagggcaagctcat

SEQ ID NO: 4789880 - DNA, 22 bp, Homo sapiens
actatggtatatattttgaaag

SEQ ID NO: 4789881 - DNA, 20 bp, Homo sapiens
actatggtatgctggccagc

SEQ ID NO: 4789882 - DNA, 21 bp, Homo sapiens
actatggtatgctggccagca

SEQ ID NO: 4789883 - DNA, 15 bp, Homo sapiens
actatgtgtcatgat

SEQ ID NO: 4789884 - DNA, 16 bp, Homo sapiens
actatgtgtcatgatt

SEQ ID NO: 4789885 - DNA, 23 bp, Homo sapiens
actattctaaggagcaaatacct

SEQ ID NO: 4789886 - DNA, 15 bp, Homo sapiens
actcaaaatgcagga

SEQ ID NO: 4789887 - DNA, 21 bp, Homo sapiens
actcaaagaggccagtacttt

SEQ ID NO: 4789888 - DNA, 14 bp, Homo sapiens
actcaagatactgg

SEQ ID NO: 4789889 - DNA, 17 bp, Homo sapiens
actcacagactgctgtc

SEQ ID NO: 4789890 - DNA, 17 bp, Homo sapiens
actcaccatttaatcat

SEQ ID NO: 4789891 - DNA, 18 bp, Homo sapiens
actcaccatttaatcatt

SEQ ID NO: 4789892 - DNA, 19 bp, Homo sapiens
actcagcaactgttagctg

SEQ ID NO: 4789893 - DNA, 17 bp, Homo sapiens
actcaggagcacagcca

SEQ ID NO: 4789894 - DNA, 20 bp, Homo sapiens
actcaggagcacagccatag

SEQ ID NO: 4789895 - DNA, 14 bp, Homo sapiens
actcaggctttcta

SEQ ID NO: 4789896 - DNA, 23 bp, Homo sapiens
actcaggtttccggctactgaca

SEQ ID NO: 4789897 - DNA, 20 bp, Homo sapiens
actcagtaaatcagtgcagt

SEQ ID NO: 4789898 - DNA, 18 bp, Homo sapiens
actcagtaacagtgcagt

SEQ ID NO: 4789899 - DNA, 21 bp, Homo sapiens
actcatacagtctctatttga

SEQ ID NO: 4789900 - DNA, 22 bp, Homo sapiens
actcatacagtctctatttgat

SEQ ID NO: 4789901 - DNA, 18 bp, Homo sapiens
actcatccattaatgtag

SEQ ID NO: 4789902 - DNA, 20 bp, Homo sapiens
actcatcccccatcagatga

SEQ ID NO: 4789903 - DNA, 14 bp, Homo sapiens
actccaagccctgg

SEQ ID NO: 4789904 - DNA, 16 bp, Homo sapiens
actccaagccctgggg

SEQ ID NO: 4789905 - DNA, 17 bp, Homo sapiens
actccaaggcaaatgtc

SEQ ID NO: 4789906 - DNA, 14 bp, Homo sapiens
actccaaggtggca

SEQ ID NO: 4789907 - DNA, 20 bp, Homo sapiens
actccaagtgggtcaattcc

SEQ ID NO: 4789908 - DNA, 17 bp, Homo sapiens
actccaggaaaactgtt

SEQ ID NO: 4789909 - DNA, 21 bp, Homo sapiens
actccaggaaaactgtttttc

SEQ ID NO: 4789910 - DNA, 17 bp, Homo sapiens
actccaggggctgggga

SEQ ID NO: 4789911 - DNA, 19 bp, Homo sapiens
actccagggttaaagaaag

SEQ ID NO: 4789912 - DNA, 21 bp, Homo sapiens
actccagggttaaagaaaggc

SEQ ID NO: 4789913 - DNA, 19 bp, Homo sapiens
actccatggtgaactgaag

SEQ ID NO: 4789914 - DNA, 12 bp, Homo sapiens
actccattctcc

SEQ ID NO: 4789915 - DNA, 14 bp, Homo sapiens
actcccagggcccg

SEQ ID NO: 4789916 - DNA, 20 bp, Homo sapiens
actccccgcccgccctcctc

SEQ ID NO: 4789917 - DNA, 18 bp, Homo sapiens
actcccttctcccctcag

SEQ ID NO: 4789918 - DNA, 14 bp, Homo sapiens
actccgtttccaaa

SEQ ID NO: 4789919 - DNA, 14 bp, Homo sapiens
actcctccccctcc

SEQ ID NO: 4789920 - DNA, 16 bp, Homo sapiens
actcctccccctcctc

SEQ ID NO: 4789921 - DNA, 18 bp, Homo sapiens
actcctccccctcctcca

SEQ ID NO: 4789922 - DNA, 13 bp, Homo sapiens
atatcattcagaa

SEQ ID NO: 4789923 - DNA, 14 bp, Homo sapiens
atatcattcagaat

SEQ ID NO: 4789924 - DNA, 13 bp, Homo sapiens
atatcatttcata

SEQ ID NO: 4789925 - DNA, 16 bp, Homo sapiens
atatcattttcctggg

SEQ ID NO: 4789926 - DNA, 14 bp, Homo sapiens
atatcctgaataac

SEQ ID NO: 4789927 - DNA, 19 bp, Homo sapiens
atatctatttatctgtctg

SEQ ID NO: 4789928 - DNA, 23 bp, Homo sapiens
atatctatttatctgtctgagcc

SEQ ID NO: 4789929 - DNA, 23 bp, Homo sapiens
atatctgaaaactggaataagaa

SEQ ID NO: 4789930 - DNA, 15 bp, Homo sapiens
atatctgtgaaatat

SEQ ID NO: 4789931 - DNA, 18 bp, Homo sapiens
atatctgtggtcttcaaa

SEQ ID NO: 4789932 - DNA, 16 bp, Homo sapiens
atatcttcatttctaa

SEQ ID NO: 4789933 - DNA, 18 bp, Homo sapiens
atatcttcatttctaaat

SEQ ID NO: 4789934 - DNA, 23 bp, Homo sapiens
atatcttcgttagtaatctgtat

SEQ ID NO: 4789935 - DNA, 16 bp, Homo sapiens
atatcttgaagaatat

SEQ ID NO: 4789936 - DNA, 14 bp, Homo sapiens
atatgaaagagaaa

SEQ ID NO: 4789937 - DNA, 16 bp, Homo sapiens
atatgaagcagaatga

SEQ ID NO: 4789938 - DNA, 20 bp, Homo sapiens
atatgaagtaagttctgaaa

SEQ ID NO: 4789939 - DNA, 14 bp, Homo sapiens
atatgacttcttgt

SEQ ID NO: 4789940 - DNA, 18 bp, Homo sapiens
atatgacttcttgttcat

SEQ ID NO: 4789941 - DNA, 14 bp, Homo sapiens
atatgagattggaa

SEQ ID NO: 4789942 - DNA, 16 bp, Homo sapiens
atatgagattggaaaa

SEQ ID NO: 4789943 - DNA, 13 bp, Homo sapiens
atatgatatgcat

SEQ ID NO: 4789944 - DNA, 17 bp, Homo sapiens
atatgattctcctctcc

SEQ ID NO: 4789945 - DNA, 14 bp, Homo sapiens
atatgcatgtagca

SEQ ID NO: 4789946 - DNA, 22 bp, Homo sapiens
atatgcctgggcagaaggaaga

SEQ ID NO: 4789947 - DNA, 16 bp, Homo sapiens
atatggaaatcctgtt

SEQ ID NO: 4789948 - DNA, 20 bp, Homo sapiens
atatggaaccttccctccaa

SEQ ID NO: 4789949 - DNA, 15 bp, Homo sapiens
atatgtaatatatac

SEQ ID NO: 4789950 - DNA, 13 bp, Homo sapiens
atatgtatatctg

SEQ ID NO: 4789951 - DNA, 15 bp, Homo sapiens
atatgtatgtaaaaa

SEQ ID NO: 4789952 - DNA, 14 bp, Homo sapiens
atatgtatgtgtga

SEQ ID NO: 4789953 - DNA, 18 bp, Homo sapiens
atatgtcagtcactaaaa

SEQ ID NO: 4789954 - DNA, 14 bp, Homo sapiens
atatgtctttaaaa

SEQ ID NO: 4789955 - DNA, 16 bp, Homo sapiens
atatgtgcttgtgtgt

SEQ ID NO: 4789956 - DNA, 18 bp, Homo sapiens
atatgtgcttgtgtgtat

SEQ ID NO: 4789957 - DNA, 21 bp, Homo sapiens
atatgtgcttgtgtgtatgtc

SEQ ID NO: 4789958 - DNA, 14 bp, Homo sapiens
atatgtgtaacttt

SEQ ID NO: 4789959 - DNA, 15 bp, Homo sapiens
atatgtgtaatatca

SEQ ID NO: 4789960 - DNA, 17 bp, Homo sapiens
atatgttattttaaaca

SEQ ID NO: 4789961 - DNA, 13 bp, Homo sapiens
atatgttgctgaa

SEQ ID NO: 4789962 - DNA, 16 bp, Homo sapiens
atatgttgctgaaaca

SEQ ID NO: 4789963 - DNA, 23 bp, Homo sapiens
atattaaaaagccaagtgtcctg

SEQ ID NO: 4789964 - DNA, 17 bp, Homo sapiens
atattaaaaattaattc

SEQ ID NO: 4789965 - DNA, 19 bp, Homo sapiens
atattaaaaattaattctt

SEQ ID NO: 4789966 - DNA, 20 bp, Homo sapiens
atattaagcacattattgta

SEQ ID NO: 4789967 - DNA, 14 bp, Homo sapiens
atattaccctcaga

SEQ ID NO: 4789968 - DNA, 18 bp, Homo sapiens
atattaccctcagaatat

SEQ ID NO: 4789969 - DNA, 23 bp, Homo sapiens
atattagagtgcccttaaaataa

SEQ ID NO: 4789970 - DNA, 16 bp, Homo sapiens
atattataagttgacc

SEQ ID NO: 4789971 - DNA, 12 bp, Homo sapiens
atattattttct

SEQ ID NO: 4789972 - DNA, 20 bp, Homo sapiens
atattcaccatccccacccc

SEQ ID NO: 4789973 - DNA, 23 bp, Homo sapiens
atattcagagatgtaccatgtta

SEQ ID NO: 4789974 - DNA, 14 bp, Homo sapiens
atattcccatggta

SEQ ID NO: 4789975 - DNA, 10 bp, Homo sapiens
atattctgtc

SEQ ID NO: 4789976 - DNA, 21 bp, Homo sapiens
atattgacaagtttaaaggct

SEQ ID NO: 4789977 - DNA, 14 bp, Homo sapiens
atattgagcagaat

SEQ ID NO: 4789978 - DNA, 13 bp, Homo sapiens
atattgataataa

SEQ ID NO: 4789979 - DNA, 19 bp, Homo sapiens
atattgataataaaattca

SEQ ID NO: 4789980 - DNA, 20 bp, Homo sapiens
atattgataataaaattcat

SEQ ID NO: 4789981 - DNA, 15 bp, Homo sapiens
atattgatctgtatt

SEQ ID NO: 4789982 - DNA, 12 bp, Homo sapiens
atattgctgtct

SEQ ID NO: 4789983 - DNA, 15 bp, Homo sapiens
atattgcttggacta

SEQ ID NO: 4789984 - DNA, 13 bp, Homo sapiens
atattgtattatc

SEQ ID NO: 4789985 - DNA, 14 bp, Homo sapiens
atattgtattatca

SEQ ID NO: 4789986 - DNA, 16 bp, Homo sapiens
atattgtattatcata

SEQ ID NO: 4789987 - DNA, 17 bp, Homo sapiens
atattgtattatcatat

SEQ ID NO: 4789988 - DNA, 19 bp, Homo sapiens
atattgtattatcatatat

SEQ ID NO: 4789989 - DNA, 12 bp, Homo sapiens
atattgtgtagg

SEQ ID NO: 4789990 - DNA, 18 bp, Homo sapiens
atattgtttaatgcaaat

SEQ ID NO: 4789991 - DNA, 17 bp, Homo sapiens
atattgttttataaatg

SEQ ID NO: 4789992 - DNA, 16 bp, Homo sapiens
atattgtttttatata

SEQ ID NO: 4789993 - DNA, 17 bp, Homo sapiens
atattgtttttatatat

SEQ ID NO: 4789994 - DNA, 19 bp, Homo sapiens
atattgtttttatatatta

SEQ ID NO: 4789995 - DNA, 14 bp, Homo sapiens
atatttaaaacttt

SEQ ID NO: 4789996 - DNA, 21 bp, Homo sapiens
atatttacaatgtattaagcc

SEQ ID NO: 4789997 - DNA, 19 bp, Homo sapiens
atatttcacttaaactttg

SEQ ID NO: 4789998 - DNA, 17 bp, Homo sapiens
atatttctcatttagca

SEQ ID NO: 4789999 - DNA, 18 bp, Homo sapiens
atatttgcttatttatat

SEQ ID NO: 4790000 - DNA, 19 bp, Homo sapiens
atatttgcttatttatatt

SEQ ID NO: 4790001 - DNA, 20 bp, Homo sapiens
atatttgcttatttatattc

SEQ ID NO: 4790002 - DNA, 16 bp, Homo sapiens
atatttggattcacag

SEQ ID NO: 4790003 - DNA, 16 bp, Homo sapiens
atatttggtgatgaga

SEQ ID NO: 4790004 - DNA, 23 bp, Homo sapiens
atatttgtttagttcagcaaaac

SEQ ID NO: 4790005 - DNA, 15 bp, Homo sapiens
atattttatttcaat

SEQ ID NO: 4790006 - DNA, 17 bp, Homo sapiens
atattttatttcaatgt

SEQ ID NO: 4790007 - DNA, 21 bp, Homo sapiens
atattttatttcaatgtaatt

SEQ ID NO: 4790008 - DNA, 12 bp, Homo sapiens
atattttcttaa

SEQ ID NO: 4790009 - DNA, 16 bp, Homo sapiens
atcaaacaaatcattt

SEQ ID NO: 4790010 - DNA, 18 bp, Homo sapiens
atcaaagactccgagaag

SEQ ID NO: 4790011 - DNA, 11 bp, Homo sapiens
atcaaagccct

SEQ ID NO: 4790012 - DNA, 22 bp, Homo sapiens
atcaaagccctccctgtctgtc

SEQ ID NO: 4790013 - DNA, 15 bp, Homo sapiens
atcaacaaagaaata

SEQ ID NO: 4790014 - DNA, 14 bp, Homo sapiens
atcaagatgggtga

SEQ ID NO: 4790015 - DNA, 15 bp, Homo sapiens
atcaaggagggagaa

SEQ ID NO: 4790016 - DNA, 12 bp, Homo sapiens
atcaaggtgctc

SEQ ID NO: 4790017 - DNA, 19 bp, Homo sapiens
atcaaggtgctcttctcat

SEQ ID NO: 4790018 - DNA, 20 bp, Homo sapiens
atcaaggtgctcttctcatt

SEQ ID NO: 4790019 - DNA, 20 bp, Homo sapiens
atcaagtattactaaattga

SEQ ID NO: 4790020 - DNA, 15 bp, Homo sapiens
atcaagtcccgaggc

SEQ ID NO: 4790021 - DNA, 13 bp, Homo sapiens
atcaatcattgta

SEQ ID NO: 4790022 - DNA, 15 bp, Homo sapiens
atcaatcattttcta

SEQ ID NO: 4790023 - DNA, 19 bp, Homo sapiens
atcaattgggttttgatct

SEQ ID NO: 4790024 - DNA, 16 bp, Homo sapiens
atcacatgcccctctt

SEQ ID NO: 4790025 - DNA, 19 bp, Homo sapiens
atcaccacagctgcagcca

SEQ ID NO: 4790026 - DNA, 20 bp, Homo sapiens
atcaccgattcttccttgcc

SEQ ID NO: 4790027 - DNA, 19 bp, Homo sapiens
atcacctgaattattaatg

SEQ ID NO: 4790028 - DNA, 16 bp, Homo sapiens
atcacgggcccgctca

SEQ ID NO: 4790029 - DNA, 17 bp, Homo sapiens
atcactaaatatctagt

SEQ ID NO: 4790030 - DNA, 18 bp, Homo sapiens
atcactaaatatctagtg

SEQ ID NO: 4790031 - DNA, 15 bp, Homo sapiens
atcactatccatgca

SEQ ID NO: 4790032 - DNA, 18 bp, Homo sapiens
atcactgaaatccctcta

SEQ ID NO: 4790033 - DNA, 22 bp, Homo sapiens
atcactgtgcagttgctgttta

SEQ ID NO: 4790034 - DNA, 19 bp, Homo sapiens
atcagaactcctttctaag

SEQ ID NO: 4790035 - DNA, 18 bp, Homo sapiens
atcagaatggaagagaga

SEQ ID NO: 4790036 - DNA, 19 bp, Homo sapiens
atcagagtgtatttttgta

SEQ ID NO: 4790037 - DNA, 12 bp, Homo sapiens
atcagcactgaa

SEQ ID NO: 4790038 - DNA, 13 bp, Homo sapiens
atcagcactgaaa

SEQ ID NO: 4790039 - DNA, 14 bp, Homo sapiens
atcagcactgccaa

SEQ ID NO: 4790040 - DNA, 17 bp, Homo sapiens
atcagcagacactccag

SEQ ID NO: 4790041 - DNA, 14 bp, Homo sapiens
atcagctctaaagc

SEQ ID NO: 4790042 - DNA, 15 bp, Homo sapiens
atcagctctgcataa

SEQ ID NO: 4790043 - DNA, 22 bp, Homo sapiens
atcagctttataataaactgtt

SEQ ID NO: 4790044 - DNA, 22 bp, Homo sapiens
atcaggaaaggaagatgtaaga

SEQ ID NO: 4790045 - DNA, 14 bp, Homo sapiens
atcaggaagagaag

SEQ ID NO: 4790046 - DNA, 19 bp, Homo sapiens
atcaggaagagaaggagca

SEQ ID NO: 4790047 - DNA, 18 bp, Homo sapiens
atcaggcctaatctcata

SEQ ID NO: 4790048 - DNA, 23 bp, Homo sapiens
atcagggcaagctcatagcacat

SEQ ID NO: 4790049 - DNA, 19 bp, Homo sapiens
atcagggcccaaataacag

SEQ ID NO: 4790050 - DNA, 18 bp, Homo sapiens
atcaggtcagagcccagg

SEQ ID NO: 4790051 - DNA, 13 bp, Homo sapiens
atcagtaaaatta

SEQ ID NO: 4790052 - DNA, 19 bp, Homo sapiens
atcagtaaaattatactgt

SEQ ID NO: 4790053 - DNA, 14 bp, Homo sapiens
atcagtacaattct

SEQ ID NO: 4790054 - DNA, 18 bp, Homo sapiens
atcagtacaattctttgt

SEQ ID NO: 4790055 - DNA, 23 bp, Homo sapiens
atcagtacaattctttgttgctt

SEQ ID NO: 4790056 - DNA, 16 bp, Homo sapiens
atcagtcaattgcttg

SEQ ID NO: 4790057 - DNA, 22 bp, Homo sapiens
atcagtccacccccattgtgaa

SEQ ID NO: 4790058 - DNA, 16 bp, Homo sapiens
atcagtgaatataaat

SEQ ID NO: 4790059 - DNA, 20 bp, Homo sapiens
atcagtgaatataaatgtac

SEQ ID NO: 4790060 - DNA, 14 bp, Homo sapiens
atcagtgtttatgt

SEQ ID NO: 4790061 - DNA, 22 bp, Homo sapiens
atcagtgtttatgtgctattaa

SEQ ID NO: 4790062 - DNA, 15 bp, Homo sapiens
atcagttacagtggc

SEQ ID NO: 4790063 - DNA, 23 bp, Homo sapiens
atcatacttgctccttgaataag

SEQ ID NO: 4790064 - DNA, 13 bp, Homo sapiens
atcatataaatat

SEQ ID NO: 4790065 - DNA, 17 bp, Homo sapiens
atcatatatgctttttt

SEQ ID NO: 4790066 - DNA, 16 bp, Homo sapiens
atcatatctgtatgcc

SEQ ID NO: 4790067 - DNA, 15 bp, Homo sapiens
atcatcttgaacatt

SEQ ID NO: 4790068 - DNA, 18 bp, Homo sapiens
atcatgacttctttacta

SEQ ID NO: 4790069 - DNA, 18 bp, Homo sapiens
atcatgggcattgctgga

SEQ ID NO: 4790070 - DNA, 13 bp, Homo sapiens
atcattctccttg

SEQ ID NO: 4790071 - DNA, 18 bp, Homo sapiens
atcattgccctcttcaag

SEQ ID NO: 4790072 - DNA, 20 bp, Homo sapiens
atcattggtatctgatatct

SEQ ID NO: 4790073 - DNA, 16 bp, Homo sapiens
atcattgtacagtttg

SEQ ID NO: 4790074 - DNA, 15 bp, Homo sapiens
atcatttcattcgtg

SEQ ID NO: 4790075 - DNA, 16 bp, Homo sapiens
atcatttccagcaaaa

SEQ ID NO: 4790076 - DNA, 19 bp, Homo sapiens
atcattttccaattaatta

SEQ ID NO: 4790077 - DNA, 15 bp, Homo sapiens
atcattttcctggga

SEQ ID NO: 4790078 - DNA, 13 bp, Homo sapiens
atcattttgatgt

SEQ ID NO: 4790079 - DNA, 15 bp, Homo sapiens
atccaaacctacctt

SEQ ID NO: 4790080 - DNA, 19 bp, Homo sapiens
atccaaagtccccattcag

SEQ ID NO: 4790081 - DNA, 14 bp, Homo sapiens
atccaactatttct

SEQ ID NO: 4790082 - DNA, 17 bp, Homo sapiens
atccaactggaaggctt

SEQ ID NO: 4790083 - DNA, 21 bp, Homo sapiens
atccaactggaaggctttatt

SEQ ID NO: 4790084 - DNA, 15 bp, Homo sapiens
atccaagcccagcct

SEQ ID NO: 4790085 - DNA, 21 bp, Homo sapiens
atccaaggaacttcatgcttg

SEQ ID NO: 4790086 - DNA, 21 bp, Homo sapiens
atccaaggaagggatgtattt

SEQ ID NO: 4790087 - DNA, 22 bp, Homo sapiens
atccaagtattttatctgtgtt

SEQ ID NO: 4790088 - DNA, 19 bp, Homo sapiens
atccaatagtctgccacaa

SEQ ID NO: 4790089 - DNA, 16 bp, Homo sapiens
atccacacacagcagc

SEQ ID NO: 4790090 - DNA, 16 bp, Homo sapiens
atccacatgtttcaga

SEQ ID NO: 4790091 - DNA, 15 bp, Homo sapiens
atccaccaccttgcc

SEQ ID NO: 4790092 - DNA, 11 bp, Homo sapiens
atccaccctga

SEQ ID NO: 4790093 - DNA, 12 bp, Homo sapiens
atccaccctgag

SEQ ID NO: 4790094 - DNA, 14 bp, Homo sapiens
atccaccctgagga

SEQ ID NO: 4790095 - DNA, 11 bp, Homo sapiens
atccacctggt

SEQ ID NO: 4790096 - DNA, 15 bp, Homo sapiens
atccagagacctgct

SEQ ID NO: 4790097 - DNA, 20 bp, Homo sapiens
atccagagacctgctccaga

SEQ ID NO: 4790098 - DNA, 24 bp, Homo sapiens
atccagagacctgctccagatcct

SEQ ID NO: 4790099 - DNA, 13 bp, Homo sapiens
atccagcggggct

SEQ ID NO: 4790100 - DNA, 17 bp, Homo sapiens
atccagcggggcttctg

SEQ ID NO: 4790101 - DNA, 21 bp, Homo sapiens
atccagcggggcttctgggcg

SEQ ID NO: 4790102 - DNA, 21 bp, Homo sapiens
atccagtatcttgaagacttt

SEQ ID NO: 4790103 - DNA, 19 bp, Homo sapiens
atccataccccctgcccca

SEQ ID NO: 4790104 - DNA, 22 bp, Homo sapiens
atccataccccctgccccagag

SEQ ID NO: 4790105 - DNA, 14 bp, Homo sapiens
atccatatcagctc

SEQ ID NO: 4790106 - DNA, 20 bp, Homo sapiens
atccatccctggtgaaagag

SEQ ID NO: 4790107 - DNA, 16 bp, Homo sapiens
atccatcgatttgtat

SEQ ID NO: 4790108 - DNA, 21 bp, Homo sapiens
atccatcgatttgtattaatg

SEQ ID NO: 4790109 - DNA, 19 bp, Homo sapiens
atccatgatcaaaatgcat

SEQ ID NO: 4790110 - DNA, 21 bp, Homo sapiens
atccatgatcaaaatgcatac

SEQ ID NO: 4790111 - DNA, 15 bp, Homo sapiens
atccatgcaccaaac

SEQ ID NO: 4790112 - DNA, 14 bp, Homo sapiens
atccatgtgtcccc

SEQ ID NO: 4790113 - DNA, 21 bp, Homo sapiens
atccatgtgtcccccctgtgg

SEQ ID NO: 4790114 - DNA, 15 bp, Homo sapiens
atccattaatttaaa

SEQ ID NO: 4790115 - DNA, 16 bp, Homo sapiens
atccatttaaaacaag

SEQ ID NO: 4790116 - DNA, 19 bp, Homo sapiens
atccatttaaaacaagctg

SEQ ID NO: 4790117 - DNA, 22 bp, Homo sapiens
atccatttaaaacaagctgata

SEQ ID NO: 4790118 - DNA, 19 bp, Homo sapiens
atcccaaacccttcagtgc

SEQ ID NO: 4790119 - DNA, 11 bp, Homo sapiens
atcccaagtca

SEQ ID NO: 4790120 - DNA, 18 bp, Homo sapiens
atcccaagtcaaacagtg

SEQ ID NO: 4790121 - DNA, 14 bp, Homo sapiens
atcccagagttatt

SEQ ID NO: 4790122 - DNA, 14 bp, Homo sapiens
atcccatactctca

SEQ ID NO: 4790123 - DNA, 18 bp, Homo sapiens
atccccagtgccagctgg

SEQ ID NO: 4790124 - DNA, 18 bp, Homo sapiens
atccccataatgcttctt

SEQ ID NO: 4790125 - DNA, 21 bp, Homo sapiens
atccccatggaacagccctgc

SEQ ID NO: 4790126 - DNA, 23 bp, Homo sapiens
atcccctcgcttcataggcagag

SEQ ID NO: 4790127 - DNA, 15 bp, Homo sapiens
atccctccttaagag

SEQ ID NO: 4790128 - DNA, 13 bp, Homo sapiens
atccctgggcccc

SEQ ID NO: 4790129 - DNA, 16 bp, Homo sapiens
atcccttggcccctct

SEQ ID NO: 4790130 - DNA, 19 bp, Homo sapiens
atcccttggcccctctctg

SEQ ID NO: 4790131 - DNA, 14 bp, Homo sapiens
atccgagcccctgt

SEQ ID NO: 4790132 - DNA, 20 bp, Homo sapiens
atccgtaccatcggtcagca

SEQ ID NO: 4790133 - DNA, 23 bp, Homo sapiens
atcctagcactttgggaggctga

SEQ ID NO: 4790134 - DNA, 10 bp, Homo sapiens
atcctcagcc

SEQ ID NO: 4790135 - DNA, 14 bp, Homo sapiens
atcctcagccccag

SEQ ID NO: 4790136 - DNA, 15 bp, Homo sapiens
atcctcagccccagg

SEQ ID NO: 4790137 - DNA, 11 bp, Homo sapiens
atcctcctcag

SEQ ID NO: 4790138 - DNA, 14 bp, Homo sapiens
atcctcctcagatc

SEQ ID NO: 4790139 - DNA, 16 bp, Homo sapiens
atcctcctcagatctt

SEQ ID NO: 4790140 - DNA, 21 bp, Homo sapiens
atcctctcttcttttcccatt

SEQ ID NO: 4790141 - DNA, 20 bp, Homo sapiens
atcctcttatatgtgcccct

SEQ ID NO: 4790142 - DNA, 17 bp, Homo sapiens
atcctctttccccactg

SEQ ID NO: 4790143 - DNA, 21 bp, Homo sapiens
atcctgacagcgccatgtgtg

SEQ ID NO: 4790144 - DNA, 14 bp, Homo sapiens
atcctgcaccctct

SEQ ID NO: 4790145 - DNA, 16 bp, Homo sapiens
atcctgcaccctctgc

SEQ ID NO: 4790146 - DNA, 20 bp, Homo sapiens
atcctggaaatttgtgtgct

SEQ ID NO: 4790147 - DNA, 19 bp, Homo sapiens
atccttactttatctgggc

SEQ ID NO: 4790148 - DNA, 20 bp, Homo sapiens
atccttactttatctgggct

SEQ ID NO: 4790149 - DNA, 22 bp, Homo sapiens
atccttcaggtcccctggccct

SEQ ID NO: 4790150 - DNA, 14 bp, Homo sapiens
atccttcccgcagc

SEQ ID NO: 4790151 - DNA, 22 bp, Homo sapiens
atccttcccgcagcaccagcct

SEQ ID NO: 4790152 - DNA, 18 bp, Homo sapiens
atccttgcacttctgtta

SEQ ID NO: 4790153 - DNA, 23 bp, Homo sapiens
atccttttgcttcatctggagtc

SEQ ID NO: 4790154 - DNA, 15 bp, Homo sapiens
atcgagagtttctat

SEQ ID NO: 4790155 - DNA, 19 bp, Homo sapiens
atcgatctggaaagagctg

SEQ ID NO: 4790156 - DNA, 20 bp, Homo sapiens
atcgatgggggatgcttcat

SEQ ID NO: 4790157 - DNA, 23 bp, Homo sapiens
atcgatgggggatgcttcatgtg

SEQ ID NO: 4790158 - DNA, 14 bp, Homo sapiens
atcggcctcctctt

SEQ ID NO: 4790159 - DNA, 13 bp, Homo sapiens
atcggtcagcagg

SEQ ID NO: 4790160 - DNA, 15 bp, Homo sapiens
atcggtgtccattta

SEQ ID NO: 4790161 - DNA, 19 bp, Homo sapiens
atcgtttcacatctgtata

SEQ ID NO: 4790162 - DNA, 18 bp, Homo sapiens
atctacaaacttttataa

SEQ ID NO: 4790163 - DNA, 21 bp, Homo sapiens
atctacaaacttttataaatg

SEQ ID NO: 4790164 - DNA, 22 bp, Homo sapiens
atctacaaacttttataaatgt

SEQ ID NO: 4790165 - DNA, 22 bp, Homo sapiens
atctactcttaaatatacaact

SEQ ID NO: 4790166 - DNA, 21 bp, Homo sapiens
atctagaagagtctattgtct

SEQ ID NO: 4790167 - DNA, 19 bp, Homo sapiens
atctagtgctaaacctatc

SEQ ID NO: 4790168 - DNA, 20 bp, Homo sapiens
atctagtgctaaacctatct

SEQ ID NO: 4790169 - DNA, 22 bp, Homo sapiens
atctagtgctaaacctatctgt

SEQ ID NO: 4790170 - DNA, 13 bp, Homo sapiens
atctagtgtctaa

SEQ ID NO: 4790171 - DNA, 15 bp, Homo sapiens
atctatctctatata

SEQ ID NO: 4790172 - DNA, 21 bp, Homo sapiens
atctatctggtgatttctagc

SEQ ID NO: 4790173 - DNA, 21 bp, Homo sapiens
atctatgggagattaaaacca

SEQ ID NO: 4790174 - DNA, 19 bp, Homo sapiens
atctatttatctgtctgag

SEQ ID NO: 4790175 - DNA, 19 bp, Homo sapiens
atctcaacctacctcgagt

SEQ ID NO: 4790176 - DNA, 13 bp, Homo sapiens
atctcagctcact

SEQ ID NO: 4790177 - DNA, 14 bp, Homo sapiens
atctcagctcactg

SEQ ID NO: 4790178 - DNA, 15 bp, Homo sapiens
atctcatacctctga

SEQ ID NO: 4790179 - DNA, 16 bp, Homo sapiens
atctcatcatgtctat

SEQ ID NO: 4790180 - DNA, 13 bp, Homo sapiens
atctccaggccca

SEQ ID NO: 4790181 - DNA, 14 bp, Homo sapiens
atctccaggcccag

SEQ ID NO: 4790182 - DNA, 22 bp, Homo sapiens
atctccaggcccagcctggccc

SEQ ID NO: 4790183 - DNA, 21 bp, Homo sapiens
atctcctgtgcacctgacttt

SEQ ID NO: 4790184 - DNA, 17 bp, Homo sapiens
atctctatataaaaaat

SEQ ID NO: 4790185 - DNA, 15 bp, Homo sapiens
atctctcaaaatgtg

SEQ ID NO: 4790186 - DNA, 19 bp, Homo sapiens
atctctcaaaatgtgccgt

SEQ ID NO: 4790187 - DNA, 16 bp, Homo sapiens
atctctctggggccct

SEQ ID NO: 4790188 - DNA, 19 bp, Homo sapiens
atctctgttctttcatact

SEQ ID NO: 4790189 - DNA, 19 bp, Homo sapiens
atctcttgtaccagcccag

SEQ ID NO: 4790190 - DNA, 20 bp, Homo sapiens
atctcttgtaccagcccagg

SEQ ID NO: 4790191 - DNA, 17 bp, Homo sapiens
atctcttgtcattctca

SEQ ID NO: 4790192 - DNA, 18 bp, Homo sapiens
atctcttgtcattctcat

SEQ ID NO: 4790193 - DNA, 13 bp, Homo sapiens
atctctttctctc

SEQ ID NO: 4790194 - DNA, 23 bp, Homo sapiens
atctctttctctctttccatctc

SEQ ID NO: 4790195 - DNA, 18 bp, Homo sapiens
atctgaaagttttgatac

SEQ ID NO: 4790196 - DNA, 22 bp, Homo sapiens
atctgaaagttttgatacttgt

SEQ ID NO: 4790197 - DNA, 17 bp, Homo sapiens
atctgaagccttttcct

SEQ ID NO: 4790198 - DNA, 14 bp, Homo sapiens
atctgaggagtcca

SEQ ID NO: 4790199 - DNA, 20 bp, Homo sapiens
atctgatatcaggaaatatc

SEQ ID NO: 4790200 - DNA, 22 bp, Homo sapiens
atctgatatcaggaaatatctg

SEQ ID NO: 4790201 - DNA, 14 bp, Homo sapiens
atctgatttctgaa

SEQ ID NO: 4790202 - DNA, 18 bp, Homo sapiens
atctgcactcctgtctct

SEQ ID NO: 4790203 - DNA, 22 bp, Homo sapiens
atctgcactcctgtctcttggg

SEQ ID NO: 4790204 - DNA, 20 bp, Homo sapiens
atctggaaaaaaaaaaatat

SEQ ID NO: 4790205 - DNA, 21 bp, Homo sapiens
atctggagtctgaaggagagg

SEQ ID NO: 4790206 - DNA, 15 bp, Homo sapiens
atctggattcaaatt

SEQ ID NO: 4790207 - DNA, 19 bp, Homo sapiens
atctggcctatgaccctgt

SEQ ID NO: 4790208 - DNA, 21 bp, Homo sapiens
atctggcctatgaccctgtgc

SEQ ID NO: 4790209 - DNA, 22 bp, Homo sapiens
atctggcctatgaccctgtgcc

SEQ ID NO: 4790210 - DNA, 12 bp, Homo sapiens
atctggcctggc

SEQ ID NO: 4790211 - DNA, 16 bp, Homo sapiens
atctggcctggcctgg

SEQ ID NO: 4790212 - DNA, 12 bp, Homo sapiens
atctgggcctgg

SEQ ID NO: 4790213 - DNA, 13 bp, Homo sapiens
atctgggcctggg

SEQ ID NO: 4790214 - DNA, 16 bp, Homo sapiens
atctgggcctgggcta

SEQ ID NO: 4790215 - DNA, 21 bp, Homo sapiens
atctgggcttaataagtcact

SEQ ID NO: 4790216 - DNA, 16 bp, Homo sapiens
atctggtattaaatgc

SEQ ID NO: 4790217 - DNA, 18 bp, Homo sapiens
atctgtaaaaccaggctg

SEQ ID NO: 4790218 - DNA, 17 bp, Homo sapiens
atctgtaaaatagtctc

SEQ ID NO: 4790219 - DNA, 21 bp, Homo sapiens
atctgtactatctagtgtcta

SEQ ID NO: 4790220 - DNA, 15 bp, Homo sapiens
atctgtataaatgtg

SEQ ID NO: 4790221 - DNA, 17 bp, Homo sapiens
atctgtataaatgtgaa

SEQ ID NO: 4790222 - DNA, 15 bp, Homo sapiens
atctgtataatactt

SEQ ID NO: 4790223 - DNA, 21 bp, Homo sapiens
atctgtataatactttgtata

SEQ ID NO: 4790224 - DNA, 13 bp, Homo sapiens
atctgtatgcctc

SEQ ID NO: 4790225 - DNA, 16 bp, Homo sapiens
atctgtattggcagca

SEQ ID NO: 4790226 - DNA, 20 bp, Homo sapiens
atctgtattggcagcacagc

SEQ ID NO: 4790227 - DNA, 21 bp, Homo sapiens
atctgtattggcagcacagct

SEQ ID NO: 4790228 - DNA, 15 bp, Homo sapiens
atctgtcagcttccc

SEQ ID NO: 4790229 - DNA, 17 bp, Homo sapiens
atctgtcagcttcccaa

SEQ ID NO: 4790230 - DNA, 16 bp, Homo sapiens
atctgtcatctctctg

SEQ ID NO: 4790231 - DNA, 17 bp, Homo sapiens
atctgtcatctctctgg

SEQ ID NO: 4790232 - DNA, 13 bp, Homo sapiens
atctgtccagaca

SEQ ID NO: 4790233 - DNA, 22 bp, Homo sapiens
atctgtccagacaagccctgct

SEQ ID NO: 4790234 - DNA, 18 bp, Homo sapiens
atctgtcgcatttcatca

SEQ ID NO: 4790235 - DNA, 15 bp, Homo sapiens
atctgtctgagccct

SEQ ID NO: 4790236 - DNA, 21 bp, Homo sapiens
atctgtctgagccctgccctc

SEQ ID NO: 4790237 - DNA, 13 bp, Homo sapiens
atctgtctttatg

SEQ ID NO: 4790238 - DNA, 15 bp, Homo sapiens
atctgtctttatgat

SEQ ID NO: 4790239 - DNA, 12 bp, Homo sapiens
atctgtgaaata

SEQ ID NO: 4790240 - DNA, 17 bp, Homo sapiens
atctgtgaaatatcatc

SEQ ID NO: 4790241 - DNA, 16 bp, Homo sapiens
atctgtggtcttcaaa

SEQ ID NO: 4790242 - DNA, 15 bp, Homo sapiens
atctgtgtgtgaatt

SEQ ID NO: 4790243 - DNA, 16 bp, Homo sapiens
atctgtgttgtctctc

SEQ ID NO: 4790244 - DNA, 14 bp, Homo sapiens
atctgttctatgga

SEQ ID NO: 4790245 - DNA, 20 bp, Homo sapiens
atctgttctatggaccaaat

SEQ ID NO: 4790246 - DNA, 18 bp, Homo sapiens
atctgttgggaaccagag

SEQ ID NO: 4790247 - DNA, 20 bp, Homo sapiens
atctgttgtaatatcagtta

SEQ ID NO: 4790248 - DNA, 23 bp, Homo sapiens
atcttaagattccattttggaaa

SEQ ID NO: 4790249 - DNA, 14 bp, Homo sapiens
atcttaatgtatat

SEQ ID NO: 4790250 - DNA, 17 bp, Homo sapiens
atcttaatgtatatcgt

SEQ ID NO: 4790251 - DNA, 13 bp, Homo sapiens
atcttatttatat

SEQ ID NO: 4790252 - DNA, 19 bp, Homo sapiens
atcttcaactaatttttga

SEQ ID NO: 4790253 - DNA, 22 bp, Homo sapiens
atcttcactgtcttactcaaga

SEQ ID NO: 4790254 - DNA, 21 bp, Homo sapiens
atcttcctagtgggccacccc

SEQ ID NO: 4790255 - DNA, 16 bp, Homo sapiens
atcttccttctcagcc

SEQ ID NO: 4790256 - DNA, 20 bp, Homo sapiens
atcttccttctcagccttgg

SEQ ID NO: 4790257 - DNA, 22 bp, Homo sapiens
atcttctgaacttggcgctgcc

SEQ ID NO: 4790258 - DNA, 17 bp, Homo sapiens
atcttgagcaaggcaag

SEQ ID NO: 4790259 - DNA, 11 bp, Homo sapiens
atcttgattaa

SEQ ID NO: 4790260 - DNA, 15 bp, Homo sapiens
atcttgcccttaata

SEQ ID NO: 4790261 - DNA, 18 bp, Homo sapiens
atcttgcctcattttgct

SEQ ID NO: 4790262 - DNA, 17 bp, Homo sapiens
atcttgctggagaagca

SEQ ID NO: 4790263 - DNA, 14 bp, Homo sapiens
atcttgctgtgaaa

SEQ ID NO: 4790264 - DNA, 15 bp, Homo sapiens
atcttgctgtgaaac

SEQ ID NO: 4790265 - DNA, 20 bp, Homo sapiens
atcttgggattcctcccctg

SEQ ID NO: 4790266 - DNA, 23 bp, Homo sapiens
atcttgggattcctcccctggaa

SEQ ID NO: 4790267 - DNA, 20 bp, Homo sapiens
atctttgagggctgacaagg

SEQ ID NO: 4790268 - DNA, 14 bp, Homo sapiens
atctttgtgacagg

SEQ ID NO: 4790269 - DNA, 21 bp, Homo sapiens
atctttgtgacaggaaagccc

SEQ ID NO: 4790270 - DNA, 12 bp, Homo sapiens
atctttgttaaa

SEQ ID NO: 4790271 - DNA, 17 bp, Homo sapiens
atgaaaaaaagggaaaa

SEQ ID NO: 4790272 - DNA, 17 bp, Homo sapiens
atgaaaaatctgaattt

SEQ ID NO: 4790273 - DNA, 18 bp, Homo sapiens
atgaaaatggctgaagaa

SEQ ID NO: 4790274 - DNA, 22 bp, Homo sapiens
atgaaaatggctgaagaaacac

SEQ ID NO: 4790275 - DNA, 19 bp, Homo sapiens
atgaaacaaatatactcat

SEQ ID NO: 4790276 - DNA, 15 bp, Homo sapiens
atgaaagcagcacac

SEQ ID NO: 4790277 - DNA, 23 bp, Homo sapiens
atgaaagcagcacacattgtgtt

SEQ ID NO: 4790278 - DNA, 21 bp, Homo sapiens
atgaaatataaactgtgagat

SEQ ID NO: 4790279 - DNA, 17 bp, Homo sapiens
atgaaatatatgtgaaa

SEQ ID NO: 4790280 - DNA, 13 bp, Homo sapiens
atgaaatgccaag

SEQ ID NO: 4790281 - DNA, 18 bp, Homo sapiens
atgaaatgccaagactct

SEQ ID NO: 4790282 - DNA, 14 bp, Homo sapiens
atgaaatgccagac

SEQ ID NO: 4790283 - DNA, 21 bp, Homo sapiens
atgaaatgccagacttctaaa

SEQ ID NO: 4790284 - DNA, 15 bp, Homo sapiens
atgaaatgttaacaa

SEQ ID NO: 4790285 - DNA, 15 bp, Homo sapiens
atgaaatttaagcac

SEQ ID NO: 4790286 - DNA, 16 bp, Homo sapiens
atgaaatttaagcaca

SEQ ID NO: 4790287 - DNA, 17 bp, Homo sapiens
atgaaatttaagcacaa

SEQ ID NO: 4790288 - DNA, 16 bp, Homo sapiens
atgaactaactgccat

SEQ ID NO: 4790289 - DNA, 17 bp, Homo sapiens
atgaagagctagagaaa

SEQ ID NO: 4790290 - DNA, 18 bp, Homo sapiens
atgaagagctagagaaat

SEQ ID NO: 4790291 - DNA, 23 bp, Homo sapiens
atgaagatgcattttaaatgtct

SEQ ID NO: 4790292 - DNA, 24 bp, Homo sapiens
atgaagatgcattttaaatgtcta

SEQ ID NO: 4790293 - DNA, 17 bp, Homo sapiens
atgaagcaaacacacag

SEQ ID NO: 4790294 - DNA, 14 bp, Homo sapiens
atgaagcagaatga

SEQ ID NO: 4790295 - DNA, 21 bp, Homo sapiens
atgaagccctaagtaaatcta

SEQ ID NO: 4790296 - DNA, 12 bp, Homo sapiens
agtgtgtacttc

SEQ ID NO: 4790297 - DNA, 17 bp, Homo sapiens
agtgtgtgtgcaatgtt

SEQ ID NO: 4790298 - DNA, 18 bp, Homo sapiens
agtgtgtgtgcaatgttc

SEQ ID NO: 4790299 - DNA, 13 bp, Homo sapiens
agtgtgttctgat

SEQ ID NO: 4790300 - DNA, 16 bp, Homo sapiens
agtgttaatccagaga

SEQ ID NO: 4790301 - DNA, 16 bp, Homo sapiens
agtgttagaaaaaact

SEQ ID NO: 4790302 - DNA, 16 bp, Homo sapiens
agtgttcaaattctga

SEQ ID NO: 4790303 - DNA, 20 bp, Homo sapiens
agtgttcaaattctgattat

SEQ ID NO: 4790304 - DNA, 16 bp, Homo sapiens
agtgttcagcatagag

SEQ ID NO: 4790305 - DNA, 20 bp, Homo sapiens
agtgttcttgggggtggggc

SEQ ID NO: 4790306 - DNA, 21 bp, Homo sapiens
agtgttgaggaggggagcaag

SEQ ID NO: 4790307 - DNA, 23 bp, Homo sapiens
agtgttgtcttattcctaattcc

SEQ ID NO: 4790308 - DNA, 13 bp, Homo sapiens
agtgtttatgtgc

SEQ ID NO: 4790309 - DNA, 23 bp, Homo sapiens
agtgtttccagtgacacaactca

SEQ ID NO: 4790310 - DNA, 22 bp, Homo sapiens
agtgtttcgttaagcagtacat

SEQ ID NO: 4790311 - DNA, 17 bp, Homo sapiens
agtgtttctagtaacag

SEQ ID NO: 4790312 - DNA, 15 bp, Homo sapiens
agtgtttttacatat

SEQ ID NO: 4790313 - DNA, 16 bp, Homo sapiens
agtgtttttacatata

SEQ ID NO: 4790314 - DNA, 19 bp, Homo sapiens
agttaagacaacaggcatt

SEQ ID NO: 4790315 - DNA, 14 bp, Homo sapiens
agttaatgtgccaa

SEQ ID NO: 4790316 - DNA, 14 bp, Homo sapiens
agttacagacaaag

SEQ ID NO: 4790317 - DNA, 21 bp, Homo sapiens
agttactgccacggtcctttg

SEQ ID NO: 4790318 - DNA, 17 bp, Homo sapiens
agttagcaggaaatagt

SEQ ID NO: 4790319 - DNA, 13 bp, Homo sapiens
agttagcccggcc

SEQ ID NO: 4790320 - DNA, 23 bp, Homo sapiens
agttagcccggccaaggacactg

SEQ ID NO: 4790321 - DNA, 21 bp, Homo sapiens
agttatccagagggttgtgat

SEQ ID NO: 4790322 - DNA, 18 bp, Homo sapiens
agttatttaccagaagtt

SEQ ID NO: 4790323 - DNA, 14 bp, Homo sapiens
agttcacaccctgc

SEQ ID NO: 4790324 - DNA, 17 bp, Homo sapiens
agttcacaccctgcaag

SEQ ID NO: 4790325 - DNA, 22 bp, Homo sapiens
agttcacaccctgcaaggccca

SEQ ID NO: 4790326 - DNA, 23 bp, Homo sapiens
agttcacaccctgcaaggcccac

SEQ ID NO: 4790327 - DNA, 13 bp, Homo sapiens
agttcatcttgaa

SEQ ID NO: 4790328 - DNA, 15 bp, Homo sapiens
agttcatcttgaatt

SEQ ID NO: 4790329 - DNA, 19 bp, Homo sapiens
agttccacaattttgtctc

SEQ ID NO: 4790330 - DNA, 21 bp, Homo sapiens
agttccacaattttgtctcta

SEQ ID NO: 4790331 - DNA, 20 bp, Homo sapiens
agttcccttgattcaaataa

SEQ ID NO: 4790332 - DNA, 23 bp, Homo sapiens
agttcctgggtttagctgtgaaa

SEQ ID NO: 4790333 - DNA, 23 bp, Homo sapiens
agttctacttcatgtaatccaaa

SEQ ID NO: 4790334 - DNA, 18 bp, Homo sapiens
agttctattatctgggtt

SEQ ID NO: 4790335 - DNA, 15 bp, Homo sapiens
agttctcatcttgta

SEQ ID NO: 4790336 - DNA, 12 bp, Homo sapiens
agttctctcctt

SEQ ID NO: 4790337 - DNA, 17 bp, Homo sapiens
agttctgaaaactgttt

SEQ ID NO: 4790338 - DNA, 22 bp, Homo sapiens
agttctgaaaactgtttatggt

SEQ ID NO: 4790339 - DNA, 12 bp, Homo sapiens
agttctgatgag

SEQ ID NO: 4790340 - DNA, 15 bp, Homo sapiens
agttctgcaaataga

SEQ ID NO: 4790341 - DNA, 15 bp, Homo sapiens
agttcttcctgtaat

SEQ ID NO: 4790342 - DNA, 14 bp, Homo sapiens
agttgaagacagag

SEQ ID NO: 4790343 - DNA, 22 bp, Homo sapiens
agttgaagggaaatcaatttaa

SEQ ID NO: 4790344 - DNA, 15 bp, Homo sapiens
agttgaatgataata

SEQ ID NO: 4790345 - DNA, 11 bp, Homo sapiens
agttgaccttt

SEQ ID NO: 4790346 - DNA, 17 bp, Homo sapiens
agttgacctttatttat

SEQ ID NO: 4790347 - DNA, 20 bp, Homo sapiens
agttgacctttatttattaa

SEQ ID NO: 4790348 - DNA, 15 bp, Homo sapiens
agttgacttcaaatg

SEQ ID NO: 4790349 - DNA, 18 bp, Homo sapiens
agttgatttaaactctta

SEQ ID NO: 4790350 - DNA, 17 bp, Homo sapiens
agttgcagtcagaagat

SEQ ID NO: 4790351 - DNA, 20 bp, Homo sapiens
agttgctactcttcagaata

SEQ ID NO: 4790352 - DNA, 14 bp, Homo sapiens
agttggaagggacc

SEQ ID NO: 4790353 - DNA, 20 bp, Homo sapiens
agttggacagcaaaaccatt

SEQ ID NO: 4790354 - DNA, 12 bp, Homo sapiens
agttggcctctg

SEQ ID NO: 4790355 - DNA, 15 bp, Homo sapiens
agttggttttgtaaa

SEQ ID NO: 4790356 - DNA, 21 bp, Homo sapiens
agttgtaggggaaatcaaggt

SEQ ID NO: 4790357 - DNA, 15 bp, Homo sapiens
agttgtcctttctga

SEQ ID NO: 4790358 - DNA, 17 bp, Homo sapiens
agttgtctgagctgctg

SEQ ID NO: 4790359 - DNA, 13 bp, Homo sapiens
agttgtcttacac

SEQ ID NO: 4790360 - DNA, 13 bp, Homo sapiens
agttgtgatctgt

SEQ ID NO: 4790361 - DNA, 18 bp, Homo sapiens
agttgtgatctgttgtaa

SEQ ID NO: 4790362 - DNA, 20 bp, Homo sapiens
agttgtgatctgttgtaata

SEQ ID NO: 4790363 - DNA, 14 bp, Homo sapiens
agtttaaaattatt

SEQ ID NO: 4790364 - DNA, 12 bp, Homo sapiens
agtttaaatctt

SEQ ID NO: 4790365 - DNA, 12 bp, Homo sapiens
agtttaacagaa

SEQ ID NO: 4790366 - DNA, 20 bp, Homo sapiens
agtttattatagtctgtact

SEQ ID NO: 4790367 - DNA, 22 bp, Homo sapiens
agtttattgccctcaaaatctt

SEQ ID NO: 4790368 - DNA, 19 bp, Homo sapiens
agtttcagataaatcatgg

SEQ ID NO: 4790369 - DNA, 21 bp, Homo sapiens
agtttcatttatgatacaaaa

SEQ ID NO: 4790370 - DNA, 19 bp, Homo sapiens
agtttccagctaagcctga

SEQ ID NO: 4790371 - DNA, 13 bp, Homo sapiens
agtttccatttgg

SEQ ID NO: 4790372 - DNA, 23 bp, Homo sapiens
agtttccatttggattttaaaca

SEQ ID NO: 4790373 - DNA, 21 bp, Homo sapiens
agtttctaaaccatgaaaagt

SEQ ID NO: 4790374 - DNA, 13 bp, Homo sapiens
agtttctaagaat

SEQ ID NO: 4790375 - DNA, 14 bp, Homo sapiens
agtttctaagaatt

SEQ ID NO: 4790376 - DNA, 16 bp, Homo sapiens
agtttctaagaattta

SEQ ID NO: 4790377 - DNA, 16 bp, Homo sapiens
agtttctatggattca

SEQ ID NO: 4790378 - DNA, 19 bp, Homo sapiens
agtttctatggattcactt

SEQ ID NO: 4790379 - DNA, 11 bp, Homo sapiens
agtttcttgca

SEQ ID NO: 4790380 - DNA, 14 bp, Homo sapiens
agtttctttacatt

SEQ ID NO: 4790381 - DNA, 16 bp, Homo sapiens
agtttgctaatgtttc

SEQ ID NO: 4790382 - DNA, 15 bp, Homo sapiens
agtttggtatgaaac

SEQ ID NO: 4790383 - DNA, 22 bp, Homo sapiens
agtttggtatgaaacaaatata

SEQ ID NO: 4790384 - DNA, 14 bp, Homo sapiens
agttttcaagcatt

SEQ ID NO: 4790385 - DNA, 21 bp, Homo sapiens
agttttctctttgtggggctt

SEQ ID NO: 4790386 - DNA, 16 bp, Homo sapiens
agttttcttttaattt

SEQ ID NO: 4790387 - DNA, 17 bp, Homo sapiens
agttttcttttaatttt

SEQ ID NO: 4790388 - DNA, 15 bp, Homo sapiens
agttttgatacttgt

SEQ ID NO: 4790389 - DNA, 18 bp, Homo sapiens
agttttgatacttgtaac

SEQ ID NO: 4790390 - DNA, 20 bp, Homo sapiens
agttttgatacttgtaactt

SEQ ID NO: 4790391 - DNA, 16 bp, Homo sapiens
ataaaaacataaaata

SEQ ID NO: 4790392 - DNA, 14 bp, Homo sapiens
ataaaaatactgac

SEQ ID NO: 4790393 - DNA, 16 bp, Homo sapiens
ataaaaattctagatt

SEQ ID NO: 4790394 - DNA, 11 bp, Homo sapiens
ataaaacagtg

SEQ ID NO: 4790395 - DNA, 12 bp, Homo sapiens
ataaaaccagaa

SEQ ID NO: 4790396 - DNA, 12 bp, Homo sapiens
ataaaagaaaga

SEQ ID NO: 4790397 - DNA, 15 bp, Homo sapiens
ataaaatctgtattg

SEQ ID NO: 4790398 - DNA, 14 bp, Homo sapiens
ataaaatggaaagg

SEQ ID NO: 4790399 - DNA, 21 bp, Homo sapiens
ataaaatggtgttttcatgta

SEQ ID NO: 4790400 - DNA, 18 bp, Homo sapiens
ataaaattcattccattt

SEQ ID NO: 4790401 - DNA, 23 bp, Homo sapiens
ataaacacatagattcacctgta

SEQ ID NO: 4790402 - DNA, 18 bp, Homo sapiens
ataaacacttctccttaa

SEQ ID NO: 4790403 - DNA, 19 bp, Homo sapiens
ataaacacttctccttaac

SEQ ID NO: 4790404 - DNA, 14 bp, Homo sapiens
ataaaccctccaag

SEQ ID NO: 4790405 - DNA, 17 bp, Homo sapiens
ataaaccggatcctgtt

SEQ ID NO: 4790406 - DNA, 18 bp, Homo sapiens
ataaaccttaatatttct

SEQ ID NO: 4790407 - DNA, 19 bp, Homo sapiens
ataaactcagtcaaatgta

SEQ ID NO: 4790408 - DNA, 13 bp, Homo sapiens
ataaactccttaa

SEQ ID NO: 4790409 - DNA, 10 bp, Homo sapiens
ataaactgtg

SEQ ID NO: 4790410 - DNA, 20 bp, Homo sapiens
ataaactgtgagataaatat

SEQ ID NO: 4790411 - DNA, 15 bp, Homo sapiens
ataaacttgtactta

SEQ ID NO: 4790412 - DNA, 16 bp, Homo sapiens
ataaacttgtacttac

SEQ ID NO: 4790413 - DNA, 15 bp, Homo sapiens
ataaaggttctatga

SEQ ID NO: 4790414 - DNA, 16 bp, Homo sapiens
ataaaggttctatgat

SEQ ID NO: 4790415 - DNA, 18 bp, Homo sapiens
ataaaggttctatgatat

SEQ ID NO: 4790416 - DNA, 18 bp, Homo sapiens
ataaagtattccacctta

SEQ ID NO: 4790417 - DNA, 17 bp, Homo sapiens
ataaataaaaatattct

SEQ ID NO: 4790418 - DNA, 18 bp, Homo sapiens
ataaataaaaatattctc

SEQ ID NO: 4790419 - DNA, 22 bp, Homo sapiens
ataaataagtaaatacattatt

SEQ ID NO: 4790420 - DNA, 15 bp, Homo sapiens
ataaatcatgggcat

SEQ ID NO: 4790421 - DNA, 13 bp, Homo sapiens
ataaatgctgctt

SEQ ID NO: 4790422 - DNA, 14 bp, Homo sapiens
ataaatgtgtaaat

SEQ ID NO: 4790423 - DNA, 14 bp, Homo sapiens
ataaatgtgtgtat

SEQ ID NO: 4790424 - DNA, 20 bp, Homo sapiens
ataaatgtgtgtatgtgtgt

SEQ ID NO: 4790425 - DNA, 14 bp, Homo sapiens
ataaatgtttatat

SEQ ID NO: 4790426 - DNA, 12 bp, Homo sapiens
ataaatgtttta

SEQ ID NO: 4790427 - DNA, 15 bp, Homo sapiens
ataaatgttttggaa

SEQ ID NO: 4790428 - DNA, 16 bp, Homo sapiens
ataaatgttttggaat

SEQ ID NO: 4790429 - DNA, 21 bp, Homo sapiens
ataaatgttttggaattcaat

SEQ ID NO: 4790430 - DNA, 19 bp, Homo sapiens
ataaattaaatatatgtat

SEQ ID NO: 4790431 - DNA, 16 bp, Homo sapiens
ataaattaatgagttt

SEQ ID NO: 4790432 - DNA, 19 bp, Homo sapiens
ataaattataatgcatcta

SEQ ID NO: 4790433 - DNA, 20 bp, Homo sapiens
ataaattattactttaaatt

SEQ ID NO: 4790434 - DNA, 14 bp, Homo sapiens
ataaattatttcta

SEQ ID NO: 4790435 - DNA, 20 bp, Homo sapiens
ataaattttggaagaattca

SEQ ID NO: 4790436 - DNA, 22 bp, Homo sapiens
ataaattttggaagaattcatg

SEQ ID NO: 4790437 - DNA, 11 bp, Homo sapiens
ataacacacat

SEQ ID NO: 4790438 - DNA, 19 bp, Homo sapiens
ataacagccttaaatcctt

SEQ ID NO: 4790439 - DNA, 16 bp, Homo sapiens
ataacataagctagaa

SEQ ID NO: 4790440 - DNA, 13 bp, Homo sapiens
ataacatgaaagt

SEQ ID NO: 4790441 - DNA, 12 bp, Homo sapiens
ataacattgtaa

SEQ ID NO: 4790442 - DNA, 13 bp, Homo sapiens
ataactagagtat

SEQ ID NO: 4790443 - DNA, 15 bp, Homo sapiens
ataactagagtatgt

SEQ ID NO: 4790444 - DNA, 23 bp, Homo sapiens
ataactagagtatgtgtatgtac

SEQ ID NO: 4790445 - DNA, 17 bp, Homo sapiens
ataactagatctcctgt

SEQ ID NO: 4790446 - DNA, 18 bp, Homo sapiens
ataactagatctcctgta

SEQ ID NO: 4790447 - DNA, 22 bp, Homo sapiens
ataactagatctcctgtaattt

SEQ ID NO: 4790448 - DNA, 16 bp, Homo sapiens
ataacttgtttgtaaa

SEQ ID NO: 4790449 - DNA, 15 bp, Homo sapiens
ataagaaaaatgctt

SEQ ID NO: 4790450 - DNA, 13 bp, Homo sapiens
ataagaaacagtt

SEQ ID NO: 4790451 - DNA, 15 bp, Homo sapiens
ataagagacaaagtt

SEQ ID NO: 4790452 - DNA, 18 bp, Homo sapiens
ataagagttacttccctt

SEQ ID NO: 4790453 - DNA, 22 bp, Homo sapiens
ataagccaaaaaatgcttgctt

SEQ ID NO: 4790454 - DNA, 17 bp, Homo sapiens
ataaggatttattctca

SEQ ID NO: 4790455 - DNA, 14 bp, Homo sapiens
ataaggctaaatgt

SEQ ID NO: 4790456 - DNA, 16 bp, Homo sapiens
ataagtaaatacatta

SEQ ID NO: 4790457 - DNA, 16 bp, Homo sapiens
ataagtaaatgtcttc

SEQ ID NO: 4790458 - DNA, 21 bp, Homo sapiens
ataagtgttggccatcatttc

SEQ ID NO: 4790459 - DNA, 13 bp, Homo sapiens
ataataaaagaat

SEQ ID NO: 4790460 - DNA, 13 bp, Homo sapiens
ataataaaattca

SEQ ID NO: 4790461 - DNA, 14 bp, Homo sapiens
ataataaaattcat

SEQ ID NO: 4790462 - DNA, 16 bp, Homo sapiens
ataataaactgtttaa

SEQ ID NO: 4790463 - DNA, 15 bp, Homo sapiens
ataataaaggttcta

SEQ ID NO: 4790464 - DNA, 18 bp, Homo sapiens
ataataaaggttctatga

SEQ ID NO: 4790465 - DNA, 19 bp, Homo sapiens
ataataaaggttctatgat

SEQ ID NO: 4790466 - DNA, 22 bp, Homo sapiens
ataataaaggttctatgatata

SEQ ID NO: 4790467 - DNA, 12 bp, Homo sapiens
ataataaagtat

SEQ ID NO: 4790468 - DNA, 13 bp, Homo sapiens
ataataaagtatt

SEQ ID NO: 4790469 - DNA, 23 bp, Homo sapiens
ataataaagtattccaccttaaa

SEQ ID NO: 4790470 - DNA, 23 bp, Homo sapiens
ataataaattgtttggcttcctc

SEQ ID NO: 4790471 - DNA, 15 bp, Homo sapiens
ataataactagatct

SEQ ID NO: 4790472 - DNA, 17 bp, Homo sapiens
ataatagctcacagcac

SEQ ID NO: 4790473 - DNA, 19 bp, Homo sapiens
ataatagctcacagcacat

SEQ ID NO: 4790474 - DNA, 20 bp, Homo sapiens
ataatagctcacagcacatt

SEQ ID NO: 4790475 - DNA, 15 bp, Homo sapiens
ataatataaatgaat

SEQ ID NO: 4790476 - DNA, 17 bp, Homo sapiens
ataatataaatgaatga

SEQ ID NO: 4790477 - DNA, 16 bp, Homo sapiens
ataatatcctgaataa

SEQ ID NO: 4790478 - DNA, 15 bp, Homo sapiens
ataatctgaaatgac

SEQ ID NO: 4790479 - DNA, 19 bp, Homo sapiens
ataatggcctcttaaaaat

SEQ ID NO: 4790480 - DNA, 16 bp, Homo sapiens
ataatggctaactttt

SEQ ID NO: 4790481 - DNA, 22 bp, Homo sapiens
ataatgggctgcaaaatgaaga

SEQ ID NO: 4790482 - DNA, 17 bp, Homo sapiens
ataatgtgggaagaaac

SEQ ID NO: 4790483 - DNA, 13 bp, Homo sapiens
ataattaaaacaa

SEQ ID NO: 4790484 - DNA, 21 bp, Homo sapiens
ataattaaaacaaaatccttg

SEQ ID NO: 4790485 - DNA, 15 bp, Homo sapiens
ataattaaatgaaat

SEQ ID NO: 4790486 - DNA, 18 bp, Homo sapiens
ataattaaatgaaatact

SEQ ID NO: 4790487 - DNA, 19 bp, Homo sapiens
ataattagatccattaatt

SEQ ID NO: 4790488 - DNA, 22 bp, Homo sapiens
ataattagatccattaatttaa

SEQ ID NO: 4790489 - DNA, 20 bp, Homo sapiens
ataattgtaaaggtgatgaa

SEQ ID NO: 4790490 - DNA, 22 bp, Homo sapiens
ataattgtcatgactttcagat

SEQ ID NO: 4790491 - DNA, 23 bp, Homo sapiens
ataattgtcatgactttcagatt

SEQ ID NO: 4790492 - DNA, 15 bp, Homo sapiens
ataattttaaaattg

SEQ ID NO: 4790493 - DNA, 16 bp, Homo sapiens
ataattttaaaattgc

SEQ ID NO: 4790494 - DNA, 18 bp, Homo sapiens
ataattttaaaattgcag

SEQ ID NO: 4790495 - DNA, 15 bp, Homo sapiens
atacaaacaggtgct

SEQ ID NO: 4790496 - DNA, 16 bp, Homo sapiens
atacaaacatgtggca

SEQ ID NO: 4790497 - DNA, 20 bp, Homo sapiens
atacaaagctgtcactcaca

SEQ ID NO: 4790498 - DNA, 19 bp, Homo sapiens
atacaacacattgaaactg

SEQ ID NO: 4790499 - DNA, 19 bp, Homo sapiens
atacaaccttcatttaaaa

SEQ ID NO: 4790500 - DNA, 20 bp, Homo sapiens
atacaactttggaatttgaa

SEQ ID NO: 4790501 - DNA, 15 bp, Homo sapiens
atacaagtgtttcta

SEQ ID NO: 4790502 - DNA, 12 bp, Homo sapiens
atacactgcatt

SEQ ID NO: 4790503 - DNA, 15 bp, Homo sapiens
atacactgcattcgt

SEQ ID NO: 4790504 - DNA, 15 bp, Homo sapiens
atacagacctccaga

SEQ ID NO: 4790505 - DNA, 20 bp, Homo sapiens
atacagacctccagattatt

SEQ ID NO: 4790506 - DNA, 23 bp, Homo sapiens
atacagagcctgttttaaaaaat

SEQ ID NO: 4790507 - DNA, 18 bp, Homo sapiens
atacagtattatagatat

SEQ ID NO: 4790508 - DNA, 22 bp, Homo sapiens
atacagtattatttagtaaaat

SEQ ID NO: 4790509 - DNA, 10 bp, Homo sapiens
atacataaaa

SEQ ID NO: 4790510 - DNA, 19 bp, Homo sapiens
atacatactatagattctt

SEQ ID NO: 4790511 - DNA, 14 bp, Homo sapiens
atacatatgtatgt

SEQ ID NO: 4790512 - DNA, 14 bp, Homo sapiens
atacatattcaaag

SEQ ID NO: 4790513 - DNA, 18 bp, Homo sapiens
atacatattcaaagtata

SEQ ID NO: 4790514 - DNA, 16 bp, Homo sapiens
atacatgatgatttca

SEQ ID NO: 4790515 - DNA, 12 bp, Homo sapiens
atacatgtatag

SEQ ID NO: 4790516 - DNA, 17 bp, Homo sapiens
atacattagacacacat

SEQ ID NO: 4790517 - DNA, 19 bp, Homo sapiens
atacattagacacacatat

SEQ ID NO: 4790518 - DNA, 20 bp, Homo sapiens
atacattagacacacatata

SEQ ID NO: 4790519 - DNA, 21 bp, Homo sapiens
atacattattgaaaagcaaat

SEQ ID NO: 4790520 - DNA, 23 bp, Homo sapiens
atacattattgaaaagcaaatct

SEQ ID NO: 4790521 - DNA, 17 bp, Homo sapiens
atacattatttctgtat

SEQ ID NO: 4790522 - DNA, 19 bp, Homo sapiens
atacattatttctgtatat

SEQ ID NO: 4790523 - DNA, 21 bp, Homo sapiens
atacattgaacacatttcctt

SEQ ID NO: 4790524 - DNA, 13 bp, Homo sapiens
ataccagcaaaag

SEQ ID NO: 4790525 - DNA, 17 bp, Homo sapiens
ataccagttcttgcaat

SEQ ID NO: 4790526 - DNA, 14 bp, Homo sapiens
ataccattttgaaa

SEQ ID NO: 4790527 - DNA, 16 bp, Homo sapiens
ataccattttgaaata

SEQ ID NO: 4790528 - DNA, 15 bp, Homo sapiens
ataccccctgcccca

SEQ ID NO: 4790529 - DNA, 20 bp, Homo sapiens
ataccccctgccccagagaa

SEQ ID NO: 4790530 - DNA, 21 bp, Homo sapiens
atacccggtggcttctggcac

SEQ ID NO: 4790531 - DNA, 16 bp, Homo sapiens
ataccctaggtctcca

SEQ ID NO: 4790532 - DNA, 21 bp, Homo sapiens
ataccctaggtctccacccct

SEQ ID NO: 4790533 - DNA, 17 bp, Homo sapiens
ataccggagctccagtt

SEQ ID NO: 4790534 - DNA, 18 bp, Homo sapiens
atacctctctctatatat

SEQ ID NO: 4790535 - DNA, 14 bp, Homo sapiens
atacctctgaccaa

SEQ ID NO: 4790536 - DNA, 15 bp, Homo sapiens
atacctctgaccaac

SEQ ID NO: 4790537 - DNA, 17 bp, Homo sapiens
atacctgcctgggacag

SEQ ID NO: 4790538 - DNA, 15 bp, Homo sapiens
ataccttagctccct

SEQ ID NO: 4790539 - DNA, 17 bp, Homo sapiens
ataccttccatctcaac

SEQ ID NO: 4790540 - DNA, 19 bp, Homo sapiens
ataccttccatctcaacct

SEQ ID NO: 4790541 - DNA, 14 bp, Homo sapiens
atacgaaacacaaa

SEQ ID NO: 4790542 - DNA, 23 bp, Homo sapiens
atactaacgaccgacgcccctcc

SEQ ID NO: 4790543 - DNA, 13 bp, Homo sapiens
atactaataaaat

SEQ ID NO: 4790544 - DNA, 16 bp, Homo sapiens
atactaataaaataca

SEQ ID NO: 4790545 - DNA, 16 bp, Homo sapiens
atactacatttgaaca

SEQ ID NO: 4790546 - DNA, 17 bp, Homo sapiens
atactatagattcttta

SEQ ID NO: 4790547 - DNA, 17 bp, Homo sapiens
atactattggacagaca

SEQ ID NO: 4790548 - DNA, 18 bp, Homo sapiens
atactattggacagacac

SEQ ID NO: 4790549 - DNA, 13 bp, Homo sapiens
atactcattagaa

SEQ ID NO: 4790550 - DNA, 14 bp, Homo sapiens
atactcatttggat

SEQ ID NO: 4790551 - DNA, 23 bp, Homo sapiens
atactcatttggatataaatctt

SEQ ID NO: 4790552 - DNA, 13 bp, Homo sapiens
atactctccagga

SEQ ID NO: 4790553 - DNA, 13 bp, Homo sapiens
atactgatgagac

SEQ ID NO: 4790554 - DNA, 14 bp, Homo sapiens
atactgatgagaca

SEQ ID NO: 4790555 - DNA, 22 bp, Homo sapiens
atactgatgagacaacacacac

SEQ ID NO: 4790556 - DNA, 14 bp, Homo sapiens
atactgctgtataa

SEQ ID NO: 4790557 - DNA, 16 bp, Homo sapiens
atactggaaataacct

SEQ ID NO: 4790558 - DNA, 14 bp, Homo sapiens
atactggactaagt

SEQ ID NO: 4790559 - DNA, 15 bp, Homo sapiens
atactggactaagtg

SEQ ID NO: 4790560 - DNA, 21 bp, Homo sapiens
atactgtttttcgtcattcca

SEQ ID NO: 4790561 - DNA, 20 bp, Homo sapiens
atacttgaaaacttctcatt

SEQ ID NO: 4790562 - DNA, 21 bp, Homo sapiens
atacttgaaaacttctcattt

SEQ ID NO: 4790563 - DNA, 14 bp, Homo sapiens
atacttgtaacttt

SEQ ID NO: 4790564 - DNA, 17 bp, Homo sapiens
atagaaaaaaacattct

SEQ ID NO: 4790565 - DNA, 22 bp, Homo sapiens
atagaaaacaggaaaaaaactt

SEQ ID NO: 4790566 - DNA, 11 bp, Homo sapiens
atagaaacatg

SEQ ID NO: 4790567 - DNA, 15 bp, Homo sapiens
atagaagaaggactg

SEQ ID NO: 4790568 - DNA, 19 bp, Homo sapiens
atagaagaaggactgaaga

SEQ ID NO: 4790569 - DNA, 16 bp, Homo sapiens
atagacaaaggcctta

SEQ ID NO: 4790570 - DNA, 21 bp, Homo sapiens
atagacaagtgttttgggttt

SEQ ID NO: 4790571 - DNA, 12 bp, Homo sapiens
atagagcacaat

SEQ ID NO: 4790572 - DNA, 21 bp, Homo sapiens
atagagcacaatattaagtgt

SEQ ID NO: 4790573 - DNA, 11 bp, Homo sapiens
atagaggttct

SEQ ID NO: 4790574 - DNA, 20 bp, Homo sapiens
atagataccattttgaaata

SEQ ID NO: 4790575 - DNA, 17 bp, Homo sapiens
atagatcacggcatgtt

SEQ ID NO: 4790576 - DNA, 15 bp, Homo sapiens
atagatggtagaaac

SEQ ID NO: 4790577 - DNA, 22 bp, Homo sapiens
atagatgtctgtgtatacatat

SEQ ID NO: 4790578 - DNA, 13 bp, Homo sapiens
atagattcacctg

SEQ ID NO: 4790579 - DNA, 18 bp, Homo sapiens
atagattcacctgtaaaa

SEQ ID NO: 4790580 - DNA, 22 bp, Homo sapiens
atagattcacctgtaaaacttt

SEQ ID NO: 4790581 - DNA, 15 bp, Homo sapiens
atagcacatgtttta

SEQ ID NO: 4790582 - DNA, 19 bp, Homo sapiens
atagcatctgctcttctct

SEQ ID NO: 4790583 - DNA, 18 bp, Homo sapiens
atagccattcatttacaa

SEQ ID NO: 4790584 - DNA, 20 bp, Homo sapiens
atagccattcatttacaact

SEQ ID NO: 4790585 - DNA, 18 bp, Homo sapiens
atagccccaggcccgccc

SEQ ID NO: 4790586 - DNA, 15 bp, Homo sapiens
atagcgtgtgtagat

SEQ ID NO: 4790587 - DNA, 18 bp, Homo sapiens
atagctcacagcacattt

SEQ ID NO: 4790588 - DNA, 19 bp, Homo sapiens
atagctccttcatgctttt

SEQ ID NO: 4790589 - DNA, 16 bp, Homo sapiens
atagcttaagaagtat

SEQ ID NO: 4790590 - DNA, 19 bp, Homo sapiens
atagcttttcacttcttaa

SEQ ID NO: 4790591 - DNA, 16 bp, Homo sapiens
atagcttttggtgttt

SEQ ID NO: 4790592 - DNA, 22 bp, Homo sapiens
ataggacaaggggtggaagggc

SEQ ID NO: 4790593 - DNA, 19 bp, Homo sapiens
ataggacttaatttagcag

SEQ ID NO: 4790594 - DNA, 14 bp, Homo sapiens
ataggagaggaaaa

SEQ ID NO: 4790595 - DNA, 16 bp, Homo sapiens
ataggagcttccagat

SEQ ID NO: 4790596 - DNA, 14 bp, Homo sapiens
ataggctggggaca

SEQ ID NO: 4790597 - DNA, 17 bp, Homo sapiens
ataggcttgtgtaattt

SEQ ID NO: 4790598 - DNA, 13 bp, Homo sapiens
ataggttctgctt

SEQ ID NO: 4790599 - DNA, 21 bp, Homo sapiens
atagtaccactgcacatcatg

SEQ ID NO: 4790600 - DNA, 21 bp, Homo sapiens
atagtcaatcaaacagggaca

SEQ ID NO: 4790601 - DNA, 14 bp, Homo sapiens
atagtcatatgtga

SEQ ID NO: 4790602 - DNA, 23 bp, Homo sapiens
atagtcatgtttctgcagtattc

SEQ ID NO: 4790603 - DNA, 13 bp, Homo sapiens
atagtctgtactt

SEQ ID NO: 4790604 - DNA, 14 bp, Homo sapiens
atagtctgtacttc

SEQ ID NO: 4790605 - DNA, 16 bp, Homo sapiens
atagtggtattttaac

SEQ ID NO: 4790606 - DNA, 17 bp, Homo sapiens
atagtggtattttaaca

SEQ ID NO: 4790607 - DNA, 14 bp, Homo sapiens
atagtgtgtccatg

SEQ ID NO: 4790608 - DNA, 21 bp, Homo sapiens
atagtgtgttgtgctttcaag

SEQ ID NO: 4790609 - DNA, 19 bp, Homo sapiens
atagtgttgtgttacaata

SEQ ID NO: 4790610 - DNA, 22 bp, Homo sapiens
atagtgttgtgttacaataagt

SEQ ID NO: 4790611 - DNA, 21 bp, Homo sapiens
atagtgtttcgttaagcagta

SEQ ID NO: 4790612 - DNA, 12 bp, Homo sapiens
atagttgtaaag

SEQ ID NO: 4790613 - DNA, 15 bp, Homo sapiens
atagttgtaaagata

SEQ ID NO: 4790614 - DNA, 21 bp, Homo sapiens
atagttgtaaagatattgtat

SEQ ID NO: 4790615 - DNA, 22 bp, Homo sapiens
atagtttctaaaccatgaaaag

SEQ ID NO: 4790616 - DNA, 17 bp, Homo sapiens
atataaaaaatatatgt

SEQ ID NO: 4790617 - DNA, 18 bp, Homo sapiens
atataaaaaatatatgta

SEQ ID NO: 4790618 - DNA, 13 bp, Homo sapiens
atataaaaataat

SEQ ID NO: 4790619 - DNA, 22 bp, Homo sapiens
atataaaaataattaaaacaaa

SEQ ID NO: 4790620 - DNA, 12 bp, Homo sapiens
atataaacttgt

SEQ ID NO: 4790621 - DNA, 14 bp, Homo sapiens
atataaatgaatga

SEQ ID NO: 4790622 - DNA, 14 bp, Homo sapiens
atataaatgtgtgt

SEQ ID NO: 4790623 - DNA, 16 bp, Homo sapiens
atataaatgtgtgtat

SEQ ID NO: 4790624 - DNA, 14 bp, Homo sapiens
atataaatgtttat

SEQ ID NO: 4790625 - DNA, 15 bp, Homo sapiens
atataaattattact

SEQ ID NO: 4790626 - DNA, 12 bp, Homo sapiens
atataacatgaa

SEQ ID NO: 4790627 - DNA, 13 bp, Homo sapiens
atataacatgaaa

SEQ ID NO: 4790628 - DNA, 17 bp, Homo sapiens
atataagacaagtctga

SEQ ID NO: 4790629 - DNA, 13 bp, Homo sapiens
atataagcttttt

SEQ ID NO: 4790630 - DNA, 12 bp, Homo sapiens
atataataaagt

SEQ ID NO: 4790631 - DNA, 21 bp, Homo sapiens
atataataaatatatatttat

SEQ ID NO: 4790632 - DNA, 12 bp, Homo sapiens
atataattctta

SEQ ID NO: 4790633 - DNA, 21 bp, Homo sapiens
atataatttgccagacagaga

SEQ ID NO: 4790634 - DNA, 23 bp, Homo sapiens
atataatttgccagacagagatc

SEQ ID NO: 4790635 - DNA, 15 bp, Homo sapiens
atatacaaacatgtg

SEQ ID NO: 4790636 - DNA, 21 bp, Homo sapiens
atatacaactttggaatttga

SEQ ID NO: 4790637 - DNA, 12 bp, Homo sapiens
atatacagagcc

SEQ ID NO: 4790638 - DNA, 15 bp, Homo sapiens
atatacatgtatagt

SEQ ID NO: 4790639 - DNA, 19 bp, Homo sapiens
atatacattagacacacat

SEQ ID NO: 4790640 - DNA, 15 bp, Homo sapiens
atatacattatttct

SEQ ID NO: 4790641 - DNA, 23 bp, Homo sapiens
atatacattatttctgtatatag

SEQ ID NO: 4790642 - DNA, 21 bp, Homo sapiens
atatagagacttctaaatcat

SEQ ID NO: 4790643 - DNA, 18 bp, Homo sapiens
atatagatgtctgtgtat

SEQ ID NO: 4790644 - DNA, 21 bp, Homo sapiens
atatagatgtctgtgtataca

SEQ ID NO: 4790645 - DNA, 20 bp, Homo sapiens
atatagcttttggtgtttga

SEQ ID NO: 4790646 - DNA, 23 bp, Homo sapiens
atataggggcaaaaatttgacat

SEQ ID NO: 4790647 - DNA, 14 bp, Homo sapiens
atatagtgttgtgt

SEQ ID NO: 4790648 - DNA, 19 bp, Homo sapiens
atatagtgttgtgttacaa

SEQ ID NO: 4790649 - DNA, 10 bp, Homo sapiens
atatataaat

SEQ ID NO: 4790650 - DNA, 15 bp, Homo sapiens
atatataaatatcta

SEQ ID NO: 4790651 - DNA, 13 bp, Homo sapiens
atatatacatata

SEQ ID NO: 4790652 - DNA, 13 bp, Homo sapiens
atatatacatgta

SEQ ID NO: 4790653 - DNA, 11 bp, Homo sapiens
atatatacatt

SEQ ID NO: 4790654 - DNA, 15 bp, Homo sapiens
atatatatatatgta

SEQ ID NO: 4790655 - DNA, 14 bp, Homo sapiens
atatatatatgtat

SEQ ID NO: 4790656 - DNA, 14 bp, Homo sapiens
atatatatttatca

SEQ ID NO: 4790657 - DNA, 19 bp, Homo sapiens
atatatgaaaactaagttc

SEQ ID NO: 4790658 - DNA, 22 bp, Homo sapiens
atatatgcttttttgcaataag

SEQ ID NO: 4790659 - DNA, 12 bp, Homo sapiens
atatatgtacag

SEQ ID NO: 4790660 - DNA, 13 bp, Homo sapiens
atatattataagt

SEQ ID NO: 4790661 - DNA, 11 bp, Homo sapiens
atatattatat

SEQ ID NO: 4790662 - DNA, 12 bp, Homo sapiens
atatattatata

SEQ ID NO: 4790663 - DNA, 15 bp, Homo sapiens
atatcacctgaatta

SEQ ID NO: 4790664 - DNA, 16 bp, Homo sapiens
atatcactcattaatt

SEQ ID NO: 4790665 - DNA, 19 bp, Homo sapiens
atatcagcagacactccag

SEQ ID NO: 4790666 - DNA, 18 bp, Homo sapiens
atatcaggaaatatctgt

SEQ ID NO: 4790667 - DNA, 21 bp, Homo sapiens
atatcagttacagtggcagta

SEQ ID NO: 4790668 - DNA, 24 bp, Homo sapiens
agcgattctcctgcctcagcctcc

SEQ ID NO: 4790669 - DNA, 16 bp, Homo sapiens
agcgcagcccccacgc

SEQ ID NO: 4790670 - DNA, 22 bp, Homo sapiens
agcgcatggcgccccgggccgc

SEQ ID NO: 4790671 - DNA, 15 bp, Homo sapiens
agcgccccgccccca

SEQ ID NO: 4790672 - DNA, 16 bp, Homo sapiens
agcgccccgcccccac

SEQ ID NO: 4790673 - DNA, 15 bp, Homo sapiens
agcgcccgaggccag

SEQ ID NO: 4790674 - DNA, 17 bp, Homo sapiens
agcgcctcccgccgcct

SEQ ID NO: 4790675 - DNA, 19 bp, Homo sapiens
agcggccccgcggagcccc

SEQ ID NO: 4790676 - DNA, 19 bp, Homo sapiens
agcggcccggcccacgcag

SEQ ID NO: 4790677 - DNA, 23 bp, Homo sapiens
agcggcccggcccacgcagagcc

SEQ ID NO: 4790678 - DNA, 15 bp, Homo sapiens
agcggctgaggacgg

SEQ ID NO: 4790679 - DNA, 23 bp, Homo sapiens
agcggctgaggacggggcagagc

SEQ ID NO: 4790680 - DNA, 15 bp, Homo sapiens
agcgggcgcgggaca

SEQ ID NO: 4790681 - DNA, 12 bp, Homo sapiens
agcggggcttct

SEQ ID NO: 4790682 - DNA, 15 bp, Homo sapiens
agcggggcttctggg

SEQ ID NO: 4790683 - DNA, 17 bp, Homo sapiens
agcggggcttctgggcg

SEQ ID NO: 4790684 - DNA, 13 bp, Homo sapiens
agcgggggctaac

SEQ ID NO: 4790685 - DNA, 21 bp, Homo sapiens
agcgtgcagtagagagcaaag

SEQ ID NO: 4790686 - DNA, 20 bp, Homo sapiens
agcgtggtggacatgcacag

SEQ ID NO: 4790687 - DNA, 19 bp, Homo sapiens
agcgtgtactaccccagaa

SEQ ID NO: 4790688 - DNA, 14 bp, Homo sapiens
agcgtgtcctatcc

SEQ ID NO: 4790689 - DNA, 21 bp, Homo sapiens
agcgtgtcctatccccggacc

SEQ ID NO: 4790690 - DNA, 21 bp, Homo sapiens
agcgtgtcctatccccggacg

SEQ ID NO: 4790691 - DNA, 14 bp, Homo sapiens
agcgttgttttgtg

SEQ ID NO: 4790692 - DNA, 17 bp, Homo sapiens
agctaagcctgatgatg

SEQ ID NO: 4790693 - DNA, 14 bp, Homo sapiens
agctaatttgtgaa

SEQ ID NO: 4790694 - DNA, 17 bp, Homo sapiens
agctacatatgtaggaa

SEQ ID NO: 4790695 - DNA, 15 bp, Homo sapiens
agctaccaggaagag

SEQ ID NO: 4790696 - DNA, 23 bp, Homo sapiens
aggaagtaattttcttctcattc

SEQ ID NO: 4790697 - DNA, 11 bp, Homo sapiens
aggaagtactg

SEQ ID NO: 4790698 - DNA, 19 bp, Homo sapiens
aggaagtactggagaaaat

SEQ ID NO: 4790699 - DNA, 17 bp, Homo sapiens
aggaagtcaggagccag

SEQ ID NO: 4790700 - DNA, 19 bp, Homo sapiens
aggaagtcaggagccagca

SEQ ID NO: 4790701 - DNA, 21 bp, Homo sapiens
aggaatcatgtgccaagcaga

SEQ ID NO: 4790702 - DNA, 16 bp, Homo sapiens
aggaatgatattgctg

SEQ ID NO: 4790703 - DNA, 19 bp, Homo sapiens
aggaatgcacatggaatat

SEQ ID NO: 4790704 - DNA, 20 bp, Homo sapiens
aggaatgctcaatgtgctgt

SEQ ID NO: 4790705 - DNA, 21 bp, Homo sapiens
aggaatgctcaatgtgctgtt

SEQ ID NO: 4790706 - DNA, 21 bp, Homo sapiens
aggaatgggccaagccagggt

SEQ ID NO: 4790707 - DNA, 12 bp, Homo sapiens
aggacactgatg

SEQ ID NO: 4790708 - DNA, 15 bp, Homo sapiens
aggacagcttcccca

SEQ ID NO: 4790709 - DNA, 17 bp, Homo sapiens
aggacagggagggaaca

SEQ ID NO: 4790710 - DNA, 18 bp, Homo sapiens
aggaccaccctgccaagg

SEQ ID NO: 4790711 - DNA, 13 bp, Homo sapiens
aggaccaggagcc

SEQ ID NO: 4790712 - DNA, 14 bp, Homo sapiens
aggaccaggagcca

SEQ ID NO: 4790713 - DNA, 20 bp, Homo sapiens
aggacccaaggtggtcttgg

SEQ ID NO: 4790714 - DNA, 20 bp, Homo sapiens
aggaccccattctgggactg

SEQ ID NO: 4790715 - DNA, 20 bp, Homo sapiens
aggacccccccagtccgccc

SEQ ID NO: 4790716 - DNA, 13 bp, Homo sapiens
aggacccctgccc

SEQ ID NO: 4790717 - DNA, 16 bp, Homo sapiens
aggacccctgccctcg

SEQ ID NO: 4790718 - DNA, 20 bp, Homo sapiens
aggaccttgcttccttctca

SEQ ID NO: 4790719 - DNA, 14 bp, Homo sapiens
aggacggggcagag

SEQ ID NO: 4790720 - DNA, 15 bp, Homo sapiens
aggacggggcagagc

SEQ ID NO: 4790721 - DNA, 16 bp, Homo sapiens
aggacggggcagagct

SEQ ID NO: 4790722 - DNA, 14 bp, Homo sapiens
aggactacagaatt

SEQ ID NO: 4790723 - DNA, 12 bp, Homo sapiens
aggactgaagaa

SEQ ID NO: 4790724 - DNA, 16 bp, Homo sapiens
aggactgaagaaaatc

SEQ ID NO: 4790725 - DNA, 20 bp, Homo sapiens
aggactggttgtctctcttc

SEQ ID NO: 4790726 - DNA, 14 bp, Homo sapiens
aggacttctgcagc

SEQ ID NO: 4790727 - DNA, 23 bp, Homo sapiens
aggacttgtgcgccggcgccccg

SEQ ID NO: 4790728 - DNA, 17 bp, Homo sapiens
aggagaaggcctgcccc

SEQ ID NO: 4790729 - DNA, 19 bp, Homo sapiens
aggagaaggcctgcccccc

SEQ ID NO: 4790730 - DNA, 20 bp, Homo sapiens
aggagaaggcctgcccccct

SEQ ID NO: 4790731 - DNA, 16 bp, Homo sapiens
aggagaccctgtcttt

SEQ ID NO: 4790732 - DNA, 17 bp, Homo sapiens
aggagaccctgtctttg

SEQ ID NO: 4790733 - DNA, 17 bp, Homo sapiens
aggagagccctctgctg

SEQ ID NO: 4790734 - DNA, 18 bp, Homo sapiens
aggagagccctctgctgc

SEQ ID NO: 4790735 - DNA, 12 bp, Homo sapiens
aggagaggctgc

SEQ ID NO: 4790736 - DNA, 16 bp, Homo sapiens
aggagatgaggctgga

SEQ ID NO: 4790737 - DNA, 17 bp, Homo sapiens
aggagatggggagggcg

SEQ ID NO: 4790738 - DNA, 20 bp, Homo sapiens
aggagcaaataccttagctc

SEQ ID NO: 4790739 - DNA, 17 bp, Homo sapiens
aggagcacacatccaag

SEQ ID NO: 4790740 - DNA, 15 bp, Homo sapiens
aggagcacagccata

SEQ ID NO: 4790741 - DNA, 9 bp, Homo sapiens
aggagcacc

SEQ ID NO: 4790742 - DNA, 11 bp, Homo sapiens
aggagcacccc

SEQ ID NO: 4790743 - DNA, 20 bp, Homo sapiens
aggagcacccccagcctccc

SEQ ID NO: 4790744 - DNA, 12 bp, Homo sapiens
aggagccaggca

SEQ ID NO: 4790745 - DNA, 17 bp, Homo sapiens
aggagcctcctgccctt

SEQ ID NO: 4790746 - DNA, 14 bp, Homo sapiens
aggagcgtgtccta

SEQ ID NO: 4790747 - DNA, 21 bp, Homo sapiens
aggagctagtgttaatccaga

SEQ ID NO: 4790748 - DNA, 23 bp, Homo sapiens
aggagctagtgttaatccagaga

SEQ ID NO: 4790749 - DNA, 15 bp, Homo sapiens
aggagctcccttttt

SEQ ID NO: 4790750 - DNA, 13 bp, Homo sapiens
aggagcttccaga

SEQ ID NO: 4790751 - DNA, 15 bp, Homo sapiens
aggaggacagggagg

SEQ ID NO: 4790752 - DNA, 16 bp, Homo sapiens
aggaggacctgggggg

SEQ ID NO: 4790753 - DNA, 22 bp, Homo sapiens
aggaggacctggggggggcaag

SEQ ID NO: 4790754 - DNA, 18 bp, Homo sapiens
aggaggatccgggctttg

SEQ ID NO: 4790755 - DNA, 14 bp, Homo sapiens
aggaggcagagaag

SEQ ID NO: 4790756 - DNA, 19 bp, Homo sapiens
aggaggggaagctgcagct

SEQ ID NO: 4790757 - DNA, 13 bp, Homo sapiens
aggaggggagcaa

SEQ ID NO: 4790758 - DNA, 14 bp, Homo sapiens
aggaggtctctaag

SEQ ID NO: 4790759 - DNA, 15 bp, Homo sapiens
aggaggtgtggagtg

SEQ ID NO: 4790760 - DNA, 16 bp, Homo sapiens
aggaggtgtggagtgg

SEQ ID NO: 4790761 - DNA, 18 bp, Homo sapiens
aggaggtgtggagtggag

SEQ ID NO: 4790762 - DNA, 19 bp, Homo sapiens
aggaggtgtggagtggagg

SEQ ID NO: 4790763 - DNA, 20 bp, Homo sapiens
aggaggtgtggagtggaggg

SEQ ID NO: 4790764 - DNA, 15 bp, Homo sapiens
aggagtgactctggc

SEQ ID NO: 4790765 - DNA, 20 bp, Homo sapiens
aggagtgactctggctgcca

SEQ ID NO: 4790766 - DNA, 12 bp, Homo sapiens
aggagtgatggg

SEQ ID NO: 4790767 - DNA, 17 bp, Homo sapiens
aggagtgcgctagagca

SEQ ID NO: 4790768 - DNA, 22 bp, Homo sapiens
aggataaataataaaggttcta

SEQ ID NO: 4790769 - DNA, 19 bp, Homo sapiens
aggataaattaatgagttt

SEQ ID NO: 4790770 - DNA, 18 bp, Homo sapiens
aggataccttccatctca

SEQ ID NO: 4790771 - DNA, 19 bp, Homo sapiens
aggatcacttgagcccaga

SEQ ID NO: 4790772 - DNA, 22 bp, Homo sapiens
aggatgaggaacctcaaactgg

SEQ ID NO: 4790773 - DNA, 14 bp, Homo sapiens
aggatgcatgcagg

SEQ ID NO: 4790774 - DNA, 18 bp, Homo sapiens
aggatgcatgcagggccc

SEQ ID NO: 4790775 - DNA, 14 bp, Homo sapiens
aggatgcccaaaga

SEQ ID NO: 4790776 - DNA, 22 bp, Homo sapiens
aggatgttctagcatggctgcc

SEQ ID NO: 4790777 - DNA, 19 bp, Homo sapiens
aggattaggtttagaatca

SEQ ID NO: 4790778 - DNA, 12 bp, Homo sapiens
aggattcaacat

SEQ ID NO: 4790779 - DNA, 11 bp, Homo sapiens
aggattctttt

SEQ ID NO: 4790780 - DNA, 17 bp, Homo sapiens
aggattcttttttcaat

SEQ ID NO: 4790781 - DNA, 22 bp, Homo sapiens
aggattcttttttcaatgtact

SEQ ID NO: 4790782 - DNA, 23 bp, Homo sapiens
aggattcttttttcaatgtactg

SEQ ID NO: 4790783 - DNA, 15 bp, Homo sapiens
aggattgtctgctgc

SEQ ID NO: 4790784 - DNA, 23 bp, Homo sapiens
aggattgtctgctgcctccaagt

SEQ ID NO: 4790785 - DNA, 16 bp, Homo sapiens
aggatttattctcaga

SEQ ID NO: 4790786 - DNA, 17 bp, Homo sapiens
aggatttattctcagaa

SEQ ID NO: 4790787 - DNA, 21 bp, Homo sapiens
aggatttattctcagaacacc

SEQ ID NO: 4790788 - DNA, 15 bp, Homo sapiens
aggcaaatgtccaag

SEQ ID NO: 4790789 - DNA, 21 bp, Homo sapiens
aggcaagacaccttcccagct

SEQ ID NO: 4790790 - DNA, 17 bp, Homo sapiens
aggcaaggctgtcaatt

SEQ ID NO: 4790791 - DNA, 15 bp, Homo sapiens
aggcacacagcagcc

SEQ ID NO: 4790792 - DNA, 18 bp, Homo sapiens
aggcacacagcagccccc

SEQ ID NO: 4790793 - DNA, 20 bp, Homo sapiens
aggcacacagcagcccccca

SEQ ID NO: 4790794 - DNA, 13 bp, Homo sapiens
aggcaccatgctg

SEQ ID NO: 4790795 - DNA, 23 bp, Homo sapiens
aggcacccgccctttccttgcct

SEQ ID NO: 4790796 - DNA, 20 bp, Homo sapiens
aggcaccgccagagtgtcct

SEQ ID NO: 4790797 - DNA, 18 bp, Homo sapiens
aggcaccggacgctggag

SEQ ID NO: 4790798 - DNA, 12 bp, Homo sapiens
aggcactgagcg

SEQ ID NO: 4790799 - DNA, 23 bp, Homo sapiens
aggcagaatggtgggctccagag

SEQ ID NO: 4790800 - DNA, 23 bp, Homo sapiens
aggcagagggatgaaatgccaag

SEQ ID NO: 4790801 - DNA, 19 bp, Homo sapiens
aggcagcaacaggaccagg

SEQ ID NO: 4790802 - DNA, 20 bp, Homo sapiens
aggcagcaacaggaccagga

SEQ ID NO: 4790803 - DNA, 22 bp, Homo sapiens
aggcagcaacaggaccaggagc

SEQ ID NO: 4790804 - DNA, 12 bp, Homo sapiens
aggcagcctgtg

SEQ ID NO: 4790805 - DNA, 11 bp, Homo sapiens
aggcaggaagt

SEQ ID NO: 4790806 - DNA, 17 bp, Homo sapiens
aggcaggaagtcaggag

SEQ ID NO: 4790807 - DNA, 19 bp, Homo sapiens
aggcaggaagtcaggagcc

SEQ ID NO: 4790808 - DNA, 20 bp, Homo sapiens
aggcaggaagtcaggagcca

SEQ ID NO: 4790809 - DNA, 18 bp, Homo sapiens
aggcagggcaaatgacat

SEQ ID NO: 4790810 - DNA, 14 bp, Homo sapiens
aggcagggccctga

SEQ ID NO: 4790811 - DNA, 13 bp, Homo sapiens
aggcatgcctctg

SEQ ID NO: 4790812 - DNA, 14 bp, Homo sapiens
aggcatgcctctga

SEQ ID NO: 4790813 - DNA, 18 bp, Homo sapiens
aggcatgcctctgatatg

SEQ ID NO: 4790814 - DNA, 19 bp, Homo sapiens
aggcattttactatgcctg

SEQ ID NO: 4790815 - DNA, 16 bp, Homo sapiens
aggccaaactcacctg

SEQ ID NO: 4790816 - DNA, 20 bp, Homo sapiens
aggccaaactcacctgcccc

SEQ ID NO: 4790817 - DNA, 15 bp, Homo sapiens
aggccaaaggaagca

SEQ ID NO: 4790818 - DNA, 24 bp, Homo sapiens
agcaaagtagtacttcttctgtaa

SEQ ID NO: 4790819 - DNA, 15 bp, Homo sapiens
agcaaatatctaaat

SEQ ID NO: 4790820 - DNA, 14 bp, Homo sapiens
agcaaattccaata

SEQ ID NO: 4790821 - DNA, 14 bp, Homo sapiens
agcaacaacttact

SEQ ID NO: 4790822 - DNA, 13 bp, Homo sapiens
agcaacaggacca

SEQ ID NO: 4790823 - DNA, 16 bp, Homo sapiens
agcaacaggaccagga

SEQ ID NO: 4790824 - DNA, 20 bp, Homo sapiens
agcaacaggaccaggagcca

SEQ ID NO: 4790825 - DNA, 22 bp, Homo sapiens
agcaacattataatggccctgt

SEQ ID NO: 4790826 - DNA, 17 bp, Homo sapiens
agcaaccctacagtata

SEQ ID NO: 4790827 - DNA, 18 bp, Homo sapiens
agcaaccctacagtatat

SEQ ID NO: 4790828 - DNA, 21 bp, Homo sapiens
agcaaccctacagtatataag

SEQ ID NO: 4790829 - DNA, 19 bp, Homo sapiens
agcaactgttagctgggaa

SEQ ID NO: 4790830 - DNA, 20 bp, Homo sapiens
agcaactgttagctgggaag

SEQ ID NO: 4790831 - DNA, 13 bp, Homo sapiens
agcaaggctgcta

SEQ ID NO: 4790832 - DNA, 16 bp, Homo sapiens
agcaagtgctgagtct

SEQ ID NO: 4790833 - DNA, 22 bp, Homo sapiens
agcaataagttgaatgataata

SEQ ID NO: 4790834 - DNA, 15 bp, Homo sapiens
agcaatcctcccact

SEQ ID NO: 4790835 - DNA, 15 bp, Homo sapiens
agcaatccttaaaaa

SEQ ID NO: 4790836 - DNA, 19 bp, Homo sapiens
agcaatcttgctgtgaaac

SEQ ID NO: 4790837 - DNA, 13 bp, Homo sapiens
agcaattctaagt

SEQ ID NO: 4790838 - DNA, 15 bp, Homo sapiens
agcacaaagcactgg

SEQ ID NO: 4790839 - DNA, 19 bp, Homo sapiens
agcacaaagcactggcctt

SEQ ID NO: 4790840 - DNA, 21 bp, Homo sapiens
agcacaatattaagtgttgta

SEQ ID NO: 4790841 - DNA, 14 bp, Homo sapiens
agcacaattgatct

SEQ ID NO: 4790842 - DNA, 23 bp, Homo sapiens
agcacacttgacatcaactgcat

SEQ ID NO: 4790843 - DNA, 15 bp, Homo sapiens
agcacagctttcctg

SEQ ID NO: 4790844 - DNA, 14 bp, Homo sapiens
agcacagtatttaa

SEQ ID NO: 4790845 - DNA, 16 bp, Homo sapiens
agcacagtatttaaca

SEQ ID NO: 4790846 - DNA, 15 bp, Homo sapiens
agcacatctcttcat

SEQ ID NO: 4790847 - DNA, 14 bp, Homo sapiens
agcacatgcctctc

SEQ ID NO: 4790848 - DNA, 16 bp, Homo sapiens
agcacatgcctctctc

SEQ ID NO: 4790849 - DNA, 21 bp, Homo sapiens
agcacatgcctctctcaggcc

SEQ ID NO: 4790850 - DNA, 15 bp, Homo sapiens
agcacatgctggcca

SEQ ID NO: 4790851 - DNA, 20 bp, Homo sapiens
agcacattattgtagagaaa

SEQ ID NO: 4790852 - DNA, 17 bp, Homo sapiens
agcaccagcctgagcca

SEQ ID NO: 4790853 - DNA, 11 bp, Homo sapiens
agcaccagctt

SEQ ID NO: 4790854 - DNA, 12 bp, Homo sapiens
agcacccccagc

SEQ ID NO: 4790855 - DNA, 13 bp, Homo sapiens
agcacccccagcc

SEQ ID NO: 4790856 - DNA, 13 bp, Homo sapiens
agccccagggccc

SEQ ID NO: 4790857 - DNA, 19 bp, Homo sapiens
agccccagggccctgctca

SEQ ID NO: 4790858 - DNA, 16 bp, Homo sapiens
agccccatccttcccg

SEQ ID NO: 4790859 - DNA, 18 bp, Homo sapiens
agccccatcgcctgggac

SEQ ID NO: 4790860 - DNA, 11 bp, Homo sapiens
agcccccaccc

SEQ ID NO: 4790861 - DNA, 22 bp, Homo sapiens
agcccccacccccgtcaccccg

SEQ ID NO: 4790862 - DNA, 14 bp, Homo sapiens
agccccccagcact

SEQ ID NO: 4790863 - DNA, 13 bp, Homo sapiens
agccccctgcacc

SEQ ID NO: 4790864 - DNA, 14 bp, Homo sapiens
agccccctgcaccc

SEQ ID NO: 4790865 - DNA, 11 bp, Homo sapiens
agccccctgct

SEQ ID NO: 4790866 - DNA, 14 bp, Homo sapiens
agccccctgcttct

SEQ ID NO: 4790867 - DNA, 15 bp, Homo sapiens
agccccctgcttctc

SEQ ID NO: 4790868 - DNA, 18 bp, Homo sapiens
agccccctgcttctcccg

SEQ ID NO: 4790869 - DNA, 21 bp, Homo sapiens
agccccctgcttctcccgcca

SEQ ID NO: 4790870 - DNA, 22 bp, Homo sapiens
agccccctgcttctcccgccat

SEQ ID NO: 4790871 - DNA, 14 bp, Homo sapiens
agccccctggcatg

SEQ ID NO: 4790872 - DNA, 14 bp, Homo sapiens
agccccggagcacc

SEQ ID NO: 4790873 - DNA, 17 bp, Homo sapiens
agcccctatcctgcacc

SEQ ID NO: 4790874 - DNA, 20 bp, Homo sapiens
agcccctatcctgcaccctc

SEQ ID NO: 4790875 - DNA, 12 bp, Homo sapiens
agcccctcccca

SEQ ID NO: 4790876 - DNA, 17 bp, Homo sapiens
agcccctcctctcctcg

SEQ ID NO: 4790877 - DNA, 18 bp, Homo sapiens
agcccctcctctcctcgt

SEQ ID NO: 4790878 - DNA, 16 bp, Homo sapiens
agcccctgctggacca

SEQ ID NO: 4790879 - DNA, 13 bp, Homo sapiens
agcccctggggcc

SEQ ID NO: 4790880 - DNA, 14 bp, Homo sapiens
agccccttgcttct

SEQ ID NO: 4790881 - DNA, 21 bp, Homo sapiens
agccccttgcttctaagggat

SEQ ID NO: 4790882 - DNA, 17 bp, Homo sapiens
agcccgatgtccctgtc

SEQ ID NO: 4790883 - DNA, 19 bp, Homo sapiens
agcccgatgtccctgtccc

SEQ ID NO: 4790884 - DNA, 17 bp, Homo sapiens
agcccgcctgcgccccc

SEQ ID NO: 4790885 - DNA, 19 bp, Homo sapiens
agcccggccaaggacactg

SEQ ID NO: 4790886 - DNA, 21 bp, Homo sapiens
agcccggccaaggacactgat

SEQ ID NO: 4790887 - DNA, 22 bp, Homo sapiens
agccctaagtaaatctaaatta

SEQ ID NO: 4790888 - DNA, 20 bp, Homo sapiens
agccctcccccttccccttc

SEQ ID NO: 4790889 - DNA, 22 bp, Homo sapiens
agccctcccccttccccttctg

SEQ ID NO: 4790890 - DNA, 17 bp, Homo sapiens
agccctccgccagccct

SEQ ID NO: 4790891 - DNA, 14 bp, Homo sapiens
agccctctttctct

SEQ ID NO: 4790892 - DNA, 16 bp, Homo sapiens
agccctctttctctct

SEQ ID NO: 4790893 - DNA, 21 bp, Homo sapiens
agccctctttctctctgtgtg

SEQ ID NO: 4790894 - DNA, 12 bp, Homo sapiens
agccctgacaac

SEQ ID NO: 4790895 - DNA, 15 bp, Homo sapiens
agccctgcccagagt

SEQ ID NO: 4790896 - DNA, 11 bp, Homo sapiens
agccctgccct

SEQ ID NO: 4790897 - DNA, 19 bp, Homo sapiens
agccctgccctcactccac

SEQ ID NO: 4790898 - DNA, 22 bp, Homo sapiens
agccctgccctcactccactcc

SEQ ID NO: 4790899 - DNA, 14 bp, Homo sapiens
agccctggcccggt

SEQ ID NO: 4790900 - DNA, 15 bp, Homo sapiens
agccctggggcaggg

SEQ ID NO: 4790901 - DNA, 18 bp, Homo sapiens
agccctggggctgggccc

SEQ ID NO: 4790902 - DNA, 15 bp, Homo sapiens
agccctgttccgcct

SEQ ID NO: 4790903 - DNA, 21 bp, Homo sapiens
agccctgttccgcctcactgg

SEQ ID NO: 4790904 - DNA, 22 bp, Homo sapiens
agccctgttccgcctcactggg

SEQ ID NO: 4790905 - DNA, 20 bp, Homo sapiens
agccgagatagccaaggcca

SEQ ID NO: 4790906 - DNA, 17 bp, Homo sapiens
agccgcagaggcccgag

SEQ ID NO: 4790907 - DNA, 18 bp, Homo sapiens
agccgcagaggcccgagg

SEQ ID NO: 4790908 - DNA, 19 bp, Homo sapiens
agccgcagaggcccgaggc

SEQ ID NO: 4790909 - DNA, 12 bp, Homo sapiens
agccgccctggg

SEQ ID NO: 4790910 - DNA, 22 bp, Homo sapiens
agccgccctgggctgtctgtca

SEQ ID NO: 4790911 - DNA, 24 bp, Homo sapiens
agccgccctgggctgtctgtcacc

SEQ ID NO: 4790912 - DNA, 14 bp, Homo sapiens
agccgggccccatg

SEQ ID NO: 4790913 - DNA, 21 bp, Homo sapiens
agccgggccccatggtcacag

SEQ ID NO: 4790914 - DNA, 16 bp, Homo sapiens
agccgtgacctccagg

SEQ ID NO: 4790915 - DNA, 15 bp, Homo sapiens
agcctaatattcatg

SEQ ID NO: 4790916 - DNA, 17 bp, Homo sapiens
agcctaatattcatgct

SEQ ID NO: 4790917 - DNA, 11 bp, Homo sapiens
agcctcacctt

SEQ ID NO: 4790918 - DNA, 23 bp, Homo sapiens
agcctccactttggatcaggaaa

SEQ ID NO: 4790919 - DNA, 17 bp, Homo sapiens
agcctcccccaggctgc

SEQ ID NO: 4790920 - DNA, 21 bp, Homo sapiens
agcctcccccaggctgcgcct

SEQ ID NO: 4790921 - DNA, 22 bp, Homo sapiens
agcctcccccaggctgcgcctg

SEQ ID NO: 4790922 - DNA, 14 bp, Homo sapiens
agcctccccctcag

SEQ ID NO: 4790923 - DNA, 14 bp, Homo sapiens
agcctcctgccctt

SEQ ID NO: 4790924 - DNA, 13 bp, Homo sapiens
agcctctccgccc

SEQ ID NO: 4790925 - DNA, 14 bp, Homo sapiens
agcctctccgccca

SEQ ID NO: 4790926 - DNA, 15 bp, Homo sapiens
agcctctccgcccac

SEQ ID NO: 4790927 - DNA, 19 bp, Homo sapiens
agcctctgaagttggacag

SEQ ID NO: 4790928 - DNA, 16 bp, Homo sapiens
agcctgagccacagtg

SEQ ID NO: 4790929 - DNA, 12 bp, Homo sapiens
agcctgagctcc

SEQ ID NO: 4790930 - DNA, 17 bp, Homo sapiens
agcctgagtcagggccc

SEQ ID NO: 4790931 - DNA, 17 bp, Homo sapiens
agcctgatgatggaagg

SEQ ID NO: 4790932 - DNA, 16 bp, Homo sapiens
agcctgcacacacctg

SEQ ID NO: 4790933 - DNA, 19 bp, Homo sapiens
agcctgcacacacctgcct

SEQ ID NO: 4790934 - DNA, 23 bp, Homo sapiens
agcctgcttcccacctccctgcc

SEQ ID NO: 4790935 - DNA, 19 bp, Homo sapiens
agcctggcacaggactgat

SEQ ID NO: 4790936 - DNA, 16 bp, Homo sapiens
agcctggcccatagaa

SEQ ID NO: 4790937 - DNA, 17 bp, Homo sapiens
agcctggcccatagaaa

SEQ ID NO: 4790938 - DNA, 16 bp, Homo sapiens
agcctggtctgtgcat

SEQ ID NO: 4790939 - DNA, 18 bp, Homo sapiens
agcctggtctgtgcattg

SEQ ID NO: 4790940 - DNA, 17 bp, Homo sapiens
agcctgtgaactgccag

SEQ ID NO: 4790941 - DNA, 13 bp, Homo sapiens
agcctgtgggtcc

SEQ ID NO: 4790942 - DNA, 18 bp, Homo sapiens
agcctttgcgctctgggt

SEQ ID NO: 4790943 - DNA, 16 bp, Homo sapiens
agcgacacaggctgcc

SEQ ID NO: 4790944 - DNA, 18 bp, Homo sapiens
agcgacacaggctgccgc

SEQ ID NO: 4790945 - DNA, 21 bp, Homo sapiens
agcgacctaaacagctgcttt

SEQ ID NO: 4790946 - DNA, 15 bp, Homo sapiens
agaaattctataaga

SEQ ID NO: 4790947 - DNA, 20 bp, Homo sapiens
agaaattctataagagacaa

SEQ ID NO: 4790948 - DNA, 12 bp, Homo sapiens
agaaattcttgt

SEQ ID NO: 4790949 - DNA, 17 bp, Homo sapiens
agaacaaaaccccagaa

SEQ ID NO: 4790950 - DNA, 12 bp, Homo sapiens
agaacaacaaca

SEQ ID NO: 4790951 - DNA, 14 bp, Homo sapiens
agaacaacaacaaa

SEQ ID NO: 4790952 - DNA, 23 bp, Homo sapiens
agaacaacaacaaagcatgctca

SEQ ID NO: 4790953 - DNA, 18 bp, Homo sapiens
agaacagacgttaccaat

SEQ ID NO: 4790954 - DNA, 17 bp, Homo sapiens
agaacagctaacaataa

SEQ ID NO: 4790955 - DNA, 19 bp, Homo sapiens
agaacatggccaatagtca

SEQ ID NO: 4790956 - DNA, 16 bp, Homo sapiens
agaaccaacgggtctg

SEQ ID NO: 4790957 - DNA, 18 bp, Homo sapiens
agaaccagcactcccagg

SEQ ID NO: 4790958 - DNA, 15 bp, Homo sapiens
agaacccccctcccc

SEQ ID NO: 4790959 - DNA, 19 bp, Homo sapiens
agaacccccctccccaagg

SEQ ID NO: 4790960 - DNA, 21 bp, Homo sapiens
agaacctgcgcaccccgttcc

SEQ ID NO: 4790961 - DNA, 17 bp, Homo sapiens
agaacgggcctccccgg

SEQ ID NO: 4790962 - DNA, 15 bp, Homo sapiens
agaactcatgtgatt

SEQ ID NO: 4790963 - DNA, 14 bp, Homo sapiens
agaactcccttctc

SEQ ID NO: 4790964 - DNA, 18 bp, Homo sapiens
agaagaaagaacggaaga

SEQ ID NO: 4790965 - DNA, 16 bp, Homo sapiens
agaagaaggactgaag

SEQ ID NO: 4790966 - DNA, 19 bp, Homo sapiens
agaagaaggactgaagaaa

SEQ ID NO: 4790967 - DNA, 13 bp, Homo sapiens
agaagaatataaa

SEQ ID NO: 4790968 - DNA, 16 bp, Homo sapiens
agaagaatattgtatt

SEQ ID NO: 4790969 - DNA, 17 bp, Homo sapiens
agaagagatcaggaaga

SEQ ID NO: 4790970 - DNA, 12 bp, Homo sapiens
agaagataaaaa

SEQ ID NO: 4790971 - DNA, 20 bp, Homo sapiens
agaagatagttgtaaagata

SEQ ID NO: 4790972 - DNA, 13 bp, Homo sapiens
agaagatctttct

SEQ ID NO: 4790973 - DNA, 22 bp, Homo sapiens
agaagatttattatgaaccgca

SEQ ID NO: 4790974 - DNA, 22 bp, Homo sapiens
agaagcacaggaatagtgagtg

SEQ ID NO: 4790975 - DNA, 23 bp, Homo sapiens
agaagcagcagctagaaagagaa

SEQ ID NO: 4790976 - DNA, 22 bp, Homo sapiens
agaagcatccaaggaacttcat

SEQ ID NO: 4790977 - DNA, 20 bp, Homo sapiens
agaagccacgctgtcctctc

SEQ ID NO: 4790978 - DNA, 19 bp, Homo sapiens
agaagcttgtattatcagt

SEQ ID NO: 4790979 - DNA, 19 bp, Homo sapiens
agaaggaaggcagggagga

SEQ ID NO: 4790980 - DNA, 20 bp, Homo sapiens
agaaggaaggcagggaggag

SEQ ID NO: 4790981 - DNA, 14 bp, Homo sapiens
agaaggactgaaga

SEQ ID NO: 4790982 - DNA, 19 bp, Homo sapiens
agaaggattcttttttcaa

SEQ ID NO: 4790983 - DNA, 19 bp, Homo sapiens
agaaggcacaggtgtaaat

SEQ ID NO: 4790984 - DNA, 14 bp, Homo sapiens
agaaggtaaataat

SEQ ID NO: 4790985 - DNA, 13 bp, Homo sapiens
agaagtaaattat

SEQ ID NO: 4790986 - DNA, 15 bp, Homo sapiens
agaagtacagggcag

SEQ ID NO: 4790987 - DNA, 17 bp, Homo sapiens
agaagtacagggcagaa

SEQ ID NO: 4790988 - DNA, 20 bp, Homo sapiens
agaagtatacgtttttcagt

SEQ ID NO: 4790989 - DNA, 16 bp, Homo sapiens
agaagtccatgtgata

SEQ ID NO: 4790990 - DNA, 14 bp, Homo sapiens
agaagtgaaaaaga

SEQ ID NO: 4790991 - DNA, 22 bp, Homo sapiens
agaagtggaaggataatgagat

SEQ ID NO: 4790992 - DNA, 20 bp, Homo sapiens
agaagttaaaggttactgtt

SEQ ID NO: 4790993 - DNA, 22 bp, Homo sapiens
agaagtttctgccgcagccctg

SEQ ID NO: 4790994 - DNA, 22 bp, Homo sapiens
agaataaaccggatcctgttgc

SEQ ID NO: 4790995 - DNA, 21 bp, Homo sapiens
agaataatgtgggaagaaaca

SEQ ID NO: 4790996 - DNA, 22 bp, Homo sapiens
agaataatgtgggaagaaacaa

SEQ ID NO: 4790997 - DNA, 15 bp, Homo sapiens
agaatactaataaaa

SEQ ID NO: 4790998 - DNA, 14 bp, Homo sapiens
agaatactgtattg

SEQ ID NO: 4790999 - DNA, 20 bp, Homo sapiens
agaatagttaaattggcttg

SEQ ID NO: 4791000 - DNA, 22 bp, Homo sapiens
ccaaagcctgggcagaaatgtg

SEQ ID NO: 4791001 - DNA, 15 bp, Homo sapiens
ccaaaggaagcacat

SEQ ID NO: 4791002 - DNA, 17 bp, Homo sapiens
ccaaaggttgtacatag

SEQ ID NO: 4791003 - DNA, 18 bp, Homo sapiens
ccaaagtgctgggattaa

SEQ ID NO: 4791004 - DNA, 19 bp, Homo sapiens
ccaaataaatgtgtaaatg

SEQ ID NO: 4791005 - DNA, 12 bp, Homo sapiens
ccaaataacagt

SEQ ID NO: 4791006 - DNA, 13 bp, Homo sapiens
ccaaatagggcaa

SEQ ID NO: 4791007 - DNA, 20 bp, Homo sapiens
ccaaatagggcaaagaatca

SEQ ID NO: 4791008 - DNA, 16 bp, Homo sapiens
ccaaatgtaaaatatt

SEQ ID NO: 4791009 - DNA, 19 bp, Homo sapiens
ccaaatgtaaaatatttat

SEQ ID NO: 4791010 - DNA, 13 bp, Homo sapiens
ccaaattctctga

SEQ ID NO: 4791011 - DNA, 18 bp, Homo sapiens
ccaaattgctgagatgtt

SEQ ID NO: 4791012 - DNA, 19 bp, Homo sapiens
ccaacaacagtcagccagc

SEQ ID NO: 4791013 - DNA, 21 bp, Homo sapiens
ccaacaacagtcagccagctt

SEQ ID NO: 4791014 - DNA, 22 bp, Homo sapiens
ccaacacccaaagcatggacta

SEQ ID NO: 4791015 - DNA, 22 bp, Homo sapiens
ccaacagagtggactcttccct

SEQ ID NO: 4791016 - DNA, 22 bp, Homo sapiens
ccaacaggctgttctgcactga

SEQ ID NO: 4791017 - DNA, 14 bp, Homo sapiens
ccaacccatgcatg

SEQ ID NO: 4791018 - DNA, 16 bp, Homo sapiens
ccaacccccacctccc

SEQ ID NO: 4791019 - DNA, 17 bp, Homo sapiens
ccaacccccacctcccg

SEQ ID NO: 4791020 - DNA, 21 bp, Homo sapiens
ccaacctcccctggtcctgca

SEQ ID NO: 4791021 - DNA, 12 bp, Homo sapiens
ccaacctggagg

SEQ ID NO: 4791022 - DNA, 13 bp, Homo sapiens
ccaacctggaggc

SEQ ID NO: 4791023 - DNA, 17 bp, Homo sapiens
ccaacctggaggctgga

SEQ ID NO: 4791024 - DNA, 17 bp, Homo sapiens
ccaacctggtaattatc

SEQ ID NO: 4791025 - DNA, 15 bp, Homo sapiens
ccaacgcacaggaaa

SEQ ID NO: 4791026 - DNA, 12 bp, Homo sapiens
ccaactctggcc

SEQ ID NO: 4791027 - DNA, 23 bp, Homo sapiens
ccaactgctgcttaaaatgcaag

SEQ ID NO: 4791028 - DNA, 12 bp, Homo sapiens
ccaactgctttg

SEQ ID NO: 4791029 - DNA, 23 bp, Homo sapiens
ccaactgctttgttttggctgct

SEQ ID NO: 4791030 - DNA, 19 bp, Homo sapiens
ccaagactctatgctctgg

SEQ ID NO: 4791031 - DNA, 22 bp, Homo sapiens
ccaagcactagccttcccagct

SEQ ID NO: 4791032 - DNA, 18 bp, Homo sapiens
ccaagccagggttccaga

SEQ ID NO: 4791033 - DNA, 20 bp, Homo sapiens
ccaagccagggttccagaca

SEQ ID NO: 4791034 - DNA, 11 bp, Homo sapiens
ccaagcccagc

SEQ ID NO: 4791035 - DNA, 22 bp, Homo sapiens
ccaagcccagcctatctctctt

SEQ ID NO: 4791036 - DNA, 12 bp, Homo sapiens
ccaagccctggg

SEQ ID NO: 4791037 - DNA, 15 bp, Homo sapiens
ccaagccctggggca

SEQ ID NO: 4791038 - DNA, 18 bp, Homo sapiens
ccaagctataaaagccca

SEQ ID NO: 4791039 - DNA, 18 bp, Homo sapiens
ccaagctgatggacatga

SEQ ID NO: 4791040 - DNA, 23 bp, Homo sapiens
ccaagctgatggacatgagagta

SEQ ID NO: 4791041 - DNA, 14 bp, Homo sapiens
ccaagctgctgccg

SEQ ID NO: 4791042 - DNA, 21 bp, Homo sapiens
ccaaggacactgatgggtcct

SEQ ID NO: 4791043 - DNA, 22 bp, Homo sapiens
ccaaggacactgatgggtcctg

SEQ ID NO: 4791044 - DNA, 16 bp, Homo sapiens
ccaaggcaaatgtcca

SEQ ID NO: 4791045 - DNA, 17 bp, Homo sapiens
ccaaggcaaatgtccaa

SEQ ID NO: 4791046 - DNA, 21 bp, Homo sapiens
ccaaggcaaatgtccaagcat

SEQ ID NO: 4791047 - DNA, 13 bp, Homo sapiens
ccaaggcactgag

SEQ ID NO: 4791048 - DNA, 14 bp, Homo sapiens
ccaaggcactgagc

SEQ ID NO: 4791049 - DNA, 17 bp, Homo sapiens
ccaaggcatccccagtg

SEQ ID NO: 4791050 - DNA, 15 bp, Homo sapiens
ccaaggccaaaggaa

SEQ ID NO: 4791051 - DNA, 16 bp, Homo sapiens
ccaaggccaaaggaag

SEQ ID NO: 4791052 - DNA, 18 bp, Homo sapiens
ccaaggcccccacctctg

SEQ ID NO: 4791053 - DNA, 17 bp, Homo sapiens
ccaagggatctgcttga

SEQ ID NO: 4791054 - DNA, 12 bp, Homo sapiens
ccaagtcatggg

SEQ ID NO: 4791055 - DNA, 16 bp, Homo sapiens
ccaagtcatgggagaa

SEQ ID NO: 4791056 - DNA, 14 bp, Homo sapiens
ccaagtcctcgccc

SEQ ID NO: 4791057 - DNA, 18 bp, Homo sapiens
ccaagtgggtcaattcct

SEQ ID NO: 4791058 - DNA, 17 bp, Homo sapiens
ccaagtgtacatttgat

SEQ ID NO: 4791059 - DNA, 12 bp, Homo sapiens
ccaagtgtcctg

SEQ ID NO: 4791060 - DNA, 21 bp, Homo sapiens
ccaatacattgaacacatttc

SEQ ID NO: 4791061 - DNA, 12 bp, Homo sapiens
ccaatatttaaa

SEQ ID NO: 4791062 - DNA, 16 bp, Homo sapiens
ccaatcagcactgaaa

SEQ ID NO: 4791063 - DNA, 17 bp, Homo sapiens
ccaatcagcactgaaaa

SEQ ID NO: 4791064 - DNA, 14 bp, Homo sapiens
ccaatgggagctca

SEQ ID NO: 4791065 - DNA, 17 bp, Homo sapiens
ccaatgggagctcatgg

SEQ ID NO: 4791066 - DNA, 20 bp, Homo sapiens
ccaatggtgtagctgtcctc

SEQ ID NO: 4791067 - DNA, 22 bp, Homo sapiens
ccaatggtgtagctgtcctctc

SEQ ID NO: 4791068 - DNA, 19 bp, Homo sapiens
ccaattaagtcctacttta

SEQ ID NO: 4791069 - DNA, 13 bp, Homo sapiens
ccaattatcaaaa

SEQ ID NO: 4791070 - DNA, 16 bp, Homo sapiens
ccaattatcaaaaaac

SEQ ID NO: 4791071 - DNA, 18 bp, Homo sapiens
ccaattatcaaaaaacag

SEQ ID NO: 4791072 - DNA, 17 bp, Homo sapiens
ccaattcatctcagcaa

SEQ ID NO: 4791073 - DNA, 20 bp, Homo sapiens
ccaattgtgagaattactgt

SEQ ID NO: 4791074 - DNA, 10 bp, Homo sapiens
ccaatttctc

SEQ ID NO: 4791075 - DNA, 18 bp, Homo sapiens
ccaatttgttctgtgcaa

SEQ ID NO: 4791076 - DNA, 13 bp, Homo sapiens
ccacaactaacaa

SEQ ID NO: 4791077 - DNA, 12 bp, Homo sapiens
ccacaactgaca

SEQ ID NO: 4791078 - DNA, 18 bp, Homo sapiens
ccacaagaactcccttct

SEQ ID NO: 4791079 - DNA, 13 bp, Homo sapiens
ccacaagagccca

SEQ ID NO: 4791080 - DNA, 20 bp, Homo sapiens
ccacaagcaggctcaacata

SEQ ID NO: 4791081 - DNA, 23 bp, Homo sapiens
ccacaatcactaaatatctagtg

SEQ ID NO: 4791082 - DNA, 15 bp, Homo sapiens
ccacacacacccttc

SEQ ID NO: 4791083 - DNA, 21 bp, Homo sapiens
ccacacacacccttccccact

SEQ ID NO: 4791084 - DNA, 12 bp, Homo sapiens
ccacacacagca

SEQ ID NO: 4791085 - DNA, 18 bp, Homo sapiens
ccacacacagcagctcca

SEQ ID NO: 4791086 - DNA, 22 bp, Homo sapiens
ccacacacagcagctccaacct

SEQ ID NO: 4791087 - DNA, 14 bp, Homo sapiens
ccacacgccggggc

SEQ ID NO: 4791088 - DNA, 15 bp, Homo sapiens
ccacacgccggggct

SEQ ID NO: 4791089 - DNA, 19 bp, Homo sapiens
ccacacgccggggctggcc

SEQ ID NO: 4791090 - DNA, 22 bp, Homo sapiens
ccacactggaatccagttttgg

SEQ ID NO: 4791091 - DNA, 18 bp, Homo sapiens
ccacagagttactgccac

SEQ ID NO: 4791092 - DNA, 12 bp, Homo sapiens
ccacagccccaa

SEQ ID NO: 4791093 - DNA, 19 bp, Homo sapiens
ccacagccccttgcttcta

SEQ ID NO: 4791094 - DNA, 18 bp, Homo sapiens
ccacagctgcctccgggc

SEQ ID NO: 4791095 - DNA, 20 bp, Homo sapiens
ccacaggagcgtgtcctatc

SEQ ID NO: 4791096 - DNA, 19 bp, Homo sapiens
ccacaggaggcaagcaagc

SEQ ID NO: 4791097 - DNA, 22 bp, Homo sapiens
ccacaggaggcaagcaagctct

SEQ ID NO: 4791098 - DNA, 23 bp, Homo sapiens
ccacagtggggcccatggcccca

SEQ ID NO: 4791099 - DNA, 24 bp, Homo sapiens
ccacagtggggcccatggccccag

SEQ ID NO: 4791100 - DNA, 14 bp, Homo sapiens
ccacagtggtcagc

SEQ ID NO: 4791101 - DNA, 15 bp, Homo sapiens
ccacataagttttct

SEQ ID NO: 4791102 - DNA, 14 bp, Homo sapiens
ccacatacactgca

SEQ ID NO: 4791103 - DNA, 21 bp, Homo sapiens
ccacatgcacatgtattctgt

SEQ ID NO: 4791104 - DNA, 22 bp, Homo sapiens
ccaccacacacacccttcccca

SEQ ID NO: 4791105 - DNA, 18 bp, Homo sapiens
ccaccactgtgtcccagt

SEQ ID NO: 4791106 - DNA, 16 bp, Homo sapiens
ccaccatggccagcta

SEQ ID NO: 4791107 - DNA, 22 bp, Homo sapiens
ccacccacaccccgtctgcccc

SEQ ID NO: 4791108 - DNA, 15 bp, Homo sapiens
ccacccactagccct

SEQ ID NO: 4791109 - DNA, 17 bp, Homo sapiens
ccacccactagccctct

SEQ ID NO: 4791110 - DNA, 18 bp, Homo sapiens
ccaccccaaacttccagg

SEQ ID NO: 4791111 - DNA, 17 bp, Homo sapiens
ccacccccagcagctca

SEQ ID NO: 4791112 - DNA, 15 bp, Homo sapiens
ccaccccgctgcctg

SEQ ID NO: 4791113 - DNA, 12 bp, Homo sapiens
ccaccccgtccc

SEQ ID NO: 4791114 - DNA, 21 bp, Homo sapiens
ccaccccgttgttgtccctgc

SEQ ID NO: 4791115 - DNA, 22 bp, Homo sapiens
ccaccccgttgttgtccctgca

SEQ ID NO: 4791116 - DNA, 16 bp, Homo sapiens
ccacccctcttccccc

SEQ ID NO: 4791117 - DNA, 13 bp, Homo sapiens
ccacccctgccca

SEQ ID NO: 4791118 - DNA, 13 bp, Homo sapiens
ccacccgccccag

SEQ ID NO: 4791119 - DNA, 17 bp, Homo sapiens
ccacccgccccagagac

SEQ ID NO: 4791120 - DNA, 22 bp, Homo sapiens
ccacccgccccagagactgccc

SEQ ID NO: 4791121 - DNA, 23 bp, Homo sapiens
ccacccgccccagagactgccca

SEQ ID NO: 4791122 - DNA, 21 bp, Homo sapiens
ccacccgcccgcccccgccct

SEQ ID NO: 4791123 - DNA, 22 bp, Homo sapiens
ccacccggatctccaggcccag

SEQ ID NO: 4791124 - DNA, 17 bp, Homo sapiens
ccaccctcgctgccacc

SEQ ID NO: 4791125 - DNA, 14 bp, Homo sapiens
ccaccctgccctgg

SEQ ID NO: 4791126 - DNA, 19 bp, Homo sapiens
ccaccctgctgccttctga

SEQ ID NO: 4791127 - DNA, 13 bp, Homo sapiens
ccaccctgggcct

SEQ ID NO: 4791128 - DNA, 14 bp, Homo sapiens
ccaccctgggcctc

SEQ ID NO: 4791129 - DNA, 15 bp, Homo sapiens
ccaccctgtctgcag

SEQ ID NO: 4791130 - DNA, 16 bp, Homo sapiens
ccaccctgtctgcagg

SEQ ID NO: 4791131 - DNA, 12 bp, Homo sapiens
ccaccgcgcccc

SEQ ID NO: 4791132 - DNA, 14 bp, Homo sapiens
ccaccgcgcccctc

SEQ ID NO: 4791133 - DNA, 17 bp, Homo sapiens
ccaccgcgcccctctgc

SEQ ID NO: 4791134 - DNA, 17 bp, Homo sapiens
ccaccgggagcctcccc

SEQ ID NO: 4791135 - DNA, 22 bp, Homo sapiens
ccaccgggagcctccccctcag

SEQ ID NO: 4791136 - DNA, 15 bp, Homo sapiens
ccaccgtgggagagg

SEQ ID NO: 4791137 - DNA, 24 bp, Homo sapiens
ccacctccagtccccctatccttg

SEQ ID NO: 4791138 - DNA, 15 bp, Homo sapiens
ccacctccctgccca

SEQ ID NO: 4791139 - DNA, 17 bp, Homo sapiens
ccacctccctgcccagg

SEQ ID NO: 4791140 - DNA, 18 bp, Homo sapiens
ccacctccctgcccaggc

SEQ ID NO: 4791141 - DNA, 13 bp, Homo sapiens
ccacctgccaggc

SEQ ID NO: 4791142 - DNA, 13 bp, Homo sapiens
ccacctgcccagt

SEQ ID NO: 4791143 - DNA, 17 bp, Homo sapiens
ccacctggaaagccagg

SEQ ID NO: 4791144 - DNA, 20 bp, Homo sapiens
ccacctggatggatctgctc

SEQ ID NO: 4791145 - DNA, 14 bp, Homo sapiens
ccaccttaaattaa

SEQ ID NO: 4791146 - DNA, 18 bp, Homo sapiens
ccaccttaaattaaacaa

SEQ ID NO: 4791147 - DNA, 23 bp, Homo sapiens
ccaccttgtacagaaccagcact

SEQ ID NO: 4791148 - DNA, 17 bp, Homo sapiens
ccacgcagagccccgga

SEQ ID NO: 4791149 - DNA, 15 bp, Homo sapiens
ccacgcccctgcctg

SEQ ID NO: 4791150 - DNA, 16 bp, Homo sapiens
ccacgcccctgcctga

SEQ ID NO: 4791151 - DNA, 20 bp, Homo sapiens
ccacgccgatataagccata

SEQ ID NO: 4791152 - DNA, 21 bp, Homo sapiens
ccacgccgatataagccatag

SEQ ID NO: 4791153 - DNA, 15 bp, Homo sapiens
ccacgcttctggagg

SEQ ID NO: 4791154 - DNA, 16 bp, Homo sapiens
ccacggccgtccctga

SEQ ID NO: 4791155 - DNA, 20 bp, Homo sapiens
ccacggtccaatccagcctt

SEQ ID NO: 4791156 - DNA, 21 bp, Homo sapiens
ccacgtgtttcgggccagggc

SEQ ID NO: 4791157 - DNA, 19 bp, Homo sapiens
ccactagccctctttctct

SEQ ID NO: 4791158 - DNA, 15 bp, Homo sapiens
ccactcatactcaga

SEQ ID NO: 4791159 - DNA, 11 bp, Homo sapiens
ccactcctccc

SEQ ID NO: 4791160 - DNA, 17 bp, Homo sapiens
ccactcctcccaactct

SEQ ID NO: 4791161 - DNA, 18 bp, Homo sapiens
ccactcctcccaactctg

SEQ ID NO: 4791162 - DNA, 14 bp, Homo sapiens
ccactctcaggacc

SEQ ID NO: 4791163 - DNA, 17 bp, Homo sapiens
ccactctcaggaccacc

SEQ ID NO: 4791164 - DNA, 19 bp, Homo sapiens
ccactctcaggaccaccct

SEQ ID NO: 4791165 - DNA, 22 bp, Homo sapiens
ccactctgaagtcccttcctgt

SEQ ID NO: 4791166 - DNA, 23 bp, Homo sapiens
ccactctgaagtcccttcctgtc

SEQ ID NO: 4791167 - DNA, 15 bp, Homo sapiens
ccactgacagcctcc

SEQ ID NO: 4791168 - DNA, 20 bp, Homo sapiens
ccactgacagcctccacctt

SEQ ID NO: 4791169 - DNA, 24 bp, Homo sapiens
ccactgatatcacgggcccgctca

SEQ ID NO: 4791170 - DNA, 14 bp, Homo sapiens
ccactgcccctgca

SEQ ID NO: 4791171 - DNA, 16 bp, Homo sapiens
ccactgcgaccacaag

SEQ ID NO: 4791172 - DNA, 15 bp, Homo sapiens
ccactgggcctgcta

SEQ ID NO: 4791173 - DNA, 17 bp, Homo sapiens
ccactgggcctgctagt

SEQ ID NO: 4791174 - DNA, 16 bp, Homo sapiens
ccacttagaagatgtt

SEQ ID NO: 4791175 - DNA, 17 bp, Homo sapiens
ccacttatttccatgga

SEQ ID NO: 4791176 - DNA, 14 bp, Homo sapiens
ccacttccttaaca

SEQ ID NO: 4791177 - DNA, 18 bp, Homo sapiens
ccacttgatgtctgagga

SEQ ID NO: 4791178 - DNA, 21 bp, Homo sapiens
ccacttgctgcactcttgcac

SEQ ID NO: 4791179 - DNA, 18 bp, Homo sapiens
ccactttctagccagagg

SEQ ID NO: 4791180 - DNA, 19 bp, Homo sapiens
ccactttctagccagagga

SEQ ID NO: 4791181 - DNA, 22 bp, Homo sapiens
ccagaaactgaactggccgctg

SEQ ID NO: 4791182 - DNA, 18 bp, Homo sapiens
ccagaaagaggaataaaa

SEQ ID NO: 4791183 - DNA, 15 bp, Homo sapiens
ccagaacaaaagata

SEQ ID NO: 4791184 - DNA, 21 bp, Homo sapiens
ccagaaccttgatggggtgag

SEQ ID NO: 4791185 - DNA, 14 bp, Homo sapiens
ccagaagcagcagc

SEQ ID NO: 4791186 - DNA, 15 bp, Homo sapiens
ccagaagcagcagct

SEQ ID NO: 4791187 - DNA, 20 bp, Homo sapiens
ccagaatgaggcacatgaca

SEQ ID NO: 4791188 - DNA, 18 bp, Homo sapiens
ccagaatttcccaaagca

SEQ ID NO: 4791189 - DNA, 21 bp, Homo sapiens
ccagaatttcccaaagcagtg

SEQ ID NO: 4791190 - DNA, 20 bp, Homo sapiens
ccagacgtggtgcttctcac

SEQ ID NO: 4791191 - DNA, 17 bp, Homo sapiens
ccagactcgagagggct

SEQ ID NO: 4791192 - DNA, 22 bp, Homo sapiens
ccagactcgagagggctgagcc

SEQ ID NO: 4791193 - DNA, 22 bp, Homo sapiens
ccagactgcaggttggacccca

SEQ ID NO: 4791194 - DNA, 21 bp, Homo sapiens
ccagacttctaaaataaatgt

SEQ ID NO: 4791195 - DNA, 15 bp, Homo sapiens
ccagagaagcctcag

SEQ ID NO: 4791196 - DNA, 16 bp, Homo sapiens
ccagagacacaagcct

SEQ ID NO: 4791197 - DNA, 16 bp, Homo sapiens
ccagagacctgctcca

SEQ ID NO: 4791198 - DNA, 18 bp, Homo sapiens
ccagagactgcccaccct

SEQ ID NO: 4791199 - DNA, 19 bp, Homo sapiens
ccagagagaagcaccccac

SEQ ID NO: 4791200 - DNA, 20 bp, Homo sapiens
ccagagagaagcaccccacc

SEQ ID NO: 4791201 - DNA, 16 bp, Homo sapiens
ccagagagaccctgcc

SEQ ID NO: 4791202 - DNA, 19 bp, Homo sapiens
ccagagcctatggaaaggg

SEQ ID NO: 4791203 - DNA, 12 bp, Homo sapiens
ccagagcctctg

SEQ ID NO: 4791204 - DNA, 13 bp, Homo sapiens
ccagagcctgggc

SEQ ID NO: 4791205 - DNA, 16 bp, Homo sapiens
ccagagcctgggcgca

SEQ ID NO: 4791206 - DNA, 18 bp, Homo sapiens
ccagagcgatgtgttctt

SEQ ID NO: 4791207 - DNA, 12 bp, Homo sapiens
ccagagctgcca

SEQ ID NO: 4791208 - DNA, 21 bp, Homo sapiens
ccagaggagagaggaccccct

SEQ ID NO: 4791209 - DNA, 21 bp, Homo sapiens
ccagagtaggtgggtcttgga

SEQ ID NO: 4791210 - DNA, 11 bp, Homo sapiens
ccagagtctct

SEQ ID NO: 4791211 - DNA, 18 bp, Homo sapiens
ccagagtgtcctgctacc

SEQ ID NO: 4791212 - DNA, 13 bp, Homo sapiens
ccagatacctgtg

SEQ ID NO: 4791213 - DNA, 16 bp, Homo sapiens
ccagatacctgtgagg

SEQ ID NO: 4791214 - DNA, 18 bp, Homo sapiens
ccagatacctgtgaggac

SEQ ID NO: 4791215 - DNA, 17 bp, Homo sapiens
ccagatgcaacctcact

SEQ ID NO: 4791216 - DNA, 14 bp, Homo sapiens
ccagcaaaatatat

SEQ ID NO: 4791217 - DNA, 18 bp, Homo sapiens
ccagcaaagttttcagat

SEQ ID NO: 4791218 - DNA, 23 bp, Homo sapiens
ccagcaacattataatggccctg

SEQ ID NO: 4791219 - DNA, 17 bp, Homo sapiens
ccagcaccatctctcct

SEQ ID NO: 4791220 - DNA, 19 bp, Homo sapiens
ccagcaccctctcctgggg

SEQ ID NO: 4791221 - DNA, 20 bp, Homo sapiens
ccagcaccctctcctggggg

SEQ ID NO: 4791222 - DNA, 15 bp, Homo sapiens
ccagcactcccaggg

SEQ ID NO: 4791223 - DNA, 17 bp, Homo sapiens
ccagcactcccagggcc

SEQ ID NO: 4791224 - DNA, 21 bp, Homo sapiens
ccagcactcccagggcccgag

SEQ ID NO: 4791225 - DNA, 22 bp, Homo sapiens
ccagcactcccagggcccgagc

SEQ ID NO: 4791226 - DNA, 15 bp, Homo sapiens
ccagcagcgcccgag

SEQ ID NO: 4791227 - DNA, 19 bp, Homo sapiens
ccagcagcgcccgaggcca

SEQ ID NO: 4791228 - DNA, 20 bp, Homo sapiens
ccagcaggctctcaggccag

SEQ ID NO: 4791229 - DNA, 19 bp, Homo sapiens
ccagcagggcgggccagga

SEQ ID NO: 4791230 - DNA, 14 bp, Homo sapiens
ccagcatagttctg

SEQ ID NO: 4791231 - DNA, 20 bp, Homo sapiens
ccagccacccggatctccag

SEQ ID NO: 4791232 - DNA, 13 bp, Homo sapiens
ccagccatggctg

SEQ ID NO: 4791233 - DNA, 17 bp, Homo sapiens
ccagcccaggcaatagt

SEQ ID NO: 4791234 - DNA, 15 bp, Homo sapiens
ccagcccccaccccc

SEQ ID NO: 4791235 - DNA, 14 bp, Homo sapiens
ccagccccctggca

SEQ ID NO: 4791236 - DNA, 21 bp, Homo sapiens
ccagccctccgccagccctgt

SEQ ID NO: 4791237 - DNA, 22 bp, Homo sapiens
ccagccctccgccagccctgtt

SEQ ID NO: 4791238 - DNA, 15 bp, Homo sapiens
ccagccctgcccaga

SEQ ID NO: 4791239 - DNA, 17 bp, Homo sapiens
ccagccgagatagccaa

SEQ ID NO: 4791240 - DNA, 14 bp, Homo sapiens
ccagccgccctggg

SEQ ID NO: 4791241 - DNA, 15 bp, Homo sapiens
ccagccgccctgggc

SEQ ID NO: 4791242 - DNA, 17 bp, Homo sapiens
ccagccgccctgggctg

SEQ ID NO: 4791243 - DNA, 12 bp, Homo sapiens
ccagcctccccc

SEQ ID NO: 4791244 - DNA, 13 bp, Homo sapiens
ccagcctccccca

SEQ ID NO: 4791245 - DNA, 16 bp, Homo sapiens
ccagcctcccccaggc

SEQ ID NO: 4791246 - DNA, 17 bp, Homo sapiens
ccagcctcccccaggct

SEQ ID NO: 4791247 - DNA, 17 bp, Homo sapiens
ccagcctgagccacagt

SEQ ID NO: 4791248 - DNA, 19 bp, Homo sapiens
ccagcctgagccacagtgg

SEQ ID NO: 4791249 - DNA, 12 bp, Homo sapiens
ccagcctggccc

SEQ ID NO: 4791250 - DNA, 13 bp, Homo sapiens
ccagcctggcccc

SEQ ID NO: 4791251 - DNA, 18 bp, Homo sapiens
ccagcctggccccaagca

SEQ ID NO: 4791252 - DNA, 18 bp, Homo sapiens
ccagcctggggcctggca

SEQ ID NO: 4791253 - DNA, 20 bp, Homo sapiens
ccagcctggggcctggcagg

SEQ ID NO: 4791254 - DNA, 17 bp, Homo sapiens
ccagcgacgcggcccgc

SEQ ID NO: 4791255 - DNA, 15 bp, Homo sapiens
ccagcgctgaacaga

SEQ ID NO: 4791256 - DNA, 18 bp, Homo sapiens
ccagcgctgaacagaccg

SEQ ID NO: 4791257 - DNA, 23 bp, Homo sapiens
ccagcgctgaacagaccggggtg

SEQ ID NO: 4791258 - DNA, 18 bp, Homo sapiens
ccagcggctcttcctgga

SEQ ID NO: 4791259 - DNA, 14 bp, Homo sapiens
ccagctatctgtca

SEQ ID NO: 4791260 - DNA, 15 bp, Homo sapiens
ccagctatctgtcat

SEQ ID NO: 4791261 - DNA, 21 bp, Homo sapiens
ccagctcaggctactgccact

SEQ ID NO: 4791262 - DNA, 11 bp, Homo sapiens
ccagctcagtc

SEQ ID NO: 4791263 - DNA, 19 bp, Homo sapiens
ccagctcagtcccacagcc

SEQ ID NO: 4791264 - DNA, 15 bp, Homo sapiens
ccagctctgagcaga

SEQ ID NO: 4791265 - DNA, 16 bp, Homo sapiens
ccagctgcaggaatca

SEQ ID NO: 4791266 - DNA, 15 bp, Homo sapiens
ccagctgcttgggct

SEQ ID NO: 4791267 - DNA, 15 bp, Homo sapiens
ccagctggcagcgcc

SEQ ID NO: 4791268 - DNA, 16 bp, Homo sapiens
ccagctggcagcgcct

SEQ ID NO: 4791269 - DNA, 13 bp, Homo sapiens
ccagctggctggg

SEQ ID NO: 4791270 - DNA, 16 bp, Homo sapiens
ccagctggctgggtcg

SEQ ID NO: 4791271 - DNA, 16 bp, Homo sapiens
ccagctggtgaatcca

SEQ ID NO: 4791272 - DNA, 16 bp, Homo sapiens
ccagctgtaccggcca

SEQ ID NO: 4791273 - DNA, 22 bp, Homo sapiens
ccagctgtaccggccactgcaa

SEQ ID NO: 4791274 - DNA, 16 bp, Homo sapiens
ccagcttggagtgcca

SEQ ID NO: 4791275 - DNA, 16 bp, Homo sapiens
ccagctttctctttgt

SEQ ID NO: 4791276 - DNA, 16 bp, Homo sapiens
ccaggaaaactgtttt

SEQ ID NO: 4791277 - DNA, 14 bp, Homo sapiens
ccaggaagccagca

SEQ ID NO: 4791278 - DNA, 20 bp, Homo sapiens
ccaggaagccagcaggctct

SEQ ID NO: 4791279 - DNA, 15 bp, Homo sapiens
ccaggaaggggacag

SEQ ID NO: 4791280 - DNA, 17 bp, Homo sapiens
ccaggaaggggacagga

SEQ ID NO: 4791281 - DNA, 14 bp, Homo sapiens
ccaggaagtaattt

SEQ ID NO: 4791282 - DNA, 20 bp, Homo sapiens
ccaggaagtcatcctgcaat

SEQ ID NO: 4791283 - DNA, 16 bp, Homo sapiens
ccaggaattctcacag

SEQ ID NO: 4791284 - DNA, 18 bp, Homo sapiens
ccaggacccccccagtcc

SEQ ID NO: 4791285 - DNA, 23 bp, Homo sapiens
ccaggaccctgggtcaccttcct

SEQ ID NO: 4791286 - DNA, 22 bp, Homo sapiens
ccaggaccttgcttccttctca

SEQ ID NO: 4791287 - DNA, 17 bp, Homo sapiens
ccaggacgcatgcaggg

SEQ ID NO: 4791288 - DNA, 17 bp, Homo sapiens
ccaggagaccctgtctt

SEQ ID NO: 4791289 - DNA, 13 bp, Homo sapiens
ccaggaggcctgg

SEQ ID NO: 4791290 - DNA, 23 bp, Homo sapiens
ccaggattgtccacaaatgtcct

SEQ ID NO: 4791291 - DNA, 22 bp, Homo sapiens
ccaggcaatagtgttgaggagg

SEQ ID NO: 4791292 - DNA, 19 bp, Homo sapiens
ccaggcaggcaaaggcccc

SEQ ID NO: 4791293 - DNA, 17 bp, Homo sapiens
ccaggcccagcctggcc

SEQ ID NO: 4791294 - DNA, 15 bp, Homo sapiens
ccaggcccgccctgc

SEQ ID NO: 4791295 - DNA, 16 bp, Homo sapiens
ccaggcccgccctgcc

SEQ ID NO: 4791296 - DNA, 18 bp, Homo sapiens
ccaggccctctctgcagt

SEQ ID NO: 4791297 - DNA, 14 bp, Homo sapiens
ccaggccgaggaag

SEQ ID NO: 4791298 - DNA, 18 bp, Homo sapiens
ccaggcctcctacagctt

SEQ ID NO: 4791299 - DNA, 19 bp, Homo sapiens
ccaggcctcctacagcttg

SEQ ID NO: 4791300 - DNA, 22 bp, Homo sapiens
ccaggcggaggggcttggagca

SEQ ID NO: 4791301 - DNA, 12 bp, Homo sapiens
ccaggctgcagg

SEQ ID NO: 4791302 - DNA, 12 bp, Homo sapiens
ccaggctgcgcc

SEQ ID NO: 4791303 - DNA, 15 bp, Homo sapiens
ccaggctgcgcctgc

SEQ ID NO: 4791304 - DNA, 16 bp, Homo sapiens
ccaggctgcgcctgcc

SEQ ID NO: 4791305 - DNA, 20 bp, Homo sapiens
ccaggctgcgcctgcccgcc

SEQ ID NO: 4791306 - DNA, 14 bp, Homo sapiens
ccagggaaccagag

SEQ ID NO: 4791307 - DNA, 22 bp, Homo sapiens
ccagggactgcagctgcaccag

SEQ ID NO: 4791308 - DNA, 13 bp, Homo sapiens
ccagggagggggt

SEQ ID NO: 4791309 - DNA, 14 bp, Homo sapiens
ccagggcagtgcta

SEQ ID NO: 4791310 - DNA, 17 bp, Homo sapiens
ccagggccctgctcagg

SEQ ID NO: 4791311 - DNA, 19 bp, Homo sapiens
ccagggccctgctcaggcc

SEQ ID NO: 4791312 - DNA, 14 bp, Homo sapiens
ccaggggctgggga

SEQ ID NO: 4791313 - DNA, 20 bp, Homo sapiens
ccagggggaagatgccaagg

SEQ ID NO: 4791314 - DNA, 12 bp, Homo sapiens
ccaggggtcagc

SEQ ID NO: 4791315 - DNA, 14 bp, Homo sapiens
ccagggtccagccc

SEQ ID NO: 4791316 - DNA, 15 bp, Homo sapiens
ccagggtccagccct

SEQ ID NO: 4791317 - DNA, 17 bp, Homo sapiens
ccagggtgcaggcgcgc

SEQ ID NO: 4791318 - DNA, 18 bp, Homo sapiens
ccagggttaaagaaaggc

SEQ ID NO: 4791319 - DNA, 20 bp, Homo sapiens
ccagggttaaagaaaggcag

SEQ ID NO: 4791320 - DNA, 15 bp, Homo sapiens
ccagggttccagaca

SEQ ID NO: 4791321 - DNA, 23 bp, Homo sapiens
ccaggtatctgatgatgttctga

SEQ ID NO: 4791322 - DNA, 22 bp, Homo sapiens
ccaggtgttgtccgtgtctgtt

SEQ ID NO: 4791323 - DNA, 11 bp, Homo sapiens
ccaggttcctc

SEQ ID NO: 4791324 - DNA, 19 bp, Homo sapiens
ccaggttgactaagaaatg

SEQ ID NO: 4791325 - DNA, 18 bp, Homo sapiens
ccaggttggagtgcagtg

SEQ ID NO: 4791326 - DNA, 22 bp, Homo sapiens
ccaggtttaagtagatttcatg

SEQ ID NO: 4791327 - DNA, 17 bp, Homo sapiens
ccagtcatggctgtccc

SEQ ID NO: 4791328 - DNA, 18 bp, Homo sapiens
ccagtcatggctgtcccc

SEQ ID NO: 4791329 - DNA, 21 bp, Homo sapiens
ccagtcatggctgtcccctgc

SEQ ID NO: 4791330 - DNA, 22 bp, Homo sapiens
ccagtcatggctgtcccctgca

SEQ ID NO: 4791331 - DNA, 15 bp, Homo sapiens
ccagtccccctatcc

SEQ ID NO: 4791332 - DNA, 18 bp, Homo sapiens
ccagtccccctatccttg

SEQ ID NO: 4791333 - DNA, 14 bp, Homo sapiens
ccagtccgccccgt

SEQ ID NO: 4791334 - DNA, 15 bp, Homo sapiens
ccagtccggtgcctt

SEQ ID NO: 4791335 - DNA, 20 bp, Homo sapiens
ccagtccggtgccttccacc

SEQ ID NO: 4791336 - DNA, 17 bp, Homo sapiens
ccagtctgaagtttcat

SEQ ID NO: 4791337 - DNA, 14 bp, Homo sapiens
ccagtcttctagtg

SEQ ID NO: 4791338 - DNA, 15 bp, Homo sapiens
ccagtcttttgtcct

SEQ ID NO: 4791339 - DNA, 20 bp, Homo sapiens
ccagtgcaatctgtccagac

SEQ ID NO: 4791340 - DNA, 21 bp, Homo sapiens
ccagtgcaatctgtccagaca

SEQ ID NO: 4791341 - DNA, 19 bp, Homo sapiens
ccagtgcagtagtgccaaa

SEQ ID NO: 4791342 - DNA, 19 bp, Homo sapiens
ccagtgcttagcaaaaaat

SEQ ID NO: 4791343 - DNA, 19 bp, Homo sapiens
ccagtgctttatccacatt

SEQ ID NO: 4791344 - DNA, 18 bp, Homo sapiens
ccagtggtggaggtgggt

SEQ ID NO: 4791345 - DNA, 20 bp, Homo sapiens
ccagtgtctggcccagccat

SEQ ID NO: 4791346 - DNA, 23 bp, Homo sapiens
ccagtgtctggcccagccatggc

SEQ ID NO: 4791347 - DNA, 21 bp, Homo sapiens
ccagttaaggaccgtggccct

SEQ ID NO: 4791348 - DNA, 22 bp, Homo sapiens
ccagttaaggaccgtggccctg

SEQ ID NO: 4791349 - DNA, 17 bp, Homo sapiens
ccagttaatgtgccaaa

SEQ ID NO: 4791350 - DNA, 16 bp, Homo sapiens
ccagttagcccggcca

SEQ ID NO: 4791351 - DNA, 19 bp, Homo sapiens
ccagttagcccggccaagg

SEQ ID NO: 4791352 - DNA, 21 bp, Homo sapiens
ccagttagcccggccaaggac

SEQ ID NO: 4791353 - DNA, 14 bp, Homo sapiens
ccagttctgatgag

SEQ ID NO: 4791354 - DNA, 18 bp, Homo sapiens
ccagttgtatattattct

SEQ ID NO: 4791355 - DNA, 14 bp, Homo sapiens
ccataaaataaata

SEQ ID NO: 4791356 - DNA, 19 bp, Homo sapiens
ccataacttgtttgtaaaa

SEQ ID NO: 4791357 - DNA, 23 bp, Homo sapiens
ccataatgcttctttcctcttaa

SEQ ID NO: 4791358 - DNA, 22 bp, Homo sapiens
ccataccccctgccccagagaa

SEQ ID NO: 4791359 - DNA, 18 bp, Homo sapiens
ccatagaaacatgacact

SEQ ID NO: 4791360 - DNA, 12 bp, Homo sapiens
ccatagacacag

SEQ ID NO: 4791361 - DNA, 17 bp, Homo sapiens
ccatagccccaggcccg

SEQ ID NO: 4791362 - DNA, 16 bp, Homo sapiens
ccatatataaattatt

SEQ ID NO: 4791363 - DNA, 17 bp, Homo sapiens
ccatatataaattatta

SEQ ID NO: 4791364 - DNA, 19 bp, Homo sapiens
ccatatataaattattact

SEQ ID NO: 4791365 - DNA, 14 bp, Homo sapiens
ccatatcagctctg

SEQ ID NO: 4791366 - DNA, 23 bp, Homo sapiens
ccatattaaaatcacaaactcat

SEQ ID NO: 4791367 - DNA, 17 bp, Homo sapiens
ccatcaccacgcagaga

SEQ ID NO: 4791368 - DNA, 13 bp, Homo sapiens
ccatcaccagaaa

SEQ ID NO: 4791369 - DNA, 17 bp, Homo sapiens
ccatcactgtgtctcat

SEQ ID NO: 4791370 - DNA, 14 bp, Homo sapiens
ccatcatttcattc

SEQ ID NO: 4791371 - DNA, 22 bp, Homo sapiens
ccatccacacacagcagctcca

SEQ ID NO: 4791372 - DNA, 13 bp, Homo sapiens
ccatccaccacct

SEQ ID NO: 4791373 - DNA, 16 bp, Homo sapiens
ccatccaccaccttgc

SEQ ID NO: 4791374 - DNA, 12 bp, Homo sapiens
ccatccaccctg

SEQ ID NO: 4791375 - DNA, 14 bp, Homo sapiens
caggctctcaggcc

SEQ ID NO: 4791376 - DNA, 17 bp, Homo sapiens
caggctctcaggccagc

SEQ ID NO: 4791377 - DNA, 19 bp, Homo sapiens
caggctctcaggccagctg

SEQ ID NO: 4791378 - DNA, 20 bp, Homo sapiens
caggctgatgccgtgcgggc

SEQ ID NO: 4791379 - DNA, 12 bp, Homo sapiens
caggctgcccag

SEQ ID NO: 4791380 - DNA, 19 bp, Homo sapiens
caggctgcccagcggctct

SEQ ID NO: 4791381 - DNA, 22 bp, Homo sapiens
caggctgccgctgctctcccag

SEQ ID NO: 4791382 - DNA, 13 bp, Homo sapiens
caggctgcgcctg

SEQ ID NO: 4791383 - DNA, 15 bp, Homo sapiens
caggctgcgcctgcc

SEQ ID NO: 4791384 - DNA, 17 bp, Homo sapiens
caggcttcgtttgcctc

SEQ ID NO: 4791385 - DNA, 16 bp, Homo sapiens
catagattaatggcac

SEQ ID NO: 4791386 - DNA, 18 bp, Homo sapiens
catagattaatggcactg

SEQ ID NO: 4791387 - DNA, 19 bp, Homo sapiens
catagattaatggcactga

SEQ ID NO: 4791388 - DNA, 22 bp, Homo sapiens
catagattcacctgtaaaactt

SEQ ID NO: 4791389 - DNA, 21 bp, Homo sapiens
catagccattcatttacaact

SEQ ID NO: 4791390 - DNA, 22 bp, Homo sapiens
catagccccaggcccgccctgc

SEQ ID NO: 4791391 - DNA, 23 bp, Homo sapiens
catagccccaggcccgccctgcc

SEQ ID NO: 4791392 - DNA, 21 bp, Homo sapiens
catagctttagagaagccata

SEQ ID NO: 4791393 - DNA, 18 bp, Homo sapiens
catagtcaatcaaacagg

SEQ ID NO: 4791394 - DNA, 19 bp, Homo sapiens
catagtcaatcaaacaggg

SEQ ID NO: 4791395 - DNA, 20 bp, Homo sapiens
catagtctgaagtgaagtac

SEQ ID NO: 4791396 - DNA, 15 bp, Homo sapiens
catagtggtatttta

SEQ ID NO: 4791397 - DNA, 18 bp, Homo sapiens
catagttctgcaataaca

SEQ ID NO: 4791398 - DNA, 19 bp, Homo sapiens
catataaacacagtaagat

SEQ ID NO: 4791399 - DNA, 11 bp, Homo sapiens
catataaatgt

SEQ ID NO: 4791400 - DNA, 12 bp, Homo sapiens
catataaatgtt

SEQ ID NO: 4791401 - DNA, 17 bp, Homo sapiens
catataaatgtttatat

SEQ ID NO: 4791402 - DNA, 20 bp, Homo sapiens
catataaatgtttatattgt

SEQ ID NO: 4791403 - DNA, 19 bp, Homo sapiens
catataaggctaaatgtaa

SEQ ID NO: 4791404 - DNA, 20 bp, Homo sapiens
catataatttgccagacaga

SEQ ID NO: 4791405 - DNA, 19 bp, Homo sapiens
catatacattatttctgta

SEQ ID NO: 4791406 - DNA, 20 bp, Homo sapiens
catatacattatttctgtat

SEQ ID NO: 4791407 - DNA, 21 bp, Homo sapiens
catataggggcaaaaatttga

SEQ ID NO: 4791408 - DNA, 23 bp, Homo sapiens
catataggggcaaaaatttgaca

SEQ ID NO: 4791409 - DNA, 24 bp, Homo sapiens
catataggggcaaaaatttgacat

SEQ ID NO: 4791410 - DNA, 12 bp, Homo sapiens
catatataaatt

SEQ ID NO: 4791411 - DNA, 18 bp, Homo sapiens
catatatgcttttttgca

SEQ ID NO: 4791412 - DNA, 22 bp, Homo sapiens
catatatgcttttttgcaataa

SEQ ID NO: 4791413 - DNA, 13 bp, Homo sapiens
catatcagctctg

SEQ ID NO: 4791414 - DNA, 14 bp, Homo sapiens
catatcatttctta

SEQ ID NO: 4791415 - DNA, 15 bp, Homo sapiens
catatgtaggaaaat

SEQ ID NO: 4791416 - DNA, 17 bp, Homo sapiens
catatgtaggaaaattt

SEQ ID NO: 4791417 - DNA, 19 bp, Homo sapiens
catatgtaggaaaattttc

SEQ ID NO: 4791418 - DNA, 21 bp, Homo sapiens
catatgtaggaaaattttctt

SEQ ID NO: 4791419 - DNA, 13 bp, Homo sapiens
catatgtatgtgt

SEQ ID NO: 4791420 - DNA, 14 bp, Homo sapiens
catatgtatgtgtg

SEQ ID NO: 4791421 - DNA, 23 bp, Homo sapiens
catatgtatgtgtgagtgtatgt

SEQ ID NO: 4791422 - DNA, 14 bp, Homo sapiens
catatgtgaagaca

SEQ ID NO: 4791423 - DNA, 19 bp, Homo sapiens
catattcaaagtatataca

SEQ ID NO: 4791424 - DNA, 15 bp, Homo sapiens
catattgataataaa

SEQ ID NO: 4791425 - DNA, 14 bp, Homo sapiens
catatttttcaaaa

SEQ ID NO: 4791426 - DNA, 16 bp, Homo sapiens
catcaaacaaatcatt

SEQ ID NO: 4791427 - DNA, 19 bp, Homo sapiens
catcaaacaaatcattttg

SEQ ID NO: 4791428 - DNA, 21 bp, Homo sapiens
catcaaatgaataatgccttt

SEQ ID NO: 4791429 - DNA, 22 bp, Homo sapiens
catcaagaaacattcagaccag

SEQ ID NO: 4791430 - DNA, 23 bp, Homo sapiens
catcaagattaattaaaatttgg

SEQ ID NO: 4791431 - DNA, 18 bp, Homo sapiens
catcaagtagtagtactt

SEQ ID NO: 4791432 - DNA, 14 bp, Homo sapiens
catcaatcattgta

SEQ ID NO: 4791433 - DNA, 20 bp, Homo sapiens
catcaatcattgtacagttt

SEQ ID NO: 4791434 - DNA, 15 bp, Homo sapiens
catcaccacagctgc

SEQ ID NO: 4791435 - DNA, 15 bp, Homo sapiens
catcaccacgcagag

SEQ ID NO: 4791436 - DNA, 15 bp, Homo sapiens
catcaccggaggagc

SEQ ID NO: 4791437 - DNA, 16 bp, Homo sapiens
catcactatccatgca

SEQ ID NO: 4791438 - DNA, 14 bp, Homo sapiens
catcatctcagctc

SEQ ID NO: 4791439 - DNA, 14 bp, Homo sapiens
catcatgtctattg

SEQ ID NO: 4791440 - DNA, 16 bp, Homo sapiens
catcatttcattcgtg

SEQ ID NO: 4791441 - DNA, 18 bp, Homo sapiens
catccaaaagtgaccagc

SEQ ID NO: 4791442 - DNA, 21 bp, Homo sapiens
catccaaaagtgaccagcata

SEQ ID NO: 4791443 - DNA, 16 bp, Homo sapiens
catccaaacctacctt

SEQ ID NO: 4791444 - DNA, 17 bp, Homo sapiens
catccaaacctacctta

SEQ ID NO: 4791445 - DNA, 22 bp, Homo sapiens
catccaaggaagggatgtattt

SEQ ID NO: 4791446 - DNA, 18 bp, Homo sapiens
catccacatgcacatgta

SEQ ID NO: 4791447 - DNA, 17 bp, Homo sapiens
catccaccctgaggagt

SEQ ID NO: 4791448 - DNA, 20 bp, Homo sapiens
catccactaggtgcccagtc

SEQ ID NO: 4791449 - DNA, 16 bp, Homo sapiens
catccagtttgttctc

SEQ ID NO: 4791450 - DNA, 13 bp, Homo sapiens
catcccactgata

SEQ ID NO: 4791451 - DNA, 19 bp, Homo sapiens
catcccatatgcctgggca

SEQ ID NO: 4791452 - DNA, 14 bp, Homo sapiens
catccctccttaag

SEQ ID NO: 4791453 - DNA, 16 bp, Homo sapiens
catccctccttaagag

SEQ ID NO: 4791454 - DNA, 19 bp, Homo sapiens
catccctgggcccctccac

SEQ ID NO: 4791455 - DNA, 24 bp, Homo sapiens
catccctgggcccctccacgcctc

SEQ ID NO: 4791456 - DNA, 13 bp, Homo sapiens
catccctggtgaa

SEQ ID NO: 4791457 - DNA, 15 bp, Homo sapiens
catcccttggcccct

SEQ ID NO: 4791458 - DNA, 18 bp, Homo sapiens
catcccttggcccctctc

SEQ ID NO: 4791459 - DNA, 13 bp, Homo sapiens
catccgagcccct

SEQ ID NO: 4791460 - DNA, 14 bp, Homo sapiens
catccgagcccctg

SEQ ID NO: 4791461 - DNA, 22 bp, Homo sapiens
catccgtaccatcggtcagcag

SEQ ID NO: 4791462 - DNA, 17 bp, Homo sapiens
catcctcacatgtggca

SEQ ID NO: 4791463 - DNA, 15 bp, Homo sapiens
catcctcagccccag

SEQ ID NO: 4791464 - DNA, 16 bp, Homo sapiens
catcctcagccccagg

SEQ ID NO: 4791465 - DNA, 19 bp, Homo sapiens
catcctcagccccagggcc

SEQ ID NO: 4791466 - DNA, 23 bp, Homo sapiens
catcctcagccccagggccctgc

SEQ ID NO: 4791467 - DNA, 16 bp, Homo sapiens
catcctcctcagatct

SEQ ID NO: 4791468 - DNA, 17 bp, Homo sapiens
catcctcttatatgtgc

SEQ ID NO: 4791469 - DNA, 20 bp, Homo sapiens
catccttcccgcagcaccag

SEQ ID NO: 4791470 - DNA, 17 bp, Homo sapiens
catccttgcacttctgt

SEQ ID NO: 4791471 - DNA, 15 bp, Homo sapiens
catcgatttgtatta

SEQ ID NO: 4791472 - DNA, 15 bp, Homo sapiens
catcgcagcccctgt

SEQ ID NO: 4791473 - DNA, 22 bp, Homo sapiens
catcgccttctggccgctgcag

SEQ ID NO: 4791474 - DNA, 15 bp, Homo sapiens
catcgccttctgggg

SEQ ID NO: 4791475 - DNA, 21 bp, Homo sapiens
catcggaggctgggcccctgg

SEQ ID NO: 4791476 - DNA, 23 bp, Homo sapiens
catcggaggctgggcccctggga

SEQ ID NO: 4791477 - DNA, 14 bp, Homo sapiens
catcggtcagcagg

SEQ ID NO: 4791478 - DNA, 18 bp, Homo sapiens
catcggtgtccatttata

SEQ ID NO: 4791479 - DNA, 20 bp, Homo sapiens
catctacacatataaacaca

SEQ ID NO: 4791480 - DNA, 23 bp, Homo sapiens
catctacacatataaacacagta

SEQ ID NO: 4791481 - DNA, 23 bp, Homo sapiens
catctcaggtggcatttgcaggt

SEQ ID NO: 4791482 - DNA, 18 bp, Homo sapiens
catctccaaatcttgcca

SEQ ID NO: 4791483 - DNA, 21 bp, Homo sapiens
catctctccccatatataaat

SEQ ID NO: 4791484 - DNA, 21 bp, Homo sapiens
catctctctggggccctgggc

SEQ ID NO: 4791485 - DNA, 13 bp, Homo sapiens
catctctgacttt

SEQ ID NO: 4791486 - DNA, 17 bp, Homo sapiens
catctctgtaaaaagca

SEQ ID NO: 4791487 - DNA, 15 bp, Homo sapiens
catctcttcatgcgc

SEQ ID NO: 4791488 - DNA, 17 bp, Homo sapiens
catctgaggagtccaaa

SEQ ID NO: 4791489 - DNA, 22 bp, Homo sapiens
catctgatatcaggaaatatct

SEQ ID NO: 4791490 - DNA, 14 bp, Homo sapiens
catctgatttctga

SEQ ID NO: 4791491 - DNA, 13 bp, Homo sapiens
catctgctcttct

SEQ ID NO: 4791492 - DNA, 16 bp, Homo sapiens
catctggcctatgacc

SEQ ID NO: 4791493 - DNA, 18 bp, Homo sapiens
catctggcctatgaccct

SEQ ID NO: 4791494 - DNA, 11 bp, Homo sapiens
catctggcctg

SEQ ID NO: 4791495 - DNA, 20 bp, Homo sapiens
catctggcctggcctggccc

SEQ ID NO: 4791496 - DNA, 21 bp, Homo sapiens
catctggcctggcctggccct

SEQ ID NO: 4791497 - DNA, 23 bp, Homo sapiens
catctggcctggcctggccctgc

SEQ ID NO: 4791498 - DNA, 20 bp, Homo sapiens
catctgtaaaaccaggctga

SEQ ID NO: 4791499 - DNA, 18 bp, Homo sapiens
catctgtaaaatagtctc

SEQ ID NO: 4791500 - DNA, 13 bp, Homo sapiens
catctgtcagctt

SEQ ID NO: 4791501 - DNA, 21 bp, Homo sapiens
catctgtgtgtgaattccttt

SEQ ID NO: 4791502 - DNA, 20 bp, Homo sapiens
catcttgaagggcccaggag

SEQ ID NO: 4791503 - DNA, 12 bp, Homo sapiens
catcttgtaaat

SEQ ID NO: 4791504 - DNA, 12 bp, Homo sapiens
catcttgtgcat

SEQ ID NO: 4791505 - DNA, 14 bp, Homo sapiens
catcttgtgcatgc

SEQ ID NO: 4791506 - DNA, 20 bp, Homo sapiens
catgtgagaaagcagatcat

SEQ ID NO: 4791507 - DNA, 18 bp, Homo sapiens
catgtggaaaactcacag

SEQ ID NO: 4791508 - DNA, 15 bp, Homo sapiens
catgtgtcccccctg

SEQ ID NO: 4791509 - DNA, 24 bp, Homo sapiens
catgtgtcccctcactctgtcagc

SEQ ID NO: 4791510 - DNA, 15 bp, Homo sapiens
catgtgtgagtcact

SEQ ID NO: 4791511 - DNA, 13 bp, Homo sapiens
catgtgtgtcagc

SEQ ID NO: 4791512 - DNA, 21 bp, Homo sapiens
catgtgtgtcagcccatgtca

SEQ ID NO: 4791513 - DNA, 14 bp, Homo sapiens
catgtgtttatcct

SEQ ID NO: 4791514 - DNA, 13 bp, Homo sapiens
catgttaaaataa

SEQ ID NO: 4791515 - DNA, 17 bp, Homo sapiens
catgttctcaataccca

SEQ ID NO: 4791516 - DNA, 11 bp, Homo sapiens
catgttctgtg

SEQ ID NO: 4791517 - DNA, 18 bp, Homo sapiens
catgttctgtgtcacgtg

SEQ ID NO: 4791518 - DNA, 18 bp, Homo sapiens
catgtttaagaaatgaga

SEQ ID NO: 4791519 - DNA, 22 bp, Homo sapiens
catgtttctgcagtattctgta

SEQ ID NO: 4791520 - DNA, 21 bp, Homo sapiens
catgttttacaaagaaacaaa

SEQ ID NO: 4791521 - DNA, 15 bp, Homo sapiens
cattaaaacaagaga

SEQ ID NO: 4791522 - DNA, 17 bp, Homo sapiens
cattaaacttctactga

SEQ ID NO: 4791523 - DNA, 17 bp, Homo sapiens
cattaagaacaaggaat

SEQ ID NO: 4791524 - DNA, 22 bp, Homo sapiens
cattaagtattccttggcccag

SEQ ID NO: 4791525 - DNA, 22 bp, Homo sapiens
cattacatcctctgcttgtcat

SEQ ID NO: 4791526 - DNA, 20 bp, Homo sapiens
cattactattaactctgcat

SEQ ID NO: 4791527 - DNA, 19 bp, Homo sapiens
cattactcaaaatgcagga

SEQ ID NO: 4791528 - DNA, 20 bp, Homo sapiens
cattagaattgaattattgg

SEQ ID NO: 4791529 - DNA, 15 bp, Homo sapiens
cattagacacacata

SEQ ID NO: 4791530 - DNA, 20 bp, Homo sapiens
cattagacacacatatacat

SEQ ID NO: 4791531 - DNA, 14 bp, Homo sapiens
cattagcccactgc

SEQ ID NO: 4791532 - DNA, 22 bp, Homo sapiens
cattaggaacagagtatatatg

SEQ ID NO: 4791533 - DNA, 22 bp, Homo sapiens
cattaggtagatgagaaaacag

SEQ ID NO: 4791534 - DNA, 11 bp, Homo sapiens
cattagtatcc

SEQ ID NO: 4791535 - DNA, 19 bp, Homo sapiens
cattatagattttcatgtt

SEQ ID NO: 4791536 - DNA, 14 bp, Homo sapiens
cattcaaaaatttc

SEQ ID NO: 4791537 - DNA, 16 bp, Homo sapiens
cattcagatctgaagt

SEQ ID NO: 4791538 - DNA, 17 bp, Homo sapiens
cattcagatctgaagta

SEQ ID NO: 4791539 - DNA, 19 bp, Homo sapiens
cattcatactcaaagaggc

SEQ ID NO: 4791540 - DNA, 14 bp, Homo sapiens
cattcatcctcaca

SEQ ID NO: 4791541 - DNA, 17 bp, Homo sapiens
cattcatcctcacatgt

SEQ ID NO: 4791542 - DNA, 18 bp, Homo sapiens
cattcatcctcacatgtg

SEQ ID NO: 4791543 - DNA, 14 bp, Homo sapiens
cattcatcctctta

SEQ ID NO: 4791544 - DNA, 13 bp, Homo sapiens
cattccacagagt

SEQ ID NO: 4791545 - DNA, 23 bp, Homo sapiens
cattccaggggctgcagccccct

SEQ ID NO: 4791546 - DNA, 12 bp, Homo sapiens
cattcctgttcc

SEQ ID NO: 4791547 - DNA, 14 bp, Homo sapiens
cattcgttgctcca

SEQ ID NO: 4791548 - DNA, 18 bp, Homo sapiens
cattctatctactgattt

SEQ ID NO: 4791549 - DNA, 20 bp, Homo sapiens
cattctgaaggccttgttaa

SEQ ID NO: 4791550 - DNA, 20 bp, Homo sapiens
cattctgattggacctggcc

SEQ ID NO: 4791551 - DNA, 20 bp, Homo sapiens
cattctggggtggggcttgg

SEQ ID NO: 4791552 - DNA, 14 bp, Homo sapiens
cattctgttccacc

SEQ ID NO: 4791553 - DNA, 12 bp, Homo sapiens
cattcttgctct

SEQ ID NO: 4791554 - DNA, 13 bp, Homo sapiens
cattcttttaaat

SEQ ID NO: 4791555 - DNA, 12 bp, Homo sapiens
cattgaaataat

SEQ ID NO: 4791556 - DNA, 14 bp, Homo sapiens
cattgaaataataa

SEQ ID NO: 4791557 - DNA, 13 bp, Homo sapiens
cattgaaatactt

SEQ ID NO: 4791558 - DNA, 22 bp, Homo sapiens
cattgaagggggatgcaggcaa

SEQ ID NO: 4791559 - DNA, 22 bp, Homo sapiens
cattgcaggaagagatgctcta

SEQ ID NO: 4791560 - DNA, 21 bp, Homo sapiens
cattgccaaggcatccccagt

SEQ ID NO: 4791561 - DNA, 13 bp, Homo sapiens
cattgccttctgg

SEQ ID NO: 4791562 - DNA, 15 bp, Homo sapiens
cattgccttctgggg

SEQ ID NO: 4791563 - DNA, 11 bp, Homo sapiens
cattgcttcac

SEQ ID NO: 4791564 - DNA, 15 bp, Homo sapiens
cattgcttcactacc

SEQ ID NO: 4791565 - DNA, 14 bp, Homo sapiens
cattgcttcattaa

SEQ ID NO: 4791566 - DNA, 15 bp, Homo sapiens
cattgcttcattaaa

SEQ ID NO: 4791567 - DNA, 18 bp, Homo sapiens
cattggccttaactggcc

SEQ ID NO: 4791568 - DNA, 20 bp, Homo sapiens
cattggccttaactggccct

SEQ ID NO: 4791569 - DNA, 21 bp, Homo sapiens
cattggccttaactggccctc

SEQ ID NO: 4791570 - DNA, 22 bp, Homo sapiens
cattggccttaactggccctcg

SEQ ID NO: 4791571 - DNA, 19 bp, Homo sapiens
cattggggggccgggcagg

SEQ ID NO: 4791572 - DNA, 14 bp, Homo sapiens
cattggttacaaat

SEQ ID NO: 4791573 - DNA, 15 bp, Homo sapiens
cattggttacaaatt

SEQ ID NO: 4791574 - DNA, 21 bp, Homo sapiens
cattgtagcctaatattcatg

SEQ ID NO: 4791575 - DNA, 13 bp, Homo sapiens
cattgtcagaatg

SEQ ID NO: 4791576 - DNA, 14 bp, Homo sapiens
cattgtcagaatgt

SEQ ID NO: 4791577 - DNA, 13 bp, Homo sapiens
cattgtcagagat

SEQ ID NO: 4791578 - DNA, 21 bp, Homo sapiens
cattgtcagagatgttttcaa

SEQ ID NO: 4791579 - DNA, 15 bp, Homo sapiens
cattgtctgtctgca

SEQ ID NO: 4791580 - DNA, 16 bp, Homo sapiens
cattgtgccctgtagc

SEQ ID NO: 4791581 - DNA, 15 bp, Homo sapiens
cattgtttgtccttt

SEQ ID NO: 4791582 - DNA, 13 bp, Homo sapiens
catttaaaacaag

SEQ ID NO: 4791583 - DNA, 13 bp, Homo sapiens
catttaatcattt

SEQ ID NO: 4791584 - DNA, 18 bp, Homo sapiens
catttacaacttccagat

SEQ ID NO: 4791585 - DNA, 22 bp, Homo sapiens
catttacaacttccagatttga

SEQ ID NO: 4791586 - DNA, 22 bp, Homo sapiens
catttagcacagtatttaacat

SEQ ID NO: 4791587 - DNA, 19 bp, Homo sapiens
catttagcatgagttctgc

SEQ ID NO: 4791588 - DNA, 16 bp, Homo sapiens
catttaggtgaggaag

SEQ ID NO: 4791589 - DNA, 16 bp, Homo sapiens
catttatgttatttat

SEQ ID NO: 4791590 - DNA, 20 bp, Homo sapiens
catttatgttatttatgatg

SEQ ID NO: 4791591 - DNA, 21 bp, Homo sapiens
catttatgttatttatgatgt

SEQ ID NO: 4791592 - DNA, 19 bp, Homo sapiens
catttatttccatattaaa

SEQ ID NO: 4791593 - DNA, 16 bp, Homo sapiens
catttcacacaactgt

SEQ ID NO: 4791594 - DNA, 20 bp, Homo sapiens
catttcccctgtggtttgtt

SEQ ID NO: 4791595 - DNA, 21 bp, Homo sapiens
catttcttccacaagagccca

SEQ ID NO: 4791596 - DNA, 19 bp, Homo sapiens
catttcttctctctgtgct

SEQ ID NO: 4791597 - DNA, 20 bp, Homo sapiens
catttcttctctctgtgctg

SEQ ID NO: 4791598 - DNA, 16 bp, Homo sapiens
catttgagagaagcca

SEQ ID NO: 4791599 - DNA, 13 bp, Homo sapiens
catttgatattgt

SEQ ID NO: 4791600 - DNA, 16 bp, Homo sapiens
catttgatattgtgta

SEQ ID NO: 4791601 - DNA, 14 bp, Homo sapiens
catttgatttgata

SEQ ID NO: 4791602 - DNA, 21 bp, Homo sapiens
catttgcaggtgaccagaatg

SEQ ID NO: 4791603 - DNA, 18 bp, Homo sapiens
catttgctaatgaatttt

SEQ ID NO: 4791604 - DNA, 21 bp, Homo sapiens
catttgctaatgaattttaaa

SEQ ID NO: 4791605 - DNA, 20 bp, Homo sapiens
catttgctgaataacaacaa

SEQ ID NO: 4791606 - DNA, 23 bp, Homo sapiens
catttgctgattgtctgaaattt

SEQ ID NO: 4791607 - DNA, 14 bp, Homo sapiens
catttggaatcata

SEQ ID NO: 4791608 - DNA, 16 bp, Homo sapiens
catttggatataaatc

SEQ ID NO: 4791609 - DNA, 18 bp, Homo sapiens
catttgggagactgagct

SEQ ID NO: 4791610 - DNA, 14 bp, Homo sapiens
catttggtggctct

SEQ ID NO: 4791611 - DNA, 15 bp, Homo sapiens
catttgtaatgtatc

SEQ ID NO: 4791612 - DNA, 23 bp, Homo sapiens
catttgtaatgtatcttatttat

SEQ ID NO: 4791613 - DNA, 18 bp, Homo sapiens
cattttaaatgtctataa

SEQ ID NO: 4791614 - DNA, 22 bp, Homo sapiens
cattttaccatcacacatgttc

SEQ ID NO: 4791615 - DNA, 16 bp, Homo sapiens
cattttactatgcctg

SEQ ID NO: 4791616 - DNA, 12 bp, Homo sapiens
cattttcagatc

SEQ ID NO: 4791617 - DNA, 13 bp, Homo sapiens
cattttccaatta

SEQ ID NO: 4791618 - DNA, 12 bp, Homo sapiens
cattttcctggg

SEQ ID NO: 4791619 - DNA, 17 bp, Homo sapiens
cattttctgttatacac

SEQ ID NO: 4791620 - DNA, 18 bp, Homo sapiens
cattttctgttatacaca

SEQ ID NO: 4791621 - DNA, 15 bp, Homo sapiens
cattttgaaatattc

SEQ ID NO: 4791622 - DNA, 12 bp, Homo sapiens
cattttgatgta

SEQ ID NO: 4791623 - DNA, 20 bp, Homo sapiens
cattttgatgtattattata

SEQ ID NO: 4791624 - DNA, 16 bp, Homo sapiens
cattttgtctggctgt

SEQ ID NO: 4791625 - DNA, 18 bp, Homo sapiens
cattttgtctggctgtgg

SEQ ID NO: 4791626 - DNA, 17 bp, Homo sapiens
catttttcattttctct

SEQ ID NO: 4791627 - DNA, 16 bp, Homo sapiens
catttttgagtaaaac

SEQ ID NO: 4791628 - DNA, 22 bp, Homo sapiens
cagctttataataaactgttta

SEQ ID NO: 4791629 - DNA, 15 bp, Homo sapiens
cagctttcctgggtc

SEQ ID NO: 4791630 - DNA, 19 bp, Homo sapiens
cagctttctctttgttctt

SEQ ID NO: 4791631 - DNA, 14 bp, Homo sapiens
caggaaaactgttt

SEQ ID NO: 4791632 - DNA, 15 bp, Homo sapiens
caggaaaactgtttt

SEQ ID NO: 4791633 - DNA, 17 bp, Homo sapiens
caggaaaactgtttttc

SEQ ID NO: 4791634 - DNA, 18 bp, Homo sapiens
caggaaaactgtttttca

SEQ ID NO: 4791635 - DNA, 17 bp, Homo sapiens
caggaaaaggctgcagc

SEQ ID NO: 4791636 - DNA, 18 bp, Homo sapiens
caggaaaccaacacccaa

SEQ ID NO: 4791637 - DNA, 20 bp, Homo sapiens
caggaaagccctcccccttc

SEQ ID NO: 4791638 - DNA, 21 bp, Homo sapiens
caggaaatagtgttcttttta

SEQ ID NO: 4791639 - DNA, 22 bp, Homo sapiens
caggaaatatctgtgaaggact

SEQ ID NO: 4791640 - DNA, 22 bp, Homo sapiens
caggaacccatcactgtgtctc

SEQ ID NO: 4791641 - DNA, 23 bp, Homo sapiens
caggaacccatcactgtgtctca

SEQ ID NO: 4791642 - DNA, 19 bp, Homo sapiens
caggaacccttacagtaga

SEQ ID NO: 4791643 - DNA, 16 bp, Homo sapiens
caggaagaaggcccgg

SEQ ID NO: 4791644 - DNA, 18 bp, Homo sapiens
caggaagaaggcccggga

SEQ ID NO: 4791645 - DNA, 13 bp, Homo sapiens
caggaagaccaca

SEQ ID NO: 4791646 - DNA, 23 bp, Homo sapiens
caggaagaccacatgcgctcctg

SEQ ID NO: 4791647 - DNA, 19 bp, Homo sapiens
caggaagacttccagcttt

SEQ ID NO: 4791648 - DNA, 14 bp, Homo sapiens
caggaagccagcag

SEQ ID NO: 4791649 - DNA, 17 bp, Homo sapiens
caggaagccagcaggct

SEQ ID NO: 4791650 - DNA, 23 bp, Homo sapiens
caggaagtaattttcttctcatt

SEQ ID NO: 4791651 - DNA, 14 bp, Homo sapiens
caggaagtactgga

SEQ ID NO: 4791652 - DNA, 18 bp, Homo sapiens
caggaatcaaaaattgaa

SEQ ID NO: 4791653 - DNA, 20 bp, Homo sapiens
caggaatgggccaagccagg

SEQ ID NO: 4791654 - DNA, 17 bp, Homo sapiens
caggacagatcaggtca

SEQ ID NO: 4791655 - DNA, 24 bp, Homo sapiens
caggacagatcaggtcagagccca

SEQ ID NO: 4791656 - DNA, 13 bp, Homo sapiens
caggaccaccctg

SEQ ID NO: 4791657 - DNA, 14 bp, Homo sapiens
caggaccaccctgc

SEQ ID NO: 4791658 - DNA, 12 bp, Homo sapiens
caggaccaggag

SEQ ID NO: 4791659 - DNA, 11 bp, Homo sapiens
caggacccccc

SEQ ID NO: 4791660 - DNA, 14 bp, Homo sapiens
caggacccccccag

SEQ ID NO: 4791661 - DNA, 15 bp, Homo sapiens
caggacccccccagt

SEQ ID NO: 4791662 - DNA, 12 bp, Homo sapiens
caggaccctggg

SEQ ID NO: 4791663 - DNA, 16 bp, Homo sapiens
caggagatgaggctgg

SEQ ID NO: 4791664 - DNA, 13 bp, Homo sapiens
caggagcacagcc

SEQ ID NO: 4791665 - DNA, 15 bp, Homo sapiens
caggagcacagccat

SEQ ID NO: 4791666 - DNA, 16 bp, Homo sapiens
caggagcacagccata

SEQ ID NO: 4791667 - DNA, 17 bp, Homo sapiens
caggagcacagccatag

SEQ ID NO: 4791668 - DNA, 23 bp, Homo sapiens
caggagcatggccgcaacttccc

SEQ ID NO: 4791669 - DNA, 15 bp, Homo sapiens
caggagcatgtccta

SEQ ID NO: 4791670 - DNA, 12 bp, Homo sapiens
caggagccagca

SEQ ID NO: 4791671 - DNA, 14 bp, Homo sapiens
caggagccagcagg

SEQ ID NO: 4791672 - DNA, 16 bp, Homo sapiens
caggagccaggtgtcc

SEQ ID NO: 4791673 - DNA, 18 bp, Homo sapiens
caggagccaggtgtcctg

SEQ ID NO: 4791674 - DNA, 16 bp, Homo sapiens
caggagccgcagaggc

SEQ ID NO: 4791675 - DNA, 15 bp, Homo sapiens
caggagcgtgtccta

SEQ ID NO: 4791676 - DNA, 23 bp, Homo sapiens
caggaggcctgggagatgcagct

SEQ ID NO: 4791677 - DNA, 15 bp, Homo sapiens
caggagtgactctgg

SEQ ID NO: 4791678 - DNA, 22 bp, Homo sapiens
caggagtgactctggctgccaa

SEQ ID NO: 4791679 - DNA, 22 bp, Homo sapiens
caggagtgggtttccctgcgtc

SEQ ID NO: 4791680 - DNA, 18 bp, Homo sapiens
caggagttcctttccctc

SEQ ID NO: 4791681 - DNA, 16 bp, Homo sapiens
caggatatcacctgaa

SEQ ID NO: 4791682 - DNA, 19 bp, Homo sapiens
caggatcctggcctgagaa

SEQ ID NO: 4791683 - DNA, 22 bp, Homo sapiens
caggatgaaggggccagaccac

SEQ ID NO: 4791684 - DNA, 20 bp, Homo sapiens
caggatgacggtattatgct

SEQ ID NO: 4791685 - DNA, 17 bp, Homo sapiens
caggatgattgtacaga

SEQ ID NO: 4791686 - DNA, 15 bp, Homo sapiens
caggatgcatgcagg

SEQ ID NO: 4791687 - DNA, 17 bp, Homo sapiens
caggatgcatgcagggc

SEQ ID NO: 4791688 - DNA, 23 bp, Homo sapiens
caggatgttcaacttaatgaaga

SEQ ID NO: 4791689 - DNA, 15 bp, Homo sapiens
caggattgtctgctg

SEQ ID NO: 4791690 - DNA, 17 bp, Homo sapiens
caggattgtctgctgcc

SEQ ID NO: 4791691 - DNA, 18 bp, Homo sapiens
caggattgtctgctgcct

SEQ ID NO: 4791692 - DNA, 17 bp, Homo sapiens
caggcaacttcagtcct

SEQ ID NO: 4791693 - DNA, 19 bp, Homo sapiens
caggcaacttcagtcctgg

SEQ ID NO: 4791694 - DNA, 18 bp, Homo sapiens
caggcaatagtgttgagg

SEQ ID NO: 4791695 - DNA, 18 bp, Homo sapiens
caggcacacagcagcccc

SEQ ID NO: 4791696 - DNA, 14 bp, Homo sapiens
caggcaccatgctg

SEQ ID NO: 4791697 - DNA, 17 bp, Homo sapiens
caggcaccatgctgggc

SEQ ID NO: 4791698 - DNA, 12 bp, Homo sapiens
caggcaccgcca

SEQ ID NO: 4791699 - DNA, 23 bp, Homo sapiens
caggcaccgccagagtgtcctgc

SEQ ID NO: 4791700 - DNA, 13 bp, Homo sapiens
caggcagggaggg

SEQ ID NO: 4791701 - DNA, 21 bp, Homo sapiens
caggcagtctttgctcagtgg

SEQ ID NO: 4791702 - DNA, 14 bp, Homo sapiens
caggcattgcacta

SEQ ID NO: 4791703 - DNA, 18 bp, Homo sapiens
caggcattgcactaaaag

SEQ ID NO: 4791704 - DNA, 20 bp, Homo sapiens
caggcattgcactaaaagtg

SEQ ID NO: 4791705 - DNA, 18 bp, Homo sapiens
caggccaaactcacctgc

SEQ ID NO: 4791706 - DNA, 18 bp, Homo sapiens
caggccacccccacctcc

SEQ ID NO: 4791707 - DNA, 21 bp, Homo sapiens
caggccagctgcttgggcttc

SEQ ID NO: 4791708 - DNA, 23 bp, Homo sapiens
caggccagctgcttgggcttcat

SEQ ID NO: 4791709 - DNA, 13 bp, Homo sapiens
caggcccagcctg

SEQ ID NO: 4791710 - DNA, 17 bp, Homo sapiens
caggcccagcctggccc

SEQ ID NO: 4791711 - DNA, 22 bp, Homo sapiens
caggccctccctgactccctgt

SEQ ID NO: 4791712 - DNA, 23 bp, Homo sapiens
caggccctccctgactccctgtg

SEQ ID NO: 4791713 - DNA, 12 bp, Homo sapiens
caggccctgcag

SEQ ID NO: 4791714 - DNA, 15 bp, Homo sapiens
caggccctggaactc

SEQ ID NO: 4791715 - DNA, 16 bp, Homo sapiens
caggccggccagcctc

SEQ ID NO: 4791716 - DNA, 17 bp, Homo sapiens
caggcctcacctggctt

SEQ ID NO: 4791717 - DNA, 18 bp, Homo sapiens
caggcctcacctggcttc

SEQ ID NO: 4791718 - DNA, 14 bp, Homo sapiens
caggcctcagggac

SEQ ID NO: 4791719 - DNA, 15 bp, Homo sapiens
caggcctcccaagct

SEQ ID NO: 4791720 - DNA, 14 bp, Homo sapiens
caggcctcctacag

SEQ ID NO: 4791721 - DNA, 16 bp, Homo sapiens
caggcctggcccagcc

SEQ ID NO: 4791722 - DNA, 20 bp, Homo sapiens
caggcctgggggctgggcag

SEQ ID NO: 4791723 - DNA, 22 bp, Homo sapiens
caggcctgggggctgggcagag

SEQ ID NO: 4791724 - DNA, 23 bp, Homo sapiens
caggcctgggggctgggcagagg

SEQ ID NO: 4791725 - DNA, 18 bp, Homo sapiens
caggcgccgcctcgcccc

SEQ ID NO: 4791726 - DNA, 19 bp, Homo sapiens
caggcggaggggcttggag

SEQ ID NO: 4791727 - DNA, 16 bp, Homo sapiens
caggcggtcactgccc

SEQ ID NO: 4791728 - DNA, 18 bp, Homo sapiens
caggctacagttgatatt

SEQ ID NO: 4791729 - DNA, 15 bp, Homo sapiens
caggctcacaactgt

SEQ ID NO: 4791730 - DNA, 16 bp, Homo sapiens
caggctcaggctgccc

SEQ ID NO: 4791731 - DNA, 18 bp, Homo sapiens
caggctcaggctgcccag

SEQ ID NO: 4791732 - DNA, 19 bp, Homo sapiens
caggctcaggctgcccagc

SEQ ID NO: 4791733 - DNA, 18 bp, Homo sapiens
caggctcccactgcccct

SEQ ID NO: 4791734 - DNA, 14 bp, Homo sapiens
caggctccccaaga

SEQ ID NO: 4791735 - DNA, 12 bp, Homo sapiens
caggctctcagg

SEQ ID NO: 4791736 - DNA, 22 bp, Homo sapiens
cagccccatcccaaacccttca

SEQ ID NO: 4791737 - DNA, 18 bp, Homo sapiens
cagcccccacccccgtca

SEQ ID NO: 4791738 - DNA, 12 bp, Homo sapiens
cagcccccacgc

SEQ ID NO: 4791739 - DNA, 22 bp, Homo sapiens
cagccccccacgcttctggagg

SEQ ID NO: 4791740 - DNA, 22 bp, Homo sapiens
cagccccctgcttctcccgcca

SEQ ID NO: 4791741 - DNA, 14 bp, Homo sapiens
cagccccctggcat

SEQ ID NO: 4791742 - DNA, 17 bp, Homo sapiens
cagccccctggcatgtt

SEQ ID NO: 4791743 - DNA, 17 bp, Homo sapiens
cagccccgcgaccaccc

SEQ ID NO: 4791744 - DNA, 22 bp, Homo sapiens
cagccccgcgaccacccctgtg

SEQ ID NO: 4791745 - DNA, 23 bp, Homo sapiens
cagccccgcgaccacccctgtgc

SEQ ID NO: 4791746 - DNA, 13 bp, Homo sapiens
cagcccctcccca

SEQ ID NO: 4791747 - DNA, 14 bp, Homo sapiens
cagcccctgctgga

SEQ ID NO: 4791748 - DNA, 16 bp, Homo sapiens
cagcccgatgtccctg

SEQ ID NO: 4791749 - DNA, 14 bp, Homo sapiens
cagccctccgccag

SEQ ID NO: 4791750 - DNA, 19 bp, Homo sapiens
cagccctccgccagccctg

SEQ ID NO: 4791751 - DNA, 20 bp, Homo sapiens
cagccctccgccagccctgt

SEQ ID NO: 4791752 - DNA, 21 bp, Homo sapiens
cagccctccgccagccctgtt

SEQ ID NO: 4791753 - DNA, 20 bp, Homo sapiens
cagccctgcagagggcacag

SEQ ID NO: 4791754 - DNA, 19 bp, Homo sapiens
cagccctgttccgcctcac

SEQ ID NO: 4791755 - DNA, 20 bp, Homo sapiens
cagccctgttccgcctcact

SEQ ID NO: 4791756 - DNA, 18 bp, Homo sapiens
cagccgccttccttgacc

SEQ ID NO: 4791757 - DNA, 15 bp, Homo sapiens
cagccgcgctctgcc

SEQ ID NO: 4791758 - DNA, 16 bp, Homo sapiens
cagccgcgctctgccc

SEQ ID NO: 4791759 - DNA, 18 bp, Homo sapiens
cagccgcgctctgcccct

SEQ ID NO: 4791760 - DNA, 19 bp, Homo sapiens
cagccgcgctctgcccctc

SEQ ID NO: 4791761 - DNA, 22 bp, Homo sapiens
cagccgcgctctgcccctccgt

SEQ ID NO: 4791762 - DNA, 15 bp, Homo sapiens
cagcctcccccaggc

SEQ ID NO: 4791763 - DNA, 18 bp, Homo sapiens
cagcctcccccaggctgc

SEQ ID NO: 4791764 - DNA, 22 bp, Homo sapiens
cagcctcccccaggctgcgcct

SEQ ID NO: 4791765 - DNA, 21 bp, Homo sapiens
cagcctctgaagttggacagc

SEQ ID NO: 4791766 - DNA, 20 bp, Homo sapiens
cagcctgagccacagtgggg

SEQ ID NO: 4791767 - DNA, 19 bp, Homo sapiens
cagcctgagctccaccctc

SEQ ID NO: 4791768 - DNA, 11 bp, Homo sapiens
cagcctgcaca

SEQ ID NO: 4791769 - DNA, 15 bp, Homo sapiens
cagcctgcacacacc

SEQ ID NO: 4791770 - DNA, 19 bp, Homo sapiens
cagcctgcacacacctgcc

SEQ ID NO: 4791771 - DNA, 23 bp, Homo sapiens
cagcctgcacacacctgcctgca

SEQ ID NO: 4791772 - DNA, 23 bp, Homo sapiens
cagcctgcttcccacctccctgc

SEQ ID NO: 4791773 - DNA, 13 bp, Homo sapiens
cagcctggcccca

SEQ ID NO: 4791774 - DNA, 19 bp, Homo sapiens
cagcctggccccaaatgtt

SEQ ID NO: 4791775 - DNA, 13 bp, Homo sapiens
cagcctggggcct

SEQ ID NO: 4791776 - DNA, 20 bp, Homo sapiens
cagcctggggcctggcaggg

SEQ ID NO: 4791777 - DNA, 21 bp, Homo sapiens
cagccttcccttcttttcctg

SEQ ID NO: 4791778 - DNA, 18 bp, Homo sapiens
cagcgcatggcgccccgg

SEQ ID NO: 4791779 - DNA, 18 bp, Homo sapiens
cagcgccatgtgtgtcag

SEQ ID NO: 4791780 - DNA, 16 bp, Homo sapiens
cagcgcccagcctggc

SEQ ID NO: 4791781 - DNA, 19 bp, Homo sapiens
cagcgcccagcctggcccc

SEQ ID NO: 4791782 - DNA, 20 bp, Homo sapiens
cagcgcccagcctggcccca

SEQ ID NO: 4791783 - DNA, 16 bp, Homo sapiens
cagcgcccgaggccag

SEQ ID NO: 4791784 - DNA, 19 bp, Homo sapiens
cagcgcccgaggccagggc

SEQ ID NO: 4791785 - DNA, 23 bp, Homo sapiens
cagcgcccgaggccagggccgcc

SEQ ID NO: 4791786 - DNA, 23 bp, Homo sapiens
cagcgcctcccgccgcctcgggc

SEQ ID NO: 4791787 - DNA, 15 bp, Homo sapiens
cagcggagaggaccc

SEQ ID NO: 4791788 - DNA, 15 bp, Homo sapiens
cagcggcccagattg

SEQ ID NO: 4791789 - DNA, 17 bp, Homo sapiens
cagcggcccggcccacg

SEQ ID NO: 4791790 - DNA, 19 bp, Homo sapiens
cagcggcccggcccacgca

SEQ ID NO: 4791791 - DNA, 15 bp, Homo sapiens
cagcgggagtctcct

SEQ ID NO: 4791792 - DNA, 17 bp, Homo sapiens
cagcgggagtctcctca

SEQ ID NO: 4791793 - DNA, 20 bp, Homo sapiens
cagcggtcttctccatctcc

SEQ ID NO: 4791794 - DNA, 15 bp, Homo sapiens
cagcgtttctccacc

SEQ ID NO: 4791795 - DNA, 15 bp, Homo sapiens
cagctaacaataaag

SEQ ID NO: 4791796 - DNA, 18 bp, Homo sapiens
cagctaacatggaagtac

SEQ ID NO: 4791797 - DNA, 15 bp, Homo sapiens
cagctaagcctgatg

SEQ ID NO: 4791798 - DNA, 17 bp, Homo sapiens
cagctaatttgtgaaag

SEQ ID NO: 4791799 - DNA, 19 bp, Homo sapiens
cagctacaggggaggctga

SEQ ID NO: 4791800 - DNA, 23 bp, Homo sapiens
cagctactcagatctgcactcct

SEQ ID NO: 4791801 - DNA, 23 bp, Homo sapiens
cagctagatttgtgtccacacta

SEQ ID NO: 4791802 - DNA, 14 bp, Homo sapiens
cagctatctgtcat

SEQ ID NO: 4791803 - DNA, 21 bp, Homo sapiens
cagctatgcgcaatgtggcat

SEQ ID NO: 4791804 - DNA, 16 bp, Homo sapiens
cagctattcacacaca

SEQ ID NO: 4791805 - DNA, 17 bp, Homo sapiens
cagctcagcattgtgta

SEQ ID NO: 4791806 - DNA, 20 bp, Homo sapiens
cagctcaggctactgccact

SEQ ID NO: 4791807 - DNA, 22 bp, Homo sapiens
cagctcaggctactgccactca

SEQ ID NO: 4791808 - DNA, 14 bp, Homo sapiens
cagctcaggggcag

SEQ ID NO: 4791809 - DNA, 20 bp, Homo sapiens
cagctcagtcccacagcccc

SEQ ID NO: 4791810 - DNA, 21 bp, Homo sapiens
cagctcagtcccacagcccct

SEQ ID NO: 4791811 - DNA, 20 bp, Homo sapiens
cagctcatagagtcccccct

SEQ ID NO: 4791812 - DNA, 13 bp, Homo sapiens
cagctccaacctg

SEQ ID NO: 4791813 - DNA, 17 bp, Homo sapiens
cagctccaacctggagg

SEQ ID NO: 4791814 - DNA, 19 bp, Homo sapiens
cagctccaacctggaggct

SEQ ID NO: 4791815 - DNA, 13 bp, Homo sapiens
cagctccactctg

SEQ ID NO: 4791816 - DNA, 20 bp, Homo sapiens
cagctcctcgggtggggcct

SEQ ID NO: 4791817 - DNA, 16 bp, Homo sapiens
cagctcctcttcctgc

SEQ ID NO: 4791818 - DNA, 21 bp, Homo sapiens
cagctctaaagcagagatgta

SEQ ID NO: 4791819 - DNA, 19 bp, Homo sapiens
cagctctcctccagccctg

SEQ ID NO: 4791820 - DNA, 21 bp, Homo sapiens
cagctctcctccagccctggg

SEQ ID NO: 4791821 - DNA, 20 bp, Homo sapiens
cagctctgagcagacagggc

SEQ ID NO: 4791822 - DNA, 21 bp, Homo sapiens
cagctcttatattgccatttc

SEQ ID NO: 4791823 - DNA, 15 bp, Homo sapiens
cagctgagctggcct

SEQ ID NO: 4791824 - DNA, 16 bp, Homo sapiens
cagctgcaccagcagg

SEQ ID NO: 4791825 - DNA, 15 bp, Homo sapiens
cagctgcaggaatca

SEQ ID NO: 4791826 - DNA, 14 bp, Homo sapiens
cagctgcctccggg

SEQ ID NO: 4791827 - DNA, 15 bp, Homo sapiens
cagctgcctccgggc

SEQ ID NO: 4791828 - DNA, 23 bp, Homo sapiens
cagctgcctccgggcctcggcct

SEQ ID NO: 4791829 - DNA, 14 bp, Homo sapiens
cagctgctcctaga

SEQ ID NO: 4791830 - DNA, 18 bp, Homo sapiens
cagctgcttgggcttcat

SEQ ID NO: 4791831 - DNA, 16 bp, Homo sapiens
cagctggactgggtgg

SEQ ID NO: 4791832 - DNA, 13 bp, Homo sapiens
cagctggcagcgc

SEQ ID NO: 4791833 - DNA, 15 bp, Homo sapiens
cagctggcagcgcct

SEQ ID NO: 4791834 - DNA, 22 bp, Homo sapiens
cagctggctgggtcgcccctcc

SEQ ID NO: 4791835 - DNA, 19 bp, Homo sapiens
cagctgggttggtatggag

SEQ ID NO: 4791836 - DNA, 18 bp, Homo sapiens
cagctggtgaatccatga

SEQ ID NO: 4791837 - DNA, 19 bp, Homo sapiens
cagagaagaaagaacggaa

SEQ ID NO: 4791838 - DNA, 15 bp, Homo sapiens
cagagacacaagcct

SEQ ID NO: 4791839 - DNA, 16 bp, Homo sapiens
cagagacacaagcctt

SEQ ID NO: 4791840 - DNA, 19 bp, Homo sapiens
cagagaccaccgcgcccct

SEQ ID NO: 4791841 - DNA, 20 bp, Homo sapiens
cagagaccaccgcgcccctc

SEQ ID NO: 4791842 - DNA, 16 bp, Homo sapiens
cagagacctcctgatg

SEQ ID NO: 4791843 - DNA, 15 bp, Homo sapiens
cagagacctgctcca

SEQ ID NO: 4791844 - DNA, 17 bp, Homo sapiens
cagagacctgctccaga

SEQ ID NO: 4791845 - DNA, 17 bp, Homo sapiens
cagagacggcagcccca

SEQ ID NO: 4791846 - DNA, 21 bp, Homo sapiens
cagagacggcagccccatcct

SEQ ID NO: 4791847 - DNA, 18 bp, Homo sapiens
cagagactgcccaccctg

SEQ ID NO: 4791848 - DNA, 23 bp, Homo sapiens
cagagagacaacttgctcctttc

SEQ ID NO: 4791849 - DNA, 14 bp, Homo sapiens
cagagagaccctgc

SEQ ID NO: 4791850 - DNA, 16 bp, Homo sapiens
cagagagaccctgcca

SEQ ID NO: 4791851 - DNA, 17 bp, Homo sapiens
cagagagaccctgccaa

SEQ ID NO: 4791852 - DNA, 16 bp, Homo sapiens
cagagatcagaattga

SEQ ID NO: 4791853 - DNA, 17 bp, Homo sapiens
cagagatggcagagcca

SEQ ID NO: 4791854 - DNA, 14 bp, Homo sapiens
cagagatgttttca

SEQ ID NO: 4791855 - DNA, 13 bp, Homo sapiens
cagagccacagaa

SEQ ID NO: 4791856 - DNA, 14 bp, Homo sapiens
cagagccatccacc

SEQ ID NO: 4791857 - DNA, 12 bp, Homo sapiens
cagagcccagga

SEQ ID NO: 4791858 - DNA, 14 bp, Homo sapiens
cagagcccaggaat

SEQ ID NO: 4791859 - DNA, 17 bp, Homo sapiens
cagagccccggagcacc

SEQ ID NO: 4791860 - DNA, 19 bp, Homo sapiens
cagagccccggagcaccac

SEQ ID NO: 4791861 - DNA, 16 bp, Homo sapiens
cagagcccgcccacct

SEQ ID NO: 4791862 - DNA, 21 bp, Homo sapiens
cagagcccgcccacctgggcc

SEQ ID NO: 4791863 - DNA, 12 bp, Homo sapiens
cagagcctgggc

SEQ ID NO: 4791864 - DNA, 19 bp, Homo sapiens
cagagcctgttttaaaaaa

SEQ ID NO: 4791865 - DNA, 16 bp, Homo sapiens
cagagcgatgtgttct

SEQ ID NO: 4791866 - DNA, 21 bp, Homo sapiens
cagagcgatgtgttctttgta

SEQ ID NO: 4791867 - DNA, 13 bp, Homo sapiens
cagagcgcagccc

SEQ ID NO: 4791868 - DNA, 16 bp, Homo sapiens
cagagcgcagccccca

SEQ ID NO: 4791869 - DNA, 17 bp, Homo sapiens
cagagctacacagggga

SEQ ID NO: 4791870 - DNA, 22 bp, Homo sapiens
cagagctgagtcggctgggcag

SEQ ID NO: 4791871 - DNA, 15 bp, Homo sapiens
cactctgccagggca

SEQ ID NO: 4791872 - DNA, 14 bp, Homo sapiens
cactgaagagtatg

SEQ ID NO: 4791873 - DNA, 20 bp, Homo sapiens
cactgacagcctccaccttg

SEQ ID NO: 4791874 - DNA, 14 bp, Homo sapiens
cactgacccttcca

SEQ ID NO: 4791875 - DNA, 22 bp, Homo sapiens
cactgaccttggagagacacag

SEQ ID NO: 4791876 - DNA, 18 bp, Homo sapiens
cactgagaaggccccagg

SEQ ID NO: 4791877 - DNA, 19 bp, Homo sapiens
cactgagaaggccccaggg

SEQ ID NO: 4791878 - DNA, 21 bp, Homo sapiens
cactgagaaggccccagggca

SEQ ID NO: 4791879 - DNA, 16 bp, Homo sapiens
cactgagcgcctgcag

SEQ ID NO: 4791880 - DNA, 14 bp, Homo sapiens
cactgagtttgaac

SEQ ID NO: 4791881 - DNA, 18 bp, Homo sapiens
cactgatatattttccag

SEQ ID NO: 4791882 - DNA, 17 bp, Homo sapiens
cactgcaacctccacct

SEQ ID NO: 4791883 - DNA, 15 bp, Homo sapiens
cactgcaccctccac

SEQ ID NO: 4791884 - DNA, 16 bp, Homo sapiens
cactgcaccctccaca

SEQ ID NO: 4791885 - DNA, 17 bp, Homo sapiens
cactgcaccctccacag

SEQ ID NO: 4791886 - DNA, 18 bp, Homo sapiens
cactgcagttatttacca

SEQ ID NO: 4791887 - DNA, 21 bp, Homo sapiens
cactgccactaaaatccaccc

SEQ ID NO: 4791888 - DNA, 22 bp, Homo sapiens
cactgccataacttgtttgtaa

SEQ ID NO: 4791889 - DNA, 18 bp, Homo sapiens
cactgcccacctgccagg

SEQ ID NO: 4791890 - DNA, 15 bp, Homo sapiens
cactgccctctgcca

SEQ ID NO: 4791891 - DNA, 23 bp, Homo sapiens
cactgcctctgccttagaggagc

SEQ ID NO: 4791892 - DNA, 19 bp, Homo sapiens
cactgctttttccttagct

SEQ ID NO: 4791893 - DNA, 14 bp, Homo sapiens
cactggaagggtcc

SEQ ID NO: 4791894 - DNA, 18 bp, Homo sapiens
cactggagcgtgtactac

SEQ ID NO: 4791895 - DNA, 20 bp, Homo sapiens
cactggccttctgatgaaat

SEQ ID NO: 4791896 - DNA, 15 bp, Homo sapiens
cactggccttgcctc

SEQ ID NO: 4791897 - DNA, 21 bp, Homo sapiens
cactggctttgggtagtgcca

SEQ ID NO: 4791898 - DNA, 15 bp, Homo sapiens
cactgggcctgctag

SEQ ID NO: 4791899 - DNA, 22 bp, Homo sapiens
cactgggcttggggaccagagc

SEQ ID NO: 4791900 - DNA, 18 bp, Homo sapiens
cactgggtgtggcctggc

SEQ ID NO: 4791901 - DNA, 18 bp, Homo sapiens
cactggtttgtttctcaa

SEQ ID NO: 4791902 - DNA, 19 bp, Homo sapiens
cactgtattaaagatgcag

SEQ ID NO: 4791903 - DNA, 18 bp, Homo sapiens
cactgtattacataaata

SEQ ID NO: 4791904 - DNA, 17 bp, Homo sapiens
cactgtcaagattaagt

SEQ ID NO: 4791905 - DNA, 20 bp, Homo sapiens
cactgtcatgcccagcttgg

SEQ ID NO: 4791906 - DNA, 13 bp, Homo sapiens
cactgtccagagt

SEQ ID NO: 4791907 - DNA, 13 bp, Homo sapiens
cactgtctgctgc

SEQ ID NO: 4791908 - DNA, 18 bp, Homo sapiens
cactgtcttactcaagat

SEQ ID NO: 4791909 - DNA, 20 bp, Homo sapiens
cactgtgcgttttagagtat

SEQ ID NO: 4791910 - DNA, 18 bp, Homo sapiens
caaggggtggaagggcag

SEQ ID NO: 4791911 - DNA, 21 bp, Homo sapiens
caaggggtggaagggcaggag

SEQ ID NO: 4791912 - DNA, 19 bp, Homo sapiens
caaggtgaaggatctgtcc

SEQ ID NO: 4791913 - DNA, 20 bp, Homo sapiens
caaggtgcacctgccccagg

SEQ ID NO: 4791914 - DNA, 15 bp, Homo sapiens
caagtaaatctatct

SEQ ID NO: 4791915 - DNA, 16 bp, Homo sapiens
caagtaaatctatctc

SEQ ID NO: 4791916 - DNA, 23 bp, Homo sapiens
caagtaaatctatctctatataa

SEQ ID NO: 4791917 - DNA, 22 bp, Homo sapiens
caagtagtagtacttaatagta

SEQ ID NO: 4791918 - DNA, 17 bp, Homo sapiens
caagtcaaacagtgtgg

SEQ ID NO: 4791919 - DNA, 15 bp, Homo sapiens
caagtcatgggagaa

SEQ ID NO: 4791920 - DNA, 14 bp, Homo sapiens
caagtcccgaggca

SEQ ID NO: 4791921 - DNA, 15 bp, Homo sapiens
caagtcccgaggcag

SEQ ID NO: 4791922 - DNA, 23 bp, Homo sapiens
caagtcccgaggcagcaacagga

SEQ ID NO: 4791923 - DNA, 16 bp, Homo sapiens
caagtcctcgcccccc

SEQ ID NO: 4791924 - DNA, 17 bp, Homo sapiens
caagtctacctgccttg

SEQ ID NO: 4791925 - DNA, 20 bp, Homo sapiens
caagtgaatgagtttccagc

SEQ ID NO: 4791926 - DNA, 23 bp, Homo sapiens
caagtgtacatttgatttgatat

SEQ ID NO: 4791927 - DNA, 14 bp, Homo sapiens
caagtgtgcctgct

SEQ ID NO: 4791928 - DNA, 21 bp, Homo sapiens
caagtgtgcctgctatccagc

SEQ ID NO: 4791929 - DNA, 19 bp, Homo sapiens
caagtgtgtgtgcaatgtt

SEQ ID NO: 4791930 - DNA, 16 bp, Homo sapiens
caagtgtttctagtaa

SEQ ID NO: 4791931 - DNA, 21 bp, Homo sapiens
caagtgtttctagtaacagta

SEQ ID NO: 4791932 - DNA, 16 bp, Homo sapiens
caagttcattcatact

SEQ ID NO: 4791933 - DNA, 22 bp, Homo sapiens
caagttggaagggaccccagat

SEQ ID NO: 4791934 - DNA, 21 bp, Homo sapiens
caagtttattgccctcaaaat

SEQ ID NO: 4791935 - DNA, 12 bp, Homo sapiens
caagtttttggt

SEQ ID NO: 4791936 - DNA, 20 bp, Homo sapiens
caagtttttggtaatgatga

SEQ ID NO: 4791937 - DNA, 20 bp, Homo sapiens
caataaaactcccttcctta

SEQ ID NO: 4791938 - DNA, 13 bp, Homo sapiens
caataagaaacag

SEQ ID NO: 4791939 - DNA, 14 bp, Homo sapiens
caataagaaacagt

SEQ ID NO: 4791940 - DNA, 23 bp, Homo sapiens
caataagaaacagtttaacagaa

SEQ ID NO: 4791941 - DNA, 14 bp, Homo sapiens
caataagatattac

SEQ ID NO: 4791942 - DNA, 15 bp, Homo sapiens
caataaggatttatt

SEQ ID NO: 4791943 - DNA, 16 bp, Homo sapiens
caataaggatttattc

SEQ ID NO: 4791944 - DNA, 20 bp, Homo sapiens
caataaggatttattctcag

SEQ ID NO: 4791945 - DNA, 17 bp, Homo sapiens
caataagttgaatgata

SEQ ID NO: 4791946 - DNA, 14 bp, Homo sapiens
caataatgaataat

SEQ ID NO: 4791947 - DNA, 15 bp, Homo sapiens
caatactttgtgtct

SEQ ID NO: 4791948 - DNA, 18 bp, Homo sapiens
caatactttgtgtctttt

SEQ ID NO: 4791949 - DNA, 14 bp, Homo sapiens
caatagccccatct

SEQ ID NO: 4791950 - DNA, 16 bp, Homo sapiens
caatagcgtgtgtaga

SEQ ID NO: 4791951 - DNA, 22 bp, Homo sapiens
caataggtttgggggacgccca

SEQ ID NO: 4791952 - DNA, 23 bp, Homo sapiens
caatagtcatatgtgaagacaga

SEQ ID NO: 4791953 - DNA, 18 bp, Homo sapiens
caatatcattttcctggg

SEQ ID NO: 4791954 - DNA, 18 bp, Homo sapiens
caatcactaaatatctag

SEQ ID NO: 4791955 - DNA, 12 bp, Homo sapiens
caatcagcactg

SEQ ID NO: 4791956 - DNA, 13 bp, Homo sapiens
caatcagcactga

SEQ ID NO: 4791957 - DNA, 14 bp, Homo sapiens
caatcagcactgaa

SEQ ID NO: 4791958 - DNA, 15 bp, Homo sapiens
caatcagcactgaaa

SEQ ID NO: 4791959 - DNA, 13 bp, Homo sapiens
caatcatctagat

SEQ ID NO: 4791960 - DNA, 23 bp, Homo sapiens
caatcatgcctacattagtgaga

SEQ ID NO: 4791961 - DNA, 22 bp, Homo sapiens
caatcattgtacagtttgttta

SEQ ID NO: 4791962 - DNA, 17 bp, Homo sapiens
caatcattgtcagagat

SEQ ID NO: 4791963 - DNA, 21 bp, Homo sapiens
caatcattgtcagagatgttt

SEQ ID NO: 4791964 - DNA, 16 bp, Homo sapiens
caatcattttgggaaa

SEQ ID NO: 4791965 - DNA, 14 bp, Homo sapiens
caatccacagtatt

SEQ ID NO: 4791966 - DNA, 20 bp, Homo sapiens
caatctctgtgactcgctta

SEQ ID NO: 4791967 - DNA, 22 bp, Homo sapiens
caatctgtccagacaagccctg

SEQ ID NO: 4791968 - DNA, 13 bp, Homo sapiens
caatcttgctgtg

SEQ ID NO: 4791969 - DNA, 15 bp, Homo sapiens
caatcttgctgtgaa

SEQ ID NO: 4791970 - DNA, 17 bp, Homo sapiens
caatgaaatatttgctt

SEQ ID NO: 4791971 - DNA, 17 bp, Homo sapiens
caatgaatatactcatt

SEQ ID NO: 4791972 - DNA, 20 bp, Homo sapiens
caatgacactggaagggtcc

SEQ ID NO: 4791973 - DNA, 19 bp, Homo sapiens
caatgattgtttaattgta

SEQ ID NO: 4791974 - DNA, 18 bp, Homo sapiens
caatgcatctgaaagttt

SEQ ID NO: 4791975 - DNA, 23 bp, Homo sapiens
caatgcctattgtaatatagaaa

SEQ ID NO: 4791976 - DNA, 14 bp, Homo sapiens
caatgcctgcctga

SEQ ID NO: 4791977 - DNA, 15 bp, Homo sapiens
caatgccttgttgta

SEQ ID NO: 4791978 - DNA, 20 bp, Homo sapiens
caatgctacaaaatgtgtgc

SEQ ID NO: 4791979 - DNA, 22 bp, Homo sapiens
caatgcttttctagcaactgtt

SEQ ID NO: 4791980 - DNA, 15 bp, Homo sapiens
caatgggagctcatg

SEQ ID NO: 4791981 - DNA, 22 bp, Homo sapiens
caatgggtaaataaatgctgct

SEQ ID NO: 4791982 - DNA, 16 bp, Homo sapiens
caatggtaattataaa

SEQ ID NO: 4791983 - DNA, 15 bp, Homo sapiens
caatggtagctctga

SEQ ID NO: 4791984 - DNA, 15 bp, Homo sapiens
caatgtactgtattg

SEQ ID NO: 4791985 - DNA, 23 bp, Homo sapiens
caatgtatcccttctcacagcac

SEQ ID NO: 4791986 - DNA, 14 bp, Homo sapiens
caatgtccaggtca

SEQ ID NO: 4791987 - DNA, 12 bp, Homo sapiens
caatgtgaaact

SEQ ID NO: 4791988 - DNA, 13 bp, Homo sapiens
caatgtgaaactg

SEQ ID NO: 4791989 - DNA, 17 bp, Homo sapiens
caatgtgaaactgagac

SEQ ID NO: 4791990 - DNA, 16 bp, Homo sapiens
caatgtgaaataaaga

SEQ ID NO: 4791991 - DNA, 16 bp, Homo sapiens
caatgtgatatgtgta

SEQ ID NO: 4791992 - DNA, 12 bp, Homo sapiens
caatgtgctgtt

SEQ ID NO: 4791993 - DNA, 16 bp, Homo sapiens
caatgtgctgttgatt

SEQ ID NO: 4791994 - DNA, 16 bp, Homo sapiens
caatgtgcttccgaga

SEQ ID NO: 4791995 - DNA, 21 bp, Homo sapiens
caatgtggtggcaataaatgt

SEQ ID NO: 4791996 - DNA, 21 bp, Homo sapiens
caatgttccgttcatctgagg

SEQ ID NO: 4791997 - DNA, 19 bp, Homo sapiens
caattaactccgtttccaa

SEQ ID NO: 4791998 - DNA, 13 bp, Homo sapiens
caattaatggaaa

SEQ ID NO: 4791999 - DNA, 19 bp, Homo sapiens
caattaatggaaaactgtt

SEQ ID NO: 4792000 - DNA, 14 bp, Homo sapiens
caattaattgtctt

SEQ ID NO: 4792001 - DNA, 18 bp, Homo sapiens
caattaattgtcttgcac

SEQ ID NO: 4792002 - DNA, 14 bp, Homo sapiens
caattaattttaga

SEQ ID NO: 4792003 - DNA, 18 bp, Homo sapiens
caattacaggaagtactg

SEQ ID NO: 4792004 - DNA, 15 bp, Homo sapiens
caattatcaaaaaac

SEQ ID NO: 4792005 - DNA, 23 bp, Homo sapiens
caattatcaaaaaacagaaaaac

SEQ ID NO: 4792006 - DNA, 19 bp, Homo sapiens
caattctaagtgagatgtt

SEQ ID NO: 4792007 - DNA, 21 bp, Homo sapiens
caattctgaaggggaaaacct

SEQ ID NO: 4792008 - DNA, 18 bp, Homo sapiens
caattggaagtctaagaa

SEQ ID NO: 4792009 - DNA, 23 bp, Homo sapiens
caatttaggaatgctcaatgtgc

SEQ ID NO: 4792010 - DNA, 13 bp, Homo sapiens
caatttattttat

SEQ ID NO: 4792011 - DNA, 14 bp, Homo sapiens
caatttattttatt

SEQ ID NO: 4792012 - DNA, 20 bp, Homo sapiens
caatttcacagagtacaaaa

SEQ ID NO: 4792013 - DNA, 21 bp, Homo sapiens
caatttcacagagtacaaaat

SEQ ID NO: 4792014 - DNA, 21 bp, Homo sapiens
caatttgaaaagcccacataa

SEQ ID NO: 4792015 - DNA, 16 bp, Homo sapiens
caattttcctaagttt

SEQ ID NO: 4792016 - DNA, 20 bp, Homo sapiens
caattttctatttaaaaaat

SEQ ID NO: 4792017 - DNA, 14 bp, Homo sapiens
caattttgtctcta

SEQ ID NO: 4792018 - DNA, 14 bp, Homo sapiens
caatttttaactta

SEQ ID NO: 4792019 - DNA, 15 bp, Homo sapiens
cacaaaacaacagca

SEQ ID NO: 4792020 - DNA, 23 bp, Homo sapiens
cacaaaacaacagcaacaacaac

SEQ ID NO: 4792021 - DNA, 22 bp, Homo sapiens
cacaaaaggctggatgtgcttt

SEQ ID NO: 4792022 - DNA, 13 bp, Homo sapiens
cacaaacagaggc

SEQ ID NO: 4792023 - DNA, 18 bp, Homo sapiens
cacaaaccacaactgaca

SEQ ID NO: 4792024 - DNA, 13 bp, Homo sapiens
cacaaaccttctt

SEQ ID NO: 4792025 - DNA, 14 bp, Homo sapiens
cacaaaccttcttt

SEQ ID NO: 4792026 - DNA, 18 bp, Homo sapiens
cacaaaccttcttttcaa

SEQ ID NO: 4792027 - DNA, 16 bp, Homo sapiens
cacaaagctatttaag

SEQ ID NO: 4792028 - DNA, 18 bp, Homo sapiens
cacaaagctatttaagtg

SEQ ID NO: 4792029 - DNA, 20 bp, Homo sapiens
cacaaagctatttaagtgga

SEQ ID NO: 4792030 - DNA, 17 bp, Homo sapiens
cacaaaggtagcttttc

SEQ ID NO: 4792031 - DNA, 13 bp, Homo sapiens
cacaaagtgaaat

SEQ ID NO: 4792032 - DNA, 17 bp, Homo sapiens
cacatagattcacctgt

SEQ ID NO: 4792033 - DNA, 17 bp, Homo sapiens
cacatagcataggctgg

SEQ ID NO: 4792034 - DNA, 19 bp, Homo sapiens
cacatagcataggctgggg

SEQ ID NO: 4792035 - DNA, 21 bp, Homo sapiens
cacatataaacacagtaagat

SEQ ID NO: 4792036 - DNA, 12 bp, Homo sapiens
cacatatacatt

SEQ ID NO: 4792037 - DNA, 14 bp, Homo sapiens
cacatatacattat

SEQ ID NO: 4792038 - DNA, 21 bp, Homo sapiens
cacatatcaagtcccgaggca

SEQ ID NO: 4792039 - DNA, 14 bp, Homo sapiens
cacatctgtatatc

SEQ ID NO: 4792040 - DNA, 15 bp, Homo sapiens
cacatgacagtggtt

SEQ ID NO: 4792041 - DNA, 13 bp, Homo sapiens
cacatgcctctct

SEQ ID NO: 4792042 - DNA, 12 bp, Homo sapiens
cacatgctggcc

SEQ ID NO: 4792043 - DNA, 14 bp, Homo sapiens
cacatgctggccag

SEQ ID NO: 4792044 - DNA, 17 bp, Homo sapiens
cacatgctggccagcct

SEQ ID NO: 4792045 - DNA, 21 bp, Homo sapiens
cacatgtattctgttggccag

SEQ ID NO: 4792046 - DNA, 15 bp, Homo sapiens
cacattatcttctgg

SEQ ID NO: 4792047 - DNA, 13 bp, Homo sapiens
cacattgaaactg

SEQ ID NO: 4792048 - DNA, 18 bp, Homo sapiens
cacattgaaactgtattt

SEQ ID NO: 4792049 - DNA, 15 bp, Homo sapiens
cacattgcttcatta

SEQ ID NO: 4792050 - DNA, 19 bp, Homo sapiens
cacatttctggccatttaa

SEQ ID NO: 4792051 - DNA, 20 bp, Homo sapiens
caccaaaggaaacccaattc

SEQ ID NO: 4792052 - DNA, 20 bp, Homo sapiens
caccaaattgctgagatgtt

SEQ ID NO: 4792053 - DNA, 19 bp, Homo sapiens
caccaacaacagtcagcca

SEQ ID NO: 4792054 - DNA, 20 bp, Homo sapiens
caccaacaacagtcagccag

SEQ ID NO: 4792055 - DNA, 14 bp, Homo sapiens
caccaagtaaatct

SEQ ID NO: 4792056 - DNA, 16 bp, Homo sapiens
caccaagtaaatctat

SEQ ID NO: 4792057 - DNA, 19 bp, Homo sapiens
caccacacacacccttccc

SEQ ID NO: 4792058 - DNA, 21 bp, Homo sapiens
caccacagaagcttgtattat

SEQ ID NO: 4792059 - DNA, 16 bp, Homo sapiens
caccaccactgtgtcc

SEQ ID NO: 4792060 - DNA, 14 bp, Homo sapiens
caccacccacccca

SEQ ID NO: 4792061 - DNA, 16 bp, Homo sapiens
caccactttcccacac

SEQ ID NO: 4792062 - DNA, 15 bp, Homo sapiens
caccagagtgtatgc

SEQ ID NO: 4792063 - DNA, 14 bp, Homo sapiens
caccagatgagaat

SEQ ID NO: 4792064 - DNA, 11 bp, Homo sapiens
caccagcctga

SEQ ID NO: 4792065 - DNA, 13 bp, Homo sapiens
caccagcctgagc

SEQ ID NO: 4792066 - DNA, 20 bp, Homo sapiens
caccagcctgagccacagtg

SEQ ID NO: 4792067 - DNA, 22 bp, Homo sapiens
caccagcctgagccacagtggg

SEQ ID NO: 4792068 - DNA, 16 bp, Homo sapiens
caccaggaagaaggcc

SEQ ID NO: 4792069 - DNA, 18 bp, Homo sapiens
caccaggaagaaggcccg

SEQ ID NO: 4792070 - DNA, 13 bp, Homo sapiens
caccagggactgc

SEQ ID NO: 4792071 - DNA, 18 bp, Homo sapiens
caccagtccacgccgggt

SEQ ID NO: 4792072 - DNA, 18 bp, Homo sapiens
caccatcaccacgcagag

SEQ ID NO: 4792073 - DNA, 22 bp, Homo sapiens
cacccacaccccgtctgcccct

SEQ ID NO: 4792074 - DNA, 14 bp, Homo sapiens
cacccaccaccccc

SEQ ID NO: 4792075 - DNA, 17 bp, Homo sapiens
cacccaccactctcagg

SEQ ID NO: 4792076 - DNA, 15 bp, Homo sapiens
cacccaccccaagct

SEQ ID NO: 4792077 - DNA, 17 bp, Homo sapiens
cacccaccccaagctgc

SEQ ID NO: 4792078 - DNA, 13 bp, Homo sapiens
cacccacccctgc

SEQ ID NO: 4792079 - DNA, 15 bp, Homo sapiens
cacccagcagcgccc

SEQ ID NO: 4792080 - DNA, 14 bp, Homo sapiens
cacccatatcatgc

SEQ ID NO: 4792081 - DNA, 17 bp, Homo sapiens
caccccaaacttccagg

SEQ ID NO: 4792082 - DNA, 12 bp, Homo sapiens
caccccacactt

SEQ ID NO: 4792083 - DNA, 22 bp, Homo sapiens
caccccacacttgcagagctgc

SEQ ID NO: 4792084 - DNA, 13 bp, Homo sapiens
cacccccagcctc

SEQ ID NO: 4792085 - DNA, 17 bp, Homo sapiens
cacccccagcctccccc

SEQ ID NO: 4792086 - DNA, 20 bp, Homo sapiens
cacccccagcctcccccagg

SEQ ID NO: 4792087 - DNA, 16 bp, Homo sapiens
caccccgctcttccca

SEQ ID NO: 4792088 - DNA, 17 bp, Homo sapiens
caccccgctcttcccaa

SEQ ID NO: 4792089 - DNA, 17 bp, Homo sapiens
caccccgctgcctggcg

SEQ ID NO: 4792090 - DNA, 15 bp, Homo sapiens
caccccggcaggccc

SEQ ID NO: 4792091 - DNA, 15 bp, Homo sapiens
caccccgtcccggcc

SEQ ID NO: 4792092 - DNA, 20 bp, Homo sapiens
caccccgttacagctcccca

SEQ ID NO: 4792093 - DNA, 17 bp, Homo sapiens
caccccgttcccagcgc

SEQ ID NO: 4792094 - DNA, 21 bp, Homo sapiens
caccccgttgttgtccctgca

SEQ ID NO: 4792095 - DNA, 18 bp, Homo sapiens
cacccctcaagccaggag

SEQ ID NO: 4792096 - DNA, 16 bp, Homo sapiens
cacccctcttccccct

SEQ ID NO: 4792097 - DNA, 19 bp, Homo sapiens
cacccctcttcccccttcc

SEQ ID NO: 4792098 - DNA, 20 bp, Homo sapiens
cacccctcttcccccttccc

SEQ ID NO: 4792099 - DNA, 21 bp, Homo sapiens
cacccctcttcccccttcccc

SEQ ID NO: 4792100 - DNA, 19 bp, Homo sapiens
cacccgccccagagactgc

SEQ ID NO: 4792101 - DNA, 15 bp, Homo sapiens
cacccgccctttcct

SEQ ID NO: 4792102 - DNA, 23 bp, Homo sapiens
cacccggatctccaggcccagcc

SEQ ID NO: 4792103 - DNA, 17 bp, Homo sapiens
cacccggcaaggggcgc

SEQ ID NO: 4792104 - DNA, 15 bp, Homo sapiens
cacccgttgagtcct

SEQ ID NO: 4792105 - DNA, 16 bp, Homo sapiens
caccctcactctgcca

SEQ ID NO: 4792106 - DNA, 19 bp, Homo sapiens
caccctcactctgccaggg

SEQ ID NO: 4792107 - DNA, 21 bp, Homo sapiens
caccctcactctgccagggca

SEQ ID NO: 4792108 - DNA, 22 bp, Homo sapiens
caccctcactctgccagggcag

SEQ ID NO: 4792109 - DNA, 18 bp, Homo sapiens
caccctccacaggagccg

SEQ ID NO: 4792110 - DNA, 22 bp, Homo sapiens
caccctgaggagtgatgggcaa

SEQ ID NO: 4792111 - DNA, 13 bp, Homo sapiens
caccctgcaaggc

SEQ ID NO: 4792112 - DNA, 14 bp, Homo sapiens
caccctgccctggc

SEQ ID NO: 4792113 - DNA, 14 bp, Homo sapiens
caccctgtctgcag

SEQ ID NO: 4792114 - DNA, 15 bp, Homo sapiens
caccctgtctgcagg

SEQ ID NO: 4792115 - DNA, 17 bp, Homo sapiens
cacccttccccactccc

SEQ ID NO: 4792116 - DNA, 14 bp, Homo sapiens
caccgcaccgggct

SEQ ID NO: 4792117 - DNA, 18 bp, Homo sapiens
caccgcattccaggggct

SEQ ID NO: 4792118 - DNA, 18 bp, Homo sapiens
caccgccacactggccgg

SEQ ID NO: 4792119 - DNA, 17 bp, Homo sapiens
caccgccagagtgtcct

SEQ ID NO: 4792120 - DNA, 19 bp, Homo sapiens
caccgccagagtgtcctgc

SEQ ID NO: 4792121 - DNA, 15 bp, Homo sapiens
caccgcccaaccccc

SEQ ID NO: 4792122 - DNA, 14 bp, Homo sapiens
caccgcgcccctct

SEQ ID NO: 4792123 - DNA, 16 bp, Homo sapiens
caccggacgctggaga

SEQ ID NO: 4792124 - DNA, 13 bp, Homo sapiens
caccgggagcctc

SEQ ID NO: 4792125 - DNA, 21 bp, Homo sapiens
caccgggagcctccccctcag

SEQ ID NO: 4792126 - DNA, 20 bp, Homo sapiens
cacctaaagggaagccctga

SEQ ID NO: 4792127 - DNA, 14 bp, Homo sapiens
cacctatctttggt

SEQ ID NO: 4792128 - DNA, 14 bp, Homo sapiens
cacctccacccgtc

SEQ ID NO: 4792129 - DNA, 22 bp, Homo sapiens
cacctcccggtgtatgcagtgg

SEQ ID NO: 4792130 - DNA, 23 bp, Homo sapiens
cacctcccggtgtatgcagtggt

SEQ ID NO: 4792131 - DNA, 18 bp, Homo sapiens
cacctccctgcagctttg

SEQ ID NO: 4792132 - DNA, 18 bp, Homo sapiens
cacctcctccgtgggcag

SEQ ID NO: 4792133 - DNA, 19 bp, Homo sapiens
cacctcgcaggttcaagca

SEQ ID NO: 4792134 - DNA, 12 bp, Homo sapiens
cacctcttcctt

SEQ ID NO: 4792135 - DNA, 16 bp, Homo sapiens
cacctctttcttcaat

SEQ ID NO: 4792136 - DNA, 13 bp, Homo sapiens
cacctgccaggct

SEQ ID NO: 4792137 - DNA, 14 bp, Homo sapiens
cacctgccaggctg

SEQ ID NO: 4792138 - DNA, 15 bp, Homo sapiens
cacctgccaggctgc

SEQ ID NO: 4792139 - DNA, 14 bp, Homo sapiens
cacctgcccagtta

SEQ ID NO: 4792140 - DNA, 13 bp, Homo sapiens
cacctgccccagg

SEQ ID NO: 4792141 - DNA, 17 bp, Homo sapiens
cacctgccccaggctca

SEQ ID NO: 4792142 - DNA, 15 bp, Homo sapiens
cacctgcccctcaac

SEQ ID NO: 4792143 - DNA, 21 bp, Homo sapiens
cacctgcccctcaactctcct

SEQ ID NO: 4792144 - DNA, 18 bp, Homo sapiens
cacctgccgctgcttgag

SEQ ID NO: 4792145 - DNA, 14 bp, Homo sapiens
cacctgcctgcaga

SEQ ID NO: 4792146 - DNA, 17 bp, Homo sapiens
cacctggaaagccaggt

SEQ ID NO: 4792147 - DNA, 14 bp, Homo sapiens
cacctggcttccca

SEQ ID NO: 4792148 - DNA, 15 bp, Homo sapiens
cacctggcttcccag

SEQ ID NO: 4792149 - DNA, 23 bp, Homo sapiens
cacctggcttcccaggaccctgg

SEQ ID NO: 4792150 - DNA, 13 bp, Homo sapiens
cacctgggcccta

SEQ ID NO: 4792151 - DNA, 16 bp, Homo sapiens
cacctgggccctaggc

SEQ ID NO: 4792152 - DNA, 17 bp, Homo sapiens
cacctgggccctaggca

SEQ ID NO: 4792153 - DNA, 20 bp, Homo sapiens
cacctgggccctaggcatac

SEQ ID NO: 4792154 - DNA, 15 bp, Homo sapiens
cacctggtggccctg

SEQ ID NO: 4792155 - DNA, 15 bp, Homo sapiens
caaatggatgtaata

SEQ ID NO: 4792156 - DNA, 13 bp, Homo sapiens
caaatggtatttt

SEQ ID NO: 4792157 - DNA, 20 bp, Homo sapiens
caaatggtattttttgtgaa

SEQ ID NO: 4792158 - DNA, 22 bp, Homo sapiens
caaatggtattttttgtgaatg

SEQ ID NO: 4792159 - DNA, 13 bp, Homo sapiens
caaatgtaaaata

SEQ ID NO: 4792160 - DNA, 19 bp, Homo sapiens
caaatgtaaaatatttata

SEQ ID NO: 4792161 - DNA, 13 bp, Homo sapiens
caaattccaatac

SEQ ID NO: 4792162 - DNA, 16 bp, Homo sapiens
caaattccaatacatt

SEQ ID NO: 4792163 - DNA, 17 bp, Homo sapiens
caaattctgattattac

SEQ ID NO: 4792164 - DNA, 21 bp, Homo sapiens
caaattctgattattacaaca

SEQ ID NO: 4792165 - DNA, 15 bp, Homo sapiens
caaatttatttccaa

SEQ ID NO: 4792166 - DNA, 23 bp, Homo sapiens
caaatttttactcaggctttcta

SEQ ID NO: 4792167 - DNA, 15 bp, Homo sapiens
caacaaagcatgctc

SEQ ID NO: 4792168 - DNA, 17 bp, Homo sapiens
caacaaagcatgctcag

SEQ ID NO: 4792169 - DNA, 12 bp, Homo sapiens
caacaacaaagc

SEQ ID NO: 4792170 - DNA, 13 bp, Homo sapiens
caacaacaacaga

SEQ ID NO: 4792171 - DNA, 19 bp, Homo sapiens
caacaacagaacaacaaca

SEQ ID NO: 4792172 - DNA, 17 bp, Homo sapiens
caacaacagtcagccag

SEQ ID NO: 4792173 - DNA, 14 bp, Homo sapiens
caacaactccagga

SEQ ID NO: 4792174 - DNA, 18 bp, Homo sapiens
caacaactccaggaaaac

SEQ ID NO: 4792175 - DNA, 18 bp, Homo sapiens
caacaacttactaaatct

SEQ ID NO: 4792176 - DNA, 16 bp, Homo sapiens
caacaatactttgtgt

SEQ ID NO: 4792177 - DNA, 20 bp, Homo sapiens
caacaatactttgtgtcttt

SEQ ID NO: 4792178 - DNA, 16 bp, Homo sapiens
caacagaacaacaaca

SEQ ID NO: 4792179 - DNA, 19 bp, Homo sapiens
caacagaacaacaacaaag

SEQ ID NO: 4792180 - DNA, 20 bp, Homo sapiens
caacagaacaacaacaaagc

SEQ ID NO: 4792181 - DNA, 22 bp, Homo sapiens
caacagactgccttatattatt

SEQ ID NO: 4792182 - DNA, 15 bp, Homo sapiens
caacagcaacaacaa

SEQ ID NO: 4792183 - DNA, 13 bp, Homo sapiens
caacagtcagcca

SEQ ID NO: 4792184 - DNA, 17 bp, Homo sapiens
caacagtcagccagctt

SEQ ID NO: 4792185 - DNA, 18 bp, Homo sapiens
caaccactgcgaccacaa

SEQ ID NO: 4792186 - DNA, 22 bp, Homo sapiens
caaccaggctacagttgatatt

SEQ ID NO: 4792187 - DNA, 13 bp, Homo sapiens
caaccatgttctt

SEQ ID NO: 4792188 - DNA, 13 bp, Homo sapiens
caacccaggtctg

SEQ ID NO: 4792189 - DNA, 16 bp, Homo sapiens
caacccaggtgttgtc

SEQ ID NO: 4792190 - DNA, 23 bp, Homo sapiens
caacccatgagcgtccaggtgat

SEQ ID NO: 4792191 - DNA, 16 bp, Homo sapiens
caacccatgcatggcc

SEQ ID NO: 4792192 - DNA, 24 bp, Homo sapiens
caacccatgcatggcctcccagcc

SEQ ID NO: 4792193 - DNA, 15 bp, Homo sapiens
caacccccacctccc

SEQ ID NO: 4792194 - DNA, 18 bp, Homo sapiens
caacccccacctcccggt

SEQ ID NO: 4792195 - DNA, 22 bp, Homo sapiens
caacccctaatcgccctgagct

SEQ ID NO: 4792196 - DNA, 15 bp, Homo sapiens
caaccctgccctgca

SEQ ID NO: 4792197 - DNA, 17 bp, Homo sapiens
caaccctgccctgcacc

SEQ ID NO: 4792198 - DNA, 19 bp, Homo sapiens
caaccctgttgctacatca

SEQ ID NO: 4792199 - DNA, 15 bp, Homo sapiens
caacctgaattaaag

SEQ ID NO: 4792200 - DNA, 21 bp, Homo sapiens
caacctgaattaaagtctaca

SEQ ID NO: 4792201 - DNA, 14 bp, Homo sapiens
caacctggaggctg

SEQ ID NO: 4792202 - DNA, 19 bp, Homo sapiens
caacctggaggctggacca

SEQ ID NO: 4792203 - DNA, 22 bp, Homo sapiens
caacctggcataggactctttg

SEQ ID NO: 4792204 - DNA, 17 bp, Homo sapiens
caacctggtggcaccag

SEQ ID NO: 4792205 - DNA, 21 bp, Homo sapiens
caacctgttcacgtgactcct

SEQ ID NO: 4792206 - DNA, 23 bp, Homo sapiens
caacctgttcacgtgactcctca

SEQ ID NO: 4792207 - DNA, 19 bp, Homo sapiens
caaccttgtactttacaat

SEQ ID NO: 4792208 - DNA, 16 bp, Homo sapiens
caactaacaatgcctt

SEQ ID NO: 4792209 - DNA, 11 bp, Homo sapiens
caactccaagg

SEQ ID NO: 4792210 - DNA, 12 bp, Homo sapiens
caactccaaggc

SEQ ID NO: 4792211 - DNA, 20 bp, Homo sapiens
caactccaaggcaaatgtcc

SEQ ID NO: 4792212 - DNA, 22 bp, Homo sapiens
caactccaaggcaaatgtccaa

SEQ ID NO: 4792213 - DNA, 19 bp, Homo sapiens
caactccaggaaaactgtt

SEQ ID NO: 4792214 - DNA, 19 bp, Homo sapiens
caactctcctccagagtca

SEQ ID NO: 4792215 - DNA, 13 bp, Homo sapiens
atttttgccctgc

SEQ ID NO: 4792216 - DNA, 15 bp, Homo sapiens
attttttgtaactct

SEQ ID NO: 4792217 - DNA, 21 bp, Homo sapiens
attttttgtctgtgataacag

SEQ ID NO: 4792218 - DNA, 15 bp, Homo sapiens
atttttttaacttta

SEQ ID NO: 4792219 - DNA, 16 bp, Homo sapiens
atttttttccagaatt

SEQ ID NO: 4792220 - DNA, 24 bp, Homo sapiens
attttttttcttccaacatgtgat

SEQ ID NO: 4792221 - DNA, 16 bp, Homo sapiens
caaaaaatgcttgctt

SEQ ID NO: 4792222 - DNA, 15 bp, Homo sapiens
caaaaaatttaagag

SEQ ID NO: 4792223 - DNA, 18 bp, Homo sapiens
caaaaactttccatgaca

SEQ ID NO: 4792224 - DNA, 24 bp, Homo sapiens
caaaaactttccatgacagtagca

SEQ ID NO: 4792225 - DNA, 20 bp, Homo sapiens
caaaaatcatcaaagtgttt

SEQ ID NO: 4792226 - DNA, 13 bp, Homo sapiens
caaaaatgaattc

SEQ ID NO: 4792227 - DNA, 14 bp, Homo sapiens
caaaaatgaattca

SEQ ID NO: 4792228 - DNA, 16 bp, Homo sapiens
caaaaatttgacattg

SEQ ID NO: 4792229 - DNA, 13 bp, Homo sapiens
caaaacaacagca

SEQ ID NO: 4792230 - DNA, 15 bp, Homo sapiens
caaaacaacagcaac

SEQ ID NO: 4792231 - DNA, 21 bp, Homo sapiens
caaaacaacagcaacaacaac

SEQ ID NO: 4792232 - DNA, 14 bp, Homo sapiens
caaaaggaatagat

SEQ ID NO: 4792233 - DNA, 16 bp, Homo sapiens
caaaagggagaacatg

SEQ ID NO: 4792234 - DNA, 16 bp, Homo sapiens
caaaagtactagcaat

SEQ ID NO: 4792235 - DNA, 15 bp, Homo sapiens
caaaagtatattcaa

SEQ ID NO: 4792236 - DNA, 21 bp, Homo sapiens
caaaagtctcaatgttccatt

SEQ ID NO: 4792237 - DNA, 16 bp, Homo sapiens
caaaataaaaccagaa

SEQ ID NO: 4792238 - DNA, 22 bp, Homo sapiens
caaaatacatgatgatttcaga

SEQ ID NO: 4792239 - DNA, 22 bp, Homo sapiens
caaaatagtcatgtttctgcag

SEQ ID NO: 4792240 - DNA, 15 bp, Homo sapiens
caaaatataaatcac

SEQ ID NO: 4792241 - DNA, 21 bp, Homo sapiens
caaaatataaatcacagattt

SEQ ID NO: 4792242 - DNA, 22 bp, Homo sapiens
caaaatgaaacgcaaccaccac

SEQ ID NO: 4792243 - DNA, 21 bp, Homo sapiens
caaaatgaactaactgccatg

SEQ ID NO: 4792244 - DNA, 12 bp, Homo sapiens
caaaatgcagga

SEQ ID NO: 4792245 - DNA, 19 bp, Homo sapiens
caaaatgtgtgcttggaaa

SEQ ID NO: 4792246 - DNA, 17 bp, Homo sapiens
caaaatttatgtcattt

SEQ ID NO: 4792247 - DNA, 19 bp, Homo sapiens
caaaatttatgtcattttc

SEQ ID NO: 4792248 - DNA, 22 bp, Homo sapiens
caaacaaatcattttgatgtat

SEQ ID NO: 4792249 - DNA, 22 bp, Homo sapiens
caaacagggacactacaaacat

SEQ ID NO: 4792250 - DNA, 14 bp, Homo sapiens
caaacagtgtggct

SEQ ID NO: 4792251 - DNA, 18 bp, Homo sapiens
caaacatttctttttcct

SEQ ID NO: 4792252 - DNA, 14 bp, Homo sapiens
caaaccacaactga

SEQ ID NO: 4792253 - DNA, 14 bp, Homo sapiens
caaaccctgcttct

SEQ ID NO: 4792254 - DNA, 20 bp, Homo sapiens
caaaccctgcttctgctgcc

SEQ ID NO: 4792255 - DNA, 24 bp, Homo sapiens
caaaccctgcttctgctgccctga

SEQ ID NO: 4792256 - DNA, 16 bp, Homo sapiens
caaacctctcagcact

SEQ ID NO: 4792257 - DNA, 13 bp, Homo sapiens
caaacctggcaga

SEQ ID NO: 4792258 - DNA, 15 bp, Homo sapiens
caaaccttcttttca

SEQ ID NO: 4792259 - DNA, 17 bp, Homo sapiens
caaaccttcttttcaat

SEQ ID NO: 4792260 - DNA, 14 bp, Homo sapiens
caaactcatccatt

SEQ ID NO: 4792261 - DNA, 16 bp, Homo sapiens
caaactcatccattaa

SEQ ID NO: 4792262 - DNA, 23 bp, Homo sapiens
caaactctctagtgcaggaaaag

SEQ ID NO: 4792263 - DNA, 13 bp, Homo sapiens
caaactgaaatta

SEQ ID NO: 4792264 - DNA, 22 bp, Homo sapiens
caaactgaaattagtgttttca

SEQ ID NO: 4792265 - DNA, 19 bp, Homo sapiens
caaactgtagtaattgtta

SEQ ID NO: 4792266 - DNA, 23 bp, Homo sapiens
caaactgtagtaattgttacaat

SEQ ID NO: 4792267 - DNA, 16 bp, Homo sapiens
caaactgttcaagaaa

SEQ ID NO: 4792268 - DNA, 16 bp, Homo sapiens
atggtgtcataactag

SEQ ID NO: 4792269 - DNA, 22 bp, Homo sapiens
atggtgtcataactagagcacg

SEQ ID NO: 4792270 - DNA, 16 bp, Homo sapiens
atggttgcaaagtgtt

SEQ ID NO: 4792271 - DNA, 13 bp, Homo sapiens
atggttgctttga

SEQ ID NO: 4792272 - DNA, 15 bp, Homo sapiens
atggttgctttgagc

SEQ ID NO: 4792273 - DNA, 11 bp, Homo sapiens
atgtaaaaagg

SEQ ID NO: 4792274 - DNA, 15 bp, Homo sapiens
atgtaaacatcataa

SEQ ID NO: 4792275 - DNA, 15 bp, Homo sapiens
atgtaaatattgctg

SEQ ID NO: 4792276 - DNA, 17 bp, Homo sapiens
atgtaaattgactgtac

SEQ ID NO: 4792277 - DNA, 14 bp, Homo sapiens
atgtaagaaataag

SEQ ID NO: 4792278 - DNA, 13 bp, Homo sapiens
atgtaagtttcta

SEQ ID NO: 4792279 - DNA, 16 bp, Homo sapiens
atgtaagtttctaaga

SEQ ID NO: 4792280 - DNA, 21 bp, Homo sapiens
atgtaagtttctaagaattta

SEQ ID NO: 4792281 - DNA, 19 bp, Homo sapiens
atgtaatatagggtttgtt

SEQ ID NO: 4792282 - DNA, 14 bp, Homo sapiens
atgtaatatataca

SEQ ID NO: 4792283 - DNA, 21 bp, Homo sapiens
atgtaatatatacatattcaa

SEQ ID NO: 4792284 - DNA, 17 bp, Homo sapiens
atgtactacatttgcat

SEQ ID NO: 4792285 - DNA, 18 bp, Homo sapiens
atgtactacatttgcatg

SEQ ID NO: 4792286 - DNA, 19 bp, Homo sapiens
atgtactacatttgcatgc

SEQ ID NO: 4792287 - DNA, 16 bp, Homo sapiens
atgtagataaagcact

SEQ ID NO: 4792288 - DNA, 22 bp, Homo sapiens
atgtagcaaattccaatacatt

SEQ ID NO: 4792289 - DNA, 21 bp, Homo sapiens
atgtaggctaagaaagaaatg

SEQ ID NO: 4792290 - DNA, 14 bp, Homo sapiens
atgtatatatttat

SEQ ID NO: 4792291 - DNA, 16 bp, Homo sapiens
atgtatatatttatta

SEQ ID NO: 4792292 - DNA, 18 bp, Homo sapiens
atgtatatgttatttttg

SEQ ID NO: 4792293 - DNA, 17 bp, Homo sapiens
atgtatgccatgtatgt

SEQ ID NO: 4792294 - DNA, 22 bp, Homo sapiens
atgtatgtaaataggtttctaa

SEQ ID NO: 4792295 - DNA, 20 bp, Homo sapiens
atgtatgtgtgagtgtatgt

SEQ ID NO: 4792296 - DNA, 12 bp, Homo sapiens
atgtattatgtc

SEQ ID NO: 4792297 - DNA, 15 bp, Homo sapiens
atgtattctcttcta

SEQ ID NO: 4792298 - DNA, 15 bp, Homo sapiens
atgtcaaatggatgt

SEQ ID NO: 4792299 - DNA, 17 bp, Homo sapiens
atgtcaatgctatggac

SEQ ID NO: 4792300 - DNA, 21 bp, Homo sapiens
atgtcaatgctatggactgca

SEQ ID NO: 4792301 - DNA, 16 bp, Homo sapiens
atgtcagtagtgcctg

SEQ ID NO: 4792302 - DNA, 17 bp, Homo sapiens
atgtcagtagtgcctgt

SEQ ID NO: 4792303 - DNA, 21 bp, Homo sapiens
atgtcagtagtgcctgtgatc

SEQ ID NO: 4792304 - DNA, 15 bp, Homo sapiens
atgtcagtgtgactg

SEQ ID NO: 4792305 - DNA, 14 bp, Homo sapiens
atgtcataaagtga

SEQ ID NO: 4792306 - DNA, 11 bp, Homo sapiens
atgtcatttgc

SEQ ID NO: 4792307 - DNA, 13 bp, Homo sapiens
atgtcatttgcta

SEQ ID NO: 4792308 - DNA, 15 bp, Homo sapiens
atgtcattttcagat

SEQ ID NO: 4792309 - DNA, 19 bp, Homo sapiens
atgtcattttcagatcctt

SEQ ID NO: 4792310 - DNA, 18 bp, Homo sapiens
atgtccaggtcacaggca

SEQ ID NO: 4792311 - DNA, 17 bp, Homo sapiens
atgtcccaaataaattt

SEQ ID NO: 4792312 - DNA, 23 bp, Homo sapiens
atgtcctaggggccgagggaaat

SEQ ID NO: 4792313 - DNA, 15 bp, Homo sapiens
atgtcggggcccctg

SEQ ID NO: 4792314 - DNA, 17 bp, Homo sapiens
atgtctataaatggtgt

SEQ ID NO: 4792315 - DNA, 13 bp, Homo sapiens
atgtctatgtgta

SEQ ID NO: 4792316 - DNA, 10 bp, Homo sapiens
atgtctgtga

SEQ ID NO: 4792317 - DNA, 15 bp, Homo sapiens
atgtctgtgtataca

SEQ ID NO: 4792318 - DNA, 21 bp, Homo sapiens
atgtctgtgtatacatatgta

SEQ ID NO: 4792319 - DNA, 16 bp, Homo sapiens
atgtcttggtttccat

SEQ ID NO: 4792320 - DNA, 13 bp, Homo sapiens
atgtctttaaaat

SEQ ID NO: 4792321 - DNA, 16 bp, Homo sapiens
atgtctttaaaatgat

SEQ ID NO: 4792322 - DNA, 18 bp, Homo sapiens
atgtgaaaaaaaaaagta

SEQ ID NO: 4792323 - DNA, 21 bp, Homo sapiens
atgtgaaaaaaaaaagtaatt

SEQ ID NO: 4792324 - DNA, 14 bp, Homo sapiens
atgtgaaaggatat

SEQ ID NO: 4792325 - DNA, 20 bp, Homo sapiens
atgtgaaaggatatgaatct

SEQ ID NO: 4792326 - DNA, 23 bp, Homo sapiens
atgtgaagacagagcagatcagt

SEQ ID NO: 4792327 - DNA, 14 bp, Homo sapiens
atgtgatatgtgta

SEQ ID NO: 4792328 - DNA, 22 bp, Homo sapiens
atgtgatatgtgtaatatcatt

SEQ ID NO: 4792329 - DNA, 14 bp, Homo sapiens
atgtgatttatgca

SEQ ID NO: 4792330 - DNA, 15 bp, Homo sapiens
atgtgcatctggcct

SEQ ID NO: 4792331 - DNA, 16 bp, Homo sapiens
atgtgcatctggccta

SEQ ID NO: 4792332 - DNA, 23 bp, Homo sapiens
atgtgccgtctttggttcctcat

SEQ ID NO: 4792333 - DNA, 19 bp, Homo sapiens
atgtgctattaatatttgt

SEQ ID NO: 4792334 - DNA, 17 bp, Homo sapiens
atgtgctcagccccaga

SEQ ID NO: 4792335 - DNA, 15 bp, Homo sapiens
atgtgctttcatcca

SEQ ID NO: 4792336 - DNA, 20 bp, Homo sapiens
atgtggaattacataacagg

SEQ ID NO: 4792337 - DNA, 17 bp, Homo sapiens
atgtggcattggggggc

SEQ ID NO: 4792338 - DNA, 22 bp, Homo sapiens
atgtggcattggggggccgggc

SEQ ID NO: 4792339 - DNA, 17 bp, Homo sapiens
atgtggcttcttcaact

SEQ ID NO: 4792340 - DNA, 20 bp, Homo sapiens
atgtgtaactttattggtct

SEQ ID NO: 4792341 - DNA, 13 bp, Homo sapiens
atgtgtaatatca

SEQ ID NO: 4792342 - DNA, 19 bp, Homo sapiens
atgtgtaatatcatttcat

SEQ ID NO: 4792343 - DNA, 17 bp, Homo sapiens
atgtgtacacatatgaa

SEQ ID NO: 4792344 - DNA, 13 bp, Homo sapiens
atgtgtatatatt

SEQ ID NO: 4792345 - DNA, 14 bp, Homo sapiens
atgtgtatatatta

SEQ ID NO: 4792346 - DNA, 22 bp, Homo sapiens
atgtgtatatattatatataca

SEQ ID NO: 4792347 - DNA, 23 bp, Homo sapiens
atgtgtatatattatatatacat

SEQ ID NO: 4792348 - DNA, 16 bp, Homo sapiens
atgtgtatcagtgttt

SEQ ID NO: 4792349 - DNA, 13 bp, Homo sapiens
atgtgtatgtact

SEQ ID NO: 4792350 - DNA, 14 bp, Homo sapiens
atgtgtatgtactt

SEQ ID NO: 4792351 - DNA, 18 bp, Homo sapiens
atgtgtatgtacttacat

SEQ ID NO: 4792352 - DNA, 18 bp, Homo sapiens
atgtgtcatgatttcaat

SEQ ID NO: 4792353 - DNA, 22 bp, Homo sapiens
atgtgtcccctcactctgtcag

SEQ ID NO: 4792354 - DNA, 17 bp, Homo sapiens
atgtgtgagtgtatgta

SEQ ID NO: 4792355 - DNA, 17 bp, Homo sapiens
atgtgttaatcttaatg

SEQ ID NO: 4792356 - DNA, 21 bp, Homo sapiens
atgttaaagaggcgtcttgta

SEQ ID NO: 4792357 - DNA, 18 bp, Homo sapiens
atgttaacaatgcctatt

SEQ ID NO: 4792358 - DNA, 16 bp, Homo sapiens
atgttagtagcactga

SEQ ID NO: 4792359 - DNA, 19 bp, Homo sapiens
atgttatttatgatgttat

SEQ ID NO: 4792360 - DNA, 20 bp, Homo sapiens
atgttatttatgatgttatt

SEQ ID NO: 4792361 - DNA, 21 bp, Homo sapiens
atgttattttgtacgtgttat

SEQ ID NO: 4792362 - DNA, 16 bp, Homo sapiens
atgttcaatatttgta

SEQ ID NO: 4792363 - DNA, 21 bp, Homo sapiens
atgttcatgtgtaacttctag

SEQ ID NO: 4792364 - DNA, 19 bp, Homo sapiens
atgttccattcagtctgca

SEQ ID NO: 4792365 - DNA, 13 bp, Homo sapiens
atgttcccagaac

SEQ ID NO: 4792366 - DNA, 20 bp, Homo sapiens
atgttccgttcatctgagga

SEQ ID NO: 4792367 - DNA, 18 bp, Homo sapiens
atgttctgtgtcacgtga

SEQ ID NO: 4792368 - DNA, 23 bp, Homo sapiens
atgttctttcctttcatcctcag

SEQ ID NO: 4792369 - DNA, 12 bp, Homo sapiens
atgttgtaatat

SEQ ID NO: 4792370 - DNA, 16 bp, Homo sapiens
atgttgtaatattttg

SEQ ID NO: 4792371 - DNA, 18 bp, Homo sapiens
atgttgtcctgtgtcatc

SEQ ID NO: 4792372 - DNA, 19 bp, Homo sapiens
atgttgtgttggtatttac

SEQ ID NO: 4792373 - DNA, 22 bp, Homo sapiens
atgttgttcgatcgtttcacat

SEQ ID NO: 4792374 - DNA, 21 bp, Homo sapiens
atgtttagatgaggttgagct

SEQ ID NO: 4792375 - DNA, 16 bp, Homo sapiens
atgtttagtagctgat

SEQ ID NO: 4792376 - DNA, 14 bp, Homo sapiens
atgtttatattgtt

SEQ ID NO: 4792377 - DNA, 18 bp, Homo sapiens
atgtttcattattctttc

SEQ ID NO: 4792378 - DNA, 21 bp, Homo sapiens
atgtttctgcagtattctgta

SEQ ID NO: 4792379 - DNA, 23 bp, Homo sapiens
atgtttgagcagtggcctacaaa

SEQ ID NO: 4792380 - DNA, 13 bp, Homo sapiens
atgtttggctgaa

SEQ ID NO: 4792381 - DNA, 14 bp, Homo sapiens
attaaaaagacact

SEQ ID NO: 4792382 - DNA, 13 bp, Homo sapiens
attaaaaagttaa

SEQ ID NO: 4792383 - DNA, 14 bp, Homo sapiens
attaaaacaagaga

SEQ ID NO: 4792384 - DNA, 23 bp, Homo sapiens
attaaaacaagagaccacttcct

SEQ ID NO: 4792385 - DNA, 12 bp, Homo sapiens
attaaaatcaca

SEQ ID NO: 4792386 - DNA, 14 bp, Homo sapiens
attaaaattagtga

SEQ ID NO: 4792387 - DNA, 15 bp, Homo sapiens
attaaacaatttatt

SEQ ID NO: 4792388 - DNA, 19 bp, Homo sapiens
attaaacaatttattttat

SEQ ID NO: 4792389 - DNA, 20 bp, Homo sapiens
attaaacaatttattttatt

SEQ ID NO: 4792390 - DNA, 11 bp, Homo sapiens
attaaactaat

SEQ ID NO: 4792391 - DNA, 13 bp, Homo sapiens
attaaactgggaa

SEQ ID NO: 4792392 - DNA, 15 bp, Homo sapiens
attaaacttcagcaa

SEQ ID NO: 4792393 - DNA, 17 bp, Homo sapiens
attaaagtctacactgc

SEQ ID NO: 4792394 - DNA, 20 bp, Homo sapiens
attaaagtctacactgcctt

SEQ ID NO: 4792395 - DNA, 15 bp, Homo sapiens
attaaatatatgtat

SEQ ID NO: 4792396 - DNA, 17 bp, Homo sapiens
attaaatatatgtatgt

SEQ ID NO: 4792397 - DNA, 18 bp, Homo sapiens
attaaatatatgtatgta

SEQ ID NO: 4792398 - DNA, 19 bp, Homo sapiens
attaaatatatgtatgtaa

SEQ ID NO: 4792399 - DNA, 21 bp, Homo sapiens
attaaatatatgtatgtaaaa

SEQ ID NO: 4792400 - DNA, 14 bp, Homo sapiens
attaaatgtagctt

SEQ ID NO: 4792401 - DNA, 15 bp, Homo sapiens
attaaattatcattg

SEQ ID NO: 4792402 - DNA, 18 bp, Homo sapiens
attaaatttattaaatgt

SEQ ID NO: 4792403 - DNA, 19 bp, Homo sapiens
attaaatttattaaatgtt

SEQ ID NO: 4792404 - DNA, 18 bp, Homo sapiens
attaaccccataattaga

SEQ ID NO: 4792405 - DNA, 20 bp, Homo sapiens
attaactctgcatagacaaa

SEQ ID NO: 4792406 - DNA, 18 bp, Homo sapiens
attaacttctattttcaa

SEQ ID NO: 4792407 - DNA, 20 bp, Homo sapiens
attaacttctattttcaagt

SEQ ID NO: 4792408 - DNA, 21 bp, Homo sapiens
attaagaaaccccctcatgga

SEQ ID NO: 4792409 - DNA, 11 bp, Homo sapiens
attaagcacat

SEQ ID NO: 4792410 - DNA, 20 bp, Homo sapiens
attaagcacattattgtaga

SEQ ID NO: 4792411 - DNA, 18 bp, Homo sapiens
attaagcccacagtatat

SEQ ID NO: 4792412 - DNA, 20 bp, Homo sapiens
attaagcccacagtatattt

SEQ ID NO: 4792413 - DNA, 17 bp, Homo sapiens
attaaggactacagaat

SEQ ID NO: 4792414 - DNA, 16 bp, Homo sapiens
attaatataaaaacat

SEQ ID NO: 4792415 - DNA, 12 bp, Homo sapiens
attaatattcat

SEQ ID NO: 4792416 - DNA, 14 bp, Homo sapiens
attaatgacaacaa

SEQ ID NO: 4792417 - DNA, 12 bp, Homo sapiens
attaatggaaaa

SEQ ID NO: 4792418 - DNA, 16 bp, Homo sapiens
attaatggaaaactgt

SEQ ID NO: 4792419 - DNA, 18 bp, Homo sapiens
attaatggaaaactgtta

SEQ ID NO: 4792420 - DNA, 16 bp, Homo sapiens
attaatttattaaatt

SEQ ID NO: 4792421 - DNA, 19 bp, Homo sapiens
attaatttattaaatttat

SEQ ID NO: 4792422 - DNA, 16 bp, Homo sapiens
attaatttgtgtagat

SEQ ID NO: 4792423 - DNA, 14 bp, Homo sapiens
attacataaataaa

SEQ ID NO: 4792424 - DNA, 14 bp, Homo sapiens
attaccatttgtta

SEQ ID NO: 4792425 - DNA, 19 bp, Homo sapiens
attaccatttgttaatatc

SEQ ID NO: 4792426 - DNA, 12 bp, Homo sapiens
attacctgaaag

SEQ ID NO: 4792427 - DNA, 17 bp, Homo sapiens
attactggatctcttaa

SEQ ID NO: 4792428 - DNA, 22 bp, Homo sapiens
attactgtgagaactgtgaata

SEQ ID NO: 4792429 - DNA, 22 bp, Homo sapiens
attactgtttgaaacttttcaa

SEQ ID NO: 4792430 - DNA, 22 bp, Homo sapiens
attactttaaattatatgatat

SEQ ID NO: 4792431 - DNA, 23 bp, Homo sapiens
attactttaaattatatgatatg

SEQ ID NO: 4792432 - DNA, 20 bp, Homo sapiens
attagaaaatgtatttatag

SEQ ID NO: 4792433 - DNA, 14 bp, Homo sapiens
attagaagaaaatg

SEQ ID NO: 4792434 - DNA, 14 bp, Homo sapiens
attagacaatgtgg

SEQ ID NO: 4792435 - DNA, 22 bp, Homo sapiens
attagacaatgtggaattacat

SEQ ID NO: 4792436 - DNA, 21 bp, Homo sapiens
attagatgactgaatttctat

SEQ ID NO: 4792437 - DNA, 20 bp, Homo sapiens
attagattttaaaacttcat

SEQ ID NO: 4792438 - DNA, 12 bp, Homo sapiens
attagcaccagc

SEQ ID NO: 4792439 - DNA, 14 bp, Homo sapiens
attagcaccagctt

SEQ ID NO: 4792440 - DNA, 16 bp, Homo sapiens
attagccaaccaggct

SEQ ID NO: 4792441 - DNA, 18 bp, Homo sapiens
attaggaacagagtatat

SEQ ID NO: 4792442 - DNA, 21 bp, Homo sapiens
attagtaagatctctttctaa

SEQ ID NO: 4792443 - DNA, 15 bp, Homo sapiens
attagtatcctgtta

SEQ ID NO: 4792444 - DNA, 15 bp, Homo sapiens
attagtgaagtatgc

SEQ ID NO: 4792445 - DNA, 17 bp, Homo sapiens
attagtgagatttgtat

SEQ ID NO: 4792446 - DNA, 14 bp, Homo sapiens
attagtgttttcat

SEQ ID NO: 4792447 - DNA, 20 bp, Homo sapiens
attagtgttttcattctggt

SEQ ID NO: 4792448 - DNA, 20 bp, Homo sapiens
attagttaggtgtgccaaac

SEQ ID NO: 4792449 - DNA, 14 bp, Homo sapiens
attataagttgacc

SEQ ID NO: 4792450 - DNA, 16 bp, Homo sapiens
attataagttgacctt

SEQ ID NO: 4792451 - DNA, 17 bp, Homo sapiens
attataatgcatctaaa

SEQ ID NO: 4792452 - DNA, 18 bp, Homo sapiens
attataatgcatctaaac

SEQ ID NO: 4792453 - DNA, 13 bp, Homo sapiens
attatactgtgtg

SEQ ID NO: 4792454 - DNA, 13 bp, Homo sapiens
attatagcatgta

SEQ ID NO: 4792455 - DNA, 16 bp, Homo sapiens
attatagtaccactgc

SEQ ID NO: 4792456 - DNA, 14 bp, Homo sapiens
attatatatacatt

SEQ ID NO: 4792457 - DNA, 18 bp, Homo sapiens
attatatctgtggtcttc

SEQ ID NO: 4792458 - DNA, 13 bp, Homo sapiens
attatatgatatg

SEQ ID NO: 4792459 - DNA, 14 bp, Homo sapiens
attatatgatatgc

SEQ ID NO: 4792460 - DNA, 18 bp, Homo sapiens
attatatgatatgcatgt

SEQ ID NO: 4792461 - DNA, 22 bp, Homo sapiens
attatattttgaacaactcgaa

SEQ ID NO: 4792462 - DNA, 13 bp, Homo sapiens
attatcatatatg

SEQ ID NO: 4792463 - DNA, 15 bp, Homo sapiens
attatcatatatgct

SEQ ID NO: 4792464 - DNA, 13 bp, Homo sapiens
attatcattgttt

SEQ ID NO: 4792465 - DNA, 14 bp, Homo sapiens
attatcattgtttg

SEQ ID NO: 4792466 - DNA, 17 bp, Homo sapiens
attatcattgtttgtcc

SEQ ID NO: 4792467 - DNA, 18 bp, Homo sapiens
attatcctcaagttgtgt

SEQ ID NO: 4792468 - DNA, 23 bp, Homo sapiens
attatcctcaagttgtgtgctat

SEQ ID NO: 4792469 - DNA, 16 bp, Homo sapiens
attatctctttctctc

SEQ ID NO: 4792470 - DNA, 13 bp, Homo sapiens
attatctgggttt

SEQ ID NO: 4792471 - DNA, 18 bp, Homo sapiens
attatctgttctatggac

SEQ ID NO: 4792472 - DNA, 21 bp, Homo sapiens
attatcttaaacccacataaa

SEQ ID NO: 4792473 - DNA, 11 bp, Homo sapiens
attatgaaatg

SEQ ID NO: 4792474 - DNA, 16 bp, Homo sapiens
attatgacgtgcacaa

SEQ ID NO: 4792475 - DNA, 12 bp, Homo sapiens
attatgcttctt

SEQ ID NO: 4792476 - DNA, 15 bp, Homo sapiens
attatgtcaaatgga

SEQ ID NO: 4792477 - DNA, 21 bp, Homo sapiens
attatgtcaaatggatgtaat

SEQ ID NO: 4792478 - DNA, 19 bp, Homo sapiens
attgcactgcagttattta

SEQ ID NO: 4792479 - DNA, 23 bp, Homo sapiens
attgccaaggcatccccagtgcc

SEQ ID NO: 4792480 - DNA, 16 bp, Homo sapiens
attgcccatgatataa

SEQ ID NO: 4792481 - DNA, 17 bp, Homo sapiens
attgctgagatgtttag

SEQ ID NO: 4792482 - DNA, 22 bp, Homo sapiens
attgctgagatgtttagtagct

SEQ ID NO: 4792483 - DNA, 19 bp, Homo sapiens
attgcttcattaaaacaag

SEQ ID NO: 4792484 - DNA, 20 bp, Homo sapiens
attgcttcattaaaacaaga

SEQ ID NO: 4792485 - DNA, 14 bp, Homo sapiens
attgcttctctaaa

SEQ ID NO: 4792486 - DNA, 17 bp, Homo sapiens
attgcttctctaaaaca

SEQ ID NO: 4792487 - DNA, 13 bp, Homo sapiens
attgcttgagcat

SEQ ID NO: 4792488 - DNA, 16 bp, Homo sapiens
attgctttataaataa

SEQ ID NO: 4792489 - DNA, 15 bp, Homo sapiens
attggaaaaaattag

SEQ ID NO: 4792490 - DNA, 15 bp, Homo sapiens
attggacctggccca

SEQ ID NO: 4792491 - DNA, 14 bp, Homo sapiens
attggacttccatt

SEQ ID NO: 4792492 - DNA, 20 bp, Homo sapiens
attggaggatgggggtcctg

SEQ ID NO: 4792493 - DNA, 16 bp, Homo sapiens
attggatcaagtatta

SEQ ID NO: 4792494 - DNA, 15 bp, Homo sapiens
attggcagcacagct

SEQ ID NO: 4792495 - DNA, 15 bp, Homo sapiens
attggcatggatttc

SEQ ID NO: 4792496 - DNA, 18 bp, Homo sapiens
attggccttaactggccc

SEQ ID NO: 4792497 - DNA, 20 bp, Homo sapiens
attggccttaactggccctc

SEQ ID NO: 4792498 - DNA, 12 bp, Homo sapiens
attggcttgttt

SEQ ID NO: 4792499 - DNA, 20 bp, Homo sapiens
attgggcccttagaatgtga

SEQ ID NO: 4792500 - DNA, 17 bp, Homo sapiens
attggttaatgaaaaat

SEQ ID NO: 4792501 - DNA, 16 bp, Homo sapiens
attggttacaaatttt

SEQ ID NO: 4792502 - DNA, 20 bp, Homo sapiens
attggttacaaatttttact

SEQ ID NO: 4792503 - DNA, 16 bp, Homo sapiens
attgtaaaggtgatga

SEQ ID NO: 4792504 - DNA, 16 bp, Homo sapiens
attgtaacttatttca

SEQ ID NO: 4792505 - DNA, 16 bp, Homo sapiens
attgtaaggaatgatt

SEQ ID NO: 4792506 - DNA, 22 bp, Homo sapiens
attgtaatatagaaaaaaacat

SEQ ID NO: 4792507 - DNA, 15 bp, Homo sapiens
attgtaatcataaat

SEQ ID NO: 4792508 - DNA, 20 bp, Homo sapiens
attgtacagaatcattgctt

SEQ ID NO: 4792509 - DNA, 21 bp, Homo sapiens
attgtacagaatcattgctta

SEQ ID NO: 4792510 - DNA, 16 bp, Homo sapiens
attgtacagtttgttt

SEQ ID NO: 4792511 - DNA, 20 bp, Homo sapiens
attgtacccttcttgtctct

SEQ ID NO: 4792512 - DNA, 19 bp, Homo sapiens
attgtagcctaatattcat

SEQ ID NO: 4792513 - DNA, 21 bp, Homo sapiens
attgtaggtcaatgaaatatt

SEQ ID NO: 4792514 - DNA, 17 bp, Homo sapiens
attgtataaaacagtgt

SEQ ID NO: 4792515 - DNA, 16 bp, Homo sapiens
attgtatatatggata

SEQ ID NO: 4792516 - DNA, 13 bp, Homo sapiens
attgtatctcctt

SEQ ID NO: 4792517 - DNA, 18 bp, Homo sapiens
attgtatctcctttaata

SEQ ID NO: 4792518 - DNA, 19 bp, Homo sapiens
attgtattatcatatatgc

SEQ ID NO: 4792519 - DNA, 16 bp, Homo sapiens
attgtcaaagtggtga

SEQ ID NO: 4792520 - DNA, 23 bp, Homo sapiens
attgtcaaagtggtgagaggcat

SEQ ID NO: 4792521 - DNA, 18 bp, Homo sapiens
atgccatgtatgttgcat

SEQ ID NO: 4792522 - DNA, 13 bp, Homo sapiens
atgcccaaatata

SEQ ID NO: 4792523 - DNA, 22 bp, Homo sapiens
atgcccaaatataacatgaaag

SEQ ID NO: 4792524 - DNA, 23 bp, Homo sapiens
atgcccagcttggagtgccacgt

SEQ ID NO: 4792525 - DNA, 13 bp, Homo sapiens
atgcctaataaac

SEQ ID NO: 4792526 - DNA, 20 bp, Homo sapiens
atgcctacattagtgagatt

SEQ ID NO: 4792527 - DNA, 13 bp, Homo sapiens
atgcctatattta

SEQ ID NO: 4792528 - DNA, 12 bp, Homo sapiens
atgcctattgta

SEQ ID NO: 4792529 - DNA, 14 bp, Homo sapiens
atgcctctctcagg

SEQ ID NO: 4792530 - DNA, 15 bp, Homo sapiens
atgcctgcctgaaca

SEQ ID NO: 4792531 - DNA, 21 bp, Homo sapiens
atgccttcataaattatttct

SEQ ID NO: 4792532 - DNA, 22 bp, Homo sapiens
atgccttcataaattatttcta

SEQ ID NO: 4792533 - DNA, 22 bp, Homo sapiens
atgcctttctagcaattgcttc

SEQ ID NO: 4792534 - DNA, 14 bp, Homo sapiens
atgcgctcctggct

SEQ ID NO: 4792535 - DNA, 15 bp, Homo sapiens
atgcgctcctggctt

SEQ ID NO: 4792536 - DNA, 16 bp, Homo sapiens
atgcgctcctggcttt

SEQ ID NO: 4792537 - DNA, 16 bp, Homo sapiens
atgcgctcttcaccag

SEQ ID NO: 4792538 - DNA, 20 bp, Homo sapiens
atgcgctcttcaccaggaag

SEQ ID NO: 4792539 - DNA, 17 bp, Homo sapiens
atgcgtggctcccagca

SEQ ID NO: 4792540 - DNA, 13 bp, Homo sapiens
atgctaaatgcaa

SEQ ID NO: 4792541 - DNA, 19 bp, Homo sapiens
atgctaaatgcaaacactg

SEQ ID NO: 4792542 - DNA, 16 bp, Homo sapiens
atgctaacctctctga

SEQ ID NO: 4792543 - DNA, 19 bp, Homo sapiens
atgctaacctctctgaact

SEQ ID NO: 4792544 - DNA, 16 bp, Homo sapiens
atgctactcagtatat

SEQ ID NO: 4792545 - DNA, 14 bp, Homo sapiens
atgctagttcttac

SEQ ID NO: 4792546 - DNA, 14 bp, Homo sapiens
atgctcaatgtgct

SEQ ID NO: 4792547 - DNA, 14 bp, Homo sapiens
atgctcagtattga

SEQ ID NO: 4792548 - DNA, 14 bp, Homo sapiens
atgctccctcatgc

SEQ ID NO: 4792549 - DNA, 13 bp, Homo sapiens
atgctcctagttt

SEQ ID NO: 4792550 - DNA, 13 bp, Homo sapiens
atgctctaacaaa

SEQ ID NO: 4792551 - DNA, 14 bp, Homo sapiens
atgctgcctgccat

SEQ ID NO: 4792552 - DNA, 15 bp, Homo sapiens
atgctgcctgccatg

SEQ ID NO: 4792553 - DNA, 15 bp, Homo sapiens
atgctgcctgcctcc

SEQ ID NO: 4792554 - DNA, 21 bp, Homo sapiens
atgctgcctgcctccggccct

SEQ ID NO: 4792555 - DNA, 20 bp, Homo sapiens
atgctgcgcttaccttccca

SEQ ID NO: 4792556 - DNA, 12 bp, Homo sapiens
atgctggccagc

SEQ ID NO: 4792557 - DNA, 13 bp, Homo sapiens
atgctggccagca

SEQ ID NO: 4792558 - DNA, 14 bp, Homo sapiens
atgctggccagcac

SEQ ID NO: 4792559 - DNA, 20 bp, Homo sapiens
atgctggccgaagatttcat

SEQ ID NO: 4792560 - DNA, 21 bp, Homo sapiens
atgctgtccctgtgggctcac

SEQ ID NO: 4792561 - DNA, 23 bp, Homo sapiens
atgctgtccctgtgggctcacac

SEQ ID NO: 4792562 - DNA, 19 bp, Homo sapiens
atgctgtcccttacgtgag

SEQ ID NO: 4792563 - DNA, 16 bp, Homo sapiens
atgctgtgtgcagagt

SEQ ID NO: 4792564 - DNA, 17 bp, Homo sapiens
atgctgtgtgcagagta

SEQ ID NO: 4792565 - DNA, 23 bp, Homo sapiens
atgctgtgtgcagagtatacaag

SEQ ID NO: 4792566 - DNA, 16 bp, Homo sapiens
atgctgttctcaatca

SEQ ID NO: 4792567 - DNA, 22 bp, Homo sapiens
atgctgttctcaatcattgtca

SEQ ID NO: 4792568 - DNA, 15 bp, Homo sapiens
atgcttaacataaac

SEQ ID NO: 4792569 - DNA, 17 bp, Homo sapiens
atgcttattagcagctg

SEQ ID NO: 4792570 - DNA, 18 bp, Homo sapiens
atgcttattagcagctgg

SEQ ID NO: 4792571 - DNA, 12 bp, Homo sapiens
atgcttcatgtg

SEQ ID NO: 4792572 - DNA, 19 bp, Homo sapiens
atgcttgcatatatttcat

SEQ ID NO: 4792573 - DNA, 14 bp, Homo sapiens
atgctttctcatgc

SEQ ID NO: 4792574 - DNA, 16 bp, Homo sapiens
atgctttctcatgcat

SEQ ID NO: 4792575 - DNA, 21 bp, Homo sapiens
atgcttttctagcaactgttg

SEQ ID NO: 4792576 - DNA, 14 bp, Homo sapiens
atgcttttctcatg

SEQ ID NO: 4792577 - DNA, 18 bp, Homo sapiens
atgcttttctcatggtat

SEQ ID NO: 4792578 - DNA, 12 bp, Homo sapiens
atgcttttttgc

SEQ ID NO: 4792579 - DNA, 22 bp, Homo sapiens
atggaaaaatgccatcaaatga

SEQ ID NO: 4792580 - DNA, 17 bp, Homo sapiens
atggaaacgcacaaccc

SEQ ID NO: 4792581 - DNA, 15 bp, Homo sapiens
atggaaagggtgtgg

SEQ ID NO: 4792582 - DNA, 21 bp, Homo sapiens
atggaaagggtgtggcttgga

SEQ ID NO: 4792583 - DNA, 15 bp, Homo sapiens
atggaaatcctgtta

SEQ ID NO: 4792584 - DNA, 18 bp, Homo sapiens
atggaaccatggaggagg

SEQ ID NO: 4792585 - DNA, 14 bp, Homo sapiens
atggaaccttccct

SEQ ID NO: 4792586 - DNA, 23 bp, Homo sapiens
atggaactcagctgtctgtggct

SEQ ID NO: 4792587 - DNA, 18 bp, Homo sapiens
atggaagtgtattggttt

SEQ ID NO: 4792588 - DNA, 15 bp, Homo sapiens
atggaatcacagcca

SEQ ID NO: 4792589 - DNA, 16 bp, Homo sapiens
atggaatcacagccaa

SEQ ID NO: 4792590 - DNA, 17 bp, Homo sapiens
atggacatgagagtagg

SEQ ID NO: 4792591 - DNA, 16 bp, Homo sapiens
atggagaggcggcctc

SEQ ID NO: 4792592 - DNA, 17 bp, Homo sapiens
atggaggagagtgttta

SEQ ID NO: 4792593 - DNA, 18 bp, Homo sapiens
atggaggtgatgaaaacc

SEQ ID NO: 4792594 - DNA, 15 bp, Homo sapiens
atggagtagagtcag

SEQ ID NO: 4792595 - DNA, 14 bp, Homo sapiens
atggatctgctcca

SEQ ID NO: 4792596 - DNA, 13 bp, Homo sapiens
atggatgtaatat

SEQ ID NO: 4792597 - DNA, 12 bp, Homo sapiens
atggattcactt

SEQ ID NO: 4792598 - DNA, 16 bp, Homo sapiens
atggattcagtttcta

SEQ ID NO: 4792599 - DNA, 22 bp, Homo sapiens
atggatttattttttgtaactc

SEQ ID NO: 4792600 - DNA, 16 bp, Homo sapiens
atggcaacgttcatgt

SEQ ID NO: 4792601 - DNA, 17 bp, Homo sapiens
atggcaagtttttggta

SEQ ID NO: 4792602 - DNA, 19 bp, Homo sapiens
atggcacttttgagctcct

SEQ ID NO: 4792603 - DNA, 17 bp, Homo sapiens
atggcagagccatccac

SEQ ID NO: 4792604 - DNA, 18 bp, Homo sapiens
atggcagagccatccacc

SEQ ID NO: 4792605 - DNA, 14 bp, Homo sapiens
atggcatgtgaaaa

SEQ ID NO: 4792606 - DNA, 18 bp, Homo sapiens
atggcatttagcacagta

SEQ ID NO: 4792607 - DNA, 21 bp, Homo sapiens
atggcatttagcacagtattt

SEQ ID NO: 4792608 - DNA, 14 bp, Homo sapiens
atggccaatagtca

SEQ ID NO: 4792609 - DNA, 21 bp, Homo sapiens
atggccaatagtcatatgtga

SEQ ID NO: 4792610 - DNA, 15 bp, Homo sapiens
atggccccagctggc

SEQ ID NO: 4792611 - DNA, 21 bp, Homo sapiens
atggccgcaacttcccaggcc

SEQ ID NO: 4792612 - DNA, 19 bp, Homo sapiens
atggcctcccagccacccg

SEQ ID NO: 4792613 - DNA, 22 bp, Homo sapiens
atggcctgtccctagggctctc

SEQ ID NO: 4792614 - DNA, 13 bp, Homo sapiens
atggctctggcta

SEQ ID NO: 4792615 - DNA, 23 bp, Homo sapiens
atggctgccaatgggagctcatg

SEQ ID NO: 4792616 - DNA, 22 bp, Homo sapiens
agggatctgcttgatatcccaa

SEQ ID NO: 4792617 - DNA, 16 bp, Homo sapiens
agggatgggggatggg

SEQ ID NO: 4792618 - DNA, 13 bp, Homo sapiens
agggcaaaatgaa

SEQ ID NO: 4792619 - DNA, 18 bp, Homo sapiens
agggcaaatgacatgcac

SEQ ID NO: 4792620 - DNA, 20 bp, Homo sapiens
agggcaagctcatagcacat

SEQ ID NO: 4792621 - DNA, 22 bp, Homo sapiens
agggcacagaaaatggaagaca

SEQ ID NO: 4792622 - DNA, 12 bp, Homo sapiens
agggcagccccg

SEQ ID NO: 4792623 - DNA, 13 bp, Homo sapiens
agggcagcccctc

SEQ ID NO: 4792624 - DNA, 15 bp, Homo sapiens
agggcagccctgcct

SEQ ID NO: 4792625 - DNA, 20 bp, Homo sapiens
agggcaggaagacttccagc

SEQ ID NO: 4792626 - DNA, 12 bp, Homo sapiens
agggcaggagct

SEQ ID NO: 4792627 - DNA, 15 bp, Homo sapiens
agggcaggagctcac

SEQ ID NO: 4792628 - DNA, 16 bp, Homo sapiens
agggcaggagctcaca

SEQ ID NO: 4792629 - DNA, 22 bp, Homo sapiens
agggcaggggctgcatcctcag

SEQ ID NO: 4792630 - DNA, 17 bp, Homo sapiens
agggcagggttctagaa

SEQ ID NO: 4792631 - DNA, 22 bp, Homo sapiens
agggcagtgctagtgagctggg

SEQ ID NO: 4792632 - DNA, 16 bp, Homo sapiens
agtccagacaccatca

SEQ ID NO: 4792633 - DNA, 17 bp, Homo sapiens
agtccatgtgataattg

SEQ ID NO: 4792634 - DNA, 18 bp, Homo sapiens
agtccccctatccttggc

SEQ ID NO: 4792635 - DNA, 19 bp, Homo sapiens
agtccccctatccttggca

SEQ ID NO: 4792636 - DNA, 22 bp, Homo sapiens
agtccccctatccttggcacca

SEQ ID NO: 4792637 - DNA, 17 bp, Homo sapiens
agtccctccctcctggc

SEQ ID NO: 4792638 - DNA, 21 bp, Homo sapiens
agtccctccctcctggctcac

SEQ ID NO: 4792639 - DNA, 23 bp, Homo sapiens
agtccgccccgtgctcctctgcc

SEQ ID NO: 4792640 - DNA, 17 bp, Homo sapiens
agtccggacccacctca

SEQ ID NO: 4792641 - DNA, 12 bp, Homo sapiens
agtccggtgcct

SEQ ID NO: 4792642 - DNA, 22 bp, Homo sapiens
agtccggtgccttccaccctgc

SEQ ID NO: 4792643 - DNA, 16 bp, Homo sapiens
agtcctagaatgtttc

SEQ ID NO: 4792644 - DNA, 17 bp, Homo sapiens
agtcctcattgttcaga

SEQ ID NO: 4792645 - DNA, 18 bp, Homo sapiens
agtcctcattgttcagaa

SEQ ID NO: 4792646 - DNA, 16 bp, Homo sapiens
agtcctcctttgcttg

SEQ ID NO: 4792647 - DNA, 15 bp, Homo sapiens
agtcctcggcagctc

SEQ ID NO: 4792648 - DNA, 20 bp, Homo sapiens
agtcctggcatgggaatgaa

SEQ ID NO: 4792649 - DNA, 13 bp, Homo sapiens
agtcgatattccc

SEQ ID NO: 4792650 - DNA, 15 bp, Homo sapiens
agtcggctgggcagg

SEQ ID NO: 4792651 - DNA, 17 bp, Homo sapiens
agtcggctgggcagggc

SEQ ID NO: 4792652 - DNA, 18 bp, Homo sapiens
agtcggctgggcagggcc

SEQ ID NO: 4792653 - DNA, 21 bp, Homo sapiens
agtctacctgccttgcctgtt

SEQ ID NO: 4792654 - DNA, 22 bp, Homo sapiens
agtctacctgccttgcctgtta

SEQ ID NO: 4792655 - DNA, 13 bp, Homo sapiens
agtctcctcactg

SEQ ID NO: 4792656 - DNA, 23 bp, Homo sapiens
agtctcctcactgccactaaaat

SEQ ID NO: 4792657 - DNA, 14 bp, Homo sapiens
agtctcctgtatca

SEQ ID NO: 4792658 - DNA, 22 bp, Homo sapiens
agtctctctaagacaaatgcag

SEQ ID NO: 4792659 - DNA, 15 bp, Homo sapiens
agtctctgaatttgt

SEQ ID NO: 4792660 - DNA, 16 bp, Homo sapiens
agtctcttgattcata

SEQ ID NO: 4792661 - DNA, 20 bp, Homo sapiens
agtctgaaggagaggagtgc

SEQ ID NO: 4792662 - DNA, 17 bp, Homo sapiens
agtctgtcagggccttg

SEQ ID NO: 4792663 - DNA, 21 bp, Homo sapiens
agtctgtgaataaagccacat

SEQ ID NO: 4792664 - DNA, 14 bp, Homo sapiens
agtctgtgcctcag

SEQ ID NO: 4792665 - DNA, 17 bp, Homo sapiens
agtctgtggagcgtcct

SEQ ID NO: 4792666 - DNA, 14 bp, Homo sapiens
agtcttccaaacca

SEQ ID NO: 4792667 - DNA, 18 bp, Homo sapiens
agtctttgctcagtggat

SEQ ID NO: 4792668 - DNA, 14 bp, Homo sapiens
agtctttgtacaga

SEQ ID NO: 4792669 - DNA, 20 bp, Homo sapiens
agtgaaaaagacttcaaatg

SEQ ID NO: 4792670 - DNA, 23 bp, Homo sapiens
agtgaaaaagacttcaaatgtta

SEQ ID NO: 4792671 - DNA, 16 bp, Homo sapiens
agtgaaattagtattt

SEQ ID NO: 4792672 - DNA, 17 bp, Homo sapiens
agtgaaattagtatttt

SEQ ID NO: 4792673 - DNA, 21 bp, Homo sapiens
agtgaaattagtattttgagc

SEQ ID NO: 4792674 - DNA, 14 bp, Homo sapiens
agtgaatataaatg

SEQ ID NO: 4792675 - DNA, 20 bp, Homo sapiens
agtgaatgagtttccagcta

SEQ ID NO: 4792676 - DNA, 11 bp, Homo sapiens
agtgaccaagg

SEQ ID NO: 4792677 - DNA, 22 bp, Homo sapiens
agtgaccgggggaagctgagcc

SEQ ID NO: 4792678 - DNA, 16 bp, Homo sapiens
agtgagatttgtattt

SEQ ID NO: 4792679 - DNA, 23 bp, Homo sapiens
agtgagatttgtatttatattag

SEQ ID NO: 4792680 - DNA, 19 bp, Homo sapiens
agtgagtttccagctgctc

SEQ ID NO: 4792681 - DNA, 17 bp, Homo sapiens
agtgatgcaataaacaa

SEQ ID NO: 4792682 - DNA, 22 bp, Homo sapiens
agtgatgggcaaggggccagga

SEQ ID NO: 4792683 - DNA, 16 bp, Homo sapiens
agtgatgtgatttatg

SEQ ID NO: 4792684 - DNA, 19 bp, Homo sapiens
agtgatgtgatttatgcat

SEQ ID NO: 4792685 - DNA, 21 bp, Homo sapiens
agtgatgtgatttatgcattt

SEQ ID NO: 4792686 - DNA, 21 bp, Homo sapiens
agtgatttgtaaaacagtggt

SEQ ID NO: 4792687 - DNA, 12 bp, Homo sapiens
agtgcacacaca

SEQ ID NO: 4792688 - DNA, 13 bp, Homo sapiens
agtgcacacacac

SEQ ID NO: 4792689 - DNA, 23 bp, Homo sapiens
agtgcagtggcgtgatctcagct

SEQ ID NO: 4792690 - DNA, 12 bp, Homo sapiens
agtgcatgtcac

SEQ ID NO: 4792691 - DNA, 14 bp, Homo sapiens
agtgcatgttaaaa

SEQ ID NO: 4792692 - DNA, 18 bp, Homo sapiens
agtgccacatggccgctg

SEQ ID NO: 4792693 - DNA, 20 bp, Homo sapiens
agtgccagctggtgaatcca

SEQ ID NO: 4792694 - DNA, 18 bp, Homo sapiens
agtgccatggccaggagt

SEQ ID NO: 4792695 - DNA, 13 bp, Homo sapiens
agtgcctggagaa

SEQ ID NO: 4792696 - DNA, 18 bp, Homo sapiens
agtgccttacacaatggt

SEQ ID NO: 4792697 - DNA, 20 bp, Homo sapiens
agtgctggcattacaggtgt

SEQ ID NO: 4792698 - DNA, 15 bp, Homo sapiens
agtgcttagcaaaaa

SEQ ID NO: 4792699 - DNA, 21 bp, Homo sapiens
agtgcttgaggccaaatgagt

SEQ ID NO: 4792700 - DNA, 16 bp, Homo sapiens
agtgctttatccacat

SEQ ID NO: 4792701 - DNA, 20 bp, Homo sapiens
agtgctttatccacattgta

SEQ ID NO: 4792702 - DNA, 19 bp, Homo sapiens
agtggaacgttctctacct

SEQ ID NO: 4792703 - DNA, 21 bp, Homo sapiens
agtggaagacagagatggcag

SEQ ID NO: 4792704 - DNA, 11 bp, Homo sapiens
agtggaatcat

SEQ ID NO: 4792705 - DNA, 15 bp, Homo sapiens
agtggacagcagctg

SEQ ID NO: 4792706 - DNA, 19 bp, Homo sapiens
agtggactcgcgagagggt

SEQ ID NO: 4792707 - DNA, 13 bp, Homo sapiens
agtggactgtatt

SEQ ID NO: 4792708 - DNA, 19 bp, Homo sapiens
agtggaggagggggtacag

SEQ ID NO: 4792709 - DNA, 17 bp, Homo sapiens
agtggaggggtcagcag

SEQ ID NO: 4792710 - DNA, 23 bp, Homo sapiens
agtggaggggtcagcaggggggt

SEQ ID NO: 4792711 - DNA, 21 bp, Homo sapiens
agtggatctggagtctgaagg

SEQ ID NO: 4792712 - DNA, 13 bp, Homo sapiens
agtggcagtattg

SEQ ID NO: 4792713 - DNA, 15 bp, Homo sapiens
agtggcatcatctca

SEQ ID NO: 4792714 - DNA, 19 bp, Homo sapiens
agtggcatcatctcagctc

SEQ ID NO: 4792715 - DNA, 16 bp, Homo sapiens
agtggccgggctgggg

SEQ ID NO: 4792716 - DNA, 16 bp, Homo sapiens
agtggcgagtccagac

SEQ ID NO: 4792717 - DNA, 17 bp, Homo sapiens
agtggcgagtccagaca

SEQ ID NO: 4792718 - DNA, 20 bp, Homo sapiens
agtggcgcgatctcagctca

SEQ ID NO: 4792719 - DNA, 20 bp, Homo sapiens
agtggcgtgatctcagctca

SEQ ID NO: 4792720 - DNA, 18 bp, Homo sapiens
agtgggagtcaagtgtgc

SEQ ID NO: 4792721 - DNA, 23 bp, Homo sapiens
agtgggagtcaagtgtgcctgct

SEQ ID NO: 4792722 - DNA, 12 bp, Homo sapiens
agtggtggaggt

SEQ ID NO: 4792723 - DNA, 17 bp, Homo sapiens
agtggttcgggggaaat

SEQ ID NO: 4792724 - DNA, 15 bp, Homo sapiens
agtggttgttttttc

SEQ ID NO: 4792725 - DNA, 22 bp, Homo sapiens
agtgtacaccactttcccacac

SEQ ID NO: 4792726 - DNA, 16 bp, Homo sapiens
agtgtatgcatacaaa

SEQ ID NO: 4792727 - DNA, 16 bp, Homo sapiens
agtgtatgtatacaca

SEQ ID NO: 4792728 - DNA, 17 bp, Homo sapiens
agtgtatgtatacacac

SEQ ID NO: 4792729 - DNA, 22 bp, Homo sapiens
agtgtattggtttctgtttgaa

SEQ ID NO: 4792730 - DNA, 16 bp, Homo sapiens
agtgtcacttttttcc

SEQ ID NO: 4792731 - DNA, 19 bp, Homo sapiens
agtgtcacttttttcctgt

SEQ ID NO: 4792732 - DNA, 21 bp, Homo sapiens
agtgtcacttttttcctgtca

SEQ ID NO: 4792733 - DNA, 22 bp, Homo sapiens
agtgtcatgaatgttgcatgac

SEQ ID NO: 4792734 - DNA, 13 bp, Homo sapiens
agtgtcattttct

SEQ ID NO: 4792735 - DNA, 23 bp, Homo sapiens
agtgtcattttctgttatacaca

SEQ ID NO: 4792736 - DNA, 16 bp, Homo sapiens
agtgtcctgctacctt

SEQ ID NO: 4792737 - DNA, 21 bp, Homo sapiens
agtgtcctgctacctttgtct

SEQ ID NO: 4792738 - DNA, 21 bp, Homo sapiens
agtgtcctgtgctttctgcat

SEQ ID NO: 4792739 - DNA, 22 bp, Homo sapiens
agtgtcctgtgctttctgcatg

SEQ ID NO: 4792740 - DNA, 18 bp, Homo sapiens
agtgtctggatcagtaaa

SEQ ID NO: 4792741 - DNA, 20 bp, Homo sapiens
agtgtctggatcagtaaaat

SEQ ID NO: 4792742 - DNA, 18 bp, Homo sapiens
agtgtctggcccagccat

SEQ ID NO: 4792743 - DNA, 18 bp, Homo sapiens
agtgtgaatataaatgtg

SEQ ID NO: 4792744 - DNA, 23 bp, Homo sapiens
agtgtgcctgctatccagccgca

SEQ ID NO: 4792745 - DNA, 15 bp, Homo sapiens
ctgcgcgcagctggc

SEQ ID NO: 4792746 - DNA, 13 bp, Homo sapiens
ctgcgctcctctg

SEQ ID NO: 4792747 - DNA, 15 bp, Homo sapiens
ctgcgctcctctgca

SEQ ID NO: 4792748 - DNA, 21 bp, Homo sapiens
ctgcggaacaggagtgactct

SEQ ID NO: 4792749 - DNA, 13 bp, Homo sapiens
ctgcgtctcctgc

SEQ ID NO: 4792750 - DNA, 14 bp, Homo sapiens
ctgcgtctcctgcc

SEQ ID NO: 4792751 - DNA, 19 bp, Homo sapiens
ctgctaagtggaagacaga

SEQ ID NO: 4792752 - DNA, 18 bp, Homo sapiens
ctgctacctttgtctcac

SEQ ID NO: 4792753 - DNA, 12 bp, Homo sapiens
ctgctatccagc

SEQ ID NO: 4792754 - DNA, 15 bp, Homo sapiens
ctgctatgtctgtga

SEQ ID NO: 4792755 - DNA, 23 bp, Homo sapiens
ctgctatttttaatttcctgtga

SEQ ID NO: 4792756 - DNA, 18 bp, Homo sapiens
ctgctcacgtctgtgagt

SEQ ID NO: 4792757 - DNA, 13 bp, Homo sapiens
ctgctcaggcctc

SEQ ID NO: 4792758 - DNA, 24 bp, Homo sapiens
ctgctcaggcctcacctggcttcc

SEQ ID NO: 4792759 - DNA, 21 bp, Homo sapiens
ctgctcaggctccccaagact

SEQ ID NO: 4792760 - DNA, 13 bp, Homo sapiens
ctccgggcctcgg

SEQ ID NO: 4792761 - DNA, 18 bp, Homo sapiens
ctccgggcctcggcctgg

SEQ ID NO: 4792762 - DNA, 21 bp, Homo sapiens
ctccgggcctcggcctggctt

SEQ ID NO: 4792763 - DNA, 15 bp, Homo sapiens
ctccgggtgtggcct

SEQ ID NO: 4792764 - DNA, 19 bp, Homo sapiens
ctccgggtgtggcctcagc

SEQ ID NO: 4792765 - DNA, 23 bp, Homo sapiens
ctccgggtgtggcctcagccctc

SEQ ID NO: 4792766 - DNA, 13 bp, Homo sapiens
ctccgtccccagg

SEQ ID NO: 4792767 - DNA, 14 bp, Homo sapiens
ctccgtccccaggg

SEQ ID NO: 4792768 - DNA, 22 bp, Homo sapiens
ctccgtggtggcggcggcactt

SEQ ID NO: 4792769 - DNA, 16 bp, Homo sapiens
ctcctaagctgccagc

SEQ ID NO: 4792770 - DNA, 14 bp, Homo sapiens
ctcctcactgccac

SEQ ID NO: 4792771 - DNA, 15 bp, Homo sapiens
ctcctcactgcccgc

SEQ ID NO: 4792772 - DNA, 17 bp, Homo sapiens
ctcctcactgcccgcac

SEQ ID NO: 4792773 - DNA, 18 bp, Homo sapiens
ctcctcactgcccgcaca

SEQ ID NO: 4792774 - DNA, 14 bp, Homo sapiens
ctcctcagatcttc

SEQ ID NO: 4792775 - DNA, 15 bp, Homo sapiens
ctcctccaaatgctg

SEQ ID NO: 4792776 - DNA, 13 bp, Homo sapiens
ctcctccagagtc

SEQ ID NO: 4792777 - DNA, 23 bp, Homo sapiens
ctcctccagtacaataaataaaa

SEQ ID NO: 4792778 - DNA, 13 bp, Homo sapiens
ctcctccatgctg

SEQ ID NO: 4792779 - DNA, 17 bp, Homo sapiens
ctcctcccaactctggc

SEQ ID NO: 4792780 - DNA, 19 bp, Homo sapiens
ctcctcccaactctggcct

SEQ ID NO: 4792781 - DNA, 21 bp, Homo sapiens
ctcctcccagctgtaccggcc

SEQ ID NO: 4792782 - DNA, 14 bp, Homo sapiens
ctcctcccccacgc

SEQ ID NO: 4792783 - DNA, 21 bp, Homo sapiens
ctcctccccctcctccatgct

SEQ ID NO: 4792784 - DNA, 16 bp, Homo sapiens
ctcctccgtgggcagc

SEQ ID NO: 4792785 - DNA, 20 bp, Homo sapiens
ctcctcgggcgcctgcgctc

SEQ ID NO: 4792786 - DNA, 21 bp, Homo sapiens
ctcctcgggcgcctgcgctcc

SEQ ID NO: 4792787 - DNA, 20 bp, Homo sapiens
ctcctcggtggcatttgctg

SEQ ID NO: 4792788 - DNA, 15 bp, Homo sapiens
ctcctcgtccggcct

SEQ ID NO: 4792789 - DNA, 20 bp, Homo sapiens
ctcctcgtccggcctgcagc

SEQ ID NO: 4792790 - DNA, 23 bp, Homo sapiens
ctcctcgtccggcctgcagccca

SEQ ID NO: 4792791 - DNA, 11 bp, Homo sapiens
ctcctctccca

SEQ ID NO: 4792792 - DNA, 19 bp, Homo sapiens
ctcctctctctccctccac

SEQ ID NO: 4792793 - DNA, 20 bp, Homo sapiens
ctcctctctctccctccact

SEQ ID NO: 4792794 - DNA, 13 bp, Homo sapiens
ctcctctctggaa

SEQ ID NO: 4792795 - DNA, 12 bp, Homo sapiens
ctcctctgcccc

SEQ ID NO: 4792796 - DNA, 15 bp, Homo sapiens
ctcctctgccccctc

SEQ ID NO: 4792797 - DNA, 18 bp, Homo sapiens
ctcctctgccccctcccc

SEQ ID NO: 4792798 - DNA, 23 bp, Homo sapiens
ctcctcttcctgcctctctcatg

SEQ ID NO: 4792799 - DNA, 15 bp, Homo sapiens
ctcctgagcctgtct

SEQ ID NO: 4792800 - DNA, 15 bp, Homo sapiens
ctcctgcagtctgtg

SEQ ID NO: 4792801 - DNA, 19 bp, Homo sapiens
ctcctgcatccctccaccc

SEQ ID NO: 4792802 - DNA, 18 bp, Homo sapiens
ctcctgctgaccttctgc

SEQ ID NO: 4792803 - DNA, 21 bp, Homo sapiens
ctcctgctgaccttctgcggc

SEQ ID NO: 4792804 - DNA, 15 bp, Homo sapiens
ctcctggccagacgc

SEQ ID NO: 4792805 - DNA, 14 bp, Homo sapiens
ctcctggctcacag

SEQ ID NO: 4792806 - DNA, 17 bp, Homo sapiens
ctcctggctcacagcca

SEQ ID NO: 4792807 - DNA, 11 bp, Homo sapiens
ctcctggcttt

SEQ ID NO: 4792808 - DNA, 14 bp, Homo sapiens
ctcctgggggtggc

SEQ ID NO: 4792809 - DNA, 16 bp, Homo sapiens
ctcctgggggtggcag

SEQ ID NO: 4792810 - DNA, 23 bp, Homo sapiens
ctcctgtctcttgggaagcagtt

SEQ ID NO: 4792811 - DNA, 16 bp, Homo sapiens
ctcctgtgagctcccc

SEQ ID NO: 4792812 - DNA, 14 bp, Homo sapiens
ctcctgtgtgtgga

SEQ ID NO: 4792813 - DNA, 20 bp, Homo sapiens
ctcctgtttcccttcccttc

SEQ ID NO: 4792814 - DNA, 17 bp, Homo sapiens
ctcctgttttcacacct

SEQ ID NO: 4792815 - DNA, 20 bp, Homo sapiens
ctcctgttttcacaccttac

SEQ ID NO: 4792816 - DNA, 13 bp, Homo sapiens
ctccttaaactac

SEQ ID NO: 4792817 - DNA, 17 bp, Homo sapiens
ctccttcactctgacag

SEQ ID NO: 4792818 - DNA, 19 bp, Homo sapiens
ctccttcatgcttttctca

SEQ ID NO: 4792819 - DNA, 11 bp, Homo sapiens
ctccttcccaa

SEQ ID NO: 4792820 - DNA, 17 bp, Homo sapiens
ctccttcccaaggcagc

SEQ ID NO: 4792821 - DNA, 19 bp, Homo sapiens
ctccttcccaaggcagctg

SEQ ID NO: 4792822 - DNA, 10 bp, Homo sapiens
ctccttctcc

SEQ ID NO: 4792823 - DNA, 12 bp, Homo sapiens
ctccttctcccc

SEQ ID NO: 4792824 - DNA, 16 bp, Homo sapiens
ctccttctcccctcca

SEQ ID NO: 4792825 - DNA, 13 bp, Homo sapiens
ctccttctgcagt

SEQ ID NO: 4792826 - DNA, 21 bp, Homo sapiens
ctccttctgcagtcagactga

SEQ ID NO: 4792827 - DNA, 11 bp, Homo sapiens
ctccttcttcc

SEQ ID NO: 4792828 - DNA, 10 bp, Homo sapiens
ctccttggcc

SEQ ID NO: 4792829 - DNA, 22 bp, Homo sapiens
ctccttggcctagcccaccctg

SEQ ID NO: 4792830 - DNA, 16 bp, Homo sapiens
ctccttggttttgcct

SEQ ID NO: 4792831 - DNA, 13 bp, Homo sapiens
ctccttgtacttg

SEQ ID NO: 4792832 - DNA, 23 bp, Homo sapiens
ctccttgtttgcctttaggcagg

SEQ ID NO: 4792833 - DNA, 14 bp, Homo sapiens
ctcctttccatcag

SEQ ID NO: 4792834 - DNA, 19 bp, Homo sapiens
ctcctttccatcagcttta

SEQ ID NO: 4792835 - DNA, 21 bp, Homo sapiens
ctcctttccatcagctttata

SEQ ID NO: 4792836 - DNA, 16 bp, Homo sapiens
ctcctttcccctctca

SEQ ID NO: 4792837 - DNA, 23 bp, Homo sapiens
ctcctttctaaggagcactagaa

SEQ ID NO: 4792838 - DNA, 24 bp, Homo sapiens
ctccttttcacagttctctccttc

SEQ ID NO: 4792839 - DNA, 13 bp, Homo sapiens
ctccttttctctt

SEQ ID NO: 4792840 - DNA, 19 bp, Homo sapiens
ctcgacattttatggaaag

SEQ ID NO: 4792841 - DNA, 15 bp, Homo sapiens
ctcgagagggctgag

SEQ ID NO: 4792842 - DNA, 16 bp, Homo sapiens
ctcgagagggctgagc

SEQ ID NO: 4792843 - DNA, 18 bp, Homo sapiens
ctcgagagggctgagccc

SEQ ID NO: 4792844 - DNA, 20 bp, Homo sapiens
ctcgagagggctgagcccct

SEQ ID NO: 4792845 - DNA, 23 bp, Homo sapiens
ctcgagagggctgagcccctcct

SEQ ID NO: 4792846 - DNA, 18 bp, Homo sapiens
ctcgagctctgtagcctg

SEQ ID NO: 4792847 - DNA, 20 bp, Homo sapiens
ctcgagctctgtagcctggt

SEQ ID NO: 4792848 - DNA, 21 bp, Homo sapiens
ctcgagtggcgagtccagaca

SEQ ID NO: 4792849 - DNA, 22 bp, Homo sapiens
ctcgagtggcgagtccagacac

SEQ ID NO: 4792850 - DNA, 22 bp, Homo sapiens
ctcgccccccgcccggcctcct

SEQ ID NO: 4792851 - DNA, 18 bp, Homo sapiens
ctcgcccccgggcccttt

SEQ ID NO: 4792852 - DNA, 13 bp, Homo sapiens
ctcgccctgtgcc

SEQ ID NO: 4792853 - DNA, 14 bp, Homo sapiens
ctcgccctgtgccc

SEQ ID NO: 4792854 - DNA, 17 bp, Homo sapiens
ctcgccgggccattctg

SEQ ID NO: 4792855 - DNA, 14 bp, Homo sapiens
ctcgcgcccctgtc

SEQ ID NO: 4792856 - DNA, 16 bp, Homo sapiens
ctcgctcccctctgcc

SEQ ID NO: 4792857 - DNA, 20 bp, Homo sapiens
ctcgcttcataggcagagcc

SEQ ID NO: 4792858 - DNA, 23 bp, Homo sapiens
ctcggccattgaacactgcaccc

SEQ ID NO: 4792859 - DNA, 16 bp, Homo sapiens
ctcggccctgtagccc

SEQ ID NO: 4792860 - DNA, 22 bp, Homo sapiens
ctcggccctgtagccctggccc

SEQ ID NO: 4792861 - DNA, 22 bp, Homo sapiens
ctcggcctcttgagagccccac

SEQ ID NO: 4792862 - DNA, 13 bp, Homo sapiens
ctcggcctggctt

SEQ ID NO: 4792863 - DNA, 23 bp, Homo sapiens
ctcggcgtgctccttttctcttt

SEQ ID NO: 4792864 - DNA, 15 bp, Homo sapiens
ctcgggaaggcctga

SEQ ID NO: 4792865 - DNA, 20 bp, Homo sapiens
ctcgggccctctctccgccc

SEQ ID NO: 4792866 - DNA, 22 bp, Homo sapiens
ctcgggccctctctccgccccg

SEQ ID NO: 4792867 - DNA, 21 bp, Homo sapiens
ctcgggccgcctcctccagac

SEQ ID NO: 4792868 - DNA, 16 bp, Homo sapiens
ctcgggcgcctgcgct

SEQ ID NO: 4792869 - DNA, 15 bp, Homo sapiens
ctcgggctctctcac

SEQ ID NO: 4792870 - DNA, 19 bp, Homo sapiens
ctcggtggcatttgctgaa

SEQ ID NO: 4792871 - DNA, 16 bp, Homo sapiens
ctcgtccggcctgcag

SEQ ID NO: 4792872 - DNA, 17 bp, Homo sapiens
ctcgtgtttcacagtgg

SEQ ID NO: 4792873 - DNA, 20 bp, Homo sapiens
ctctaaaactatcagcagcg

SEQ ID NO: 4792874 - DNA, 24 bp, Homo sapiens
ctctaaaatgctgttctcaatcat

SEQ ID NO: 4792875 - DNA, 20 bp, Homo sapiens
ctctaactgtatatttgtat

SEQ ID NO: 4792876 - DNA, 22 bp, Homo sapiens
ctctaagaaatggctttccaca

SEQ ID NO: 4792877 - DNA, 17 bp, Homo sapiens
ctctactgaaaacacaa

SEQ ID NO: 4792878 - DNA, 14 bp, Homo sapiens
ctctagggttgctg

SEQ ID NO: 4792879 - DNA, 21 bp, Homo sapiens
ctctagggttgctggagcctg

SEQ ID NO: 4792880 - DNA, 17 bp, Homo sapiens
ctctaggtaaactagca

SEQ ID NO: 4792881 - DNA, 22 bp, Homo sapiens
ctctagttgacttcaaatgtgt

SEQ ID NO: 4792882 - DNA, 20 bp, Homo sapiens
ctctagttgtggacttttcc

SEQ ID NO: 4792883 - DNA, 17 bp, Homo sapiens
ctctatccttttttcct

SEQ ID NO: 4792884 - DNA, 14 bp, Homo sapiens
ctctatgctctgga

SEQ ID NO: 4792885 - DNA, 17 bp, Homo sapiens
ctctatttgatttgcaa

SEQ ID NO: 4792886 - DNA, 16 bp, Homo sapiens
ctctcaaacctggcag

SEQ ID NO: 4792887 - DNA, 20 bp, Homo sapiens
ctctcaattgagttaaatca

SEQ ID NO: 4792888 - DNA, 21 bp, Homo sapiens
ctctcacacacatagattaat

SEQ ID NO: 4792889 - DNA, 20 bp, Homo sapiens
ctctcaccccccgacctggc

SEQ ID NO: 4792890 - DNA, 21 bp, Homo sapiens
ctctcaccccccgacctggct

SEQ ID NO: 4792891 - DNA, 14 bp, Homo sapiens
ctctcagaactcct

SEQ ID NO: 4792892 - DNA, 17 bp, Homo sapiens
ctctcagaactcctgtg

SEQ ID NO: 4792893 - DNA, 17 bp, Homo sapiens
ctctcagatccctcggt

SEQ ID NO: 4792894 - DNA, 18 bp, Homo sapiens
ctctcaggaccaccctgc

SEQ ID NO: 4792895 - DNA, 19 bp, Homo sapiens
ctctcaggaccaccctgcc

SEQ ID NO: 4792896 - DNA, 21 bp, Homo sapiens
ctctcaggaccaccctgccaa

SEQ ID NO: 4792897 - DNA, 22 bp, Homo sapiens
ctctcaggaccaccctgccaag

SEQ ID NO: 4792898 - DNA, 20 bp, Homo sapiens
ctctcaggccaaactcacct

SEQ ID NO: 4792899 - DNA, 22 bp, Homo sapiens
ctctcaggccaaactcacctgc

SEQ ID NO: 4792900 - DNA, 18 bp, Homo sapiens
ctctcagtatcttaaaat

SEQ ID NO: 4792901 - DNA, 16 bp, Homo sapiens
ctctcattcccaggca

SEQ ID NO: 4792902 - DNA, 20 bp, Homo sapiens
ctctccaggattgtccacaa

SEQ ID NO: 4792903 - DNA, 22 bp, Homo sapiens
ctctccatctcttgtaccagcc

SEQ ID NO: 4792904 - DNA, 15 bp, Homo sapiens
ctctccctaccctct

SEQ ID NO: 4792905 - DNA, 16 bp, Homo sapiens
ctctccctcagtcctt

SEQ ID NO: 4792906 - DNA, 15 bp, Homo sapiens
ctctccctccactcc

SEQ ID NO: 4792907 - DNA, 16 bp, Homo sapiens
ctctccctccactcct

SEQ ID NO: 4792908 - DNA, 22 bp, Homo sapiens
ctctccggatggaatcacagcc

SEQ ID NO: 4792909 - DNA, 12 bp, Homo sapiens
ctctcctccaga

SEQ ID NO: 4792910 - DNA, 12 bp, Homo sapiens
ctctcctccagc

SEQ ID NO: 4792911 - DNA, 16 bp, Homo sapiens
ctctcctccagccctg

SEQ ID NO: 4792912 - DNA, 20 bp, Homo sapiens
ctctcctccttttcacagtt

SEQ ID NO: 4792913 - DNA, 23 bp, Homo sapiens
ctctcctcggtggcatttgctga

SEQ ID NO: 4792914 - DNA, 13 bp, Homo sapiens
ctctcctctctgg

SEQ ID NO: 4792915 - DNA, 17 bp, Homo sapiens
ctctccttccttaccca

SEQ ID NO: 4792916 - DNA, 13 bp, Homo sapiens
ctctcgctcccct

SEQ ID NO: 4792917 - DNA, 19 bp, Homo sapiens
ctctcgggctctctcaccc

SEQ ID NO: 4792918 - DNA, 19 bp, Homo sapiens
ctctcgtagaacctgcgca

SEQ ID NO: 4792919 - DNA, 18 bp, Homo sapiens
ctctctaagacaaatgca

SEQ ID NO: 4792920 - DNA, 15 bp, Homo sapiens
ctctctatatataca

SEQ ID NO: 4792921 - DNA, 22 bp, Homo sapiens
ctctctatatatacatgtatag

SEQ ID NO: 4792922 - DNA, 13 bp, Homo sapiens
ctctctcacccag

SEQ ID NO: 4792923 - DNA, 15 bp, Homo sapiens
ctctctcacccagcc

SEQ ID NO: 4792924 - DNA, 13 bp, Homo sapiens
ctctctcaggcca

SEQ ID NO: 4792925 - DNA, 14 bp, Homo sapiens
ctctctcattccca

SEQ ID NO: 4792926 - DNA, 20 bp, Homo sapiens
ctctctcccaactgctgctt

SEQ ID NO: 4792927 - DNA, 17 bp, Homo sapiens
ctctctccctccactcc

SEQ ID NO: 4792928 - DNA, 19 bp, Homo sapiens
ctctctccctccactcctc

SEQ ID NO: 4792929 - DNA, 12 bp, Homo sapiens
ctctctccgccc

SEQ ID NO: 4792930 - DNA, 18 bp, Homo sapiens
ctctctcctctctctccc

SEQ ID NO: 4792931 - DNA, 22 bp, Homo sapiens
ctctctcctgtttcccttccct

SEQ ID NO: 4792932 - DNA, 13 bp, Homo sapiens
ctctctctatata

SEQ ID NO: 4792933 - DNA, 14 bp, Homo sapiens
ctctctctatatat

SEQ ID NO: 4792934 - DNA, 9 bp, Homo sapiens
ctctctctc

SEQ ID NO: 4792935 - DNA, 16 bp, Homo sapiens
ctctctctctctgttc

SEQ ID NO: 4792936 - DNA, 12 bp, Homo sapiens
ctctctctctgt

SEQ ID NO: 4792937 - DNA, 14 bp, Homo sapiens
ctctctctctgttc

SEQ ID NO: 4792938 - DNA, 16 bp, Homo sapiens
ctctctctctgttcca

SEQ ID NO: 4792939 - DNA, 10 bp, Homo sapiens
ctctctctgt

SEQ ID NO: 4792940 - DNA, 11 bp, Homo sapiens
ctctctctgtt

SEQ ID NO: 4792941 - DNA, 13 bp, Homo sapiens
ctctctctgttcc

SEQ ID NO: 4792942 - DNA, 20 bp, Homo sapiens
ctctctggggccctgggcct

SEQ ID NO: 4792943 - DNA, 15 bp, Homo sapiens
ctctctgtgtggcaa

SEQ ID NO: 4792944 - DNA, 18 bp, Homo sapiens
ctctctgttccaagtgtg

SEQ ID NO: 4792945 - DNA, 20 bp, Homo sapiens
ctctctgtttaccctccctg

SEQ ID NO: 4792946 - DNA, 22 bp, Homo sapiens
ctctctgtttaccctccctgtc

SEQ ID NO: 4792947 - DNA, 23 bp, Homo sapiens
ctctctgtttaccctccctgtcc

SEQ ID NO: 4792948 - DNA, 22 bp, Homo sapiens
ctctcttaccccgtccctttcc

SEQ ID NO: 4792949 - DNA, 18 bp, Homo sapiens
ctctcttcggtggccttg

SEQ ID NO: 4792950 - DNA, 13 bp, Homo sapiens
ctctcttcttact

SEQ ID NO: 4792951 - DNA, 20 bp, Homo sapiens
ctctcttgccgaggagccag

SEQ ID NO: 4792952 - DNA, 19 bp, Homo sapiens
ctctcttggtctctttctt

SEQ ID NO: 4792953 - DNA, 15 bp, Homo sapiens
ctctgaactgcaaca

SEQ ID NO: 4792954 - DNA, 13 bp, Homo sapiens
ctctgaagtccct

SEQ ID NO: 4792955 - DNA, 17 bp, Homo sapiens
ctctgaagtcccttcct

SEQ ID NO: 4792956 - DNA, 16 bp, Homo sapiens
ctctgaagttggacag

SEQ ID NO: 4792957 - DNA, 16 bp, Homo sapiens
ctctgaatctctcaaa

SEQ ID NO: 4792958 - DNA, 20 bp, Homo sapiens
ctctgaatctctcaaaatgt

SEQ ID NO: 4792959 - DNA, 14 bp, Homo sapiens
ctctgacaagggct

SEQ ID NO: 4792960 - DNA, 21 bp, Homo sapiens
ctctgacagctgtcctgagct

SEQ ID NO: 4792961 - DNA, 13 bp, Homo sapiens
ctctgacagtatt

SEQ ID NO: 4792962 - DNA, 13 bp, Homo sapiens
ctctgagaacaga

SEQ ID NO: 4792963 - DNA, 15 bp, Homo sapiens
ctctgagaagaggag

SEQ ID NO: 4792964 - DNA, 18 bp, Homo sapiens
ctctgagaagaggagccc

SEQ ID NO: 4792965 - DNA, 16 bp, Homo sapiens
ctctgagcagtgggga

SEQ ID NO: 4792966 - DNA, 13 bp, Homo sapiens
ctctgagtcctca

SEQ ID NO: 4792967 - DNA, 14 bp, Homo sapiens
ctctgatatgggac

SEQ ID NO: 4792968 - DNA, 17 bp, Homo sapiens
ctctgatatgggactga

SEQ ID NO: 4792969 - DNA, 19 bp, Homo sapiens
ctctgatatgggactgagc

SEQ ID NO: 4792970 - DNA, 21 bp, Homo sapiens
ctctgatatgggactgagcct

SEQ ID NO: 4792971 - DNA, 13 bp, Homo sapiens
ctctgatggcact

SEQ ID NO: 4792972 - DNA, 19 bp, Homo sapiens
ctctgatggcacttttgag

SEQ ID NO: 4792973 - DNA, 17 bp, Homo sapiens
ctctgcagcctgagctc

SEQ ID NO: 4792974 - DNA, 23 bp, Homo sapiens
ctctgcataagattatatacaaa

SEQ ID NO: 4792975 - DNA, 20 bp, Homo sapiens
ctctgcatagacaaaggcct

SEQ ID NO: 4792976 - DNA, 15 bp, Homo sapiens
ctctgccacactctg

SEQ ID NO: 4792977 - DNA, 17 bp, Homo sapiens
ctctgccacactctgac

SEQ ID NO: 4792978 - DNA, 14 bp, Homo sapiens
ctctgccccctccc

SEQ ID NO: 4792979 - DNA, 15 bp, Homo sapiens
ctctgccccctcccc

SEQ ID NO: 4792980 - DNA, 21 bp, Homo sapiens
ctctgcccctccgtccccagg

SEQ ID NO: 4792981 - DNA, 22 bp, Homo sapiens
ctctgcccctccgtccccaggg

SEQ ID NO: 4792982 - DNA, 20 bp, Homo sapiens
ctctgccggtcccccatgcc

SEQ ID NO: 4792983 - DNA, 16 bp, Homo sapiens
ctctgcgccccagcga

SEQ ID NO: 4792984 - DNA, 18 bp, Homo sapiens
ctctgctggtcttcaatt

SEQ ID NO: 4792985 - DNA, 17 bp, Homo sapiens
ctctggaagagggaggg

SEQ ID NO: 4792986 - DNA, 20 bp, Homo sapiens
ctctggacctgaccagactg

SEQ ID NO: 4792987 - DNA, 16 bp, Homo sapiens
ctctggctgccaagat

SEQ ID NO: 4792988 - DNA, 14 bp, Homo sapiens
ctctggggccctgg

SEQ ID NO: 4792989 - DNA, 15 bp, Homo sapiens
ctctggggccctggg

SEQ ID NO: 4792990 - DNA, 21 bp, Homo sapiens
ctctgtaaatgaaaaaaccca

SEQ ID NO: 4792991 - DNA, 14 bp, Homo sapiens
ctctgtagcctggt

SEQ ID NO: 4792992 - DNA, 16 bp, Homo sapiens
ctctgtagcctggtct

SEQ ID NO: 4792993 - DNA, 17 bp, Homo sapiens
ctctgtagcctggtctg

SEQ ID NO: 4792994 - DNA, 18 bp, Homo sapiens
ctctgtagcctggtctgt

SEQ ID NO: 4792995 - DNA, 20 bp, Homo sapiens
ctctgtagcctggtctgtgc

SEQ ID NO: 4792996 - DNA, 22 bp, Homo sapiens
ctctgtagcctggtctgtgcat

SEQ ID NO: 4792997 - DNA, 23 bp, Homo sapiens
ctctgtcagccagccgccctggg

SEQ ID NO: 4792998 - DNA, 16 bp, Homo sapiens
ctctgtcagtttgtga

SEQ ID NO: 4792999 - DNA, 23 bp, Homo sapiens
ctctgtcagtttgtgaagtgatt

SEQ ID NO: 4793000 - DNA, 18 bp, Homo sapiens
ctctgtctataggactta

SEQ ID NO: 4793001 - DNA, 19 bp, Homo sapiens
ctctgtgactcgcttagct

SEQ ID NO: 4793002 - DNA, 20 bp, Homo sapiens
ctctgtgctaagttgtctta

SEQ ID NO: 4793003 - DNA, 19 bp, Homo sapiens
ctctgtggtaagagatatg

SEQ ID NO: 4793004 - DNA, 20 bp, Homo sapiens
ctctgtggtaagagatatgc

SEQ ID NO: 4793005 - DNA, 12 bp, Homo sapiens
ctctgtgtggca

SEQ ID NO: 4793006 - DNA, 12 bp, Homo sapiens
ctctgttccaag

SEQ ID NO: 4793007 - DNA, 18 bp, Homo sapiens
ctctgttccaagtgtgtg

SEQ ID NO: 4793008 - DNA, 19 bp, Homo sapiens
ctctgttccaagtgtgtgt

SEQ ID NO: 4793009 - DNA, 22 bp, Homo sapiens
ctcttaccccgtccctttccct

SEQ ID NO: 4793010 - DNA, 20 bp, Homo sapiens
ctcttacctgtaatagcctc

SEQ ID NO: 4793011 - DNA, 19 bp, Homo sapiens
ctcttactaaccaccattt

SEQ ID NO: 4793012 - DNA, 17 bp, Homo sapiens
ctcttagcttttctgca

SEQ ID NO: 4793013 - DNA, 17 bp, Homo sapiens
ctcttatatgtgcccct

SEQ ID NO: 4793014 - DNA, 23 bp, Homo sapiens
ctcttatatgtgccccttcccca

SEQ ID NO: 4793015 - DNA, 13 bp, Homo sapiens
ctcttcaccagga

SEQ ID NO: 4793016 - DNA, 13 bp, Homo sapiens
ctcttcagcacaa

SEQ ID NO: 4793017 - DNA, 22 bp, Homo sapiens
ctcttcatgcgcagtccccagg

SEQ ID NO: 4793018 - DNA, 22 bp, Homo sapiens
ctcttcccaagtcctcgccccc

SEQ ID NO: 4793019 - DNA, 13 bp, Homo sapiens
ctcttcccccttc

SEQ ID NO: 4793020 - DNA, 19 bp, Homo sapiens
ctcttcccccttcccctgc

SEQ ID NO: 4793021 - DNA, 16 bp, Homo sapiens
ctcttccctctcgctc

SEQ ID NO: 4793022 - DNA, 14 bp, Homo sapiens
ctcttcgctgtgat

SEQ ID NO: 4793023 - DNA, 16 bp, Homo sapiens
ctcttcggtggccttg

SEQ ID NO: 4793024 - DNA, 19 bp, Homo sapiens
ctcttcggtggccttgagt

SEQ ID NO: 4793025 - DNA, 21 bp, Homo sapiens
ctcttctacaatacaacacat

SEQ ID NO: 4793026 - DNA, 16 bp, Homo sapiens
ctcttctcagctccac

SEQ ID NO: 4793027 - DNA, 19 bp, Homo sapiens
ctcttctcagctccactct

SEQ ID NO: 4793028 - DNA, 20 bp, Homo sapiens
ctcttctcagctccactctg

SEQ ID NO: 4793029 - DNA, 15 bp, Homo sapiens
ctcttctgttctcaa

SEQ ID NO: 4793030 - DNA, 16 bp, Homo sapiens
ctcttctgttctcaaa

SEQ ID NO: 4793031 - DNA, 21 bp, Homo sapiens
ctcttcttactgtatttggga

SEQ ID NO: 4793032 - DNA, 12 bp, Homo sapiens
ctcttcttcctt

SEQ ID NO: 4793033 - DNA, 24 bp, Homo sapiens
ctcttgattcataatgacttaagc

SEQ ID NO: 4793034 - DNA, 19 bp, Homo sapiens
ctcttgctgtttaccgccc

SEQ ID NO: 4793035 - DNA, 21 bp, Homo sapiens
ctcttgctgtttaccgcccac

SEQ ID NO: 4793036 - DNA, 23 bp, Homo sapiens
ctcttgctgtttaccgcccaccc

SEQ ID NO: 4793037 - DNA, 14 bp, Homo sapiens
ctcttgggaagcag

SEQ ID NO: 4793038 - DNA, 21 bp, Homo sapiens
ctcttggtctctttctttcca

SEQ ID NO: 4793039 - DNA, 16 bp, Homo sapiens
ctcttgtaccagccca

SEQ ID NO: 4793040 - DNA, 14 bp, Homo sapiens
ctcttgtcattctc

SEQ ID NO: 4793041 - DNA, 13 bp, Homo sapiens
ctctttaaattat

SEQ ID NO: 4793042 - DNA, 14 bp, Homo sapiens
ctctttaaattatg

SEQ ID NO: 4793043 - DNA, 23 bp, Homo sapiens
ctctttagttgatttaaactctt

SEQ ID NO: 4793044 - DNA, 20 bp, Homo sapiens
ctctttattgtctgtaaatc

SEQ ID NO: 4793045 - DNA, 17 bp, Homo sapiens
ctctttctcattcttgc

SEQ ID NO: 4793046 - DNA, 14 bp, Homo sapiens
ctctttctctctgt

SEQ ID NO: 4793047 - DNA, 21 bp, Homo sapiens
ctctttctctctttccatctc

SEQ ID NO: 4793048 - DNA, 12 bp, Homo sapiens
ctctttcttcaa

SEQ ID NO: 4793049 - DNA, 22 bp, Homo sapiens
ctctttcttttgtgcatatggc

SEQ ID NO: 4793050 - DNA, 18 bp, Homo sapiens
ctctttgggcctggctcc

SEQ ID NO: 4793051 - DNA, 18 bp, Homo sapiens
ctctttgtggggcttggc

SEQ ID NO: 4793052 - DNA, 20 bp, Homo sapiens
ctctttgtggggcttggcgt

SEQ ID NO: 4793053 - DNA, 15 bp, Homo sapiens
ctctttgttcttcaa

SEQ ID NO: 4793054 - DNA, 16 bp, Homo sapiens
ctcttttaaatcagat

SEQ ID NO: 4793055 - DNA, 20 bp, Homo sapiens
ctctttttatcgccattcca

SEQ ID NO: 4793056 - DNA, 15 bp, Homo sapiens
ctgaaaactggaata

SEQ ID NO: 4793057 - DNA, 23 bp, Homo sapiens
ctgaaaactggaataagaagcaa

SEQ ID NO: 4793058 - DNA, 14 bp, Homo sapiens
ctgaaaactgttta

SEQ ID NO: 4793059 - DNA, 17 bp, Homo sapiens
ctgaaactatagaataa

SEQ ID NO: 4793060 - DNA, 15 bp, Homo sapiens
ctgaaagttttgata

SEQ ID NO: 4793061 - DNA, 13 bp, Homo sapiens
ctgaaataaaact

SEQ ID NO: 4793062 - DNA, 16 bp, Homo sapiens
ctgaaattagtgtttt

SEQ ID NO: 4793063 - DNA, 18 bp, Homo sapiens
ctgaaattagtgttttca

SEQ ID NO: 4793064 - DNA, 20 bp, Homo sapiens
ctgaaattagtgttttcatt

SEQ ID NO: 4793065 - DNA, 20 bp, Homo sapiens
ctgaaattatgtcaaatgga

SEQ ID NO: 4793066 - DNA, 22 bp, Homo sapiens
ctgaacagaccggggtggagtc

SEQ ID NO: 4793067 - DNA, 19 bp, Homo sapiens
ctgaacgatccttcaaagt

SEQ ID NO: 4793068 - DNA, 21 bp, Homo sapiens
ctgaactcacagactgctgtc

SEQ ID NO: 4793069 - DNA, 15 bp, Homo sapiens
ctgaactggccccag

SEQ ID NO: 4793070 - DNA, 13 bp, Homo sapiens
ctgaactggccgc

SEQ ID NO: 4793071 - DNA, 21 bp, Homo sapiens
ctgaactggccgctgggagaa

SEQ ID NO: 4793072 - DNA, 21 bp, Homo sapiens
ctgaacttggcgctgcccctg

SEQ ID NO: 4793073 - DNA, 15 bp, Homo sapiens
ctgaactttggaagc

SEQ ID NO: 4793074 - DNA, 20 bp, Homo sapiens
ctgaagaaaatccttcagca

SEQ ID NO: 4793075 - DNA, 16 bp, Homo sapiens
ctgaagaaacaaggca

SEQ ID NO: 4793076 - DNA, 14 bp, Homo sapiens
ctgaagaaacacag

SEQ ID NO: 4793077 - DNA, 19 bp, Homo sapiens
ctgaagaaacacagcatgc

SEQ ID NO: 4793078 - DNA, 13 bp, Homo sapiens
ctgaagagtggaa

SEQ ID NO: 4793079 - DNA, 18 bp, Homo sapiens
ctgaagccttttcctgag

SEQ ID NO: 4793080 - DNA, 21 bp, Homo sapiens
ctgaaggcagagggatgaaat

SEQ ID NO: 4793081 - DNA, 14 bp, Homo sapiens
ctgaagggagggga

SEQ ID NO: 4793082 - DNA, 17 bp, Homo sapiens
ctgaagggaggggaaga

SEQ ID NO: 4793083 - DNA, 18 bp, Homo sapiens
ctgaagggaggggaagag

SEQ ID NO: 4793084 - DNA, 23 bp, Homo sapiens
ctgaagggaggggaagagagagg

SEQ ID NO: 4793085 - DNA, 13 bp, Homo sapiens
ctgaagtcccttc

SEQ ID NO: 4793086 - DNA, 20 bp, Homo sapiens
ctgaagtcccttcctgtcct

SEQ ID NO: 4793087 - DNA, 17 bp, Homo sapiens
ctgaagtctttgtacag

SEQ ID NO: 4793088 - DNA, 17 bp, Homo sapiens
ctgaagtttcatttatg

SEQ ID NO: 4793089 - DNA, 14 bp, Homo sapiens
ctgaataacaacaa

SEQ ID NO: 4793090 - DNA, 13 bp, Homo sapiens
ctgaatctctcaa

SEQ ID NO: 4793091 - DNA, 21 bp, Homo sapiens
ctgaatctctcaaaatgtgcc

SEQ ID NO: 4793092 - DNA, 20 bp, Homo sapiens
ctgaatgctatttgtgtaac

SEQ ID NO: 4793093 - DNA, 13 bp, Homo sapiens
ctgaattaaagtc

SEQ ID NO: 4793094 - DNA, 15 bp, Homo sapiens
ctgaattattaatga

SEQ ID NO: 4793095 - DNA, 16 bp, Homo sapiens
ctgaattgttatgtaa

SEQ ID NO: 4793096 - DNA, 17 bp, Homo sapiens
ctgaattgttatgtaaa

SEQ ID NO: 4793097 - DNA, 13 bp, Homo sapiens
ctgaatttctatg

SEQ ID NO: 4793098 - DNA, 22 bp, Homo sapiens
ctgaatttggggctacttatat

SEQ ID NO: 4793099 - DNA, 14 bp, Homo sapiens
ctgacaaattttaa

SEQ ID NO: 4793100 - DNA, 21 bp, Homo sapiens
ctgacacaatggtagctctga

SEQ ID NO: 4793101 - DNA, 12 bp, Homo sapiens
ctgacacctgcc

SEQ ID NO: 4793102 - DNA, 15 bp, Homo sapiens
ctgacacctgccgct

SEQ ID NO: 4793103 - DNA, 20 bp, Homo sapiens
ctgacagcgccatgtgtgtc

SEQ ID NO: 4793104 - DNA, 21 bp, Homo sapiens
ctgacagcgccatgtgtgtca

SEQ ID NO: 4793105 - DNA, 22 bp, Homo sapiens
ctgacaggccttcctcctctca

SEQ ID NO: 4793106 - DNA, 23 bp, Homo sapiens
ctgacaggccttcctcctctcaa

SEQ ID NO: 4793107 - DNA, 19 bp, Homo sapiens
ctgacatcagaggtatctt

SEQ ID NO: 4793108 - DNA, 21 bp, Homo sapiens
ctgacatgctaacctctctga

SEQ ID NO: 4793109 - DNA, 15 bp, Homo sapiens
ctgaccaacaggctg

SEQ ID NO: 4793110 - DNA, 12 bp, Homo sapiens
ctgaccctcact

SEQ ID NO: 4793111 - DNA, 18 bp, Homo sapiens
ctgaccctccaccgcaga

SEQ ID NO: 4793112 - DNA, 22 bp, Homo sapiens
ctgaccgggcttcctccctcca

SEQ ID NO: 4793113 - DNA, 14 bp, Homo sapiens
ctgacctgcctctc

SEQ ID NO: 4793114 - DNA, 18 bp, Homo sapiens
ctgacctgcctctcacac

SEQ ID NO: 4793115 - DNA, 21 bp, Homo sapiens
ctgaccttggagagacacagc

SEQ ID NO: 4793116 - DNA, 21 bp, Homo sapiens
ctgacgcaaaaccactttcct

SEQ ID NO: 4793117 - DNA, 17 bp, Homo sapiens
ctgacggccctgcaatg

SEQ ID NO: 4793118 - DNA, 14 bp, Homo sapiens
ctgactcagtgcag

SEQ ID NO: 4793119 - DNA, 16 bp, Homo sapiens
ctgactcagtgcaggg

SEQ ID NO: 4793120 - DNA, 21 bp, Homo sapiens
ctgactcagtgcagggacagc

SEQ ID NO: 4793121 - DNA, 23 bp, Homo sapiens
ctgactcagtgcagggacagcct

SEQ ID NO: 4793122 - DNA, 14 bp, Homo sapiens
ctgactccctgtgg

SEQ ID NO: 4793123 - DNA, 15 bp, Homo sapiens
ctgactccctgtggg

SEQ ID NO: 4793124 - DNA, 21 bp, Homo sapiens
ctgactccctgtgggggtggc

SEQ ID NO: 4793125 - DNA, 16 bp, Homo sapiens
ctgactgttctcttac

SEQ ID NO: 4793126 - DNA, 14 bp, Homo sapiens
ctgcataaccgcac

SEQ ID NO: 4793127 - DNA, 14 bp, Homo sapiens
ctgcatagacaaag

SEQ ID NO: 4793128 - DNA, 16 bp, Homo sapiens
ctgcatccctccaccc

SEQ ID NO: 4793129 - DNA, 21 bp, Homo sapiens
ctgcatccctccaccccagtc

SEQ ID NO: 4793130 - DNA, 18 bp, Homo sapiens
ctgcatcccttggcccct

SEQ ID NO: 4793131 - DNA, 20 bp, Homo sapiens
ctgcatcccttggcccctct

SEQ ID NO: 4793132 - DNA, 22 bp, Homo sapiens
ctgcatcccttggcccctctct

SEQ ID NO: 4793133 - DNA, 14 bp, Homo sapiens
ctgcatcctcagcc

SEQ ID NO: 4793134 - DNA, 16 bp, Homo sapiens
ctgcatcctcagcccc

SEQ ID NO: 4793135 - DNA, 20 bp, Homo sapiens
ctgcatcctcagccccaggg

SEQ ID NO: 4793136 - DNA, 16 bp, Homo sapiens
cttgcattttagctaa

SEQ ID NO: 4793137 - DNA, 14 bp, Homo sapiens
cttgccacaatcac

SEQ ID NO: 4793138 - DNA, 19 bp, Homo sapiens
cttgcggcaccgcccaccc

SEQ ID NO: 4793139 - DNA, 21 bp, Homo sapiens
cttgcggcaccgcccacccac

SEQ ID NO: 4793140 - DNA, 22 bp, Homo sapiens
cttgctcaccaagctgttccac

SEQ ID NO: 4793141 - DNA, 17 bp, Homo sapiens
cttgctccttgaataag

SEQ ID NO: 4793142 - DNA, 12 bp, Homo sapiens
cttgctcctttc

SEQ ID NO: 4793143 - DNA, 19 bp, Homo sapiens
cttgctcctttccatcagc

SEQ ID NO: 4793144 - DNA, 21 bp, Homo sapiens
cttgctctgctcatctacaca

SEQ ID NO: 4793145 - DNA, 21 bp, Homo sapiens
cttgctcttaagtaccagaag

SEQ ID NO: 4793146 - DNA, 23 bp, Homo sapiens
cttgctgcactcttgcacatgga

SEQ ID NO: 4793147 - DNA, 14 bp, Homo sapiens
cttgctggaaaact

SEQ ID NO: 4793148 - DNA, 20 bp, Homo sapiens
cttgctggaaaactgccaca

SEQ ID NO: 4793149 - DNA, 18 bp, Homo sapiens
cttgctgtgaaacagtgt

SEQ ID NO: 4793150 - DNA, 22 bp, Homo sapiens
cttgctgtttaccgcccaccca

SEQ ID NO: 4793151 - DNA, 20 bp, Homo sapiens
cttgcttcttgtgtttgaaa

SEQ ID NO: 4793152 - DNA, 16 bp, Homo sapiens
cttggaaatgggagac

SEQ ID NO: 4793153 - DNA, 11 bp, Homo sapiens
cttggagagga

SEQ ID NO: 4793154 - DNA, 13 bp, Homo sapiens
cttggagggatgg

SEQ ID NO: 4793155 - DNA, 20 bp, Homo sapiens
cttggataggagcttccaga

SEQ ID NO: 4793156 - DNA, 16 bp, Homo sapiens
cttggatgtcatatct

SEQ ID NO: 4793157 - DNA, 13 bp, Homo sapiens
cttggcaccaaag

SEQ ID NO: 4793158 - DNA, 23 bp, Homo sapiens
cttggcaggagtgggctctgagc

SEQ ID NO: 4793159 - DNA, 16 bp, Homo sapiens
cttggcattgaccttc

SEQ ID NO: 4793160 - DNA, 12 bp, Homo sapiens
cttggcccagca

SEQ ID NO: 4793161 - DNA, 12 bp, Homo sapiens
cttggcccctct

SEQ ID NO: 4793162 - DNA, 18 bp, Homo sapiens
cttggcctagcccaccct

SEQ ID NO: 4793163 - DNA, 20 bp, Homo sapiens
cttggcctagcccaccctgc

SEQ ID NO: 4793164 - DNA, 12 bp, Homo sapiens
cttggcgctgcc

SEQ ID NO: 4793165 - DNA, 23 bp, Homo sapiens
cttggcgctgcccctggcagccc

SEQ ID NO: 4793166 - DNA, 16 bp, Homo sapiens
cttggctcagacacct

SEQ ID NO: 4793167 - DNA, 19 bp, Homo sapiens
cttggctcagacacctaga

SEQ ID NO: 4793168 - DNA, 16 bp, Homo sapiens
cttgggaagcagtttc

SEQ ID NO: 4793169 - DNA, 21 bp, Homo sapiens
cttgggaagcagtttcagata

SEQ ID NO: 4793170 - DNA, 22 bp, Homo sapiens
cttgggaagcagtttcagataa

SEQ ID NO: 4793171 - DNA, 19 bp, Homo sapiens
cttgggcacgggagagcgc

SEQ ID NO: 4793172 - DNA, 16 bp, Homo sapiens
cttgggctggcaccca

SEQ ID NO: 4793173 - DNA, 16 bp, Homo sapiens
cttggggaaggggcct

SEQ ID NO: 4793174 - DNA, 17 bp, Homo sapiens
cttggggaaggggcctg

SEQ ID NO: 4793175 - DNA, 21 bp, Homo sapiens
cttggggaaggggcctgggct

SEQ ID NO: 4793176 - DNA, 18 bp, Homo sapiens
cttggggaccagagctgc

SEQ ID NO: 4793177 - DNA, 19 bp, Homo sapiens
cttggggaccagagctgcc

SEQ ID NO: 4793178 - DNA, 20 bp, Homo sapiens
cttggggaccagagctgcca

SEQ ID NO: 4793179 - DNA, 21 bp, Homo sapiens
cttgggggtggggctgcatcc

SEQ ID NO: 4793180 - DNA, 19 bp, Homo sapiens
cttggggtagagaggacag

SEQ ID NO: 4793181 - DNA, 22 bp, Homo sapiens
cttggtagaagcccttctacct

SEQ ID NO: 4793182 - DNA, 22 bp, Homo sapiens
cttggtcacaaagctatttaag

SEQ ID NO: 4793183 - DNA, 19 bp, Homo sapiens
cttggtctctttctttcca

SEQ ID NO: 4793184 - DNA, 15 bp, Homo sapiens
cttggtgactgtccc

SEQ ID NO: 4793185 - DNA, 17 bp, Homo sapiens
cttggtgttgttatggc

SEQ ID NO: 4793186 - DNA, 16 bp, Homo sapiens
cttggttcccatttgc

SEQ ID NO: 4793187 - DNA, 20 bp, Homo sapiens
cttggttcccatttgctcct

SEQ ID NO: 4793188 - DNA, 16 bp, Homo sapiens
cttggttcctccagca

SEQ ID NO: 4793189 - DNA, 22 bp, Homo sapiens
cttggttcctccagcaatgcct

SEQ ID NO: 4793190 - DNA, 15 bp, Homo sapiens
cttggttgttccttt

SEQ ID NO: 4793191 - DNA, 22 bp, Homo sapiens
cttggttgttcctttttctttt

SEQ ID NO: 4793192 - DNA, 16 bp, Homo sapiens
cttggtttccatcaaa

SEQ ID NO: 4793193 - DNA, 21 bp, Homo sapiens
cttggtttccatcaaagccct

SEQ ID NO: 4793194 - DNA, 23 bp, Homo sapiens
cttggtttccatcaaagccctcc

SEQ ID NO: 4793195 - DNA, 20 bp, Homo sapiens
cttggttttgcctctttaaa

SEQ ID NO: 4793196 - DNA, 22 bp, Homo sapiens
cttgtaaaactgtgacattcca

SEQ ID NO: 4793197 - DNA, 17 bp, Homo sapiens
cttgtaaataatgctta

SEQ ID NO: 4793198 - DNA, 10 bp, Homo sapiens
cttgtaactt

SEQ ID NO: 4793199 - DNA, 14 bp, Homo sapiens
cttgtacagaacca

SEQ ID NO: 4793200 - DNA, 21 bp, Homo sapiens
cttgtacagaaccagcactcc

SEQ ID NO: 4793201 - DNA, 13 bp, Homo sapiens
cttgtaccagccc

SEQ ID NO: 4793202 - DNA, 14 bp, Homo sapiens
cttgtaccagccca

SEQ ID NO: 4793203 - DNA, 21 bp, Homo sapiens
cttgtacttacactgaaatcc

SEQ ID NO: 4793204 - DNA, 16 bp, Homo sapiens
cttgtactttacaatc

SEQ ID NO: 4793205 - DNA, 17 bp, Homo sapiens
cttgtattatcagtgaa

SEQ ID NO: 4793206 - DNA, 17 bp, Homo sapiens
cttgtcattctcatcca

SEQ ID NO: 4793207 - DNA, 16 bp, Homo sapiens
cttgtcattctgctaa

SEQ ID NO: 4793208 - DNA, 20 bp, Homo sapiens
cttgtgtatcctgacagcgc

SEQ ID NO: 4793209 - DNA, 10 bp, Homo sapiens
cttgtgtatg

SEQ ID NO: 4793210 - DNA, 17 bp, Homo sapiens
cttgtgtgtatgtctat

SEQ ID NO: 4793211 - DNA, 21 bp, Homo sapiens
cttgtgtgtttattgtcaaag

SEQ ID NO: 4793212 - DNA, 15 bp, Homo sapiens
cttgtgttcaatctg

SEQ ID NO: 4793213 - DNA, 18 bp, Homo sapiens
cttgttatggtagaaaaa

SEQ ID NO: 4793214 - DNA, 22 bp, Homo sapiens
cttgttatgttgtaatattttg

SEQ ID NO: 4793215 - DNA, 13 bp, Homo sapiens
cttttttgggggg

SEQ ID NO: 4793216 - DNA, 22 bp, Homo sapiens
ctttttttaagtgttctgtggc

SEQ ID NO: 4793217 - DNA, 18 bp, Homo sapiens
cttttttttttttttggt

SEQ ID NO: 4793218 - DNA, 13 bp, Homo sapiens
gaaaaaaactttt

SEQ ID NO: 4793219 - DNA, 17 bp, Homo sapiens
gaaaaaaacttttataa

SEQ ID NO: 4793220 - DNA, 23 bp, Homo sapiens
gaaaaaaacttttataaattaaa

SEQ ID NO: 4793221 - DNA, 19 bp, Homo sapiens
gaaaaaaagggaaaacaaa

SEQ ID NO: 4793222 - DNA, 21 bp, Homo sapiens
gaaaaaaagggaaaacaaata

SEQ ID NO: 4793223 - DNA, 14 bp, Homo sapiens
gaaaaaactggaaa

SEQ ID NO: 4793224 - DNA, 18 bp, Homo sapiens
gaaaaaagtgcaacttga

SEQ ID NO: 4793225 - DNA, 17 bp, Homo sapiens
gaaaaagatattgtatt

SEQ ID NO: 4793226 - DNA, 13 bp, Homo sapiens
gaaaaagtgtttt

SEQ ID NO: 4793227 - DNA, 15 bp, Homo sapiens
gaaaaagtgttttta

SEQ ID NO: 4793228 - DNA, 16 bp, Homo sapiens
gaaaaagtgtttttac

SEQ ID NO: 4793229 - DNA, 16 bp, Homo sapiens
gaaaaatctgaatttc

SEQ ID NO: 4793230 - DNA, 20 bp, Homo sapiens
gaaaaattagatgactgaat

SEQ ID NO: 4793231 - DNA, 15 bp, Homo sapiens
gaaaaatttcacgat

SEQ ID NO: 4793232 - DNA, 19 bp, Homo sapiens
gaaaacaaatatttcactt

SEQ ID NO: 4793233 - DNA, 20 bp, Homo sapiens
gaaaaccatctggcctggcc

SEQ ID NO: 4793234 - DNA, 23 bp, Homo sapiens
gaaaacctcagttggcctctgcc

SEQ ID NO: 4793235 - DNA, 20 bp, Homo sapiens
gaaaacctgaggccaaatat

SEQ ID NO: 4793236 - DNA, 18 bp, Homo sapiens
gaaaacgatttaatttat

SEQ ID NO: 4793237 - DNA, 22 bp, Homo sapiens
gaaaactatcctgcgggtttta

SEQ ID NO: 4793238 - DNA, 13 bp, Homo sapiens
gaaaactgccaca

SEQ ID NO: 4793239 - DNA, 15 bp, Homo sapiens
gaaaagagaaacact

SEQ ID NO: 4793240 - DNA, 22 bp, Homo sapiens
gaaaagcaaatctgtataaatg

SEQ ID NO: 4793241 - DNA, 23 bp, Homo sapiens
gaaaaggttcttcatccctttcc

SEQ ID NO: 4793242 - DNA, 16 bp, Homo sapiens
gaaaatgagaatctgt

SEQ ID NO: 4793243 - DNA, 15 bp, Homo sapiens
gaaaatgctttctca

SEQ ID NO: 4793244 - DNA, 23 bp, Homo sapiens
gaaaatggacgtgttatgactcc

SEQ ID NO: 4793245 - DNA, 15 bp, Homo sapiens
gaaaatggctgaaga

SEQ ID NO: 4793246 - DNA, 17 bp, Homo sapiens
gaaaatggctgaagaaa

SEQ ID NO: 4793247 - DNA, 12 bp, Homo sapiens
gaaaattcaaca

SEQ ID NO: 4793248 - DNA, 17 bp, Homo sapiens
gaaaattttcttcttta

SEQ ID NO: 4793249 - DNA, 13 bp, Homo sapiens
gaaacaaatatac

SEQ ID NO: 4793250 - DNA, 23 bp, Homo sapiens
gaaacaaatatactcatttggat

SEQ ID NO: 4793251 - DNA, 18 bp, Homo sapiens
gaaacacagcatgcattt

SEQ ID NO: 4793252 - DNA, 19 bp, Homo sapiens
gaaacacagcatgcattta

SEQ ID NO: 4793253 - DNA, 23 bp, Homo sapiens
gaaacacagcatgcatttagcat

SEQ ID NO: 4793254 - DNA, 18 bp, Homo sapiens
gaaacacggagtttccat

SEQ ID NO: 4793255 - DNA, 20 bp, Homo sapiens
gaaacacggagtttccattt

SEQ ID NO: 4793256 - DNA, 18 bp, Homo sapiens
gaaacactcgtgtgcatg

SEQ ID NO: 4793257 - DNA, 21 bp, Homo sapiens
gaaacactcgtgtgcatgaga

SEQ ID NO: 4793258 - DNA, 22 bp, Homo sapiens
gaaacactttgaggacatttat

SEQ ID NO: 4793259 - DNA, 15 bp, Homo sapiens
gaaacagtgtggatg

SEQ ID NO: 4793260 - DNA, 12 bp, Homo sapiens
gaaacatctgat

SEQ ID NO: 4793261 - DNA, 14 bp, Homo sapiens
gaaacatctgattt

SEQ ID NO: 4793262 - DNA, 18 bp, Homo sapiens
gaaacatctgatttctga

SEQ ID NO: 4793263 - DNA, 20 bp, Homo sapiens
gaaacatctgatttctgaac

SEQ ID NO: 4793264 - DNA, 13 bp, Homo sapiens
gaaacatttatct

SEQ ID NO: 4793265 - DNA, 22 bp, Homo sapiens
gaaacccttgactgttatctcg

SEQ ID NO: 4793266 - DNA, 17 bp, Homo sapiens
gaaaccttttaaaaaaa

SEQ ID NO: 4793267 - DNA, 20 bp, Homo sapiens
gaaaccttttaaaaaaataa

SEQ ID NO: 4793268 - DNA, 22 bp, Homo sapiens
gaaactcatacagtctctattt

SEQ ID NO: 4793269 - DNA, 16 bp, Homo sapiens
gaaactgacttgctgt

SEQ ID NO: 4793270 - DNA, 21 bp, Homo sapiens
gaaacttcctataccggagct

SEQ ID NO: 4793271 - DNA, 22 bp, Homo sapiens
gaaacttttcaaggcacattga

SEQ ID NO: 4793272 - DNA, 11 bp, Homo sapiens
gaaagaaaaaa

SEQ ID NO: 4793273 - DNA, 19 bp, Homo sapiens
gaaagaccctaggtgctca

SEQ ID NO: 4793274 - DNA, 11 bp, Homo sapiens
gaaagagaaaa

SEQ ID NO: 4793275 - DNA, 13 bp, Homo sapiens
gaaagagaaaaag

SEQ ID NO: 4793276 - DNA, 17 bp, Homo sapiens
gaaagagctgttttgga

SEQ ID NO: 4793277 - DNA, 19 bp, Homo sapiens
gaaagaggaataaaatgat

SEQ ID NO: 4793278 - DNA, 16 bp, Homo sapiens
gaaagagtaaaaccaa

SEQ ID NO: 4793279 - DNA, 20 bp, Homo sapiens
gaaagagtaaaaccaaaggt

SEQ ID NO: 4793280 - DNA, 20 bp, Homo sapiens
gaaagcagtcagcggagagg

SEQ ID NO: 4793281 - DNA, 21 bp, Homo sapiens
gaaagcagtcagcggagagga

SEQ ID NO: 4793282 - DNA, 18 bp, Homo sapiens
gaaagccctcccccttcc

SEQ ID NO: 4793283 - DNA, 17 bp, Homo sapiens
gaaaggaggcatgcctc

SEQ ID NO: 4793284 - DNA, 21 bp, Homo sapiens
gaaaggaggcatgcctctgat

SEQ ID NO: 4793285 - DNA, 21 bp, Homo sapiens
gaaagtcaagtctacctgcct

SEQ ID NO: 4793286 - DNA, 17 bp, Homo sapiens
gaaagttgtgatctgtt

SEQ ID NO: 4793287 - DNA, 22 bp, Homo sapiens
gaaagttttgatacttgtaact

SEQ ID NO: 4793288 - DNA, 13 bp, Homo sapiens
gaaataaatctaa

SEQ ID NO: 4793289 - DNA, 15 bp, Homo sapiens
gaaataaatctaaat

SEQ ID NO: 4793290 - DNA, 20 bp, Homo sapiens
gaaatacttgacaacatttt

SEQ ID NO: 4793291 - DNA, 20 bp, Homo sapiens
gaaataggagggaaaccttt

SEQ ID NO: 4793292 - DNA, 15 bp, Homo sapiens
gaaatataaactgtg

SEQ ID NO: 4793293 - DNA, 17 bp, Homo sapiens
gaaatataaactgtgag

SEQ ID NO: 4793294 - DNA, 14 bp, Homo sapiens
gaaatatatgtgaa

SEQ ID NO: 4793295 - DNA, 18 bp, Homo sapiens
gaaatatctgtgaaatat

SEQ ID NO: 4793296 - DNA, 20 bp, Homo sapiens
gaaatatctgtgaaggactt

SEQ ID NO: 4793297 - DNA, 17 bp, Homo sapiens
gaaatattcacaaggtt

SEQ ID NO: 4793298 - DNA, 20 bp, Homo sapiens
gaaatatttgcttatttata

SEQ ID NO: 4793299 - DNA, 23 bp, Homo sapiens
gaaatattttctactttaaattg

SEQ ID NO: 4793300 - DNA, 17 bp, Homo sapiens
gaaatgaaaatggctga

SEQ ID NO: 4793301 - DNA, 11 bp, Homo sapiens
gaaatgagaaa

SEQ ID NO: 4793302 - DNA, 14 bp, Homo sapiens
gaaatgagaaattg

SEQ ID NO: 4793303 - DNA, 19 bp, Homo sapiens
gaaatgagatcccagagtt

SEQ ID NO: 4793304 - DNA, 17 bp, Homo sapiens
gaaatgattgagagcag

SEQ ID NO: 4793305 - DNA, 16 bp, Homo sapiens
gaaatgccaagactct

SEQ ID NO: 4793306 - DNA, 19 bp, Homo sapiens
gaaatgccagtggtggagg

SEQ ID NO: 4793307 - DNA, 21 bp, Homo sapiens
gaaatgctaacctgtggaaag

SEQ ID NO: 4793308 - DNA, 22 bp, Homo sapiens
gaaatgctgatttaaacttctt

SEQ ID NO: 4793309 - DNA, 20 bp, Homo sapiens
gaaatggatagattgtttta

SEQ ID NO: 4793310 - DNA, 13 bp, Homo sapiens
gaaattcacactg

SEQ ID NO: 4793311 - DNA, 16 bp, Homo sapiens
gaaattcttgcactgt

SEQ ID NO: 4793312 - DNA, 21 bp, Homo sapiens
gaaattgtgccaaagatagca

SEQ ID NO: 4793313 - DNA, 22 bp, Homo sapiens
gaaatttaagcacaaaaaattt

SEQ ID NO: 4793314 - DNA, 13 bp, Homo sapiens
gaaatttctcagc

SEQ ID NO: 4793315 - DNA, 20 bp, Homo sapiens
gaaatttttttccagaattg

SEQ ID NO: 4793316 - DNA, 23 bp, Homo sapiens
gaacaaatatgattctcctctcc

SEQ ID NO: 4793317 - DNA, 24 bp, Homo sapiens
gaacaaatatgattctcctctccc

SEQ ID NO: 4793318 - DNA, 13 bp, Homo sapiens
gaacaaattttca

SEQ ID NO: 4793319 - DNA, 15 bp, Homo sapiens
gaacaaattttcaca

SEQ ID NO: 4793320 - DNA, 18 bp, Homo sapiens
gaacaaggcaaggctgtc

SEQ ID NO: 4793321 - DNA, 14 bp, Homo sapiens
gaacaccaagtaaa

SEQ ID NO: 4793322 - DNA, 15 bp, Homo sapiens
gaacaccaagtaaat

SEQ ID NO: 4793323 - DNA, 16 bp, Homo sapiens
gaacactgcaccctcc

SEQ ID NO: 4793324 - DNA, 16 bp, Homo sapiens
gaacagaccggggtgg

SEQ ID NO: 4793325 - DNA, 15 bp, Homo sapiens
gaacagacctcggct

SEQ ID NO: 4793326 - DNA, 14 bp, Homo sapiens
gaacagagtatata

SEQ ID NO: 4793327 - DNA, 20 bp, Homo sapiens
gaacaggagtgactctggct

SEQ ID NO: 4793328 - DNA, 16 bp, Homo sapiens
gaacaggttcacgtga

SEQ ID NO: 4793329 - DNA, 21 bp, Homo sapiens
gaacatgagtttatgggaatg

SEQ ID NO: 4793330 - DNA, 20 bp, Homo sapiens
gaacatgccctcagctaagc

SEQ ID NO: 4793331 - DNA, 15 bp, Homo sapiens
gaaccagcactccca

SEQ ID NO: 4793332 - DNA, 22 bp, Homo sapiens
gaaccagcactcccagggcccg

SEQ ID NO: 4793333 - DNA, 20 bp, Homo sapiens
gaaccaggaggcctgggaga

SEQ ID NO: 4793334 - DNA, 15 bp, Homo sapiens
gaaccatggaggagg

SEQ ID NO: 4793335 - DNA, 18 bp, Homo sapiens
gaacccatcactgtgtct

SEQ ID NO: 4793336 - DNA, 17 bp, Homo sapiens
ctgtgcatctggcctgg

SEQ ID NO: 4793337 - DNA, 22 bp, Homo sapiens
ctgtgccatggatgattctttt

SEQ ID NO: 4793338 - DNA, 15 bp, Homo sapiens
ctgtgccccgcctcc

SEQ ID NO: 4793339 - DNA, 18 bp, Homo sapiens
ctgtgccccgcctcccgg

SEQ ID NO: 4793340 - DNA, 12 bp, Homo sapiens
ctgtgccctctc

SEQ ID NO: 4793341 - DNA, 20 bp, Homo sapiens
ctgtgctaagttgtcttaca

SEQ ID NO: 4793342 - DNA, 18 bp, Homo sapiens
ctgtgctttctgcatgct

SEQ ID NO: 4793343 - DNA, 22 bp, Homo sapiens
ctgtggagcgtccttgtccccg

SEQ ID NO: 4793344 - DNA, 11 bp, Homo sapiens
ctgtggataaa

SEQ ID NO: 4793345 - DNA, 21 bp, Homo sapiens
ctgtggataaattttggaaga

SEQ ID NO: 4793346 - DNA, 14 bp, Homo sapiens
ctgtggcccctcct

SEQ ID NO: 4793347 - DNA, 22 bp, Homo sapiens
ctgtggcccctccttctcccct

SEQ ID NO: 4793348 - DNA, 23 bp, Homo sapiens
ctgtggcccctccttctcccctc

SEQ ID NO: 4793349 - DNA, 20 bp, Homo sapiens
ctgtggcttcccatgtcttt

SEQ ID NO: 4793350 - DNA, 12 bp, Homo sapiens
ctgtgggactgg

SEQ ID NO: 4793351 - DNA, 16 bp, Homo sapiens
ctgtgggactggccca

SEQ ID NO: 4793352 - DNA, 14 bp, Homo sapiens
ctgtgggagtccac

SEQ ID NO: 4793353 - DNA, 15 bp, Homo sapiens
ctgtgggagtccact

SEQ ID NO: 4793354 - DNA, 19 bp, Homo sapiens
ctgtgggagtccactttcc

SEQ ID NO: 4793355 - DNA, 20 bp, Homo sapiens
ctgtgggagtccactttcct

SEQ ID NO: 4793356 - DNA, 21 bp, Homo sapiens
ctgtgggagtccactttcctc

SEQ ID NO: 4793357 - DNA, 22 bp, Homo sapiens
ctgtgggagtccactttcctct

SEQ ID NO: 4793358 - DNA, 23 bp, Homo sapiens
ctgtgggagtccactttcctctc

SEQ ID NO: 4793359 - DNA, 11 bp, Homo sapiens
ctgtgggcagc

SEQ ID NO: 4793360 - DNA, 12 bp, Homo sapiens
ctgtgggcagca

SEQ ID NO: 4793361 - DNA, 15 bp, Homo sapiens
ctgtgggcagcaccc

SEQ ID NO: 4793362 - DNA, 16 bp, Homo sapiens
ctgtgggcagcaccct

SEQ ID NO: 4793363 - DNA, 19 bp, Homo sapiens
ctgtgggcagcaccctccc

SEQ ID NO: 4793364 - DNA, 14 bp, Homo sapiens
ctgtgggctcacac

SEQ ID NO: 4793365 - DNA, 13 bp, Homo sapiens
ctggtctggagcc

SEQ ID NO: 4793366 - DNA, 21 bp, Homo sapiens
ctggtctggagcccctatcct

SEQ ID NO: 4793367 - DNA, 20 bp, Homo sapiens
ctggtctgtgcattgtggct

SEQ ID NO: 4793368 - DNA, 23 bp, Homo sapiens
ctggtgaaagagtaaaaccaaag

SEQ ID NO: 4793369 - DNA, 22 bp, Homo sapiens
ctggtgacctttttaatccagg

SEQ ID NO: 4793370 - DNA, 14 bp, Homo sapiens
ctggtggcaccaga

SEQ ID NO: 4793371 - DNA, 19 bp, Homo sapiens
ctggtggcaccagatgcaa

SEQ ID NO: 4793372 - DNA, 21 bp, Homo sapiens
ctggtttgtttctcaagcgct

SEQ ID NO: 4793373 - DNA, 19 bp, Homo sapiens
ctgtaaaatagtctcattg

SEQ ID NO: 4793374 - DNA, 12 bp, Homo sapiens
ctgtaaagaatt

SEQ ID NO: 4793375 - DNA, 17 bp, Homo sapiens
ctgtaaatctaacatta

SEQ ID NO: 4793376 - DNA, 20 bp, Homo sapiens
ctgtaaatctaacattatta

SEQ ID NO: 4793377 - DNA, 12 bp, Homo sapiens
ctgtaactgtcc

SEQ ID NO: 4793378 - DNA, 17 bp, Homo sapiens
ctgtaatagcctcacct

SEQ ID NO: 4793379 - DNA, 18 bp, Homo sapiens
ctgtaatatttacaatgt

SEQ ID NO: 4793380 - DNA, 14 bp, Homo sapiens
ctgtaattttgtag

SEQ ID NO: 4793381 - DNA, 18 bp, Homo sapiens
ctgtacgtctggtgttct

SEQ ID NO: 4793382 - DNA, 13 bp, Homo sapiens
ctgtactttccca

SEQ ID NO: 4793383 - DNA, 14 bp, Homo sapiens
ctgtagacatctgt

SEQ ID NO: 4793384 - DNA, 12 bp, Homo sapiens
ctgtagccctgg

SEQ ID NO: 4793385 - DNA, 14 bp, Homo sapiens
ctgtagcctggtct

SEQ ID NO: 4793386 - DNA, 18 bp, Homo sapiens
ctgtagcctggtctgtgc

SEQ ID NO: 4793387 - DNA, 20 bp, Homo sapiens
ctgtagcctggtctgtgcat

SEQ ID NO: 4793388 - DNA, 20 bp, Homo sapiens
ctgtagtttttgttcacctt

SEQ ID NO: 4793389 - DNA, 15 bp, Homo sapiens
ctgtgggctcacacc

SEQ ID NO: 4793390 - DNA, 17 bp, Homo sapiens
ctgtgggctcacaccgg

SEQ ID NO: 4793391 - DNA, 22 bp, Homo sapiens
ctgtgggctcacaccggcactg

SEQ ID NO: 4793392 - DNA, 14 bp, Homo sapiens
ctgtgggggtggcc

SEQ ID NO: 4793393 - DNA, 17 bp, Homo sapiens
ctgtgggggtggccatc

SEQ ID NO: 4793394 - DNA, 22 bp, Homo sapiens
ctgtggggtttttaatctcttg

SEQ ID NO: 4793395 - DNA, 23 bp, Homo sapiens
ctgtggggtttttaatctcttgt

SEQ ID NO: 4793396 - DNA, 22 bp, Homo sapiens
ctgtgggtttctaaagctgcca

SEQ ID NO: 4793397 - DNA, 22 bp, Homo sapiens
ctgtggtcttcaaattgtcttt

SEQ ID NO: 4793398 - DNA, 12 bp, Homo sapiens
ctgtgtatacat

SEQ ID NO: 4793399 - DNA, 20 bp, Homo sapiens
ctgtgtatacatatgtatgt

SEQ ID NO: 4793400 - DNA, 22 bp, Homo sapiens
ctgtgtatacatatgtatgtgt

SEQ ID NO: 4793401 - DNA, 23 bp, Homo sapiens
ctgtgtatacatatgtatgtgtg

SEQ ID NO: 4793402 - DNA, 18 bp, Homo sapiens
ctgtgtcacgtgaccctg

SEQ ID NO: 4793403 - DNA, 23 bp, Homo sapiens
ctgtgtcacgtgaccctgtgccc

SEQ ID NO: 4793404 - DNA, 16 bp, Homo sapiens
ctgtgtcatctgtcag

SEQ ID NO: 4793405 - DNA, 13 bp, Homo sapiens
ctgtgtcccagtg

SEQ ID NO: 4793406 - DNA, 20 bp, Homo sapiens
ctgtgtcccagtgtctggcc

SEQ ID NO: 4793407 - DNA, 23 bp, Homo sapiens
ctgtgtcccagtgtctggcccag

SEQ ID NO: 4793408 - DNA, 15 bp, Homo sapiens
ctgtgtggcaaacat

SEQ ID NO: 4793409 - DNA, 16 bp, Homo sapiens
ctgtgtggcaaacatt

SEQ ID NO: 4793410 - DNA, 18 bp, Homo sapiens
ctgtgtggcaaacattta

SEQ ID NO: 4793411 - DNA, 14 bp, Homo sapiens
ctgtgtgtgacacc

SEQ ID NO: 4793412 - DNA, 21 bp, Homo sapiens
ctgtgtgtgacaccaccactg

SEQ ID NO: 4793413 - DNA, 23 bp, Homo sapiens
ctgtgtgtgacaccaccactgtg

SEQ ID NO: 4793414 - DNA, 20 bp, Homo sapiens
ctgtgttctcaacacacagt

SEQ ID NO: 4793415 - DNA, 16 bp, Homo sapiens
ctgtgtttcatgttct

SEQ ID NO: 4793416 - DNA, 18 bp, Homo sapiens
ctgtgtttcatgttctgt

SEQ ID NO: 4793417 - DNA, 19 bp, Homo sapiens
ctgtgtttcatgttctgtg

SEQ ID NO: 4793418 - DNA, 22 bp, Homo sapiens
ctgtgtttcatgttctgtgtca

SEQ ID NO: 4793419 - DNA, 23 bp, Homo sapiens
ctgtgtttcatgttctgtgtcac

SEQ ID NO: 4793420 - DNA, 17 bp, Homo sapiens
ctgttaagggaagctga

SEQ ID NO: 4793421 - DNA, 13 bp, Homo sapiens
ctgttatacacag

SEQ ID NO: 4793422 - DNA, 16 bp, Homo sapiens
ctgttatctgtcttta

SEQ ID NO: 4793423 - DNA, 18 bp, Homo sapiens
ctgttcacgtgactcctc

SEQ ID NO: 4793424 - DNA, 21 bp, Homo sapiens
ctgttcacgtgactcctcaat

SEQ ID NO: 4793425 - DNA, 14 bp, Homo sapiens
ctgttcattgtaag

SEQ ID NO: 4793426 - DNA, 15 bp, Homo sapiens
ctgttccaagtgtgt

SEQ ID NO: 4793427 - DNA, 21 bp, Homo sapiens
ctgttccaagtgtgtgtgcaa

SEQ ID NO: 4793428 - DNA, 13 bp, Homo sapiens
ctgttccgcctca

SEQ ID NO: 4793429 - DNA, 17 bp, Homo sapiens
ctgttccgcctcactgg

SEQ ID NO: 4793430 - DNA, 21 bp, Homo sapiens
ctgttctatggaccaaatgta

SEQ ID NO: 4793431 - DNA, 15 bp, Homo sapiens
ctgttctcaaatgct

SEQ ID NO: 4793432 - DNA, 15 bp, Homo sapiens
ctgttctcaatcatt

SEQ ID NO: 4793433 - DNA, 15 bp, Homo sapiens
ctgttctgcactgaa

SEQ ID NO: 4793434 - DNA, 16 bp, Homo sapiens
ctgttctgcactgaaa

SEQ ID NO: 4793435 - DNA, 18 bp, Homo sapiens
ctgttctgcactgaaaag

SEQ ID NO: 4793436 - DNA, 16 bp, Homo sapiens
ctgttctggcagagtt

SEQ ID NO: 4793437 - DNA, 20 bp, Homo sapiens
ctgttctttcatactacatt

SEQ ID NO: 4793438 - DNA, 13 bp, Homo sapiens
ctgttctttttga

SEQ ID NO: 4793439 - DNA, 22 bp, Homo sapiens
ctgttgaagtgcatgttaaaat

SEQ ID NO: 4793440 - DNA, 21 bp, Homo sapiens
ctgttgattaatttctgccat

SEQ ID NO: 4793441 - DNA, 19 bp, Homo sapiens
ctgttgctacatcagagtg

SEQ ID NO: 4793442 - DNA, 20 bp, Homo sapiens
ctgttgctacatcagagtgt

SEQ ID NO: 4793443 - DNA, 21 bp, Homo sapiens
ctgttggtcttaactaatgta

SEQ ID NO: 4793444 - DNA, 15 bp, Homo sapiens
ctgtttaccctccct

SEQ ID NO: 4793445 - DNA, 23 bp, Homo sapiens
ctgtttaccgcccacccagcagc

SEQ ID NO: 4793446 - DNA, 19 bp, Homo sapiens
ctgtttcccttcccttcca

SEQ ID NO: 4793447 - DNA, 15 bp, Homo sapiens
ctgtttctcctccat

SEQ ID NO: 4793448 - DNA, 18 bp, Homo sapiens
ctgtttgaaacttttcaa

SEQ ID NO: 4793449 - DNA, 14 bp, Homo sapiens
ctgtttttgaagaa

SEQ ID NO: 4793450 - DNA, 21 bp, Homo sapiens
cttaaaagctatcttcatgta

SEQ ID NO: 4793451 - DNA, 20 bp, Homo sapiens
cttaaacaaaaactttccat

SEQ ID NO: 4793452 - DNA, 16 bp, Homo sapiens
cttaaacccacataaa

SEQ ID NO: 4793453 - DNA, 23 bp, Homo sapiens
cttaaagaacagctaacaataaa

SEQ ID NO: 4793454 - DNA, 15 bp, Homo sapiens
cttaaataaaaatta

SEQ ID NO: 4793455 - DNA, 12 bp, Homo sapiens
cttaaattaaac

SEQ ID NO: 4793456 - DNA, 14 bp, Homo sapiens
cttaaattaaacaa

SEQ ID NO: 4793457 - DNA, 16 bp, Homo sapiens
cttaacagatcacatg

SEQ ID NO: 4793458 - DNA, 16 bp, Homo sapiens
cttaacataaacttgt

SEQ ID NO: 4793459 - DNA, 17 bp, Homo sapiens
cttaacataaacttgta

SEQ ID NO: 4793460 - DNA, 20 bp, Homo sapiens
cttaacataaacttgtactt

SEQ ID NO: 4793461 - DNA, 20 bp, Homo sapiens
cttaacccccatttttgtaa

SEQ ID NO: 4793462 - DNA, 22 bp, Homo sapiens
cttaacccccatttttgtaata

SEQ ID NO: 4793463 - DNA, 22 bp, Homo sapiens
cttaaccctgacaaattttaat

SEQ ID NO: 4793464 - DNA, 16 bp, Homo sapiens
cttaactaatgtaaat

SEQ ID NO: 4793465 - DNA, 15 bp, Homo sapiens
cttaactggccctcg

SEQ ID NO: 4793466 - DNA, 21 bp, Homo sapiens
cttaagaagtatccctgattt

SEQ ID NO: 4793467 - DNA, 16 bp, Homo sapiens
cttaagcctgtgtata

SEQ ID NO: 4793468 - DNA, 20 bp, Homo sapiens
cttaagcctgtgtataaaaa

SEQ ID NO: 4793469 - DNA, 23 bp, Homo sapiens
cttaagctgcccaatttcacaga

SEQ ID NO: 4793470 - DNA, 13 bp, Homo sapiens
cttaaggaaaaga

SEQ ID NO: 4793471 - DNA, 18 bp, Homo sapiens
cttaaggaaaagagaaac

SEQ ID NO: 4793472 - DNA, 18 bp, Homo sapiens
cttaaggacagtgttcaa

SEQ ID NO: 4793473 - DNA, 20 bp, Homo sapiens
cttaaggacagtgttcaaat

SEQ ID NO: 4793474 - DNA, 16 bp, Homo sapiens
cttaataactatggta

SEQ ID NO: 4793475 - DNA, 23 bp, Homo sapiens
cttaatatccctggagttcctca

SEQ ID NO: 4793476 - DNA, 12 bp, Homo sapiens
cttaatatttct

SEQ ID NO: 4793477 - DNA, 13 bp, Homo sapiens
cttaatgaagaaa

SEQ ID NO: 4793478 - DNA, 12 bp, Homo sapiens
cttaatgactta

SEQ ID NO: 4793479 - DNA, 15 bp, Homo sapiens
cttcccagctgctcc

SEQ ID NO: 4793480 - DNA, 16 bp, Homo sapiens
cttcccagctggcagc

SEQ ID NO: 4793481 - DNA, 19 bp, Homo sapiens
cttcccagctggcagcgcc

SEQ ID NO: 4793482 - DNA, 14 bp, Homo sapiens
cttcccagcttccc

SEQ ID NO: 4793483 - DNA, 17 bp, Homo sapiens
cttcccaggaccctggg

SEQ ID NO: 4793484 - DNA, 19 bp, Homo sapiens
cttcccaggaccctgggtc

SEQ ID NO: 4793485 - DNA, 17 bp, Homo sapiens
cttcccatgtctttctc

SEQ ID NO: 4793486 - DNA, 16 bp, Homo sapiens
cttccccaaggcactg

SEQ ID NO: 4793487 - DNA, 13 bp, Homo sapiens
cttccccacaata

SEQ ID NO: 4793488 - DNA, 10 bp, Homo sapiens
cttccccact

SEQ ID NO: 4793489 - DNA, 11 bp, Homo sapiens
cttccccactc

SEQ ID NO: 4793490 - DNA, 12 bp, Homo sapiens
cttccccactcc

SEQ ID NO: 4793491 - DNA, 19 bp, Homo sapiens
cttccccatcgccttctgg

SEQ ID NO: 4793492 - DNA, 19 bp, Homo sapiens
cttccccattgccttctgg

SEQ ID NO: 4793493 - DNA, 22 bp, Homo sapiens
cttcccccagcacaaagcactg

SEQ ID NO: 4793494 - DNA, 16 bp, Homo sapiens
cttccccgtgcggccc

SEQ ID NO: 4793495 - DNA, 14 bp, Homo sapiens
cttcccctgaggac

SEQ ID NO: 4793496 - DNA, 15 bp, Homo sapiens
cttcccctgcgccct

SEQ ID NO: 4793497 - DNA, 14 bp, Homo sapiens
cttcccgcagcacc

SEQ ID NO: 4793498 - DNA, 21 bp, Homo sapiens
cttcccgcagcaccagcctga

SEQ ID NO: 4793499 - DNA, 22 bp, Homo sapiens
cttcccgcagcaccagcctgag

SEQ ID NO: 4793500 - DNA, 14 bp, Homo sapiens
cttccctagttctt

SEQ ID NO: 4793501 - DNA, 13 bp, Homo sapiens
cttccctctcgct

SEQ ID NO: 4793502 - DNA, 22 bp, Homo sapiens
cttccctctcgctcccctctgc

SEQ ID NO: 4793503 - DNA, 23 bp, Homo sapiens
cttccctgacactgtctgctgcc

SEQ ID NO: 4793504 - DNA, 24 bp, Homo sapiens
cttccctgacactgtctgctgccc

SEQ ID NO: 4793505 - DNA, 13 bp, Homo sapiens
cttccctgcttca

SEQ ID NO: 4793506 - DNA, 22 bp, Homo sapiens
cttcccttccactgcctctgcc

SEQ ID NO: 4793507 - DNA, 17 bp, Homo sapiens
cttccgagattcagact

SEQ ID NO: 4793508 - DNA, 16 bp, Homo sapiens
cttccgtgagacacaa

SEQ ID NO: 4793509 - DNA, 19 bp, Homo sapiens
cttcctataccggagctcc

SEQ ID NO: 4793510 - DNA, 21 bp, Homo sapiens
cttcctattaatttattaaat

SEQ ID NO: 4793511 - DNA, 18 bp, Homo sapiens
cttcctcatctccatgct

SEQ ID NO: 4793512 - DNA, 22 bp, Homo sapiens
cttcctccaaagcctgggcaga

SEQ ID NO: 4793513 - DNA, 10 bp, Homo sapiens
cttcctcctg

SEQ ID NO: 4793514 - DNA, 11 bp, Homo sapiens
cttcctcctga

SEQ ID NO: 4793515 - DNA, 23 bp, Homo sapiens
cttcctctcttttttggggggag

SEQ ID NO: 4793516 - DNA, 20 bp, Homo sapiens
cttcctctggggctctaggg

SEQ ID NO: 4793517 - DNA, 13 bp, Homo sapiens
cttcctgcctctc

SEQ ID NO: 4793518 - DNA, 17 bp, Homo sapiens
cttcctggacagtgaga

SEQ ID NO: 4793519 - DNA, 12 bp, Homo sapiens
cttcctgtcctg

SEQ ID NO: 4793520 - DNA, 13 bp, Homo sapiens
cttcctgtcctgc

SEQ ID NO: 4793521 - DNA, 16 bp, Homo sapiens
cttcctgtcctgctca

SEQ ID NO: 4793522 - DNA, 13 bp, Homo sapiens
cttccttctcagc

SEQ ID NO: 4793523 - DNA, 12 bp, Homo sapiens
cttccttctcat

SEQ ID NO: 4793524 - DNA, 13 bp, Homo sapiens
cttccttgccaca

SEQ ID NO: 4793525 - DNA, 18 bp, Homo sapiens
cttccttgccacaatcac

SEQ ID NO: 4793526 - DNA, 19 bp, Homo sapiens
cttccttttgtatcctcca

SEQ ID NO: 4793527 - DNA, 19 bp, Homo sapiens
cttcgctattcccaggcag

SEQ ID NO: 4793528 - DNA, 23 bp, Homo sapiens
cttcgctgtgatgcatgagctcc

SEQ ID NO: 4793529 - DNA, 15 bp, Homo sapiens
cttcggtggccttga

SEQ ID NO: 4793530 - DNA, 18 bp, Homo sapiens
cttctaaaactactgcct

SEQ ID NO: 4793531 - DNA, 19 bp, Homo sapiens
cttctaaaactactgcctt

SEQ ID NO: 4793532 - DNA, 13 bp, Homo sapiens
cttctaaatcata

SEQ ID NO: 4793533 - DNA, 20 bp, Homo sapiens
cttctaaatcataatcatcc

SEQ ID NO: 4793534 - DNA, 20 bp, Homo sapiens
cttctaagggatccagagac

SEQ ID NO: 4793535 - DNA, 20 bp, Homo sapiens
cttctaatatttattgcttt

SEQ ID NO: 4793536 - DNA, 14 bp, Homo sapiens
cttctactccatgg

SEQ ID NO: 4793537 - DNA, 22 bp, Homo sapiens
cttctactccatggtgaactga

SEQ ID NO: 4793538 - DNA, 23 bp, Homo sapiens
cttctactccatggtgaactgaa

SEQ ID NO: 4793539 - DNA, 18 bp, Homo sapiens
cttctaggggcaggtgaa

SEQ ID NO: 4793540 - DNA, 13 bp, Homo sapiens
cttctattttcaa

SEQ ID NO: 4793541 - DNA, 21 bp, Homo sapiens
cttctcaaatgctactcagta

SEQ ID NO: 4793542 - DNA, 15 bp, Homo sapiens
cttctcacagcacat

SEQ ID NO: 4793543 - DNA, 18 bp, Homo sapiens
cttctcacagcacatgct

SEQ ID NO: 4793544 - DNA, 17 bp, Homo sapiens
cttctcagctccactct

SEQ ID NO: 4793545 - DNA, 19 bp, Homo sapiens
cttctcagctccactctga

SEQ ID NO: 4793546 - DNA, 20 bp, Homo sapiens
cttctcagctccactctgaa

SEQ ID NO: 4793547 - DNA, 16 bp, Homo sapiens
cttctcatcttgcctc

SEQ ID NO: 4793548 - DNA, 12 bp, Homo sapiens
cttctcattttt

SEQ ID NO: 4793549 - DNA, 18 bp, Homo sapiens
cttctcattttttcctga

SEQ ID NO: 4793550 - DNA, 16 bp, Homo sapiens
cttctccacctccccc

SEQ ID NO: 4793551 - DNA, 14 bp, Homo sapiens
cttctcccctccag

SEQ ID NO: 4793552 - DNA, 15 bp, Homo sapiens
cttctcccctccaga

SEQ ID NO: 4793553 - DNA, 16 bp, Homo sapiens
cttctcccctccagac

SEQ ID NO: 4793554 - DNA, 19 bp, Homo sapiens
cttctcccctccagacccc

SEQ ID NO: 4793555 - DNA, 20 bp, Homo sapiens
cttctcccctccagacccct

SEQ ID NO: 4793556 - DNA, 18 bp, Homo sapiens
cttctcccgccattggcc

SEQ ID NO: 4793557 - DNA, 11 bp, Homo sapiens
cttctcctgca

SEQ ID NO: 4793558 - DNA, 13 bp, Homo sapiens
cttctcctgcagt

SEQ ID NO: 4793559 - DNA, 18 bp, Homo sapiens
cttctcctgcagtctgtg

SEQ ID NO: 4793560 - DNA, 12 bp, Homo sapiens
cttctccttaac

SEQ ID NO: 4793561 - DNA, 14 bp, Homo sapiens
cttctctctgtgct

SEQ ID NO: 4793562 - DNA, 21 bp, Homo sapiens
cttctcttacgctctctgtct

SEQ ID NO: 4793563 - DNA, 22 bp, Homo sapiens
cttctgaacttggcgctgcccc

SEQ ID NO: 4793564 - DNA, 14 bp, Homo sapiens
cttctgacggccct

SEQ ID NO: 4793565 - DNA, 17 bp, Homo sapiens
cttctgacggccctgca

SEQ ID NO: 4793566 - DNA, 18 bp, Homo sapiens
cttctgacggccctgcaa

SEQ ID NO: 4793567 - DNA, 15 bp, Homo sapiens
cttctgactgtttac

SEQ ID NO: 4793568 - DNA, 14 bp, Homo sapiens
cttctgatctgaga

SEQ ID NO: 4793569 - DNA, 20 bp, Homo sapiens
cttctgatgaaatgttaaca

SEQ ID NO: 4793570 - DNA, 17 bp, Homo sapiens
cttctgcagtcagactg

SEQ ID NO: 4793571 - DNA, 18 bp, Homo sapiens
cttctgcattactattaa

SEQ ID NO: 4793572 - DNA, 20 bp, Homo sapiens
cttctgcattactattaact

SEQ ID NO: 4793573 - DNA, 17 bp, Homo sapiens
cttctggaggtggggag

SEQ ID NO: 4793574 - DNA, 20 bp, Homo sapiens
cttctggaggtggggagggc

SEQ ID NO: 4793575 - DNA, 23 bp, Homo sapiens
cttctggctgctgcagtcagcac

SEQ ID NO: 4793576 - DNA, 21 bp, Homo sapiens
cttctgggacaggcaccatgc

SEQ ID NO: 4793577 - DNA, 22 bp, Homo sapiens
cttctgggacaggcaccatgct

SEQ ID NO: 4793578 - DNA, 15 bp, Homo sapiens
cttctggggagggac

SEQ ID NO: 4793579 - DNA, 14 bp, Homo sapiens
cttctgtgcatctg

SEQ ID NO: 4793580 - DNA, 12 bp, Homo sapiens
cttctgttctca

SEQ ID NO: 4793581 - DNA, 19 bp, Homo sapiens
cttcttaaggacagtgttc

SEQ ID NO: 4793582 - DNA, 15 bp, Homo sapiens
cttcttactgtattt

SEQ ID NO: 4793583 - DNA, 21 bp, Homo sapiens
cttcttcatccatagacacag

SEQ ID NO: 4793584 - DNA, 15 bp, Homo sapiens
cttcttcccccaggg

SEQ ID NO: 4793585 - DNA, 17 bp, Homo sapiens
cttcttctgtaatattt

SEQ ID NO: 4793586 - DNA, 18 bp, Homo sapiens
cttcttctgtaatattta

SEQ ID NO: 4793587 - DNA, 22 bp, Homo sapiens
cttcttctgtaatatttacaat

SEQ ID NO: 4793588 - DNA, 19 bp, Homo sapiens
cttcttgcggcaccgccca

SEQ ID NO: 4793589 - DNA, 22 bp, Homo sapiens
cttcttgcggcaccgcccaccc

SEQ ID NO: 4793590 - DNA, 13 bp, Homo sapiens
cttcttgggggca

SEQ ID NO: 4793591 - DNA, 18 bp, Homo sapiens
cttcttgggggcagacca

SEQ ID NO: 4793592 - DNA, 19 bp, Homo sapiens
cttcttgggggcagaccag

SEQ ID NO: 4793593 - DNA, 13 bp, Homo sapiens
cttcttgtctctc

SEQ ID NO: 4793594 - DNA, 15 bp, Homo sapiens
cttcttgtgtttgaa

SEQ ID NO: 4793595 - DNA, 16 bp, Homo sapiens
cttcttgtgtttgaaa

SEQ ID NO: 4793596 - DNA, 13 bp, Homo sapiens
cttcttgttcatg

SEQ ID NO: 4793597 - DNA, 18 bp, Homo sapiens
cttctttaatttttctgt

SEQ ID NO: 4793598 - DNA, 17 bp, Homo sapiens
cttctttactaacactg

SEQ ID NO: 4793599 - DNA, 19 bp, Homo sapiens
cttctttactaacactggc

SEQ ID NO: 4793600 - DNA, 23 bp, Homo sapiens
cttctttactcggcgtgctcctt

SEQ ID NO: 4793601 - DNA, 16 bp, Homo sapiens
ctcattgccaaggcat

SEQ ID NO: 4793602 - DNA, 20 bp, Homo sapiens
ctcatttagcattgaaataa

SEQ ID NO: 4793603 - DNA, 15 bp, Homo sapiens
ctcatttgcatccta

SEQ ID NO: 4793604 - DNA, 18 bp, Homo sapiens
ctcatttgccaggaagat

SEQ ID NO: 4793605 - DNA, 21 bp, Homo sapiens
ctcattttgcttcccatctga

SEQ ID NO: 4793606 - DNA, 17 bp, Homo sapiens
ctccaagccctggggca

SEQ ID NO: 4793607 - DNA, 15 bp, Homo sapiens
ctccaaggcaaatgt

SEQ ID NO: 4793608 - DNA, 16 bp, Homo sapiens
ctccaaggcaaatgtc

SEQ ID NO: 4793609 - DNA, 18 bp, Homo sapiens
ctccaaggcaaatgtcca

SEQ ID NO: 4793610 - DNA, 14 bp, Homo sapiens
ctccaagtcatggg

SEQ ID NO: 4793611 - DNA, 20 bp, Homo sapiens
ctccaagtcatgggagaaga

SEQ ID NO: 4793612 - DNA, 21 bp, Homo sapiens
ctccacacacttcttccaaaa

SEQ ID NO: 4793613 - DNA, 15 bp, Homo sapiens
ctccacacctccacc

SEQ ID NO: 4793614 - DNA, 16 bp, Homo sapiens
ctccacacctccaccc

SEQ ID NO: 4793615 - DNA, 13 bp, Homo sapiens
ctccacaggagcc

SEQ ID NO: 4793616 - DNA, 21 bp, Homo sapiens
ctccacccctcaagccaggag

SEQ ID NO: 4793617 - DNA, 22 bp, Homo sapiens
ctccacccctcaagccaggaga

SEQ ID NO: 4793618 - DNA, 16 bp, Homo sapiens
ctccacccgtcctggg

SEQ ID NO: 4793619 - DNA, 21 bp, Homo sapiens
ctccacctcccccaaaccctg

SEQ ID NO: 4793620 - DNA, 17 bp, Homo sapiens
ctccaccttgagcacta

SEQ ID NO: 4793621 - DNA, 18 bp, Homo sapiens
ctccacgcctcctggcca

SEQ ID NO: 4793622 - DNA, 21 bp, Homo sapiens
ctccacgcctcctggccagac

SEQ ID NO: 4793623 - DNA, 18 bp, Homo sapiens
ctccacgcttagggtctg

SEQ ID NO: 4793624 - DNA, 19 bp, Homo sapiens
ctccactttctagccagag

SEQ ID NO: 4793625 - DNA, 21 bp, Homo sapiens
ctccagaatttcccaaagcag

SEQ ID NO: 4793626 - DNA, 22 bp, Homo sapiens
ctccagaatttcccaaagcagt

SEQ ID NO: 4793627 - DNA, 15 bp, Homo sapiens
ctccagacccctacc

SEQ ID NO: 4793628 - DNA, 11 bp, Homo sapiens
ctccagactct

SEQ ID NO: 4793629 - DNA, 18 bp, Homo sapiens
ctccagagcctgggcgca

SEQ ID NO: 4793630 - DNA, 20 bp, Homo sapiens
ctccagagtaggtgggtctt

SEQ ID NO: 4793631 - DNA, 18 bp, Homo sapiens
ctccagattattttctat

SEQ ID NO: 4793632 - DNA, 22 bp, Homo sapiens
ctccagattattttctatattt

SEQ ID NO: 4793633 - DNA, 22 bp, Homo sapiens
ctccagccaatttcaaagaaaa

SEQ ID NO: 4793634 - DNA, 16 bp, Homo sapiens
ctccaggaaaactgtt

SEQ ID NO: 4793635 - DNA, 22 bp, Homo sapiens
ctccaggaagggaccccactgg

SEQ ID NO: 4793636 - DNA, 22 bp, Homo sapiens
ctccaggattgtccacaaatgt

SEQ ID NO: 4793637 - DNA, 17 bp, Homo sapiens
ctccaggcccagcctgg

SEQ ID NO: 4793638 - DNA, 22 bp, Homo sapiens
ctccaggcccagcctggcccca

SEQ ID NO: 4793639 - DNA, 17 bp, Homo sapiens
ctccaggggctggggac

SEQ ID NO: 4793640 - DNA, 19 bp, Homo sapiens
ctccaggggctggggactt

SEQ ID NO: 4793641 - DNA, 13 bp, Homo sapiens
ctccaggttcctc

SEQ ID NO: 4793642 - DNA, 14 bp, Homo sapiens
ctccaggttcctca

SEQ ID NO: 4793643 - DNA, 15 bp, Homo sapiens
ctccagtacaataaa

SEQ ID NO: 4793644 - DNA, 21 bp, Homo sapiens
ctccagtataaattacatgca

SEQ ID NO: 4793645 - DNA, 23 bp, Homo sapiens
ctccagtttctcttaagctgccc

SEQ ID NO: 4793646 - DNA, 19 bp, Homo sapiens
ctccagtttgcccaccaca

SEQ ID NO: 4793647 - DNA, 20 bp, Homo sapiens
ctccatctcttgtaccagcc

SEQ ID NO: 4793648 - DNA, 19 bp, Homo sapiens
ctccatgctcctcactgcc

SEQ ID NO: 4793649 - DNA, 14 bp, Homo sapiens
ctccatgctctttc

SEQ ID NO: 4793650 - DNA, 22 bp, Homo sapiens
ctccatgctctttcaccctgcc

SEQ ID NO: 4793651 - DNA, 17 bp, Homo sapiens
ctccatgctgtccctgt

SEQ ID NO: 4793652 - DNA, 19 bp, Homo sapiens
ctccattaaacttctactg

SEQ ID NO: 4793653 - DNA, 20 bp, Homo sapiens
ctccattaaacttctactga

SEQ ID NO: 4793654 - DNA, 20 bp, Homo sapiens
ctcccaaataaactccttaa

SEQ ID NO: 4793655 - DNA, 16 bp, Homo sapiens
ctcccaactctggcct

SEQ ID NO: 4793656 - DNA, 21 bp, Homo sapiens
ctcccaagctgatggacatga

SEQ ID NO: 4793657 - DNA, 15 bp, Homo sapiens
ctcccacctccagtc

SEQ ID NO: 4793658 - DNA, 21 bp, Homo sapiens
ctcccacctctttcttcaatt

SEQ ID NO: 4793659 - DNA, 15 bp, Homo sapiens
ctcccagccctgccc

SEQ ID NO: 4793660 - DNA, 19 bp, Homo sapiens
ctcccagctgtaccggcca

SEQ ID NO: 4793661 - DNA, 23 bp, Homo sapiens
ctcccagctgtaccggccactgc

SEQ ID NO: 4793662 - DNA, 24 bp, Homo sapiens
ctcccagctgtaccggccactgca

SEQ ID NO: 4793663 - DNA, 12 bp, Homo sapiens
ctcccagggccc

SEQ ID NO: 4793664 - DNA, 22 bp, Homo sapiens
ctcccagggtcctgggggctgc

SEQ ID NO: 4793665 - DNA, 18 bp, Homo sapiens
ctccccatatataaatta

SEQ ID NO: 4793666 - DNA, 21 bp, Homo sapiens
ctccccatatataaattatta

SEQ ID NO: 4793667 - DNA, 15 bp, Homo sapiens
ctccccatggtgcag

SEQ ID NO: 4793668 - DNA, 19 bp, Homo sapiens
ctcccccaaaccctgcttc

SEQ ID NO: 4793669 - DNA, 22 bp, Homo sapiens
ctcccccacggccgtccctgac

SEQ ID NO: 4793670 - DNA, 23 bp, Homo sapiens
ctccccctcagctctccctcaca

SEQ ID NO: 4793671 - DNA, 13 bp, Homo sapiens
ctccccctcctcc

SEQ ID NO: 4793672 - DNA, 14 bp, Homo sapiens
ctcccctctcctga

SEQ ID NO: 4793673 - DNA, 15 bp, Homo sapiens
ctcccctctcctgag

SEQ ID NO: 4793674 - DNA, 19 bp, Homo sapiens
ctcccctcttcttgcggca

SEQ ID NO: 4793675 - DNA, 13 bp, Homo sapiens
ctcccctggtcct

SEQ ID NO: 4793676 - DNA, 16 bp, Homo sapiens
ctcccctggtcctgca

SEQ ID NO: 4793677 - DNA, 19 bp, Homo sapiens
ctcccctggtcctgcactg

SEQ ID NO: 4793678 - DNA, 21 bp, Homo sapiens
ctcccgcatgctgcctgcctc

SEQ ID NO: 4793679 - DNA, 22 bp, Homo sapiens
ctcccgcatgctgcctgcctcc

SEQ ID NO: 4793680 - DNA, 20 bp, Homo sapiens
ctcccgccgcctcgggccgc

SEQ ID NO: 4793681 - DNA, 16 bp, Homo sapiens
ctcccggggtgcccgt

SEQ ID NO: 4793682 - DNA, 19 bp, Homo sapiens
ctcccggggtgcccgtgtg

SEQ ID NO: 4793683 - DNA, 19 bp, Homo sapiens
ctcccggtgtatgcagtgg

SEQ ID NO: 4793684 - DNA, 14 bp, Homo sapiens
ctcccggtgtgcag

SEQ ID NO: 4793685 - DNA, 18 bp, Homo sapiens
ctcccggtgtgcagcggg

SEQ ID NO: 4793686 - DNA, 16 bp, Homo sapiens
ctccctaccctcttct

SEQ ID NO: 4793687 - DNA, 19 bp, Homo sapiens
ctccctaccctcttctcag

SEQ ID NO: 4793688 - DNA, 21 bp, Homo sapiens
ctccctacttagacccagtca

SEQ ID NO: 4793689 - DNA, 20 bp, Homo sapiens
ctccctccacacctccaccc

SEQ ID NO: 4793690 - DNA, 16 bp, Homo sapiens
ctccctccactcctcc

SEQ ID NO: 4793691 - DNA, 17 bp, Homo sapiens
ctccctccactcctccc

SEQ ID NO: 4793692 - DNA, 13 bp, Homo sapiens
ctccctcccgcac

SEQ ID NO: 4793693 - DNA, 14 bp, Homo sapiens
ctccctccctccac

SEQ ID NO: 4793694 - DNA, 16 bp, Homo sapiens
ctccctccctccctgc

SEQ ID NO: 4793695 - DNA, 14 bp, Homo sapiens
ctccctcctggctc

SEQ ID NO: 4793696 - DNA, 17 bp, Homo sapiens
ctccctcctggctcaca

SEQ ID NO: 4793697 - DNA, 18 bp, Homo sapiens
ctccctcctggctcacag

SEQ ID NO: 4793698 - DNA, 20 bp, Homo sapiens
ctccctcctggctcacagcc

SEQ ID NO: 4793699 - DNA, 13 bp, Homo sapiens
ctccctcctgtgt

SEQ ID NO: 4793700 - DNA, 20 bp, Homo sapiens
ctccctgactccctgtgggg

SEQ ID NO: 4793701 - DNA, 19 bp, Homo sapiens
ctccctgctccctgctccc

SEQ ID NO: 4793702 - DNA, 16 bp, Homo sapiens
ctccctggccccagtg

SEQ ID NO: 4793703 - DNA, 17 bp, Homo sapiens
ctccctggggaggaccc

SEQ ID NO: 4793704 - DNA, 19 bp, Homo sapiens
ctccctggggaggacccct

SEQ ID NO: 4793705 - DNA, 14 bp, Homo sapiens
ctccctgtctgtct

SEQ ID NO: 4793706 - DNA, 17 bp, Homo sapiens
ctccctgtgggggtggc

SEQ ID NO: 4793707 - DNA, 15 bp, Homo sapiens
ctcccttcatccttc

SEQ ID NO: 4793708 - DNA, 15 bp, Homo sapiens
ctcccttccttatgc

SEQ ID NO: 4793709 - DNA, 19 bp, Homo sapiens
ctcccttctcccctcagcc

SEQ ID NO: 4793710 - DNA, 18 bp, Homo sapiens
ctcccttctttccttcct

SEQ ID NO: 4793711 - DNA, 14 bp, Homo sapiens
ctcccttgagctgg

SEQ ID NO: 4793712 - DNA, 18 bp, Homo sapiens
ctccgaacgctgctccat

SEQ ID NO: 4793713 - DNA, 20 bp, Homo sapiens
ctccgaacgctgctccatgc

SEQ ID NO: 4793714 - DNA, 14 bp, Homo sapiens
ctccgccagccctg

SEQ ID NO: 4793715 - DNA, 14 bp, Homo sapiens
ctccgccccccggc

SEQ ID NO: 4793716 - DNA, 22 bp, Homo sapiens
ctccgccccccggcctggcccc

SEQ ID NO: 4793717 - DNA, 21 bp, Homo sapiens
ctccggatggaatcacagcca

SEQ ID NO: 4793718 - DNA, 22 bp, Homo sapiens
ctccggatggaatcacagccaa

SEQ ID NO: 4793719 - DNA, 23 bp, Homo sapiens
ctccggatggaatcacagccaat

SEQ ID NO: 4793720 - DNA, 12 bp, Homo sapiens
ctccggcagagg

SEQ ID NO: 4793721 - DNA, 20 bp, Homo sapiens
ctccggcagaggcagggccc

SEQ ID NO: 4793722 - DNA, 17 bp, Homo sapiens
ctccggccctgccccac

SEQ ID NO: 4793723 - DNA, 18 bp, Homo sapiens
ctccggccctgccccaca

SEQ ID NO: 4793724 - DNA, 14 bp, Homo sapiens
cgggcctccccggg

SEQ ID NO: 4793725 - DNA, 16 bp, Homo sapiens
cgggcctcggcctggc

SEQ ID NO: 4793726 - DNA, 15 bp, Homo sapiens
cgggcgcccggactg

SEQ ID NO: 4793727 - DNA, 16 bp, Homo sapiens
cgggcgcccggactga

SEQ ID NO: 4793728 - DNA, 14 bp, Homo sapiens
cgggcgcctgcgct

SEQ ID NO: 4793729 - DNA, 17 bp, Homo sapiens
cgggcgcctgcgctcct

SEQ ID NO: 4793730 - DNA, 20 bp, Homo sapiens
cgggcgcctgcgctcctctg

SEQ ID NO: 4793731 - DNA, 14 bp, Homo sapiens
cgggcggggcgagg

SEQ ID NO: 4793732 - DNA, 23 bp, Homo sapiens
cggggcctgggtccccctcctgc

SEQ ID NO: 4793733 - DNA, 20 bp, Homo sapiens
cggggcggcatccgagcccc

SEQ ID NO: 4793734 - DNA, 21 bp, Homo sapiens
cggggcggcatccgagcccct

SEQ ID NO: 4793735 - DNA, 11 bp, Homo sapiens
cggggctggcc

SEQ ID NO: 4793736 - DNA, 16 bp, Homo sapiens
cgggggaagctgagcc

SEQ ID NO: 4793737 - DNA, 15 bp, Homo sapiens
cgggggaggagcacc

SEQ ID NO: 4793738 - DNA, 20 bp, Homo sapiens
cgggggcggctctgggaagc

SEQ ID NO: 4793739 - DNA, 19 bp, Homo sapiens
cgggggctaactggcccca

SEQ ID NO: 4793740 - DNA, 22 bp, Homo sapiens
cgggggctaactggccccaggc

SEQ ID NO: 4793741 - DNA, 14 bp, Homo sapiens
cgggggctgcttct

SEQ ID NO: 4793742 - DNA, 22 bp, Homo sapiens
cgggtcatattcataccttctg

SEQ ID NO: 4793743 - DNA, 13 bp, Homo sapiens
cgggtctgtggga

SEQ ID NO: 4793744 - DNA, 15 bp, Homo sapiens
cgggtgtggcctcag

SEQ ID NO: 4793745 - DNA, 20 bp, Homo sapiens
cgggtgtggcctcagccctc

SEQ ID NO: 4793746 - DNA, 23 bp, Homo sapiens
cggtcactgcccacctgccaggc

SEQ ID NO: 4793747 - DNA, 15 bp, Homo sapiens
cggtccaatccagcc

SEQ ID NO: 4793748 - DNA, 22 bp, Homo sapiens
cggtccaccccgtcccggcccc

SEQ ID NO: 4793749 - DNA, 20 bp, Homo sapiens
cggtcccccatgccaccacc

SEQ ID NO: 4793750 - DNA, 16 bp, Homo sapiens
cggtgagactctgagg

SEQ ID NO: 4793751 - DNA, 21 bp, Homo sapiens
cggtgccttccaccctgccct

SEQ ID NO: 4793752 - DNA, 17 bp, Homo sapiens
cggtggcttctggcacc

SEQ ID NO: 4793753 - DNA, 21 bp, Homo sapiens
cggtgggagccgtcagcctgt

SEQ ID NO: 4793754 - DNA, 23 bp, Homo sapiens
cggtgggcgcctgtcgggcccgc

SEQ ID NO: 4793755 - DNA, 17 bp, Homo sapiens
cggtggggccagcgctg

SEQ ID NO: 4793756 - DNA, 15 bp, Homo sapiens
cggtgtccatttata

SEQ ID NO: 4793757 - DNA, 17 bp, Homo sapiens
cggttggccggctggcc

SEQ ID NO: 4793758 - DNA, 18 bp, Homo sapiens
cggttggccggctggccg

SEQ ID NO: 4793759 - DNA, 16 bp, Homo sapiens
cgtagaacctgcgcac

SEQ ID NO: 4793760 - DNA, 20 bp, Homo sapiens
cgtatgcagtgtagatttta

SEQ ID NO: 4793761 - DNA, 15 bp, Homo sapiens
cgtatgttatacaac

SEQ ID NO: 4793762 - DNA, 14 bp, Homo sapiens
cgtcaatgtgaaat

SEQ ID NO: 4793763 - DNA, 20 bp, Homo sapiens
cgtcagtcgatattcccagg

SEQ ID NO: 4793764 - DNA, 20 bp, Homo sapiens
cgtcatcggaggctgggccc

SEQ ID NO: 4793765 - DNA, 17 bp, Homo sapiens
cgtccacatacactgca

SEQ ID NO: 4793766 - DNA, 11 bp, Homo sapiens
cgtccccaggg

SEQ ID NO: 4793767 - DNA, 14 bp, Homo sapiens
cgtccccagggtgc

SEQ ID NO: 4793768 - DNA, 12 bp, Homo sapiens
cgtcccggcccc

SEQ ID NO: 4793769 - DNA, 18 bp, Homo sapiens
cgtcccgggcactgtcat

SEQ ID NO: 4793770 - DNA, 24 bp, Homo sapiens
cgtcccgggcactgtcatgcccag

SEQ ID NO: 4793771 - DNA, 16 bp, Homo sapiens
cgtccctagcagtgaa

SEQ ID NO: 4793772 - DNA, 22 bp, Homo sapiens
cgtccctcgagctctgtagcct

SEQ ID NO: 4793773 - DNA, 12 bp, Homo sapiens
cgtcccttctct

SEQ ID NO: 4793774 - DNA, 22 bp, Homo sapiens
cgtccctttccctgcatccctt

SEQ ID NO: 4793775 - DNA, 17 bp, Homo sapiens
cgtccgcccgcccaccc

SEQ ID NO: 4793776 - DNA, 20 bp, Homo sapiens
cgtccgcccgcccaccccgc

SEQ ID NO: 4793777 - DNA, 18 bp, Homo sapiens
cgtccggcctgcagccca

SEQ ID NO: 4793778 - DNA, 16 bp, Homo sapiens
cgtccgtccgcccgcc

SEQ ID NO: 4793779 - DNA, 17 bp, Homo sapiens
cgtcctgctcgccctgt

SEQ ID NO: 4793780 - DNA, 12 bp, Homo sapiens
cgtcctgggtgc

SEQ ID NO: 4793781 - DNA, 15 bp, Homo sapiens
cgtccttgtccccgc

SEQ ID NO: 4793782 - DNA, 22 bp, Homo sapiens
cgtcctttcctctcctctctgg

SEQ ID NO: 4793783 - DNA, 16 bp, Homo sapiens
cgtctccctggcccca

SEQ ID NO: 4793784 - DNA, 14 bp, Homo sapiens
cgtctggtgttctc

SEQ ID NO: 4793785 - DNA, 13 bp, Homo sapiens
cgtcttccctgct

SEQ ID NO: 4793786 - DNA, 13 bp, Homo sapiens
cgtcttgtatttt

SEQ ID NO: 4793787 - DNA, 19 bp, Homo sapiens
cgtctttggttcctcatgg

SEQ ID NO: 4793788 - DNA, 21 bp, Homo sapiens
cgtctttggttcctcatggct

SEQ ID NO: 4793789 - DNA, 15 bp, Homo sapiens
cgtgaccctgtgccc

SEQ ID NO: 4793790 - DNA, 18 bp, Homo sapiens
cgtgaccctgtgccccgc

SEQ ID NO: 4793791 - DNA, 15 bp, Homo sapiens
cgtgaccggcccgcc

SEQ ID NO: 4793792 - DNA, 17 bp, Homo sapiens
cgtgacttcagactctc

SEQ ID NO: 4793793 - DNA, 22 bp, Homo sapiens
cgtgacttcagactctctcctc

SEQ ID NO: 4793794 - DNA, 14 bp, Homo sapiens
cgtgagacacaaga

SEQ ID NO: 4793795 - DNA, 21 bp, Homo sapiens
cgtgagcaggaaggcctgggt

SEQ ID NO: 4793796 - DNA, 15 bp, Homo sapiens
cgtgagcgccccgcc

SEQ ID NO: 4793797 - DNA, 17 bp, Homo sapiens
cgtgagtcctggcatgg

SEQ ID NO: 4793798 - DNA, 19 bp, Homo sapiens
cgtgagtcctggcatggga

SEQ ID NO: 4793799 - DNA, 24 bp, Homo sapiens
cgtgatccacccgcctcagcctcc

SEQ ID NO: 4793800 - DNA, 18 bp, Homo sapiens
cgtgcacaaaccttcttt

SEQ ID NO: 4793801 - DNA, 12 bp, Homo sapiens
cgtgcagggcca

SEQ ID NO: 4793802 - DNA, 13 bp, Homo sapiens
cgtgcagggccag

SEQ ID NO: 4793803 - DNA, 13 bp, Homo sapiens
cgtgcatttgtga

SEQ ID NO: 4793804 - DNA, 22 bp, Homo sapiens
cgtgccacatcaataacaacag

SEQ ID NO: 4793805 - DNA, 17 bp, Homo sapiens
cgtgcccatttcacaca

SEQ ID NO: 4793806 - DNA, 13 bp, Homo sapiens
cgtgcccccagcg

SEQ ID NO: 4793807 - DNA, 22 bp, Homo sapiens
cgtgccttccccgtgcggcccg

SEQ ID NO: 4793808 - DNA, 12 bp, Homo sapiens
cgtgcggcccgt

SEQ ID NO: 4793809 - DNA, 22 bp, Homo sapiens
cgtgcggcccgtgcgcagccgc

SEQ ID NO: 4793810 - DNA, 20 bp, Homo sapiens
cgtgctcttctgttctcaaa

SEQ ID NO: 4793811 - DNA, 16 bp, Homo sapiens
cgtggcatcttaaaag

SEQ ID NO: 4793812 - DNA, 15 bp, Homo sapiens
cgtggccgctgccca

SEQ ID NO: 4793813 - DNA, 16 bp, Homo sapiens
cgtggccgctgcccac

SEQ ID NO: 4793814 - DNA, 19 bp, Homo sapiens
cgtggccgctgctgtgaca

SEQ ID NO: 4793815 - DNA, 17 bp, Homo sapiens
cgtgggatccagagaga

SEQ ID NO: 4793816 - DNA, 23 bp, Homo sapiens
cgtggtgaggttgtgctgcctgt

SEQ ID NO: 4793817 - DNA, 18 bp, Homo sapiens
cgtggtggcggcggcact

SEQ ID NO: 4793818 - DNA, 15 bp, Homo sapiens
cgtggtgtgaggccc

SEQ ID NO: 4793819 - DNA, 15 bp, Homo sapiens
cgtgtcaatgtgtgc

SEQ ID NO: 4793820 - DNA, 14 bp, Homo sapiens
cgtgtcctatcccc

SEQ ID NO: 4793821 - DNA, 21 bp, Homo sapiens
cgtgtcttttaaaaactcctg

SEQ ID NO: 4793822 - DNA, 15 bp, Homo sapiens
cgtgtgcatgagaat

SEQ ID NO: 4793823 - DNA, 14 bp, Homo sapiens
cgtgtggccctgtg

SEQ ID NO: 4793824 - DNA, 19 bp, Homo sapiens
cgtgtggccctgtgggagt

SEQ ID NO: 4793825 - DNA, 23 bp, Homo sapiens
cgtgtggccctgtgggagtccac

SEQ ID NO: 4793826 - DNA, 13 bp, Homo sapiens
cgtgtggcctggg

SEQ ID NO: 4793827 - DNA, 14 bp, Homo sapiens
cgtgtggcctgggt

SEQ ID NO: 4793828 - DNA, 16 bp, Homo sapiens
cgtgtggcctgggtcc

SEQ ID NO: 4793829 - DNA, 15 bp, Homo sapiens
cgtgttcacacacac

SEQ ID NO: 4793830 - DNA, 17 bp, Homo sapiens
cgtgttggttgtgactt

SEQ ID NO: 4793831 - DNA, 16 bp, Homo sapiens
cgtgtttcgggccagg

SEQ ID NO: 4793832 - DNA, 22 bp, Homo sapiens
cgtgtttttggttttctccttc

SEQ ID NO: 4793833 - DNA, 20 bp, Homo sapiens
cgttaagcagtacatcttgt

SEQ ID NO: 4793834 - DNA, 17 bp, Homo sapiens
cgttaatcttgctgctt

SEQ ID NO: 4793835 - DNA, 13 bp, Homo sapiens
cgttaattaaaca

SEQ ID NO: 4793836 - DNA, 14 bp, Homo sapiens
cgttacagctcccc

SEQ ID NO: 4793837 - DNA, 21 bp, Homo sapiens
cgttatgtaagtttctaagaa

SEQ ID NO: 4793838 - DNA, 13 bp, Homo sapiens
cgttcgcggcggt

SEQ ID NO: 4793839 - DNA, 23 bp, Homo sapiens
cgttgcaaccactgcaatatctt

SEQ ID NO: 4793840 - DNA, 15 bp, Homo sapiens
cgttgttgtccctgc

SEQ ID NO: 4793841 - DNA, 14 bp, Homo sapiens
cgttgttttgtgga

SEQ ID NO: 4793842 - DNA, 15 bp, Homo sapiens
cgttgttttgtggat

SEQ ID NO: 4793843 - DNA, 18 bp, Homo sapiens
cgtttcacatctgtatat

SEQ ID NO: 4793844 - DNA, 16 bp, Homo sapiens
cgtttgcctccagaac

SEQ ID NO: 4793845 - DNA, 22 bp, Homo sapiens
cgtttttgtgctgtgggcagca

SEQ ID NO: 4793846 - DNA, 20 bp, Homo sapiens
ctaaaaaagctgaatcagac

SEQ ID NO: 4793847 - DNA, 17 bp, Homo sapiens
ctaaaactactgccttt

SEQ ID NO: 4793848 - DNA, 16 bp, Homo sapiens
ctaaaagtgatgtgat

SEQ ID NO: 4793849 - DNA, 18 bp, Homo sapiens
ctaaaagtgatgtgattt

SEQ ID NO: 4793850 - DNA, 20 bp, Homo sapiens
ctaaaagtgatgtgatttat

SEQ ID NO: 4793851 - DNA, 22 bp, Homo sapiens
ctaaaagtgatgtgatttatgc

SEQ ID NO: 4793852 - DNA, 14 bp, Homo sapiens
ctaaaataaatgtt

SEQ ID NO: 4793853 - DNA, 15 bp, Homo sapiens
ctaaaataaatgttt

SEQ ID NO: 4793854 - DNA, 21 bp, Homo sapiens
ctaaaatccacccagcccact

SEQ ID NO: 4793855 - DNA, 21 bp, Homo sapiens
ctaaacatagtggtattttaa

SEQ ID NO: 4793856 - DNA, 15 bp, Homo sapiens
ctaaacccaaataaa

SEQ ID NO: 4793857 - DNA, 17 bp, Homo sapiens
ctaaacctatctgtatt

SEQ ID NO: 4793858 - DNA, 20 bp, Homo sapiens
ctaaacctatctgtattggc

SEQ ID NO: 4793859 - DNA, 15 bp, Homo sapiens
ctaaagaaaaagata

SEQ ID NO: 4793860 - DNA, 14 bp, Homo sapiens
ctaaagacagaaaa

SEQ ID NO: 4793861 - DNA, 18 bp, Homo sapiens
ctaaagatctttttttaa

SEQ ID NO: 4793862 - DNA, 13 bp, Homo sapiens
ctaaagcagagat

SEQ ID NO: 4793863 - DNA, 16 bp, Homo sapiens
ctaaagcagagatgta

SEQ ID NO: 4793864 - DNA, 11 bp, Homo sapiens
ctaaagctgcc

SEQ ID NO: 4793865 - DNA, 14 bp, Homo sapiens
ctaaagctgccagc

SEQ ID NO: 4793866 - DNA, 15 bp, Homo sapiens
ctaaagctgccagcc

SEQ ID NO: 4793867 - DNA, 20 bp, Homo sapiens
ctaaaggaaacaaagcaata

SEQ ID NO: 4793868 - DNA, 16 bp, Homo sapiens
ctaaagggaagccctg

SEQ ID NO: 4793869 - DNA, 15 bp, Homo sapiens
ctaaaggggacagat

SEQ ID NO: 4793870 - DNA, 21 bp, Homo sapiens
ctaaaggggacagatcttgag

SEQ ID NO: 4793871 - DNA, 21 bp, Homo sapiens
ctaaataatatcctgaataac

SEQ ID NO: 4793872 - DNA, 20 bp, Homo sapiens
ctaaatagatttttagattc

SEQ ID NO: 4793873 - DNA, 15 bp, Homo sapiens
ctaaatatctagtgc

SEQ ID NO: 4793874 - DNA, 20 bp, Homo sapiens
ctaaatatctagtgctaaac

SEQ ID NO: 4793875 - DNA, 12 bp, Homo sapiens
ctaaatgttcat

SEQ ID NO: 4793876 - DNA, 14 bp, Homo sapiens
ctaaatgttcatgt

SEQ ID NO: 4793877 - DNA, 19 bp, Homo sapiens
ctaaattaacaaattcagt

SEQ ID NO: 4793878 - DNA, 12 bp, Homo sapiens
ctaacaataaag

SEQ ID NO: 4793879 - DNA, 12 bp, Homo sapiens
ctaacagagact

SEQ ID NO: 4793880 - DNA, 15 bp, Homo sapiens
ctaacatggaagtac

SEQ ID NO: 4793881 - DNA, 22 bp, Homo sapiens
ctaaccccaacgcacaggaaaa

SEQ ID NO: 4793882 - DNA, 18 bp, Homo sapiens
ctaacccctagtgtcttt

SEQ ID NO: 4793883 - DNA, 14 bp, Homo sapiens
ctaacgggcgcctt

SEQ ID NO: 4793884 - DNA, 20 bp, Homo sapiens
ctaactgatttccatccaaa

SEQ ID NO: 4793885 - DNA, 12 bp, Homo sapiens
ctaactgccatg

SEQ ID NO: 4793886 - DNA, 13 bp, Homo sapiens
ctaactggcccca

SEQ ID NO: 4793887 - DNA, 16 bp, Homo sapiens
ctaactggccccaggc

SEQ ID NO: 4793888 - DNA, 18 bp, Homo sapiens
ctaacttggggaaggggc

SEQ ID NO: 4793889 - DNA, 19 bp, Homo sapiens
ctaagaaatagcatcgatg

SEQ ID NO: 4793890 - DNA, 19 bp, Homo sapiens
ctaagaaatatctgtgaaa

SEQ ID NO: 4793891 - DNA, 22 bp, Homo sapiens
ctaagaaatatctgtgaaatat

SEQ ID NO: 4793892 - DNA, 21 bp, Homo sapiens
ctaagaaatgccagtggtgga

SEQ ID NO: 4793893 - DNA, 17 bp, Homo sapiens
ctaagaacccatggaaa

SEQ ID NO: 4793894 - DNA, 13 bp, Homo sapiens
ctaagaatttaga

SEQ ID NO: 4793895 - DNA, 14 bp, Homo sapiens
ctaagatcttgcct

SEQ ID NO: 4793896 - DNA, 12 bp, Homo sapiens
ctaagattgtac

SEQ ID NO: 4793897 - DNA, 13 bp, Homo sapiens
ctaagattgtaca

SEQ ID NO: 4793898 - DNA, 15 bp, Homo sapiens
ctaagctgccagcct

SEQ ID NO: 4793899 - DNA, 23 bp, Homo sapiens
ctaaggagcactagaatgagaaa

SEQ ID NO: 4793900 - DNA, 14 bp, Homo sapiens
ctaagggatccaga

SEQ ID NO: 4793901 - DNA, 17 bp, Homo sapiens
ctaagggatccagagac

SEQ ID NO: 4793902 - DNA, 22 bp, Homo sapiens
ctaagggcaggaagacttccag

SEQ ID NO: 4793903 - DNA, 19 bp, Homo sapiens
ctaagtaaattttctttaa

SEQ ID NO: 4793904 - DNA, 15 bp, Homo sapiens
ctaagtgagatgttt

SEQ ID NO: 4793905 - DNA, 18 bp, Homo sapiens
ctaagtggaagacagaga

SEQ ID NO: 4793906 - DNA, 19 bp, Homo sapiens
ctaatagctacatctactt

SEQ ID NO: 4793907 - DNA, 13 bp, Homo sapiens
ctaatattcatgc

SEQ ID NO: 4793908 - DNA, 18 bp, Homo sapiens
ctaatattcatgctgcct

SEQ ID NO: 4793909 - DNA, 20 bp, Homo sapiens
ctaatattcatgctgcctgc

SEQ ID NO: 4793910 - DNA, 18 bp, Homo sapiens
ctaatatttattgcttta

SEQ ID NO: 4793911 - DNA, 15 bp, Homo sapiens
ctaatctcatacctc

SEQ ID NO: 4793912 - DNA, 14 bp, Homo sapiens
ctaattagtgtcca

SEQ ID NO: 4793913 - DNA, 20 bp, Homo sapiens
ctaatttttattaatttgta

SEQ ID NO: 4793914 - DNA, 12 bp, Homo sapiens
ctaatttttcct

SEQ ID NO: 4793915 - DNA, 11 bp, Homo sapiens
ctaatttttgt

SEQ ID NO: 4793916 - DNA, 20 bp, Homo sapiens
ctaatttttgtatttttagt

SEQ ID NO: 4793917 - DNA, 23 bp, Homo sapiens
ctacaatatcattttcctgggag

SEQ ID NO: 4793918 - DNA, 20 bp, Homo sapiens
ctacacatataaacacagta

SEQ ID NO: 4793919 - DNA, 17 bp, Homo sapiens
ctacagaagtggaagga

SEQ ID NO: 4793920 - DNA, 13 bp, Homo sapiens
ctacagcctgcac

SEQ ID NO: 4793921 - DNA, 14 bp, Homo sapiens
ctacagcctgcaca

SEQ ID NO: 4793922 - DNA, 15 bp, Homo sapiens
ctacagcctgcacac

SEQ ID NO: 4793923 - DNA, 20 bp, Homo sapiens
ctacagcctgcacacacctg

SEQ ID NO: 4793924 - DNA, 19 bp, Homo sapiens
ctacagcttgaccgtgagg

SEQ ID NO: 4793925 - DNA, 22 bp, Homo sapiens
ctacagcttgaccgtgaggcca

SEQ ID NO: 4793926 - DNA, 16 bp, Homo sapiens
ctacaggggaggctga

SEQ ID NO: 4793927 - DNA, 11 bp, Homo sapiens
ctacatatgta

SEQ ID NO: 4793928 - DNA, 13 bp, Homo sapiens
ctacatctgaaat

SEQ ID NO: 4793929 - DNA, 19 bp, Homo sapiens
ctacatgcaaatctggctt

SEQ ID NO: 4793930 - DNA, 20 bp, Homo sapiens
ctacatgcaaatctggctta

SEQ ID NO: 4793931 - DNA, 17 bp, Homo sapiens
ctacattagtgagattt

SEQ ID NO: 4793932 - DNA, 19 bp, Homo sapiens
ctacatttgaacagggcaa

SEQ ID NO: 4793933 - DNA, 13 bp, Homo sapiens
ctacatttgcatg

SEQ ID NO: 4793934 - DNA, 19 bp, Homo sapiens
ctaccaactaagttgtatt

SEQ ID NO: 4793935 - DNA, 14 bp, Homo sapiens
ctaccacagctgcc

SEQ ID NO: 4793936 - DNA, 15 bp, Homo sapiens
ctaccacagctgcct

SEQ ID NO: 4793937 - DNA, 16 bp, Homo sapiens
ctaccacagctgcctc

SEQ ID NO: 4793938 - DNA, 17 bp, Homo sapiens
ctaccacagctgcctcc

SEQ ID NO: 4793939 - DNA, 21 bp, Homo sapiens
ctaccacagctgcctccgggc

SEQ ID NO: 4793940 - DNA, 18 bp, Homo sapiens
ctaccaccctcgctgcca

SEQ ID NO: 4793941 - DNA, 21 bp, Homo sapiens
ctaccaggaagaggggcgctg

SEQ ID NO: 4793942 - DNA, 16 bp, Homo sapiens
ctaccctcttctcagc

SEQ ID NO: 4793943 - DNA, 19 bp, Homo sapiens
ctaccctcttctcagctcc

SEQ ID NO: 4793944 - DNA, 22 bp, Homo sapiens
ctaccctcttctcagctccact

SEQ ID NO: 4793945 - DNA, 18 bp, Homo sapiens
ctacctataaatggactt

SEQ ID NO: 4793946 - DNA, 19 bp, Homo sapiens
ctaccttatagagcacaat

SEQ ID NO: 4793947 - DNA, 21 bp, Homo sapiens
ctaccttcaacatgtgctcgc

SEQ ID NO: 4793948 - DNA, 19 bp, Homo sapiens
ctaccttccagtcaggatg

SEQ ID NO: 4793949 - DNA, 20 bp, Homo sapiens
ctacctttggcttaattcca

SEQ ID NO: 4793950 - DNA, 21 bp, Homo sapiens
ctacctttggcttaattccaa

SEQ ID NO: 4793951 - DNA, 21 bp, Homo sapiens
ctacctttgtctcacgattcc

SEQ ID NO: 4793952 - DNA, 14 bp, Homo sapiens
ctactagcaccatc

SEQ ID NO: 4793953 - DNA, 15 bp, Homo sapiens
ctactcagatctgca

SEQ ID NO: 4793954 - DNA, 18 bp, Homo sapiens
ctactcagatctgcactc

SEQ ID NO: 4793955 - DNA, 18 bp, Homo sapiens
ctactcctccccctcctc

SEQ ID NO: 4793956 - DNA, 23 bp, Homo sapiens
ctactcctccccctcctccatgc

SEQ ID NO: 4793957 - DNA, 13 bp, Homo sapiens
ctactcttaaata

SEQ ID NO: 4793958 - DNA, 14 bp, Homo sapiens
ctactgagaaactt

SEQ ID NO: 4793959 - DNA, 13 bp, Homo sapiens
ctactgcctttca

SEQ ID NO: 4793960 - DNA, 18 bp, Homo sapiens
ctactgtttaagtgaatt

SEQ ID NO: 4793961 - DNA, 15 bp, Homo sapiens
ctacttaaacaaaaa

SEQ ID NO: 4793962 - DNA, 22 bp, Homo sapiens
ctacttaaacaaaaactttcca

SEQ ID NO: 4793963 - DNA, 16 bp, Homo sapiens
ctacttagacccagtc

SEQ ID NO: 4793964 - DNA, 14 bp, Homo sapiens
ctagaaagagaaaa

SEQ ID NO: 4793965 - DNA, 21 bp, Homo sapiens
ctagaaagagaaaaagccctc

SEQ ID NO: 4793966 - DNA, 17 bp, Homo sapiens
ctagaatactaataaaa

SEQ ID NO: 4793967 - DNA, 19 bp, Homo sapiens
ctagaatactaataaaata

SEQ ID NO: 4793968 - DNA, 20 bp, Homo sapiens
ctagaatgagaaatcatgtt

SEQ ID NO: 4793969 - DNA, 21 bp, Homo sapiens
ctagacgagcaggcttcttcc

SEQ ID NO: 4793970 - DNA, 16 bp, Homo sapiens
ctagagaaattcttgt

SEQ ID NO: 4793971 - DNA, 23 bp, Homo sapiens
ctagaggggacaagccaggccct

SEQ ID NO: 4793972 - DNA, 15 bp, Homo sapiens
ctagatatgagaaat

SEQ ID NO: 4793973 - DNA, 21 bp, Homo sapiens
ctagatctcctgtaattttgt

SEQ ID NO: 4793974 - DNA, 14 bp, Homo sapiens
ctagcaacaactta

SEQ ID NO: 4793975 - DNA, 15 bp, Homo sapiens
ctagccaggcctccc

SEQ ID NO: 4793976 - DNA, 13 bp, Homo sapiens
ctagccatatatt

SEQ ID NO: 4793977 - DNA, 19 bp, Homo sapiens
ctagccctctttctctctg

SEQ ID NO: 4793978 - DNA, 21 bp, Homo sapiens
ctagccctctttctctctgtg

SEQ ID NO: 4793979 - DNA, 19 bp, Homo sapiens
ctagggctctccaagcact

SEQ ID NO: 4793980 - DNA, 15 bp, Homo sapiens
ctaggggcaggtgaa

SEQ ID NO: 4793981 - DNA, 18 bp, Homo sapiens
ctagggttgctggagcct

SEQ ID NO: 4793982 - DNA, 14 bp, Homo sapiens
ctaggtctccaccc

SEQ ID NO: 4793983 - DNA, 15 bp, Homo sapiens
ctaggtgcccagtct

SEQ ID NO: 4793984 - DNA, 18 bp, Homo sapiens
ctaggtgcccagtcttga

SEQ ID NO: 4793985 - DNA, 21 bp, Homo sapiens
ctaggtgggtcaactccaagg

SEQ ID NO: 4793986 - DNA, 16 bp, Homo sapiens
ctagtaggtctgcaca

SEQ ID NO: 4793987 - DNA, 14 bp, Homo sapiens
ctagtatcactgct

SEQ ID NO: 4793988 - DNA, 18 bp, Homo sapiens
ctagtatcactgcttttt

SEQ ID NO: 4793989 - DNA, 23 bp, Homo sapiens
ctagtccggacccacctcacccc

SEQ ID NO: 4793990 - DNA, 12 bp, Homo sapiens
ctagtctgtgcc

SEQ ID NO: 4793991 - DNA, 16 bp, Homo sapiens
ctagtctgtgcctcag

SEQ ID NO: 4793992 - DNA, 14 bp, Homo sapiens
ctagtgagctgggc

SEQ ID NO: 4793993 - DNA, 17 bp, Homo sapiens
ctagtgagctgggcatg

SEQ ID NO: 4793994 - DNA, 17 bp, Homo sapiens
ctagtgctaaacctatc

SEQ ID NO: 4793995 - DNA, 19 bp, Homo sapiens
ctagtgttaatccagagaa

SEQ ID NO: 4793996 - DNA, 15 bp, Homo sapiens
ctagttagagactcg

SEQ ID NO: 4793997 - DNA, 18 bp, Homo sapiens
ctagttagctcacaagcc

SEQ ID NO: 4793998 - DNA, 21 bp, Homo sapiens
ctagttagctcacaagccgtg

SEQ ID NO: 4793999 - DNA, 16 bp, Homo sapiens
ctagtttaaaattatt

SEQ ID NO: 4794000 - DNA, 13 bp, Homo sapiens
ctataaatggact

SEQ ID NO: 4794001 - DNA, 23 bp, Homo sapiens
ctataaatggacttgcttcttgt

SEQ ID NO: 4794002 - DNA, 17 bp, Homo sapiens
ctataatgtgaaatgta

SEQ ID NO: 4794003 - DNA, 21 bp, Homo sapiens
ctataatgtgaaatgtaactg

SEQ ID NO: 4794004 - DNA, 22 bp, Homo sapiens
ctataatgtgaaatgtaactgt

SEQ ID NO: 4794005 - DNA, 22 bp, Homo sapiens
ctataccctaggtctccacccc

SEQ ID NO: 4794006 - DNA, 16 bp, Homo sapiens
ctataccggagctcca

SEQ ID NO: 4794007 - DNA, 18 bp, Homo sapiens
ctataccggagctccagt

SEQ ID NO: 4794008 - DNA, 23 bp, Homo sapiens
ctataccggagctccagtttctc

SEQ ID NO: 4794009 - DNA, 12 bp, Homo sapiens
ctatagaataaa

SEQ ID NO: 4794010 - DNA, 22 bp, Homo sapiens
ctatagattctttattagtgaa

SEQ ID NO: 4794011 - DNA, 12 bp, Homo sapiens
ctatataaaaaa

SEQ ID NO: 4794012 - DNA, 19 bp, Homo sapiens
ctatataaaaaatatatgt

SEQ ID NO: 4794013 - DNA, 21 bp, Homo sapiens
ctatatatacatatacacaaa

SEQ ID NO: 4794014 - DNA, 17 bp, Homo sapiens
ctatatatacatgtata

SEQ ID NO: 4794015 - DNA, 19 bp, Homo sapiens
ctatatatacatgtatagt

SEQ ID NO: 4794016 - DNA, 12 bp, Homo sapiens
ctatatttactg

SEQ ID NO: 4794017 - DNA, 17 bp, Homo sapiens
ctatatttggattcaca

SEQ ID NO: 4794018 - DNA, 20 bp, Homo sapiens
ctatcaccaaaagacgaggc

SEQ ID NO: 4794019 - DNA, 16 bp, Homo sapiens
ctatcagggcaagctc

SEQ ID NO: 4794020 - DNA, 21 bp, Homo sapiens
ctatccacagaacctttgtca

SEQ ID NO: 4794021 - DNA, 19 bp, Homo sapiens
ctatccagccgcaaatcca

SEQ ID NO: 4794022 - DNA, 23 bp, Homo sapiens
ctatccctggacgcatgcagggc

SEQ ID NO: 4794023 - DNA, 16 bp, Homo sapiens
ctatcctgcaccctct

SEQ ID NO: 4794024 - DNA, 17 bp, Homo sapiens
ctatccttggcaccaaa

SEQ ID NO: 4794025 - DNA, 14 bp, Homo sapiens
ctatccttttttcc

SEQ ID NO: 4794026 - DNA, 20 bp, Homo sapiens
ctatctcccacaaataagtt

SEQ ID NO: 4794027 - DNA, 19 bp, Homo sapiens
ctatctcgctagccatata

SEQ ID NO: 4794028 - DNA, 22 bp, Homo sapiens
ctatctctatataaaaaatata

SEQ ID NO: 4794029 - DNA, 14 bp, Homo sapiens
ctatctctcttctg

SEQ ID NO: 4794030 - DNA, 12 bp, Homo sapiens
ctatctcttcct

SEQ ID NO: 4794031 - DNA, 16 bp, Homo sapiens
ctatctggtattaaat

SEQ ID NO: 4794032 - DNA, 16 bp, Homo sapiens
ctatctggtgatttct

SEQ ID NO: 4794033 - DNA, 15 bp, Homo sapiens
ctatctgtattggca

SEQ ID NO: 4794034 - DNA, 14 bp, Homo sapiens
ctatcttcatgtaa

SEQ ID NO: 4794035 - DNA, 15 bp, Homo sapiens
ctatgacaataaatt

SEQ ID NO: 4794036 - DNA, 16 bp, Homo sapiens
ctatgacaataaattt

SEQ ID NO: 4794037 - DNA, 13 bp, Homo sapiens
ctatgaccctgtg

SEQ ID NO: 4794038 - DNA, 18 bp, Homo sapiens
ctatgaccctgtgcctgt

SEQ ID NO: 4794039 - DNA, 20 bp, Homo sapiens
ctatgaccctgtgcctgtgt

SEQ ID NO: 4794040 - DNA, 20 bp, Homo sapiens
ctatgagacctcccccaggg

SEQ ID NO: 4794041 - DNA, 22 bp, Homo sapiens
ctatgagacctcccccagggag

SEQ ID NO: 4794042 - DNA, 14 bp, Homo sapiens
ctatgatatgtgct

SEQ ID NO: 4794043 - DNA, 20 bp, Homo sapiens
ctatgattaaactgggaaat

SEQ ID NO: 4794044 - DNA, 22 bp, Homo sapiens
ctatgattaaactgggaaatga

SEQ ID NO: 4794045 - DNA, 13 bp, Homo sapiens
ctatgcacaccaa

SEQ ID NO: 4794046 - DNA, 16 bp, Homo sapiens
ctatgcacaccaaatt

SEQ ID NO: 4794047 - DNA, 21 bp, Homo sapiens
ctatgcacaccaaattgctga

SEQ ID NO: 4794048 - DNA, 22 bp, Homo sapiens
ctatgcacaccaaattgctgag

SEQ ID NO: 4794049 - DNA, 16 bp, Homo sapiens
ctatgctgtgtgcaga

SEQ ID NO: 4794050 - DNA, 17 bp, Homo sapiens
ctatgctgtgtgcagag

SEQ ID NO: 4794051 - DNA, 20 bp, Homo sapiens
ctatggaaagggtgtggctt

SEQ ID NO: 4794052 - DNA, 19 bp, Homo sapiens
ctatggaccaaatgtaaaa

SEQ ID NO: 4794053 - DNA, 21 bp, Homo sapiens
ctatggaccaaatgtaaaata

SEQ ID NO: 4794054 - DNA, 17 bp, Homo sapiens
ctatggactgcacaaaa

SEQ ID NO: 4794055 - DNA, 17 bp, Homo sapiens
ctatggattcacttcta

SEQ ID NO: 4794056 - DNA, 23 bp, Homo sapiens
ctatggcatattgataataaaat

SEQ ID NO: 4794057 - DNA, 16 bp, Homo sapiens
ctatggctgtattttt

SEQ ID NO: 4794058 - DNA, 21 bp, Homo sapiens
ctatgggagattaaaaccaga

SEQ ID NO: 4794059 - DNA, 18 bp, Homo sapiens
ctatggtaaataactgtg

SEQ ID NO: 4794060 - DNA, 20 bp, Homo sapiens
ctatggtaaataactgtgac

SEQ ID NO: 4794061 - DNA, 22 bp, Homo sapiens
ctatggtaaataactgtgactg

SEQ ID NO: 4794062 - DNA, 19 bp, Homo sapiens
ctatggtatgctggccagc

SEQ ID NO: 4794063 - DNA, 18 bp, Homo sapiens
ctatgtccaacagagtgg

SEQ ID NO: 4794064 - DNA, 17 bp, Homo sapiens
ctatgtgagcacaaagg

SEQ ID NO: 4794065 - DNA, 13 bp, Homo sapiens
ctatgtgtatata

SEQ ID NO: 4794066 - DNA, 17 bp, Homo sapiens
ctatgtgtatatattat

SEQ ID NO: 4794067 - DNA, 17 bp, Homo sapiens
ctatgtgtcatgatttc

SEQ ID NO: 4794068 - DNA, 21 bp, Homo sapiens
ctatgtgtcatgatttcaatg

SEQ ID NO: 4794069 - DNA, 11 bp, Homo sapiens
ctattaatatt

SEQ ID NO: 4794070 - DNA, 12 bp, Homo sapiens
ctattaatattt

SEQ ID NO: 4794071 - DNA, 13 bp, Homo sapiens
ctattaatatttg

SEQ ID NO: 4794072 - DNA, 13 bp, Homo sapiens
ctattatctgggt

SEQ ID NO: 4794073 - DNA, 15 bp, Homo sapiens
ctattatctgggttt

SEQ ID NO: 4794074 - DNA, 22 bp, Homo sapiens
ctattatctgggttttagaaat

SEQ ID NO: 4794075 - DNA, 14 bp, Homo sapiens
ctattcacacacac

SEQ ID NO: 4794076 - DNA, 23 bp, Homo sapiens
ctattcccatcgctggaaaacag

SEQ ID NO: 4794077 - DNA, 16 bp, Homo sapiens
ctattccttctggcct

SEQ ID NO: 4794078 - DNA, 13 bp, Homo sapiens
ctattctccagaa

SEQ ID NO: 4794079 - DNA, 22 bp, Homo sapiens
ctattgctgtaaataaaaatag

SEQ ID NO: 4794080 - DNA, 20 bp, Homo sapiens
ctattgtgctttctatctaa

SEQ ID NO: 4794081 - DNA, 18 bp, Homo sapiens
ctattgtttataggaaat

SEQ ID NO: 4794082 - DNA, 15 bp, Homo sapiens
ctatttaaaaaatga

SEQ ID NO: 4794083 - DNA, 21 bp, Homo sapiens
ctatttcaccatgttgccaat

SEQ ID NO: 4794084 - DNA, 13 bp, Homo sapiens
ctcaaaatgtgcc

SEQ ID NO: 4794085 - DNA, 14 bp, Homo sapiens
ctcaaacctggcag

SEQ ID NO: 4794086 - DNA, 15 bp, Homo sapiens
ctcaaacctggcaga

SEQ ID NO: 4794087 - DNA, 16 bp, Homo sapiens
ctcaaacctggcagat

SEQ ID NO: 4794088 - DNA, 20 bp, Homo sapiens
ctcaaagaggccagtacttt

SEQ ID NO: 4794089 - DNA, 18 bp, Homo sapiens
ctcaaatgctaaatgcaa

SEQ ID NO: 4794090 - DNA, 24 bp, Homo sapiens
ctcaaatgctaaatgcaaacactg

SEQ ID NO: 4794091 - DNA, 18 bp, Homo sapiens
ctcaacataacataagct

SEQ ID NO: 4794092 - DNA, 16 bp, Homo sapiens
ctcaactaaatccaaa

SEQ ID NO: 4794093 - DNA, 19 bp, Homo sapiens
ctcaactctcctccagagt

SEQ ID NO: 4794094 - DNA, 21 bp, Homo sapiens
ctcaactctcctccagagtca

SEQ ID NO: 4794095 - DNA, 20 bp, Homo sapiens
ctcaagagcataatggtaaa

SEQ ID NO: 4794096 - DNA, 15 bp, Homo sapiens
ctcaagatactggac

SEQ ID NO: 4794097 - DNA, 14 bp, Homo sapiens
ctcaagccaggaga

SEQ ID NO: 4794098 - DNA, 15 bp, Homo sapiens
ctcaagccaggagac

SEQ ID NO: 4794099 - DNA, 18 bp, Homo sapiens
ctcaagccaggagaccct

SEQ ID NO: 4794100 - DNA, 19 bp, Homo sapiens
ctcaagtcggtgggcctgc

SEQ ID NO: 4794101 - DNA, 15 bp, Homo sapiens
ctcaagttgtgtgct

SEQ ID NO: 4794102 - DNA, 18 bp, Homo sapiens
ctcaagtttcagagtcag

SEQ ID NO: 4794103 - DNA, 15 bp, Homo sapiens
ctcaatgcttttcta

SEQ ID NO: 4794104 - DNA, 12 bp, Homo sapiens
ctcaatgtgctg

SEQ ID NO: 4794105 - DNA, 15 bp, Homo sapiens
ctcaatgtgctgttg

SEQ ID NO: 4794106 - DNA, 18 bp, Homo sapiens
ctcaattctgaaggggaa

SEQ ID NO: 4794107 - DNA, 13 bp, Homo sapiens
ctcacaagccgtg

SEQ ID NO: 4794108 - DNA, 14 bp, Homo sapiens
ctcacaagccgtgt

SEQ ID NO: 4794109 - DNA, 21 bp, Homo sapiens
ctcacaagccgtgttttatga

SEQ ID NO: 4794110 - DNA, 16 bp, Homo sapiens
ctcacaccggcactgt

SEQ ID NO: 4794111 - DNA, 20 bp, Homo sapiens
ctcacaccggcactgtgcac

SEQ ID NO: 4794112 - DNA, 17 bp, Homo sapiens
ctcacacctcccttcat

SEQ ID NO: 4794113 - DNA, 15 bp, Homo sapiens
ctcacagactgctgt

SEQ ID NO: 4794114 - DNA, 21 bp, Homo sapiens
ctcacagcacatgctggccag

SEQ ID NO: 4794115 - DNA, 18 bp, Homo sapiens
ctcacagccaccacctgg

SEQ ID NO: 4794116 - DNA, 20 bp, Homo sapiens
ctcacaggttcacccagcgc

SEQ ID NO: 4794117 - DNA, 21 bp, Homo sapiens
ctcacaggttcacccagcgcc

SEQ ID NO: 4794118 - DNA, 12 bp, Homo sapiens
ctcacagtgacc

SEQ ID NO: 4794119 - DNA, 16 bp, Homo sapiens
ctcacagtgacccttc

SEQ ID NO: 4794120 - DNA, 18 bp, Homo sapiens
ctcacagtgacccttccc

SEQ ID NO: 4794121 - DNA, 17 bp, Homo sapiens
ctcaccaggaaattctg

SEQ ID NO: 4794122 - DNA, 21 bp, Homo sapiens
ctcaccatttaatcatttcca

SEQ ID NO: 4794123 - DNA, 22 bp, Homo sapiens
ctcaccatttaatcatttccag

SEQ ID NO: 4794124 - DNA, 13 bp, Homo sapiens
ctcacccagcctg

SEQ ID NO: 4794125 - DNA, 14 bp, Homo sapiens
ctcacccagcctgg

SEQ ID NO: 4794126 - DNA, 20 bp, Homo sapiens
ctcaccccccgacctggctg

SEQ ID NO: 4794127 - DNA, 22 bp, Homo sapiens
ctcaccccccgacctggctgag

SEQ ID NO: 4794128 - DNA, 17 bp, Homo sapiens
ctcaccctctgtccttc

SEQ ID NO: 4794129 - DNA, 14 bp, Homo sapiens
ctcacctgcccctc

SEQ ID NO: 4794130 - DNA, 16 bp, Homo sapiens
ctcacctgcccctcaa

SEQ ID NO: 4794131 - DNA, 15 bp, Homo sapiens
ctcaccttctgtttt

SEQ ID NO: 4794132 - DNA, 14 bp, Homo sapiens
ctcacgattccagt

SEQ ID NO: 4794133 - DNA, 22 bp, Homo sapiens
ctcactatggtatgctggccag

SEQ ID NO: 4794134 - DNA, 14 bp, Homo sapiens
ctcactccactccc

SEQ ID NO: 4794135 - DNA, 16 bp, Homo sapiens
ctcactccactcccct

SEQ ID NO: 4794136 - DNA, 11 bp, Homo sapiens
ctcactctgcc

SEQ ID NO: 4794137 - DNA, 13 bp, Homo sapiens
ctcactctgccag

SEQ ID NO: 4794138 - DNA, 14 bp, Homo sapiens
ctcactctgccagg

SEQ ID NO: 4794139 - DNA, 13 bp, Homo sapiens
ctcactctgtcag

SEQ ID NO: 4794140 - DNA, 15 bp, Homo sapiens
ctcactgacttctcc

SEQ ID NO: 4794141 - DNA, 19 bp, Homo sapiens
ctcactgacttctcccggg

SEQ ID NO: 4794142 - DNA, 13 bp, Homo sapiens
ctcactgagaagg

SEQ ID NO: 4794143 - DNA, 15 bp, Homo sapiens
ctcactgggtgtggc

SEQ ID NO: 4794144 - DNA, 17 bp, Homo sapiens
ctcactgggtgtggcct

SEQ ID NO: 4794145 - DNA, 21 bp, Homo sapiens
ctcactgggtgtggcctggct

SEQ ID NO: 4794146 - DNA, 19 bp, Homo sapiens
ctcagaagtgaaaaagact

SEQ ID NO: 4794147 - DNA, 17 bp, Homo sapiens
ctcagacgggctgagag

SEQ ID NO: 4794148 - DNA, 15 bp, Homo sapiens
ctcagaggagaggag

SEQ ID NO: 4794149 - DNA, 17 bp, Homo sapiens
ctcagaggagaggagca

SEQ ID NO: 4794150 - DNA, 18 bp, Homo sapiens
ctcagaggagaggagcaa

SEQ ID NO: 4794151 - DNA, 19 bp, Homo sapiens
ctcagagggtccctaggtg

SEQ ID NO: 4794152 - DNA, 22 bp, Homo sapiens
ctcagatccctcggtcagcacc

SEQ ID NO: 4794153 - DNA, 14 bp, Homo sapiens
ctcagatctgcact

SEQ ID NO: 4794154 - DNA, 21 bp, Homo sapiens
ctcagatctgcactcctgtct

SEQ ID NO: 4794155 - DNA, 15 bp, Homo sapiens
ctcagatcttctgtg

SEQ ID NO: 4794156 - DNA, 16 bp, Homo sapiens
ctcagatcttctgtgg

SEQ ID NO: 4794157 - DNA, 19 bp, Homo sapiens
ctcagcaagtgctgagtct

SEQ ID NO: 4794158 - DNA, 14 bp, Homo sapiens
ctcagccccagacc

SEQ ID NO: 4794159 - DNA, 15 bp, Homo sapiens
ctcagccccagacct

SEQ ID NO: 4794160 - DNA, 18 bp, Homo sapiens
ctcagccccagacctgcc

SEQ ID NO: 4794161 - DNA, 15 bp, Homo sapiens
ctcagccccagggcc

SEQ ID NO: 4794162 - DNA, 18 bp, Homo sapiens
ctcagccccagggccctg

SEQ ID NO: 4794163 - DNA, 20 bp, Homo sapiens
ctcagccccagggccctgct

SEQ ID NO: 4794164 - DNA, 21 bp, Homo sapiens
ctcagccccagggccctgctc

SEQ ID NO: 4794165 - DNA, 15 bp, Homo sapiens
ctcagctcactgcaa

SEQ ID NO: 4794166 - DNA, 20 bp, Homo sapiens
ctcagctcactgcaacctcc

SEQ ID NO: 4794167 - DNA, 12 bp, Homo sapiens
ctcagctccact

SEQ ID NO: 4794168 - DNA, 19 bp, Homo sapiens
ctcagctccactctgaagt

SEQ ID NO: 4794169 - DNA, 15 bp, Homo sapiens
ctcagctctccctca

SEQ ID NO: 4794170 - DNA, 18 bp, Homo sapiens
ctcagctgtctgtggctt

SEQ ID NO: 4794171 - DNA, 17 bp, Homo sapiens
ctcaggaccaccctgcc

SEQ ID NO: 4794172 - DNA, 19 bp, Homo sapiens
ctcaggaccaccctgccaa

SEQ ID NO: 4794173 - DNA, 21 bp, Homo sapiens
ctcaggaccaccctgccaagg

SEQ ID NO: 4794174 - DNA, 13 bp, Homo sapiens
ctcaggagaaggc

SEQ ID NO: 4794175 - DNA, 17 bp, Homo sapiens
ctcaggagaaggcctgc

SEQ ID NO: 4794176 - DNA, 23 bp, Homo sapiens
ctcaggagaaggcctgcccccct

SEQ ID NO: 4794177 - DNA, 16 bp, Homo sapiens
ctcaggagcacagcca

SEQ ID NO: 4794178 - DNA, 19 bp, Homo sapiens
ctcaggagcacagccatag

SEQ ID NO: 4794179 - DNA, 14 bp, Homo sapiens
ctcaggcagtgcag

SEQ ID NO: 4794180 - DNA, 21 bp, Homo sapiens
ctcaggccaaactcacctgcc

SEQ ID NO: 4794181 - DNA, 15 bp, Homo sapiens
ctcaggccagctgct

SEQ ID NO: 4794182 - DNA, 13 bp, Homo sapiens
ctcaggcctcacc

SEQ ID NO: 4794183 - DNA, 21 bp, Homo sapiens
ctcaggcctcacctggcttcc

SEQ ID NO: 4794184 - DNA, 12 bp, Homo sapiens
ctcaggctgccc

SEQ ID NO: 4794185 - DNA, 14 bp, Homo sapiens
ctcaggctgcccag

SEQ ID NO: 4794186 - DNA, 16 bp, Homo sapiens
ctcagggaccaaggag

SEQ ID NO: 4794187 - DNA, 15 bp, Homo sapiens
ctcagggcatgctta

SEQ ID NO: 4794188 - DNA, 13 bp, Homo sapiens
ctcaggggcagct

SEQ ID NO: 4794189 - DNA, 16 bp, Homo sapiens
ctcagtaacagtgcag

SEQ ID NO: 4794190 - DNA, 18 bp, Homo sapiens
ctcagtaaggcagtgcag

SEQ ID NO: 4794191 - DNA, 16 bp, Homo sapiens
ctcagtcagcccagtg

SEQ ID NO: 4794192 - DNA, 15 bp, Homo sapiens
ctcagtcccacagcc

SEQ ID NO: 4794193 - DNA, 18 bp, Homo sapiens
ctcagtcccacagcccct

SEQ ID NO: 4794194 - DNA, 19 bp, Homo sapiens
ctcagtccctccctcctgg

SEQ ID NO: 4794195 - DNA, 21 bp, Homo sapiens
ctcagtccctccctcctggct

SEQ ID NO: 4794196 - DNA, 24 bp, Homo sapiens
ctcagtccctccctcctggctcac

SEQ ID NO: 4794197 - DNA, 20 bp, Homo sapiens
ctcagtgcagggacagcctg

SEQ ID NO: 4794198 - DNA, 18 bp, Homo sapiens
ctcagttaggcagtgcag

SEQ ID NO: 4794199 - DNA, 19 bp, Homo sapiens
ctcataactagagtatgtg

SEQ ID NO: 4794200 - DNA, 20 bp, Homo sapiens
ctcataactagagtatgtgt

SEQ ID NO: 4794201 - DNA, 21 bp, Homo sapiens
ctcataactagagtatgtgta

SEQ ID NO: 4794202 - DNA, 21 bp, Homo sapiens
ctcatacagtctctatttgat

SEQ ID NO: 4794203 - DNA, 15 bp, Homo sapiens
ctcatagcacatgtt

SEQ ID NO: 4794204 - DNA, 20 bp, Homo sapiens
ctcatagcacatgttttaca

SEQ ID NO: 4794205 - DNA, 21 bp, Homo sapiens
ctcatagcacatgttttacaa

SEQ ID NO: 4794206 - DNA, 19 bp, Homo sapiens
ctcatatacttgaatatta

SEQ ID NO: 4794207 - DNA, 21 bp, Homo sapiens
ctcatcaggtaaactgatgct

SEQ ID NO: 4794208 - DNA, 20 bp, Homo sapiens
ctcatcagtgtcattttctg

SEQ ID NO: 4794209 - DNA, 23 bp, Homo sapiens
ctcatcagtgtcattttctgtta

SEQ ID NO: 4794210 - DNA, 21 bp, Homo sapiens
ctcatccaaaagtgaccagca

SEQ ID NO: 4794211 - DNA, 22 bp, Homo sapiens
ctcatccactaggtgcccagtc

SEQ ID NO: 4794212 - DNA, 15 bp, Homo sapiens
ctcatcccaaaagct

SEQ ID NO: 4794213 - DNA, 15 bp, Homo sapiens
ctcatctccatgctc

SEQ ID NO: 4794214 - DNA, 16 bp, Homo sapiens
ctcatctgtaaaacca

SEQ ID NO: 4794215 - DNA, 18 bp, Homo sapiens
ctcatggctgttatctgt

SEQ ID NO: 4794216 - DNA, 13 bp, Homo sapiens
ctcatggcttggg

SEQ ID NO: 4794217 - DNA, 22 bp, Homo sapiens
ctcatggtcccacttccccatc

SEQ ID NO: 4794218 - DNA, 21 bp, Homo sapiens
ctcatgttttatatgattaaa

SEQ ID NO: 4794219 - DNA, 13 bp, Homo sapiens
ctcattagctctc

SEQ ID NO: 4794220 - DNA, 21 bp, Homo sapiens
ctcattatcgccttttgacag

SEQ ID NO: 4794221 - DNA, 14 bp, Homo sapiens
ctcattcttctaaa

SEQ ID NO: 4794222 - DNA, 14 bp, Homo sapiens
ctcattgccaaggc

SEQ ID NO: 4794223 - DNA, 18 bp, Homo sapiens
cctgggacgcccctttct

SEQ ID NO: 4794224 - DNA, 21 bp, Homo sapiens
cctgggcaacagagtgagacc

SEQ ID NO: 4794225 - DNA, 23 bp, Homo sapiens
cctgggcacatagcataggctgg

SEQ ID NO: 4794226 - DNA, 12 bp, Homo sapiens
cctgggcagaag

SEQ ID NO: 4794227 - DNA, 14 bp, Homo sapiens
cctgggcagaagga

SEQ ID NO: 4794228 - DNA, 16 bp, Homo sapiens
cctgggcagcccagag

SEQ ID NO: 4794229 - DNA, 19 bp, Homo sapiens
cctgggcagcccagagaga

SEQ ID NO: 4794230 - DNA, 22 bp, Homo sapiens
cctgggcccctccacgcctcct

SEQ ID NO: 4794231 - DNA, 13 bp, Homo sapiens
cctgggccctagg

SEQ ID NO: 4794232 - DNA, 15 bp, Homo sapiens
cctgggccctaggca

SEQ ID NO: 4794233 - DNA, 13 bp, Homo sapiens
cctgggcctcccg

SEQ ID NO: 4794234 - DNA, 22 bp, Homo sapiens
cctgggcctcccgtccgtccgc

SEQ ID NO: 4794235 - DNA, 19 bp, Homo sapiens
cctgggctgtctgtcacca

SEQ ID NO: 4794236 - DNA, 15 bp, Homo sapiens
cctgggctgtgagga

SEQ ID NO: 4794237 - DNA, 22 bp, Homo sapiens
cctgggctgtgaggacagggcc

SEQ ID NO: 4794238 - DNA, 14 bp, Homo sapiens
cctggggaggaccc

SEQ ID NO: 4794239 - DNA, 17 bp, Homo sapiens
cctggggaggacccctg

SEQ ID NO: 4794240 - DNA, 22 bp, Homo sapiens
cctggggaggacccctgccctc

SEQ ID NO: 4794241 - DNA, 12 bp, Homo sapiens
cctggggcctgg

SEQ ID NO: 4794242 - DNA, 13 bp, Homo sapiens
cctggggcctggc

SEQ ID NO: 4794243 - DNA, 12 bp, Homo sapiens
cctggggctggg

SEQ ID NO: 4794244 - DNA, 18 bp, Homo sapiens
cctgggggctgctgcact

SEQ ID NO: 4794245 - DNA, 19 bp, Homo sapiens
cctgggggctgctgcactg

SEQ ID NO: 4794246 - DNA, 22 bp, Homo sapiens
cctgggggctgttagctcagag

SEQ ID NO: 4794247 - DNA, 18 bp, Homo sapiens
cctggggggcacagccag

SEQ ID NO: 4794248 - DNA, 14 bp, Homo sapiens
cctgggggtggcag

SEQ ID NO: 4794249 - DNA, 18 bp, Homo sapiens
cctgggggtggcaggcac

SEQ ID NO: 4794250 - DNA, 14 bp, Homo sapiens
cctggggtctctga

SEQ ID NO: 4794251 - DNA, 16 bp, Homo sapiens
cctggggtctctgagc

SEQ ID NO: 4794252 - DNA, 18 bp, Homo sapiens
cctggggtctctgagcag

SEQ ID NO: 4794253 - DNA, 23 bp, Homo sapiens
cctggggtctctgagcagtgggg

SEQ ID NO: 4794254 - DNA, 15 bp, Homo sapiens
cctgggtcaccttcc

SEQ ID NO: 4794255 - DNA, 16 bp, Homo sapiens
cctgggtccccctcct

SEQ ID NO: 4794256 - DNA, 23 bp, Homo sapiens
cctgggtcctcggccctgtagcc

SEQ ID NO: 4794257 - DNA, 12 bp, Homo sapiens
cctgggtgctca

SEQ ID NO: 4794258 - DNA, 16 bp, Homo sapiens
cctgggtgctgtcatg

SEQ ID NO: 4794259 - DNA, 22 bp, Homo sapiens
cctgggtgctgtcatgcccagc

SEQ ID NO: 4794260 - DNA, 15 bp, Homo sapiens
cctgggtgtgacctg

SEQ ID NO: 4794261 - DNA, 20 bp, Homo sapiens
cctgggtgtgacctgacacc

SEQ ID NO: 4794262 - DNA, 16 bp, Homo sapiens
cctggtaggtctggat

SEQ ID NO: 4794263 - DNA, 14 bp, Homo sapiens
cctggtctggagcc

SEQ ID NO: 4794264 - DNA, 18 bp, Homo sapiens
cctggtctggagccccta

SEQ ID NO: 4794265 - DNA, 20 bp, Homo sapiens
cctggtctggagcccctatc

SEQ ID NO: 4794266 - DNA, 21 bp, Homo sapiens
cctggtctggagcccctatcc

SEQ ID NO: 4794267 - DNA, 23 bp, Homo sapiens
cctggtctgtgcattgtggctgt

SEQ ID NO: 4794268 - DNA, 15 bp, Homo sapiens
cctggtgaaagagta

SEQ ID NO: 4794269 - DNA, 14 bp, Homo sapiens
cctggtggcaccag

SEQ ID NO: 4794270 - DNA, 18 bp, Homo sapiens
cctggtggcaccagatgc

SEQ ID NO: 4794271 - DNA, 13 bp, Homo sapiens
cctggtgtggaag

SEQ ID NO: 4794272 - DNA, 13 bp, Homo sapiens
cctgtaaaacttt

SEQ ID NO: 4794273 - DNA, 14 bp, Homo sapiens
cctgtagccctggc

SEQ ID NO: 4794274 - DNA, 17 bp, Homo sapiens
cctgtagccctggcccg

SEQ ID NO: 4794275 - DNA, 14 bp, Homo sapiens
cctgtcactgtcca

SEQ ID NO: 4794276 - DNA, 18 bp, Homo sapiens
cctgtccccagttaatgt

SEQ ID NO: 4794277 - DNA, 16 bp, Homo sapiens
cctgtccctagggctc

SEQ ID NO: 4794278 - DNA, 17 bp, Homo sapiens
cctgtccctagggctct

SEQ ID NO: 4794279 - DNA, 24 bp, Homo sapiens
cctgtccctagggctctccaagca

SEQ ID NO: 4794280 - DNA, 12 bp, Homo sapiens
cctgtcctggct

SEQ ID NO: 4794281 - DNA, 14 bp, Homo sapiens
cctgtcgggcccgc

SEQ ID NO: 4794282 - DNA, 16 bp, Homo sapiens
cctgtcgggcccgcac

SEQ ID NO: 4794283 - DNA, 18 bp, Homo sapiens
cctgtctcttgggaagca

SEQ ID NO: 4794284 - DNA, 21 bp, Homo sapiens
cctgtctcttgggaagcagtt

SEQ ID NO: 4794285 - DNA, 20 bp, Homo sapiens
cctgtctgtctgtctctctt

SEQ ID NO: 4794286 - DNA, 19 bp, Homo sapiens
cctgtctttgctgtttata

SEQ ID NO: 4794287 - DNA, 16 bp, Homo sapiens
cctgtgaactgccagg

SEQ ID NO: 4794288 - DNA, 20 bp, Homo sapiens
cctgtgaggatagagacttg

SEQ ID NO: 4794289 - DNA, 21 bp, Homo sapiens
cctgtgaggatagagacttgc

SEQ ID NO: 4794290 - DNA, 16 bp, Homo sapiens
cctgtgatcgtgtgtt

SEQ ID NO: 4794291 - DNA, 20 bp, Homo sapiens
cctgtgatcgtgtgttgcca

SEQ ID NO: 4794292 - DNA, 20 bp, Homo sapiens
cctgtgccccgcctcccggg

SEQ ID NO: 4794293 - DNA, 23 bp, Homo sapiens
cctgtgccccgcctcccggggtg

SEQ ID NO: 4794294 - DNA, 15 bp, Homo sapiens
cctgtgccctctcac

SEQ ID NO: 4794295 - DNA, 14 bp, Homo sapiens
cctgtgcctgtgtt

SEQ ID NO: 4794296 - DNA, 11 bp, Homo sapiens
cctgtgctttc

SEQ ID NO: 4794297 - DNA, 13 bp, Homo sapiens
cctgtgggagtcc

SEQ ID NO: 4794298 - DNA, 16 bp, Homo sapiens
cctgtgggagtccact

SEQ ID NO: 4794299 - DNA, 21 bp, Homo sapiens
cctgtgggagtccactttcct

SEQ ID NO: 4794300 - DNA, 14 bp, Homo sapiens
cctgtgggctcaca

SEQ ID NO: 4794301 - DNA, 16 bp, Homo sapiens
cctgtgggctcacacc

SEQ ID NO: 4794302 - DNA, 14 bp, Homo sapiens
cctgtgggggtggc

SEQ ID NO: 4794303 - DNA, 15 bp, Homo sapiens
cctgtgggtccttgc

SEQ ID NO: 4794304 - DNA, 17 bp, Homo sapiens
cctgtggtctgtgtgtg

SEQ ID NO: 4794305 - DNA, 13 bp, Homo sapiens
cctgtggtttgtt

SEQ ID NO: 4794306 - DNA, 14 bp, Homo sapiens
cctgtgtcatctgt

SEQ ID NO: 4794307 - DNA, 17 bp, Homo sapiens
cctgtgtttgctcccat

SEQ ID NO: 4794308 - DNA, 17 bp, Homo sapiens
cctgttacttaaatagc

SEQ ID NO: 4794309 - DNA, 20 bp, Homo sapiens
cctgttaggggaaaatagta

SEQ ID NO: 4794310 - DNA, 16 bp, Homo sapiens
cctgttcattgtaagc

SEQ ID NO: 4794311 - DNA, 18 bp, Homo sapiens
cctgttcccatgagatga

SEQ ID NO: 4794312 - DNA, 13 bp, Homo sapiens
cctgttccgcctc

SEQ ID NO: 4794313 - DNA, 17 bp, Homo sapiens
cctgttccgcctcactg

SEQ ID NO: 4794314 - DNA, 12 bp, Homo sapiens
cctgttctggca

SEQ ID NO: 4794315 - DNA, 16 bp, Homo sapiens
cctgttgggccaggag

SEQ ID NO: 4794316 - DNA, 17 bp, Homo sapiens
cctgttgggccaggagc

SEQ ID NO: 4794317 - DNA, 18 bp, Homo sapiens
cctgttgggccaggagcc

SEQ ID NO: 4794318 - DNA, 23 bp, Homo sapiens
cctgttgggccaggagcctcctg

SEQ ID NO: 4794319 - DNA, 19 bp, Homo sapiens
cctgttttcacaccttaca

SEQ ID NO: 4794320 - DNA, 18 bp, Homo sapiens
ccttaaaaaaaaaaatga

SEQ ID NO: 4794321 - DNA, 20 bp, Homo sapiens
ccttaaaaagaccatgcatt

SEQ ID NO: 4794322 - DNA, 18 bp, Homo sapiens
ccttaaactaccaccctc

SEQ ID NO: 4794323 - DNA, 14 bp, Homo sapiens
ccttaactggccct

SEQ ID NO: 4794324 - DNA, 15 bp, Homo sapiens
ccttaactggccctc

SEQ ID NO: 4794325 - DNA, 18 bp, Homo sapiens
ccttaactggccctcggg

SEQ ID NO: 4794326 - DNA, 20 bp, Homo sapiens
ccttaactggccctcgggcc

SEQ ID NO: 4794327 - DNA, 12 bp, Homo sapiens
ccttaatatttc

SEQ ID NO: 4794328 - DNA, 19 bp, Homo sapiens
ccttaatatttcttcaaat

SEQ ID NO: 4794329 - DNA, 22 bp, Homo sapiens
ccttacaaagccagctctgagc

SEQ ID NO: 4794330 - DNA, 20 bp, Homo sapiens
ccttacacaatggttttctt

SEQ ID NO: 4794331 - DNA, 18 bp, Homo sapiens
ccttagaccaggcaggca

SEQ ID NO: 4794332 - DNA, 18 bp, Homo sapiens
ccttatgcatactgagat

SEQ ID NO: 4794333 - DNA, 12 bp, Homo sapiens
ccttattaaaat

SEQ ID NO: 4794334 - DNA, 13 bp, Homo sapiens
ccttcactctgac

SEQ ID NO: 4794335 - DNA, 20 bp, Homo sapiens
ccttcatctggattccagag

SEQ ID NO: 4794336 - DNA, 17 bp, Homo sapiens
ccttcatgcttttctca

SEQ ID NO: 4794337 - DNA, 21 bp, Homo sapiens
ccttccaccctgccctggcct

SEQ ID NO: 4794338 - DNA, 23 bp, Homo sapiens
ccttccaccctgccctggcctac

SEQ ID NO: 4794339 - DNA, 13 bp, Homo sapiens
ccttccactgcct

SEQ ID NO: 4794340 - DNA, 16 bp, Homo sapiens
ccttccactgcctctg

SEQ ID NO: 4794341 - DNA, 21 bp, Homo sapiens
ccttccacttcagggttctaa

SEQ ID NO: 4794342 - DNA, 13 bp, Homo sapiens
ccttccagacata

SEQ ID NO: 4794343 - DNA, 16 bp, Homo sapiens
ccttccaggacccctg

SEQ ID NO: 4794344 - DNA, 15 bp, Homo sapiens
ccttcccaacctccc

SEQ ID NO: 4794345 - DNA, 17 bp, Homo sapiens
ccttcccaatcagcact

SEQ ID NO: 4794346 - DNA, 16 bp, Homo sapiens
ccttcccagctgctcc

SEQ ID NO: 4794347 - DNA, 21 bp, Homo sapiens
ccttcccctgaggacctttct

SEQ ID NO: 4794348 - DNA, 16 bp, Homo sapiens
ccttcccctgcgccct

SEQ ID NO: 4794349 - DNA, 17 bp, Homo sapiens
ccttcccctgcgccctc

SEQ ID NO: 4794350 - DNA, 22 bp, Homo sapiens
ccttcccctgcgccctccctcc

SEQ ID NO: 4794351 - DNA, 14 bp, Homo sapiens
ccttccccttctgt

SEQ ID NO: 4794352 - DNA, 21 bp, Homo sapiens
ccttccccttctgtgtcacag

SEQ ID NO: 4794353 - DNA, 19 bp, Homo sapiens
ccttcccgcagcaccagcc

SEQ ID NO: 4794354 - DNA, 17 bp, Homo sapiens
ccttccctgacactgtc

SEQ ID NO: 4794355 - DNA, 22 bp, Homo sapiens
ccttcccttcttttcctgggtg

SEQ ID NO: 4794356 - DNA, 14 bp, Homo sapiens
ccttcctcctctca

SEQ ID NO: 4794357 - DNA, 16 bp, Homo sapiens
ccttcctgggcagccc

SEQ ID NO: 4794358 - DNA, 17 bp, Homo sapiens
ccttcctgggcagccca

SEQ ID NO: 4794359 - DNA, 13 bp, Homo sapiens
ccttcctgtcctg

SEQ ID NO: 4794360 - DNA, 15 bp, Homo sapiens
ccttctcagccttgg

SEQ ID NO: 4794361 - DNA, 16 bp, Homo sapiens
ccttctcagccttggt

SEQ ID NO: 4794362 - DNA, 23 bp, Homo sapiens
ccttctcagccttggttcctgat

SEQ ID NO: 4794363 - DNA, 12 bp, Homo sapiens
ccttctccacag

SEQ ID NO: 4794364 - DNA, 17 bp, Homo sapiens
ccttctcccctcagcca

SEQ ID NO: 4794365 - DNA, 16 bp, Homo sapiens
ccttctcccctccaga

SEQ ID NO: 4794366 - DNA, 21 bp, Homo sapiens
ccttctcccctccagacccct

SEQ ID NO: 4794367 - DNA, 15 bp, Homo sapiens
ccttctgacggccct

SEQ ID NO: 4794368 - DNA, 21 bp, Homo sapiens
ccttctgatctgagaagacat

SEQ ID NO: 4794369 - DNA, 15 bp, Homo sapiens
ccttctgatgaaatg

SEQ ID NO: 4794370 - DNA, 19 bp, Homo sapiens
ccttctgcagtcagactga

SEQ ID NO: 4794371 - DNA, 17 bp, Homo sapiens
ccttctggccgctgcag

SEQ ID NO: 4794372 - DNA, 21 bp, Homo sapiens
ccttctggggaggggctccgt

SEQ ID NO: 4794373 - DNA, 17 bp, Homo sapiens
ccttcttcccccagggt

SEQ ID NO: 4794374 - DNA, 14 bp, Homo sapiens
ccttctttccttcc

SEQ ID NO: 4794375 - DNA, 13 bp, Homo sapiens
ccttcttttcctg

SEQ ID NO: 4794376 - DNA, 17 bp, Homo sapiens
ccttgaccccacacgcc

SEQ ID NO: 4794377 - DNA, 22 bp, Homo sapiens
ccttgaccttcctctggggctc

SEQ ID NO: 4794378 - DNA, 18 bp, Homo sapiens
ccttgagccgtgacctcc

SEQ ID NO: 4794379 - DNA, 20 bp, Homo sapiens
ccttgagtagtttttatctg

SEQ ID NO: 4794380 - DNA, 13 bp, Homo sapiens
ccttgatggggtg

SEQ ID NO: 4794381 - DNA, 17 bp, Homo sapiens
ccttgccacaatcacta

SEQ ID NO: 4794382 - DNA, 15 bp, Homo sapiens
ccttgcttccttctc

SEQ ID NO: 4794383 - DNA, 18 bp, Homo sapiens
ccttgctttctcttctaa

SEQ ID NO: 4794384 - DNA, 17 bp, Homo sapiens
ccttggacctagaggat

SEQ ID NO: 4794385 - DNA, 14 bp, Homo sapiens
ccttggatttttga

SEQ ID NO: 4794386 - DNA, 14 bp, Homo sapiens
ccttggcaccaaag

SEQ ID NO: 4794387 - DNA, 16 bp, Homo sapiens
ccttggcaccaaagat

SEQ ID NO: 4794388 - DNA, 20 bp, Homo sapiens
ccttggcaccaaagatgcag

SEQ ID NO: 4794389 - DNA, 23 bp, Homo sapiens
ccttggcaccaaagatgcagccg

SEQ ID NO: 4794390 - DNA, 14 bp, Homo sapiens
ccttggcccagcag

SEQ ID NO: 4794391 - DNA, 23 bp, Homo sapiens
ccttggcccagcagcggcccaga

SEQ ID NO: 4794392 - DNA, 15 bp, Homo sapiens
ccttggcctagccca

SEQ ID NO: 4794393 - DNA, 14 bp, Homo sapiens
ccttgggcacggga

SEQ ID NO: 4794394 - DNA, 17 bp, Homo sapiens
ccttgggcacgggagag

SEQ ID NO: 4794395 - DNA, 18 bp, Homo sapiens
ccttgggcacgggagagc

SEQ ID NO: 4794396 - DNA, 22 bp, Homo sapiens
ccttgtacagaaccagcactcc

SEQ ID NO: 4794397 - DNA, 21 bp, Homo sapiens
ccttgtagacgcacctgctga

SEQ ID NO: 4794398 - DNA, 15 bp, Homo sapiens
ccttgtctaaagatc

SEQ ID NO: 4794399 - DNA, 20 bp, Homo sapiens
ccttgtgtatcctgacagcg

SEQ ID NO: 4794400 - DNA, 14 bp, Homo sapiens
cctttaagagaaat

SEQ ID NO: 4794401 - DNA, 22 bp, Homo sapiens
cctttacagctctcctccagcc

SEQ ID NO: 4794402 - DNA, 15 bp, Homo sapiens
cctttagaatattaa

SEQ ID NO: 4794403 - DNA, 18 bp, Homo sapiens
cctttatcatgtgtttct

SEQ ID NO: 4794404 - DNA, 14 bp, Homo sapiens
cctttatttattaa

SEQ ID NO: 4794405 - DNA, 18 bp, Homo sapiens
cctttatttattaaactt

SEQ ID NO: 4794406 - DNA, 21 bp, Homo sapiens
cctttattttaaatgatctgt

SEQ ID NO: 4794407 - DNA, 15 bp, Homo sapiens
cctttcatcctcagc

SEQ ID NO: 4794408 - DNA, 18 bp, Homo sapiens
cctttcatcctcagcaag

SEQ ID NO: 4794409 - DNA, 22 bp, Homo sapiens
cctttccctccgaacgctgctc

SEQ ID NO: 4794410 - DNA, 14 bp, Homo sapiens
cctttccctgcatc

SEQ ID NO: 4794411 - DNA, 18 bp, Homo sapiens
cctttccctgcatccctt

SEQ ID NO: 4794412 - DNA, 14 bp, Homo sapiens
cctttccgctgtcg

SEQ ID NO: 4794413 - DNA, 16 bp, Homo sapiens
cctttccgctgtcgcc

SEQ ID NO: 4794414 - DNA, 12 bp, Homo sapiens
cctttctggaat

SEQ ID NO: 4794415 - DNA, 14 bp, Homo sapiens
cctttcttccttcc

SEQ ID NO: 4794416 - DNA, 17 bp, Homo sapiens
cctttcttccttccttt

SEQ ID NO: 4794417 - DNA, 21 bp, Homo sapiens
cctttcttttgaatcaatctg

SEQ ID NO: 4794418 - DNA, 19 bp, Homo sapiens
cctttggttccccgcgaag

SEQ ID NO: 4794419 - DNA, 21 bp, Homo sapiens
cctttgtctcacgattccagt

SEQ ID NO: 4794420 - DNA, 15 bp, Homo sapiens
ccttttctattcctt

SEQ ID NO: 4794421 - DNA, 17 bp, Homo sapiens
ccttttgagtgccttac

SEQ ID NO: 4794422 - DNA, 20 bp, Homo sapiens
ccttttgcttcatctggagt

SEQ ID NO: 4794423 - DNA, 18 bp, Homo sapiens
ccttttgggtttgcctta

SEQ ID NO: 4794424 - DNA, 15 bp, Homo sapiens
cctttttaatccagg

SEQ ID NO: 4794425 - DNA, 18 bp, Homo sapiens
ccttttttattgaataac

SEQ ID NO: 4794426 - DNA, 17 bp, Homo sapiens
cgaaacccttgactgtt

SEQ ID NO: 4794427 - DNA, 13 bp, Homo sapiens
cgaaatgaaaatg

SEQ ID NO: 4794428 - DNA, 22 bp, Homo sapiens
cgaaatgaaaatggctgaagaa

SEQ ID NO: 4794429 - DNA, 23 bp, Homo sapiens
cgaaccgtgagcaggaaggcctg

SEQ ID NO: 4794430 - DNA, 21 bp, Homo sapiens
cgaacgctgctccatgcacag

SEQ ID NO: 4794431 - DNA, 23 bp, Homo sapiens
cgaactcgggattacagaaacac

SEQ ID NO: 4794432 - DNA, 18 bp, Homo sapiens
cgaagatttcatccagaa

SEQ ID NO: 4794433 - DNA, 14 bp, Homo sapiens
cgaagccagtccag

SEQ ID NO: 4794434 - DNA, 15 bp, Homo sapiens
cgaagggcagccccg

SEQ ID NO: 4794435 - DNA, 17 bp, Homo sapiens
cgaagtccgaggcctgg

SEQ ID NO: 4794436 - DNA, 16 bp, Homo sapiens
cgaagtgcaatgatag

SEQ ID NO: 4794437 - DNA, 17 bp, Homo sapiens
cgaatattgagcaatat

SEQ ID NO: 4794438 - DNA, 21 bp, Homo sapiens
cgaatcactcatttatttcca

SEQ ID NO: 4794439 - DNA, 13 bp, Homo sapiens
cgacacaggctgc

SEQ ID NO: 4794440 - DNA, 16 bp, Homo sapiens
cgacacaggctgccgc

SEQ ID NO: 4794441 - DNA, 20 bp, Homo sapiens
cgacctaaacagctgcttta

SEQ ID NO: 4794442 - DNA, 12 bp, Homo sapiens
cgacctggctga

SEQ ID NO: 4794443 - DNA, 20 bp, Homo sapiens
cgactttctttaacatatca

SEQ ID NO: 4794444 - DNA, 12 bp, Homo sapiens
cgagagggctga

SEQ ID NO: 4794445 - DNA, 16 bp, Homo sapiens
cgagagggctgagccc

SEQ ID NO: 4794446 - DNA, 18 bp, Homo sapiens
cgagatagccaaggccaa

SEQ ID NO: 4794447 - DNA, 18 bp, Homo sapiens
cgagcagagcgcagcccc

SEQ ID NO: 4794448 - DNA, 22 bp, Homo sapiens
cgagcagagcgcagcccccacg

SEQ ID NO: 4794449 - DNA, 21 bp, Homo sapiens
cgagctctgtagcctggtctg

SEQ ID NO: 4794450 - DNA, 13 bp, Homo sapiens
cgaggccagggcc

SEQ ID NO: 4794451 - DNA, 13 bp, Homo sapiens
cgaggcctggctc

SEQ ID NO: 4794452 - DNA, 15 bp, Homo sapiens
cgaggcctggctctg

SEQ ID NO: 4794453 - DNA, 19 bp, Homo sapiens
cgaggcctggctctggagc

SEQ ID NO: 4794454 - DNA, 15 bp, Homo sapiens
cgagggcgcctgggt

SEQ ID NO: 4794455 - DNA, 16 bp, Homo sapiens
cgagggcgcctgggtc

SEQ ID NO: 4794456 - DNA, 15 bp, Homo sapiens
cgagtcaccttccag

SEQ ID NO: 4794457 - DNA, 17 bp, Homo sapiens
cgagtgagctaccagga

SEQ ID NO: 4794458 - DNA, 19 bp, Homo sapiens
cgagtgagctaccaggaag

SEQ ID NO: 4794459 - DNA, 19 bp, Homo sapiens
cgagtggcgagtccagaca

SEQ ID NO: 4794460 - DNA, 17 bp, Homo sapiens
cgagtgtagtcccggag

SEQ ID NO: 4794461 - DNA, 18 bp, Homo sapiens
cgagttacagacaaagcg

SEQ ID NO: 4794462 - DNA, 15 bp, Homo sapiens
cgatataagccatag

SEQ ID NO: 4794463 - DNA, 22 bp, Homo sapiens
cgatataagccatagccccagg

SEQ ID NO: 4794464 - DNA, 18 bp, Homo sapiens
cgatcatatctgtatgcc

SEQ ID NO: 4794465 - DNA, 21 bp, Homo sapiens
cgatccccatggaacagccct

SEQ ID NO: 4794466 - DNA, 14 bp, Homo sapiens
cgatgcgtggctcc

SEQ ID NO: 4794467 - DNA, 18 bp, Homo sapiens
cgatgggggatgcttcat

SEQ ID NO: 4794468 - DNA, 19 bp, Homo sapiens
cgatgggggatgcttcatg

SEQ ID NO: 4794469 - DNA, 23 bp, Homo sapiens
cgatgtggacctctactttccag

SEQ ID NO: 4794470 - DNA, 11 bp, Homo sapiens
cgattccagtg

SEQ ID NO: 4794471 - DNA, 19 bp, Homo sapiens
cgattcttccttgccacaa

SEQ ID NO: 4794472 - DNA, 20 bp, Homo sapiens
cgcaaatacatgcctttcca

SEQ ID NO: 4794473 - DNA, 20 bp, Homo sapiens
cgcaacagctgtgtgtgccc

SEQ ID NO: 4794474 - DNA, 21 bp, Homo sapiens
cgcaagcgacacaggctgccg

SEQ ID NO: 4794475 - DNA, 21 bp, Homo sapiens
cgcaatatgggaggaacaaag

SEQ ID NO: 4794476 - DNA, 13 bp, Homo sapiens
cgcaatgtggcat

SEQ ID NO: 4794477 - DNA, 15 bp, Homo sapiens
cgcacaacatgcaca

SEQ ID NO: 4794478 - DNA, 22 bp, Homo sapiens
cgcacaccctcactctgccagg

SEQ ID NO: 4794479 - DNA, 15 bp, Homo sapiens
cgcacagcagcctgc

SEQ ID NO: 4794480 - DNA, 22 bp, Homo sapiens
cgcaccccgatgtggacctcta

SEQ ID NO: 4794481 - DNA, 17 bp, Homo sapiens
cgcaccgggctggcctg

SEQ ID NO: 4794482 - DNA, 13 bp, Homo sapiens
cgcactcaggagc

SEQ ID NO: 4794483 - DNA, 14 bp, Homo sapiens
cgcagagccccgga

SEQ ID NO: 4794484 - DNA, 22 bp, Homo sapiens
cgcagaggtggggtgctggggc

SEQ ID NO: 4794485 - DNA, 12 bp, Homo sapiens
cgcagcaccagc

SEQ ID NO: 4794486 - DNA, 22 bp, Homo sapiens
cgcagcgggcgcgggacaggac

SEQ ID NO: 4794487 - DNA, 14 bp, Homo sapiens
cgcagcggggtagg

SEQ ID NO: 4794488 - DNA, 23 bp, Homo sapiens
cgcagggcgctccggcagaggca

SEQ ID NO: 4794489 - DNA, 21 bp, Homo sapiens
cgcaggggcccctcctccaga

SEQ ID NO: 4794490 - DNA, 22 bp, Homo sapiens
cgcatagtgtgctcggacacag

SEQ ID NO: 4794491 - DNA, 23 bp, Homo sapiens
cgcatagtgtgctcggacacagt

SEQ ID NO: 4794492 - DNA, 21 bp, Homo sapiens
cgcatgctgcctgcctccggc

SEQ ID NO: 4794493 - DNA, 23 bp, Homo sapiens
cgcatgctgcctgcctccggccc

SEQ ID NO: 4794494 - DNA, 13 bp, Homo sapiens
cgcattccagggg

SEQ ID NO: 4794495 - DNA, 14 bp, Homo sapiens
cgcatttcatcaag

SEQ ID NO: 4794496 - DNA, 21 bp, Homo sapiens
cgccagagtgtcctgctacct

SEQ ID NO: 4794497 - DNA, 21 bp, Homo sapiens
cgccagccctgttccgcctca

SEQ ID NO: 4794498 - DNA, 12 bp, Homo sapiens
cgccattccagg

SEQ ID NO: 4794499 - DNA, 14 bp, Homo sapiens
cgccattggcctta

SEQ ID NO: 4794500 - DNA, 22 bp, Homo sapiens
cgccattggccttaactggccc

SEQ ID NO: 4794501 - DNA, 23 bp, Homo sapiens
cgccattggccttaactggccct

SEQ ID NO: 4794502 - DNA, 13 bp, Homo sapiens
cgcccacccacac

SEQ ID NO: 4794503 - DNA, 14 bp, Homo sapiens
cgcccacccagcag

SEQ ID NO: 4794504 - DNA, 10 bp, Homo sapiens
cgcccacccc

SEQ ID NO: 4794505 - DNA, 14 bp, Homo sapiens
cgcccaccccgctg

SEQ ID NO: 4794506 - DNA, 16 bp, Homo sapiens
cgcccaccccgctgcc

SEQ ID NO: 4794507 - DNA, 14 bp, Homo sapiens
cgcccacctgccca

SEQ ID NO: 4794508 - DNA, 15 bp, Homo sapiens
cgcccacctgggccc

SEQ ID NO: 4794509 - DNA, 16 bp, Homo sapiens
cgcccacctgggccct

SEQ ID NO: 4794510 - DNA, 22 bp, Homo sapiens
cgcccacgcggctgctgcttct

SEQ ID NO: 4794511 - DNA, 13 bp, Homo sapiens
cgcccagccccca

SEQ ID NO: 4794512 - DNA, 14 bp, Homo sapiens
cgcccaggccatca

SEQ ID NO: 4794513 - DNA, 14 bp, Homo sapiens
cgccccagagactg

SEQ ID NO: 4794514 - DNA, 16 bp, Homo sapiens
cgccccagagactgcc

SEQ ID NO: 4794515 - DNA, 17 bp, Homo sapiens
cgccccagagactgccc

SEQ ID NO: 4794516 - DNA, 20 bp, Homo sapiens
cgccccagagactgcccacc

SEQ ID NO: 4794517 - DNA, 22 bp, Homo sapiens
cgccccagagactgcccaccct

SEQ ID NO: 4794518 - DNA, 23 bp, Homo sapiens
cgccccagagactgcccaccctg

SEQ ID NO: 4794519 - DNA, 21 bp, Homo sapiens
cgccccagcgacgcggcccgc

SEQ ID NO: 4794520 - DNA, 12 bp, Homo sapiens
cgccccaggccc

SEQ ID NO: 4794521 - DNA, 23 bp, Homo sapiens
cgcccccacccctacagcctgca

SEQ ID NO: 4794522 - DNA, 12 bp, Homo sapiens
cgccccccgccc

SEQ ID NO: 4794523 - DNA, 19 bp, Homo sapiens
cgccccccggcctggcccc

SEQ ID NO: 4794524 - DNA, 16 bp, Homo sapiens
cgcccccgcccaggcc

SEQ ID NO: 4794525 - DNA, 14 bp, Homo sapiens
cgccccgcccccac

SEQ ID NO: 4794526 - DNA, 16 bp, Homo sapiens
cgccccggacagggtg

SEQ ID NO: 4794527 - DNA, 16 bp, Homo sapiens
cgccccgggccgcgag

SEQ ID NO: 4794528 - DNA, 10 bp, Homo sapiens
cgcccctccc

SEQ ID NO: 4794529 - DNA, 17 bp, Homo sapiens
cgcccctccgggcagag

SEQ ID NO: 4794530 - DNA, 13 bp, Homo sapiens
cgcccctcctcgg

SEQ ID NO: 4794531 - DNA, 14 bp, Homo sapiens
cgcccctcctcggg

SEQ ID NO: 4794532 - DNA, 13 bp, Homo sapiens
cgcccctctgcgc

SEQ ID NO: 4794533 - DNA, 14 bp, Homo sapiens
cgcccctctgcgcc

SEQ ID NO: 4794534 - DNA, 12 bp, Homo sapiens
cgcccctgccca

SEQ ID NO: 4794535 - DNA, 15 bp, Homo sapiens
cgcccctgcccagca

SEQ ID NO: 4794536 - DNA, 18 bp, Homo sapiens
cgcccctgcccagcacct

SEQ ID NO: 4794537 - DNA, 12 bp, Homo sapiens
cgcccctgcctg

SEQ ID NO: 4794538 - DNA, 19 bp, Homo sapiens
cgcccgaggccagggccgc

SEQ ID NO: 4794539 - DNA, 22 bp, Homo sapiens
cgcccgcccaccccgctgcctg

SEQ ID NO: 4794540 - DNA, 23 bp, Homo sapiens
cgcccgcccccgccctcgctccg

SEQ ID NO: 4794541 - DNA, 21 bp, Homo sapiens
cgcccgccctcctctgccccc

SEQ ID NO: 4794542 - DNA, 21 bp, Homo sapiens
cgcccgccggttggccggctg

SEQ ID NO: 4794543 - DNA, 14 bp, Homo sapiens
cgcccggcctccta

SEQ ID NO: 4794544 - DNA, 11 bp, Homo sapiens
cgccctccctc

SEQ ID NO: 4794545 - DNA, 21 bp, Homo sapiens
cgccctccctccctccacacc

SEQ ID NO: 4794546 - DNA, 10 bp, Homo sapiens
cgccctcctc

SEQ ID NO: 4794547 - DNA, 11 bp, Homo sapiens
cgccctcctct

SEQ ID NO: 4794548 - DNA, 12 bp, Homo sapiens
cgccctgcccgc

SEQ ID NO: 4794549 - DNA, 20 bp, Homo sapiens
cgcccttccctgacactgtc

SEQ ID NO: 4794550 - DNA, 18 bp, Homo sapiens
cgccctttccttgccttc

SEQ ID NO: 4794551 - DNA, 17 bp, Homo sapiens
cgccgatataagccata

SEQ ID NO: 4794552 - DNA, 20 bp, Homo sapiens
cgccgatataagccatagcc

SEQ ID NO: 4794553 - DNA, 16 bp, Homo sapiens
cgccgcctccctcacc

SEQ ID NO: 4794554 - DNA, 16 bp, Homo sapiens
cgccgcctcgggccgc

SEQ ID NO: 4794555 - DNA, 13 bp, Homo sapiens
cgccggcgccccg

SEQ ID NO: 4794556 - DNA, 14 bp, Homo sapiens
cgccggcgccccgg

SEQ ID NO: 4794557 - DNA, 17 bp, Homo sapiens
cgccggggctggccctg

SEQ ID NO: 4794558 - DNA, 22 bp, Homo sapiens
cgccggggctggccctgccctc

SEQ ID NO: 4794559 - DNA, 21 bp, Homo sapiens
cgccggttggccggctggccg

SEQ ID NO: 4794560 - DNA, 12 bp, Homo sapiens
cgcctcactggg

SEQ ID NO: 4794561 - DNA, 13 bp, Homo sapiens
cgcctccatccac

SEQ ID NO: 4794562 - DNA, 14 bp, Homo sapiens
cgcctcccgccgcc

SEQ ID NO: 4794563 - DNA, 20 bp, Homo sapiens
cgcctcccgccgcctcgggc

SEQ ID NO: 4794564 - DNA, 14 bp, Homo sapiens
cgcctcctccagac

SEQ ID NO: 4794565 - DNA, 14 bp, Homo sapiens
cgcctcctggccag

SEQ ID NO: 4794566 - DNA, 15 bp, Homo sapiens
cgcctcctggccaga

SEQ ID NO: 4794567 - DNA, 22 bp, Homo sapiens
cgcctcgggccgcctcctccag

SEQ ID NO: 4794568 - DNA, 12 bp, Homo sapiens
cgcctgcccgcc

SEQ ID NO: 4794569 - DNA, 15 bp, Homo sapiens
cgcctgcgcctcctc

SEQ ID NO: 4794570 - DNA, 18 bp, Homo sapiens
cgcctgcgcctcctcctg

SEQ ID NO: 4794571 - DNA, 20 bp, Homo sapiens
cgcctgcgcctcctcctgca

SEQ ID NO: 4794572 - DNA, 17 bp, Homo sapiens
cgcctgcgctcctctgc

SEQ ID NO: 4794573 - DNA, 20 bp, Homo sapiens
cgcctgcgctcctctgcagc

SEQ ID NO: 4794574 - DNA, 20 bp, Homo sapiens
cgcctgggaaattgctccat

SEQ ID NO: 4794575 - DNA, 13 bp, Homo sapiens
cgcgaccacccct

SEQ ID NO: 4794576 - DNA, 21 bp, Homo sapiens
cgcgcaccgcccaacccccac

SEQ ID NO: 4794577 - DNA, 12 bp, Homo sapiens
cgcgcagctggc

SEQ ID NO: 4794578 - DNA, 17 bp, Homo sapiens
cgcgcccccaggacccc

SEQ ID NO: 4794579 - DNA, 11 bp, Homo sapiens
cgcgcccctgt

SEQ ID NO: 4794580 - DNA, 19 bp, Homo sapiens
cgcgcccctgtccatccgt

SEQ ID NO: 4794581 - DNA, 13 bp, Homo sapiens
cgcgcgcccccag

SEQ ID NO: 4794582 - DNA, 14 bp, Homo sapiens
cgcgcgcccccagg

SEQ ID NO: 4794583 - DNA, 21 bp, Homo sapiens
cgcgcgcccccaggacccccc

SEQ ID NO: 4794584 - DNA, 19 bp, Homo sapiens
cgcgcgggacagcggcccc

SEQ ID NO: 4794585 - DNA, 13 bp, Homo sapiens
cgcgcgtgccccc

SEQ ID NO: 4794586 - DNA, 19 bp, Homo sapiens
cgcgcgttcgcggcggtgg

SEQ ID NO: 4794587 - DNA, 13 bp, Homo sapiens
cgcgctctgcccc

SEQ ID NO: 4794588 - DNA, 16 bp, Homo sapiens
cgcgctctgcccctcc

SEQ ID NO: 4794589 - DNA, 16 bp, Homo sapiens
cgcggagcccccgccc

SEQ ID NO: 4794590 - DNA, 13 bp, Homo sapiens
cgcgggacaggac

SEQ ID NO: 4794591 - DNA, 22 bp, Homo sapiens
cgcgggcgagaagggcgcagga

SEQ ID NO: 4794592 - DNA, 20 bp, Homo sapiens
cgcgtccacatacactgcat

SEQ ID NO: 4794593 - DNA, 12 bp, Homo sapiens
cgcgtgccccca

SEQ ID NO: 4794594 - DNA, 15 bp, Homo sapiens
cgcgtggttctgcca

SEQ ID NO: 4794595 - DNA, 18 bp, Homo sapiens
cgctattcccaggcaggg

SEQ ID NO: 4794596 - DNA, 23 bp, Homo sapiens
cgctcagaagagggaactaagca

SEQ ID NO: 4794597 - DNA, 14 bp, Homo sapiens
cgctcccctctgcc

SEQ ID NO: 4794598 - DNA, 21 bp, Homo sapiens
cgctccggcagaggcagggcc

SEQ ID NO: 4794599 - DNA, 20 bp, Homo sapiens
cgctcctctgcagcctgagc

SEQ ID NO: 4794600 - DNA, 23 bp, Homo sapiens
cgctcctctgcagcctgagctcc

SEQ ID NO: 4794601 - DNA, 12 bp, Homo sapiens
cgctctgcccct

SEQ ID NO: 4794602 - DNA, 13 bp, Homo sapiens
cgctctgcccctc

SEQ ID NO: 4794603 - DNA, 20 bp, Homo sapiens
cgctctgcccctccgtcccc

SEQ ID NO: 4794604 - DNA, 23 bp, Homo sapiens
cgctcttcaccaggaagaaggcc

SEQ ID NO: 4794605 - DNA, 18 bp, Homo sapiens
cgctgcagtcagcacaga

SEQ ID NO: 4794606 - DNA, 13 bp, Homo sapiens
cgctgccacccac

SEQ ID NO: 4794607 - DNA, 16 bp, Homo sapiens
cgctgccacccacccc

SEQ ID NO: 4794608 - DNA, 14 bp, Homo sapiens
cgctgcccccacag

SEQ ID NO: 4794609 - DNA, 19 bp, Homo sapiens
cgctgcccctggcagcccc

SEQ ID NO: 4794610 - DNA, 12 bp, Homo sapiens
cgctgcctggcg

SEQ ID NO: 4794611 - DNA, 18 bp, Homo sapiens
cgctgcctggcgggcagc

SEQ ID NO: 4794612 - DNA, 15 bp, Homo sapiens
cgctgctctcccagg

SEQ ID NO: 4794613 - DNA, 21 bp, Homo sapiens
cgctgcttgagtggacagcag

SEQ ID NO: 4794614 - DNA, 15 bp, Homo sapiens
cgctggagaccctgc

SEQ ID NO: 4794615 - DNA, 19 bp, Homo sapiens
cgctggagaccctgcgccc

SEQ ID NO: 4794616 - DNA, 22 bp, Homo sapiens
cgctggagaccctgcgcccctg

SEQ ID NO: 4794617 - DNA, 14 bp, Homo sapiens
cgctgtatgattta

SEQ ID NO: 4794618 - DNA, 22 bp, Homo sapiens
cgctgtcagccattcctgttcc

SEQ ID NO: 4794619 - DNA, 15 bp, Homo sapiens
cgctgtccgtcctgc

SEQ ID NO: 4794620 - DNA, 17 bp, Homo sapiens
cgctgtcgccccaggcc

SEQ ID NO: 4794621 - DNA, 18 bp, Homo sapiens
cgctgtcgccccaggccc

SEQ ID NO: 4794622 - DNA, 19 bp, Homo sapiens
cgctgtgatgcatgagctc

SEQ ID NO: 4794623 - DNA, 23 bp, Homo sapiens
cgcttaaacatttccctgctgag

SEQ ID NO: 4794624 - DNA, 16 bp, Homo sapiens
cgcttcataggcagag

SEQ ID NO: 4794625 - DNA, 16 bp, Homo sapiens
cgcttctcctgcagtc

SEQ ID NO: 4794626 - DNA, 13 bp, Homo sapiens
cggaacaggagtg

SEQ ID NO: 4794627 - DNA, 20 bp, Homo sapiens
cggaaggggcgctcctccca

SEQ ID NO: 4794628 - DNA, 22 bp, Homo sapiens
cggaaggggcgctcctcccagc

SEQ ID NO: 4794629 - DNA, 23 bp, Homo sapiens
cggaaggggcgctcctcccagct

SEQ ID NO: 4794630 - DNA, 23 bp, Homo sapiens
cggaattccacctggaaagccag

SEQ ID NO: 4794631 - DNA, 15 bp, Homo sapiens
cggaccggagcggct

SEQ ID NO: 4794632 - DNA, 14 bp, Homo sapiens
cggacgccccccgg

SEQ ID NO: 4794633 - DNA, 13 bp, Homo sapiens
cggacgctggctc

SEQ ID NO: 4794634 - DNA, 14 bp, Homo sapiens
cggacgctggctcg

SEQ ID NO: 4794635 - DNA, 16 bp, Homo sapiens
cggacgggacagcggc

SEQ ID NO: 4794636 - DNA, 20 bp, Homo sapiens
cggactgaccgaagggacgg

SEQ ID NO: 4794637 - DNA, 20 bp, Homo sapiens
cggactttgcaggagttcct

SEQ ID NO: 4794638 - DNA, 15 bp, Homo sapiens
cggagaggaccccat

SEQ ID NO: 4794639 - DNA, 20 bp, Homo sapiens
cggagatgcatctgtggcct

SEQ ID NO: 4794640 - DNA, 15 bp, Homo sapiens
cggagcccccgcccc

SEQ ID NO: 4794641 - DNA, 19 bp, Homo sapiens
cggagcccccgcccctccc

SEQ ID NO: 4794642 - DNA, 22 bp, Homo sapiens
cggagcccccgcccctccccct

SEQ ID NO: 4794643 - DNA, 13 bp, Homo sapiens
cggagcggctgag

SEQ ID NO: 4794644 - DNA, 15 bp, Homo sapiens
cggagcggctgagga

SEQ ID NO: 4794645 - DNA, 15 bp, Homo sapiens
cggaggcaggaccag

SEQ ID NO: 4794646 - DNA, 14 bp, Homo sapiens
cggaggccttccct

SEQ ID NO: 4794647 - DNA, 15 bp, Homo sapiens
cggaggccttccctt

SEQ ID NO: 4794648 - DNA, 15 bp, Homo sapiens
cggaggcgcccacct

SEQ ID NO: 4794649 - DNA, 20 bp, Homo sapiens
cggaggcgcccacctgccca

SEQ ID NO: 4794650 - DNA, 22 bp, Homo sapiens
cggaggcgcccacctgcccagt

SEQ ID NO: 4794651 - DNA, 19 bp, Homo sapiens
cggaggctgggcccctggg

SEQ ID NO: 4794652 - DNA, 20 bp, Homo sapiens
cggaggctgggcccctggga

SEQ ID NO: 4794653 - DNA, 18 bp, Homo sapiens
cggagtttccatttggat

SEQ ID NO: 4794654 - DNA, 17 bp, Homo sapiens
cggatctccaggcccag

SEQ ID NO: 4794655 - DNA, 19 bp, Homo sapiens
cggatctccaggcccagcc

SEQ ID NO: 4794656 - DNA, 17 bp, Homo sapiens
cggcaaggggcgcgcgc

SEQ ID NO: 4794657 - DNA, 14 bp, Homo sapiens
cggcaccgcccacc

SEQ ID NO: 4794658 - DNA, 15 bp, Homo sapiens
cggcaccgcccaccc

SEQ ID NO: 4794659 - DNA, 13 bp, Homo sapiens
cggcaccttcccc

SEQ ID NO: 4794660 - DNA, 14 bp, Homo sapiens
cggcagaggcaggg

SEQ ID NO: 4794661 - DNA, 18 bp, Homo sapiens
cggcagaggcagggccct

SEQ ID NO: 4794662 - DNA, 19 bp, Homo sapiens
cggcagaggcagggccctg

SEQ ID NO: 4794663 - DNA, 24 bp, Homo sapiens
cggcagaggcagggccctggggtc

SEQ ID NO: 4794664 - DNA, 11 bp, Homo sapiens
cggcagcccca

SEQ ID NO: 4794665 - DNA, 12 bp, Homo sapiens
cggcaggccctg

SEQ ID NO: 4794666 - DNA, 13 bp, Homo sapiens
cggcaggccctgc

SEQ ID NO: 4794667 - DNA, 16 bp, Homo sapiens
cggcaggccctgcagt

SEQ ID NO: 4794668 - DNA, 13 bp, Homo sapiens
cggcatccgagcc

SEQ ID NO: 4794669 - DNA, 16 bp, Homo sapiens
cggcatccgagcccct

SEQ ID NO: 4794670 - DNA, 18 bp, Homo sapiens
cggcatccgagcccctgt

SEQ ID NO: 4794671 - DNA, 16 bp, Homo sapiens
cggccaaggacactga

SEQ ID NO: 4794672 - DNA, 20 bp, Homo sapiens
cggccactagtggggtcctg

SEQ ID NO: 4794673 - DNA, 14 bp, Homo sapiens
cggccactgcaacc

SEQ ID NO: 4794674 - DNA, 19 bp, Homo sapiens
cggccaggcacggaggctc

SEQ ID NO: 4794675 - DNA, 22 bp, Homo sapiens
cggccattgaacactgcaccct

SEQ ID NO: 4794676 - DNA, 22 bp, Homo sapiens
cggcccacgcagagccccggag

SEQ ID NO: 4794677 - DNA, 12 bp, Homo sapiens
cggcccccctct

SEQ ID NO: 4794678 - DNA, 16 bp, Homo sapiens
cggccccgcgcgtgcc

SEQ ID NO: 4794679 - DNA, 20 bp, Homo sapiens
cggccccgcggagcccccgc

SEQ ID NO: 4794680 - DNA, 15 bp, Homo sapiens
cggcccgccaccttg

SEQ ID NO: 4794681 - DNA, 17 bp, Homo sapiens
cggcccggcccacgcag

SEQ ID NO: 4794682 - DNA, 15 bp, Homo sapiens
cggcccgtgcgcagc

SEQ ID NO: 4794683 - DNA, 22 bp, Homo sapiens
cggccctgcaatgtatcccttc

SEQ ID NO: 4794684 - DNA, 16 bp, Homo sapiens
cggccctgtagccctg

SEQ ID NO: 4794685 - DNA, 18 bp, Homo sapiens
cggccctgtagccctggc

SEQ ID NO: 4794686 - DNA, 13 bp, Homo sapiens
cggccgctctccg

SEQ ID NO: 4794687 - DNA, 14 bp, Homo sapiens
cggccgctctccgc

SEQ ID NO: 4794688 - DNA, 19 bp, Homo sapiens
cggcctcttgagagcccca

SEQ ID NO: 4794689 - DNA, 14 bp, Homo sapiens
cggcctgcagccca

SEQ ID NO: 4794690 - DNA, 18 bp, Homo sapiens
cggcctgcagcccagaac

SEQ ID NO: 4794691 - DNA, 19 bp, Homo sapiens
cggcgtccctgagggccct

SEQ ID NO: 4794692 - DNA, 23 bp, Homo sapiens
cggcgtccctgagggcccttccc

SEQ ID NO: 4794693 - DNA, 15 bp, Homo sapiens
cggctaagaggctgc

SEQ ID NO: 4794694 - DNA, 16 bp, Homo sapiens
cggctaagaggctgct

SEQ ID NO: 4794695 - DNA, 24 bp, Homo sapiens
cggctcggcctcttgagagcccca

SEQ ID NO: 4794696 - DNA, 17 bp, Homo sapiens
cggctctgaggctgccc

SEQ ID NO: 4794697 - DNA, 19 bp, Homo sapiens
cggctctgaggctgcccca

SEQ ID NO: 4794698 - DNA, 22 bp, Homo sapiens
cggctgaggacggggcagagct

SEQ ID NO: 4794699 - DNA, 18 bp, Homo sapiens
cggctggaccacgtctcc

SEQ ID NO: 4794700 - DNA, 14 bp, Homo sapiens
cggctggccggtcc

SEQ ID NO: 4794701 - DNA, 12 bp, Homo sapiens
cggctgggcagg

SEQ ID NO: 4794702 - DNA, 18 bp, Homo sapiens
cgggaaaggcatctaaga

SEQ ID NO: 4794703 - DNA, 15 bp, Homo sapiens
cgggacagcggcccc

SEQ ID NO: 4794704 - DNA, 13 bp, Homo sapiens
cgggacaggactt

SEQ ID NO: 4794705 - DNA, 16 bp, Homo sapiens
cgggactacagaagtg

SEQ ID NO: 4794706 - DNA, 16 bp, Homo sapiens
cgggagagcgccaccc

SEQ ID NO: 4794707 - DNA, 17 bp, Homo sapiens
cgggagagcgccacccg

SEQ ID NO: 4794708 - DNA, 16 bp, Homo sapiens
cgggagccgcaggggc

SEQ ID NO: 4794709 - DNA, 19 bp, Homo sapiens
cgggagcctccccctcaga

SEQ ID NO: 4794710 - DNA, 12 bp, Homo sapiens
cgggaggaggat

SEQ ID NO: 4794711 - DNA, 17 bp, Homo sapiens
cgggagtctcctcactg

SEQ ID NO: 4794712 - DNA, 20 bp, Homo sapiens
cgggagtctcctcactgcca

SEQ ID NO: 4794713 - DNA, 13 bp, Homo sapiens
cgggatggttggt

SEQ ID NO: 4794714 - DNA, 17 bp, Homo sapiens
cgggattacagaaacac

SEQ ID NO: 4794715 - DNA, 21 bp, Homo sapiens
cgggcacccccggacgccccc

SEQ ID NO: 4794716 - DNA, 15 bp, Homo sapiens
cgggcagagaccacc

SEQ ID NO: 4794717 - DNA, 20 bp, Homo sapiens
cgggcagagaccaccgcgcc

SEQ ID NO: 4794718 - DNA, 14 bp, Homo sapiens
cgggcagcccctgc

SEQ ID NO: 4794719 - DNA, 21 bp, Homo sapiens
cgggcagcccctgctggacca

SEQ ID NO: 4794720 - DNA, 17 bp, Homo sapiens
cgggcaggtcctgccca

SEQ ID NO: 4794721 - DNA, 17 bp, Homo sapiens
cgggccagggcgtggct

SEQ ID NO: 4794722 - DNA, 21 bp, Homo sapiens
cgggcccgctcaacctctcag

SEQ ID NO: 4794723 - DNA, 15 bp, Homo sapiens
cgggccgcctcctcc

SEQ ID NO: 4794724 - DNA, 13 bp, Homo sapiens
ccatccaccctga

SEQ ID NO: 4794725 - DNA, 23 bp, Homo sapiens
ccatcccaaacccttcagtgcca

SEQ ID NO: 4794726 - DNA, 14 bp, Homo sapiens
ccatcccactgata

SEQ ID NO: 4794727 - DNA, 16 bp, Homo sapiens
ccatccctgggcccct

SEQ ID NO: 4794728 - DNA, 17 bp, Homo sapiens
ccatccctgggcccctc

SEQ ID NO: 4794729 - DNA, 18 bp, Homo sapiens
ccatccctgggcccctcc

SEQ ID NO: 4794730 - DNA, 19 bp, Homo sapiens
ccatccctgggcccctcca

SEQ ID NO: 4794731 - DNA, 12 bp, Homo sapiens
ccatccttcccg

SEQ ID NO: 4794732 - DNA, 17 bp, Homo sapiens
ccatccttttgcttcat

SEQ ID NO: 4794733 - DNA, 14 bp, Homo sapiens
ccatcgatttgtat

SEQ ID NO: 4794734 - DNA, 14 bp, Homo sapiens
ccatcggtcagcag

SEQ ID NO: 4794735 - DNA, 22 bp, Homo sapiens
ccatcggtgtccatttatagaa

SEQ ID NO: 4794736 - DNA, 13 bp, Homo sapiens
ccatctaccttcc

SEQ ID NO: 4794737 - DNA, 14 bp, Homo sapiens
ccatctaccttcca

SEQ ID NO: 4794738 - DNA, 20 bp, Homo sapiens
ccatctcttgtaccagccca

SEQ ID NO: 4794739 - DNA, 13 bp, Homo sapiens
ccatctgaagagt

SEQ ID NO: 4794740 - DNA, 14 bp, Homo sapiens
ccatctggcctggc

SEQ ID NO: 4794741 - DNA, 17 bp, Homo sapiens
ccatctggcctggcctg

SEQ ID NO: 4794742 - DNA, 22 bp, Homo sapiens
ccatctggcctggcctggccct

SEQ ID NO: 4794743 - DNA, 17 bp, Homo sapiens
ccatgaaaagttttcaa

SEQ ID NO: 4794744 - DNA, 14 bp, Homo sapiens
ccatgacagtagca

SEQ ID NO: 4794745 - DNA, 16 bp, Homo sapiens
ccatgacagtagcata

SEQ ID NO: 4794746 - DNA, 17 bp, Homo sapiens
ccatgaggaacaaggca

SEQ ID NO: 4794747 - DNA, 18 bp, Homo sapiens
ccatgaggaacaaggcaa

SEQ ID NO: 4794748 - DNA, 18 bp, Homo sapiens
ccatgatcaaaatgcata

SEQ ID NO: 4794749 - DNA, 15 bp, Homo sapiens
ccatgatttggggtg

SEQ ID NO: 4794750 - DNA, 13 bp, Homo sapiens
ccatgcaccaaac

SEQ ID NO: 4794751 - DNA, 21 bp, Homo sapiens
ccatgcagatctagccaggcc

SEQ ID NO: 4794752 - DNA, 22 bp, Homo sapiens
ccatgcagatctagccaggcct

SEQ ID NO: 4794753 - DNA, 21 bp, Homo sapiens
ccatgcaggcagcctgcagac

SEQ ID NO: 4794754 - DNA, 18 bp, Homo sapiens
ccatgcatggcctcccag

SEQ ID NO: 4794755 - DNA, 20 bp, Homo sapiens
ccatgcatggcctcccagcc

SEQ ID NO: 4794756 - DNA, 22 bp, Homo sapiens
ccatgcatggcctcccagccac

SEQ ID NO: 4794757 - DNA, 21 bp, Homo sapiens
ccatgcattcagatctgaagt

SEQ ID NO: 4794758 - DNA, 19 bp, Homo sapiens
ccatgccaccacccacccc

SEQ ID NO: 4794759 - DNA, 14 bp, Homo sapiens
ccatgccctccctg

SEQ ID NO: 4794760 - DNA, 22 bp, Homo sapiens
ccatgctcctcactgcccgcac

SEQ ID NO: 4794761 - DNA, 11 bp, Homo sapiens
ccatgctgggc

SEQ ID NO: 4794762 - DNA, 13 bp, Homo sapiens
ccatgctgtccct

SEQ ID NO: 4794763 - DNA, 15 bp, Homo sapiens
ccatgctgtccctgt

SEQ ID NO: 4794764 - DNA, 15 bp, Homo sapiens
ccatggaacagccct

SEQ ID NO: 4794765 - DNA, 16 bp, Homo sapiens
ccatggaacagccctg

SEQ ID NO: 4794766 - DNA, 18 bp, Homo sapiens
ccatggaacagccctgca

SEQ ID NO: 4794767 - DNA, 16 bp, Homo sapiens
ccatggattcccctgg

SEQ ID NO: 4794768 - DNA, 20 bp, Homo sapiens
ccatggattcccctggacat

SEQ ID NO: 4794769 - DNA, 13 bp, Homo sapiens
ccatggccccagc

SEQ ID NO: 4794770 - DNA, 15 bp, Homo sapiens
ccatggccccagctg

SEQ ID NO: 4794771 - DNA, 15 bp, Homo sapiens
ccatggctggatgtg

SEQ ID NO: 4794772 - DNA, 15 bp, Homo sapiens
ccatggtagactgtg

SEQ ID NO: 4794773 - DNA, 18 bp, Homo sapiens
ccatggtcacagacccct

SEQ ID NO: 4794774 - DNA, 19 bp, Homo sapiens
ccatggtcacagacccctg

SEQ ID NO: 4794775 - DNA, 21 bp, Homo sapiens
ccatggtgaactgaagcagag

SEQ ID NO: 4794776 - DNA, 14 bp, Homo sapiens
ccatgtaaatacca

SEQ ID NO: 4794777 - DNA, 18 bp, Homo sapiens
ccatgtgtcccccctgtg

SEQ ID NO: 4794778 - DNA, 22 bp, Homo sapiens
ccatgtgtcccccctgtggtct

SEQ ID NO: 4794779 - DNA, 20 bp, Homo sapiens
ccattaaacttctactgagc

SEQ ID NO: 4794780 - DNA, 21 bp, Homo sapiens
ccattaaacttctactgagca

SEQ ID NO: 4794781 - DNA, 22 bp, Homo sapiens
ccattaaacttctactgagcaa

SEQ ID NO: 4794782 - DNA, 12 bp, Homo sapiens
ccattaatttaa

SEQ ID NO: 4794783 - DNA, 15 bp, Homo sapiens
ccattaatttaaatg

SEQ ID NO: 4794784 - DNA, 18 bp, Homo sapiens
ccattcagtctatgctgt

SEQ ID NO: 4794785 - DNA, 23 bp, Homo sapiens
ccattcagtctatgctgtgtgca

SEQ ID NO: 4794786 - DNA, 11 bp, Homo sapiens
ccattcctgag

SEQ ID NO: 4794787 - DNA, 22 bp, Homo sapiens
ccattctatgactcttgtctcc

SEQ ID NO: 4794788 - DNA, 21 bp, Homo sapiens
ccattgttcaggattctaata

SEQ ID NO: 4794789 - DNA, 17 bp, Homo sapiens
ccatttaaaacaagctg

SEQ ID NO: 4794790 - DNA, 19 bp, Homo sapiens
ccatttaactagcacttta

SEQ ID NO: 4794791 - DNA, 21 bp, Homo sapiens
ccatttaatcatttccagcaa

SEQ ID NO: 4794792 - DNA, 18 bp, Homo sapiens
ccatttcacattcctgac

SEQ ID NO: 4794793 - DNA, 16 bp, Homo sapiens
ccatttggaatcatat

SEQ ID NO: 4794794 - DNA, 12 bp, Homo sapiens
ccatttgtaatg

SEQ ID NO: 4794795 - DNA, 17 bp, Homo sapiens
ccatttgtaatgtatct

SEQ ID NO: 4794796 - DNA, 20 bp, Homo sapiens
ccattttgctgtcccttttc

SEQ ID NO: 4794797 - DNA, 14 bp, Homo sapiens
ccattttggaaaat

SEQ ID NO: 4794798 - DNA, 14 bp, Homo sapiens
ccatttttacaagt

SEQ ID NO: 4794799 - DNA, 22 bp, Homo sapiens
ccattttttgtctgtgataaca

SEQ ID NO: 4794800 - DNA, 15 bp, Homo sapiens
cccaaacagcatgtg

SEQ ID NO: 4794801 - DNA, 13 bp, Homo sapiens
cccaaaccctgct

SEQ ID NO: 4794802 - DNA, 18 bp, Homo sapiens
cccaaaccctgcttctgc

SEQ ID NO: 4794803 - DNA, 19 bp, Homo sapiens
cccaaacttccaggttcca

SEQ ID NO: 4794804 - DNA, 19 bp, Homo sapiens
cccaaataaatgtgtaaat

SEQ ID NO: 4794805 - DNA, 17 bp, Homo sapiens
cccaaattggtgtttct

SEQ ID NO: 4794806 - DNA, 20 bp, Homo sapiens
cccaacaatactttgtgtct

SEQ ID NO: 4794807 - DNA, 12 bp, Homo sapiens
cccaacccccac

SEQ ID NO: 4794808 - DNA, 15 bp, Homo sapiens
cccaacccccacctc

SEQ ID NO: 4794809 - DNA, 19 bp, Homo sapiens
cccaacccccacctcccgg

SEQ ID NO: 4794810 - DNA, 16 bp, Homo sapiens
cccaacgcacaggaaa

SEQ ID NO: 4794811 - DNA, 19 bp, Homo sapiens
cccaacgtactcctcagac

SEQ ID NO: 4794812 - DNA, 14 bp, Homo sapiens
cccaactctggcct

SEQ ID NO: 4794813 - DNA, 20 bp, Homo sapiens
cccaagcacctgggattaca

SEQ ID NO: 4794814 - DNA, 21 bp, Homo sapiens
cccaaggaagaacaaatatga

SEQ ID NO: 4794815 - DNA, 23 bp, Homo sapiens
cccaaggtggtcttggagaggag

SEQ ID NO: 4794816 - DNA, 22 bp, Homo sapiens
cccaatccaacccatgcatggc

SEQ ID NO: 4794817 - DNA, 19 bp, Homo sapiens
cccaattatcctccttcac

SEQ ID NO: 4794818 - DNA, 18 bp, Homo sapiens
cccacacagcccgagccc

SEQ ID NO: 4794819 - DNA, 12 bp, Homo sapiens
cccacacaggcc

SEQ ID NO: 4794820 - DNA, 15 bp, Homo sapiens
tactggggggcaggc

SEQ ID NO: 4794821 - DNA, 21 bp, Homo sapiens
tactggtaagattgttattaa

SEQ ID NO: 4794822 - DNA, 15 bp, Homo sapiens
tactgtactttccca

SEQ ID NO: 4794823 - DNA, 15 bp, Homo sapiens
tactgtgagaactgt

SEQ ID NO: 4794824 - DNA, 19 bp, Homo sapiens
tactgtgagaactgtgaat

SEQ ID NO: 4794825 - DNA, 19 bp, Homo sapiens
tactgtttaagtgaattga

SEQ ID NO: 4794826 - DNA, 22 bp, Homo sapiens
tactgtttgaaacttttcaagg

SEQ ID NO: 4794827 - DNA, 21 bp, Homo sapiens
tactgttttgtgcggtgtgtc

SEQ ID NO: 4794828 - DNA, 15 bp, Homo sapiens
tactgtttttatcct

SEQ ID NO: 4794829 - DNA, 21 bp, Homo sapiens
tacttaaacaaaaactttcca

SEQ ID NO: 4794830 - DNA, 13 bp, Homo sapiens
tacttaaagcttg

SEQ ID NO: 4794831 - DNA, 21 bp, Homo sapiens
tacttaaatagcatctgctct

SEQ ID NO: 4794832 - DNA, 21 bp, Homo sapiens
tacttacacacctgagaatgt

SEQ ID NO: 4794833 - DNA, 15 bp, Homo sapiens
tacttaggaaatact

SEQ ID NO: 4794834 - DNA, 15 bp, Homo sapiens
tacttatattctgca

SEQ ID NO: 4794835 - DNA, 12 bp, Homo sapiens
tacttcttctgt

SEQ ID NO: 4794836 - DNA, 14 bp, Homo sapiens
tacttgaatagtat

SEQ ID NO: 4794837 - DNA, 12 bp, Homo sapiens
tacttgattaag

SEQ ID NO: 4794838 - DNA, 14 bp, Homo sapiens
tacttgattaagga

SEQ ID NO: 4794839 - DNA, 12 bp, Homo sapiens
tacttgtaactt

SEQ ID NO: 4794840 - DNA, 21 bp, Homo sapiens
tactttaaattatatgatatg

SEQ ID NO: 4794841 - DNA, 16 bp, Homo sapiens
tactttaaattgtgga

SEQ ID NO: 4794842 - DNA, 17 bp, Homo sapiens
tactttaaattgtggat

SEQ ID NO: 4794843 - DNA, 16 bp, Homo sapiens
tactttacctctctgt

SEQ ID NO: 4794844 - DNA, 17 bp, Homo sapiens
tactttacctctctgtc

SEQ ID NO: 4794845 - DNA, 18 bp, Homo sapiens
tactttacctctctgtca

SEQ ID NO: 4794846 - DNA, 19 bp, Homo sapiens
tactttacctctctgtcat

SEQ ID NO: 4794847 - DNA, 16 bp, Homo sapiens
tactttgcattgtctg

SEQ ID NO: 4794848 - DNA, 18 bp, Homo sapiens
tactttgcattgtctgtc

SEQ ID NO: 4794849 - DNA, 16 bp, Homo sapiens
tactttgtatacaagt

SEQ ID NO: 4794850 - DNA, 13 bp, Homo sapiens
tactttgtgtctt

SEQ ID NO: 4794851 - DNA, 12 bp, Homo sapiens
tagaaaaattag

SEQ ID NO: 4794852 - DNA, 13 bp, Homo sapiens
tagaaacatgaca

SEQ ID NO: 4794853 - DNA, 16 bp, Homo sapiens
tagaaactttggaagt

SEQ ID NO: 4794854 - DNA, 23 bp, Homo sapiens
tagaaattctataagagacaaag

SEQ ID NO: 4794855 - DNA, 20 bp, Homo sapiens
tagaagaaggactgaagaaa

SEQ ID NO: 4794856 - DNA, 21 bp, Homo sapiens
tagaagaaggactgaagaaaa

SEQ ID NO: 4794857 - DNA, 17 bp, Homo sapiens
tagaagagtctattgtc

SEQ ID NO: 4794858 - DNA, 22 bp, Homo sapiens
tagaataatgtgggaagaaaca

SEQ ID NO: 4794859 - DNA, 21 bp, Homo sapiens
tagaatactaataaaatacat

SEQ ID NO: 4794860 - DNA, 20 bp, Homo sapiens
tagaatactgtattgttaca

SEQ ID NO: 4794861 - DNA, 23 bp, Homo sapiens
tagaatattaaaaattaattctt

SEQ ID NO: 4794862 - DNA, 18 bp, Homo sapiens
tagaatcaagtctgtgaa

SEQ ID NO: 4794863 - DNA, 19 bp, Homo sapiens
tagaatccaaattctctga

SEQ ID NO: 4794864 - DNA, 14 bp, Homo sapiens
tagaatctcagcac

SEQ ID NO: 4794865 - DNA, 14 bp, Homo sapiens
tagaatgagaaatc

SEQ ID NO: 4794866 - DNA, 16 bp, Homo sapiens
tagaatgagaaatcat

SEQ ID NO: 4794867 - DNA, 12 bp, Homo sapiens
tagaatgtgaaa

SEQ ID NO: 4794868 - DNA, 16 bp, Homo sapiens
tagaatgtttcatttg

SEQ ID NO: 4794869 - DNA, 22 bp, Homo sapiens
tagacaatgtggaattacataa

SEQ ID NO: 4794870 - DNA, 18 bp, Homo sapiens
tagacacacatatacatt

SEQ ID NO: 4794871 - DNA, 14 bp, Homo sapiens
tagacatctgtcct

SEQ ID NO: 4794872 - DNA, 18 bp, Homo sapiens
tagaccgtggtgtcctct

SEQ ID NO: 4794873 - DNA, 18 bp, Homo sapiens
tagactctaaaactatca

SEQ ID NO: 4794874 - DNA, 20 bp, Homo sapiens
tagactttaattcttctctt

SEQ ID NO: 4794875 - DNA, 12 bp, Homo sapiens
tagagcacaata

SEQ ID NO: 4794876 - DNA, 17 bp, Homo sapiens
tagagcattctggggtg

SEQ ID NO: 4794877 - DNA, 14 bp, Homo sapiens
tagaggataaataa

SEQ ID NO: 4794878 - DNA, 16 bp, Homo sapiens
tagaggataaataata

SEQ ID NO: 4794879 - DNA, 17 bp, Homo sapiens
tagagggtccagtcttc

SEQ ID NO: 4794880 - DNA, 17 bp, Homo sapiens
tagagtatgtgtatgta

SEQ ID NO: 4794881 - DNA, 20 bp, Homo sapiens
tagagtgcccttaaaataat

SEQ ID NO: 4794882 - DNA, 22 bp, Homo sapiens
tagagtgcccttaaaataatga

SEQ ID NO: 4794883 - DNA, 14 bp, Homo sapiens
tagataaagcactg

SEQ ID NO: 4794884 - DNA, 13 bp, Homo sapiens
tagatataaatat

SEQ ID NO: 4794885 - DNA, 21 bp, Homo sapiens
tagatattcaggaaatgttca

SEQ ID NO: 4794886 - DNA, 20 bp, Homo sapiens
tagatctcctgtaattttgt

SEQ ID NO: 4794887 - DNA, 23 bp, Homo sapiens
tagatctcctgtaattttgtagt

SEQ ID NO: 4794888 - DNA, 15 bp, Homo sapiens
tagatggtagaaact

SEQ ID NO: 4794889 - DNA, 15 bp, Homo sapiens
tagatgtctgtgtat

SEQ ID NO: 4794890 - DNA, 15 bp, Homo sapiens
tagattaatggcact

SEQ ID NO: 4794891 - DNA, 13 bp, Homo sapiens
tagattcacctgt

SEQ ID NO: 4794892 - DNA, 16 bp, Homo sapiens
tagattcacctgtaaa

SEQ ID NO: 4794893 - DNA, 20 bp, Homo sapiens
tagattcacctgtaaaactt

SEQ ID NO: 4794894 - DNA, 21 bp, Homo sapiens
tagattcacctgtaaaacttt

SEQ ID NO: 4794895 - DNA, 17 bp, Homo sapiens
tagattcctacttaaac

SEQ ID NO: 4794896 - DNA, 18 bp, Homo sapiens
tagattcctacttaaaca

SEQ ID NO: 4794897 - DNA, 23 bp, Homo sapiens
tagattcctacttaaacaaaaac

SEQ ID NO: 4794898 - DNA, 12 bp, Homo sapiens
tagattctttat

SEQ ID NO: 4794899 - DNA, 15 bp, Homo sapiens
tagattctttattag

SEQ ID NO: 4794900 - DNA, 13 bp, Homo sapiens
tagattttatagt

SEQ ID NO: 4794901 - DNA, 19 bp, Homo sapiens
tagattttatagtgtgttg

SEQ ID NO: 4794902 - DNA, 23 bp, Homo sapiens
tagcaaaaggatgatttaacatt

SEQ ID NO: 4794903 - DNA, 19 bp, Homo sapiens
tagcaaatcgtacattgtg

SEQ ID NO: 4794904 - DNA, 21 bp, Homo sapiens
tagcaaatcgtacattgtgcc

SEQ ID NO: 4794905 - DNA, 14 bp, Homo sapiens
tagcaaattccaat

SEQ ID NO: 4794906 - DNA, 17 bp, Homo sapiens
tagcacagtatttaaca

SEQ ID NO: 4794907 - DNA, 13 bp, Homo sapiens
tagcacatgtttt

SEQ ID NO: 4794908 - DNA, 14 bp, Homo sapiens
tagcacatgtttta

SEQ ID NO: 4794909 - DNA, 16 bp, Homo sapiens
tagcacatgttttaca

SEQ ID NO: 4794910 - DNA, 16 bp, Homo sapiens
tagcacttgacctttt

SEQ ID NO: 4794911 - DNA, 20 bp, Homo sapiens
tagcaggaatttaattaggt

SEQ ID NO: 4794912 - DNA, 14 bp, Homo sapiens
tagcagttctgcaa

SEQ ID NO: 4794913 - DNA, 19 bp, Homo sapiens
tagcatactgatgagacaa

SEQ ID NO: 4794914 - DNA, 22 bp, Homo sapiens
tagcatactgatgagacaacac

SEQ ID NO: 4794915 - DNA, 14 bp, Homo sapiens
tagcatataaatgt

SEQ ID NO: 4794916 - DNA, 18 bp, Homo sapiens
tagcatatataattttat

SEQ ID NO: 4794917 - DNA, 14 bp, Homo sapiens
tagcattgaaataa

SEQ ID NO: 4794918 - DNA, 19 bp, Homo sapiens
tagcattttaatagtttct

SEQ ID NO: 4794919 - DNA, 14 bp, Homo sapiens
tagccaaggccaaa

SEQ ID NO: 4794920 - DNA, 11 bp, Homo sapiens
tagccagagga

SEQ ID NO: 4794921 - DNA, 11 bp, Homo sapiens
tagccaggcct

SEQ ID NO: 4794922 - DNA, 21 bp, Homo sapiens
tagcccacaataatgaataat

SEQ ID NO: 4794923 - DNA, 14 bp, Homo sapiens
tagcccaccctgct

SEQ ID NO: 4794924 - DNA, 23 bp, Homo sapiens
tagccccaggcccgccctgcccg

SEQ ID NO: 4794925 - DNA, 15 bp, Homo sapiens
tagcccggccaagga

SEQ ID NO: 4794926 - DNA, 19 bp, Homo sapiens
tagccctctttctctctgt

SEQ ID NO: 4794927 - DNA, 21 bp, Homo sapiens
tagccctctttctctctgtgt

SEQ ID NO: 4794928 - DNA, 12 bp, Homo sapiens
tagccctggccc

SEQ ID NO: 4794929 - DNA, 15 bp, Homo sapiens
tagccgggccccatg

SEQ ID NO: 4794930 - DNA, 19 bp, Homo sapiens
tagcctaatattcatgctg

SEQ ID NO: 4794931 - DNA, 22 bp, Homo sapiens
tagcctaatattcatgctgcct

SEQ ID NO: 4794932 - DNA, 15 bp, Homo sapiens
tagcctctccgccca

SEQ ID NO: 4794933 - DNA, 16 bp, Homo sapiens
tagcctggtctgtgca

SEQ ID NO: 4794934 - DNA, 19 bp, Homo sapiens
tagccttcccagcttcccg

SEQ ID NO: 4794935 - DNA, 17 bp, Homo sapiens
tagctagttagctcaca

SEQ ID NO: 4794936 - DNA, 16 bp, Homo sapiens
tagctcacaagccgtg

SEQ ID NO: 4794937 - DNA, 13 bp, Homo sapiens
tagctcacagcac

SEQ ID NO: 4794938 - DNA, 16 bp, Homo sapiens
tagctcacagcacatt

SEQ ID NO: 4794939 - DNA, 15 bp, Homo sapiens
tagctccgcgtgtct

SEQ ID NO: 4794940 - DNA, 17 bp, Homo sapiens
tagctccgcgtgtctca

SEQ ID NO: 4794941 - DNA, 13 bp, Homo sapiens
tagctccttagct

SEQ ID NO: 4794942 - DNA, 22 bp, Homo sapiens
tagctccttcatgcttttctca

SEQ ID NO: 4794943 - DNA, 17 bp, Homo sapiens
tataattttaaaattgc

SEQ ID NO: 4794944 - DNA, 18 bp, Homo sapiens
tataattttattgctgga

SEQ ID NO: 4794945 - DNA, 21 bp, Homo sapiens
tatacaaagctgtcactcaca

SEQ ID NO: 4794946 - DNA, 19 bp, Homo sapiens
tatacaaccttcatttaaa

SEQ ID NO: 4794947 - DNA, 19 bp, Homo sapiens
tatacaagtactggtaaga

SEQ ID NO: 4794948 - DNA, 11 bp, Homo sapiens
tatacagacct

SEQ ID NO: 4794949 - DNA, 18 bp, Homo sapiens
tatacagacctccagatt

SEQ ID NO: 4794950 - DNA, 17 bp, Homo sapiens
tatacatatgtatgtgt

SEQ ID NO: 4794951 - DNA, 19 bp, Homo sapiens
tatacatatgtatgtgtga

SEQ ID NO: 4794952 - DNA, 23 bp, Homo sapiens
tatacatattcaaagtatataca

SEQ ID NO: 4794953 - DNA, 16 bp, Homo sapiens
tatacatcacgttaaa

SEQ ID NO: 4794954 - DNA, 14 bp, Homo sapiens
tatacatgtatagt

SEQ ID NO: 4794955 - DNA, 16 bp, Homo sapiens
tatacatgtatagtga

SEQ ID NO: 4794956 - DNA, 17 bp, Homo sapiens
tatacattagacacaca

SEQ ID NO: 4794957 - DNA, 18 bp, Homo sapiens
tatacattagacacacat

SEQ ID NO: 4794958 - DNA, 17 bp, Homo sapiens
tatacattatttctgta

SEQ ID NO: 4794959 - DNA, 17 bp, Homo sapiens
tataccagcaaaagtgc

SEQ ID NO: 4794960 - DNA, 21 bp, Homo sapiens
tataccctaggtctccacccc

SEQ ID NO: 4794961 - DNA, 16 bp, Homo sapiens
tataccggagctccag

SEQ ID NO: 4794962 - DNA, 21 bp, Homo sapiens
tataccggagctccagtttct

SEQ ID NO: 4794963 - DNA, 23 bp, Homo sapiens
tataccggagctccagtttctct

SEQ ID NO: 4794964 - DNA, 16 bp, Homo sapiens
tatacgagaacaggca

SEQ ID NO: 4794965 - DNA, 16 bp, Homo sapiens
tatactcattagaatt

SEQ ID NO: 4794966 - DNA, 22 bp, Homo sapiens
tatactcattagaattaccatt

SEQ ID NO: 4794967 - DNA, 21 bp, Homo sapiens
tatactcatttggatataaat

SEQ ID NO: 4794968 - DNA, 23 bp, Homo sapiens
tatactgtgtgtgagtgtgaata

SEQ ID NO: 4794969 - DNA, 17 bp, Homo sapiens
tatagagacttctaaat

SEQ ID NO: 4794970 - DNA, 11 bp, Homo sapiens
tatagagcaca

SEQ ID NO: 4794971 - DNA, 17 bp, Homo sapiens
tatagatggtagaaact

SEQ ID NO: 4794972 - DNA, 21 bp, Homo sapiens
tatagatggtagaaactttgg

SEQ ID NO: 4794973 - DNA, 17 bp, Homo sapiens
tatagatgtctgtgtat

SEQ ID NO: 4794974 - DNA, 22 bp, Homo sapiens
tatagatgtctgtgtatacata

SEQ ID NO: 4794975 - DNA, 13 bp, Homo sapiens
tatagattcttta

SEQ ID NO: 4794976 - DNA, 14 bp, Homo sapiens
tatagattctttat

SEQ ID NO: 4794977 - DNA, 20 bp, Homo sapiens
tatagcttttggtgtttgag

SEQ ID NO: 4794978 - DNA, 15 bp, Homo sapiens
tataggacttaattt

SEQ ID NO: 4794979 - DNA, 15 bp, Homo sapiens
tatagtgttgtgtta

SEQ ID NO: 4794980 - DNA, 23 bp, Homo sapiens
tatataaaaaatatatgtaatat

SEQ ID NO: 4794981 - DNA, 12 bp, Homo sapiens
tatataaaacaa

SEQ ID NO: 4794982 - DNA, 15 bp, Homo sapiens
tatatacatgtatag

SEQ ID NO: 4794983 - DNA, 17 bp, Homo sapiens
tatatacatgtatagtg

SEQ ID NO: 4794984 - DNA, 15 bp, Homo sapiens
tatatacattagaca

SEQ ID NO: 4794985 - DNA, 18 bp, Homo sapiens
tatatacattagacacac

SEQ ID NO: 4794986 - DNA, 19 bp, Homo sapiens
tatatacattagacacaca

SEQ ID NO: 4794987 - DNA, 21 bp, Homo sapiens
tatatagatgtctgtgtatac

SEQ ID NO: 4794988 - DNA, 13 bp, Homo sapiens
tatatataaatat

SEQ ID NO: 4794989 - DNA, 14 bp, Homo sapiens
tatatatacatgta

SEQ ID NO: 4794990 - DNA, 23 bp, Homo sapiens
tatatatacattagacacacata

SEQ ID NO: 4794991 - DNA, 14 bp, Homo sapiens
tatatatatatgta

SEQ ID NO: 4794992 - DNA, 23 bp, Homo sapiens
tatatatgaagtaagttctgaaa

SEQ ID NO: 4794993 - DNA, 20 bp, Homo sapiens
tatatatgtatatctgtgta

SEQ ID NO: 4794994 - DNA, 10 bp, Homo sapiens
tatatattat

SEQ ID NO: 4794995 - DNA, 15 bp, Homo sapiens
tatatattataagtt

SEQ ID NO: 4794996 - DNA, 20 bp, Homo sapiens
tatatatttatcatatttaa

SEQ ID NO: 4794997 - DNA, 19 bp, Homo sapiens
tatatatttattattttca

SEQ ID NO: 4794998 - DNA, 13 bp, Homo sapiens
tatatcagctcta

SEQ ID NO: 4794999 - DNA, 16 bp, Homo sapiens
tatatcgttatcactg

SEQ ID NO: 4795000 - DNA, 12 bp, Homo sapiens
tatatctgaaaa

SEQ ID NO: 4795001 - DNA, 19 bp, Homo sapiens
tatatgaagcagaatgaga

SEQ ID NO: 4795002 - DNA, 18 bp, Homo sapiens
tatatgcctatatttata

SEQ ID NO: 4795003 - DNA, 18 bp, Homo sapiens
tatatgtaatatatacat

SEQ ID NO: 4795004 - DNA, 11 bp, Homo sapiens
tatatgtacag

SEQ ID NO: 4795005 - DNA, 13 bp, Homo sapiens
tatatgtacagtt

SEQ ID NO: 4795006 - DNA, 20 bp, Homo sapiens
tatatgtacagttatacata

SEQ ID NO: 4795007 - DNA, 15 bp, Homo sapiens
tatatgtatatattt

SEQ ID NO: 4795008 - DNA, 20 bp, Homo sapiens
tatatgtatatatttattat

SEQ ID NO: 4795009 - DNA, 15 bp, Homo sapiens
tatatgtatatctgt

SEQ ID NO: 4795010 - DNA, 18 bp, Homo sapiens
tatatgtgaaaggatatg

SEQ ID NO: 4795011 - DNA, 22 bp, Homo sapiens
tatatgtttggctgaaattatg

SEQ ID NO: 4795012 - DNA, 17 bp, Homo sapiens
tatattcagagatgtac

SEQ ID NO: 4795013 - DNA, 18 bp, Homo sapiens
tatattccaggtttaagt

SEQ ID NO: 4795014 - DNA, 21 bp, Homo sapiens
tatattccaggtttaagtaga

SEQ ID NO: 4795015 - DNA, 17 bp, Homo sapiens
tatattgtttttatata

SEQ ID NO: 4795016 - DNA, 22 bp, Homo sapiens
tatattgtttttatatattata

SEQ ID NO: 4795017 - DNA, 18 bp, Homo sapiens
tatatttactgtttataa

SEQ ID NO: 4795018 - DNA, 17 bp, Homo sapiens
tatattttatttcaatg

SEQ ID NO: 4795019 - DNA, 16 bp, Homo sapiens
tatcaaaaaacagaaa

SEQ ID NO: 4795020 - DNA, 17 bp, Homo sapiens
tatcaaaaaacagaaaa

SEQ ID NO: 4795021 - DNA, 20 bp, Homo sapiens
tatcaaaaaacagaaaaaca

SEQ ID NO: 4795022 - DNA, 20 bp, Homo sapiens
tatcactgtgcagttgctgt

SEQ ID NO: 4795023 - DNA, 17 bp, Homo sapiens
tatcagggcaagctcat

SEQ ID NO: 4795024 - DNA, 20 bp, Homo sapiens
tatcagggcccaaataacag

SEQ ID NO: 4795025 - DNA, 21 bp, Homo sapiens
tatcagggcccaaataacagt

SEQ ID NO: 4795026 - DNA, 16 bp, Homo sapiens
tatcagtacaattctt

SEQ ID NO: 4795027 - DNA, 13 bp, Homo sapiens
tatcagtgaatat

SEQ ID NO: 4795028 - DNA, 22 bp, Homo sapiens
tatcagttacagtggcagtatt

SEQ ID NO: 4795029 - DNA, 18 bp, Homo sapiens
tatcatatatgctttttt

SEQ ID NO: 4795030 - DNA, 13 bp, Homo sapiens
tatcatatttaat

SEQ ID NO: 4795031 - DNA, 19 bp, Homo sapiens
tatcatgcttctactccat

SEQ ID NO: 4795032 - DNA, 16 bp, Homo sapiens
tatcattgtttgtcct

SEQ ID NO: 4795033 - DNA, 16 bp, Homo sapiens
tatcattttccaatta

SEQ ID NO: 4795034 - DNA, 20 bp, Homo sapiens
tatccacagaacctttgtca

SEQ ID NO: 4795035 - DNA, 19 bp, Homo sapiens
tatcccgccagggagtgtg

SEQ ID NO: 4795036 - DNA, 12 bp, Homo sapiens
tatcccttctca

SEQ ID NO: 4795037 - DNA, 16 bp, Homo sapiens
tatcctcaagttgtgt

SEQ ID NO: 4795038 - DNA, 19 bp, Homo sapiens
tatcctcaagttgtgtgct

SEQ ID NO: 4795039 - DNA, 22 bp, Homo sapiens
tatcctgacagcgccatgtgtg

SEQ ID NO: 4795040 - DNA, 13 bp, Homo sapiens
tatcctgcaccct

SEQ ID NO: 4795041 - DNA, 15 bp, Homo sapiens
tatcctgcaccctct

SEQ ID NO: 4795042 - DNA, 18 bp, Homo sapiens
tatcctgttaggggaaaa

SEQ ID NO: 4795043 - DNA, 15 bp, Homo sapiens
tatccttttttcctt

SEQ ID NO: 4795044 - DNA, 14 bp, Homo sapiens
tatcgccattccag

SEQ ID NO: 4795045 - DNA, 18 bp, Homo sapiens
tatctaatttttattaat

SEQ ID NO: 4795046 - DNA, 21 bp, Homo sapiens
tatctagtaggtctgcacaca

SEQ ID NO: 4795047 - DNA, 23 bp, Homo sapiens
tatctagtaggtctgcacacata

SEQ ID NO: 4795048 - DNA, 17 bp, Homo sapiens
tatctagtgctaaacct

SEQ ID NO: 4795049 - DNA, 22 bp, Homo sapiens
tatctagtgctaaacctatctg

SEQ ID NO: 4795050 - DNA, 15 bp, Homo sapiens
tatctatttatctgt

SEQ ID NO: 4795051 - DNA, 19 bp, Homo sapiens
tatctcggactttgcagga

SEQ ID NO: 4795052 - DNA, 14 bp, Homo sapiens
tatctcttcctgtc

SEQ ID NO: 4795053 - DNA, 15 bp, Homo sapiens
tatctgaaaactgga

SEQ ID NO: 4795054 - DNA, 13 bp, Homo sapiens
tatctgaaagtca

SEQ ID NO: 4795055 - DNA, 15 bp, Homo sapiens
tatctgaactcacag

SEQ ID NO: 4795056 - DNA, 21 bp, Homo sapiens
tatctgaactcacagactgct

SEQ ID NO: 4795057 - DNA, 23 bp, Homo sapiens
tatctgaactcacagactgctgt

SEQ ID NO: 4795058 - DNA, 15 bp, Homo sapiens
tatctgatatctgtt

SEQ ID NO: 4795059 - DNA, 16 bp, Homo sapiens
tatctgggcctgggct

SEQ ID NO: 4795060 - DNA, 21 bp, Homo sapiens
tatctgggggactagaacaca

SEQ ID NO: 4795061 - DNA, 19 bp, Homo sapiens
tatctgggttttagaaatt

SEQ ID NO: 4795062 - DNA, 19 bp, Homo sapiens
tatctggtattaaatgcca

SEQ ID NO: 4795063 - DNA, 17 bp, Homo sapiens
tatctgtattggcagca

SEQ ID NO: 4795064 - DNA, 16 bp, Homo sapiens
tatctgtctttatgat

SEQ ID NO: 4795065 - DNA, 21 bp, Homo sapiens
tattagagtgcccttaaaata

SEQ ID NO: 4795066 - DNA, 17 bp, Homo sapiens
tattagccctgcatttt

SEQ ID NO: 4795067 - DNA, 22 bp, Homo sapiens
tattagccctgcattttcatag

SEQ ID NO: 4795068 - DNA, 23 bp, Homo sapiens
tattataatataatatggaacct

SEQ ID NO: 4795069 - DNA, 15 bp, Homo sapiens
tattatagatataaa

SEQ ID NO: 4795070 - DNA, 14 bp, Homo sapiens
tattatagtctgta

SEQ ID NO: 4795071 - DNA, 17 bp, Homo sapiens
tattatagtctgtactt

SEQ ID NO: 4795072 - DNA, 15 bp, Homo sapiens
tattatattaatata

SEQ ID NO: 4795073 - DNA, 14 bp, Homo sapiens
tattatcatatatg

SEQ ID NO: 4795074 - DNA, 17 bp, Homo sapiens
tattatcatatatgctt

SEQ ID NO: 4795075 - DNA, 14 bp, Homo sapiens
tattatctgggttt

SEQ ID NO: 4795076 - DNA, 20 bp, Homo sapiens
tattatcttaaacccacata

SEQ ID NO: 4795077 - DNA, 22 bp, Homo sapiens
tattatcttaaacccacataaa

SEQ ID NO: 4795078 - DNA, 22 bp, Homo sapiens
tattatggtgatactccaaggt

SEQ ID NO: 4795079 - DNA, 15 bp, Homo sapiens
tattattattactgt

SEQ ID NO: 4795080 - DNA, 16 bp, Homo sapiens
tattatttagtaaaat

SEQ ID NO: 4795081 - DNA, 23 bp, Homo sapiens
tattatttagtaaaattatctgt

SEQ ID NO: 4795082 - DNA, 14 bp, Homo sapiens
tattcaaaaattat

SEQ ID NO: 4795083 - DNA, 14 bp, Homo sapiens
tattcaaagtatat

SEQ ID NO: 4795084 - DNA, 17 bp, Homo sapiens
tattcaagaagatagtt

SEQ ID NO: 4795085 - DNA, 14 bp, Homo sapiens
tattcacacacaca

SEQ ID NO: 4795086 - DNA, 20 bp, Homo sapiens
tattcagagatgtaccatgt

SEQ ID NO: 4795087 - DNA, 13 bp, Homo sapiens
tattcaggaaatg

SEQ ID NO: 4795088 - DNA, 21 bp, Homo sapiens
tattcatgctgcctgccatgt

SEQ ID NO: 4795089 - DNA, 22 bp, Homo sapiens
tattcatgctgcctgccatgtg

SEQ ID NO: 4795090 - DNA, 14 bp, Homo sapiens
tattccaccttaaa

SEQ ID NO: 4795091 - DNA, 19 bp, Homo sapiens
tattccaccttaaattaaa

SEQ ID NO: 4795092 - DNA, 20 bp, Homo sapiens
tattccaccttaaattaaac

SEQ ID NO: 4795093 - DNA, 14 bp, Homo sapiens
tattcccaggcagg

SEQ ID NO: 4795094 - DNA, 23 bp, Homo sapiens
tattcccatggtagactgtgaca

SEQ ID NO: 4795095 - DNA, 14 bp, Homo sapiens
tattccttctggcc

SEQ ID NO: 4795096 - DNA, 15 bp, Homo sapiens
tattccttctggcct

SEQ ID NO: 4795097 - DNA, 16 bp, Homo sapiens
tattccttctggcctt

SEQ ID NO: 4795098 - DNA, 23 bp, Homo sapiens
tattctgtagccaacttaaacct

SEQ ID NO: 4795099 - DNA, 14 bp, Homo sapiens
tattgaatataatg

SEQ ID NO: 4795100 - DNA, 21 bp, Homo sapiens
tattgacgacctacatctgaa

SEQ ID NO: 4795101 - DNA, 15 bp, Homo sapiens
tattgagacactgtc

SEQ ID NO: 4795102 - DNA, 19 bp, Homo sapiens
tattgagcagaattcattc

SEQ ID NO: 4795103 - DNA, 14 bp, Homo sapiens
tattgagtgtacat

SEQ ID NO: 4795104 - DNA, 17 bp, Homo sapiens
tattgataataaaattc

SEQ ID NO: 4795105 - DNA, 15 bp, Homo sapiens
tattgctgaagaatc

SEQ ID NO: 4795106 - DNA, 18 bp, Homo sapiens
tattgctggaatctacta

SEQ ID NO: 4795107 - DNA, 14 bp, Homo sapiens
tattgctgtaaata

SEQ ID NO: 4795108 - DNA, 19 bp, Homo sapiens
tattgctgtaaataaaaat

SEQ ID NO: 4795109 - DNA, 20 bp, Homo sapiens
tattgctgtaaataaaaata

SEQ ID NO: 4795110 - DNA, 21 bp, Homo sapiens
tattgctgtctgaaaaagtgt

SEQ ID NO: 4795111 - DNA, 16 bp, Homo sapiens
tattggacttccattt

SEQ ID NO: 4795112 - DNA, 17 bp, Homo sapiens
tattggacttccatttg

SEQ ID NO: 4795113 - DNA, 20 bp, Homo sapiens
tattggcatggatttccttt

SEQ ID NO: 4795114 - DNA, 21 bp, Homo sapiens
tattgtattatcatatatgct

SEQ ID NO: 4795115 - DNA, 16 bp, Homo sapiens
tattgtccttgtgtat

SEQ ID NO: 4795116 - DNA, 14 bp, Homo sapiens
tattgttcttgtaa

SEQ ID NO: 4795117 - DNA, 15 bp, Homo sapiens
tattgttttataaat

SEQ ID NO: 4795118 - DNA, 12 bp, Homo sapiens
tatttaacattc

SEQ ID NO: 4795119 - DNA, 15 bp, Homo sapiens
tatttaagtggactg

SEQ ID NO: 4795120 - DNA, 18 bp, Homo sapiens
tatttaagtggactgtat

SEQ ID NO: 4795121 - DNA, 21 bp, Homo sapiens
tatttaagtggactgtatttc

SEQ ID NO: 4795122 - DNA, 16 bp, Homo sapiens
tatttacaatgtatta

SEQ ID NO: 4795123 - DNA, 17 bp, Homo sapiens
tatttacaatgtattaa

SEQ ID NO: 4795124 - DNA, 23 bp, Homo sapiens
tatttaccagaagtttaaatctt

SEQ ID NO: 4795125 - DNA, 16 bp, Homo sapiens
tatttactgtttataa

SEQ ID NO: 4795126 - DNA, 14 bp, Homo sapiens
tatttacttgttat

SEQ ID NO: 4795127 - DNA, 19 bp, Homo sapiens
tatttataaaccagcagca

SEQ ID NO: 4795128 - DNA, 14 bp, Homo sapiens
tatttataaatgaa

SEQ ID NO: 4795129 - DNA, 16 bp, Homo sapiens
tatttataaatgaaga

SEQ ID NO: 4795130 - DNA, 17 bp, Homo sapiens
tatttataaatgaagat

SEQ ID NO: 4795131 - DNA, 21 bp, Homo sapiens
tatttataacattgtaaatga

SEQ ID NO: 4795132 - DNA, 14 bp, Homo sapiens
tatttatctgtctg

SEQ ID NO: 4795133 - DNA, 20 bp, Homo sapiens
tatttattaaacttcagcaa

SEQ ID NO: 4795134 - DNA, 19 bp, Homo sapiens
tatttcacttaaactttgt

SEQ ID NO: 4795135 - DNA, 23 bp, Homo sapiens
tatttctgtatatagatgtctgt

SEQ ID NO: 4795136 - DNA, 18 bp, Homo sapiens
tatttgaaacacacagtg

SEQ ID NO: 4795137 - DNA, 22 bp, Homo sapiens
tatttgaaacacacagtgacca

SEQ ID NO: 4795138 - DNA, 16 bp, Homo sapiens
tatttgaggaaactca

SEQ ID NO: 4795139 - DNA, 14 bp, Homo sapiens
tatttgatttgcaa

SEQ ID NO: 4795140 - DNA, 14 bp, Homo sapiens
tatttgcttattta

SEQ ID NO: 4795141 - DNA, 20 bp, Homo sapiens
tatttgtatgatattttaaa

SEQ ID NO: 4795142 - DNA, 15 bp, Homo sapiens
tatttgtattagtaa

SEQ ID NO: 4795143 - DNA, 19 bp, Homo sapiens
tattttaaaatctcctaaa

SEQ ID NO: 4795144 - DNA, 16 bp, Homo sapiens
tattttaacatagcag

SEQ ID NO: 4795145 - DNA, 13 bp, Homo sapiens
tattttagcagtt

SEQ ID NO: 4795146 - DNA, 16 bp, Homo sapiens
tattttatttcaatgt

SEQ ID NO: 4795147 - DNA, 13 bp, Homo sapiens
tattttcgtgcat

SEQ ID NO: 4795148 - DNA, 17 bp, Homo sapiens
tattttcgtgcatttgt

SEQ ID NO: 4795149 - DNA, 19 bp, Homo sapiens
tattttcgtgcatttgtga

SEQ ID NO: 4795150 - DNA, 19 bp, Homo sapiens
tattttctatatttggatt

SEQ ID NO: 4795151 - DNA, 14 bp, Homo sapiens
tattttctgtaatt

SEQ ID NO: 4795152 - DNA, 16 bp, Homo sapiens
tcacgagtcatccaga

SEQ ID NO: 4795153 - DNA, 15 bp, Homo sapiens
tcacgattccagtgc

SEQ ID NO: 4795154 - DNA, 15 bp, Homo sapiens
tcacgcaacttgaaa

SEQ ID NO: 4795155 - DNA, 14 bp, Homo sapiens
tcacgctttcatga

SEQ ID NO: 4795156 - DNA, 16 bp, Homo sapiens
tcacgctttcatgacc

SEQ ID NO: 4795157 - DNA, 14 bp, Homo sapiens
tcacgtctgtgagt

SEQ ID NO: 4795158 - DNA, 16 bp, Homo sapiens
tcacgtctgtgagtct

SEQ ID NO: 4795159 - DNA, 22 bp, Homo sapiens
tcacgtctgtgagtctgtcctt

SEQ ID NO: 4795160 - DNA, 18 bp, Homo sapiens
tcacgtgaccctgtgccc

SEQ ID NO: 4795161 - DNA, 20 bp, Homo sapiens
tcactaccctcctgtaaaat

SEQ ID NO: 4795162 - DNA, 15 bp, Homo sapiens
tcactatgcatttta

SEQ ID NO: 4795163 - DNA, 14 bp, Homo sapiens
tcactcatttattt

SEQ ID NO: 4795164 - DNA, 16 bp, Homo sapiens
tcactccactcccctc

SEQ ID NO: 4795165 - DNA, 17 bp, Homo sapiens
tcactccactcccctca

SEQ ID NO: 4795166 - DNA, 11 bp, Homo sapiens
tcactctgcca

SEQ ID NO: 4795167 - DNA, 12 bp, Homo sapiens
tcactctgccag

SEQ ID NO: 4795168 - DNA, 13 bp, Homo sapiens
tcactctgccagg

SEQ ID NO: 4795169 - DNA, 21 bp, Homo sapiens
tcactctgccagggcagtgct

SEQ ID NO: 4795170 - DNA, 15 bp, Homo sapiens
tcactctgtcagcca

SEQ ID NO: 4795171 - DNA, 20 bp, Homo sapiens
tcactctgtcagccagccgc

SEQ ID NO: 4795172 - DNA, 14 bp, Homo sapiens
tcactgaataaata

SEQ ID NO: 4795173 - DNA, 20 bp, Homo sapiens
tcactgacatcagcactgcc

SEQ ID NO: 4795174 - DNA, 19 bp, Homo sapiens
tcactgagaaggccccagg

SEQ ID NO: 4795175 - DNA, 11 bp, Homo sapiens
tcactgccact

SEQ ID NO: 4795176 - DNA, 19 bp, Homo sapiens
tcactgcccacctgccagg

SEQ ID NO: 4795177 - DNA, 19 bp, Homo sapiens
tcactgcccgcacaccctc

SEQ ID NO: 4795178 - DNA, 20 bp, Homo sapiens
tcactgcccgcacaccctca

SEQ ID NO: 4795179 - DNA, 11 bp, Homo sapiens
tcactgctttg

SEQ ID NO: 4795180 - DNA, 13 bp, Homo sapiens
tcactgtattaaa

SEQ ID NO: 4795181 - DNA, 16 bp, Homo sapiens
tcactgtattaaagat

SEQ ID NO: 4795182 - DNA, 17 bp, Homo sapiens
tcactgtcttactcaag

SEQ ID NO: 4795183 - DNA, 18 bp, Homo sapiens
tcactgtcttactcaaga

SEQ ID NO: 4795184 - DNA, 13 bp, Homo sapiens
tcactgtgtctca

SEQ ID NO: 4795185 - DNA, 14 bp, Homo sapiens
tcactgttcatgaa

SEQ ID NO: 4795186 - DNA, 14 bp, Homo sapiens
tcacttcctagggt

SEQ ID NO: 4795187 - DNA, 14 bp, Homo sapiens
tcacttcttaagga

SEQ ID NO: 4795188 - DNA, 21 bp, Homo sapiens
tcactttaccttcagcagtta

SEQ ID NO: 4795189 - DNA, 17 bp, Homo sapiens
tcacttttttataaatt

SEQ ID NO: 4795190 - DNA, 15 bp, Homo sapiens
tcacttttttcctgt

SEQ ID NO: 4795191 - DNA, 16 bp, Homo sapiens
tcagaaaagcacctct

SEQ ID NO: 4795192 - DNA, 21 bp, Homo sapiens
tcagaaaagcacctcttgaag

SEQ ID NO: 4795193 - DNA, 16 bp, Homo sapiens
tcagaaacaatttctg

SEQ ID NO: 4795194 - DNA, 16 bp, Homo sapiens
tcagaaactaaaacaa

SEQ ID NO: 4795195 - DNA, 20 bp, Homo sapiens
tcagaaagggcagcccctcc

SEQ ID NO: 4795196 - DNA, 21 bp, Homo sapiens
tcagaaagggcagcccctccc

SEQ ID NO: 4795197 - DNA, 16 bp, Homo sapiens
tcagaactcctttcta

SEQ ID NO: 4795198 - DNA, 17 bp, Homo sapiens
tcagaactcctttctaa

SEQ ID NO: 4795199 - DNA, 20 bp, Homo sapiens
tcagaactcctttctaagga

SEQ ID NO: 4795200 - DNA, 17 bp, Homo sapiens
tcagaaggttgttttat

SEQ ID NO: 4795201 - DNA, 19 bp, Homo sapiens
tcagaagtttctgccgcag

SEQ ID NO: 4795202 - DNA, 19 bp, Homo sapiens
tcagaatatggacaaagaa

SEQ ID NO: 4795203 - DNA, 18 bp, Homo sapiens
tcagaatattaagcacat

SEQ ID NO: 4795204 - DNA, 20 bp, Homo sapiens
tcagaatattaagcacatta

SEQ ID NO: 4795205 - DNA, 22 bp, Homo sapiens
tcagaatggaagagagaaagca

SEQ ID NO: 4795206 - DNA, 18 bp, Homo sapiens
tcagaatgtgcaaagcag

SEQ ID NO: 4795207 - DNA, 14 bp, Homo sapiens
tcagagatgtacca

SEQ ID NO: 4795208 - DNA, 16 bp, Homo sapiens
tcagagatgttttcaa

SEQ ID NO: 4795209 - DNA, 13 bp, Homo sapiens
tcagagcccagga

SEQ ID NO: 4795210 - DNA, 18 bp, Homo sapiens
tcagaggcagagacctcc

SEQ ID NO: 4795211 - DNA, 17 bp, Homo sapiens
tcagaggttctttgagg

SEQ ID NO: 4795212 - DNA, 13 bp, Homo sapiens
tcagagtgtattt

SEQ ID NO: 4795213 - DNA, 17 bp, Homo sapiens
tcagataaagtgaccag

SEQ ID NO: 4795214 - DNA, 17 bp, Homo sapiens
tcagataaatcatgggc

SEQ ID NO: 4795215 - DNA, 22 bp, Homo sapiens
tcagatccctcggtcagcaccg

SEQ ID NO: 4795216 - DNA, 13 bp, Homo sapiens
tcagatccttcca

SEQ ID NO: 4795217 - DNA, 14 bp, Homo sapiens
tcagatctgaagta

SEQ ID NO: 4795218 - DNA, 18 bp, Homo sapiens
tcagatctgcactcctgt

SEQ ID NO: 4795219 - DNA, 23 bp, Homo sapiens
tcagatctgcactcctgtctctt

SEQ ID NO: 4795220 - DNA, 12 bp, Homo sapiens
tcagatgtttga

SEQ ID NO: 4795221 - DNA, 22 bp, Homo sapiens
tcagattgtaaaggtaggtgca

SEQ ID NO: 4795222 - DNA, 12 bp, Homo sapiens
tcagcacagaga

SEQ ID NO: 4795223 - DNA, 12 bp, Homo sapiens
tcagcactgaaa

SEQ ID NO: 4795224 - DNA, 14 bp, Homo sapiens
tcagcactgaaaat

SEQ ID NO: 4795225 - DNA, 15 bp, Homo sapiens
tcagcactgaaaata

SEQ ID NO: 4795226 - DNA, 16 bp, Homo sapiens
tcagcatagagctata

SEQ ID NO: 4795227 - DNA, 17 bp, Homo sapiens
tcagccagccgccctgg

SEQ ID NO: 4795228 - DNA, 14 bp, Homo sapiens
tcagccagcttggt

SEQ ID NO: 4795229 - DNA, 18 bp, Homo sapiens
tcagccccagacctgccg

SEQ ID NO: 4795230 - DNA, 20 bp, Homo sapiens
tcagccccagggccctgctc

SEQ ID NO: 4795231 - DNA, 21 bp, Homo sapiens
tcagccccagggccctgctca

SEQ ID NO: 4795232 - DNA, 23 bp, Homo sapiens
tcagccccagggccctgctcagg

SEQ ID NO: 4795233 - DNA, 20 bp, Homo sapiens
tcagcctcccgagtagctgg

SEQ ID NO: 4795234 - DNA, 23 bp, Homo sapiens
tcagctaagccccctactgagaa

SEQ ID NO: 4795235 - DNA, 22 bp, Homo sapiens
tcagctcagcattgtgtacaaa

SEQ ID NO: 4795236 - DNA, 13 bp, Homo sapiens
tcagctccactct

SEQ ID NO: 4795237 - DNA, 20 bp, Homo sapiens
tcagctctaaagcagagatg

SEQ ID NO: 4795238 - DNA, 17 bp, Homo sapiens
tcagctggtgtcagtcc

SEQ ID NO: 4795239 - DNA, 13 bp, Homo sapiens
tcagcttcccaac

SEQ ID NO: 4795240 - DNA, 17 bp, Homo sapiens
tcagcttcccaacaata

SEQ ID NO: 4795241 - DNA, 13 bp, Homo sapiens
tcagctttataat

SEQ ID NO: 4795242 - DNA, 21 bp, Homo sapiens
tcagctttataataaactgtt

SEQ ID NO: 4795243 - DNA, 12 bp, Homo sapiens
tcaggaatgggc

SEQ ID NO: 4795244 - DNA, 18 bp, Homo sapiens
tcaggaccaccctgccaa

SEQ ID NO: 4795245 - DNA, 15 bp, Homo sapiens
tcaggagccagcagg

SEQ ID NO: 4795246 - DNA, 21 bp, Homo sapiens
tcaggattccttcttccccaa

SEQ ID NO: 4795247 - DNA, 17 bp, Homo sapiens
gttttgtggataagaaa

SEQ ID NO: 4795248 - DNA, 22 bp, Homo sapiens
gtttttacatatagctttgcaa

SEQ ID NO: 4795249 - DNA, 18 bp, Homo sapiens
gtttttctgttccctgct

SEQ ID NO: 4795250 - DNA, 12 bp, Homo sapiens
gtttttgaagaa

SEQ ID NO: 4795251 - DNA, 20 bp, Homo sapiens
gtttttgaagaagggaaatt

SEQ ID NO: 4795252 - DNA, 21 bp, Homo sapiens
gtttttgaagaagggaaattc

SEQ ID NO: 4795253 - DNA, 17 bp, Homo sapiens
gtttttgtgctgtgggc

SEQ ID NO: 4795254 - DNA, 18 bp, Homo sapiens
gtttttgttcaccttctg

SEQ ID NO: 4795255 - DNA, 23 bp, Homo sapiens
gtttttgttcaccttctgtgcat

SEQ ID NO: 4795256 - DNA, 15 bp, Homo sapiens
taaaaaaaaaaatga

SEQ ID NO: 4795257 - DNA, 14 bp, Homo sapiens
taaaaaaataatat

SEQ ID NO: 4795258 - DNA, 20 bp, Homo sapiens
taaaaaatatatgtaatata

SEQ ID NO: 4795259 - DNA, 12 bp, Homo sapiens
taaaaaatgaat

SEQ ID NO: 4795260 - DNA, 13 bp, Homo sapiens
taaaaacataaaa

SEQ ID NO: 4795261 - DNA, 19 bp, Homo sapiens
taaaaactgcccattgtaa

SEQ ID NO: 4795262 - DNA, 19 bp, Homo sapiens
taaaaagccaagtgtcctg

SEQ ID NO: 4795263 - DNA, 21 bp, Homo sapiens
taaaaatagctataaatagtg

SEQ ID NO: 4795264 - DNA, 10 bp, Homo sapiens
taaaaatatt

SEQ ID NO: 4795265 - DNA, 21 bp, Homo sapiens
taaaaatccctcttcctccaa

SEQ ID NO: 4795266 - DNA, 15 bp, Homo sapiens
taaaaattaattctt

SEQ ID NO: 4795267 - DNA, 17 bp, Homo sapiens
taaaaattatctttaaa

SEQ ID NO: 4795268 - DNA, 12 bp, Homo sapiens
taaaacaaaatc

SEQ ID NO: 4795269 - DNA, 21 bp, Homo sapiens
taaaacaagagaccacttcct

SEQ ID NO: 4795270 - DNA, 21 bp, Homo sapiens
taaaacaagctgatagtgttt

SEQ ID NO: 4795271 - DNA, 22 bp, Homo sapiens
taaaacacaacatctttttcta

SEQ ID NO: 4795272 - DNA, 19 bp, Homo sapiens
taaaacagatttgttcatt

SEQ ID NO: 4795273 - DNA, 16 bp, Homo sapiens
taaaacagtgtttcca

SEQ ID NO: 4795274 - DNA, 19 bp, Homo sapiens
taaaacagtgtttccagtg

SEQ ID NO: 4795275 - DNA, 20 bp, Homo sapiens
taaaacattatagattttca

SEQ ID NO: 4795276 - DNA, 22 bp, Homo sapiens
taaaacccttggtctgtgttct

SEQ ID NO: 4795277 - DNA, 23 bp, Homo sapiens
taaaaccttacttaaagcttgtt

SEQ ID NO: 4795278 - DNA, 19 bp, Homo sapiens
taaaactactgcctttcaa

SEQ ID NO: 4795279 - DNA, 17 bp, Homo sapiens
taaaactcccttcctta

SEQ ID NO: 4795280 - DNA, 10 bp, Homo sapiens
taaaactgtg

SEQ ID NO: 4795281 - DNA, 11 bp, Homo sapiens
taaaactgtga

SEQ ID NO: 4795282 - DNA, 13 bp, Homo sapiens
taaaactgtgaca

SEQ ID NO: 4795283 - DNA, 18 bp, Homo sapiens
taaaactgtgacattcca

SEQ ID NO: 4795284 - DNA, 16 bp, Homo sapiens
taaaagaaaccctgca

SEQ ID NO: 4795285 - DNA, 18 bp, Homo sapiens
taaaagaaagatgctgat

SEQ ID NO: 4795286 - DNA, 15 bp, Homo sapiens
taaaagaatcatttg

SEQ ID NO: 4795287 - DNA, 16 bp, Homo sapiens
taaaagcatatataaa

SEQ ID NO: 4795288 - DNA, 20 bp, Homo sapiens
taaaagcatatataaaacaa

SEQ ID NO: 4795289 - DNA, 22 bp, Homo sapiens
taaaagctatcttcatgtaaat

SEQ ID NO: 4795290 - DNA, 21 bp, Homo sapiens
taaaaggaggacagggaggga

SEQ ID NO: 4795291 - DNA, 20 bp, Homo sapiens
taaaagttctcaaatattgg

SEQ ID NO: 4795292 - DNA, 18 bp, Homo sapiens
taaaataaatgttttgga

SEQ ID NO: 4795293 - DNA, 20 bp, Homo sapiens
taaaataaccccgggcaaga

SEQ ID NO: 4795294 - DNA, 14 bp, Homo sapiens
taaaataatgattt

SEQ ID NO: 4795295 - DNA, 16 bp, Homo sapiens
taaaataattatatga

SEQ ID NO: 4795296 - DNA, 14 bp, Homo sapiens
taaaatacatacta

SEQ ID NO: 4795297 - DNA, 13 bp, Homo sapiens
taaaatacttctt

SEQ ID NO: 4795298 - DNA, 22 bp, Homo sapiens
taaaatacttctttttacaatg

SEQ ID NO: 4795299 - DNA, 14 bp, Homo sapiens
taaaatagtctcat

SEQ ID NO: 4795300 - DNA, 19 bp, Homo sapiens
taaaatagtctcattgcca

SEQ ID NO: 4795301 - DNA, 14 bp, Homo sapiens
taaaatatacaaac

SEQ ID NO: 4795302 - DNA, 19 bp, Homo sapiens
taaaatatagtgttgtgtt

SEQ ID NO: 4795303 - DNA, 19 bp, Homo sapiens
taaaatatttataaatgaa

SEQ ID NO: 4795304 - DNA, 20 bp, Homo sapiens
taaaatatttataaatgaag

SEQ ID NO: 4795305 - DNA, 14 bp, Homo sapiens
taaaatattttctt

SEQ ID NO: 4795306 - DNA, 21 bp, Homo sapiens
taaaatcaaatttttctggga

SEQ ID NO: 4795307 - DNA, 17 bp, Homo sapiens
taaaatctgtattgcta

SEQ ID NO: 4795308 - DNA, 23 bp, Homo sapiens
taaaatgattcacttttattgta

SEQ ID NO: 4795309 - DNA, 18 bp, Homo sapiens
taaaatgctgttctcaat

SEQ ID NO: 4795310 - DNA, 21 bp, Homo sapiens
taaaatggaaaggtcctgctg

SEQ ID NO: 4795311 - DNA, 15 bp, Homo sapiens
taatatcttgaagaa

SEQ ID NO: 4795312 - DNA, 13 bp, Homo sapiens
taatatggaacct

SEQ ID NO: 4795313 - DNA, 18 bp, Homo sapiens
taatatggaaccttccct

SEQ ID NO: 4795314 - DNA, 13 bp, Homo sapiens
taatattcatgct

SEQ ID NO: 4795315 - DNA, 15 bp, Homo sapiens
taatatttacaatgt

SEQ ID NO: 4795316 - DNA, 16 bp, Homo sapiens
taatatttacaatgta

SEQ ID NO: 4795317 - DNA, 20 bp, Homo sapiens
taatatttacaatgtattaa

SEQ ID NO: 4795318 - DNA, 14 bp, Homo sapiens
taatatttattgct

SEQ ID NO: 4795319 - DNA, 15 bp, Homo sapiens
taatatttattgctt

SEQ ID NO: 4795320 - DNA, 20 bp, Homo sapiens
taatatttattgctttataa

SEQ ID NO: 4795321 - DNA, 18 bp, Homo sapiens
taatatttcttcaaatat

SEQ ID NO: 4795322 - DNA, 22 bp, Homo sapiens
taatcaatactttgaacacaaa

SEQ ID NO: 4795323 - DNA, 23 bp, Homo sapiens
taatcaatactttgaacacaaag

SEQ ID NO: 4795324 - DNA, 20 bp, Homo sapiens
taatccatgtgctgctgtgg

SEQ ID NO: 4795325 - DNA, 22 bp, Homo sapiens
taatccatgtgctgctgtggca

SEQ ID NO: 4795326 - DNA, 20 bp, Homo sapiens
taatcctctaggaggtctct

SEQ ID NO: 4795327 - DNA, 23 bp, Homo sapiens
taatctagagctatgcacaccaa

SEQ ID NO: 4795328 - DNA, 14 bp, Homo sapiens
taatctcttcttat

SEQ ID NO: 4795329 - DNA, 18 bp, Homo sapiens
taatctgtcgcatttcat

SEQ ID NO: 4795330 - DNA, 19 bp, Homo sapiens
taatcttgttgataaaaat

SEQ ID NO: 4795331 - DNA, 17 bp, Homo sapiens
taatctttcggtctcct

SEQ ID NO: 4795332 - DNA, 20 bp, Homo sapiens
taatctttcggtctccttaa

SEQ ID NO: 4795333 - DNA, 22 bp, Homo sapiens
taatgaaaaatctgaatttcta

SEQ ID NO: 4795334 - DNA, 14 bp, Homo sapiens
taatgaagaaatac

SEQ ID NO: 4795335 - DNA, 16 bp, Homo sapiens
taatgaagaaatacag

SEQ ID NO: 4795336 - DNA, 11 bp, Homo sapiens
taatgaataat

SEQ ID NO: 4795337 - DNA, 15 bp, Homo sapiens
taatgacttaagcac

SEQ ID NO: 4795338 - DNA, 21 bp, Homo sapiens
taatgacttaagcacacttga

SEQ ID NO: 4795339 - DNA, 20 bp, Homo sapiens
taatgagccaataaagctca

SEQ ID NO: 4795340 - DNA, 14 bp, Homo sapiens
taatgattcaatgt

SEQ ID NO: 4795341 - DNA, 16 bp, Homo sapiens
taatgattcttgtgtc

SEQ ID NO: 4795342 - DNA, 21 bp, Homo sapiens
taatgcaaatgaaggaatgca

SEQ ID NO: 4795343 - DNA, 18 bp, Homo sapiens
taatgcttaacataaact

SEQ ID NO: 4795344 - DNA, 14 bp, Homo sapiens
taatggaaaactgt

SEQ ID NO: 4795345 - DNA, 13 bp, Homo sapiens
taatggcactgat

SEQ ID NO: 4795346 - DNA, 14 bp, Homo sapiens
taatggtttttatt

SEQ ID NO: 4795347 - DNA, 14 bp, Homo sapiens
taatgtaacttaat

SEQ ID NO: 4795348 - DNA, 19 bp, Homo sapiens
taatgtaacttaattataa

SEQ ID NO: 4795349 - DNA, 14 bp, Homo sapiens
taatgtatcttatt

SEQ ID NO: 4795350 - DNA, 21 bp, Homo sapiens
taatgtatcttatttatatat

SEQ ID NO: 4795351 - DNA, 16 bp, Homo sapiens
taatgtcataaagtga

SEQ ID NO: 4795352 - DNA, 13 bp, Homo sapiens
taatgtgaaatgt

SEQ ID NO: 4795353 - DNA, 22 bp, Homo sapiens
taatgtgccaaaatgtcaattt

SEQ ID NO: 4795354 - DNA, 12 bp, Homo sapiens
taatgtttgtaa

SEQ ID NO: 4795355 - DNA, 13 bp, Homo sapiens
taattaaactgat

SEQ ID NO: 4795356 - DNA, 15 bp, Homo sapiens
taattaaatgaaata

SEQ ID NO: 4795357 - DNA, 16 bp, Homo sapiens
taattaaatgaaatac

SEQ ID NO: 4795358 - DNA, 18 bp, Homo sapiens
taattaaatgaaatactt

SEQ ID NO: 4795359 - DNA, 11 bp, Homo sapiens
taattaatttc

SEQ ID NO: 4795360 - DNA, 14 bp, Homo sapiens
taattagatccatt

SEQ ID NO: 4795361 - DNA, 23 bp, Homo sapiens
taattagatccattaatttaaat

SEQ ID NO: 4795362 - DNA, 13 bp, Homo sapiens
taattagtgtcca

SEQ ID NO: 4795363 - DNA, 23 bp, Homo sapiens
taattctcagaagtgaaaaagac

SEQ ID NO: 4795364 - DNA, 23 bp, Homo sapiens
taattcttaccgaaatgaaaatg

SEQ ID NO: 4795365 - DNA, 15 bp, Homo sapiens
taattcttacctcat

SEQ ID NO: 4795366 - DNA, 18 bp, Homo sapiens
taattcttctcctttgtc

SEQ ID NO: 4795367 - DNA, 16 bp, Homo sapiens
taattctttatcacat

SEQ ID NO: 4795368 - DNA, 23 bp, Homo sapiens
taattgaaaagaagtagtgtctg

SEQ ID NO: 4795369 - DNA, 16 bp, Homo sapiens
taattgtaaaggtgat

SEQ ID NO: 4795370 - DNA, 23 bp, Homo sapiens
taattgtacccttcttgtctctc

SEQ ID NO: 4795371 - DNA, 21 bp, Homo sapiens
taattgtaggtcaatgaaata

SEQ ID NO: 4795372 - DNA, 15 bp, Homo sapiens
taattgtataaaaca

SEQ ID NO: 4795373 - DNA, 17 bp, Homo sapiens
taattgtataaaacagt

SEQ ID NO: 4795374 - DNA, 17 bp, Homo sapiens
taatttatgaagatagt

SEQ ID NO: 4795375 - DNA, 11 bp, Homo sapiens
taatttgcatc

SEQ ID NO: 4795376 - DNA, 19 bp, Homo sapiens
taatttgccagacagagat

SEQ ID NO: 4795377 - DNA, 15 bp, Homo sapiens
gggggcacagccaga

SEQ ID NO: 4795378 - DNA, 21 bp, Homo sapiens
gggggccatgttcccagaacc

SEQ ID NO: 4795379 - DNA, 15 bp, Homo sapiens
gggggctgggcagag

SEQ ID NO: 4795380 - DNA, 10 bp, Homo sapiens
ggggggagaa

SEQ ID NO: 4795381 - DNA, 11 bp, Homo sapiens
ggggggagaaa

SEQ ID NO: 4795382 - DNA, 11 bp, Homo sapiens
ggggggcaggc

SEQ ID NO: 4795383 - DNA, 21 bp, Homo sapiens
ggggtcgggggaggagcaccc

SEQ ID NO: 4795384 - DNA, 18 bp, Homo sapiens
ggggtgcccgtgtggcct

SEQ ID NO: 4795385 - DNA, 20 bp, Homo sapiens
ggggtgcccgtgtggcctgg

SEQ ID NO: 4795386 - DNA, 22 bp, Homo sapiens
ggggtgcccgtgtggcctgggt

SEQ ID NO: 4795387 - DNA, 19 bp, Homo sapiens
ggggtgctggggctgcatg

SEQ ID NO: 4795388 - DNA, 17 bp, Homo sapiens
ggggtggggacctcagg

SEQ ID NO: 4795389 - DNA, 19 bp, Homo sapiens
ggggtggggcttggaaggg

SEQ ID NO: 4795390 - DNA, 22 bp, Homo sapiens
ggggtgggggagaatggctctg

SEQ ID NO: 4795391 - DNA, 18 bp, Homo sapiens
ggggtggttggaggcctg

SEQ ID NO: 4795392 - DNA, 18 bp, Homo sapiens
ggggttgggttccagaca

SEQ ID NO: 4795393 - DNA, 18 bp, Homo sapiens
gggtaaataaatgctgct

SEQ ID NO: 4795394 - DNA, 17 bp, Homo sapiens
gggtaacaaagtgagac

SEQ ID NO: 4795395 - DNA, 14 bp, Homo sapiens
gggtagtgccatgg

SEQ ID NO: 4795396 - DNA, 16 bp, Homo sapiens
gggtatcatgcttcta

SEQ ID NO: 4795397 - DNA, 15 bp, Homo sapiens
gggtcagttgggccc

SEQ ID NO: 4795398 - DNA, 14 bp, Homo sapiens
gggtccccctcctg

SEQ ID NO: 4795399 - DNA, 22 bp, Homo sapiens
gggtccccctcctgcacgcgga

SEQ ID NO: 4795400 - DNA, 18 bp, Homo sapiens
gggtccctaattctcttc

SEQ ID NO: 4795401 - DNA, 13 bp, Homo sapiens
gggtcctcccagc

SEQ ID NO: 4795402 - DNA, 15 bp, Homo sapiens
gggtcctcccagctg

SEQ ID NO: 4795403 - DNA, 15 bp, Homo sapiens
gggtcctcggccctg

SEQ ID NO: 4795404 - DNA, 13 bp, Homo sapiens
gggtcgcccctcc

SEQ ID NO: 4795405 - DNA, 21 bp, Homo sapiens
gggtcgggggaggagcacccc

SEQ ID NO: 4795406 - DNA, 15 bp, Homo sapiens
gggtctctgagcagt

SEQ ID NO: 4795407 - DNA, 16 bp, Homo sapiens
gggtctgctcctggga

SEQ ID NO: 4795408 - DNA, 15 bp, Homo sapiens
gggtctgtcccgggt

SEQ ID NO: 4795409 - DNA, 10 bp, Homo sapiens
gggtctgtga

SEQ ID NO: 4795410 - DNA, 22 bp, Homo sapiens
gggtgcaggcgcgcaccgccca

SEQ ID NO: 4795411 - DNA, 20 bp, Homo sapiens
gggtgcccgtgtggcctggg

SEQ ID NO: 4795412 - DNA, 21 bp, Homo sapiens
gggtgcccgtgtggcctgggt

SEQ ID NO: 4795413 - DNA, 10 bp, Homo sapiens
gggtgctcag

SEQ ID NO: 4795414 - DNA, 16 bp, Homo sapiens
gggtgctcagggcatg

SEQ ID NO: 4795415 - DNA, 21 bp, Homo sapiens
gggtgctgtcatgcccagctt

SEQ ID NO: 4795416 - DNA, 17 bp, Homo sapiens
gggtggaagggcaggag

SEQ ID NO: 4795417 - DNA, 16 bp, Homo sapiens
gggtggcagcgcccag

SEQ ID NO: 4795418 - DNA, 22 bp, Homo sapiens
gggtggcaggcacacagcagcc

SEQ ID NO: 4795419 - DNA, 23 bp, Homo sapiens
gggtggcaggcacacagcagccc

SEQ ID NO: 4795420 - DNA, 13 bp, Homo sapiens
gggtggccatccc

SEQ ID NO: 4795421 - DNA, 14 bp, Homo sapiens
gggtggctggagcc

SEQ ID NO: 4795422 - DNA, 22 bp, Homo sapiens
gggtgggccccacagtggtcag

SEQ ID NO: 4795423 - DNA, 23 bp, Homo sapiens
gggtgggccccacagtggtcagc

SEQ ID NO: 4795424 - DNA, 17 bp, Homo sapiens
gggtggggcttggaagg

SEQ ID NO: 4795425 - DNA, 19 bp, Homo sapiens
gggtgtcccctggtgcccc

SEQ ID NO: 4795426 - DNA, 11 bp, Homo sapiens
gggtgtggcct

SEQ ID NO: 4795427 - DNA, 14 bp, Homo sapiens
gggtgtggcttgga

SEQ ID NO: 4795428 - DNA, 19 bp, Homo sapiens
gggttaacagtaaatatac

SEQ ID NO: 4795429 - DNA, 13 bp, Homo sapiens
gggttccagacag

SEQ ID NO: 4795430 - DNA, 23 bp, Homo sapiens
gggttccagacagagtggatctg

SEQ ID NO: 4795431 - DNA, 14 bp, Homo sapiens
gggttccagacagg

SEQ ID NO: 4795432 - DNA, 14 bp, Homo sapiens
gggttctatattta

SEQ ID NO: 4795433 - DNA, 13 bp, Homo sapiens
gggttgttgcaga

SEQ ID NO: 4795434 - DNA, 17 bp, Homo sapiens
gggtttctaaagctgcc

SEQ ID NO: 4795435 - DNA, 14 bp, Homo sapiens
gggtttgggcagtg

SEQ ID NO: 4795436 - DNA, 17 bp, Homo sapiens
gggttttagaaattcta

SEQ ID NO: 4795437 - DNA, 15 bp, Homo sapiens
gggttttcacttcct

SEQ ID NO: 4795438 - DNA, 21 bp, Homo sapiens
gggttttcttccctagcttat

SEQ ID NO: 4795439 - DNA, 21 bp, Homo sapiens
ggtaaactgatgctttcagat

SEQ ID NO: 4795440 - DNA, 19 bp, Homo sapiens
ggtaaataaatgctgcttt

SEQ ID NO: 4795441 - DNA, 21 bp, Homo sapiens
ggtaaataaatgctgctttgg

SEQ ID NO: 4795442 - DNA, 22 bp, Homo sapiens
ggtaaataaatgctgctttggg

SEQ ID NO: 4795443 - DNA, 15 bp, Homo sapiens
ggtaaataactgtga

SEQ ID NO: 4795444 - DNA, 17 bp, Homo sapiens
ggtaacttgctgtgaaa

SEQ ID NO: 4795445 - DNA, 18 bp, Homo sapiens
ggtacaagctacatatgt

SEQ ID NO: 4795446 - DNA, 14 bp, Homo sapiens
ggtacagcccaggc

SEQ ID NO: 4795447 - DNA, 15 bp, Homo sapiens
ggtacagcccaggcg

SEQ ID NO: 4795448 - DNA, 14 bp, Homo sapiens
ggtagctctgaagg

SEQ ID NO: 4795449 - DNA, 21 bp, Homo sapiens
ggtataggacaaggggtggaa

SEQ ID NO: 4795450 - DNA, 23 bp, Homo sapiens
ggtataggacaaggggtggaagg

SEQ ID NO: 4795451 - DNA, 14 bp, Homo sapiens
ggtatctctttctc

SEQ ID NO: 4795452 - DNA, 12 bp, Homo sapiens
ggtatgatcatt

SEQ ID NO: 4795453 - DNA, 14 bp, Homo sapiens
ggtatgctggccag

SEQ ID NO: 4795454 - DNA, 16 bp, Homo sapiens
ggtatgctggccagca

SEQ ID NO: 4795455 - DNA, 17 bp, Homo sapiens
ggtatgctggccagcac

SEQ ID NO: 4795456 - DNA, 18 bp, Homo sapiens
ggtatgctggccagcacc

SEQ ID NO: 4795457 - DNA, 21 bp, Homo sapiens
ggtatgctggccagcaccctc

SEQ ID NO: 4795458 - DNA, 12 bp, Homo sapiens
ggtatttactgc

SEQ ID NO: 4795459 - DNA, 19 bp, Homo sapiens
ggtatttactgcaatgtct

SEQ ID NO: 4795460 - DNA, 17 bp, Homo sapiens
ggtattttttgtgaatg

SEQ ID NO: 4795461 - DNA, 15 bp, Homo sapiens
ggtcaccttcctggg

SEQ ID NO: 4795462 - DNA, 16 bp, Homo sapiens
ggtcaccttcctgggc

SEQ ID NO: 4795463 - DNA, 18 bp, Homo sapiens
ggtcaccttcctgggcag

SEQ ID NO: 4795464 - DNA, 15 bp, Homo sapiens
ggtcagagcccagga

SEQ ID NO: 4795465 - DNA, 14 bp, Homo sapiens
ggtcaggccctgga

SEQ ID NO: 4795466 - DNA, 20 bp, Homo sapiens
ggtcagtgaagcccaggagg

SEQ ID NO: 4795467 - DNA, 21 bp, Homo sapiens
ggtcagtgaagcccaggagga

SEQ ID NO: 4795468 - DNA, 19 bp, Homo sapiens
ggtccacacaccacagaag

SEQ ID NO: 4795469 - DNA, 14 bp, Homo sapiens
ggtccaccccgtcc

SEQ ID NO: 4795470 - DNA, 15 bp, Homo sapiens
ggtccaccccgtccc

SEQ ID NO: 4795471 - DNA, 23 bp, Homo sapiens
ggtccaccccgtcccggccccgc

SEQ ID NO: 4795472 - DNA, 19 bp, Homo sapiens
gtaaaactgtgacattcca

SEQ ID NO: 4795473 - DNA, 21 bp, Homo sapiens
gtaaaacttgtattggaagta

SEQ ID NO: 4795474 - DNA, 14 bp, Homo sapiens
gtaaaattatctgt

SEQ ID NO: 4795475 - DNA, 19 bp, Homo sapiens
gtaaaattatctgttctat

SEQ ID NO: 4795476 - DNA, 15 bp, Homo sapiens
gtaaataaaaatagc

SEQ ID NO: 4795477 - DNA, 16 bp, Homo sapiens
gtaaataaatgctgct

SEQ ID NO: 4795478 - DNA, 19 bp, Homo sapiens
gtaaataaatgctgctttg

SEQ ID NO: 4795479 - DNA, 11 bp, Homo sapiens
gtaaataactg

SEQ ID NO: 4795480 - DNA, 13 bp, Homo sapiens
gtaaataactgtg

SEQ ID NO: 4795481 - DNA, 20 bp, Homo sapiens
gtaaataatgattcaatgtg

SEQ ID NO: 4795482 - DNA, 23 bp, Homo sapiens
gtaaataatgattcaatgtgaat

SEQ ID NO: 4795483 - DNA, 13 bp, Homo sapiens
gtaaataggtttc

SEQ ID NO: 4795484 - DNA, 23 bp, Homo sapiens
gtaaataggtttctaaaaagtca

SEQ ID NO: 4795485 - DNA, 22 bp, Homo sapiens
gtaaatattgctgtctgaaaaa

SEQ ID NO: 4795486 - DNA, 23 bp, Homo sapiens
gtaaatcccacgacataagctgg

SEQ ID NO: 4795487 - DNA, 20 bp, Homo sapiens
gtaaatctaacattattact

SEQ ID NO: 4795488 - DNA, 16 bp, Homo sapiens
gtaaatctatctctat

SEQ ID NO: 4795489 - DNA, 15 bp, Homo sapiens
gtaaatgatatgtct

SEQ ID NO: 4795490 - DNA, 12 bp, Homo sapiens
gtaaatgtcttc

SEQ ID NO: 4795491 - DNA, 20 bp, Homo sapiens
gtaaatgtcttcatgttgat

SEQ ID NO: 4795492 - DNA, 15 bp, Homo sapiens
gtaaatgtggacaca

SEQ ID NO: 4795493 - DNA, 20 bp, Homo sapiens
gtaaattcctaattctatga

SEQ ID NO: 4795494 - DNA, 16 bp, Homo sapiens
gtaacagtatttccat

SEQ ID NO: 4795495 - DNA, 18 bp, Homo sapiens
gtaacctctacaggcatt

SEQ ID NO: 4795496 - DNA, 12 bp, Homo sapiens
gtaactgaaagg

SEQ ID NO: 4795497 - DNA, 22 bp, Homo sapiens
gtaactgccattttttgtctgt

SEQ ID NO: 4795498 - DNA, 23 bp, Homo sapiens
gtaactgccattttttgtctgtg

SEQ ID NO: 4795499 - DNA, 20 bp, Homo sapiens
gtaactgtccgtagtatcag

SEQ ID NO: 4795500 - DNA, 20 bp, Homo sapiens
gtaactgttaacccagtgtt

SEQ ID NO: 4795501 - DNA, 19 bp, Homo sapiens
gtaacttgctgtgaaatga

SEQ ID NO: 4795502 - DNA, 15 bp, Homo sapiens
gtaagataggttctg

SEQ ID NO: 4795503 - DNA, 17 bp, Homo sapiens
gtaagatctctttctaa

SEQ ID NO: 4795504 - DNA, 17 bp, Homo sapiens
gtaagttgaagggaaat

SEQ ID NO: 4795505 - DNA, 19 bp, Homo sapiens
gtaagttgaagggaaatca

SEQ ID NO: 4795506 - DNA, 20 bp, Homo sapiens
gtaagttgaagggaaatcaa

SEQ ID NO: 4795507 - DNA, 22 bp, Homo sapiens
gtaagttgaagggaaatcaatt

SEQ ID NO: 4795508 - DNA, 14 bp, Homo sapiens
gtaagtttctaaga

SEQ ID NO: 4795509 - DNA, 20 bp, Homo sapiens
gtaatatcagttacagtggc

SEQ ID NO: 4795510 - DNA, 17 bp, Homo sapiens
gtaatatcatttcataa

SEQ ID NO: 4795511 - DNA, 12 bp, Homo sapiens
gtaatattaaat

SEQ ID NO: 4795512 - DNA, 23 bp, Homo sapiens
gtaatatttacaatgtattaagc

SEQ ID NO: 4795513 - DNA, 17 bp, Homo sapiens
gtaatggatatgaaaga

SEQ ID NO: 4795514 - DNA, 21 bp, Homo sapiens
gtaatggatatgaaagagaaa

SEQ ID NO: 4795515 - DNA, 20 bp, Homo sapiens
gtaatggggaagattagaaa

SEQ ID NO: 4795516 - DNA, 16 bp, Homo sapiens
gtaatgtaacttaatt

SEQ ID NO: 4795517 - DNA, 23 bp, Homo sapiens
gtaatgtattttacagtacatgt

SEQ ID NO: 4795518 - DNA, 13 bp, Homo sapiens
gtaattaaactgt

SEQ ID NO: 4795519 - DNA, 12 bp, Homo sapiens
gtaattcctcta

SEQ ID NO: 4795520 - DNA, 20 bp, Homo sapiens
gtaattcttctcctttgtca

SEQ ID NO: 4795521 - DNA, 21 bp, Homo sapiens
gtaattcttctcctttgtcaa

SEQ ID NO: 4795522 - DNA, 17 bp, Homo sapiens
gtaattttcttctcatt

SEQ ID NO: 4795523 - DNA, 18 bp, Homo sapiens
gtaattttcttctcattc

SEQ ID NO: 4795524 - DNA, 13 bp, Homo sapiens
gtacaattctttg

SEQ ID NO: 4795525 - DNA, 22 bp, Homo sapiens
gtacaattctttgttgcttaat

SEQ ID NO: 4795526 - DNA, 20 bp, Homo sapiens
gtacagaaccagcactccca

SEQ ID NO: 4795527 - DNA, 23 bp, Homo sapiens
gtacagaaccagcactcccaggg

SEQ ID NO: 4795528 - DNA, 18 bp, Homo sapiens
gtacagaatcattgctta

SEQ ID NO: 4795529 - DNA, 16 bp, Homo sapiens
gtacataaagtaataa

SEQ ID NO: 4795530 - DNA, 15 bp, Homo sapiens
gtacatcttgtgcat

SEQ ID NO: 4795531 - DNA, 21 bp, Homo sapiens
gtacatcttgtgcatgcaaaa

SEQ ID NO: 4795532 - DNA, 14 bp, Homo sapiens
gtacatttatgtgt

SEQ ID NO: 4795533 - DNA, 16 bp, Homo sapiens
gtaccagccctggggc

SEQ ID NO: 4795534 - DNA, 13 bp, Homo sapiens
gtaccatcccact

SEQ ID NO: 4795535 - DNA, 15 bp, Homo sapiens
gtaccatcccactga

SEQ ID NO: 4795536 - DNA, 17 bp, Homo sapiens
gtaccatgttaaagagg

SEQ ID NO: 4795537 - DNA, 14 bp, Homo sapiens
gtaccggccactgc

SEQ ID NO: 4795538 - DNA, 21 bp, Homo sapiens
gtacgtgttattattattata

SEQ ID NO: 4795539 - DNA, 14 bp, Homo sapiens
gtactaccccagga

SEQ ID NO: 4795540 - DNA, 18 bp, Homo sapiens
gtactaccccaggacgca

SEQ ID NO: 4795541 - DNA, 22 bp, Homo sapiens
gtactaccccaggacgcatgca

SEQ ID NO: 4795542 - DNA, 17 bp, Homo sapiens
gtactatctagtgtcta

SEQ ID NO: 4795543 - DNA, 16 bp, Homo sapiens
gtactggagaaaatgg

SEQ ID NO: 4795544 - DNA, 16 bp, Homo sapiens
gtactgtactttccca

SEQ ID NO: 4795545 - DNA, 23 bp, Homo sapiens
gtactgtactttcccaggttgac

SEQ ID NO: 4795546 - DNA, 12 bp, Homo sapiens
gtactgtattgg

SEQ ID NO: 4795547 - DNA, 21 bp, Homo sapiens
gtacttcttcatccatagaca

SEQ ID NO: 4795548 - DNA, 23 bp, Homo sapiens
gtacttcttcatccatagacaca

SEQ ID NO: 4795549 - DNA, 16 bp, Homo sapiens
gtacttcttctgtaat

SEQ ID NO: 4795550 - DNA, 23 bp, Homo sapiens
gtacttgccctgaccatgcattt

SEQ ID NO: 4795551 - DNA, 12 bp, Homo sapiens
gtagaaaaattt

SEQ ID NO: 4795552 - DNA, 15 bp, Homo sapiens
gtagaaactttggaa

SEQ ID NO: 4795553 - DNA, 22 bp, Homo sapiens
gtagaaattttatctcttcttc

SEQ ID NO: 4795554 - DNA, 16 bp, Homo sapiens
gtagaatcttgttaat

SEQ ID NO: 4795555 - DNA, 14 bp, Homo sapiens
gtagagaggacagt

SEQ ID NO: 4795556 - DNA, 15 bp, Homo sapiens
gtagagtcaggagaa

SEQ ID NO: 4795557 - DNA, 15 bp, Homo sapiens
gtagatcatttttat

SEQ ID NO: 4795558 - DNA, 20 bp, Homo sapiens
gtagcaacccaggtgttgtc

SEQ ID NO: 4795559 - DNA, 18 bp, Homo sapiens
gtagcagagtcattgtta

SEQ ID NO: 4795560 - DNA, 22 bp, Homo sapiens
gtagcccacaataatgaataat

SEQ ID NO: 4795561 - DNA, 20 bp, Homo sapiens
gtagcctaatattcatgctg

SEQ ID NO: 4795562 - DNA, 12 bp, Homo sapiens
gtagcctggtct

SEQ ID NO: 4795563 - DNA, 16 bp, Homo sapiens
gtagcctggtctgtgc

SEQ ID NO: 4795564 - DNA, 17 bp, Homo sapiens
gtagcctggtctgtgca

SEQ ID NO: 4795565 - DNA, 19 bp, Homo sapiens
gtagcctggtctgtgcatt

SEQ ID NO: 4795566 - DNA, 17 bp, Homo sapiens
gtagctcgtgtgcttag

SEQ ID NO: 4795567 - DNA, 19 bp, Homo sapiens
gtagcttacctgacacaag

SEQ ID NO: 4795568 - DNA, 22 bp, Homo sapiens
gtagcttacctgacacaagagg

SEQ ID NO: 4795569 - DNA, 18 bp, Homo sapiens
gtaggaaatctgaagcct

SEQ ID NO: 4795570 - DNA, 21 bp, Homo sapiens
gtagggaagaaaactatcctg

SEQ ID NO: 4795571 - DNA, 15 bp, Homo sapiens
gtaggtctgcacaca

SEQ ID NO: 4795572 - DNA, 17 bp, Homo sapiens
gtaggtctgcacacata

SEQ ID NO: 4795573 - DNA, 17 bp, Homo sapiens
gtagtacttcttctgta

SEQ ID NO: 4795574 - DNA, 22 bp, Homo sapiens
gtagtacttcttctgtaatatt

SEQ ID NO: 4795575 - DNA, 17 bp, Homo sapiens
gtagtagaatctcagca

SEQ ID NO: 4795576 - DNA, 17 bp, Homo sapiens
gtagtagttgatgacca

SEQ ID NO: 4795577 - DNA, 21 bp, Homo sapiens
gtagtgttattgccaggaaag

SEQ ID NO: 4795578 - DNA, 13 bp, Homo sapiens
gtagtgttgggtg

SEQ ID NO: 4795579 - DNA, 17 bp, Homo sapiens
gtataaaaaagaaaact

SEQ ID NO: 4795580 - DNA, 17 bp, Homo sapiens
gtataaaacagtgtttc

SEQ ID NO: 4795581 - DNA, 19 bp, Homo sapiens
gtataaaatggtgttttca

SEQ ID NO: 4795582 - DNA, 12 bp, Homo sapiens
gtataaaatgta

SEQ ID NO: 4795583 - DNA, 12 bp, Homo sapiens
gtataaactttt

SEQ ID NO: 4795584 - DNA, 19 bp, Homo sapiens
gtataaattacatgcatga

SEQ ID NO: 4795585 - DNA, 17 bp, Homo sapiens
gtataagatgctgctga

SEQ ID NO: 4795586 - DNA, 21 bp, Homo sapiens
gtataagatgctgctgagcac

SEQ ID NO: 4795587 - DNA, 13 bp, Homo sapiens
gtataattatgaa

SEQ ID NO: 4795588 - DNA, 12 bp, Homo sapiens
gtatacaaacag

SEQ ID NO: 4795589 - DNA, 14 bp, Homo sapiens
gtatacaaacaggt

SEQ ID NO: 4795590 - DNA, 14 bp, Homo sapiens
gtatacatatgtat

SEQ ID NO: 4795591 - DNA, 12 bp, Homo sapiens
gtataggacaag

SEQ ID NO: 4795592 - DNA, 16 bp, Homo sapiens
gtataggacaaggggt

SEQ ID NO: 4795593 - DNA, 12 bp, Homo sapiens
gtatataagctt

SEQ ID NO: 4795594 - DNA, 13 bp, Homo sapiens
gtcatgggagaag

SEQ ID NO: 4795595 - DNA, 20 bp, Homo sapiens
gtcattagaattgaattatt

SEQ ID NO: 4795596 - DNA, 14 bp, Homo sapiens
gtcattctcatcca

SEQ ID NO: 4795597 - DNA, 13 bp, Homo sapiens
gtcatttgctaat

SEQ ID NO: 4795598 - DNA, 19 bp, Homo sapiens
gtcatttgctaatgaattt

SEQ ID NO: 4795599 - DNA, 19 bp, Homo sapiens
gtcatttggtggctctaac

SEQ ID NO: 4795600 - DNA, 19 bp, Homo sapiens
gtcattttctgttatacac

SEQ ID NO: 4795601 - DNA, 13 bp, Homo sapiens
gtccaatccagcc

SEQ ID NO: 4795602 - DNA, 14 bp, Homo sapiens
gtccaatccagcct

SEQ ID NO: 4795603 - DNA, 13 bp, Homo sapiens
gtccacaaatgtc

SEQ ID NO: 4795604 - DNA, 14 bp, Homo sapiens
gtccacaaatgtcc

SEQ ID NO: 4795605 - DNA, 15 bp, Homo sapiens
gtccacaaatgtcct

SEQ ID NO: 4795606 - DNA, 17 bp, Homo sapiens
gtccacaaatgtcctca

SEQ ID NO: 4795607 - DNA, 21 bp, Homo sapiens
gtccacaaatgtcctcagagg

SEQ ID NO: 4795608 - DNA, 15 bp, Homo sapiens
gtccacacaccacag

SEQ ID NO: 4795609 - DNA, 13 bp, Homo sapiens
gtccacatacact

SEQ ID NO: 4795610 - DNA, 17 bp, Homo sapiens
gtccacccccattgtga

SEQ ID NO: 4795611 - DNA, 19 bp, Homo sapiens
gtccacccccattgtgaat

SEQ ID NO: 4795612 - DNA, 20 bp, Homo sapiens
gtccacccccattgtgaatg

SEQ ID NO: 4795613 - DNA, 21 bp, Homo sapiens
gtccacccccattgtgaatgt

SEQ ID NO: 4795614 - DNA, 13 bp, Homo sapiens
gtccaccttctgc

SEQ ID NO: 4795615 - DNA, 20 bp, Homo sapiens
gtccaccttctgccaaggcc

SEQ ID NO: 4795616 - DNA, 16 bp, Homo sapiens
gtccactttcctctct

SEQ ID NO: 4795617 - DNA, 19 bp, Homo sapiens
gtccactttcctctctctc

SEQ ID NO: 4795618 - DNA, 17 bp, Homo sapiens
gtccagaacaaaagata

SEQ ID NO: 4795619 - DNA, 16 bp, Homo sapiens
gtccagacaagccctg

SEQ ID NO: 4795620 - DNA, 22 bp, Homo sapiens
gtccagccctccgccagccctg

SEQ ID NO: 4795621 - DNA, 19 bp, Homo sapiens
gtccagggtccagccctcc

SEQ ID NO: 4795622 - DNA, 16 bp, Homo sapiens
gtccaggtcacaggca

SEQ ID NO: 4795623 - DNA, 11 bp, Homo sapiens
gtccaggtgat

SEQ ID NO: 4795624 - DNA, 15 bp, Homo sapiens
gtccatccgtctctg

SEQ ID NO: 4795625 - DNA, 19 bp, Homo sapiens
gtcccaccgggagcctccc

SEQ ID NO: 4795626 - DNA, 21 bp, Homo sapiens
gtcccacttccccatctgtgt

SEQ ID NO: 4795627 - DNA, 23 bp, Homo sapiens
gtcccagctacaggggaggctga

SEQ ID NO: 4795628 - DNA, 16 bp, Homo sapiens
gtcccagtccggtgcc

SEQ ID NO: 4795629 - DNA, 21 bp, Homo sapiens
gtcccagtccggtgccttcca

SEQ ID NO: 4795630 - DNA, 14 bp, Homo sapiens
gtcccagtgtctgg

SEQ ID NO: 4795631 - DNA, 17 bp, Homo sapiens
gtcccagtgtctggccc

SEQ ID NO: 4795632 - DNA, 23 bp, Homo sapiens
gtcccagtgtctggcccagccat

SEQ ID NO: 4795633 - DNA, 16 bp, Homo sapiens
gtcccccatgccacca

SEQ ID NO: 4795634 - DNA, 17 bp, Homo sapiens
gtcccccatgccaccac

SEQ ID NO: 4795635 - DNA, 18 bp, Homo sapiens
gtcccccatgccaccacc

SEQ ID NO: 4795636 - DNA, 19 bp, Homo sapiens
gtcccccatgccaccaccc

SEQ ID NO: 4795637 - DNA, 15 bp, Homo sapiens
gtcccccctgtggtc

SEQ ID NO: 4795638 - DNA, 16 bp, Homo sapiens
gtccccgcactgggct

SEQ ID NO: 4795639 - DNA, 16 bp, Homo sapiens
gtccccggacgctggc

SEQ ID NO: 4795640 - DNA, 17 bp, Homo sapiens
gtccccggacgctggct

SEQ ID NO: 4795641 - DNA, 18 bp, Homo sapiens
gtccccggacgctggctc

SEQ ID NO: 4795642 - DNA, 13 bp, Homo sapiens
gtcccctcactct

SEQ ID NO: 4795643 - DNA, 19 bp, Homo sapiens
gtcccgagggcgcctgggt

SEQ ID NO: 4795644 - DNA, 18 bp, Homo sapiens
gtcccgccctggctcttt

SEQ ID NO: 4795645 - DNA, 16 bp, Homo sapiens
gtcccgggcactgtca

SEQ ID NO: 4795646 - DNA, 22 bp, Homo sapiens
gtcccgggtactcagtcagccc

SEQ ID NO: 4795647 - DNA, 18 bp, Homo sapiens
gtcccgtgccctgtttcc

SEQ ID NO: 4795648 - DNA, 16 bp, Homo sapiens
gtccctaggtgggtca

SEQ ID NO: 4795649 - DNA, 18 bp, Homo sapiens
gtccctcgagctctgtag

SEQ ID NO: 4795650 - DNA, 21 bp, Homo sapiens
gtccctcgagctctgtagcct

SEQ ID NO: 4795651 - DNA, 14 bp, Homo sapiens
gtccctgacttccc

SEQ ID NO: 4795652 - DNA, 15 bp, Homo sapiens
gtccctgacttccca

SEQ ID NO: 4795653 - DNA, 15 bp, Homo sapiens
gtccctgagggccct

SEQ ID NO: 4795654 - DNA, 18 bp, Homo sapiens
gtccctgagggcccttcc

SEQ ID NO: 4795655 - DNA, 16 bp, Homo sapiens
gtccctgtcccctcct

SEQ ID NO: 4795656 - DNA, 19 bp, Homo sapiens
gtcccttacgtgagtcctg

SEQ ID NO: 4795657 - DNA, 15 bp, Homo sapiens
gtcccttcctgtcct

SEQ ID NO: 4795658 - DNA, 21 bp, Homo sapiens
gtcccttcctgtcctgctcac

SEQ ID NO: 4795659 - DNA, 21 bp, Homo sapiens
gtcccttctctttggggctcc

SEQ ID NO: 4795660 - DNA, 16 bp, Homo sapiens
gtccctttccctgcat

SEQ ID NO: 4795661 - DNA, 13 bp, Homo sapiens
gtcccttttcctt

SEQ ID NO: 4795662 - DNA, 20 bp, Homo sapiens
gtccgaggcctggctctgga

SEQ ID NO: 4795663 - DNA, 20 bp, Homo sapiens
gtccgccccgtgctcctctg

SEQ ID NO: 4795664 - DNA, 13 bp, Homo sapiens
gtccgcccgccca

SEQ ID NO: 4795665 - DNA, 17 bp, Homo sapiens
gtccgcccgcccacccc

SEQ ID NO: 4795666 - DNA, 16 bp, Homo sapiens
gtccggcctgcagccc

SEQ ID NO: 4795667 - DNA, 16 bp, Homo sapiens
gtccggtgccttccac

SEQ ID NO: 4795668 - DNA, 15 bp, Homo sapiens
gtccgtccgcccgcc

SEQ ID NO: 4795669 - DNA, 20 bp, Homo sapiens
gtccgtcctgctcgccctgt

SEQ ID NO: 4795670 - DNA, 18 bp, Homo sapiens
gtccgtctgtcctgcgcc

SEQ ID NO: 4795671 - DNA, 23 bp, Homo sapiens
gtcctacaatatcattttcctgg

SEQ ID NO: 4795672 - DNA, 18 bp, Homo sapiens
gtcctagaatgtttcatt

SEQ ID NO: 4795673 - DNA, 14 bp, Homo sapiens
gtcctatccctgga

SEQ ID NO: 4795674 - DNA, 14 bp, Homo sapiens
gtcctcggccctgt

SEQ ID NO: 4795675 - DNA, 19 bp, Homo sapiens
gtcctcggccctgtagccc

SEQ ID NO: 4795676 - DNA, 23 bp, Homo sapiens
gtcctcggccctgtagccctggc

SEQ ID NO: 4795677 - DNA, 19 bp, Homo sapiens
gtcctctcagaactcctgt

SEQ ID NO: 4795678 - DNA, 13 bp, Homo sapiens
gtcctctcgagcc

SEQ ID NO: 4795679 - DNA, 18 bp, Homo sapiens
gtcctctcgtagaacctg

SEQ ID NO: 4795680 - DNA, 19 bp, Homo sapiens
gtcctgagccccctgcacc

SEQ ID NO: 4795681 - DNA, 15 bp, Homo sapiens
gtcctgagctaacac

SEQ ID NO: 4795682 - DNA, 16 bp, Homo sapiens
gtcctgcccatgtgtc

SEQ ID NO: 4795683 - DNA, 21 bp, Homo sapiens
gtcctgcccatgtgtcccctc

SEQ ID NO: 4795684 - DNA, 23 bp, Homo sapiens
gtcctgcccatgtgtcccctcac

SEQ ID NO: 4795685 - DNA, 19 bp, Homo sapiens
gtcctgcgcctgcgcctcc

SEQ ID NO: 4795686 - DNA, 16 bp, Homo sapiens
gtcctgctacctttgt

SEQ ID NO: 4795687 - DNA, 21 bp, Homo sapiens
gtcctgctcacgtctgtgagt

SEQ ID NO: 4795688 - DNA, 22 bp, Homo sapiens
gtcctgctcgccctgtgccctc

SEQ ID NO: 4795689 - DNA, 20 bp, Homo sapiens
gtcctgctgctcgggaaggc

SEQ ID NO: 4795690 - DNA, 22 bp, Homo sapiens
gtcctgctgctcgggaaggcct

SEQ ID NO: 4795691 - DNA, 16 bp, Homo sapiens
gtcctggcatgggaat

SEQ ID NO: 4795692 - DNA, 17 bp, Homo sapiens
gtcctggcccgggagcc

SEQ ID NO: 4795693 - DNA, 20 bp, Homo sapiens
gtcctggctcccagggtcct

SEQ ID NO: 4795694 - DNA, 12 bp, Homo sapiens
gtcctggggtgg

SEQ ID NO: 4795695 - DNA, 10 bp, Homo sapiens
gtcctgggtg

SEQ ID NO: 4795696 - DNA, 17 bp, Homo sapiens
gtcctgggtgctgtcat

SEQ ID NO: 4795697 - DNA, 17 bp, Homo sapiens
gtcctgtcctggctccc

SEQ ID NO: 4795698 - DNA, 16 bp, Homo sapiens
gtcctgtgagatgtgt

SEQ ID NO: 4795699 - DNA, 18 bp, Homo sapiens
gtcctgtgtcatctgtca

SEQ ID NO: 4795700 - DNA, 18 bp, Homo sapiens
gtccttccaacctgttca

SEQ ID NO: 4795701 - DNA, 15 bp, Homo sapiens
gtccttgtccccgcc

SEQ ID NO: 4795702 - DNA, 15 bp, Homo sapiens
gtcctttcctctcct

SEQ ID NO: 4795703 - DNA, 19 bp, Homo sapiens
gtcctttcctctcctctct

SEQ ID NO: 4795704 - DNA, 15 bp, Homo sapiens
gtcgccccaggccct

SEQ ID NO: 4795705 - DNA, 16 bp, Homo sapiens
gtcgccccaggccctc

SEQ ID NO: 4795706 - DNA, 18 bp, Homo sapiens
gtcgccccaggccctccc

SEQ ID NO: 4795707 - DNA, 22 bp, Homo sapiens
gtcgccccaggccctccctgac

SEQ ID NO: 4795708 - DNA, 11 bp, Homo sapiens
gtcgctgtccg

SEQ ID NO: 4795709 - DNA, 18 bp, Homo sapiens
gtcggctgggcagggccg

SEQ ID NO: 4795710 - DNA, 17 bp, Homo sapiens
gtcgggggaggagcacc

SEQ ID NO: 4795711 - DNA, 21 bp, Homo sapiens
gtcgggggaggagcaccccca

SEQ ID NO: 4795712 - DNA, 18 bp, Homo sapiens
gtctacctgaaaattcaa

SEQ ID NO: 4795713 - DNA, 22 bp, Homo sapiens
gtctagctatgctgtatctgtg

SEQ ID NO: 4795714 - DNA, 20 bp, Homo sapiens
gtctatctggtattaaatgc

SEQ ID NO: 4795715 - DNA, 22 bp, Homo sapiens
gtctatctggtattaaatgcca

SEQ ID NO: 4795716 - DNA, 21 bp, Homo sapiens
gtgcaataaaactcccttcct

SEQ ID NO: 4795717 - DNA, 20 bp, Homo sapiens
gtgcaatttgtttgtgcttc

SEQ ID NO: 4795718 - DNA, 22 bp, Homo sapiens
gtgcacaaaccttcttttcaat

SEQ ID NO: 4795719 - DNA, 17 bp, Homo sapiens
gtgcacctgccccaggc

SEQ ID NO: 4795720 - DNA, 14 bp, Homo sapiens
gtgcagagtataca

SEQ ID NO: 4795721 - DNA, 20 bp, Homo sapiens
gtgcaggcgcgcaccgccca

SEQ ID NO: 4795722 - DNA, 21 bp, Homo sapiens
gtgcagggacagcctgcacag

SEQ ID NO: 4795723 - DNA, 23 bp, Homo sapiens
gtgcagggcctgtaatcccagca

SEQ ID NO: 4795724 - DNA, 14 bp, Homo sapiens
gtgcagtagtgtca

SEQ ID NO: 4795725 - DNA, 19 bp, Homo sapiens
gtgcagtttggtatgaaac

SEQ ID NO: 4795726 - DNA, 14 bp, Homo sapiens
gtgcatctggccta

SEQ ID NO: 4795727 - DNA, 16 bp, Homo sapiens
gtgcatctggcctatg

SEQ ID NO: 4795728 - DNA, 21 bp, Homo sapiens
gtgcatctggcctatgaccct

SEQ ID NO: 4795729 - DNA, 22 bp, Homo sapiens
gtgcatctggcctatgaccctg

SEQ ID NO: 4795730 - DNA, 15 bp, Homo sapiens
gtgcatctggcctgg

SEQ ID NO: 4795731 - DNA, 17 bp, Homo sapiens
gtgcatgagaatgtcat

SEQ ID NO: 4795732 - DNA, 20 bp, Homo sapiens
gtgcatgccttcataaatta

SEQ ID NO: 4795733 - DNA, 22 bp, Homo sapiens
gtgcatgctgtcccttacgtga

SEQ ID NO: 4795734 - DNA, 18 bp, Homo sapiens
gtgcatgtcacatgacat

SEQ ID NO: 4795735 - DNA, 23 bp, Homo sapiens
gtgcatgtcacatgacatccaca

SEQ ID NO: 4795736 - DNA, 16 bp, Homo sapiens
gtgcatgttaaaataa

SEQ ID NO: 4795737 - DNA, 19 bp, Homo sapiens
gtgcatgttaaaataatta

SEQ ID NO: 4795738 - DNA, 18 bp, Homo sapiens
gtgcatttgagagaagcc

SEQ ID NO: 4795739 - DNA, 24 bp, Homo sapiens
gtgcatttgagagaagccacgctg

SEQ ID NO: 4795740 - DNA, 21 bp, Homo sapiens
gtgccacatggccgctgccca

SEQ ID NO: 4795741 - DNA, 22 bp, Homo sapiens
gtgccacatggccgctgcccac

SEQ ID NO: 4795742 - DNA, 15 bp, Homo sapiens
gtgccagacgtgctc

SEQ ID NO: 4795743 - DNA, 19 bp, Homo sapiens
gtgccagctggtgaatcca

SEQ ID NO: 4795744 - DNA, 15 bp, Homo sapiens
gtgccatggccagga

SEQ ID NO: 4795745 - DNA, 19 bp, Homo sapiens
gtgcccacccgtgttctcc

SEQ ID NO: 4795746 - DNA, 15 bp, Homo sapiens
gtgcccagtcttgag

SEQ ID NO: 4795747 - DNA, 19 bp, Homo sapiens
gtgccccccatgccctccc

SEQ ID NO: 4795748 - DNA, 23 bp, Homo sapiens
gtgccccctggggggcacagcca

SEQ ID NO: 4795749 - DNA, 17 bp, Homo sapiens
gtgccccgcctcccggg

SEQ ID NO: 4795750 - DNA, 16 bp, Homo sapiens
gtgcccctcctgcccc

SEQ ID NO: 4795751 - DNA, 16 bp, Homo sapiens
gtgcccgtgtggcctg

SEQ ID NO: 4795752 - DNA, 18 bp, Homo sapiens
gtgcccgtgtggcctggg

SEQ ID NO: 4795753 - DNA, 15 bp, Homo sapiens
gtgccctctcactga

SEQ ID NO: 4795754 - DNA, 22 bp, Homo sapiens
gtgccctgttgacctaccctgg

SEQ ID NO: 4795755 - DNA, 13 bp, Homo sapiens
gtgccctgtttcc

SEQ ID NO: 4795756 - DNA, 23 bp, Homo sapiens
gtgccgcttaaacatttccctgc

SEQ ID NO: 4795757 - DNA, 16 bp, Homo sapiens
gtgcctgctatccagc

SEQ ID NO: 4795758 - DNA, 18 bp, Homo sapiens
gtgcctgctatccagccg

SEQ ID NO: 4795759 - DNA, 18 bp, Homo sapiens
gtgcctgtgtttcatgtt

SEQ ID NO: 4795760 - DNA, 14 bp, Homo sapiens
ggcaggcctcccaa

SEQ ID NO: 4795761 - DNA, 22 bp, Homo sapiens
ggcaggcctcccaagctgatgg

SEQ ID NO: 4795762 - DNA, 15 bp, Homo sapiens
ggcagggaggtcagg

SEQ ID NO: 4795763 - DNA, 19 bp, Homo sapiens
ggcagggaggtcaggccct

SEQ ID NO: 4795764 - DNA, 16 bp, Homo sapiens
ggcagggccgcagggc

SEQ ID NO: 4795765 - DNA, 13 bp, Homo sapiens
ggcagtgcagtgc

SEQ ID NO: 4795766 - DNA, 24 bp, Homo sapiens
ggcagtgctagtgagctgggcatg

SEQ ID NO: 4795767 - DNA, 13 bp, Homo sapiens
ggcagtggagagg

SEQ ID NO: 4795768 - DNA, 19 bp, Homo sapiens
ggcagtgttcttgggggtg

SEQ ID NO: 4795769 - DNA, 18 bp, Homo sapiens
ggcatactctccaggatt

SEQ ID NO: 4795770 - DNA, 15 bp, Homo sapiens
ggcataggactcttt

SEQ ID NO: 4795771 - DNA, 15 bp, Homo sapiens
ggcatccacttcaca

SEQ ID NO: 4795772 - DNA, 17 bp, Homo sapiens
ggcatccgagcccctgt

SEQ ID NO: 4795773 - DNA, 15 bp, Homo sapiens
ggcatgcctggacaa

SEQ ID NO: 4795774 - DNA, 22 bp, Homo sapiens
ggcatgcttattagcagctggg

SEQ ID NO: 4795775 - DNA, 18 bp, Homo sapiens
ggcatgggaatgaatgtc

SEQ ID NO: 4795776 - DNA, 13 bp, Homo sapiens
ggcatgggtggag

SEQ ID NO: 4795777 - DNA, 19 bp, Homo sapiens
ggccaaaggaagcacatgc

SEQ ID NO: 4795778 - DNA, 21 bp, Homo sapiens
ggccaagccagggttccagac

SEQ ID NO: 4795779 - DNA, 20 bp, Homo sapiens
ggccaaggacactgatgggt

SEQ ID NO: 4795780 - DNA, 19 bp, Homo sapiens
ggccagaccacgcccctgc

SEQ ID NO: 4795781 - DNA, 17 bp, Homo sapiens
ggccagacgctgccgct

SEQ ID NO: 4795782 - DNA, 19 bp, Homo sapiens
ggccagcaccctctcctgg

SEQ ID NO: 4795783 - DNA, 20 bp, Homo sapiens
ggccagcaccctctcctggg

SEQ ID NO: 4795784 - DNA, 23 bp, Homo sapiens
ggccagcaccctctcctgggggt

SEQ ID NO: 4795785 - DNA, 16 bp, Homo sapiens
ggccagcccgcagagg

SEQ ID NO: 4795786 - DNA, 21 bp, Homo sapiens
ggccagcctggggcctggcag

SEQ ID NO: 4795787 - DNA, 17 bp, Homo sapiens
ggccaggaaggggacag

SEQ ID NO: 4795788 - DNA, 19 bp, Homo sapiens
ggccaggaaggggacagga

SEQ ID NO: 4795789 - DNA, 13 bp, Homo sapiens
ggccaggagcctc

SEQ ID NO: 4795790 - DNA, 22 bp, Homo sapiens
ggccaggagtgggtttccctgc

SEQ ID NO: 4795791 - DNA, 18 bp, Homo sapiens
ggccaggcttgtctcgaa

SEQ ID NO: 4795792 - DNA, 14 bp, Homo sapiens
ggccagtactttgc

SEQ ID NO: 4795793 - DNA, 19 bp, Homo sapiens
ggccatccctgggcccctc

SEQ ID NO: 4795794 - DNA, 16 bp, Homo sapiens
ggccatgttcccagaa

SEQ ID NO: 4795795 - DNA, 13 bp, Homo sapiens
ggccatttcacat

SEQ ID NO: 4795796 - DNA, 23 bp, Homo sapiens
ggcccacaggaggcaagcaagct

SEQ ID NO: 4795797 - DNA, 20 bp, Homo sapiens
ggcccaccagggactgcagc

SEQ ID NO: 4795798 - DNA, 21 bp, Homo sapiens
ggcccaccagggactgcagct

SEQ ID NO: 4795799 - DNA, 15 bp, Homo sapiens
ggcccacccctcttc

SEQ ID NO: 4795800 - DNA, 23 bp, Homo sapiens
ggcccacccctcttcccccttcc

SEQ ID NO: 4795801 - DNA, 14 bp, Homo sapiens
ggcccacgcagagc

SEQ ID NO: 4795802 - DNA, 18 bp, Homo sapiens
ggcccacgcagagccccg

SEQ ID NO: 4795803 - DNA, 20 bp, Homo sapiens
ggcccacgcagagccccgga

SEQ ID NO: 4795804 - DNA, 16 bp, Homo sapiens
ggcccacgtcctgggt

SEQ ID NO: 4795805 - DNA, 18 bp, Homo sapiens
ggcccagcagcggcccag

SEQ ID NO: 4795806 - DNA, 13 bp, Homo sapiens
ggcccagccagca

SEQ ID NO: 4795807 - DNA, 13 bp, Homo sapiens
ggcccagccatgg

SEQ ID NO: 4795808 - DNA, 11 bp, Homo sapiens
ggcccagcctg

SEQ ID NO: 4795809 - DNA, 13 bp, Homo sapiens
ggcccagcctggc

SEQ ID NO: 4795810 - DNA, 21 bp, Homo sapiens
ggcccatggccccagctggct

SEQ ID NO: 4795811 - DNA, 13 bp, Homo sapiens
ggcccatggtgga

SEQ ID NO: 4795812 - DNA, 13 bp, Homo sapiens
ggccccacagtgg

SEQ ID NO: 4795813 - DNA, 16 bp, Homo sapiens
ggccccacagtggtca

SEQ ID NO: 4795814 - DNA, 13 bp, Homo sapiens
ggccccagctggc

SEQ ID NO: 4795815 - DNA, 17 bp, Homo sapiens
ggcccccacaggggatg

SEQ ID NO: 4795816 - DNA, 19 bp, Homo sapiens
ggccccccagctcaggggc

SEQ ID NO: 4795817 - DNA, 20 bp, Homo sapiens
ggcccccggaggcgcccacc

SEQ ID NO: 4795818 - DNA, 21 bp, Homo sapiens
ggcccccggaggcgcccacct

SEQ ID NO: 4795819 - DNA, 16 bp, Homo sapiens
ggccccgcggagcccc

SEQ ID NO: 4795820 - DNA, 17 bp, Homo sapiens
ggccccgcggagccccc

SEQ ID NO: 4795821 - DNA, 13 bp, Homo sapiens
ggcccctccacgc

SEQ ID NO: 4795822 - DNA, 20 bp, Homo sapiens
ggcccctcctccagagcctg

SEQ ID NO: 4795823 - DNA, 11 bp, Homo sapiens
ggcccctcctt

SEQ ID NO: 4795824 - DNA, 20 bp, Homo sapiens
ggcccctccttctcccctcc

SEQ ID NO: 4795825 - DNA, 20 bp, Homo sapiens
ggcccctgggatgggaccag

SEQ ID NO: 4795826 - DNA, 14 bp, Homo sapiens
ggcccgaggcaccg

SEQ ID NO: 4795827 - DNA, 14 bp, Homo sapiens
ggcccgccccaggc

SEQ ID NO: 4795828 - DNA, 15 bp, Homo sapiens
ggcccgccctgcccg

SEQ ID NO: 4795829 - DNA, 17 bp, Homo sapiens
ggcccgctcaacctctc

SEQ ID NO: 4795830 - DNA, 18 bp, Homo sapiens
ggcccgctcaacctctca

SEQ ID NO: 4795831 - DNA, 19 bp, Homo sapiens
ggcccgctcaacctctcag

SEQ ID NO: 4795832 - DNA, 20 bp, Homo sapiens
ggcccgctcaacctctcaga

SEQ ID NO: 4795833 - DNA, 22 bp, Homo sapiens
ggcccgctcaacctctcagatc

SEQ ID NO: 4795834 - DNA, 14 bp, Homo sapiens
ggcccggcccacgc

SEQ ID NO: 4795835 - DNA, 19 bp, Homo sapiens
ggcccggcccacgcagagc

SEQ ID NO: 4795836 - DNA, 18 bp, Homo sapiens
ggcccggtcccagtccgg

SEQ ID NO: 4795837 - DNA, 21 bp, Homo sapiens
ggcccggtcccagtccggtgc

SEQ ID NO: 4795838 - DNA, 23 bp, Homo sapiens
ggcccggtcccagtccggtgcct

SEQ ID NO: 4795839 - DNA, 14 bp, Homo sapiens
ggcccgtgcgcagc

SEQ ID NO: 4795840 - DNA, 11 bp, Homo sapiens
ggccctccctg

SEQ ID NO: 4795841 - DNA, 21 bp, Homo sapiens
ggccctccctgactccctgtg

SEQ ID NO: 4795842 - DNA, 22 bp, Homo sapiens
ggccctccctgactccctgtgg

SEQ ID NO: 4795843 - DNA, 16 bp, Homo sapiens
ggccctcgggccctct

SEQ ID NO: 4795844 - DNA, 20 bp, Homo sapiens
ggccctcgggccctctctcc

SEQ ID NO: 4795845 - DNA, 22 bp, Homo sapiens
ggccctgccccacacaggcctg

SEQ ID NO: 4795846 - DNA, 11 bp, Homo sapiens
ggccctgccct

SEQ ID NO: 4795847 - DNA, 14 bp, Homo sapiens
ggccctgccctccc

SEQ ID NO: 4795848 - DNA, 16 bp, Homo sapiens
ggccctgccctccccc

SEQ ID NO: 4795849 - DNA, 17 bp, Homo sapiens
ggccctgccctccccca

SEQ ID NO: 4795850 - DNA, 15 bp, Homo sapiens
ggccctggaactcta

SEQ ID NO: 4795851 - DNA, 13 bp, Homo sapiens
ggccctgggcctc

SEQ ID NO: 4795852 - DNA, 16 bp, Homo sapiens
ggccctgggcctcagt

SEQ ID NO: 4795853 - DNA, 16 bp, Homo sapiens
ggccctggggtctctg

SEQ ID NO: 4795854 - DNA, 14 bp, Homo sapiens
ggccctgtagccct

SEQ ID NO: 4795855 - DNA, 17 bp, Homo sapiens
ggccctgtagccctggc

SEQ ID NO: 4795856 - DNA, 17 bp, Homo sapiens
ggccctgtgggagtcca

SEQ ID NO: 4795857 - DNA, 12 bp, Homo sapiens
ggcccttccttc

SEQ ID NO: 4795858 - DNA, 17 bp, Homo sapiens
ggcccttccttcaccca

SEQ ID NO: 4795859 - DNA, 17 bp, Homo sapiens
ggccgagggaaatgctg

SEQ ID NO: 4795860 - DNA, 12 bp, Homo sapiens
ggccgcagggcg

SEQ ID NO: 4795861 - DNA, 20 bp, Homo sapiens
ggccgcagggcgctccggca

SEQ ID NO: 4795862 - DNA, 23 bp, Homo sapiens
ggccgccgaagggcagccccgcg

SEQ ID NO: 4795863 - DNA, 14 bp, Homo sapiens
ggccgcctcctcca

SEQ ID NO: 4795864 - DNA, 19 bp, Homo sapiens
ggccgcctcctccagactc

SEQ ID NO: 4795865 - DNA, 18 bp, Homo sapiens
ggccgctctccgcccccc

SEQ ID NO: 4795866 - DNA, 21 bp, Homo sapiens
ggccgctctccgccccccggc

SEQ ID NO: 4795867 - DNA, 17 bp, Homo sapiens
ggccgctgcagtcagca

SEQ ID NO: 4795868 - DNA, 21 bp, Homo sapiens
ggccgctgcagtcagcacaga

SEQ ID NO: 4795869 - DNA, 22 bp, Homo sapiens
ggccgctgcagtcagcacagag

SEQ ID NO: 4795870 - DNA, 16 bp, Homo sapiens
ggccgctgctgtgaca

SEQ ID NO: 4795871 - DNA, 22 bp, Homo sapiens
ggccgctgggagaaaagccaga

SEQ ID NO: 4795872 - DNA, 21 bp, Homo sapiens
ggccggcccacgtcctgggtg

SEQ ID NO: 4795873 - DNA, 23 bp, Homo sapiens
ggccggtccaccccgtcccggcc

SEQ ID NO: 4795874 - DNA, 21 bp, Homo sapiens
ggccgtccctgacttcccagc

SEQ ID NO: 4795875 - DNA, 23 bp, Homo sapiens
ggcctaatccacctggtggccct

SEQ ID NO: 4795876 - DNA, 16 bp, Homo sapiens
ggcctaccacagctgc

SEQ ID NO: 4795877 - DNA, 17 bp, Homo sapiens
ggcctaccacagctgcc

SEQ ID NO: 4795878 - DNA, 22 bp, Homo sapiens
ggcctaccacagctgcctccgg

SEQ ID NO: 4795879 - DNA, 14 bp, Homo sapiens
ggcctatgaccctg

SEQ ID NO: 4795880 - DNA, 19 bp, Homo sapiens
ggcctatgaccctgtgcct

SEQ ID NO: 4795881 - DNA, 21 bp, Homo sapiens
ggcctatgaccctgtgcctgt

SEQ ID NO: 4795882 - DNA, 23 bp, Homo sapiens
ggctgctgcagtcagcacagaga

SEQ ID NO: 4795883 - DNA, 20 bp, Homo sapiens
ggctgctgcttctccctggg

SEQ ID NO: 4795884 - DNA, 12 bp, Homo sapiens
ggctgcttctcc

SEQ ID NO: 4795885 - DNA, 16 bp, Homo sapiens
ggctgcttctccacct

SEQ ID NO: 4795886 - DNA, 18 bp, Homo sapiens
ggctgcttctccacctcc

SEQ ID NO: 4795887 - DNA, 15 bp, Homo sapiens
ggctggaccaactgc

SEQ ID NO: 4795888 - DNA, 22 bp, Homo sapiens
ggctggagccccatcgcctggg

SEQ ID NO: 4795889 - DNA, 13 bp, Homo sapiens
ggctggagtgggc

SEQ ID NO: 4795890 - DNA, 14 bp, Homo sapiens
ggctggataggaga

SEQ ID NO: 4795891 - DNA, 19 bp, Homo sapiens
ggctggcacccactggagg

SEQ ID NO: 4795892 - DNA, 12 bp, Homo sapiens
ggctggccctgc

SEQ ID NO: 4795893 - DNA, 15 bp, Homo sapiens
ggctggccctgccct

SEQ ID NO: 4795894 - DNA, 18 bp, Homo sapiens
ggctggccctgccctccc

SEQ ID NO: 4795895 - DNA, 18 bp, Homo sapiens
ggctggccggtccacccc

SEQ ID NO: 4795896 - DNA, 18 bp, Homo sapiens
ggctggcggggtctgctc

SEQ ID NO: 4795897 - DNA, 13 bp, Homo sapiens
ggctgggcagggc

SEQ ID NO: 4795898 - DNA, 13 bp, Homo sapiens
ggctgggcccctg

SEQ ID NO: 4795899 - DNA, 17 bp, Homo sapiens
ggctgggcccctgggat

SEQ ID NO: 4795900 - DNA, 21 bp, Homo sapiens
ggctgggcccctgggatggga

SEQ ID NO: 4795901 - DNA, 16 bp, Homo sapiens
gcttggagggatggag

SEQ ID NO: 4795902 - DNA, 16 bp, Homo sapiens
gcttggggaccagagc

SEQ ID NO: 4795903 - DNA, 22 bp, Homo sapiens
gcttggggaccagagctgccac

SEQ ID NO: 4795904 - DNA, 13 bp, Homo sapiens
ggagggcgctttt

SEQ ID NO: 4795905 - DNA, 23 bp, Homo sapiens
ggaggggtcagcaggggggttgg

SEQ ID NO: 4795906 - DNA, 16 bp, Homo sapiens
ggaggtcaggccctgg

SEQ ID NO: 4795907 - DNA, 21 bp, Homo sapiens
gcgggcagcccctgctggacc

SEQ ID NO: 4795908 - DNA, 23 bp, Homo sapiens
gcgggggctaactggccccaggc

SEQ ID NO: 4795909 - DNA, 23 bp, Homo sapiens
gcgggtcatattcataccttctg

SEQ ID NO: 4795910 - DNA, 18 bp, Homo sapiens
gcgggtggctggagcccc

SEQ ID NO: 4795911 - DNA, 22 bp, Homo sapiens
gcggtcactgcccacctgccag

SEQ ID NO: 4795912 - DNA, 18 bp, Homo sapiens
gcggtggactgcgctgga

SEQ ID NO: 4795913 - DNA, 14 bp, Homo sapiens
gcgtagttccctgg

SEQ ID NO: 4795914 - DNA, 13 bp, Homo sapiens
gcgtccaggtgat

SEQ ID NO: 4795915 - DNA, 19 bp, Homo sapiens
gcgtccctagcagtgaact

SEQ ID NO: 4795916 - DNA, 19 bp, Homo sapiens
gcgtccctgagggcccttc

SEQ ID NO: 4795917 - DNA, 12 bp, Homo sapiens
gcgtccttgtcc

SEQ ID NO: 4795918 - DNA, 22 bp, Homo sapiens
gcgtcctttcctctcctctctg

SEQ ID NO: 4795919 - DNA, 23 bp, Homo sapiens
gcgtcctttcctctcctctctgg

SEQ ID NO: 4795920 - DNA, 21 bp, Homo sapiens
gcgtgacttcagactctctcc

SEQ ID NO: 4795921 - DNA, 24 bp, Homo sapiens
gcgtgacttcagactctctcctct

SEQ ID NO: 4795922 - DNA, 14 bp, Homo sapiens
gcgtggagcaggcg

SEQ ID NO: 4795923 - DNA, 20 bp, Homo sapiens
gcgtggtggacatgcacagc

SEQ ID NO: 4795924 - DNA, 15 bp, Homo sapiens
gcgtggttctgccac

SEQ ID NO: 4795925 - DNA, 22 bp, Homo sapiens
gcgttgtctggccacactggaa

SEQ ID NO: 4795926 - DNA, 18 bp, Homo sapiens
gctaaaaaagctgaatca

SEQ ID NO: 4795927 - DNA, 20 bp, Homo sapiens
gctaaacctatctgtattgg

SEQ ID NO: 4795928 - DNA, 12 bp, Homo sapiens
gctaacaataaa

SEQ ID NO: 4795929 - DNA, 14 bp, Homo sapiens
gctaacatggaagt

SEQ ID NO: 4795930 - DNA, 14 bp, Homo sapiens
gctaacctctctga

SEQ ID NO: 4795931 - DNA, 14 bp, Homo sapiens
gctaactggcccca

SEQ ID NO: 4795932 - DNA, 21 bp, Homo sapiens
gctaagccccctactgagaaa

SEQ ID NO: 4795933 - DNA, 17 bp, Homo sapiens
gctaagttgtcttacac

SEQ ID NO: 4795934 - DNA, 23 bp, Homo sapiens
gctaagttgtcttacacttctca

SEQ ID NO: 4795935 - DNA, 21 bp, Homo sapiens
gctaatgaattttaaaagcat

SEQ ID NO: 4795936 - DNA, 14 bp, Homo sapiens
gctaattaaaaagt

SEQ ID NO: 4795937 - DNA, 14 bp, Homo sapiens
gctaatttgtgaaa

SEQ ID NO: 4795938 - DNA, 22 bp, Homo sapiens
gctacacaggggaaaagaggag

SEQ ID NO: 4795939 - DNA, 17 bp, Homo sapiens
gctacaggggaggctga

SEQ ID NO: 4795940 - DNA, 15 bp, Homo sapiens
gctacagttgatatt

SEQ ID NO: 4795941 - DNA, 22 bp, Homo sapiens
gctacagttgatatttaaaaga

SEQ ID NO: 4795942 - DNA, 17 bp, Homo sapiens
gctacttatattctgca

SEQ ID NO: 4795943 - DNA, 23 bp, Homo sapiens
gctagaaagagaaaaagccctct

SEQ ID NO: 4795944 - DNA, 20 bp, Homo sapiens
gctagagcattctggggtgg

SEQ ID NO: 4795945 - DNA, 17 bp, Homo sapiens
gctagaggattagtaag

SEQ ID NO: 4795946 - DNA, 20 bp, Homo sapiens
gctaggttaataggaggaca

SEQ ID NO: 4795947 - DNA, 22 bp, Homo sapiens
gctaggttaataggaggacaga

SEQ ID NO: 4795948 - DNA, 23 bp, Homo sapiens
gctatagttactgtcctgttgat

SEQ ID NO: 4795949 - DNA, 23 bp, Homo sapiens
gctatatatatatatatatgtat

SEQ ID NO: 4795950 - DNA, 22 bp, Homo sapiens
gctatatgcctatatttataaa

SEQ ID NO: 4795951 - DNA, 23 bp, Homo sapiens
gctatccacagaacctttgtcaa

SEQ ID NO: 4795952 - DNA, 21 bp, Homo sapiens
gctatctgtcatctctctggg

SEQ ID NO: 4795953 - DNA, 14 bp, Homo sapiens
gctatcttcatgta

SEQ ID NO: 4795954 - DNA, 18 bp, Homo sapiens
gctatcttcatgtaaatt

SEQ ID NO: 4795955 - DNA, 12 bp, Homo sapiens
gctatgcacacc

SEQ ID NO: 4795956 - DNA, 18 bp, Homo sapiens
gctatgcacaccaaattg

SEQ ID NO: 4795957 - DNA, 17 bp, Homo sapiens
gctatgctgttcattga

SEQ ID NO: 4795958 - DNA, 13 bp, Homo sapiens
gctatgtctgtga

SEQ ID NO: 4795959 - DNA, 14 bp, Homo sapiens
gctatgtctgtgat

SEQ ID NO: 4795960 - DNA, 14 bp, Homo sapiens
gctattaagaaact

SEQ ID NO: 4795961 - DNA, 12 bp, Homo sapiens
gctattaatatt

SEQ ID NO: 4795962 - DNA, 15 bp, Homo sapiens
gctattcacacacac

SEQ ID NO: 4795963 - DNA, 13 bp, Homo sapiens
gctattcccaggc

SEQ ID NO: 4795964 - DNA, 14 bp, Homo sapiens
gctattcccaggca

SEQ ID NO: 4795965 - DNA, 16 bp, Homo sapiens
gctattcgtaagttct

SEQ ID NO: 4795966 - DNA, 21 bp, Homo sapiens
gctattgtttataggaaataa

SEQ ID NO: 4795967 - DNA, 11 bp, Homo sapiens
gctatttaagt

SEQ ID NO: 4795968 - DNA, 22 bp, Homo sapiens
gctatttttaatttcctgtgag

SEQ ID NO: 4795969 - DNA, 13 bp, Homo sapiens
gctcaacctctca

SEQ ID NO: 4795970 - DNA, 14 bp, Homo sapiens
gctcaacctctcag

SEQ ID NO: 4795971 - DNA, 21 bp, Homo sapiens
gctcaacctctcagatccctc

SEQ ID NO: 4795972 - DNA, 17 bp, Homo sapiens
gctcaaggctgcagtga

SEQ ID NO: 4795973 - DNA, 20 bp, Homo sapiens
gctcaataaggcagtgcagt

SEQ ID NO: 4795974 - DNA, 21 bp, Homo sapiens
gctcaataaggcagtgcagtg

SEQ ID NO: 4795975 - DNA, 21 bp, Homo sapiens
gctcacaccgcaccgggctgg

SEQ ID NO: 4795976 - DNA, 20 bp, Homo sapiens
gctcacaccggcactgtgca

SEQ ID NO: 4795977 - DNA, 17 bp, Homo sapiens
gctcacacttgggctgg

SEQ ID NO: 4795978 - DNA, 11 bp, Homo sapiens
gctcacagcac

SEQ ID NO: 4795979 - DNA, 21 bp, Homo sapiens
gctcacagccaccacctggat

SEQ ID NO: 4795980 - DNA, 20 bp, Homo sapiens
gctcacctttgggcaaaggc

SEQ ID NO: 4795981 - DNA, 11 bp, Homo sapiens
gctcagaagag

SEQ ID NO: 4795982 - DNA, 16 bp, Homo sapiens
gctcagaggagaggag

SEQ ID NO: 4795983 - DNA, 17 bp, Homo sapiens
gctcagccccagacctg

SEQ ID NO: 4795984 - DNA, 16 bp, Homo sapiens
gctcaggcctcacctg

SEQ ID NO: 4795985 - DNA, 18 bp, Homo sapiens
gctcaggctccccaagac

SEQ ID NO: 4795986 - DNA, 15 bp, Homo sapiens
gctcagggcatgctt

SEQ ID NO: 4795987 - DNA, 15 bp, Homo sapiens
gctcaggggcagctc

SEQ ID NO: 4795988 - DNA, 16 bp, Homo sapiens
gctcaggggcagctca

SEQ ID NO: 4795989 - DNA, 19 bp, Homo sapiens
gctcaggggcagctcatag

SEQ ID NO: 4795990 - DNA, 20 bp, Homo sapiens
gctcagtaacacagtgcagt

SEQ ID NO: 4795991 - DNA, 21 bp, Homo sapiens
gctcagtaacacagtgcagtg

SEQ ID NO: 4795992 - DNA, 15 bp, Homo sapiens
gctcagtattgagac

SEQ ID NO: 4795993 - DNA, 22 bp, Homo sapiens
gctcagtattgagacactgtca

SEQ ID NO: 4795994 - DNA, 17 bp, Homo sapiens
gctcagtcccacagccc

SEQ ID NO: 4795995 - DNA, 17 bp, Homo sapiens
gctcagtggatcacaca

SEQ ID NO: 4795996 - DNA, 19 bp, Homo sapiens
gctcataactagagtatgt

SEQ ID NO: 4795997 - DNA, 19 bp, Homo sapiens
gctcataagtaaatgtctt

SEQ ID NO: 4795998 - DNA, 22 bp, Homo sapiens
gctcatagcacatgttttacaa

SEQ ID NO: 4795999 - DNA, 22 bp, Homo sapiens
gctcatcagaaacaatttctgt

SEQ ID NO: 4796000 - DNA, 16 bp, Homo sapiens
gctccaacctggaggc

SEQ ID NO: 4796001 - DNA, 19 bp, Homo sapiens
gctccaacctggaggctgg

SEQ ID NO: 4796002 - DNA, 20 bp, Homo sapiens
gctccaacctggaggctgga

SEQ ID NO: 4796003 - DNA, 22 bp, Homo sapiens
gctccaacctggaggctggacc

SEQ ID NO: 4796004 - DNA, 16 bp, Homo sapiens
gctccaccctcccctc

SEQ ID NO: 4796005 - DNA, 15 bp, Homo sapiens
gctccactctgaagt

SEQ ID NO: 4796006 - DNA, 21 bp, Homo sapiens
gctccactctgaagtcccttc

SEQ ID NO: 4796007 - DNA, 19 bp, Homo sapiens
gctccagagtaggtgggtc

SEQ ID NO: 4796008 - DNA, 14 bp, Homo sapiens
gctccagatcctct

SEQ ID NO: 4796009 - DNA, 15 bp, Homo sapiens
gctccagatcctctt

SEQ ID NO: 4796010 - DNA, 16 bp, Homo sapiens
gctccagtagctccgc

SEQ ID NO: 4796011 - DNA, 17 bp, Homo sapiens
gctccagtataaattac

SEQ ID NO: 4796012 - DNA, 12 bp, Homo sapiens
gctccagtttct

SEQ ID NO: 4796013 - DNA, 19 bp, Homo sapiens
gctccatgcagatctagcc

SEQ ID NO: 4796014 - DNA, 23 bp, Homo sapiens
gctccatgctcctcactgcccgc

SEQ ID NO: 4796015 - DNA, 15 bp, Homo sapiens
gctcccacctcggac

SEQ ID NO: 4796016 - DNA, 19 bp, Homo sapiens
gctcccactgcccctgcac

SEQ ID NO: 4796017 - DNA, 16 bp, Homo sapiens
gctcccagcagaggcc

SEQ ID NO: 4796018 - DNA, 16 bp, Homo sapiens
gctcccggtgtgcagc

SEQ ID NO: 4796019 - DNA, 13 bp, Homo sapiens
gctccctcccgca

SEQ ID NO: 4796020 - DNA, 13 bp, Homo sapiens
gctccctcgctgt

SEQ ID NO: 4796021 - DNA, 15 bp, Homo sapiens
gctcccttgagctgg

SEQ ID NO: 4796022 - DNA, 12 bp, Homo sapiens
gctccggcagag

SEQ ID NO: 4796023 - DNA, 19 bp, Homo sapiens
gctccggcagaggcagggc

SEQ ID NO: 4796024 - DNA, 20 bp, Homo sapiens
gctccggcagaggcagggcc

SEQ ID NO: 4796025 - DNA, 22 bp, Homo sapiens
gctccggcagaggcagggccct

SEQ ID NO: 4796026 - DNA, 22 bp, Homo sapiens
gctccgtggtggcggcggcact

SEQ ID NO: 4796027 - DNA, 17 bp, Homo sapiens
gctcctaagctgccagc

SEQ ID NO: 4796028 - DNA, 17 bp, Homo sapiens
gctcctccagtacaata

SEQ ID NO: 4796029 - DNA, 16 bp, Homo sapiens
gctcctcccagctgta

SEQ ID NO: 4796030 - DNA, 14 bp, Homo sapiens
gctcctctgcagcc

SEQ ID NO: 4796031 - DNA, 16 bp, Homo sapiens
gctcctctgcagcctg

SEQ ID NO: 4796032 - DNA, 20 bp, Homo sapiens
gctcctctgcagcctgagct

SEQ ID NO: 4796033 - DNA, 14 bp, Homo sapiens
gctccttcatgctt

SEQ ID NO: 4796034 - DNA, 14 bp, Homo sapiens
gctccttgaataag

SEQ ID NO: 4796035 - DNA, 19 bp, Homo sapiens
gctccttggttttgcctct

SEQ ID NO: 4796036 - DNA, 17 bp, Homo sapiens
gctcctttccatcagct

SEQ ID NO: 4796037 - DNA, 12 bp, Homo sapiens
gctcgccctgtg

SEQ ID NO: 4796038 - DNA, 16 bp, Homo sapiens
gctcgccctgtgccct

SEQ ID NO: 4796039 - DNA, 20 bp, Homo sapiens
gctcgccctgtgccctctca

SEQ ID NO: 4796040 - DNA, 13 bp, Homo sapiens
gctcggcctcttg

SEQ ID NO: 4796041 - DNA, 13 bp, Homo sapiens
gctcgggaaggcc

SEQ ID NO: 4796042 - DNA, 19 bp, Homo sapiens
gctcgggaaggcctgaggg

SEQ ID NO: 4796043 - DNA, 15 bp, Homo sapiens
gctctaaagcagaga

SEQ ID NO: 4796044 - DNA, 19 bp, Homo sapiens
gctctagggttgctggagc

SEQ ID NO: 4796045 - DNA, 18 bp, Homo sapiens
gctctcaggccagctgct

SEQ ID NO: 4796046 - DNA, 21 bp, Homo sapiens
gctctcaggccagctgcttgg

SEQ ID NO: 4796047 - DNA, 23 bp, Homo sapiens
gctctctcacccagcctggtact

SEQ ID NO: 4796048 - DNA, 20 bp, Homo sapiens
gctctctggacctgaccaga

SEQ ID NO: 4796049 - DNA, 22 bp, Homo sapiens
gctctcttgccgaggagccagg

SEQ ID NO: 4796050 - DNA, 21 bp, Homo sapiens
gctctgaagggaggggaagag

SEQ ID NO: 4796051 - DNA, 15 bp, Homo sapiens
gctctgaatctctca

SEQ ID NO: 4796052 - DNA, 20 bp, Homo sapiens
gctctgaatgctatttgtgt

SEQ ID NO: 4796053 - DNA, 14 bp, Homo sapiens
gctctgagaagagg

SEQ ID NO: 4796054 - DNA, 22 bp, Homo sapiens
gctctgagaagaggagccctca

SEQ ID NO: 4796055 - DNA, 23 bp, Homo sapiens
gctctgaggctgccccaggggca

SEQ ID NO: 4796056 - DNA, 22 bp, Homo sapiens
gctctgcatgattagtgcaata

SEQ ID NO: 4796057 - DNA, 14 bp, Homo sapiens
gctctgcccctccg

SEQ ID NO: 4796058 - DNA, 18 bp, Homo sapiens
gctctgctcatctacaca

SEQ ID NO: 4796059 - DNA, 23 bp, Homo sapiens
gctctggaaaacctgaggccaaa

SEQ ID NO: 4796060 - DNA, 14 bp, Homo sapiens
gctctggagcccgc

SEQ ID NO: 4796061 - DNA, 15 bp, Homo sapiens
gctctggagcccgcc

SEQ ID NO: 4796062 - DNA, 18 bp, Homo sapiens
gctctgggctatatgcct

SEQ ID NO: 4796063 - DNA, 14 bp, Homo sapiens
gctctgtagcctgg

SEQ ID NO: 4796064 - DNA, 17 bp, Homo sapiens
gctctgtagcctggtct

SEQ ID NO: 4796065 - DNA, 22 bp, Homo sapiens
gctctgtagcctggtctgtgca

SEQ ID NO: 4796066 - DNA, 16 bp, Homo sapiens
gctcttctgttctcaa

SEQ ID NO: 4796067 - DNA, 15 bp, Homo sapiens
gctctttcaccctgc

SEQ ID NO: 4796068 - DNA, 18 bp, Homo sapiens
gctctttcaccctgccac

SEQ ID NO: 4796069 - DNA, 15 bp, Homo sapiens
gctcttttcacagct

SEQ ID NO: 4796070 - DNA, 12 bp, Homo sapiens
gctgaaattatg

SEQ ID NO: 4796071 - DNA, 17 bp, Homo sapiens
gctgaaattatgtcaaa

SEQ ID NO: 4796072 - DNA, 20 bp, Homo sapiens
gctgaagaaacacagcatgc

SEQ ID NO: 4796073 - DNA, 15 bp, Homo sapiens
gctgacctgcctctc

SEQ ID NO: 4796074 - DNA, 23 bp, Homo sapiens
gctgacctgcctctcacacacat

SEQ ID NO: 4796075 - DNA, 15 bp, Homo sapiens
gctgactcagtgcag

SEQ ID NO: 4796076 - DNA, 22 bp, Homo sapiens
gctgagaatccccgtgctcaca

SEQ ID NO: 4796077 - DNA, 20 bp, Homo sapiens
gctgagacacagcccagaga

SEQ ID NO: 4796078 - DNA, 22 bp, Homo sapiens
gctgagacacagcccagagact

SEQ ID NO: 4796079 - DNA, 21 bp, Homo sapiens
gctgaggacggggcagagctg

SEQ ID NO: 4796080 - DNA, 16 bp, Homo sapiens
gctgagtcggctgggc

SEQ ID NO: 4796081 - DNA, 14 bp, Homo sapiens
gctgagtgcgacca

SEQ ID NO: 4796082 - DNA, 20 bp, Homo sapiens
gctgagttttctctttgtgg

SEQ ID NO: 4796083 - DNA, 16 bp, Homo sapiens
gctgatggagaaggaa

SEQ ID NO: 4796084 - DNA, 16 bp, Homo sapiens
gctgcactgccctccg

SEQ ID NO: 4796085 - DNA, 20 bp, Homo sapiens
gctgcagccaaccccatcct

SEQ ID NO: 4796086 - DNA, 13 bp, Homo sapiens
gctgcagccccct

SEQ ID NO: 4796087 - DNA, 14 bp, Homo sapiens
gctgcagccccctg

SEQ ID NO: 4796088 - DNA, 17 bp, Homo sapiens
gctgcagctaatttgtg

SEQ ID NO: 4796089 - DNA, 22 bp, Homo sapiens
gctgcagcttgggagagcccct

SEQ ID NO: 4796090 - DNA, 19 bp, Homo sapiens
gctgcagtcagcacagaga

SEQ ID NO: 4796091 - DNA, 14 bp, Homo sapiens
gctgcatcctcagc

SEQ ID NO: 4796092 - DNA, 15 bp, Homo sapiens
gctgcatcctcagcc

SEQ ID NO: 4796093 - DNA, 18 bp, Homo sapiens
gctgcatcctcagcccca

SEQ ID NO: 4796094 - DNA, 22 bp, Homo sapiens
gctgcatcctcagccccagggc

SEQ ID NO: 4796095 - DNA, 12 bp, Homo sapiens
gctgccacccac

SEQ ID NO: 4796096 - DNA, 23 bp, Homo sapiens
gctgccacccaccccaagctgct

SEQ ID NO: 4796097 - DNA, 21 bp, Homo sapiens
gctgccagccgagatagccaa

SEQ ID NO: 4796098 - DNA, 16 bp, Homo sapiens
gctgccaggctcccac

SEQ ID NO: 4796099 - DNA, 22 bp, Homo sapiens
gctgcccaatttcacagagtac

SEQ ID NO: 4796100 - DNA, 14 bp, Homo sapiens
gctgcccccacaga

SEQ ID NO: 4796101 - DNA, 19 bp, Homo sapiens
gctgcccccacagatccat

SEQ ID NO: 4796102 - DNA, 22 bp, Homo sapiens
gctgcccccacagatccatcct

SEQ ID NO: 4796103 - DNA, 17 bp, Homo sapiens
gctgcccctggcagccc

SEQ ID NO: 4796104 - DNA, 17 bp, Homo sapiens
gctgccgctgcaccacg

SEQ ID NO: 4796105 - DNA, 14 bp, Homo sapiens
gctgcctcccccca

SEQ ID NO: 4796106 - DNA, 21 bp, Homo sapiens
gctgcctccgggcctcggcct

SEQ ID NO: 4796107 - DNA, 19 bp, Homo sapiens
gctgcctgcccgcacagca

SEQ ID NO: 4796108 - DNA, 16 bp, Homo sapiens
gctgcctgcctccggc

SEQ ID NO: 4796109 - DNA, 13 bp, Homo sapiens
gctgcctggaggg

SEQ ID NO: 4796110 - DNA, 12 bp, Homo sapiens
gctgcctggcgg

SEQ ID NO: 4796111 - DNA, 16 bp, Homo sapiens
gctgcctggcgggcag

SEQ ID NO: 4796112 - DNA, 17 bp, Homo sapiens
gctgcctggcgggcagc

SEQ ID NO: 4796113 - DNA, 18 bp, Homo sapiens
gctgcctggcgggcagcc

SEQ ID NO: 4796114 - DNA, 19 bp, Homo sapiens
gctgcctggcgggcagccc

SEQ ID NO: 4796115 - DNA, 21 bp, Homo sapiens
gctgcctggcgggcagcccct

SEQ ID NO: 4796116 - DNA, 22 bp, Homo sapiens
gctgcctggcgggcagcccctg

SEQ ID NO: 4796117 - DNA, 23 bp, Homo sapiens
gctgccttctgacggccctgcaa

SEQ ID NO: 4796118 - DNA, 17 bp, Homo sapiens
gctgcgcctgcccgccc

SEQ ID NO: 4796119 - DNA, 23 bp, Homo sapiens
gctgcgctcccacctcggacacc

SEQ ID NO: 4796120 - DNA, 15 bp, Homo sapiens
gctgctcctagaggg

SEQ ID NO: 4796121 - DNA, 15 bp, Homo sapiens
gctgctctcccaggt

SEQ ID NO: 4796122 - DNA, 23 bp, Homo sapiens
gctgctgagcacatctcttcatg

SEQ ID NO: 4796123 - DNA, 21 bp, Homo sapiens
gctgctgcagtcagcacagag

SEQ ID NO: 4796124 - DNA, 18 bp, Homo sapiens
gctgctgccgcctcacct

SEQ ID NO: 4796125 - DNA, 20 bp, Homo sapiens
gctgctgtatttgaggaaac

SEQ ID NO: 4796126 - DNA, 14 bp, Homo sapiens
gctgcttctccacc

SEQ ID NO: 4796127 - DNA, 14 bp, Homo sapiens
gctgcttctccctg

SEQ ID NO: 4796128 - DNA, 22 bp, Homo sapiens
gctgcttgagtggacagcagct

SEQ ID NO: 4796129 - DNA, 16 bp, Homo sapiens
gctgcttgggcttcat

SEQ ID NO: 4796130 - DNA, 22 bp, Homo sapiens
gctgcttgggcttcatcctcct

SEQ ID NO: 4796131 - DNA, 13 bp, Homo sapiens
gctgctttccaac

SEQ ID NO: 4796132 - DNA, 16 bp, Homo sapiens
gctgctttccatggca

SEQ ID NO: 4796133 - DNA, 15 bp, Homo sapiens
gctggaccaaggtgc

SEQ ID NO: 4796134 - DNA, 21 bp, Homo sapiens
gctggaccacgtctccctggc

SEQ ID NO: 4796135 - DNA, 20 bp, Homo sapiens
gctggactgatggttgcttt

SEQ ID NO: 4796136 - DNA, 21 bp, Homo sapiens
gctggactgatggttgctttg

SEQ ID NO: 4796137 - DNA, 23 bp, Homo sapiens
gctggactgggtgggccccacag

SEQ ID NO: 4796138 - DNA, 19 bp, Homo sapiens
gctggagcctgagtcaggg

SEQ ID NO: 4796139 - DNA, 23 bp, Homo sapiens
gctggagcctgagtcagggccca

SEQ ID NO: 4796140 - DNA, 12 bp, Homo sapiens
gctggagtgcag

SEQ ID NO: 4796141 - DNA, 18 bp, Homo sapiens
gctggagtgggctctctg

SEQ ID NO: 4796142 - DNA, 16 bp, Homo sapiens
gctggatggggcggcc

SEQ ID NO: 4796143 - DNA, 21 bp, Homo sapiens
gctggatgtgcatctggccta

SEQ ID NO: 4796144 - DNA, 15 bp, Homo sapiens
gctggatgtgctttc

SEQ ID NO: 4796145 - DNA, 15 bp, Homo sapiens
gctggcagcgcctcc

SEQ ID NO: 4796146 - DNA, 15 bp, Homo sapiens
gctggccagcaccct

SEQ ID NO: 4796147 - DNA, 17 bp, Homo sapiens
gctggccagcaccctct

SEQ ID NO: 4796148 - DNA, 15 bp, Homo sapiens
gctggccagcctggg

SEQ ID NO: 4796149 - DNA, 16 bp, Homo sapiens
gctggccagcctgggg

SEQ ID NO: 4796150 - DNA, 21 bp, Homo sapiens
gctggccagcctggggcctgg

SEQ ID NO: 4796151 - DNA, 23 bp, Homo sapiens
gctggccagcctggggcctggca

SEQ ID NO: 4796152 - DNA, 13 bp, Homo sapiens
gctggccctgccc

SEQ ID NO: 4796153 - DNA, 20 bp, Homo sapiens
gctggccctgccctccccca

SEQ ID NO: 4796154 - DNA, 18 bp, Homo sapiens
gctggccggtccaccccg

SEQ ID NO: 4796155 - DNA, 22 bp, Homo sapiens
gctggccggtccaccccgtccc

SEQ ID NO: 4796156 - DNA, 19 bp, Homo sapiens
gctggcctgacacaatggt

SEQ ID NO: 4796157 - DNA, 16 bp, Homo sapiens
gctgggcagaggaaag

SEQ ID NO: 4796158 - DNA, 15 bp, Homo sapiens
gctgggcagggccgc

SEQ ID NO: 4796159 - DNA, 21 bp, Homo sapiens
gctgggcagggccgcagggcg

SEQ ID NO: 4796160 - DNA, 22 bp, Homo sapiens
gctgggccccccagctcagggg

SEQ ID NO: 4796161 - DNA, 15 bp, Homo sapiens
gctgggcccctggga

SEQ ID NO: 4796162 - DNA, 19 bp, Homo sapiens
gctgggcgcctctgtcctg

SEQ ID NO: 4796163 - DNA, 16 bp, Homo sapiens
gctggggggctgtcct

SEQ ID NO: 4796164 - DNA, 18 bp, Homo sapiens
gctggggggctgtcctga

SEQ ID NO: 4796165 - DNA, 17 bp, Homo sapiens
gctggggtggggacctc

SEQ ID NO: 4796166 - DNA, 19 bp, Homo sapiens
gctggggtggggacctcag

SEQ ID NO: 4796167 - DNA, 22 bp, Homo sapiens
gctggggtggggacctcaggcc

SEQ ID NO: 4796168 - DNA, 17 bp, Homo sapiens
gctgggtcccgggtgcc

SEQ ID NO: 4796169 - DNA, 16 bp, Homo sapiens
gctgggtcgcccctcc

SEQ ID NO: 4796170 - DNA, 19 bp, Homo sapiens
gctgggtcgcccctcctcg

SEQ ID NO: 4796171 - DNA, 13 bp, Homo sapiens
gctgggtgggaat

SEQ ID NO: 4796172 - DNA, 14 bp, Homo sapiens
gctggtaactgtta

SEQ ID NO: 4796173 - DNA, 16 bp, Homo sapiens
gctgtaaataaaaata

SEQ ID NO: 4796174 - DNA, 17 bp, Homo sapiens
gctgtaaataaaaatag

SEQ ID NO: 4796175 - DNA, 14 bp, Homo sapiens
gctgtacagatatc

SEQ ID NO: 4796176 - DNA, 20 bp, Homo sapiens
gctgtaccggccactgcaac

SEQ ID NO: 4796177 - DNA, 17 bp, Homo sapiens
gctgtatacaaacaggt

SEQ ID NO: 4796178 - DNA, 18 bp, Homo sapiens
gctgtatacaaacaggtg

SEQ ID NO: 4796179 - DNA, 14 bp, Homo sapiens
gctgtatctgtgct

SEQ ID NO: 4796180 - DNA, 20 bp, Homo sapiens
gctgtatgatttaggcttct

SEQ ID NO: 4796181 - DNA, 20 bp, Homo sapiens
gctgtattatcttaaaccca

SEQ ID NO: 4796182 - DNA, 20 bp, Homo sapiens
gctgtcaaatccatgtgtcc

SEQ ID NO: 4796183 - DNA, 22 bp, Homo sapiens
gctgtcaaatccatgtgtcccc

SEQ ID NO: 4796184 - DNA, 16 bp, Homo sapiens
gctgtcaattacagga

SEQ ID NO: 4796185 - DNA, 17 bp, Homo sapiens
gctgtcaattacaggaa

SEQ ID NO: 4796186 - DNA, 13 bp, Homo sapiens
gctgtcccctgca

SEQ ID NO: 4796187 - DNA, 22 bp, Homo sapiens
gctgtccctgtgggctcacacc

SEQ ID NO: 4796188 - DNA, 21 bp, Homo sapiens
gctgtcccttacgtgagtcct

SEQ ID NO: 4796189 - DNA, 22 bp, Homo sapiens
gctgtcccttacgtgagtcctg

SEQ ID NO: 4796190 - DNA, 21 bp, Homo sapiens
gctgtccgtcctgctcgccct

SEQ ID NO: 4796191 - DNA, 23 bp, Homo sapiens
gctgtccgtcctgctcgccctgt

SEQ ID NO: 4796192 - DNA, 20 bp, Homo sapiens
gctgtcctctcgagcccaga

SEQ ID NO: 4796193 - DNA, 21 bp, Homo sapiens
gctgtcgccccaggccctccc

SEQ ID NO: 4796194 - DNA, 20 bp, Homo sapiens
gctgtctgaaaaagtgtttt

SEQ ID NO: 4796195 - DNA, 13 bp, Homo sapiens
gctgtctgtcacc

SEQ ID NO: 4796196 - DNA, 15 bp, Homo sapiens
gctgtctgtggcttc

SEQ ID NO: 4796197 - DNA, 17 bp, Homo sapiens
gctgtctgtgtgaggct

SEQ ID NO: 4796198 - DNA, 18 bp, Homo sapiens
gctgtgaggacagggccc

SEQ ID NO: 4796199 - DNA, 21 bp, Homo sapiens
gctgtgatgcatgagctccct

SEQ ID NO: 4796200 - DNA, 23 bp, Homo sapiens
gctgtgcgggcgcccggactgac

SEQ ID NO: 4796201 - DNA, 18 bp, Homo sapiens
gctgtggcatcaggaaag

SEQ ID NO: 4796202 - DNA, 14 bp, Homo sapiens
gctgtggcccctcc

SEQ ID NO: 4796203 - DNA, 18 bp, Homo sapiens
gctgtggcccctccttct

SEQ ID NO: 4796204 - DNA, 23 bp, Homo sapiens
gctgtggcccctccttctcccct

SEQ ID NO: 4796205 - DNA, 13 bp, Homo sapiens
gctgtgggcagca

SEQ ID NO: 4796206 - DNA, 15 bp, Homo sapiens
gctgtgggcagcacc

SEQ ID NO: 4796207 - DNA, 15 bp, Homo sapiens
gctgtgtctcccttc

SEQ ID NO: 4796208 - DNA, 13 bp, Homo sapiens
gctgttatctgtc

SEQ ID NO: 4796209 - DNA, 15 bp, Homo sapiens
gctgttctcaatcat

SEQ ID NO: 4796210 - DNA, 15 bp, Homo sapiens
gctgttgattctttc

SEQ ID NO: 4796211 - DNA, 13 bp, Homo sapiens
gcttaaacatttt

SEQ ID NO: 4796212 - DNA, 14 bp, Homo sapiens
gcttaagcctgtgt

SEQ ID NO: 4796213 - DNA, 19 bp, Homo sapiens
gcttaaggaaaagagaaac

SEQ ID NO: 4796214 - DNA, 17 bp, Homo sapiens
gcttagctgaaacctaa

SEQ ID NO: 4796215 - DNA, 16 bp, Homo sapiens
gcttatcagaactcct

SEQ ID NO: 4796216 - DNA, 21 bp, Homo sapiens
gcttatcagaactcctttcta

SEQ ID NO: 4796217 - DNA, 23 bp, Homo sapiens
gcttatcagaactcctttctaag

SEQ ID NO: 4796218 - DNA, 13 bp, Homo sapiens
gcttatttatatt

SEQ ID NO: 4796219 - DNA, 17 bp, Homo sapiens
gcttcaccgcattccag

SEQ ID NO: 4796220 - DNA, 18 bp, Homo sapiens
gcttcaccgcattccagg

SEQ ID NO: 4796221 - DNA, 14 bp, Homo sapiens
gcttcataggcaga

SEQ ID NO: 4796222 - DNA, 21 bp, Homo sapiens
gcttcatcctcctcagatctt

SEQ ID NO: 4796223 - DNA, 15 bp, Homo sapiens
gcttcattaaaacaa

SEQ ID NO: 4796224 - DNA, 10 bp, Homo sapiens
gcttccagat

SEQ ID NO: 4796225 - DNA, 12 bp, Homo sapiens
gcttccagctca

SEQ ID NO: 4796226 - DNA, 23 bp, Homo sapiens
gcttccagctcagtcccacagcc

SEQ ID NO: 4796227 - DNA, 14 bp, Homo sapiens
gcttcccaacaata

SEQ ID NO: 4796228 - DNA, 14 bp, Homo sapiens
gcttcccacctccc

SEQ ID NO: 4796229 - DNA, 11 bp, Homo sapiens
gcttcccagga

SEQ ID NO: 4796230 - DNA, 20 bp, Homo sapiens
gcttcccaggaccctgggtc

SEQ ID NO: 4796231 - DNA, 21 bp, Homo sapiens
gcttcccatcaccggaggagc

SEQ ID NO: 4796232 - DNA, 21 bp, Homo sapiens
gcttcccatctgaagagtgga

SEQ ID NO: 4796233 - DNA, 15 bp, Homo sapiens
gcttccccatcgcct

SEQ ID NO: 4796234 - DNA, 14 bp, Homo sapiens
gcttccccattgcc

SEQ ID NO: 4796235 - DNA, 15 bp, Homo sapiens
gcttccccattgcct

SEQ ID NO: 4796236 - DNA, 20 bp, Homo sapiens
gcttcccctaacctgggttg

SEQ ID NO: 4796237 - DNA, 20 bp, Homo sapiens
gcttccgagattcagactgc

SEQ ID NO: 4796238 - DNA, 11 bp, Homo sapiens
gcttcctcctg

SEQ ID NO: 4796239 - DNA, 19 bp, Homo sapiens
gcttcgtttgcctccagaa

SEQ ID NO: 4796240 - DNA, 22 bp, Homo sapiens
gcttctaatatttattgcttta

SEQ ID NO: 4796241 - DNA, 15 bp, Homo sapiens
gcttctcacactgga

SEQ ID NO: 4796242 - DNA, 18 bp, Homo sapiens
gcttctcacactggagga

SEQ ID NO: 4796243 - DNA, 14 bp, Homo sapiens
gcttctcccgccat

SEQ ID NO: 4796244 - DNA, 19 bp, Homo sapiens
gcttctcccgccattggcc

SEQ ID NO: 4796245 - DNA, 21 bp, Homo sapiens
gcttctcccgccattggcctt

SEQ ID NO: 4796246 - DNA, 14 bp, Homo sapiens
gcttctccctgggg

SEQ ID NO: 4796247 - DNA, 15 bp, Homo sapiens
gcttctccctgggga

SEQ ID NO: 4796248 - DNA, 15 bp, Homo sapiens
gcttctcctgcagtc

SEQ ID NO: 4796249 - DNA, 24 bp, Homo sapiens
gcttctgggacaggcaccatgctg

SEQ ID NO: 4796250 - DNA, 24 bp, Homo sapiens
gcttctgggcgccggttccacgtg

SEQ ID NO: 4796251 - DNA, 20 bp, Homo sapiens
gcttcttgtgtttgaaacac

SEQ ID NO: 4796252 - DNA, 16 bp, Homo sapiens
gcttgaccgtgaggcc

SEQ ID NO: 4796253 - DNA, 17 bp, Homo sapiens
gcttgaccgtgaggcca

SEQ ID NO: 4796254 - DNA, 18 bp, Homo sapiens
gcttgaccgtgaggccag

SEQ ID NO: 4796255 - DNA, 16 bp, Homo sapiens
gcttgagtggacagca

SEQ ID NO: 4796256 - DNA, 22 bp, Homo sapiens
gcttgagtggacagcagctgga

SEQ ID NO: 4796257 - DNA, 15 bp, Homo sapiens
gcttgatatcccaag

SEQ ID NO: 4796258 - DNA, 21 bp, Homo sapiens
gcttgattctaaaggggacag

SEQ ID NO: 4796259 - DNA, 16 bp, Homo sapiens
gcttgctattaagaaa

SEQ ID NO: 4796260 - DNA, 14 bp, Homo sapiens
gcttgcttctctgc

SEQ ID NO: 4796261 - DNA, 15 bp, Homo sapiens
gcttggagcagagac

SEQ ID NO: 4796262 - DNA, 16 bp, Homo sapiens
gcttggagcagagacg

SEQ ID NO: 4796263 - DNA, 22 bp, Homo sapiens
gcttggagcagagacggcagcc

SEQ ID NO: 4796264 - DNA, 23 bp, Homo sapiens
gcttggagcagagacggcagccc

SEQ ID NO: 4796265 - DNA, 21 bp, Homo sapiens
gcctgggacgcccctttctct

SEQ ID NO: 4796266 - DNA, 18 bp, Homo sapiens
gcctgggagatgcagctg

SEQ ID NO: 4796267 - DNA, 15 bp, Homo sapiens
gcctgggcagaagga

SEQ ID NO: 4796268 - DNA, 18 bp, Homo sapiens
gcctgggcagaaggaaga

SEQ ID NO: 4796269 - DNA, 17 bp, Homo sapiens
gcctgggctgtgaggac

SEQ ID NO: 4796270 - DNA, 13 bp, Homo sapiens
gcctggggcctgg

SEQ ID NO: 4796271 - DNA, 17 bp, Homo sapiens
gcctggggcctggcagg

SEQ ID NO: 4796272 - DNA, 17 bp, Homo sapiens
gcctgggtccccctcct

SEQ ID NO: 4796273 - DNA, 19 bp, Homo sapiens
gcctgggtccccctcctgc

SEQ ID NO: 4796274 - DNA, 16 bp, Homo sapiens
gcctgggtcctcccag

SEQ ID NO: 4796275 - DNA, 19 bp, Homo sapiens
gcctgggtcctcccagctg

SEQ ID NO: 4796276 - DNA, 17 bp, Homo sapiens
gcctgggtcctcggccc

SEQ ID NO: 4796277 - DNA, 19 bp, Homo sapiens
gcctgggtcctcggccctg

SEQ ID NO: 4796278 - DNA, 20 bp, Homo sapiens
gcctgggtcctcggccctgt

SEQ ID NO: 4796279 - DNA, 17 bp, Homo sapiens
gcctggtctggagcccc

SEQ ID NO: 4796280 - DNA, 15 bp, Homo sapiens
gcctggtctgtgcat

SEQ ID NO: 4796281 - DNA, 23 bp, Homo sapiens
gcctggtctgtgcattgtggctg

SEQ ID NO: 4796282 - DNA, 14 bp, Homo sapiens
gcctgtccctaggg

SEQ ID NO: 4796283 - DNA, 23 bp, Homo sapiens
gcctgtccctagggctctccaag

SEQ ID NO: 4796284 - DNA, 18 bp, Homo sapiens
gcctgtcgggcccgcact

SEQ ID NO: 4796285 - DNA, 21 bp, Homo sapiens
gcctgttgggccaggagcctc

SEQ ID NO: 4796286 - DNA, 16 bp, Homo sapiens
gccttaactggccctc

SEQ ID NO: 4796287 - DNA, 19 bp, Homo sapiens
gccttaactggccctcggg

SEQ ID NO: 4796288 - DNA, 22 bp, Homo sapiens
gccttaactggccctcgggccc

SEQ ID NO: 4796289 - DNA, 23 bp, Homo sapiens
gccttaattcttacctcatttgc

SEQ ID NO: 4796290 - DNA, 16 bp, Homo sapiens
gccttacacaatggtt

SEQ ID NO: 4796291 - DNA, 20 bp, Homo sapiens
gccttacacaatggttttct

SEQ ID NO: 4796292 - DNA, 15 bp, Homo sapiens
gccttagaggagccc

SEQ ID NO: 4796293 - DNA, 21 bp, Homo sapiens
gccttattaaaatattttctt

SEQ ID NO: 4796294 - DNA, 16 bp, Homo sapiens
gccttccaccctgccc

SEQ ID NO: 4796295 - DNA, 19 bp, Homo sapiens
gccttccaccctgccctgg

SEQ ID NO: 4796296 - DNA, 15 bp, Homo sapiens
gccttcccagcttcc

SEQ ID NO: 4796297 - DNA, 14 bp, Homo sapiens
gccttccctttaca

SEQ ID NO: 4796298 - DNA, 13 bp, Homo sapiens
gccttccttgacc

SEQ ID NO: 4796299 - DNA, 18 bp, Homo sapiens
gccttccttgaccttcct

SEQ ID NO: 4796300 - DNA, 20 bp, Homo sapiens
gccttccttgaccttcctct

SEQ ID NO: 4796301 - DNA, 18 bp, Homo sapiens
gccttctggccgctgcag

SEQ ID NO: 4796302 - DNA, 15 bp, Homo sapiens
gccttggttcctcca

SEQ ID NO: 4796303 - DNA, 13 bp, Homo sapiens
gccttggttcctg

SEQ ID NO: 4796304 - DNA, 15 bp, Homo sapiens
gccttgtttttttct

SEQ ID NO: 4796305 - DNA, 16 bp, Homo sapiens
gccttgtttttttcta

SEQ ID NO: 4796306 - DNA, 16 bp, Homo sapiens
gcctttaggcaggaag

SEQ ID NO: 4796307 - DNA, 21 bp, Homo sapiens
gcctttcaaagtgcacacaca

SEQ ID NO: 4796308 - DNA, 13 bp, Homo sapiens
gcctttcctctct

SEQ ID NO: 4796309 - DNA, 22 bp, Homo sapiens
gcctttgtaaccacaactttca

SEQ ID NO: 4796310 - DNA, 17 bp, Homo sapiens
gcgaagtccgaggcctg

SEQ ID NO: 4796311 - DNA, 18 bp, Homo sapiens
gcgacatctctgactttc

SEQ ID NO: 4796312 - DNA, 18 bp, Homo sapiens
gcgactgtgaaactggaa

SEQ ID NO: 4796313 - DNA, 17 bp, Homo sapiens
gcgacttcacaaaatgc

SEQ ID NO: 4796314 - DNA, 19 bp, Homo sapiens
gcgaggctttaagcgaggc

SEQ ID NO: 4796315 - DNA, 16 bp, Homo sapiens
gcgagtccagacacca

SEQ ID NO: 4796316 - DNA, 23 bp, Homo sapiens
gcgcaagcgacacaggctgccgc

SEQ ID NO: 4796317 - DNA, 14 bp, Homo sapiens
gcgcaccgcccaac

SEQ ID NO: 4796318 - DNA, 22 bp, Homo sapiens
gcgcaccgcccaacccccacct

SEQ ID NO: 4796319 - DNA, 16 bp, Homo sapiens
gcgcagccgcgctctg

SEQ ID NO: 4796320 - DNA, 13 bp, Homo sapiens
gcgcagtccccag

SEQ ID NO: 4796321 - DNA, 22 bp, Homo sapiens
gcgcatagtgtgctcggacaca

SEQ ID NO: 4796322 - DNA, 15 bp, Homo sapiens
gcgccacccgcccgc

SEQ ID NO: 4796323 - DNA, 12 bp, Homo sapiens
gcgcccacctgc

SEQ ID NO: 4796324 - DNA, 15 bp, Homo sapiens
gcgcccacctgccca

SEQ ID NO: 4796325 - DNA, 13 bp, Homo sapiens
gcgcccccaggac

SEQ ID NO: 4796326 - DNA, 14 bp, Homo sapiens
gcgcccccaggacc

SEQ ID NO: 4796327 - DNA, 17 bp, Homo sapiens
gcgcccccaggaccccc

SEQ ID NO: 4796328 - DNA, 15 bp, Homo sapiens
gcgccccccagtgga

SEQ ID NO: 4796329 - DNA, 19 bp, Homo sapiens
gcgccccgcccccacccct

SEQ ID NO: 4796330 - DNA, 16 bp, Homo sapiens
gcgcccctctgcgccc

SEQ ID NO: 4796331 - DNA, 14 bp, Homo sapiens
gcgcccctgcccag

SEQ ID NO: 4796332 - DNA, 15 bp, Homo sapiens
gcgcccctgcccagc

SEQ ID NO: 4796333 - DNA, 11 bp, Homo sapiens
gcgcccctgtc

SEQ ID NO: 4796334 - DNA, 13 bp, Homo sapiens
gcgccctccctcc

SEQ ID NO: 4796335 - DNA, 14 bp, Homo sapiens
gcgccctccctccc

SEQ ID NO: 4796336 - DNA, 15 bp, Homo sapiens
gcgccgcctcgcccc

SEQ ID NO: 4796337 - DNA, 23 bp, Homo sapiens
gcgccgcctcgcccccgggccct

SEQ ID NO: 4796338 - DNA, 13 bp, Homo sapiens
gcgccggcgcccc

SEQ ID NO: 4796339 - DNA, 16 bp, Homo sapiens
gcgcctcctcctgcat

SEQ ID NO: 4796340 - DNA, 17 bp, Homo sapiens
gcgcctgcccgcccgcc

SEQ ID NO: 4796341 - DNA, 13 bp, Homo sapiens
gcgcctgcgcctc

SEQ ID NO: 4796342 - DNA, 15 bp, Homo sapiens
gcgcctgcgcctcct

SEQ ID NO: 4796343 - DNA, 16 bp, Homo sapiens
gcgcctgcgctcctct

SEQ ID NO: 4796344 - DNA, 18 bp, Homo sapiens
gcgcctgcgctcctctgc

SEQ ID NO: 4796345 - DNA, 20 bp, Homo sapiens
gcgcctgcgctcctctgcag

SEQ ID NO: 4796346 - DNA, 22 bp, Homo sapiens
gcgcctgggtcctcccagctga

SEQ ID NO: 4796347 - DNA, 18 bp, Homo sapiens
gcgcctgtcgggcccgca

SEQ ID NO: 4796348 - DNA, 13 bp, Homo sapiens
gcgcgcaccgccc

SEQ ID NO: 4796349 - DNA, 14 bp, Homo sapiens
gcgcgcccccagga

SEQ ID NO: 4796350 - DNA, 19 bp, Homo sapiens
gcgcgcgggacagcggccc

SEQ ID NO: 4796351 - DNA, 21 bp, Homo sapiens
gcgcgcgggacagcggccccg

SEQ ID NO: 4796352 - DNA, 20 bp, Homo sapiens
gcgcgggacagcggccccgc

SEQ ID NO: 4796353 - DNA, 14 bp, Homo sapiens
gcgcgtgcccccag

SEQ ID NO: 4796354 - DNA, 16 bp, Homo sapiens
gcgcgtgcccccagcg

SEQ ID NO: 4796355 - DNA, 13 bp, Homo sapiens
gcgcgtgccttcc

SEQ ID NO: 4796356 - DNA, 14 bp, Homo sapiens
gcgcgtgccttccc

SEQ ID NO: 4796357 - DNA, 12 bp, Homo sapiens
gcgctcctctgc

SEQ ID NO: 4796358 - DNA, 18 bp, Homo sapiens
gcgctcctctgcagcctg

SEQ ID NO: 4796359 - DNA, 19 bp, Homo sapiens
gcgctcctctgcagcctga

SEQ ID NO: 4796360 - DNA, 14 bp, Homo sapiens
gcgctcctggcttt

SEQ ID NO: 4796361 - DNA, 18 bp, Homo sapiens
gcgctcctggcttttaaa

SEQ ID NO: 4796362 - DNA, 16 bp, Homo sapiens
gcgctgcccccacaga

SEQ ID NO: 4796363 - DNA, 14 bp, Homo sapiens
gcgctgcccctggc

SEQ ID NO: 4796364 - DNA, 18 bp, Homo sapiens
gcgctgcccctggcagcc

SEQ ID NO: 4796365 - DNA, 15 bp, Homo sapiens
gcgcttaccttccca

SEQ ID NO: 4796366 - DNA, 17 bp, Homo sapiens
gcggaaaccgggtggca

SEQ ID NO: 4796367 - DNA, 14 bp, Homo sapiens
gcggagaggacccc

SEQ ID NO: 4796368 - DNA, 21 bp, Homo sapiens
gcggagcccccgcccctcccc

SEQ ID NO: 4796369 - DNA, 16 bp, Homo sapiens
gcggagctctggcttt

SEQ ID NO: 4796370 - DNA, 17 bp, Homo sapiens
gcggaggcccctgaggg

SEQ ID NO: 4796371 - DNA, 17 bp, Homo sapiens
gcggcaaagatccagcg

SEQ ID NO: 4796372 - DNA, 15 bp, Homo sapiens
gcccctgcctgagac

SEQ ID NO: 4796373 - DNA, 16 bp, Homo sapiens
gcccctgcgtgtgttc

SEQ ID NO: 4796374 - DNA, 14 bp, Homo sapiens
gcccctgctggacc

SEQ ID NO: 4796375 - DNA, 15 bp, Homo sapiens
gcccctgggatggga

SEQ ID NO: 4796376 - DNA, 17 bp, Homo sapiens
gcccctggggcctagac

SEQ ID NO: 4796377 - DNA, 21 bp, Homo sapiens
gcccctgtccatccgtctctg

SEQ ID NO: 4796378 - DNA, 23 bp, Homo sapiens
gcccctgtccatccgtctctgtc

SEQ ID NO: 4796379 - DNA, 12 bp, Homo sapiens
gccccttcccac

SEQ ID NO: 4796380 - DNA, 14 bp, Homo sapiens
gccccttcccacgt

SEQ ID NO: 4796381 - DNA, 15 bp, Homo sapiens
gccccttcccacgtc

SEQ ID NO: 4796382 - DNA, 14 bp, Homo sapiens
gccccttccccatg

SEQ ID NO: 4796383 - DNA, 20 bp, Homo sapiens
gcccgagcgcgtgccttccc

SEQ ID NO: 4796384 - DNA, 16 bp, Homo sapiens
gcccgaggccagggcc

SEQ ID NO: 4796385 - DNA, 17 bp, Homo sapiens
gcccgaggccagggccg

SEQ ID NO: 4796386 - DNA, 13 bp, Homo sapiens
gcccgatgtccct

SEQ ID NO: 4796387 - DNA, 14 bp, Homo sapiens
gcccgcacaccctc

SEQ ID NO: 4796388 - DNA, 22 bp, Homo sapiens
gcccgcacaccctcactctgcc

SEQ ID NO: 4796389 - DNA, 17 bp, Homo sapiens
gcccgcactcaggagca

SEQ ID NO: 4796390 - DNA, 13 bp, Homo sapiens
gcccgcccacccc

SEQ ID NO: 4796391 - DNA, 14 bp, Homo sapiens
gcccgcccaccccg

SEQ ID NO: 4796392 - DNA, 15 bp, Homo sapiens
gcccgcccaccccgc

SEQ ID NO: 4796393 - DNA, 19 bp, Homo sapiens
gcccgcccaccccgctgcc

SEQ ID NO: 4796394 - DNA, 14 bp, Homo sapiens
gcccgccccaggcc

SEQ ID NO: 4796395 - DNA, 14 bp, Homo sapiens
gcccgcccgccggt

SEQ ID NO: 4796396 - DNA, 17 bp, Homo sapiens
gcccgccctcctctgcc

SEQ ID NO: 4796397 - DNA, 22 bp, Homo sapiens
gcccgccctcctctgccccctc

SEQ ID NO: 4796398 - DNA, 13 bp, Homo sapiens
gcccgccctgccc

SEQ ID NO: 4796399 - DNA, 17 bp, Homo sapiens
gcccgccggttggccgg

SEQ ID NO: 4796400 - DNA, 21 bp, Homo sapiens
gcccgcgggtggctggagccc

SEQ ID NO: 4796401 - DNA, 15 bp, Homo sapiens
gcccgctcaacctct

SEQ ID NO: 4796402 - DNA, 21 bp, Homo sapiens
gaagaggggtataggacaagg

SEQ ID NO: 4796403 - DNA, 17 bp, Homo sapiens
gaagagtctattgtctc

SEQ ID NO: 4796404 - DNA, 15 bp, Homo sapiens
gaagagtggaaatgg

SEQ ID NO: 4796405 - DNA, 15 bp, Homo sapiens
gaagatgcattttaa

SEQ ID NO: 4796406 - DNA, 12 bp, Homo sapiens
gaagatgccaag

SEQ ID NO: 4796407 - DNA, 22 bp, Homo sapiens
gaagcaaacacacagactctgt

SEQ ID NO: 4796408 - DNA, 14 bp, Homo sapiens
gaagcaaataaata

SEQ ID NO: 4796409 - DNA, 20 bp, Homo sapiens
gaagcacatgcctctctcag

SEQ ID NO: 4796410 - DNA, 21 bp, Homo sapiens
gaagcacatgcctctctcagg

SEQ ID NO: 4796411 - DNA, 20 bp, Homo sapiens
gaagcagtttcagataaatc

SEQ ID NO: 4796412 - DNA, 19 bp, Homo sapiens
gaagccagcaggctctcag

SEQ ID NO: 4796413 - DNA, 11 bp, Homo sapiens
gaagcccaccc

SEQ ID NO: 4796414 - DNA, 13 bp, Homo sapiens
gaagcccacccgc

SEQ ID NO: 4796415 - DNA, 14 bp, Homo sapiens
gaagcccacccgcc

SEQ ID NO: 4796416 - DNA, 21 bp, Homo sapiens
gaagcccacccgccccagaga

SEQ ID NO: 4796417 - DNA, 13 bp, Homo sapiens
gaagcccaggagg

SEQ ID NO: 4796418 - DNA, 15 bp, Homo sapiens
gaagccggcggagct

SEQ ID NO: 4796419 - DNA, 23 bp, Homo sapiens
gaagccggcggagctctggcttt

SEQ ID NO: 4796420 - DNA, 15 bp, Homo sapiens
gaagctgcagcttgg

SEQ ID NO: 4796421 - DNA, 15 bp, Homo sapiens
gaaggaacgtcccct

SEQ ID NO: 4796422 - DNA, 18 bp, Homo sapiens
gaaggaatgcaataaaga

SEQ ID NO: 4796423 - DNA, 13 bp, Homo sapiens
gaaggactacagg

SEQ ID NO: 4796424 - DNA, 16 bp, Homo sapiens
gaaggaggggaagctg

SEQ ID NO: 4796425 - DNA, 19 bp, Homo sapiens
gaaggaggggaagctgcag

SEQ ID NO: 4796426 - DNA, 21 bp, Homo sapiens
gaaggattcttttttcaatgt

SEQ ID NO: 4796427 - DNA, 18 bp, Homo sapiens
gaaggcacaggtgtaaat

SEQ ID NO: 4796428 - DNA, 19 bp, Homo sapiens
gaaggcacaggtgtaaata

SEQ ID NO: 4796429 - DNA, 16 bp, Homo sapiens
gaaggcagggaggagg

SEQ ID NO: 4796430 - DNA, 13 bp, Homo sapiens
gaaggccccaggg

SEQ ID NO: 4796431 - DNA, 18 bp, Homo sapiens
gaaggcccgggaggagga

SEQ ID NO: 4796432 - DNA, 12 bp, Homo sapiens
gaaggcctgagg

SEQ ID NO: 4796433 - DNA, 13 bp, Homo sapiens
gaaggcctgaggg

SEQ ID NO: 4796434 - DNA, 17 bp, Homo sapiens
gaaggcctgagggaagc

SEQ ID NO: 4796435 - DNA, 19 bp, Homo sapiens
gaaggcctgagggaagccc

SEQ ID NO: 4796436 - DNA, 18 bp, Homo sapiens
gaaggcctgccccccttc

SEQ ID NO: 4796437 - DNA, 19 bp, Homo sapiens
gaaggcctgccccccttcc

SEQ ID NO: 4796438 - DNA, 14 bp, Homo sapiens
gaaggctttattct

SEQ ID NO: 4796439 - DNA, 16 bp, Homo sapiens
gaagggaaatcaattt

SEQ ID NO: 4796440 - DNA, 18 bp, Homo sapiens
gaagggaaatcaatttaa

SEQ ID NO: 4796441 - DNA, 17 bp, Homo sapiens
gaagggaggggaagaga

SEQ ID NO: 4796442 - DNA, 13 bp, Homo sapiens
gaaggggacagga

SEQ ID NO: 4796443 - DNA, 20 bp, Homo sapiens
gaaggggcctgggctgtgag

SEQ ID NO: 4796444 - DNA, 23 bp, Homo sapiens
gaaggggcgctcctcccagctgt

SEQ ID NO: 4796445 - DNA, 14 bp, Homo sapiens
gaagggtggatgtc

SEQ ID NO: 4796446 - DNA, 19 bp, Homo sapiens
gaaggtattggctgaactg

SEQ ID NO: 4796447 - DNA, 12 bp, Homo sapiens
gaagtaaattat

SEQ ID NO: 4796448 - DNA, 22 bp, Homo sapiens
gaagtaactccccttaaaatgt

SEQ ID NO: 4796449 - DNA, 17 bp, Homo sapiens
gaagtaagttctgaaaa

SEQ ID NO: 4796450 - DNA, 23 bp, Homo sapiens
gaagtagtgtctggatcagtaaa

SEQ ID NO: 4796451 - DNA, 20 bp, Homo sapiens
gaagtatagatggtagaaac

SEQ ID NO: 4796452 - DNA, 22 bp, Homo sapiens
gaagtatgatttgttcctttct

SEQ ID NO: 4796453 - DNA, 16 bp, Homo sapiens
gaagtatgtcagttat

SEQ ID NO: 4796454 - DNA, 13 bp, Homo sapiens
gaagtcaggagcc

SEQ ID NO: 4796455 - DNA, 19 bp, Homo sapiens
gaagtctttgtacagacaa

SEQ ID NO: 4796456 - DNA, 11 bp, Homo sapiens
gaagtgaccaa

SEQ ID NO: 4796457 - DNA, 12 bp, Homo sapiens
gaagtgaccaag

SEQ ID NO: 4796458 - DNA, 12 bp, Homo sapiens
gaagtgcatgtt

SEQ ID NO: 4796459 - DNA, 22 bp, Homo sapiens
gaagtgggattcaggaatgggc

SEQ ID NO: 4796460 - DNA, 20 bp, Homo sapiens
gaagtgtattggtttctgtt

SEQ ID NO: 4796461 - DNA, 16 bp, Homo sapiens
gaagtgtgttctgatg

SEQ ID NO: 4796462 - DNA, 16 bp, Homo sapiens
gaagttgtcctttctg

SEQ ID NO: 4796463 - DNA, 20 bp, Homo sapiens
gaataaactccccagcgtat

SEQ ID NO: 4796464 - DNA, 16 bp, Homo sapiens
gaataagaatggagca

SEQ ID NO: 4796465 - DNA, 17 bp, Homo sapiens
gaataatgcctttgtaa

SEQ ID NO: 4796466 - DNA, 23 bp, Homo sapiens
gaatactaataaaatacatacta

SEQ ID NO: 4796467 - DNA, 14 bp, Homo sapiens
gaatagtattgtgt

SEQ ID NO: 4796468 - DNA, 16 bp, Homo sapiens
gaatataaatgtacta

SEQ ID NO: 4796469 - DNA, 17 bp, Homo sapiens
gaatataaatgtgtgta

SEQ ID NO: 4796470 - DNA, 20 bp, Homo sapiens
gaatatactcattagaatta

SEQ ID NO: 4796471 - DNA, 22 bp, Homo sapiens
gatttgatatacagacctccag

SEQ ID NO: 4796472 - DNA, 12 bp, Homo sapiens
gatttgttcatt

SEQ ID NO: 4796473 - DNA, 19 bp, Homo sapiens
gattttaaacaaaatttat

SEQ ID NO: 4796474 - DNA, 11 bp, Homo sapiens
gattttatgtt

SEQ ID NO: 4796475 - DNA, 15 bp, Homo sapiens
gcaaaaaataatgac

SEQ ID NO: 4796476 - DNA, 15 bp, Homo sapiens
gcaaaaatttgacat

SEQ ID NO: 4796477 - DNA, 17 bp, Homo sapiens
gcaaaaccattgcttca

SEQ ID NO: 4796478 - DNA, 10 bp, Homo sapiens
gcaaacattt

SEQ ID NO: 4796479 - DNA, 17 bp, Homo sapiens
gcaaaccaggctgcagg

SEQ ID NO: 4796480 - DNA, 18 bp, Homo sapiens
gcaaactgaagcccacag

SEQ ID NO: 4796481 - DNA, 21 bp, Homo sapiens
gcaaagcatgccaatttctct

SEQ ID NO: 4796482 - DNA, 13 bp, Homo sapiens
gcaaagtagtact

SEQ ID NO: 4796483 - DNA, 18 bp, Homo sapiens
gcaaagtgttgtcttatt

SEQ ID NO: 4796484 - DNA, 14 bp, Homo sapiens
gcaaagttttcaga

SEQ ID NO: 4796485 - DNA, 19 bp, Homo sapiens
gcaaataccttagctccct

SEQ ID NO: 4796486 - DNA, 21 bp, Homo sapiens
gcaaatagaaaacaggaaaaa

SEQ ID NO: 4796487 - DNA, 17 bp, Homo sapiens
gcaaatcgtacattgtg

SEQ ID NO: 4796488 - DNA, 13 bp, Homo sapiens
gcaaatgtccaag

SEQ ID NO: 4796489 - DNA, 15 bp, Homo sapiens
gcaaatgtccaagca

SEQ ID NO: 4796490 - DNA, 17 bp, Homo sapiens
gcaaattccaatacatt

SEQ ID NO: 4796491 - DNA, 24 bp, Homo sapiens
gcaaatttctagatatgagaaata

SEQ ID NO: 4796492 - DNA, 17 bp, Homo sapiens
gcaacaacaacagaaca

SEQ ID NO: 4796493 - DNA, 11 bp, Homo sapiens
gcaacactgga

SEQ ID NO: 4796494 - DNA, 23 bp, Homo sapiens
gcaacagactgccttatattatt

SEQ ID NO: 4796495 - DNA, 16 bp, Homo sapiens
gcaacagctgtgtgtg

SEQ ID NO: 4796496 - DNA, 17 bp, Homo sapiens
gcaacaggaccaggagc

SEQ ID NO: 4796497 - DNA, 18 bp, Homo sapiens
gcaacaggaccaggagcc

SEQ ID NO: 4796498 - DNA, 21 bp, Homo sapiens
gcaacaggaccaggagccagg

SEQ ID NO: 4796499 - DNA, 16 bp, Homo sapiens
gcaacatttccgaaga

SEQ ID NO: 4796500 - DNA, 14 bp, Homo sapiens
gcaaccttgtactt

SEQ ID NO: 4796501 - DNA, 16 bp, Homo sapiens
gcaaccttgtacttta

SEQ ID NO: 4796502 - DNA, 20 bp, Homo sapiens
gcaaccttgtactttacaat

SEQ ID NO: 4796503 - DNA, 16 bp, Homo sapiens
gcaactgttggataat

SEQ ID NO: 4796504 - DNA, 17 bp, Homo sapiens
gcaacttcagtcctggg

SEQ ID NO: 4796505 - DNA, 14 bp, Homo sapiens
gcaacttcccaggc

SEQ ID NO: 4796506 - DNA, 13 bp, Homo sapiens
gcaagaagtggga

SEQ ID NO: 4796507 - DNA, 14 bp, Homo sapiens
gcaagagctcagga

SEQ ID NO: 4796508 - DNA, 17 bp, Homo sapiens
gcaagcaagctctcttg

SEQ ID NO: 4796509 - DNA, 17 bp, Homo sapiens
gcaagctcatagcacat

SEQ ID NO: 4796510 - DNA, 14 bp, Homo sapiens
gcaagctctcttgc

SEQ ID NO: 4796511 - DNA, 16 bp, Homo sapiens
gcaaggcaagaagtgg

SEQ ID NO: 4796512 - DNA, 13 bp, Homo sapiens
gcaaggcccacag

SEQ ID NO: 4796513 - DNA, 13 bp, Homo sapiens
gcaaggggccagg

SEQ ID NO: 4796514 - DNA, 23 bp, Homo sapiens
gcaaggggcgcgcgcccccagga

SEQ ID NO: 4796515 - DNA, 23 bp, Homo sapiens
gcaaggtgcacctgccccaggct

SEQ ID NO: 4796516 - DNA, 19 bp, Homo sapiens
gcaataacagttttaagat

SEQ ID NO: 4796517 - DNA, 14 bp, Homo sapiens
gcaataagttgaat

SEQ ID NO: 4796518 - DNA, 17 bp, Homo sapiens
gcaataagttgaatgat

SEQ ID NO: 4796519 - DNA, 23 bp, Homo sapiens
gcaatcctcccacttcagcctcc

SEQ ID NO: 4796520 - DNA, 15 bp, Homo sapiens
gcaatcttgctgtga

SEQ ID NO: 4796521 - DNA, 19 bp, Homo sapiens
gcaatgcatctgaaagttt

SEQ ID NO: 4796522 - DNA, 22 bp, Homo sapiens
gcaatgttccgttcatctgagg

SEQ ID NO: 4796523 - DNA, 20 bp, Homo sapiens
gcaattctaagtgagatgtt

SEQ ID NO: 4796524 - DNA, 19 bp, Homo sapiens
gcacaaaaaatttaagaga

SEQ ID NO: 4796525 - DNA, 16 bp, Homo sapiens
gcacaaacagaggccg

SEQ ID NO: 4796526 - DNA, 20 bp, Homo sapiens
gcacaaaccttcttttcaat

SEQ ID NO: 4796527 - DNA, 22 bp, Homo sapiens
gcacaaaccttcttttcaatgc

SEQ ID NO: 4796528 - DNA, 15 bp, Homo sapiens
gcacaacatgcacat

SEQ ID NO: 4796529 - DNA, 19 bp, Homo sapiens
gcacaattgatctcttttt

SEQ ID NO: 4796530 - DNA, 23 bp, Homo sapiens
gcacacacacgcgtccacataca

SEQ ID NO: 4796531 - DNA, 19 bp, Homo sapiens
gcacacagcagccccccag

SEQ ID NO: 4796532 - DNA, 14 bp, Homo sapiens
gcacacataacaca

SEQ ID NO: 4796533 - DNA, 17 bp, Homo sapiens
gcacacatccaagaggg

SEQ ID NO: 4796534 - DNA, 19 bp, Homo sapiens
gcacaccctcactctgcca

SEQ ID NO: 4796535 - DNA, 23 bp, Homo sapiens
gcacaccctcactctgccagggc

SEQ ID NO: 4796536 - DNA, 20 bp, Homo sapiens
gcacagagagcggcttcccc

SEQ ID NO: 4796537 - DNA, 20 bp, Homo sapiens
gcacagaggatggcttcccc

SEQ ID NO: 4796538 - DNA, 12 bp, Homo sapiens
gcacagcagcct

SEQ ID NO: 4796539 - DNA, 17 bp, Homo sapiens
gcacagcagcctgcttc

SEQ ID NO: 4796540 - DNA, 13 bp, Homo sapiens
gcacagccagaaa

SEQ ID NO: 4796541 - DNA, 12 bp, Homo sapiens
gcacagccatag

SEQ ID NO: 4796542 - DNA, 18 bp, Homo sapiens
gcacagctttcctgggtc

SEQ ID NO: 4796543 - DNA, 15 bp, Homo sapiens
gcacaggaaaaggta

SEQ ID NO: 4796544 - DNA, 17 bp, Homo sapiens
gcacatgcctctctcag

SEQ ID NO: 4796545 - DNA, 19 bp, Homo sapiens
gcacatgcctctctcaggc

SEQ ID NO: 4796546 - DNA, 22 bp, Homo sapiens
gcacatgcctctctcaggccaa

SEQ ID NO: 4796547 - DNA, 18 bp, Homo sapiens
gcacatgctggccagcct

SEQ ID NO: 4796548 - DNA, 13 bp, Homo sapiens
gcacatgttttac

SEQ ID NO: 4796549 - DNA, 21 bp, Homo sapiens
gcacatttgttaatgattctt

SEQ ID NO: 4796550 - DNA, 19 bp, Homo sapiens
gcaccaaagatgcagccgc

SEQ ID NO: 4796551 - DNA, 20 bp, Homo sapiens
gcaccacggcgtttttttac

SEQ ID NO: 4796552 - DNA, 12 bp, Homo sapiens
gcaccagcctga

SEQ ID NO: 4796553 - DNA, 16 bp, Homo sapiens
gcaccagcctgagcca

SEQ ID NO: 4796554 - DNA, 14 bp, Homo sapiens
gcaccatgctgggc

SEQ ID NO: 4796555 - DNA, 16 bp, Homo sapiens
gcaccatgctgggccg

SEQ ID NO: 4796556 - DNA, 20 bp, Homo sapiens
gcaccatgctgggccggggt

SEQ ID NO: 4796557 - DNA, 17 bp, Homo sapiens
gcacccaccactctcag

SEQ ID NO: 4796558 - DNA, 18 bp, Homo sapiens
gcacccaccactctcagg

SEQ ID NO: 4796559 - DNA, 19 bp, Homo sapiens
gcacccaccactctcagga

SEQ ID NO: 4796560 - DNA, 12 bp, Homo sapiens
gcacccacccct

SEQ ID NO: 4796561 - DNA, 11 bp, Homo sapiens
gcacccccagc

SEQ ID NO: 4796562 - DNA, 16 bp, Homo sapiens
gcacccccagcctccc

SEQ ID NO: 4796563 - DNA, 23 bp, Homo sapiens
gcacccgtgtttgtaaaaatgta

SEQ ID NO: 4796564 - DNA, 16 bp, Homo sapiens
gcaccctcccccgcag

SEQ ID NO: 4796565 - DNA, 17 bp, Homo sapiens
gcaccctctcctggggg

SEQ ID NO: 4796566 - DNA, 23 bp, Homo sapiens
gcaccctctgctatgtctgtgat

SEQ ID NO: 4796567 - DNA, 19 bp, Homo sapiens
gcaccgccagagtgtcctg

SEQ ID NO: 4796568 - DNA, 20 bp, Homo sapiens
gcaccgccagagtgtcctgc

SEQ ID NO: 4796569 - DNA, 13 bp, Homo sapiens
gcaccgcccaccc

SEQ ID NO: 4796570 - DNA, 14 bp, Homo sapiens
gcaccgcccaccca

SEQ ID NO: 4796571 - DNA, 20 bp, Homo sapiens
gcaccggacgctggagaccc

SEQ ID NO: 4796572 - DNA, 20 bp, Homo sapiens
gcaccgtggtgtgaggcccc

SEQ ID NO: 4796573 - DNA, 13 bp, Homo sapiens
gcacctcctccgt

SEQ ID NO: 4796574 - DNA, 13 bp, Homo sapiens
gcacctgccccag

SEQ ID NO: 4796575 - DNA, 16 bp, Homo sapiens
gcacctgccccaggct

SEQ ID NO: 4796576 - DNA, 15 bp, Homo sapiens
gcacctggcgggctg

SEQ ID NO: 4796577 - DNA, 18 bp, Homo sapiens
gcaccttgggcacgggag

SEQ ID NO: 4796578 - DNA, 21 bp, Homo sapiens
gcacgcggccgctctccgccc

SEQ ID NO: 4796579 - DNA, 20 bp, Homo sapiens
gcacgggagagcgccacccg

SEQ ID NO: 4796580 - DNA, 19 bp, Homo sapiens
gcacgttctccagactcta

SEQ ID NO: 4796581 - DNA, 15 bp, Homo sapiens
gcactaaaagtgatg

SEQ ID NO: 4796582 - DNA, 14 bp, Homo sapiens
gcactaaggccgtg

SEQ ID NO: 4796583 - DNA, 14 bp, Homo sapiens
gcactaatcaatac

SEQ ID NO: 4796584 - DNA, 15 bp, Homo sapiens
gcactagaatgagaa

SEQ ID NO: 4796585 - DNA, 20 bp, Homo sapiens
gcactagaatgagaaatcat

SEQ ID NO: 4796586 - DNA, 18 bp, Homo sapiens
gcactagccttcccagct

SEQ ID NO: 4796587 - DNA, 18 bp, Homo sapiens
gcactcaggagcacagcc

SEQ ID NO: 4796588 - DNA, 20 bp, Homo sapiens
gcactcaggagcacagccat

SEQ ID NO: 4796589 - DNA, 14 bp, Homo sapiens
gcactcccagggcc

SEQ ID NO: 4796590 - DNA, 19 bp, Homo sapiens
gcactcccagggcccgagc

SEQ ID NO: 4796591 - DNA, 23 bp, Homo sapiens
gcactctactctgcgacgatccc

SEQ ID NO: 4796592 - DNA, 17 bp, Homo sapiens
gcactgagcgcctgcag

SEQ ID NO: 4796593 - DNA, 21 bp, Homo sapiens
gccacccggatctccaggccc

SEQ ID NO: 4796594 - DNA, 16 bp, Homo sapiens
gccaccctctgctgca

SEQ ID NO: 4796595 - DNA, 19 bp, Homo sapiens
gccaccctctgctgcacag

SEQ ID NO: 4796596 - DNA, 17 bp, Homo sapiens
gccacctgcctgttggg

SEQ ID NO: 4796597 - DNA, 13 bp, Homo sapiens
gccacgctgtcct

SEQ ID NO: 4796598 - DNA, 18 bp, Homo sapiens
gccacgttgcagaaaaag

SEQ ID NO: 4796599 - DNA, 18 bp, Homo sapiens
gccactaaaatccaccca

SEQ ID NO: 4796600 - DNA, 17 bp, Homo sapiens
gccactcaggcagcctg

SEQ ID NO: 4796601 - DNA, 14 bp, Homo sapiens
gccagacagagatc

SEQ ID NO: 4796602 - DNA, 17 bp, Homo sapiens
gccagacttctaaaata

SEQ ID NO: 4796603 - DNA, 21 bp, Homo sapiens
gccagacttctaaaataaatg

SEQ ID NO: 4796604 - DNA, 15 bp, Homo sapiens
gccagagacacaagc

SEQ ID NO: 4796605 - DNA, 13 bp, Homo sapiens
gccagagcctctg

SEQ ID NO: 4796606 - DNA, 22 bp, Homo sapiens
gccagaggagagaggaccccct

SEQ ID NO: 4796607 - DNA, 15 bp, Homo sapiens
gccagcaccctctcc

SEQ ID NO: 4796608 - DNA, 17 bp, Homo sapiens
gccagcaccctctcctg

SEQ ID NO: 4796609 - DNA, 18 bp, Homo sapiens
gccagcaccctctcctgg

SEQ ID NO: 4796610 - DNA, 20 bp, Homo sapiens
gccagcaccctctcctgggg

SEQ ID NO: 4796611 - DNA, 20 bp, Homo sapiens
gccagcaggctctcaggcca

SEQ ID NO: 4796612 - DNA, 21 bp, Homo sapiens
gccagcagggcgggccaggag

SEQ ID NO: 4796613 - DNA, 23 bp, Homo sapiens
gccagcaggttctctcctgtgag

SEQ ID NO: 4796614 - DNA, 21 bp, Homo sapiens
gccagccacggggactcagcc

SEQ ID NO: 4796615 - DNA, 19 bp, Homo sapiens
gccagcccgcagaggtggg

SEQ ID NO: 4796616 - DNA, 22 bp, Homo sapiens
gccagccctgttccgcctcact

SEQ ID NO: 4796617 - DNA, 20 bp, Homo sapiens
gccagccgagatagccaagg

SEQ ID NO: 4796618 - DNA, 21 bp, Homo sapiens
gccagccgagatagccaaggc

SEQ ID NO: 4796619 - DNA, 15 bp, Homo sapiens
gccagccgccctggg

SEQ ID NO: 4796620 - DNA, 18 bp, Homo sapiens
gccagccgccctgggctg

SEQ ID NO: 4796621 - DNA, 14 bp, Homo sapiens
gccagcctggggcc

SEQ ID NO: 4796622 - DNA, 16 bp, Homo sapiens
gccagctctgagcaga

SEQ ID NO: 4796623 - DNA, 16 bp, Homo sapiens
gccagctgcttgggct

SEQ ID NO: 4796624 - DNA, 11 bp, Homo sapiens
gccaggaagcc

SEQ ID NO: 4796625 - DNA, 18 bp, Homo sapiens
gccaggaagccagcaggc

SEQ ID NO: 4796626 - DNA, 19 bp, Homo sapiens
gccaggaagccagcaggct

SEQ ID NO: 4796627 - DNA, 14 bp, Homo sapiens
gccaggaaggggac

SEQ ID NO: 4796628 - DNA, 21 bp, Homo sapiens
gccaggaaggggacaggattg

SEQ ID NO: 4796629 - DNA, 11 bp, Homo sapiens
gccaggagacc

SEQ ID NO: 4796630 - DNA, 19 bp, Homo sapiens
gccaggagcctcctgccct

SEQ ID NO: 4796631 - DNA, 13 bp, Homo sapiens
gccaggccctctc

SEQ ID NO: 4796632 - DNA, 20 bp, Homo sapiens
gccaggcctcagggaccaag

SEQ ID NO: 4796633 - DNA, 12 bp, Homo sapiens
gccaggctgcag

SEQ ID NO: 4796634 - DNA, 14 bp, Homo sapiens
gccaggctgcaggg

SEQ ID NO: 4796635 - DNA, 18 bp, Homo sapiens
gccagggcagtgctagtg

SEQ ID NO: 4796636 - DNA, 19 bp, Homo sapiens
gccagggtttacccagtgg

SEQ ID NO: 4796637 - DNA, 17 bp, Homo sapiens
gccaggtgtcctgactg

SEQ ID NO: 4796638 - DNA, 13 bp, Homo sapiens
gccataacttgtt

SEQ ID NO: 4796639 - DNA, 18 bp, Homo sapiens
gccataacttgtttgtaa

SEQ ID NO: 4796640 - DNA, 13 bp, Homo sapiens
gccatagccccag

SEQ ID NO: 4796641 - DNA, 19 bp, Homo sapiens
gccatatattttctgagta

SEQ ID NO: 4796642 - DNA, 13 bp, Homo sapiens
gccatcatttcat

SEQ ID NO: 4796643 - DNA, 13 bp, Homo sapiens
gccatccctgggc

SEQ ID NO: 4796644 - DNA, 14 bp, Homo sapiens
gccatccctgggcc

SEQ ID NO: 4796645 - DNA, 16 bp, Homo sapiens
gccatccctgggcccc

SEQ ID NO: 4796646 - DNA, 20 bp, Homo sapiens
gccatccctgggcccctcca

SEQ ID NO: 4796647 - DNA, 18 bp, Homo sapiens
gccatgaggaacaaggca

SEQ ID NO: 4796648 - DNA, 11 bp, Homo sapiens
gccatgctctt

SEQ ID NO: 4796649 - DNA, 13 bp, Homo sapiens
gccatggccagga

SEQ ID NO: 4796650 - DNA, 20 bp, Homo sapiens
gccatggctggatgtgcatc

SEQ ID NO: 4796651 - DNA, 23 bp, Homo sapiens
gccatggctggatgtgcatctgg

SEQ ID NO: 4796652 - DNA, 14 bp, Homo sapiens
gccatgggtgcttg

SEQ ID NO: 4796653 - DNA, 22 bp, Homo sapiens
gccattcatttacaacttccag

SEQ ID NO: 4796654 - DNA, 22 bp, Homo sapiens
gccattctgattggacctggcc

SEQ ID NO: 4796655 - DNA, 24 bp, Homo sapiens
gccattctgattggacctggccca

SEQ ID NO: 4796656 - DNA, 16 bp, Homo sapiens
gccattgaacactgca

SEQ ID NO: 4796657 - DNA, 20 bp, Homo sapiens
gccattgaacactgcaccct

SEQ ID NO: 4796658 - DNA, 22 bp, Homo sapiens
gccattggccttaactggccct

SEQ ID NO: 4796659 - DNA, 23 bp, Homo sapiens
gccattggccttaactggccctc

SEQ ID NO: 4796660 - DNA, 22 bp, Homo sapiens
gccatttcattgagggaaaaca

SEQ ID NO: 4796661 - DNA, 17 bp, Homo sapiens
gccatttcttccacaag

SEQ ID NO: 4796662 - DNA, 20 bp, Homo sapiens
gccatttcttccacaagagc

SEQ ID NO: 4796663 - DNA, 22 bp, Homo sapiens
gccatttcttccacaagagccc

SEQ ID NO: 4796664 - DNA, 16 bp, Homo sapiens
gcccaaagatgcagcc

SEQ ID NO: 4796665 - DNA, 17 bp, Homo sapiens
gcccaaataacagtggc

SEQ ID NO: 4796666 - DNA, 22 bp, Homo sapiens
gcccaaccgggaaaggcatcta

SEQ ID NO: 4796667 - DNA, 17 bp, Homo sapiens
gcccaaggcccccacct

SEQ ID NO: 4796668 - DNA, 19 bp, Homo sapiens
gcccaaggcccccacctct

SEQ ID NO: 4796669 - DNA, 15 bp, Homo sapiens
gcccacagtatattt

SEQ ID NO: 4796670 - DNA, 16 bp, Homo sapiens
gcccaccagggactgc

SEQ ID NO: 4796671 - DNA, 19 bp, Homo sapiens
gcccaccagggactgcagc

SEQ ID NO: 4796672 - DNA, 21 bp, Homo sapiens
gcccacccacaccccgtctgc

SEQ ID NO: 4796673 - DNA, 17 bp, Homo sapiens
gcccacccagcagcgcc

SEQ ID NO: 4796674 - DNA, 10 bp, Homo sapiens
gcccaccccg

SEQ ID NO: 4796675 - DNA, 15 bp, Homo sapiens
gcccacccgccccag

SEQ ID NO: 4796676 - DNA, 16 bp, Homo sapiens
gcccacccgccccaga

SEQ ID NO: 4796677 - DNA, 20 bp, Homo sapiens
gcccacccgccccagagact

SEQ ID NO: 4796678 - DNA, 23 bp, Homo sapiens
gcccacccgtgttctcctccaaa

SEQ ID NO: 4796679 - DNA, 12 bp, Homo sapiens
gcccaccctgct

SEQ ID NO: 4796680 - DNA, 18 bp, Homo sapiens
gcccaccctgctgccttc

SEQ ID NO: 4796681 - DNA, 18 bp, Homo sapiens
gcccaccctgggcctccc

SEQ ID NO: 4796682 - DNA, 18 bp, Homo sapiens
gcccacctgccaggctgc

SEQ ID NO: 4796683 - DNA, 19 bp, Homo sapiens
gcccacctgccaggctgca

SEQ ID NO: 4796684 - DNA, 21 bp, Homo sapiens
gcccacctgccaggctgcagg

SEQ ID NO: 4796685 - DNA, 22 bp, Homo sapiens
gcccacctgccaggctgcaggg

SEQ ID NO: 4796686 - DNA, 23 bp, Homo sapiens
gcccacctgccaggctgcaggga

SEQ ID NO: 4796687 - DNA, 13 bp, Homo sapiens
gcccacctgccca

SEQ ID NO: 4796688 - DNA, 12 bp, Homo sapiens
gcccacctgggc

SEQ ID NO: 4796689 - DNA, 13 bp, Homo sapiens
gcccacctgggcc

SEQ ID NO: 4796690 - DNA, 18 bp, Homo sapiens
gcccacctgggccctagg

SEQ ID NO: 4796691 - DNA, 22 bp, Homo sapiens
gcccacctgggccctaggcata

SEQ ID NO: 4796692 - DNA, 16 bp, Homo sapiens
gcccacgcagagcccc

SEQ ID NO: 4796693 - DNA, 23 bp, Homo sapiens
gcccacgcagagccccggagcac

SEQ ID NO: 4796694 - DNA, 19 bp, Homo sapiens
gcccacggctaagaggctg

SEQ ID NO: 4796695 - DNA, 17 bp, Homo sapiens
gcccacgtcctgggtgc

SEQ ID NO: 4796696 - DNA, 23 bp, Homo sapiens
gcccacgtcctgggtgctgtcat

SEQ ID NO: 4796697 - DNA, 24 bp, Homo sapiens
gcccactaactgaggagctagtgt

SEQ ID NO: 4796698 - DNA, 18 bp, Homo sapiens
gcccagaacgggcctccc

SEQ ID NO: 4796699 - DNA, 21 bp, Homo sapiens
gcccagagagaccctgccaac

SEQ ID NO: 4796700 - DNA, 17 bp, Homo sapiens
gcccagcacctcctccg

SEQ ID NO: 4796701 - DNA, 20 bp, Homo sapiens
gcccagcacctcctccgtgg

SEQ ID NO: 4796702 - DNA, 18 bp, Homo sapiens
gcccagcagcggcccaga

SEQ ID NO: 4796703 - DNA, 20 bp, Homo sapiens
gcccagcagcggcccagatt

SEQ ID NO: 4796704 - DNA, 12 bp, Homo sapiens
gcccagccatgg

SEQ ID NO: 4796705 - DNA, 14 bp, Homo sapiens
gcccagcccccacc

SEQ ID NO: 4796706 - DNA, 15 bp, Homo sapiens
gcccagcccccaccc

SEQ ID NO: 4796707 - DNA, 16 bp, Homo sapiens
gcccagcccccacccc

SEQ ID NO: 4796708 - DNA, 20 bp, Homo sapiens
gcccagcccccacccccgtc

SEQ ID NO: 4796709 - DNA, 12 bp, Homo sapiens
gcccagcctggc

SEQ ID NO: 4796710 - DNA, 16 bp, Homo sapiens
gcccagcctggcccca

SEQ ID NO: 4796711 - DNA, 13 bp, Homo sapiens
gcccagcttggag

SEQ ID NO: 4796712 - DNA, 19 bp, Homo sapiens
gcccaggaagtaattttct

SEQ ID NO: 4796713 - DNA, 15 bp, Homo sapiens
gcccaggaggacctg

SEQ ID NO: 4796714 - DNA, 16 bp, Homo sapiens
gcccaggaggacctgg

SEQ ID NO: 4796715 - DNA, 23 bp, Homo sapiens
gcccaggccatcaccacagctgc

SEQ ID NO: 4796716 - DNA, 18 bp, Homo sapiens
gcccaggccggccagcct

SEQ ID NO: 4796717 - DNA, 13 bp, Homo sapiens
gcccaggcctcct

SEQ ID NO: 4796718 - DNA, 23 bp, Homo sapiens
gcccagtgcaatctgtccagaca

SEQ ID NO: 4796719 - DNA, 16 bp, Homo sapiens
gcccagttagcccggc

SEQ ID NO: 4796720 - DNA, 17 bp, Homo sapiens
gcccagttagcccggcc

SEQ ID NO: 4796721 - DNA, 23 bp, Homo sapiens
gcccagttagcccggccaaggac

SEQ ID NO: 4796722 - DNA, 14 bp, Homo sapiens
gcccatgtgtcccc

SEQ ID NO: 4796723 - DNA, 16 bp, Homo sapiens
gcccatgtgtcccctc

SEQ ID NO: 4796724 - DNA, 19 bp, Homo sapiens
gcccatgtgtcccctcact

SEQ ID NO: 4796725 - DNA, 13 bp, Homo sapiens
gcccattgtaact

SEQ ID NO: 4796726 - DNA, 15 bp, Homo sapiens
gccccacacaggcct

SEQ ID NO: 4796727 - DNA, 16 bp, Homo sapiens
gccccacacaggcctg

SEQ ID NO: 4796728 - DNA, 21 bp, Homo sapiens
gccccacacaggcctggccca

SEQ ID NO: 4796729 - DNA, 13 bp, Homo sapiens
gccccacagtggt

SEQ ID NO: 4796730 - DNA, 16 bp, Homo sapiens
gccccacagtggtcag

SEQ ID NO: 4796731 - DNA, 17 bp, Homo sapiens
gccccacagtggtcagc

SEQ ID NO: 4796732 - DNA, 23 bp, Homo sapiens
gccccacccctgaactggcccca

SEQ ID NO: 4796733 - DNA, 16 bp, Homo sapiens
gccccagacctgccgc

SEQ ID NO: 4796734 - DNA, 23 bp, Homo sapiens
gccccagagaagcctcagtccct

SEQ ID NO: 4796735 - DNA, 24 bp, Homo sapiens
gccccagagaagcctcagtccctc

SEQ ID NO: 4796736 - DNA, 14 bp, Homo sapiens
gccccagagactgc

SEQ ID NO: 4796737 - DNA, 21 bp, Homo sapiens
gccccagagactgcccaccct

SEQ ID NO: 4796738 - DNA, 17 bp, Homo sapiens
gccccagctggctgggt

SEQ ID NO: 4796739 - DNA, 19 bp, Homo sapiens
gccccagctggctgggtcg

SEQ ID NO: 4796740 - DNA, 14 bp, Homo sapiens
gccccaggccctcc

SEQ ID NO: 4796741 - DNA, 15 bp, Homo sapiens
gccccaggccctccc

SEQ ID NO: 4796742 - DNA, 19 bp, Homo sapiens
gccccaggcggaggggctt

SEQ ID NO: 4796743 - DNA, 22 bp, Homo sapiens
gccccaggcggaggggcttgga

SEQ ID NO: 4796744 - DNA, 19 bp, Homo sapiens
gccccatccttcccgcagc

SEQ ID NO: 4796745 - DNA, 21 bp, Homo sapiens
gccccatccttcccgcagcac

SEQ ID NO: 4796746 - DNA, 22 bp, Homo sapiens
gccccatccttcccgcagcacc

SEQ ID NO: 4796747 - DNA, 23 bp, Homo sapiens
gccccatcgcctgggacgcccct

SEQ ID NO: 4796748 - DNA, 13 bp, Homo sapiens
gccccatctctcc

SEQ ID NO: 4796749 - DNA, 15 bp, Homo sapiens
gcccccacagatcca

SEQ ID NO: 4796750 - DNA, 20 bp, Homo sapiens
gcccccacccccgtcacccc

SEQ ID NO: 4796751 - DNA, 16 bp, Homo sapiens
gcccccacccctacag

SEQ ID NO: 4796752 - DNA, 20 bp, Homo sapiens
gcccccacccctacagcctg

SEQ ID NO: 4796753 - DNA, 15 bp, Homo sapiens
gcccccacctctgtg

SEQ ID NO: 4796754 - DNA, 14 bp, Homo sapiens
gcccccaggacccc

SEQ ID NO: 4796755 - DNA, 20 bp, Homo sapiens
gcccccatgcaggcagcctg

SEQ ID NO: 4796756 - DNA, 18 bp, Homo sapiens
gccccccctatctcttcc

SEQ ID NO: 4796757 - DNA, 21 bp, Homo sapiens
gccccccctatctcttcctgt

SEQ ID NO: 4796758 - DNA, 16 bp, Homo sapiens
gccccccggcctggcc

SEQ ID NO: 4796759 - DNA, 20 bp, Homo sapiens
gccccccggcctggccccct

SEQ ID NO: 4796760 - DNA, 18 bp, Homo sapiens
gccccccttcccacccct

SEQ ID NO: 4796761 - DNA, 14 bp, Homo sapiens
gcccccgcccaggc

SEQ ID NO: 4796762 - DNA, 21 bp, Homo sapiens
gcccccgcccctccccctaca

SEQ ID NO: 4796763 - DNA, 16 bp, Homo sapiens
gcccccgccctcgctc

SEQ ID NO: 4796764 - DNA, 18 bp, Homo sapiens
gcccccggaggcgcccac

SEQ ID NO: 4796765 - DNA, 21 bp, Homo sapiens
gcccccggaggcgcccacctg

SEQ ID NO: 4796766 - DNA, 18 bp, Homo sapiens
gccccctcccccgcagac

SEQ ID NO: 4796767 - DNA, 20 bp, Homo sapiens
gccccctcccccgcagacag

SEQ ID NO: 4796768 - DNA, 22 bp, Homo sapiens
gccccctcgcgcccctgtccat

SEQ ID NO: 4796769 - DNA, 21 bp, Homo sapiens
gccccctctcttaccccgtcc

SEQ ID NO: 4796770 - DNA, 13 bp, Homo sapiens
gccccctgcaccc

SEQ ID NO: 4796771 - DNA, 12 bp, Homo sapiens
gccccctgcttc

SEQ ID NO: 4796772 - DNA, 13 bp, Homo sapiens
gccccctgcttct

SEQ ID NO: 4796773 - DNA, 22 bp, Homo sapiens
gccccctggggggcacagccag

SEQ ID NO: 4796774 - DNA, 12 bp, Homo sapiens
gccccgcctccc

SEQ ID NO: 4796775 - DNA, 15 bp, Homo sapiens
gccccgcgcgtgccc

SEQ ID NO: 4796776 - DNA, 21 bp, Homo sapiens
gccccgcgcgtgcccccagcg

SEQ ID NO: 4796777 - DNA, 13 bp, Homo sapiens
gccccgcggagcc

SEQ ID NO: 4796778 - DNA, 14 bp, Homo sapiens
gccccgcggagccc

SEQ ID NO: 4796779 - DNA, 15 bp, Homo sapiens
gccccgcggagcccc

SEQ ID NO: 4796780 - DNA, 19 bp, Homo sapiens
gccccgcggagcccccgcc

SEQ ID NO: 4796781 - DNA, 21 bp, Homo sapiens
gccccggacagggtggcaccc

SEQ ID NO: 4796782 - DNA, 16 bp, Homo sapiens
gccccggagcaccacg

SEQ ID NO: 4796783 - DNA, 16 bp, Homo sapiens
gccccgggccgcgagc

SEQ ID NO: 4796784 - DNA, 16 bp, Homo sapiens
gcccctatcctgcacc

SEQ ID NO: 4796785 - DNA, 15 bp, Homo sapiens
gcccctccacgcctc

SEQ ID NO: 4796786 - DNA, 17 bp, Homo sapiens
gcccctccacgcctcct

SEQ ID NO: 4796787 - DNA, 20 bp, Homo sapiens
gcccctccacgcctcctggc

SEQ ID NO: 4796788 - DNA, 21 bp, Homo sapiens
gcccctccacgcctcctggcc

SEQ ID NO: 4796789 - DNA, 17 bp, Homo sapiens
gcccctccctcctgtgt

SEQ ID NO: 4796790 - DNA, 19 bp, Homo sapiens
gcccctccgggcagagacc

SEQ ID NO: 4796791 - DNA, 16 bp, Homo sapiens
gcccctccgtccccag

SEQ ID NO: 4796792 - DNA, 20 bp, Homo sapiens
gcccctccgtccccagggtg

SEQ ID NO: 4796793 - DNA, 20 bp, Homo sapiens
gcccctcctcgggcgcctgc

SEQ ID NO: 4796794 - DNA, 21 bp, Homo sapiens
gcccctcctcgggcgcctgcg

SEQ ID NO: 4796795 - DNA, 22 bp, Homo sapiens
gcccctcctcgggcgcctgcgc

SEQ ID NO: 4796796 - DNA, 13 bp, Homo sapiens
gcccctcctctcc

SEQ ID NO: 4796797 - DNA, 17 bp, Homo sapiens
gcccctcctctcctcgt

SEQ ID NO: 4796798 - DNA, 17 bp, Homo sapiens
gcccctccttctcccct

SEQ ID NO: 4796799 - DNA, 21 bp, Homo sapiens
gcccctccttctcccctccag

SEQ ID NO: 4796800 - DNA, 23 bp, Homo sapiens
gcccctctctgtttaccctccct

SEQ ID NO: 4796801 - DNA, 12 bp, Homo sapiens
gcccctctgcgc

SEQ ID NO: 4796802 - DNA, 20 bp, Homo sapiens
gcccctctgcgccccagcga

SEQ ID NO: 4796803 - DNA, 17 bp, Homo sapiens
gcccctgcccagcacct

SEQ ID NO: 4796804 - DNA, 18 bp, Homo sapiens
gcccctgcccagcacctc

SEQ ID NO: 4796805 - DNA, 18 bp, Homo sapiens
ttattcctaattcctgta

SEQ ID NO: 4796806 - DNA, 12 bp, Homo sapiens
ttattctcagaa

SEQ ID NO: 4796807 - DNA, 14 bp, Homo sapiens
ttattctcagaaca

SEQ ID NO: 4796808 - DNA, 13 bp, Homo sapiens
ttattcttccaag

SEQ ID NO: 4796809 - DNA, 17 bp, Homo sapiens
ttattgatattctaaga

SEQ ID NO: 4796810 - DNA, 19 bp, Homo sapiens
ttattgatattctaagaaa

SEQ ID NO: 4796811 - DNA, 21 bp, Homo sapiens
ttattgatattctaagaaata

SEQ ID NO: 4796812 - DNA, 17 bp, Homo sapiens
ttattggtcttgcccta

SEQ ID NO: 4796813 - DNA, 14 bp, Homo sapiens
ttattgtctgtaaa

SEQ ID NO: 4796814 - DNA, 21 bp, Homo sapiens
ttatttaaaatgtaaaaagga

SEQ ID NO: 4796815 - DNA, 14 bp, Homo sapiens
ttatttagtaaaat

SEQ ID NO: 4796816 - DNA, 15 bp, Homo sapiens
ttatttataacattg

SEQ ID NO: 4796817 - DNA, 18 bp, Homo sapiens
ttatttatattcagagat

SEQ ID NO: 4796818 - DNA, 15 bp, Homo sapiens
ttatttattaaactt

SEQ ID NO: 4796819 - DNA, 12 bp, Homo sapiens
ttatttcaatgt

SEQ ID NO: 4796820 - DNA, 22 bp, Homo sapiens
ttatttcccaacccaggattca

SEQ ID NO: 4796821 - DNA, 19 bp, Homo sapiens
ttatttctcgggtgcattt

SEQ ID NO: 4796822 - DNA, 15 bp, Homo sapiens
ttatttgtcagtgta

SEQ ID NO: 4796823 - DNA, 17 bp, Homo sapiens
ttattttaattcagttg

SEQ ID NO: 4796824 - DNA, 12 bp, Homo sapiens
ttattttagcag

SEQ ID NO: 4796825 - DNA, 21 bp, Homo sapiens
ttattttagcagttctgcaaa

SEQ ID NO: 4796826 - DNA, 15 bp, Homo sapiens
ttattttgtggcttt

SEQ ID NO: 4796827 - DNA, 17 bp, Homo sapiens
ttattttttgtaactct

SEQ ID NO: 4796828 - DNA, 21 bp, Homo sapiens
ttattttttttcttccaacat

SEQ ID NO: 4796829 - DNA, 14 bp, Homo sapiens
ttcaaaatattgag

SEQ ID NO: 4796830 - DNA, 23 bp, Homo sapiens
ttcaaaatattgagcagaattca

SEQ ID NO: 4796831 - DNA, 19 bp, Homo sapiens
ttcaaagaacccccctccc

SEQ ID NO: 4796832 - DNA, 23 bp, Homo sapiens
ttcaaagagaaaacatctcatca

SEQ ID NO: 4796833 - DNA, 11 bp, Homo sapiens
ttcaaaggctt

SEQ ID NO: 4796834 - DNA, 18 bp, Homo sapiens
ttcaaagtatatacagag

SEQ ID NO: 4796835 - DNA, 20 bp, Homo sapiens
ttcaaagtatatacagagcc

SEQ ID NO: 4796836 - DNA, 19 bp, Homo sapiens
ttcaaataaccctgaatca

SEQ ID NO: 4796837 - DNA, 22 bp, Homo sapiens
ttcaaataaccctgaatcagag

SEQ ID NO: 4796838 - DNA, 16 bp, Homo sapiens
ttcaaatgtgtaactt

SEQ ID NO: 4796839 - DNA, 19 bp, Homo sapiens
ttcaacctggtggcaccag

SEQ ID NO: 4796840 - DNA, 16 bp, Homo sapiens
ttcaacttcaggaaag

SEQ ID NO: 4796841 - DNA, 12 bp, Homo sapiens
ttcaagaaataa

SEQ ID NO: 4796842 - DNA, 21 bp, Homo sapiens
ttcaagatctaaatcatatat

SEQ ID NO: 4796843 - DNA, 21 bp, Homo sapiens
ttcaagcaaagacagtttctt

SEQ ID NO: 4796844 - DNA, 16 bp, Homo sapiens
ttcaagcaatcctccc

SEQ ID NO: 4796845 - DNA, 21 bp, Homo sapiens
ttcaagcgattctcctgcctc

SEQ ID NO: 4796846 - DNA, 14 bp, Homo sapiens
ttcaaggcacattg

SEQ ID NO: 4796847 - DNA, 22 bp, Homo sapiens
ttcaagtcatggggagattcct

SEQ ID NO: 4796848 - DNA, 19 bp, Homo sapiens
ttcaagttgcagtcagaag

SEQ ID NO: 4796849 - DNA, 22 bp, Homo sapiens
ttcaatccacagtattgttctt

SEQ ID NO: 4796850 - DNA, 15 bp, Homo sapiens
ttcaatgcaatgcat

SEQ ID NO: 4796851 - DNA, 16 bp, Homo sapiens
ttcaatgggtaaataa

SEQ ID NO: 4796852 - DNA, 20 bp, Homo sapiens
ttcaatgggtaaataaatgc

SEQ ID NO: 4796853 - DNA, 15 bp, Homo sapiens
ttcaatgtactgtat

SEQ ID NO: 4796854 - DNA, 13 bp, Homo sapiens
ttcaatgttaaat

SEQ ID NO: 4796855 - DNA, 19 bp, Homo sapiens
ttcacacaaagtgaaatta

SEQ ID NO: 4796856 - DNA, 11 bp, Homo sapiens
ttcacaccctg

SEQ ID NO: 4796857 - DNA, 13 bp, Homo sapiens
ttcacaccctgca

SEQ ID NO: 4796858 - DNA, 20 bp, Homo sapiens
ttcacaccttacaaagccag

SEQ ID NO: 4796859 - DNA, 13 bp, Homo sapiens
ttcacagttctct

SEQ ID NO: 4796860 - DNA, 20 bp, Homo sapiens
ttcacagttctctccttctt

SEQ ID NO: 4796861 - DNA, 23 bp, Homo sapiens
ttcaccacaaccctgttgctaca

SEQ ID NO: 4796862 - DNA, 18 bp, Homo sapiens
ttcaccaggaagaaggcc

SEQ ID NO: 4796863 - DNA, 20 bp, Homo sapiens
ttcaccaggaagaaggcccg

SEQ ID NO: 4796864 - DNA, 22 bp, Homo sapiens
ttcaccagtttccaagtttatt

SEQ ID NO: 4796865 - DNA, 20 bp, Homo sapiens
ttcaccccggcaggccctgc

SEQ ID NO: 4796866 - DNA, 11 bp, Homo sapiens
ttcacctgtaa

SEQ ID NO: 4796867 - DNA, 14 bp, Homo sapiens
ttcacctgtaaaac

SEQ ID NO: 4796868 - DNA, 19 bp, Homo sapiens
ttcacttaaactttgtcac

SEQ ID NO: 4796869 - DNA, 14 bp, Homo sapiens
ttcactttgacact

SEQ ID NO: 4796870 - DNA, 15 bp, Homo sapiens
ttcagactctctcct

SEQ ID NO: 4796871 - DNA, 20 bp, Homo sapiens
ttcagactctctcctctctc

SEQ ID NO: 4796872 - DNA, 22 bp, Homo sapiens
ttcagagatgtaccatgttaaa

SEQ ID NO: 4796873 - DNA, 15 bp, Homo sapiens
ttcagagttctctgt

SEQ ID NO: 4796874 - DNA, 14 bp, Homo sapiens
ttcagattgtaaag

SEQ ID NO: 4796875 - DNA, 12 bp, Homo sapiens
ttcagattgtat

SEQ ID NO: 4796876 - DNA, 14 bp, Homo sapiens
ttcagcaaccctac

SEQ ID NO: 4796877 - DNA, 20 bp, Homo sapiens
ttcagcatcgtgtgggtccc

SEQ ID NO: 4796878 - DNA, 22 bp, Homo sapiens
ttcagtcctgggagacccatgt

SEQ ID NO: 4796879 - DNA, 14 bp, Homo sapiens
ttcagtctatgctg

SEQ ID NO: 4796880 - DNA, 21 bp, Homo sapiens
ttcagtggacatttgttctgg

SEQ ID NO: 4796881 - DNA, 23 bp, Homo sapiens
ttcataatgacttaagcacactt

SEQ ID NO: 4796882 - DNA, 14 bp, Homo sapiens
ttcatacattccta

SEQ ID NO: 4796883 - DNA, 14 bp, Homo sapiens
ttcatactacattt

SEQ ID NO: 4796884 - DNA, 16 bp, Homo sapiens
ttcatactacatttga

SEQ ID NO: 4796885 - DNA, 13 bp, Homo sapiens
ttcatataatttg

SEQ ID NO: 4796886 - DNA, 23 bp, Homo sapiens
ttcatataggggcaaaaatttga

SEQ ID NO: 4796887 - DNA, 13 bp, Homo sapiens
ttcatcaatcatt

SEQ ID NO: 4796888 - DNA, 15 bp, Homo sapiens
ttcatcagaaaaagt

SEQ ID NO: 4796889 - DNA, 17 bp, Homo sapiens
ttcatccctctggggct

SEQ ID NO: 4796890 - DNA, 16 bp, Homo sapiens
ttcatcctcacatgtg

SEQ ID NO: 4796891 - DNA, 16 bp, Homo sapiens
ttcatcctcagcaagt

SEQ ID NO: 4796892 - DNA, 15 bp, Homo sapiens
ttcatcctcctcaga

SEQ ID NO: 4796893 - DNA, 19 bp, Homo sapiens
ttcatctgaggagtccaaa

SEQ ID NO: 4796894 - DNA, 12 bp, Homo sapiens
ttcatcttgaat

SEQ ID NO: 4796895 - DNA, 22 bp, Homo sapiens
ttcatgaattagaagaaaatgg

SEQ ID NO: 4796896 - DNA, 16 bp, Homo sapiens
ttcatgattagacaat

SEQ ID NO: 4796897 - DNA, 19 bp, Homo sapiens
ttcatgcgcagtccccagg

SEQ ID NO: 4796898 - DNA, 19 bp, Homo sapiens
ttcatgctgcctgccatgt

SEQ ID NO: 4796899 - DNA, 21 bp, Homo sapiens
ttcatgcttgatttgaccact

SEQ ID NO: 4796900 - DNA, 15 bp, Homo sapiens
ttcatgttctgtgtc

SEQ ID NO: 4796901 - DNA, 16 bp, Homo sapiens
ttcatgttctgtgtca

SEQ ID NO: 4796902 - DNA, 18 bp, Homo sapiens
ttcatgtttaagaaatga

SEQ ID NO: 4796903 - DNA, 13 bp, Homo sapiens
ttcatgttttgct

SEQ ID NO: 4796904 - DNA, 18 bp, Homo sapiens
ttcattccatttgctgat

SEQ ID NO: 4796905 - DNA, 20 bp, Homo sapiens
ttcattccgaaaaaaaaatg

SEQ ID NO: 4796906 - DNA, 20 bp, Homo sapiens
ttcatttacaacttccagat

SEQ ID NO: 4796907 - DNA, 12 bp, Homo sapiens
ttcattttctct

SEQ ID NO: 4796908 - DNA, 13 bp, Homo sapiens
ttcattttctctc

SEQ ID NO: 4796909 - DNA, 17 bp, Homo sapiens
ttcattttctctcctcg

SEQ ID NO: 4796910 - DNA, 22 bp, Homo sapiens
ttcatttttgaaactgcatttg

SEQ ID NO: 4796911 - DNA, 18 bp, Homo sapiens
ttcattttttttaattga

SEQ ID NO: 4796912 - DNA, 17 bp, Homo sapiens
ttccaaaggttgtacat

SEQ ID NO: 4796913 - DNA, 22 bp, Homo sapiens
ttccaagggtcttcctcctaaa

SEQ ID NO: 4796914 - DNA, 18 bp, Homo sapiens
ttccaatgccaattcatc

SEQ ID NO: 4796915 - DNA, 23 bp, Homo sapiens
ttccaatgtggtggcaataaatg

SEQ ID NO: 4796916 - DNA, 18 bp, Homo sapiens
ttccacaattttgtctct

SEQ ID NO: 4796917 - DNA, 14 bp, Homo sapiens
ttccaccctgccct

SEQ ID NO: 4796918 - DNA, 21 bp, Homo sapiens
ttccaccctgccctggcctac

SEQ ID NO: 4796919 - DNA, 19 bp, Homo sapiens
ttccacctggaaagccagg

SEQ ID NO: 4796920 - DNA, 14 bp, Homo sapiens
ttccaccttaaatt

SEQ ID NO: 4796921 - DNA, 18 bp, Homo sapiens
ttccaccttaaattaaac

SEQ ID NO: 4796922 - DNA, 14 bp, Homo sapiens
ttccactgcctctg

SEQ ID NO: 4796923 - DNA, 16 bp, Homo sapiens
ttccactgcctctgcc

SEQ ID NO: 4796924 - DNA, 12 bp, Homo sapiens
ttccagaattga

SEQ ID NO: 4796925 - DNA, 15 bp, Homo sapiens
ttccagaattgagag

SEQ ID NO: 4796926 - DNA, 20 bp, Homo sapiens
ttccagacagggtggggctt

SEQ ID NO: 4796927 - DNA, 12 bp, Homo sapiens
ttccagcaaaat

SEQ ID NO: 4796928 - DNA, 23 bp, Homo sapiens
ttccagctttctctttgttcttc

SEQ ID NO: 4796929 - DNA, 21 bp, Homo sapiens
ttccaggctagtccggaccca

SEQ ID NO: 4796930 - DNA, 21 bp, Homo sapiens
ttgatctcagcatcctggaaa

SEQ ID NO: 4796931 - DNA, 18 bp, Homo sapiens
ttgatctctgttctttca

SEQ ID NO: 4796932 - DNA, 12 bp, Homo sapiens
ttgatctgtatt

SEQ ID NO: 4796933 - DNA, 14 bp, Homo sapiens
ttgatctgtattaa

SEQ ID NO: 4796934 - DNA, 18 bp, Homo sapiens
ttgatgaccaatctctgt

SEQ ID NO: 4796935 - DNA, 19 bp, Homo sapiens
ttgatggctatgttttgga

SEQ ID NO: 4796936 - DNA, 23 bp, Homo sapiens
ttgatggtagaaattttatctct

SEQ ID NO: 4796937 - DNA, 17 bp, Homo sapiens
ttgattcataatgactt

SEQ ID NO: 4796938 - DNA, 22 bp, Homo sapiens
ttgatttgcaacactgccaaac

SEQ ID NO: 4796939 - DNA, 23 bp, Homo sapiens
ttgcaataaggatttattctcag

SEQ ID NO: 4796940 - DNA, 20 bp, Homo sapiens
ttgcaattgtttaagaatca

SEQ ID NO: 4796941 - DNA, 22 bp, Homo sapiens
ttgcaattgtttaagaatcatg

SEQ ID NO: 4796942 - DNA, 23 bp, Homo sapiens
ttgcaattgtttaagaatcatgg

SEQ ID NO: 4796943 - DNA, 20 bp, Homo sapiens
ttgcacacacagtctgttca

SEQ ID NO: 4796944 - DNA, 17 bp, Homo sapiens
ttgcactaaaagtgatg

SEQ ID NO: 4796945 - DNA, 15 bp, Homo sapiens
ttgcactgtatccaa

SEQ ID NO: 4796946 - DNA, 13 bp, Homo sapiens
ttgcacttctgtt

SEQ ID NO: 4796947 - DNA, 19 bp, Homo sapiens
ttgcacttctgttatcagg

SEQ ID NO: 4796948 - DNA, 13 bp, Homo sapiens
ttgcagaaaaaga

SEQ ID NO: 4796949 - DNA, 14 bp, Homo sapiens
ttgcagagtaaatc

SEQ ID NO: 4796950 - DNA, 17 bp, Homo sapiens
ttgcaggaagggaagag

SEQ ID NO: 4796951 - DNA, 16 bp, Homo sapiens
ttgcaggtgaccagaa

SEQ ID NO: 4796952 - DNA, 18 bp, Homo sapiens
ttgcaggtgaccagaatg

SEQ ID NO: 4796953 - DNA, 17 bp, Homo sapiens
ttgcagtcagaagatct

SEQ ID NO: 4796954 - DNA, 23 bp, Homo sapiens
ttgcagttagactcaaagaagta

SEQ ID NO: 4796955 - DNA, 22 bp, Homo sapiens
ttgcatatatttcatgaataca

SEQ ID NO: 4796956 - DNA, 21 bp, Homo sapiens
ttgcatcacaatttgttgaat

SEQ ID NO: 4796957 - DNA, 20 bp, Homo sapiens
ttgcatcctatcgatctgga

SEQ ID NO: 4796958 - DNA, 15 bp, Homo sapiens
ttgcattgtctgtct

SEQ ID NO: 4796959 - DNA, 17 bp, Homo sapiens
ttgccagacagagatca

SEQ ID NO: 4796960 - DNA, 15 bp, Homo sapiens
ttgccaggaagatgg

SEQ ID NO: 4796961 - DNA, 19 bp, Homo sapiens
ttgccaggctggagtgcag

SEQ ID NO: 4796962 - DNA, 23 bp, Homo sapiens
ttgccaggctggagtgcagtggc

SEQ ID NO: 4796963 - DNA, 13 bp, Homo sapiens
ttgccccacctcc

SEQ ID NO: 4796964 - DNA, 17 bp, Homo sapiens
ttgccgaggagccaggc

SEQ ID NO: 4796965 - DNA, 12 bp, Homo sapiens
ttgcctgaagaa

SEQ ID NO: 4796966 - DNA, 14 bp, Homo sapiens
ttgccttctgggga

SEQ ID NO: 4796967 - DNA, 15 bp, Homo sapiens
ttgccttctttactc

SEQ ID NO: 4796968 - DNA, 15 bp, Homo sapiens
ttgcgctctgggttt

SEQ ID NO: 4796969 - DNA, 21 bp, Homo sapiens
ttgcggcaccgcccacccaca

SEQ ID NO: 4796970 - DNA, 22 bp, Homo sapiens
ttgctaagataattaaatgaaa

SEQ ID NO: 4796971 - DNA, 22 bp, Homo sapiens
ttgctaatgaattttaaaagca

SEQ ID NO: 4796972 - DNA, 16 bp, Homo sapiens
ttgctaattaaaaagt

SEQ ID NO: 4796973 - DNA, 19 bp, Homo sapiens
ttgctagcaacaacttact

SEQ ID NO: 4796974 - DNA, 22 bp, Homo sapiens
ttgctagcaacaacttactaaa

SEQ ID NO: 4796975 - DNA, 16 bp, Homo sapiens
ttgctcataagtaaat

SEQ ID NO: 4796976 - DNA, 16 bp, Homo sapiens
ttgctctccattcttt

SEQ ID NO: 4796977 - DNA, 19 bp, Homo sapiens
ttgctctctcattcccagg

SEQ ID NO: 4796978 - DNA, 20 bp, Homo sapiens
ttgctcttaagtaccagaag

SEQ ID NO: 4796979 - DNA, 19 bp, Homo sapiens
ttgctgaataacaacaatt

SEQ ID NO: 4796980 - DNA, 16 bp, Homo sapiens
ttgctgatattgcagt

SEQ ID NO: 4796981 - DNA, 19 bp, Homo sapiens
ttgctgcactcttgcacat

SEQ ID NO: 4796982 - DNA, 15 bp, Homo sapiens
ttgctggaaaactgc

SEQ ID NO: 4796983 - DNA, 18 bp, Homo sapiens
ttgctggaaaactgccac

SEQ ID NO: 4796984 - DNA, 15 bp, Homo sapiens
ttgctggcatttgct

SEQ ID NO: 4796985 - DNA, 15 bp, Homo sapiens
ttgctgtaaataaaa

SEQ ID NO: 4796986 - DNA, 15 bp, Homo sapiens
ttgctgtctgaaaaa

SEQ ID NO: 4796987 - DNA, 17 bp, Homo sapiens
ttgctgtttaccgccca

SEQ ID NO: 4796988 - DNA, 16 bp, Homo sapiens
ttgcttatttatattc

SEQ ID NO: 4796989 - DNA, 16 bp, Homo sapiens
ttgcttcattaaaaca

SEQ ID NO: 4796990 - DNA, 13 bp, Homo sapiens
ttgcttctctgcc

SEQ ID NO: 4796991 - DNA, 16 bp, Homo sapiens
ttgctttataaataaa

SEQ ID NO: 4796992 - DNA, 20 bp, Homo sapiens
ttggaaaacgatttaattta

SEQ ID NO: 4796993 - DNA, 12 bp, Homo sapiens
ttggaaaataat

SEQ ID NO: 4796994 - DNA, 13 bp, Homo sapiens
ttggaagaattca

SEQ ID NO: 4796995 - DNA, 21 bp, Homo sapiens
ttggaagggcgctgagggcag

SEQ ID NO: 4796996 - DNA, 14 bp, Homo sapiens
ttggaagtatagat

SEQ ID NO: 4796997 - DNA, 15 bp, Homo sapiens
ttggaattcaatggg

SEQ ID NO: 4796998 - DNA, 16 bp, Homo sapiens
ttggaattctgcttct

SEQ ID NO: 4796999 - DNA, 14 bp, Homo sapiens
ttggacagcaaaac

SEQ ID NO: 4797000 - DNA, 15 bp, Homo sapiens
ttggactacctataa

SEQ ID NO: 4797001 - DNA, 18 bp, Homo sapiens
ttggactacctataaatg

SEQ ID NO: 4797002 - DNA, 15 bp, Homo sapiens
ttggagaggaggtgt

SEQ ID NO: 4797003 - DNA, 23 bp, Homo sapiens
ttggagcagagacggcagcccca

SEQ ID NO: 4797004 - DNA, 15 bp, Homo sapiens
ttggatcaagtatta

SEQ ID NO: 4797005 - DNA, 13 bp, Homo sapiens
ttggatgaatgca

SEQ ID NO: 4797006 - DNA, 12 bp, Homo sapiens
ttggattcacag

SEQ ID NO: 4797007 - DNA, 20 bp, Homo sapiens
ttggattcacagcctttgcg

SEQ ID NO: 4797008 - DNA, 15 bp, Homo sapiens
ttggattttaaacaa

SEQ ID NO: 4797009 - DNA, 23 bp, Homo sapiens
ttggcaccaaagatgcagccgcc

SEQ ID NO: 4797010 - DNA, 12 bp, Homo sapiens
ttggcagcacag

SEQ ID NO: 4797011 - DNA, 22 bp, Homo sapiens
ttggcatctctccccatatata

SEQ ID NO: 4797012 - DNA, 13 bp, Homo sapiens
ttggcattatctc

SEQ ID NO: 4797013 - DNA, 16 bp, Homo sapiens
ttggccagcacgttct

SEQ ID NO: 4797014 - DNA, 12 bp, Homo sapiens
ttggcctctgcc

SEQ ID NO: 4797015 - DNA, 18 bp, Homo sapiens
ttggccttaactggccct

SEQ ID NO: 4797016 - DNA, 23 bp, Homo sapiens
ttggcgctgcccctggcagcccc

SEQ ID NO: 4797017 - DNA, 14 bp, Homo sapiens
ttggcgtggagcag

SEQ ID NO: 4797018 - DNA, 16 bp, Homo sapiens
ttggctattgtccttg

SEQ ID NO: 4797019 - DNA, 15 bp, Homo sapiens
ttggctgattggaaa

SEQ ID NO: 4797020 - DNA, 20 bp, Homo sapiens
ttggctgattggaaaataat

SEQ ID NO: 4797021 - DNA, 16 bp, Homo sapiens
ttggctgccaagagtc

SEQ ID NO: 4797022 - DNA, 15 bp, Homo sapiens
ttggcttcagaattg

SEQ ID NO: 4797023 - DNA, 12 bp, Homo sapiens
ttgggaagcagt

SEQ ID NO: 4797024 - DNA, 22 bp, Homo sapiens
ttgggaagcagtttcagataaa

SEQ ID NO: 4797025 - DNA, 15 bp, Homo sapiens
ttgggagagcccctg

SEQ ID NO: 4797026 - DNA, 23 bp, Homo sapiens
ttgggcagtggagaggggacttg

SEQ ID NO: 4797027 - DNA, 17 bp, Homo sapiens
ttgggcccttagaatgt

SEQ ID NO: 4797028 - DNA, 17 bp, Homo sapiens
ttgggctgaatgtatgt

SEQ ID NO: 4797029 - DNA, 22 bp, Homo sapiens
ttgggctgaatgtatgtaaata

SEQ ID NO: 4797030 - DNA, 15 bp, Homo sapiens
ttgggctggcaccca

SEQ ID NO: 4797031 - DNA, 16 bp, Homo sapiens
ttgggctggcacccac

SEQ ID NO: 4797032 - DNA, 20 bp, Homo sapiens
ttggggaaggggcctgggct

SEQ ID NO: 4797033 - DNA, 11 bp, Homo sapiens
ttggggctcct

SEQ ID NO: 4797034 - DNA, 12 bp, Homo sapiens
ttggggctcctt

SEQ ID NO: 4797035 - DNA, 23 bp, Homo sapiens
ttgggggacgcccagcccccacc

SEQ ID NO: 4797036 - DNA, 15 bp, Homo sapiens
ttggggtagagagga

SEQ ID NO: 4797037 - DNA, 13 bp, Homo sapiens
ttggtatgaaaca

SEQ ID NO: 4797038 - DNA, 14 bp, Homo sapiens
ttggtatgaaacaa

SEQ ID NO: 4797039 - DNA, 21 bp, Homo sapiens
ttggtatgaaacaaatatact

SEQ ID NO: 4797040 - DNA, 13 bp, Homo sapiens
ttggtatggagtt

SEQ ID NO: 4797041 - DNA, 23 bp, Homo sapiens
ttggtcacaaagctatttaagtg

SEQ ID NO: 4797042 - DNA, 12 bp, Homo sapiens
ttggtcttgccc

SEQ ID NO: 4797043 - DNA, 14 bp, Homo sapiens
ttggtgaataacct

SEQ ID NO: 4797044 - DNA, 14 bp, Homo sapiens
ttggtgactgtccc

SEQ ID NO: 4797045 - DNA, 16 bp, Homo sapiens
ttggtgatgagactta

SEQ ID NO: 4797046 - DNA, 15 bp, Homo sapiens
ttggttacaaatttt

SEQ ID NO: 4797047 - DNA, 23 bp, Homo sapiens
ttggttacaaatttttactcagg

SEQ ID NO: 4797048 - DNA, 15 bp, Homo sapiens
ttggttagtgcatgt

SEQ ID NO: 4797049 - DNA, 10 bp, Homo sapiens
ttggttcctg

SEQ ID NO: 4797050 - DNA, 20 bp, Homo sapiens
ttggttgcaattgtttaaga

SEQ ID NO: 4797051 - DNA, 16 bp, Homo sapiens
ttggtttgtgggtcca

SEQ ID NO: 4797052 - DNA, 15 bp, Homo sapiens
ttggttttctccttc

SEQ ID NO: 4797053 - DNA, 16 bp, Homo sapiens
ttccagggaaccagag

SEQ ID NO: 4797054 - DNA, 15 bp, Homo sapiens
ttccagtcaggatga

SEQ ID NO: 4797055 - DNA, 15 bp, Homo sapiens
ttccagtgtattttc

SEQ ID NO: 4797056 - DNA, 19 bp, Homo sapiens
ttccagtgtattttctgtg

SEQ ID NO: 4797057 - DNA, 20 bp, Homo sapiens
ttccatacgtgcccatttca

SEQ ID NO: 4797058 - DNA, 22 bp, Homo sapiens
ttccatacgtgcccatttcaca

SEQ ID NO: 4797059 - DNA, 12 bp, Homo sapiens
ttccatattaaa

SEQ ID NO: 4797060 - DNA, 13 bp, Homo sapiens
ttccatattaaaa

SEQ ID NO: 4797061 - DNA, 15 bp, Homo sapiens
ttccatcagctttat

SEQ ID NO: 4797062 - DNA, 21 bp, Homo sapiens
ttccatgggagcaaatatcta

SEQ ID NO: 4797063 - DNA, 17 bp, Homo sapiens
ttccatgggttgaacaa

SEQ ID NO: 4797064 - DNA, 15 bp, Homo sapiens
ttccattctatgact

SEQ ID NO: 4797065 - DNA, 18 bp, Homo sapiens
ttcccaatcagcactgaa

SEQ ID NO: 4797066 - DNA, 14 bp, Homo sapiens
ttcccaattatcaa

SEQ ID NO: 4797067 - DNA, 17 bp, Homo sapiens
ttcccacaagaaattca

SEQ ID NO: 4797068 - DNA, 19 bp, Homo sapiens
ttcccacccactagccctc

SEQ ID NO: 4797069 - DNA, 16 bp, Homo sapiens
ttcccacctccctgcc

SEQ ID NO: 4797070 - DNA, 23 bp, Homo sapiens
ttcccactgcggaacaggagtga

SEQ ID NO: 4797071 - DNA, 21 bp, Homo sapiens
ttcccagcaaagttttcagat

SEQ ID NO: 4797072 - DNA, 23 bp, Homo sapiens
ttcccagcgcatggcgccccggg

SEQ ID NO: 4797073 - DNA, 18 bp, Homo sapiens
ttcccagctgctcctaga

SEQ ID NO: 4797074 - DNA, 16 bp, Homo sapiens
ttcccagggccgcttc

SEQ ID NO: 4797075 - DNA, 17 bp, Homo sapiens
ttcccatcaccggagga

SEQ ID NO: 4797076 - DNA, 16 bp, Homo sapiens
ttcccatgcaggctaa

SEQ ID NO: 4797077 - DNA, 19 bp, Homo sapiens
ttcccatttccttgtctaa

SEQ ID NO: 4797078 - DNA, 18 bp, Homo sapiens
ttcccatttgtaatgtat

SEQ ID NO: 4797079 - DNA, 18 bp, Homo sapiens
ttccccaaggcactgagc

SEQ ID NO: 4797080 - DNA, 19 bp, Homo sapiens
ttccccaaggcactgagcg

SEQ ID NO: 4797081 - DNA, 16 bp, Homo sapiens
ttccccactcccgtga

SEQ ID NO: 4797082 - DNA, 15 bp, Homo sapiens
ttccccatctgtgtg

SEQ ID NO: 4797083 - DNA, 13 bp, Homo sapiens
ttcccccttcccc

SEQ ID NO: 4797084 - DNA, 15 bp, Homo sapiens
ttcccccttcccctg

SEQ ID NO: 4797085 - DNA, 16 bp, Homo sapiens
ttcccccttcccctgc

SEQ ID NO: 4797086 - DNA, 16 bp, Homo sapiens
ttcccctgcgccctcc

SEQ ID NO: 4797087 - DNA, 17 bp, Homo sapiens
ttcccctgcgccctccc

SEQ ID NO: 4797088 - DNA, 13 bp, Homo sapiens
ttcccgcagcacc

SEQ ID NO: 4797089 - DNA, 19 bp, Homo sapiens
ttcccgggaacgcttgctc

SEQ ID NO: 4797090 - DNA, 19 bp, Homo sapiens
ttcccgtggctttgtgctt

SEQ ID NO: 4797091 - DNA, 18 bp, Homo sapiens
ttccctcagccctcatta

SEQ ID NO: 4797092 - DNA, 21 bp, Homo sapiens
ttccctgacactgtctgctgc

SEQ ID NO: 4797093 - DNA, 16 bp, Homo sapiens
ttccctgcatcccttg

SEQ ID NO: 4797094 - DNA, 21 bp, Homo sapiens
ttccctgcgcgcagctggcgc

SEQ ID NO: 4797095 - DNA, 13 bp, Homo sapiens
ttcccttccactg

SEQ ID NO: 4797096 - DNA, 18 bp, Homo sapiens
ttcccttgattcaaataa

SEQ ID NO: 4797097 - DNA, 18 bp, Homo sapiens
ttccgcgtggttctgcca

SEQ ID NO: 4797098 - DNA, 15 bp, Homo sapiens
ttccgtgagacacaa

SEQ ID NO: 4797099 - DNA, 13 bp, Homo sapiens
ttccgttcatctg

SEQ ID NO: 4797100 - DNA, 13 bp, Homo sapiens
ttcctaatcctct

SEQ ID NO: 4797101 - DNA, 14 bp, Homo sapiens
ttcctaattctatg

SEQ ID NO: 4797102 - DNA, 15 bp, Homo sapiens
ttcctcatctccatg

SEQ ID NO: 4797103 - DNA, 11 bp, Homo sapiens
ttcctcatggc

SEQ ID NO: 4797104 - DNA, 21 bp, Homo sapiens
ttcctccccagccccctggca

SEQ ID NO: 4797105 - DNA, 12 bp, Homo sapiens
ttcctccctcca

SEQ ID NO: 4797106 - DNA, 19 bp, Homo sapiens
ttcctcctcagtcttctca

SEQ ID NO: 4797107 - DNA, 18 bp, Homo sapiens
ttcctctaagatcttgcc

SEQ ID NO: 4797108 - DNA, 18 bp, Homo sapiens
ttcctctgtctcctaagc

SEQ ID NO: 4797109 - DNA, 22 bp, Homo sapiens
ttcctcttagaagaatattgta

SEQ ID NO: 4797110 - DNA, 18 bp, Homo sapiens
ttcctgaagaattgaaaa

SEQ ID NO: 4797111 - DNA, 15 bp, Homo sapiens
ttcctgaccctcact

SEQ ID NO: 4797112 - DNA, 23 bp, Homo sapiens
ttcctgaggtcatctgtaaaata

SEQ ID NO: 4797113 - DNA, 16 bp, Homo sapiens
ttcctgggcagcccag

SEQ ID NO: 4797114 - DNA, 19 bp, Homo sapiens
ttcctgggcagcccagaga

SEQ ID NO: 4797115 - DNA, 15 bp, Homo sapiens
ttcctgggtgctcag

SEQ ID NO: 4797116 - DNA, 11 bp, Homo sapiens
ttcctgtcaat

SEQ ID NO: 4797117 - DNA, 15 bp, Homo sapiens
ttcctgtcctgctca

SEQ ID NO: 4797118 - DNA, 21 bp, Homo sapiens
ttcctgtcctgctcacgtctg

SEQ ID NO: 4797119 - DNA, 13 bp, Homo sapiens
ttcctgtgaggat

SEQ ID NO: 4797120 - DNA, 14 bp, Homo sapiens
ttccttaacagctg

SEQ ID NO: 4797121 - DNA, 19 bp, Homo sapiens
ttccttagtataatattaa

SEQ ID NO: 4797122 - DNA, 16 bp, Homo sapiens
ttccttcacccaccac

SEQ ID NO: 4797123 - DNA, 21 bp, Homo sapiens
ttccttctcatcttgcctcat

SEQ ID NO: 4797124 - DNA, 17 bp, Homo sapiens
ttccttctgatctgaga

SEQ ID NO: 4797125 - DNA, 13 bp, Homo sapiens
ttccttctggcct

SEQ ID NO: 4797126 - DNA, 14 bp, Homo sapiens
ttccttctggcctt

SEQ ID NO: 4797127 - DNA, 15 bp, Homo sapiens
ttccttggcccagca

SEQ ID NO: 4797128 - DNA, 15 bp, Homo sapiens
ttcctttcatcctca

SEQ ID NO: 4797129 - DNA, 16 bp, Homo sapiens
ttcctttgacctctca

SEQ ID NO: 4797130 - DNA, 21 bp, Homo sapiens
ttccttttctattccttctgg

SEQ ID NO: 4797131 - DNA, 16 bp, Homo sapiens
ttcgcagaacatgagt

SEQ ID NO: 4797132 - DNA, 17 bp, Homo sapiens
ttcgctattcccaggca

SEQ ID NO: 4797133 - DNA, 22 bp, Homo sapiens
ttcgctattcccaggcagggag

SEQ ID NO: 4797134 - DNA, 23 bp, Homo sapiens
ttcgtccttagaatactgtattg

SEQ ID NO: 4797135 - DNA, 18 bp, Homo sapiens
ttcgtcttccctgcttca

SEQ ID NO: 4797136 - DNA, 12 bp, Homo sapiens
ttcgtgcatttg

SEQ ID NO: 4797137 - DNA, 15 bp, Homo sapiens
ttcgtttgcctccag

SEQ ID NO: 4797138 - DNA, 18 bp, Homo sapiens
ttctaaaaagtcagatgt

SEQ ID NO: 4797139 - DNA, 16 bp, Homo sapiens
ttctaaaactactgcc

SEQ ID NO: 4797140 - DNA, 22 bp, Homo sapiens
ttctaaaataaatgttttggaa

SEQ ID NO: 4797141 - DNA, 13 bp, Homo sapiens
ttctaaagctgcc

SEQ ID NO: 4797142 - DNA, 18 bp, Homo sapiens
ttctaaatcataatcatc

SEQ ID NO: 4797143 - DNA, 15 bp, Homo sapiens
ttctaagaatttaga

SEQ ID NO: 4797144 - DNA, 22 bp, Homo sapiens
ttctaagattgtacatatggaa

SEQ ID NO: 4797145 - DNA, 22 bp, Homo sapiens
ttctactcgagttacagacaaa

SEQ ID NO: 4797146 - DNA, 18 bp, Homo sapiens
ttctagaatactaataaa

SEQ ID NO: 4797147 - DNA, 15 bp, Homo sapiens
ttctagattaccatg

SEQ ID NO: 4797148 - DNA, 14 bp, Homo sapiens
ttctagcaactgtt

SEQ ID NO: 4797149 - DNA, 16 bp, Homo sapiens
ttctagcatggctgcc

SEQ ID NO: 4797150 - DNA, 20 bp, Homo sapiens
ttctagtaacagtatttcca

SEQ ID NO: 4797151 - DNA, 16 bp, Homo sapiens
ttctatatttactgtt

SEQ ID NO: 4797152 - DNA, 16 bp, Homo sapiens
ttctatatttggattc

SEQ ID NO: 4797153 - DNA, 23 bp, Homo sapiens
ttctatatttggattcacagcct

SEQ ID NO: 4797154 - DNA, 21 bp, Homo sapiens
ttctatggaccaaatgtaaaa

SEQ ID NO: 4797155 - DNA, 19 bp, Homo sapiens
ttctatggattcacttcta

SEQ ID NO: 4797156 - DNA, 18 bp, Homo sapiens
ttctatgtccaacagagt

SEQ ID NO: 4797157 - DNA, 17 bp, Homo sapiens
ttctattatctgggttt

SEQ ID NO: 4797158 - DNA, 14 bp, Homo sapiens
ttctattccttctg

SEQ ID NO: 4797159 - DNA, 18 bp, Homo sapiens
ttctattccttctggcct

SEQ ID NO: 4797160 - DNA, 14 bp, Homo sapiens
ttctattgtttctt

SEQ ID NO: 4797161 - DNA, 18 bp, Homo sapiens
ttctcaaatgctaaatgc

SEQ ID NO: 4797162 - DNA, 19 bp, Homo sapiens
ttctcaaatgctactcagt

SEQ ID NO: 4797163 - DNA, 20 bp, Homo sapiens
ttctcaaatgctactcagta

SEQ ID NO: 4797164 - DNA, 15 bp, Homo sapiens
ttctcaacacacagt

SEQ ID NO: 4797165 - DNA, 18 bp, Homo sapiens
ttctcaagcgctatccac

SEQ ID NO: 4797166 - DNA, 16 bp, Homo sapiens
ttctcaatgcttttct

SEQ ID NO: 4797167 - DNA, 22 bp, Homo sapiens
ttctcacactctaactgtatat

SEQ ID NO: 4797168 - DNA, 15 bp, Homo sapiens
ttctcagaagtgaaa

SEQ ID NO: 4797169 - DNA, 16 bp, Homo sapiens
ttctcagaagtgaaaa

SEQ ID NO: 4797170 - DNA, 22 bp, Homo sapiens
ttctcagaagtgaaaaagactt

SEQ ID NO: 4797171 - DNA, 19 bp, Homo sapiens
ttctcagccttggttcctg

SEQ ID NO: 4797172 - DNA, 21 bp, Homo sapiens
ttctcagcgggagtctcctca

SEQ ID NO: 4797173 - DNA, 15 bp, Homo sapiens
ttctcatccaaaagt

SEQ ID NO: 4797174 - DNA, 17 bp, Homo sapiens
ttctcatccaaaagtga

SEQ ID NO: 4797175 - DNA, 14 bp, Homo sapiens
ttctcatcttgcct

SEQ ID NO: 4797176 - DNA, 16 bp, Homo sapiens
ttctcattcttctaaa

SEQ ID NO: 4797177 - DNA, 13 bp, Homo sapiens
ttctcatttatgt

SEQ ID NO: 4797178 - DNA, 19 bp, Homo sapiens
ttctcattttttcctgaga

SEQ ID NO: 4797179 - DNA, 12 bp, Homo sapiens
ttctccacctcc

SEQ ID NO: 4797180 - DNA, 19 bp, Homo sapiens
ttctccagcctcagcctcc

SEQ ID NO: 4797181 - DNA, 18 bp, Homo sapiens
ttctccattaaacttcta

SEQ ID NO: 4797182 - DNA, 15 bp, Homo sapiens
ttctcccatgatttg

SEQ ID NO: 4797183 - DNA, 16 bp, Homo sapiens
ttctccccctcagctc

SEQ ID NO: 4797184 - DNA, 16 bp, Homo sapiens
ttctcccctccaagtg

SEQ ID NO: 4797185 - DNA, 15 bp, Homo sapiens
ttctcccctccagac

SEQ ID NO: 4797186 - DNA, 22 bp, Homo sapiens
ttctccctggggaggacccctg

SEQ ID NO: 4797187 - DNA, 13 bp, Homo sapiens
ttctcctctccca

SEQ ID NO: 4797188 - DNA, 14 bp, Homo sapiens
ttctccttaacccc

SEQ ID NO: 4797189 - DNA, 18 bp, Homo sapiens
ttctccttgtacttgaat

SEQ ID NO: 4797190 - DNA, 22 bp, Homo sapiens
ttctctcaggtgcgtgccacat

SEQ ID NO: 4797191 - DNA, 13 bp, Homo sapiens
ttctctctgtgct

SEQ ID NO: 4797192 - DNA, 12 bp, Homo sapiens
ttctctctgtgt

SEQ ID NO: 4797193 - DNA, 13 bp, Homo sapiens
ttctctctgtgtg

SEQ ID NO: 4797194 - DNA, 12 bp, Homo sapiens
ttctctcttggt

SEQ ID NO: 4797195 - DNA, 20 bp, Homo sapiens
ttctctgccggtggggccag

SEQ ID NO: 4797196 - DNA, 22 bp, Homo sapiens
ttctcttacgctctctgtctgg

SEQ ID NO: 4797197 - DNA, 17 bp, Homo sapiens
ttctcttcgctgtgatg

SEQ ID NO: 4797198 - DNA, 12 bp, Homo sapiens
ttctctttcaca

SEQ ID NO: 4797199 - DNA, 22 bp, Homo sapiens
ttctctttgtggggcttggcgt

SEQ ID NO: 4797200 - DNA, 19 bp, Homo sapiens
ttctgaacttggcgctgcc

SEQ ID NO: 4797201 - DNA, 23 bp, Homo sapiens
ttctgaacttggcgctgcccctg

SEQ ID NO: 4797202 - DNA, 14 bp, Homo sapiens
ttctgaagatctca

SEQ ID NO: 4797203 - DNA, 16 bp, Homo sapiens
ttctgaagatctcaga

SEQ ID NO: 4797204 - DNA, 20 bp, Homo sapiens
ttctgaaggggaaaacctca

SEQ ID NO: 4797205 - DNA, 14 bp, Homo sapiens
ttctgacggccctg

SEQ ID NO: 4797206 - DNA, 17 bp, Homo sapiens
ttctgatacatctgtca

SEQ ID NO: 4797207 - DNA, 15 bp, Homo sapiens
ttctgatcctctctt

SEQ ID NO: 4797208 - DNA, 14 bp, Homo sapiens
ttctgatgaaatgt

SEQ ID NO: 4797209 - DNA, 16 bp, Homo sapiens
ttctgattattacaac

SEQ ID NO: 4797210 - DNA, 17 bp, Homo sapiens
ttctgcaaatagaaaac

SEQ ID NO: 4797211 - DNA, 23 bp, Homo sapiens
ttctgcaaatagaaaacaggaaa

SEQ ID NO: 4797212 - DNA, 11 bp, Homo sapiens
ttctgcaataa

SEQ ID NO: 4797213 - DNA, 19 bp, Homo sapiens
ttctgcaataacagtttta

SEQ ID NO: 4797214 - DNA, 14 bp, Homo sapiens
ttctgcacatacag

SEQ ID NO: 4797215 - DNA, 17 bp, Homo sapiens
ttctgcacatacagatg

SEQ ID NO: 4797216 - DNA, 13 bp, Homo sapiens
ttctgcactgaaa

SEQ ID NO: 4797217 - DNA, 17 bp, Homo sapiens
ttctgcagtattctgta

SEQ ID NO: 4797218 - DNA, 18 bp, Homo sapiens
ttctgcatgcttagagca

SEQ ID NO: 4797219 - DNA, 21 bp, Homo sapiens
ttctgcattactattaactct

SEQ ID NO: 4797220 - DNA, 14 bp, Homo sapiens
ttctgccgcagccc

SEQ ID NO: 4797221 - DNA, 16 bp, Homo sapiens
ttctgctaatttatga

SEQ ID NO: 4797222 - DNA, 14 bp, Homo sapiens
ttctgctttctgat

SEQ ID NO: 4797223 - DNA, 17 bp, Homo sapiens
ttctggactatagctgt

SEQ ID NO: 4797224 - DNA, 22 bp, Homo sapiens
ttctgggaagaaaatgagatgg

SEQ ID NO: 4797225 - DNA, 13 bp, Homo sapiens
ttctggtccttag

SEQ ID NO: 4797226 - DNA, 20 bp, Homo sapiens
ttctggtccttagtaaattc

SEQ ID NO: 4797227 - DNA, 23 bp, Homo sapiens
ttctgtaatatttacaatgtatt

SEQ ID NO: 4797228 - DNA, 13 bp, Homo sapiens
ttctgtaattctt

SEQ ID NO: 4797229 - DNA, 14 bp, Homo sapiens
ttctgtatatagat

SEQ ID NO: 4797230 - DNA, 22 bp, Homo sapiens
ttctgtcaaagtcagaacaaat

SEQ ID NO: 4797231 - DNA, 14 bp, Homo sapiens
ttctgtcaatgaaa

SEQ ID NO: 4797232 - DNA, 18 bp, Homo sapiens
ttctgtgcatctggcctg

SEQ ID NO: 4797233 - DNA, 20 bp, Homo sapiens
ttctgtgtcacgtgaccctg

SEQ ID NO: 4797234 - DNA, 21 bp, Homo sapiens
ttctgtgtcacgtgaccctgt

SEQ ID NO: 4797235 - DNA, 14 bp, Homo sapiens
ttctgttatacaca

SEQ ID NO: 4797236 - DNA, 15 bp, Homo sapiens
ttctgttggtcttaa

SEQ ID NO: 4797237 - DNA, 15 bp, Homo sapiens
ttcttacctcatttg

SEQ ID NO: 4797238 - DNA, 21 bp, Homo sapiens
ttcttatacagataaaacatg

SEQ ID NO: 4797239 - DNA, 18 bp, Homo sapiens
ttcttatgccatataatt

SEQ ID NO: 4797240 - DNA, 20 bp, Homo sapiens
ttcttcatccatagacacag

SEQ ID NO: 4797241 - DNA, 22 bp, Homo sapiens
ttcttcatccatagacacagta

SEQ ID NO: 4797242 - DNA, 19 bp, Homo sapiens
ttcttccaaaaggaagcac

SEQ ID NO: 4797243 - DNA, 22 bp, Homo sapiens
ttcttccccaaggcactgagcg

SEQ ID NO: 4797244 - DNA, 23 bp, Homo sapiens
ttcttccccaaggcactgagcgc

SEQ ID NO: 4797245 - DNA, 21 bp, Homo sapiens
ttcttcccccagggtcccctg

SEQ ID NO: 4797246 - DNA, 13 bp, Homo sapiens
ttcttccctagct

SEQ ID NO: 4797247 - DNA, 13 bp, Homo sapiens
ttcttccttcctt

SEQ ID NO: 4797248 - DNA, 12 bp, Homo sapiens
ttcttccttgcc

SEQ ID NO: 4797249 - DNA, 22 bp, Homo sapiens
ttcttctccactttctagccag

SEQ ID NO: 4797250 - DNA, 12 bp, Homo sapiens
ttcttctccttt

SEQ ID NO: 4797251 - DNA, 13 bp, Homo sapiens
ttcttctgtaata

SEQ ID NO: 4797252 - DNA, 13 bp, Homo sapiens
ttcttgcaagctc

SEQ ID NO: 4797253 - DNA, 20 bp, Homo sapiens
ttcttgcaagctccagtagc

SEQ ID NO: 4797254 - DNA, 21 bp, Homo sapiens
ttcttgcaagctccagtagct

SEQ ID NO: 4797255 - DNA, 19 bp, Homo sapiens
ttcttgcactgtatccaag

SEQ ID NO: 4797256 - DNA, 19 bp, Homo sapiens
ttcttgcagtcatcagaag

SEQ ID NO: 4797257 - DNA, 18 bp, Homo sapiens
ttcttggagtcttccaaa

SEQ ID NO: 4797258 - DNA, 21 bp, Homo sapiens
ttcttgtaaaactgtgacatt

SEQ ID NO: 4797259 - DNA, 23 bp, Homo sapiens
ttcttgtaaaactgtgacattcc

SEQ ID NO: 4797260 - DNA, 12 bp, Homo sapiens
ttcttgtatctg

SEQ ID NO: 4797261 - DNA, 22 bp, Homo sapiens
ttcttgtatctggattcaaatt

SEQ ID NO: 4797262 - DNA, 12 bp, Homo sapiens
ttcttgtctctc

SEQ ID NO: 4797263 - DNA, 15 bp, Homo sapiens
ttcttgtctctctgg

SEQ ID NO: 4797264 - DNA, 14 bp, Homo sapiens
ttcttgtgtgttta

SEQ ID NO: 4797265 - DNA, 14 bp, Homo sapiens
ttcttgtgtttgaa

SEQ ID NO: 4797266 - DNA, 20 bp, Homo sapiens
ttcttgttcatgttttgcta

SEQ ID NO: 4797267 - DNA, 22 bp, Homo sapiens
ttcttgtttaccaaagaagagt

SEQ ID NO: 4797268 - DNA, 15 bp, Homo sapiens
ttctttaacatatca

SEQ ID NO: 4797269 - DNA, 14 bp, Homo sapiens
ttctttaaccagtc

SEQ ID NO: 4797270 - DNA, 12 bp, Homo sapiens
ttctttaatttt

SEQ ID NO: 4797271 - DNA, 14 bp, Homo sapiens
ttctttataatggc

SEQ ID NO: 4797272 - DNA, 13 bp, Homo sapiens
ttctttattcaca

SEQ ID NO: 4797273 - DNA, 14 bp, Homo sapiens
ttctttccttcctt

SEQ ID NO: 4797274 - DNA, 22 bp, Homo sapiens
ttctttgagggactgcctctgc

SEQ ID NO: 4797275 - DNA, 15 bp, Homo sapiens
ttctttgttttgggt

SEQ ID NO: 4797276 - DNA, 17 bp, Homo sapiens
ttcttttcaatgcaatg

SEQ ID NO: 4797277 - DNA, 13 bp, Homo sapiens
ttcttttcccatt

SEQ ID NO: 4797278 - DNA, 11 bp, Homo sapiens
ttcttttgtgc

SEQ ID NO: 4797279 - DNA, 14 bp, Homo sapiens
ttcttttgtgcata

SEQ ID NO: 4797280 - DNA, 19 bp, Homo sapiens
ttctttttaggctctgaga

SEQ ID NO: 4797281 - DNA, 17 bp, Homo sapiens
ttgaaaactctcagtca

SEQ ID NO: 4797282 - DNA, 18 bp, Homo sapiens
ttgaaacacacagtgacc

SEQ ID NO: 4797283 - DNA, 22 bp, Homo sapiens
ttgaaacacacagtgaccaagg

SEQ ID NO: 4797284 - DNA, 17 bp, Homo sapiens
ttgaaactgcatttgtg

SEQ ID NO: 4797285 - DNA, 18 bp, Homo sapiens
ttgaaactgcatttgtgc

SEQ ID NO: 4797286 - DNA, 14 bp, Homo sapiens
ttgaaactgtattt

SEQ ID NO: 4797287 - DNA, 20 bp, Homo sapiens
ttgaaaggagaaaaaaaaag

SEQ ID NO: 4797288 - DNA, 17 bp, Homo sapiens
ttgaaataacagcctta

SEQ ID NO: 4797289 - DNA, 14 bp, Homo sapiens
ttgaaatacttgaa

SEQ ID NO: 4797290 - DNA, 13 bp, Homo sapiens
ttgaaatttctca

SEQ ID NO: 4797291 - DNA, 21 bp, Homo sapiens
ttgaacaactcgaatcactca

SEQ ID NO: 4797292 - DNA, 19 bp, Homo sapiens
ttgaacactgcaccctcca

SEQ ID NO: 4797293 - DNA, 22 bp, Homo sapiens
ttgaacattaatccacatgttt

SEQ ID NO: 4797294 - DNA, 20 bp, Homo sapiens
ttgaagacttcaaaatattg

SEQ ID NO: 4797295 - DNA, 13 bp, Homo sapiens
ttgaaggactaca

SEQ ID NO: 4797296 - DNA, 22 bp, Homo sapiens
ttgaataaactccccagcgtat

SEQ ID NO: 4797297 - DNA, 14 bp, Homo sapiens
ttgaattgtaagga

SEQ ID NO: 4797298 - DNA, 21 bp, Homo sapiens
ttgaattgtgtggagaagtgt

SEQ ID NO: 4797299 - DNA, 18 bp, Homo sapiens
ttgacaataagaaacagt

SEQ ID NO: 4797300 - DNA, 23 bp, Homo sapiens
ttgacaataagaaacagtttaac

SEQ ID NO: 4797301 - DNA, 18 bp, Homo sapiens
ttgacacttttcatatca

SEQ ID NO: 4797302 - DNA, 15 bp, Homo sapiens
ttgacattgtcagaa

SEQ ID NO: 4797303 - DNA, 21 bp, Homo sapiens
tgttttggatgaatgcagtat

SEQ ID NO: 4797304 - DNA, 18 bp, Homo sapiens
tgttttgtggataagaaa

SEQ ID NO: 4797305 - DNA, 18 bp, Homo sapiens
tgttttttctttataatg

SEQ ID NO: 4797306 - DNA, 15 bp, Homo sapiens
tgtttttttctaata

SEQ ID NO: 4797307 - DNA, 16 bp, Homo sapiens
ttaaaaaaaaaaatga

SEQ ID NO: 4797308 - DNA, 20 bp, Homo sapiens
ttaaaaaaaatattctgtca

SEQ ID NO: 4797309 - DNA, 21 bp, Homo sapiens
ttaaaaaaaatattctgtcat

SEQ ID NO: 4797310 - DNA, 20 bp, Homo sapiens
ttaaaaaaataatataaatg

SEQ ID NO: 4797311 - DNA, 15 bp, Homo sapiens
ttaaaaaagatggat

SEQ ID NO: 4797312 - DNA, 13 bp, Homo sapiens
ttaaaaaatacag

SEQ ID NO: 4797313 - DNA, 18 bp, Homo sapiens
ttaaaaattaattcttta

SEQ ID NO: 4797314 - DNA, 20 bp, Homo sapiens
ttaaaaattatctttaaaac

SEQ ID NO: 4797315 - DNA, 13 bp, Homo sapiens
ttaaaacaaaatc

SEQ ID NO: 4797316 - DNA, 20 bp, Homo sapiens
ttaaaacaagagaccacttc

SEQ ID NO: 4797317 - DNA, 23 bp, Homo sapiens
ttaaaacaagagaccacttcctt

SEQ ID NO: 4797318 - DNA, 12 bp, Homo sapiens
ttaaaacaagct

SEQ ID NO: 4797319 - DNA, 22 bp, Homo sapiens
ttaaaactagttagattcactt

SEQ ID NO: 4797320 - DNA, 19 bp, Homo sapiens
ttaaaagcatatataaaac

SEQ ID NO: 4797321 - DNA, 19 bp, Homo sapiens
ttaaaagctatcttcatgt

SEQ ID NO: 4797322 - DNA, 20 bp, Homo sapiens
ttaaaatagttacaagcatt

SEQ ID NO: 4797323 - DNA, 22 bp, Homo sapiens
ttaaaatatagatgtgttttat

SEQ ID NO: 4797324 - DNA, 23 bp, Homo sapiens
ttaaaatcatatttacctgtgaa

SEQ ID NO: 4797325 - DNA, 23 bp, Homo sapiens
ttaaaatgattcacttttattgt

SEQ ID NO: 4797326 - DNA, 20 bp, Homo sapiens
ttaaaatggcatttagcaca

SEQ ID NO: 4797327 - DNA, 15 bp, Homo sapiens
ttaaaattggttaat

SEQ ID NO: 4797328 - DNA, 14 bp, Homo sapiens
ttaaacaaaattta

SEQ ID NO: 4797329 - DNA, 16 bp, Homo sapiens
ttaaacaatttatttt

SEQ ID NO: 4797330 - DNA, 11 bp, Homo sapiens
ttaaacatttt

SEQ ID NO: 4797331 - DNA, 18 bp, Homo sapiens
ttaaacctgtgctttcat

SEQ ID NO: 4797332 - DNA, 13 bp, Homo sapiens
ttaaacttctact

SEQ ID NO: 4797333 - DNA, 18 bp, Homo sapiens
ttaaacttctactgagca

SEQ ID NO: 4797334 - DNA, 21 bp, Homo sapiens
ttaaactttgtcacttctgct

SEQ ID NO: 4797335 - DNA, 21 bp, Homo sapiens
ttaaagaggcgtcttgtattt

SEQ ID NO: 4797336 - DNA, 22 bp, Homo sapiens
ttaaagaggcgtcttgtatttt

SEQ ID NO: 4797337 - DNA, 20 bp, Homo sapiens
ttaaagatgcaggttttcta

SEQ ID NO: 4797338 - DNA, 17 bp, Homo sapiens
ttaaagcaatcttggca

SEQ ID NO: 4797339 - DNA, 17 bp, Homo sapiens
ttaaaggaaagttctat

SEQ ID NO: 4797340 - DNA, 21 bp, Homo sapiens
ttaaaggtctcccacaagact

SEQ ID NO: 4797341 - DNA, 17 bp, Homo sapiens
ttaaagtctacactgcc

SEQ ID NO: 4797342 - DNA, 21 bp, Homo sapiens
ttaaagtctacactgcctttg

SEQ ID NO: 4797343 - DNA, 12 bp, Homo sapiens
ttaaataaaata

SEQ ID NO: 4797344 - DNA, 15 bp, Homo sapiens
ttaaataaaataacc

SEQ ID NO: 4797345 - DNA, 15 bp, Homo sapiens
ttaaatagcatctgc

SEQ ID NO: 4797346 - DNA, 23 bp, Homo sapiens
ttaaatagcatctgctcttctct

SEQ ID NO: 4797347 - DNA, 16 bp, Homo sapiens
ttaaatatatgtatgt

SEQ ID NO: 4797348 - DNA, 19 bp, Homo sapiens
ttaaatatatgtatgtaaa

SEQ ID NO: 4797349 - DNA, 16 bp, Homo sapiens
ttaaatctacaaactt

SEQ ID NO: 4797350 - DNA, 19 bp, Homo sapiens
ttaaatctacaaactttta

SEQ ID NO: 4797351 - DNA, 15 bp, Homo sapiens
ttaaatctttgttaa

SEQ ID NO: 4797352 - DNA, 12 bp, Homo sapiens
ttaaatgaaata

SEQ ID NO: 4797353 - DNA, 13 bp, Homo sapiens
ttaaattgtggat

SEQ ID NO: 4797354 - DNA, 15 bp, Homo sapiens
ttaacaatgcctatt

SEQ ID NO: 4797355 - DNA, 20 bp, Homo sapiens
ttaacaatgcctattgtaat

SEQ ID NO: 4797356 - DNA, 14 bp, Homo sapiens
ttaacagtaaatat

SEQ ID NO: 4797357 - DNA, 16 bp, Homo sapiens
ttaacagtaaatatac

SEQ ID NO: 4797358 - DNA, 19 bp, Homo sapiens
ttaacagtaaatatacact

SEQ ID NO: 4797359 - DNA, 18 bp, Homo sapiens
ttaacatagcagctggtt

SEQ ID NO: 4797360 - DNA, 19 bp, Homo sapiens
ttaacatatcattcagaat

SEQ ID NO: 4797361 - DNA, 22 bp, Homo sapiens
ttaacccagtgttcagcataga

SEQ ID NO: 4797362 - DNA, 21 bp, Homo sapiens
ttaacccccatttttgtaata

SEQ ID NO: 4797363 - DNA, 22 bp, Homo sapiens
ttaaccgggactacagaagtgg

SEQ ID NO: 4797364 - DNA, 15 bp, Homo sapiens
ttaactaatgtaaat

SEQ ID NO: 4797365 - DNA, 13 bp, Homo sapiens
ttaactggccctc

SEQ ID NO: 4797366 - DNA, 17 bp, Homo sapiens
ttaagaaatgagaaatt

SEQ ID NO: 4797367 - DNA, 13 bp, Homo sapiens
ttaagaatcatgg

SEQ ID NO: 4797368 - DNA, 18 bp, Homo sapiens
ttaagagattttatgttt

SEQ ID NO: 4797369 - DNA, 17 bp, Homo sapiens
ttaagatgtgtcttcaa

SEQ ID NO: 4797370 - DNA, 21 bp, Homo sapiens
ttaagatgtgtcttcaatttg

SEQ ID NO: 4797371 - DNA, 22 bp, Homo sapiens
ttaagcacaaccatgttcttga

SEQ ID NO: 4797372 - DNA, 19 bp, Homo sapiens
ttaagcagtacatcttgtg

SEQ ID NO: 4797373 - DNA, 15 bp, Homo sapiens
ttaaggaaaagagaa

SEQ ID NO: 4797374 - DNA, 21 bp, Homo sapiens
ttaaggacagtgttcaaattc

SEQ ID NO: 4797375 - DNA, 17 bp, Homo sapiens
ttaaggactacagaatt

SEQ ID NO: 4797376 - DNA, 9 bp, Homo sapiens
ttaaggtgg

SEQ ID NO: 4797377 - DNA, 16 bp, Homo sapiens
ttaagtaccagaagcc

SEQ ID NO: 4797378 - DNA, 22 bp, Homo sapiens
ttaagtattccttggcccagca

SEQ ID NO: 4797379 - DNA, 17 bp, Homo sapiens
ttaagtctcaattctga

SEQ ID NO: 4797380 - DNA, 19 bp, Homo sapiens
ttaagtggactgtatttcg

SEQ ID NO: 4797381 - DNA, 15 bp, Homo sapiens
ttaagtgttctgtgg

SEQ ID NO: 4797382 - DNA, 22 bp, Homo sapiens
ttaagtgttgtacaattactgt

SEQ ID NO: 4797383 - DNA, 18 bp, Homo sapiens
ttaataaagattccatgg

SEQ ID NO: 4797384 - DNA, 18 bp, Homo sapiens
ttaataactatggtaaat

SEQ ID NO: 4797385 - DNA, 17 bp, Homo sapiens
ttaataggaggacagaa

SEQ ID NO: 4797386 - DNA, 17 bp, Homo sapiens
ttaataggcttgtgtaa

SEQ ID NO: 4797387 - DNA, 14 bp, Homo sapiens
ttaatagtttctaa

SEQ ID NO: 4797388 - DNA, 15 bp, Homo sapiens
ttaatatactcctta

SEQ ID NO: 4797389 - DNA, 12 bp, Homo sapiens
ttaatatttctt

SEQ ID NO: 4797390 - DNA, 17 bp, Homo sapiens
ttaatccacacatcagt

SEQ ID NO: 4797391 - DNA, 11 bp, Homo sapiens
ttaatccagag

SEQ ID NO: 4797392 - DNA, 16 bp, Homo sapiens
ttaatctagagctatg

SEQ ID NO: 4797393 - DNA, 13 bp, Homo sapiens
ttaatctcttgtc

SEQ ID NO: 4797394 - DNA, 13 bp, Homo sapiens
ttaatcttcatgg

SEQ ID NO: 4797395 - DNA, 23 bp, Homo sapiens
ttaatgaatgcccaggaagtaat

SEQ ID NO: 4797396 - DNA, 19 bp, Homo sapiens
ttaatgattcttgtgtcat

SEQ ID NO: 4797397 - DNA, 14 bp, Homo sapiens
ttaatgtctttgtg

SEQ ID NO: 4797398 - DNA, 15 bp, Homo sapiens
ttaatgtctttgtgt

SEQ ID NO: 4797399 - DNA, 13 bp, Homo sapiens
ttaattgaaaaga

SEQ ID NO: 4797400 - DNA, 14 bp, Homo sapiens
ttaatttattaaat

SEQ ID NO: 4797401 - DNA, 20 bp, Homo sapiens
ttaatttattaaatttatta

SEQ ID NO: 4797402 - DNA, 13 bp, Homo sapiens
ttaatttatttca

SEQ ID NO: 4797403 - DNA, 14 bp, Homo sapiens
ttaatttatttcat

SEQ ID NO: 4797404 - DNA, 15 bp, Homo sapiens
ttaatttcctgtgag

SEQ ID NO: 4797405 - DNA, 20 bp, Homo sapiens
ttaatttctgccatttcatg

SEQ ID NO: 4797406 - DNA, 11 bp, Homo sapiens
ttaatttgtgt

SEQ ID NO: 4797407 - DNA, 20 bp, Homo sapiens
ttaattttgacactgaaata

SEQ ID NO: 4797408 - DNA, 19 bp, Homo sapiens
ttacaaatttttactcagg

SEQ ID NO: 4797409 - DNA, 15 bp, Homo sapiens
ttacaacattcaact

SEQ ID NO: 4797410 - DNA, 14 bp, Homo sapiens
ttacaatgtattaa

SEQ ID NO: 4797411 - DNA, 19 bp, Homo sapiens
ttacacacctgagaatgtg

SEQ ID NO: 4797412 - DNA, 22 bp, Homo sapiens
ttacacacctgagaatgtgcct

SEQ ID NO: 4797413 - DNA, 23 bp, Homo sapiens
ttacacacgtgcaatttgtttgt

SEQ ID NO: 4797414 - DNA, 23 bp, Homo sapiens
ttacacttctcaaatgctactca

SEQ ID NO: 4797415 - DNA, 23 bp, Homo sapiens
ttacagctctcctccagccctgg

SEQ ID NO: 4797416 - DNA, 11 bp, Homo sapiens
ttacagctgaa

SEQ ID NO: 4797417 - DNA, 15 bp, Homo sapiens
ttacagtggcagtat

SEQ ID NO: 4797418 - DNA, 17 bp, Homo sapiens
ttacagtggcagtattg

SEQ ID NO: 4797419 - DNA, 15 bp, Homo sapiens
ttacataacaggcat

SEQ ID NO: 4797420 - DNA, 13 bp, Homo sapiens
ttacatagtctga

SEQ ID NO: 4797421 - DNA, 18 bp, Homo sapiens
ttacatagtctgaagtga

SEQ ID NO: 4797422 - DNA, 14 bp, Homo sapiens
ttacatcctctgct

SEQ ID NO: 4797423 - DNA, 21 bp, Homo sapiens
ttacatcctctgcttgtcatt

SEQ ID NO: 4797424 - DNA, 20 bp, Homo sapiens
ttaccagaagtttaaatctt

SEQ ID NO: 4797425 - DNA, 12 bp, Homo sapiens
ttaccctccctg

SEQ ID NO: 4797426 - DNA, 17 bp, Homo sapiens
ttaccctccctgtcccc

SEQ ID NO: 4797427 - DNA, 15 bp, Homo sapiens
ttacccttcaatgtt

SEQ ID NO: 4797428 - DNA, 18 bp, Homo sapiens
ttacccttcaatgttaaa

SEQ ID NO: 4797429 - DNA, 14 bp, Homo sapiens
ttaccctttctttt

SEQ ID NO: 4797430 - DNA, 15 bp, Homo sapiens
ttacctctctgtcat

SEQ ID NO: 4797431 - DNA, 12 bp, Homo sapiens
ttacctgacaca

SEQ ID NO: 4797432 - DNA, 14 bp, Homo sapiens
ttacgctctctgtc

SEQ ID NO: 4797433 - DNA, 17 bp, Homo sapiens
ttactaacagtaactgc

SEQ ID NO: 4797434 - DNA, 22 bp, Homo sapiens
ttactaacagtaactgccattt

SEQ ID NO: 4797435 - DNA, 14 bp, Homo sapiens
ttactaataggtct

SEQ ID NO: 4797436 - DNA, 13 bp, Homo sapiens
ttactatgcctgt

SEQ ID NO: 4797437 - DNA, 16 bp, Homo sapiens
ttactattaactctgc

SEQ ID NO: 4797438 - DNA, 18 bp, Homo sapiens
ttactcaggctttctatt

SEQ ID NO: 4797439 - DNA, 16 bp, Homo sapiens
ttactgcaatgtctgt

SEQ ID NO: 4797440 - DNA, 14 bp, Homo sapiens
ttactgtctgtaag

SEQ ID NO: 4797441 - DNA, 18 bp, Homo sapiens
ttagaaaaaactggaaac

SEQ ID NO: 4797442 - DNA, 13 bp, Homo sapiens
ttagaaagaatta

SEQ ID NO: 4797443 - DNA, 14 bp, Homo sapiens
ttagaaagaattag

SEQ ID NO: 4797444 - DNA, 15 bp, Homo sapiens
ttagaaattctataa

SEQ ID NO: 4797445 - DNA, 14 bp, Homo sapiens
ttagaatattaaaa

SEQ ID NO: 4797446 - DNA, 11 bp, Homo sapiens
ttagaatgtga

SEQ ID NO: 4797447 - DNA, 15 bp, Homo sapiens
ttagaatgtgaaaaa

SEQ ID NO: 4797448 - DNA, 16 bp, Homo sapiens
ttagaatgtgaaaaaa

SEQ ID NO: 4797449 - DNA, 13 bp, Homo sapiens
ttagacaatgtgg

SEQ ID NO: 4797450 - DNA, 21 bp, Homo sapiens
ttagacaatgtggaattacat

SEQ ID NO: 4797451 - DNA, 13 bp, Homo sapiens
ttagacacacata

SEQ ID NO: 4797452 - DNA, 16 bp, Homo sapiens
ttagacacacatatac

SEQ ID NO: 4797453 - DNA, 20 bp, Homo sapiens
ttagacacacatatacatta

SEQ ID NO: 4797454 - DNA, 13 bp, Homo sapiens
ttagagaagccat

SEQ ID NO: 4797455 - DNA, 12 bp, Homo sapiens
ttagagaataag

SEQ ID NO: 4797456 - DNA, 22 bp, Homo sapiens
ttagaggataaataataaaggt

SEQ ID NO: 4797457 - DNA, 23 bp, Homo sapiens
ttagaggataaataataaaggtt

SEQ ID NO: 4797458 - DNA, 20 bp, Homo sapiens
ttagagtgcccttaaaataa

SEQ ID NO: 4797459 - DNA, 22 bp, Homo sapiens
ttagagtgcccttaaaataatg

SEQ ID NO: 4797460 - DNA, 20 bp, Homo sapiens
ttagatccattaatttaaat

SEQ ID NO: 4797461 - DNA, 15 bp, Homo sapiens
ttagattcactttga

SEQ ID NO: 4797462 - DNA, 18 bp, Homo sapiens
ttagattcctacttaaac

SEQ ID NO: 4797463 - DNA, 21 bp, Homo sapiens
ttagatttctcacactctaac

SEQ ID NO: 4797464 - DNA, 12 bp, Homo sapiens
ttagcacagagg

SEQ ID NO: 4797465 - DNA, 14 bp, Homo sapiens
ttagcacagtattt

SEQ ID NO: 4797466 - DNA, 17 bp, Homo sapiens
ttagcacagtatttaac

SEQ ID NO: 4797467 - DNA, 22 bp, Homo sapiens
ttagcaggaaatagtgttcttt

SEQ ID NO: 4797468 - DNA, 18 bp, Homo sapiens
ttagcagtccatttttga

SEQ ID NO: 4797469 - DNA, 16 bp, Homo sapiens
ttagccaaccaggcta

SEQ ID NO: 4797470 - DNA, 23 bp, Homo sapiens
ttagcccggccaaggacactgat

SEQ ID NO: 4797471 - DNA, 14 bp, Homo sapiens
ttagccgggcccca

SEQ ID NO: 4797472 - DNA, 23 bp, Homo sapiens
ttagctcacaagccgtgttttat

SEQ ID NO: 4797473 - DNA, 14 bp, Homo sapiens
ttaggaacagagta

SEQ ID NO: 4797474 - DNA, 21 bp, Homo sapiens
ttaggaacagagtatatatgt

SEQ ID NO: 4797475 - DNA, 18 bp, Homo sapiens
ttaggaatgctcaatgtg

SEQ ID NO: 4797476 - DNA, 19 bp, Homo sapiens
ttaggaatgctcaatgtgc

SEQ ID NO: 4797477 - DNA, 22 bp, Homo sapiens
ttaggcccgccaaacttctgaa

SEQ ID NO: 4797478 - DNA, 14 bp, Homo sapiens
ttaggggaaaatag

SEQ ID NO: 4797479 - DNA, 21 bp, Homo sapiens
ttaggtaatggatatgaaaga

SEQ ID NO: 4797480 - DNA, 21 bp, Homo sapiens
ttagtaaaattatctgttcta

SEQ ID NO: 4797481 - DNA, 14 bp, Homo sapiens
ttagtaaattccta

SEQ ID NO: 4797482 - DNA, 12 bp, Homo sapiens
ttagtaatagat

SEQ ID NO: 4797483 - DNA, 14 bp, Homo sapiens
ttagtaatctgtat

SEQ ID NO: 4797484 - DNA, 13 bp, Homo sapiens
ttagtagctgata

SEQ ID NO: 4797485 - DNA, 15 bp, Homo sapiens
ttagtgttttcattc

SEQ ID NO: 4797486 - DNA, 17 bp, Homo sapiens
ttagttaggtgtgccaa

SEQ ID NO: 4797487 - DNA, 14 bp, Homo sapiens
ttataaatgaagat

SEQ ID NO: 4797488 - DNA, 16 bp, Homo sapiens
ttataaatgaagatgc

SEQ ID NO: 4797489 - DNA, 19 bp, Homo sapiens
ttataaatggaggtacagg

SEQ ID NO: 4797490 - DNA, 18 bp, Homo sapiens
ttataaattaaatatatg

SEQ ID NO: 4797491 - DNA, 21 bp, Homo sapiens
ttataaggctgactcttacta

SEQ ID NO: 4797492 - DNA, 14 bp, Homo sapiens
ttataagttgacct

SEQ ID NO: 4797493 - DNA, 14 bp, Homo sapiens
ttataataaactgt

SEQ ID NO: 4797494 - DNA, 23 bp, Homo sapiens
ttataatcagaatggaagagaga

SEQ ID NO: 4797495 - DNA, 17 bp, Homo sapiens
ttataatgcatctaaac

SEQ ID NO: 4797496 - DNA, 19 bp, Homo sapiens
ttataatggccctgtagct

SEQ ID NO: 4797497 - DNA, 16 bp, Homo sapiens
ttatacaaccttcatt

SEQ ID NO: 4797498 - DNA, 15 bp, Homo sapiens
ttataccagcaaaag

SEQ ID NO: 4797499 - DNA, 20 bp, Homo sapiens
ttataggaaataaatctaaa

SEQ ID NO: 4797500 - DNA, 15 bp, Homo sapiens
ttatatacaaagctg

SEQ ID NO: 4797501 - DNA, 13 bp, Homo sapiens
ttatatataaata

SEQ ID NO: 4797502 - DNA, 13 bp, Homo sapiens
ttatatatgtata

SEQ ID NO: 4797503 - DNA, 15 bp, Homo sapiens
ttatatattataagt

SEQ ID NO: 4797504 - DNA, 20 bp, Homo sapiens
ttatatgacttcttgttcat

SEQ ID NO: 4797505 - DNA, 15 bp, Homo sapiens
ttatatgatatgcat

SEQ ID NO: 4797506 - DNA, 16 bp, Homo sapiens
ttatatgatatgcatg

SEQ ID NO: 4797507 - DNA, 18 bp, Homo sapiens
ttatatgatatgcatgta

SEQ ID NO: 4797508 - DNA, 21 bp, Homo sapiens
ttatatgattaaattatcatt

SEQ ID NO: 4797509 - DNA, 23 bp, Homo sapiens
ttatattcagagatgtaccatgt

SEQ ID NO: 4797510 - DNA, 20 bp, Homo sapiens
ttatattcccaaatctcaaa

SEQ ID NO: 4797511 - DNA, 12 bp, Homo sapiens
ttatcaaaaaac

SEQ ID NO: 4797512 - DNA, 20 bp, Homo sapiens
ttatcagaactcctttctaa

SEQ ID NO: 4797513 - DNA, 15 bp, Homo sapiens
ttatcagagtcatga

SEQ ID NO: 4797514 - DNA, 18 bp, Homo sapiens
ttatcagtgaatataaat

SEQ ID NO: 4797515 - DNA, 19 bp, Homo sapiens
ttatcagtgaatataaatg

SEQ ID NO: 4797516 - DNA, 19 bp, Homo sapiens
ttatcagtttgctaatgtt

SEQ ID NO: 4797517 - DNA, 11 bp, Homo sapiens
ttatcatgtgt

SEQ ID NO: 4797518 - DNA, 12 bp, Homo sapiens
ttatcattgttt

SEQ ID NO: 4797519 - DNA, 20 bp, Homo sapiens
ttatctccagccaatttcaa

SEQ ID NO: 4797520 - DNA, 21 bp, Homo sapiens
ttatctccagccaatttcaaa

SEQ ID NO: 4797521 - DNA, 23 bp, Homo sapiens
ttatctccagccaatttcaaaga

SEQ ID NO: 4797522 - DNA, 13 bp, Homo sapiens
ttatctcttcttc

SEQ ID NO: 4797523 - DNA, 16 bp, Homo sapiens
ttatctgggttttaga

SEQ ID NO: 4797524 - DNA, 11 bp, Homo sapiens
ttatctgtgtt

SEQ ID NO: 4797525 - DNA, 15 bp, Homo sapiens
ttatctgtgttgtct

SEQ ID NO: 4797526 - DNA, 11 bp, Homo sapiens
ttatctgttct

SEQ ID NO: 4797527 - DNA, 12 bp, Homo sapiens
ttatctgttcta

SEQ ID NO: 4797528 - DNA, 15 bp, Homo sapiens
ttatctgttctatgg

SEQ ID NO: 4797529 - DNA, 16 bp, Homo sapiens
ttatgactaatcctta

SEQ ID NO: 4797530 - DNA, 11 bp, Homo sapiens
ttatgactcca

SEQ ID NO: 4797531 - DNA, 11 bp, Homo sapiens
ttatgatgtta

SEQ ID NO: 4797532 - DNA, 19 bp, Homo sapiens
ttatggtagaaaaatttca

SEQ ID NO: 4797533 - DNA, 13 bp, Homo sapiens
ttatggtattttc

SEQ ID NO: 4797534 - DNA, 20 bp, Homo sapiens
ttatgtaagtttctaagaat

SEQ ID NO: 4797535 - DNA, 12 bp, Homo sapiens
ttatgtcatttt

SEQ ID NO: 4797536 - DNA, 20 bp, Homo sapiens
ttatgtcctgtgagatgtgt

SEQ ID NO: 4797537 - DNA, 14 bp, Homo sapiens
ttatgttgtaatat

SEQ ID NO: 4797538 - DNA, 18 bp, Homo sapiens
ttatgttgtaatattttg

SEQ ID NO: 4797539 - DNA, 21 bp, Homo sapiens
ttatgttgttcaaatgcattt

SEQ ID NO: 4797540 - DNA, 14 bp, Homo sapiens
ttattaaacttcag

SEQ ID NO: 4797541 - DNA, 24 bp, Homo sapiens
ttattaaatgtagcttcagtcatt

SEQ ID NO: 4797542 - DNA, 15 bp, Homo sapiens
ttattaaatttatta

SEQ ID NO: 4797543 - DNA, 20 bp, Homo sapiens
ttattaaatttattaaatgt

SEQ ID NO: 4797544 - DNA, 14 bp, Homo sapiens
ttattaatgaatgc

SEQ ID NO: 4797545 - DNA, 22 bp, Homo sapiens
ttattacaacaagcaaactgaa

SEQ ID NO: 4797546 - DNA, 18 bp, Homo sapiens
ttattagcaccagcttgc

SEQ ID NO: 4797547 - DNA, 23 bp, Homo sapiens
ttattagccctgcattttcatag

SEQ ID NO: 4797548 - DNA, 19 bp, Homo sapiens
ttattaggttaagtctcaa

SEQ ID NO: 4797549 - DNA, 18 bp, Homo sapiens
ttattatagtctgtactt

SEQ ID NO: 4797550 - DNA, 13 bp, Homo sapiens
ttattattactgt

SEQ ID NO: 4797551 - DNA, 15 bp, Homo sapiens
ttattcaaagagaaa

SEQ ID NO: 4797552 - DNA, 23 bp, Homo sapiens
ttattcaaagagaaaacatctca

SEQ ID NO: 4797553 - DNA, 16 bp, Homo sapiens
ttattcattagctgtg

SEQ ID NO: 4797554 - DNA, 16 bp, Homo sapiens
tgtgagggcaaaccag

SEQ ID NO: 4797555 - DNA, 15 bp, Homo sapiens
tgtgagtctgtcctt

SEQ ID NO: 4797556 - DNA, 16 bp, Homo sapiens
tgtgagtgtatgtata

SEQ ID NO: 4797557 - DNA, 18 bp, Homo sapiens
tgtgagtgtatgtataca

SEQ ID NO: 4797558 - DNA, 21 bp, Homo sapiens
tgtgagtgtatgtatacacac

SEQ ID NO: 4797559 - DNA, 23 bp, Homo sapiens
tgtgagtgtatgtatacacacac

SEQ ID NO: 4797560 - DNA, 15 bp, Homo sapiens
tgtgatatgtgtaat

SEQ ID NO: 4797561 - DNA, 16 bp, Homo sapiens
tgtgatctgtccttcc

SEQ ID NO: 4797562 - DNA, 12 bp, Homo sapiens
tgtgatgcagga

SEQ ID NO: 4797563 - DNA, 16 bp, Homo sapiens
tgtgatgcatgagctc

SEQ ID NO: 4797564 - DNA, 16 bp, Homo sapiens
tgtgatttatgcattt

SEQ ID NO: 4797565 - DNA, 18 bp, Homo sapiens
tgtgcacctgactttgga

SEQ ID NO: 4797566 - DNA, 16 bp, Homo sapiens
tgtgcagttgctgttt

SEQ ID NO: 4797567 - DNA, 14 bp, Homo sapiens
tgtgcagtttggta

SEQ ID NO: 4797568 - DNA, 17 bp, Homo sapiens
tgtgcatctggcctatg

SEQ ID NO: 4797569 - DNA, 18 bp, Homo sapiens
tgtgcatctggcctatga

SEQ ID NO: 4797570 - DNA, 15 bp, Homo sapiens
tgtgcatctggcctg

SEQ ID NO: 4797571 - DNA, 22 bp, Homo sapiens
tgtgcatgcaaaaatgaattca

SEQ ID NO: 4797572 - DNA, 16 bp, Homo sapiens
tgtgcattgtggctgt

SEQ ID NO: 4797573 - DNA, 12 bp, Homo sapiens
tgtgccaaacta

SEQ ID NO: 4797574 - DNA, 21 bp, Homo sapiens
tgtgcccacccgtgttctcct

SEQ ID NO: 4797575 - DNA, 15 bp, Homo sapiens
tgtgccccttcccca

SEQ ID NO: 4797576 - DNA, 21 bp, Homo sapiens
tgtgcctctcagtatcttaaa

SEQ ID NO: 4797577 - DNA, 18 bp, Homo sapiens
tgtgcctctctctcccaa

SEQ ID NO: 4797578 - DNA, 15 bp, Homo sapiens
tgtgcctgctatcca

SEQ ID NO: 4797579 - DNA, 19 bp, Homo sapiens
tgtgcctgctatccagccg

SEQ ID NO: 4797580 - DNA, 21 bp, Homo sapiens
tgtgcctgctatccagccgca

SEQ ID NO: 4797581 - DNA, 13 bp, Homo sapiens
tgtgcctgtgttt

SEQ ID NO: 4797582 - DNA, 13 bp, Homo sapiens
tgtgcctttcact

SEQ ID NO: 4797583 - DNA, 17 bp, Homo sapiens
tgtgcgccggcgccccg

SEQ ID NO: 4797584 - DNA, 20 bp, Homo sapiens
tgtgcgtatgcagtgtagat

SEQ ID NO: 4797585 - DNA, 15 bp, Homo sapiens
tgtgcgttttagagt

SEQ ID NO: 4797586 - DNA, 17 bp, Homo sapiens
tgtgctattaatatttg

SEQ ID NO: 4797587 - DNA, 18 bp, Homo sapiens
tgtgctattaatatttgt

SEQ ID NO: 4797588 - DNA, 18 bp, Homo sapiens
tgtgcttcacacaaagtg

SEQ ID NO: 4797589 - DNA, 14 bp, Homo sapiens
tgtgcttgtgtgta

SEQ ID NO: 4797590 - DNA, 12 bp, Homo sapiens
tgtgcttgttct

SEQ ID NO: 4797591 - DNA, 14 bp, Homo sapiens
tgtgcttgttcttc

SEQ ID NO: 4797592 - DNA, 16 bp, Homo sapiens
tgtgcttgttcttcct

SEQ ID NO: 4797593 - DNA, 19 bp, Homo sapiens
tgtgcttgttcttcctctt

SEQ ID NO: 4797594 - DNA, 13 bp, Homo sapiens
tgtgctttcatgt

SEQ ID NO: 4797595 - DNA, 13 bp, Homo sapiens
tgtgctttctgca

SEQ ID NO: 4797596 - DNA, 14 bp, Homo sapiens
tgtgctttctgcat

SEQ ID NO: 4797597 - DNA, 22 bp, Homo sapiens
tgtggaaggcacactgagcaag

SEQ ID NO: 4797598 - DNA, 20 bp, Homo sapiens
tgtggacaatgagtggaata

SEQ ID NO: 4797599 - DNA, 18 bp, Homo sapiens
tgtggacttttccccatt

SEQ ID NO: 4797600 - DNA, 12 bp, Homo sapiens
tgtggagtggag

SEQ ID NO: 4797601 - DNA, 14 bp, Homo sapiens
tgtggagtggaggg

SEQ ID NO: 4797602 - DNA, 21 bp, Homo sapiens
tgtggagttcatcttgaattg

SEQ ID NO: 4797603 - DNA, 19 bp, Homo sapiens
tgtggataagaaaaatgct

SEQ ID NO: 4797604 - DNA, 16 bp, Homo sapiens
tgtggatgaaaaaaag

SEQ ID NO: 4797605 - DNA, 14 bp, Homo sapiens
tgtggcaaacattt

SEQ ID NO: 4797606 - DNA, 17 bp, Homo sapiens
tgtggcacgtaaggtct

SEQ ID NO: 4797607 - DNA, 19 bp, Homo sapiens
tgtggcccctccttctccc

SEQ ID NO: 4797608 - DNA, 22 bp, Homo sapiens
tgtggcccctccttctcccctc

SEQ ID NO: 4797609 - DNA, 15 bp, Homo sapiens
tgtggccctgtggga

SEQ ID NO: 4797610 - DNA, 16 bp, Homo sapiens
tgtggccctgtgggag

SEQ ID NO: 4797611 - DNA, 18 bp, Homo sapiens
tgtggcctcagccctcag

SEQ ID NO: 4797612 - DNA, 20 bp, Homo sapiens
tgtggcctgggtcctcggcc

SEQ ID NO: 4797613 - DNA, 17 bp, Homo sapiens
tgtggctaaaaaagctg

SEQ ID NO: 4797614 - DNA, 23 bp, Homo sapiens
tgtggctgtcaaatccatgtgtc

SEQ ID NO: 4797615 - DNA, 15 bp, Homo sapiens
tgtggcttaaacatt

SEQ ID NO: 4797616 - DNA, 17 bp, Homo sapiens
tgtggcttaaacatttt

SEQ ID NO: 4797617 - DNA, 12 bp, Homo sapiens
tgtggcttggaa

SEQ ID NO: 4797618 - DNA, 15 bp, Homo sapiens
tgtgggaagaaacaa

SEQ ID NO: 4797619 - DNA, 19 bp, Homo sapiens
tgtgggaagaaacaaaccc

SEQ ID NO: 4797620 - DNA, 15 bp, Homo sapiens
tgtgggactggccca

SEQ ID NO: 4797621 - DNA, 18 bp, Homo sapiens
tgtgggactggcccaccc

SEQ ID NO: 4797622 - DNA, 14 bp, Homo sapiens
tgtgggagtccact

SEQ ID NO: 4797623 - DNA, 20 bp, Homo sapiens
tgtgggagtccactttcctc

SEQ ID NO: 4797624 - DNA, 13 bp, Homo sapiens
tgtgggcagcacc

SEQ ID NO: 4797625 - DNA, 15 bp, Homo sapiens
tgtgggcagcaccct

SEQ ID NO: 4797626 - DNA, 13 bp, Homo sapiens
tgtgggctcacac

SEQ ID NO: 4797627 - DNA, 14 bp, Homo sapiens
tgtgggggtggcca

SEQ ID NO: 4797628 - DNA, 17 bp, Homo sapiens
tgtgggggtggccatcc

SEQ ID NO: 4797629 - DNA, 20 bp, Homo sapiens
tgtggggtttttaatctctt

SEQ ID NO: 4797630 - DNA, 14 bp, Homo sapiens
tgtgggtgccctgt

SEQ ID NO: 4797631 - DNA, 20 bp, Homo sapiens
tgtgggtttactctgtgcta

SEQ ID NO: 4797632 - DNA, 14 bp, Homo sapiens
tgtggtctgtgtgt

SEQ ID NO: 4797633 - DNA, 16 bp, Homo sapiens
tgtggtctgtgtgtga

SEQ ID NO: 4797634 - DNA, 9 bp, Homo sapiens
tgtgtaaat

SEQ ID NO: 4797635 - DNA, 13 bp, Homo sapiens
tgtgtacaaaata

SEQ ID NO: 4797636 - DNA, 15 bp, Homo sapiens
tgtgtacacatatga

SEQ ID NO: 4797637 - DNA, 17 bp, Homo sapiens
tgtgtactgtaaagaat

SEQ ID NO: 4797638 - DNA, 13 bp, Homo sapiens
tgtgtacttcttc

SEQ ID NO: 4797639 - DNA, 15 bp, Homo sapiens
tgtgtagatagtatg

SEQ ID NO: 4797640 - DNA, 13 bp, Homo sapiens
tgtgtaggaaatc

SEQ ID NO: 4797641 - DNA, 16 bp, Homo sapiens
tgtgtaggaaatctga

SEQ ID NO: 4797642 - DNA, 22 bp, Homo sapiens
tgtgtaggaaatctgaagcctt

SEQ ID NO: 4797643 - DNA, 15 bp, Homo sapiens
tgtgtatcctgacag

SEQ ID NO: 4797644 - DNA, 17 bp, Homo sapiens
tgtgtatgtacttacat

SEQ ID NO: 4797645 - DNA, 12 bp, Homo sapiens
tgtgtatgtcta

SEQ ID NO: 4797646 - DNA, 17 bp, Homo sapiens
tgtgtcacagttcttgg

SEQ ID NO: 4797647 - DNA, 19 bp, Homo sapiens
tgtgtcacgtgaccctgtg

SEQ ID NO: 4797648 - DNA, 20 bp, Homo sapiens
tgtgtcacgtgaccctgtgc

SEQ ID NO: 4797649 - DNA, 21 bp, Homo sapiens
tgtgtcacgtgaccctgtgcc

SEQ ID NO: 4797650 - DNA, 23 bp, Homo sapiens
tgtgtcacgtgaccctgtgcccc

SEQ ID NO: 4797651 - DNA, 15 bp, Homo sapiens
tgtgtcatctgtcag

SEQ ID NO: 4797652 - DNA, 18 bp, Homo sapiens
tgtgtcatctgtcagctt

SEQ ID NO: 4797653 - DNA, 11 bp, Homo sapiens
tgtgtcccagt

SEQ ID NO: 4797654 - DNA, 21 bp, Homo sapiens
tgtgtcccagtgtctggccca

SEQ ID NO: 4797655 - DNA, 21 bp, Homo sapiens
tgtgtcccccctgtggtctgt

SEQ ID NO: 4797656 - DNA, 15 bp, Homo sapiens
tgtgtcccctcactc

SEQ ID NO: 4797657 - DNA, 17 bp, Homo sapiens
tgtgtcccctcactctg

SEQ ID NO: 4797658 - DNA, 23 bp, Homo sapiens
tgtgtctccagctgattttaact

SEQ ID NO: 4797659 - DNA, 19 bp, Homo sapiens
tgtgtctggtccacacacc

SEQ ID NO: 4797660 - DNA, 17 bp, Homo sapiens
tgtgtcttttgttctct

SEQ ID NO: 4797661 - DNA, 14 bp, Homo sapiens
tgtgtgaattcctt

SEQ ID NO: 4797662 - DNA, 20 bp, Homo sapiens
tgtgtgacaccaccactgtg

SEQ ID NO: 4797663 - DNA, 23 bp, Homo sapiens
tgtgtgacaccaccactgtgtcc

SEQ ID NO: 4797664 - DNA, 16 bp, Homo sapiens
tgtgtgagtgtatgta

SEQ ID NO: 4797665 - DNA, 18 bp, Homo sapiens
tgtgtgagtgtatgtata

SEQ ID NO: 4797666 - DNA, 13 bp, Homo sapiens
tgtgtgcaatgtt

SEQ ID NO: 4797667 - DNA, 22 bp, Homo sapiens
tgtgtgcagagtatacaagtgt

SEQ ID NO: 4797668 - DNA, 20 bp, Homo sapiens
tgtgtgcttcacacaaagtg

SEQ ID NO: 4797669 - DNA, 15 bp, Homo sapiens
tgtgtggcaaacatt

SEQ ID NO: 4797670 - DNA, 20 bp, Homo sapiens
tgtgtggcctaatccacctg

SEQ ID NO: 4797671 - DNA, 22 bp, Homo sapiens
tgtgtggcctaatccacctggt

SEQ ID NO: 4797672 - DNA, 15 bp, Homo sapiens
tgtgtgggcccaagg

SEQ ID NO: 4797673 - DNA, 18 bp, Homo sapiens
tgtgtgggtttactctgt

SEQ ID NO: 4797674 - DNA, 12 bp, Homo sapiens
tgtgtgtatgtg

SEQ ID NO: 4797675 - DNA, 22 bp, Homo sapiens
tgtgtgtccagcacctttgtaa

SEQ ID NO: 4797676 - DNA, 21 bp, Homo sapiens
tgtgtgtggaaggcacccgcc

SEQ ID NO: 4797677 - DNA, 19 bp, Homo sapiens
tgtgtgtttattgtcaaag

SEQ ID NO: 4797678 - DNA, 23 bp, Homo sapiens
tgtgtgtttattgtcaaagtggt

SEQ ID NO: 4797679 - DNA, 15 bp, Homo sapiens
tgtgtgtttctgtcc

SEQ ID NO: 4797680 - DNA, 17 bp, Homo sapiens
tgtgttacaataagtgt

SEQ ID NO: 4797681 - DNA, 20 bp, Homo sapiens
tgtgttctcaacacacagta

SEQ ID NO: 4797682 - DNA, 15 bp, Homo sapiens
tgtgttctgatgagg

SEQ ID NO: 4797683 - DNA, 22 bp, Homo sapiens
tgtgttgccattttgtctggct

SEQ ID NO: 4797684 - DNA, 24 bp, Homo sapiens
tgtgttgccattttgtctggctgt

SEQ ID NO: 4797685 - DNA, 20 bp, Homo sapiens
tgtgtttcatgttctgtgtc

SEQ ID NO: 4797686 - DNA, 21 bp, Homo sapiens
tgtgttttgtccaaaactgta

SEQ ID NO: 4797687 - DNA, 21 bp, Homo sapiens
tgttaaaaacatgtgaaagat

SEQ ID NO: 4797688 - DNA, 17 bp, Homo sapiens
tgttaaaatatagtgtt

SEQ ID NO: 4797689 - DNA, 14 bp, Homo sapiens
tgttaacaatgcct

SEQ ID NO: 4797690 - DNA, 18 bp, Homo sapiens
tgttaacttatgtctctt

SEQ ID NO: 4797691 - DNA, 17 bp, Homo sapiens
tgttaacttattcaaag

SEQ ID NO: 4797692 - DNA, 23 bp, Homo sapiens
tgttaacttattcaaagagaaaa

SEQ ID NO: 4797693 - DNA, 22 bp, Homo sapiens
tgttaataaagtgcactgccac

SEQ ID NO: 4797694 - DNA, 12 bp, Homo sapiens
tgttaatatcac

SEQ ID NO: 4797695 - DNA, 16 bp, Homo sapiens
tgttaatccagagaac

SEQ ID NO: 4797696 - DNA, 20 bp, Homo sapiens
tgttaatgattcttgtgtca

SEQ ID NO: 4797697 - DNA, 17 bp, Homo sapiens
tgttacaggtgtactat

SEQ ID NO: 4797698 - DNA, 21 bp, Homo sapiens
tgttacagtaatgtcataaag

SEQ ID NO: 4797699 - DNA, 22 bp, Homo sapiens
tgttactgatttggccgttttg

SEQ ID NO: 4797700 - DNA, 12 bp, Homo sapiens
tgttacttaaat

SEQ ID NO: 4797701 - DNA, 11 bp, Homo sapiens
tgttagaatta

SEQ ID NO: 4797702 - DNA, 24 bp, Homo sapiens
tgttagctcagaggagaggagcaa

SEQ ID NO: 4797703 - DNA, 21 bp, Homo sapiens
tgttatacaaccttcatttaa

SEQ ID NO: 4797704 - DNA, 22 bp, Homo sapiens
tgttatacaaccttcatttaaa

SEQ ID NO: 4797705 - DNA, 15 bp, Homo sapiens
tgttatatcagcaga

SEQ ID NO: 4797706 - DNA, 18 bp, Homo sapiens
tgttatattcattcttta

SEQ ID NO: 4797707 - DNA, 20 bp, Homo sapiens
tgttatcagtacaattcttt

SEQ ID NO: 4797708 - DNA, 22 bp, Homo sapiens
tgttatcagtacaattctttgt

SEQ ID NO: 4797709 - DNA, 16 bp, Homo sapiens
tgttatctgtctttat

SEQ ID NO: 4797710 - DNA, 13 bp, Homo sapiens
tgttatgttgtaa

SEQ ID NO: 4797711 - DNA, 14 bp, Homo sapiens
tgttattaaatgta

SEQ ID NO: 4797712 - DNA, 20 bp, Homo sapiens
tgttattattattatattgt

SEQ ID NO: 4797713 - DNA, 20 bp, Homo sapiens
tgttattcaataactattgc

SEQ ID NO: 4797714 - DNA, 19 bp, Homo sapiens
tgttcaaagaacccccctc

SEQ ID NO: 4797715 - DNA, 16 bp, Homo sapiens
tgttcaaattctgatt

SEQ ID NO: 4797716 - DNA, 18 bp, Homo sapiens
tgttcaacttaatgaaga

SEQ ID NO: 4797717 - DNA, 15 bp, Homo sapiens
tgttcaatctgtgaa

SEQ ID NO: 4797718 - DNA, 18 bp, Homo sapiens
tgttcacgtgactcctca

SEQ ID NO: 4797719 - DNA, 14 bp, Homo sapiens
tgttcagaaaagca

SEQ ID NO: 4797720 - DNA, 15 bp, Homo sapiens
tgttcagaaaagcac

SEQ ID NO: 4797721 - DNA, 12 bp, Homo sapiens
tgttcagcatag

SEQ ID NO: 4797722 - DNA, 18 bp, Homo sapiens
tgttcatgttttgctaat

SEQ ID NO: 4797723 - DNA, 11 bp, Homo sapiens
tgttcattcta

SEQ ID NO: 4797724 - DNA, 10 bp, Homo sapiens
tgttccaagt

SEQ ID NO: 4797725 - DNA, 14 bp, Homo sapiens
tgttccctgctggg

SEQ ID NO: 4797726 - DNA, 15 bp, Homo sapiens
tgttccgttcatctg

SEQ ID NO: 4797727 - DNA, 15 bp, Homo sapiens
tgttcctgactgttc

SEQ ID NO: 4797728 - DNA, 21 bp, Homo sapiens
tgttcgattacgtcatcaaaa

SEQ ID NO: 4797729 - DNA, 14 bp, Homo sapiens
tgttcgcttggctc

SEQ ID NO: 4797730 - DNA, 15 bp, Homo sapiens
tgttctaatggatta

SEQ ID NO: 4797731 - DNA, 19 bp, Homo sapiens
tgttctagttagcaggaaa

SEQ ID NO: 4797732 - DNA, 15 bp, Homo sapiens
tgttctcaacacaca

SEQ ID NO: 4797733 - DNA, 23 bp, Homo sapiens
tgttctcaatcattgtcagagat

SEQ ID NO: 4797734 - DNA, 20 bp, Homo sapiens
tgttctcctccaaatgctgt

SEQ ID NO: 4797735 - DNA, 17 bp, Homo sapiens
tgttctcttactgccga

SEQ ID NO: 4797736 - DNA, 18 bp, Homo sapiens
tgttctgatgaggcattt

SEQ ID NO: 4797737 - DNA, 12 bp, Homo sapiens
tgttctgcactg

SEQ ID NO: 4797738 - DNA, 15 bp, Homo sapiens
tgttctgcactgaaa

SEQ ID NO: 4797739 - DNA, 19 bp, Homo sapiens
tgttctgggttaacagtaa

SEQ ID NO: 4797740 - DNA, 13 bp, Homo sapiens
tgttctgtgcaac

SEQ ID NO: 4797741 - DNA, 23 bp, Homo sapiens
tgttctgtgtcacgtgaccctgt

SEQ ID NO: 4797742 - DNA, 15 bp, Homo sapiens
tgttcttcaatgtga

SEQ ID NO: 4797743 - DNA, 17 bp, Homo sapiens
tgttcttcaatgtgaaa

SEQ ID NO: 4797744 - DNA, 22 bp, Homo sapiens
tgttcttcaatgtgaaactgag

SEQ ID NO: 4797745 - DNA, 14 bp, Homo sapiens
tgttcttgagcagc

SEQ ID NO: 4797746 - DNA, 16 bp, Homo sapiens
tgttcttgagcagctg

SEQ ID NO: 4797747 - DNA, 21 bp, Homo sapiens
tgttcttgagcagctgaattg

SEQ ID NO: 4797748 - DNA, 18 bp, Homo sapiens
tgttctttcatactacat

SEQ ID NO: 4797749 - DNA, 16 bp, Homo sapiens
tgttctttttgactga

SEQ ID NO: 4797750 - DNA, 19 bp, Homo sapiens
tgttgaagtgcatgttaaa

SEQ ID NO: 4797751 - DNA, 14 bp, Homo sapiens
tgttgacctaccct

SEQ ID NO: 4797752 - DNA, 15 bp, Homo sapiens
tgttgacctaccctg

SEQ ID NO: 4797753 - DNA, 17 bp, Homo sapiens
tgttgaggaggggagca

SEQ ID NO: 4797754 - DNA, 21 bp, Homo sapiens
tgttgatctatgggaaatcta

SEQ ID NO: 4797755 - DNA, 14 bp, Homo sapiens
tgttgattaaaaca

SEQ ID NO: 4797756 - DNA, 20 bp, Homo sapiens
tgttgattaatttctgccat

SEQ ID NO: 4797757 - DNA, 19 bp, Homo sapiens
tgttgcagttaattcttgc

SEQ ID NO: 4797758 - DNA, 15 bp, Homo sapiens
tgttgctacatcaga

SEQ ID NO: 4797759 - DNA, 15 bp, Homo sapiens
tgttgctctccattc

SEQ ID NO: 4797760 - DNA, 14 bp, Homo sapiens
tgttgcttaatcta

SEQ ID NO: 4797761 - DNA, 21 bp, Homo sapiens
tgttgcttaatctagagctat

SEQ ID NO: 4797762 - DNA, 20 bp, Homo sapiens
tgttggccatcatttcattc

SEQ ID NO: 4797763 - DNA, 21 bp, Homo sapiens
tgttgtaatatcagttacagt

SEQ ID NO: 4797764 - DNA, 20 bp, Homo sapiens
tgttgtaatattttgctgct

SEQ ID NO: 4797765 - DNA, 16 bp, Homo sapiens
tgttgtacaattactg

SEQ ID NO: 4797766 - DNA, 19 bp, Homo sapiens
tgttgtacaattactgtga

SEQ ID NO: 4797767 - DNA, 16 bp, Homo sapiens
tgttgtcctgtgtcat

SEQ ID NO: 4797768 - DNA, 22 bp, Homo sapiens
tgttgtcctgtgtcatctgtca

SEQ ID NO: 4797769 - DNA, 18 bp, Homo sapiens
tgttgtgttacaataagt

SEQ ID NO: 4797770 - DNA, 20 bp, Homo sapiens
tgtttaagaatcatggattt

SEQ ID NO: 4797771 - DNA, 17 bp, Homo sapiens
tgtttaatacgcttgag

SEQ ID NO: 4797772 - DNA, 15 bp, Homo sapiens
tgtttaattgtaggt

SEQ ID NO: 4797773 - DNA, 16 bp, Homo sapiens
tgtttaccctccctgt

SEQ ID NO: 4797774 - DNA, 15 bp, Homo sapiens
tgtttacttgaatag

SEQ ID NO: 4797775 - DNA, 22 bp, Homo sapiens
tgtttacttgaatagtattgtg

SEQ ID NO: 4797776 - DNA, 15 bp, Homo sapiens
tgtttagtagctgat

SEQ ID NO: 4797777 - DNA, 19 bp, Homo sapiens
tgtttagtcagtgtactct

SEQ ID NO: 4797778 - DNA, 21 bp, Homo sapiens
tgtttatattgtttttatata

SEQ ID NO: 4797779 - DNA, 19 bp, Homo sapiens
tgtttattgtcaaagtggt

SEQ ID NO: 4797780 - DNA, 23 bp, Homo sapiens
tgtttatttttgctctccctccc

SEQ ID NO: 4797781 - DNA, 15 bp, Homo sapiens
tgtttcaccagtttc

SEQ ID NO: 4797782 - DNA, 17 bp, Homo sapiens
tgtttcatgttctgtgt

SEQ ID NO: 4797783 - DNA, 20 bp, Homo sapiens
tgtttctgcagtattctgta

SEQ ID NO: 4797784 - DNA, 18 bp, Homo sapiens
tgtttctgtcctgtaact

SEQ ID NO: 4797785 - DNA, 11 bp, Homo sapiens
tgtttcttggt

SEQ ID NO: 4797786 - DNA, 17 bp, Homo sapiens
tgtttctttccttctga

SEQ ID NO: 4797787 - DNA, 23 bp, Homo sapiens
tgtttgaaacactcgtgtgcatg

SEQ ID NO: 4797788 - DNA, 16 bp, Homo sapiens
tgtttgaattgatttt

SEQ ID NO: 4797789 - DNA, 20 bp, Homo sapiens
tgtttgaattttcaaaggct

SEQ ID NO: 4797790 - DNA, 14 bp, Homo sapiens
tgtttggcaagaaa

SEQ ID NO: 4797791 - DNA, 21 bp, Homo sapiens
tgtttgggaaaggcagggccc

SEQ ID NO: 4797792 - DNA, 23 bp, Homo sapiens
tgtttgggaaaggcagggccctg

SEQ ID NO: 4797793 - DNA, 18 bp, Homo sapiens
tgtttgtaaaagagctgt

SEQ ID NO: 4797794 - DNA, 13 bp, Homo sapiens
tgtttgtaagcaa

SEQ ID NO: 4797795 - DNA, 12 bp, Homo sapiens
tgtttgtgcttc

SEQ ID NO: 4797796 - DNA, 13 bp, Homo sapiens
tgtttgtgcttct

SEQ ID NO: 4797797 - DNA, 19 bp, Homo sapiens
tgtttgtgcttctaatatt

SEQ ID NO: 4797798 - DNA, 20 bp, Homo sapiens
tgttttacaaagaaacaaaa

SEQ ID NO: 4797799 - DNA, 13 bp, Homo sapiens
tgttttataaatg

SEQ ID NO: 4797800 - DNA, 14 bp, Homo sapiens
tgttttataaatgg

SEQ ID NO: 4797801 - DNA, 16 bp, Homo sapiens
tgttttatagaggttc

SEQ ID NO: 4797802 - DNA, 21 bp, Homo sapiens
tgttttattttaattcagttg

SEQ ID NO: 4797803 - DNA, 23 bp, Homo sapiens
tgttttggaattcaatgggtaaa

SEQ ID NO: 4797804 - DNA, 19 bp, Homo sapiens
tgtcagtttgtgaagtgat

SEQ ID NO: 4797805 - DNA, 20 bp, Homo sapiens
tgtcataaagtgagaaaact

SEQ ID NO: 4797806 - DNA, 17 bp, Homo sapiens
tgtcataactagagcac

SEQ ID NO: 4797807 - DNA, 16 bp, Homo sapiens
tgtcatctctctgggg

SEQ ID NO: 4797808 - DNA, 16 bp, Homo sapiens
tgtcatctgtcagctt

SEQ ID NO: 4797809 - DNA, 21 bp, Homo sapiens
tgtcattagaattgaattatt

SEQ ID NO: 4797810 - DNA, 12 bp, Homo sapiens
tgtcattctcat

SEQ ID NO: 4797811 - DNA, 17 bp, Homo sapiens
tgtcattctcatccaaa

SEQ ID NO: 4797812 - DNA, 23 bp, Homo sapiens
tgtcattctcatccaaaagtgac

SEQ ID NO: 4797813 - DNA, 17 bp, Homo sapiens
tgtcattggttacaaat

SEQ ID NO: 4797814 - DNA, 22 bp, Homo sapiens
tgtcattggttacaaattttta

SEQ ID NO: 4797815 - DNA, 12 bp, Homo sapiens
tgtcatttgcta

SEQ ID NO: 4797816 - DNA, 20 bp, Homo sapiens
tgtcatttgctaatgaattt

SEQ ID NO: 4797817 - DNA, 20 bp, Homo sapiens
tgtcattttcagatccttcc

SEQ ID NO: 4797818 - DNA, 21 bp, Homo sapiens
tgtcattttctgttatacaca

SEQ ID NO: 4797819 - DNA, 22 bp, Homo sapiens
tgtcattttctgttatacacag

SEQ ID NO: 4797820 - DNA, 19 bp, Homo sapiens
tgtccaagcatcagcaaga

SEQ ID NO: 4797821 - DNA, 18 bp, Homo sapiens
tgtccagacaagccctgc

SEQ ID NO: 4797822 - DNA, 13 bp, Homo sapiens
tgtccaggtcaca

SEQ ID NO: 4797823 - DNA, 17 bp, Homo sapiens
tgtccaggtcacaggca

SEQ ID NO: 4797824 - DNA, 18 bp, Homo sapiens
tgtccaggtcacaggcat

SEQ ID NO: 4797825 - DNA, 13 bp, Homo sapiens
tgtccatccgtct

SEQ ID NO: 4797826 - DNA, 20 bp, Homo sapiens
tgtccatccgtctctgtccg

SEQ ID NO: 4797827 - DNA, 19 bp, Homo sapiens
tgtcccacccccagcagct

SEQ ID NO: 4797828 - DNA, 22 bp, Homo sapiens
tgtcccaccgggagcctccccc

SEQ ID NO: 4797829 - DNA, 12 bp, Homo sapiens
tgtcccagtgtc

SEQ ID NO: 4797830 - DNA, 14 bp, Homo sapiens
tgtcccagtgtctg

SEQ ID NO: 4797831 - DNA, 18 bp, Homo sapiens
tgtcccagtgtctggccc

SEQ ID NO: 4797832 - DNA, 23 bp, Homo sapiens
tgtcccatgaccttgacgtgtgt

SEQ ID NO: 4797833 - DNA, 13 bp, Homo sapiens
tgtcccccctgtg

SEQ ID NO: 4797834 - DNA, 17 bp, Homo sapiens
tgtccccgcactgggct

SEQ ID NO: 4797835 - DNA, 15 bp, Homo sapiens
tgtcccctcactctg

SEQ ID NO: 4797836 - DNA, 16 bp, Homo sapiens
tgtcccctcactctgt

SEQ ID NO: 4797837 - DNA, 19 bp, Homo sapiens
tgtcccgggtactcagtca

SEQ ID NO: 4797838 - DNA, 16 bp, Homo sapiens
tgtccctgtgggctca

SEQ ID NO: 4797839 - DNA, 17 bp, Homo sapiens
tgtcccttttccttttt

SEQ ID NO: 4797840 - DNA, 12 bp, Homo sapiens
tgtccgcgtcct

SEQ ID NO: 4797841 - DNA, 19 bp, Homo sapiens
tgtccgtcctgctcgccct

SEQ ID NO: 4797842 - DNA, 14 bp, Homo sapiens
tgtccgtctgtcct

SEQ ID NO: 4797843 - DNA, 21 bp, Homo sapiens
tgtccgtgaaagttgtgatct

SEQ ID NO: 4797844 - DNA, 16 bp, Homo sapiens
tgtcctatccctggac

SEQ ID NO: 4797845 - DNA, 21 bp, Homo sapiens
tgtcctcatgtgagaaagcag

SEQ ID NO: 4797846 - DNA, 20 bp, Homo sapiens
tgtcctctcagaactcctgt

SEQ ID NO: 4797847 - DNA, 13 bp, Homo sapiens
tgtcctctcgagc

SEQ ID NO: 4797848 - DNA, 16 bp, Homo sapiens
tgtcctctcgagccca

SEQ ID NO: 4797849 - DNA, 20 bp, Homo sapiens
tgtcctctgtccgtctgtcc

SEQ ID NO: 4797850 - DNA, 17 bp, Homo sapiens
tgtcctgagctaacact

SEQ ID NO: 4797851 - DNA, 21 bp, Homo sapiens
tgtcctgcatgtatgccatgt

SEQ ID NO: 4797852 - DNA, 15 bp, Homo sapiens
tgtcctgcgcctgcg

SEQ ID NO: 4797853 - DNA, 18 bp, Homo sapiens
tgtcctgctacctttgtc

SEQ ID NO: 4797854 - DNA, 12 bp, Homo sapiens
tgtcctgctcac

SEQ ID NO: 4797855 - DNA, 21 bp, Homo sapiens
tgtcctgctcacgtctgtgag

SEQ ID NO: 4797856 - DNA, 20 bp, Homo sapiens
tgtcctgtaactgttacagt

SEQ ID NO: 4797857 - DNA, 23 bp, Homo sapiens
tgtcctgtgagatgtgtatcagt

SEQ ID NO: 4797858 - DNA, 17 bp, Homo sapiens
tgtcctgtgtcatctgt

SEQ ID NO: 4797859 - DNA, 12 bp, Homo sapiens
tgtccttccccc

SEQ ID NO: 4797860 - DNA, 21 bp, Homo sapiens
tgtcctttatgtattctcttc

SEQ ID NO: 4797861 - DNA, 21 bp, Homo sapiens
tgtcgccccaggccctccctg

SEQ ID NO: 4797862 - DNA, 16 bp, Homo sapiens
tgtcggggcccctgcg

SEQ ID NO: 4797863 - DNA, 12 bp, Homo sapiens
tgtctaaagatc

SEQ ID NO: 4797864 - DNA, 21 bp, Homo sapiens
tgtctaaagatctttttttaa

SEQ ID NO: 4797865 - DNA, 13 bp, Homo sapiens
tgtctcaaaataa

SEQ ID NO: 4797866 - DNA, 19 bp, Homo sapiens
tgtctcaaaataaaaccag

SEQ ID NO: 4797867 - DNA, 21 bp, Homo sapiens
tgtctcaaaataaaaccagaa

SEQ ID NO: 4797868 - DNA, 16 bp, Homo sapiens
tgtctcacgattccag

SEQ ID NO: 4797869 - DNA, 19 bp, Homo sapiens
tgtctcacgattccagtgc

SEQ ID NO: 4797870 - DNA, 23 bp, Homo sapiens
tgtctcatggtcccacttcccca

SEQ ID NO: 4797871 - DNA, 12 bp, Homo sapiens
tgtctcatgttt

SEQ ID NO: 4797872 - DNA, 17 bp, Homo sapiens
tgtctcatttgccagga

SEQ ID NO: 4797873 - DNA, 16 bp, Homo sapiens
tgtctccagctgattt

SEQ ID NO: 4797874 - DNA, 20 bp, Homo sapiens
tgtctctagttgacttcaaa

SEQ ID NO: 4797875 - DNA, 23 bp, Homo sapiens
tgtctctccctaccctcttctca

SEQ ID NO: 4797876 - DNA, 16 bp, Homo sapiens
tgtctcttgggaagca

SEQ ID NO: 4797877 - DNA, 17 bp, Homo sapiens
tgtctcttgggaagcag

SEQ ID NO: 4797878 - DNA, 21 bp, Homo sapiens
tgtctcttgttaaatgagctt

SEQ ID NO: 4797879 - DNA, 13 bp, Homo sapiens
tgtctgaaatttt

SEQ ID NO: 4797880 - DNA, 15 bp, Homo sapiens
tgtctgaaattttct

SEQ ID NO: 4797881 - DNA, 16 bp, Homo sapiens
tgtctgagccctgccc

SEQ ID NO: 4797882 - DNA, 14 bp, Homo sapiens
tgtctgctgcctcc

SEQ ID NO: 4797883 - DNA, 14 bp, Homo sapiens
tgtctggcccagcc

SEQ ID NO: 4797884 - DNA, 20 bp, Homo sapiens
tgtctggcccagccatggct

SEQ ID NO: 4797885 - DNA, 15 bp, Homo sapiens
tgtctggctgtacgt

SEQ ID NO: 4797886 - DNA, 19 bp, Homo sapiens
tgtctggctgtggcccctc

SEQ ID NO: 4797887 - DNA, 15 bp, Homo sapiens
tgtctggtccacaca

SEQ ID NO: 4797888 - DNA, 21 bp, Homo sapiens
tgtctggtccacacaccacag

SEQ ID NO: 4797889 - DNA, 18 bp, Homo sapiens
tgtctgtaagagaattct

SEQ ID NO: 4797890 - DNA, 16 bp, Homo sapiens
tgtctgtcccagttaa

SEQ ID NO: 4797891 - DNA, 18 bp, Homo sapiens
tgtctgtccctaaacata

SEQ ID NO: 4797892 - DNA, 12 bp, Homo sapiens
tgtctgtgtata

SEQ ID NO: 4797893 - DNA, 16 bp, Homo sapiens
tgtctgtgtatacata

SEQ ID NO: 4797894 - DNA, 17 bp, Homo sapiens
tgtctgtgtatacatat

SEQ ID NO: 4797895 - DNA, 22 bp, Homo sapiens
tgtcttacaactgactgactta

SEQ ID NO: 4797896 - DNA, 23 bp, Homo sapiens
tgtcttacaactgactgacttag

SEQ ID NO: 4797897 - DNA, 16 bp, Homo sapiens
tgtcttactcaagata

SEQ ID NO: 4797898 - DNA, 17 bp, Homo sapiens
tgtcttattcctaattc

SEQ ID NO: 4797899 - DNA, 19 bp, Homo sapiens
tgtcttcaaccctgccctg

SEQ ID NO: 4797900 - DNA, 20 bp, Homo sapiens
tgtcttcaatttgtataaaa

SEQ ID NO: 4797901 - DNA, 21 bp, Homo sapiens
tgtcttcttgggggcagacca

SEQ ID NO: 4797902 - DNA, 19 bp, Homo sapiens
tgtcttgcactggccttct

SEQ ID NO: 4797903 - DNA, 15 bp, Homo sapiens
tgtctttaaaatgat

SEQ ID NO: 4797904 - DNA, 13 bp, Homo sapiens
tgtctttgctgtt

SEQ ID NO: 4797905 - DNA, 15 bp, Homo sapiens
tgtcttttgttctct

SEQ ID NO: 4797906 - DNA, 17 bp, Homo sapiens
tgtgaaaagtaaaacag

SEQ ID NO: 4797907 - DNA, 13 bp, Homo sapiens
tgtgaaataaaga

SEQ ID NO: 4797908 - DNA, 20 bp, Homo sapiens
tgtgaagaaacatttatctt

SEQ ID NO: 4797909 - DNA, 17 bp, Homo sapiens
tgtgaatataaatgtgt

SEQ ID NO: 4797910 - DNA, 13 bp, Homo sapiens
tgtgaatatgtgt

SEQ ID NO: 4797911 - DNA, 14 bp, Homo sapiens
tgtgaatatgtgta

SEQ ID NO: 4797912 - DNA, 19 bp, Homo sapiens
tgtgaatatgtgtaacttt

SEQ ID NO: 4797913 - DNA, 21 bp, Homo sapiens
tgtgacaccaccactgtgtcc

SEQ ID NO: 4797914 - DNA, 23 bp, Homo sapiens
tgtgacaccaccactgtgtccca

SEQ ID NO: 4797915 - DNA, 18 bp, Homo sapiens
tgtgacaggaaagccctc

SEQ ID NO: 4797916 - DNA, 22 bp, Homo sapiens
tgtgacaggaaagccctccccc

SEQ ID NO: 4797917 - DNA, 21 bp, Homo sapiens
tgtgacctgacacctgccgct

SEQ ID NO: 4797918 - DNA, 21 bp, Homo sapiens
tgtgactcgcttagctgaaac

SEQ ID NO: 4797919 - DNA, 16 bp, Homo sapiens
tgtgagaactgtgaat

SEQ ID NO: 4797920 - DNA, 18 bp, Homo sapiens
tgtgagaactgtgaatat

SEQ ID NO: 4797921 - DNA, 21 bp, Homo sapiens
tgtgagaactgtgaatatgtg

SEQ ID NO: 4797922 - DNA, 22 bp, Homo sapiens
tgtgagataaatatcattatag

SEQ ID NO: 4797923 - DNA, 19 bp, Homo sapiens
tgtgagccaaagagaaaag

SEQ ID NO: 4797924 - DNA, 22 bp, Homo sapiens
tgtgaggacagggcccccacag

SEQ ID NO: 4797925 - DNA, 12 bp, Homo sapiens
tgtgaggactgg

SEQ ID NO: 4797926 - DNA, 16 bp, Homo sapiens
tgtgaggatagagact

SEQ ID NO: 4797927 - DNA, 23 bp, Homo sapiens
tgtgaggctccctccctccctgc

SEQ ID NO: 4797928 - DNA, 23 bp, Homo sapiens
tcaggattgaggatgaactcagg

SEQ ID NO: 4797929 - DNA, 14 bp, Homo sapiens
tcaggcagcctgtg

SEQ ID NO: 4797930 - DNA, 20 bp, Homo sapiens
tcaggccaaactcacctgcc

SEQ ID NO: 4797931 - DNA, 13 bp, Homo sapiens
tcaggccagctgc

SEQ ID NO: 4797932 - DNA, 18 bp, Homo sapiens
tcaggcctcacctggctt

SEQ ID NO: 4797933 - DNA, 20 bp, Homo sapiens
tcaggcctcacctggcttcc

SEQ ID NO: 4797934 - DNA, 12 bp, Homo sapiens
tcaggctctgaa

SEQ ID NO: 4797935 - DNA, 15 bp, Homo sapiens
tcaggctctgaatct

SEQ ID NO: 4797936 - DNA, 21 bp, Homo sapiens
tcaggctgcccagcggctctt

SEQ ID NO: 4797937 - DNA, 15 bp, Homo sapiens
tcagggaccaaggag

SEQ ID NO: 4797938 - DNA, 23 bp, Homo sapiens
tcagggcaagctcatagcacatg

SEQ ID NO: 4797939 - DNA, 13 bp, Homo sapiens
tcagggcccagag

SEQ ID NO: 4797940 - DNA, 17 bp, Homo sapiens
tcagggcccagaggctg

SEQ ID NO: 4797941 - DNA, 19 bp, Homo sapiens
tcagggcccagaggctgag

SEQ ID NO: 4797942 - DNA, 15 bp, Homo sapiens
tcagggccttggccc

SEQ ID NO: 4797943 - DNA, 15 bp, Homo sapiens
tcaggtcagagccca

SEQ ID NO: 4797944 - DNA, 20 bp, Homo sapiens
tcaggtcagagcccaggaat

SEQ ID NO: 4797945 - DNA, 15 bp, Homo sapiens
tcaggtcccctggcc

SEQ ID NO: 4797946 - DNA, 23 bp, Homo sapiens
tcaggtcccctggcccttccttc

SEQ ID NO: 4797947 - DNA, 16 bp, Homo sapiens
tcaggtgcgtgccaca

SEQ ID NO: 4797948 - DNA, 23 bp, Homo sapiens
tcagtaaaattatactgtgtgtg

SEQ ID NO: 4797949 - DNA, 22 bp, Homo sapiens
tcagtaatctgtcgcatttcat

SEQ ID NO: 4797950 - DNA, 23 bp, Homo sapiens
tcagtagctccttggttttgcct

SEQ ID NO: 4797951 - DNA, 16 bp, Homo sapiens
tcagtagtgcctgtga

SEQ ID NO: 4797952 - DNA, 16 bp, Homo sapiens
tcagtatcttaaaatt

SEQ ID NO: 4797953 - DNA, 15 bp, Homo sapiens
tcagtattgagacac

SEQ ID NO: 4797954 - DNA, 12 bp, Homo sapiens
tctatgtgtata

SEQ ID NO: 4797955 - DNA, 15 bp, Homo sapiens
tctatgtgtatatat

SEQ ID NO: 4797956 - DNA, 17 bp, Homo sapiens
tctatgtgtatatatta

SEQ ID NO: 4797957 - DNA, 13 bp, Homo sapiens
tctattaaaagcc

SEQ ID NO: 4797958 - DNA, 17 bp, Homo sapiens
tctattccttctggcct

SEQ ID NO: 4797959 - DNA, 12 bp, Homo sapiens
tctattgtgctt

SEQ ID NO: 4797960 - DNA, 16 bp, Homo sapiens
tctatttatctgtctg

SEQ ID NO: 4797961 - DNA, 14 bp, Homo sapiens
tctcaaacctggca

SEQ ID NO: 4797962 - DNA, 16 bp, Homo sapiens
tctcaaactcctgacc

SEQ ID NO: 4797963 - DNA, 16 bp, Homo sapiens
tctcaaatgctaaatg

SEQ ID NO: 4797964 - DNA, 19 bp, Homo sapiens
tctcaaatgctaaatgcaa

SEQ ID NO: 4797965 - DNA, 14 bp, Homo sapiens
tctcaatcattgtc

SEQ ID NO: 4797966 - DNA, 19 bp, Homo sapiens
tctcaattctgaaggggaa

SEQ ID NO: 4797967 - DNA, 13 bp, Homo sapiens
tctcaattgagtt

SEQ ID NO: 4797968 - DNA, 14 bp, Homo sapiens
tctcacacacatag

SEQ ID NO: 4797969 - DNA, 17 bp, Homo sapiens
tctcacagcacatgctg

SEQ ID NO: 4797970 - DNA, 17 bp, Homo sapiens
tctcacgattccagtgc

SEQ ID NO: 4797971 - DNA, 18 bp, Homo sapiens
tctcacgattccagtgca

SEQ ID NO: 4797972 - DNA, 21 bp, Homo sapiens
tctcagaacaccaagtaaatc

SEQ ID NO: 4797973 - DNA, 15 bp, Homo sapiens
tctcagataaagtga

SEQ ID NO: 4797974 - DNA, 16 bp, Homo sapiens
tctcagatccctcggt

SEQ ID NO: 4797975 - DNA, 14 bp, Homo sapiens
tctcagatgggctg

SEQ ID NO: 4797976 - DNA, 22 bp, Homo sapiens
tctcagcaaattcttgaataaa

SEQ ID NO: 4797977 - DNA, 19 bp, Homo sapiens
tctcagcatcctggaaatt

SEQ ID NO: 4797978 - DNA, 18 bp, Homo sapiens
tctcagccttggttcctg

SEQ ID NO: 4797979 - DNA, 19 bp, Homo sapiens
tctcagccttggttcctga

SEQ ID NO: 4797980 - DNA, 16 bp, Homo sapiens
tctcagctcactgcaa

SEQ ID NO: 4797981 - DNA, 18 bp, Homo sapiens
tctcagctcactgcaacc

SEQ ID NO: 4797982 - DNA, 15 bp, Homo sapiens
tctcagctccactct

SEQ ID NO: 4797983 - DNA, 18 bp, Homo sapiens
tctcaggaccaccctgcc

SEQ ID NO: 4797984 - DNA, 19 bp, Homo sapiens
tctcaggaccaccctgcca

SEQ ID NO: 4797985 - DNA, 20 bp, Homo sapiens
tctcaggaccaccctgccaa

SEQ ID NO: 4797986 - DNA, 21 bp, Homo sapiens
tctcaggaccaccctgccaag

SEQ ID NO: 4797987 - DNA, 10 bp, Homo sapiens
tctcaggcca

SEQ ID NO: 4797988 - DNA, 18 bp, Homo sapiens
tctcaggccagctgcttg

SEQ ID NO: 4797989 - DNA, 19 bp, Homo sapiens
tctcaggtggcatttgcag

SEQ ID NO: 4797990 - DNA, 15 bp, Homo sapiens
tctcagtatcttaaa

SEQ ID NO: 4797991 - DNA, 17 bp, Homo sapiens
tctcagtatcttaaaat

SEQ ID NO: 4797992 - DNA, 15 bp, Homo sapiens
tctcatccaaaagtg

SEQ ID NO: 4797993 - DNA, 21 bp, Homo sapiens
tctcatctgtaaaaccaggct

SEQ ID NO: 4797994 - DNA, 14 bp, Homo sapiens
tctcatcttgcctc

SEQ ID NO: 4797995 - DNA, 23 bp, Homo sapiens
tctcatcttgtaaataatgctta

SEQ ID NO: 4797996 - DNA, 19 bp, Homo sapiens
tctcatggtcccacttccc

SEQ ID NO: 4797997 - DNA, 19 bp, Homo sapiens
tctcattgccaaggcatcc

SEQ ID NO: 4797998 - DNA, 15 bp, Homo sapiens
tctcatttatgttat

SEQ ID NO: 4797999 - DNA, 20 bp, Homo sapiens
tctcatttatgttatttatg

SEQ ID NO: 4798000 - DNA, 16 bp, Homo sapiens
tctcattttttcctga

SEQ ID NO: 4798001 - DNA, 22 bp, Homo sapiens
tctccaagcactagccttccca

SEQ ID NO: 4798002 - DNA, 13 bp, Homo sapiens
tctccacccctca

SEQ ID NO: 4798003 - DNA, 14 bp, Homo sapiens
tctccacccctcaa

SEQ ID NO: 4798004 - DNA, 23 bp, Homo sapiens
tctccacccctcaagccaggaga

SEQ ID NO: 4798005 - DNA, 16 bp, Homo sapiens
tctccacctgaagtga

SEQ ID NO: 4798006 - DNA, 17 bp, Homo sapiens
tctccacctgaagtgat

SEQ ID NO: 4798007 - DNA, 21 bp, Homo sapiens
tctccagaaaaatcaatcatt

SEQ ID NO: 4798008 - DNA, 19 bp, Homo sapiens
tctccagcctcagcctccc

SEQ ID NO: 4798009 - DNA, 15 bp, Homo sapiens
tctccaggcccagcc

SEQ ID NO: 4798010 - DNA, 16 bp, Homo sapiens
tctccaggcccagcct

SEQ ID NO: 4798011 - DNA, 18 bp, Homo sapiens
tctccaggcccagcctgg

SEQ ID NO: 4798012 - DNA, 23 bp, Homo sapiens
tctccaggcccagcctggcccca

SEQ ID NO: 4798013 - DNA, 19 bp, Homo sapiens
tctccaggggtttacagtg

SEQ ID NO: 4798014 - DNA, 23 bp, Homo sapiens
tctccatgctctttcaccctgcc

SEQ ID NO: 4798015 - DNA, 15 bp, Homo sapiens
tctccattaaacttc

SEQ ID NO: 4798016 - DNA, 23 bp, Homo sapiens
tctcccaaataaactccttaacc

SEQ ID NO: 4798017 - DNA, 16 bp, Homo sapiens
tctcccaactgctgct

SEQ ID NO: 4798018 - DNA, 13 bp, Homo sapiens
tctccccatatat

SEQ ID NO: 4798019 - DNA, 17 bp, Homo sapiens
tctccccatatataaat

SEQ ID NO: 4798020 - DNA, 21 bp, Homo sapiens
tctccccatatataaattatt

SEQ ID NO: 4798021 - DNA, 14 bp, Homo sapiens
tctccccctcagct

SEQ ID NO: 4798022 - DNA, 12 bp, Homo sapiens
tctcccctccag

SEQ ID NO: 4798023 - DNA, 14 bp, Homo sapiens
tctcccctccagac

SEQ ID NO: 4798024 - DNA, 17 bp, Homo sapiens
tctcccgccattggcct

SEQ ID NO: 4798025 - DNA, 15 bp, Homo sapiens
tctccctaccctctt

SEQ ID NO: 4798026 - DNA, 14 bp, Homo sapiens
tctccctccactcc

SEQ ID NO: 4798027 - DNA, 16 bp, Homo sapiens
tctccctccactcctc

SEQ ID NO: 4798028 - DNA, 19 bp, Homo sapiens
tctccctccactcctccca

SEQ ID NO: 4798029 - DNA, 19 bp, Homo sapiens
tctccctcccttctttcct

SEQ ID NO: 4798030 - DNA, 18 bp, Homo sapiens
tctccctggggaggaccc

SEQ ID NO: 4798031 - DNA, 22 bp, Homo sapiens
tctccctggggaggacccctgc

SEQ ID NO: 4798032 - DNA, 22 bp, Homo sapiens
tctccggatggaatcacagcca

SEQ ID NO: 4798033 - DNA, 15 bp, Homo sapiens
tctccgggtgtggcc

SEQ ID NO: 4798034 - DNA, 17 bp, Homo sapiens
tctccgggtgtggcctc

SEQ ID NO: 4798035 - DNA, 19 bp, Homo sapiens
tctccgggtgtggcctcag

SEQ ID NO: 4798036 - DNA, 21 bp, Homo sapiens
tctccgggtgtggcctcagcc

SEQ ID NO: 4798037 - DNA, 23 bp, Homo sapiens
tctccgggtgtggcctcagccct

SEQ ID NO: 4798038 - DNA, 12 bp, Homo sapiens
tctcctcactgc

SEQ ID NO: 4798039 - DNA, 18 bp, Homo sapiens
tctcctcactgccactaa

SEQ ID NO: 4798040 - DNA, 16 bp, Homo sapiens
tctcctccaaatgctg

SEQ ID NO: 4798041 - DNA, 15 bp, Homo sapiens
tctcctccagagtca

SEQ ID NO: 4798042 - DNA, 18 bp, Homo sapiens
tctcctccagccctgggc

SEQ ID NO: 4798043 - DNA, 21 bp, Homo sapiens
tctcctccttttcacagttct

SEQ ID NO: 4798044 - DNA, 22 bp, Homo sapiens
tctcctcggtggcatttgctga

SEQ ID NO: 4798045 - DNA, 24 bp, Homo sapiens
tctcctcggtggcatttgctgaat

SEQ ID NO: 4798046 - DNA, 16 bp, Homo sapiens
tctcctctctctccct

SEQ ID NO: 4798047 - DNA, 18 bp, Homo sapiens
tctcctctctctccctcc

SEQ ID NO: 4798048 - DNA, 13 bp, Homo sapiens
tctcctctgtcag

SEQ ID NO: 4798049 - DNA, 15 bp, Homo sapiens
tctcctgagcctgtc

SEQ ID NO: 4798050 - DNA, 15 bp, Homo sapiens
tctcctgattattta

SEQ ID NO: 4798051 - DNA, 15 bp, Homo sapiens
tctcctgcagtctgt

SEQ ID NO: 4798052 - DNA, 16 bp, Homo sapiens
tctcctgccttggcct

SEQ ID NO: 4798053 - DNA, 19 bp, Homo sapiens
tctcctgggggtggcaggc

SEQ ID NO: 4798054 - DNA, 15 bp, Homo sapiens
tctcctgtatcattt

SEQ ID NO: 4798055 - DNA, 12 bp, Homo sapiens
tctccttcactc

SEQ ID NO: 4798056 - DNA, 17 bp, Homo sapiens
tctccttcactctgaca

SEQ ID NO: 4798057 - DNA, 14 bp, Homo sapiens
tctccttccttacc

SEQ ID NO: 4798058 - DNA, 12 bp, Homo sapiens
tctccttgtact

SEQ ID NO: 4798059 - DNA, 16 bp, Homo sapiens
tctccttgtacttgaa

SEQ ID NO: 4798060 - DNA, 19 bp, Homo sapiens
tctccttgtacttgaataa

SEQ ID NO: 4798061 - DNA, 18 bp, Homo sapiens
tctcgagcccagatggaa

SEQ ID NO: 4798062 - DNA, 16 bp, Homo sapiens
tctcgctcccctctgc

SEQ ID NO: 4798063 - DNA, 14 bp, Homo sapiens
tctcgtgattgata

SEQ ID NO: 4798064 - DNA, 14 bp, Homo sapiens
tctctaaaacagca

SEQ ID NO: 4798065 - DNA, 16 bp, Homo sapiens
tctctaaaatgctgtt

SEQ ID NO: 4798066 - DNA, 19 bp, Homo sapiens
tctctaaaatgctgttctc

SEQ ID NO: 4798067 - DNA, 20 bp, Homo sapiens
tctctaaaatgctgttctca

SEQ ID NO: 4798068 - DNA, 14 bp, Homo sapiens
tctctaaacccaaa

SEQ ID NO: 4798069 - DNA, 13 bp, Homo sapiens
tctctaagaattc

SEQ ID NO: 4798070 - DNA, 23 bp, Homo sapiens
tctctagttgacttcaaatgtgt

SEQ ID NO: 4798071 - DNA, 13 bp, Homo sapiens
tctctatataaaa

SEQ ID NO: 4798072 - DNA, 14 bp, Homo sapiens
tctctatataaaaa

SEQ ID NO: 4798073 - DNA, 22 bp, Homo sapiens
tctctatataaaaaatatatgt

SEQ ID NO: 4798074 - DNA, 14 bp, Homo sapiens
tctctcaaaatgtg

SEQ ID NO: 4798075 - DNA, 17 bp, Homo sapiens
tctctccatctaccttc

SEQ ID NO: 4798076 - DNA, 16 bp, Homo sapiens
tctctccccatatata

SEQ ID NO: 4798077 - DNA, 15 bp, Homo sapiens
tgataataaaattca

SEQ ID NO: 4798078 - DNA, 16 bp, Homo sapiens
tgataatagctcacag

SEQ ID NO: 4798079 - DNA, 22 bp, Homo sapiens
tgataatagctcacagcacatt

SEQ ID NO: 4798080 - DNA, 17 bp, Homo sapiens
tgataatcccatactct

SEQ ID NO: 4798081 - DNA, 18 bp, Homo sapiens
tgataattgtaaaggtga

SEQ ID NO: 4798082 - DNA, 24 bp, Homo sapiens
tgataattgtaaaggtgatgaatt

SEQ ID NO: 4798083 - DNA, 17 bp, Homo sapiens
tgatacttgtaactttt

SEQ ID NO: 4798084 - DNA, 16 bp, Homo sapiens
tgatagaagaaggact

SEQ ID NO: 4798085 - DNA, 24 bp, Homo sapiens
tgatagaagaaggactgaagaaaa

SEQ ID NO: 4798086 - DNA, 17 bp, Homo sapiens
tgatatacagacctcca

SEQ ID NO: 4798087 - DNA, 15 bp, Homo sapiens
tgatatctgtttgct

SEQ ID NO: 4798088 - DNA, 12 bp, Homo sapiens
tgatatgcatgt

SEQ ID NO: 4798089 - DNA, 13 bp, Homo sapiens
tgatatgtgtaat

SEQ ID NO: 4798090 - DNA, 23 bp, Homo sapiens
tgatatgtgtaatatcatttcat

SEQ ID NO: 4798091 - DNA, 12 bp, Homo sapiens
tgatattgtgta

SEQ ID NO: 4798092 - DNA, 12 bp, Homo sapiens
tgatatttaaaa

SEQ ID NO: 4798093 - DNA, 20 bp, Homo sapiens
tgatcaaggtgctcttctca

SEQ ID NO: 4798094 - DNA, 22 bp, Homo sapiens
tgatcaaggtgctcttctcatt

SEQ ID NO: 4798095 - DNA, 18 bp, Homo sapiens
tgatctcagctcactgca

SEQ ID NO: 4798096 - DNA, 14 bp, Homo sapiens
tgatctctccacgg

SEQ ID NO: 4798097 - DNA, 18 bp, Homo sapiens
tgatctggtgcgtgtggc

SEQ ID NO: 4798098 - DNA, 19 bp, Homo sapiens
tgatctggtgcgtgtggcc

SEQ ID NO: 4798099 - DNA, 13 bp, Homo sapiens
tgatctgtattaa

SEQ ID NO: 4798100 - DNA, 22 bp, Homo sapiens
tgatctgtatttaatggttttt

SEQ ID NO: 4798101 - DNA, 13 bp, Homo sapiens
tgatctgtccttc

SEQ ID NO: 4798102 - DNA, 15 bp, Homo sapiens
tgatctgtccttcca

SEQ ID NO: 4798103 - DNA, 20 bp, Homo sapiens
tgatctgtccttccaacctg

SEQ ID NO: 4798104 - DNA, 19 bp, Homo sapiens
tgatgaagttgtacaacac

SEQ ID NO: 4798105 - DNA, 18 bp, Homo sapiens
tgatgaccaatctctgtg

SEQ ID NO: 4798106 - DNA, 22 bp, Homo sapiens
tgatgactatgctttgctatca

SEQ ID NO: 4798107 - DNA, 14 bp, Homo sapiens
tgatgatgttctga

SEQ ID NO: 4798108 - DNA, 15 bp, Homo sapiens
tgatgatttcagaaa

SEQ ID NO: 4798109 - DNA, 15 bp, Homo sapiens
tgatgcatgagctcc

SEQ ID NO: 4798110 - DNA, 14 bp, Homo sapiens
tgatgccgtgcggg

SEQ ID NO: 4798111 - DNA, 20 bp, Homo sapiens
tgatgcgtctacccagactc

SEQ ID NO: 4798112 - DNA, 15 bp, Homo sapiens
tgatggaagggcctt

SEQ ID NO: 4798113 - DNA, 19 bp, Homo sapiens
tgatggacatgagagtagg

SEQ ID NO: 4798114 - DNA, 13 bp, Homo sapiens
tgatggagaagga

SEQ ID NO: 4798115 - DNA, 15 bp, Homo sapiens
tgatggagaaggaag

SEQ ID NO: 4798116 - DNA, 17 bp, Homo sapiens
tgatggagaaggaaggc

SEQ ID NO: 4798117 - DNA, 16 bp, Homo sapiens
tgatggatgagaaaaa

SEQ ID NO: 4798118 - DNA, 21 bp, Homo sapiens
tgatggcacttttgagctcct

SEQ ID NO: 4798119 - DNA, 14 bp, Homo sapiens
tgatggccaggcct

SEQ ID NO: 4798120 - DNA, 17 bp, Homo sapiens
tgatggctatgttttgg

SEQ ID NO: 4798121 - DNA, 17 bp, Homo sapiens
tgatgggcaaggggcca

SEQ ID NO: 4798122 - DNA, 22 bp, Homo sapiens
tgatgggcaaggggccaggaag

SEQ ID NO: 4798123 - DNA, 14 bp, Homo sapiens
tgatggttgctttg

SEQ ID NO: 4798124 - DNA, 23 bp, Homo sapiens
tgatggttgctttgagcccacag

SEQ ID NO: 4798125 - DNA, 18 bp, Homo sapiens
tgatgtgatttatgcatt

SEQ ID NO: 4798126 - DNA, 18 bp, Homo sapiens
tgatgtgctcatcagaaa

SEQ ID NO: 4798127 - DNA, 19 bp, Homo sapiens
tgattaaattatcattgtt

SEQ ID NO: 4798128 - DNA, 19 bp, Homo sapiens
tgattaaggactacagaat

SEQ ID NO: 4798129 - DNA, 20 bp, Homo sapiens
tgattaaggactacagaatt

SEQ ID NO: 4798130 - DNA, 12 bp, Homo sapiens
tgattaagtata

SEQ ID NO: 4798131 - DNA, 18 bp, Homo sapiens
tgattaagtatatctatc

SEQ ID NO: 4798132 - DNA, 21 bp, Homo sapiens
tgattaatttctgccatttca

SEQ ID NO: 4798133 - DNA, 18 bp, Homo sapiens
tgattacctgaaagccct

SEQ ID NO: 4798134 - DNA, 14 bp, Homo sapiens
tgattatgaaatgc

SEQ ID NO: 4798135 - DNA, 17 bp, Homo sapiens
tgattatgaaatgccag

SEQ ID NO: 4798136 - DNA, 19 bp, Homo sapiens
tgattcaaataaccctgaa

SEQ ID NO: 4798137 - DNA, 14 bp, Homo sapiens
tgattcacttttat

SEQ ID NO: 4798138 - DNA, 16 bp, Homo sapiens
tgattcataatgactt

SEQ ID NO: 4798139 - DNA, 15 bp, Homo sapiens
tgattctaaagggga

SEQ ID NO: 4798140 - DNA, 16 bp, Homo sapiens
tgattctcctctccca

SEQ ID NO: 4798141 - DNA, 15 bp, Homo sapiens
tgattgcccaatgga

SEQ ID NO: 4798142 - DNA, 14 bp, Homo sapiens
tgattggaaaataa

SEQ ID NO: 4798143 - DNA, 15 bp, Homo sapiens
tgattggacctggcc

SEQ ID NO: 4798144 - DNA, 20 bp, Homo sapiens
tgattggacctggcccagtg

SEQ ID NO: 4798145 - DNA, 19 bp, Homo sapiens
tgattgtacagaatcattg

SEQ ID NO: 4798146 - DNA, 23 bp, Homo sapiens
tgattgtacagaatcattgctta

SEQ ID NO: 4798147 - DNA, 21 bp, Homo sapiens
tgattgtctaaccaattgtga

SEQ ID NO: 4798148 - DNA, 22 bp, Homo sapiens
tgattgtctaaccaattgtgag

SEQ ID NO: 4798149 - DNA, 18 bp, Homo sapiens
tgattgttcctccccagc

SEQ ID NO: 4798150 - DNA, 15 bp, Homo sapiens
tgattgtttaattgt

SEQ ID NO: 4798151 - DNA, 13 bp, Homo sapiens
tgatttatgcatt

SEQ ID NO: 4798152 - DNA, 14 bp, Homo sapiens
tgatttatgcattt

SEQ ID NO: 4798153 - DNA, 13 bp, Homo sapiens
tgatttcagaaac

SEQ ID NO: 4798154 - DNA, 16 bp, Homo sapiens
tgatttccatccaaac

SEQ ID NO: 4798155 - DNA, 17 bp, Homo sapiens
tgatttgcaacactgcc

SEQ ID NO: 4798156 - DNA, 20 bp, Homo sapiens
tgatttgggctgaatgtatg

SEQ ID NO: 4798157 - DNA, 14 bp, Homo sapiens
tgcaaaaatgaatt

SEQ ID NO: 4798158 - DNA, 16 bp, Homo sapiens
tgcaaaaatgaattca

SEQ ID NO: 4798159 - DNA, 13 bp, Homo sapiens
tgcaaaatgaaga

SEQ ID NO: 4798160 - DNA, 15 bp, Homo sapiens
tgcaaatagaaaaca

SEQ ID NO: 4798161 - DNA, 21 bp, Homo sapiens
tgcaaatattgctattgttta

SEQ ID NO: 4798162 - DNA, 14 bp, Homo sapiens
tgcaaatgaaggaa

SEQ ID NO: 4798163 - DNA, 21 bp, Homo sapiens
tgcaaatgaaggaatgcaata

SEQ ID NO: 4798164 - DNA, 16 bp, Homo sapiens
tgcaacaaactcaaaa

SEQ ID NO: 4798165 - DNA, 11 bp, Homo sapiens
tgcaacactgc

SEQ ID NO: 4798166 - DNA, 18 bp, Homo sapiens
tgcaacactgccaaacat

SEQ ID NO: 4798167 - DNA, 14 bp, Homo sapiens
tgcaacagactgcc

SEQ ID NO: 4798168 - DNA, 13 bp, Homo sapiens
tgcaacctccacc

SEQ ID NO: 4798169 - DNA, 12 bp, Homo sapiens
tgcaagctccag

SEQ ID NO: 4798170 - DNA, 13 bp, Homo sapiens
tgcaagctccagt

SEQ ID NO: 4798171 - DNA, 14 bp, Homo sapiens
tgcaagctccagta

SEQ ID NO: 4798172 - DNA, 21 bp, Homo sapiens
tgcaagctccagtagctccgc

SEQ ID NO: 4798173 - DNA, 16 bp, Homo sapiens
tgcaaggacaagcaat

SEQ ID NO: 4798174 - DNA, 16 bp, Homo sapiens
tgcaaggcccacagga

SEQ ID NO: 4798175 - DNA, 16 bp, Homo sapiens
tgcaaggtgcacctgc

SEQ ID NO: 4798176 - DNA, 16 bp, Homo sapiens
tgcaataaactcagtc

SEQ ID NO: 4798177 - DNA, 14 bp, Homo sapiens
tgcaataaagagta

SEQ ID NO: 4798178 - DNA, 17 bp, Homo sapiens
tgcaataaagagtaaat

SEQ ID NO: 4798179 - DNA, 20 bp, Homo sapiens
tgcaataacagttttaagat

SEQ ID NO: 4798180 - DNA, 21 bp, Homo sapiens
tgcaataacagttttaagatg

SEQ ID NO: 4798181 - DNA, 20 bp, Homo sapiens
tgcaataagatattaccctc

SEQ ID NO: 4798182 - DNA, 21 bp, Homo sapiens
tgcaataaggatttattctca

SEQ ID NO: 4798183 - DNA, 13 bp, Homo sapiens
tgcaatatcttcg

SEQ ID NO: 4798184 - DNA, 18 bp, Homo sapiens
tgcaatctgtccagacaa

SEQ ID NO: 4798185 - DNA, 19 bp, Homo sapiens
tgcaatctgtccagacaag

SEQ ID NO: 4798186 - DNA, 17 bp, Homo sapiens
tgcaatgcatctgaaag

SEQ ID NO: 4798187 - DNA, 18 bp, Homo sapiens
tgcaatgcatctgaaagt

SEQ ID NO: 4798188 - DNA, 20 bp, Homo sapiens
tgcaatgcatctgaaagttt

SEQ ID NO: 4798189 - DNA, 24 bp, Homo sapiens
tgcaatgtatcccttctcacagca

SEQ ID NO: 4798190 - DNA, 22 bp, Homo sapiens
tgcaattgtttaagaatcatgg

SEQ ID NO: 4798191 - DNA, 20 bp, Homo sapiens
tgcaatttgtttgtgcttct

SEQ ID NO: 4798192 - DNA, 21 bp, Homo sapiens
tgcaatttgtttgtgcttcta

SEQ ID NO: 4798193 - DNA, 13 bp, Homo sapiens
tgcacaaaccttc

SEQ ID NO: 4798194 - DNA, 21 bp, Homo sapiens
tgcacacataacacacatcag

SEQ ID NO: 4798195 - DNA, 20 bp, Homo sapiens
tgcacaccaaattgctgaga

SEQ ID NO: 4798196 - DNA, 20 bp, Homo sapiens
tgcacagctaacatggaagt

SEQ ID NO: 4798197 - DNA, 15 bp, Homo sapiens
tgcacagtggtccag

SEQ ID NO: 4798198 - DNA, 13 bp, Homo sapiens
tgcacatacagat

SEQ ID NO: 4798199 - DNA, 14 bp, Homo sapiens
acttactatggtat

SEQ ID NO: 4798200 - DNA, 15 bp, Homo sapiens
acttagacccagtca

SEQ ID NO: 4798201 - DNA, 12 bp, Homo sapiens
acttatgtctct

SEQ ID NO: 4798202 - DNA, 15 bp, Homo sapiens
acttatgtctcttgt

SEQ ID NO: 4798203 - DNA, 15 bp, Homo sapiens
acttattcaaagaga

SEQ ID NO: 4798204 - DNA, 17 bp, Homo sapiens
acttattcaaagagaaa

SEQ ID NO: 4798205 - DNA, 16 bp, Homo sapiens
acttattgattaagta

SEQ ID NO: 4798206 - DNA, 17 bp, Homo sapiens
acttattttgattgttt

SEQ ID NO: 4798207 - DNA, 15 bp, Homo sapiens
acttcaaatgtgtaa

SEQ ID NO: 4798208 - DNA, 18 bp, Homo sapiens
acttcaaatgtgtaactt

SEQ ID NO: 4798209 - DNA, 13 bp, Homo sapiens
acttcacaaaatg

SEQ ID NO: 4798210 - DNA, 18 bp, Homo sapiens
acttcagactctctcctc

SEQ ID NO: 4798211 - DNA, 9 bp, Homo sapiens
acttcagca

SEQ ID NO: 4798212 - DNA, 21 bp, Homo sapiens
acttcagcaaccctacagtat

SEQ ID NO: 4798213 - DNA, 18 bp, Homo sapiens
acttcagttctcatcttg

SEQ ID NO: 4798214 - DNA, 14 bp, Homo sapiens
acttccagctttct

SEQ ID NO: 4798215 - DNA, 18 bp, Homo sapiens
acttccccatctgtgtgt

SEQ ID NO: 4798216 - DNA, 21 bp, Homo sapiens
acttcctataccggagctcca

SEQ ID NO: 4798217 - DNA, 16 bp, Homo sapiens
acttcctattaattta

SEQ ID NO: 4798218 - DNA, 17 bp, Homo sapiens
acttcctattaatttat

SEQ ID NO: 4798219 - DNA, 22 bp, Homo sapiens
acttcgctattcccaggcaggg

SEQ ID NO: 4798220 - DNA, 19 bp, Homo sapiens
acttcgggggcggctctgg

SEQ ID NO: 4798221 - DNA, 15 bp, Homo sapiens
acttctaaaataaat

SEQ ID NO: 4798222 - DNA, 16 bp, Homo sapiens
acttctaaatcataat

SEQ ID NO: 4798223 - DNA, 22 bp, Homo sapiens
acttctattttcaagtggaaac

SEQ ID NO: 4798224 - DNA, 14 bp, Homo sapiens
acttctcatttatg

SEQ ID NO: 4798225 - DNA, 15 bp, Homo sapiens
acttctcatttatgt

SEQ ID NO: 4798226 - DNA, 15 bp, Homo sapiens
acttctgttatcagg

SEQ ID NO: 4798227 - DNA, 22 bp, Homo sapiens
acttcttcatccatagacacag

SEQ ID NO: 4798228 - DNA, 14 bp, Homo sapiens
acttcttctgtaat

SEQ ID NO: 4798229 - DNA, 23 bp, Homo sapiens
acttgaaaacttctcatttatgt

SEQ ID NO: 4798230 - DNA, 16 bp, Homo sapiens
acttgaaattatatct

SEQ ID NO: 4798231 - DNA, 16 bp, Homo sapiens
acttgaatagtattgt

SEQ ID NO: 4798232 - DNA, 16 bp, Homo sapiens
acttgacgcagccccc

SEQ ID NO: 4798233 - DNA, 19 bp, Homo sapiens
acttgagcccagagtgaac

SEQ ID NO: 4798234 - DNA, 18 bp, Homo sapiens
acttgatgtctgaggata

SEQ ID NO: 4798235 - DNA, 14 bp, Homo sapiens
acttgattaaggac

SEQ ID NO: 4798236 - DNA, 16 bp, Homo sapiens
acttgattaaggacta

SEQ ID NO: 4798237 - DNA, 17 bp, Homo sapiens
acttgccactgccataa

SEQ ID NO: 4798238 - DNA, 21 bp, Homo sapiens
acttgccctgaccatgcattt

SEQ ID NO: 4798239 - DNA, 14 bp, Homo sapiens
acttgctcctttcc

SEQ ID NO: 4798240 - DNA, 23 bp, Homo sapiens
acttgctcctttccatcagcttt

SEQ ID NO: 4798241 - DNA, 18 bp, Homo sapiens
acttgctgtgaaatgact

SEQ ID NO: 4798242 - DNA, 22 bp, Homo sapiens
acttgcttcttgtgtttgaaac

SEQ ID NO: 4798243 - DNA, 15 bp, Homo sapiens
acttggaatttgctt

SEQ ID NO: 4798244 - DNA, 23 bp, Homo sapiens
acttggataggagcttccagatg

SEQ ID NO: 4798245 - DNA, 18 bp, Homo sapiens
acttggggaaggggcctg

SEQ ID NO: 4798246 - DNA, 21 bp, Homo sapiens
acttggggaaggggcctgggc

SEQ ID NO: 4798247 - DNA, 23 bp, Homo sapiens
acttggggaaggggcctgggctg

SEQ ID NO: 4798248 - DNA, 17 bp, Homo sapiens
agaaagggcagcccctc

SEQ ID NO: 4798249 - DNA, 19 bp, Homo sapiens
agaaagggcagcccctccc

SEQ ID NO: 4798250 - DNA, 19 bp, Homo sapiens
agaaatatctgtgaaatat

SEQ ID NO: 4798251 - DNA, 19 bp, Homo sapiens
agaaatcccctaactgatt

SEQ ID NO: 4798252 - DNA, 20 bp, Homo sapiens
agaaatcccctaactgattt

SEQ ID NO: 4798253 - DNA, 20 bp, Homo sapiens
agaaatgccagtggtggagg

SEQ ID NO: 4798254 - DNA, 16 bp, Homo sapiens
agaaatggctttccac

SEQ ID NO: 4798255 - DNA, 16 bp, Homo sapiens
agaaatgtgctgcaaa

SEQ ID NO: 4798256 - DNA, 19 bp, Homo sapiens
agaaatgtgctgcaaagag

SEQ ID NO: 4798257 - DNA, 19 bp, Homo sapiens
agaaatgtggatgctcttt

SEQ ID NO: 4798258 - DNA, 13 bp, Homo sapiens
agaaattagggct

SEQ ID NO: 4798259 - DNA, 20 bp, Homo sapiens
agaaattagggctctaattt

SEQ ID NO: 4798260 - DNA, 11 bp, Homo sapiens
agaaattctat

SEQ ID NO: 4798261 - DNA, 23 bp, Homo sapiens
agaaattgacctgatttccattt

SEQ ID NO: 4798262 - DNA, 17 bp, Homo sapiens
agaaattgtgccaaaga

SEQ ID NO: 4798263 - DNA, 15 bp, Homo sapiens
agaacaaacctctat

SEQ ID NO: 4798264 - DNA, 22 bp, Homo sapiens
agaacaaatatgattctcctct

SEQ ID NO: 4798265 - DNA, 17 bp, Homo sapiens
agaacaaggaattgctt

SEQ ID NO: 4798266 - DNA, 18 bp, Homo sapiens
agaacagctaacaataaa

SEQ ID NO: 4798267 - DNA, 19 bp, Homo sapiens
agaacagctaacaataaag

SEQ ID NO: 4798268 - DNA, 17 bp, Homo sapiens
agaaccaacgggtctgt

SEQ ID NO: 4798269 - DNA, 16 bp, Homo sapiens
agaaccagcactccca

SEQ ID NO: 4798270 - DNA, 17 bp, Homo sapiens
agaaccagcactcccag

SEQ ID NO: 4798271 - DNA, 18 bp, Homo sapiens
agaaccaggaggcctggg

SEQ ID NO: 4798272 - DNA, 21 bp, Homo sapiens
agaacccatggaaaaatgcca

SEQ ID NO: 4798273 - DNA, 18 bp, Homo sapiens
agaaccccccgcaatgtg

SEQ ID NO: 4798274 - DNA, 21 bp, Homo sapiens
agaaccccccgcaatgtgctt

SEQ ID NO: 4798275 - DNA, 16 bp, Homo sapiens
agaacgcatgcagggc

SEQ ID NO: 4798276 - DNA, 13 bp, Homo sapiens
agaacggaagaag

SEQ ID NO: 4798277 - DNA, 14 bp, Homo sapiens
agaactaaatagat

SEQ ID NO: 4798278 - DNA, 15 bp, Homo sapiens
agaactcccttctcc

SEQ ID NO: 4798279 - DNA, 19 bp, Homo sapiens
agaactcccttctcccctc

SEQ ID NO: 4798280 - DNA, 15 bp, Homo sapiens
agaactcctttctaa

SEQ ID NO: 4798281 - DNA, 18 bp, Homo sapiens
agaactgacttcctgaac

SEQ ID NO: 4798282 - DNA, 12 bp, Homo sapiens
agaactgtgaat

SEQ ID NO: 4798283 - DNA, 13 bp, Homo sapiens
agaactgtgaata

SEQ ID NO: 4798284 - DNA, 18 bp, Homo sapiens
agaactgtgaatatgtgt

SEQ ID NO: 4798285 - DNA, 20 bp, Homo sapiens
agaactgtgaatatgtgtaa

SEQ ID NO: 4798286 - DNA, 15 bp, Homo sapiens
agaagagaatgcaca

SEQ ID NO: 4798287 - DNA, 17 bp, Homo sapiens
agaagaggcagattcaa

SEQ ID NO: 4798288 - DNA, 15 bp, Homo sapiens
agaagagtctattgt

SEQ ID NO: 4798289 - DNA, 22 bp, Homo sapiens
agaagagtctttgattcaccaa

SEQ ID NO: 4798290 - DNA, 16 bp, Homo sapiens
agaagatagttgtaaa

SEQ ID NO: 4798291 - DNA, 22 bp, Homo sapiens
agaagatgaaaatggaagtggc

SEQ ID NO: 4798292 - DNA, 16 bp, Homo sapiens
agaagcaccccaccac

SEQ ID NO: 4798293 - DNA, 22 bp, Homo sapiens
agaagcagcagctagaaagaga

SEQ ID NO: 4798294 - DNA, 17 bp, Homo sapiens
agaagcccattaaaata

SEQ ID NO: 4798295 - DNA, 14 bp, Homo sapiens
agaagcttgtatta

SEQ ID NO: 4798296 - DNA, 11 bp, Homo sapiens
agaaggaaggc

SEQ ID NO: 4798297 - DNA, 17 bp, Homo sapiens
agaaggaaggcagggag

SEQ ID NO: 4798298 - DNA, 16 bp, Homo sapiens
agaaggactgaagaaa

SEQ ID NO: 4798299 - DNA, 23 bp, Homo sapiens
agaaggcccgggaggaggatccg

SEQ ID NO: 4798300 - DNA, 16 bp, Homo sapiens
agaaggcctgcccccc

SEQ ID NO: 4798301 - DNA, 21 bp, Homo sapiens
aaacctcagttggcctctgcc

SEQ ID NO: 4798302 - DNA, 22 bp, Homo sapiens
aaacctcagttggcctctgccc

SEQ ID NO: 4798303 - DNA, 20 bp, Homo sapiens
aaacctctttcggaaatgat

SEQ ID NO: 4798304 - DNA, 13 bp, Homo sapiens
aaacctgtgcttt

SEQ ID NO: 4798305 - DNA, 16 bp, Homo sapiens
aaaccttcttttcaat

SEQ ID NO: 4798306 - DNA, 22 bp, Homo sapiens
aaaccttcttttcaatgcaatg

SEQ ID NO: 4798307 - DNA, 12 bp, Homo sapiens
aaacgccatgtc

SEQ ID NO: 4798308 - DNA, 18 bp, Homo sapiens
aaactactgcctttcaaa

SEQ ID NO: 4798309 - DNA, 17 bp, Homo sapiens
aaactatcagcagcggc

SEQ ID NO: 4798310 - DNA, 21 bp, Homo sapiens
aaactcatacagtctctattt

SEQ ID NO: 4798311 - DNA, 11 bp, Homo sapiens
aaactgccaca

SEQ ID NO: 4798312 - DNA, 13 bp, Homo sapiens
aaactggaaacat

SEQ ID NO: 4798313 - DNA, 15 bp, Homo sapiens
aaactggaataagaa

SEQ ID NO: 4798314 - DNA, 10 bp, Homo sapiens
aaactgtgac

SEQ ID NO: 4798315 - DNA, 12 bp, Homo sapiens
aaactgtgacat

SEQ ID NO: 4798316 - DNA, 14 bp, Homo sapiens
aaactgtgacattc

SEQ ID NO: 4798317 - DNA, 20 bp, Homo sapiens
aaactgtgagataaatatca

SEQ ID NO: 4798318 - DNA, 21 bp, Homo sapiens
aaactgtgagataaatatcat

SEQ ID NO: 4798319 - DNA, 22 bp, Homo sapiens
aaactgttcaagaaataataaa

SEQ ID NO: 4798320 - DNA, 18 bp, Homo sapiens
aaacttctgaactttgga

SEQ ID NO: 4798321 - DNA, 20 bp, Homo sapiens
aaacttggtgcttattgata

SEQ ID NO: 4798322 - DNA, 23 bp, Homo sapiens
aaacttgtacttacactgaaatc

SEQ ID NO: 4798323 - DNA, 23 bp, Homo sapiens
aaacttgtgttcaatctgtgaag

SEQ ID NO: 4798324 - DNA, 15 bp, Homo sapiens
aaactttattttata

SEQ ID NO: 4798325 - DNA, 21 bp, Homo sapiens
aaactttattttatataataa

SEQ ID NO: 4798326 - DNA, 16 bp, Homo sapiens
aaactttccatgacag

SEQ ID NO: 4798327 - DNA, 22 bp, Homo sapiens
aaactttggaagttttacttga

SEQ ID NO: 4798328 - DNA, 11 bp, Homo sapiens
aaactttgtca

SEQ ID NO: 4798329 - DNA, 15 bp, Homo sapiens
aaactttgtcacttc

SEQ ID NO: 4798330 - DNA, 17 bp, Homo sapiens
aaacttttataaatgtt

SEQ ID NO: 4798331 - DNA, 21 bp, Homo sapiens
aaacttttataaatgttttaa

SEQ ID NO: 4798332 - DNA, 17 bp, Homo sapiens
aaacttttataaattaa

SEQ ID NO: 4798333 - DNA, 18 bp, Homo sapiens
aaacttttataaattaaa

SEQ ID NO: 4798334 - DNA, 13 bp, Homo sapiens
aaagaaaacagac

SEQ ID NO: 4798335 - DNA, 17 bp, Homo sapiens
aaagaaatcagctttgt

SEQ ID NO: 4798336 - DNA, 23 bp, Homo sapiens
aaagaacagcacagtcttttcct

SEQ ID NO: 4798337 - DNA, 15 bp, Homo sapiens
aaagaaccaggaggc

SEQ ID NO: 4798338 - DNA, 17 bp, Homo sapiens
aaagaacccccctcccc

SEQ ID NO: 4798339 - DNA, 17 bp, Homo sapiens
aaagaagtccatgtgat

SEQ ID NO: 4798340 - DNA, 22 bp, Homo sapiens
aaagaatcacctaattaatttc

SEQ ID NO: 4798341 - DNA, 16 bp, Homo sapiens
aaagaatccctgttca

SEQ ID NO: 4798342 - DNA, 22 bp, Homo sapiens
aaagaatccctgttcattgtaa

SEQ ID NO: 4798343 - DNA, 20 bp, Homo sapiens
aaagacaaatatttctttct

SEQ ID NO: 4798344 - DNA, 16 bp, Homo sapiens
aaagaccatgcattca

SEQ ID NO: 4798345 - DNA, 18 bp, Homo sapiens
aaagaccatgcattcaga

SEQ ID NO: 4798346 - DNA, 18 bp, Homo sapiens
aaagaccctaggtgctca

SEQ ID NO: 4798347 - DNA, 18 bp, Homo sapiens
aaagacttcaaatgttat

SEQ ID NO: 4798348 - DNA, 21 bp, Homo sapiens
aaagaggcgtcttgtattttc

SEQ ID NO: 4798349 - DNA, 13 bp, Homo sapiens
aaagaggctatgt

SEQ ID NO: 4798350 - DNA, 13 bp, Homo sapiens
aaagatagcagaa

SEQ ID NO: 4798351 - DNA, 17 bp, Homo sapiens
aaagataggtatggaaa

SEQ ID NO: 4798352 - DNA, 13 bp, Homo sapiens
aaagatattgtat

SEQ ID NO: 4798353 - DNA, 13 bp, Homo sapiens
aaagatccattta

SEQ ID NO: 4798354 - DNA, 19 bp, Homo sapiens
aaagatccatttaaaacaa

SEQ ID NO: 4798355 - DNA, 18 bp, Homo sapiens
aaagatctcctgtgcacc

SEQ ID NO: 4798356 - DNA, 21 bp, Homo sapiens
aaagatgcagccgccttcctt

SEQ ID NO: 4798357 - DNA, 13 bp, Homo sapiens
aaagatggaagtg

SEQ ID NO: 4798358 - DNA, 12 bp, Homo sapiens
aaagatggattt

SEQ ID NO: 4798359 - DNA, 15 bp, Homo sapiens
aaagattccatgggt

SEQ ID NO: 4798360 - DNA, 13 bp, Homo sapiens
aaagcaactttcc

SEQ ID NO: 4798361 - DNA, 22 bp, Homo sapiens
aaagcactggccttgcctccag

SEQ ID NO: 4798362 - DNA, 23 bp, Homo sapiens
aaagcactggccttgcctccagg

SEQ ID NO: 4798363 - DNA, 18 bp, Homo sapiens
aaagcagagatgtattat

SEQ ID NO: 4798364 - DNA, 17 bp, Homo sapiens
aaagcagcctggccaac

SEQ ID NO: 4798365 - DNA, 23 bp, Homo sapiens
aaagcagtatgtacaggctgaga

SEQ ID NO: 4798366 - DNA, 16 bp, Homo sapiens
aaagcagtgcatgctg

SEQ ID NO: 4798367 - DNA, 22 bp, Homo sapiens
aaagcagtgcatgctgtccctt

SEQ ID NO: 4798368 - DNA, 17 bp, Homo sapiens
aaagcatattgactttt

SEQ ID NO: 4798369 - DNA, 18 bp, Homo sapiens
aaagcatgctcagtattg

SEQ ID NO: 4798370 - DNA, 10 bp, Homo sapiens
aaagccacat

SEQ ID NO: 4798371 - DNA, 18 bp, Homo sapiens
aaagccacataaccagcg

SEQ ID NO: 4798372 - DNA, 12 bp, Homo sapiens
aaagccctccct

SEQ ID NO: 4798373 - DNA, 15 bp, Homo sapiens
aaagccctccctgtc

SEQ ID NO: 4798374 - DNA, 17 bp, Homo sapiens
aaagcctctgtgctgca

SEQ ID NO: 4798375 - DNA, 13 bp, Homo sapiens
aaagctgccagcc

SEQ ID NO: 4798376 - DNA, 22 bp, Homo sapiens
aaagctgccagccgagatagcc

SEQ ID NO: 4798377 - DNA, 18 bp, Homo sapiens
aaaggaggcatgcctctg

SEQ ID NO: 4798378 - DNA, 16 bp, Homo sapiens
aaaggatgatttaaca

SEQ ID NO: 4798379 - DNA, 15 bp, Homo sapiens
aaaggcagagattgg

SEQ ID NO: 4798380 - DNA, 16 bp, Homo sapiens
aaaggcagagattggg

SEQ ID NO: 4798381 - DNA, 11 bp, Homo sapiens
aaaggcagggc

SEQ ID NO: 4798382 - DNA, 23 bp, Homo sapiens
aaaggctgcagctaatttgtgaa

SEQ ID NO: 4798383 - DNA, 13 bp, Homo sapiens
aaaggcttctcca

SEQ ID NO: 4798384 - DNA, 18 bp, Homo sapiens
aaaggcttgagtctggat

SEQ ID NO: 4798385 - DNA, 15 bp, Homo sapiens
aaagggaagccctga

SEQ ID NO: 4798386 - DNA, 18 bp, Homo sapiens
aaagggagccatgctctt

SEQ ID NO: 4798387 - DNA, 19 bp, Homo sapiens
aaagggcagcccctcccca

SEQ ID NO: 4798388 - DNA, 22 bp, Homo sapiens
aaagggcagcccctccccatgg

SEQ ID NO: 4798389 - DNA, 15 bp, Homo sapiens
aaagggcattttgta

SEQ ID NO: 4798390 - DNA, 12 bp, Homo sapiens
aaaggtggtggt

SEQ ID NO: 4798391 - DNA, 14 bp, Homo sapiens
aaaggttactgttt

SEQ ID NO: 4798392 - DNA, 15 bp, Homo sapiens
aaaggttcttcatcc

SEQ ID NO: 4798393 - DNA, 21 bp, Homo sapiens
aaaggttcttcatccctttcc

SEQ ID NO: 4798394 - DNA, 22 bp, Homo sapiens
aaagtaaaacagatttgttcat

SEQ ID NO: 4798395 - DNA, 23 bp, Homo sapiens
aaagtaaaacagatttgttcatt

SEQ ID NO: 4798396 - DNA, 12 bp, Homo sapiens
aaagtaatttac

SEQ ID NO: 4798397 - DNA, 14 bp, Homo sapiens
aaagtatatacaga

SEQ ID NO: 4798398 - DNA, 16 bp, Homo sapiens
aaagtatatacagagc

SEQ ID NO: 4798399 - DNA, 14 bp, Homo sapiens
aaagtattccacct

SEQ ID NO: 4798400 - DNA, 20 bp, Homo sapiens
aaagtattccaccttaaatt

SEQ ID NO: 4798401 - DNA, 15 bp, Homo sapiens
aaagtcaaactttca

SEQ ID NO: 4798402 - DNA, 15 bp, Homo sapiens
aaagtcagatgacta

SEQ ID NO: 4798403 - DNA, 14 bp, Homo sapiens
aaagtcagatgttt

SEQ ID NO: 4798404 - DNA, 19 bp, Homo sapiens
aaagtctcaatgttccatt

SEQ ID NO: 4798405 - DNA, 22 bp, Homo sapiens
aaagtgaaattagtattttgag

SEQ ID NO: 4798406 - DNA, 15 bp, Homo sapiens
aaagtgaccagcata

SEQ ID NO: 4798407 - DNA, 17 bp, Homo sapiens
aaagtgttgtcttattc

SEQ ID NO: 4798408 - DNA, 20 bp, Homo sapiens
aaagttaaacgtgatgtgct

SEQ ID NO: 4798409 - DNA, 21 bp, Homo sapiens
aaagttacctggaatcaaata

SEQ ID NO: 4798410 - DNA, 21 bp, Homo sapiens
aaagttctattatctgggttt

SEQ ID NO: 4798411 - DNA, 13 bp, Homo sapiens
aaataaaaattct

SEQ ID NO: 4798412 - DNA, 14 bp, Homo sapiens
aaataaaaccagaa

SEQ ID NO: 4798413 - DNA, 14 bp, Homo sapiens
aaataaaagaaaga

SEQ ID NO: 4798414 - DNA, 19 bp, Homo sapiens
aaataaacacatagattca

SEQ ID NO: 4798415 - DNA, 14 bp, Homo sapiens
aaataaaccttaat

SEQ ID NO: 4798416 - DNA, 24 bp, Homo sapiens
aaataaagagttctccttgtactt

SEQ ID NO: 4798417 - DNA, 15 bp, Homo sapiens
aaataaataatctca

SEQ ID NO: 4798418 - DNA, 12 bp, Homo sapiens
aaataaatatca

SEQ ID NO: 4798419 - DNA, 13 bp, Homo sapiens
aaataaatctaaa

SEQ ID NO: 4798420 - DNA, 16 bp, Homo sapiens
aaataaatgttttgga

SEQ ID NO: 4798421 - DNA, 19 bp, Homo sapiens
aaataaccctgaatcagag

SEQ ID NO: 4798422 - DNA, 14 bp, Homo sapiens
aaataataaaagaa

SEQ ID NO: 4798423 - DNA, 16 bp, Homo sapiens
aacccatcactgtgtc

SEQ ID NO: 4798424 - DNA, 21 bp, Homo sapiens
aacccatgagcgtccaggtga

SEQ ID NO: 4798425 - DNA, 16 bp, Homo sapiens
aacccccacctcccgg

SEQ ID NO: 4798426 - DNA, 16 bp, Homo sapiens
aacccccatttttgta

SEQ ID NO: 4798427 - DNA, 15 bp, Homo sapiens
aaccctataaaagtg

SEQ ID NO: 4798428 - DNA, 13 bp, Homo sapiens
aaccctgcttctg

SEQ ID NO: 4798429 - DNA, 20 bp, Homo sapiens
aaccctgcttctgctgccct

SEQ ID NO: 4798430 - DNA, 13 bp, Homo sapiens
aacccttctttta

SEQ ID NO: 4798431 - DNA, 15 bp, Homo sapiens
aaccgggaaaggcat

SEQ ID NO: 4798432 - DNA, 15 bp, Homo sapiens
aaccgggactacaga

SEQ ID NO: 4798433 - DNA, 17 bp, Homo sapiens
aaccgggactacagaag

SEQ ID NO: 4798434 - DNA, 23 bp, Homo sapiens
aaccgtcaatgtgaaataaagag

SEQ ID NO: 4798435 - DNA, 15 bp, Homo sapiens
aacctaccttataga

SEQ ID NO: 4798436 - DNA, 21 bp, Homo sapiens
aacctaccttatagagcacaa

SEQ ID NO: 4798437 - DNA, 17 bp, Homo sapiens
aacctcccctggtcctg

SEQ ID NO: 4798438 - DNA, 16 bp, Homo sapiens
aacctctacaggcatt

SEQ ID NO: 4798439 - DNA, 15 bp, Homo sapiens
aacctctcagatccc

SEQ ID NO: 4798440 - DNA, 19 bp, Homo sapiens
aacctctctgaactgcaac

SEQ ID NO: 4798441 - DNA, 20 bp, Homo sapiens
aacctctgatttattttgta

SEQ ID NO: 4798442 - DNA, 17 bp, Homo sapiens
aacctgccacaatgtga

SEQ ID NO: 4798443 - DNA, 22 bp, Homo sapiens
aacctgccacaatgtgatatgt

SEQ ID NO: 4798444 - DNA, 15 bp, Homo sapiens
aacctggaggctgga

SEQ ID NO: 4798445 - DNA, 17 bp, Homo sapiens
aacctggggttttgact

SEQ ID NO: 4798446 - DNA, 18 bp, Homo sapiens
aacctgtgctttcatgtt

SEQ ID NO: 4798447 - DNA, 12 bp, Homo sapiens
aacctgtgtctc

SEQ ID NO: 4798448 - DNA, 13 bp, Homo sapiens
aacctgttcctga

SEQ ID NO: 4798449 - DNA, 18 bp, Homo sapiens
aaccttaatatttcttca

SEQ ID NO: 4798450 - DNA, 17 bp, Homo sapiens
aaccttaatttgaaata

SEQ ID NO: 4798451 - DNA, 15 bp, Homo sapiens
aaccttacttaaagc

SEQ ID NO: 4798452 - DNA, 13 bp, Homo sapiens
aaccttccctcca

SEQ ID NO: 4798453 - DNA, 15 bp, Homo sapiens
aaccttcttttcaat

SEQ ID NO: 4798454 - DNA, 20 bp, Homo sapiens
aaccttcttttcaatgcaat

SEQ ID NO: 4798455 - DNA, 21 bp, Homo sapiens
aaccttcttttcaatgcaatg

SEQ ID NO: 4798456 - DNA, 22 bp, Homo sapiens
aaccttcttttcaatgcaatgc

SEQ ID NO: 4798457 - DNA, 18 bp, Homo sapiens
aaccttgtactttacaat

SEQ ID NO: 4798458 - DNA, 16 bp, Homo sapiens
aaccttttgagtgcct

SEQ ID NO: 4798459 - DNA, 16 bp, Homo sapiens
aacgaacatggcatgt

SEQ ID NO: 4798460 - DNA, 17 bp, Homo sapiens
aacgaccgacgcccctc

SEQ ID NO: 4798461 - DNA, 19 bp, Homo sapiens
aacgaccgacgcccctccg

SEQ ID NO: 4798462 - DNA, 12 bp, Homo sapiens
aacgcacaggaa

SEQ ID NO: 4798463 - DNA, 18 bp, Homo sapiens
aacgctgctccatgcaca

SEQ ID NO: 4798464 - DNA, 23 bp, Homo sapiens
aacgctgctccatgcacaggaaa

SEQ ID NO: 4798465 - DNA, 14 bp, Homo sapiens
aacggaagaagaga

SEQ ID NO: 4798466 - DNA, 13 bp, Homo sapiens
aacgggtctgtgg

SEQ ID NO: 4798467 - DNA, 17 bp, Homo sapiens
aacgtgaggtttcagta

SEQ ID NO: 4798468 - DNA, 18 bp, Homo sapiens
aacgtgggagttcagctg

SEQ ID NO: 4798469 - DNA, 17 bp, Homo sapiens
aacgttcatgttcatct

SEQ ID NO: 4798470 - DNA, 20 bp, Homo sapiens
aacgttcatgttcatctcag

SEQ ID NO: 4798471 - DNA, 17 bp, Homo sapiens
aactaagttgtatttta

SEQ ID NO: 4798472 - DNA, 18 bp, Homo sapiens
aactaatgacaagtgact

SEQ ID NO: 4798473 - DNA, 22 bp, Homo sapiens
aactaccgttcccaaattggtg

SEQ ID NO: 4798474 - DNA, 19 bp, Homo sapiens
aactagagtatgtgtatgt

SEQ ID NO: 4798475 - DNA, 20 bp, Homo sapiens
aactagagtatgtgtatgta

SEQ ID NO: 4798476 - DNA, 19 bp, Homo sapiens
aactatggtaaataactgt

SEQ ID NO: 4798477 - DNA, 20 bp, Homo sapiens
aactatggtaaataactgtg

SEQ ID NO: 4798478 - DNA, 22 bp, Homo sapiens
aactatggtaaataactgtgac

SEQ ID NO: 4798479 - DNA, 16 bp, Homo sapiens
aactcacctgcccctc

SEQ ID NO: 4798480 - DNA, 22 bp, Homo sapiens
aactcatacagtctctatttga

SEQ ID NO: 4798481 - DNA, 15 bp, Homo sapiens
aactccaaggcaaat

SEQ ID NO: 4798482 - DNA, 18 bp, Homo sapiens
aactccaaggcaaatgtc

SEQ ID NO: 4798483 - DNA, 19 bp, Homo sapiens
aactccaaggcaaatgtcc

SEQ ID NO: 4798484 - DNA, 13 bp, Homo sapiens
aactccaggaaaa

SEQ ID NO: 4798485 - DNA, 22 bp, Homo sapiens
aactccagggttaaagaaaggc

SEQ ID NO: 4798486 - DNA, 14 bp, Homo sapiens
aactccctcctccc

SEQ ID NO: 4798487 - DNA, 19 bp, Homo sapiens
aactcccttctcccctcag

SEQ ID NO: 4798488 - DNA, 15 bp, Homo sapiens
aactccgtttccaaa

SEQ ID NO: 4798489 - DNA, 18 bp, Homo sapiens
aactctatctgggcctgg

SEQ ID NO: 4798490 - DNA, 21 bp, Homo sapiens
aactctatctgggcctgggct

SEQ ID NO: 4798491 - DNA, 18 bp, Homo sapiens
aactctcctccagagtca

SEQ ID NO: 4798492 - DNA, 19 bp, Homo sapiens
aactctctagtgcaggaaa

SEQ ID NO: 4798493 - DNA, 18 bp, Homo sapiens
aactctgcatagacaaag

SEQ ID NO: 4798494 - DNA, 19 bp, Homo sapiens
aactcttcaaggtctgctt

SEQ ID NO: 4798495 - DNA, 11 bp, Homo sapiens
aactgacacag

SEQ ID NO: 4798496 - DNA, 14 bp, Homo sapiens
aactgacacaggaa

SEQ ID NO: 4798497 - DNA, 13 bp, Homo sapiens
aactgacttgctg

SEQ ID NO: 4798498 - DNA, 14 bp, Homo sapiens
aactgatgctttca

SEQ ID NO: 4798499 - DNA, 16 bp, Homo sapiens
aactgatgctttcaga

SEQ ID NO: 4798500 - DNA, 15 bp, Homo sapiens
aactgcaacactgga

SEQ ID NO: 4798501 - DNA, 22 bp, Homo sapiens
aactggccctcgggccctctct

SEQ ID NO: 4798502 - DNA, 16 bp, Homo sapiens
aactgtatatttgtat

SEQ ID NO: 4798503 - DNA, 22 bp, Homo sapiens
aactgtatttacttgttatgtt

SEQ ID NO: 4798504 - DNA, 15 bp, Homo sapiens
aactgtcattacaga

SEQ ID NO: 4798505 - DNA, 18 bp, Homo sapiens
aactgtgagataaatatc

SEQ ID NO: 4798506 - DNA, 16 bp, Homo sapiens
aactgtggataaattt

SEQ ID NO: 4798507 - DNA, 14 bp, Homo sapiens
aactgtttatggta

SEQ ID NO: 4798508 - DNA, 19 bp, Homo sapiens
aactgtttatggtattttc

SEQ ID NO: 4798509 - DNA, 18 bp, Homo sapiens
aacttaaacctgtgcttt

SEQ ID NO: 4798510 - DNA, 17 bp, Homo sapiens
aacttaatgaagaaata

SEQ ID NO: 4798511 - DNA, 13 bp, Homo sapiens
aacttattttgat

SEQ ID NO: 4798512 - DNA, 15 bp, Homo sapiens
aacttattttgattg

SEQ ID NO: 4798513 - DNA, 18 bp, Homo sapiens
aacttcatgctgtctgtg

SEQ ID NO: 4798514 - DNA, 13 bp, Homo sapiens
aacttcatgcttg

SEQ ID NO: 4798515 - DNA, 23 bp, Homo sapiens
aacttccaggttccatccaccac

SEQ ID NO: 4798516 - DNA, 18 bp, Homo sapiens
aacttcctttgagaattg

SEQ ID NO: 4798517 - DNA, 17 bp, Homo sapiens
aacttgctcctttccat

SEQ ID NO: 4798518 - DNA, 19 bp, Homo sapiens
aacttgctcctttccatca

SEQ ID NO: 4798519 - DNA, 17 bp, Homo sapiens
aacttggcgctgcccct

SEQ ID NO: 4798520 - DNA, 15 bp, Homo sapiens
aacttggggaagggg

SEQ ID NO: 4798521 - DNA, 17 bp, Homo sapiens
aacttggggaaggggcc

SEQ ID NO: 4798522 - DNA, 15 bp, Homo sapiens
aactttagaaataaa

SEQ ID NO: 4798523 - DNA, 16 bp, Homo sapiens
aactttccatgacagt

SEQ ID NO: 4798524 - DNA, 19 bp, Homo sapiens
aactttccatgacagtagc

SEQ ID NO: 4798525 - DNA, 23 bp, Homo sapiens
aactttggaagttttacttgatt

SEQ ID NO: 4798526 - DNA, 20 bp, Homo sapiens
aactttgtcacttctgctgt

SEQ ID NO: 4798527 - DNA, 16 bp, Homo sapiens
aacttttataaattaa

SEQ ID NO: 4798528 - DNA, 18 bp, Homo sapiens
aacttttataaattaaat

SEQ ID NO: 4798529 - DNA, 21 bp, Homo sapiens
aacttttttttttttttggtt

SEQ ID NO: 4798530 - DNA, 17 bp, Homo sapiens
aagaaaaaaaaaatgat

SEQ ID NO: 4798531 - DNA, 12 bp, Homo sapiens
aagaaaaatgtg

SEQ ID NO: 4798532 - DNA, 20 bp, Homo sapiens
aagaaaagaatccctgttca

SEQ ID NO: 4798533 - DNA, 14 bp, Homo sapiens
aagaaaatggatga

SEQ ID NO: 4798534 - DNA, 15 bp, Homo sapiens
aagaaacaaaatata

SEQ ID NO: 4798535 - DNA, 16 bp, Homo sapiens
aagaaacagtttaaca

SEQ ID NO: 4798536 - DNA, 12 bp, Homo sapiens
aagaaagaaatg

SEQ ID NO: 4798537 - DNA, 16 bp, Homo sapiens
aagaaagatgctgatg

SEQ ID NO: 4798538 - DNA, 16 bp, Homo sapiens
aagaaaggaaaccttt

SEQ ID NO: 4798539 - DNA, 17 bp, Homo sapiens
aagaaagggagaaggat

SEQ ID NO: 4798540 - DNA, 14 bp, Homo sapiens
aagaaatgagaaat

SEQ ID NO: 4798541 - DNA, 22 bp, Homo sapiens
aagaacccccctccccaaggaa

SEQ ID NO: 4798542 - DNA, 14 bp, Homo sapiens
aagaacggaagaag

SEQ ID NO: 4798543 - DNA, 21 bp, Homo sapiens
aagaactcccttctcccctca

SEQ ID NO: 4798544 - DNA, 21 bp, Homo sapiens
aagaagaactcaccagggttt

SEQ ID NO: 4798545 - DNA, 15 bp, Homo sapiens
aagttataccagcaa

SEQ ID NO: 4798546 - DNA, 13 bp, Homo sapiens
aagttatagtact

SEQ ID NO: 4798547 - DNA, 14 bp, Homo sapiens
aagttctattatct

SEQ ID NO: 4798548 - DNA, 15 bp, Homo sapiens
aagttgaagggaaat

SEQ ID NO: 4798549 - DNA, 12 bp, Homo sapiens
aagttgaccttt

SEQ ID NO: 4798550 - DNA, 13 bp, Homo sapiens
aagttgaccttta

SEQ ID NO: 4798551 - DNA, 21 bp, Homo sapiens
aagttgcagtcagaagatctt

SEQ ID NO: 4798552 - DNA, 13 bp, Homo sapiens
aagttggaaggga

SEQ ID NO: 4798553 - DNA, 14 bp, Homo sapiens
aagttggttttgta

SEQ ID NO: 4798554 - DNA, 22 bp, Homo sapiens
aagttggttttgtaaaattcca

SEQ ID NO: 4798555 - DNA, 22 bp, Homo sapiens
aagttgtattttaataaagatt

SEQ ID NO: 4798556 - DNA, 15 bp, Homo sapiens
aagttgtcctttctg

SEQ ID NO: 4798557 - DNA, 12 bp, Homo sapiens
aagttgtgtgct

SEQ ID NO: 4798558 - DNA, 19 bp, Homo sapiens
aagttgtgtgctattcgta

SEQ ID NO: 4798559 - DNA, 14 bp, Homo sapiens
aagtttaaatcttt

SEQ ID NO: 4798560 - DNA, 18 bp, Homo sapiens
aagtttaaatctttgtta

SEQ ID NO: 4798561 - DNA, 13 bp, Homo sapiens
aagtttcatttat

SEQ ID NO: 4798562 - DNA, 13 bp, Homo sapiens
aagtttctttgag

SEQ ID NO: 4798563 - DNA, 22 bp, Homo sapiens
aagtttctttgagggttccatg

SEQ ID NO: 4798564 - DNA, 22 bp, Homo sapiens
aagtttggaagtacataaagta

SEQ ID NO: 4798565 - DNA, 24 bp, Homo sapiens
aataaaaatagctataaatagtga

SEQ ID NO: 4798566 - DNA, 13 bp, Homo sapiens
aataaaaattcta

SEQ ID NO: 4798567 - DNA, 14 bp, Homo sapiens
aataaaacattagt

SEQ ID NO: 4798568 - DNA, 19 bp, Homo sapiens
aataaaaccagaaagagga

SEQ ID NO: 4798569 - DNA, 17 bp, Homo sapiens
aataaaactcccttcct

SEQ ID NO: 4798570 - DNA, 20 bp, Homo sapiens
aataaaatgtttatttttgc

SEQ ID NO: 4798571 - DNA, 13 bp, Homo sapiens
aataaaattcatt

SEQ ID NO: 4798572 - DNA, 17 bp, Homo sapiens
aataaaattcattccat

SEQ ID NO: 4798573 - DNA, 18 bp, Homo sapiens
aataaacacatagattca

SEQ ID NO: 4798574 - DNA, 21 bp, Homo sapiens
aataaacacatagattcacct

SEQ ID NO: 4798575 - DNA, 17 bp, Homo sapiens
aataaaccggatcctgt

SEQ ID NO: 4798576 - DNA, 21 bp, Homo sapiens
aataaactccccagcgtatcc

SEQ ID NO: 4798577 - DNA, 19 bp, Homo sapiens
aataaaggttctatgatat

SEQ ID NO: 4798578 - DNA, 11 bp, Homo sapiens
aataaataatc

SEQ ID NO: 4798579 - DNA, 12 bp, Homo sapiens
aataaatctaaa

SEQ ID NO: 4798580 - DNA, 20 bp, Homo sapiens
aataaatgtcccaaataaat

SEQ ID NO: 4798581 - DNA, 13 bp, Homo sapiens
aataaatgtgtaa

SEQ ID NO: 4798582 - DNA, 21 bp, Homo sapiens
aataaatttataacaattgat

SEQ ID NO: 4798583 - DNA, 16 bp, Homo sapiens
aataaccgtaaaggtt

SEQ ID NO: 4798584 - DNA, 15 bp, Homo sapiens
aataactagatctcc

SEQ ID NO: 4798585 - DNA, 22 bp, Homo sapiens
aataactagatctcctgtaatt

SEQ ID NO: 4798586 - DNA, 14 bp, Homo sapiens
aataactatggtaa

SEQ ID NO: 4798587 - DNA, 22 bp, Homo sapiens
aataactatggtaaataactgt

SEQ ID NO: 4798588 - DNA, 20 bp, Homo sapiens
aataactggatattctttat

SEQ ID NO: 4798589 - DNA, 15 bp, Homo sapiens
aataagaagcaaata

SEQ ID NO: 4798590 - DNA, 14 bp, Homo sapiens
aataaggatttatt

SEQ ID NO: 4798591 - DNA, 18 bp, Homo sapiens
aataaggatttattctca

SEQ ID NO: 4798592 - DNA, 20 bp, Homo sapiens
aataaggatttattctcaga

SEQ ID NO: 4798593 - DNA, 20 bp, Homo sapiens
aataatgattcaatgtgaat

SEQ ID NO: 4798594 - DNA, 14 bp, Homo sapiens
aataatgatttaag

SEQ ID NO: 4798595 - DNA, 16 bp, Homo sapiens
aataatgcctttgtaa

SEQ ID NO: 4798596 - DNA, 15 bp, Homo sapiens
aataattatatgaag

SEQ ID NO: 4798597 - DNA, 22 bp, Homo sapiens
aatacaacacattgaaactgta

SEQ ID NO: 4798598 - DNA, 14 bp, Homo sapiens
aatacagtattatt

SEQ ID NO: 4798599 - DNA, 23 bp, Homo sapiens
aatacagtattatttagtaaaat

SEQ ID NO: 4798600 - DNA, 17 bp, Homo sapiens
aatacatgatgatttca

SEQ ID NO: 4798601 - DNA, 21 bp, Homo sapiens
aatacattattggacttccat

SEQ ID NO: 4798602 - DNA, 16 bp, Homo sapiens
aataccagactgcagg

SEQ ID NO: 4798603 - DNA, 20 bp, Homo sapiens
aatactattggacagacaca

SEQ ID NO: 4798604 - DNA, 22 bp, Homo sapiens
aatactattggacagacacaga

SEQ ID NO: 4798605 - DNA, 12 bp, Homo sapiens
aatactgtattg

SEQ ID NO: 4798606 - DNA, 23 bp, Homo sapiens
aatactgtattgttacagctgaa

SEQ ID NO: 4798607 - DNA, 23 bp, Homo sapiens
aatactttgtatacaagtactgg

SEQ ID NO: 4798608 - DNA, 14 bp, Homo sapiens
aatagccccatctc

SEQ ID NO: 4798609 - DNA, 14 bp, Homo sapiens
aatagcctcacctt

SEQ ID NO: 4798610 - DNA, 18 bp, Homo sapiens
aatagctataaatagtga

SEQ ID NO: 4798611 - DNA, 21 bp, Homo sapiens
aatagcttttcacttcttaag

SEQ ID NO: 4798612 - DNA, 13 bp, Homo sapiens
aataggcttgtgt

SEQ ID NO: 4798613 - DNA, 19 bp, Homo sapiens
aatagtaaataatgattca

SEQ ID NO: 4798614 - DNA, 16 bp, Homo sapiens
aatagttccattctat

SEQ ID NO: 4798615 - DNA, 19 bp, Homo sapiens
aatagttccattctatgac

SEQ ID NO: 4798616 - DNA, 22 bp, Homo sapiens
aatagtttctaaaccatgaaaa

SEQ ID NO: 4798617 - DNA, 17 bp, Homo sapiens
aatataaactgtgagat

SEQ ID NO: 4798618 - DNA, 21 bp, Homo sapiens
aatataaactgtgagataaat

SEQ ID NO: 4798619 - DNA, 19 bp, Homo sapiens
aatataaataaataaaaat

SEQ ID NO: 4798620 - DNA, 14 bp, Homo sapiens
aatataaatcacag

SEQ ID NO: 4798621 - DNA, 19 bp, Homo sapiens
aatataaatcacagatttc

SEQ ID NO: 4798622 - DNA, 15 bp, Homo sapiens
aatataaatgaatga

SEQ ID NO: 4798623 - DNA, 22 bp, Homo sapiens
aatataaatgaatgaaatataa

SEQ ID NO: 4798624 - DNA, 11 bp, Homo sapiens
aatataaatgt

SEQ ID NO: 4798625 - DNA, 19 bp, Homo sapiens
aatataaatgtactacatt

SEQ ID NO: 4798626 - DNA, 12 bp, Homo sapiens
aatataaatgtg

SEQ ID NO: 4798627 - DNA, 13 bp, Homo sapiens
aatataaatgtgt

SEQ ID NO: 4798628 - DNA, 15 bp, Homo sapiens
aatataacatgaaag

SEQ ID NO: 4798629 - DNA, 12 bp, Homo sapiens
aatataagacaa

SEQ ID NO: 4798630 - DNA, 13 bp, Homo sapiens
aatatacaacttt

SEQ ID NO: 4798631 - DNA, 16 bp, Homo sapiens
aatatacactttacat

SEQ ID NO: 4798632 - DNA, 17 bp, Homo sapiens
aatatactcatttggat

SEQ ID NO: 4798633 - DNA, 23 bp, Homo sapiens
aatatagggtttgtttgctgctt

SEQ ID NO: 4798634 - DNA, 14 bp, Homo sapiens
aatatatatttatc

SEQ ID NO: 4798635 - DNA, 12 bp, Homo sapiens
aatatatgtatg

SEQ ID NO: 4798636 - DNA, 13 bp, Homo sapiens
aatatatgtatgt

SEQ ID NO: 4798637 - DNA, 19 bp, Homo sapiens
aatatatgtatgtaaaaat

SEQ ID NO: 4798638 - DNA, 13 bp, Homo sapiens
aatatatgtgaaa

SEQ ID NO: 4798639 - DNA, 13 bp, Homo sapiens
aatatcactcatt

SEQ ID NO: 4798640 - DNA, 18 bp, Homo sapiens
aatatcagttacagtggc

SEQ ID NO: 4798641 - DNA, 19 bp, Homo sapiens
aatatcatttcataaaaat

SEQ ID NO: 4798642 - DNA, 16 bp, Homo sapiens
aatatccaagcccagc

SEQ ID NO: 4798643 - DNA, 16 bp, Homo sapiens
aatatctaaataatgg

SEQ ID NO: 4798644 - DNA, 19 bp, Homo sapiens
aatatctagtgctaaacct

SEQ ID NO: 4798645 - DNA, 23 bp, Homo sapiens
aatatctatttatctgtctgagc

SEQ ID NO: 4798646 - DNA, 15 bp, Homo sapiens
aatatctctatttaa

SEQ ID NO: 4798647 - DNA, 19 bp, Homo sapiens
aatatgattctcctctccc

SEQ ID NO: 4798648 - DNA, 20 bp, Homo sapiens
aatatgattctcctctccca

SEQ ID NO: 4798649 - DNA, 18 bp, Homo sapiens
aatatggaaccttccctc

SEQ ID NO: 4798650 - DNA, 16 bp, Homo sapiens
aatatgggaggaacaa

SEQ ID NO: 4798651 - DNA, 12 bp, Homo sapiens
aatatgtgtaac

SEQ ID NO: 4798652 - DNA, 13 bp, Homo sapiens
aatatgtgtaact

SEQ ID NO: 4798653 - DNA, 16 bp, Homo sapiens
aatatgtgtaactttt

SEQ ID NO: 4798654 - DNA, 14 bp, Homo sapiens
aatattaaaaatta

SEQ ID NO: 4798655 - DNA, 18 bp, Homo sapiens
aatattaaaaattaattc

SEQ ID NO: 4798656 - DNA, 14 bp, Homo sapiens
aatattaagcacat

SEQ ID NO: 4798657 - DNA, 23 bp, Homo sapiens
aatattaagcacattattgtaga

SEQ ID NO: 4798658 - DNA, 16 bp, Homo sapiens
aatattcatgctgcct

SEQ ID NO: 4798659 - DNA, 14 bp, Homo sapiens
aatattgagcaata

SEQ ID NO: 4798660 - DNA, 15 bp, Homo sapiens
aatattgatctgtat

SEQ ID NO: 4798661 - DNA, 23 bp, Homo sapiens
aatattgctattgtttataggaa

SEQ ID NO: 4798662 - DNA, 12 bp, Homo sapiens
aatattgttaaa

SEQ ID NO: 4798663 - DNA, 18 bp, Homo sapiens
aatattgtttaatgcaaa

SEQ ID NO: 4798664 - DNA, 22 bp, Homo sapiens
aatattgtttaatgcaaatgaa

SEQ ID NO: 4798665 - DNA, 15 bp, Homo sapiens
aatatttacaatgta

SEQ ID NO: 4798666 - DNA, 16 bp, Homo sapiens
aatatttataaatgaa

SEQ ID NO: 4798667 - DNA, 15 bp, Homo sapiens
aatatttattgcttt

SEQ ID NO: 4798668 - DNA, 19 bp, Homo sapiens
aattgttatgtaaacatca

SEQ ID NO: 4798669 - DNA, 19 bp, Homo sapiens
aattgtttaagaatcatgg

SEQ ID NO: 4798670 - DNA, 21 bp, Homo sapiens
aattgtttggcttcctcctga

SEQ ID NO: 4798671 - DNA, 18 bp, Homo sapiens
aatttaaatgatttaaat

SEQ ID NO: 4798672 - DNA, 15 bp, Homo sapiens
aatttaagcacaaaa

SEQ ID NO: 4798673 - DNA, 17 bp, Homo sapiens
aatttacaaacctctca

SEQ ID NO: 4798674 - DNA, 15 bp, Homo sapiens
aatttacctgaagtc

SEQ ID NO: 4798675 - DNA, 17 bp, Homo sapiens
aatttacctgaagtctt

SEQ ID NO: 4798676 - DNA, 20 bp, Homo sapiens
aatttagaggataaataata

SEQ ID NO: 4798677 - DNA, 18 bp, Homo sapiens
aatttagcagtccatttt

SEQ ID NO: 4798678 - DNA, 20 bp, Homo sapiens
aatttagcagtccatttttg

SEQ ID NO: 4798679 - DNA, 22 bp, Homo sapiens
aatttaggaatgctcaatgtgc

SEQ ID NO: 4798680 - DNA, 23 bp, Homo sapiens
aatttatgtcattttcagatcct

SEQ ID NO: 4798681 - DNA, 22 bp, Homo sapiens
aatttcaaagaaaacagaccag

SEQ ID NO: 4798682 - DNA, 17 bp, Homo sapiens
aatttcccaaagcagtg

SEQ ID NO: 4798683 - DNA, 11 bp, Homo sapiens
aatttctcagc

SEQ ID NO: 4798684 - DNA, 23 bp, Homo sapiens
aatttctcttaagtactgaaata

SEQ ID NO: 4798685 - DNA, 14 bp, Homo sapiens
aatttctgccattt

SEQ ID NO: 4798686 - DNA, 23 bp, Homo sapiens
aatttgaagaattaatgacaaca

SEQ ID NO: 4798687 - DNA, 17 bp, Homo sapiens
aatttgacattgtcaga

SEQ ID NO: 4798688 - DNA, 19 bp, Homo sapiens
aatttgacattgtcagaat

SEQ ID NO: 4798689 - DNA, 22 bp, Homo sapiens
aatttgacattgtcagaatgtt

SEQ ID NO: 4798690 - DNA, 16 bp, Homo sapiens
aatttgccagacagag

SEQ ID NO: 4798691 - DNA, 18 bp, Homo sapiens
aatttgggacctgcttca

SEQ ID NO: 4798692 - DNA, 22 bp, Homo sapiens
aatttgggacctgcttcattca

SEQ ID NO: 4798693 - DNA, 15 bp, Homo sapiens
aatttgtataaaatg

SEQ ID NO: 4798694 - DNA, 14 bp, Homo sapiens
aatttgtgaaagtg

SEQ ID NO: 4798695 - DNA, 16 bp, Homo sapiens
aatttgtgaaagtggc

SEQ ID NO: 4798696 - DNA, 13 bp, Homo sapiens
aatttgtgtagat

SEQ ID NO: 4798697 - DNA, 13 bp, Homo sapiens
aatttgtttgtgc

SEQ ID NO: 4798698 - DNA, 21 bp, Homo sapiens
aattttaaaaaagatggattt

SEQ ID NO: 4798699 - DNA, 17 bp, Homo sapiens
aattttaaaattgcagc

SEQ ID NO: 4798700 - DNA, 13 bp, Homo sapiens
aattttaaagcaa

SEQ ID NO: 4798701 - DNA, 21 bp, Homo sapiens
aattttataaggctgactctt

SEQ ID NO: 4798702 - DNA, 17 bp, Homo sapiens
aattttctagaatacta

SEQ ID NO: 4798703 - DNA, 23 bp, Homo sapiens
aattttctttaaccagtctgaag

SEQ ID NO: 4798704 - DNA, 18 bp, Homo sapiens
aattttggaagaattcat

SEQ ID NO: 4798705 - DNA, 19 bp, Homo sapiens
aattttggaagaattcatg

SEQ ID NO: 4798706 - DNA, 18 bp, Homo sapiens
aatttttttccagaattg

SEQ ID NO: 4798707 - DNA, 17 bp, Homo sapiens
acaaaaactttccatga

SEQ ID NO: 4798708 - DNA, 21 bp, Homo sapiens
acaaaaactttccatgacagt

SEQ ID NO: 4798709 - DNA, 12 bp, Homo sapiens
acaaaacaaatc

SEQ ID NO: 4798710 - DNA, 12 bp, Homo sapiens
acaaaacaacag

SEQ ID NO: 4798711 - DNA, 17 bp, Homo sapiens
acaaaaggctggatgtg

SEQ ID NO: 4798712 - DNA, 15 bp, Homo sapiens
acaaaagggagaaca

SEQ ID NO: 4798713 - DNA, 16 bp, Homo sapiens
acaaaagggagaacat

SEQ ID NO: 4798714 - DNA, 16 bp, Homo sapiens
acaaaagtatattcaa

SEQ ID NO: 4798715 - DNA, 21 bp, Homo sapiens
acaaaagtctcaatgttccat

SEQ ID NO: 4798716 - DNA, 13 bp, Homo sapiens
acaaaatgaaacg

SEQ ID NO: 4798717 - DNA, 22 bp, Homo sapiens
acaaaatgaaacgcaaccacca

SEQ ID NO: 4798718 - DNA, 15 bp, Homo sapiens
acaaaccacaactga

SEQ ID NO: 4798719 - DNA, 20 bp, Homo sapiens
acaaaccacaactgacacag

SEQ ID NO: 4798720 - DNA, 14 bp, Homo sapiens
acaaaccttctttt

SEQ ID NO: 4798721 - DNA, 18 bp, Homo sapiens
acaaacgtaatttgttat

SEQ ID NO: 4798722 - DNA, 19 bp, Homo sapiens
acaaactcaaaatctggga

SEQ ID NO: 4798723 - DNA, 14 bp, Homo sapiens
acaaacttttataa

SEQ ID NO: 4798724 - DNA, 19 bp, Homo sapiens
acaaagaaaatgagaatct

SEQ ID NO: 4798725 - DNA, 12 bp, Homo sapiens
acaaagaaacaa

SEQ ID NO: 4798726 - DNA, 16 bp, Homo sapiens
acaaagatattattta

SEQ ID NO: 4798727 - DNA, 17 bp, Homo sapiens
acaaagtgaaattagta

SEQ ID NO: 4798728 - DNA, 22 bp, Homo sapiens
acaaagtgaaattagtattttg

SEQ ID NO: 4798729 - DNA, 23 bp, Homo sapiens
acaaagtgaaattagtattttga

SEQ ID NO: 4798730 - DNA, 18 bp, Homo sapiens
acaaagtttggaagtaca

SEQ ID NO: 4798731 - DNA, 19 bp, Homo sapiens
acaaatattgcttggacta

SEQ ID NO: 4798732 - DNA, 20 bp, Homo sapiens
acaaatatttcacttaaact

SEQ ID NO: 4798733 - DNA, 15 bp, Homo sapiens
acaaatcagtaattt

SEQ ID NO: 4798734 - DNA, 19 bp, Homo sapiens
acaaatctcactgtattaa

SEQ ID NO: 4798735 - DNA, 22 bp, Homo sapiens
acaaatggcttgttcagtcact

SEQ ID NO: 4798736 - DNA, 14 bp, Homo sapiens
acaaattcagtgga

SEQ ID NO: 4798737 - DNA, 21 bp, Homo sapiens
acaaattcagtggacatttgt

SEQ ID NO: 4798738 - DNA, 14 bp, Homo sapiens
acaaattccttccc

SEQ ID NO: 4798739 - DNA, 13 bp, Homo sapiens
acaaattttcaca

SEQ ID NO: 4798740 - DNA, 20 bp, Homo sapiens
acaaatttttactcaggctt

SEQ ID NO: 4798741 - DNA, 15 bp, Homo sapiens
acaacaaagcatgct

SEQ ID NO: 4798742 - DNA, 17 bp, Homo sapiens
acaacaagcaaactgaa

SEQ ID NO: 4798743 - DNA, 23 bp, Homo sapiens
acaacaatttaggaatgctcaat

SEQ ID NO: 4798744 - DNA, 19 bp, Homo sapiens
acaacaccagcaacattat

SEQ ID NO: 4798745 - DNA, 14 bp, Homo sapiens
acaacagcaacaac

SEQ ID NO: 4798746 - DNA, 14 bp, Homo sapiens
acaacagtcagcca

SEQ ID NO: 4798747 - DNA, 13 bp, Homo sapiens
acaacatgcacat

SEQ ID NO: 4798748 - DNA, 14 bp, Homo sapiens
acaacatgcacatt

SEQ ID NO: 4798749 - DNA, 21 bp, Homo sapiens
acaaccactgggatcagctgg

SEQ ID NO: 4798750 - DNA, 16 bp, Homo sapiens
acaaccatgttcttga

SEQ ID NO: 4798751 - DNA, 14 bp, Homo sapiens
acaacgatttctcc

SEQ ID NO: 4798752 - DNA, 17 bp, Homo sapiens
acaactaacaatgcctt

SEQ ID NO: 4798753 - DNA, 15 bp, Homo sapiens
acaactccaggaaaa

SEQ ID NO: 4798754 - DNA, 12 bp, Homo sapiens
acaactgacaca

SEQ ID NO: 4798755 - DNA, 17 bp, Homo sapiens
acaactgactgacttag

SEQ ID NO: 4798756 - DNA, 17 bp, Homo sapiens
acaactgtggataaatt

SEQ ID NO: 4798757 - DNA, 12 bp, Homo sapiens
acaacttccaga

SEQ ID NO: 4798758 - DNA, 14 bp, Homo sapiens
acaacttccagatt

SEQ ID NO: 4798759 - DNA, 17 bp, Homo sapiens
acaacttccagatttga

SEQ ID NO: 4798760 - DNA, 13 bp, Homo sapiens
acaacttgctcct

SEQ ID NO: 4798761 - DNA, 14 bp, Homo sapiens
acaagaactccctt

SEQ ID NO: 4798762 - DNA, 17 bp, Homo sapiens
acaagagaccacttcct

SEQ ID NO: 4798763 - DNA, 21 bp, Homo sapiens
acaagagaccacttccttaac

SEQ ID NO: 4798764 - DNA, 18 bp, Homo sapiens
acaagcaaactgaaatta

SEQ ID NO: 4798765 - DNA, 19 bp, Homo sapiens
acaagcacaattgatctct

SEQ ID NO: 4798766 - DNA, 19 bp, Homo sapiens
acaagccacgttgcagaaa

SEQ ID NO: 4798767 - DNA, 15 bp, Homo sapiens
acaagccctgcttgc

SEQ ID NO: 4798768 - DNA, 16 bp, Homo sapiens
acaaggcaaggctgtc

SEQ ID NO: 4798769 - DNA, 23 bp, Homo sapiens
acaaggggtggaagggcaggagc

SEQ ID NO: 4798770 - DNA, 18 bp, Homo sapiens
acaagtgacttatttgct

SEQ ID NO: 4798771 - DNA, 22 bp, Homo sapiens
acaatactttgtgtcttttgtt

SEQ ID NO: 4798772 - DNA, 17 bp, Homo sapiens
acaatatcattttcctg

SEQ ID NO: 4798773 - DNA, 20 bp, Homo sapiens
acaatgcctattgtaatata

SEQ ID NO: 4798774 - DNA, 16 bp, Homo sapiens
acaatgccttgttgta

SEQ ID NO: 4798775 - DNA, 14 bp, Homo sapiens
acaatggtaacatt

SEQ ID NO: 4798776 - DNA, 16 bp, Homo sapiens
acaatggtagctctga

SEQ ID NO: 4798777 - DNA, 23 bp, Homo sapiens
acaatgtgatatgtgtaatatca

SEQ ID NO: 4798778 - DNA, 13 bp, Homo sapiens
acaattactgtga

SEQ ID NO: 4798779 - DNA, 14 bp, Homo sapiens
acaattactgtgag

SEQ ID NO: 4798780 - DNA, 20 bp, Homo sapiens
acaattactgtgagaactgt

SEQ ID NO: 4798781 - DNA, 22 bp, Homo sapiens
acaattactgtgagaactgtga

SEQ ID NO: 4798782 - DNA, 13 bp, Homo sapiens
acaattagatttc

SEQ ID NO: 4798783 - DNA, 22 bp, Homo sapiens
acaattctttgttgcttaatct

SEQ ID NO: 4798784 - DNA, 19 bp, Homo sapiens
acaattgatctctttttat

SEQ ID NO: 4798785 - DNA, 13 bp, Homo sapiens
acaattgattttc

SEQ ID NO: 4798786 - DNA, 21 bp, Homo sapiens
acaattgattttccccctaat

SEQ ID NO: 4798787 - DNA, 14 bp, Homo sapiens
acaatttattttat

SEQ ID NO: 4798788 - DNA, 20 bp, Homo sapiens
acaatttattttattttagc

SEQ ID NO: 4798789 - DNA, 17 bp, Homo sapiens
acacaaaacaaatcctg

SEQ ID NO: 4798790 - DNA, 14 bp, Homo sapiens
accagagctgccac

SEQ ID NO: 4798791 - DNA, 13 bp, Homo sapiens
accagcactccca

SEQ ID NO: 4798792 - DNA, 14 bp, Homo sapiens
accagcactcccag

SEQ ID NO: 4798793 - DNA, 15 bp, Homo sapiens
accagcactcccagg

SEQ ID NO: 4798794 - DNA, 16 bp, Homo sapiens
accagcactcccaggg

SEQ ID NO: 4798795 - DNA, 20 bp, Homo sapiens
accagccctggggctgggcc

SEQ ID NO: 4798796 - DNA, 22 bp, Homo sapiens
accagctcaggctactgccact

SEQ ID NO: 4798797 - DNA, 17 bp, Homo sapiens
accagcttgcttctctg

SEQ ID NO: 4798798 - DNA, 17 bp, Homo sapiens
accaggaagaaggcccg

SEQ ID NO: 4798799 - DNA, 21 bp, Homo sapiens
accaggaagaaggcccgggag

SEQ ID NO: 4798800 - DNA, 20 bp, Homo sapiens
accaggagccaggtgtcctg

SEQ ID NO: 4798801 - DNA, 18 bp, Homo sapiens
accaggaggcctgggaga

SEQ ID NO: 4798802 - DNA, 19 bp, Homo sapiens
accaggctacagttgatat

SEQ ID NO: 4798803 - DNA, 19 bp, Homo sapiens
accaggctcacaactgttt

SEQ ID NO: 4798804 - DNA, 14 bp, Homo sapiens
accaggctgcaggt

SEQ ID NO: 4798805 - DNA, 19 bp, Homo sapiens
accagtctgaagtttcatt

SEQ ID NO: 4798806 - DNA, 20 bp, Homo sapiens
accagttcttgcaataagat

SEQ ID NO: 4798807 - DNA, 19 bp, Homo sapiens
accatagcttaagaagtat

SEQ ID NO: 4798808 - DNA, 21 bp, Homo sapiens
accatccatccctggtgaaag

SEQ ID NO: 4798809 - DNA, 15 bp, Homo sapiens
accatcccactgata

SEQ ID NO: 4798810 - DNA, 16 bp, Homo sapiens
accatcggtcagcagg

SEQ ID NO: 4798811 - DNA, 17 bp, Homo sapiens
accatctggcctggcct

SEQ ID NO: 4798812 - DNA, 22 bp, Homo sapiens
accatctggcctggcctggccc

SEQ ID NO: 4798813 - DNA, 23 bp, Homo sapiens
accatcttgggattcctcccctg

SEQ ID NO: 4798814 - DNA, 15 bp, Homo sapiens
accatgaaaagtttt

SEQ ID NO: 4798815 - DNA, 18 bp, Homo sapiens
accatgcattcagatctg

SEQ ID NO: 4798816 - DNA, 22 bp, Homo sapiens
accatgcattcagatctgaagt

SEQ ID NO: 4798817 - DNA, 20 bp, Homo sapiens
accattaagaacaaggaatt

SEQ ID NO: 4798818 - DNA, 19 bp, Homo sapiens
accattatggctttgtgct

SEQ ID NO: 4798819 - DNA, 18 bp, Homo sapiens
accatttaatcatttcca

SEQ ID NO: 4798820 - DNA, 16 bp, Homo sapiens
accatttcccctgtgg

SEQ ID NO: 4798821 - DNA, 22 bp, Homo sapiens
accatttcccctgtggtttgtt

SEQ ID NO: 4798822 - DNA, 12 bp, Homo sapiens
acccaaaagatt

SEQ ID NO: 4798823 - DNA, 15 bp, Homo sapiens
acccaaataaatgtg

SEQ ID NO: 4798824 - DNA, 16 bp, Homo sapiens
acccaaataaatgtgt

SEQ ID NO: 4798825 - DNA, 23 bp, Homo sapiens
acccaaggtggtcttggagagga

SEQ ID NO: 4798826 - DNA, 22 bp, Homo sapiens
acccacaccccgtctgcccctt

SEQ ID NO: 4798827 - DNA, 12 bp, Homo sapiens
acccacataaac

SEQ ID NO: 4798828 - DNA, 13 bp, Homo sapiens
acccacataaaca

SEQ ID NO: 4798829 - DNA, 15 bp, Homo sapiens
acccacataaacact

SEQ ID NO: 4798830 - DNA, 14 bp, Homo sapiens
acccaccaccccca

SEQ ID NO: 4798831 - DNA, 12 bp, Homo sapiens
acccacccctgc

SEQ ID NO: 4798832 - DNA, 14 bp, Homo sapiens
acccacccctgccc

SEQ ID NO: 4798833 - DNA, 15 bp, Homo sapiens
acccactagccctct

SEQ ID NO: 4798834 - DNA, 16 bp, Homo sapiens
acccactagccctctt

SEQ ID NO: 4798835 - DNA, 15 bp, Homo sapiens
acccaggattcaaca

SEQ ID NO: 4798836 - DNA, 19 bp, Homo sapiens
acccaggattcaacatcaa

SEQ ID NO: 4798837 - DNA, 19 bp, Homo sapiens
acccaggttggagtgcagt

SEQ ID NO: 4798838 - DNA, 20 bp, Homo sapiens
acccaggttggagtgcagtg

SEQ ID NO: 4798839 - DNA, 12 bp, Homo sapiens
acccagtgttca

SEQ ID NO: 4798840 - DNA, 19 bp, Homo sapiens
acccatcggtgtccattta

SEQ ID NO: 4798841 - DNA, 20 bp, Homo sapiens
acccatgagcgtccaggtga

SEQ ID NO: 4798842 - DNA, 19 bp, Homo sapiens
acccatgcatggcctccca

SEQ ID NO: 4798843 - DNA, 21 bp, Homo sapiens
acccatgcatggcctcccagc

SEQ ID NO: 4798844 - DNA, 18 bp, Homo sapiens
acccatggaaaaatgcca

SEQ ID NO: 4798845 - DNA, 20 bp, Homo sapiens
accccacacgccggggctgg

SEQ ID NO: 4798846 - DNA, 22 bp, Homo sapiens
accccacacgccggggctggcc

SEQ ID NO: 4798847 - DNA, 23 bp, Homo sapiens
accccaccacacacacccttccc

SEQ ID NO: 4798848 - DNA, 18 bp, Homo sapiens
accccaccctgtctgcag

SEQ ID NO: 4798849 - DNA, 19 bp, Homo sapiens
accccaccctgtctgcagg

SEQ ID NO: 4798850 - DNA, 17 bp, Homo sapiens
accccagatacctgtga

SEQ ID NO: 4798851 - DNA, 18 bp, Homo sapiens
accccagatacctgtgag

SEQ ID NO: 4798852 - DNA, 23 bp, Homo sapiens
accccagatacctgtgaggactg

SEQ ID NO: 4798853 - DNA, 22 bp, Homo sapiens
accccaggacgcatgcagggcc

SEQ ID NO: 4798854 - DNA, 18 bp, Homo sapiens
accccagtccccgggaaa

SEQ ID NO: 4798855 - DNA, 14 bp, Homo sapiens
acccccacctcccg

SEQ ID NO: 4798856 - DNA, 19 bp, Homo sapiens
acccccacctccctgcagc

SEQ ID NO: 4798857 - DNA, 13 bp, Homo sapiens
acccccagcctcc

SEQ ID NO: 4798858 - DNA, 16 bp, Homo sapiens
acccccagcctccccc

SEQ ID NO: 4798859 - DNA, 15 bp, Homo sapiens
acccccatgccaatg

SEQ ID NO: 4798860 - DNA, 22 bp, Homo sapiens
accccccgcccccgcccaggcc

SEQ ID NO: 4798861 - DNA, 16 bp, Homo sapiens
accccctgccccagag

SEQ ID NO: 4798862 - DNA, 13 bp, Homo sapiens
accccgctgcctg

SEQ ID NO: 4798863 - DNA, 21 bp, Homo sapiens
accccgctgcctggcgggcag

SEQ ID NO: 4798864 - DNA, 14 bp, Homo sapiens
accccggcaggccc

SEQ ID NO: 4798865 - DNA, 19 bp, Homo sapiens
accccggcaggccctgcag

SEQ ID NO: 4798866 - DNA, 21 bp, Homo sapiens
accccggcaggccctgcagtg

SEQ ID NO: 4798867 - DNA, 13 bp, Homo sapiens
accccgtcccggc

SEQ ID NO: 4798868 - DNA, 20 bp, Homo sapiens
accccgtccctttccctgca

SEQ ID NO: 4798869 - DNA, 22 bp, Homo sapiens
accccgtccctttccctgcatc

SEQ ID NO: 4798870 - DNA, 13 bp, Homo sapiens
accccgtctgccc

SEQ ID NO: 4798871 - DNA, 23 bp, Homo sapiens
accccgtctgccccttgacccca

SEQ ID NO: 4798872 - DNA, 18 bp, Homo sapiens
accccgttacagctcccc

SEQ ID NO: 4798873 - DNA, 17 bp, Homo sapiens
accccgttcccagcgca

SEQ ID NO: 4798874 - DNA, 15 bp, Homo sapiens
accccgttgttgtcc

SEQ ID NO: 4798875 - DNA, 22 bp, Homo sapiens
acccctaaaagaaaccctgcac

SEQ ID NO: 4798876 - DNA, 17 bp, Homo sapiens
acccctacagcctgcac

SEQ ID NO: 4798877 - DNA, 13 bp, Homo sapiens
acccctcttcccc

SEQ ID NO: 4798878 - DNA, 21 bp, Homo sapiens
acccctgaactggccccagct

SEQ ID NO: 4798879 - DNA, 16 bp, Homo sapiens
acccctgccctcggcc

SEQ ID NO: 4798880 - DNA, 22 bp, Homo sapiens
acccctgggggaggcttccagc

SEQ ID NO: 4798881 - DNA, 18 bp, Homo sapiens
acccctgggtgggccctg

SEQ ID NO: 4798882 - DNA, 15 bp, Homo sapiens
acccgccccagagac

SEQ ID NO: 4798883 - DNA, 20 bp, Homo sapiens
acccgccccagagactgccc

SEQ ID NO: 4798884 - DNA, 14 bp, Homo sapiens
acccgcccgccccc

SEQ ID NO: 4798885 - DNA, 21 bp, Homo sapiens
acccgccctttccttgccttc

SEQ ID NO: 4798886 - DNA, 21 bp, Homo sapiens
acccggctgactcagtgcagg

SEQ ID NO: 4798887 - DNA, 14 bp, Homo sapiens
acccggtggcttct

SEQ ID NO: 4798888 - DNA, 19 bp, Homo sapiens
acccggtggcttctggcac

SEQ ID NO: 4798889 - DNA, 22 bp, Homo sapiens
acccggtggcttctggcacctg

SEQ ID NO: 4798890 - DNA, 12 bp, Homo sapiens
acccgtcctggg

SEQ ID NO: 4798891 - DNA, 21 bp, Homo sapiens
acccgttttatgatttactca

SEQ ID NO: 4798892 - DNA, 15 bp, Homo sapiens
accctacagtatata

SEQ ID NO: 4798893 - DNA, 21 bp, Homo sapiens
accctaggtctccacccctca

SEQ ID NO: 4798894 - DNA, 23 bp, Homo sapiens
accctaggtctccacccctcaag

SEQ ID NO: 4798895 - DNA, 12 bp, Homo sapiens
accctaggtgct

SEQ ID NO: 4798896 - DNA, 22 bp, Homo sapiens
accctcagaatattaagcacat

SEQ ID NO: 4798897 - DNA, 11 bp, Homo sapiens
accctccaagg

SEQ ID NO: 4798898 - DNA, 18 bp, Homo sapiens
accctccaagggatctgc

SEQ ID NO: 4798899 - DNA, 14 bp, Homo sapiens
accctcccctctcc

SEQ ID NO: 4798900 - DNA, 18 bp, Homo sapiens
accctcccctctcctgag

SEQ ID NO: 4798901 - DNA, 16 bp, Homo sapiens
accctcgctgccaccc

SEQ ID NO: 4798902 - DNA, 23 bp, Homo sapiens
accctctcctgggggtggcaggc

SEQ ID NO: 4798903 - DNA, 15 bp, Homo sapiens
accctctgctatgtc

SEQ ID NO: 4798904 - DNA, 19 bp, Homo sapiens
accctctgctatgtctgtg

SEQ ID NO: 4798905 - DNA, 20 bp, Homo sapiens
accctctgctgcacagtagt

SEQ ID NO: 4798906 - DNA, 15 bp, Homo sapiens
accctctgtccttcc

SEQ ID NO: 4798907 - DNA, 19 bp, Homo sapiens
accctcttctcagctccac

SEQ ID NO: 4798908 - DNA, 23 bp, Homo sapiens
accctcttctcagctccactctg

SEQ ID NO: 4798909 - DNA, 23 bp, Homo sapiens
accctgaaatattttctacttta

SEQ ID NO: 4798910 - DNA, 15 bp, Homo sapiens
accctgcaaggccca

SEQ ID NO: 4798911 - DNA, 16 bp, Homo sapiens
actacagaagtggaag

SEQ ID NO: 4798912 - DNA, 19 bp, Homo sapiens
actacaggtattttcatca

SEQ ID NO: 4798913 - DNA, 15 bp, Homo sapiens
actacaggttttatg

SEQ ID NO: 4798914 - DNA, 15 bp, Homo sapiens
actacatttgcatgc

SEQ ID NO: 4798915 - DNA, 12 bp, Homo sapiens
actaccaccctc

SEQ ID NO: 4798916 - DNA, 16 bp, Homo sapiens
actaccaccctcgctg

SEQ ID NO: 4798917 - DNA, 20 bp, Homo sapiens
actaccccagaacgcatgca

SEQ ID NO: 4798918 - DNA, 19 bp, Homo sapiens
actaccctcctgtaaaata

SEQ ID NO: 4798919 - DNA, 20 bp, Homo sapiens
actaccctcctgtaaaatac

SEQ ID NO: 4798920 - DNA, 13 bp, Homo sapiens
actacgcctggct

SEQ ID NO: 4798921 - DNA, 15 bp, Homo sapiens
actactgcctttcaa

SEQ ID NO: 4798922 - DNA, 17 bp, Homo sapiens
actactgcctttcaaag

SEQ ID NO: 4798923 - DNA, 11 bp, Homo sapiens
actagagcacg

SEQ ID NO: 4798924 - DNA, 22 bp, Homo sapiens
actagagcacgggcgttatgta

SEQ ID NO: 4798925 - DNA, 15 bp, Homo sapiens
actagagtatgtgta

SEQ ID NO: 4798926 - DNA, 16 bp, Homo sapiens
actagagtatgtgtat

SEQ ID NO: 4798927 - DNA, 19 bp, Homo sapiens
actagcaataagttgaatg

SEQ ID NO: 4798928 - DNA, 12 bp, Homo sapiens
actagccctctt

SEQ ID NO: 4798929 - DNA, 17 bp, Homo sapiens
actagccctctttctct

SEQ ID NO: 4798930 - DNA, 16 bp, Homo sapiens
actagtatttgttgag

SEQ ID NO: 4798931 - DNA, 19 bp, Homo sapiens
actataatgtgaaatgtaa

SEQ ID NO: 4798932 - DNA, 16 bp, Homo sapiens
actatagcaaagtagt

SEQ ID NO: 4798933 - DNA, 20 bp, Homo sapiens
actatagcaaagtagtactt

SEQ ID NO: 4798934 - DNA, 16 bp, Homo sapiens
actatgattccaatta

SEQ ID NO: 4798935 - DNA, 16 bp, Homo sapiens
actatgcctgttgatc

SEQ ID NO: 4798936 - DNA, 19 bp, Homo sapiens
actatggagcctggcacag

SEQ ID NO: 4798937 - DNA, 22 bp, Homo sapiens
actatggtatgctggccagcac

SEQ ID NO: 4798938 - DNA, 17 bp, Homo sapiens
actattggacagacaca

SEQ ID NO: 4798939 - DNA, 16 bp, Homo sapiens
actattgttagtctct

SEQ ID NO: 4798940 - DNA, 22 bp, Homo sapiens
actatttctacacagtgggaac

SEQ ID NO: 4798941 - DNA, 19 bp, Homo sapiens
actcaaagaggccagtact

SEQ ID NO: 4798942 - DNA, 18 bp, Homo sapiens
actcaagatactggacta

SEQ ID NO: 4798943 - DNA, 13 bp, Homo sapiens
actcacaaaaggc

SEQ ID NO: 4798944 - DNA, 15 bp, Homo sapiens
actcacaaaaggctg

SEQ ID NO: 4798945 - DNA, 15 bp, Homo sapiens
actcacagactgctg

SEQ ID NO: 4798946 - DNA, 14 bp, Homo sapiens
actcacctgcccct

SEQ ID NO: 4798947 - DNA, 21 bp, Homo sapiens
actcacctgcccctcaactct

SEQ ID NO: 4798948 - DNA, 20 bp, Homo sapiens
actcactaaaagttctcaaa

SEQ ID NO: 4798949 - DNA, 14 bp, Homo sapiens
actcagatctgcac

SEQ ID NO: 4798950 - DNA, 18 bp, Homo sapiens
actcagctgtctgtggct

SEQ ID NO: 4798951 - DNA, 21 bp, Homo sapiens
actcagtgcagggacagcctg

SEQ ID NO: 4798952 - DNA, 18 bp, Homo sapiens
actcatccagaactgtct

SEQ ID NO: 4798953 - DNA, 12 bp, Homo sapiens
actcatccatta

SEQ ID NO: 4798954 - DNA, 22 bp, Homo sapiens
actcatttatttccatattaaa

SEQ ID NO: 4798955 - DNA, 18 bp, Homo sapiens
actcatttggatataaat

SEQ ID NO: 4798956 - DNA, 19 bp, Homo sapiens
actcatttggatataaatc

SEQ ID NO: 4798957 - DNA, 22 bp, Homo sapiens
actcatttggatataaatctta

SEQ ID NO: 4798958 - DNA, 15 bp, Homo sapiens
actccaagccctggg

SEQ ID NO: 4798959 - DNA, 18 bp, Homo sapiens
actccaagccctggggca

SEQ ID NO: 4798960 - DNA, 13 bp, Homo sapiens
actccaaggcaaa

SEQ ID NO: 4798961 - DNA, 22 bp, Homo sapiens
actccaaggcaaatgtccaagc

SEQ ID NO: 4798962 - DNA, 13 bp, Homo sapiens
actccactcccct

SEQ ID NO: 4798963 - DNA, 15 bp, Homo sapiens
actccactcccctca

SEQ ID NO: 4798964 - DNA, 14 bp, Homo sapiens
actccagaagcagc

SEQ ID NO: 4798965 - DNA, 16 bp, Homo sapiens
actccagaagcagcag

SEQ ID NO: 4798966 - DNA, 20 bp, Homo sapiens
actccagggttaaagaaagg

SEQ ID NO: 4798967 - DNA, 22 bp, Homo sapiens
actccagtttgcccaccacaac

SEQ ID NO: 4798968 - DNA, 17 bp, Homo sapiens
actccatggtgaactga

SEQ ID NO: 4798969 - DNA, 21 bp, Homo sapiens
actccattactaaagacagaa

SEQ ID NO: 4798970 - DNA, 13 bp, Homo sapiens
actcccagggccc

SEQ ID NO: 4798971 - DNA, 12 bp, Homo sapiens
actcccccagag

SEQ ID NO: 4798972 - DNA, 16 bp, Homo sapiens
actcccccagaggtgg

SEQ ID NO: 4798973 - DNA, 21 bp, Homo sapiens
actccccgcccgccctcctct

SEQ ID NO: 4798974 - DNA, 17 bp, Homo sapiens
actcctccccctcctcc

SEQ ID NO: 4798975 - DNA, 23 bp, Homo sapiens
actcctccccctcctccatgctg

SEQ ID NO: 4798976 - DNA, 21 bp, Homo sapiens
actcctgtctcttgggaagca

SEQ ID NO: 4798977 - DNA, 19 bp, Homo sapiens
actcctgtgtgtggaaggc

SEQ ID NO: 4798978 - DNA, 17 bp, Homo sapiens
actccttaaaaatgtat

SEQ ID NO: 4798979 - DNA, 16 bp, Homo sapiens
actccttggcctagcc

SEQ ID NO: 4798980 - DNA, 18 bp, Homo sapiens
actccttggcctagccca

SEQ ID NO: 4798981 - DNA, 16 bp, Homo sapiens
actcgagagggctgag

SEQ ID NO: 4798982 - DNA, 21 bp, Homo sapiens
actcgagagggctgagcccct

SEQ ID NO: 4798983 - DNA, 14 bp, Homo sapiens
actcgcgagagggt

SEQ ID NO: 4798984 - DNA, 17 bp, Homo sapiens
actcgggattacagaaa

SEQ ID NO: 4798985 - DNA, 18 bp, Homo sapiens
actcgtgtgcatgagaat

SEQ ID NO: 4798986 - DNA, 21 bp, Homo sapiens
actcgtgtgcatgagaatgtc

SEQ ID NO: 4798987 - DNA, 15 bp, Homo sapiens
actctaactgtatat

SEQ ID NO: 4798988 - DNA, 18 bp, Homo sapiens
actctaactgtatatttg

SEQ ID NO: 4798989 - DNA, 23 bp, Homo sapiens
actctaagaaatggctttccaca

SEQ ID NO: 4798990 - DNA, 14 bp, Homo sapiens
actctagatgttta

SEQ ID NO: 4798991 - DNA, 23 bp, Homo sapiens
actctagatgtttagatgaggtt

SEQ ID NO: 4798992 - DNA, 17 bp, Homo sapiens
actctatctgggcctgg

SEQ ID NO: 4798993 - DNA, 15 bp, Homo sapiens
actctatgctctgga

SEQ ID NO: 4798994 - DNA, 22 bp, Homo sapiens
actctatgctctggaaaacctg

SEQ ID NO: 4798995 - DNA, 19 bp, Homo sapiens
actctcaggaccaccctgc

SEQ ID NO: 4798996 - DNA, 14 bp, Homo sapiens
actctgacaagggc

SEQ ID NO: 4798997 - DNA, 20 bp, Homo sapiens
actctgacaagggctgacct

SEQ ID NO: 4798998 - DNA, 13 bp, Homo sapiens
actctgagtcctc

SEQ ID NO: 4798999 - DNA, 16 bp, Homo sapiens
actctgcgacgatccc

SEQ ID NO: 4799000 - DNA, 22 bp, Homo sapiens
actctggccttggttcctccag

SEQ ID NO: 4799001 - DNA, 14 bp, Homo sapiens
actctggctgccaa

SEQ ID NO: 4799002 - DNA, 16 bp, Homo sapiens
actctgtaacatcact

SEQ ID NO: 4799003 - DNA, 15 bp, Homo sapiens
actctgtcagccagc

SEQ ID NO: 4799004 - DNA, 17 bp, Homo sapiens
actctgtcagccagccg

SEQ ID NO: 4799005 - DNA, 19 bp, Homo sapiens
actcttaaatatacaactt

SEQ ID NO: 4799006 - DNA, 17 bp, Homo sapiens
actcttgtctcctcctc

SEQ ID NO: 4799007 - DNA, 21 bp, Homo sapiens
actcttgtctcctcctccagg

SEQ ID NO: 4799008 - DNA, 20 bp, Homo sapiens
actctttattgtctgtaaat

SEQ ID NO: 4799009 - DNA, 22 bp, Homo sapiens
actgaaattagtgttttcattc

SEQ ID NO: 4799010 - DNA, 19 bp, Homo sapiens
actgaacgatccttcaaag

SEQ ID NO: 4799011 - DNA, 12 bp, Homo sapiens
actgaagcagag

SEQ ID NO: 4799012 - DNA, 15 bp, Homo sapiens
actgaataaataagt

SEQ ID NO: 4799013 - DNA, 12 bp, Homo sapiens
actgaatttcta

SEQ ID NO: 4799014 - DNA, 14 bp, Homo sapiens
actgacagcctcca

SEQ ID NO: 4799015 - DNA, 12 bp, Homo sapiens
actgacccttcc

SEQ ID NO: 4799016 - DNA, 16 bp, Homo sapiens
actgagaaggccccag

SEQ ID NO: 4799017 - DNA, 16 bp, Homo sapiens
actgagacaatgcctt

SEQ ID NO: 4799018 - DNA, 14 bp, Homo sapiens
actgatatattttc

SEQ ID NO: 4799019 - DNA, 13 bp, Homo sapiens
actgatctctcgt

SEQ ID NO: 4799020 - DNA, 22 bp, Homo sapiens
actgatgggtatcatgcttcta

SEQ ID NO: 4799021 - DNA, 15 bp, Homo sapiens
actgatgggtcctgc

SEQ ID NO: 4799022 - DNA, 18 bp, Homo sapiens
actgatgggtcctgctgc

SEQ ID NO: 4799023 - DNA, 19 bp, Homo sapiens
actgatggttgctttgagc

SEQ ID NO: 4799024 - DNA, 23 bp, Homo sapiens
actgatttgggctgaatgtatgt

SEQ ID NO: 4799025 - DNA, 14 bp, Homo sapiens
actgcaacactgga

SEQ ID NO: 4799026 - DNA, 17 bp, Homo sapiens
actgcaacccatgagcg

SEQ ID NO: 4799027 - DNA, 15 bp, Homo sapiens
actgcaatgtctgtc

SEQ ID NO: 4799028 - DNA, 14 bp, Homo sapiens
actgcaccctccac

SEQ ID NO: 4799029 - DNA, 21 bp, Homo sapiens
actgcaccctccacaggagcc

SEQ ID NO: 4799030 - DNA, 17 bp, Homo sapiens
actgcaggttggacccc

SEQ ID NO: 4799031 - DNA, 18 bp, Homo sapiens
actgcaggttggacccca

SEQ ID NO: 4799032 - DNA, 20 bp, Homo sapiens
actgcatcaagatgtgacat

SEQ ID NO: 4799033 - DNA, 13 bp, Homo sapiens
agaactcctttct

SEQ ID NO: 4799034 - DNA, 17 bp, Homo sapiens
agaactgtgaatatgtg

SEQ ID NO: 4799035 - DNA, 19 bp, Homo sapiens
agaactgtgaatatgtgta

SEQ ID NO: 4799036 - DNA, 22 bp, Homo sapiens
agaagaatattgtattgttaga

SEQ ID NO: 4799037 - DNA, 15 bp, Homo sapiens
agaagaatttgaaga

SEQ ID NO: 4799038 - DNA, 22 bp, Homo sapiens
agaagaatttgaagacttcaaa

SEQ ID NO: 4799039 - DNA, 19 bp, Homo sapiens
agaagaggggtataggaca

SEQ ID NO: 4799040 - DNA, 15 bp, Homo sapiens
agaagatagttgtaa

SEQ ID NO: 4799041 - DNA, 18 bp, Homo sapiens
agaagatagttgtaaaga

SEQ ID NO: 4799042 - DNA, 12 bp, Homo sapiens
agaagatgaaaa

SEQ ID NO: 4799043 - DNA, 19 bp, Homo sapiens
agaagccggcggagctctg

SEQ ID NO: 4799044 - DNA, 18 bp, Homo sapiens
agaagctctcgagggaag

SEQ ID NO: 4799045 - DNA, 14 bp, Homo sapiens
agaaggaggaaccc

SEQ ID NO: 4799046 - DNA, 22 bp, Homo sapiens
agaaggattcttttttcaatgt

SEQ ID NO: 4799047 - DNA, 22 bp, Homo sapiens
agaaggcacaggtgtaaatata

SEQ ID NO: 4799048 - DNA, 13 bp, Homo sapiens
agaaggcccggga

SEQ ID NO: 4799049 - DNA, 15 bp, Homo sapiens
agaaggcccgggagg

SEQ ID NO: 4799050 - DNA, 16 bp, Homo sapiens
agaaggcccgggagga

SEQ ID NO: 4799051 - DNA, 15 bp, Homo sapiens
agaaggcctgccccc

SEQ ID NO: 4799052 - DNA, 19 bp, Homo sapiens
agaaggcctgccccccttc

SEQ ID NO: 4799053 - DNA, 22 bp, Homo sapiens
agaaggcctgccccccttccca

SEQ ID NO: 4799054 - DNA, 14 bp, Homo sapiens
agaagggaaattca

SEQ ID NO: 4799055 - DNA, 22 bp, Homo sapiens
agaagggaaattcacactgtgc

SEQ ID NO: 4799056 - DNA, 14 bp, Homo sapiens
agaagtacagggca

SEQ ID NO: 4799057 - DNA, 21 bp, Homo sapiens
agaagtgaaaaagacttcaaa

SEQ ID NO: 4799058 - DNA, 22 bp, Homo sapiens
agaagtgggattcaggaatggg

SEQ ID NO: 4799059 - DNA, 21 bp, Homo sapiens
agaagttaaaggttactgttt

SEQ ID NO: 4799060 - DNA, 21 bp, Homo sapiens
agaagtttaaatctttgttaa

SEQ ID NO: 4799061 - DNA, 22 bp, Homo sapiens
agaagtttaaatctttgttaaa

SEQ ID NO: 4799062 - DNA, 19 bp, Homo sapiens
agaatattaaaaattaatt

SEQ ID NO: 4799063 - DNA, 15 bp, Homo sapiens
agaatattgtattgt

SEQ ID NO: 4799064 - DNA, 14 bp, Homo sapiens
agaatcaagtctgt

SEQ ID NO: 4799065 - DNA, 21 bp, Homo sapiens
agaatcatggatttatttttt

SEQ ID NO: 4799066 - DNA, 14 bp, Homo sapiens
agaatcattgctta

SEQ ID NO: 4799067 - DNA, 22 bp, Homo sapiens
agaatccccgtgctcacagtag

SEQ ID NO: 4799068 - DNA, 21 bp, Homo sapiens
agaatcgatgggggatgcttc

SEQ ID NO: 4799069 - DNA, 22 bp, Homo sapiens
agaatcgatgggggatgcttca

SEQ ID NO: 4799070 - DNA, 18 bp, Homo sapiens
agaatctcagcactttgt

SEQ ID NO: 4799071 - DNA, 14 bp, Homo sapiens
agaatctgtgcagt

SEQ ID NO: 4799072 - DNA, 21 bp, Homo sapiens
agaatcttgttaatttcattc

SEQ ID NO: 4799073 - DNA, 19 bp, Homo sapiens
agaatgaggcacatgacag

SEQ ID NO: 4799074 - DNA, 19 bp, Homo sapiens
agaatgcacaaacagaggc

SEQ ID NO: 4799075 - DNA, 23 bp, Homo sapiens
agaatgcacaaacagaggccgcc

SEQ ID NO: 4799076 - DNA, 19 bp, Homo sapiens
agaatggtgggctccagag

SEQ ID NO: 4799077 - DNA, 21 bp, Homo sapiens
agaatggtgggctccagagta

SEQ ID NO: 4799078 - DNA, 17 bp, Homo sapiens
agaatgtcatttgctaa

SEQ ID NO: 4799079 - DNA, 18 bp, Homo sapiens
agaatgtcatttgctaat

SEQ ID NO: 4799080 - DNA, 19 bp, Homo sapiens
agaatgtcatttgctaatg

SEQ ID NO: 4799081 - DNA, 23 bp, Homo sapiens
agaatgttgaaactgacttgctg

SEQ ID NO: 4799082 - DNA, 14 bp, Homo sapiens
agaatgttgtgttg

SEQ ID NO: 4799083 - DNA, 13 bp, Homo sapiens
agaatgtttcatt

SEQ ID NO: 4799084 - DNA, 15 bp, Homo sapiens
agaatgtttcatttg

SEQ ID NO: 4799085 - DNA, 17 bp, Homo sapiens
agaattaatgacaacaa

SEQ ID NO: 4799086 - DNA, 18 bp, Homo sapiens
agaattaccatttgttaa

SEQ ID NO: 4799087 - DNA, 18 bp, Homo sapiens
agaattagccaaccaggc

SEQ ID NO: 4799088 - DNA, 21 bp, Homo sapiens
agaattaggtaatggatatga

SEQ ID NO: 4799089 - DNA, 23 bp, Homo sapiens
agaattcatgatgctagttctta

SEQ ID NO: 4799090 - DNA, 22 bp, Homo sapiens
agaattgggcccttagaatgtg

SEQ ID NO: 4799091 - DNA, 23 bp, Homo sapiens
agaattgtgcgacttcacaaaat

SEQ ID NO: 4799092 - DNA, 21 bp, Homo sapiens
agaatttgaagacttcaaaat

SEQ ID NO: 4799093 - DNA, 13 bp, Homo sapiens
agaattttaaaaa

SEQ ID NO: 4799094 - DNA, 17 bp, Homo sapiens
agaattttaaaaaagat

SEQ ID NO: 4799095 - DNA, 21 bp, Homo sapiens
agaattttaaaaaagatggat

SEQ ID NO: 4799096 - DNA, 22 bp, Homo sapiens
agaattttaaaaaagatggatt

SEQ ID NO: 4799097 - DNA, 13 bp, Homo sapiens
agacaaatgcagt

SEQ ID NO: 4799098 - DNA, 13 bp, Homo sapiens
agacaacacacac

SEQ ID NO: 4799099 - DNA, 15 bp, Homo sapiens
agacaacaggcattt

SEQ ID NO: 4799100 - DNA, 15 bp, Homo sapiens
agacaacttgctcct

SEQ ID NO: 4799101 - DNA, 19 bp, Homo sapiens
agacaacttgctcctttcc

SEQ ID NO: 4799102 - DNA, 21 bp, Homo sapiens
agacaagtctgagtagttatg

SEQ ID NO: 4799103 - DNA, 21 bp, Homo sapiens
agacaatgtggaattacataa

SEQ ID NO: 4799104 - DNA, 18 bp, Homo sapiens
agacacattatcttctgg

SEQ ID NO: 4799105 - DNA, 13 bp, Homo sapiens
agacactgtcaag

SEQ ID NO: 4799106 - DNA, 11 bp, Homo sapiens
agacagagatg

SEQ ID NO: 4799107 - DNA, 12 bp, Homo sapiens
agacagagtgga

SEQ ID NO: 4799108 - DNA, 14 bp, Homo sapiens
agacagagtggatc

SEQ ID NO: 4799109 - DNA, 15 bp, Homo sapiens
agacaggatgttcaa

SEQ ID NO: 4799110 - DNA, 17 bp, Homo sapiens
agacagggcgtcctctc

SEQ ID NO: 4799111 - DNA, 18 bp, Homo sapiens
agacagggcgtcctctcg

SEQ ID NO: 4799112 - DNA, 13 bp, Homo sapiens
agacagggtgggg

SEQ ID NO: 4799113 - DNA, 14 bp, Homo sapiens
agacagggtggggc

SEQ ID NO: 4799114 - DNA, 19 bp, Homo sapiens
agacagggtggggcttaga

SEQ ID NO: 4799115 - DNA, 19 bp, Homo sapiens
agacagtttcttgcaagct

SEQ ID NO: 4799116 - DNA, 22 bp, Homo sapiens
agacagtttcttgcaagctcca

SEQ ID NO: 4799117 - DNA, 16 bp, Homo sapiens
agacatccacaatgga

SEQ ID NO: 4799118 - DNA, 18 bp, Homo sapiens
agacattcaccaacaaca

SEQ ID NO: 4799119 - DNA, 23 bp, Homo sapiens
agaccacatgcgctcctggcttt

SEQ ID NO: 4799120 - DNA, 18 bp, Homo sapiens
agaccacccatatcatgc

SEQ ID NO: 4799121 - DNA, 19 bp, Homo sapiens
agaccacccatatcatgca

SEQ ID NO: 4799122 - DNA, 16 bp, Homo sapiens
agaccacgcccctgcc

SEQ ID NO: 4799123 - DNA, 16 bp, Homo sapiens
agaccacttccttaac

SEQ ID NO: 4799124 - DNA, 12 bp, Homo sapiens
agaccagagagc

SEQ ID NO: 4799125 - DNA, 17 bp, Homo sapiens
agaccatgcattcagat

SEQ ID NO: 4799126 - DNA, 23 bp, Homo sapiens
agaccatgcattcagatctgaag

SEQ ID NO: 4799127 - DNA, 22 bp, Homo sapiens
agacccccatggtaatgtaact

SEQ ID NO: 4799128 - DNA, 23 bp, Homo sapiens
agacccctgggggaggcttccag

SEQ ID NO: 4799129 - DNA, 14 bp, Homo sapiens
agacccctgggtgg

SEQ ID NO: 4799130 - DNA, 20 bp, Homo sapiens
agaccctgccaactttccag

SEQ ID NO: 4799131 - DNA, 21 bp, Homo sapiens
agaccctgccaactttccaga

SEQ ID NO: 4799132 - DNA, 15 bp, Homo sapiens
agaccctgcgcccct

SEQ ID NO: 4799133 - DNA, 14 bp, Homo sapiens
agaccggggtggag

SEQ ID NO: 4799134 - DNA, 23 bp, Homo sapiens
agaccggggtggagtcagggctg

SEQ ID NO: 4799135 - DNA, 17 bp, Homo sapiens
agaccgtggtgtcctct

SEQ ID NO: 4799136 - DNA, 20 bp, Homo sapiens
agaccgtggtgtcctctgtc

SEQ ID NO: 4799137 - DNA, 12 bp, Homo sapiens
agacctccccca

SEQ ID NO: 4799138 - DNA, 20 bp, Homo sapiens
agacctcccccagggagggg

SEQ ID NO: 4799139 - DNA, 16 bp, Homo sapiens
agacctcggctgtgtg

SEQ ID NO: 4799140 - DNA, 20 bp, Homo sapiens
agacctcggctgtgtgggga

SEQ ID NO: 4799141 - DNA, 18 bp, Homo sapiens
agacctgctccagatcct

SEQ ID NO: 4799142 - DNA, 18 bp, Homo sapiens
agacgaggtgtcttcctt

SEQ ID NO: 4799143 - DNA, 15 bp, Homo sapiens
agacggacgggacag

SEQ ID NO: 4799144 - DNA, 23 bp, Homo sapiens
agacggacgggacagcggcccgg

SEQ ID NO: 4799145 - DNA, 14 bp, Homo sapiens
agacggatccacag

SEQ ID NO: 4799146 - DNA, 13 bp, Homo sapiens
agacggcagcccc

SEQ ID NO: 4799147 - DNA, 16 bp, Homo sapiens
agacgtggtgcttctc

SEQ ID NO: 4799148 - DNA, 22 bp, Homo sapiens
agactaaatgagaggaaaagaa

SEQ ID NO: 4799149 - DNA, 24 bp, Homo sapiens
agactaagggcaggaagacttcca

SEQ ID NO: 4799150 - DNA, 16 bp, Homo sapiens
agactatggagcctgg

SEQ ID NO: 4799151 - DNA, 21 bp, Homo sapiens
agactatggagcctggcacag

SEQ ID NO: 4799152 - DNA, 19 bp, Homo sapiens
agactcaaagaagtactgt

SEQ ID NO: 4799153 - DNA, 21 bp, Homo sapiens
agactcaaggcctccagccac

SEQ ID NO: 4799154 - DNA, 12 bp, Homo sapiens
agcaatcttggc

SEQ ID NO: 4799155 - DNA, 14 bp, Homo sapiens
agcaatcttggcag

SEQ ID NO: 4799156 - DNA, 18 bp, Homo sapiens
agcacaaaaaatttaaga

SEQ ID NO: 4799157 - DNA, 14 bp, Homo sapiens
agcacaaagcactg

SEQ ID NO: 4799158 - DNA, 16 bp, Homo sapiens
agcacacccttagcct

SEQ ID NO: 4799159 - DNA, 19 bp, Homo sapiens
agcacactgagtttgaaca

SEQ ID NO: 4799160 - DNA, 21 bp, Homo sapiens
agcacagagagcggcttcccc

SEQ ID NO: 4799161 - DNA, 22 bp, Homo sapiens
agcacagagagcggcttcccca

SEQ ID NO: 4799162 - DNA, 21 bp, Homo sapiens
agcacagaggatggcttcccc

SEQ ID NO: 4799163 - DNA, 22 bp, Homo sapiens
agcacagaggatggcttcccca

SEQ ID NO: 4799164 - DNA, 14 bp, Homo sapiens
agcacagccatagc

SEQ ID NO: 4799165 - DNA, 19 bp, Homo sapiens
agcacagctactcagatct

SEQ ID NO: 4799166 - DNA, 19 bp, Homo sapiens
agcacagtatttaacattc

SEQ ID NO: 4799167 - DNA, 16 bp, Homo sapiens
agcacatgctggccag

SEQ ID NO: 4799168 - DNA, 18 bp, Homo sapiens
agcacattattgtagaga

SEQ ID NO: 4799169 - DNA, 16 bp, Homo sapiens
agcaccagcctgagcc

SEQ ID NO: 4799170 - DNA, 21 bp, Homo sapiens
agcaccagcctgagccacagt

SEQ ID NO: 4799171 - DNA, 13 bp, Homo sapiens
agcaccagcttgc

SEQ ID NO: 4799172 - DNA, 22 bp, Homo sapiens
agcaccagcttgcttctctgcc

SEQ ID NO: 4799173 - DNA, 14 bp, Homo sapiens
agcacccccagcct

SEQ ID NO: 4799174 - DNA, 19 bp, Homo sapiens
agcacccccagcctccccc

SEQ ID NO: 4799175 - DNA, 13 bp, Homo sapiens
agcaccctccccc

SEQ ID NO: 4799176 - DNA, 14 bp, Homo sapiens
agcaccctcccccg

SEQ ID NO: 4799177 - DNA, 18 bp, Homo sapiens
agcaccctcccccgcagc

SEQ ID NO: 4799178 - DNA, 14 bp, Homo sapiens
agcaccctctcctg

SEQ ID NO: 4799179 - DNA, 18 bp, Homo sapiens
agcaccctctcctggggg

SEQ ID NO: 4799180 - DNA, 16 bp, Homo sapiens
agcaccgaatattgag

SEQ ID NO: 4799181 - DNA, 21 bp, Homo sapiens
agcaccgtggtgtgaggcccc

SEQ ID NO: 4799182 - DNA, 13 bp, Homo sapiens
agcacctcttgaa

SEQ ID NO: 4799183 - DNA, 22 bp, Homo sapiens
agcacctcttgaagaactgact

SEQ ID NO: 4799184 - DNA, 23 bp, Homo sapiens
agcacctttagaatattaaaaat

SEQ ID NO: 4799185 - DNA, 13 bp, Homo sapiens
agcacctttgtaa

SEQ ID NO: 4799186 - DNA, 22 bp, Homo sapiens
agcacgggcgttatgtaagttt

SEQ ID NO: 4799187 - DNA, 19 bp, Homo sapiens
agcactaaacttggtgctt

SEQ ID NO: 4799188 - DNA, 17 bp, Homo sapiens
agcactaaggccgtgtc

SEQ ID NO: 4799189 - DNA, 13 bp, Homo sapiens
agcactagaatga

SEQ ID NO: 4799190 - DNA, 12 bp, Homo sapiens
agcactcccagg

SEQ ID NO: 4799191 - DNA, 14 bp, Homo sapiens
agcactcccagggc

SEQ ID NO: 4799192 - DNA, 19 bp, Homo sapiens
agcactgccaactcggctg

SEQ ID NO: 4799193 - DNA, 22 bp, Homo sapiens
agcactggccttgcctccagga

SEQ ID NO: 4799194 - DNA, 20 bp, Homo sapiens
agcactgtttggatatgaga

SEQ ID NO: 4799195 - DNA, 17 bp, Homo sapiens
agcactttataagccaa

SEQ ID NO: 4799196 - DNA, 18 bp, Homo sapiens
agcactttgggaggctga

SEQ ID NO: 4799197 - DNA, 13 bp, Homo sapiens
agcagaatgagat

SEQ ID NO: 4799198 - DNA, 17 bp, Homo sapiens
agcagaatgagatgatt

SEQ ID NO: 4799199 - DNA, 16 bp, Homo sapiens
agcagaattcattcat

SEQ ID NO: 4799200 - DNA, 14 bp, Homo sapiens
agcagacactccag

SEQ ID NO: 4799201 - DNA, 21 bp, Homo sapiens
agcagagacggcagccccatc

SEQ ID NO: 4799202 - DNA, 16 bp, Homo sapiens
agcagagatgtattat

SEQ ID NO: 4799203 - DNA, 15 bp, Homo sapiens
agcagagcgcagccc

SEQ ID NO: 4799204 - DNA, 15 bp, Homo sapiens
agcagagtcattgtt

SEQ ID NO: 4799205 - DNA, 15 bp, Homo sapiens
agcagcagcagcagc

SEQ ID NO: 4799206 - DNA, 15 bp, Homo sapiens
agcagcagtttgtga

SEQ ID NO: 4799207 - DNA, 20 bp, Homo sapiens
agcagcagtttgtgatctgt

SEQ ID NO: 4799208 - DNA, 13 bp, Homo sapiens
agcagccccccag

SEQ ID NO: 4799209 - DNA, 17 bp, Homo sapiens
agcagccccccagcact

SEQ ID NO: 4799210 - DNA, 18 bp, Homo sapiens
agcagccccccagcacta

SEQ ID NO: 4799211 - DNA, 14 bp, Homo sapiens
agcagcctctgaag

SEQ ID NO: 4799212 - DNA, 16 bp, Homo sapiens
agcagcctgcttccca

SEQ ID NO: 4799213 - DNA, 19 bp, Homo sapiens
agcagcgcccgaggccagg

SEQ ID NO: 4799214 - DNA, 11 bp, Homo sapiens
agcagctccaa

SEQ ID NO: 4799215 - DNA, 14 bp, Homo sapiens
agcagctccaacct

SEQ ID NO: 4799216 - DNA, 16 bp, Homo sapiens
agcagctccaacctgg

SEQ ID NO: 4799217 - DNA, 21 bp, Homo sapiens
agcagctccaacctggaggct

SEQ ID NO: 4799218 - DNA, 23 bp, Homo sapiens
agcagctccaacctggaggctgg

SEQ ID NO: 4799219 - DNA, 17 bp, Homo sapiens
agcaggaaggcctgggt

SEQ ID NO: 4799220 - DNA, 15 bp, Homo sapiens
agcaggagcatggcc

SEQ ID NO: 4799221 - DNA, 19 bp, Homo sapiens
agcaggctctcaggccagc

SEQ ID NO: 4799222 - DNA, 23 bp, Homo sapiens
agcaggggggttgggttccagac

SEQ ID NO: 4799223 - DNA, 15 bp, Homo sapiens
agcagtacatcttgt

SEQ ID NO: 4799224 - DNA, 16 bp, Homo sapiens
agcagtaccatcccac

SEQ ID NO: 4799225 - DNA, 21 bp, Homo sapiens
agcagtaccatcccactgata

SEQ ID NO: 4799226 - DNA, 13 bp, Homo sapiens
agcagtggggagc

SEQ ID NO: 4799227 - DNA, 23 bp, Homo sapiens
agcagtgtcctgtgctttctgca

SEQ ID NO: 4799228 - DNA, 14 bp, Homo sapiens
agcagtttcagata

SEQ ID NO: 4799229 - DNA, 22 bp, Homo sapiens
agcataccagttcttgcaataa

SEQ ID NO: 4799230 - DNA, 16 bp, Homo sapiens
agcataggctggggac

SEQ ID NO: 4799231 - DNA, 17 bp, Homo sapiens
agcataggctggggaca

SEQ ID NO: 4799232 - DNA, 18 bp, Homo sapiens
agcataggctggggacac

SEQ ID NO: 4799233 - DNA, 21 bp, Homo sapiens
agcatagttctgcaataacag

SEQ ID NO: 4799234 - DNA, 22 bp, Homo sapiens
agcatagttctgcaataacagt

SEQ ID NO: 4799235 - DNA, 20 bp, Homo sapiens
agcatataaggctaaatgta

SEQ ID NO: 4799236 - DNA, 21 bp, Homo sapiens
agcatataaggctaaatgtaa

SEQ ID NO: 4799237 - DNA, 11 bp, Homo sapiens
agcatatataa

SEQ ID NO: 4799238 - DNA, 23 bp, Homo sapiens
agcatcctggaaatttgtgtgct

SEQ ID NO: 4799239 - DNA, 16 bp, Homo sapiens
agcatcgtgtgggtcc

SEQ ID NO: 4799240 - DNA, 16 bp, Homo sapiens
agcatctatgtgagac

SEQ ID NO: 4799241 - DNA, 22 bp, Homo sapiens
agcatgaagataaacacagctg

SEQ ID NO: 4799242 - DNA, 16 bp, Homo sapiens
agcatgagttctgcac

SEQ ID NO: 4799243 - DNA, 18 bp, Homo sapiens
agcatgcatttagcatga

SEQ ID NO: 4799244 - DNA, 20 bp, Homo sapiens
agcatgcatttagcatgagt

SEQ ID NO: 4799245 - DNA, 23 bp, Homo sapiens
agcatggactaaccccaacgcac

SEQ ID NO: 4799246 - DNA, 12 bp, Homo sapiens
agcatggctgcc

SEQ ID NO: 4799247 - DNA, 19 bp, Homo sapiens
agcatggctgccaatggga

SEQ ID NO: 4799248 - DNA, 17 bp, Homo sapiens
agcatgtcttatttaaa

SEQ ID NO: 4799249 - DNA, 13 bp, Homo sapiens
agcattctggggt

SEQ ID NO: 4799250 - DNA, 16 bp, Homo sapiens
agcatttgactttctg

SEQ ID NO: 4799251 - DNA, 21 bp, Homo sapiens
agcattttaatagtttctaaa

SEQ ID NO: 4799252 - DNA, 22 bp, Homo sapiens
agcattttaatagtttctaaac

SEQ ID NO: 4799253 - DNA, 20 bp, Homo sapiens
agccaaagagaaaagattaa

SEQ ID NO: 4799254 - DNA, 23 bp, Homo sapiens
agccaacttaaacctgtgctttc

SEQ ID NO: 4799255 - DNA, 23 bp, Homo sapiens
agccaaggccaaaggaagcacat

SEQ ID NO: 4799256 - DNA, 16 bp, Homo sapiens
agccaatttcaaagaa

SEQ ID NO: 4799257 - DNA, 17 bp, Homo sapiens
agccaatttcaaagaaa

SEQ ID NO: 4799258 - DNA, 13 bp, Homo sapiens
agccacagtgggg

SEQ ID NO: 4799259 - DNA, 14 bp, Homo sapiens
agccacagtggggc

SEQ ID NO: 4799260 - DNA, 20 bp, Homo sapiens
agccacagtggggcccatgg

SEQ ID NO: 4799261 - DNA, 14 bp, Homo sapiens
agccacataaccag

SEQ ID NO: 4799262 - DNA, 19 bp, Homo sapiens
agccacccggatctccagg

SEQ ID NO: 4799263 - DNA, 21 bp, Homo sapiens
agccacccggatctccaggcc

SEQ ID NO: 4799264 - DNA, 11 bp, Homo sapiens
agccagaggag

SEQ ID NO: 4799265 - DNA, 20 bp, Homo sapiens
agccagaggagagaggaccc

SEQ ID NO: 4799266 - DNA, 14 bp, Homo sapiens
agccagatgacagg

SEQ ID NO: 4799267 - DNA, 16 bp, Homo sapiens
agccagcaggctctca

SEQ ID NO: 4799268 - DNA, 20 bp, Homo sapiens
agccagcaggctctcaggcc

SEQ ID NO: 4799269 - DNA, 23 bp, Homo sapiens
agccagcaggctctcaggccagc

SEQ ID NO: 4799270 - DNA, 11 bp, Homo sapiens
agccagcaggt

SEQ ID NO: 4799271 - DNA, 15 bp, Homo sapiens
agccagccgccctgg

SEQ ID NO: 4799272 - DNA, 16 bp, Homo sapiens
agccagccgccctggg

SEQ ID NO: 4799273 - DNA, 22 bp, Homo sapiens
agccagccgccctgggctgtct

SEQ ID NO: 4799274 - DNA, 15 bp, Homo sapiens
agccaggagaccctg

SEQ ID NO: 4799275 - DNA, 18 bp, Homo sapiens
agccaggagaccctgtct

SEQ ID NO: 4799276 - DNA, 17 bp, Homo sapiens
aggcaccatgctgggcc

SEQ ID NO: 4799277 - DNA, 22 bp, Homo sapiens
aggcaccgccagagtgtcctgc

SEQ ID NO: 4799278 - DNA, 23 bp, Homo sapiens
aggcaccgccagagtgtcctgct

SEQ ID NO: 4799279 - DNA, 17 bp, Homo sapiens
aggcaccggacgctgga

SEQ ID NO: 4799280 - DNA, 15 bp, Homo sapiens
aggcagaatggtggg

SEQ ID NO: 4799281 - DNA, 17 bp, Homo sapiens
aggcagcaacaggacca

SEQ ID NO: 4799282 - DNA, 18 bp, Homo sapiens
aggcagcctgtgggtcct

SEQ ID NO: 4799283 - DNA, 19 bp, Homo sapiens
aggcagcctgtgggtcctt

SEQ ID NO: 4799284 - DNA, 13 bp, Homo sapiens
aggcagctgcagt

SEQ ID NO: 4799285 - DNA, 14 bp, Homo sapiens
aggcagctggattg

SEQ ID NO: 4799286 - DNA, 12 bp, Homo sapiens
aggcagggaggg

SEQ ID NO: 4799287 - DNA, 16 bp, Homo sapiens
aggcagggcaaatgac

SEQ ID NO: 4799288 - DNA, 24 bp, Homo sapiens
aggcagggcaaatgacatgcactg

SEQ ID NO: 4799289 - DNA, 12 bp, Homo sapiens
aggcagggccct

SEQ ID NO: 4799290 - DNA, 13 bp, Homo sapiens
aggcagggccctg

SEQ ID NO: 4799291 - DNA, 16 bp, Homo sapiens
aggcagggccctgaaa

SEQ ID NO: 4799292 - DNA, 14 bp, Homo sapiens
aggcagtctttgct

SEQ ID NO: 4799293 - DNA, 15 bp, Homo sapiens
aggcatactctccag

SEQ ID NO: 4799294 - DNA, 14 bp, Homo sapiens
aggcatccccagtg

SEQ ID NO: 4799295 - DNA, 18 bp, Homo sapiens
aggcatctaagacattca

SEQ ID NO: 4799296 - DNA, 11 bp, Homo sapiens
aggcatgagct

SEQ ID NO: 4799297 - DNA, 17 bp, Homo sapiens
aggcatgcctctgatat

SEQ ID NO: 4799298 - DNA, 21 bp, Homo sapiens
aggcatgcctctgatatggga

SEQ ID NO: 4799299 - DNA, 19 bp, Homo sapiens
aggccaaaggaagcacatg

SEQ ID NO: 4799300 - DNA, 19 bp, Homo sapiens
aggccaaatgagttccctt

SEQ ID NO: 4799301 - DNA, 18 bp, Homo sapiens
aggccagagacacaagcc

SEQ ID NO: 4799302 - DNA, 23 bp, Homo sapiens
aggccagagacacaagccttcgg

SEQ ID NO: 4799303 - DNA, 13 bp, Homo sapiens
aggccagctgctt

SEQ ID NO: 4799304 - DNA, 18 bp, Homo sapiens
aggcccaaccaccagatg

SEQ ID NO: 4799305 - DNA, 21 bp, Homo sapiens
aggccccatcagcatcccacg

SEQ ID NO: 4799306 - DNA, 13 bp, Homo sapiens
aggcccccggagg

SEQ ID NO: 4799307 - DNA, 13 bp, Homo sapiens
aggccccttccca

SEQ ID NO: 4799308 - DNA, 14 bp, Homo sapiens
aggcccgccctgcc

SEQ ID NO: 4799309 - DNA, 13 bp, Homo sapiens
aggcccgggagga

SEQ ID NO: 4799310 - DNA, 14 bp, Homo sapiens
aggccctccctgac

SEQ ID NO: 4799311 - DNA, 22 bp, Homo sapiens
aggccctccctgactccctgtg

SEQ ID NO: 4799312 - DNA, 12 bp, Homo sapiens
aggccctgcagt

SEQ ID NO: 4799313 - DNA, 13 bp, Homo sapiens
aggccctgcagtg

SEQ ID NO: 4799314 - DNA, 14 bp, Homo sapiens
aggccggccagcct

SEQ ID NO: 4799315 - DNA, 22 bp, Homo sapiens
aggccggtgggaagagggcagg

SEQ ID NO: 4799316 - DNA, 18 bp, Homo sapiens
aggccgtgtctctgagga

SEQ ID NO: 4799317 - DNA, 19 bp, Homo sapiens
aggcctaatctcatacctc

SEQ ID NO: 4799318 - DNA, 16 bp, Homo sapiens
aggcctcacctggctt

SEQ ID NO: 4799319 - DNA, 18 bp, Homo sapiens
aggcctcacctggcttcc

SEQ ID NO: 4799320 - DNA, 23 bp, Homo sapiens
aggcctcccgcatgctgcctgcc

SEQ ID NO: 4799321 - DNA, 22 bp, Homo sapiens
aggcctgagggaagcccacccg

SEQ ID NO: 4799322 - DNA, 23 bp, Homo sapiens
aggcctgagggaagcccacccgc

SEQ ID NO: 4799323 - DNA, 17 bp, Homo sapiens
aggcctgccccccttcc

SEQ ID NO: 4799324 - DNA, 19 bp, Homo sapiens
aggcctgccccccttccca

SEQ ID NO: 4799325 - DNA, 23 bp, Homo sapiens
aggcctgccccccttcccacccc

SEQ ID NO: 4799326 - DNA, 12 bp, Homo sapiens
aggcctggccca

SEQ ID NO: 4799327 - DNA, 22 bp, Homo sapiens
aggcctggcccagccagcaggt

SEQ ID NO: 4799328 - DNA, 18 bp, Homo sapiens
aggcctgggggctgggca

SEQ ID NO: 4799329 - DNA, 20 bp, Homo sapiens
aggcctgggggctgggcaga

SEQ ID NO: 4799330 - DNA, 14 bp, Homo sapiens
aggcctggtctgga

SEQ ID NO: 4799331 - DNA, 16 bp, Homo sapiens
aggcctggtctggagc

SEQ ID NO: 4799332 - DNA, 14 bp, Homo sapiens
aggccttaacaaac

SEQ ID NO: 4799333 - DNA, 19 bp, Homo sapiens
aggccttcctcctctcaaa

SEQ ID NO: 4799334 - DNA, 17 bp, Homo sapiens
aggcgcccacctgccca

SEQ ID NO: 4799335 - DNA, 20 bp, Homo sapiens
aggcgccgcctcgcccccgg

SEQ ID NO: 4799336 - DNA, 12 bp, Homo sapiens
aggcgcgcaccg

SEQ ID NO: 4799337 - DNA, 19 bp, Homo sapiens
aggcgcgcaccgcccaacc

SEQ ID NO: 4799338 - DNA, 15 bp, Homo sapiens
aggcgtcttgtattt

SEQ ID NO: 4799339 - DNA, 18 bp, Homo sapiens
aggcgtgggatccagaga

SEQ ID NO: 4799340 - DNA, 14 bp, Homo sapiens
aggctaagaaagaa

SEQ ID NO: 4799341 - DNA, 18 bp, Homo sapiens
aggctacagttgatattt

SEQ ID NO: 4799342 - DNA, 13 bp, Homo sapiens
aggctactgccac

SEQ ID NO: 4799343 - DNA, 16 bp, Homo sapiens
aggctcacaactgttt

SEQ ID NO: 4799344 - DNA, 23 bp, Homo sapiens
aggctcacaactgtttttgaaga

SEQ ID NO: 4799345 - DNA, 18 bp, Homo sapiens
aggctcaggctgcccagc

SEQ ID NO: 4799346 - DNA, 22 bp, Homo sapiens
aggctccttagtttattgtggt

SEQ ID NO: 4799347 - DNA, 12 bp, Homo sapiens
aggctctcaggc

SEQ ID NO: 4799348 - DNA, 15 bp, Homo sapiens
aggctctcaggccag

SEQ ID NO: 4799349 - DNA, 16 bp, Homo sapiens
aggctctcaggccagc

SEQ ID NO: 4799350 - DNA, 18 bp, Homo sapiens
aggctctcaggccagctg

SEQ ID NO: 4799351 - DNA, 19 bp, Homo sapiens
aggctctcaggccagctgc

SEQ ID NO: 4799352 - DNA, 21 bp, Homo sapiens
aggctctcaggccagctgctt

SEQ ID NO: 4799353 - DNA, 15 bp, Homo sapiens
aggctctgaatctct

SEQ ID NO: 4799354 - DNA, 21 bp, Homo sapiens
aggctctgagactaaatgaga

SEQ ID NO: 4799355 - DNA, 21 bp, Homo sapiens
aggctgagacacagcccagag

SEQ ID NO: 4799356 - DNA, 17 bp, Homo sapiens
aggctgcagctaatttg

SEQ ID NO: 4799357 - DNA, 14 bp, Homo sapiens
aggctgcagggaca

SEQ ID NO: 4799358 - DNA, 12 bp, Homo sapiens
aggctgcccagc

SEQ ID NO: 4799359 - DNA, 15 bp, Homo sapiens
aggctgcgcctgccc

SEQ ID NO: 4799360 - DNA, 18 bp, Homo sapiens
aggctgcgcctgcccgcc

SEQ ID NO: 4799361 - DNA, 17 bp, Homo sapiens
aggctgctaagtggaag

SEQ ID NO: 4799362 - DNA, 11 bp, Homo sapiens
aggctggacca

SEQ ID NO: 4799363 - DNA, 16 bp, Homo sapiens
aggctggataggagag

SEQ ID NO: 4799364 - DNA, 17 bp, Homo sapiens
aggctggataggagagg

SEQ ID NO: 4799365 - DNA, 14 bp, Homo sapiens
aggctggcggggtc

SEQ ID NO: 4799366 - DNA, 14 bp, Homo sapiens
aggctgggcccctg

SEQ ID NO: 4799367 - DNA, 16 bp, Homo sapiens
aggctgggcccctggg

SEQ ID NO: 4799368 - DNA, 12 bp, Homo sapiens
aggctggggaca

SEQ ID NO: 4799369 - DNA, 19 bp, Homo sapiens
aggctgtcaattacaggaa

SEQ ID NO: 4799370 - DNA, 18 bp, Homo sapiens
aggctgttctgcactgaa

SEQ ID NO: 4799371 - DNA, 19 bp, Homo sapiens
aggctgttctgcactgaaa

SEQ ID NO: 4799372 - DNA, 20 bp, Homo sapiens
aggctgttctgcactgaaaa

SEQ ID NO: 4799373 - DNA, 15 bp, Homo sapiens
aggcttccagctcag

SEQ ID NO: 4799374 - DNA, 18 bp, Homo sapiens
aggcttcgtttgcctcca

SEQ ID NO: 4799375 - DNA, 21 bp, Homo sapiens
aggcttctatgtccaacagag

SEQ ID NO: 4799376 - DNA, 19 bp, Homo sapiens
aggctttattcttccaagt

SEQ ID NO: 4799377 - DNA, 12 bp, Homo sapiens
aggctttctatt

SEQ ID NO: 4799378 - DNA, 14 bp, Homo sapiens
agggaaatcaattt

SEQ ID NO: 4799379 - DNA, 21 bp, Homo sapiens
agggaaatcaatttaaaggaa

SEQ ID NO: 4799380 - DNA, 23 bp, Homo sapiens
agggaaattcacactgtgcgttt

SEQ ID NO: 4799381 - DNA, 23 bp, Homo sapiens
agggaagaaaactatcctgcggg

SEQ ID NO: 4799382 - DNA, 15 bp, Homo sapiens
agggaagcccacccg

SEQ ID NO: 4799383 - DNA, 13 bp, Homo sapiens
agggacacagagg

SEQ ID NO: 4799384 - DNA, 13 bp, Homo sapiens
agggacagcctgc

SEQ ID NO: 4799385 - DNA, 17 bp, Homo sapiens
agggacatgtctttggc

SEQ ID NO: 4799386 - DNA, 19 bp, Homo sapiens
agggacccttggctcctgt

SEQ ID NO: 4799387 - DNA, 22 bp, Homo sapiens
agggacgacccggggcgggctg

SEQ ID NO: 4799388 - DNA, 19 bp, Homo sapiens
agggacgactttctttaac

SEQ ID NO: 4799389 - DNA, 20 bp, Homo sapiens
agggacgactttctttaaca

SEQ ID NO: 4799390 - DNA, 18 bp, Homo sapiens
agggactccaagccctgg

SEQ ID NO: 4799391 - DNA, 19 bp, Homo sapiens
agggactccaagccctggg

SEQ ID NO: 4799392 - DNA, 20 bp, Homo sapiens
agggactccaagccctgggg

SEQ ID NO: 4799393 - DNA, 17 bp, Homo sapiens
agggactgcctctgcca

SEQ ID NO: 4799394 - DNA, 14 bp, Homo sapiens
agggagaaaggcaa

SEQ ID NO: 4799395 - DNA, 16 bp, Homo sapiens
agggagccatgctctt

SEQ ID NO: 4799396 - DNA, 22 bp, Homo sapiens
agggagggaacagacctcggct

SEQ ID NO: 4799397 - DNA, 16 bp, Homo sapiens
agggaggtcaggccct

SEQ ID NO: 4799398 - DNA, 16 bp, Homo sapiens
agtctcctcactgcca

SEQ ID NO: 4799399 - DNA, 17 bp, Homo sapiens
agtctcctcactgccac

SEQ ID NO: 4799400 - DNA, 19 bp, Homo sapiens
agtctcctcactgccacta

SEQ ID NO: 4799401 - DNA, 18 bp, Homo sapiens
agtctctctaagacaaat

SEQ ID NO: 4799402 - DNA, 17 bp, Homo sapiens
agtctcttgattcataa

SEQ ID NO: 4799403 - DNA, 15 bp, Homo sapiens
agtctgaaggagagg

SEQ ID NO: 4799404 - DNA, 17 bp, Homo sapiens
agtctgaagtttcattt

SEQ ID NO: 4799405 - DNA, 11 bp, Homo sapiens
agtctgcagct

SEQ ID NO: 4799406 - DNA, 20 bp, Homo sapiens
agtctgcagctattcacaca

SEQ ID NO: 4799407 - DNA, 11 bp, Homo sapiens
agtctggataa

SEQ ID NO: 4799408 - DNA, 19 bp, Homo sapiens
agtctgtacttcagttctc

SEQ ID NO: 4799409 - DNA, 18 bp, Homo sapiens
agtctgtgaataaagcca

SEQ ID NO: 4799410 - DNA, 15 bp, Homo sapiens
agtcttgagtgggcc

SEQ ID NO: 4799411 - DNA, 17 bp, Homo sapiens
agtcttgagtgggcccc

SEQ ID NO: 4799412 - DNA, 18 bp, Homo sapiens
agtcttgttgttcatata

SEQ ID NO: 4799413 - DNA, 21 bp, Homo sapiens
agtgaaaacctctttcggaaa

SEQ ID NO: 4799414 - DNA, 19 bp, Homo sapiens
agtgaactatttctacaca

SEQ ID NO: 4799415 - DNA, 22 bp, Homo sapiens
agtgaagccagctgcaggaatc

SEQ ID NO: 4799416 - DNA, 16 bp, Homo sapiens
agtgaagcccaggagg

SEQ ID NO: 4799417 - DNA, 21 bp, Homo sapiens
agtgaagtatgcactaatcaa

SEQ ID NO: 4799418 - DNA, 11 bp, Homo sapiens
agtgaccagca

SEQ ID NO: 4799419 - DNA, 21 bp, Homo sapiens
agtgaccagcataccagttct

SEQ ID NO: 4799420 - DNA, 13 bp, Homo sapiens
agtgacccttccc

SEQ ID NO: 4799421 - DNA, 19 bp, Homo sapiens
agtgactgaacgatccttc

SEQ ID NO: 4799422 - DNA, 17 bp, Homo sapiens
agtgagaaaactgtgac

SEQ ID NO: 4799423 - DNA, 16 bp, Homo sapiens
agtgagaaaatgaaca

SEQ ID NO: 4799424 - DNA, 21 bp, Homo sapiens
agtgagaaatttttttccaga

SEQ ID NO: 4799425 - DNA, 23 bp, Homo sapiens
agtgagacctccctgtctctaca

SEQ ID NO: 4799426 - DNA, 16 bp, Homo sapiens
agtgagagcagggctg

SEQ ID NO: 4799427 - DNA, 20 bp, Homo sapiens
agtgagagcagggctgggcg

SEQ ID NO: 4799428 - DNA, 14 bp, Homo sapiens
agtgagatgtttgg

SEQ ID NO: 4799429 - DNA, 17 bp, Homo sapiens
agtgagatgtttggcaa

SEQ ID NO: 4799430 - DNA, 20 bp, Homo sapiens
agtgagatttgtatttatat

SEQ ID NO: 4799431 - DNA, 15 bp, Homo sapiens
agtgagctaccagga

SEQ ID NO: 4799432 - DNA, 18 bp, Homo sapiens
agtgagctaccaggaaga

SEQ ID NO: 4799433 - DNA, 16 bp, Homo sapiens
agtgaggatgaaaaaa

SEQ ID NO: 4799434 - DNA, 15 bp, Homo sapiens
agtgagttggggcga

SEQ ID NO: 4799435 - DNA, 14 bp, Homo sapiens
agtgatgtgattta

SEQ ID NO: 4799436 - DNA, 23 bp, Homo sapiens
agtgatgtggtgggagcacagct

SEQ ID NO: 4799437 - DNA, 17 bp, Homo sapiens
agtgcagggacagcctg

SEQ ID NO: 4799438 - DNA, 20 bp, Homo sapiens
agtgcagggacagcctgcac

SEQ ID NO: 4799439 - DNA, 21 bp, Homo sapiens
agtgcagggacagcctgcaca

SEQ ID NO: 4799440 - DNA, 15 bp, Homo sapiens
agtgcagtagtgcca

SEQ ID NO: 4799441 - DNA, 23 bp, Homo sapiens
agtgcagtggcatcatctcagct

SEQ ID NO: 4799442 - DNA, 23 bp, Homo sapiens
agtgcagtggcgcgatctcagct

SEQ ID NO: 4799443 - DNA, 16 bp, Homo sapiens
agtgcatgctgtccct

SEQ ID NO: 4799444 - DNA, 17 bp, Homo sapiens
agtgcatgtcacatgac

SEQ ID NO: 4799445 - DNA, 20 bp, Homo sapiens
agtgcattcattcatcctct

SEQ ID NO: 4799446 - DNA, 22 bp, Homo sapiens
agtgcattcattcatcctctta

SEQ ID NO: 4799447 - DNA, 13 bp, Homo sapiens
agtgcctgtgatc

SEQ ID NO: 4799448 - DNA, 15 bp, Homo sapiens
agtgccttacacaat

SEQ ID NO: 4799449 - DNA, 20 bp, Homo sapiens
agtgctaaacctatctgtat

SEQ ID NO: 4799450 - DNA, 21 bp, Homo sapiens
agtgctagtgagctgggcatg

SEQ ID NO: 4799451 - DNA, 15 bp, Homo sapiens
agtgctcagtattga

SEQ ID NO: 4799452 - DNA, 17 bp, Homo sapiens
agtgctttatccacatt

SEQ ID NO: 4799453 - DNA, 18 bp, Homo sapiens
agtggaagacagagatgg

SEQ ID NO: 4799454 - DNA, 22 bp, Homo sapiens
agtggaagacagagatggcaga

SEQ ID NO: 4799455 - DNA, 13 bp, Homo sapiens
agtggaagagctg

SEQ ID NO: 4799456 - DNA, 22 bp, Homo sapiens
agtggaagatttcttgactatt

SEQ ID NO: 4799457 - DNA, 21 bp, Homo sapiens
agtggaaggataatgagatgt

SEQ ID NO: 4799458 - DNA, 12 bp, Homo sapiens
agtggacagcag

SEQ ID NO: 4799459 - DNA, 14 bp, Homo sapiens
agtggacatttgtt

SEQ ID NO: 4799460 - DNA, 18 bp, Homo sapiens
agtggacgtgggctccag

SEQ ID NO: 4799461 - DNA, 16 bp, Homo sapiens
agtggactcttccctc

SEQ ID NO: 4799462 - DNA, 15 bp, Homo sapiens
agtggactgtatttc

SEQ ID NO: 4799463 - DNA, 16 bp, Homo sapiens
agtggactgtatttcg

SEQ ID NO: 4799464 - DNA, 14 bp, Homo sapiens
agtggatcacacac

SEQ ID NO: 4799465 - DNA, 13 bp, Homo sapiens
agtggatctggag

SEQ ID NO: 4799466 - DNA, 21 bp, Homo sapiens
agtggcctacaaatcagtaat

SEQ ID NO: 4799467 - DNA, 19 bp, Homo sapiens
agtggcgtgatctcagctc

SEQ ID NO: 4799468 - DNA, 18 bp, Homo sapiens
agtgggaactctgacaag

SEQ ID NO: 4799469 - DNA, 22 bp, Homo sapiens
agtgggatcttacccacttccc

SEQ ID NO: 4799470 - DNA, 14 bp, Homo sapiens
agtgggccccctct

SEQ ID NO: 4799471 - DNA, 16 bp, Homo sapiens
agtgggcggcttccct

SEQ ID NO: 4799472 - DNA, 23 bp, Homo sapiens
agtggggacgggggctgcttctc

SEQ ID NO: 4799473 - DNA, 20 bp, Homo sapiens
agtggggcccatggccccag

SEQ ID NO: 4799474 - DNA, 21 bp, Homo sapiens
agtggggcccatggccccagc

SEQ ID NO: 4799475 - DNA, 22 bp, Homo sapiens
agtggggcccatggccccagct

SEQ ID NO: 4799476 - DNA, 19 bp, Homo sapiens
agtgggggagtggccacag

SEQ ID NO: 4799477 - DNA, 20 bp, Homo sapiens
agtggtagagtcctaggaca

SEQ ID NO: 4799478 - DNA, 21 bp, Homo sapiens
agtggtggtgaacagaacaaa

SEQ ID NO: 4799479 - DNA, 17 bp, Homo sapiens
agtgtaacccaagcatt

SEQ ID NO: 4799480 - DNA, 21 bp, Homo sapiens
agtgtacatttgatttgatat

SEQ ID NO: 4799481 - DNA, 16 bp, Homo sapiens
agtgtactctgagtcc

SEQ ID NO: 4799482 - DNA, 16 bp, Homo sapiens
agtgtactggatttaa

SEQ ID NO: 4799483 - DNA, 15 bp, Homo sapiens
agtgtatgcatacaa

SEQ ID NO: 4799484 - DNA, 13 bp, Homo sapiens
agtgtatgtatac

SEQ ID NO: 4799485 - DNA, 20 bp, Homo sapiens
agtgtatttaatgtttgtaa

SEQ ID NO: 4799486 - DNA, 21 bp, Homo sapiens
agtgtatttaatgtttgtaag

SEQ ID NO: 4799487 - DNA, 15 bp, Homo sapiens
agtgtatttttgtaa

SEQ ID NO: 4799488 - DNA, 22 bp, Homo sapiens
agtgtcacttttttcctgtcaa

SEQ ID NO: 4799489 - DNA, 21 bp, Homo sapiens
agtgtcattttctgttataca

SEQ ID NO: 4799490 - DNA, 17 bp, Homo sapiens
agtgtccaactccaagt

SEQ ID NO: 4799491 - DNA, 21 bp, Homo sapiens
agtgtctggatcagtaaaatt

SEQ ID NO: 4799492 - DNA, 19 bp, Homo sapiens
agtgtctggcccagccatg

SEQ ID NO: 4799493 - DNA, 21 bp, Homo sapiens
agtgtctggcccagccatggc

SEQ ID NO: 4799494 - DNA, 23 bp, Homo sapiens
agtgtcttttttttcttcacctc

SEQ ID NO: 4799495 - DNA, 15 bp, Homo sapiens
agtgtgagtgttaga

SEQ ID NO: 4799496 - DNA, 12 bp, Homo sapiens
agtgtgcctgct

SEQ ID NO: 4799497 - DNA, 16 bp, Homo sapiens
agtgtgcctgctatcc

SEQ ID NO: 4799498 - DNA, 18 bp, Homo sapiens
agtgtgctcggacacagt

SEQ ID NO: 4799499 - DNA, 19 bp, Homo sapiens
agtgttataaaatctgtat

SEQ ID NO: 4799500 - DNA, 17 bp, Homo sapiens
agtgttcaaattctgat

SEQ ID NO: 4799501 - DNA, 18 bp, Homo sapiens
agtgttcaaattctgatt

SEQ ID NO: 4799502 - DNA, 18 bp, Homo sapiens
agtgttcccttctggctg

SEQ ID NO: 4799503 - DNA, 20 bp, Homo sapiens
agtgttgaggaggggagcaa

SEQ ID NO: 4799504 - DNA, 21 bp, Homo sapiens
agtgttgggtggaggatggac

SEQ ID NO: 4799505 - DNA, 22 bp, Homo sapiens
agtgttgtgttacaataagtgt

SEQ ID NO: 4799506 - DNA, 22 bp, Homo sapiens
agtgtttaattgtataaaacag

SEQ ID NO: 4799507 - DNA, 17 bp, Homo sapiens
agtgttttcattctggt

SEQ ID NO: 4799508 - DNA, 17 bp, Homo sapiens
agttaaaggttactgtt

SEQ ID NO: 4799509 - DNA, 22 bp, Homo sapiens
agttaagcacaaccatgttctt

SEQ ID NO: 4799510 - DNA, 15 bp, Homo sapiens
agttaatgtgccaaa

SEQ ID NO: 4799511 - DNA, 16 bp, Homo sapiens
agttacagacaaagcg

SEQ ID NO: 4799512 - DNA, 17 bp, Homo sapiens
agttacagacaaagcgt

SEQ ID NO: 4799513 - DNA, 18 bp, Homo sapiens
agttacagacaaagcgtg

SEQ ID NO: 4799514 - DNA, 19 bp, Homo sapiens
agttagagactcgcctggg

SEQ ID NO: 4799515 - DNA, 18 bp, Homo sapiens
agttagctcacaagccgt

SEQ ID NO: 4799516 - DNA, 16 bp, Homo sapiens
agttataccagcaaaa

SEQ ID NO: 4799517 - DNA, 23 bp, Homo sapiens
agttatatgacttcttgttcatg

SEQ ID NO: 4799518 - DNA, 20 bp, Homo sapiens
agttattaaagtaatttaca

SEQ ID NO: 4799519 - DNA, 16 bp, Homo sapiens
atattctgcagaaaat

SEQ ID NO: 4799520 - DNA, 14 bp, Homo sapiens
atattgagcaatat

SEQ ID NO: 4799521 - DNA, 13 bp, Homo sapiens
atattgagcagaa

SEQ ID NO: 4799522 - DNA, 14 bp, Homo sapiens
atattgataataaa

SEQ ID NO: 4799523 - DNA, 16 bp, Homo sapiens
atattgatctgtatta

SEQ ID NO: 4799524 - DNA, 20 bp, Homo sapiens
atattgctattgtttatagg

SEQ ID NO: 4799525 - DNA, 24 bp, Homo sapiens
atattgctattgtttataggaaat

SEQ ID NO: 4799526 - DNA, 22 bp, Homo sapiens
atattgcttggactacctataa

SEQ ID NO: 4799527 - DNA, 16 bp, Homo sapiens
atattgtttaatgcaa

SEQ ID NO: 4799528 - DNA, 19 bp, Homo sapiens
atattgttttataaatgga

SEQ ID NO: 4799529 - DNA, 13 bp, Homo sapiens
atatttaaagtct

SEQ ID NO: 4799530 - DNA, 17 bp, Homo sapiens
atatttacaatgtatta

SEQ ID NO: 4799531 - DNA, 13 bp, Homo sapiens
atatttactgttt

SEQ ID NO: 4799532 - DNA, 19 bp, Homo sapiens
atatttattattttcatat

SEQ ID NO: 4799533 - DNA, 12 bp, Homo sapiens
atatttattgct

SEQ ID NO: 4799534 - DNA, 13 bp, Homo sapiens
atatttattgctt

SEQ ID NO: 4799535 - DNA, 14 bp, Homo sapiens
atatttattgcttt

SEQ ID NO: 4799536 - DNA, 18 bp, Homo sapiens
atatttattgctttataa

SEQ ID NO: 4799537 - DNA, 21 bp, Homo sapiens
atatttattgctttataaata

SEQ ID NO: 4799538 - DNA, 12 bp, Homo sapiens
atatttcactta

SEQ ID NO: 4799539 - DNA, 22 bp, Homo sapiens
atatttcacttaaactttgtca

SEQ ID NO: 4799540 - DNA, 12 bp, Homo sapiens
atatttcttcaa

SEQ ID NO: 4799541 - DNA, 18 bp, Homo sapiens
atatttcttcaaatatct

SEQ ID NO: 4799542 - DNA, 14 bp, Homo sapiens
atatttgcttattt

SEQ ID NO: 4799543 - DNA, 16 bp, Homo sapiens
atatttgcttatttat

SEQ ID NO: 4799544 - DNA, 13 bp, Homo sapiens
atatttgtatgat

SEQ ID NO: 4799545 - DNA, 13 bp, Homo sapiens
atattttcttaat

SEQ ID NO: 4799546 - DNA, 13 bp, Homo sapiens
atcaaaaaacaga

SEQ ID NO: 4799547 - DNA, 15 bp, Homo sapiens
atcaaaaaacagaaa

SEQ ID NO: 4799548 - DNA, 12 bp, Homo sapiens
atcaaaatgcat

SEQ ID NO: 4799549 - DNA, 22 bp, Homo sapiens
atcaaagtgtttaattgtataa

SEQ ID NO: 4799550 - DNA, 23 bp, Homo sapiens
atcaaagtgtttaattgtataaa

SEQ ID NO: 4799551 - DNA, 19 bp, Homo sapiens
atcaaataaaaattctaga

SEQ ID NO: 4799552 - DNA, 13 bp, Homo sapiens
atcaaatttttct

SEQ ID NO: 4799553 - DNA, 21 bp, Homo sapiens
atcaactgcatcaagatgtga

SEQ ID NO: 4799554 - DNA, 21 bp, Homo sapiens
atcaaggtgaaggatctgtcc

SEQ ID NO: 4799555 - DNA, 21 bp, Homo sapiens
atcaagtattactaaattgac

SEQ ID NO: 4799556 - DNA, 14 bp, Homo sapiens
atcaagtctgtgaa

SEQ ID NO: 4799557 - DNA, 19 bp, Homo sapiens
atcaatcacaaaagtatat

SEQ ID NO: 4799558 - DNA, 23 bp, Homo sapiens
atcaatcacaaaagtatattcaa

SEQ ID NO: 4799559 - DNA, 15 bp, Homo sapiens
atcaatcattgtaca

SEQ ID NO: 4799560 - DNA, 19 bp, Homo sapiens
atcaatctggcttctgcat

SEQ ID NO: 4799561 - DNA, 21 bp, Homo sapiens
atcaatgttcacgcaacttga

SEQ ID NO: 4799562 - DNA, 21 bp, Homo sapiens
atcacaaaagtatattcaaaa

SEQ ID NO: 4799563 - DNA, 18 bp, Homo sapiens
atcacaaactcatccatt

SEQ ID NO: 4799564 - DNA, 15 bp, Homo sapiens
atcacagatttccaa

SEQ ID NO: 4799565 - DNA, 21 bp, Homo sapiens
atcacatgcccctcttagaag

SEQ ID NO: 4799566 - DNA, 21 bp, Homo sapiens
atcaccgattcttccttgcca

SEQ ID NO: 4799567 - DNA, 22 bp, Homo sapiens
atcaccgggaacgcccccgccc

SEQ ID NO: 4799568 - DNA, 20 bp, Homo sapiens
atcacctaattaatttcagt

SEQ ID NO: 4799569 - DNA, 18 bp, Homo sapiens
atcacctgaattattaat

SEQ ID NO: 4799570 - DNA, 21 bp, Homo sapiens
atcacctgaattattaatgaa

SEQ ID NO: 4799571 - DNA, 15 bp, Homo sapiens
atcacgggcccgctc

SEQ ID NO: 4799572 - DNA, 13 bp, Homo sapiens
atcactcattaat

SEQ ID NO: 4799573 - DNA, 14 bp, Homo sapiens
atcactcatttatt

SEQ ID NO: 4799574 - DNA, 16 bp, Homo sapiens
atcactgtgtctcatg

SEQ ID NO: 4799575 - DNA, 16 bp, Homo sapiens
atcagaactcctttct

SEQ ID NO: 4799576 - DNA, 21 bp, Homo sapiens
atcagaactcctttctaagga

SEQ ID NO: 4799577 - DNA, 20 bp, Homo sapiens
atcagaatggaagagagaaa

SEQ ID NO: 4799578 - DNA, 20 bp, Homo sapiens
atcagacagtggatgagaca

SEQ ID NO: 4799579 - DNA, 20 bp, Homo sapiens
atcagagtgtatttttgtaa

SEQ ID NO: 4799580 - DNA, 15 bp, Homo sapiens
atcagcactgaaaat

SEQ ID NO: 4799581 - DNA, 13 bp, Homo sapiens
atcagctagattt

SEQ ID NO: 4799582 - DNA, 12 bp, Homo sapiens
atcagctttata

SEQ ID NO: 4799583 - DNA, 19 bp, Homo sapiens
atcagctttataataaact

SEQ ID NO: 4799584 - DNA, 21 bp, Homo sapiens
atcagctttataataaactgt

SEQ ID NO: 4799585 - DNA, 23 bp, Homo sapiens
atcaggaaatatctgtgaaggac

SEQ ID NO: 4799586 - DNA, 19 bp, Homo sapiens
atcaggcctaatctcatac

SEQ ID NO: 4799587 - DNA, 20 bp, Homo sapiens
atcagggcccaaataacagt

SEQ ID NO: 4799588 - DNA, 23 bp, Homo sapiens
atcagtccacccccattgtgaat

SEQ ID NO: 4799589 - DNA, 16 bp, Homo sapiens
atcagtcctagaatgt

SEQ ID NO: 4799590 - DNA, 19 bp, Homo sapiens
atcatatataataaattaa

SEQ ID NO: 4799591 - DNA, 11 bp, Homo sapiens
atcatatatgc

SEQ ID NO: 4799592 - DNA, 16 bp, Homo sapiens
atcatatttaatagga

SEQ ID NO: 4799593 - DNA, 23 bp, Homo sapiens
atcatatttaataggataaatta

SEQ ID NO: 4799594 - DNA, 19 bp, Homo sapiens
atcatcaccgattcttcct

SEQ ID NO: 4799595 - DNA, 21 bp, Homo sapiens
atcatcaccgattcttccttg

SEQ ID NO: 4799596 - DNA, 21 bp, Homo sapiens
atcatcacgtatgttatacaa

SEQ ID NO: 4799597 - DNA, 13 bp, Homo sapiens
atcatctcagctc

SEQ ID NO: 4799598 - DNA, 19 bp, Homo sapiens
atcatgcacacaattagat

SEQ ID NO: 4799599 - DNA, 22 bp, Homo sapiens
atcatgcctacattagtgagat

SEQ ID NO: 4799600 - DNA, 14 bp, Homo sapiens
atcatgggcattgc

SEQ ID NO: 4799601 - DNA, 14 bp, Homo sapiens
atcatgtctattgt

SEQ ID NO: 4799602 - DNA, 21 bp, Homo sapiens
atcatgtctattgtccaaagt

SEQ ID NO: 4799603 - DNA, 18 bp, Homo sapiens
atcatgtgtttctgtgta

SEQ ID NO: 4799604 - DNA, 23 bp, Homo sapiens
atcattgctgctgtagcaacaga

SEQ ID NO: 4799605 - DNA, 14 bp, Homo sapiens
atcatttcattcgt

SEQ ID NO: 4799606 - DNA, 17 bp, Homo sapiens
atcatttccagcaaaat

SEQ ID NO: 4799607 - DNA, 21 bp, Homo sapiens
atcatttccagcaaaatatat

SEQ ID NO: 4799608 - DNA, 14 bp, Homo sapiens
atcattttgatgta

SEQ ID NO: 4799609 - DNA, 14 bp, Homo sapiens
atcattttgggaaa

SEQ ID NO: 4799610 - DNA, 18 bp, Homo sapiens
atccaaaatagtcatgtt

SEQ ID NO: 4799611 - DNA, 22 bp, Homo sapiens
atccaaaatagtcatgtttctg

SEQ ID NO: 4799612 - DNA, 13 bp, Homo sapiens
atccaactccagg

SEQ ID NO: 4799613 - DNA, 14 bp, Homo sapiens
atccaactttgtag

SEQ ID NO: 4799614 - DNA, 13 bp, Homo sapiens
atccaagagggac

SEQ ID NO: 4799615 - DNA, 20 bp, Homo sapiens
atccaagagggactccaagc

SEQ ID NO: 4799616 - DNA, 23 bp, Homo sapiens
atccaaggaacttcatgcttgat

SEQ ID NO: 4799617 - DNA, 16 bp, Homo sapiens
atccacaaattcctcc

SEQ ID NO: 4799618 - DNA, 20 bp, Homo sapiens
atccacacacagcagctcca

SEQ ID NO: 4799619 - DNA, 14 bp, Homo sapiens
atccacagtattgt

SEQ ID NO: 4799620 - DNA, 17 bp, Homo sapiens
atccacagtgagttggg

SEQ ID NO: 4799621 - DNA, 15 bp, Homo sapiens
atccacatgcacatg

SEQ ID NO: 4799622 - DNA, 15 bp, Homo sapiens
atccacattgtagcc

SEQ ID NO: 4799623 - DNA, 20 bp, Homo sapiens
atccacctggtggccctgcg

SEQ ID NO: 4799624 - DNA, 19 bp, Homo sapiens
atccactaggtgcccagtc

SEQ ID NO: 4799625 - DNA, 21 bp, Homo sapiens
atccagaactgtcttagtcat

SEQ ID NO: 4799626 - DNA, 19 bp, Homo sapiens
atccagagacctgctccag

SEQ ID NO: 4799627 - DNA, 20 bp, Homo sapiens
atccagagggttgtgatttt

SEQ ID NO: 4799628 - DNA, 22 bp, Homo sapiens
atccagccgcaaatccataccc

SEQ ID NO: 4799629 - DNA, 14 bp, Homo sapiens
atccagtatcttga

SEQ ID NO: 4799630 - DNA, 15 bp, Homo sapiens
atccataccccctgc

SEQ ID NO: 4799631 - DNA, 21 bp, Homo sapiens
atccataccccctgccccaga

SEQ ID NO: 4799632 - DNA, 14 bp, Homo sapiens
atccatagacacag

SEQ ID NO: 4799633 - DNA, 22 bp, Homo sapiens
atccatccctggtgaaagagta

SEQ ID NO: 4799634 - DNA, 13 bp, Homo sapiens
atccattaattta

SEQ ID NO: 4799635 - DNA, 20 bp, Homo sapiens
atcccaaacccttcagtgcc

SEQ ID NO: 4799636 - DNA, 20 bp, Homo sapiens
atcccaagtcaaacagtgtg

SEQ ID NO: 4799637 - DNA, 21 bp, Homo sapiens
atcccaagttggaagggaccc

SEQ ID NO: 4799638 - DNA, 17 bp, Homo sapiens
atcccatatgcctgggc

SEQ ID NO: 4799639 - DNA, 22 bp, Homo sapiens
atccccaccctcccctctcctg

SEQ ID NO: 4799640 - DNA, 18 bp, Homo sapiens
atccccatggaacagccc

SEQ ID NO: 4799641 - DNA, 23 bp, Homo sapiens
atccccatggaacagccctgcac

SEQ ID NO: 4799642 - DNA, 16 bp, Homo sapiens
atccccgtgctcacag

SEQ ID NO: 4799643 - DNA, 19 bp, Homo sapiens
atccctccccttgccacat

SEQ ID NO: 4799644 - DNA, 20 bp, Homo sapiens
atccctccccttgccacatc

SEQ ID NO: 4799645 - DNA, 17 bp, Homo sapiens
atccctccttaagagat

SEQ ID NO: 4799646 - DNA, 21 bp, Homo sapiens
atccctcggtcagcaccgtgg

SEQ ID NO: 4799647 - DNA, 18 bp, Homo sapiens
atccctcttcctccaaag

SEQ ID NO: 4799648 - DNA, 16 bp, Homo sapiens
atccctgggcccctcc

SEQ ID NO: 4799649 - DNA, 21 bp, Homo sapiens
atccctgggcccctccacgcc

SEQ ID NO: 4799650 - DNA, 17 bp, Homo sapiens
atccctgttcattgtaa

SEQ ID NO: 4799651 - DNA, 14 bp, Homo sapiens
atcccttctcacag

SEQ ID NO: 4799652 - DNA, 16 bp, Homo sapiens
atcccttctcacagca

SEQ ID NO: 4799653 - DNA, 14 bp, Homo sapiens
atcccttggcccct

SEQ ID NO: 4799654 - DNA, 16 bp, Homo sapiens
atccgagcccctgttt

SEQ ID NO: 4799655 - DNA, 20 bp, Homo sapiens
atcctatcgatctggaaaga

SEQ ID NO: 4799656 - DNA, 18 bp, Homo sapiens
atcctcaagttgtgtgct

SEQ ID NO: 4799657 - DNA, 21 bp, Homo sapiens
atcctcaagttgtgtgctatt

SEQ ID NO: 4799658 - DNA, 12 bp, Homo sapiens
atcctcagcaag

SEQ ID NO: 4799659 - DNA, 18 bp, Homo sapiens
atcctcagccccagggcc

SEQ ID NO: 4799660 - DNA, 21 bp, Homo sapiens
atcctccgcggaggcccctga

SEQ ID NO: 4799661 - DNA, 18 bp, Homo sapiens
atcctctttccccactga

SEQ ID NO: 4799662 - DNA, 20 bp, Homo sapiens
atcctctttccccactgaag

SEQ ID NO: 4799663 - DNA, 22 bp, Homo sapiens
atcctctttccccactgaagaa

SEQ ID NO: 4799664 - DNA, 17 bp, Homo sapiens
atcctctttgagtgaag

SEQ ID NO: 4799665 - DNA, 12 bp, Homo sapiens
atcctgaataac

SEQ ID NO: 4799666 - DNA, 17 bp, Homo sapiens
atcctgcaccctctgct

SEQ ID NO: 4799667 - DNA, 15 bp, Homo sapiens
atcctggagttctgg

SEQ ID NO: 4799668 - DNA, 21 bp, Homo sapiens
atcctggattcctctaagatc

SEQ ID NO: 4799669 - DNA, 12 bp, Homo sapiens
atcctggcctga

SEQ ID NO: 4799670 - DNA, 22 bp, Homo sapiens
atccttaaaaagaccatgcatt

SEQ ID NO: 4799671 - DNA, 22 bp, Homo sapiens
atccttcatctggattccagag

SEQ ID NO: 4799672 - DNA, 16 bp, Homo sapiens
atccttggcaccaaag

SEQ ID NO: 4799673 - DNA, 21 bp, Homo sapiens
atccttttgcttcatctggag

SEQ ID NO: 4799674 - DNA, 20 bp, Homo sapiens
atccttttttattgaataac

SEQ ID NO: 4799675 - DNA, 14 bp, Homo sapiens
atccttttttcctt

SEQ ID NO: 4799676 - DNA, 15 bp, Homo sapiens
atcgacctcactgtc

SEQ ID NO: 4799677 - DNA, 18 bp, Homo sapiens
atcgatttgtattaatgt

SEQ ID NO: 4799678 - DNA, 20 bp, Homo sapiens
atcgatttgtattaatgtag

SEQ ID NO: 4799679 - DNA, 22 bp, Homo sapiens
atcggaggctgggcccctggga

SEQ ID NO: 4799680 - DNA, 17 bp, Homo sapiens
atcggggctaacagaga

SEQ ID NO: 4799681 - DNA, 23 bp, Homo sapiens
atcggtgtccatttatagaataa

SEQ ID NO: 4799682 - DNA, 20 bp, Homo sapiens
atcgttgcaaccactgcaat

SEQ ID NO: 4799683 - DNA, 16 bp, Homo sapiens
atcgtttcacatctgt

SEQ ID NO: 4799684 - DNA, 16 bp, Homo sapiens
atctaaattaacttct

SEQ ID NO: 4799685 - DNA, 19 bp, Homo sapiens
atctaaattaacttctatt

SEQ ID NO: 4799686 - DNA, 14 bp, Homo sapiens
atctaacattatta

SEQ ID NO: 4799687 - DNA, 17 bp, Homo sapiens
atctacaaacttttata

SEQ ID NO: 4799688 - DNA, 23 bp, Homo sapiens
atctacaaacttttataaatgtt

SEQ ID NO: 4799689 - DNA, 17 bp, Homo sapiens
atctacacatataaaca

SEQ ID NO: 4799690 - DNA, 19 bp, Homo sapiens
atctagaagagtctattgt

SEQ ID NO: 4799691 - DNA, 14 bp, Homo sapiens
atctagccaggcct

SEQ ID NO: 4799692 - DNA, 17 bp, Homo sapiens
atctagccaggcctccc

SEQ ID NO: 4799693 - DNA, 22 bp, Homo sapiens
atctagtaggtctgcacacata

SEQ ID NO: 4799694 - DNA, 17 bp, Homo sapiens
atctagtgctaaaccta

SEQ ID NO: 4799695 - DNA, 21 bp, Homo sapiens
atctagtgctaaacctatctg

SEQ ID NO: 4799696 - DNA, 15 bp, Homo sapiens
atctatatatacata

SEQ ID NO: 4799697 - DNA, 19 bp, Homo sapiens
atctatctggtgatttcta

SEQ ID NO: 4799698 - DNA, 23 bp, Homo sapiens
atctatctggtgatttctagctc

SEQ ID NO: 4799699 - DNA, 23 bp, Homo sapiens
atctcaaaagatctcctgtgcac

SEQ ID NO: 4799700 - DNA, 20 bp, Homo sapiens
atctcagataaagtgaccag

SEQ ID NO: 4799701 - DNA, 16 bp, Homo sapiens
atctcaggtggcattt

SEQ ID NO: 4799702 - DNA, 20 bp, Homo sapiens
atctcaggtggcatttgcag

SEQ ID NO: 4799703 - DNA, 20 bp, Homo sapiens
atctcatgtctgtttaatac

SEQ ID NO: 4799704 - DNA, 18 bp, Homo sapiens
atctccagccaatttcaa

SEQ ID NO: 4799705 - DNA, 10 bp, Homo sapiens
atctccaggc

SEQ ID NO: 4799706 - DNA, 12 bp, Homo sapiens
atctccaggccc

SEQ ID NO: 4799707 - DNA, 18 bp, Homo sapiens
atctccaggcccagcctg

SEQ ID NO: 4799708 - DNA, 23 bp, Homo sapiens
atctccaggcccagcctggcccc

SEQ ID NO: 4799709 - DNA, 20 bp, Homo sapiens
atctcctgtaattttgtagt

SEQ ID NO: 4799710 - DNA, 19 bp, Homo sapiens
atctccttgattacataat

SEQ ID NO: 4799711 - DNA, 13 bp, Homo sapiens
atctcgctagcca

SEQ ID NO: 4799712 - DNA, 17 bp, Homo sapiens
atctctcaaaatgtgcc

SEQ ID NO: 4799713 - DNA, 17 bp, Homo sapiens
atctctccccatatata

SEQ ID NO: 4799714 - DNA, 18 bp, Homo sapiens
atctctccccatatataa

SEQ ID NO: 4799715 - DNA, 22 bp, Homo sapiens
atctctcgtgattgataagaac

SEQ ID NO: 4799716 - DNA, 13 bp, Homo sapiens
atctctctggggc

SEQ ID NO: 4799717 - DNA, 22 bp, Homo sapiens
atctctctggggccctgggcct

SEQ ID NO: 4799718 - DNA, 23 bp, Homo sapiens
atctctctggggccctgggcctc

SEQ ID NO: 4799719 - DNA, 23 bp, Homo sapiens
atctctgactttctttagtcttt

SEQ ID NO: 4799720 - DNA, 21 bp, Homo sapiens
atctctgctttgtttccttct

SEQ ID NO: 4799721 - DNA, 20 bp, Homo sapiens
atctctgttctttcatacta

SEQ ID NO: 4799722 - DNA, 23 bp, Homo sapiens
atctctgttctttcatactacat

SEQ ID NO: 4799723 - DNA, 24 bp, Homo sapiens
atctctgttctttcatactacatt

SEQ ID NO: 4799724 - DNA, 13 bp, Homo sapiens
atctcttcttcct

SEQ ID NO: 4799725 - DNA, 18 bp, Homo sapiens
atctcttgtaccagccca

SEQ ID NO: 4799726 - DNA, 14 bp, Homo sapiens
atctctttctctct

SEQ ID NO: 4799727 - DNA, 12 bp, Homo sapiens
atctgaaatcta

SEQ ID NO: 4799728 - DNA, 15 bp, Homo sapiens
atctgaaatctacaa

SEQ ID NO: 4799729 - DNA, 18 bp, Homo sapiens
atctgaaatctacaacat

SEQ ID NO: 4799730 - DNA, 18 bp, Homo sapiens
atctgaactcacagactg

SEQ ID NO: 4799731 - DNA, 22 bp, Homo sapiens
atctgaactcacagactgctgt

SEQ ID NO: 4799732 - DNA, 15 bp, Homo sapiens
atctgaagagtggaa

SEQ ID NO: 4799733 - DNA, 12 bp, Homo sapiens
atctgaagtagt

SEQ ID NO: 4799734 - DNA, 21 bp, Homo sapiens
atctgaagtagtgtgagtgtt

SEQ ID NO: 4799735 - DNA, 15 bp, Homo sapiens
atctgaggagtccaa

SEQ ID NO: 4799736 - DNA, 15 bp, Homo sapiens
atctgcactcctgtc

SEQ ID NO: 4799737 - DNA, 16 bp, Homo sapiens
atctgcactcctgtct

SEQ ID NO: 4799738 - DNA, 13 bp, Homo sapiens
atctggagtccct

SEQ ID NO: 4799739 - DNA, 19 bp, Homo sapiens
atctggagtccctcctccc

SEQ ID NO: 4799740 - DNA, 22 bp, Homo sapiens
atctggagtctgaaggagagga

SEQ ID NO: 4799741 - DNA, 23 bp, Homo sapiens
atctggagtctgaaggagaggag

SEQ ID NO: 4799742 - DNA, 23 bp, Homo sapiens
atctggcctggcctggccctgcc

SEQ ID NO: 4799743 - DNA, 14 bp, Homo sapiens
atctgggcctgggc

SEQ ID NO: 4799744 - DNA, 15 bp, Homo sapiens
atctggtattaaatg

SEQ ID NO: 4799745 - DNA, 18 bp, Homo sapiens
atctggtattaaatgcca

SEQ ID NO: 4799746 - DNA, 15 bp, Homo sapiens
atctggtgatttcta

SEQ ID NO: 4799747 - DNA, 17 bp, Homo sapiens
atctggtgatttctagc

SEQ ID NO: 4799748 - DNA, 13 bp, Homo sapiens
atctggtgcgtgt

SEQ ID NO: 4799749 - DNA, 17 bp, Homo sapiens
atctgtaaaaccaggct

SEQ ID NO: 4799750 - DNA, 16 bp, Homo sapiens
atctgtataatacttt

SEQ ID NO: 4799751 - DNA, 24 bp, Homo sapiens
atctgtataatactttgtatacaa

SEQ ID NO: 4799752 - DNA, 16 bp, Homo sapiens
atctgtatatcagctc

SEQ ID NO: 4799753 - DNA, 18 bp, Homo sapiens
atctgtatatcagctcta

SEQ ID NO: 4799754 - DNA, 15 bp, Homo sapiens
atctgtcagtgagtc

SEQ ID NO: 4799755 - DNA, 19 bp, Homo sapiens
atctgtcatctctctgggg

SEQ ID NO: 4799756 - DNA, 12 bp, Homo sapiens
atctgtccagac

SEQ ID NO: 4799757 - DNA, 14 bp, Homo sapiens
atctgtccagacaa

SEQ ID NO: 4799758 - DNA, 21 bp, Homo sapiens
atctgtccagacaagccctgc

SEQ ID NO: 4799759 - DNA, 22 bp, Homo sapiens
atctgtctgagccctgccctca

SEQ ID NO: 4799760 - DNA, 11 bp, Homo sapiens
atctgtgaaat

SEQ ID NO: 4799761 - DNA, 20 bp, Homo sapiens
atggagcctggcacaggact

SEQ ID NO: 4799762 - DNA, 22 bp, Homo sapiens
atggagcctggcacaggactga

SEQ ID NO: 4799763 - DNA, 23 bp, Homo sapiens
atggagcctggcacaggactgat

SEQ ID NO: 4799764 - DNA, 15 bp, Homo sapiens
atggaggaggaagac

SEQ ID NO: 4799765 - DNA, 20 bp, Homo sapiens
atggagtagagtcaggagaa

SEQ ID NO: 4799766 - DNA, 21 bp, Homo sapiens
atggagtgtcaccagctgcca

SEQ ID NO: 4799767 - DNA, 14 bp, Homo sapiens
atggatagattgtt

SEQ ID NO: 4799768 - DNA, 15 bp, Homo sapiens
atggatatgaaagag

SEQ ID NO: 4799769 - DNA, 22 bp, Homo sapiens
atggatatttttaatttatgat

SEQ ID NO: 4799770 - DNA, 18 bp, Homo sapiens
atggatctgctccatgca

SEQ ID NO: 4799771 - DNA, 15 bp, Homo sapiens
atggatgacaaagaa

SEQ ID NO: 4799772 - DNA, 23 bp, Homo sapiens
atggatgggggttacctagccct

SEQ ID NO: 4799773 - DNA, 18 bp, Homo sapiens
atggattataatcagaat

SEQ ID NO: 4799774 - DNA, 23 bp, Homo sapiens
atggattgggtatcaaaatgaat

SEQ ID NO: 4799775 - DNA, 21 bp, Homo sapiens
atggatttattttttgtaact

SEQ ID NO: 4799776 - DNA, 14 bp, Homo sapiens
atggatttgacaca

SEQ ID NO: 4799777 - DNA, 16 bp, Homo sapiens
atggatttgacacact

SEQ ID NO: 4799778 - DNA, 15 bp, Homo sapiens
atggcacttttgagc

SEQ ID NO: 4799779 - DNA, 16 bp, Homo sapiens
atggcacttttgagct

SEQ ID NO: 4799780 - DNA, 12 bp, Homo sapiens
atggcagagcca

SEQ ID NO: 4799781 - DNA, 13 bp, Homo sapiens
atggcagagccat

SEQ ID NO: 4799782 - DNA, 16 bp, Homo sapiens
atggccaagtgtacat

SEQ ID NO: 4799783 - DNA, 13 bp, Homo sapiens
atggccaggcctc

SEQ ID NO: 4799784 - DNA, 12 bp, Homo sapiens
atggccccagct

SEQ ID NO: 4799785 - DNA, 19 bp, Homo sapiens
atggccctgtagctctgaa

SEQ ID NO: 4799786 - DNA, 17 bp, Homo sapiens
atggcctcccagccacc

SEQ ID NO: 4799787 - DNA, 14 bp, Homo sapiens
atggcctgtcccta

SEQ ID NO: 4799788 - DNA, 20 bp, Homo sapiens
atggcctgtccctagggctc

SEQ ID NO: 4799789 - DNA, 12 bp, Homo sapiens
atggctgaagaa

SEQ ID NO: 4799790 - DNA, 13 bp, Homo sapiens
atggctgaagaaa

SEQ ID NO: 4799791 - DNA, 16 bp, Homo sapiens
atggctgaagaaacac

SEQ ID NO: 4799792 - DNA, 17 bp, Homo sapiens
atggctgaagaaacaca

SEQ ID NO: 4799793 - DNA, 17 bp, Homo sapiens
atggctggatgtgcatc

SEQ ID NO: 4799794 - DNA, 18 bp, Homo sapiens
atggctggatgtgcatct

SEQ ID NO: 4799795 - DNA, 16 bp, Homo sapiens
atggctgtatttttag

SEQ ID NO: 4799796 - DNA, 19 bp, Homo sapiens
atggctgtatttttagaga

SEQ ID NO: 4799797 - DNA, 16 bp, Homo sapiens
atggctgtcccctgca

SEQ ID NO: 4799798 - DNA, 21 bp, Homo sapiens
atggctgtcccctgcaagtgg

SEQ ID NO: 4799799 - DNA, 19 bp, Homo sapiens
atggctgttatctgtcttt

SEQ ID NO: 4799800 - DNA, 19 bp, Homo sapiens
atggcttccgtgagacaca

SEQ ID NO: 4799801 - DNA, 20 bp, Homo sapiens
atggcttccgtgagacacaa

SEQ ID NO: 4799802 - DNA, 23 bp, Homo sapiens
atgggaaagaccctaggtgctca

SEQ ID NO: 4799803 - DNA, 19 bp, Homo sapiens
atgggagagaagagaatgc

SEQ ID NO: 4799804 - DNA, 14 bp, Homo sapiens
atgggaggaacaaa

SEQ ID NO: 4799805 - DNA, 14 bp, Homo sapiens
atgggccaagccag

SEQ ID NO: 4799806 - DNA, 16 bp, Homo sapiens
atgggccaagccaggg

SEQ ID NO: 4799807 - DNA, 23 bp, Homo sapiens
atgggccaagccagggttccaga

SEQ ID NO: 4799808 - DNA, 23 bp, Homo sapiens
atgggccagggtttacccagtgg

SEQ ID NO: 4799809 - DNA, 17 bp, Homo sapiens
atggggaactcccccag

SEQ ID NO: 4799810 - DNA, 20 bp, Homo sapiens
atggggaactcccccagagg

SEQ ID NO: 4799811 - DNA, 18 bp, Homo sapiens
atggggcggcctgcagac

SEQ ID NO: 4799812 - DNA, 14 bp, Homo sapiens
atgggggatgcttc

SEQ ID NO: 4799813 - DNA, 23 bp, Homo sapiens
atggggtgagaagtacagggcag

SEQ ID NO: 4799814 - DNA, 18 bp, Homo sapiens
atggggtgggagccacag

SEQ ID NO: 4799815 - DNA, 20 bp, Homo sapiens
atgggtgattatgaaatgcc

SEQ ID NO: 4799816 - DNA, 22 bp, Homo sapiens
atgggtgttttgatctctgttc

SEQ ID NO: 4799817 - DNA, 16 bp, Homo sapiens
atggtaaataactgtg

SEQ ID NO: 4799818 - DNA, 13 bp, Homo sapiens
atggtagaaactt

SEQ ID NO: 4799819 - DNA, 18 bp, Homo sapiens
atggtagaaactttggaa

SEQ ID NO: 4799820 - DNA, 18 bp, Homo sapiens
atggtagaaattttatct

SEQ ID NO: 4799821 - DNA, 23 bp, Homo sapiens
atggtagctctgaagggagggga

SEQ ID NO: 4799822 - DNA, 22 bp, Homo sapiens
atggtatgctggccagcaccct

SEQ ID NO: 4799823 - DNA, 23 bp, Homo sapiens
atggtattttcgtgcatttgtga

SEQ ID NO: 4799824 - DNA, 17 bp, Homo sapiens
atggtattttttgtgaa

SEQ ID NO: 4799825 - DNA, 19 bp, Homo sapiens
atggtcccacttccccatc

SEQ ID NO: 4799826 - DNA, 21 bp, Homo sapiens
atggtcccacttccccatctg

SEQ ID NO: 4799827 - DNA, 16 bp, Homo sapiens
atggtgaactgtcatt

SEQ ID NO: 4799828 - DNA, 20 bp, Homo sapiens
atggtgagggatacccatcc

SEQ ID NO: 4799829 - DNA, 11 bp, Homo sapiens
atggtgcagtg

SEQ ID NO: 4799830 - DNA, 16 bp, Homo sapiens
atggtgcagtgaagaa

SEQ ID NO: 4799831 - DNA, 16 bp, Homo sapiens
atggtgggctccagag

SEQ ID NO: 4799832 - DNA, 16 bp, Homo sapiens
atggtgtagctgtcct

SEQ ID NO: 4799833 - DNA, 17 bp, Homo sapiens
atggtgtagctgtcctc

SEQ ID NO: 4799834 - DNA, 21 bp, Homo sapiens
atggtgtcataactagagcac

SEQ ID NO: 4799835 - DNA, 18 bp, Homo sapiens
atggtgtcctgcatgtat

SEQ ID NO: 4799836 - DNA, 21 bp, Homo sapiens
atggttacctctgcataaata

SEQ ID NO: 4799837 - DNA, 22 bp, Homo sapiens
atgtaaaacacaagactgtcat

SEQ ID NO: 4799838 - DNA, 12 bp, Homo sapiens
atgtaaaatatt

SEQ ID NO: 4799839 - DNA, 22 bp, Homo sapiens
atgtaaaatatttataaatgaa

SEQ ID NO: 4799840 - DNA, 22 bp, Homo sapiens
atgtaaatattgctgtctgaaa

SEQ ID NO: 4799841 - DNA, 22 bp, Homo sapiens
atgtaactgtccgtagtatcag

SEQ ID NO: 4799842 - DNA, 14 bp, Homo sapiens
atgtaagtttctaa

SEQ ID NO: 4799843 - DNA, 15 bp, Homo sapiens
atgtaagtttctaag

SEQ ID NO: 4799844 - DNA, 17 bp, Homo sapiens
atgtaagtttctaagaa

SEQ ID NO: 4799845 - DNA, 20 bp, Homo sapiens
atgtaagtttctaagaattt

SEQ ID NO: 4799846 - DNA, 16 bp, Homo sapiens
atgtaatattaaattc

SEQ ID NO: 4799847 - DNA, 19 bp, Homo sapiens
atgtaattaaactgttaac

SEQ ID NO: 4799848 - DNA, 17 bp, Homo sapiens
atgtaccatgttaaaga

SEQ ID NO: 4799849 - DNA, 12 bp, Homo sapiens
atgtactgtatt

SEQ ID NO: 4799850 - DNA, 20 bp, Homo sapiens
atgtagagcacaatggaatt

SEQ ID NO: 4799851 - DNA, 14 bp, Homo sapiens
atgtagcatataaa

SEQ ID NO: 4799852 - DNA, 15 bp, Homo sapiens
atgtagcatataaat

SEQ ID NO: 4799853 - DNA, 19 bp, Homo sapiens
atgtagcttcagtcattaa

SEQ ID NO: 4799854 - DNA, 14 bp, Homo sapiens
atgtatacacacac

SEQ ID NO: 4799855 - DNA, 23 bp, Homo sapiens
atgtatatctgtgtaagacacgt

SEQ ID NO: 4799856 - DNA, 18 bp, Homo sapiens
atgtatcttatttatata

SEQ ID NO: 4799857 - DNA, 13 bp, Homo sapiens
atgtatgtaaaaa

SEQ ID NO: 4799858 - DNA, 19 bp, Homo sapiens
atgtatgtgtgagtgtatg

SEQ ID NO: 4799859 - DNA, 21 bp, Homo sapiens
atgtatgtgtgagtgtatgta

SEQ ID NO: 4799860 - DNA, 22 bp, Homo sapiens
atgtatgtgtgagtgtatgtat

SEQ ID NO: 4799861 - DNA, 17 bp, Homo sapiens
atgtatgttgcatgaat

SEQ ID NO: 4799862 - DNA, 21 bp, Homo sapiens
atgtatgttttttactgtttg

SEQ ID NO: 4799863 - DNA, 19 bp, Homo sapiens
atgtatttgtagtgttatt

SEQ ID NO: 4799864 - DNA, 19 bp, Homo sapiens
atgtcaatcaagatgggtg

SEQ ID NO: 4799865 - DNA, 13 bp, Homo sapiens
atgtcagtgtgac

SEQ ID NO: 4799866 - DNA, 22 bp, Homo sapiens
atgtcagttataataacctggt

SEQ ID NO: 4799867 - DNA, 21 bp, Homo sapiens
atgtcatttgctaatgaattt

SEQ ID NO: 4799868 - DNA, 16 bp, Homo sapiens
atgtcattttcagatc

SEQ ID NO: 4799869 - DNA, 16 bp, Homo sapiens
atgtccaggtcacagg

SEQ ID NO: 4799870 - DNA, 14 bp, Homo sapiens
atgtcccaaataaa

SEQ ID NO: 4799871 - DNA, 16 bp, Homo sapiens
atgtcccaaataaatt

SEQ ID NO: 4799872 - DNA, 18 bp, Homo sapiens
atgtcccatgaccttgac

SEQ ID NO: 4799873 - DNA, 15 bp, Homo sapiens
atgtccctgtcccct

SEQ ID NO: 4799874 - DNA, 22 bp, Homo sapiens
atgtcctaggggccgagggaaa

SEQ ID NO: 4799875 - DNA, 16 bp, Homo sapiens
atgtcggggcccctgc

SEQ ID NO: 4799876 - DNA, 19 bp, Homo sapiens
atgtcggggcccctgcgtg

SEQ ID NO: 4799877 - DNA, 12 bp, Homo sapiens
atgtctatgtgt

SEQ ID NO: 4799878 - DNA, 14 bp, Homo sapiens
atgtctatgtgtat

SEQ ID NO: 4799879 - DNA, 19 bp, Homo sapiens
atgtctatgtgtatatatt

SEQ ID NO: 4799880 - DNA, 21 bp, Homo sapiens
atgtctatgtgtatatattat

SEQ ID NO: 4799881 - DNA, 14 bp, Homo sapiens
atgtctattgtcca

SEQ ID NO: 4799882 - DNA, 21 bp, Homo sapiens
attctccagaaaaatcaatca

SEQ ID NO: 4799883 - DNA, 13 bp, Homo sapiens
attctcctctccc

SEQ ID NO: 4799884 - DNA, 18 bp, Homo sapiens
attctgattattacaaca

SEQ ID NO: 4799885 - DNA, 20 bp, Homo sapiens
attctgattggacctggccc

SEQ ID NO: 4799886 - DNA, 22 bp, Homo sapiens
attctgcagcccgatgtccctg

SEQ ID NO: 4799887 - DNA, 17 bp, Homo sapiens
attctgctaatttatga

SEQ ID NO: 4799888 - DNA, 18 bp, Homo sapiens
attctgctaatttatgaa

SEQ ID NO: 4799889 - DNA, 14 bp, Homo sapiens
attcttaaatatgt

SEQ ID NO: 4799890 - DNA, 20 bp, Homo sapiens
attcttaccgaaatgaaaat

SEQ ID NO: 4799891 - DNA, 21 bp, Homo sapiens
attcttaccgaaatgaaaatg

SEQ ID NO: 4799892 - DNA, 23 bp, Homo sapiens
attcttaccgaaatgaaaatggc

SEQ ID NO: 4799893 - DNA, 17 bp, Homo sapiens
attcttacctcatttgc

SEQ ID NO: 4799894 - DNA, 22 bp, Homo sapiens
attcttccttgccacaatcact

SEQ ID NO: 4799895 - DNA, 21 bp, Homo sapiens
attcttctaaaactactgcct

SEQ ID NO: 4799896 - DNA, 22 bp, Homo sapiens
attcttctcctttgtcaaatgg

SEQ ID NO: 4799897 - DNA, 13 bp, Homo sapiens
attcttgaataaa

SEQ ID NO: 4799898 - DNA, 14 bp, Homo sapiens
attcttgcactgta

SEQ ID NO: 4799899 - DNA, 14 bp, Homo sapiens
attcttgctctgct

SEQ ID NO: 4799900 - DNA, 15 bp, Homo sapiens
attctttatcacatg

SEQ ID NO: 4799901 - DNA, 22 bp, Homo sapiens
attctttcaatccacagtattg

SEQ ID NO: 4799902 - DNA, 14 bp, Homo sapiens
attctttgttgctt

SEQ ID NO: 4799903 - DNA, 19 bp, Homo sapiens
attgaaaaaatattgttta

SEQ ID NO: 4799904 - DNA, 20 bp, Homo sapiens
attgaaaagaagtagtgtct

SEQ ID NO: 4799905 - DNA, 20 bp, Homo sapiens
attgaaaattattaatcaga

SEQ ID NO: 4799906 - DNA, 22 bp, Homo sapiens
attgaaaattattaatcagaag

SEQ ID NO: 4799907 - DNA, 13 bp, Homo sapiens
attgaaactgtat

SEQ ID NO: 4799908 - DNA, 15 bp, Homo sapiens
attgaaactgtattt

SEQ ID NO: 4799909 - DNA, 21 bp, Homo sapiens
attgaaccgtcaatgtgaaat

SEQ ID NO: 4799910 - DNA, 22 bp, Homo sapiens
attgaaccgtcaatgtgaaata

SEQ ID NO: 4799911 - DNA, 21 bp, Homo sapiens
attgaagagagatatatctga

SEQ ID NO: 4799912 - DNA, 10 bp, Homo sapiens
attgacattt

SEQ ID NO: 4799913 - DNA, 19 bp, Homo sapiens
attgactggtcccccatgg

SEQ ID NO: 4799914 - DNA, 15 bp, Homo sapiens
attgagacactgtca

SEQ ID NO: 4799915 - DNA, 17 bp, Homo sapiens
attgagacactgtcaag

SEQ ID NO: 4799916 - DNA, 17 bp, Homo sapiens
attgagagcagcctctt

SEQ ID NO: 4799917 - DNA, 18 bp, Homo sapiens
attgagcagaattcattc

SEQ ID NO: 4799918 - DNA, 19 bp, Homo sapiens
attgagttaaatcagtaat

SEQ ID NO: 4799919 - DNA, 15 bp, Homo sapiens
attgataataaaatt

SEQ ID NO: 4799920 - DNA, 18 bp, Homo sapiens
attgataataaaattcat

SEQ ID NO: 4799921 - DNA, 23 bp, Homo sapiens
attgatattctaagaaatatctg

SEQ ID NO: 4799922 - DNA, 15 bp, Homo sapiens
attgatctcttttta

SEQ ID NO: 4799923 - DNA, 20 bp, Homo sapiens
attgatctgtattaagctcc

SEQ ID NO: 4799924 - DNA, 14 bp, Homo sapiens
attgattaaaagca

SEQ ID NO: 4799925 - DNA, 20 bp, Homo sapiens
attgcacacacagtctgttc

SEQ ID NO: 4799926 - DNA, 13 bp, Homo sapiens
attgcactaaaag

SEQ ID NO: 4799927 - DNA, 14 bp, Homo sapiens
attgcactaaaagt

SEQ ID NO: 4799928 - DNA, 18 bp, Homo sapiens
attgcagcagttgctagc

SEQ ID NO: 4799929 - DNA, 17 bp, Homo sapiens
attgcatttttaccttt

SEQ ID NO: 4799930 - DNA, 19 bp, Homo sapiens
attgccaaggcatccccag

SEQ ID NO: 4799931 - DNA, 20 bp, Homo sapiens
attgccaaggcatccccagt

SEQ ID NO: 4799932 - DNA, 23 bp, Homo sapiens
attgccatttcttccacaagagc

SEQ ID NO: 4799933 - DNA, 19 bp, Homo sapiens
attgctattgtttatagga

SEQ ID NO: 4799934 - DNA, 15 bp, Homo sapiens
attgctccattcctg

SEQ ID NO: 4799935 - DNA, 21 bp, Homo sapiens
attgctctggggcttgctatt

SEQ ID NO: 4799936 - DNA, 21 bp, Homo sapiens
attgctgagatgtttagtagc

SEQ ID NO: 4799937 - DNA, 23 bp, Homo sapiens
attgctgagatgtttagtagctg

SEQ ID NO: 4799938 - DNA, 23 bp, Homo sapiens
attgctggactgatggttgcttt

SEQ ID NO: 4799939 - DNA, 18 bp, Homo sapiens
attgctgtaaataaaaat

SEQ ID NO: 4799940 - DNA, 20 bp, Homo sapiens
attgctgtaaataaaaatag

SEQ ID NO: 4799941 - DNA, 21 bp, Homo sapiens
attgctgtaaataaaaatagc

SEQ ID NO: 4799942 - DNA, 16 bp, Homo sapiens
attgctgtctgaaaaa

SEQ ID NO: 4799943 - DNA, 15 bp, Homo sapiens
attgcttctccctca

SEQ ID NO: 4799944 - DNA, 13 bp, Homo sapiens
attgctttataaa

SEQ ID NO: 4799945 - DNA, 15 bp, Homo sapiens
attgctttataaata

SEQ ID NO: 4799946 - DNA, 17 bp, Homo sapiens
attgctttataaataaa

SEQ ID NO: 4799947 - DNA, 23 bp, Homo sapiens
attggaagtatagatggtagaaa

SEQ ID NO: 4799948 - DNA, 15 bp, Homo sapiens
attggacagacacag

SEQ ID NO: 4799949 - DNA, 16 bp, Homo sapiens
attggacagacacaga

SEQ ID NO: 4799950 - DNA, 13 bp, Homo sapiens
attggacttccat

SEQ ID NO: 4799951 - DNA, 15 bp, Homo sapiens
attggacttccattt

SEQ ID NO: 4799952 - DNA, 16 bp, Homo sapiens
attggcagcacagcta

SEQ ID NO: 4799953 - DNA, 10 bp, Homo sapiens
attggcctta

SEQ ID NO: 4799954 - DNA, 21 bp, Homo sapiens
attggccttaactggccctcg

SEQ ID NO: 4799955 - DNA, 19 bp, Homo sapiens
attgggcccttagaatgtg

SEQ ID NO: 4799956 - DNA, 23 bp, Homo sapiens
attgggtaagggactccagaagc

SEQ ID NO: 4799957 - DNA, 15 bp, Homo sapiens
attggtaccagagcc

SEQ ID NO: 4799958 - DNA, 15 bp, Homo sapiens
attggttaatgaaaa

SEQ ID NO: 4799959 - DNA, 15 bp, Homo sapiens
attggttctatttat

SEQ ID NO: 4799960 - DNA, 14 bp, Homo sapiens
attggtttctgttt

SEQ ID NO: 4799961 - DNA, 18 bp, Homo sapiens
attgtaaaggtaggtgca

SEQ ID NO: 4799962 - DNA, 18 bp, Homo sapiens
attgtaaaggtgatgaat

SEQ ID NO: 4799963 - DNA, 20 bp, Homo sapiens
attgtaaaggtgatgaattt

SEQ ID NO: 4799964 - DNA, 21 bp, Homo sapiens
attgtaaaggtgatgaattta

SEQ ID NO: 4799965 - DNA, 23 bp, Homo sapiens
attgtaaaggtgatgaatttacc

SEQ ID NO: 4799966 - DNA, 13 bp, Homo sapiens
attgtaatcataa

SEQ ID NO: 4799967 - DNA, 17 bp, Homo sapiens
attgtacctaagtaaat

SEQ ID NO: 4799968 - DNA, 13 bp, Homo sapiens
attgtagagaaaa

SEQ ID NO: 4799969 - DNA, 22 bp, Homo sapiens
attgtagagaaaaaaaaatatg

SEQ ID NO: 4799970 - DNA, 20 bp, Homo sapiens
attgtataaaacagtgtttc

SEQ ID NO: 4799971 - DNA, 14 bp, Homo sapiens
attgtatctccttt

SEQ ID NO: 4799972 - DNA, 15 bp, Homo sapiens
attgtatctgaactc

SEQ ID NO: 4799973 - DNA, 16 bp, Homo sapiens
attgtattatcatata

SEQ ID NO: 4799974 - DNA, 18 bp, Homo sapiens
attgtattatcatatatg

SEQ ID NO: 4799975 - DNA, 21 bp, Homo sapiens
attgtattcctcacattcaca

SEQ ID NO: 4799976 - DNA, 13 bp, Homo sapiens
attgtattgttag

SEQ ID NO: 4799977 - DNA, 14 bp, Homo sapiens
attgtcagaatgtt

SEQ ID NO: 4799978 - DNA, 18 bp, Homo sapiens
attgtcagaatgttgtgt

SEQ ID NO: 4799979 - DNA, 17 bp, Homo sapiens
attgtccacaaatgtcc

SEQ ID NO: 4799980 - DNA, 15 bp, Homo sapiens
attgtccttgtgtat

SEQ ID NO: 4799981 - DNA, 15 bp, Homo sapiens
attgtctgctgcctc

SEQ ID NO: 4799982 - DNA, 17 bp, Homo sapiens
attgtctgctgcctcca

SEQ ID NO: 4799983 - DNA, 19 bp, Homo sapiens
attgtctgctgcctccaag

SEQ ID NO: 4799984 - DNA, 18 bp, Homo sapiens
attgtcttttgtcatgtg

SEQ ID NO: 4799985 - DNA, 13 bp, Homo sapiens
attgtgccctgta

SEQ ID NO: 4799986 - DNA, 16 bp, Homo sapiens
attgtgccctgtagct

SEQ ID NO: 4799987 - DNA, 14 bp, Homo sapiens
attgtggatgaaga

SEQ ID NO: 4799988 - DNA, 12 bp, Homo sapiens
attgtggttggt

SEQ ID NO: 4799989 - DNA, 14 bp, Homo sapiens
attgtgtaggaaat

SEQ ID NO: 4799990 - DNA, 15 bp, Homo sapiens
attgtgtaggaaatc

SEQ ID NO: 4799991 - DNA, 19 bp, Homo sapiens
attgtgtattatgttgttc

SEQ ID NO: 4799992 - DNA, 15 bp, Homo sapiens
attgttaaatgataa

SEQ ID NO: 4799993 - DNA, 14 bp, Homo sapiens
attgttacaatttt

SEQ ID NO: 4799994 - DNA, 15 bp, Homo sapiens
attgttagatgtttg

SEQ ID NO: 4799995 - DNA, 14 bp, Homo sapiens
attgttattaaatg

SEQ ID NO: 4799996 - DNA, 17 bp, Homo sapiens
attgttcctccccagcc

SEQ ID NO: 4799997 - DNA, 14 bp, Homo sapiens
attgtttaaaagca

SEQ ID NO: 4799998 - DNA, 14 bp, Homo sapiens
attgtttgatgaat

SEQ ID NO: 4799999 - DNA, 21 bp, Homo sapiens
attgtttgatgaataaaatgt

SEQ ID NO: 4800000 - DNA, 22 bp, Homo sapiens
attgtttgatgaataaaatgtt

SEQ ID NO: 4800001 - DNA, 23 bp, Homo sapiens
attgtttgatgaataaaatgttt

SEQ ID NO: 4800002 - DNA, 20 bp, Homo sapiens
attgtttggcttcctcctga

SEQ ID NO: 4800003 - DNA, 19 bp, Homo sapiens
attgttttagagactatgg

SEQ ID NO: 4800004 - DNA, 21 bp, Homo sapiens
caaactgaaattagtgttttc

SEQ ID NO: 4800005 - DNA, 21 bp, Homo sapiens
caaactgtagtaattgttaca

SEQ ID NO: 4800006 - DNA, 22 bp, Homo sapiens
caaactgtagtaattgttacaa

SEQ ID NO: 4800007 - DNA, 14 bp, Homo sapiens
caaacttaacagat

SEQ ID NO: 4800008 - DNA, 18 bp, Homo sapiens
caaacttttataaatgtt

SEQ ID NO: 4800009 - DNA, 15 bp, Homo sapiens
caaagaaaatgagaa

SEQ ID NO: 4800010 - DNA, 17 bp, Homo sapiens
caaagaaacaaaatata

SEQ ID NO: 4800011 - DNA, 15 bp, Homo sapiens
caaagaacccccctc

SEQ ID NO: 4800012 - DNA, 22 bp, Homo sapiens
caaagaatcacctaattaattt

SEQ ID NO: 4800013 - DNA, 15 bp, Homo sapiens
caaagacggtagaga

SEQ ID NO: 4800014 - DNA, 16 bp, Homo sapiens
caaagatattatttat

SEQ ID NO: 4800015 - DNA, 13 bp, Homo sapiens
caaagatgcagcc

SEQ ID NO: 4800016 - DNA, 12 bp, Homo sapiens
caaagatggctt

SEQ ID NO: 4800017 - DNA, 14 bp, Homo sapiens
caaagatggcttcc

SEQ ID NO: 4800018 - DNA, 21 bp, Homo sapiens
caaagcagtgcatgctgtccc

SEQ ID NO: 4800019 - DNA, 18 bp, Homo sapiens
caaagcatgctcagtatt

SEQ ID NO: 4800020 - DNA, 20 bp, Homo sapiens
caaagcatgctcagtattga

SEQ ID NO: 4800021 - DNA, 14 bp, Homo sapiens
caaagccagctctg

SEQ ID NO: 4800022 - DNA, 16 bp, Homo sapiens
caaagccagctctgag

SEQ ID NO: 4800023 - DNA, 20 bp, Homo sapiens
caaagccagctctgagcaga

SEQ ID NO: 4800024 - DNA, 22 bp, Homo sapiens
caaagctatttaagtggactgt

SEQ ID NO: 4800025 - DNA, 14 bp, Homo sapiens
caaaggagattgga

SEQ ID NO: 4800026 - DNA, 21 bp, Homo sapiens
caaaggatgcccaaagatgca

SEQ ID NO: 4800027 - DNA, 14 bp, Homo sapiens
caaagtcctttccc

SEQ ID NO: 4800028 - DNA, 15 bp, Homo sapiens
caaagtgcacacaca

SEQ ID NO: 4800029 - DNA, 21 bp, Homo sapiens
caaagtgtttaattgtataaa

SEQ ID NO: 4800030 - DNA, 21 bp, Homo sapiens
caaagttaaacgtgatgtgct

SEQ ID NO: 4800031 - DNA, 13 bp, Homo sapiens
caaagttttcaga

SEQ ID NO: 4800032 - DNA, 14 bp, Homo sapiens
caaagttttcagat

SEQ ID NO: 4800033 - DNA, 12 bp, Homo sapiens
caaataaatgtg

SEQ ID NO: 4800034 - DNA, 13 bp, Homo sapiens
caaataaatgtgt

SEQ ID NO: 4800035 - DNA, 14 bp, Homo sapiens
caaataaatgtgta

SEQ ID NO: 4800036 - DNA, 18 bp, Homo sapiens
caaataaatgtgtaaatg

SEQ ID NO: 4800037 - DNA, 19 bp, Homo sapiens
caaataaatgtgtaaatgt

SEQ ID NO: 4800038 - DNA, 20 bp, Homo sapiens
caaataaatgtgtaaatgtg

SEQ ID NO: 4800039 - DNA, 11 bp, Homo sapiens
caaataacagt

SEQ ID NO: 4800040 - DNA, 12 bp, Homo sapiens
caaatagaaaac

SEQ ID NO: 4800041 - DNA, 13 bp, Homo sapiens
caaatagaaaaca

SEQ ID NO: 4800042 - DNA, 20 bp, Homo sapiens
caaatagggcaaagaatcaa

SEQ ID NO: 4800043 - DNA, 17 bp, Homo sapiens
caaatataacatgaaag

SEQ ID NO: 4800044 - DNA, 13 bp, Homo sapiens
caaatatactcat

SEQ ID NO: 4800045 - DNA, 18 bp, Homo sapiens
caaatatactcatttgga

SEQ ID NO: 4800046 - DNA, 14 bp, Homo sapiens
caaatatctaaata

SEQ ID NO: 4800047 - DNA, 20 bp, Homo sapiens
caaatatctaaataatggcc

SEQ ID NO: 4800048 - DNA, 16 bp, Homo sapiens
caaatatctctattta

SEQ ID NO: 4800049 - DNA, 23 bp, Homo sapiens
caaatattgctattgtttatagg

SEQ ID NO: 4800050 - DNA, 13 bp, Homo sapiens
caaatatttcact

SEQ ID NO: 4800051 - DNA, 17 bp, Homo sapiens
caaatccataccccctg

SEQ ID NO: 4800052 - DNA, 18 bp, Homo sapiens
caaatccataccccctgc

SEQ ID NO: 4800053 - DNA, 19 bp, Homo sapiens
caaatccataccccctgcc

SEQ ID NO: 4800054 - DNA, 14 bp, Homo sapiens
caaatccatgtgtc

SEQ ID NO: 4800055 - DNA, 18 bp, Homo sapiens
caaatcctgcatttagat

SEQ ID NO: 4800056 - DNA, 16 bp, Homo sapiens
caaatctgtataaatg

SEQ ID NO: 4800057 - DNA, 15 bp, Homo sapiens
caaatgaaggaatgc

SEQ ID NO: 4800058 - DNA, 14 bp, Homo sapiens
caaatgacatgcac

SEQ ID NO: 4800059 - DNA, 20 bp, Homo sapiens
caaatgcagtgtatttaatg

SEQ ID NO: 4800060 - DNA, 14 bp, Homo sapiens
caaatggatgtaat

SEQ ID NO: 4800061 - DNA, 14 bp, Homo sapiens
caaatggtattttt

SEQ ID NO: 4800062 - DNA, 12 bp, Homo sapiens
caaatgtaaaat

SEQ ID NO: 4800063 - DNA, 14 bp, Homo sapiens
caaatgtcctcaga

SEQ ID NO: 4800064 - DNA, 13 bp, Homo sapiens
caaattctgatta

SEQ ID NO: 4800065 - DNA, 12 bp, Homo sapiens
caaattgctgag

SEQ ID NO: 4800066 - DNA, 14 bp, Homo sapiens
caaatttttactca

SEQ ID NO: 4800067 - DNA, 19 bp, Homo sapiens
caaatttttactcaggctt

SEQ ID NO: 4800068 - DNA, 22 bp, Homo sapiens
caaatttttactcaggctttct

SEQ ID NO: 4800069 - DNA, 19 bp, Homo sapiens
caacaaaagggagaacatg

SEQ ID NO: 4800070 - DNA, 23 bp, Homo sapiens
caacaaacctgtttctgcagcca

SEQ ID NO: 4800071 - DNA, 19 bp, Homo sapiens
caacaaagcatgctcagta

SEQ ID NO: 4800072 - DNA, 15 bp, Homo sapiens
caacaacagaacaac

SEQ ID NO: 4800073 - DNA, 12 bp, Homo sapiens
caacaagaagaa

SEQ ID NO: 4800074 - DNA, 22 bp, Homo sapiens
caacaagcaaactgaaattagt

SEQ ID NO: 4800075 - DNA, 17 bp, Homo sapiens
caacacattgaaactgt

SEQ ID NO: 4800076 - DNA, 19 bp, Homo sapiens
caacacctgccgtaagtta

SEQ ID NO: 4800077 - DNA, 12 bp, Homo sapiens
caacagaacaac

SEQ ID NO: 4800078 - DNA, 21 bp, Homo sapiens
caacagaacaacaacaaagca

SEQ ID NO: 4800079 - DNA, 18 bp, Homo sapiens
caacagacctaagaaata

SEQ ID NO: 4800080 - DNA, 18 bp, Homo sapiens
caacagcaacaacaacag

SEQ ID NO: 4800081 - DNA, 22 bp, Homo sapiens
caacagcaacaacaacagaaca

SEQ ID NO: 4800082 - DNA, 19 bp, Homo sapiens
caacagccaatatttaaaa

SEQ ID NO: 4800083 - DNA, 19 bp, Homo sapiens
caacaggctgttctgcact

SEQ ID NO: 4800084 - DNA, 20 bp, Homo sapiens
caacaggctgttctgcactg

SEQ ID NO: 4800085 - DNA, 23 bp, Homo sapiens
caacaggctgttctgcactgaaa

SEQ ID NO: 4800086 - DNA, 13 bp, Homo sapiens
caacatgcacatt

SEQ ID NO: 4800087 - DNA, 18 bp, Homo sapiens
caacatggggcccctctc

SEQ ID NO: 4800088 - DNA, 15 bp, Homo sapiens
caacatgtgctcgct

SEQ ID NO: 4800089 - DNA, 14 bp, Homo sapiens
caacatttccgaag

SEQ ID NO: 4800090 - DNA, 18 bp, Homo sapiens
caacccatgcatggcctc

SEQ ID NO: 4800091 - DNA, 22 bp, Homo sapiens
caacccatgcatggcctcccag

SEQ ID NO: 4800092 - DNA, 23 bp, Homo sapiens
caacccatgcatggcctcccagc

SEQ ID NO: 4800093 - DNA, 12 bp, Homo sapiens
caacccccacct

SEQ ID NO: 4800094 - DNA, 19 bp, Homo sapiens
caacccccacctcccggtg

SEQ ID NO: 4800095 - DNA, 12 bp, Homo sapiens
caaccctgccct

SEQ ID NO: 4800096 - DNA, 16 bp, Homo sapiens
caaccctgccctgcac

SEQ ID NO: 4800097 - DNA, 17 bp, Homo sapiens
caacctcccctggtcct

SEQ ID NO: 4800098 - DNA, 16 bp, Homo sapiens
caacctgaattaaagt

SEQ ID NO: 4800099 - DNA, 17 bp, Homo sapiens
caacctgaattaaagtc

SEQ ID NO: 4800100 - DNA, 19 bp, Homo sapiens
caacctgaattaaagtcta

SEQ ID NO: 4800101 - DNA, 16 bp, Homo sapiens
caacctgccacaatgt

SEQ ID NO: 4800102 - DNA, 17 bp, Homo sapiens
caacctgccacaatgtg

SEQ ID NO: 4800103 - DNA, 19 bp, Homo sapiens
caacctgccacaatgtgat

SEQ ID NO: 4800104 - DNA, 17 bp, Homo sapiens
caacctggaggctggac

SEQ ID NO: 4800105 - DNA, 21 bp, Homo sapiens
caacctggcataggactcttt

SEQ ID NO: 4800106 - DNA, 15 bp, Homo sapiens
caacctggtggcacc

SEQ ID NO: 4800107 - DNA, 17 bp, Homo sapiens
caaccttgtactttaca

SEQ ID NO: 4800108 - DNA, 14 bp, Homo sapiens
caacgggtctgtgg

SEQ ID NO: 4800109 - DNA, 14 bp, Homo sapiens
caactaacaatgcc

SEQ ID NO: 4800110 - DNA, 15 bp, Homo sapiens
caactaacaatgcct

SEQ ID NO: 4800111 - DNA, 23 bp, Homo sapiens
caactaagtagactttaattctt

SEQ ID NO: 4800112 - DNA, 14 bp, Homo sapiens
caactaatttttga

SEQ ID NO: 4800113 - DNA, 22 bp, Homo sapiens
caactcgaatcactcatttatt

SEQ ID NO: 4800114 - DNA, 23 bp, Homo sapiens
caactctaaagtgctaataataa

SEQ ID NO: 4800115 - DNA, 20 bp, Homo sapiens
caactctcctccagagtcag

SEQ ID NO: 4800116 - DNA, 15 bp, Homo sapiens
caactctggccttgg

SEQ ID NO: 4800117 - DNA, 22 bp, Homo sapiens
caactctggccttggttcctcc

SEQ ID NO: 4800118 - DNA, 16 bp, Homo sapiens
caactgacacaggaaa

SEQ ID NO: 4800119 - DNA, 17 bp, Homo sapiens
caactgcatcaagatgt

SEQ ID NO: 4800120 - DNA, 20 bp, Homo sapiens
caactgcatcaagatgtgac

SEQ ID NO: 4800121 - DNA, 18 bp, Homo sapiens
caactgtggataaatttt

SEQ ID NO: 4800122 - DNA, 17 bp, Homo sapiens
caactgtttttgaagaa

SEQ ID NO: 4800123 - DNA, 14 bp, Homo sapiens
caacttaaacctgt

SEQ ID NO: 4800124 - DNA, 14 bp, Homo sapiens
caacttaatgaaga

SEQ ID NO: 4800125 - DNA, 16 bp, Homo sapiens
caacttactaaatcta

SEQ ID NO: 4800126 - DNA, 16 bp, Homo sapiens
caacttccagatttga

SEQ ID NO: 4800127 - DNA, 19 bp, Homo sapiens
cacagctttcctgggtctg

SEQ ID NO: 4800128 - DNA, 23 bp, Homo sapiens
cacaggaaaccaacacccaaagc

SEQ ID NO: 4800129 - DNA, 18 bp, Homo sapiens
cacaggagcatgtcctat

SEQ ID NO: 4800130 - DNA, 19 bp, Homo sapiens
cacaggagccgcagaggcc

SEQ ID NO: 4800131 - DNA, 15 bp, Homo sapiens
cacaggagcgtgtac

SEQ ID NO: 4800132 - DNA, 21 bp, Homo sapiens
cacaggagcgtgtactacccc

SEQ ID NO: 4800133 - DNA, 15 bp, Homo sapiens
cacaggagctccctt

SEQ ID NO: 4800134 - DNA, 16 bp, Homo sapiens
cacaggagctcccttt

SEQ ID NO: 4800135 - DNA, 17 bp, Homo sapiens
cacaggagctccctttt

SEQ ID NO: 4800136 - DNA, 18 bp, Homo sapiens
cacaggagctcccttttt

SEQ ID NO: 4800137 - DNA, 19 bp, Homo sapiens
cacaggaggcaagcaagct

SEQ ID NO: 4800138 - DNA, 13 bp, Homo sapiens
cacaggatcctgg

SEQ ID NO: 4800139 - DNA, 17 bp, Homo sapiens
cacaggatcctggcctg

SEQ ID NO: 4800140 - DNA, 21 bp, Homo sapiens
cacaggatcctggcctgagaa

SEQ ID NO: 4800141 - DNA, 12 bp, Homo sapiens
cacaggcctggc

SEQ ID NO: 4800142 - DNA, 21 bp, Homo sapiens
cacaggcctggcccagccagc

SEQ ID NO: 4800143 - DNA, 14 bp, Homo sapiens
cacaggctgccgct

SEQ ID NO: 4800144 - DNA, 17 bp, Homo sapiens
cacagggacgacccggg

SEQ ID NO: 4800145 - DNA, 19 bp, Homo sapiens
cacaggggaaaagaggagt

SEQ ID NO: 4800146 - DNA, 16 bp, Homo sapiens
cacaggttcacccagc

SEQ ID NO: 4800147 - DNA, 19 bp, Homo sapiens
cacagtaagataggttctg

SEQ ID NO: 4800148 - DNA, 16 bp, Homo sapiens
cacagtatattttatt

SEQ ID NO: 4800149 - DNA, 19 bp, Homo sapiens
cacagtattgttcttgtaa

SEQ ID NO: 4800150 - DNA, 14 bp, Homo sapiens
cacagtatttaaca

SEQ ID NO: 4800151 - DNA, 13 bp, Homo sapiens
cacagtgggaact

SEQ ID NO: 4800152 - DNA, 14 bp, Homo sapiens
cacagtgggaactc

SEQ ID NO: 4800153 - DNA, 14 bp, Homo sapiens
cacagtgggcggct

SEQ ID NO: 4800154 - DNA, 19 bp, Homo sapiens
cacagtgggcggcttccct

SEQ ID NO: 4800155 - DNA, 17 bp, Homo sapiens
cacagtggggcccatgg

SEQ ID NO: 4800156 - DNA, 22 bp, Homo sapiens
cacataaacacttctccttaac

SEQ ID NO: 4800157 - DNA, 14 bp, Homo sapiens
cacataagttttct

SEQ ID NO: 4800158 - DNA, 21 bp, Homo sapiens
cacatagattaatggcactga

SEQ ID NO: 4800159 - DNA, 22 bp, Homo sapiens
cacatagattaatggcactgat

SEQ ID NO: 4800160 - DNA, 22 bp, Homo sapiens
cacatagattcacctgtaaaac

SEQ ID NO: 4800161 - DNA, 21 bp, Homo sapiens
cacatagcataggctggggac

SEQ ID NO: 4800162 - DNA, 16 bp, Homo sapiens
cacatataaacacagt

SEQ ID NO: 4800163 - DNA, 17 bp, Homo sapiens
cacatcgcagcccctgt

SEQ ID NO: 4800164 - DNA, 14 bp, Homo sapiens
cacatgcacatgta

SEQ ID NO: 4800165 - DNA, 14 bp, Homo sapiens
cacatgcccctctt

SEQ ID NO: 4800166 - DNA, 15 bp, Homo sapiens
cacatgcgctcctgg

SEQ ID NO: 4800167 - DNA, 23 bp, Homo sapiens
cacatgcgctcctggcttttaaa

SEQ ID NO: 4800168 - DNA, 14 bp, Homo sapiens
cacatgtattctgt

SEQ ID NO: 4800169 - DNA, 21 bp, Homo sapiens
cacattattgtagagaaaaaa

SEQ ID NO: 4800170 - DNA, 14 bp, Homo sapiens
cacattcatcctca

SEQ ID NO: 4800171 - DNA, 19 bp, Homo sapiens
cacattcatcctcacatgt

SEQ ID NO: 4800172 - DNA, 15 bp, Homo sapiens
cacattcctgaccct

SEQ ID NO: 4800173 - DNA, 16 bp, Homo sapiens
cacattgaaactgtat

SEQ ID NO: 4800174 - DNA, 19 bp, Homo sapiens
cacattgaaactgtattta

SEQ ID NO: 4800175 - DNA, 21 bp, Homo sapiens
cacattgaaatacttgaaaac

SEQ ID NO: 4800176 - DNA, 20 bp, Homo sapiens
cacattgcacacacagtctg

SEQ ID NO: 4800177 - DNA, 13 bp, Homo sapiens
cacattgcttcat

SEQ ID NO: 4800178 - DNA, 18 bp, Homo sapiens
cacattgcttcattaaaa

SEQ ID NO: 4800179 - DNA, 14 bp, Homo sapiens
caccaaagatgcag

SEQ ID NO: 4800180 - DNA, 15 bp, Homo sapiens
caccaaattgctgag

SEQ ID NO: 4800181 - DNA, 23 bp, Homo sapiens
caccaaattgctgagatgtttag

SEQ ID NO: 4800182 - DNA, 17 bp, Homo sapiens
caccacacacacccttc

SEQ ID NO: 4800183 - DNA, 13 bp, Homo sapiens
caccaccactgtg

SEQ ID NO: 4800184 - DNA, 16 bp, Homo sapiens
caccacggcgtttttt

SEQ ID NO: 4800185 - DNA, 20 bp, Homo sapiens
caccacggcgtttttttaca

SEQ ID NO: 4800186 - DNA, 17 bp, Homo sapiens
caccactctcaggacca

SEQ ID NO: 4800187 - DNA, 13 bp, Homo sapiens
caccactgtgtcc

SEQ ID NO: 4800188 - DNA, 17 bp, Homo sapiens
caccactgtgtcccagt

SEQ ID NO: 4800189 - DNA, 19 bp, Homo sapiens
caccactgtgtcccagtgt

SEQ ID NO: 4800190 - DNA, 20 bp, Homo sapiens
caccactgtgtcccagtgtc

SEQ ID NO: 4800191 - DNA, 22 bp, Homo sapiens
caccactttgtctctgagaaca

SEQ ID NO: 4800192 - DNA, 18 bp, Homo sapiens
caccagagtgtatgcata

SEQ ID NO: 4800193 - DNA, 19 bp, Homo sapiens
caccagagtgtatgcatac

SEQ ID NO: 4800194 - DNA, 18 bp, Homo sapiens
caccagcctgagccacag

SEQ ID NO: 4800195 - DNA, 14 bp, Homo sapiens
caccagctatctgt

SEQ ID NO: 4800196 - DNA, 20 bp, Homo sapiens
caccagctgccaaaatcgta

SEQ ID NO: 4800197 - DNA, 11 bp, Homo sapiens
caccaggaaga

SEQ ID NO: 4800198 - DNA, 23 bp, Homo sapiens
caccaggaagaaggcccgggagg

SEQ ID NO: 4800199 - DNA, 15 bp, Homo sapiens
caccagggactgcag

SEQ ID NO: 4800200 - DNA, 13 bp, Homo sapiens
caccatcaccacg

SEQ ID NO: 4800201 - DNA, 19 bp, Homo sapiens
caccatcaccacgcagaga

SEQ ID NO: 4800202 - DNA, 13 bp, Homo sapiens
caccatgctgggc

SEQ ID NO: 4800203 - DNA, 20 bp, Homo sapiens
caccatgttggccaggcttg

SEQ ID NO: 4800204 - DNA, 23 bp, Homo sapiens
caccatttaatcatttccagcaa

SEQ ID NO: 4800205 - DNA, 19 bp, Homo sapiens
caccatttcccctgtggtt

SEQ ID NO: 4800206 - DNA, 20 bp, Homo sapiens
cacccacaccccgtctgccc

SEQ ID NO: 4800207 - DNA, 11 bp, Homo sapiens
cacccacccct

SEQ ID NO: 4800208 - DNA, 14 bp, Homo sapiens
cacccacccctgcc

SEQ ID NO: 4800209 - DNA, 17 bp, Homo sapiens
cacccacccctgcccag

SEQ ID NO: 4800210 - DNA, 14 bp, Homo sapiens
cacccactagccct

SEQ ID NO: 4800211 - DNA, 20 bp, Homo sapiens
cacccactagccctctttct

SEQ ID NO: 4800212 - DNA, 12 bp, Homo sapiens
cacccagcagcg

SEQ ID NO: 4800213 - DNA, 20 bp, Homo sapiens
cacccagcccactaactgag

SEQ ID NO: 4800214 - DNA, 11 bp, Homo sapiens
cacccagcctg

SEQ ID NO: 4800215 - DNA, 12 bp, Homo sapiens
cacccagcctgg

SEQ ID NO: 4800216 - DNA, 16 bp, Homo sapiens
cacccccagcagctca

SEQ ID NO: 4800217 - DNA, 14 bp, Homo sapiens
cacccccagcctcc

SEQ ID NO: 4800218 - DNA, 16 bp, Homo sapiens
cacccccagcctcccc

SEQ ID NO: 4800219 - DNA, 15 bp, Homo sapiens
cacccccattgtgaa

SEQ ID NO: 4800220 - DNA, 20 bp, Homo sapiens
cacccccgtcaccccgctct

SEQ ID NO: 4800221 - DNA, 13 bp, Homo sapiens
caccccgctgcct

SEQ ID NO: 4800222 - DNA, 23 bp, Homo sapiens
caccccgctgcctggcgggcagc

SEQ ID NO: 4800223 - DNA, 16 bp, Homo sapiens
caccccggcaggccct

SEQ ID NO: 4800224 - DNA, 19 bp, Homo sapiens
caccccggcaggccctgca

SEQ ID NO: 4800225 - DNA, 22 bp, Homo sapiens
caccccggcaggccctgcagtg

SEQ ID NO: 4800226 - DNA, 19 bp, Homo sapiens
caccccgtcccggccccgc

SEQ ID NO: 4800227 - DNA, 14 bp, Homo sapiens
caccccgtctgccc

SEQ ID NO: 4800228 - DNA, 16 bp, Homo sapiens
caccccgtctgcccct

SEQ ID NO: 4800229 - DNA, 19 bp, Homo sapiens
caccccgttcccagcgcat

SEQ ID NO: 4800230 - DNA, 19 bp, Homo sapiens
caccccgttgttgtccctg

SEQ ID NO: 4800231 - DNA, 17 bp, Homo sapiens
cacccctacagcctgca

SEQ ID NO: 4800232 - DNA, 19 bp, Homo sapiens
cacccctcaagccaggaga

SEQ ID NO: 4800233 - DNA, 14 bp, Homo sapiens
cacccctcttcccc

SEQ ID NO: 4800234 - DNA, 18 bp, Homo sapiens
cacccctgaactggcccc

SEQ ID NO: 4800235 - DNA, 13 bp, Homo sapiens
cacccctgcccag

SEQ ID NO: 4800236 - DNA, 14 bp, Homo sapiens
cacccgccccagag

SEQ ID NO: 4800237 - DNA, 21 bp, Homo sapiens
cacccgccccagagactgccc

SEQ ID NO: 4800238 - DNA, 19 bp, Homo sapiens
cacccgcccgcccccgccc

SEQ ID NO: 4800239 - DNA, 16 bp, Homo sapiens
cacccggatctccagg

SEQ ID NO: 4800240 - DNA, 17 bp, Homo sapiens
cacccggatctccaggc

SEQ ID NO: 4800241 - DNA, 18 bp, Homo sapiens
cacccggatctccaggcc

SEQ ID NO: 4800242 - DNA, 21 bp, Homo sapiens
cacccggatctccaggcccag

SEQ ID NO: 4800243 - DNA, 17 bp, Homo sapiens
cacccgtgttctcctcc

SEQ ID NO: 4800244 - DNA, 16 bp, Homo sapiens
cacccgtgtttgtaaa

SEQ ID NO: 4800245 - DNA, 18 bp, Homo sapiens
caccctcactctgccagg

SEQ ID NO: 4800246 - DNA, 17 bp, Homo sapiens
caccctccacaggagcc

SEQ ID NO: 4800247 - DNA, 17 bp, Homo sapiens
caccctccccattagta

SEQ ID NO: 4800248 - DNA, 14 bp, Homo sapiens
caccctcccctctc

SEQ ID NO: 4800249 - DNA, 17 bp, Homo sapiens
cagacaataaaatggaa

SEQ ID NO: 4800250 - DNA, 13 bp, Homo sapiens
cagacaccatcac

SEQ ID NO: 4800251 - DNA, 14 bp, Homo sapiens
cagacacctagact

SEQ ID NO: 4800252 - DNA, 14 bp, Homo sapiens
cagacagacagacg

SEQ ID NO: 4800253 - DNA, 13 bp, Homo sapiens
cagacagagtgga

SEQ ID NO: 4800254 - DNA, 17 bp, Homo sapiens
cagacagggtggggctt

SEQ ID NO: 4800255 - DNA, 19 bp, Homo sapiens
cagacagggtggggcttag

SEQ ID NO: 4800256 - DNA, 17 bp, Homo sapiens
cagacatacgaaacaca

SEQ ID NO: 4800257 - DNA, 20 bp, Homo sapiens
cagaccacactctgcctggc

SEQ ID NO: 4800258 - DNA, 21 bp, Homo sapiens
cagaccagcatagttctgcaa

SEQ ID NO: 4800259 - DNA, 14 bp, Homo sapiens
cagacccctaccct

SEQ ID NO: 4800260 - DNA, 17 bp, Homo sapiens
cagaccgatccttccca

SEQ ID NO: 4800261 - DNA, 18 bp, Homo sapiens
cagaccggggtggagtca

SEQ ID NO: 4800262 - DNA, 20 bp, Homo sapiens
cagacggacgggacagcggc

SEQ ID NO: 4800263 - DNA, 17 bp, Homo sapiens
cagacgggctgagagga

SEQ ID NO: 4800264 - DNA, 14 bp, Homo sapiens
cagacggggggctg

SEQ ID NO: 4800265 - DNA, 16 bp, Homo sapiens
cagactcgagagggct

SEQ ID NO: 4800266 - DNA, 21 bp, Homo sapiens
cagactcgagagggctgagcc

SEQ ID NO: 4800267 - DNA, 17 bp, Homo sapiens
cagactctctcctctct

SEQ ID NO: 4800268 - DNA, 23 bp, Homo sapiens
cagactctctcctctctctccct

SEQ ID NO: 4800269 - DNA, 12 bp, Homo sapiens
cagactgcaggt

SEQ ID NO: 4800270 - DNA, 15 bp, Homo sapiens
cagactgcaggttgg

SEQ ID NO: 4800271 - DNA, 15 bp, Homo sapiens
cagactgctgtctta

SEQ ID NO: 4800272 - DNA, 21 bp, Homo sapiens
cagacttcgctattcccaggc

SEQ ID NO: 4800273 - DNA, 24 bp, Homo sapiens
cagacttcgctattcccaggcagg

SEQ ID NO: 4800274 - DNA, 17 bp, Homo sapiens
cagacttctaaaataaa

SEQ ID NO: 4800275 - DNA, 23 bp, Homo sapiens
cagagaagcctcagtccctccct

SEQ ID NO: 4800276 - DNA, 22 bp, Homo sapiens
cagagacggcagccccatcctt

SEQ ID NO: 4800277 - DNA, 15 bp, Homo sapiens
cagagactgcccacc

SEQ ID NO: 4800278 - DNA, 16 bp, Homo sapiens
cagagagaagcacccc

SEQ ID NO: 4800279 - DNA, 20 bp, Homo sapiens
cagagagacaacttgctcct

SEQ ID NO: 4800280 - DNA, 19 bp, Homo sapiens
cagagaggggaggtgggag

SEQ ID NO: 4800281 - DNA, 20 bp, Homo sapiens
cagagaggggaggtgggagg

SEQ ID NO: 4800282 - DNA, 15 bp, Homo sapiens
cagagatggcagagc

SEQ ID NO: 4800283 - DNA, 18 bp, Homo sapiens
cagagatggcagagccat

SEQ ID NO: 4800284 - DNA, 22 bp, Homo sapiens
cagagccatccaccctgaggag

SEQ ID NO: 4800285 - DNA, 23 bp, Homo sapiens
cagagcccaggaattctcacagg

SEQ ID NO: 4800286 - DNA, 16 bp, Homo sapiens
cagagccccggagcac

SEQ ID NO: 4800287 - DNA, 19 bp, Homo sapiens
cagagcccgcccacctggg

SEQ ID NO: 4800288 - DNA, 22 bp, Homo sapiens
cagagcccgcccacctgggccc

SEQ ID NO: 4800289 - DNA, 18 bp, Homo sapiens
cagagcctatggaaaggg

SEQ ID NO: 4800290 - DNA, 11 bp, Homo sapiens
cagagcctctg

SEQ ID NO: 4800291 - DNA, 15 bp, Homo sapiens
cagagcctgttttaa

SEQ ID NO: 4800292 - DNA, 18 bp, Homo sapiens
cagagcctgttttaaaaa

SEQ ID NO: 4800293 - DNA, 22 bp, Homo sapiens
cagagcgatgtgttctttgtac

SEQ ID NO: 4800294 - DNA, 19 bp, Homo sapiens
cagagcgcagcccccacgc

SEQ ID NO: 4800295 - DNA, 18 bp, Homo sapiens
cagagctgagtcggctgg

SEQ ID NO: 4800296 - DNA, 21 bp, Homo sapiens
cagagctgagtcggctgggca

SEQ ID NO: 4800297 - DNA, 19 bp, Homo sapiens
cagagctgatggagaagga

SEQ ID NO: 4800298 - DNA, 18 bp, Homo sapiens
cagagctgccacctgcct

SEQ ID NO: 4800299 - DNA, 20 bp, Homo sapiens
cagaggaaagcaaaggagat

SEQ ID NO: 4800300 - DNA, 20 bp, Homo sapiens
cagaggacggcttccccatc

SEQ ID NO: 4800301 - DNA, 17 bp, Homo sapiens
cagaggagcaaggttta

SEQ ID NO: 4800302 - DNA, 14 bp, Homo sapiens
cagaggcagggccc

SEQ ID NO: 4800303 - DNA, 16 bp, Homo sapiens
cagaggcagggccctg

SEQ ID NO: 4800304 - DNA, 18 bp, Homo sapiens
cagaggcagggccctggg

SEQ ID NO: 4800305 - DNA, 19 bp, Homo sapiens
cagaggcattggaggatgg

SEQ ID NO: 4800306 - DNA, 17 bp, Homo sapiens
cagaggcccgaggcacc

SEQ ID NO: 4800307 - DNA, 17 bp, Homo sapiens
cagaggtggggtgctgg

SEQ ID NO: 4800308 - DNA, 21 bp, Homo sapiens
cagaggtggggtgctggggct

SEQ ID NO: 4800309 - DNA, 15 bp, Homo sapiens
cagagtaggtgggtc

SEQ ID NO: 4800310 - DNA, 16 bp, Homo sapiens
cagagtatacaagtgt

SEQ ID NO: 4800311 - DNA, 18 bp, Homo sapiens
cagagtatacaagtgttt

SEQ ID NO: 4800312 - DNA, 14 bp, Homo sapiens
cagagtatatatgt

SEQ ID NO: 4800313 - DNA, 15 bp, Homo sapiens
cagagtatatatgta

SEQ ID NO: 4800314 - DNA, 17 bp, Homo sapiens
cagagtatatatgtaca

SEQ ID NO: 4800315 - DNA, 18 bp, Homo sapiens
cagagtatatatgtacag

SEQ ID NO: 4800316 - DNA, 14 bp, Homo sapiens
cagagtatgggcac

SEQ ID NO: 4800317 - DNA, 16 bp, Homo sapiens
cagagtcaagctgatg

SEQ ID NO: 4800318 - DNA, 20 bp, Homo sapiens
cagagtgatttgtaaaacag

SEQ ID NO: 4800319 - DNA, 18 bp, Homo sapiens
cagagtggactcttccct

SEQ ID NO: 4800320 - DNA, 14 bp, Homo sapiens
cagagtggatctgg

SEQ ID NO: 4800321 - DNA, 15 bp, Homo sapiens
cagagtggatctgga

SEQ ID NO: 4800322 - DNA, 19 bp, Homo sapiens
cagagtggatctggagtct

SEQ ID NO: 4800323 - DNA, 18 bp, Homo sapiens
cagagtgtatttttgtaa

SEQ ID NO: 4800324 - DNA, 14 bp, Homo sapiens
cagagttgaagaca

SEQ ID NO: 4800325 - DNA, 15 bp, Homo sapiens
cagagttgaagacag

SEQ ID NO: 4800326 - DNA, 17 bp, Homo sapiens
cagagttgaagacagag

SEQ ID NO: 4800327 - DNA, 14 bp, Homo sapiens
cagataaatcatgg

SEQ ID NO: 4800328 - DNA, 18 bp, Homo sapiens
cagataaatcatgggcat

SEQ ID NO: 4800329 - DNA, 18 bp, Homo sapiens
cagatacctgtgaggact

SEQ ID NO: 4800330 - DNA, 21 bp, Homo sapiens
cagatatcgagagtttctatg

SEQ ID NO: 4800331 - DNA, 21 bp, Homo sapiens
cagatcaacagacctaagaaa

SEQ ID NO: 4800332 - DNA, 20 bp, Homo sapiens
cagatccctcggtcagcacc

SEQ ID NO: 4800333 - DNA, 20 bp, Homo sapiens
cagatcctctttccccactg

SEQ ID NO: 4800334 - DNA, 12 bp, Homo sapiens
cagatccttcca

SEQ ID NO: 4800335 - DNA, 15 bp, Homo sapiens
cagatctagccaggc

SEQ ID NO: 4800336 - DNA, 22 bp, Homo sapiens
cagatctgcactcctgtctctt

SEQ ID NO: 4800337 - DNA, 16 bp, Homo sapiens
cagatcttgagcaagg

SEQ ID NO: 4800338 - DNA, 14 bp, Homo sapiens
cagatgacagggag

SEQ ID NO: 4800339 - DNA, 16 bp, Homo sapiens
cagatgcaacctcact

SEQ ID NO: 4800340 - DNA, 19 bp, Homo sapiens
cagatgggtgtcccctggt

SEQ ID NO: 4800341 - DNA, 14 bp, Homo sapiens
cagattattttcta

SEQ ID NO: 4800342 - DNA, 18 bp, Homo sapiens
cagattattttctatatt

SEQ ID NO: 4800343 - DNA, 19 bp, Homo sapiens
cagattattttctatattt

SEQ ID NO: 4800344 - DNA, 22 bp, Homo sapiens
cagattcacctccattaaccaa

SEQ ID NO: 4800345 - DNA, 12 bp, Homo sapiens
cagattcacctt

SEQ ID NO: 4800346 - DNA, 13 bp, Homo sapiens
cagattgtatctg

SEQ ID NO: 4800347 - DNA, 19 bp, Homo sapiens
cagatttccaaaagtacta

SEQ ID NO: 4800348 - DNA, 13 bp, Homo sapiens
cagatttgttcat

SEQ ID NO: 4800349 - DNA, 14 bp, Homo sapiens
cagatttgttcatt

SEQ ID NO: 4800350 - DNA, 18 bp, Homo sapiens
cagcaaaaccattgcttc

SEQ ID NO: 4800351 - DNA, 17 bp, Homo sapiens
cagcaaaatatatgttt

SEQ ID NO: 4800352 - DNA, 21 bp, Homo sapiens
cagcaaattcttgaataaact

SEQ ID NO: 4800353 - DNA, 16 bp, Homo sapiens
cagcaaccctacagta

SEQ ID NO: 4800354 - DNA, 20 bp, Homo sapiens
cagcaagataaacacaattt

SEQ ID NO: 4800355 - DNA, 13 bp, Homo sapiens
cagcacaaagcac

SEQ ID NO: 4800356 - DNA, 17 bp, Homo sapiens
cagcacagagagcggct

SEQ ID NO: 4800357 - DNA, 20 bp, Homo sapiens
cagcacctcctccgtgggca

SEQ ID NO: 4800358 - DNA, 22 bp, Homo sapiens
cagcacctcctccgtgggcagc

SEQ ID NO: 4800359 - DNA, 18 bp, Homo sapiens
cagcactaaggccgtgtc

SEQ ID NO: 4800360 - DNA, 20 bp, Homo sapiens
cagcactaattagtgtccaa

SEQ ID NO: 4800361 - DNA, 14 bp, Homo sapiens
cagcactcccaggg

SEQ ID NO: 4800362 - DNA, 16 bp, Homo sapiens
cagcactcccagggcc

SEQ ID NO: 4800363 - DNA, 17 bp, Homo sapiens
cagcactcccagggccc

SEQ ID NO: 4800364 - DNA, 11 bp, Homo sapiens
cagcactgaaa

SEQ ID NO: 4800365 - DNA, 12 bp, Homo sapiens
cagcactgaaaa

SEQ ID NO: 4800366 - DNA, 14 bp, Homo sapiens
cagcactgaaaata

SEQ ID NO: 4800367 - DNA, 19 bp, Homo sapiens
cagcagcagtttgtgatct

SEQ ID NO: 4800368 - DNA, 18 bp, Homo sapiens
cagcagccccccagcact

SEQ ID NO: 4800369 - DNA, 21 bp, Homo sapiens
cagcagccccccagcactaag

SEQ ID NO: 4800370 - DNA, 18 bp, Homo sapiens
cagcagcctctgaagttg

SEQ ID NO: 4800371 - DNA, 13 bp, Homo sapiens
caggctgcaggga

SEQ ID NO: 4800372 - DNA, 16 bp, Homo sapiens
caggctgcccagcggc

SEQ ID NO: 4800373 - DNA, 21 bp, Homo sapiens
caggctgttctgcactgaaaa

SEQ ID NO: 4800374 - DNA, 13 bp, Homo sapiens
cagggacagcctg

SEQ ID NO: 4800375 - DNA, 14 bp, Homo sapiens
cagggacagcctgc

SEQ ID NO: 4800376 - DNA, 17 bp, Homo sapiens
cagggacagcctgcaca

SEQ ID NO: 4800377 - DNA, 17 bp, Homo sapiens
cagggacagttgggtgt

SEQ ID NO: 4800378 - DNA, 21 bp, Homo sapiens
cagggacagttgggtgtgaga

SEQ ID NO: 4800379 - DNA, 14 bp, Homo sapiens
cagggacgacccgg

SEQ ID NO: 4800380 - DNA, 14 bp, Homo sapiens
cagggagctgggga

SEQ ID NO: 4800381 - DNA, 21 bp, Homo sapiens
cagggagggaaacccggggaa

SEQ ID NO: 4800382 - DNA, 23 bp, Homo sapiens
cagggagtgtgatgcaggaagac

SEQ ID NO: 4800383 - DNA, 19 bp, Homo sapiens
cagggatgctatctcgcta

SEQ ID NO: 4800384 - DNA, 23 bp, Homo sapiens
cagggatgggggatgggccaggg

SEQ ID NO: 4800385 - DNA, 18 bp, Homo sapiens
cagggcaaaatgaactaa

SEQ ID NO: 4800386 - DNA, 21 bp, Homo sapiens
cagggcaaatgacatgcactg

SEQ ID NO: 4800387 - DNA, 17 bp, Homo sapiens
cagggcaatcaatgttc

SEQ ID NO: 4800388 - DNA, 18 bp, Homo sapiens
cagggcagaaccaagaac

SEQ ID NO: 4800389 - DNA, 16 bp, Homo sapiens
cagggcccagaggctg

SEQ ID NO: 4800390 - DNA, 17 bp, Homo sapiens
cagggcccagaggctga

SEQ ID NO: 4800391 - DNA, 14 bp, Homo sapiens
cagggcccccacag

SEQ ID NO: 4800392 - DNA, 15 bp, Homo sapiens
cagggcccccatgca

SEQ ID NO: 4800393 - DNA, 18 bp, Homo sapiens
cagggcccccatgcaggc

SEQ ID NO: 4800394 - DNA, 15 bp, Homo sapiens
cagggcccgagcgcg

SEQ ID NO: 4800395 - DNA, 20 bp, Homo sapiens
cagggccctgaaatggcctg

SEQ ID NO: 4800396 - DNA, 14 bp, Homo sapiens
cagggccctgctca

SEQ ID NO: 4800397 - DNA, 14 bp, Homo sapiens
cagggccgcagggc

SEQ ID NO: 4800398 - DNA, 16 bp, Homo sapiens
cagggccgcagggcgc

SEQ ID NO: 4800399 - DNA, 22 bp, Homo sapiens
cagggccgccgaagggcagccc

SEQ ID NO: 4800400 - DNA, 18 bp, Homo sapiens
cagggccttggcccaggg

SEQ ID NO: 4800401 - DNA, 13 bp, Homo sapiens
cagggcgctccgg

SEQ ID NO: 4800402 - DNA, 20 bp, Homo sapiens
cagggcgctccggcagaggc

SEQ ID NO: 4800403 - DNA, 21 bp, Homo sapiens
cagggcgctccggcagaggca

SEQ ID NO: 4800404 - DNA, 18 bp, Homo sapiens
cagggcgggccaggagaa

SEQ ID NO: 4800405 - DNA, 16 bp, Homo sapiens
cagggctgggcgcctc

SEQ ID NO: 4800406 - DNA, 17 bp, Homo sapiens
cagggctgggcgcctct

SEQ ID NO: 4800407 - DNA, 18 bp, Homo sapiens
cagggctgggcgcctctg

SEQ ID NO: 4800408 - DNA, 14 bp, Homo sapiens
caggggaggctgag

SEQ ID NO: 4800409 - DNA, 18 bp, Homo sapiens
caggggcccctcctccag

SEQ ID NO: 4800410 - DNA, 15 bp, Homo sapiens
caggggctgcagccc

SEQ ID NO: 4800411 - DNA, 16 bp, Homo sapiens
caggggctgcagcccc

SEQ ID NO: 4800412 - DNA, 23 bp, Homo sapiens
caggggctgcagccccctgcttc

SEQ ID NO: 4800413 - DNA, 23 bp, Homo sapiens
caggggggttgggttccagacag

SEQ ID NO: 4800414 - DNA, 15 bp, Homo sapiens
cagggggtttgagga

SEQ ID NO: 4800415 - DNA, 20 bp, Homo sapiens
cagggggtttgaggaccctc

SEQ ID NO: 4800416 - DNA, 14 bp, Homo sapiens
cagggtccagccct

SEQ ID NO: 4800417 - DNA, 17 bp, Homo sapiens
cagggtccagccctccg

SEQ ID NO: 4800418 - DNA, 21 bp, Homo sapiens
cagggtcctgggggctgctgc

SEQ ID NO: 4800419 - DNA, 17 bp, Homo sapiens
cagggtgcaggcgcgca

SEQ ID NO: 4800420 - DNA, 19 bp, Homo sapiens
cagggtgcaggcgcgcacc

SEQ ID NO: 4800421 - DNA, 13 bp, Homo sapiens
cagggtggggctt

SEQ ID NO: 4800422 - DNA, 22 bp, Homo sapiens
cagggttaaagaaaggcagaga

SEQ ID NO: 4800423 - DNA, 17 bp, Homo sapiens
cagggttctagaagggg

SEQ ID NO: 4800424 - DNA, 19 bp, Homo sapiens
cagggttctagaaggggcg

SEQ ID NO: 4800425 - DNA, 17 bp, Homo sapiens
cagggtttacccagtgg

SEQ ID NO: 4800426 - DNA, 18 bp, Homo sapiens
caggtcctgcccatgtgt

SEQ ID NO: 4800427 - DNA, 21 bp, Homo sapiens
caggtcctgcccatgtgtccc

SEQ ID NO: 4800428 - DNA, 22 bp, Homo sapiens
caggtcctgcccatgtgtcccc

SEQ ID NO: 4800429 - DNA, 23 bp, Homo sapiens
caggtcctgcccatgtgtcccct

SEQ ID NO: 4800430 - DNA, 23 bp, Homo sapiens
caggtgatcccccaaacagcatg

SEQ ID NO: 4800431 - DNA, 18 bp, Homo sapiens
caggtgcctcccagccct

SEQ ID NO: 4800432 - DNA, 16 bp, Homo sapiens
caggtgcgtgccacat

SEQ ID NO: 4800433 - DNA, 18 bp, Homo sapiens
caggtggcatttgcaggt

SEQ ID NO: 4800434 - DNA, 21 bp, Homo sapiens
caggtggggttttcacttcct

SEQ ID NO: 4800435 - DNA, 22 bp, Homo sapiens
caggtggggttttcacttccta

SEQ ID NO: 4800436 - DNA, 12 bp, Homo sapiens
caggtgtaaata

SEQ ID NO: 4800437 - DNA, 14 bp, Homo sapiens
caggtgtaaatata

SEQ ID NO: 4800438 - DNA, 15 bp, Homo sapiens
caggttcacccagcg

SEQ ID NO: 4800439 - DNA, 15 bp, Homo sapiens
caggttccatccacc

SEQ ID NO: 4800440 - DNA, 14 bp, Homo sapiens
caggttctctcctg

SEQ ID NO: 4800441 - DNA, 14 bp, Homo sapiens
caggttttatgaga

SEQ ID NO: 4800442 - DNA, 12 bp, Homo sapiens
caggttttcctg

SEQ ID NO: 4800443 - DNA, 17 bp, Homo sapiens
cagtaaaattatactgt

SEQ ID NO: 4800444 - DNA, 12 bp, Homo sapiens
cagtaaatatac

SEQ ID NO: 4800445 - DNA, 19 bp, Homo sapiens
cagtaacacagtgcagtgc

SEQ ID NO: 4800446 - DNA, 14 bp, Homo sapiens
cagtaactgccatt

SEQ ID NO: 4800447 - DNA, 21 bp, Homo sapiens
cagtaatctttcggtctcctt

SEQ ID NO: 4800448 - DNA, 15 bp, Homo sapiens
cagtaattttcggat

SEQ ID NO: 4800449 - DNA, 21 bp, Homo sapiens
cagtacaattctttgttgctt

SEQ ID NO: 4800450 - DNA, 23 bp, Homo sapiens
cagtacaattctttgttgcttaa

SEQ ID NO: 4800451 - DNA, 14 bp, Homo sapiens
cagtacatcttgtg

SEQ ID NO: 4800452 - DNA, 18 bp, Homo sapiens
cagtacatcttgtgcatg

SEQ ID NO: 4800453 - DNA, 16 bp, Homo sapiens
cagtaccatcccactg

SEQ ID NO: 4800454 - DNA, 24 bp, Homo sapiens
cagtagagggtccagtcttctagt

SEQ ID NO: 4800455 - DNA, 18 bp, Homo sapiens
cagtagcatactgatgag

SEQ ID NO: 4800456 - DNA, 19 bp, Homo sapiens
cagtagcatactgatgaga

SEQ ID NO: 4800457 - DNA, 21 bp, Homo sapiens
cagtagcatactgatgagaca

SEQ ID NO: 4800458 - DNA, 23 bp, Homo sapiens
cagtagcattttaatagtttcta

SEQ ID NO: 4800459 - DNA, 15 bp, Homo sapiens
cagtagtgccaaaag

SEQ ID NO: 4800460 - DNA, 22 bp, Homo sapiens
cagtagtgccaaaaggcccctt

SEQ ID NO: 4800461 - DNA, 15 bp, Homo sapiens
cagtagtgcctgtga

SEQ ID NO: 4800462 - DNA, 23 bp, Homo sapiens
cagtagtgtcacttttttcctgt

SEQ ID NO: 4800463 - DNA, 21 bp, Homo sapiens
cagtagtgttgggtggaggat

SEQ ID NO: 4800464 - DNA, 24 bp, Homo sapiens
cagtagtgttgggtggaggatgga

SEQ ID NO: 4800465 - DNA, 13 bp, Homo sapiens
cagtataaattac

SEQ ID NO: 4800466 - DNA, 16 bp, Homo sapiens
cagtataaattacatg

SEQ ID NO: 4800467 - DNA, 17 bp, Homo sapiens
cagtataaattacatgc

SEQ ID NO: 4800468 - DNA, 20 bp, Homo sapiens
cagtataaattacatgcatg

SEQ ID NO: 4800469 - DNA, 21 bp, Homo sapiens
cagtataaattacatgcatga

SEQ ID NO: 4800470 - DNA, 14 bp, Homo sapiens
cagtatagataaat

SEQ ID NO: 4800471 - DNA, 22 bp, Homo sapiens
cagtatattttatttcaatgta

SEQ ID NO: 4800472 - DNA, 24 bp, Homo sapiens
cagtatccgcgagcctgcttgctg

SEQ ID NO: 4800473 - DNA, 14 bp, Homo sapiens
cagtatcctggatt

SEQ ID NO: 4800474 - DNA, 21 bp, Homo sapiens
cagtatcctggattcctctaa

SEQ ID NO: 4800475 - DNA, 16 bp, Homo sapiens
cagtatgtacaggctg

SEQ ID NO: 4800476 - DNA, 19 bp, Homo sapiens
cagtattaacatcaaagac

SEQ ID NO: 4800477 - DNA, 20 bp, Homo sapiens
cagtattatagatataaata

SEQ ID NO: 4800478 - DNA, 21 bp, Homo sapiens
cagtattatagatataaatat

SEQ ID NO: 4800479 - DNA, 20 bp, Homo sapiens
cagtattatttagtaaaatt

SEQ ID NO: 4800480 - DNA, 22 bp, Homo sapiens
cagtattatttagtaaaattat

SEQ ID NO: 4800481 - DNA, 23 bp, Homo sapiens
cagtattgacgacctacatctga

SEQ ID NO: 4800482 - DNA, 15 bp, Homo sapiens
cagtattgacttctt

SEQ ID NO: 4800483 - DNA, 13 bp, Homo sapiens
cagtatttaacat

SEQ ID NO: 4800484 - DNA, 16 bp, Homo sapiens
cagtcagcacagagag

SEQ ID NO: 4800485 - DNA, 19 bp, Homo sapiens
cagtcagcacagagagcgg

SEQ ID NO: 4800486 - DNA, 16 bp, Homo sapiens
cagtcagccagcttgg

SEQ ID NO: 4800487 - DNA, 12 bp, Homo sapiens
cagtcagcccag

SEQ ID NO: 4800488 - DNA, 15 bp, Homo sapiens
cagtcagcggagagg

SEQ ID NO: 4800489 - DNA, 19 bp, Homo sapiens
cagtcattaaattactata

SEQ ID NO: 4800490 - DNA, 13 bp, Homo sapiens
cagtccaattttc

SEQ ID NO: 4800491 - DNA, 14 bp, Homo sapiens
cagtccaattttcc

SEQ ID NO: 4800492 - DNA, 15 bp, Homo sapiens
catacctctctctat

SEQ ID NO: 4800493 - DNA, 15 bp, Homo sapiens
catactatagattct

SEQ ID NO: 4800494 - DNA, 18 bp, Homo sapiens
catactgatgagacaaca

SEQ ID NO: 4800495 - DNA, 21 bp, Homo sapiens
catactgatgagacaacacac

SEQ ID NO: 4800496 - DNA, 23 bp, Homo sapiens
catactgatgagacaacacacac

SEQ ID NO: 4800497 - DNA, 17 bp, Homo sapiens
catagaaacatgacact

SEQ ID NO: 4800498 - DNA, 20 bp, Homo sapiens
catagaaacatgacactgac

SEQ ID NO: 4800499 - DNA, 18 bp, Homo sapiens
catagaagttaaaggtta

SEQ ID NO: 4800500 - DNA, 16 bp, Homo sapiens
catagacaaaggcctt

SEQ ID NO: 4800501 - DNA, 21 bp, Homo sapiens
catagacaaaggccttaacaa

SEQ ID NO: 4800502 - DNA, 12 bp, Homo sapiens
catagataccat

SEQ ID NO: 4800503 - DNA, 21 bp, Homo sapiens
catagataccattttgaaata

SEQ ID NO: 4800504 - DNA, 22 bp, Homo sapiens
catagataccattttgaaatat

SEQ ID NO: 4800505 - DNA, 20 bp, Homo sapiens
catagattaatggcactgat

SEQ ID NO: 4800506 - DNA, 16 bp, Homo sapiens
catagattcacctgta

SEQ ID NO: 4800507 - DNA, 18 bp, Homo sapiens
catagattcacctgtaaa

SEQ ID NO: 4800508 - DNA, 23 bp, Homo sapiens
catagattcacctgtaaaacttt

SEQ ID NO: 4800509 - DNA, 15 bp, Homo sapiens
catagccattcattt

SEQ ID NO: 4800510 - DNA, 15 bp, Homo sapiens
catagccccaggccc

SEQ ID NO: 4800511 - DNA, 16 bp, Homo sapiens
catagccccaggcccg

SEQ ID NO: 4800512 - DNA, 19 bp, Homo sapiens
catagctttagagaagcca

SEQ ID NO: 4800513 - DNA, 20 bp, Homo sapiens
catagctttagagaagccat

SEQ ID NO: 4800514 - DNA, 22 bp, Homo sapiens
catagctttagagaagccataa

SEQ ID NO: 4800515 - DNA, 14 bp, Homo sapiens
cataggcagagccc

SEQ ID NO: 4800516 - DNA, 13 bp, Homo sapiens
cataggctgggga

SEQ ID NO: 4800517 - DNA, 20 bp, Homo sapiens
catagtagaactttataaaa

SEQ ID NO: 4800518 - DNA, 18 bp, Homo sapiens
catagtggtattttaaca

SEQ ID NO: 4800519 - DNA, 16 bp, Homo sapiens
catagtggtcatttgg

SEQ ID NO: 4800520 - DNA, 21 bp, Homo sapiens
catagtttgaattcatgcctc

SEQ ID NO: 4800521 - DNA, 16 bp, Homo sapiens
catataaacacagtaa

SEQ ID NO: 4800522 - DNA, 20 bp, Homo sapiens
catataaacacagtaagata

SEQ ID NO: 4800523 - DNA, 15 bp, Homo sapiens
catataaatgtttat

SEQ ID NO: 4800524 - DNA, 16 bp, Homo sapiens
catataaatgtttata

SEQ ID NO: 4800525 - DNA, 21 bp, Homo sapiens
catatacattatttctgtata

SEQ ID NO: 4800526 - DNA, 15 bp, Homo sapiens
catatagctttgcaa

SEQ ID NO: 4800527 - DNA, 12 bp, Homo sapiens
catatataaaac

SEQ ID NO: 4800528 - DNA, 14 bp, Homo sapiens
catatataaattat

SEQ ID NO: 4800529 - DNA, 17 bp, Homo sapiens
catatatgcttttttgc

SEQ ID NO: 4800530 - DNA, 19 bp, Homo sapiens
catatatgcttttttgcaa

SEQ ID NO: 4800531 - DNA, 21 bp, Homo sapiens
catatatgcttttttgcaata

SEQ ID NO: 4800532 - DNA, 18 bp, Homo sapiens
catatcagctctgcataa

SEQ ID NO: 4800533 - DNA, 15 bp, Homo sapiens
catatgaacgcacaa

SEQ ID NO: 4800534 - DNA, 22 bp, Homo sapiens
catatgcctgggcagaaggaag

SEQ ID NO: 4800535 - DNA, 22 bp, Homo sapiens
catatggaaatcctgttactta

SEQ ID NO: 4800536 - DNA, 23 bp, Homo sapiens
catatggcaacgttcatgttcat

SEQ ID NO: 4800537 - DNA, 18 bp, Homo sapiens
catatgtaggaaaatttt

SEQ ID NO: 4800538 - DNA, 11 bp, Homo sapiens
catattaaaat

SEQ ID NO: 4800539 - DNA, 13 bp, Homo sapiens
catattaaaatca

SEQ ID NO: 4800540 - DNA, 15 bp, Homo sapiens
catattaaaatcaca

SEQ ID NO: 4800541 - DNA, 17 bp, Homo sapiens
catattaaaatcacaaa

SEQ ID NO: 4800542 - DNA, 22 bp, Homo sapiens
catattcaaagtatatacagag

SEQ ID NO: 4800543 - DNA, 16 bp, Homo sapiens
catattgataataaaa

SEQ ID NO: 4800544 - DNA, 17 bp, Homo sapiens
catattgataataaaat

SEQ ID NO: 4800545 - DNA, 21 bp, Homo sapiens
catcaaacaaatcattttgat

SEQ ID NO: 4800546 - DNA, 14 bp, Homo sapiens
catcaaagtgttta

SEQ ID NO: 4800547 - DNA, 16 bp, Homo sapiens
catcaaagtgtttaat

SEQ ID NO: 4800548 - DNA, 14 bp, Homo sapiens
catcaagatgtgac

SEQ ID NO: 4800549 - DNA, 18 bp, Homo sapiens
catcaagtctccacgtgt

SEQ ID NO: 4800550 - DNA, 18 bp, Homo sapiens
catcaattgggttttgat

SEQ ID NO: 4800551 - DNA, 14 bp, Homo sapiens
catcaccacagctg

SEQ ID NO: 4800552 - DNA, 15 bp, Homo sapiens
catcaccgattcttc

SEQ ID NO: 4800553 - DNA, 20 bp, Homo sapiens
catcaccgattcttccttgc

SEQ ID NO: 4800554 - DNA, 21 bp, Homo sapiens
catcaccgattcttccttgcc

SEQ ID NO: 4800555 - DNA, 14 bp, Homo sapiens
catcagaagtggta

SEQ ID NO: 4800556 - DNA, 20 bp, Homo sapiens
catcagagtgtatttttgta

SEQ ID NO: 4800557 - DNA, 21 bp, Homo sapiens
catcagagtgtatttttgtaa

SEQ ID NO: 4800558 - DNA, 14 bp, Homo sapiens
catcagcaagacaa

SEQ ID NO: 4800559 - DNA, 14 bp, Homo sapiens
catcagctttataa

SEQ ID NO: 4800560 - DNA, 22 bp, Homo sapiens
catcagtccacccccattgtga

SEQ ID NO: 4800561 - DNA, 19 bp, Homo sapiens
catcagtgtcattttctgt

SEQ ID NO: 4800562 - DNA, 13 bp, Homo sapiens
catccaaacctac

SEQ ID NO: 4800563 - DNA, 21 bp, Homo sapiens
catccaaggaacttcatgctt

SEQ ID NO: 4800564 - DNA, 22 bp, Homo sapiens
catccaaggaacttcatgcttg

SEQ ID NO: 4800565 - DNA, 16 bp, Homo sapiens
catccacacacagcag

SEQ ID NO: 4800566 - DNA, 17 bp, Homo sapiens
catccacacacagcagc

SEQ ID NO: 4800567 - DNA, 18 bp, Homo sapiens
catccacacacagcagct

SEQ ID NO: 4800568 - DNA, 19 bp, Homo sapiens
catccacacacagcagctc

SEQ ID NO: 4800569 - DNA, 21 bp, Homo sapiens
catccacacacagcagctcca

SEQ ID NO: 4800570 - DNA, 15 bp, Homo sapiens
catccacatgcacat

SEQ ID NO: 4800571 - DNA, 12 bp, Homo sapiens
catccaccacct

SEQ ID NO: 4800572 - DNA, 15 bp, Homo sapiens
catccagtttgttct

SEQ ID NO: 4800573 - DNA, 15 bp, Homo sapiens
catccatagacacag

SEQ ID NO: 4800574 - DNA, 19 bp, Homo sapiens
catccatagacacagtatt

SEQ ID NO: 4800575 - DNA, 19 bp, Homo sapiens
catcccaaacccttcagtg

SEQ ID NO: 4800576 - DNA, 21 bp, Homo sapiens
catcccacgatcggccttggt

SEQ ID NO: 4800577 - DNA, 18 bp, Homo sapiens
catcccactgatatcacg

SEQ ID NO: 4800578 - DNA, 24 bp, Homo sapiens
catccccaccctcccctctcctga

SEQ ID NO: 4800579 - DNA, 18 bp, Homo sapiens
catccccagtgccagctg

SEQ ID NO: 4800580 - DNA, 13 bp, Homo sapiens
catccctccaccc

SEQ ID NO: 4800581 - DNA, 19 bp, Homo sapiens
catccctctggggctgttc

SEQ ID NO: 4800582 - DNA, 19 bp, Homo sapiens
catccctggtgaaagagta

SEQ ID NO: 4800583 - DNA, 13 bp, Homo sapiens
catcccttggccc

SEQ ID NO: 4800584 - DNA, 19 bp, Homo sapiens
catcccttggcccctctct

SEQ ID NO: 4800585 - DNA, 15 bp, Homo sapiens
catccgagcccctgt

SEQ ID NO: 4800586 - DNA, 16 bp, Homo sapiens
catccgagcccctgtt

SEQ ID NO: 4800587 - DNA, 18 bp, Homo sapiens
catccgctgcgctcccac

SEQ ID NO: 4800588 - DNA, 14 bp, Homo sapiens
catccgtctctgtc

SEQ ID NO: 4800589 - DNA, 13 bp, Homo sapiens
catcctcagcaag

SEQ ID NO: 4800590 - DNA, 14 bp, Homo sapiens
catcctcagcaagt

SEQ ID NO: 4800591 - DNA, 16 bp, Homo sapiens
catcctcagcaagtgc

SEQ ID NO: 4800592 - DNA, 17 bp, Homo sapiens
catcctcagccccaggg

SEQ ID NO: 4800593 - DNA, 11 bp, Homo sapiens
catcctcctca

SEQ ID NO: 4800594 - DNA, 12 bp, Homo sapiens
catcctcctcag

SEQ ID NO: 4800595 - DNA, 15 bp, Homo sapiens
catcctcctcagatc

SEQ ID NO: 4800596 - DNA, 18 bp, Homo sapiens
catcctcctcagatcttc

SEQ ID NO: 4800597 - DNA, 20 bp, Homo sapiens
catcctcctccgatttctaa

SEQ ID NO: 4800598 - DNA, 21 bp, Homo sapiens
catcctggaaatttgtgtgct

SEQ ID NO: 4800599 - DNA, 15 bp, Homo sapiens
catccttcccgcagc

SEQ ID NO: 4800600 - DNA, 19 bp, Homo sapiens
catccttcccgcagcacca

SEQ ID NO: 4800601 - DNA, 23 bp, Homo sapiens
catccttcccgcagcaccagcct

SEQ ID NO: 4800602 - DNA, 22 bp, Homo sapiens
catccttttttaaaaaaaagaa

SEQ ID NO: 4800603 - DNA, 12 bp, Homo sapiens
catcgcctggga

SEQ ID NO: 4800604 - DNA, 21 bp, Homo sapiens
catcgcctgggacgccccttt

SEQ ID NO: 4800605 - DNA, 22 bp, Homo sapiens
catcgccttctggggaggggct

SEQ ID NO: 4800606 - DNA, 14 bp, Homo sapiens
catcgctggaaaac

SEQ ID NO: 4800607 - DNA, 20 bp, Homo sapiens
catcggaggctgggcccctg

SEQ ID NO: 4800608 - DNA, 23 bp, Homo sapiens
catcgttgcaaccactgcaatat

SEQ ID NO: 4800609 - DNA, 12 bp, Homo sapiens
catctaaaccac

SEQ ID NO: 4800610 - DNA, 19 bp, Homo sapiens
catctaaataattcatctt

SEQ ID NO: 4800611 - DNA, 19 bp, Homo sapiens
catctatctggtgatttct

SEQ ID NO: 4800612 - DNA, 16 bp, Homo sapiens
catctcaaacactgct

SEQ ID NO: 4800613 - DNA, 15 bp, Homo sapiens
catctcaacctacct

SEQ ID NO: 4800614 - DNA, 18 bp, Homo sapiens
cattttcagatccttcca

SEQ ID NO: 4800615 - DNA, 13 bp, Homo sapiens
cattttcctggga

SEQ ID NO: 4800616 - DNA, 20 bp, Homo sapiens
cattttctagccctctccct

SEQ ID NO: 4800617 - DNA, 14 bp, Homo sapiens
cattttctctcctc

SEQ ID NO: 4800618 - DNA, 16 bp, Homo sapiens
cattttgcttcccatc

SEQ ID NO: 4800619 - DNA, 20 bp, Homo sapiens
cattttgggggtttttaatc

SEQ ID NO: 4800620 - DNA, 14 bp, Homo sapiens
cattttgtctggct

SEQ ID NO: 4800621 - DNA, 21 bp, Homo sapiens
cattttgtctggctgtggccc

SEQ ID NO: 4800622 - DNA, 15 bp, Homo sapiens
catttttgtaatata

SEQ ID NO: 4800623 - DNA, 14 bp, Homo sapiens
cattttttgtctgt

SEQ ID NO: 4800624 - DNA, 15 bp, Homo sapiens
ccaaaagctgctttc

SEQ ID NO: 4800625 - DNA, 17 bp, Homo sapiens
ccaaacagaaaggagtt

SEQ ID NO: 4800626 - DNA, 15 bp, Homo sapiens
ccaaacagcatgtgc

SEQ ID NO: 4800627 - DNA, 14 bp, Homo sapiens
ccaaactgtagtaa

SEQ ID NO: 4800628 - DNA, 16 bp, Homo sapiens
ccaaactgttcaagaa

SEQ ID NO: 4800629 - DNA, 13 bp, Homo sapiens
ccaaagatgcagc

SEQ ID NO: 4800630 - DNA, 14 bp, Homo sapiens
ccaaagatgcagcc

SEQ ID NO: 4800631 - DNA, 19 bp, Homo sapiens
ccaaagatgcagccgcctt

SEQ ID NO: 4800632 - DNA, 14 bp, Homo sapiens
ccaaagcatggact

SEQ ID NO: 4800633 - DNA, 14 bp, Homo sapiens
ccaaatataaactt

SEQ ID NO: 4800634 - DNA, 17 bp, Homo sapiens
ccaaatattcattttga

SEQ ID NO: 4800635 - DNA, 15 bp, Homo sapiens
ccaaatattgatctg

SEQ ID NO: 4800636 - DNA, 14 bp, Homo sapiens
ccaaatgtaaaata

SEQ ID NO: 4800637 - DNA, 15 bp, Homo sapiens
ccaaatgtaaaatat

SEQ ID NO: 4800638 - DNA, 20 bp, Homo sapiens
ccaacaatactttgtgtctt

SEQ ID NO: 4800639 - DNA, 20 bp, Homo sapiens
ccaacacccaaagcatggac

SEQ ID NO: 4800640 - DNA, 22 bp, Homo sapiens
ccaacccaggattcaacatcaa

SEQ ID NO: 4800641 - DNA, 15 bp, Homo sapiens
ccaacccccacctcc

SEQ ID NO: 4800642 - DNA, 13 bp, Homo sapiens
ccaacctcccctg

SEQ ID NO: 4800643 - DNA, 24 bp, Homo sapiens
ccaacctcccctggtcctgcactg

SEQ ID NO: 4800644 - DNA, 15 bp, Homo sapiens
ccaacctggaggctg

SEQ ID NO: 4800645 - DNA, 20 bp, Homo sapiens
ccaacctggaggctggacca

SEQ ID NO: 4800646 - DNA, 16 bp, Homo sapiens
ccaacctggtaattat

SEQ ID NO: 4800647 - DNA, 12 bp, Homo sapiens
ccaactccaggg

SEQ ID NO: 4800648 - DNA, 12 bp, Homo sapiens
ccaactttccag

SEQ ID NO: 4800649 - DNA, 20 bp, Homo sapiens
ccaagcacctgggattacaa

SEQ ID NO: 4800650 - DNA, 23 bp, Homo sapiens
ccaagcagaggttgggaggccat

SEQ ID NO: 4800651 - DNA, 19 bp, Homo sapiens
ccaagccagggttccagac

SEQ ID NO: 4800652 - DNA, 22 bp, Homo sapiens
ccaagccagggttccagacagg

SEQ ID NO: 4800653 - DNA, 12 bp, Homo sapiens
ccaagctgctgc

SEQ ID NO: 4800654 - DNA, 21 bp, Homo sapiens
ccaagctgctgccgcctcacc

SEQ ID NO: 4800655 - DNA, 21 bp, Homo sapiens
ccaagctgttccacttctcta

SEQ ID NO: 4800656 - DNA, 16 bp, Homo sapiens
ccaaggcactgagcgc

SEQ ID NO: 4800657 - DNA, 12 bp, Homo sapiens
ccaaggcagctg

SEQ ID NO: 4800658 - DNA, 14 bp, Homo sapiens
ccaaggcatcccca

SEQ ID NO: 4800659 - DNA, 21 bp, Homo sapiens
ccaaggcatccccagtgccag

SEQ ID NO: 4800660 - DNA, 17 bp, Homo sapiens
ccaaggccaaaggaagc

SEQ ID NO: 4800661 - DNA, 18 bp, Homo sapiens
ccaaggccaaaggaagca

SEQ ID NO: 4800662 - DNA, 21 bp, Homo sapiens
ccaaggccaaaggaagcacat

SEQ ID NO: 4800663 - DNA, 17 bp, Homo sapiens
ccaaggccagcccacac

SEQ ID NO: 4800664 - DNA, 19 bp, Homo sapiens
ccaaggcccccacctctgt

SEQ ID NO: 4800665 - DNA, 16 bp, Homo sapiens
ccaaggtggtcttgga

SEQ ID NO: 4800666 - DNA, 23 bp, Homo sapiens
ccaaggtggtcttggagaggagg

SEQ ID NO: 4800667 - DNA, 23 bp, Homo sapiens
ccaaggtttggggaagaacgaag

SEQ ID NO: 4800668 - DNA, 22 bp, Homo sapiens
ccaagttatttgatctggtgcg

SEQ ID NO: 4800669 - DNA, 20 bp, Homo sapiens
ccaagttcattcatactcaa

SEQ ID NO: 4800670 - DNA, 17 bp, Homo sapiens
ccaatagtcatatgtga

SEQ ID NO: 4800671 - DNA, 22 bp, Homo sapiens
ccaatccaacccatgcatggcc

SEQ ID NO: 4800672 - DNA, 13 bp, Homo sapiens
ccaatccagcctt

SEQ ID NO: 4800673 - DNA, 16 bp, Homo sapiens
ccaatctctgtgactc

SEQ ID NO: 4800674 - DNA, 17 bp, Homo sapiens
ccaatgaagcaaacaca

SEQ ID NO: 4800675 - DNA, 19 bp, Homo sapiens
ccaatgccaattcatctca

SEQ ID NO: 4800676 - DNA, 19 bp, Homo sapiens
ccaatgtccaggtcacagg

SEQ ID NO: 4800677 - DNA, 22 bp, Homo sapiens
ccaatgtggtggcaataaatgt

SEQ ID NO: 4800678 - DNA, 18 bp, Homo sapiens
ccacaaatgtcctcagag

SEQ ID NO: 4800679 - DNA, 14 bp, Homo sapiens
ccacaactgacaca

SEQ ID NO: 4800680 - DNA, 13 bp, Homo sapiens
ccacaagaaattc

SEQ ID NO: 4800681 - DNA, 23 bp, Homo sapiens
ccacaagactggtattctctttg

SEQ ID NO: 4800682 - DNA, 16 bp, Homo sapiens
ccacaagagcccaggc

SEQ ID NO: 4800683 - DNA, 19 bp, Homo sapiens
ccacaagagcccaggcctc

SEQ ID NO: 4800684 - DNA, 21 bp, Homo sapiens
ccacaagagcccaggcctcct

SEQ ID NO: 4800685 - DNA, 13 bp, Homo sapiens
ccacaagcacaat

SEQ ID NO: 4800686 - DNA, 14 bp, Homo sapiens
ccacacacaccctt

SEQ ID NO: 4800687 - DNA, 17 bp, Homo sapiens
ccacacacacccttccc

SEQ ID NO: 4800688 - DNA, 15 bp, Homo sapiens
ccacacacagcagct

SEQ ID NO: 4800689 - DNA, 18 bp, Homo sapiens
ccacacaggcctggccca

SEQ ID NO: 4800690 - DNA, 19 bp, Homo sapiens
ccacacaggcctggcccag

SEQ ID NO: 4800691 - DNA, 22 bp, Homo sapiens
ccacacaggcctggcccagcca

SEQ ID NO: 4800692 - DNA, 19 bp, Homo sapiens
ccacaccccgtctgcccct

SEQ ID NO: 4800693 - DNA, 22 bp, Homo sapiens
ccacacgccggggctggccctg

SEQ ID NO: 4800694 - DNA, 17 bp, Homo sapiens
ccacagaacctttgtca

SEQ ID NO: 4800695 - DNA, 21 bp, Homo sapiens
ccacagatccatccttttgct

SEQ ID NO: 4800696 - DNA, 17 bp, Homo sapiens
ccacagcagcctctgaa

SEQ ID NO: 4800697 - DNA, 19 bp, Homo sapiens
ccacagcagcctctgaagt

SEQ ID NO: 4800698 - DNA, 13 bp, Homo sapiens
ccacagctgcctc

SEQ ID NO: 4800699 - DNA, 23 bp, Homo sapiens
ccacaggagccgcagaggcccga

SEQ ID NO: 4800700 - DNA, 15 bp, Homo sapiens
ccacaggagcgtgta

SEQ ID NO: 4800701 - DNA, 17 bp, Homo sapiens
ccacaggagcgtgtact

SEQ ID NO: 4800702 - DNA, 23 bp, Homo sapiens
ccacaggagcgtgtcctatcccc

SEQ ID NO: 4800703 - DNA, 11 bp, Homo sapiens
ccacagggacg

SEQ ID NO: 4800704 - DNA, 23 bp, Homo sapiens
ccacagtaatctttcggtctcct

SEQ ID NO: 4800705 - DNA, 23 bp, Homo sapiens
ccacataaacacttctccttaac

SEQ ID NO: 4800706 - DNA, 16 bp, Homo sapiens
ccacatacactgcatt

SEQ ID NO: 4800707 - DNA, 22 bp, Homo sapiens
ccacatccccaccctcccctct

SEQ ID NO: 4800708 - DNA, 15 bp, Homo sapiens
ccacatgcgctcctg

SEQ ID NO: 4800709 - DNA, 17 bp, Homo sapiens
ccacatggccgctgccc

SEQ ID NO: 4800710 - DNA, 18 bp, Homo sapiens
ccacattgcttcattaaa

SEQ ID NO: 4800711 - DNA, 23 bp, Homo sapiens
ccacattgcttcattaaaacaag

SEQ ID NO: 4800712 - DNA, 23 bp, Homo sapiens
ccacatttctggccatttaacta

SEQ ID NO: 4800713 - DNA, 22 bp, Homo sapiens
ccaccaagctgctctccttcac

SEQ ID NO: 4800714 - DNA, 16 bp, Homo sapiens
ccaccacacacaccct

SEQ ID NO: 4800715 - DNA, 17 bp, Homo sapiens
ccaccacacacaccctt

SEQ ID NO: 4800716 - DNA, 14 bp, Homo sapiens
ccaccacctggatg

SEQ ID NO: 4800717 - DNA, 15 bp, Homo sapiens
ccaccaccttgccaa

SEQ ID NO: 4800718 - DNA, 16 bp, Homo sapiens
ccaccactctcaggac

SEQ ID NO: 4800719 - DNA, 12 bp, Homo sapiens
ccaccactgtgt

SEQ ID NO: 4800720 - DNA, 14 bp, Homo sapiens
ccaccactgtgtcc

SEQ ID NO: 4800721 - DNA, 15 bp, Homo sapiens
ccaccactgtgtccc

SEQ ID NO: 4800722 - DNA, 16 bp, Homo sapiens
ccaccactgtgtccca

SEQ ID NO: 4800723 - DNA, 13 bp, Homo sapiens
ccacccaccccaa

SEQ ID NO: 4800724 - DNA, 16 bp, Homo sapiens
ccacccactagccctc

SEQ ID NO: 4800725 - DNA, 12 bp, Homo sapiens
ccacccagcagc

SEQ ID NO: 4800726 - DNA, 20 bp, Homo sapiens
ccacccagcagcgcccgagg

SEQ ID NO: 4800727 - DNA, 14 bp, Homo sapiens
ccacccagcccact

SEQ ID NO: 4800728 - DNA, 13 bp, Homo sapiens
ccaccccgctgcc

SEQ ID NO: 4800729 - DNA, 17 bp, Homo sapiens
ccacccctacagcctgc

SEQ ID NO: 4800730 - DNA, 19 bp, Homo sapiens
ccacccctacagcctgcac

SEQ ID NO: 4800731 - DNA, 21 bp, Homo sapiens
ccacccctcttcccccttccc

SEQ ID NO: 4800732 - DNA, 15 bp, Homo sapiens
ccacccctgcccagg

SEQ ID NO: 4800733 - DNA, 19 bp, Homo sapiens
ccacccgccccagagactg

SEQ ID NO: 4800734 - DNA, 15 bp, Homo sapiens
ccacccgtgttctcc

SEQ ID NO: 4800735 - DNA, 14 bp, Homo sapiens
ccaccctcccctct

SEQ ID NO: 4800736 - DNA, 16 bp, Homo sapiens
ccagggttccagacag

SEQ ID NO: 4800737 - DNA, 17 bp, Homo sapiens
ccagggtttacccagtg

SEQ ID NO: 4800738 - DNA, 16 bp, Homo sapiens
ccaggtgtcctgactg

SEQ ID NO: 4800739 - DNA, 23 bp, Homo sapiens
ccaggttccatccaccaccttgc

SEQ ID NO: 4800740 - DNA, 13 bp, Homo sapiens
ccaggttcctcaa

SEQ ID NO: 4800741 - DNA, 21 bp, Homo sapiens
ccagtataaattacatgcatg

SEQ ID NO: 4800742 - DNA, 22 bp, Homo sapiens
ccagtatcttgaagacttttct

SEQ ID NO: 4800743 - DNA, 15 bp, Homo sapiens
ccagtcatggctgtc

SEQ ID NO: 4800744 - DNA, 17 bp, Homo sapiens
ccagtccaattttccta

SEQ ID NO: 4800745 - DNA, 14 bp, Homo sapiens
ccagtccccctatc

SEQ ID NO: 4800746 - DNA, 13 bp, Homo sapiens
ccagtccccggga

SEQ ID NO: 4800747 - DNA, 15 bp, Homo sapiens
ccagtccccgggaaa

SEQ ID NO: 4800748 - DNA, 13 bp, Homo sapiens
ccagtccgccccg

SEQ ID NO: 4800749 - DNA, 20 bp, Homo sapiens
ccagtccgccccgtgctcct

SEQ ID NO: 4800750 - DNA, 14 bp, Homo sapiens
ccagtccggtgcct

SEQ ID NO: 4800751 - DNA, 19 bp, Homo sapiens
ccagtccggtgccttccac

SEQ ID NO: 4800752 - DNA, 12 bp, Homo sapiens
ccagtctgaagt

SEQ ID NO: 4800753 - DNA, 22 bp, Homo sapiens
ccagtcttgagtgggccccctc

SEQ ID NO: 4800754 - DNA, 23 bp, Homo sapiens
ccagtcttgagtgggccccctct

SEQ ID NO: 4800755 - DNA, 17 bp, Homo sapiens
ccagtgcaatctgtcca

SEQ ID NO: 4800756 - DNA, 17 bp, Homo sapiens
ccagtgcagtagtgcca

SEQ ID NO: 4800757 - DNA, 21 bp, Homo sapiens
ccagtggactcgcgagagggt

SEQ ID NO: 4800758 - DNA, 12 bp, Homo sapiens
ccagtgggacag

SEQ ID NO: 4800759 - DNA, 17 bp, Homo sapiens
ccagtgggacagaggag

SEQ ID NO: 4800760 - DNA, 20 bp, Homo sapiens
ccagtggtggaggtgggtgt

SEQ ID NO: 4800761 - DNA, 18 bp, Homo sapiens
ccagtgtattttctgtgt

SEQ ID NO: 4800762 - DNA, 17 bp, Homo sapiens
ccagttccctcagccct

SEQ ID NO: 4800763 - DNA, 13 bp, Homo sapiens
ccagttcttgcaa

SEQ ID NO: 4800764 - DNA, 16 bp, Homo sapiens
ccagttcttgcaataa

SEQ ID NO: 4800765 - DNA, 20 bp, Homo sapiens
ccataacgttagactgcaat

SEQ ID NO: 4800766 - DNA, 18 bp, Homo sapiens
ccataacttccagtatca

SEQ ID NO: 4800767 - DNA, 13 bp, Homo sapiens
ccataatgcttct

SEQ ID NO: 4800768 - DNA, 18 bp, Homo sapiens
ccataccccctgccccag

SEQ ID NO: 4800769 - DNA, 21 bp, Homo sapiens
ccataccccctgccccagaga

SEQ ID NO: 4800770 - DNA, 21 bp, Homo sapiens
ccatagaaacatgacactgac

SEQ ID NO: 4800771 - DNA, 18 bp, Homo sapiens
ccatagtttgaattcatg

SEQ ID NO: 4800772 - DNA, 12 bp, Homo sapiens
ccatatataaat

SEQ ID NO: 4800773 - DNA, 14 bp, Homo sapiens
ccatatataaatta

SEQ ID NO: 4800774 - DNA, 15 bp, Homo sapiens
ccatcaccacagctg

SEQ ID NO: 4800775 - DNA, 18 bp, Homo sapiens
ccatcaccacgcagagag

SEQ ID NO: 4800776 - DNA, 12 bp, Homo sapiens
ccatcactgtgt

SEQ ID NO: 4800777 - DNA, 21 bp, Homo sapiens
ccatcagatgatgggagtggg

SEQ ID NO: 4800778 - DNA, 21 bp, Homo sapiens
ccatcatcaccgattcttcct

SEQ ID NO: 4800779 - DNA, 12 bp, Homo sapiens
ccatcatttcat

SEQ ID NO: 4800780 - DNA, 15 bp, Homo sapiens
ccatccaccctgagg

SEQ ID NO: 4800781 - DNA, 16 bp, Homo sapiens
ccatccaccctgagga

SEQ ID NO: 4800782 - DNA, 18 bp, Homo sapiens
ccatccaccctgaggagt

SEQ ID NO: 4800783 - DNA, 19 bp, Homo sapiens
ccatcccatatgcctgggc

SEQ ID NO: 4800784 - DNA, 21 bp, Homo sapiens
ccatcccatatgcctgggcag

SEQ ID NO: 4800785 - DNA, 14 bp, Homo sapiens
ccatccctggtgaa

SEQ ID NO: 4800786 - DNA, 22 bp, Homo sapiens
ccatccctggtgaaagagtaaa

SEQ ID NO: 4800787 - DNA, 19 bp, Homo sapiens
ccatcctaaggtgcttacc

SEQ ID NO: 4800788 - DNA, 14 bp, Homo sapiens
ccatccttgcactt

SEQ ID NO: 4800789 - DNA, 16 bp, Homo sapiens
ccatccttttgcttca

SEQ ID NO: 4800790 - DNA, 15 bp, Homo sapiens
ccatctctcctcctt

SEQ ID NO: 4800791 - DNA, 12 bp, Homo sapiens
ccatctggcctg

SEQ ID NO: 4800792 - DNA, 13 bp, Homo sapiens
ccatctggcctgg

SEQ ID NO: 4800793 - DNA, 16 bp, Homo sapiens
ccatctggcctggcct

SEQ ID NO: 4800794 - DNA, 16 bp, Homo sapiens
ccatctgtgtgtgaat

SEQ ID NO: 4800795 - DNA, 20 bp, Homo sapiens
ccatctgtgtgtgaattcct

SEQ ID NO: 4800796 - DNA, 17 bp, Homo sapiens
ccatcttaaatttctaa

SEQ ID NO: 4800797 - DNA, 13 bp, Homo sapiens
ccatgaccttgac

SEQ ID NO: 4800798 - DNA, 19 bp, Homo sapiens
ccatgaccttgacgtgtgt

SEQ ID NO: 4800799 - DNA, 17 bp, Homo sapiens
ccatgactgcattttac

SEQ ID NO: 4800800 - DNA, 16 bp, Homo sapiens
ccatgaggaacaaggc

SEQ ID NO: 4800801 - DNA, 20 bp, Homo sapiens
ccatgaggaacaaggcaagg

SEQ ID NO: 4800802 - DNA, 12 bp, Homo sapiens
ccatgatctgta

SEQ ID NO: 4800803 - DNA, 12 bp, Homo sapiens
ccatgcaccaaa

SEQ ID NO: 4800804 - DNA, 16 bp, Homo sapiens
ccatgcaggcagcctg

SEQ ID NO: 4800805 - DNA, 20 bp, Homo sapiens
ccatgcaggcagcctgcaga

SEQ ID NO: 4800806 - DNA, 12 bp, Homo sapiens
ccatgcatggcc

SEQ ID NO: 4800807 - DNA, 16 bp, Homo sapiens
ccatgcatggcctccc

SEQ ID NO: 4800808 - DNA, 17 bp, Homo sapiens
ccatgcatggcctccca

SEQ ID NO: 4800809 - DNA, 15 bp, Homo sapiens
ccatgcattcagatc

SEQ ID NO: 4800810 - DNA, 13 bp, Homo sapiens
ccatgccaatgtc

SEQ ID NO: 4800811 - DNA, 17 bp, Homo sapiens
ccatgccaatgtccagg

SEQ ID NO: 4800812 - DNA, 20 bp, Homo sapiens
ccatgccaccacccacccca

SEQ ID NO: 4800813 - DNA, 11 bp, Homo sapiens
ccatgccctcc

SEQ ID NO: 4800814 - DNA, 16 bp, Homo sapiens
ccatgctcagctcagc

SEQ ID NO: 4800815 - DNA, 16 bp, Homo sapiens
ccatgctcctcactgc

SEQ ID NO: 4800816 - DNA, 18 bp, Homo sapiens
ccatgctctttcaccctg

SEQ ID NO: 4800817 - DNA, 23 bp, Homo sapiens
ccatgctctttcaccctgccacc

SEQ ID NO: 4800818 - DNA, 19 bp, Homo sapiens
ccatgctgtccctgtgggc

SEQ ID NO: 4800819 - DNA, 22 bp, Homo sapiens
ccatgctgtccctgtgggctca

SEQ ID NO: 4800820 - DNA, 23 bp, Homo sapiens
ccatgctgtccctgtgggctcac

SEQ ID NO: 4800821 - DNA, 17 bp, Homo sapiens
ccatggaacagccctgc

SEQ ID NO: 4800822 - DNA, 18 bp, Homo sapiens
ccatggaaccatggagga

SEQ ID NO: 4800823 - DNA, 20 bp, Homo sapiens
ccatggaaccatggaggagg

SEQ ID NO: 4800824 - DNA, 22 bp, Homo sapiens
ccatggaaccatggaggaggaa

SEQ ID NO: 4800825 - DNA, 14 bp, Homo sapiens
ccatggccccagct

SEQ ID NO: 4800826 - DNA, 18 bp, Homo sapiens
ccatggccccagctggct

SEQ ID NO: 4800827 - DNA, 14 bp, Homo sapiens
ccatggctggatgt

SEQ ID NO: 4800828 - DNA, 19 bp, Homo sapiens
ccatggctggatgtgcatc

SEQ ID NO: 4800829 - DNA, 21 bp, Homo sapiens
ccatggctggatgtgcatctg

SEQ ID NO: 4800830 - DNA, 14 bp, Homo sapiens
ccatgggctgctgg

SEQ ID NO: 4800831 - DNA, 18 bp, Homo sapiens
ccatggtagactgtgaca

SEQ ID NO: 4800832 - DNA, 16 bp, Homo sapiens
ccatggtcacagaccc

SEQ ID NO: 4800833 - DNA, 14 bp, Homo sapiens
ccatggtgaactga

SEQ ID NO: 4800834 - DNA, 14 bp, Homo sapiens
ccatggtgcagtga

SEQ ID NO: 4800835 - DNA, 17 bp, Homo sapiens
ccatggtggtttcagaa

SEQ ID NO: 4800836 - DNA, 21 bp, Homo sapiens
ccatggtggtttcagaaaggg

SEQ ID NO: 4800837 - DNA, 23 bp, Homo sapiens
ccatgtaaataccagactgcagg

SEQ ID NO: 4800838 - DNA, 13 bp, Homo sapiens
ccatgtcaatcaa

SEQ ID NO: 4800839 - DNA, 12 bp, Homo sapiens
ccatgtgctgct

SEQ ID NO: 4800840 - DNA, 21 bp, Homo sapiens
ccatgtgtcccccctgtggtc

SEQ ID NO: 4800841 - DNA, 23 bp, Homo sapiens
ccatgtgtcccccctgtggtctg

SEQ ID NO: 4800842 - DNA, 16 bp, Homo sapiens
ccatgtgtcccctcac

SEQ ID NO: 4800843 - DNA, 22 bp, Homo sapiens
ccatgtgtcccctcactctgtc

SEQ ID NO: 4800844 - DNA, 17 bp, Homo sapiens
ccatgtgtgtcagccca

SEQ ID NO: 4800845 - DNA, 12 bp, Homo sapiens
ccatgttcccag

SEQ ID NO: 4800846 - DNA, 13 bp, Homo sapiens
ccatgttcccaga

SEQ ID NO: 4800847 - DNA, 14 bp, Homo sapiens
ccatgttcccagaa

SEQ ID NO: 4800848 - DNA, 19 bp, Homo sapiens
ccattaaacttctactgag

SEQ ID NO: 4800849 - DNA, 18 bp, Homo sapiens
ccattactaaagacagaa

SEQ ID NO: 4800850 - DNA, 16 bp, Homo sapiens
ccattcagtctgcagc

SEQ ID NO: 4800851 - DNA, 16 bp, Homo sapiens
ccattcatttacaact

SEQ ID NO: 4800852 - DNA, 23 bp, Homo sapiens
ccattccatggaaccatggagga

SEQ ID NO: 4800853 - DNA, 20 bp, Homo sapiens
ccattgaacactgcaccctc

SEQ ID NO: 4800854 - DNA, 21 bp, Homo sapiens
ccattgaagggggatgcaggc

SEQ ID NO: 4800855 - DNA, 14 bp, Homo sapiens
ccattgcttcacta

SEQ ID NO: 4800856 - DNA, 19 bp, Homo sapiens
ccattggccttaactggcc

SEQ ID NO: 4800857 - DNA, 21 bp, Homo sapiens
ccattggccttaactggccct

SEQ ID NO: 4800858 - DNA, 20 bp, Homo sapiens
ccctaaaagaaaccctgcac

SEQ ID NO: 4800859 - DNA, 18 bp, Homo sapiens
ccctaaacatagtggtat

SEQ ID NO: 4800860 - DNA, 22 bp, Homo sapiens
ccctaactgatttccatccaaa

SEQ ID NO: 4800861 - DNA, 21 bp, Homo sapiens
ccctaagttcctatttcattt

SEQ ID NO: 4800862 - DNA, 19 bp, Homo sapiens
ccctaattctcttcgctgt

SEQ ID NO: 4800863 - DNA, 13 bp, Homo sapiens
ccctacagcctgc

SEQ ID NO: 4800864 - DNA, 15 bp, Homo sapiens
ccctacagcctgcac

SEQ ID NO: 4800865 - DNA, 16 bp, Homo sapiens
ccctacagcctgcaca

SEQ ID NO: 4800866 - DNA, 17 bp, Homo sapiens
ccctacagcctgcacac

SEQ ID NO: 4800867 - DNA, 13 bp, Homo sapiens
ccctacagtatat

SEQ ID NO: 4800868 - DNA, 15 bp, Homo sapiens
ccctacagtatataa

SEQ ID NO: 4800869 - DNA, 23 bp, Homo sapiens
ccctacttaggaaatactcagca

SEQ ID NO: 4800870 - DNA, 16 bp, Homo sapiens
ccctatcctgcaccct

SEQ ID NO: 4800871 - DNA, 21 bp, Homo sapiens
ccctcacacctcccttcatcc

SEQ ID NO: 4800872 - DNA, 13 bp, Homo sapiens
ccctcactccact

SEQ ID NO: 4800873 - DNA, 18 bp, Homo sapiens
ccctcactctgccagggc

SEQ ID NO: 4800874 - DNA, 18 bp, Homo sapiens
ccctcactctgtcagcca

SEQ ID NO: 4800875 - DNA, 18 bp, Homo sapiens
ccctcagatgatctctcc

SEQ ID NO: 4800876 - DNA, 13 bp, Homo sapiens
ccctcatccacta

SEQ ID NO: 4800877 - DNA, 18 bp, Homo sapiens
ccctcatcttgaagggcc

SEQ ID NO: 4800878 - DNA, 13 bp, Homo sapiens
ccctccacacact

SEQ ID NO: 4800879 - DNA, 19 bp, Homo sapiens
ccctccacacctccacccg

SEQ ID NO: 4800880 - DNA, 14 bp, Homo sapiens
ccctccacaggagc

SEQ ID NO: 4800881 - DNA, 17 bp, Homo sapiens
ccctccacaggagccgc

SEQ ID NO: 4800882 - DNA, 21 bp, Homo sapiens
ccctccaccgcagaaggaagg

SEQ ID NO: 4800883 - DNA, 17 bp, Homo sapiens
ccctccacgcctcctgg

SEQ ID NO: 4800884 - DNA, 20 bp, Homo sapiens
ccctccacgcctcctggcca

SEQ ID NO: 4800885 - DNA, 13 bp, Homo sapiens
ccctccactcctc

SEQ ID NO: 4800886 - DNA, 14 bp, Homo sapiens
ccctccactcctcc

SEQ ID NO: 4800887 - DNA, 10 bp, Homo sapiens
ccctccagac

SEQ ID NO: 4800888 - DNA, 11 bp, Homo sapiens
ccctccagacc

SEQ ID NO: 4800889 - DNA, 22 bp, Homo sapiens
ccctccagacccctaccctttc

SEQ ID NO: 4800890 - DNA, 10 bp, Homo sapiens
ccctcccagg

SEQ ID NO: 4800891 - DNA, 23 bp, Homo sapiens
ccctccccatggtgcagtgaaga

SEQ ID NO: 4800892 - DNA, 15 bp, Homo sapiens
ccctcccccacggcc

SEQ ID NO: 4800893 - DNA, 14 bp, Homo sapiens
ccctcccccgcaga

SEQ ID NO: 4800894 - DNA, 23 bp, Homo sapiens
ccctccccctacagatcctccgc

SEQ ID NO: 4800895 - DNA, 12 bp, Homo sapiens
ccctccctccac

SEQ ID NO: 4800896 - DNA, 14 bp, Homo sapiens
ccctccctccacac

SEQ ID NO: 4800897 - DNA, 20 bp, Homo sapiens
ccctccctgactccctgtgg

SEQ ID NO: 4800898 - DNA, 11 bp, Homo sapiens
ccctccctgct

SEQ ID NO: 4800899 - DNA, 21 bp, Homo sapiens
ccctccgggcagagaccaccg

SEQ ID NO: 4800900 - DNA, 22 bp, Homo sapiens
ccctccgggcagagaccaccgc

SEQ ID NO: 4800901 - DNA, 15 bp, Homo sapiens
ccctccgtccccagg

SEQ ID NO: 4800902 - DNA, 17 bp, Homo sapiens
ccctccgtccccagggt

SEQ ID NO: 4800903 - DNA, 19 bp, Homo sapiens
ccctccgtccccagggtgc

SEQ ID NO: 4800904 - DNA, 19 bp, Homo sapiens
ccctcctccagagcctggg

SEQ ID NO: 4800905 - DNA, 14 bp, Homo sapiens
ccctcctccatgct

SEQ ID NO: 4800906 - DNA, 21 bp, Homo sapiens
ccctcctcgggcgcctgcgct

SEQ ID NO: 4800907 - DNA, 12 bp, Homo sapiens
ccctcctctgcc

SEQ ID NO: 4800908 - DNA, 22 bp, Homo sapiens
ccctcctggctcacagccacca

SEQ ID NO: 4800909 - DNA, 14 bp, Homo sapiens
ccctcctgtaaaat

SEQ ID NO: 4800910 - DNA, 20 bp, Homo sapiens
ccctccttctcccctccaga

SEQ ID NO: 4800911 - DNA, 14 bp, Homo sapiens
ccctcgcgcccctg

SEQ ID NO: 4800912 - DNA, 16 bp, Homo sapiens
ccctcgcgcccctgtc

SEQ ID NO: 4800913 - DNA, 23 bp, Homo sapiens
ccctcgcttcataggcagagccc

SEQ ID NO: 4800914 - DNA, 14 bp, Homo sapiens
ccctctccctcagt

SEQ ID NO: 4800915 - DNA, 12 bp, Homo sapiens
ccctctcctggg

SEQ ID NO: 4800916 - DNA, 13 bp, Homo sapiens
ccctctcctgggg

SEQ ID NO: 4800917 - DNA, 15 bp, Homo sapiens
ccctctccttcctta

SEQ ID NO: 4800918 - DNA, 19 bp, Homo sapiens
ccctctcgctcccctctgc

SEQ ID NO: 4800919 - DNA, 19 bp, Homo sapiens
ccctctcgggctctctcac

SEQ ID NO: 4800920 - DNA, 13 bp, Homo sapiens
ccctctctgcagt

SEQ ID NO: 4800921 - DNA, 12 bp, Homo sapiens
ccctctgcgccc

SEQ ID NO: 4800922 - DNA, 16 bp, Homo sapiens
ccctctgcgccccagc

SEQ ID NO: 4800923 - DNA, 19 bp, Homo sapiens
ccctctgctatgtctgtga

SEQ ID NO: 4800924 - DNA, 14 bp, Homo sapiens
ccctctgctgcaca

SEQ ID NO: 4800925 - DNA, 14 bp, Homo sapiens
ccctctgctgcttt

SEQ ID NO: 4800926 - DNA, 22 bp, Homo sapiens
ccctcttagaagaaatatgagc

SEQ ID NO: 4800927 - DNA, 12 bp, Homo sapiens
ccctcttccccc

SEQ ID NO: 4800928 - DNA, 13 bp, Homo sapiens
ccctcttccccct

SEQ ID NO: 4800929 - DNA, 17 bp, Homo sapiens
ccctcttcccccttccc

SEQ ID NO: 4800930 - DNA, 17 bp, Homo sapiens
ccctcttctcagctcca

SEQ ID NO: 4800931 - DNA, 19 bp, Homo sapiens
ccctctttctctctgtgtg

SEQ ID NO: 4800932 - DNA, 22 bp, Homo sapiens
ccctctttctctctgtgtggca

SEQ ID NO: 4800933 - DNA, 16 bp, Homo sapiens
ccctgaaatggcctgt

SEQ ID NO: 4800934 - DNA, 20 bp, Homo sapiens
ccctgaaatggcctgtccct

SEQ ID NO: 4800935 - DNA, 24 bp, Homo sapiens
ccctgaaatggcctgtccctaggg

SEQ ID NO: 4800936 - DNA, 18 bp, Homo sapiens
ccctgaactggccccagc

SEQ ID NO: 4800937 - DNA, 20 bp, Homo sapiens
ccctgacaacaactatcacc

SEQ ID NO: 4800938 - DNA, 18 bp, Homo sapiens
ccctgactccctgtgggg

SEQ ID NO: 4800939 - DNA, 22 bp, Homo sapiens
ccctgacttcccagctggcagc

SEQ ID NO: 4800940 - DNA, 20 bp, Homo sapiens
ccctgagggacgagcagagc

SEQ ID NO: 4800941 - DNA, 14 bp, Homo sapiens
ccctgagggccctt

SEQ ID NO: 4800942 - DNA, 16 bp, Homo sapiens
ccctgagggcccttcc

SEQ ID NO: 4800943 - DNA, 18 bp, Homo sapiens
ccctgagggcccttccca

SEQ ID NO: 4800944 - DNA, 19 bp, Homo sapiens
ccctgatgcgtctacccag

SEQ ID NO: 4800945 - DNA, 16 bp, Homo sapiens
ccctgcaaggcccaca

SEQ ID NO: 4800946 - DNA, 17 bp, Homo sapiens
ccctgcaaggcccacag

SEQ ID NO: 4800947 - DNA, 14 bp, Homo sapiens
ccctgcacccaccc

SEQ ID NO: 4800948 - DNA, 23 bp, Homo sapiens
ccctgcacccacccctgcccagg

SEQ ID NO: 4800949 - DNA, 15 bp, Homo sapiens
ccctgcagctttgag

SEQ ID NO: 4800950 - DNA, 20 bp, Homo sapiens
ccctgcagctttgaggctgg

SEQ ID NO: 4800951 - DNA, 12 bp, Homo sapiens
ccctgcagggca

SEQ ID NO: 4800952 - DNA, 20 bp, Homo sapiens
ccctgcagtgttcgcttggc

SEQ ID NO: 4800953 - DNA, 13 bp, Homo sapiens
ccctgcatccctt

SEQ ID NO: 4800954 - DNA, 16 bp, Homo sapiens
ccctgcatcccttggc

SEQ ID NO: 4800955 - DNA, 18 bp, Homo sapiens
ccctgccaactttccaga

SEQ ID NO: 4800956 - DNA, 13 bp, Homo sapiens
ccctgccaccctc

SEQ ID NO: 4800957 - DNA, 23 bp, Homo sapiens
ccctgccaccctctgctgcacag

SEQ ID NO: 4800958 - DNA, 18 bp, Homo sapiens
ccctgccagggggtttga

SEQ ID NO: 4800959 - DNA, 12 bp, Homo sapiens
ccctgcccagag

SEQ ID NO: 4800960 - DNA, 24 bp, Homo sapiens
ccctgcccagagtatgggcactca

SEQ ID NO: 4800961 - DNA, 13 bp, Homo sapiens
ccctgcccagcac

SEQ ID NO: 4800962 - DNA, 20 bp, Homo sapiens
ccctgcccagcacctcctcc

SEQ ID NO: 4800963 - DNA, 12 bp, Homo sapiens
ccctgcccaggc

SEQ ID NO: 4800964 - DNA, 13 bp, Homo sapiens
ccctgcccaggca

SEQ ID NO: 4800965 - DNA, 22 bp, Homo sapiens
ccctgcccaggcagtctttgct

SEQ ID NO: 4800966 - DNA, 18 bp, Homo sapiens
ccctgcccaggccggcca

SEQ ID NO: 4800967 - DNA, 22 bp, Homo sapiens
ccctgcccaggccggccagcct

SEQ ID NO: 4800968 - DNA, 20 bp, Homo sapiens
ccctgccccacacaggcctg

SEQ ID NO: 4800969 - DNA, 13 bp, Homo sapiens
ccctgccccagag

SEQ ID NO: 4800970 - DNA, 16 bp, Homo sapiens
ccctgccccagagaag

SEQ ID NO: 4800971 - DNA, 21 bp, Homo sapiens
ccctgccccagagaagcctca

SEQ ID NO: 4800972 - DNA, 13 bp, Homo sapiens
ccctgccctcact

SEQ ID NO: 4800973 - DNA, 14 bp, Homo sapiens
ccctgccctcactc

SEQ ID NO: 4800974 - DNA, 18 bp, Homo sapiens
ccctgccctcactccact

SEQ ID NO: 4800975 - DNA, 21 bp, Homo sapiens
ccctgccctcactccactccc

SEQ ID NO: 4800976 - DNA, 15 bp, Homo sapiens
ccctgccctccccca

SEQ ID NO: 4800977 - DNA, 16 bp, Homo sapiens
ccctgccctcccccac

SEQ ID NO: 4800978 - DNA, 12 bp, Homo sapiens
ccctgccctcgg

SEQ ID NO: 4800979 - DNA, 15 bp, Homo sapiens
ccctgccctcggcca

SEQ ID NO: 4800980 - DNA, 17 bp, Homo sapiens
ccctgccctcggccatt

SEQ ID NO: 4800981 - DNA, 13 bp, Homo sapiens
cctccagacccct

SEQ ID NO: 4800982 - DNA, 14 bp, Homo sapiens
cctccagaccccta

SEQ ID NO: 4800983 - DNA, 21 bp, Homo sapiens
cctccagactcgagagggctg

SEQ ID NO: 4800984 - DNA, 22 bp, Homo sapiens
cctccagactcgagagggctga

SEQ ID NO: 4800985 - DNA, 15 bp, Homo sapiens
cctccagagcctggg

SEQ ID NO: 4800986 - DNA, 16 bp, Homo sapiens
cctccagagcctgggc

SEQ ID NO: 4800987 - DNA, 18 bp, Homo sapiens
cctccagagcctgggcgc

SEQ ID NO: 4800988 - DNA, 22 bp, Homo sapiens
cctccagcaatgcctgcctgaa

SEQ ID NO: 4800989 - DNA, 20 bp, Homo sapiens
cctccagccacttatttcca

SEQ ID NO: 4800990 - DNA, 14 bp, Homo sapiens
cctccagccctggg

SEQ ID NO: 4800991 - DNA, 15 bp, Homo sapiens
cctccagccctgggc

SEQ ID NO: 4800992 - DNA, 17 bp, Homo sapiens
cctccagccctgggcac

SEQ ID NO: 4800993 - DNA, 22 bp, Homo sapiens
cctccaggaggactgttctaac

SEQ ID NO: 4800994 - DNA, 16 bp, Homo sapiens
cctccagttctgatga

SEQ ID NO: 4800995 - DNA, 19 bp, Homo sapiens
cctccagttctgatgaggc

SEQ ID NO: 4800996 - DNA, 16 bp, Homo sapiens
cctccatgctgtccct

SEQ ID NO: 4800997 - DNA, 17 bp, Homo sapiens
cctcccaactctggcct

SEQ ID NO: 4800998 - DNA, 15 bp, Homo sapiens
cctcccacctccagt

SEQ ID NO: 4800999 - DNA, 12 bp, Homo sapiens
cctcccagccac

SEQ ID NO: 4801000 - DNA, 17 bp, Homo sapiens
cctcccagccctgccca

SEQ ID NO: 4801001 - DNA, 20 bp, Homo sapiens
cctcccagccctgcccagag

SEQ ID NO: 4801002 - DNA, 19 bp, Homo sapiens
cctccccagccccctggca

SEQ ID NO: 4801003 - DNA, 12 bp, Homo sapiens
cctcccccacgc

SEQ ID NO: 4801004 - DNA, 15 bp, Homo sapiens
cctcccccaggctgc

SEQ ID NO: 4801005 - DNA, 18 bp, Homo sapiens
cctcccccaggctgcgcc

SEQ ID NO: 4801006 - DNA, 21 bp, Homo sapiens
cctcccccaggctgcgcctgc

SEQ ID NO: 4801007 - DNA, 22 bp, Homo sapiens
cctcccccaggctgcgcctgcc

SEQ ID NO: 4801008 - DNA, 12 bp, Homo sapiens
cctcccccaggg

SEQ ID NO: 4801009 - DNA, 15 bp, Homo sapiens
cctcccccagggagg

SEQ ID NO: 4801010 - DNA, 16 bp, Homo sapiens
cctcccccgcagacag

SEQ ID NO: 4801011 - DNA, 14 bp, Homo sapiens
cctcccccttcccc

SEQ ID NO: 4801012 - DNA, 18 bp, Homo sapiens
cctccccgggggtccccg

SEQ ID NO: 4801013 - DNA, 14 bp, Homo sapiens
cctcccctggaagt

SEQ ID NO: 4801014 - DNA, 16 bp, Homo sapiens
cctcccgcatgctgcc

SEQ ID NO: 4801015 - DNA, 18 bp, Homo sapiens
cctcccgcatgctgcctg

SEQ ID NO: 4801016 - DNA, 14 bp, Homo sapiens
cctcccgccgcctc

SEQ ID NO: 4801017 - DNA, 16 bp, Homo sapiens
cctcccggggtgcccg

SEQ ID NO: 4801018 - DNA, 17 bp, Homo sapiens
cctcccggggtgcccgt

SEQ ID NO: 4801019 - DNA, 20 bp, Homo sapiens
cctcccggggtgcccgtgtg

SEQ ID NO: 4801020 - DNA, 19 bp, Homo sapiens
cctccctccacacctccac

SEQ ID NO: 4801021 - DNA, 21 bp, Homo sapiens
cctccctgactccctgtgggg

SEQ ID NO: 4801022 - DNA, 12 bp, Homo sapiens
cctccctgcagc

SEQ ID NO: 4801023 - DNA, 13 bp, Homo sapiens
cctccctgcagct

SEQ ID NO: 4801024 - DNA, 13 bp, Homo sapiens
cctccctgcccag

SEQ ID NO: 4801025 - DNA, 14 bp, Homo sapiens
cctccctgctccct

SEQ ID NO: 4801026 - DNA, 13 bp, Homo sapiens
cctccctgctgcc

SEQ ID NO: 4801027 - DNA, 15 bp, Homo sapiens
cctccctgctgccag

SEQ ID NO: 4801028 - DNA, 17 bp, Homo sapiens
cctcccttctttccttc

SEQ ID NO: 4801029 - DNA, 21 bp, Homo sapiens
cctccctttttaaacaaatgg

SEQ ID NO: 4801030 - DNA, 15 bp, Homo sapiens
cctccgccagccctg

SEQ ID NO: 4801031 - DNA, 17 bp, Homo sapiens
cctccgcggaggcccct

SEQ ID NO: 4801032 - DNA, 20 bp, Homo sapiens
cctccgcggaggcccctgag

SEQ ID NO: 4801033 - DNA, 17 bp, Homo sapiens
cctccggccctgcccca

SEQ ID NO: 4801034 - DNA, 18 bp, Homo sapiens
cctccggccctgccccac

SEQ ID NO: 4801035 - DNA, 20 bp, Homo sapiens
cctccggccctgccccacac

SEQ ID NO: 4801036 - DNA, 16 bp, Homo sapiens
cctccgggcagagacc

SEQ ID NO: 4801037 - DNA, 18 bp, Homo sapiens
cctccgtgggcagctcct

SEQ ID NO: 4801038 - DNA, 22 bp, Homo sapiens
cctccgtgggcagctcctcggg

SEQ ID NO: 4801039 - DNA, 11 bp, Homo sapiens
cctcctagcct

SEQ ID NO: 4801040 - DNA, 14 bp, Homo sapiens
cctcctccagactc

SEQ ID NO: 4801041 - DNA, 12 bp, Homo sapiens
cctcctccatgc

SEQ ID NO: 4801042 - DNA, 19 bp, Homo sapiens
cctcctcccccacgcctcc

SEQ ID NO: 4801043 - DNA, 23 bp, Homo sapiens
cctcctccgtgggcagctcctcg

SEQ ID NO: 4801044 - DNA, 13 bp, Homo sapiens
cctcctcctgcat

SEQ ID NO: 4801045 - DNA, 15 bp, Homo sapiens
cctcctcgggcgcct

SEQ ID NO: 4801046 - DNA, 19 bp, Homo sapiens
cctcctcgggcgcctgcgc

SEQ ID NO: 4801047 - DNA, 20 bp, Homo sapiens
cctcctcgggcgcctgcgct

SEQ ID NO: 4801048 - DNA, 21 bp, Homo sapiens
cctcctctcaaacctggcaga

SEQ ID NO: 4801049 - DNA, 14 bp, Homo sapiens
cctcctctgccccc

SEQ ID NO: 4801050 - DNA, 17 bp, Homo sapiens
cctcctctgccccctcc

SEQ ID NO: 4801051 - DNA, 20 bp, Homo sapiens
cctcctcttcaccccggcag

SEQ ID NO: 4801052 - DNA, 13 bp, Homo sapiens
cctcctggccaga

SEQ ID NO: 4801053 - DNA, 17 bp, Homo sapiens
cctcctggccagacgct

SEQ ID NO: 4801054 - DNA, 13 bp, Homo sapiens
cctcctggctcac

SEQ ID NO: 4801055 - DNA, 16 bp, Homo sapiens
cctcctggctcacagc

SEQ ID NO: 4801056 - DNA, 21 bp, Homo sapiens
cctccttcactccctgtcata

SEQ ID NO: 4801057 - DNA, 14 bp, Homo sapiens
cctccttctcccct

SEQ ID NO: 4801058 - DNA, 15 bp, Homo sapiens
cctccttctcccctc

SEQ ID NO: 4801059 - DNA, 17 bp, Homo sapiens
cctccttctcccctcca

SEQ ID NO: 4801060 - DNA, 21 bp, Homo sapiens
cctccttctgcagtcagactg

SEQ ID NO: 4801061 - DNA, 17 bp, Homo sapiens
cctcgcccccgggccct

SEQ ID NO: 4801062 - DNA, 12 bp, Homo sapiens
cctcgcgcccct

SEQ ID NO: 4801063 - DNA, 18 bp, Homo sapiens
cctcgcgcccctgtccat

SEQ ID NO: 4801064 - DNA, 15 bp, Homo sapiens
cctcgctgccaccca

SEQ ID NO: 4801065 - DNA, 14 bp, Homo sapiens
cctcgctgtatgat

SEQ ID NO: 4801066 - DNA, 22 bp, Homo sapiens
cctcggccattgaacactgcac

SEQ ID NO: 4801067 - DNA, 14 bp, Homo sapiens
cctcggccctgtag

SEQ ID NO: 4801068 - DNA, 18 bp, Homo sapiens
cctcggcctggcttcacc

SEQ ID NO: 4801069 - DNA, 20 bp, Homo sapiens
cctcgggccgcctcctccag

SEQ ID NO: 4801070 - DNA, 22 bp, Homo sapiens
cctcgggccgcctcctccagac

SEQ ID NO: 4801071 - DNA, 17 bp, Homo sapiens
cctcgggcgcctgcgct

SEQ ID NO: 4801072 - DNA, 20 bp, Homo sapiens
cctcggtggcatttgctgaa

SEQ ID NO: 4801073 - DNA, 23 bp, Homo sapiens
cctcgtcccgagggcgcctgggt

SEQ ID NO: 4801074 - DNA, 17 bp, Homo sapiens
cctcgtccggcctgcag

SEQ ID NO: 4801075 - DNA, 19 bp, Homo sapiens
cctcgtccggcctgcagcc

SEQ ID NO: 4801076 - DNA, 19 bp, Homo sapiens
cctctagctaccatttcaa

SEQ ID NO: 4801077 - DNA, 13 bp, Homo sapiens
cctctcaaacctg

SEQ ID NO: 4801078 - DNA, 18 bp, Homo sapiens
cctctcaaacctggcaga

SEQ ID NO: 4801079 - DNA, 13 bp, Homo sapiens
cctctcacacaca

SEQ ID NO: 4801080 - DNA, 18 bp, Homo sapiens
cctctcagaactcctgtg

SEQ ID NO: 4801081 - DNA, 20 bp, Homo sapiens
cctctcagaactcctgtgtg

SEQ ID NO: 4801082 - DNA, 14 bp, Homo sapiens
cctctcagatccct

SEQ ID NO: 4801083 - DNA, 22 bp, Homo sapiens
cctctcccaaataaactcctta

SEQ ID NO: 4801084 - DNA, 14 bp, Homo sapiens
cctctccctcagtc

SEQ ID NO: 4801085 - DNA, 19 bp, Homo sapiens
cctctccctcagtccttta

SEQ ID NO: 4801086 - DNA, 19 bp, Homo sapiens
cctctcctcgtccggcctg

SEQ ID NO: 4801087 - DNA, 21 bp, Homo sapiens
cctctcctcgtccggcctgca

SEQ ID NO: 4801088 - DNA, 11 bp, Homo sapiens
cctctcctctc

SEQ ID NO: 4801089 - DNA, 15 bp, Homo sapiens
cctctcctctctgga

SEQ ID NO: 4801090 - DNA, 16 bp, Homo sapiens
cctctcctgagcctgt

SEQ ID NO: 4801091 - DNA, 12 bp, Homo sapiens
cctctcctgggg

SEQ ID NO: 4801092 - DNA, 14 bp, Homo sapiens
cctctcgagcccag

SEQ ID NO: 4801093 - DNA, 17 bp, Homo sapiens
cctctcgggctctctca

SEQ ID NO: 4801094 - DNA, 14 bp, Homo sapiens
cctctctctccctc

SEQ ID NO: 4801095 - DNA, 15 bp, Homo sapiens
cctctctctccctcc

SEQ ID NO: 4801096 - DNA, 20 bp, Homo sapiens
cctctctctctctctctctg

SEQ ID NO: 4801097 - DNA, 22 bp, Homo sapiens
cctctctctctctctctctgtt

SEQ ID NO: 4801098 - DNA, 12 bp, Homo sapiens
cctctctgcagt

SEQ ID NO: 4801099 - DNA, 13 bp, Homo sapiens
cctctctggaaga

SEQ ID NO: 4801100 - DNA, 23 bp, Homo sapiens
cctctctggaaggttttgcttct

SEQ ID NO: 4801101 - DNA, 18 bp, Homo sapiens
cctctctgtttaccctcc

SEQ ID NO: 4801102 - DNA, 17 bp, Homo sapiens
cctctcttaccccgtcc

SEQ ID NO: 4801103 - DNA, 22 bp, Homo sapiens
cctctcttaccccgtccctttc

SEQ ID NO: 4801104 - DNA, 19 bp, Homo sapiens
cctggggtggttggaggcc

SEQ ID NO: 4801105 - DNA, 20 bp, Homo sapiens
cctggggtggttggaggcct

SEQ ID NO: 4801106 - DNA, 22 bp, Homo sapiens
cctggggtggttggaggcctgg

SEQ ID NO: 4801107 - DNA, 21 bp, Homo sapiens
cctgggtaacaaagtgagacc

SEQ ID NO: 4801108 - DNA, 15 bp, Homo sapiens
cctgggtccccctcc

SEQ ID NO: 4801109 - DNA, 17 bp, Homo sapiens
cctgggtccccctcctg

SEQ ID NO: 4801110 - DNA, 19 bp, Homo sapiens
cctgggtccccctcctgca

SEQ ID NO: 4801111 - DNA, 20 bp, Homo sapiens
cctgggtccccctcctgcac

SEQ ID NO: 4801112 - DNA, 16 bp, Homo sapiens
cctgggtcctcccagc

SEQ ID NO: 4801113 - DNA, 17 bp, Homo sapiens
cctgggtcctcccagct

SEQ ID NO: 4801114 - DNA, 16 bp, Homo sapiens
cctgggtcctcggccc

SEQ ID NO: 4801115 - DNA, 21 bp, Homo sapiens
cctgggtcctcggccctgtag

SEQ ID NO: 4801116 - DNA, 14 bp, Homo sapiens
cctggtcctgcact

SEQ ID NO: 4801117 - DNA, 17 bp, Homo sapiens
cctggtcctgcactgtc

SEQ ID NO: 4801118 - DNA, 13 bp, Homo sapiens
cctggtggcacca

SEQ ID NO: 4801119 - DNA, 23 bp, Homo sapiens
cctggtggcaccagatgcaacct

SEQ ID NO: 4801120 - DNA, 13 bp, Homo sapiens
cctggtggccctg

SEQ ID NO: 4801121 - DNA, 20 bp, Homo sapiens
cctgtaaaactttattttat

SEQ ID NO: 4801122 - DNA, 13 bp, Homo sapiens
cctgtagccctgg

SEQ ID NO: 4801123 - DNA, 15 bp, Homo sapiens
cctgtagccctggcc

SEQ ID NO: 4801124 - DNA, 20 bp, Homo sapiens
cctgtagccctggcccggtc

SEQ ID NO: 4801125 - DNA, 13 bp, Homo sapiens
cctgtagctcctt

SEQ ID NO: 4801126 - DNA, 12 bp, Homo sapiens
cctgtcaacctg

SEQ ID NO: 4801127 - DNA, 15 bp, Homo sapiens
cctgtcaacctgaat

SEQ ID NO: 4801128 - DNA, 13 bp, Homo sapiens
cctgtcaatatat

SEQ ID NO: 4801129 - DNA, 14 bp, Homo sapiens
cctgtcccctcctc

SEQ ID NO: 4801130 - DNA, 12 bp, Homo sapiens
cctgtccctagg

SEQ ID NO: 4801131 - DNA, 16 bp, Homo sapiens
cctgtcctggctccca

SEQ ID NO: 4801132 - DNA, 12 bp, Homo sapiens
cctgtcgggccc

SEQ ID NO: 4801133 - DNA, 19 bp, Homo sapiens
cctgtctaacttggggaag

SEQ ID NO: 4801134 - DNA, 23 bp, Homo sapiens
cctgtctccctacttagacccag

SEQ ID NO: 4801135 - DNA, 14 bp, Homo sapiens
cctgtctcctctgt

SEQ ID NO: 4801136 - DNA, 17 bp, Homo sapiens
cctgtctcctctgtcag

SEQ ID NO: 4801137 - DNA, 22 bp, Homo sapiens
cctgtctcttgggaagcagttt

SEQ ID NO: 4801138 - DNA, 12 bp, Homo sapiens
cctgtctgcagg

SEQ ID NO: 4801139 - DNA, 13 bp, Homo sapiens
cctgtctgcaggc

SEQ ID NO: 4801140 - DNA, 18 bp, Homo sapiens
cctgtctttgctgtttat

SEQ ID NO: 4801141 - DNA, 23 bp, Homo sapiens
cctgtctttgctgtttatatata

SEQ ID NO: 4801142 - DNA, 23 bp, Homo sapiens
cctgtgagatgtgtatcagtgtt

SEQ ID NO: 4801143 - DNA, 15 bp, Homo sapiens
cctgtgagctcccca

SEQ ID NO: 4801144 - DNA, 20 bp, Homo sapiens
cctgtgagctccccaatcca

SEQ ID NO: 4801145 - DNA, 23 bp, Homo sapiens
cctgtgaggatagagacttgcag

SEQ ID NO: 4801146 - DNA, 15 bp, Homo sapiens
cctgtgatcgtgtgt

SEQ ID NO: 4801147 - DNA, 14 bp, Homo sapiens
cctgtgccccgcct

SEQ ID NO: 4801148 - DNA, 14 bp, Homo sapiens
cctgtgctttctgc

SEQ ID NO: 4801149 - DNA, 18 bp, Homo sapiens
cctgtgctttctgcatgc

SEQ ID NO: 4801150 - DNA, 15 bp, Homo sapiens
cctgtgggagtccac

SEQ ID NO: 4801151 - DNA, 22 bp, Homo sapiens
cctgtgggagtccactttcctc

SEQ ID NO: 4801152 - DNA, 23 bp, Homo sapiens
cctgtgggagtccactttcctct

SEQ ID NO: 4801153 - DNA, 13 bp, Homo sapiens
cctgtgggctcac

SEQ ID NO: 4801154 - DNA, 19 bp, Homo sapiens
cctgtgggctcacaccggc

SEQ ID NO: 4801155 - DNA, 18 bp, Homo sapiens
cctgtgggggtggccatc

SEQ ID NO: 4801156 - DNA, 21 bp, Homo sapiens
cctgtgggggtggccatccct

SEQ ID NO: 4801157 - DNA, 14 bp, Homo sapiens
cctgtggtctgtgt

SEQ ID NO: 4801158 - DNA, 18 bp, Homo sapiens
cctgtggtgaggtcctgt

SEQ ID NO: 4801159 - DNA, 20 bp, Homo sapiens
cctgtggtgaggtcctgtcc

SEQ ID NO: 4801160 - DNA, 21 bp, Homo sapiens
cctgtggtttgttatcagtac

SEQ ID NO: 4801161 - DNA, 13 bp, Homo sapiens
cctgtgtcatctg

SEQ ID NO: 4801162 - DNA, 21 bp, Homo sapiens
cctgtgtctggtccacacacc

SEQ ID NO: 4801163 - DNA, 15 bp, Homo sapiens
cctgtgtgtggaagg

SEQ ID NO: 4801164 - DNA, 16 bp, Homo sapiens
cctgtgtgtggaaggc

SEQ ID NO: 4801165 - DNA, 21 bp, Homo sapiens
cctgttccattccatggaacc

SEQ ID NO: 4801166 - DNA, 19 bp, Homo sapiens
cctgttccgcctcactggg

SEQ ID NO: 4801167 - DNA, 13 bp, Homo sapiens
cctgttcctgact

SEQ ID NO: 4801168 - DNA, 17 bp, Homo sapiens
cctgttctggcagagtt

SEQ ID NO: 4801169 - DNA, 21 bp, Homo sapiens
cctgttgacctaccctggacc

SEQ ID NO: 4801170 - DNA, 21 bp, Homo sapiens
cctgttgctacatcagagtgt

SEQ ID NO: 4801171 - DNA, 15 bp, Homo sapiens
cctgtttctcctcca

SEQ ID NO: 4801172 - DNA, 20 bp, Homo sapiens
ccttaaaaaatatgctctcc

SEQ ID NO: 4801173 - DNA, 15 bp, Homo sapiens
ccttaaactaccacc

SEQ ID NO: 4801174 - DNA, 21 bp, Homo sapiens
ccttaaattaaacaatttatt

SEQ ID NO: 4801175 - DNA, 19 bp, Homo sapiens
ccttaactggccctcgggc

SEQ ID NO: 4801176 - DNA, 21 bp, Homo sapiens
ccttaactggccctcgggccc

SEQ ID NO: 4801177 - DNA, 11 bp, Homo sapiens
ccttaatattt

SEQ ID NO: 4801178 - DNA, 13 bp, Homo sapiens
ccttacaaagcca

SEQ ID NO: 4801179 - DNA, 14 bp, Homo sapiens
ccttacaaagccag

SEQ ID NO: 4801180 - DNA, 18 bp, Homo sapiens
ccttagcctccagcaccc

SEQ ID NO: 4801181 - DNA, 18 bp, Homo sapiens
ccttagctcccttgagct

SEQ ID NO: 4801182 - DNA, 18 bp, Homo sapiens
ccttagcttaatgactta

SEQ ID NO: 4801183 - DNA, 16 bp, Homo sapiens
ccttagtaaattccta

SEQ ID NO: 4801184 - DNA, 17 bp, Homo sapiens
ccttagtataatattaa

SEQ ID NO: 4801185 - DNA, 14 bp, Homo sapiens
ccttatcataaatt

SEQ ID NO: 4801186 - DNA, 16 bp, Homo sapiens
ccttatcataaattca

SEQ ID NO: 4801187 - DNA, 13 bp, Homo sapiens
ccttattaaaata

SEQ ID NO: 4801188 - DNA, 23 bp, Homo sapiens
ccttattaaaatattttcttaat

SEQ ID NO: 4801189 - DNA, 22 bp, Homo sapiens
ccttcaaagtctcaatgaaata

SEQ ID NO: 4801190 - DNA, 15 bp, Homo sapiens
ccttcaatgttaaat

SEQ ID NO: 4801191 - DNA, 19 bp, Homo sapiens
ccttcacccaccaccccca

SEQ ID NO: 4801192 - DNA, 19 bp, Homo sapiens
ccttcaggtcccctggccc

SEQ ID NO: 4801193 - DNA, 20 bp, Homo sapiens
ccttcaggtcccctggccct

SEQ ID NO: 4801194 - DNA, 14 bp, Homo sapiens
ccttcagtgccaaa

SEQ ID NO: 4801195 - DNA, 19 bp, Homo sapiens
ccttcataaattatttcta

SEQ ID NO: 4801196 - DNA, 16 bp, Homo sapiens
ccttccaacctgttca

SEQ ID NO: 4801197 - DNA, 13 bp, Homo sapiens
ccttccaccctgc

SEQ ID NO: 4801198 - DNA, 14 bp, Homo sapiens
ccttccaccctgcc

SEQ ID NO: 4801199 - DNA, 17 bp, Homo sapiens
ccttccaccctgccctg

SEQ ID NO: 4801200 - DNA, 19 bp, Homo sapiens
ccttccaccctgccctggc

SEQ ID NO: 4801201 - DNA, 18 bp, Homo sapiens
ccttccactgcctctgcc

SEQ ID NO: 4801202 - DNA, 17 bp, Homo sapiens
ccttcccaacctcccct

SEQ ID NO: 4801203 - DNA, 18 bp, Homo sapiens
ccttcccaatcagcactg

SEQ ID NO: 4801204 - DNA, 19 bp, Homo sapiens
ccttcccaatcagcactga

SEQ ID NO: 4801205 - DNA, 21 bp, Homo sapiens
ccttcccaatcagcactgaaa

SEQ ID NO: 4801206 - DNA, 13 bp, Homo sapiens
ccttcccacccct

SEQ ID NO: 4801207 - DNA, 14 bp, Homo sapiens
ccttcccagctgct

SEQ ID NO: 4801208 - DNA, 11 bp, Homo sapiens
ccttccccact

SEQ ID NO: 4801209 - DNA, 14 bp, Homo sapiens
ccttccccactccc

SEQ ID NO: 4801210 - DNA, 18 bp, Homo sapiens
ccttccccttctgtgtca

SEQ ID NO: 4801211 - DNA, 12 bp, Homo sapiens
ccttccctccaa

SEQ ID NO: 4801212 - DNA, 13 bp, Homo sapiens
ccttccctccaaa

SEQ ID NO: 4801213 - DNA, 23 bp, Homo sapiens
ccttcccttccactgcctctgcc

SEQ ID NO: 4801214 - DNA, 16 bp, Homo sapiens
ccttcctgtcctgctc

SEQ ID NO: 4801215 - DNA, 17 bp, Homo sapiens
ccttcctgtcctgctca

SEQ ID NO: 4801216 - DNA, 14 bp, Homo sapiens
ccttccttgacctt

SEQ ID NO: 4801217 - DNA, 15 bp, Homo sapiens
ccttcggcgccttaa

SEQ ID NO: 4801218 - DNA, 21 bp, Homo sapiens
ccttctcagccttggttcctg

SEQ ID NO: 4801219 - DNA, 17 bp, Homo sapiens
ccttctcccctccagac

SEQ ID NO: 4801220 - DNA, 20 bp, Homo sapiens
ccttctcccctccagacccc

SEQ ID NO: 4801221 - DNA, 22 bp, Homo sapiens
ccttctcccctccagaccccta

SEQ ID NO: 4801222 - DNA, 18 bp, Homo sapiens
ccttctgacggccctgca

SEQ ID NO: 4801223 - DNA, 19 bp, Homo sapiens
ccttctgacggccctgcaa

SEQ ID NO: 4801224 - DNA, 22 bp, Homo sapiens
ccttctgatgaagttgtacaac

SEQ ID NO: 4801225 - DNA, 12 bp, Homo sapiens
ccttctggcctt

SEQ ID NO: 4801226 - DNA, 12 bp, Homo sapiens
cgtcaatgtgaa

SEQ ID NO: 4801227 - DNA, 12 bp, Homo sapiens
cgtcagcctgtg

SEQ ID NO: 4801228 - DNA, 13 bp, Homo sapiens
cgtcagcctgtga

SEQ ID NO: 4801229 - DNA, 15 bp, Homo sapiens
cgtcagcctgtgaac

SEQ ID NO: 4801230 - DNA, 19 bp, Homo sapiens
cgtccccagggtgcaggcg

SEQ ID NO: 4801231 - DNA, 21 bp, Homo sapiens
cgtcccgagggcgcctgggtc

SEQ ID NO: 4801232 - DNA, 14 bp, Homo sapiens
cgtcccggccccgc

SEQ ID NO: 4801233 - DNA, 17 bp, Homo sapiens
cgtccctcgagctctgt

SEQ ID NO: 4801234 - DNA, 17 bp, Homo sapiens
cgtccctgagggccctt

SEQ ID NO: 4801235 - DNA, 18 bp, Homo sapiens
cgtccctgagggcccttc

SEQ ID NO: 4801236 - DNA, 20 bp, Homo sapiens
cgtccctgagggcccttccc

SEQ ID NO: 4801237 - DNA, 16 bp, Homo sapiens
cgtccctttccctgca

SEQ ID NO: 4801238 - DNA, 13 bp, Homo sapiens
cgtccgcacgcgg

SEQ ID NO: 4801239 - DNA, 16 bp, Homo sapiens
cgtccggcctgcagcc

SEQ ID NO: 4801240 - DNA, 16 bp, Homo sapiens
cgtcctgctcgccctg

SEQ ID NO: 4801241 - DNA, 20 bp, Homo sapiens
cgtcctgctcgccctgtgcc

SEQ ID NO: 4801242 - DNA, 23 bp, Homo sapiens
cgtcctgctcgccctgtgccctc

SEQ ID NO: 4801243 - DNA, 11 bp, Homo sapiens
cgtcctgggtg

SEQ ID NO: 4801244 - DNA, 15 bp, Homo sapiens
cgtctacccagactc

SEQ ID NO: 4801245 - DNA, 22 bp, Homo sapiens
cgtctagctatgctgtatctgt

SEQ ID NO: 4801246 - DNA, 12 bp, Homo sapiens
cgtctctgtccg

SEQ ID NO: 4801247 - DNA, 16 bp, Homo sapiens
cgtctgattgttcctc

SEQ ID NO: 4801248 - DNA, 18 bp, Homo sapiens
cgtctgattgttcctccc

SEQ ID NO: 4801249 - DNA, 10 bp, Homo sapiens
cgtctgcccc

SEQ ID NO: 4801250 - DNA, 11 bp, Homo sapiens
cgtctgcccct

SEQ ID NO: 4801251 - DNA, 19 bp, Homo sapiens
cgtctgccccttgacccca

SEQ ID NO: 4801252 - DNA, 13 bp, Homo sapiens
cgtctgtcctgcg

SEQ ID NO: 4801253 - DNA, 20 bp, Homo sapiens
cgtctttggttcctcatggc

SEQ ID NO: 4801254 - DNA, 13 bp, Homo sapiens
cgtgaccctgtgc

SEQ ID NO: 4801255 - DNA, 14 bp, Homo sapiens
cgtgaccctgtgcc

SEQ ID NO: 4801256 - DNA, 19 bp, Homo sapiens
cgtgacttcagactctctc

SEQ ID NO: 4801257 - DNA, 16 bp, Homo sapiens
cgtgaggccagagaca

SEQ ID NO: 4801258 - DNA, 23 bp, Homo sapiens
cgtgaggtttcagtagctccttg

SEQ ID NO: 4801259 - DNA, 18 bp, Homo sapiens
cgtgagtcctggcatggg

SEQ ID NO: 4801260 - DNA, 15 bp, Homo sapiens
cgtgcacaaaccttc

SEQ ID NO: 4801261 - DNA, 17 bp, Homo sapiens
cgtgcacaaaccttctt

SEQ ID NO: 4801262 - DNA, 12 bp, Homo sapiens
cgtgcatttgtg

SEQ ID NO: 4801263 - DNA, 15 bp, Homo sapiens
cgtgcatttgtgagc

SEQ ID NO: 4801264 - DNA, 14 bp, Homo sapiens
cgtgccctgtttcc

SEQ ID NO: 4801265 - DNA, 16 bp, Homo sapiens
cgtgccttccccgtgc

SEQ ID NO: 4801266 - DNA, 21 bp, Homo sapiens
cgtgcgcagccgcgctctgcc

SEQ ID NO: 4801267 - DNA, 22 bp, Homo sapiens
cgtgcgcagccgcgctctgccc

SEQ ID NO: 4801268 - DNA, 21 bp, Homo sapiens
cgtgcggcccgtgcgcagccg

SEQ ID NO: 4801269 - DNA, 18 bp, Homo sapiens
cgtgctccttttctcttt

SEQ ID NO: 4801270 - DNA, 17 bp, Homo sapiens
cgtgctcttctgttctc

SEQ ID NO: 4801271 - DNA, 18 bp, Homo sapiens
cgtgctcttctgttctca

SEQ ID NO: 4801272 - DNA, 22 bp, Homo sapiens
cgtgctgcccgagggcaggggc

SEQ ID NO: 4801273 - DNA, 22 bp, Homo sapiens
cgtggagcaggcggtggggaga

SEQ ID NO: 4801274 - DNA, 23 bp, Homo sapiens
cgtgggagtatgttatttctctg

SEQ ID NO: 4801275 - DNA, 15 bp, Homo sapiens
cgtgggatccagaga

SEQ ID NO: 4801276 - DNA, 18 bp, Homo sapiens
cgtgggatccagagagaa

SEQ ID NO: 4801277 - DNA, 13 bp, Homo sapiens
cgtgggctccagg

SEQ ID NO: 4801278 - DNA, 14 bp, Homo sapiens
cgtggtgtgaggcc

SEQ ID NO: 4801279 - DNA, 19 bp, Homo sapiens
cgtggtgtgaggcccccgg

SEQ ID NO: 4801280 - DNA, 15 bp, Homo sapiens
cgtgtactaccccag

SEQ ID NO: 4801281 - DNA, 15 bp, Homo sapiens
cgtgtggccctgtgg

SEQ ID NO: 4801282 - DNA, 16 bp, Homo sapiens
cgtgtggccctgtggg

SEQ ID NO: 4801283 - DNA, 17 bp, Homo sapiens
cgtgtggccctgtggga

SEQ ID NO: 4801284 - DNA, 18 bp, Homo sapiens
cgtgtggccctgtgggag

SEQ ID NO: 4801285 - DNA, 20 bp, Homo sapiens
cgtgtggccctgtgggagtc

SEQ ID NO: 4801286 - DNA, 12 bp, Homo sapiens
cgtgtggcctgg

SEQ ID NO: 4801287 - DNA, 17 bp, Homo sapiens
cgtgtggcctgggtcct

SEQ ID NO: 4801288 - DNA, 15 bp, Homo sapiens
cgtgttatgactcca

SEQ ID NO: 4801289 - DNA, 14 bp, Homo sapiens
cgtgttattattat

SEQ ID NO: 4801290 - DNA, 19 bp, Homo sapiens
cgtgttattattattatat

SEQ ID NO: 4801291 - DNA, 14 bp, Homo sapiens
cgtgttcacacaca

SEQ ID NO: 4801292 - DNA, 18 bp, Homo sapiens
cgtgttctcctccaaatg

SEQ ID NO: 4801293 - DNA, 21 bp, Homo sapiens
cgtgtttttggttttctcctt

SEQ ID NO: 4801294 - DNA, 16 bp, Homo sapiens
cgttagtaatctgtat

SEQ ID NO: 4801295 - DNA, 17 bp, Homo sapiens
cgttatgtaagtttcta

SEQ ID NO: 4801296 - DNA, 21 bp, Homo sapiens
cgttcccagcgcatggcgccc

SEQ ID NO: 4801297 - DNA, 15 bp, Homo sapiens
cgttgagtccttttg

SEQ ID NO: 4801298 - DNA, 15 bp, Homo sapiens
cgttgctccagtata

SEQ ID NO: 4801299 - DNA, 17 bp, Homo sapiens
cgttgttgtccctgcag

SEQ ID NO: 4801300 - DNA, 19 bp, Homo sapiens
cgttgttttgtggataaga

SEQ ID NO: 4801301 - DNA, 15 bp, Homo sapiens
cgtttcacatctgta

SEQ ID NO: 4801302 - DNA, 19 bp, Homo sapiens
cgtttttgctggcttgcac

SEQ ID NO: 4801303 - DNA, 15 bp, Homo sapiens
cgtttttgtgctgtg

SEQ ID NO: 4801304 - DNA, 19 bp, Homo sapiens
cgtttttgtgctgtgggca

SEQ ID NO: 4801305 - DNA, 18 bp, Homo sapiens
ctaaaaagtcagatgttt

SEQ ID NO: 4801306 - DNA, 20 bp, Homo sapiens
ctaaaactactgcctttcaa

SEQ ID NO: 4801307 - DNA, 12 bp, Homo sapiens
ctaaaaggagga

SEQ ID NO: 4801308 - DNA, 21 bp, Homo sapiens
ctaaaagttctcaaatattgg

SEQ ID NO: 4801309 - DNA, 12 bp, Homo sapiens
ctaaaataaatg

SEQ ID NO: 4801310 - DNA, 13 bp, Homo sapiens
ctaaaataaatgt

SEQ ID NO: 4801311 - DNA, 17 bp, Homo sapiens
ctaaaataaatgttttg

SEQ ID NO: 4801312 - DNA, 19 bp, Homo sapiens
ctaaaataaatgttttgga

SEQ ID NO: 4801313 - DNA, 13 bp, Homo sapiens
ctaaaatccaccc

SEQ ID NO: 4801314 - DNA, 20 bp, Homo sapiens
ctaaaatccacccagcccac

SEQ ID NO: 4801315 - DNA, 17 bp, Homo sapiens
ctaaaatgctgttctca

SEQ ID NO: 4801316 - DNA, 19 bp, Homo sapiens
ctaaaatgctgttctcaat

SEQ ID NO: 4801317 - DNA, 22 bp, Homo sapiens
ctaaaatgctgttctcaatcat

SEQ ID NO: 4801318 - DNA, 19 bp, Homo sapiens
ctaaacccaaataaatgtg

SEQ ID NO: 4801319 - DNA, 21 bp, Homo sapiens
ctaaagatctttttttaagtg

SEQ ID NO: 4801320 - DNA, 20 bp, Homo sapiens
ctaaagtcaggccattcagt

SEQ ID NO: 4801321 - DNA, 20 bp, Homo sapiens
ctaaataaacacatagattc

SEQ ID NO: 4801322 - DNA, 18 bp, Homo sapiens
ctaaataatatcctgaat

SEQ ID NO: 4801323 - DNA, 16 bp, Homo sapiens
ctaaataatggcctgg

SEQ ID NO: 4801324 - DNA, 18 bp, Homo sapiens
ctaaatagatttttagat

SEQ ID NO: 4801325 - DNA, 22 bp, Homo sapiens
ctaaatagatttttagattcct

SEQ ID NO: 4801326 - DNA, 15 bp, Homo sapiens
ctaaatcataatcat

SEQ ID NO: 4801327 - DNA, 21 bp, Homo sapiens
ctaaatgcaaacactgtgtat

SEQ ID NO: 4801328 - DNA, 13 bp, Homo sapiens
ctaaatgttcatg

SEQ ID NO: 4801329 - DNA, 13 bp, Homo sapiens
ctaaattaacaaa

SEQ ID NO: 4801330 - DNA, 13 bp, Homo sapiens
ctaacaataaagt

SEQ ID NO: 4801331 - DNA, 11 bp, Homo sapiens
ctaacactggc

SEQ ID NO: 4801332 - DNA, 14 bp, Homo sapiens
ctaacagtaactgc

SEQ ID NO: 4801333 - DNA, 17 bp, Homo sapiens
ctaacagtaactgccat

SEQ ID NO: 4801334 - DNA, 18 bp, Homo sapiens
ctaacagtaactgccatt

SEQ ID NO: 4801335 - DNA, 17 bp, Homo sapiens
ctaaccccaacgcacag

SEQ ID NO: 4801336 - DNA, 13 bp, Homo sapiens
ctaacctctctga

SEQ ID NO: 4801337 - DNA, 21 bp, Homo sapiens
ctaacgaccgacgcccctccg

SEQ ID NO: 4801338 - DNA, 16 bp, Homo sapiens
ctaactagtaatcttg

SEQ ID NO: 4801339 - DNA, 17 bp, Homo sapiens
ctaactccttacagaag

SEQ ID NO: 4801340 - DNA, 18 bp, Homo sapiens
ctaactgaggagctagtg

SEQ ID NO: 4801341 - DNA, 13 bp, Homo sapiens
ctaactgccatgt

SEQ ID NO: 4801342 - DNA, 14 bp, Homo sapiens
ctaactggccccag

SEQ ID NO: 4801343 - DNA, 12 bp, Homo sapiens
ctaactgtatat

SEQ ID NO: 4801344 - DNA, 15 bp, Homo sapiens
ctaactgtatatttg

SEQ ID NO: 4801345 - DNA, 16 bp, Homo sapiens
ctaactgtatatttgt

SEQ ID NO: 4801346 - DNA, 19 bp, Homo sapiens
ctaactgtatatttgtatg

SEQ ID NO: 4801347 - DNA, 20 bp, Homo sapiens
ctaagaaatatctgtgaaat

SEQ ID NO: 4801348 - DNA, 11 bp, Homo sapiens
ctaagaattca

SEQ ID NO: 4801349 - DNA, 13 bp, Homo sapiens
ctccaagccctgg

SEQ ID NO: 4801350 - DNA, 18 bp, Homo sapiens
ctccaagccctggggcag

SEQ ID NO: 4801351 - DNA, 21 bp, Homo sapiens
ctccaagccctggggcagggt

SEQ ID NO: 4801352 - DNA, 19 bp, Homo sapiens
ctccaaggcaaatgtccaa

SEQ ID NO: 4801353 - DNA, 13 bp, Homo sapiens
ctccaagggatct

SEQ ID NO: 4801354 - DNA, 14 bp, Homo sapiens
ctccaagggatctg

SEQ ID NO: 4801355 - DNA, 18 bp, Homo sapiens
ctccacacacttcttcca

SEQ ID NO: 4801356 - DNA, 14 bp, Homo sapiens
ctccacacctccac

SEQ ID NO: 4801357 - DNA, 12 bp, Homo sapiens
ctccacaggagc

SEQ ID NO: 4801358 - DNA, 20 bp, Homo sapiens
ctccacaggagccgcagagg

SEQ ID NO: 4801359 - DNA, 21 bp, Homo sapiens
ctccacaggagccgcagaggc

SEQ ID NO: 4801360 - DNA, 12 bp, Homo sapiens
ctccacccctca

SEQ ID NO: 4801361 - DNA, 14 bp, Homo sapiens
ctccacccctcaag

SEQ ID NO: 4801362 - DNA, 18 bp, Homo sapiens
ctccacccctcaagccag

SEQ ID NO: 4801363 - DNA, 20 bp, Homo sapiens
ctccacccgtcctggggtgg

SEQ ID NO: 4801364 - DNA, 14 bp, Homo sapiens
ctccaccctcccct

SEQ ID NO: 4801365 - DNA, 16 bp, Homo sapiens
ctccaccgcagaagga

SEQ ID NO: 4801366 - DNA, 14 bp, Homo sapiens
ctccacctccccca

SEQ ID NO: 4801367 - DNA, 14 bp, Homo sapiens
ctccacgcctcctg

SEQ ID NO: 4801368 - DNA, 15 bp, Homo sapiens
ctccacgcctcctgg

SEQ ID NO: 4801369 - DNA, 16 bp, Homo sapiens
ctccacgcctcctggc

SEQ ID NO: 4801370 - DNA, 21 bp, Homo sapiens
ctccacgtgtttcgggccagg

SEQ ID NO: 4801371 - DNA, 9 bp, Homo sapiens
ctccactcc

SEQ ID NO: 4801372 - DNA, 17 bp, Homo sapiens
ctccactcccctcatcc

SEQ ID NO: 4801373 - DNA, 17 bp, Homo sapiens
ctccactcctcccaact

SEQ ID NO: 4801374 - DNA, 22 bp, Homo sapiens
ctccactttctagccagaggag

SEQ ID NO: 4801375 - DNA, 20 bp, Homo sapiens
ctccagaaaaatcaatcatt

SEQ ID NO: 4801376 - DNA, 22 bp, Homo sapiens
ctccagaacaaacctctatatg

SEQ ID NO: 4801377 - DNA, 12 bp, Homo sapiens
ctccagaagcag

SEQ ID NO: 4801378 - DNA, 13 bp, Homo sapiens
ctccagaagcagc

SEQ ID NO: 4801379 - DNA, 14 bp, Homo sapiens
ctccagaagcagca

SEQ ID NO: 4801380 - DNA, 22 bp, Homo sapiens
ctccagaagcagcagctagaaa

SEQ ID NO: 4801381 - DNA, 15 bp, Homo sapiens
ctccagaatttccca

SEQ ID NO: 4801382 - DNA, 21 bp, Homo sapiens
ctccagacccctaccctttcc

SEQ ID NO: 4801383 - DNA, 22 bp, Homo sapiens
ctccagacccctaccctttccc

SEQ ID NO: 4801384 - DNA, 23 bp, Homo sapiens
ctccagacccctaccctttccca

SEQ ID NO: 4801385 - DNA, 19 bp, Homo sapiens
ctccagactcgagagggct

SEQ ID NO: 4801386 - DNA, 21 bp, Homo sapiens
ctccagactcgagagggctga

SEQ ID NO: 4801387 - DNA, 18 bp, Homo sapiens
ctccagatcctctttccc

SEQ ID NO: 4801388 - DNA, 16 bp, Homo sapiens
ctccagattattttct

SEQ ID NO: 4801389 - DNA, 18 bp, Homo sapiens
ctccagccacttatttcc

SEQ ID NO: 4801390 - DNA, 12 bp, Homo sapiens
ctccagccctgg

SEQ ID NO: 4801391 - DNA, 15 bp, Homo sapiens
ctccagccctgggca

SEQ ID NO: 4801392 - DNA, 19 bp, Homo sapiens
ctccaggaggactgttcta

SEQ ID NO: 4801393 - DNA, 12 bp, Homo sapiens
ctccaggcccag

SEQ ID NO: 4801394 - DNA, 15 bp, Homo sapiens
ctccaggcccagcct

SEQ ID NO: 4801395 - DNA, 18 bp, Homo sapiens
ctccaggcccagcctggc

SEQ ID NO: 4801396 - DNA, 14 bp, Homo sapiens
ctccagtataaatt

SEQ ID NO: 4801397 - DNA, 21 bp, Homo sapiens
ctccagtccccctatccttgg

SEQ ID NO: 4801398 - DNA, 20 bp, Homo sapiens
ctccagtgctttatccacat

SEQ ID NO: 4801399 - DNA, 21 bp, Homo sapiens
ctccagtgctttatccacatt

SEQ ID NO: 4801400 - DNA, 18 bp, Homo sapiens
ctccagtttgcccaccac

SEQ ID NO: 4801401 - DNA, 21 bp, Homo sapiens
ctccagtttgcccaccacaac

SEQ ID NO: 4801402 - DNA, 19 bp, Homo sapiens
ctccatctcttgtaccagc

SEQ ID NO: 4801403 - DNA, 21 bp, Homo sapiens
ctccatctcttgtaccagccc

SEQ ID NO: 4801404 - DNA, 18 bp, Homo sapiens
ctccatgcagatctagcc

SEQ ID NO: 4801405 - DNA, 21 bp, Homo sapiens
ctccatgcagatctagccagg

SEQ ID NO: 4801406 - DNA, 14 bp, Homo sapiens
ctccatgctgtccc

SEQ ID NO: 4801407 - DNA, 21 bp, Homo sapiens
ctccatggtgaactgaagcag

SEQ ID NO: 4801408 - DNA, 23 bp, Homo sapiens
ctccatggtgaactgaagcagag

SEQ ID NO: 4801409 - DNA, 15 bp, Homo sapiens
ctccattaaacttct

SEQ ID NO: 4801410 - DNA, 13 bp, Homo sapiens
ctccattcctgag

SEQ ID NO: 4801411 - DNA, 21 bp, Homo sapiens
ctcccaaagtgctgggattaa

SEQ ID NO: 4801412 - DNA, 18 bp, Homo sapiens
ctcccaaataaactcctt

SEQ ID NO: 4801413 - DNA, 15 bp, Homo sapiens
ctcccaactctggcc

SEQ ID NO: 4801414 - DNA, 18 bp, Homo sapiens
ctcccaagctgatggaca

SEQ ID NO: 4801415 - DNA, 13 bp, Homo sapiens
ctcccacctccag

SEQ ID NO: 4801416 - DNA, 18 bp, Homo sapiens
ctcccacctcggacacca

SEQ ID NO: 4801417 - DNA, 14 bp, Homo sapiens
ctcccacctctttc

SEQ ID NO: 4801418 - DNA, 15 bp, Homo sapiens
ctcccacctctttct

SEQ ID NO: 4801419 - DNA, 17 bp, Homo sapiens
ctcccactgcccctgca

SEQ ID NO: 4801420 - DNA, 12 bp, Homo sapiens
ctcccagccacc

SEQ ID NO: 4801421 - DNA, 21 bp, Homo sapiens
ctcccagctgtaccggccact

SEQ ID NO: 4801422 - DNA, 15 bp, Homo sapiens
ctcccagggcccgag

SEQ ID NO: 4801423 - DNA, 23 bp, Homo sapiens
ctcccaggtgaaatccacaccag

SEQ ID NO: 4801424 - DNA, 14 bp, Homo sapiens
ctcccagtcatgtt

SEQ ID NO: 4801425 - DNA, 15 bp, Homo sapiens
ctccccaagacttga

SEQ ID NO: 4801426 - DNA, 20 bp, Homo sapiens
ctccccaatccaacccatgc

SEQ ID NO: 4801427 - DNA, 15 bp, Homo sapiens
ctccccatatataaa

SEQ ID NO: 4801428 - DNA, 14 bp, Homo sapiens
ctcccccagaggtg

SEQ ID NO: 4801429 - DNA, 11 bp, Homo sapiens
ctcccccaggc

SEQ ID NO: 4801430 - DNA, 16 bp, Homo sapiens
ctcccccaggctgcgc

SEQ ID NO: 4801431 - DNA, 18 bp, Homo sapiens
ctcccccaggctgcgcct

SEQ ID NO: 4801432 - DNA, 13 bp, Homo sapiens
ctccccctcagct

SEQ ID NO: 4801433 - DNA, 21 bp, Homo sapiens
ctccccgcccgccctcctctg

SEQ ID NO: 4801434 - DNA, 14 bp, Homo sapiens
ctcccctccagacc

SEQ ID NO: 4801435 - DNA, 14 bp, Homo sapiens
ctcccctggtcctg

SEQ ID NO: 4801436 - DNA, 16 bp, Homo sapiens
ctcccgcatgctgcct

SEQ ID NO: 4801437 - DNA, 15 bp, Homo sapiens
ctcccgccattggcc

SEQ ID NO: 4801438 - DNA, 22 bp, Homo sapiens
ctcccggggtgcccgtgtggcc

SEQ ID NO: 4801439 - DNA, 15 bp, Homo sapiens
ctcccggtgtgcagc

SEQ ID NO: 4801440 - DNA, 19 bp, Homo sapiens
ctccctaagtccactctag

SEQ ID NO: 4801441 - DNA, 13 bp, Homo sapiens
ctccctaccctct

SEQ ID NO: 4801442 - DNA, 19 bp, Homo sapiens
ctccctcacacctcccttc

SEQ ID NO: 4801443 - DNA, 10 bp, Homo sapiens
ctccctccac

SEQ ID NO: 4801444 - DNA, 14 bp, Homo sapiens
ctccctccacacct

SEQ ID NO: 4801445 - DNA, 19 bp, Homo sapiens
ctccctccacacctccacc

SEQ ID NO: 4801446 - DNA, 13 bp, Homo sapiens
ctccctccactcc

SEQ ID NO: 4801447 - DNA, 15 bp, Homo sapiens
ctccctccctccaca

SEQ ID NO: 4801448 - DNA, 15 bp, Homo sapiens
ctccctcctggctca

SEQ ID NO: 4801449 - DNA, 16 bp, Homo sapiens
ctccctgactccctgt

SEQ ID NO: 4801450 - DNA, 14 bp, Homo sapiens
ctccctgctccctg

SEQ ID NO: 4801451 - DNA, 21 bp, Homo sapiens
ctccctggcagcacaggaaaa

SEQ ID NO: 4801452 - DNA, 14 bp, Homo sapiens
ctccctggccccag

SEQ ID NO: 4801453 - DNA, 17 bp, Homo sapiens
ctccctggccccagtga

SEQ ID NO: 4801454 - DNA, 21 bp, Homo sapiens
ctccctggggaggacccctgc

SEQ ID NO: 4801455 - DNA, 23 bp, Homo sapiens
ctccctggggaggacccctgccc

SEQ ID NO: 4801456 - DNA, 13 bp, Homo sapiens
ctccctgtcccct

SEQ ID NO: 4801457 - DNA, 14 bp, Homo sapiens
ctccctgtcccctg

SEQ ID NO: 4801458 - DNA, 21 bp, Homo sapiens
ctccctgtgggggtggccatc

SEQ ID NO: 4801459 - DNA, 22 bp, Homo sapiens
ctccctgtgggggtggccatcc

SEQ ID NO: 4801460 - DNA, 23 bp, Homo sapiens
ctccctgtgggggtggccatccc

SEQ ID NO: 4801461 - DNA, 24 bp, Homo sapiens
ctccctgtgggggtggccatccct

SEQ ID NO: 4801462 - DNA, 20 bp, Homo sapiens
ctcccttctttccttccttt

SEQ ID NO: 4801463 - DNA, 19 bp, Homo sapiens
ctccctttatcatgtgttt

SEQ ID NO: 4801464 - DNA, 15 bp, Homo sapiens
ctccctttttgaatt

SEQ ID NO: 4801465 - DNA, 16 bp, Homo sapiens
ctccgaacgctgctcc

SEQ ID NO: 4801466 - DNA, 15 bp, Homo sapiens
ctccgccagccctgt

SEQ ID NO: 4801467 - DNA, 21 bp, Homo sapiens
ctccgccccccggcctggccc

SEQ ID NO: 4801468 - DNA, 23 bp, Homo sapiens
ctccgccccccggcctggccccc

SEQ ID NO: 4801469 - DNA, 14 bp, Homo sapiens
ctccgcccttccct

SEQ ID NO: 4801470 - DNA, 20 bp, Homo sapiens
ctccgcccttccctgacact

SEQ ID NO: 4801471 - DNA, 17 bp, Homo sapiens
ctctgtccgtctgtcct

SEQ ID NO: 4801472 - DNA, 15 bp, Homo sapiens
ctctgtccttccccc

SEQ ID NO: 4801473 - DNA, 22 bp, Homo sapiens
ctctgtctcctaagctggagtg

SEQ ID NO: 4801474 - DNA, 19 bp, Homo sapiens
ctctgtcttggtaggtttg

SEQ ID NO: 4801475 - DNA, 15 bp, Homo sapiens
ctctgtgacccccat

SEQ ID NO: 4801476 - DNA, 21 bp, Homo sapiens
ctctgtgactcgcttagctga

SEQ ID NO: 4801477 - DNA, 10 bp, Homo sapiens
ctctgtggcc

SEQ ID NO: 4801478 - DNA, 13 bp, Homo sapiens
ctctgtgtggcaa

SEQ ID NO: 4801479 - DNA, 20 bp, Homo sapiens
ctctgtgtggcaaacattta

SEQ ID NO: 4801480 - DNA, 20 bp, Homo sapiens
ctctgttatttgtcctcatg

SEQ ID NO: 4801481 - DNA, 13 bp, Homo sapiens
ctctgttccaagt

SEQ ID NO: 4801482 - DNA, 15 bp, Homo sapiens
ctctgtttaccctcc

SEQ ID NO: 4801483 - DNA, 20 bp, Homo sapiens
ctctgtttaccctccctgtc

SEQ ID NO: 4801484 - DNA, 22 bp, Homo sapiens
ctcttaaaaattatctttaaaa

SEQ ID NO: 4801485 - DNA, 15 bp, Homo sapiens
ctcttaagctgccca

SEQ ID NO: 4801486 - DNA, 18 bp, Homo sapiens
ctcttagaagaatattgt

SEQ ID NO: 4801487 - DNA, 19 bp, Homo sapiens
ctcttcaccccggcaggcc

SEQ ID NO: 4801488 - DNA, 22 bp, Homo sapiens
ctcttcaccccggcaggccctg

SEQ ID NO: 4801489 - DNA, 14 bp, Homo sapiens
ctcttcccccttcc

SEQ ID NO: 4801490 - DNA, 15 bp, Homo sapiens
ctcttcccccttccc

SEQ ID NO: 4801491 - DNA, 14 bp, Homo sapiens
ctcttcggtggcct

SEQ ID NO: 4801492 - DNA, 23 bp, Homo sapiens
ctcttcggtggccttgagtctct

SEQ ID NO: 4801493 - DNA, 15 bp, Homo sapiens
ctcttctcagctcca

SEQ ID NO: 4801494 - DNA, 18 bp, Homo sapiens
ctcttctcattttttcct

SEQ ID NO: 4801495 - DNA, 19 bp, Homo sapiens
ctcttctgttctcaaatgc

SEQ ID NO: 4801496 - DNA, 16 bp, Homo sapiens
ctcttcttttcccatt

SEQ ID NO: 4801497 - DNA, 16 bp, Homo sapiens
ctcttgccgaggagcc

SEQ ID NO: 4801498 - DNA, 21 bp, Homo sapiens
ctcttgccgaggagccaggca

SEQ ID NO: 4801499 - DNA, 14 bp, Homo sapiens
ctctttcagtctac

SEQ ID NO: 4801500 - DNA, 15 bp, Homo sapiens
ctctttccccactga

SEQ ID NO: 4801501 - DNA, 17 bp, Homo sapiens
ctctttcggaaatgatt

SEQ ID NO: 4801502 - DNA, 15 bp, Homo sapiens
ctctttctcattctt

SEQ ID NO: 4801503 - DNA, 15 bp, Homo sapiens
ctctttctctctgtg

SEQ ID NO: 4801504 - DNA, 16 bp, Homo sapiens
ctctttctctctgtgt

SEQ ID NO: 4801505 - DNA, 18 bp, Homo sapiens
ctctttcttcaattaatg

SEQ ID NO: 4801506 - DNA, 14 bp, Homo sapiens
ctctttctttccaa

SEQ ID NO: 4801507 - DNA, 15 bp, Homo sapiens
ctctttctttccaaa

SEQ ID NO: 4801508 - DNA, 17 bp, Homo sapiens
ctctttgaaaattcttg

SEQ ID NO: 4801509 - DNA, 18 bp, Homo sapiens
ctctttgggtttcttgtt

SEQ ID NO: 4801510 - DNA, 22 bp, Homo sapiens
ctcttttgctctctcattccca

SEQ ID NO: 4801511 - DNA, 20 bp, Homo sapiens
ctgaaaaccatctggcctgg

SEQ ID NO: 4801512 - DNA, 22 bp, Homo sapiens
ctgaaaaccatctggcctggcc

SEQ ID NO: 4801513 - DNA, 13 bp, Homo sapiens
ctgaaaactggaa

SEQ ID NO: 4801514 - DNA, 13 bp, Homo sapiens
ctgaaatctacaa

SEQ ID NO: 4801515 - DNA, 24 bp, Homo sapiens
ctgaaatggcctgtccctagggct

SEQ ID NO: 4801516 - DNA, 23 bp, Homo sapiens
ctgaaattagtgttttcattctg

SEQ ID NO: 4801517 - DNA, 11 bp, Homo sapiens
ctgaaattatg

SEQ ID NO: 4801518 - DNA, 18 bp, Homo sapiens
ctgaaattatgtcaaatg

SEQ ID NO: 4801519 - DNA, 14 bp, Homo sapiens
ctgaaattttctag

SEQ ID NO: 4801520 - DNA, 12 bp, Homo sapiens
ctgaacactcat

SEQ ID NO: 4801521 - DNA, 20 bp, Homo sapiens
ctgaactatcagggcaagct

SEQ ID NO: 4801522 - DNA, 13 bp, Homo sapiens
ctgaactcacaga

SEQ ID NO: 4801523 - DNA, 19 bp, Homo sapiens
ctgaactcacagactgctg

SEQ ID NO: 4801524 - DNA, 16 bp, Homo sapiens
ctgaactgcaacactg

SEQ ID NO: 4801525 - DNA, 16 bp, Homo sapiens
ctgaagaaacacagca

SEQ ID NO: 4801526 - DNA, 16 bp, Homo sapiens
ctgaagcagagtcaag

SEQ ID NO: 4801527 - DNA, 23 bp, Homo sapiens
ctgaaggaattctggagtgagtt

SEQ ID NO: 4801528 - DNA, 13 bp, Homo sapiens
ctgaaggagagga

SEQ ID NO: 4801529 - DNA, 23 bp, Homo sapiens
ctgaaggcagagggatgaaatgc

SEQ ID NO: 4801530 - DNA, 16 bp, Homo sapiens
ctgaagggaggggaag

SEQ ID NO: 4801531 - DNA, 20 bp, Homo sapiens
ctgaagggaggggaagagag

SEQ ID NO: 4801532 - DNA, 16 bp, Homo sapiens
ctgaaggggaaaacct

SEQ ID NO: 4801533 - DNA, 20 bp, Homo sapiens
ctgaaggggaaaacctcagt

SEQ ID NO: 4801534 - DNA, 24 bp, Homo sapiens
ctgaagtctttgtacagacaacaa

SEQ ID NO: 4801535 - DNA, 14 bp, Homo sapiens
ctgaagttggacag

SEQ ID NO: 4801536 - DNA, 17 bp, Homo sapiens
ctgaataaataagtaaa

SEQ ID NO: 4801537 - DNA, 17 bp, Homo sapiens
ctgaatcagaggcagag

SEQ ID NO: 4801538 - DNA, 17 bp, Homo sapiens
ctgaatgagaagtaaat

SEQ ID NO: 4801539 - DNA, 15 bp, Homo sapiens
ctgaatgtatgtaaa

SEQ ID NO: 4801540 - DNA, 16 bp, Homo sapiens
ctgaatgtatgtaaat

SEQ ID NO: 4801541 - DNA, 12 bp, Homo sapiens
ctgaattaaagt

SEQ ID NO: 4801542 - DNA, 14 bp, Homo sapiens
ctgaattaaagtct

SEQ ID NO: 4801543 - DNA, 12 bp, Homo sapiens
ctgaattattaa

SEQ ID NO: 4801544 - DNA, 14 bp, Homo sapiens
ctgaattattaatg

SEQ ID NO: 4801545 - DNA, 17 bp, Homo sapiens
ctgaattattaatgaat

SEQ ID NO: 4801546 - DNA, 19 bp, Homo sapiens
ctgaattattaatgaatgc

SEQ ID NO: 4801547 - DNA, 15 bp, Homo sapiens
ctgaattgttatgta

SEQ ID NO: 4801548 - DNA, 23 bp, Homo sapiens
ctgaatttgtcgggttctcccat

SEQ ID NO: 4801549 - DNA, 12 bp, Homo sapiens
ctgacaagggct

SEQ ID NO: 4801550 - DNA, 14 bp, Homo sapiens
ctgacaagggctga

SEQ ID NO: 4801551 - DNA, 13 bp, Homo sapiens
ctgacacaggaaa

SEQ ID NO: 4801552 - DNA, 21 bp, Homo sapiens
ctgacacaggaaaccaacacc

SEQ ID NO: 4801553 - DNA, 21 bp, Homo sapiens
ctgacacctgccgctgcttga

SEQ ID NO: 4801554 - DNA, 15 bp, Homo sapiens
ctgacaccttttcag

SEQ ID NO: 4801555 - DNA, 12 bp, Homo sapiens
ctgacagcctcc

SEQ ID NO: 4801556 - DNA, 13 bp, Homo sapiens
ctgacagcctcca

SEQ ID NO: 4801557 - DNA, 14 bp, Homo sapiens
ctgacagctgtcct

SEQ ID NO: 4801558 - DNA, 17 bp, Homo sapiens
ctgacaggaaagtggat

SEQ ID NO: 4801559 - DNA, 13 bp, Homo sapiens
ctgacatgctaac

SEQ ID NO: 4801560 - DNA, 13 bp, Homo sapiens
ctgaccctcactt

SEQ ID NO: 4801561 - DNA, 23 bp, Homo sapiens
ctgaccctccaccgcagaaggaa

SEQ ID NO: 4801562 - DNA, 15 bp, Homo sapiens
ctgacccttccagac

SEQ ID NO: 4801563 - DNA, 16 bp, Homo sapiens
ctgacccttccagaca

SEQ ID NO: 4801564 - DNA, 13 bp, Homo sapiens
ctgaccgaaggga

SEQ ID NO: 4801565 - DNA, 13 bp, Homo sapiens
ctgaccttctgcg

SEQ ID NO: 4801566 - DNA, 19 bp, Homo sapiens
ctgaccttggagagacaca

SEQ ID NO: 4801567 - DNA, 23 bp, Homo sapiens
ctgacggcagtaaatccacagtg

SEQ ID NO: 4801568 - DNA, 23 bp, Homo sapiens
ctgactccctgtgggggtggcca

SEQ ID NO: 4801569 - DNA, 14 bp, Homo sapiens
ctgactgtcctaca

SEQ ID NO: 4801570 - DNA, 23 bp, Homo sapiens
ctgactgtgaggtgggcctttga

SEQ ID NO: 4801571 - DNA, 23 bp, Homo sapiens
ctgactgttctcttactgccgaa

SEQ ID NO: 4801572 - DNA, 21 bp, Homo sapiens
ctgactgtttacacctttccg

SEQ ID NO: 4801573 - DNA, 15 bp, Homo sapiens
ctgacttcccagctg

SEQ ID NO: 4801574 - DNA, 19 bp, Homo sapiens
ctgacttcccagctggcag

SEQ ID NO: 4801575 - DNA, 23 bp, Homo sapiens
ctgacttcccagctggcagcgcc

SEQ ID NO: 4801576 - DNA, 24 bp, Homo sapiens
ctgacttcccagctggcagcgcct

SEQ ID NO: 4801577 - DNA, 12 bp, Homo sapiens
ctgacttgcaga

SEQ ID NO: 4801578 - DNA, 21 bp, Homo sapiens
ctgactttggagacgatgctt

SEQ ID NO: 4801579 - DNA, 18 bp, Homo sapiens
ctgagaagagtcgagtga

SEQ ID NO: 4801580 - DNA, 18 bp, Homo sapiens
ctgagaaggccccagggc

SEQ ID NO: 4801581 - DNA, 21 bp, Homo sapiens
ctgagaaggccccagggcagc

SEQ ID NO: 4801582 - DNA, 21 bp, Homo sapiens
ctgagaatccccgtgctcaca

SEQ ID NO: 4801583 - DNA, 21 bp, Homo sapiens
ctgagacacagcccagagact

SEQ ID NO: 4801584 - DNA, 17 bp, Homo sapiens
ctgagagtagagtcact

SEQ ID NO: 4801585 - DNA, 17 bp, Homo sapiens
ctgagatgggaggatca

SEQ ID NO: 4801586 - DNA, 15 bp, Homo sapiens
ctgagcagacagggc

SEQ ID NO: 4801587 - DNA, 23 bp, Homo sapiens
ctgagcagacagggcgtcctctc

SEQ ID NO: 4801588 - DNA, 16 bp, Homo sapiens
ctgagcagtggggagc

SEQ ID NO: 4801589 - DNA, 16 bp, Homo sapiens
ctgagccccctgcacc

SEQ ID NO: 4801590 - DNA, 17 bp, Homo sapiens
ctgagccccctgcaccc

SEQ ID NO: 4801591 - DNA, 20 bp, Homo sapiens
ctgagccccctgcacccacc

SEQ ID NO: 4801592 - DNA, 14 bp, Homo sapiens
ctgagcctgtctct

SEQ ID NO: 4801593 - DNA, 18 bp, Homo sapiens
ctgggacaggcaccatgc

SEQ ID NO: 4801594 - DNA, 13 bp, Homo sapiens
ctgggacgcccct

SEQ ID NO: 4801595 - DNA, 14 bp, Homo sapiens
ctgggactgctcag

SEQ ID NO: 4801596 - DNA, 19 bp, Homo sapiens
ctgggactgctcaggctcc

SEQ ID NO: 4801597 - DNA, 17 bp, Homo sapiens
ctgggagaaaagccaga

SEQ ID NO: 4801598 - DNA, 22 bp, Homo sapiens
ctgggagaaccaaaaagaggct

SEQ ID NO: 4801599 - DNA, 14 bp, Homo sapiens
ctgggagatgcagc

SEQ ID NO: 4801600 - DNA, 18 bp, Homo sapiens
ctgggatcagctggtgtc

SEQ ID NO: 4801601 - DNA, 15 bp, Homo sapiens
ctgggatgggaccag

SEQ ID NO: 4801602 - DNA, 19 bp, Homo sapiens
ctgggatgggaccagggat

SEQ ID NO: 4801603 - DNA, 16 bp, Homo sapiens
ctgggcagaggaaagc

SEQ ID NO: 4801604 - DNA, 16 bp, Homo sapiens
ctgggcagcccagaga

SEQ ID NO: 4801605 - DNA, 18 bp, Homo sapiens
ctgggcagcccagagaga

SEQ ID NO: 4801606 - DNA, 17 bp, Homo sapiens
ctgggcagggccgcagg

SEQ ID NO: 4801607 - DNA, 20 bp, Homo sapiens
ctgggcatggtaccagccct

SEQ ID NO: 4801608 - DNA, 20 bp, Homo sapiens
ctgggccccccagctcaggg

SEQ ID NO: 4801609 - DNA, 19 bp, Homo sapiens
ctgggcccctccacgcctc

SEQ ID NO: 4801610 - DNA, 12 bp, Homo sapiens
ctgggcccctgg

SEQ ID NO: 4801611 - DNA, 14 bp, Homo sapiens
ctgggcccctggga

SEQ ID NO: 4801612 - DNA, 15 bp, Homo sapiens
ctgggccctaggcat

SEQ ID NO: 4801613 - DNA, 20 bp, Homo sapiens
ctgggccctaggcatactct

SEQ ID NO: 4801614 - DNA, 20 bp, Homo sapiens
ctgggcctcagttcaacctg

SEQ ID NO: 4801615 - DNA, 14 bp, Homo sapiens
ctgggcctcccgtc

SEQ ID NO: 4801616 - DNA, 22 bp, Homo sapiens
ctgggcctcccgtccgtccgcc

SEQ ID NO: 4801617 - DNA, 13 bp, Homo sapiens
ctgggcctgggct

SEQ ID NO: 4801618 - DNA, 16 bp, Homo sapiens
ctgggcctgggctagg

SEQ ID NO: 4801619 - DNA, 22 bp, Homo sapiens
ctgggcgccggttccacgtggg

SEQ ID NO: 4801620 - DNA, 20 bp, Homo sapiens
ctgggcgcctctgtcctggc

SEQ ID NO: 4801621 - DNA, 17 bp, Homo sapiens
ctgggctgtctgtcacc

SEQ ID NO: 4801622 - DNA, 20 bp, Homo sapiens
ctgggctgtctgtcaccagc

SEQ ID NO: 4801623 - DNA, 14 bp, Homo sapiens
ctgggctgtgagga

SEQ ID NO: 4801624 - DNA, 15 bp, Homo sapiens
ctgggctgtgaggac

SEQ ID NO: 4801625 - DNA, 17 bp, Homo sapiens
ctgggcttggggaccag

SEQ ID NO: 4801626 - DNA, 23 bp, Homo sapiens
ctggggacacaggatcctggcct

SEQ ID NO: 4801627 - DNA, 17 bp, Homo sapiens
ctggggaggcctgcctg

SEQ ID NO: 4801628 - DNA, 17 bp, Homo sapiens
ctggggagggacacaga

SEQ ID NO: 4801629 - DNA, 16 bp, Homo sapiens
ctggggaggggctccg

SEQ ID NO: 4801630 - DNA, 14 bp, Homo sapiens
ctggggcagggtgg

SEQ ID NO: 4801631 - DNA, 21 bp, Homo sapiens
ctggggcagggtggggggcca

SEQ ID NO: 4801632 - DNA, 19 bp, Homo sapiens
ctggggcctagactctgta

SEQ ID NO: 4801633 - DNA, 18 bp, Homo sapiens
ctggggcctggcagggag

SEQ ID NO: 4801634 - DNA, 14 bp, Homo sapiens
ctggggctgggccc

SEQ ID NO: 4801635 - DNA, 20 bp, Homo sapiens
ctgggggaggcttccagctc

SEQ ID NO: 4801636 - DNA, 21 bp, Homo sapiens
ctgggggaggcttccagctca

SEQ ID NO: 4801637 - DNA, 12 bp, Homo sapiens
ctgggggctgct

SEQ ID NO: 4801638 - DNA, 16 bp, Homo sapiens
ctgggggctgctgcac

SEQ ID NO: 4801639 - DNA, 14 bp, Homo sapiens
ctgggggctgggca

SEQ ID NO: 4801640 - DNA, 18 bp, Homo sapiens
ctgggggctgggcagagg

SEQ ID NO: 4801641 - DNA, 20 bp, Homo sapiens
ctggggggcacagccagaaa

SEQ ID NO: 4801642 - DNA, 17 bp, Homo sapiens
ctggggtctctgagcag

SEQ ID NO: 4801643 - DNA, 20 bp, Homo sapiens
ctggggtctctgagcagtgg

SEQ ID NO: 4801644 - DNA, 21 bp, Homo sapiens
ctggggtctctgagcagtggg

SEQ ID NO: 4801645 - DNA, 17 bp, Homo sapiens
ctggggtggggacctca

SEQ ID NO: 4801646 - DNA, 23 bp, Homo sapiens
ctggggtggggacctcaggcctg

SEQ ID NO: 4801647 - DNA, 13 bp, Homo sapiens
ctggggtggggct

SEQ ID NO: 4801648 - DNA, 15 bp, Homo sapiens
ctggggtggggcttg

SEQ ID NO: 4801649 - DNA, 16 bp, Homo sapiens
ctggggtggggcttgg

SEQ ID NO: 4801650 - DNA, 18 bp, Homo sapiens
ctggggtggggcttggaa

SEQ ID NO: 4801651 - DNA, 21 bp, Homo sapiens
ctggggtggttggaggcctgg

SEQ ID NO: 4801652 - DNA, 23 bp, Homo sapiens
ctggggttttgacttgccactgc

SEQ ID NO: 4801653 - DNA, 20 bp, Homo sapiens
ctgggtcaccttcctgggca

SEQ ID NO: 4801654 - DNA, 13 bp, Homo sapiens
ctgggtccccctc

SEQ ID NO: 4801655 - DNA, 12 bp, Homo sapiens
ctgggtcccggg

SEQ ID NO: 4801656 - DNA, 14 bp, Homo sapiens
ctgggtcgcccctc

SEQ ID NO: 4801657 - DNA, 20 bp, Homo sapiens
ctgggtggatcggcctcctc

SEQ ID NO: 4801658 - DNA, 19 bp, Homo sapiens
ctgggtgggccccacagtg

SEQ ID NO: 4801659 - DNA, 16 bp, Homo sapiens
ctgggtgggccctgcc

SEQ ID NO: 4801660 - DNA, 17 bp, Homo sapiens
ctgggtgtgacctgaca

SEQ ID NO: 4801661 - DNA, 16 bp, Homo sapiens
ctgggtttgggcagtg

SEQ ID NO: 4801662 - DNA, 17 bp, Homo sapiens
ctgggtttgggcagtgg

SEQ ID NO: 4801663 - DNA, 18 bp, Homo sapiens
ctgggtttgggcagtgga

SEQ ID NO: 4801664 - DNA, 20 bp, Homo sapiens
ctgggtttgggcagtggaga

SEQ ID NO: 4801665 - DNA, 21 bp, Homo sapiens
ctgggtttgggcagtggagag

SEQ ID NO: 4801666 - DNA, 17 bp, Homo sapiens
ctgggttttagaaattc

SEQ ID NO: 4801667 - DNA, 22 bp, Homo sapiens
ctggtaagattgttattaaatg

SEQ ID NO: 4801668 - DNA, 23 bp, Homo sapiens
ctggtaagattgttattaaatgt

SEQ ID NO: 4801669 - DNA, 15 bp, Homo sapiens
ctggtattaaatgcc

SEQ ID NO: 4801670 - DNA, 19 bp, Homo sapiens
ctggtattaaatgccaagg

SEQ ID NO: 4801671 - DNA, 18 bp, Homo sapiens
ctggtccacacaccacag

SEQ ID NO: 4801672 - DNA, 21 bp, Homo sapiens
ctggtccacacaccacagaag

SEQ ID NO: 4801673 - DNA, 18 bp, Homo sapiens
ctggtcccccatgggctg

SEQ ID NO: 4801674 - DNA, 19 bp, Homo sapiens
ctggtcccccatgggctgc

SEQ ID NO: 4801675 - DNA, 15 bp, Homo sapiens
ctggtcctgcactgt

SEQ ID NO: 4801676 - DNA, 16 bp, Homo sapiens
ctggtctggagcccct

SEQ ID NO: 4801677 - DNA, 17 bp, Homo sapiens
ctggtctggagccccta

SEQ ID NO: 4801678 - DNA, 18 bp, Homo sapiens
ctggtctggagcccctat

SEQ ID NO: 4801679 - DNA, 20 bp, Homo sapiens
ctggtctggagcccctatcc

SEQ ID NO: 4801680 - DNA, 13 bp, Homo sapiens
ctggtgaatccat

SEQ ID NO: 4801681 - DNA, 12 bp, Homo sapiens
ctggtgcccctc

SEQ ID NO: 4801682 - DNA, 16 bp, Homo sapiens
ctggtgcgtgtggccc

SEQ ID NO: 4801683 - DNA, 18 bp, Homo sapiens
ctggtggcaccagatgca

SEQ ID NO: 4801684 - DNA, 22 bp, Homo sapiens
ctggtggcaccagatgcaacct

SEQ ID NO: 4801685 - DNA, 13 bp, Homo sapiens
ctggtggccctgc

SEQ ID NO: 4801686 - DNA, 14 bp, Homo sapiens
ctggtggccctgcg

SEQ ID NO: 4801687 - DNA, 15 bp, Homo sapiens
ctggttgtctctctt

SEQ ID NO: 4801688 - DNA, 14 bp, Homo sapiens
ctgtaaaactttat

SEQ ID NO: 4801689 - DNA, 23 bp, Homo sapiens
ctgtaaaatactattggacagac

SEQ ID NO: 4801690 - DNA, 13 bp, Homo sapiens
ctgtaatatttac

SEQ ID NO: 4801691 - DNA, 14 bp, Homo sapiens
ctgtaatatttaca

SEQ ID NO: 4801692 - DNA, 20 bp, Homo sapiens
ctgtaatcacactctcttct

SEQ ID NO: 4801693 - DNA, 20 bp, Homo sapiens
ctgtaattcttctcctttgt

SEQ ID NO: 4801694 - DNA, 22 bp, Homo sapiens
ctgtaattcttctcctttgtca

SEQ ID NO: 4801695 - DNA, 18 bp, Homo sapiens
ctgtactatctagtgtct

SEQ ID NO: 4801696 - DNA, 19 bp, Homo sapiens
ctgtactttcccaggttga

SEQ ID NO: 4801697 - DNA, 17 bp, Homo sapiens
ctgtagacatctgtcct

SEQ ID NO: 4801698 - DNA, 19 bp, Homo sapiens
ctgtagccaacttaaacct

SEQ ID NO: 4801699 - DNA, 13 bp, Homo sapiens
ctgtagccctggc

SEQ ID NO: 4801700 - DNA, 15 bp, Homo sapiens
ctgtagccctggccc

SEQ ID NO: 4801701 - DNA, 16 bp, Homo sapiens
ctgtagccctggcccg

SEQ ID NO: 4801702 - DNA, 23 bp, Homo sapiens
ctgtagccctggcccggtcccag

SEQ ID NO: 4801703 - DNA, 17 bp, Homo sapiens
ctgtagcctggtctgtg

SEQ ID NO: 4801704 - DNA, 16 bp, Homo sapiens
ctgtagctccttagct

SEQ ID NO: 4801705 - DNA, 19 bp, Homo sapiens
ctgtagctctgaatgctat

SEQ ID NO: 4801706 - DNA, 22 bp, Homo sapiens
ctgtagtttttgttcaccttct

SEQ ID NO: 4801707 - DNA, 13 bp, Homo sapiens
ctgtataaatgtg

SEQ ID NO: 4801708 - DNA, 21 bp, Homo sapiens
ctgtataatactttgtataca

SEQ ID NO: 4801709 - DNA, 14 bp, Homo sapiens
ctgtatacaaacag

SEQ ID NO: 4801710 - DNA, 16 bp, Homo sapiens
ctgtatacaaacaggt

SEQ ID NO: 4801711 - DNA, 20 bp, Homo sapiens
ctgtatacaaacaggtgcta

SEQ ID NO: 4801712 - DNA, 21 bp, Homo sapiens
ctgtatatttgtatgatattt

SEQ ID NO: 4801713 - DNA, 13 bp, Homo sapiens
ctgtatctgtgct

SEQ ID NO: 4801714 - DNA, 16 bp, Homo sapiens
ctgtattaaagatgca

SEQ ID NO: 4801715 - DNA, 16 bp, Homo sapiens
cttctttccttccttt

SEQ ID NO: 4801716 - DNA, 23 bp, Homo sapiens
cttcttttaagatgtgtcttcaa

SEQ ID NO: 4801717 - DNA, 16 bp, Homo sapiens
cttcttttcaatgcaa

SEQ ID NO: 4801718 - DNA, 21 bp, Homo sapiens
cttcttttcaatgcaatgcat

SEQ ID NO: 4801719 - DNA, 17 bp, Homo sapiens
cttcttttcctgggtgc

SEQ ID NO: 4801720 - DNA, 13 bp, Homo sapiens
cttctttttggca

SEQ ID NO: 4801721 - DNA, 16 bp, Homo sapiens
cttgaaaacttctcat

SEQ ID NO: 4801722 - DNA, 18 bp, Homo sapiens
cttgaaaacttctcattt

SEQ ID NO: 4801723 - DNA, 20 bp, Homo sapiens
cttgaaattatatctgtggt

SEQ ID NO: 4801724 - DNA, 14 bp, Homo sapiens
cttgaagaactgac

SEQ ID NO: 4801725 - DNA, 14 bp, Homo sapiens
cttgaagaatattg

SEQ ID NO: 4801726 - DNA, 15 bp, Homo sapiens
cttgaagaatattgt

SEQ ID NO: 4801727 - DNA, 18 bp, Homo sapiens
cttgaatagtattgtgtt

SEQ ID NO: 4801728 - DNA, 20 bp, Homo sapiens
cttgaatgatgccatgagga

SEQ ID NO: 4801729 - DNA, 19 bp, Homo sapiens
cttgaatgcttaaatgatc

SEQ ID NO: 4801730 - DNA, 18 bp, Homo sapiens
cttgaattgtaaggaatg

SEQ ID NO: 4801731 - DNA, 20 bp, Homo sapiens
cttgaccgtgaggccagaga

SEQ ID NO: 4801732 - DNA, 21 bp, Homo sapiens
cttgaccgtgaggccagagac

SEQ ID NO: 4801733 - DNA, 13 bp, Homo sapiens
cttgaccttcctc

SEQ ID NO: 4801734 - DNA, 14 bp, Homo sapiens
cttgaccttcctct

SEQ ID NO: 4801735 - DNA, 17 bp, Homo sapiens
cttgaccttcctctggg

SEQ ID NO: 4801736 - DNA, 22 bp, Homo sapiens
cttgaccttcctctggggctct

SEQ ID NO: 4801737 - DNA, 17 bp, Homo sapiens
cttgacgtgtgtggtcc

SEQ ID NO: 4801738 - DNA, 17 bp, Homo sapiens
cttgagagccccacccc

SEQ ID NO: 4801739 - DNA, 18 bp, Homo sapiens
cttgagcaaggcaagaag

SEQ ID NO: 4801740 - DNA, 16 bp, Homo sapiens
cttgagcatgcccaaa

SEQ ID NO: 4801741 - DNA, 15 bp, Homo sapiens
cttgagctggttttc

SEQ ID NO: 4801742 - DNA, 17 bp, Homo sapiens
cttgagctggttttctc

SEQ ID NO: 4801743 - DNA, 20 bp, Homo sapiens
cttgaggccaaatgagttcc

SEQ ID NO: 4801744 - DNA, 23 bp, Homo sapiens
cttgagggacgactttctttaac

SEQ ID NO: 4801745 - DNA, 21 bp, Homo sapiens
cttgagtggacagcagctgga

SEQ ID NO: 4801746 - DNA, 22 bp, Homo sapiens
cttgagtggacagcagctggac

SEQ ID NO: 4801747 - DNA, 21 bp, Homo sapiens
cttgattaaggactacagaat

SEQ ID NO: 4801748 - DNA, 13 bp, Homo sapiens
cttgcaagctcca

SEQ ID NO: 4801749 - DNA, 14 bp, Homo sapiens
cttgcaagctccag

SEQ ID NO: 4801750 - DNA, 19 bp, Homo sapiens
cttgcaagctccagtagct

SEQ ID NO: 4801751 - DNA, 21 bp, Homo sapiens
cttgcaagctccagtagctcc

SEQ ID NO: 4801752 - DNA, 18 bp, Homo sapiens
cttgcactggccttctga

SEQ ID NO: 4801753 - DNA, 19 bp, Homo sapiens
cttgcactggccttctgat

SEQ ID NO: 4801754 - DNA, 14 bp, Homo sapiens
cttgcacttctgtt

SEQ ID NO: 4801755 - DNA, 19 bp, Homo sapiens
cttgcacttctgttatcag

SEQ ID NO: 4801756 - DNA, 17 bp, Homo sapiens
cttgcagtcatcagaag

SEQ ID NO: 4801757 - DNA, 15 bp, Homo sapiens
cttgccaatggtgta

SEQ ID NO: 4801758 - DNA, 20 bp, Homo sapiens
cttgccacaatcactaaata

SEQ ID NO: 4801759 - DNA, 14 bp, Homo sapiens
cttgccactgccat

SEQ ID NO: 4801760 - DNA, 15 bp, Homo sapiens
cttgccctattataa

SEQ ID NO: 4801761 - DNA, 16 bp, Homo sapiens
cttgccctattataat

SEQ ID NO: 4801762 - DNA, 13 bp, Homo sapiens
cttgccgaggagc

SEQ ID NO: 4801763 - DNA, 15 bp, Homo sapiens
cttgccgaggagcca

SEQ ID NO: 4801764 - DNA, 17 bp, Homo sapiens
cttgccgaggagccagg

SEQ ID NO: 4801765 - DNA, 18 bp, Homo sapiens
cttgccgaggagccaggc

SEQ ID NO: 4801766 - DNA, 20 bp, Homo sapiens
cttgccgaggagccaggcaa

SEQ ID NO: 4801767 - DNA, 12 bp, Homo sapiens
cttgcctccagg

SEQ ID NO: 4801768 - DNA, 17 bp, Homo sapiens
cttgcggcaccgcccac

SEQ ID NO: 4801769 - DNA, 18 bp, Homo sapiens
cttgcggcaccgcccacc

SEQ ID NO: 4801770 - DNA, 22 bp, Homo sapiens
cttgcggcaccgcccacccaca

SEQ ID NO: 4801771 - DNA, 18 bp, Homo sapiens
cttgctcttaagtaccag

SEQ ID NO: 4801772 - DNA, 16 bp, Homo sapiens
cttgctgcactcttgc

SEQ ID NO: 4801773 - DNA, 18 bp, Homo sapiens
cttgctggaaaactgcca

SEQ ID NO: 4801774 - DNA, 21 bp, Homo sapiens
cttgctggaaaactgccacaa

SEQ ID NO: 4801775 - DNA, 13 bp, Homo sapiens
cttgctgtgaaac

SEQ ID NO: 4801776 - DNA, 17 bp, Homo sapiens
cttgctgtgaaacagtg

SEQ ID NO: 4801777 - DNA, 20 bp, Homo sapiens
cttgctgtttaccgcccacc

SEQ ID NO: 4801778 - DNA, 20 bp, Homo sapiens
cttgcttcaaccccatgaga

SEQ ID NO: 4801779 - DNA, 15 bp, Homo sapiens
cttgcttccttctca

SEQ ID NO: 4801780 - DNA, 14 bp, Homo sapiens
cttgcttcttgtgt

SEQ ID NO: 4801781 - DNA, 17 bp, Homo sapiens
cttgcttcttgtgtttg

SEQ ID NO: 4801782 - DNA, 19 bp, Homo sapiens
cttgcttcttgtgtttgaa

SEQ ID NO: 4801783 - DNA, 12 bp, Homo sapiens
cttggaaaatgt

SEQ ID NO: 4801784 - DNA, 19 bp, Homo sapiens
cttggactacctataaatg

SEQ ID NO: 4801785 - DNA, 16 bp, Homo sapiens
cttggagagacacagc

SEQ ID NO: 4801786 - DNA, 13 bp, Homo sapiens
cttggagaggagg

SEQ ID NO: 4801787 - DNA, 19 bp, Homo sapiens
cttggagaggaggtgtgga

SEQ ID NO: 4801788 - DNA, 21 bp, Homo sapiens
cttggagcagagacggcagcc

SEQ ID NO: 4801789 - DNA, 22 bp, Homo sapiens
cttggagcagagacggcagccc

SEQ ID NO: 4801790 - DNA, 22 bp, Homo sapiens
cttggagcgtttttgctggctt

SEQ ID NO: 4801791 - DNA, 15 bp, Homo sapiens
cttggataggagctt

SEQ ID NO: 4801792 - DNA, 22 bp, Homo sapiens
cttggattggtaccagagccta

SEQ ID NO: 4801793 - DNA, 12 bp, Homo sapiens
cttggcaccaaa

SEQ ID NO: 4801794 - DNA, 21 bp, Homo sapiens
cttggcaggagtgggctctga

SEQ ID NO: 4801795 - DNA, 21 bp, Homo sapiens
cttggcccagcagcggcccag

SEQ ID NO: 4801796 - DNA, 21 bp, Homo sapiens
cttggcctagcccaccctgct

SEQ ID NO: 4801797 - DNA, 16 bp, Homo sapiens
cttggcgtggagcagg

SEQ ID NO: 4801798 - DNA, 18 bp, Homo sapiens
cttggcgtggagcaggcg

SEQ ID NO: 4801799 - DNA, 15 bp, Homo sapiens
cttggctagtcacat

SEQ ID NO: 4801800 - DNA, 20 bp, Homo sapiens
cttggctcagacacctagac

SEQ ID NO: 4801801 - DNA, 17 bp, Homo sapiens
cttgggacggaagtggc

SEQ ID NO: 4801802 - DNA, 16 bp, Homo sapiens
cttgggattcctcccc

SEQ ID NO: 4801803 - DNA, 21 bp, Homo sapiens
cttgggattcctcccctggaa

SEQ ID NO: 4801804 - DNA, 17 bp, Homo sapiens
cttgggcacgggagagc

SEQ ID NO: 4801805 - DNA, 21 bp, Homo sapiens
cttgggcacgggagagcgcca

SEQ ID NO: 4801806 - DNA, 23 bp, Homo sapiens
cttgggcacgggagagcgccacc

SEQ ID NO: 4801807 - DNA, 23 bp, Homo sapiens
cttgggcgggccatttcacattc

SEQ ID NO: 4801808 - DNA, 19 bp, Homo sapiens
cttgggctggcacccactg

SEQ ID NO: 4801809 - DNA, 13 bp, Homo sapiens
cttgggcttcatc

SEQ ID NO: 4801810 - DNA, 20 bp, Homo sapiens
cttggggaaggggcctgggc

SEQ ID NO: 4801811 - DNA, 22 bp, Homo sapiens
cttggggaaggggcctgggctg

SEQ ID NO: 4801812 - DNA, 16 bp, Homo sapiens
cttggggaccagagct

SEQ ID NO: 4801813 - DNA, 16 bp, Homo sapiens
cttgggggtggggctg

SEQ ID NO: 4801814 - DNA, 19 bp, Homo sapiens
cttgggggtggggctgcat

SEQ ID NO: 4801815 - DNA, 17 bp, Homo sapiens
cttggggtagagaggac

SEQ ID NO: 4801816 - DNA, 20 bp, Homo sapiens
cttgggtgtggctcctctgt

SEQ ID NO: 4801817 - DNA, 11 bp, Homo sapiens
cttggtctctt

SEQ ID NO: 4801818 - DNA, 20 bp, Homo sapiens
cttggtctctttctttccaa

SEQ ID NO: 4801819 - DNA, 22 bp, Homo sapiens
cttggtctgtgttctcaacaca

SEQ ID NO: 4801820 - DNA, 19 bp, Homo sapiens
cttggtgattacctgaaag

SEQ ID NO: 4801821 - DNA, 23 bp, Homo sapiens
cttggtgattacctgaaagccct

SEQ ID NO: 4801822 - DNA, 19 bp, Homo sapiens
cttggtgcctaatgttcca

SEQ ID NO: 4801823 - DNA, 15 bp, Homo sapiens
cttggttcctccagc

SEQ ID NO: 4801824 - DNA, 19 bp, Homo sapiens
cttggttgttcctttttct

SEQ ID NO: 4801825 - DNA, 16 bp, Homo sapiens
cttggttttgcctctt

SEQ ID NO: 4801826 - DNA, 19 bp, Homo sapiens
cttggttttgcctctttaa

SEQ ID NO: 4801827 - DNA, 21 bp, Homo sapiens
cttggttttgcctctttaaat

SEQ ID NO: 4801828 - DNA, 14 bp, Homo sapiens
cttgtaaaactgtg

SEQ ID NO: 4801829 - DNA, 20 bp, Homo sapiens
cttgtaaaactgtgacattc

SEQ ID NO: 4801830 - DNA, 12 bp, Homo sapiens
cttgtaactttt

SEQ ID NO: 4801831 - DNA, 13 bp, Homo sapiens
cttgtagggtgag

SEQ ID NO: 4801832 - DNA, 19 bp, Homo sapiens
cttgtagggtgaggcgtgg

SEQ ID NO: 4801833 - DNA, 15 bp, Homo sapiens
cttgtcattctcatc

SEQ ID NO: 4801834 - DNA, 18 bp, Homo sapiens
cttgtctcctcctccagg

SEQ ID NO: 4801835 - DNA, 12 bp, Homo sapiens
cttgtgcatgca

SEQ ID NO: 4801836 - DNA, 21 bp, Homo sapiens
gaaatgagatcccagagttat

SEQ ID NO: 4801837 - DNA, 22 bp, Homo sapiens
gaaatgccaagactctatgctc

SEQ ID NO: 4801838 - DNA, 18 bp, Homo sapiens
gaaatgccagacttctaa

SEQ ID NO: 4801839 - DNA, 23 bp, Homo sapiens
gaaatgccagacttctaaaataa

SEQ ID NO: 4801840 - DNA, 15 bp, Homo sapiens
gaaatgctaacctgt

SEQ ID NO: 4801841 - DNA, 23 bp, Homo sapiens
gaaatggcctgtccctagggctc

SEQ ID NO: 4801842 - DNA, 20 bp, Homo sapiens
gaaatggggaactcccccag

SEQ ID NO: 4801843 - DNA, 17 bp, Homo sapiens
gaaatgtggatgctctt

SEQ ID NO: 4801844 - DNA, 16 bp, Homo sapiens
gaaattagtattttga

SEQ ID NO: 4801845 - DNA, 14 bp, Homo sapiens
gaaattagtgtttt

SEQ ID NO: 4801846 - DNA, 21 bp, Homo sapiens
gaaattagtgttttcattctg

SEQ ID NO: 4801847 - DNA, 15 bp, Homo sapiens
gaaattatatctgtg

SEQ ID NO: 4801848 - DNA, 15 bp, Homo sapiens
gaaattcacactgtg

SEQ ID NO: 4801849 - DNA, 16 bp, Homo sapiens
gaaattcacactgtgc

SEQ ID NO: 4801850 - DNA, 22 bp, Homo sapiens
gaaattctataagagacaaagt

SEQ ID NO: 4801851 - DNA, 15 bp, Homo sapiens
gaaattgtgccaaag

SEQ ID NO: 4801852 - DNA, 13 bp, Homo sapiens
gaaatttaagcac

SEQ ID NO: 4801853 - DNA, 11 bp, Homo sapiens
gaaatttattc

SEQ ID NO: 4801854 - DNA, 21 bp, Homo sapiens
gaaatttgtgtgcttcacaca

SEQ ID NO: 4801855 - DNA, 15 bp, Homo sapiens
gaaattttatctctt

SEQ ID NO: 4801856 - DNA, 14 bp, Homo sapiens
gaaattttctagaa

SEQ ID NO: 4801857 - DNA, 15 bp, Homo sapiens
gaaattttctagaat

SEQ ID NO: 4801858 - DNA, 16 bp, Homo sapiens
gaaatttttttccaga

SEQ ID NO: 4801859 - DNA, 21 bp, Homo sapiens
gaacaaggcaaggctgtcaat

SEQ ID NO: 4801860 - DNA, 16 bp, Homo sapiens
gaacaccaagtaaatc

SEQ ID NO: 4801861 - DNA, 23 bp, Homo sapiens
gaacaccaagtaaatctatctct

SEQ ID NO: 4801862 - DNA, 17 bp, Homo sapiens
gaacagagtatatatgt

SEQ ID NO: 4801863 - DNA, 21 bp, Homo sapiens
gaacagagtatatatgtacag

SEQ ID NO: 4801864 - DNA, 13 bp, Homo sapiens
gaacagccctgca

SEQ ID NO: 4801865 - DNA, 17 bp, Homo sapiens
gaacagctaacaataaa

SEQ ID NO: 4801866 - DNA, 18 bp, Homo sapiens
gaacagctaacaataaag

SEQ ID NO: 4801867 - DNA, 16 bp, Homo sapiens
gaacagggcaaaatga

SEQ ID NO: 4801868 - DNA, 19 bp, Homo sapiens
gaacataaaccctccaagg

SEQ ID NO: 4801869 - DNA, 17 bp, Homo sapiens
gaaccagcactcccagg

SEQ ID NO: 4801870 - DNA, 20 bp, Homo sapiens
gaaccagcactcccagggcc

SEQ ID NO: 4801871 - DNA, 21 bp, Homo sapiens
gaaccagcactcccagggccc

SEQ ID NO: 4801872 - DNA, 23 bp, Homo sapiens
gaaccagcactcccagggcccga

SEQ ID NO: 4801873 - DNA, 15 bp, Homo sapiens
gaaccaggaggcctg

SEQ ID NO: 4801874 - DNA, 13 bp, Homo sapiens
gaacccccctccc

SEQ ID NO: 4801875 - DNA, 19 bp, Homo sapiens
gaaccgaggactccagggg

SEQ ID NO: 4801876 - DNA, 14 bp, Homo sapiens
gaacctcaaactgg

SEQ ID NO: 4801877 - DNA, 17 bp, Homo sapiens
gaacctgcgcaccccgt

SEQ ID NO: 4801878 - DNA, 13 bp, Homo sapiens
gaacctgctcttc

SEQ ID NO: 4801879 - DNA, 18 bp, Homo sapiens
gaacctggggttttgact

SEQ ID NO: 4801880 - DNA, 21 bp, Homo sapiens
gaaccttcccgtctgattgtt

SEQ ID NO: 4801881 - DNA, 15 bp, Homo sapiens
gaaccttccctccaa

SEQ ID NO: 4801882 - DNA, 17 bp, Homo sapiens
gaaccttgatggggtga

SEQ ID NO: 4801883 - DNA, 21 bp, Homo sapiens
gaaccttttgagtgccttaca

SEQ ID NO: 4801884 - DNA, 15 bp, Homo sapiens
gaacgcccccgcccc

SEQ ID NO: 4801885 - DNA, 19 bp, Homo sapiens
gaacgctgctccatgcaca

SEQ ID NO: 4801886 - DNA, 21 bp, Homo sapiens
gaacgctgctccatgcacagg

SEQ ID NO: 4801887 - DNA, 16 bp, Homo sapiens
gaactaactgccatgt

SEQ ID NO: 4801888 - DNA, 16 bp, Homo sapiens
gaactcccccagaggt

SEQ ID NO: 4801889 - DNA, 12 bp, Homo sapiens
gaactccttggc

SEQ ID NO: 4801890 - DNA, 15 bp, Homo sapiens
gaactccttggccta

SEQ ID NO: 4801891 - DNA, 21 bp, Homo sapiens
gaactccttggcctagcccac

SEQ ID NO: 4801892 - DNA, 19 bp, Homo sapiens
gaactcgggattacagaaa

SEQ ID NO: 4801893 - DNA, 19 bp, Homo sapiens
gaactctatctgggcctgg

SEQ ID NO: 4801894 - DNA, 13 bp, Homo sapiens
gaactctgacaag

SEQ ID NO: 4801895 - DNA, 15 bp, Homo sapiens
gaactctgacaaggg

SEQ ID NO: 4801896 - DNA, 14 bp, Homo sapiens
gaactgaagcagag

SEQ ID NO: 4801897 - DNA, 15 bp, Homo sapiens
gaactgaagcagagt

SEQ ID NO: 4801898 - DNA, 13 bp, Homo sapiens
gaactggccccag

SEQ ID NO: 4801899 - DNA, 18 bp, Homo sapiens
gaactggccgctgggaga

SEQ ID NO: 4801900 - DNA, 17 bp, Homo sapiens
gaactgtgaatatgtgt

SEQ ID NO: 4801901 - DNA, 19 bp, Homo sapiens
gaacttggtgcctaatgtt

SEQ ID NO: 4801902 - DNA, 17 bp, Homo sapiens
gaactttccaggaaggc

SEQ ID NO: 4801903 - DNA, 14 bp, Homo sapiens
gaagaaaactatcc

SEQ ID NO: 4801904 - DNA, 21 bp, Homo sapiens
gaagaaaactatcctgcgggt

SEQ ID NO: 4801905 - DNA, 18 bp, Homo sapiens
gaagaaacacagcatgca

SEQ ID NO: 4801906 - DNA, 12 bp, Homo sapiens
gaagaaagggag

SEQ ID NO: 4801907 - DNA, 19 bp, Homo sapiens
gaagaactagccatgtgct

SEQ ID NO: 4801908 - DNA, 17 bp, Homo sapiens
gaagaaggactgaagaa

SEQ ID NO: 4801909 - DNA, 21 bp, Homo sapiens
gaagaaggcccgggaggagga

SEQ ID NO: 4801910 - DNA, 15 bp, Homo sapiens
gaagaattaatgaca

SEQ ID NO: 4801911 - DNA, 13 bp, Homo sapiens
gaagaatttgaag

SEQ ID NO: 4801912 - DNA, 14 bp, Homo sapiens
gaagaatttgaaga

SEQ ID NO: 4801913 - DNA, 22 bp, Homo sapiens
gaagacagagatggcagagcca

SEQ ID NO: 4801914 - DNA, 23 bp, Homo sapiens
gaagacatgaacgttttctcttc

SEQ ID NO: 4801915 - DNA, 14 bp, Homo sapiens
gaagacttccagct

SEQ ID NO: 4801916 - DNA, 20 bp, Homo sapiens
gaagacttccagctttctct

SEQ ID NO: 4801917 - DNA, 22 bp, Homo sapiens
gaagacttccagctttctcttt

SEQ ID NO: 4801918 - DNA, 20 bp, Homo sapiens
gaagacttttctttcagcca

SEQ ID NO: 4801919 - DNA, 12 bp, Homo sapiens
gaagagaaggag

SEQ ID NO: 4801920 - DNA, 19 bp, Homo sapiens
gaagagaatgcacaaacag

SEQ ID NO: 4801921 - DNA, 16 bp, Homo sapiens
gaagagctagagaaat

SEQ ID NO: 4801922 - DNA, 15 bp, Homo sapiens
gaagaggagccctca

SEQ ID NO: 4801923 - DNA, 16 bp, Homo sapiens
gaagaggcagattcaa

SEQ ID NO: 4801924 - DNA, 17 bp, Homo sapiens
gaagagggaactaagca

SEQ ID NO: 4801925 - DNA, 19 bp, Homo sapiens
gaagaggggcgctgccccc

SEQ ID NO: 4801926 - DNA, 22 bp, Homo sapiens
gaagaggggcgctgcccccaca

SEQ ID NO: 4801927 - DNA, 16 bp, Homo sapiens
gaagatgcattttaaa

SEQ ID NO: 4801928 - DNA, 15 bp, Homo sapiens
gaagcacatgcctct

SEQ ID NO: 4801929 - DNA, 22 bp, Homo sapiens
gaagcacatgcctctctcaggc

SEQ ID NO: 4801930 - DNA, 16 bp, Homo sapiens
gaagcaccccaccaca

SEQ ID NO: 4801931 - DNA, 12 bp, Homo sapiens
gaagcagaatga

SEQ ID NO: 4801932 - DNA, 22 bp, Homo sapiens
gaagcagaatgagatgatttaa

SEQ ID NO: 4801933 - DNA, 17 bp, Homo sapiens
gaagcagtgtgtacttc

SEQ ID NO: 4801934 - DNA, 11 bp, Homo sapiens
gaagcagtttc

SEQ ID NO: 4801935 - DNA, 15 bp, Homo sapiens
gaagcagtttcagat

SEQ ID NO: 4801936 - DNA, 21 bp, Homo sapiens
gaagcagtttcagataaatca

SEQ ID NO: 4801937 - DNA, 23 bp, Homo sapiens
gaagcatccaaggaacttcatgc

SEQ ID NO: 4801938 - DNA, 17 bp, Homo sapiens
gaagccacgctgtcctc

SEQ ID NO: 4801939 - DNA, 15 bp, Homo sapiens
gaagccagcaggctc

SEQ ID NO: 4801940 - DNA, 20 bp, Homo sapiens
gaagccagcaggctctcagg

SEQ ID NO: 4801941 - DNA, 22 bp, Homo sapiens
gaagcccacccgccccagagac

SEQ ID NO: 4801942 - DNA, 22 bp, Homo sapiens
gaagccggcggagctctggctt

SEQ ID NO: 4801943 - DNA, 15 bp, Homo sapiens
gaagccttttcctga

SEQ ID NO: 4801944 - DNA, 22 bp, Homo sapiens
gaaggaaggctccatctccagt

SEQ ID NO: 4801945 - DNA, 16 bp, Homo sapiens
gaaggaatgcaataaa

SEQ ID NO: 4801946 - DNA, 13 bp, Homo sapiens
gaaggagaggagt

SEQ ID NO: 4801947 - DNA, 14 bp, Homo sapiens
gaaggagaggagtg

SEQ ID NO: 4801948 - DNA, 15 bp, Homo sapiens
gaaggagaggagtgc

SEQ ID NO: 4801949 - DNA, 17 bp, Homo sapiens
gaaggagaggagtgcgc

SEQ ID NO: 4801950 - DNA, 14 bp, Homo sapiens
gaaggcacccgccc

SEQ ID NO: 4801951 - DNA, 14 bp, Homo sapiens
gaaggcagggagga

SEQ ID NO: 4801952 - DNA, 17 bp, Homo sapiens
gaaggcagggaggaggc

SEQ ID NO: 4801953 - DNA, 16 bp, Homo sapiens
gaaggccccagggcag

SEQ ID NO: 4801954 - DNA, 21 bp, Homo sapiens
gaaggcctgccccccttccca

SEQ ID NO: 4801955 - DNA, 21 bp, Homo sapiens
gaagggaggggaagagagagg

SEQ ID NO: 4801956 - DNA, 17 bp, Homo sapiens
gaagggagtgaaaacct

SEQ ID NO: 4801957 - DNA, 12 bp, Homo sapiens
gaagggcaggag

SEQ ID NO: 4801958 - DNA, 13 bp, Homo sapiens
gagagcgccaccc

SEQ ID NO: 4801959 - DNA, 15 bp, Homo sapiens
gagagcgccacccgc

SEQ ID NO: 4801960 - DNA, 16 bp, Homo sapiens
gagagcgccacccgcc

SEQ ID NO: 4801961 - DNA, 21 bp, Homo sapiens
gagagcggcttccccatcgcc

SEQ ID NO: 4801962 - DNA, 21 bp, Homo sapiens
gagaggaccccattctgggac

SEQ ID NO: 4801963 - DNA, 22 bp, Homo sapiens
gagaggaggtgtggagtggagg

SEQ ID NO: 4801964 - DNA, 15 bp, Homo sapiens
gagaggatgaacatc

SEQ ID NO: 4801965 - DNA, 14 bp, Homo sapiens
gagaggcatccagt

SEQ ID NO: 4801966 - DNA, 20 bp, Homo sapiens
gagaggcctgggtgtgacct

SEQ ID NO: 4801967 - DNA, 22 bp, Homo sapiens
gagaggggacttggataggagc

SEQ ID NO: 4801968 - DNA, 20 bp, Homo sapiens
gagagggtgccgcgggcgag

SEQ ID NO: 4801969 - DNA, 22 bp, Homo sapiens
gagagtttctatggattcactt

SEQ ID NO: 4801970 - DNA, 14 bp, Homo sapiens
gagatagccaaggc

SEQ ID NO: 4801971 - DNA, 19 bp, Homo sapiens
gagatagccaaggccaaag

SEQ ID NO: 4801972 - DNA, 18 bp, Homo sapiens
gagatatatctgaaaact

SEQ ID NO: 4801973 - DNA, 17 bp, Homo sapiens
gagatattttgtaaaat

SEQ ID NO: 4801974 - DNA, 20 bp, Homo sapiens
gagatattttgtaaaatgta

SEQ ID NO: 4801975 - DNA, 14 bp, Homo sapiens
gagatcagaattga

SEQ ID NO: 4801976 - DNA, 22 bp, Homo sapiens
gagatgcatctgtggcctgggg

SEQ ID NO: 4801977 - DNA, 19 bp, Homo sapiens
gagatggtgccccctgggg

SEQ ID NO: 4801978 - DNA, 15 bp, Homo sapiens
gagatgtagcaaatt

SEQ ID NO: 4801979 - DNA, 14 bp, Homo sapiens
gagatgttttcaag

SEQ ID NO: 4801980 - DNA, 13 bp, Homo sapiens
gagattaatttgt

SEQ ID NO: 4801981 - DNA, 23 bp, Homo sapiens
gagattatttacaagaagaactc

SEQ ID NO: 4801982 - DNA, 17 bp, Homo sapiens
gagattgggggggcttg

SEQ ID NO: 4801983 - DNA, 22 bp, Homo sapiens
gagatttagggttctatattta

SEQ ID NO: 4801984 - DNA, 21 bp, Homo sapiens
gagatttgtatttatattaga

SEQ ID NO: 4801985 - DNA, 20 bp, Homo sapiens
gagcaaactgaagcccacag

SEQ ID NO: 4801986 - DNA, 20 bp, Homo sapiens
gagcaagaccccatctcaaa

SEQ ID NO: 4801987 - DNA, 14 bp, Homo sapiens
gagcacagccatag

SEQ ID NO: 4801988 - DNA, 14 bp, Homo sapiens
gagcacccccagcc

SEQ ID NO: 4801989 - DNA, 21 bp, Homo sapiens
gagcacccccagcctccccca

SEQ ID NO: 4801990 - DNA, 21 bp, Homo sapiens
gagcactagaatgagaaatca

SEQ ID NO: 4801991 - DNA, 19 bp, Homo sapiens
gagcagagacgaagacccc

SEQ ID NO: 4801992 - DNA, 18 bp, Homo sapiens
gagcagagacggcagccc

SEQ ID NO: 4801993 - DNA, 20 bp, Homo sapiens
gagcagagacggcagcccca

SEQ ID NO: 4801994 - DNA, 14 bp, Homo sapiens
gagcaggaaggcct

SEQ ID NO: 4801995 - DNA, 15 bp, Homo sapiens
gagcaggaaggcctg

SEQ ID NO: 4801996 - DNA, 18 bp, Homo sapiens
gagcaggaaggcctgggt

SEQ ID NO: 4801997 - DNA, 21 bp, Homo sapiens
gagcagtggccgggctgggga

SEQ ID NO: 4801998 - DNA, 23 bp, Homo sapiens
gagcagtgtcctgtgctttctgc

SEQ ID NO: 4801999 - DNA, 21 bp, Homo sapiens
gagcatataaggctaaatgta

SEQ ID NO: 4802000 - DNA, 15 bp, Homo sapiens
gagcatgaagataaa

SEQ ID NO: 4802001 - DNA, 22 bp, Homo sapiens
gagcatgctccctcatgcagat

SEQ ID NO: 4802002 - DNA, 15 bp, Homo sapiens
gagccagagcctctg

SEQ ID NO: 4802003 - DNA, 21 bp, Homo sapiens
gagcccacaggagctcccttt

SEQ ID NO: 4802004 - DNA, 21 bp, Homo sapiens
gagcccacggctaagaggctg

SEQ ID NO: 4802005 - DNA, 20 bp, Homo sapiens
gagccccccgtgttcacaca

SEQ ID NO: 4802006 - DNA, 13 bp, Homo sapiens
gagccccggagca

SEQ ID NO: 4802007 - DNA, 16 bp, Homo sapiens
gagccccggagcacca

SEQ ID NO: 4802008 - DNA, 22 bp, Homo sapiens
gagcccctatcctgcaccctct

SEQ ID NO: 4802009 - DNA, 12 bp, Homo sapiens
gagcccctcctc

SEQ ID NO: 4802010 - DNA, 15 bp, Homo sapiens
gagcccctcctctcc

SEQ ID NO: 4802011 - DNA, 22 bp, Homo sapiens
gagcccctcctctcctcgtccg

SEQ ID NO: 4802012 - DNA, 22 bp, Homo sapiens
gagccctctgctgctttccaac

SEQ ID NO: 4802013 - DNA, 19 bp, Homo sapiens
gagccctgccctcactcca

SEQ ID NO: 4802014 - DNA, 17 bp, Homo sapiens
gagccgcagaggcccga

SEQ ID NO: 4802015 - DNA, 23 bp, Homo sapiens
gagccgcagaggcccgaggcacc

SEQ ID NO: 4802016 - DNA, 14 bp, Homo sapiens
gagccgcaggggcc

SEQ ID NO: 4802017 - DNA, 23 bp, Homo sapiens
gagcctatggaaagggtgtggct

SEQ ID NO: 4802018 - DNA, 19 bp, Homo sapiens
gagcctccaggttcctcaa

SEQ ID NO: 4802019 - DNA, 12 bp, Homo sapiens
gagcctccccct

SEQ ID NO: 4802020 - DNA, 13 bp, Homo sapiens
gagcctccccctc

SEQ ID NO: 4802021 - DNA, 16 bp, Homo sapiens
gagcctccccctcaga

SEQ ID NO: 4802022 - DNA, 17 bp, Homo sapiens
gagcctccccctcagat

SEQ ID NO: 4802023 - DNA, 14 bp, Homo sapiens
gagcctcctgccct

SEQ ID NO: 4802024 - DNA, 16 bp, Homo sapiens
gagcctgagtcagggc

SEQ ID NO: 4802025 - DNA, 18 bp, Homo sapiens
gagcctggcccatagaaa

SEQ ID NO: 4802026 - DNA, 13 bp, Homo sapiens
gagcctgtctctc

SEQ ID NO: 4802027 - DNA, 15 bp, Homo sapiens
gagcctgtctctccc

SEQ ID NO: 4802028 - DNA, 17 bp, Homo sapiens
gagcgatgtgttctttg

SEQ ID NO: 4802029 - DNA, 14 bp, Homo sapiens
gagcgcagccccca

SEQ ID NO: 4802030 - DNA, 15 bp, Homo sapiens
gagcggctgaggacg

SEQ ID NO: 4802031 - DNA, 13 bp, Homo sapiens
gagctaccaggaa

SEQ ID NO: 4802032 - DNA, 14 bp, Homo sapiens
gagctaccaggaag

SEQ ID NO: 4802033 - DNA, 17 bp, Homo sapiens
gagctaccaggaagagg

SEQ ID NO: 4802034 - DNA, 19 bp, Homo sapiens
gagctaccaggaagagggg

SEQ ID NO: 4802035 - DNA, 22 bp, Homo sapiens
gagctatgatatgtgcttgtgt

SEQ ID NO: 4802036 - DNA, 17 bp, Homo sapiens
gagctatgcacaccaaa

SEQ ID NO: 4802037 - DNA, 15 bp, Homo sapiens
gagctccaccctccc

SEQ ID NO: 4802038 - DNA, 15 bp, Homo sapiens
gagctccctttttga

SEQ ID NO: 4802039 - DNA, 22 bp, Homo sapiens
gagctccctttttgaattgtgt

SEQ ID NO: 4802040 - DNA, 13 bp, Homo sapiens
gagctctggcttt

SEQ ID NO: 4802041 - DNA, 16 bp, Homo sapiens
gagctctgtagcctgg

SEQ ID NO: 4802042 - DNA, 15 bp, Homo sapiens
gagctgatggagaag

SEQ ID NO: 4802043 - DNA, 16 bp, Homo sapiens
gagctgatggagaagg

SEQ ID NO: 4802044 - DNA, 13 bp, Homo sapiens
gagctgccacctg

SEQ ID NO: 4802045 - DNA, 15 bp, Homo sapiens
gagctgctgtatttg

SEQ ID NO: 4802046 - DNA, 14 bp, Homo sapiens
gagctgggcatggt

SEQ ID NO: 4802047 - DNA, 20 bp, Homo sapiens
gagctggggaatcccctcgc

SEQ ID NO: 4802048 - DNA, 16 bp, Homo sapiens
gagctggttttctctg

SEQ ID NO: 4802049 - DNA, 16 bp, Homo sapiens
gaggaaaaggcttgag

SEQ ID NO: 4802050 - DNA, 21 bp, Homo sapiens
gaggaaaaggcttgagtctgg

SEQ ID NO: 4802051 - DNA, 17 bp, Homo sapiens
gaggaaagcaaaggaga

SEQ ID NO: 4802052 - DNA, 14 bp, Homo sapiens
gaggaacaaggcaa

SEQ ID NO: 4802053 - DNA, 16 bp, Homo sapiens
gaggaacaaggcaagg

SEQ ID NO: 4802054 - DNA, 16 bp, Homo sapiens
gaggaagggcccccgg

SEQ ID NO: 4802055 - DNA, 21 bp, Homo sapiens
gaggacagcttccccatcgcc

SEQ ID NO: 4802056 - DNA, 13 bp, Homo sapiens
gaggacccctgcc

SEQ ID NO: 4802057 - DNA, 14 bp, Homo sapiens
gaggacccctgccc

SEQ ID NO: 4802058 - DNA, 16 bp, Homo sapiens
gaggacccctgccctc

SEQ ID NO: 4802059 - DNA, 21 bp, Homo sapiens
gaggacggcttccccatcgcc

SEQ ID NO: 4802060 - DNA, 16 bp, Homo sapiens
gaggacggggcagagc

SEQ ID NO: 4802061 - DNA, 18 bp, Homo sapiens
gaggacggggcagagctg

SEQ ID NO: 4802062 - DNA, 22 bp, Homo sapiens
gaggacgtcatcggaggctggg

SEQ ID NO: 4802063 - DNA, 13 bp, Homo sapiens
gaggactccaggg

SEQ ID NO: 4802064 - DNA, 15 bp, Homo sapiens
gaggactccaggggc

SEQ ID NO: 4802065 - DNA, 23 bp, Homo sapiens
gaggactgttggctgattggaaa

SEQ ID NO: 4802066 - DNA, 15 bp, Homo sapiens
gaggagagaggaccc

SEQ ID NO: 4802067 - DNA, 13 bp, Homo sapiens
gaggagcaccccc

SEQ ID NO: 4802068 - DNA, 17 bp, Homo sapiens
gaggagcacccccagcc

SEQ ID NO: 4802069 - DNA, 15 bp, Homo sapiens
gaggagcgtgtccta

SEQ ID NO: 4802070 - DNA, 16 bp, Homo sapiens
gaggaggcagagaaga

SEQ ID NO: 4802071 - DNA, 12 bp, Homo sapiens
gaggaggggagc

SEQ ID NO: 4802072 - DNA, 19 bp, Homo sapiens
gaggaggtgtggagtggag

SEQ ID NO: 4802073 - DNA, 11 bp, Homo sapiens
gaggagtccaa

SEQ ID NO: 4802074 - DNA, 12 bp, Homo sapiens
gaggagtccaaa

SEQ ID NO: 4802075 - DNA, 13 bp, Homo sapiens
gaggagtccaaaa

SEQ ID NO: 4802076 - DNA, 16 bp, Homo sapiens
gaggagtgatgggcaa

SEQ ID NO: 4802077 - DNA, 14 bp, Homo sapiens
gaggatccgggctt

SEQ ID NO: 4802078 - DNA, 13 bp, Homo sapiens
gaggatggacgag

SEQ ID NO: 4802079 - DNA, 15 bp, Homo sapiens
gaggcagaatggtgg

SEQ ID NO: 4802080 - DNA, 24 bp, Homo sapiens
gattgcggtgtgagatggtgcccc

SEQ ID NO: 4802081 - DNA, 12 bp, Homo sapiens
gattggaaaata

SEQ ID NO: 4802082 - DNA, 15 bp, Homo sapiens
gattggaaaataata

SEQ ID NO: 4802083 - DNA, 14 bp, Homo sapiens
gattggacctggcc

SEQ ID NO: 4802084 - DNA, 22 bp, Homo sapiens
gattgggggggcttggggtaga

SEQ ID NO: 4802085 - DNA, 21 bp, Homo sapiens
gattgtacagaatcattgctt

SEQ ID NO: 4802086 - DNA, 20 bp, Homo sapiens
gattgtatctgaactcacag

SEQ ID NO: 4802087 - DNA, 12 bp, Homo sapiens
gattgttcctcc

SEQ ID NO: 4802088 - DNA, 15 bp, Homo sapiens
gattgtttgatgaat

SEQ ID NO: 4802089 - DNA, 12 bp, Homo sapiens
gatttaattctt

SEQ ID NO: 4802090 - DNA, 15 bp, Homo sapiens
gatttactaacagta

SEQ ID NO: 4802091 - DNA, 13 bp, Homo sapiens
gatttattctcag

SEQ ID NO: 4802092 - DNA, 19 bp, Homo sapiens
gatttattttttgtaactc

SEQ ID NO: 4802093 - DNA, 14 bp, Homo sapiens
gatttcaatgattg

SEQ ID NO: 4802094 - DNA, 18 bp, Homo sapiens
gatttcatgattagacaa

SEQ ID NO: 4802095 - DNA, 17 bp, Homo sapiens
gatttgcaacactgcca

SEQ ID NO: 4802096 - DNA, 17 bp, Homo sapiens
gatttgggctgaatgta

SEQ ID NO: 4802097 - DNA, 18 bp, Homo sapiens
gatttgtaaaacagtggt

SEQ ID NO: 4802098 - DNA, 12 bp, Homo sapiens
gatttgtattaa

SEQ ID NO: 4802099 - DNA, 11 bp, Homo sapiens
gatttgttcat

SEQ ID NO: 4802100 - DNA, 23 bp, Homo sapiens
gattttatgtttaaaatggcatt

SEQ ID NO: 4802101 - DNA, 17 bp, Homo sapiens
gatttttgccctgcgtc

SEQ ID NO: 4802102 - DNA, 13 bp, Homo sapiens
gcaaaaatgaatt

SEQ ID NO: 4802103 - DNA, 15 bp, Homo sapiens
gcaaaaccattgctt

SEQ ID NO: 4802104 - DNA, 21 bp, Homo sapiens
gcaaaatacatgatgatttca

SEQ ID NO: 4802105 - DNA, 21 bp, Homo sapiens
gcaaaatatatgtttggctga

SEQ ID NO: 4802106 - DNA, 12 bp, Homo sapiens
gcaaaatgaaga

SEQ ID NO: 4802107 - DNA, 14 bp, Homo sapiens
gcaaacactgtgta

SEQ ID NO: 4802108 - DNA, 19 bp, Homo sapiens
gcaaacactgtgtatttat

SEQ ID NO: 4802109 - DNA, 11 bp, Homo sapiens
gcaaacattta

SEQ ID NO: 4802110 - DNA, 20 bp, Homo sapiens
gcaaacatttctttttcctt

SEQ ID NO: 4802111 - DNA, 18 bp, Homo sapiens
gcaaaccaatttgttctg

SEQ ID NO: 4802112 - DNA, 19 bp, Homo sapiens
gcaaaccaatttgttctgt

SEQ ID NO: 4802113 - DNA, 14 bp, Homo sapiens
gcaaaccaggctgc

SEQ ID NO: 4802114 - DNA, 22 bp, Homo sapiens
gcaaactgaaattagtgttttc

SEQ ID NO: 4802115 - DNA, 18 bp, Homo sapiens
gcaaagacagtttcttgc

SEQ ID NO: 4802116 - DNA, 19 bp, Homo sapiens
gcaaagacagtttcttgca

SEQ ID NO: 4802117 - DNA, 13 bp, Homo sapiens
gcaaagatccagc

SEQ ID NO: 4802118 - DNA, 17 bp, Homo sapiens
gcaaatagaaaacagga

SEQ ID NO: 4802119 - DNA, 18 bp, Homo sapiens
gcaaatccataccccctg

SEQ ID NO: 4802120 - DNA, 21 bp, Homo sapiens
gcaaatccataccccctgccc

SEQ ID NO: 4802121 - DNA, 18 bp, Homo sapiens
gcaaatctgtataaatgt

SEQ ID NO: 4802122 - DNA, 16 bp, Homo sapiens
gcaaatgacatgcact

SEQ ID NO: 4802123 - DNA, 19 bp, Homo sapiens
gcaaatgacatgcactgac

SEQ ID NO: 4802124 - DNA, 14 bp, Homo sapiens
gcaaattccaatac

SEQ ID NO: 4802125 - DNA, 18 bp, Homo sapiens
gcaacaacttactaaatc

SEQ ID NO: 4802126 - DNA, 12 bp, Homo sapiens
gcaacactgcca

SEQ ID NO: 4802127 - DNA, 18 bp, Homo sapiens
gcaacactgccaaacatc

SEQ ID NO: 4802128 - DNA, 16 bp, Homo sapiens
gcaacaggaccaggag

SEQ ID NO: 4802129 - DNA, 13 bp, Homo sapiens
gcaaccaccacca

SEQ ID NO: 4802130 - DNA, 18 bp, Homo sapiens
gcaaccaccaccaaccac

SEQ ID NO: 4802131 - DNA, 15 bp, Homo sapiens
gcaacctcactatgg

SEQ ID NO: 4802132 - DNA, 21 bp, Homo sapiens
gcaactgttagctgggaagaa

SEQ ID NO: 4802133 - DNA, 16 bp, Homo sapiens
gcaacttcagtcctgg

SEQ ID NO: 4802134 - DNA, 15 bp, Homo sapiens
gcaacttcccaggcc

SEQ ID NO: 4802135 - DNA, 16 bp, Homo sapiens
gcaacttcccaggccg

SEQ ID NO: 4802136 - DNA, 19 bp, Homo sapiens
gcaacttgaaattatatct

SEQ ID NO: 4802137 - DNA, 14 bp, Homo sapiens
gcaagaagaatata

SEQ ID NO: 4802138 - DNA, 16 bp, Homo sapiens
gcaagagctcaggaga

SEQ ID NO: 4802139 - DNA, 17 bp, Homo sapiens
gcaagagctcaggagaa

SEQ ID NO: 4802140 - DNA, 22 bp, Homo sapiens
gcaagatagctccttcatgctt

SEQ ID NO: 4802141 - DNA, 16 bp, Homo sapiens
gcaagcgacacaggct

SEQ ID NO: 4802142 - DNA, 18 bp, Homo sapiens
gcaagctcatagcacatg

SEQ ID NO: 4802143 - DNA, 20 bp, Homo sapiens
gcaagctcatagcacatgtt

SEQ ID NO: 4802144 - DNA, 16 bp, Homo sapiens
gcaagctccagtagct

SEQ ID NO: 4802145 - DNA, 18 bp, Homo sapiens
gcaagctccagtagctcc

SEQ ID NO: 4802146 - DNA, 16 bp, Homo sapiens
gcaaggacaagcaatt

SEQ ID NO: 4802147 - DNA, 17 bp, Homo sapiens
gcaaggcaagaagtggg

SEQ ID NO: 4802148 - DNA, 14 bp, Homo sapiens
gcaaggctgctaag

SEQ ID NO: 4802149 - DNA, 11 bp, Homo sapiens
gcaaggctgtc

SEQ ID NO: 4802150 - DNA, 13 bp, Homo sapiens
gcaaggctgtcaa

SEQ ID NO: 4802151 - DNA, 20 bp, Homo sapiens
gcaaggggaccgccccaggc

SEQ ID NO: 4802152 - DNA, 15 bp, Homo sapiens
gcaaggggccaggaa

SEQ ID NO: 4802153 - DNA, 21 bp, Homo sapiens
gcaaggggccaggaaggggac

SEQ ID NO: 4802154 - DNA, 22 bp, Homo sapiens
gcaaggtgaacaccactttgtc

SEQ ID NO: 4802155 - DNA, 21 bp, Homo sapiens
gcaaggtgcacctgccccagg

SEQ ID NO: 4802156 - DNA, 23 bp, Homo sapiens
gcaataaatgtcccaaataaatt

SEQ ID NO: 4802157 - DNA, 13 bp, Homo sapiens
gcaataacagttt

SEQ ID NO: 4802158 - DNA, 14 bp, Homo sapiens
gcaataacagtttt

SEQ ID NO: 4802159 - DNA, 22 bp, Homo sapiens
gcaataaggatttattctcaga

SEQ ID NO: 4802160 - DNA, 23 bp, Homo sapiens
gcaataaggggagagtaaccctg

SEQ ID NO: 4802161 - DNA, 22 bp, Homo sapiens
gcaatagtgttgaggaggggag

SEQ ID NO: 4802162 - DNA, 20 bp, Homo sapiens
gcaatatcttcgttagtaat

SEQ ID NO: 4802163 - DNA, 20 bp, Homo sapiens
gcaatccttaaaaagaccat

SEQ ID NO: 4802164 - DNA, 15 bp, Homo sapiens
gcaatctgtccagac

SEQ ID NO: 4802165 - DNA, 12 bp, Homo sapiens
gcaatcttgctg

SEQ ID NO: 4802166 - DNA, 23 bp, Homo sapiens
gcaatgttccgttcatctgagga

SEQ ID NO: 4802167 - DNA, 21 bp, Homo sapiens
gcaattgcttctctaaaacag

SEQ ID NO: 4802168 - DNA, 21 bp, Homo sapiens
gcaattgtttaagaatcatgg

SEQ ID NO: 4802169 - DNA, 18 bp, Homo sapiens
gcaatttgtttgtgcttc

SEQ ID NO: 4802170 - DNA, 20 bp, Homo sapiens
gcaatttgtttgtgcttcta

SEQ ID NO: 4802171 - DNA, 15 bp, Homo sapiens
gcacaaacagaggcc

SEQ ID NO: 4802172 - DNA, 14 bp, Homo sapiens
gcacaaaccttctt

SEQ ID NO: 4802173 - DNA, 15 bp, Homo sapiens
gcacaaaccttcttt

SEQ ID NO: 4802174 - DNA, 18 bp, Homo sapiens
gcacaaagcactggcctt

SEQ ID NO: 4802175 - DNA, 17 bp, Homo sapiens
gcacaaccatgttcttg

SEQ ID NO: 4802176 - DNA, 18 bp, Homo sapiens
gcacaaccatgttcttga

SEQ ID NO: 4802177 - DNA, 17 bp, Homo sapiens
gcacaagaagtttcttc

SEQ ID NO: 4802178 - DNA, 20 bp, Homo sapiens
gcacacaactgtggtcccag

SEQ ID NO: 4802179 - DNA, 14 bp, Homo sapiens
gcacacagcagccc

SEQ ID NO: 4802180 - DNA, 17 bp, Homo sapiens
gcacacagcagcccccc

SEQ ID NO: 4802181 - DNA, 15 bp, Homo sapiens
gcacacattgtgtta

SEQ ID NO: 4802182 - DNA, 21 bp, Homo sapiens
gcacaccaaattgctgagatg

SEQ ID NO: 4802183 - DNA, 17 bp, Homo sapiens
gcacaccctcactctgc

SEQ ID NO: 4802184 - DNA, 21 bp, Homo sapiens
gcacaccctcactctgccagg

SEQ ID NO: 4802185 - DNA, 23 bp, Homo sapiens
gcacacctcggccgaggcctgcg

SEQ ID NO: 4802186 - DNA, 17 bp, Homo sapiens
gcacactgagtttgaac

SEQ ID NO: 4802187 - DNA, 22 bp, Homo sapiens
gcacagaaaatggaagacagct

SEQ ID NO: 4802188 - DNA, 20 bp, Homo sapiens
gcacagcagcctgcttccca

SEQ ID NO: 4802189 - DNA, 19 bp, Homo sapiens
gcacagctaacatggaagt

SEQ ID NO: 4802190 - DNA, 18 bp, Homo sapiens
gcacagctactcagatct

SEQ ID NO: 4802191 - DNA, 14 bp, Homo sapiens
gcacaggtgtaaat

SEQ ID NO: 4802192 - DNA, 16 bp, Homo sapiens
gcacagtagtgttggg

SEQ ID NO: 4802193 - DNA, 20 bp, Homo sapiens
gcacagtagtgttgggtgga

SEQ ID NO: 4802194 - DNA, 23 bp, Homo sapiens
gcacagtagtgttgggtggagga

SEQ ID NO: 4802195 - DNA, 13 bp, Homo sapiens
gcacatgcctctc

SEQ ID NO: 4802196 - DNA, 14 bp, Homo sapiens
gcacatgcctctct

SEQ ID NO: 4802197 - DNA, 21 bp, Homo sapiens
gcacatgcctctctcaggcca

SEQ ID NO: 4802198 - DNA, 15 bp, Homo sapiens
gcacatgctggccag

SEQ ID NO: 4802199 - DNA, 23 bp, Homo sapiens
gcacatgttttacaaagaaacaa

SEQ ID NO: 4802200 - DNA, 15 bp, Homo sapiens
gcacattcatcctca

SEQ ID NO: 4802201 - DNA, 21 bp, Homo sapiens
gcacattcatcctcacatgtg

SEQ ID NO: 4802202 - DNA, 19 bp, Homo sapiens
gcatgtatgccatgtatgt

SEQ ID NO: 4802203 - DNA, 14 bp, Homo sapiens
gcatgtcacatgac

SEQ ID NO: 4802204 - DNA, 14 bp, Homo sapiens
gcatgtcggggccc

SEQ ID NO: 4802205 - DNA, 16 bp, Homo sapiens
gcatgtcggggcccct

SEQ ID NO: 4802206 - DNA, 17 bp, Homo sapiens
gcattatctctttctct

SEQ ID NO: 4802207 - DNA, 18 bp, Homo sapiens
gcattatctctttctctc

SEQ ID NO: 4802208 - DNA, 14 bp, Homo sapiens
gcattcgttgctcc

SEQ ID NO: 4802209 - DNA, 19 bp, Homo sapiens
gcattctggggtggggctt

SEQ ID NO: 4802210 - DNA, 13 bp, Homo sapiens
gcattgaaataat

SEQ ID NO: 4802211 - DNA, 15 bp, Homo sapiens
gcattgaccttcatg

SEQ ID NO: 4802212 - DNA, 14 bp, Homo sapiens
gcattgcactaaaa

SEQ ID NO: 4802213 - DNA, 15 bp, Homo sapiens
gcattgcactaaaag

SEQ ID NO: 4802214 - DNA, 19 bp, Homo sapiens
gcattggggggccgggcag

SEQ ID NO: 4802215 - DNA, 23 bp, Homo sapiens
gcatttaagaattgccagtcttt

SEQ ID NO: 4802216 - DNA, 18 bp, Homo sapiens
gcatttagcacagtattt

SEQ ID NO: 4802217 - DNA, 23 bp, Homo sapiens
gcatttagcacagtatttaacat

SEQ ID NO: 4802218 - DNA, 14 bp, Homo sapiens
gcatttatgcatga

SEQ ID NO: 4802219 - DNA, 22 bp, Homo sapiens
gcatttgctgaataacaacaat

SEQ ID NO: 4802220 - DNA, 20 bp, Homo sapiens
gcattttaatagtttctaaa

SEQ ID NO: 4802221 - DNA, 15 bp, Homo sapiens
gcattttgtacaatg

SEQ ID NO: 4802222 - DNA, 17 bp, Homo sapiens
gcatttttacctttcat

SEQ ID NO: 4802223 - DNA, 16 bp, Homo sapiens
gccaaaatgtcaattt

SEQ ID NO: 4802224 - DNA, 19 bp, Homo sapiens
gccaaaatgtcaattttta

SEQ ID NO: 4802225 - DNA, 22 bp, Homo sapiens
gccaaaatgtcaatttttaact

SEQ ID NO: 4802226 - DNA, 16 bp, Homo sapiens
gccaaactcacctgcc

SEQ ID NO: 4802227 - DNA, 16 bp, Homo sapiens
gccaaagatagcagaa

SEQ ID NO: 4802228 - DNA, 16 bp, Homo sapiens
gccaaaggaagcacat

SEQ ID NO: 4802229 - DNA, 16 bp, Homo sapiens
gccaaccccatcctca

SEQ ID NO: 4802230 - DNA, 15 bp, Homo sapiens
gccaactttccagac

SEQ ID NO: 4802231 - DNA, 16 bp, Homo sapiens
gccaagactctatgct

SEQ ID NO: 4802232 - DNA, 20 bp, Homo sapiens
gccaagccagggttccagac

SEQ ID NO: 4802233 - DNA, 22 bp, Homo sapiens
gccaagccagggttccagacag

SEQ ID NO: 4802234 - DNA, 16 bp, Homo sapiens
gccaaggacactgatg

SEQ ID NO: 4802235 - DNA, 15 bp, Homo sapiens
gccaaggccagccca

SEQ ID NO: 4802236 - DNA, 14 bp, Homo sapiens
gccaaggtctgaac

SEQ ID NO: 4802237 - DNA, 15 bp, Homo sapiens
gccaagtgtcctgct

SEQ ID NO: 4802238 - DNA, 21 bp, Homo sapiens
gccaataaagctcacacttgg

SEQ ID NO: 4802239 - DNA, 21 bp, Homo sapiens
gccaatgtccaggtcacaggc

SEQ ID NO: 4802240 - DNA, 20 bp, Homo sapiens
gccaatttcaaagaaaacag

SEQ ID NO: 4802241 - DNA, 20 bp, Homo sapiens
gccaatttctcttaagtact

SEQ ID NO: 4802242 - DNA, 19 bp, Homo sapiens
gccacaagggcagtggaag

SEQ ID NO: 4802243 - DNA, 14 bp, Homo sapiens
gccacaatgtgata

SEQ ID NO: 4802244 - DNA, 17 bp, Homo sapiens
gccacaatgtgatatgt

SEQ ID NO: 4802245 - DNA, 19 bp, Homo sapiens
gccacaatgtgatatgtgt

SEQ ID NO: 4802246 - DNA, 20 bp, Homo sapiens
gccacagcagcctctgaagt

SEQ ID NO: 4802247 - DNA, 15 bp, Homo sapiens
gccacagtggggccc

SEQ ID NO: 4802248 - DNA, 16 bp, Homo sapiens
gccacagtggggccca

SEQ ID NO: 4802249 - DNA, 20 bp, Homo sapiens
gccacagtggggcccatggc

SEQ ID NO: 4802250 - DNA, 21 bp, Homo sapiens
gccacagtggggcccatggcc

SEQ ID NO: 4802251 - DNA, 22 bp, Homo sapiens
gccacagtggggcccatggccc

SEQ ID NO: 4802252 - DNA, 17 bp, Homo sapiens
gccacatcgcagcccct

SEQ ID NO: 4802253 - DNA, 13 bp, Homo sapiens
gccacccacccca

SEQ ID NO: 4802254 - DNA, 15 bp, Homo sapiens
gccaccctctgctgc

SEQ ID NO: 4802255 - DNA, 18 bp, Homo sapiens
gccaccttgtacagaacc

SEQ ID NO: 4802256 - DNA, 19 bp, Homo sapiens
gccacgctgtcctctcgag

SEQ ID NO: 4802257 - DNA, 22 bp, Homo sapiens
gccacgctgtcctctcgagccc

SEQ ID NO: 4802258 - DNA, 18 bp, Homo sapiens
gccacggggactcagccc

SEQ ID NO: 4802259 - DNA, 14 bp, Homo sapiens
gccacgtggccgct

SEQ ID NO: 4802260 - DNA, 21 bp, Homo sapiens
gccacgtggccgctgcccacg

SEQ ID NO: 4802261 - DNA, 21 bp, Homo sapiens
gccactattgttagtctcttg

SEQ ID NO: 4802262 - DNA, 20 bp, Homo sapiens
gccactggaaacttttggga

SEQ ID NO: 4802263 - DNA, 20 bp, Homo sapiens
gccacttagggagtgtgcct

SEQ ID NO: 4802264 - DNA, 19 bp, Homo sapiens
gccagaccacgcccctgcc

SEQ ID NO: 4802265 - DNA, 22 bp, Homo sapiens
gccagacttctaaaataaatgt

SEQ ID NO: 4802266 - DNA, 20 bp, Homo sapiens
gccagagacacaagccttcg

SEQ ID NO: 4802267 - DNA, 12 bp, Homo sapiens
gccagaggagag

SEQ ID NO: 4802268 - DNA, 13 bp, Homo sapiens
gccagaggagaga

SEQ ID NO: 4802269 - DNA, 13 bp, Homo sapiens
gccagagtgtcct

SEQ ID NO: 4802270 - DNA, 14 bp, Homo sapiens
gccagagtgtcctg

SEQ ID NO: 4802271 - DNA, 16 bp, Homo sapiens
gccagatgacagggag

SEQ ID NO: 4802272 - DNA, 16 bp, Homo sapiens
gccagcaccctctcct

SEQ ID NO: 4802273 - DNA, 19 bp, Homo sapiens
gccagcaccctctcctggg

SEQ ID NO: 4802274 - DNA, 21 bp, Homo sapiens
gccagcaggctctcaggccag

SEQ ID NO: 4802275 - DNA, 13 bp, Homo sapiens
gccagcccgcaga

SEQ ID NO: 4802276 - DNA, 20 bp, Homo sapiens
gccagccctgttccgcctca

SEQ ID NO: 4802277 - DNA, 17 bp, Homo sapiens
gccagccgccctgggct

SEQ ID NO: 4802278 - DNA, 20 bp, Homo sapiens
gccagccgccctgggctgtc

SEQ ID NO: 4802279 - DNA, 16 bp, Homo sapiens
gccagcctggggcctg

SEQ ID NO: 4802280 - DNA, 18 bp, Homo sapiens
gccagcctggggcctggc

SEQ ID NO: 4802281 - DNA, 20 bp, Homo sapiens
gccagcctggggcctggcag

SEQ ID NO: 4802282 - DNA, 14 bp, Homo sapiens
gccagcgctgaaca

SEQ ID NO: 4802283 - DNA, 13 bp, Homo sapiens
gccagctctgagc

SEQ ID NO: 4802284 - DNA, 20 bp, Homo sapiens
gccagctgcaggaatcaaaa

SEQ ID NO: 4802285 - DNA, 15 bp, Homo sapiens
gccagctgcttgggc

SEQ ID NO: 4802286 - DNA, 17 bp, Homo sapiens
gccagctgcttgggctt

SEQ ID NO: 4802287 - DNA, 20 bp, Homo sapiens
gccagctgcttgggcttcat

SEQ ID NO: 4802288 - DNA, 17 bp, Homo sapiens
gccagctggtgaatcca

SEQ ID NO: 4802289 - DNA, 14 bp, Homo sapiens
gccaggaagccagc

SEQ ID NO: 4802290 - DNA, 15 bp, Homo sapiens
gccaggaagccagca

SEQ ID NO: 4802291 - DNA, 17 bp, Homo sapiens
gccaggaagccagcagg

SEQ ID NO: 4802292 - DNA, 13 bp, Homo sapiens
gccaggaagggga

SEQ ID NO: 4802293 - DNA, 16 bp, Homo sapiens
gccaggaaggggacag

SEQ ID NO: 4802294 - DNA, 17 bp, Homo sapiens
gccaggaaggggacagg

SEQ ID NO: 4802295 - DNA, 20 bp, Homo sapiens
gccaggaaggggacaggatt

SEQ ID NO: 4802296 - DNA, 17 bp, Homo sapiens
gccaggagaccctgtct

SEQ ID NO: 4802297 - DNA, 13 bp, Homo sapiens
gccaggagtgggt

SEQ ID NO: 4802298 - DNA, 20 bp, Homo sapiens
gccaggagtgggtttccctg

SEQ ID NO: 4802299 - DNA, 21 bp, Homo sapiens
gccaggagtgggtttccctgc

SEQ ID NO: 4802300 - DNA, 22 bp, Homo sapiens
gccaggcaacttcagtcctggg

SEQ ID NO: 4802301 - DNA, 17 bp, Homo sapiens
gccaggcacggaggctc

SEQ ID NO: 4802302 - DNA, 15 bp, Homo sapiens
gccaggccctctctg

SEQ ID NO: 4802303 - DNA, 16 bp, Homo sapiens
gccaggccctctctgc

SEQ ID NO: 4802304 - DNA, 18 bp, Homo sapiens
gccaggccctctctgcag

SEQ ID NO: 4802305 - DNA, 19 bp, Homo sapiens
gccaggccctctctgcagt

SEQ ID NO: 4802306 - DNA, 18 bp, Homo sapiens
gccaggctggagtgcagt

SEQ ID NO: 4802307 - DNA, 14 bp, Homo sapiens
gccagggagcgagt

SEQ ID NO: 4802308 - DNA, 20 bp, Homo sapiens
gccaggggcttctccccctc

SEQ ID NO: 4802309 - DNA, 23 bp, Homo sapiens
gccaggggcttctccccctcagc

SEQ ID NO: 4802310 - DNA, 14 bp, Homo sapiens
gccagggttccaga

SEQ ID NO: 4802311 - DNA, 17 bp, Homo sapiens
gccagggttccagacag

SEQ ID NO: 4802312 - DNA, 13 bp, Homo sapiens
gccaggtgtcctg

SEQ ID NO: 4802313 - DNA, 19 bp, Homo sapiens
gccagtggtggaggtgggt

SEQ ID NO: 4802314 - DNA, 17 bp, Homo sapiens
gccataacttgtttgta

SEQ ID NO: 4802315 - DNA, 15 bp, Homo sapiens
gccatagccccaggc

SEQ ID NO: 4802316 - DNA, 12 bp, Homo sapiens
gccatcacgctt

SEQ ID NO: 4802317 - DNA, 18 bp, Homo sapiens
gccatccaccctgaggag

SEQ ID NO: 4802318 - DNA, 22 bp, Homo sapiens
gccatgatctgtatttaatggt

SEQ ID NO: 4802319 - DNA, 12 bp, Homo sapiens
gccatggctgga

SEQ ID NO: 4802320 - DNA, 17 bp, Homo sapiens
gccatgtaggctaagaa

SEQ ID NO: 4802321 - DNA, 20 bp, Homo sapiens
gccatgtatgttgcatgaat

SEQ ID NO: 4802322 - DNA, 18 bp, Homo sapiens
gccatgtgtgtcagccca

SEQ ID NO: 4802323 - DNA, 19 bp, Homo sapiens
gccattctgattggacctg

SEQ ID NO: 4802324 - DNA, 11 bp, Homo sapiens
gccctgtggga

SEQ ID NO: 4802325 - DNA, 21 bp, Homo sapiens
gccctgtgggagtccactttc

SEQ ID NO: 4802326 - DNA, 14 bp, Homo sapiens
gccctgtttccaat

SEQ ID NO: 4802327 - DNA, 15 bp, Homo sapiens
gcccttcccaacctc

SEQ ID NO: 4802328 - DNA, 18 bp, Homo sapiens
gcccttcccaacctcccc

SEQ ID NO: 4802329 - DNA, 13 bp, Homo sapiens
gcccttccttcac

SEQ ID NO: 4802330 - DNA, 15 bp, Homo sapiens
gcccttccttcaccc

SEQ ID NO: 4802331 - DNA, 20 bp, Homo sapiens
gcccttccttcacccaccac

SEQ ID NO: 4802332 - DNA, 21 bp, Homo sapiens
gcccttccttcacccaccacc

SEQ ID NO: 4802333 - DNA, 19 bp, Homo sapiens
gccgaggaagggcccccgg

SEQ ID NO: 4802334 - DNA, 18 bp, Homo sapiens
gccgaggagccaggcaac

SEQ ID NO: 4802335 - DNA, 17 bp, Homo sapiens
gccgatataagccatag

SEQ ID NO: 4802336 - DNA, 18 bp, Homo sapiens
gccgcaacttcccaggcc

SEQ ID NO: 4802337 - DNA, 23 bp, Homo sapiens
gccgcagggcgctccggcagagg

SEQ ID NO: 4802338 - DNA, 12 bp, Homo sapiens
gccgccctgggc

SEQ ID NO: 4802339 - DNA, 13 bp, Homo sapiens
gccgccctgggct

SEQ ID NO: 4802340 - DNA, 24 bp, Homo sapiens
gccgccctgggctgtctgtcacca

SEQ ID NO: 4802341 - DNA, 18 bp, Homo sapiens
gccgccgaagggcagccc

SEQ ID NO: 4802342 - DNA, 20 bp, Homo sapiens
gccgccgaagggcagccccg

SEQ ID NO: 4802343 - DNA, 14 bp, Homo sapiens
gccgcctcaccttc

SEQ ID NO: 4802344 - DNA, 19 bp, Homo sapiens
gccgcctcaccttccttga

SEQ ID NO: 4802345 - DNA, 14 bp, Homo sapiens
gccgcctccctcac

SEQ ID NO: 4802346 - DNA, 17 bp, Homo sapiens
gccgcctccctcacccg

SEQ ID NO: 4802347 - DNA, 20 bp, Homo sapiens
gccgcctccctcacccggca

SEQ ID NO: 4802348 - DNA, 12 bp, Homo sapiens
gccgcctcctcc

SEQ ID NO: 4802349 - DNA, 13 bp, Homo sapiens
gccgcctcctcca

SEQ ID NO: 4802350 - DNA, 15 bp, Homo sapiens
gccgcctcctccaga

SEQ ID NO: 4802351 - DNA, 16 bp, Homo sapiens
gccgcctcgggccgcc

SEQ ID NO: 4802352 - DNA, 20 bp, Homo sapiens
gccgcctcgggccgcctcct

SEQ ID NO: 4802353 - DNA, 23 bp, Homo sapiens
gccgcctcgggccgcctcctcca

SEQ ID NO: 4802354 - DNA, 24 bp, Homo sapiens
gccgcctcgggccgcctcctccag

SEQ ID NO: 4802355 - DNA, 13 bp, Homo sapiens
gccgcgctctgcc

SEQ ID NO: 4802356 - DNA, 14 bp, Homo sapiens
gccgcgctctgccc

SEQ ID NO: 4802357 - DNA, 23 bp, Homo sapiens
gccgcgggcgagaagggcgcagg

SEQ ID NO: 4802358 - DNA, 19 bp, Homo sapiens
gccgctgcagtcagcacag

SEQ ID NO: 4802359 - DNA, 12 bp, Homo sapiens
gccgctgcccac

SEQ ID NO: 4802360 - DNA, 15 bp, Homo sapiens
gccgctgccgctgca

SEQ ID NO: 4802361 - DNA, 12 bp, Homo sapiens
gccgctggaggc

SEQ ID NO: 4802362 - DNA, 22 bp, Homo sapiens
gccgcttaaacatttccctgct

SEQ ID NO: 4802363 - DNA, 13 bp, Homo sapiens
gccggcgccccgg

SEQ ID NO: 4802364 - DNA, 21 bp, Homo sapiens
gccggctggccggtccacccc

SEQ ID NO: 4802365 - DNA, 17 bp, Homo sapiens
gccgggcaggtcctgcc

SEQ ID NO: 4802366 - DNA, 14 bp, Homo sapiens
gccggggctggccc

SEQ ID NO: 4802367 - DNA, 18 bp, Homo sapiens
gccggggctggccctgcc

SEQ ID NO: 4802368 - DNA, 18 bp, Homo sapiens
gccgggtcgcctgccctg

SEQ ID NO: 4802369 - DNA, 13 bp, Homo sapiens
gccggtccacccc

SEQ ID NO: 4802370 - DNA, 14 bp, Homo sapiens
gccggtccaccccg

SEQ ID NO: 4802371 - DNA, 17 bp, Homo sapiens
gccggtcccccatgcca

SEQ ID NO: 4802372 - DNA, 22 bp, Homo sapiens
gccggtcccccatgccaccacc

SEQ ID NO: 4802373 - DNA, 19 bp, Homo sapiens
gccggtggggccagcgctg

SEQ ID NO: 4802374 - DNA, 15 bp, Homo sapiens
gccggttggccggct

SEQ ID NO: 4802375 - DNA, 19 bp, Homo sapiens
gccggttggccggctggcc

SEQ ID NO: 4802376 - DNA, 15 bp, Homo sapiens
gcctaataaacaatt

SEQ ID NO: 4802377 - DNA, 22 bp, Homo sapiens
gcctaatattcatgctgcctgc

SEQ ID NO: 4802378 - DNA, 13 bp, Homo sapiens
gcctaccacagct

SEQ ID NO: 4802379 - DNA, 19 bp, Homo sapiens
gcctaccacagctgcctcc

SEQ ID NO: 4802380 - DNA, 17 bp, Homo sapiens
gcctaggatcttcactg

SEQ ID NO: 4802381 - DNA, 15 bp, Homo sapiens
gcctatatttataaa

SEQ ID NO: 4802382 - DNA, 14 bp, Homo sapiens
gcctatgaccctgt

SEQ ID NO: 4802383 - DNA, 15 bp, Homo sapiens
gcctatgaccctgtg

SEQ ID NO: 4802384 - DNA, 21 bp, Homo sapiens
gcctattgtaatatagaaaaa

SEQ ID NO: 4802385 - DNA, 19 bp, Homo sapiens
gcctcaccagccctggcaa

SEQ ID NO: 4802386 - DNA, 14 bp, Homo sapiens
gcctcacccttgcg

SEQ ID NO: 4802387 - DNA, 20 bp, Homo sapiens
gcctcacctggcttcccagg

SEQ ID NO: 4802388 - DNA, 21 bp, Homo sapiens
gcctcacctggcttcccagga

SEQ ID NO: 4802389 - DNA, 16 bp, Homo sapiens
gcctcagccctcagaa

SEQ ID NO: 4802390 - DNA, 12 bp, Homo sapiens
gcctcaggtcct

SEQ ID NO: 4802391 - DNA, 17 bp, Homo sapiens
gcctcagtccctccctc

SEQ ID NO: 4802392 - DNA, 22 bp, Homo sapiens
gcctcagtccctccctcctggc

SEQ ID NO: 4802393 - DNA, 16 bp, Homo sapiens
gcctcagttcaacctg

SEQ ID NO: 4802394 - DNA, 21 bp, Homo sapiens
gcctcatcttccttctcagcc

SEQ ID NO: 4802395 - DNA, 18 bp, Homo sapiens
gcctccaagtcatgggag

SEQ ID NO: 4802396 - DNA, 12 bp, Homo sapiens
gcctccagaacc

SEQ ID NO: 4802397 - DNA, 17 bp, Homo sapiens
gcctccaggttcctcaa

SEQ ID NO: 4802398 - DNA, 23 bp, Homo sapiens
gcctccatccacacacagcagct

SEQ ID NO: 4802399 - DNA, 18 bp, Homo sapiens
gcctcccagccctgccca

SEQ ID NO: 4802400 - DNA, 19 bp, Homo sapiens
gcctcccagccctgcccag

SEQ ID NO: 4802401 - DNA, 14 bp, Homo sapiens
gcctcccaggttca

SEQ ID NO: 4802402 - DNA, 12 bp, Homo sapiens
gcctcccccagg

SEQ ID NO: 4802403 - DNA, 13 bp, Homo sapiens
gcctcccccaggc

SEQ ID NO: 4802404 - DNA, 19 bp, Homo sapiens
gcctcccccaggctgcgcc

SEQ ID NO: 4802405 - DNA, 15 bp, Homo sapiens
gcctccccctcagat

SEQ ID NO: 4802406 - DNA, 22 bp, Homo sapiens
gcctccccctcagatgatctct

SEQ ID NO: 4802407 - DNA, 15 bp, Homo sapiens
gcctccccgggggtc

SEQ ID NO: 4802408 - DNA, 21 bp, Homo sapiens
gcctccccgggggtccccgga

SEQ ID NO: 4802409 - DNA, 17 bp, Homo sapiens
gcctcccgcatgctgcc

SEQ ID NO: 4802410 - DNA, 21 bp, Homo sapiens
gcctcccgcatgctgcctgcc

SEQ ID NO: 4802411 - DNA, 13 bp, Homo sapiens
gcctcccgccgcc

SEQ ID NO: 4802412 - DNA, 22 bp, Homo sapiens
gcctcccggggtgcccgtgtgg

SEQ ID NO: 4802413 - DNA, 14 bp, Homo sapiens
gcctccggccctgc

SEQ ID NO: 4802414 - DNA, 15 bp, Homo sapiens
gcctccggccctgcc

SEQ ID NO: 4802415 - DNA, 23 bp, Homo sapiens
gcctccggccctgccccacacag

SEQ ID NO: 4802416 - DNA, 14 bp, Homo sapiens
gcctccgggcctcg

SEQ ID NO: 4802417 - DNA, 16 bp, Homo sapiens
gcctccgggcctcggc

SEQ ID NO: 4802418 - DNA, 22 bp, Homo sapiens
gcctccgggcctcggcctggct

SEQ ID NO: 4802419 - DNA, 23 bp, Homo sapiens
gcctccgggcctcggcctggctt

SEQ ID NO: 4802420 - DNA, 14 bp, Homo sapiens
gcctcctagcctct

SEQ ID NO: 4802421 - DNA, 15 bp, Homo sapiens
gcctcctagcctctc

SEQ ID NO: 4802422 - DNA, 15 bp, Homo sapiens
gcctcctggccagac

SEQ ID NO: 4802423 - DNA, 19 bp, Homo sapiens
gcctcctggccagacgctg

SEQ ID NO: 4802424 - DNA, 16 bp, Homo sapiens
gcctcgcccccgggcc

SEQ ID NO: 4802425 - DNA, 12 bp, Homo sapiens
gcctcggcctgg

SEQ ID NO: 4802426 - DNA, 13 bp, Homo sapiens
gcctcggcctggc

SEQ ID NO: 4802427 - DNA, 14 bp, Homo sapiens
gcctcgggccgcct

SEQ ID NO: 4802428 - DNA, 22 bp, Homo sapiens
gcctcgggccgcctcctccaga

SEQ ID NO: 4802429 - DNA, 21 bp, Homo sapiens
gcctctcagtatcttaaaatt

SEQ ID NO: 4802430 - DNA, 16 bp, Homo sapiens
gcctctccgcccacgc

SEQ ID NO: 4802431 - DNA, 19 bp, Homo sapiens
gcctctctggaagagggag

SEQ ID NO: 4802432 - DNA, 15 bp, Homo sapiens
gcctctgatatggga

SEQ ID NO: 4802433 - DNA, 19 bp, Homo sapiens
gcctctgatatgggactga

SEQ ID NO: 4802434 - DNA, 19 bp, Homo sapiens
gcctctgcccctcttccct

SEQ ID NO: 4802435 - DNA, 12 bp, Homo sapiens
gcctctgtcctg

SEQ ID NO: 4802436 - DNA, 23 bp, Homo sapiens
gcctcttgaatgcttaaatgatc

SEQ ID NO: 4802437 - DNA, 18 bp, Homo sapiens
gcctcttgagagccccac

SEQ ID NO: 4802438 - DNA, 15 bp, Homo sapiens
gcctctttaaattat

SEQ ID NO: 4802439 - DNA, 17 bp, Homo sapiens
gcctctttaaattatga

SEQ ID NO: 4802440 - DNA, 13 bp, Homo sapiens
gcctgagaagagt

SEQ ID NO: 4802441 - DNA, 22 bp, Homo sapiens
gcctgagaattgaggggaggtg

SEQ ID NO: 4802442 - DNA, 12 bp, Homo sapiens
gcctgagccaca

SEQ ID NO: 4802443 - DNA, 22 bp, Homo sapiens
gcctgagccacagtggggccca

SEQ ID NO: 4802444 - DNA, 16 bp, Homo sapiens
gcctgagctccaccct

SEQ ID NO: 4802445 - DNA, 22 bp, Homo sapiens
gcctgagctccaccctcccctc

SEQ ID NO: 4802446 - DNA, 15 bp, Homo sapiens
gcgccggcgccccgg

SEQ ID NO: 4802447 - DNA, 17 bp, Homo sapiens
gcgccggcgccccggac

SEQ ID NO: 4802448 - DNA, 14 bp, Homo sapiens
gcgcctcctcctgc

SEQ ID NO: 4802449 - DNA, 15 bp, Homo sapiens
gcgcctcctcctgca

SEQ ID NO: 4802450 - DNA, 11 bp, Homo sapiens
gcgcctgcccg

SEQ ID NO: 4802451 - DNA, 16 bp, Homo sapiens
gcgcctgcgcctcctc

SEQ ID NO: 4802452 - DNA, 21 bp, Homo sapiens
gcgcctgcgcctcctcctgca

SEQ ID NO: 4802453 - DNA, 23 bp, Homo sapiens
gcgcctgcgctcctctgcagcct

SEQ ID NO: 4802454 - DNA, 14 bp, Homo sapiens
gcgcgcaccgccca

SEQ ID NO: 4802455 - DNA, 22 bp, Homo sapiens
gcgcgcaccgcccaacccccac

SEQ ID NO: 4802456 - DNA, 16 bp, Homo sapiens
gcgcgcccccaggacc

SEQ ID NO: 4802457 - DNA, 14 bp, Homo sapiens
gcgcgcgcccccag

SEQ ID NO: 4802458 - DNA, 22 bp, Homo sapiens
gcgcgcgggacagcggccccgc

SEQ ID NO: 4802459 - DNA, 13 bp, Homo sapiens
gcgcgtgccccca

SEQ ID NO: 4802460 - DNA, 23 bp, Homo sapiens
gcgctagagcattctggggtggg

SEQ ID NO: 4802461 - DNA, 15 bp, Homo sapiens
gcgctatccacagaa

SEQ ID NO: 4802462 - DNA, 20 bp, Homo sapiens
gcgctccggcagaggcaggg

SEQ ID NO: 4802463 - DNA, 14 bp, Homo sapiens
gcgctcctcccagc

SEQ ID NO: 4802464 - DNA, 17 bp, Homo sapiens
gcgctcctcccagctgt

SEQ ID NO: 4802465 - DNA, 21 bp, Homo sapiens
gcgctcctctgcagcctgagc

SEQ ID NO: 4802466 - DNA, 23 bp, Homo sapiens
gcgctcctctgcagcctgagctc

SEQ ID NO: 4802467 - DNA, 18 bp, Homo sapiens
gcgctctgcccctccgtc

SEQ ID NO: 4802468 - DNA, 14 bp, Homo sapiens
gcgctgagggcagg

SEQ ID NO: 4802469 - DNA, 14 bp, Homo sapiens
gcgctgcccccaca

SEQ ID NO: 4802470 - DNA, 17 bp, Homo sapiens
gcgctgcccctggcagc

SEQ ID NO: 4802471 - DNA, 21 bp, Homo sapiens
gcgctgcccctggcagcccct

SEQ ID NO: 4802472 - DNA, 18 bp, Homo sapiens
gcggaccggagcggctga

SEQ ID NO: 4802473 - DNA, 12 bp, Homo sapiens
gcggagcccccg

SEQ ID NO: 4802474 - DNA, 17 bp, Homo sapiens
gcggagcccccgcccct

SEQ ID NO: 4802475 - DNA, 19 bp, Homo sapiens
gcggagcccccgcccctcc

SEQ ID NO: 4802476 - DNA, 20 bp, Homo sapiens
gcggagcccccgcccctccc

SEQ ID NO: 4802477 - DNA, 11 bp, Homo sapiens
gcggaggcccc

SEQ ID NO: 4802478 - DNA, 16 bp, Homo sapiens
gcggaggggcttggag

SEQ ID NO: 4802479 - DNA, 23 bp, Homo sapiens
gcggaggggcttggagcagagac

SEQ ID NO: 4802480 - DNA, 12 bp, Homo sapiens
gcggcaccgccc

SEQ ID NO: 4802481 - DNA, 16 bp, Homo sapiens
gcggcaccgcccaccc

SEQ ID NO: 4802482 - DNA, 17 bp, Homo sapiens
gcggcaccgcccaccca

SEQ ID NO: 4802483 - DNA, 17 bp, Homo sapiens
gcggcccggcccacgca

SEQ ID NO: 4802484 - DNA, 22 bp, Homo sapiens
gcggcccggcccacgcagagcc

SEQ ID NO: 4802485 - DNA, 16 bp, Homo sapiens
gcggcccgtgcgcagc

SEQ ID NO: 4802486 - DNA, 22 bp, Homo sapiens
gcggcccgtgcgcagccgcgct

SEQ ID NO: 4802487 - DNA, 22 bp, Homo sapiens
gcggcggtggactgcgctggac

SEQ ID NO: 4802488 - DNA, 13 bp, Homo sapiens
gcggctctgggaa

SEQ ID NO: 4802489 - DNA, 14 bp, Homo sapiens
gcggctctgggaag

SEQ ID NO: 4802490 - DNA, 14 bp, Homo sapiens
gcggctcttcctgg

SEQ ID NO: 4802491 - DNA, 15 bp, Homo sapiens
gcggctcttcctgga

SEQ ID NO: 4802492 - DNA, 12 bp, Homo sapiens
gcggctgaggac

SEQ ID NO: 4802493 - DNA, 14 bp, Homo sapiens
gcggcttccctgcg

SEQ ID NO: 4802494 - DNA, 16 bp, Homo sapiens
gcggcttccctgcgac

SEQ ID NO: 4802495 - DNA, 18 bp, Homo sapiens
gcgggacagcggccccgc

SEQ ID NO: 4802496 - DNA, 18 bp, Homo sapiens
gcgggagtctcctcactg

SEQ ID NO: 4802497 - DNA, 14 bp, Homo sapiens
gcgggcagcccctg

SEQ ID NO: 4802498 - DNA, 11 bp, Homo sapiens
gcgggccagga

SEQ ID NO: 4802499 - DNA, 22 bp, Homo sapiens
gcgggccatttcacattcctga

SEQ ID NO: 4802500 - DNA, 14 bp, Homo sapiens
gcgggcgcgggaca

SEQ ID NO: 4802501 - DNA, 20 bp, Homo sapiens
gcggggcggcatccgagccc

SEQ ID NO: 4802502 - DNA, 20 bp, Homo sapiens
gcgggggctaactggcccca

SEQ ID NO: 4802503 - DNA, 22 bp, Homo sapiens
gcgggggctaactggccccagg

SEQ ID NO: 4802504 - DNA, 15 bp, Homo sapiens
gcggtcactgcccac

SEQ ID NO: 4802505 - DNA, 22 bp, Homo sapiens
gcggtgtgagatggtgccccct

SEQ ID NO: 4802506 - DNA, 14 bp, Homo sapiens
gcgtccacatacac

SEQ ID NO: 4802507 - DNA, 20 bp, Homo sapiens
gcgtccctgagggcccttcc

SEQ ID NO: 4802508 - DNA, 16 bp, Homo sapiens
gcgtcctttcctctcc

SEQ ID NO: 4802509 - DNA, 21 bp, Homo sapiens
gcgtcctttcctctcctctct

SEQ ID NO: 4802510 - DNA, 14 bp, Homo sapiens
gcgtctacccagac

SEQ ID NO: 4802511 - DNA, 16 bp, Homo sapiens
gcgtcttgtattttct

SEQ ID NO: 4802512 - DNA, 15 bp, Homo sapiens
gcgtgaccggcccgc

SEQ ID NO: 4802513 - DNA, 20 bp, Homo sapiens
gcgtgaccggcccgccacct

SEQ ID NO: 4802514 - DNA, 12 bp, Homo sapiens
gcgtgatctcag

SEQ ID NO: 4802515 - DNA, 15 bp, Homo sapiens
gcgtgatctcagctc

SEQ ID NO: 4802516 - DNA, 14 bp, Homo sapiens
gcgtgcccccagcg

SEQ ID NO: 4802517 - DNA, 22 bp, Homo sapiens
gcgtgccttccccgtgcggccc

SEQ ID NO: 4802518 - DNA, 15 bp, Homo sapiens
gcgtgctccttttct

SEQ ID NO: 4802519 - DNA, 20 bp, Homo sapiens
gcgtgcttgcatgtgctgca

SEQ ID NO: 4802520 - DNA, 19 bp, Homo sapiens
gcgtggcttggcattgacc

SEQ ID NO: 4802521 - DNA, 18 bp, Homo sapiens
gcgtgtcctatccccgga

SEQ ID NO: 4802522 - DNA, 18 bp, Homo sapiens
gcgtgtggccctgtggga

SEQ ID NO: 4802523 - DNA, 21 bp, Homo sapiens
gcgtgtggccctgtgggagtc

SEQ ID NO: 4802524 - DNA, 17 bp, Homo sapiens
gcgttgttttgtggata

SEQ ID NO: 4802525 - DNA, 14 bp, Homo sapiens
gcgtttttttacaa

SEQ ID NO: 4802526 - DNA, 18 bp, Homo sapiens
gctaaacctatctgtatt

SEQ ID NO: 4802527 - DNA, 13 bp, Homo sapiens
gctaaatgcaaac

SEQ ID NO: 4802528 - DNA, 20 bp, Homo sapiens
gctaaatgcaaacactgtgt

SEQ ID NO: 4802529 - DNA, 21 bp, Homo sapiens
gctaaatgcaaacactgtgta

SEQ ID NO: 4802530 - DNA, 18 bp, Homo sapiens
gctaaatgcctaataaac

SEQ ID NO: 4802531 - DNA, 19 bp, Homo sapiens
gctaaatgcctaataaaca

SEQ ID NO: 4802532 - DNA, 13 bp, Homo sapiens
gctaacaataaag

SEQ ID NO: 4802533 - DNA, 14 bp, Homo sapiens
gctaacaataaagt

SEQ ID NO: 4802534 - DNA, 13 bp, Homo sapiens
gctaacgggcgcc

SEQ ID NO: 4802535 - DNA, 22 bp, Homo sapiens
gctaagataattaaatgaaata

SEQ ID NO: 4802536 - DNA, 16 bp, Homo sapiens
gctaatgaattttaaa

SEQ ID NO: 4802537 - DNA, 23 bp, Homo sapiens
gctaatgaattttaaaagcatat

SEQ ID NO: 4802538 - DNA, 13 bp, Homo sapiens
gctaatttgtgaa

SEQ ID NO: 4802539 - DNA, 16 bp, Homo sapiens
gctacaaaatgtgtgc

SEQ ID NO: 4802540 - DNA, 14 bp, Homo sapiens
gctacacaggggaa

SEQ ID NO: 4802541 - DNA, 15 bp, Homo sapiens
gctacatcagagtgt

SEQ ID NO: 4802542 - DNA, 13 bp, Homo sapiens
gctactcagatct

SEQ ID NO: 4802543 - DNA, 13 bp, Homo sapiens
gctagaaaaatta

SEQ ID NO: 4802544 - DNA, 21 bp, Homo sapiens
gctagacgagcaggcttcttc

SEQ ID NO: 4802545 - DNA, 14 bp, Homo sapiens
gctagccatatatt

SEQ ID NO: 4802546 - DNA, 15 bp, Homo sapiens
gctagtgagctgggc

SEQ ID NO: 4802547 - DNA, 19 bp, Homo sapiens
gctagtgttaatccagaga

SEQ ID NO: 4802548 - DNA, 21 bp, Homo sapiens
gctagtgttaatccagagaac

SEQ ID NO: 4802549 - DNA, 19 bp, Homo sapiens
gctagttagagactcgcct

SEQ ID NO: 4802550 - DNA, 21 bp, Homo sapiens
gctatccacagaacctttgtc

SEQ ID NO: 4802551 - DNA, 13 bp, Homo sapiens
gctatcttcatgt

SEQ ID NO: 4802552 - DNA, 19 bp, Homo sapiens
gctatcttcatgtaaattg

SEQ ID NO: 4802553 - DNA, 13 bp, Homo sapiens
gctatgcacacca

SEQ ID NO: 4802554 - DNA, 15 bp, Homo sapiens
gctatgtctcatgtt

SEQ ID NO: 4802555 - DNA, 16 bp, Homo sapiens
gctatgtctcatgttt

SEQ ID NO: 4802556 - DNA, 19 bp, Homo sapiens
gctattaacaattaattgt

SEQ ID NO: 4802557 - DNA, 12 bp, Homo sapiens
gctattaagaaa

SEQ ID NO: 4802558 - DNA, 14 bp, Homo sapiens
gctattcacacaca

SEQ ID NO: 4802559 - DNA, 15 bp, Homo sapiens
gctattcccaggcag

SEQ ID NO: 4802560 - DNA, 17 bp, Homo sapiens
gctattcgtaagttctg

SEQ ID NO: 4802561 - DNA, 18 bp, Homo sapiens
gctattcgtaagttctgt

SEQ ID NO: 4802562 - DNA, 20 bp, Homo sapiens
gctattcgtaagttctgtgc

SEQ ID NO: 4802563 - DNA, 15 bp, Homo sapiens
gctattgtccttgtg

SEQ ID NO: 4802564 - DNA, 21 bp, Homo sapiens
gctattgtccttgtgtatcct

SEQ ID NO: 4802565 - DNA, 20 bp, Homo sapiens
gctatttaagtggactgtat

SEQ ID NO: 4802566 - DNA, 22 bp, Homo sapiens
gctatttaagtggactgtattt

SEQ ID NO: 4802567 - DNA, 18 bp, Homo sapiens
gctcaagtttcagagtca

SEQ ID NO: 4802568 - DNA, 12 bp, Homo sapiens
gctcaatgtgct

SEQ ID NO: 4802569 - DNA, 17 bp, Homo sapiens
ggacagatgggtgtccc

SEQ ID NO: 4802570 - DNA, 21 bp, Homo sapiens
ggacagcaaaaccattgcttc

SEQ ID NO: 4802571 - DNA, 15 bp, Homo sapiens
ggacagcagctggac

SEQ ID NO: 4802572 - DNA, 23 bp, Homo sapiens
ggacagcagctggactgggtggg

SEQ ID NO: 4802573 - DNA, 18 bp, Homo sapiens
ggacagcctgcacagtgg

SEQ ID NO: 4802574 - DNA, 23 bp, Homo sapiens
ggacagcggccccgcggagcccc

SEQ ID NO: 4802575 - DNA, 21 bp, Homo sapiens
ggacagggagggaacagacct

SEQ ID NO: 4802576 - DNA, 20 bp, Homo sapiens
ggacagggcccccacagggg

SEQ ID NO: 4802577 - DNA, 20 bp, Homo sapiens
ggacagtgagagcagggctg

SEQ ID NO: 4802578 - DNA, 19 bp, Homo sapiens
ggacagttcacaccctgca

SEQ ID NO: 4802579 - DNA, 20 bp, Homo sapiens
ggacatgagagtagggccct

SEQ ID NO: 4802580 - DNA, 17 bp, Homo sapiens
ggaccaccctgccaagg

SEQ ID NO: 4802581 - DNA, 18 bp, Homo sapiens
ggaccacgtctccctggc

SEQ ID NO: 4802582 - DNA, 15 bp, Homo sapiens
ggaccaggagccagg

SEQ ID NO: 4802583 - DNA, 17 bp, Homo sapiens
ggaccccattctgggac

SEQ ID NO: 4802584 - DNA, 12 bp, Homo sapiens
ggacccctgccc

SEQ ID NO: 4802585 - DNA, 17 bp, Homo sapiens
ggaccggacgcatgcag

SEQ ID NO: 4802586 - DNA, 14 bp, Homo sapiens
ggaccggagcggct

SEQ ID NO: 4802587 - DNA, 20 bp, Homo sapiens
ggaccggagcggctgaggac

SEQ ID NO: 4802588 - DNA, 14 bp, Homo sapiens
ggacctcaggcctg

SEQ ID NO: 4802589 - DNA, 13 bp, Homo sapiens
ggaccttgcttcc

SEQ ID NO: 4802590 - DNA, 18 bp, Homo sapiens
ggacgagcagagcgcagc

SEQ ID NO: 4802591 - DNA, 19 bp, Homo sapiens
ggacgagcagagcgcagcc

SEQ ID NO: 4802592 - DNA, 23 bp, Homo sapiens
ggacgagcagagcgcagccccca

SEQ ID NO: 4802593 - DNA, 14 bp, Homo sapiens
ggacgcatgcaggg

SEQ ID NO: 4802594 - DNA, 12 bp, Homo sapiens
ggacgcccagcc

SEQ ID NO: 4802595 - DNA, 13 bp, Homo sapiens
ggacgcccagccc

SEQ ID NO: 4802596 - DNA, 21 bp, Homo sapiens
ggacgccccccggcctgatgg

SEQ ID NO: 4802597 - DNA, 13 bp, Homo sapiens
ggacgggacagcg

SEQ ID NO: 4802598 - DNA, 21 bp, Homo sapiens
ggacgggacagcggcccggcc

SEQ ID NO: 4802599 - DNA, 23 bp, Homo sapiens
ggacgggacagcggcccggccca

SEQ ID NO: 4802600 - DNA, 15 bp, Homo sapiens
ggacggggcagagct

SEQ ID NO: 4802601 - DNA, 16 bp, Homo sapiens
ggacggggcagagctg

SEQ ID NO: 4802602 - DNA, 13 bp, Homo sapiens
ggacgggggctgc

SEQ ID NO: 4802603 - DNA, 17 bp, Homo sapiens
ggacgggggctgcttct

SEQ ID NO: 4802604 - DNA, 10 bp, Homo sapiens
ggactaaatt

SEQ ID NO: 4802605 - DNA, 15 bp, Homo sapiens
ggactacagaagtgg

SEQ ID NO: 4802606 - DNA, 16 bp, Homo sapiens
ggactccaagccctgg

SEQ ID NO: 4802607 - DNA, 17 bp, Homo sapiens
ggactccaagccctggg

SEQ ID NO: 4802608 - DNA, 22 bp, Homo sapiens
ggactccaagccctggggcagg

SEQ ID NO: 4802609 - DNA, 14 bp, Homo sapiens
ggactgaagaaaat

SEQ ID NO: 4802610 - DNA, 17 bp, Homo sapiens
ggactgagcctggccca

SEQ ID NO: 4802611 - DNA, 12 bp, Homo sapiens
ggactgcctctg

SEQ ID NO: 4802612 - DNA, 15 bp, Homo sapiens
ggactgcctctgcca

SEQ ID NO: 4802613 - DNA, 16 bp, Homo sapiens
ggactgcgctggacga

SEQ ID NO: 4802614 - DNA, 18 bp, Homo sapiens
ggactggcccacccctct

SEQ ID NO: 4802615 - DNA, 19 bp, Homo sapiens
ggactgggtgggccccaca

SEQ ID NO: 4802616 - DNA, 14 bp, Homo sapiens
ggactggttgtctc

SEQ ID NO: 4802617 - DNA, 19 bp, Homo sapiens
ggactgtcttcaaccctgc

SEQ ID NO: 4802618 - DNA, 22 bp, Homo sapiens
ggactgtcttcaaccctgccct

SEQ ID NO: 4802619 - DNA, 22 bp, Homo sapiens
ggactgttggctgattggaaaa

SEQ ID NO: 4802620 - DNA, 18 bp, Homo sapiens
ggagaaaggcaaaccaat

SEQ ID NO: 4802621 - DNA, 18 bp, Homo sapiens
ggagaaggcctgcccccc

SEQ ID NO: 4802622 - DNA, 23 bp, Homo sapiens
ggagaaggcctgccccccttccc

SEQ ID NO: 4802623 - DNA, 21 bp, Homo sapiens
ggagaccccttggggagcagg

SEQ ID NO: 4802624 - DNA, 15 bp, Homo sapiens
ggagactaacttatt

SEQ ID NO: 4802625 - DNA, 21 bp, Homo sapiens
ggagacttggatgtcatatct

SEQ ID NO: 4802626 - DNA, 17 bp, Homo sapiens
ggagaggaactccttgg

SEQ ID NO: 4802627 - DNA, 21 bp, Homo sapiens
ggagaggagcaaacaggaaaa

SEQ ID NO: 4802628 - DNA, 16 bp, Homo sapiens
ggagaggcggcctcgt

SEQ ID NO: 4802629 - DNA, 15 bp, Homo sapiens
ggagatgaggctgga

SEQ ID NO: 4802630 - DNA, 19 bp, Homo sapiens
ggagatgcatctgtggcct

SEQ ID NO: 4802631 - DNA, 22 bp, Homo sapiens
ggagatgcatctgtggcctggg

SEQ ID NO: 4802632 - DNA, 20 bp, Homo sapiens
ggagatggggagggcgcttt

SEQ ID NO: 4802633 - DNA, 15 bp, Homo sapiens
ggagattaaaaccag

SEQ ID NO: 4802634 - DNA, 13 bp, Homo sapiens
ggagcaaggttta

SEQ ID NO: 4802635 - DNA, 14 bp, Homo sapiens
ggagcacccccagc

SEQ ID NO: 4802636 - DNA, 23 bp, Homo sapiens
ggagcagagctgatggagaagga

SEQ ID NO: 4802637 - DNA, 21 bp, Homo sapiens
ggagcaggcggtggggagaga

SEQ ID NO: 4802638 - DNA, 23 bp, Homo sapiens
ggagcaggcggtggggagagatg

SEQ ID NO: 4802639 - DNA, 21 bp, Homo sapiens
ggagcatgtcctatccctgga

SEQ ID NO: 4802640 - DNA, 10 bp, Homo sapiens
ggagccaggt

SEQ ID NO: 4802641 - DNA, 23 bp, Homo sapiens
ggagcccacggctaagaggctgc

SEQ ID NO: 4802642 - DNA, 14 bp, Homo sapiens
ggagccccatcgcc

SEQ ID NO: 4802643 - DNA, 18 bp, Homo sapiens
ggagccgcagaggcccga

SEQ ID NO: 4802644 - DNA, 14 bp, Homo sapiens
ggagccgcaggggc

SEQ ID NO: 4802645 - DNA, 22 bp, Homo sapiens
ggagccgcaggggcccctcctc

SEQ ID NO: 4802646 - DNA, 19 bp, Homo sapiens
ggagcctccccctcagatg

SEQ ID NO: 4802647 - DNA, 14 bp, Homo sapiens
ggagcctcctgccc

SEQ ID NO: 4802648 - DNA, 14 bp, Homo sapiens
ggagcctggcacag

SEQ ID NO: 4802649 - DNA, 19 bp, Homo sapiens
ggagcctggcacaggactg

SEQ ID NO: 4802650 - DNA, 20 bp, Homo sapiens
ggagcgggggctaactggcc

SEQ ID NO: 4802651 - DNA, 19 bp, Homo sapiens
ggagcgtccttgtccccgc

SEQ ID NO: 4802652 - DNA, 19 bp, Homo sapiens
ggagctccctttttgaatt

SEQ ID NO: 4802653 - DNA, 14 bp, Homo sapiens
ggagcttccagatg

SEQ ID NO: 4802654 - DNA, 17 bp, Homo sapiens
ggaggacccctgccctc

SEQ ID NO: 4802655 - DNA, 19 bp, Homo sapiens
ggaggagaaggaggaaccc

SEQ ID NO: 4802656 - DNA, 11 bp, Homo sapiens
ggaggagcacc

SEQ ID NO: 4802657 - DNA, 13 bp, Homo sapiens
ggaggagcacccc

SEQ ID NO: 4802658 - DNA, 14 bp, Homo sapiens
ggaggaggatccgg

SEQ ID NO: 4802659 - DNA, 18 bp, Homo sapiens
ggaggaggcagagaagaa

SEQ ID NO: 4802660 - DNA, 12 bp, Homo sapiens
ggaggatggacg

SEQ ID NO: 4802661 - DNA, 15 bp, Homo sapiens
ggaggcctggtctgg

SEQ ID NO: 4802662 - DNA, 20 bp, Homo sapiens
ggaggctgagatgggaggat

SEQ ID NO: 4802663 - DNA, 18 bp, Homo sapiens
ggaggctggaccaactgc

SEQ ID NO: 4802664 - DNA, 13 bp, Homo sapiens
ggaggctgggccc

SEQ ID NO: 4802665 - DNA, 13 bp, Homo sapiens
ggaggcttccagc

SEQ ID NO: 4802666 - DNA, 16 bp, Homo sapiens
ggagggatggagaggc

SEQ ID NO: 4802667 - DNA, 13 bp, Homo sapiens
ggaggggaagctg

SEQ ID NO: 4802668 - DNA, 15 bp, Homo sapiens
ggaggggagcaaggc

SEQ ID NO: 4802669 - DNA, 15 bp, Homo sapiens
ggaggggccctgtca

SEQ ID NO: 4802670 - DNA, 20 bp, Homo sapiens
ggaggggcttggagcagaga

SEQ ID NO: 4802671 - DNA, 22 bp, Homo sapiens
ggagtcagggctgtgctttccg

SEQ ID NO: 4802672 - DNA, 19 bp, Homo sapiens
ggagtccactttcctctct

SEQ ID NO: 4802673 - DNA, 18 bp, Homo sapiens
ggagtctcctcactgcca

SEQ ID NO: 4802674 - DNA, 14 bp, Homo sapiens
ggagtgactctggc

SEQ ID NO: 4802675 - DNA, 14 bp, Homo sapiens
ggagtgatgggcaa

SEQ ID NO: 4802676 - DNA, 17 bp, Homo sapiens
ggagtgatgggcaaggg

SEQ ID NO: 4802677 - DNA, 12 bp, Homo sapiens
ggagtgccacat

SEQ ID NO: 4802678 - DNA, 20 bp, Homo sapiens
ggagtgccacgtggccgctg

SEQ ID NO: 4802679 - DNA, 18 bp, Homo sapiens
ggagtgggtttccctgcg

SEQ ID NO: 4802680 - DNA, 17 bp, Homo sapiens
ggagtttccatttggat

SEQ ID NO: 4802681 - DNA, 15 bp, Homo sapiens
ggatacgtgtcaatg

SEQ ID NO: 4802682 - DNA, 14 bp, Homo sapiens
ggatagagacttgc

SEQ ID NO: 4802683 - DNA, 16 bp, Homo sapiens
ggatatttttaattta

SEQ ID NO: 4802684 - DNA, 14 bp, Homo sapiens
ggatcctggcctga

SEQ ID NO: 4802685 - DNA, 12 bp, Homo sapiens
ggatcctgttgc

SEQ ID NO: 4802686 - DNA, 11 bp, Homo sapiens
ggatctccagg

SEQ ID NO: 4802687 - DNA, 14 bp, Homo sapiens
ggatctccaggccc

SEQ ID NO: 4802688 - DNA, 15 bp, Homo sapiens
ggatctccaggccca

SEQ ID NO: 4802689 - DNA, 16 bp, Homo sapiens
ggatctccaggcccag

SEQ ID NO: 4802690 - DNA, 18 bp, Homo sapiens
ggatctcttaagacagca

SEQ ID NO: 4802691 - DNA, 17 bp, Homo sapiens
ggatcttacccacttcc

SEQ ID NO: 4802692 - DNA, 18 bp, Homo sapiens
ggcgcaggaaccgaggac

SEQ ID NO: 4802693 - DNA, 15 bp, Homo sapiens
ggcgcccacctgccc

SEQ ID NO: 4802694 - DNA, 18 bp, Homo sapiens
ggcgccggttccacgtgg

SEQ ID NO: 4802695 - DNA, 17 bp, Homo sapiens
ggcgcctctgtcctggc

SEQ ID NO: 4802696 - DNA, 18 bp, Homo sapiens
ggcgcctgggtcctccca

SEQ ID NO: 4802697 - DNA, 13 bp, Homo sapiens
ggcgcgcaccgcc

SEQ ID NO: 4802698 - DNA, 15 bp, Homo sapiens
ggcgcgcaccgccca

SEQ ID NO: 4802699 - DNA, 14 bp, Homo sapiens
ggcgcgcgccccca

SEQ ID NO: 4802700 - DNA, 19 bp, Homo sapiens
ggcgcgggacaggacttgt

SEQ ID NO: 4802701 - DNA, 17 bp, Homo sapiens
ggcgctccggcagaggc

SEQ ID NO: 4802702 - DNA, 18 bp, Homo sapiens
ggcgctccggcagaggca

SEQ ID NO: 4802703 - DNA, 19 bp, Homo sapiens
ggcgctccggcagaggcag

SEQ ID NO: 4802704 - DNA, 18 bp, Homo sapiens
ggcgctcctcccagctgt

SEQ ID NO: 4802705 - DNA, 21 bp, Homo sapiens
ggcgctgcccccacagatcca

SEQ ID NO: 4802706 - DNA, 17 bp, Homo sapiens
ggcgctgcccctggcag

SEQ ID NO: 4802707 - DNA, 18 bp, Homo sapiens
ggcgctgcccctggcagc

SEQ ID NO: 4802708 - DNA, 19 bp, Homo sapiens
ggcgctgcccctggcagcc

SEQ ID NO: 4802709 - DNA, 13 bp, Homo sapiens
ggcggagctctgg

SEQ ID NO: 4802710 - DNA, 19 bp, Homo sapiens
ggcggcatccgagcccctg

SEQ ID NO: 4802711 - DNA, 14 bp, Homo sapiens
ggcggcttccctgc

SEQ ID NO: 4802712 - DNA, 13 bp, Homo sapiens
ggcgggcagcccc

SEQ ID NO: 4802713 - DNA, 14 bp, Homo sapiens
ggcgggcagcccct

SEQ ID NO: 4802714 - DNA, 18 bp, Homo sapiens
ggcgggcagcccctgctg

SEQ ID NO: 4802715 - DNA, 22 bp, Homo sapiens
ggcgggcagcccctgctggacc

SEQ ID NO: 4802716 - DNA, 14 bp, Homo sapiens
ggcgggccaggaga

SEQ ID NO: 4802717 - DNA, 22 bp, Homo sapiens
ggcggggctgtgcgggcgcccg

SEQ ID NO: 4802718 - DNA, 14 bp, Homo sapiens
ggcgtcctctcgta

SEQ ID NO: 4802719 - DNA, 12 bp, Homo sapiens
ggcgtgctcctt

SEQ ID NO: 4802720 - DNA, 13 bp, Homo sapiens
ggcgtgctccttt

SEQ ID NO: 4802721 - DNA, 22 bp, Homo sapiens
ggcgtgggatccagagagaagc

SEQ ID NO: 4802722 - DNA, 20 bp, Homo sapiens
ggctaaatgcctaataaaca

SEQ ID NO: 4802723 - DNA, 14 bp, Homo sapiens
ggctaacgggcgcc

SEQ ID NO: 4802724 - DNA, 14 bp, Homo sapiens
ggctaactggcccc

SEQ ID NO: 4802725 - DNA, 19 bp, Homo sapiens
ggctaactggccccaggcg

SEQ ID NO: 4802726 - DNA, 16 bp, Homo sapiens
ggctaagaggctgctg

SEQ ID NO: 4802727 - DNA, 17 bp, Homo sapiens
ggctagtctgtgcctca

SEQ ID NO: 4802728 - DNA, 21 bp, Homo sapiens
ggctatatgcctatatttata

SEQ ID NO: 4802729 - DNA, 22 bp, Homo sapiens
ggctcacaccggcactgtgcac

SEQ ID NO: 4802730 - DNA, 12 bp, Homo sapiens
ggctcacagcca

SEQ ID NO: 4802731 - DNA, 13 bp, Homo sapiens
ggctcacagccac

SEQ ID NO: 4802732 - DNA, 16 bp, Homo sapiens
ggctcacagccaccac

SEQ ID NO: 4802733 - DNA, 20 bp, Homo sapiens
ggctcacagccaccacctgg

SEQ ID NO: 4802734 - DNA, 13 bp, Homo sapiens
ggctcaggctgcc

SEQ ID NO: 4802735 - DNA, 18 bp, Homo sapiens
ggctccatgctcctcact

SEQ ID NO: 4802736 - DNA, 14 bp, Homo sapiens
ggctcggcctcttg

SEQ ID NO: 4802737 - DNA, 18 bp, Homo sapiens
ggctcgtgtttcacagtg

SEQ ID NO: 4802738 - DNA, 20 bp, Homo sapiens
ggctcgtgtttcacagtggg

SEQ ID NO: 4802739 - DNA, 22 bp, Homo sapiens
ggctctagggttgctggagcct

SEQ ID NO: 4802740 - DNA, 11 bp, Homo sapiens
ggctctcaggc

SEQ ID NO: 4802741 - DNA, 13 bp, Homo sapiens
ggctctcaggcca

SEQ ID NO: 4802742 - DNA, 16 bp, Homo sapiens
ggctctcaggccagct

SEQ ID NO: 4802743 - DNA, 18 bp, Homo sapiens
ggctctcaggccagctgc

SEQ ID NO: 4802744 - DNA, 20 bp, Homo sapiens
ggctctctcacccagcctgg

SEQ ID NO: 4802745 - DNA, 21 bp, Homo sapiens
ggctctctggacctgaccaga

SEQ ID NO: 4802746 - DNA, 12 bp, Homo sapiens
ggctctgagact

SEQ ID NO: 4802747 - DNA, 19 bp, Homo sapiens
ggctctgagactaaatgag

SEQ ID NO: 4802748 - DNA, 23 bp, Homo sapiens
ggctctggagcccgcctgcgccc

SEQ ID NO: 4802749 - DNA, 23 bp, Homo sapiens
ggctgagagggtgtgggtgccct

SEQ ID NO: 4802750 - DNA, 11 bp, Homo sapiens
ggctgagcccc

SEQ ID NO: 4802751 - DNA, 19 bp, Homo sapiens
ggctgagcccctcctctcc

SEQ ID NO: 4802752 - DNA, 16 bp, Homo sapiens
ggctgattggaaaata

SEQ ID NO: 4802753 - DNA, 17 bp, Homo sapiens
ggctgattggaaaataa

SEQ ID NO: 4802754 - DNA, 18 bp, Homo sapiens
ggctgattggaaaataat

SEQ ID NO: 4802755 - DNA, 22 bp, Homo sapiens
ggctgattggaaaataataaaa

SEQ ID NO: 4802756 - DNA, 14 bp, Homo sapiens
ggctgcagccccct

SEQ ID NO: 4802757 - DNA, 14 bp, Homo sapiens
ggctgcagtgagcc

SEQ ID NO: 4802758 - DNA, 18 bp, Homo sapiens
ggctgcatcctcagcccc

SEQ ID NO: 4802759 - DNA, 19 bp, Homo sapiens
ggctgcatcctcagcccca

SEQ ID NO: 4802760 - DNA, 21 bp, Homo sapiens
ggctgcatcctcagccccagg

SEQ ID NO: 4802761 - DNA, 23 bp, Homo sapiens
ggctgcccagcggctcttcctgg

SEQ ID NO: 4802762 - DNA, 17 bp, Homo sapiens
ggctgccccaggggcac

SEQ ID NO: 4802763 - DNA, 21 bp, Homo sapiens
ggctgccgctgctctcccagg

SEQ ID NO: 4802764 - DNA, 15 bp, Homo sapiens
ggctgcgcctgcccg

SEQ ID NO: 4802765 - DNA, 19 bp, Homo sapiens
ggctgcgcctgcccgcccg

SEQ ID NO: 4802766 - DNA, 23 bp, Homo sapiens
ggctgctgaaaaccatctggcct

SEQ ID NO: 4802767 - DNA, 21 bp, Homo sapiens
ggctgctgcagtcagcacaga

SEQ ID NO: 4802768 - DNA, 19 bp, Homo sapiens
ggctgctgcttctccctgg

SEQ ID NO: 4802769 - DNA, 23 bp, Homo sapiens
ggctgcttctccacctcccccaa

SEQ ID NO: 4802770 - DNA, 22 bp, Homo sapiens
ggctggaccacgtctccctggc

SEQ ID NO: 4802771 - DNA, 12 bp, Homo sapiens
ggctggagcccc

SEQ ID NO: 4802772 - DNA, 19 bp, Homo sapiens
ggctggatgtgcatctggc

SEQ ID NO: 4802773 - DNA, 21 bp, Homo sapiens
ggctggatgtgcatctggcct

SEQ ID NO: 4802774 - DNA, 13 bp, Homo sapiens
ggctggccctgcc

SEQ ID NO: 4802775 - DNA, 14 bp, Homo sapiens
ggctggccctgccc

SEQ ID NO: 4802776 - DNA, 17 bp, Homo sapiens
ggctggccctgccctcc

SEQ ID NO: 4802777 - DNA, 13 bp, Homo sapiens
ggctgggcagagg

SEQ ID NO: 4802778 - DNA, 15 bp, Homo sapiens
ggctgggcagaggaa

SEQ ID NO: 4802779 - DNA, 15 bp, Homo sapiens
ggctgggcagggccg

SEQ ID NO: 4802780 - DNA, 17 bp, Homo sapiens
ggctgggcagggccgca

SEQ ID NO: 4802781 - DNA, 18 bp, Homo sapiens
ggctgggcagggccgcag

SEQ ID NO: 4802782 - DNA, 19 bp, Homo sapiens
ggctgggcagggccgcagg

SEQ ID NO: 4802783 - DNA, 13 bp, Homo sapiens
ggctgggcccccc

SEQ ID NO: 4802784 - DNA, 19 bp, Homo sapiens
ggctgggccccccagctca

SEQ ID NO: 4802785 - DNA, 22 bp, Homo sapiens
ggctgggccccccagctcaggg

SEQ ID NO: 4802786 - DNA, 14 bp, Homo sapiens
ggctggggacttcg

SEQ ID NO: 4802787 - DNA, 15 bp, Homo sapiens
ggctggggaggcctg

SEQ ID NO: 4802788 - DNA, 16 bp, Homo sapiens
ggctgggtcgcccctc

SEQ ID NO: 4802789 - DNA, 19 bp, Homo sapiens
ggctgggtcgcccctcctc

SEQ ID NO: 4802790 - DNA, 22 bp, Homo sapiens
ggctgggtttgggcagtggaga

SEQ ID NO: 4802791 - DNA, 15 bp, Homo sapiens
ggctgtcaattacag

SEQ ID NO: 4802792 - DNA, 19 bp, Homo sapiens
ggctgtcattccatgagtc

SEQ ID NO: 4802793 - DNA, 14 bp, Homo sapiens
ggctgtgaggacag

SEQ ID NO: 4802794 - DNA, 17 bp, Homo sapiens
ggctgtgaggacagggc

SEQ ID NO: 4802795 - DNA, 16 bp, Homo sapiens
ggctgtgcgggcgccc

SEQ ID NO: 4802796 - DNA, 19 bp, Homo sapiens
ggctgtgcgggcgcccgga

SEQ ID NO: 4802797 - DNA, 12 bp, Homo sapiens
ggctgtggcccc

SEQ ID NO: 4802798 - DNA, 13 bp, Homo sapiens
ggctgttatctgt

SEQ ID NO: 4802799 - DNA, 14 bp, Homo sapiens
ggcttaaacatttt

SEQ ID NO: 4802800 - DNA, 16 bp, Homo sapiens
ggcttagtaatagatc

SEQ ID NO: 4802801 - DNA, 18 bp, Homo sapiens
ggcttcaccgcattccag

SEQ ID NO: 4802802 - DNA, 22 bp, Homo sapiens
ggcttcaccgcattccaggggc

SEQ ID NO: 4802803 - DNA, 14 bp, Homo sapiens
ggcttccatggtgg

SEQ ID NO: 4802804 - DNA, 11 bp, Homo sapiens
ggcttcccagg

SEQ ID NO: 4802805 - DNA, 19 bp, Homo sapiens
ggcttcccaggaccctggg

SEQ ID NO: 4802806 - DNA, 17 bp, Homo sapiens
ggcttccgtgagacaca

SEQ ID NO: 4802807 - DNA, 13 bp, Homo sapiens
ggcttcctcctga

SEQ ID NO: 4802808 - DNA, 14 bp, Homo sapiens
ggcttctccccctc

SEQ ID NO: 4802809 - DNA, 13 bp, Homo sapiens
ggcttcttcaact

SEQ ID NO: 4802810 - DNA, 15 bp, Homo sapiens
ggcttgagtctggat

SEQ ID NO: 4802811 - DNA, 13 bp, Homo sapiens
ggcttggagcaga

SEQ ID NO: 4802812 - DNA, 16 bp, Homo sapiens
ggcttggagcagagac

SEQ ID NO: 4802813 - DNA, 23 bp, Homo sapiens
ggcttggagcagagacggcagcc

SEQ ID NO: 4802814 - DNA, 21 bp, Homo sapiens
ggcttggcattgaccttcatg

SEQ ID NO: 4802815 - DNA, 14 bp, Homo sapiens
gggtgtcccctggt

SEQ ID NO: 4802816 - DNA, 13 bp, Homo sapiens
gggtgtggcctca

SEQ ID NO: 4802817 - DNA, 15 bp, Homo sapiens
gggtgtggcctcagc

SEQ ID NO: 4802818 - DNA, 14 bp, Homo sapiens
gggttaaagaaagg

SEQ ID NO: 4802819 - DNA, 12 bp, Homo sapiens
gggttccagaca

SEQ ID NO: 4802820 - DNA, 16 bp, Homo sapiens
gggttctagaaggggc

SEQ ID NO: 4802821 - DNA, 22 bp, Homo sapiens
gggttctatatttactgtttat

SEQ ID NO: 4802822 - DNA, 15 bp, Homo sapiens
gggttgctggagcct

SEQ ID NO: 4802823 - DNA, 16 bp, Homo sapiens
gggttgggttccagac

SEQ ID NO: 4802824 - DNA, 18 bp, Homo sapiens
gggttgggttccagacag

SEQ ID NO: 4802825 - DNA, 23 bp, Homo sapiens
gggtttttaatctttgtgacagg

SEQ ID NO: 4802826 - DNA, 14 bp, Homo sapiens
ggtaaataactgtg

SEQ ID NO: 4802827 - DNA, 22 bp, Homo sapiens
ggtagaaactttggaagtttta

SEQ ID NO: 4802828 - DNA, 22 bp, Homo sapiens
ggtagaagcccttctaccttcc

SEQ ID NO: 4802829 - DNA, 16 bp, Homo sapiens
ggtagctctgaaggga

SEQ ID NO: 4802830 - DNA, 18 bp, Homo sapiens
ggtagcttacctgacaca

SEQ ID NO: 4802831 - DNA, 17 bp, Homo sapiens
ggtattatctagtaggt

SEQ ID NO: 4802832 - DNA, 15 bp, Homo sapiens
ggtattttaacatag

SEQ ID NO: 4802833 - DNA, 16 bp, Homo sapiens
ggtattttaacatagc

SEQ ID NO: 4802834 - DNA, 20 bp, Homo sapiens
ggtattttcgtgcatttgtg

SEQ ID NO: 4802835 - DNA, 14 bp, Homo sapiens
ggtcaactccaagg

SEQ ID NO: 4802836 - DNA, 16 bp, Homo sapiens
ggtcaactccaaggca

SEQ ID NO: 4802837 - DNA, 19 bp, Homo sapiens
ggtcaactccaaggcaaat

SEQ ID NO: 4802838 - DNA, 20 bp, Homo sapiens
ggtcaactccaaggcaaatg

SEQ ID NO: 4802839 - DNA, 17 bp, Homo sapiens
ggtcacaaagctattta

SEQ ID NO: 4802840 - DNA, 23 bp, Homo sapiens
ggtcactgcccacctgccaggct

SEQ ID NO: 4802841 - DNA, 17 bp, Homo sapiens
ggtcactggagtagttg

SEQ ID NO: 4802842 - DNA, 23 bp, Homo sapiens
ggtcagcaccgtggtgtgaggcc

SEQ ID NO: 4802843 - DNA, 19 bp, Homo sapiens
ggtcagcgattcctgccaa

SEQ ID NO: 4802844 - DNA, 18 bp, Homo sapiens
ggtcaggccctggaactc

SEQ ID NO: 4802845 - DNA, 16 bp, Homo sapiens
ggtcaggtgggaaagc

SEQ ID NO: 4802846 - DNA, 19 bp, Homo sapiens
ggtcagtgttataaaatct

SEQ ID NO: 4802847 - DNA, 23 bp, Homo sapiens
ggtcatattcataccttctgatg

SEQ ID NO: 4802848 - DNA, 18 bp, Homo sapiens
ggtcatatttggtgatga

SEQ ID NO: 4802849 - DNA, 16 bp, Homo sapiens
ggtccaatccagcctt

SEQ ID NO: 4802850 - DNA, 18 bp, Homo sapiens
ggtccaatccagccttct

SEQ ID NO: 4802851 - DNA, 18 bp, Homo sapiens
ggtccaccccgtcccggc

SEQ ID NO: 4802852 - DNA, 20 bp, Homo sapiens
ggtccaccccgtcccggccc

SEQ ID NO: 4802853 - DNA, 22 bp, Homo sapiens
ggtccaccccgtcccggccccg

SEQ ID NO: 4802854 - DNA, 15 bp, Homo sapiens
ggtccagccctccgc

SEQ ID NO: 4802855 - DNA, 23 bp, Homo sapiens
ggtccagccctccgccagccctg

SEQ ID NO: 4802856 - DNA, 21 bp, Homo sapiens
ggtccaggagatgaggctgga

SEQ ID NO: 4802857 - DNA, 17 bp, Homo sapiens
ggtccagggtccagccc

SEQ ID NO: 4802858 - DNA, 18 bp, Homo sapiens
ggtccagggtccagccct

SEQ ID NO: 4802859 - DNA, 17 bp, Homo sapiens
ggtcccccatgccacca

SEQ ID NO: 4802860 - DNA, 19 bp, Homo sapiens
ggtcccctggcccttcctt

SEQ ID NO: 4802861 - DNA, 19 bp, Homo sapiens
ggtcccgggtgccccccat

SEQ ID NO: 4802862 - DNA, 23 bp, Homo sapiens
ggtcctcggccctgtagccctgg

SEQ ID NO: 4802863 - DNA, 21 bp, Homo sapiens
ggtcctgggggctgctgcact

SEQ ID NO: 4802864 - DNA, 21 bp, Homo sapiens
ggtccttaaaaaaaaaaatga

SEQ ID NO: 4802865 - DNA, 23 bp, Homo sapiens
ggtcgggggaggagcacccccag

SEQ ID NO: 4802866 - DNA, 18 bp, Homo sapiens
ggtctcatgctccttaat

SEQ ID NO: 4802867 - DNA, 12 bp, Homo sapiens
ggtctctgagca

SEQ ID NO: 4802868 - DNA, 19 bp, Homo sapiens
ggtctctgagcagtgggga

SEQ ID NO: 4802869 - DNA, 17 bp, Homo sapiens
ggtctctttctttccaa

SEQ ID NO: 4802870 - DNA, 12 bp, Homo sapiens
ggtctgcacaca

SEQ ID NO: 4802871 - DNA, 21 bp, Homo sapiens
ggtctgcacacataacacaca

SEQ ID NO: 4802872 - DNA, 13 bp, Homo sapiens
ggtctgctcctgg

SEQ ID NO: 4802873 - DNA, 15 bp, Homo sapiens
ggtctgctcctggga

SEQ ID NO: 4802874 - DNA, 13 bp, Homo sapiens
ggtctggagcccc

SEQ ID NO: 4802875 - DNA, 18 bp, Homo sapiens
ggtctggattttcaaaga

SEQ ID NO: 4802876 - DNA, 15 bp, Homo sapiens
ggtctgtgtgtgaca

SEQ ID NO: 4802877 - DNA, 21 bp, Homo sapiens
ggtctgtgttctcaacacaca

SEQ ID NO: 4802878 - DNA, 20 bp, Homo sapiens
ggtcttagggtacagcccag

SEQ ID NO: 4802879 - DNA, 13 bp, Homo sapiens
ggtcttctccatc

SEQ ID NO: 4802880 - DNA, 13 bp, Homo sapiens
ggtcttggagagg

SEQ ID NO: 4802881 - DNA, 16 bp, Homo sapiens
ggtgaacttggttccc

SEQ ID NO: 4802882 - DNA, 20 bp, Homo sapiens
ggtgacctttttaatccagg

SEQ ID NO: 4802883 - DNA, 16 bp, Homo sapiens
ggtgactgtcccaccg

SEQ ID NO: 4802884 - DNA, 12 bp, Homo sapiens
ggtgagaagtac

SEQ ID NO: 4802885 - DNA, 18 bp, Homo sapiens
ggtgagaagtacagggca

SEQ ID NO: 4802886 - DNA, 17 bp, Homo sapiens
ggtgaggtcaggtgcct

SEQ ID NO: 4802887 - DNA, 21 bp, Homo sapiens
ggtgatactccaaggtggcat

SEQ ID NO: 4802888 - DNA, 16 bp, Homo sapiens
ggtgattacctgaaag

SEQ ID NO: 4802889 - DNA, 19 bp, Homo sapiens
ggtgcacctgccccaggct

SEQ ID NO: 4802890 - DNA, 13 bp, Homo sapiens
ggtgcagtgaaga

SEQ ID NO: 4802891 - DNA, 19 bp, Homo sapiens
ggtgcatttgagagaagcc

SEQ ID NO: 4802892 - DNA, 15 bp, Homo sapiens
ggtgcccgtgtggcc

SEQ ID NO: 4802893 - DNA, 18 bp, Homo sapiens
ggtgcccgtgtggcctgg

SEQ ID NO: 4802894 - DNA, 19 bp, Homo sapiens
ggtgccgcgggcgagaagg

SEQ ID NO: 4802895 - DNA, 20 bp, Homo sapiens
ggtgcctcccagccctgccc

SEQ ID NO: 4802896 - DNA, 16 bp, Homo sapiens
ggtgcggaccggagcg

SEQ ID NO: 4802897 - DNA, 22 bp, Homo sapiens
ggtgcgtgtggccctgtgggag

SEQ ID NO: 4802898 - DNA, 22 bp, Homo sapiens
ggtgctcataactagagtatgt

SEQ ID NO: 4802899 - DNA, 15 bp, Homo sapiens
ggtgctggggctgca

SEQ ID NO: 4802900 - DNA, 18 bp, Homo sapiens
ggtgctgtcatgcccagc

SEQ ID NO: 4802901 - DNA, 16 bp, Homo sapiens
ggtggaagggcaggag

SEQ ID NO: 4802902 - DNA, 21 bp, Homo sapiens
ggtggaagggcaggagctcac

SEQ ID NO: 4802903 - DNA, 22 bp, Homo sapiens
ggtggaattattagcaccagct

SEQ ID NO: 4802904 - DNA, 17 bp, Homo sapiens
ggtggactgcgctggac

SEQ ID NO: 4802905 - DNA, 16 bp, Homo sapiens
ggtggagtcagggctg

SEQ ID NO: 4802906 - DNA, 21 bp, Homo sapiens
ggtggagtcagggctgtgctt

SEQ ID NO: 4802907 - DNA, 20 bp, Homo sapiens
ggtggcaccagatgcaacct

SEQ ID NO: 4802908 - DNA, 16 bp, Homo sapiens
ggtggcacccaccact

SEQ ID NO: 4802909 - DNA, 19 bp, Homo sapiens
ggtggcacccaccactctc

SEQ ID NO: 4802910 - DNA, 22 bp, Homo sapiens
ggtggcacccaccactctcagg

SEQ ID NO: 4802911 - DNA, 20 bp, Homo sapiens
ggtggcaggcacacagcagc

SEQ ID NO: 4802912 - DNA, 15 bp, Homo sapiens
ggtggcatttgctga

SEQ ID NO: 4802913 - DNA, 22 bp, Homo sapiens
ggtggccagcccgcagaggtgg

SEQ ID NO: 4802914 - DNA, 23 bp, Homo sapiens
ggtggccagcccgcagaggtggg

SEQ ID NO: 4802915 - DNA, 19 bp, Homo sapiens
ggtggccatccctgggccc

SEQ ID NO: 4802916 - DNA, 22 bp, Homo sapiens
ggtggccatccctgggcccctc

SEQ ID NO: 4802917 - DNA, 15 bp, Homo sapiens
ggtggccgtcacgct

SEQ ID NO: 4802918 - DNA, 12 bp, Homo sapiens
ggtggccttgag

SEQ ID NO: 4802919 - DNA, 16 bp, Homo sapiens
ggtgggccccacagtg

SEQ ID NO: 4802920 - DNA, 14 bp, Homo sapiens
ggtgggctccagag

SEQ ID NO: 4802921 - DNA, 15 bp, Homo sapiens
ggtgggctccagagt

SEQ ID NO: 4802922 - DNA, 15 bp, Homo sapiens
ggtggggagggcctc

SEQ ID NO: 4802923 - DNA, 15 bp, Homo sapiens
ggtggggcttggaag

SEQ ID NO: 4802924 - DNA, 14 bp, Homo sapiens
ggtggggtgctggg

SEQ ID NO: 4802925 - DNA, 18 bp, Homo sapiens
ggtggtcttggagaggag

SEQ ID NO: 4802926 - DNA, 22 bp, Homo sapiens
ggtggtcttggagaggaggtgt

SEQ ID NO: 4802927 - DNA, 16 bp, Homo sapiens
ggtggttggaggcctg

SEQ ID NO: 4802928 - DNA, 17 bp, Homo sapiens
ggtggttggaggcctgg

SEQ ID NO: 4802929 - DNA, 17 bp, Homo sapiens
ggtggtttcagaaaggg

SEQ ID NO: 4802930 - DNA, 14 bp, Homo sapiens
ggtgtcctctgtcc

SEQ ID NO: 4802931 - DNA, 15 bp, Homo sapiens
ggtgtcctctgtccg

SEQ ID NO: 4802932 - DNA, 20 bp, Homo sapiens
ggtgtgaggcccccggaggc

SEQ ID NO: 4802933 - DNA, 15 bp, Homo sapiens
ggtgtggagtggagg

SEQ ID NO: 4802934 - DNA, 21 bp, Homo sapiens
ggtgtggagtggaggggtcag

SEQ ID NO: 4802935 - DNA, 12 bp, Homo sapiens
ggtgtggcctca

SEQ ID NO: 4802936 - DNA, 13 bp, Homo sapiens
gtagcctggtctg

SEQ ID NO: 4802937 - DNA, 17 bp, Homo sapiens
gtagctagtttaaaatt

SEQ ID NO: 4802938 - DNA, 20 bp, Homo sapiens
gtagctagtttaaaattatt

SEQ ID NO: 4802939 - DNA, 17 bp, Homo sapiens
gtagcttacctgacaca

SEQ ID NO: 4802940 - DNA, 21 bp, Homo sapiens
gtagcttcagtcattaaatta

SEQ ID NO: 4802941 - DNA, 16 bp, Homo sapiens
gtaggaaccgatctgc

SEQ ID NO: 4802942 - DNA, 23 bp, Homo sapiens
gtagggaacggcctgagaggagc

SEQ ID NO: 4802943 - DNA, 19 bp, Homo sapiens
gtaggttgtgatgatagca

SEQ ID NO: 4802944 - DNA, 18 bp, Homo sapiens
gtagtagaatctcagcac

SEQ ID NO: 4802945 - DNA, 22 bp, Homo sapiens
gtagtgccaaaaggccccttcc

SEQ ID NO: 4802946 - DNA, 16 bp, Homo sapiens
gtagtgccatggccag

SEQ ID NO: 4802947 - DNA, 18 bp, Homo sapiens
gtagtgttgggtggagga

SEQ ID NO: 4802948 - DNA, 19 bp, Homo sapiens
gtagtgttgggtggaggat

SEQ ID NO: 4802949 - DNA, 21 bp, Homo sapiens
gtagtttttgttcaccttctg

SEQ ID NO: 4802950 - DNA, 21 bp, Homo sapiens
gtataaaacagtgtttccagt

SEQ ID NO: 4802951 - DNA, 13 bp, Homo sapiens
gtataaattacat

SEQ ID NO: 4802952 - DNA, 13 bp, Homo sapiens
gtataatactttg

SEQ ID NO: 4802953 - DNA, 14 bp, Homo sapiens
gtatacaagtactg

SEQ ID NO: 4802954 - DNA, 13 bp, Homo sapiens
gtatacacacaca

SEQ ID NO: 4802955 - DNA, 15 bp, Homo sapiens
gtatacatatgtatg

SEQ ID NO: 4802956 - DNA, 19 bp, Homo sapiens
gtatacatatgtatgtgtg

SEQ ID NO: 4802957 - DNA, 12 bp, Homo sapiens
gtatatatgtac

SEQ ID NO: 4802958 - DNA, 15 bp, Homo sapiens
gtatatatgtacagt

SEQ ID NO: 4802959 - DNA, 20 bp, Homo sapiens
gtatatattatatatacatt

SEQ ID NO: 4802960 - DNA, 20 bp, Homo sapiens
gtatatcagctctaaagcag

SEQ ID NO: 4802961 - DNA, 13 bp, Homo sapiens
gtatatctgtgta

SEQ ID NO: 4802962 - DNA, 16 bp, Homo sapiens
gtatcattttccaatt

SEQ ID NO: 4802963 - DNA, 22 bp, Homo sapiens
gtatcattttccaattaattat

SEQ ID NO: 4802964 - DNA, 17 bp, Homo sapiens
gtatcccttctcacagc

SEQ ID NO: 4802965 - DNA, 19 bp, Homo sapiens
gtatcccttctcacagcac

SEQ ID NO: 4802966 - DNA, 15 bp, Homo sapiens
gtatcctggattcct

SEQ ID NO: 4802967 - DNA, 14 bp, Homo sapiens
gtatctcctttaat

SEQ ID NO: 4802968 - DNA, 19 bp, Homo sapiens
gtatctgaactcacagact

SEQ ID NO: 4802969 - DNA, 21 bp, Homo sapiens
gtatctggattcaaatttatt

SEQ ID NO: 4802970 - DNA, 17 bp, Homo sapiens
gtatcttactttcctct

SEQ ID NO: 4802971 - DNA, 13 bp, Homo sapiens
gtatcttatttat

SEQ ID NO: 4802972 - DNA, 15 bp, Homo sapiens
gtatcttatttatat

SEQ ID NO: 4802973 - DNA, 17 bp, Homo sapiens
gtatgaaacaaatatac

SEQ ID NO: 4802974 - DNA, 16 bp, Homo sapiens
gtatgaaatatatgtg

SEQ ID NO: 4802975 - DNA, 17 bp, Homo sapiens
gtatgcaagaagaatat

SEQ ID NO: 4802976 - DNA, 20 bp, Homo sapiens
gtatgctggccagcaccctc

SEQ ID NO: 4802977 - DNA, 19 bp, Homo sapiens
gtatgtacaggctgagaca

SEQ ID NO: 4802978 - DNA, 21 bp, Homo sapiens
gtatgtccagaacaaaagata

SEQ ID NO: 4802979 - DNA, 13 bp, Homo sapiens
gtatgtctatgtg

SEQ ID NO: 4802980 - DNA, 16 bp, Homo sapiens
gtatgtctatgtgtat

SEQ ID NO: 4802981 - DNA, 20 bp, Homo sapiens
gtatgtctatgtgtatatat

SEQ ID NO: 4802982 - DNA, 15 bp, Homo sapiens
gtatgtgtatgtact

SEQ ID NO: 4802983 - DNA, 21 bp, Homo sapiens
gtatgtgtgagtgtatgtata

SEQ ID NO: 4802984 - DNA, 12 bp, Homo sapiens
gtattaatgtag

SEQ ID NO: 4802985 - DNA, 22 bp, Homo sapiens
gtattaatgtagggcagaatag

SEQ ID NO: 4802986 - DNA, 15 bp, Homo sapiens
gtattacataaataa

SEQ ID NO: 4802987 - DNA, 13 bp, Homo sapiens
gtattatcatata

SEQ ID NO: 4802988 - DNA, 20 bp, Homo sapiens
gtattatcttaaacccacat

SEQ ID NO: 4802989 - DNA, 16 bp, Homo sapiens
gtattatttagtaaaa

SEQ ID NO: 4802990 - DNA, 19 bp, Homo sapiens
gtattccaccttaaattaa

SEQ ID NO: 4802991 - DNA, 16 bp, Homo sapiens
gtattccttggcccag

SEQ ID NO: 4802992 - DNA, 20 bp, Homo sapiens
gtattccttggcccagcagc

SEQ ID NO: 4802993 - DNA, 15 bp, Homo sapiens
gtattctctttgcct

SEQ ID NO: 4802994 - DNA, 18 bp, Homo sapiens
gtattgacaataagaaac

SEQ ID NO: 4802995 - DNA, 21 bp, Homo sapiens
gtattgacaataagaaacagt

SEQ ID NO: 4802996 - DNA, 13 bp, Homo sapiens
gtattggcagcac

SEQ ID NO: 4802997 - DNA, 23 bp, Homo sapiens
gtattggtttctgtttgaatttt

SEQ ID NO: 4802998 - DNA, 17 bp, Homo sapiens
gtattgtaggtggtgtt

SEQ ID NO: 4802999 - DNA, 17 bp, Homo sapiens
gtattgtgagatcctgt

SEQ ID NO: 4803000 - DNA, 21 bp, Homo sapiens
gtattgttcttgtaaaactgt

SEQ ID NO: 4803001 - DNA, 21 bp, Homo sapiens
gtatttataagaaaaatgtga

SEQ ID NO: 4803002 - DNA, 16 bp, Homo sapiens
gtatttcagatgcttt

SEQ ID NO: 4803003 - DNA, 23 bp, Homo sapiens
gtatttgaggaaactcatacagt

SEQ ID NO: 4803004 - DNA, 22 bp, Homo sapiens
gtatttggttaaaggtctccca

SEQ ID NO: 4803005 - DNA, 22 bp, Homo sapiens
gtattttatctgtgttgtctct

SEQ ID NO: 4803006 - DNA, 15 bp, Homo sapiens
gtattttcgtgcatt

SEQ ID NO: 4803007 - DNA, 22 bp, Homo sapiens
gtattttcttcccatttgtaat

SEQ ID NO: 4803008 - DNA, 10 bp, Homo sapiens
gtattttgag

SEQ ID NO: 4803009 - DNA, 14 bp, Homo sapiens
gtatttttagagat

SEQ ID NO: 4803010 - DNA, 22 bp, Homo sapiens
gtatttttagagattaatttgt

SEQ ID NO: 4803011 - DNA, 23 bp, Homo sapiens
gtcaaactttcacctcagatttt

SEQ ID NO: 4803012 - DNA, 13 bp, Homo sapiens
gtcaaatccatgt

SEQ ID NO: 4803013 - DNA, 20 bp, Homo sapiens
gtcaaatggatgtaatatag

SEQ ID NO: 4803014 - DNA, 14 bp, Homo sapiens
gtcaaatggtattt

SEQ ID NO: 4803015 - DNA, 21 bp, Homo sapiens
gtcaaatggtattttttgtga

SEQ ID NO: 4803016 - DNA, 12 bp, Homo sapiens
gtcaacctgaat

SEQ ID NO: 4803017 - DNA, 14 bp, Homo sapiens
gtcaacctgaatta

SEQ ID NO: 4803018 - DNA, 16 bp, Homo sapiens
gtcaacctgaattaaa

SEQ ID NO: 4803019 - DNA, 20 bp, Homo sapiens
gtcaacctgaattaaagtct

SEQ ID NO: 4803020 - DNA, 20 bp, Homo sapiens
gtcaactccaaggcaaatgt

SEQ ID NO: 4803021 - DNA, 23 bp, Homo sapiens
gtcaactccaaggcaaatgtcca

SEQ ID NO: 4803022 - DNA, 16 bp, Homo sapiens
gtcaagtgtgcctgct

SEQ ID NO: 4803023 - DNA, 11 bp, Homo sapiens
gtcaatatata

SEQ ID NO: 4803024 - DNA, 13 bp, Homo sapiens
gtcaatcaaacag

SEQ ID NO: 4803025 - DNA, 22 bp, Homo sapiens
gtcaatcaagatgggtgattat

SEQ ID NO: 4803026 - DNA, 20 bp, Homo sapiens
gtcaatgaaatatttgctta

SEQ ID NO: 4803027 - DNA, 21 bp, Homo sapiens
gtcaatgaaatatttgcttat

SEQ ID NO: 4803028 - DNA, 18 bp, Homo sapiens
gtcaatgtgaaataaaga

SEQ ID NO: 4803029 - DNA, 16 bp, Homo sapiens
gtcaattacaggaagt

SEQ ID NO: 4803030 - DNA, 17 bp, Homo sapiens
gtcaattgcttgagcat

SEQ ID NO: 4803031 - DNA, 20 bp, Homo sapiens
gtcaattgcttgagcatgcc

SEQ ID NO: 4803032 - DNA, 19 bp, Homo sapiens
gtcacagacccctggggga

SEQ ID NO: 4803033 - DNA, 20 bp, Homo sapiens
gtcacatatcaagtcccgag

SEQ ID NO: 4803034 - DNA, 23 bp, Homo sapiens
gtcacatatcaagtcccgaggca

SEQ ID NO: 4803035 - DNA, 18 bp, Homo sapiens
gtcaccccgctcttccca

SEQ ID NO: 4803036 - DNA, 13 bp, Homo sapiens
gtcaccttcctgg

SEQ ID NO: 4803037 - DNA, 17 bp, Homo sapiens
gtcaccttcctgggcag

SEQ ID NO: 4803038 - DNA, 23 bp, Homo sapiens
gtcaccttcctgggcagcccaga

SEQ ID NO: 4803039 - DNA, 17 bp, Homo sapiens
gtcacgtgaccctgtgc

SEQ ID NO: 4803040 - DNA, 19 bp, Homo sapiens
gtcacgtgaccctgtgccc

SEQ ID NO: 4803041 - DNA, 23 bp, Homo sapiens
gtcactcacaaaaggctggatgt

SEQ ID NO: 4803042 - DNA, 18 bp, Homo sapiens
gtcactgcccacctgcca

SEQ ID NO: 4803043 - DNA, 12 bp, Homo sapiens
gtcacttctgct

SEQ ID NO: 4803044 - DNA, 19 bp, Homo sapiens
gtcacttctgctgtacaga

SEQ ID NO: 4803045 - DNA, 18 bp, Homo sapiens
gtcacttttttcctgtca

SEQ ID NO: 4803046 - DNA, 23 bp, Homo sapiens
gtcagaagtttctgccgcagccc

SEQ ID NO: 4803047 - DNA, 14 bp, Homo sapiens
gtcagagcccagga

SEQ ID NO: 4803048 - DNA, 13 bp, Homo sapiens
gtcagcagggggg

SEQ ID NO: 4803049 - DNA, 16 bp, Homo sapiens
gtcagcccatgtcaat

SEQ ID NO: 4803050 - DNA, 19 bp, Homo sapiens
gtcagcccatgtcaatcaa

SEQ ID NO: 4803051 - DNA, 18 bp, Homo sapiens
gtcagcgattcctgccaa

SEQ ID NO: 4803052 - DNA, 17 bp, Homo sapiens
gtcagcggagaggaccc

SEQ ID NO: 4803053 - DNA, 13 bp, Homo sapiens
gtcagcttcccaa

SEQ ID NO: 4803054 - DNA, 18 bp, Homo sapiens
gtcagcttcccaacaata

SEQ ID NO: 4803055 - DNA, 13 bp, Homo sapiens
gtcaggagccagc

SEQ ID NO: 4803056 - DNA, 15 bp, Homo sapiens
gtcaggccctggaac

SEQ ID NO: 4803057 - DNA, 21 bp, Homo sapiens
gtcaggctctgaatctctcaa

SEQ ID NO: 4803058 - DNA, 20 bp, Homo sapiens
gtgagggcaaaccaggctgc

SEQ ID NO: 4803059 - DNA, 19 bp, Homo sapiens
gtgaggtcctgtcctggct

SEQ ID NO: 4803060 - DNA, 17 bp, Homo sapiens
gtgaggttgtgctgcct

SEQ ID NO: 4803061 - DNA, 14 bp, Homo sapiens
gtgaggtttcagta

SEQ ID NO: 4803062 - DNA, 15 bp, Homo sapiens
gtgagtgtggcttag

SEQ ID NO: 4803063 - DNA, 15 bp, Homo sapiens
gtgagttggggcgac

SEQ ID NO: 4803064 - DNA, 16 bp, Homo sapiens
gtgatatgtgtaatat

SEQ ID NO: 4803065 - DNA, 19 bp, Homo sapiens
gtgatatgtgtaatatcat

SEQ ID NO: 4803066 - DNA, 20 bp, Homo sapiens
gtgatccacccgcctcagcc

SEQ ID NO: 4803067 - DNA, 16 bp, Homo sapiens
gtgatgaatttaccat

SEQ ID NO: 4803068 - DNA, 22 bp, Homo sapiens
gtgatgcgcatgtcacggaggg

SEQ ID NO: 4803069 - DNA, 15 bp, Homo sapiens
gtgatgtggtggccg

SEQ ID NO: 4803070 - DNA, 22 bp, Homo sapiens
gtgatttctcaccctctgtcct

SEQ ID NO: 4803071 - DNA, 13 bp, Homo sapiens
gtgcaacagactg

SEQ ID NO: 4803072 - DNA, 23 bp, Homo sapiens
gtgcaatttgtttgtgcttctaa

SEQ ID NO: 4803073 - DNA, 12 bp, Homo sapiens
gtgcacacacac

SEQ ID NO: 4803074 - DNA, 15 bp, Homo sapiens
gtgcacctgccccag

SEQ ID NO: 4803075 - DNA, 21 bp, Homo sapiens
gtgcacctgccccaggctcag

SEQ ID NO: 4803076 - DNA, 19 bp, Homo sapiens
gtgcactctactctgcgac

SEQ ID NO: 4803077 - DNA, 21 bp, Homo sapiens
gtgcagaaggtgaaatggagg

SEQ ID NO: 4803078 - DNA, 18 bp, Homo sapiens
gtgcaggcgcgcaccgcc

SEQ ID NO: 4803079 - DNA, 17 bp, Homo sapiens
gtgcagttgctgtttac

SEQ ID NO: 4803080 - DNA, 22 bp, Homo sapiens
gtgcagtttggtatgaaacaaa

SEQ ID NO: 4803081 - DNA, 13 bp, Homo sapiens
gtgcatctggcct

SEQ ID NO: 4803082 - DNA, 14 bp, Homo sapiens
gtgcatctggcctg

SEQ ID NO: 4803083 - DNA, 16 bp, Homo sapiens
gtgcatgagaatgtca

SEQ ID NO: 4803084 - DNA, 18 bp, Homo sapiens
gtgcatgagaatgtcatt

SEQ ID NO: 4803085 - DNA, 19 bp, Homo sapiens
gtgcatgagaatgtcattt

SEQ ID NO: 4803086 - DNA, 21 bp, Homo sapiens
gtgcatgagaatgtcatttgc

SEQ ID NO: 4803087 - DNA, 17 bp, Homo sapiens
gtgcatgcaaaaatgaa

SEQ ID NO: 4803088 - DNA, 20 bp, Homo sapiens
gtgcatgttaaaataattat

SEQ ID NO: 4803089 - DNA, 16 bp, Homo sapiens
gtgccaaaaggcccct

SEQ ID NO: 4803090 - DNA, 18 bp, Homo sapiens
gtgccatggccaggagtg

SEQ ID NO: 4803091 - DNA, 20 bp, Homo sapiens
gtgcccacccgtgttctcct

SEQ ID NO: 4803092 - DNA, 15 bp, Homo sapiens
gtgccccccatgccc

SEQ ID NO: 4803093 - DNA, 15 bp, Homo sapiens
gtgccccgcctcccg

SEQ ID NO: 4803094 - DNA, 20 bp, Homo sapiens
gtgcctaactccttacagaa

SEQ ID NO: 4803095 - DNA, 15 bp, Homo sapiens
gtgcctcaagagaag

SEQ ID NO: 4803096 - DNA, 14 bp, Homo sapiens
gtgcctcagtgaga

SEQ ID NO: 4803097 - DNA, 19 bp, Homo sapiens
gtgcctcccagccctgccc

SEQ ID NO: 4803098 - DNA, 20 bp, Homo sapiens
gtgcctcccagccctgccca

SEQ ID NO: 4803099 - DNA, 16 bp, Homo sapiens
gtgcctctctctccca

SEQ ID NO: 4803100 - DNA, 15 bp, Homo sapiens
gtgccttccaccctg

SEQ ID NO: 4803101 - DNA, 14 bp, Homo sapiens
gtgccttccccgtg

SEQ ID NO: 4803102 - DNA, 20 bp, Homo sapiens
gtgccttccccgtgcggccc

SEQ ID NO: 4803103 - DNA, 11 bp, Homo sapiens
gtgccttgggc

SEQ ID NO: 4803104 - DNA, 17 bp, Homo sapiens
gtgcgacttcacaaaat

SEQ ID NO: 4803105 - DNA, 15 bp, Homo sapiens
gtgcgcagccgcgct

SEQ ID NO: 4803106 - DNA, 23 bp, Homo sapiens
gtgcgcagccgcgctctgcccct

SEQ ID NO: 4803107 - DNA, 15 bp, Homo sapiens
gtgcgccggcgcccc

SEQ ID NO: 4803108 - DNA, 19 bp, Homo sapiens
gtgcgctagagcattctgg

SEQ ID NO: 4803109 - DNA, 19 bp, Homo sapiens
gtgcggcccgtgcgcagcc

SEQ ID NO: 4803110 - DNA, 22 bp, Homo sapiens
gtgcgtgaccggcccgccacct

SEQ ID NO: 4803111 - DNA, 21 bp, Homo sapiens
gtgcgtgtggccctgtgggag

SEQ ID NO: 4803112 - DNA, 14 bp, Homo sapiens
gtgctattaatatt

SEQ ID NO: 4803113 - DNA, 16 bp, Homo sapiens
gtgctcaaaatgcaaa

SEQ ID NO: 4803114 - DNA, 13 bp, Homo sapiens
gtgctcagggcat

SEQ ID NO: 4803115 - DNA, 14 bp, Homo sapiens
gtgctcagggcatg

SEQ ID NO: 4803116 - DNA, 15 bp, Homo sapiens
gtgctcatcagaaac

SEQ ID NO: 4803117 - DNA, 22 bp, Homo sapiens
gtgctcatcagaaacaatttct

SEQ ID NO: 4803118 - DNA, 17 bp, Homo sapiens
gtgctcttctgttctca

SEQ ID NO: 4803119 - DNA, 21 bp, Homo sapiens
gtgctgtcatgcccagcttgg

SEQ ID NO: 4803120 - DNA, 23 bp, Homo sapiens
gtgctgtcatgcccagcttggag

SEQ ID NO: 4803121 - DNA, 13 bp, Homo sapiens
gtgctgtgggcag

SEQ ID NO: 4803122 - DNA, 14 bp, Homo sapiens
gtgctgttgattct

SEQ ID NO: 4803123 - DNA, 22 bp, Homo sapiens
gtgcttagcaaaaaataatgac

SEQ ID NO: 4803124 - DNA, 18 bp, Homo sapiens
gtgcttatgtcatttctt

SEQ ID NO: 4803125 - DNA, 21 bp, Homo sapiens
gtgcttatgtcatttcttctc

SEQ ID NO: 4803126 - DNA, 21 bp, Homo sapiens
gtgcttattgatattctaaga

SEQ ID NO: 4803127 - DNA, 14 bp, Homo sapiens
gtgcttcacacaaa

SEQ ID NO: 4803128 - DNA, 19 bp, Homo sapiens
gtgcttcacacaaagtgaa

SEQ ID NO: 4803129 - DNA, 19 bp, Homo sapiens
gtgcttccgagattcagac

SEQ ID NO: 4803130 - DNA, 21 bp, Homo sapiens
gtgcttctaatatttattgct

SEQ ID NO: 4803131 - DNA, 21 bp, Homo sapiens
gtgcttgtgtgtatgtctatg

SEQ ID NO: 4803132 - DNA, 18 bp, Homo sapiens
gtgctttatccacattgt

SEQ ID NO: 4803133 - DNA, 13 bp, Homo sapiens
gtgctttcatgtt

SEQ ID NO: 4803134 - DNA, 16 bp, Homo sapiens
gtggaaaactcacaga

SEQ ID NO: 4803135 - DNA, 16 bp, Homo sapiens
gtggaagacagagatg

SEQ ID NO: 4803136 - DNA, 20 bp, Homo sapiens
gtggaagacagagatggcag

SEQ ID NO: 4803137 - DNA, 20 bp, Homo sapiens
gtggaagagctgctgtattt

SEQ ID NO: 4803138 - DNA, 17 bp, Homo sapiens
gtggaagggcaggagct

SEQ ID NO: 4803139 - DNA, 23 bp, Homo sapiens
gtggaattacataacaggcattg

SEQ ID NO: 4803140 - DNA, 14 bp, Homo sapiens
gtggacagcagctg

SEQ ID NO: 4803141 - DNA, 19 bp, Homo sapiens
gtggacagcagctggactg

SEQ ID NO: 4803142 - DNA, 20 bp, Homo sapiens
gtggacagcagctggactgg

SEQ ID NO: 4803143 - DNA, 13 bp, Homo sapiens
gtggaccacgacc

SEQ ID NO: 4803144 - DNA, 20 bp, Homo sapiens
gtggacgtgggctccaggga

SEQ ID NO: 4803145 - DNA, 16 bp, Homo sapiens
gtggactcgcgagagg

SEQ ID NO: 4803146 - DNA, 14 bp, Homo sapiens
gtggactgcgctgg

SEQ ID NO: 4803147 - DNA, 15 bp, Homo sapiens
gtggagaagtgtgtt

SEQ ID NO: 4803148 - DNA, 12 bp, Homo sapiens
gtggaggatgga

SEQ ID NO: 4803149 - DNA, 20 bp, Homo sapiens
gtggatactggggggcaggc

SEQ ID NO: 4803150 - DNA, 23 bp, Homo sapiens
gtggatactggggggcaggcctc

SEQ ID NO: 4803151 - DNA, 12 bp, Homo sapiens
gtggatgaaaaa

SEQ ID NO: 4803152 - DNA, 12 bp, Homo sapiens
gtggatgctctt

SEQ ID NO: 4803153 - DNA, 15 bp, Homo sapiens
gtggattgttttttc

SEQ ID NO: 4803154 - DNA, 18 bp, Homo sapiens
gtggcaagctcttcattg

SEQ ID NO: 4803155 - DNA, 17 bp, Homo sapiens
gtggcacacaactgtgg

SEQ ID NO: 4803156 - DNA, 20 bp, Homo sapiens
gtggcaccagatgcaacctc

SEQ ID NO: 4803157 - DNA, 20 bp, Homo sapiens
gtggcaggcacacagcagcc

SEQ ID NO: 4803158 - DNA, 22 bp, Homo sapiens
gtggcaggcacacagcagcccc

SEQ ID NO: 4803159 - DNA, 19 bp, Homo sapiens
gtggcatcatctcagctca

SEQ ID NO: 4803160 - DNA, 15 bp, Homo sapiens
gtggccagcccgcag

SEQ ID NO: 4803161 - DNA, 19 bp, Homo sapiens
gtggccagcccgcagaggt

SEQ ID NO: 4803162 - DNA, 18 bp, Homo sapiens
gtggccatccctgggccc

SEQ ID NO: 4803163 - DNA, 20 bp, Homo sapiens
gtggccatccctgggcccct

SEQ ID NO: 4803164 - DNA, 17 bp, Homo sapiens
gtggcccctccttctcc

SEQ ID NO: 4803165 - DNA, 22 bp, Homo sapiens
gtggcccctccttctcccctcc

SEQ ID NO: 4803166 - DNA, 17 bp, Homo sapiens
gtggccctgccctctcc

SEQ ID NO: 4803167 - DNA, 22 bp, Homo sapiens
gtggccgggctggggaggcctg

SEQ ID NO: 4803168 - DNA, 19 bp, Homo sapiens
gtggcctacaaatcagtaa

SEQ ID NO: 4803169 - DNA, 23 bp, Homo sapiens
gtggcctggcttctgggacaggc

SEQ ID NO: 4803170 - DNA, 22 bp, Homo sapiens
gtggcctgggtcctcggccctg

SEQ ID NO: 4803171 - DNA, 19 bp, Homo sapiens
gtggccttgagtctctgaa

SEQ ID NO: 4803172 - DNA, 15 bp, Homo sapiens
gtggcgagtccagac

SEQ ID NO: 4803173 - DNA, 19 bp, Homo sapiens
gtggcgcgatctcagctca

SEQ ID NO: 4803174 - DNA, 15 bp, Homo sapiens
gtggctggagcccca

SEQ ID NO: 4803175 - DNA, 22 bp, Homo sapiens
gtggctgtcaaatccatgtgtc

SEQ ID NO: 4803176 - DNA, 22 bp, Homo sapiens
gtgggagtcaagtgtgcctgct

SEQ ID NO: 4803177 - DNA, 18 bp, Homo sapiens
gtgggatccagagagaag

SEQ ID NO: 4803178 - DNA, 23 bp, Homo sapiens
gtgggatcttacccacttccctg

SEQ ID NO: 4803179 - DNA, 15 bp, Homo sapiens
taaacctatctgtat

SEQ ID NO: 4803180 - DNA, 21 bp, Homo sapiens
taaacctgtgctttcatgttt

SEQ ID NO: 4803181 - DNA, 17 bp, Homo sapiens
taaacctgttcctgact

SEQ ID NO: 4803182 - DNA, 14 bp, Homo sapiens
taaaccttaatatt

SEQ ID NO: 4803183 - DNA, 21 bp, Homo sapiens
taaactaccaccctcgctgcc

SEQ ID NO: 4803184 - DNA, 22 bp, Homo sapiens
taaactaccaccctcgctgcca

SEQ ID NO: 4803185 - DNA, 14 bp, Homo sapiens
taaactgggaaatg

SEQ ID NO: 4803186 - DNA, 12 bp, Homo sapiens
taaactgtgaga

SEQ ID NO: 4803187 - DNA, 14 bp, Homo sapiens
taaacttctactga

SEQ ID NO: 4803188 - DNA, 17 bp, Homo sapiens
taaacttctactgagca

SEQ ID NO: 4803189 - DNA, 14 bp, Homo sapiens
taaacttttaccac

SEQ ID NO: 4803190 - DNA, 14 bp, Homo sapiens
taaagaaaaagata

SEQ ID NO: 4803191 - DNA, 17 bp, Homo sapiens
taaagaaaccttttaaa

SEQ ID NO: 4803192 - DNA, 18 bp, Homo sapiens
taaagaagtccatgtgat

SEQ ID NO: 4803193 - DNA, 14 bp, Homo sapiens
taaagacagaaaaa

SEQ ID NO: 4803194 - DNA, 20 bp, Homo sapiens
taaagacagaaaaaaataaa

SEQ ID NO: 4803195 - DNA, 15 bp, Homo sapiens
taaagagtaaatata

SEQ ID NO: 4803196 - DNA, 15 bp, Homo sapiens
taaagagttctcctt

SEQ ID NO: 4803197 - DNA, 18 bp, Homo sapiens
taaagagttctccttgta

SEQ ID NO: 4803198 - DNA, 15 bp, Homo sapiens
taaagatattgtatc

SEQ ID NO: 4803199 - DNA, 16 bp, Homo sapiens
taaagatattgtatct

SEQ ID NO: 4803200 - DNA, 17 bp, Homo sapiens
taaagatattgtatctc

SEQ ID NO: 4803201 - DNA, 24 bp, Homo sapiens
taaagatattgtatctcctttaat

SEQ ID NO: 4803202 - DNA, 19 bp, Homo sapiens
taaagatctttttttaagt

SEQ ID NO: 4803203 - DNA, 20 bp, Homo sapiens
taaagatctttttttaagtg

SEQ ID NO: 4803204 - DNA, 22 bp, Homo sapiens
taaagatctttttttaagtgtt

SEQ ID NO: 4803205 - DNA, 21 bp, Homo sapiens
taaagcaagctcacttgcttt

SEQ ID NO: 4803206 - DNA, 13 bp, Homo sapiens
taaagctcacact

SEQ ID NO: 4803207 - DNA, 14 bp, Homo sapiens
taaagctcacactt

SEQ ID NO: 4803208 - DNA, 19 bp, Homo sapiens
taaagctcacacttgggct

SEQ ID NO: 4803209 - DNA, 16 bp, Homo sapiens
taaaggtgatgaattt

SEQ ID NO: 4803210 - DNA, 15 bp, Homo sapiens
taaaggttactgttt

SEQ ID NO: 4803211 - DNA, 18 bp, Homo sapiens
taaaggttactgttttta

SEQ ID NO: 4803212 - DNA, 13 bp, Homo sapiens
taaaggttctatg

SEQ ID NO: 4803213 - DNA, 21 bp, Homo sapiens
taaagtattccaccttaaatt

SEQ ID NO: 4803214 - DNA, 15 bp, Homo sapiens
taaagtctacactgc

SEQ ID NO: 4803215 - DNA, 20 bp, Homo sapiens
taaagttccatgaagacaaa

SEQ ID NO: 4803216 - DNA, 13 bp, Homo sapiens
taaataaaaatag

SEQ ID NO: 4803217 - DNA, 12 bp, Homo sapiens
taaataaaataa

SEQ ID NO: 4803218 - DNA, 23 bp, Homo sapiens
taaataaacacatagattcacct

SEQ ID NO: 4803219 - DNA, 16 bp, Homo sapiens
taaataaataaaaata

SEQ ID NO: 4803220 - DNA, 15 bp, Homo sapiens
taaataaatgctgct

SEQ ID NO: 4803221 - DNA, 13 bp, Homo sapiens
taaataactgtga

SEQ ID NO: 4803222 - DNA, 14 bp, Homo sapiens
taaataactgtgac

SEQ ID NO: 4803223 - DNA, 17 bp, Homo sapiens
taaataagtaaatacat

SEQ ID NO: 4803224 - DNA, 19 bp, Homo sapiens
taaataataaaggttctat

SEQ ID NO: 4803225 - DNA, 21 bp, Homo sapiens
taaataataaaggttctatga

SEQ ID NO: 4803226 - DNA, 14 bp, Homo sapiens
taaataatctcatc

SEQ ID NO: 4803227 - DNA, 13 bp, Homo sapiens
taaatagcatctg

SEQ ID NO: 4803228 - DNA, 16 bp, Homo sapiens
taaatagcatctgctc

SEQ ID NO: 4803229 - DNA, 17 bp, Homo sapiens
taaatagtaaataatga

SEQ ID NO: 4803230 - DNA, 22 bp, Homo sapiens
taaatagtatccaactttgtag

SEQ ID NO: 4803231 - DNA, 14 bp, Homo sapiens
taaatagtgaaaat

SEQ ID NO: 4803232 - DNA, 12 bp, Homo sapiens
taaatatacaac

SEQ ID NO: 4803233 - DNA, 15 bp, Homo sapiens
taaatatatgtatgt

SEQ ID NO: 4803234 - DNA, 16 bp, Homo sapiens
taaatatatgtatgta

SEQ ID NO: 4803235 - DNA, 23 bp, Homo sapiens
taaatatctagtgctaaacctat

SEQ ID NO: 4803236 - DNA, 13 bp, Homo sapiens
taaatattgctgt

SEQ ID NO: 4803237 - DNA, 20 bp, Homo sapiens
taaatattgctgtctgaaaa

SEQ ID NO: 4803238 - DNA, 17 bp, Homo sapiens
taaatcacagatttcca

SEQ ID NO: 4803239 - DNA, 18 bp, Homo sapiens
taaatcacagatttccaa

SEQ ID NO: 4803240 - DNA, 23 bp, Homo sapiens
taaatccaatagtctgccacaag

SEQ ID NO: 4803241 - DNA, 22 bp, Homo sapiens
taaatcctttacaagatggaga

SEQ ID NO: 4803242 - DNA, 17 bp, Homo sapiens
taaatctaaattaactt

SEQ ID NO: 4803243 - DNA, 18 bp, Homo sapiens
taaatctatctctatata

SEQ ID NO: 4803244 - DNA, 19 bp, Homo sapiens
taaatctatctctatataa

SEQ ID NO: 4803245 - DNA, 21 bp, Homo sapiens
taaatctatctctatataaaa

SEQ ID NO: 4803246 - DNA, 15 bp, Homo sapiens
taaatctttgttaaa

SEQ ID NO: 4803247 - DNA, 14 bp, Homo sapiens
taaatgaaatactt

SEQ ID NO: 4803248 - DNA, 12 bp, Homo sapiens
taaatgaagatg

SEQ ID NO: 4803249 - DNA, 16 bp, Homo sapiens
taaatgaagatgcatt

SEQ ID NO: 4803250 - DNA, 19 bp, Homo sapiens
taaatgatatgtctttaaa

SEQ ID NO: 4803251 - DNA, 16 bp, Homo sapiens
taaatgcaaacactgt

SEQ ID NO: 4803252 - DNA, 17 bp, Homo sapiens
taaatgcaaacactgtg

SEQ ID NO: 4803253 - DNA, 14 bp, Homo sapiens
taaatgctgctttg

SEQ ID NO: 4803254 - DNA, 20 bp, Homo sapiens
taaatgtactacatttgcat

SEQ ID NO: 4803255 - DNA, 22 bp, Homo sapiens
taaatgtcccaaataaatttat

SEQ ID NO: 4803256 - DNA, 15 bp, Homo sapiens
taaatgtcttcatgt

SEQ ID NO: 4803257 - DNA, 13 bp, Homo sapiens
taaatgtgtaaat

SEQ ID NO: 4803258 - DNA, 15 bp, Homo sapiens
taaatgtgtgtatgt

SEQ ID NO: 4803259 - DNA, 16 bp, Homo sapiens
taaatgtgtgtatgtg

SEQ ID NO: 4803260 - DNA, 14 bp, Homo sapiens
taaattaaacaatt

SEQ ID NO: 4803261 - DNA, 16 bp, Homo sapiens
taaattaaataaaata

SEQ ID NO: 4803262 - DNA, 21 bp, Homo sapiens
taaattaaatatatgtatgta

SEQ ID NO: 4803263 - DNA, 19 bp, Homo sapiens
taaattaacaaattcagtg

SEQ ID NO: 4803264 - DNA, 21 bp, Homo sapiens
taaattacatgcatgagcacc

SEQ ID NO: 4803265 - DNA, 21 bp, Homo sapiens
taaattataatgcatctaaac

SEQ ID NO: 4803266 - DNA, 19 bp, Homo sapiens
taaattatatgatatgcat

SEQ ID NO: 4803267 - DNA, 22 bp, Homo sapiens
taaattatatgatatgcatgta

SEQ ID NO: 4803268 - DNA, 15 bp, Homo sapiens
taaattatcattgtt

SEQ ID NO: 4803269 - DNA, 11 bp, Homo sapiens
taaattatgac

SEQ ID NO: 4803270 - DNA, 13 bp, Homo sapiens
taaattattactt

SEQ ID NO: 4803271 - DNA, 17 bp, Homo sapiens
taaattattactttaaa

SEQ ID NO: 4803272 - DNA, 16 bp, Homo sapiens
taaattatttctaaaa

SEQ ID NO: 4803273 - DNA, 23 bp, Homo sapiens
taaattttataaggctgactctt

SEQ ID NO: 4803274 - DNA, 15 bp, Homo sapiens
taaattttatctcag

SEQ ID NO: 4803275 - DNA, 18 bp, Homo sapiens
taaattttctttaagtca

SEQ ID NO: 4803276 - DNA, 16 bp, Homo sapiens
taaattttctttttct

SEQ ID NO: 4803277 - DNA, 13 bp, Homo sapiens
taaattttggaag

SEQ ID NO: 4803278 - DNA, 23 bp, Homo sapiens
taaattttggaagaattcatgat

SEQ ID NO: 4803279 - DNA, 24 bp, Homo sapiens
taaattttggaagaattcatgatg

SEQ ID NO: 4803280 - DNA, 13 bp, Homo sapiens
taacaaagtgaga

SEQ ID NO: 4803281 - DNA, 23 bp, Homo sapiens
taacaacaatttaggaatgctca

SEQ ID NO: 4803282 - DNA, 17 bp, Homo sapiens
taacaatgcctattgta

SEQ ID NO: 4803283 - DNA, 21 bp, Homo sapiens
taacaatgcctattgtaatat

SEQ ID NO: 4803284 - DNA, 17 bp, Homo sapiens
taacaatgccttgttgt

SEQ ID NO: 4803285 - DNA, 18 bp, Homo sapiens
taacaatgccttgttgta

SEQ ID NO: 4803286 - DNA, 12 bp, Homo sapiens
taacagctgtat

SEQ ID NO: 4803287 - DNA, 17 bp, Homo sapiens
taacaggcattgcacta

SEQ ID NO: 4803288 - DNA, 14 bp, Homo sapiens
taacagtaaatata

SEQ ID NO: 4803289 - DNA, 16 bp, Homo sapiens
taacagtaaatataca

SEQ ID NO: 4803290 - DNA, 18 bp, Homo sapiens
taacagtaaatatacact

SEQ ID NO: 4803291 - DNA, 19 bp, Homo sapiens
taacagtaactgccatttt

SEQ ID NO: 4803292 - DNA, 16 bp, Homo sapiens
taacagtatttccata

SEQ ID NO: 4803293 - DNA, 23 bp, Homo sapiens
taacataagctagaaaaattaga

SEQ ID NO: 4803294 - DNA, 20 bp, Homo sapiens
taacatatcattcagaatgt

SEQ ID NO: 4803295 - DNA, 20 bp, Homo sapiens
taacatcactatccatgcac

SEQ ID NO: 4803296 - DNA, 19 bp, Homo sapiens
taacattctatttcaactt

SEQ ID NO: 4803297 - DNA, 12 bp, Homo sapiens
taacattgtaaa

SEQ ID NO: 4803298 - DNA, 17 bp, Homo sapiens
taacattgtaaatgata

SEQ ID NO: 4803299 - DNA, 14 bp, Homo sapiens
taaccacaactttc

SEQ ID NO: 4803300 - DNA, 21 bp, Homo sapiens
taaccacaactttcactataa

SEQ ID NO: 4803301 - DNA, 20 bp, Homo sapiens
tacatgggtgttttgatctc

SEQ ID NO: 4803302 - DNA, 19 bp, Homo sapiens
tacattagacacacatata

SEQ ID NO: 4803303 - DNA, 16 bp, Homo sapiens
tacattagtgagattt

SEQ ID NO: 4803304 - DNA, 15 bp, Homo sapiens
tacattatttctgta

SEQ ID NO: 4803305 - DNA, 19 bp, Homo sapiens
tacattcttgctctgctca

SEQ ID NO: 4803306 - DNA, 21 bp, Homo sapiens
tacattcttgctctgctcatc

SEQ ID NO: 4803307 - DNA, 20 bp, Homo sapiens
tacatttatgtgtgaagcaa

SEQ ID NO: 4803308 - DNA, 22 bp, Homo sapiens
tacatttgcatgccttttgggt

SEQ ID NO: 4803309 - DNA, 17 bp, Homo sapiens
taccaaatataaacttg

SEQ ID NO: 4803310 - DNA, 14 bp, Homo sapiens
taccaaatgccttt

SEQ ID NO: 4803311 - DNA, 14 bp, Homo sapiens
taccacagctgcct

SEQ ID NO: 4803312 - DNA, 16 bp, Homo sapiens
taccacagctgcctcc

SEQ ID NO: 4803313 - DNA, 19 bp, Homo sapiens
taccaccctcgctgccacc

SEQ ID NO: 4803314 - DNA, 14 bp, Homo sapiens
taccagactgcagg

SEQ ID NO: 4803315 - DNA, 15 bp, Homo sapiens
taccagactgcaggt

SEQ ID NO: 4803316 - DNA, 21 bp, Homo sapiens
taccagactgcaggttggacc

SEQ ID NO: 4803317 - DNA, 16 bp, Homo sapiens
taccagccctggggct

SEQ ID NO: 4803318 - DNA, 19 bp, Homo sapiens
taccagccctggggctggg

SEQ ID NO: 4803319 - DNA, 15 bp, Homo sapiens
taccagttcttgcaa

SEQ ID NO: 4803320 - DNA, 20 bp, Homo sapiens
taccatagcttaagaagtat

SEQ ID NO: 4803321 - DNA, 13 bp, Homo sapiens
taccatcaaacaa

SEQ ID NO: 4803322 - DNA, 14 bp, Homo sapiens
taccatcaaacaaa

SEQ ID NO: 4803323 - DNA, 15 bp, Homo sapiens
taccatgttaaagag

SEQ ID NO: 4803324 - DNA, 21 bp, Homo sapiens
taccattatggctttgtgctt

SEQ ID NO: 4803325 - DNA, 15 bp, Homo sapiens
taccattttgaaata

SEQ ID NO: 4803326 - DNA, 15 bp, Homo sapiens
tacccacttccctgc

SEQ ID NO: 4803327 - DNA, 19 bp, Homo sapiens
taccccagaacgcatgcag

SEQ ID NO: 4803328 - DNA, 19 bp, Homo sapiens
taccccaggacgcatgcag

SEQ ID NO: 4803329 - DNA, 19 bp, Homo sapiens
taccccaggatgcatgcag

SEQ ID NO: 4803330 - DNA, 14 bp, Homo sapiens
taccccctgcccca

SEQ ID NO: 4803331 - DNA, 14 bp, Homo sapiens
tacccggtggcttc

SEQ ID NO: 4803332 - DNA, 17 bp, Homo sapiens
taccctaggtctccacc

SEQ ID NO: 4803333 - DNA, 22 bp, Homo sapiens
taccctaggtctccacccctca

SEQ ID NO: 4803334 - DNA, 22 bp, Homo sapiens
taccctcagaatattaagcaca

SEQ ID NO: 4803335 - DNA, 16 bp, Homo sapiens
taccgcccacccagca

SEQ ID NO: 4803336 - DNA, 17 bp, Homo sapiens
taccgcccacccagcag

SEQ ID NO: 4803337 - DNA, 13 bp, Homo sapiens
taccggagctcca

SEQ ID NO: 4803338 - DNA, 14 bp, Homo sapiens
taccggagctccag

SEQ ID NO: 4803339 - DNA, 19 bp, Homo sapiens
tacctaagtaaattttctt

SEQ ID NO: 4803340 - DNA, 14 bp, Homo sapiens
tacctataaatgga

SEQ ID NO: 4803341 - DNA, 21 bp, Homo sapiens
tacctataaatggacttgctt

SEQ ID NO: 4803342 - DNA, 18 bp, Homo sapiens
tacctattgctgtaaata

SEQ ID NO: 4803343 - DNA, 18 bp, Homo sapiens
tacctcaacaagaagaat

SEQ ID NO: 4803344 - DNA, 19 bp, Homo sapiens
tacctcaacaagaagaatt

SEQ ID NO: 4803345 - DNA, 12 bp, Homo sapiens
tacctcatttgc

SEQ ID NO: 4803346 - DNA, 15 bp, Homo sapiens
tacctcatttgcatc

SEQ ID NO: 4803347 - DNA, 15 bp, Homo sapiens
tacctctaataacct

SEQ ID NO: 4803348 - DNA, 18 bp, Homo sapiens
tacctgccaggaagccag

SEQ ID NO: 4803349 - DNA, 23 bp, Homo sapiens
tacctgcctgggacagccactgg

SEQ ID NO: 4803350 - DNA, 21 bp, Homo sapiens
tacctggaatcaaataaaaat

SEQ ID NO: 4803351 - DNA, 14 bp, Homo sapiens
tacctgtaggtcta

SEQ ID NO: 4803352 - DNA, 14 bp, Homo sapiens
tacctgtgaggact

SEQ ID NO: 4803353 - DNA, 15 bp, Homo sapiens
taccttatagagcac

SEQ ID NO: 4803354 - DNA, 17 bp, Homo sapiens
taccttcaacatgtgct

SEQ ID NO: 4803355 - DNA, 19 bp, Homo sapiens
tacgaggcttctctaaccc

SEQ ID NO: 4803356 - DNA, 18 bp, Homo sapiens
tacgggagggtaaggctg

SEQ ID NO: 4803357 - DNA, 15 bp, Homo sapiens
tacggtgagactctg

SEQ ID NO: 4803358 - DNA, 13 bp, Homo sapiens
tacgtgagtcctg

SEQ ID NO: 4803359 - DNA, 20 bp, Homo sapiens
tacgtgcccatttcacacaa

SEQ ID NO: 4803360 - DNA, 14 bp, Homo sapiens
tacgtgtcaatgtg

SEQ ID NO: 4803361 - DNA, 12 bp, Homo sapiens
tactaacagtaa

SEQ ID NO: 4803362 - DNA, 16 bp, Homo sapiens
tactaacagtaactgc

SEQ ID NO: 4803363 - DNA, 17 bp, Homo sapiens
tactaaccaccatttcc

SEQ ID NO: 4803364 - DNA, 23 bp, Homo sapiens
tactaacgaccgacgcccctccg

SEQ ID NO: 4803365 - DNA, 16 bp, Homo sapiens
tactaataaaatacat

SEQ ID NO: 4803366 - DNA, 17 bp, Homo sapiens
tactaataaaatacata

SEQ ID NO: 4803367 - DNA, 22 bp, Homo sapiens
tactagaaccttctaatccatg

SEQ ID NO: 4803368 - DNA, 21 bp, Homo sapiens
tactagcaataagttgaatga

SEQ ID NO: 4803369 - DNA, 17 bp, Homo sapiens
tactatagattctttat

SEQ ID NO: 4803370 - DNA, 23 bp, Homo sapiens
tactatggctgtatttttagaga

SEQ ID NO: 4803371 - DNA, 14 bp, Homo sapiens
tactattggacaga

SEQ ID NO: 4803372 - DNA, 17 bp, Homo sapiens
tactattggacagacac

SEQ ID NO: 4803373 - DNA, 17 bp, Homo sapiens
tactcaaactccattct

SEQ ID NO: 4803374 - DNA, 19 bp, Homo sapiens
tactcaagatactggacta

SEQ ID NO: 4803375 - DNA, 16 bp, Homo sapiens
tactcagtcagcccag

SEQ ID NO: 4803376 - DNA, 21 bp, Homo sapiens
tactcagtcagcccagtggga

SEQ ID NO: 4803377 - DNA, 22 bp, Homo sapiens
tactcatttggatataaatctt

SEQ ID NO: 4803378 - DNA, 19 bp, Homo sapiens
tactcctccccctcctcca

SEQ ID NO: 4803379 - DNA, 21 bp, Homo sapiens
tactccttaaaaatgtatgtt

SEQ ID NO: 4803380 - DNA, 15 bp, Homo sapiens
tactctgtgctaagt

SEQ ID NO: 4803381 - DNA, 21 bp, Homo sapiens
tactcttcagaatatggacaa

SEQ ID NO: 4803382 - DNA, 22 bp, Homo sapiens
tactgatttgggctgaatgtat

SEQ ID NO: 4803383 - DNA, 21 bp, Homo sapiens
tactgcaatgtctgtccctaa

SEQ ID NO: 4803384 - DNA, 16 bp, Homo sapiens
tactgcctttcaaagt

SEQ ID NO: 4803385 - DNA, 23 bp, Homo sapiens
tactgcctttcaaagtgcacaca

SEQ ID NO: 4803386 - DNA, 15 bp, Homo sapiens
tactggatctcttaa

SEQ ID NO: 4803387 - DNA, 14 bp, Homo sapiens
tactggggggcagg

SEQ ID NO: 4803388 - DNA, 17 bp, Homo sapiens
tactggtaagattgtta

SEQ ID NO: 4803389 - DNA, 18 bp, Homo sapiens
tactgtacagattgctgc

SEQ ID NO: 4803390 - DNA, 16 bp, Homo sapiens
tactgtactttcccag

SEQ ID NO: 4803391 - DNA, 17 bp, Homo sapiens
tactgtctgtaagagaa

SEQ ID NO: 4803392 - DNA, 23 bp, Homo sapiens
tactgtgtgtgagtgtgaatata

SEQ ID NO: 4803393 - DNA, 20 bp, Homo sapiens
tactgtttgaaacttttcaa

SEQ ID NO: 4803394 - DNA, 20 bp, Homo sapiens
tacttaaatagcatctgctc

SEQ ID NO: 4803395 - DNA, 14 bp, Homo sapiens
tacttaatagtacc

SEQ ID NO: 4803396 - DNA, 22 bp, Homo sapiens
tacttacacacctgagaatgtg

SEQ ID NO: 4803397 - DNA, 13 bp, Homo sapiens
tacttacatgggt

SEQ ID NO: 4803398 - DNA, 14 bp, Homo sapiens
tacttatattctgc

SEQ ID NO: 4803399 - DNA, 15 bp, Homo sapiens
tacttcttctgtaat

SEQ ID NO: 4803400 - DNA, 14 bp, Homo sapiens
tacttctttttggt

SEQ ID NO: 4803401 - DNA, 19 bp, Homo sapiens
tacttgaaaacttctcatt

SEQ ID NO: 4803402 - DNA, 16 bp, Homo sapiens
tacttgccctgaccat

SEQ ID NO: 4803403 - DNA, 19 bp, Homo sapiens
tacttgctccttgaataag

SEQ ID NO: 4803404 - DNA, 14 bp, Homo sapiens
tacttgtaactttt

SEQ ID NO: 4803405 - DNA, 17 bp, Homo sapiens
tacttgttatgttgtaa

SEQ ID NO: 4803406 - DNA, 18 bp, Homo sapiens
tacttgttatgttgtaat

SEQ ID NO: 4803407 - DNA, 19 bp, Homo sapiens
tacttgttatgttgtaata

SEQ ID NO: 4803408 - DNA, 12 bp, Homo sapiens
tactttaaatta

SEQ ID NO: 4803409 - DNA, 16 bp, Homo sapiens
tactttaaattatatg

SEQ ID NO: 4803410 - DNA, 22 bp, Homo sapiens
tactttaaattatatgatatgc

SEQ ID NO: 4803411 - DNA, 18 bp, Homo sapiens
tactttacaatcatgcct

SEQ ID NO: 4803412 - DNA, 15 bp, Homo sapiens
tactttcttcaaaat

SEQ ID NO: 4803413 - DNA, 22 bp, Homo sapiens
tacttttggtggagacttggat

SEQ ID NO: 4803414 - DNA, 15 bp, Homo sapiens
tagaaaaaactggaa

SEQ ID NO: 4803415 - DNA, 16 bp, Homo sapiens
tagaaaaaactggaaa

SEQ ID NO: 4803416 - DNA, 23 bp, Homo sapiens
tagaaaaaactggaaacatctga

SEQ ID NO: 4803417 - DNA, 13 bp, Homo sapiens
tagaaaaatttca

SEQ ID NO: 4803418 - DNA, 17 bp, Homo sapiens
tagaaaacaggaaaaaa

SEQ ID NO: 4803419 - DNA, 23 bp, Homo sapiens
tagaaactttggaagttttactt

SEQ ID NO: 4803420 - DNA, 13 bp, Homo sapiens
tagaaattctata

SEQ ID NO: 4803421 - DNA, 20 bp, Homo sapiens
tagaaattctataagagaca

SEQ ID NO: 4803422 - DNA, 21 bp, Homo sapiens
tagaaatttattcttatctta

SEQ ID NO: 4803423 - DNA, 22 bp, Homo sapiens
tatatagatgtctgtgtataca

SEQ ID NO: 4803424 - DNA, 23 bp, Homo sapiens
tatatagatgtctgtgtatacat

SEQ ID NO: 4803425 - DNA, 18 bp, Homo sapiens
tatatataaatatctatt

SEQ ID NO: 4803426 - DNA, 12 bp, Homo sapiens
tatatatacatt

SEQ ID NO: 4803427 - DNA, 13 bp, Homo sapiens
tatatatacatta

SEQ ID NO: 4803428 - DNA, 14 bp, Homo sapiens
tatatatacattag

SEQ ID NO: 4803429 - DNA, 16 bp, Homo sapiens
tatatatgaagtaagt

SEQ ID NO: 4803430 - DNA, 14 bp, Homo sapiens
tatatatgtacagt

SEQ ID NO: 4803431 - DNA, 16 bp, Homo sapiens
tatatattatatatac

SEQ ID NO: 4803432 - DNA, 18 bp, Homo sapiens
tatatattatatatacat

SEQ ID NO: 4803433 - DNA, 19 bp, Homo sapiens
tatatattatatatacatt

SEQ ID NO: 4803434 - DNA, 20 bp, Homo sapiens
tatatattatatatacatta

SEQ ID NO: 4803435 - DNA, 19 bp, Homo sapiens
tatatattttgaaaggaga

SEQ ID NO: 4803436 - DNA, 21 bp, Homo sapiens
tatatcagactgctttgagaa

SEQ ID NO: 4803437 - DNA, 18 bp, Homo sapiens
tatatcagcagacactcc

SEQ ID NO: 4803438 - DNA, 13 bp, Homo sapiens
tatatctatctat

SEQ ID NO: 4803439 - DNA, 16 bp, Homo sapiens
tatatctgaaaactgg

SEQ ID NO: 4803440 - DNA, 14 bp, Homo sapiens
tatatctgtggtct

SEQ ID NO: 4803441 - DNA, 14 bp, Homo sapiens
tatatgaaaactaa

SEQ ID NO: 4803442 - DNA, 16 bp, Homo sapiens
tatatgatatgcatgt

SEQ ID NO: 4803443 - DNA, 14 bp, Homo sapiens
tatatgattaaatt

SEQ ID NO: 4803444 - DNA, 15 bp, Homo sapiens
tatatgcctatattt

SEQ ID NO: 4803445 - DNA, 23 bp, Homo sapiens
tatatgcttttttgcaataagga

SEQ ID NO: 4803446 - DNA, 14 bp, Homo sapiens
tatatgtacagtta

SEQ ID NO: 4803447 - DNA, 13 bp, Homo sapiens
tatattataagtt

SEQ ID NO: 4803448 - DNA, 14 bp, Homo sapiens
tatattataagttg

SEQ ID NO: 4803449 - DNA, 14 bp, Homo sapiens
tatattatatatac

SEQ ID NO: 4803450 - DNA, 16 bp, Homo sapiens
tatattatatatacat

SEQ ID NO: 4803451 - DNA, 16 bp, Homo sapiens
tatattattttctgta

SEQ ID NO: 4803452 - DNA, 21 bp, Homo sapiens
tatattcagagatgtaccatg

SEQ ID NO: 4803453 - DNA, 13 bp, Homo sapiens
tatattcattctt

SEQ ID NO: 4803454 - DNA, 13 bp, Homo sapiens
tatattgttttat

SEQ ID NO: 4803455 - DNA, 13 bp, Homo sapiens
tatatttactgtt

SEQ ID NO: 4803456 - DNA, 14 bp, Homo sapiens
tatatttactgttt

SEQ ID NO: 4803457 - DNA, 19 bp, Homo sapiens
tatatttactgtttataat

SEQ ID NO: 4803458 - DNA, 13 bp, Homo sapiens
tatatttatcata

SEQ ID NO: 4803459 - DNA, 19 bp, Homo sapiens
tatcaaaaaacagaaaaac

SEQ ID NO: 4803460 - DNA, 17 bp, Homo sapiens
tatcacctgaattatta

SEQ ID NO: 4803461 - DNA, 21 bp, Homo sapiens
tatcacctgaattattaatga

SEQ ID NO: 4803462 - DNA, 22 bp, Homo sapiens
tatcacctgaattattaatgaa

SEQ ID NO: 4803463 - DNA, 20 bp, Homo sapiens
tatcactgctttttccttag

SEQ ID NO: 4803464 - DNA, 13 bp, Homo sapiens
tatcagaactcct

SEQ ID NO: 4803465 - DNA, 20 bp, Homo sapiens
tatcagaactcctttctaag

SEQ ID NO: 4803466 - DNA, 22 bp, Homo sapiens
tatcagaactcctttctaagga

SEQ ID NO: 4803467 - DNA, 19 bp, Homo sapiens
tatcagcagacactccagt

SEQ ID NO: 4803468 - DNA, 17 bp, Homo sapiens
tatcagctctaaagcag

SEQ ID NO: 4803469 - DNA, 21 bp, Homo sapiens
tatcagctctaaagcagagat

SEQ ID NO: 4803470 - DNA, 19 bp, Homo sapiens
tatcagggcccaaataaca

SEQ ID NO: 4803471 - DNA, 20 bp, Homo sapiens
tatcagtacaattctttgtt

SEQ ID NO: 4803472 - DNA, 14 bp, Homo sapiens
tatcagtgaatata

SEQ ID NO: 4803473 - DNA, 13 bp, Homo sapiens
tatcatgcttcta

SEQ ID NO: 4803474 - DNA, 13 bp, Homo sapiens
tatcatgtgtttc

SEQ ID NO: 4803475 - DNA, 16 bp, Homo sapiens
tatcattatagcatgt

SEQ ID NO: 4803476 - DNA, 17 bp, Homo sapiens
tatcattatagcatgta

SEQ ID NO: 4803477 - DNA, 17 bp, Homo sapiens
tatcatttcttaaccca

SEQ ID NO: 4803478 - DNA, 21 bp, Homo sapiens
tatccacagaacctttgtcaa

SEQ ID NO: 4803479 - DNA, 23 bp, Homo sapiens
tatccacattgtagcctaatatt

SEQ ID NO: 4803480 - DNA, 16 bp, Homo sapiens
tatccatgcaccaaac

SEQ ID NO: 4803481 - DNA, 21 bp, Homo sapiens
tatccccggacgcatgcaggg

SEQ ID NO: 4803482 - DNA, 20 bp, Homo sapiens
tatcctcaagttgtgtgcta

SEQ ID NO: 4803483 - DNA, 20 bp, Homo sapiens
tatcctctatccttttttcc

SEQ ID NO: 4803484 - DNA, 13 bp, Homo sapiens
tatcctgaataac

SEQ ID NO: 4803485 - DNA, 20 bp, Homo sapiens
tatcctgcaccctctgctat

SEQ ID NO: 4803486 - DNA, 21 bp, Homo sapiens
tatcctgcgggttttaattta

SEQ ID NO: 4803487 - DNA, 22 bp, Homo sapiens
tatcctttattttaaatgatct

SEQ ID NO: 4803488 - DNA, 14 bp, Homo sapiens
tatcgaaagtaaaa

SEQ ID NO: 4803489 - DNA, 17 bp, Homo sapiens
tatcgccttttgacagc

SEQ ID NO: 4803490 - DNA, 16 bp, Homo sapiens
tatcggtataaaggca

SEQ ID NO: 4803491 - DNA, 13 bp, Homo sapiens
tatctaaataatg

SEQ ID NO: 4803492 - DNA, 18 bp, Homo sapiens
tatctagtgctaaaccta

SEQ ID NO: 4803493 - DNA, 14 bp, Homo sapiens
tatctcatcaacaa

SEQ ID NO: 4803494 - DNA, 23 bp, Homo sapiens
tatctcatcaacaaagaaatatt

SEQ ID NO: 4803495 - DNA, 20 bp, Homo sapiens
tatctccagccaatttcaaa

SEQ ID NO: 4803496 - DNA, 16 bp, Homo sapiens
tatctgggttttagaa

SEQ ID NO: 4803497 - DNA, 19 bp, Homo sapiens
tatctgtattggcagcaca

SEQ ID NO: 4803498 - DNA, 21 bp, Homo sapiens
tatctgtattggcagcacagc

SEQ ID NO: 4803499 - DNA, 23 bp, Homo sapiens
tatctgtattggcagcacagcta

SEQ ID NO: 4803500 - DNA, 17 bp, Homo sapiens
tatctgtctgagccctg

SEQ ID NO: 4803501 - DNA, 19 bp, Homo sapiens
tatctgtctgagccctgcc

SEQ ID NO: 4803502 - DNA, 15 bp, Homo sapiens
tatctgtctttatga

SEQ ID NO: 4803503 - DNA, 17 bp, Homo sapiens
tatctgtgaaatatcat

SEQ ID NO: 4803504 - DNA, 12 bp, Homo sapiens
tatctgttctat

SEQ ID NO: 4803505 - DNA, 15 bp, Homo sapiens
tatcttcatgtaaat

SEQ ID NO: 4803506 - DNA, 16 bp, Homo sapiens
tatcttcatgtaaatt

SEQ ID NO: 4803507 - DNA, 23 bp, Homo sapiens
tatcttcatgtaaattgactgta

SEQ ID NO: 4803508 - DNA, 23 bp, Homo sapiens
tatcttcgttagtaatctgtata

SEQ ID NO: 4803509 - DNA, 14 bp, Homo sapiens
tatcttgaagactt

SEQ ID NO: 4803510 - DNA, 16 bp, Homo sapiens
tatgaaacaaatatac

SEQ ID NO: 4803511 - DNA, 17 bp, Homo sapiens
tatgaaacaaatatact

SEQ ID NO: 4803512 - DNA, 19 bp, Homo sapiens
tatgaaacaaatatactca

SEQ ID NO: 4803513 - DNA, 15 bp, Homo sapiens
tatgaaagagaaaat

SEQ ID NO: 4803514 - DNA, 22 bp, Homo sapiens
tatgaaatgccagacttctaaa

SEQ ID NO: 4803515 - DNA, 22 bp, Homo sapiens
tatgaacgcacaacatgcacat

SEQ ID NO: 4803516 - DNA, 17 bp, Homo sapiens
tatgaagcagaatgaga

SEQ ID NO: 4803517 - DNA, 15 bp, Homo sapiens
tatgaatctgagaga

SEQ ID NO: 4803518 - DNA, 16 bp, Homo sapiens
tatgactccagaattt

SEQ ID NO: 4803519 - DNA, 20 bp, Homo sapiens
tatgacttcttgttcatgtt

SEQ ID NO: 4803520 - DNA, 14 bp, Homo sapiens
tatgagatactttg

SEQ ID NO: 4803521 - DNA, 18 bp, Homo sapiens
tatgagcatgctccctca

SEQ ID NO: 4803522 - DNA, 20 bp, Homo sapiens
tatgagcatgctccctcatg

SEQ ID NO: 4803523 - DNA, 13 bp, Homo sapiens
tatgataaatttg

SEQ ID NO: 4803524 - DNA, 12 bp, Homo sapiens
tatgatatgcat

SEQ ID NO: 4803525 - DNA, 15 bp, Homo sapiens
tatgatatgcatgta

SEQ ID NO: 4803526 - DNA, 21 bp, Homo sapiens
tatgatgttattttgtacgtg

SEQ ID NO: 4803527 - DNA, 19 bp, Homo sapiens
tatgattaaattatcattg

SEQ ID NO: 4803528 - DNA, 17 bp, Homo sapiens
tatgatttaggcttcta

SEQ ID NO: 4803529 - DNA, 12 bp, Homo sapiens
tatgatttcatg

SEQ ID NO: 4803530 - DNA, 20 bp, Homo sapiens
tatgatttgttcctttctgg

SEQ ID NO: 4803531 - DNA, 20 bp, Homo sapiens
tatgcacaccaaattgctga

SEQ ID NO: 4803532 - DNA, 21 bp, Homo sapiens
tatgcacaccaaattgctgag

SEQ ID NO: 4803533 - DNA, 21 bp, Homo sapiens
tatgcatacaaatctcactgt

SEQ ID NO: 4803534 - DNA, 23 bp, Homo sapiens
tatgcatacaaatctcactgtat

SEQ ID NO: 4803535 - DNA, 16 bp, Homo sapiens
tatgcatgagaactaa

SEQ ID NO: 4803536 - DNA, 14 bp, Homo sapiens
tatgcatttatgca

SEQ ID NO: 4803537 - DNA, 17 bp, Homo sapiens
tatgcatttatgcatga

SEQ ID NO: 4803538 - DNA, 22 bp, Homo sapiens
tatgccatgtatgttgcatgaa

SEQ ID NO: 4803539 - DNA, 16 bp, Homo sapiens
tatgcctatatttata

SEQ ID NO: 4803540 - DNA, 18 bp, Homo sapiens
tatgcctgttgatctatg

SEQ ID NO: 4803541 - DNA, 22 bp, Homo sapiens
tatgctggaagtctcaaataat

SEQ ID NO: 4803542 - DNA, 19 bp, Homo sapiens
tatgctggccagcaccctc

SEQ ID NO: 4803543 - DNA, 14 bp, Homo sapiens
tatgctgtatctgt

SEQ ID NO: 4803544 - DNA, 13 bp, Homo sapiens
tatgcttcttgga

SEQ ID NO: 4803545 - DNA, 14 bp, Homo sapiens
tcagaactcctgtg

SEQ ID NO: 4803546 - DNA, 20 bp, Homo sapiens
tcagaactcctgtgtgtgga

SEQ ID NO: 4803547 - DNA, 12 bp, Homo sapiens
tcagaatgttgt

SEQ ID NO: 4803548 - DNA, 15 bp, Homo sapiens
tcagacacctagact

SEQ ID NO: 4803549 - DNA, 17 bp, Homo sapiens
tcagactctctcctctc

SEQ ID NO: 4803550 - DNA, 16 bp, Homo sapiens
tcagactgctttgaga

SEQ ID NO: 4803551 - DNA, 18 bp, Homo sapiens
tcagagaccgtgagcgcc

SEQ ID NO: 4803552 - DNA, 18 bp, Homo sapiens
tcagagatgtaccatgtt

SEQ ID NO: 4803553 - DNA, 19 bp, Homo sapiens
tcagagatgtccattttta

SEQ ID NO: 4803554 - DNA, 17 bp, Homo sapiens
tcagagatgttttcaag

SEQ ID NO: 4803555 - DNA, 20 bp, Homo sapiens
tcagagtgtatttttgtaat

SEQ ID NO: 4803556 - DNA, 21 bp, Homo sapiens
tcagagtgtatttttgtaatt

SEQ ID NO: 4803557 - DNA, 19 bp, Homo sapiens
tcagatctgcactcctgtc

SEQ ID NO: 4803558 - DNA, 22 bp, Homo sapiens
tcagatctgcactcctgtctct

SEQ ID NO: 4803559 - DNA, 14 bp, Homo sapiens
tcagattgtatctg

SEQ ID NO: 4803560 - DNA, 15 bp, Homo sapiens
tcagcaaattcttga

SEQ ID NO: 4803561 - DNA, 20 bp, Homo sapiens
tcagcaaattcttgaataaa

SEQ ID NO: 4803562 - DNA, 11 bp, Homo sapiens
tcagcaaccct

SEQ ID NO: 4803563 - DNA, 18 bp, Homo sapiens
tcagcaaccctacagtat

SEQ ID NO: 4803564 - DNA, 21 bp, Homo sapiens
tcagcaaccctacagtatata

SEQ ID NO: 4803565 - DNA, 17 bp, Homo sapiens
tcagcaatccttaaaaa

SEQ ID NO: 4803566 - DNA, 13 bp, Homo sapiens
tcagcactgaaaa

SEQ ID NO: 4803567 - DNA, 21 bp, Homo sapiens
tcagcactgaaaataccatca

SEQ ID NO: 4803568 - DNA, 12 bp, Homo sapiens
tcagcatcccac

SEQ ID NO: 4803569 - DNA, 16 bp, Homo sapiens
tcagcatcctggaaat

SEQ ID NO: 4803570 - DNA, 18 bp, Homo sapiens
tcagcatcctggaaattt

SEQ ID NO: 4803571 - DNA, 20 bp, Homo sapiens
tcagcatcctggaaatttgt

SEQ ID NO: 4803572 - DNA, 22 bp, Homo sapiens
tcagcatcctggaaatttgtgt

SEQ ID NO: 4803573 - DNA, 22 bp, Homo sapiens
tcagccaagaattcttaaatat

SEQ ID NO: 4803574 - DNA, 15 bp, Homo sapiens
tcagccagccgccct

SEQ ID NO: 4803575 - DNA, 23 bp, Homo sapiens
tcagccagccgccctgggctgtc

SEQ ID NO: 4803576 - DNA, 13 bp, Homo sapiens
tcagccagcttgg

SEQ ID NO: 4803577 - DNA, 17 bp, Homo sapiens
tcagccccagggccctg

SEQ ID NO: 4803578 - DNA, 18 bp, Homo sapiens
tcagccccagggccctgc

SEQ ID NO: 4803579 - DNA, 19 bp, Homo sapiens
tcagccccagggccctgct

SEQ ID NO: 4803580 - DNA, 12 bp, Homo sapiens
tcagcctgtgaa

SEQ ID NO: 4803581 - DNA, 17 bp, Homo sapiens
tcagccttggttcctga

SEQ ID NO: 4803582 - DNA, 18 bp, Homo sapiens
tcagccttggttcctgat

SEQ ID NO: 4803583 - DNA, 17 bp, Homo sapiens
tcagcgattcctgccaa

SEQ ID NO: 4803584 - DNA, 14 bp, Homo sapiens
tcagctccactctg

SEQ ID NO: 4803585 - DNA, 16 bp, Homo sapiens
tcagctccactctgaa

SEQ ID NO: 4803586 - DNA, 22 bp, Homo sapiens
tcagctctaaagcagagatgta

SEQ ID NO: 4803587 - DNA, 13 bp, Homo sapiens
tcagctctgcata

SEQ ID NO: 4803588 - DNA, 20 bp, Homo sapiens
tcagctgtgaatctgttgat

SEQ ID NO: 4803589 - DNA, 22 bp, Homo sapiens
tcaggaaatgttcactgaataa

SEQ ID NO: 4803590 - DNA, 16 bp, Homo sapiens
tcaggaagagaaggag

SEQ ID NO: 4803591 - DNA, 21 bp, Homo sapiens
tcaggaatgggccaagccagg

SEQ ID NO: 4803592 - DNA, 17 bp, Homo sapiens
tcaggaccaccctgcca

SEQ ID NO: 4803593 - DNA, 20 bp, Homo sapiens
tcaggaccaccctgccaagg

SEQ ID NO: 4803594 - DNA, 21 bp, Homo sapiens
tcaggagaaggcctgcccccc

SEQ ID NO: 4803595 - DNA, 20 bp, Homo sapiens
tcaggagagccctctgctgc

SEQ ID NO: 4803596 - DNA, 16 bp, Homo sapiens
tcaggagcacagccat

SEQ ID NO: 4803597 - DNA, 14 bp, Homo sapiens
tcaggagccagcag

SEQ ID NO: 4803598 - DNA, 23 bp, Homo sapiens
tcaggccaaactcacctgcccct

SEQ ID NO: 4803599 - DNA, 14 bp, Homo sapiens
tcaggccagctgct

SEQ ID NO: 4803600 - DNA, 21 bp, Homo sapiens
tcaggcctgggggctgggcag

SEQ ID NO: 4803601 - DNA, 16 bp, Homo sapiens
tcaggctctgaatctc

SEQ ID NO: 4803602 - DNA, 12 bp, Homo sapiens
tcaggctttcta

SEQ ID NO: 4803603 - DNA, 19 bp, Homo sapiens
tcagggaccaaggagatgg

SEQ ID NO: 4803604 - DNA, 13 bp, Homo sapiens
tcagggcaagctc

SEQ ID NO: 4803605 - DNA, 11 bp, Homo sapiens
tcagggccttg

SEQ ID NO: 4803606 - DNA, 19 bp, Homo sapiens
tcaggtcagagcccaggaa

SEQ ID NO: 4803607 - DNA, 23 bp, Homo sapiens
tcaggtgcctcaagagaaggcaa

SEQ ID NO: 4803608 - DNA, 16 bp, Homo sapiens
tcaggtggcatttgca

SEQ ID NO: 4803609 - DNA, 17 bp, Homo sapiens
tcaggtggcatttgcag

SEQ ID NO: 4803610 - DNA, 20 bp, Homo sapiens
tcagtaaaattatactgtgt

SEQ ID NO: 4803611 - DNA, 21 bp, Homo sapiens
tcagtaaaattatactgtgtg

SEQ ID NO: 4803612 - DNA, 12 bp, Homo sapiens
tcagtaatctgt

SEQ ID NO: 4803613 - DNA, 14 bp, Homo sapiens
tcagtagcatttta

SEQ ID NO: 4803614 - DNA, 13 bp, Homo sapiens
tcagtagctcctt

SEQ ID NO: 4803615 - DNA, 20 bp, Homo sapiens
tcagtagctccttggttttg

SEQ ID NO: 4803616 - DNA, 21 bp, Homo sapiens
tcagtccacccccattgtgaa

SEQ ID NO: 4803617 - DNA, 16 bp, Homo sapiens
tcagtcccacagcccc

SEQ ID NO: 4803618 - DNA, 17 bp, Homo sapiens
tcagtcccacagcccct

SEQ ID NO: 4803619 - DNA, 17 bp, Homo sapiens
tcagtccctccctcctg

SEQ ID NO: 4803620 - DNA, 19 bp, Homo sapiens
tcagtctatgctgtgtgca

SEQ ID NO: 4803621 - DNA, 14 bp, Homo sapiens
tcagtctttgtcaa

SEQ ID NO: 4803622 - DNA, 17 bp, Homo sapiens
tcagtgaagcccaggag

SEQ ID NO: 4803623 - DNA, 23 bp, Homo sapiens
tcagtgaagcccaggaggacctg

SEQ ID NO: 4803624 - DNA, 16 bp, Homo sapiens
tcagtgaatataaatg

SEQ ID NO: 4803625 - DNA, 17 bp, Homo sapiens
tcagtgaatataaatgt

SEQ ID NO: 4803626 - DNA, 18 bp, Homo sapiens
tcagtgaatataaatgta

SEQ ID NO: 4803627 - DNA, 18 bp, Homo sapiens
tcagtgcagggacagcct

SEQ ID NO: 4803628 - DNA, 19 bp, Homo sapiens
tcagtgcagggacagcctg

SEQ ID NO: 4803629 - DNA, 20 bp, Homo sapiens
tcagtgcagggacagcctgc

SEQ ID NO: 4803630 - DNA, 16 bp, Homo sapiens
tcagtggacatttgtt

SEQ ID NO: 4803631 - DNA, 18 bp, Homo sapiens
tcagtggacatttgttct

SEQ ID NO: 4803632 - DNA, 18 bp, Homo sapiens
tcagtgtcattttctgtt

SEQ ID NO: 4803633 - DNA, 18 bp, Homo sapiens
tcagtgtttatgtgctat

SEQ ID NO: 4803634 - DNA, 22 bp, Homo sapiens
tcagttcaacctggtggcacca

SEQ ID NO: 4803635 - DNA, 16 bp, Homo sapiens
tcagttctcatcttgt

SEQ ID NO: 4803636 - DNA, 13 bp, Homo sapiens
tcagttgaaaaga

SEQ ID NO: 4803637 - DNA, 14 bp, Homo sapiens
tcagttggcctctg

SEQ ID NO: 4803638 - DNA, 16 bp, Homo sapiens
tcagtttcaacatgaa

SEQ ID NO: 4803639 - DNA, 20 bp, Homo sapiens
tcagtttgtgaagtgattga

SEQ ID NO: 4803640 - DNA, 16 bp, Homo sapiens
tcataaatagtaaata

SEQ ID NO: 4803641 - DNA, 17 bp, Homo sapiens
tcataaattatttctaa

SEQ ID NO: 4803642 - DNA, 21 bp, Homo sapiens
tcataaattatttctaaaaca

SEQ ID NO: 4803643 - DNA, 15 bp, Homo sapiens
tcataactagagtat

SEQ ID NO: 4803644 - DNA, 18 bp, Homo sapiens
tcataactagagtatgtg

SEQ ID NO: 4803645 - DNA, 20 bp, Homo sapiens
tcataactagagtatgtgta

SEQ ID NO: 4803646 - DNA, 23 bp, Homo sapiens
tcataactagagtatgtgtatgt

SEQ ID NO: 4803647 - DNA, 14 bp, Homo sapiens
tcataagtaaatgt

SEQ ID NO: 4803648 - DNA, 23 bp, Homo sapiens
tcataccttctgatgaagttgta

SEQ ID NO: 4803649 - DNA, 12 bp, Homo sapiens
tcatactacatt

SEQ ID NO: 4803650 - DNA, 17 bp, Homo sapiens
tcatactgaaattgttt

SEQ ID NO: 4803651 - DNA, 13 bp, Homo sapiens
tcatacttaaaaa

SEQ ID NO: 4803652 - DNA, 15 bp, Homo sapiens
tcatagataccattt

SEQ ID NO: 4803653 - DNA, 22 bp, Homo sapiens
tcatagataccattttgaaata

SEQ ID NO: 4803654 - DNA, 14 bp, Homo sapiens
tcatagcacatgtt

SEQ ID NO: 4803655 - DNA, 16 bp, Homo sapiens
tcatagcacatgtttt

SEQ ID NO: 4803656 - DNA, 20 bp, Homo sapiens
tcatagtagaactttataaa

SEQ ID NO: 4803657 - DNA, 22 bp, Homo sapiens
tcatataatttgccagacagag

SEQ ID NO: 4803658 - DNA, 23 bp, Homo sapiens
tcatataatttgccagacagaga

SEQ ID NO: 4803659 - DNA, 17 bp, Homo sapiens
tcatatataataaatta

SEQ ID NO: 4803660 - DNA, 23 bp, Homo sapiens
tcatatatgcttttttgcaataa

SEQ ID NO: 4803661 - DNA, 20 bp, Homo sapiens
tcatatgggatactgctggt

SEQ ID NO: 4803662 - DNA, 17 bp, Homo sapiens
tcatatgtgaagacaga

SEQ ID NO: 4803663 - DNA, 16 bp, Homo sapiens
tcatcaacaaagaaat

SEQ ID NO: 4803664 - DNA, 21 bp, Homo sapiens
tcatcaagattaattaaaatt

SEQ ID NO: 4803665 - DNA, 20 bp, Homo sapiens
tcatcaagtagcgttggaga

SEQ ID NO: 4803666 - DNA, 14 bp, Homo sapiens
tcccaaataaattt

SEQ ID NO: 4803667 - DNA, 22 bp, Homo sapiens
tcccaaataaatttataacaat

SEQ ID NO: 4803668 - DNA, 22 bp, Homo sapiens
tcccaacaatactttgtgtctt

SEQ ID NO: 4803669 - DNA, 14 bp, Homo sapiens
tcccaacgtactcc

SEQ ID NO: 4803670 - DNA, 14 bp, Homo sapiens
tcccaactgctgct

SEQ ID NO: 4803671 - DNA, 15 bp, Homo sapiens
tcccaactgctgctt

SEQ ID NO: 4803672 - DNA, 20 bp, Homo sapiens
tcccaagcacctgggattac

SEQ ID NO: 4803673 - DNA, 20 bp, Homo sapiens
tcccaagtagctgagactac

SEQ ID NO: 4803674 - DNA, 20 bp, Homo sapiens
tcccaagtcaaacagtgtgg

SEQ ID NO: 4803675 - DNA, 21 bp, Homo sapiens
tcccaagtcaaacagtgtggc

SEQ ID NO: 4803676 - DNA, 15 bp, Homo sapiens
tcccaagtcctcgcc

SEQ ID NO: 4803677 - DNA, 22 bp, Homo sapiens
tcccaagtcctcgccccccgcc

SEQ ID NO: 4803678 - DNA, 23 bp, Homo sapiens
tcccaagtcctcgccccccgccc

SEQ ID NO: 4803679 - DNA, 15 bp, Homo sapiens
tcccaatcagcactg

SEQ ID NO: 4803680 - DNA, 16 bp, Homo sapiens
tcccaatcagcactga

SEQ ID NO: 4803681 - DNA, 14 bp, Homo sapiens
tcccacactgtgaa

SEQ ID NO: 4803682 - DNA, 19 bp, Homo sapiens
tcccacccccagcagctca

SEQ ID NO: 4803683 - DNA, 14 bp, Homo sapiens
tcccacctccctgc

SEQ ID NO: 4803684 - DNA, 15 bp, Homo sapiens
tcccacctctttgga

SEQ ID NO: 4803685 - DNA, 19 bp, Homo sapiens
tcccacgacataagctggt

SEQ ID NO: 4803686 - DNA, 15 bp, Homo sapiens
tcccactgcccctgc

SEQ ID NO: 4803687 - DNA, 16 bp, Homo sapiens
tcccagaaccttgatg

SEQ ID NO: 4803688 - DNA, 23 bp, Homo sapiens
tcccagccacccggatctccagg

SEQ ID NO: 4803689 - DNA, 17 bp, Homo sapiens
tcccagccctgcccaga

SEQ ID NO: 4803690 - DNA, 14 bp, Homo sapiens
tcccagctacaggg

SEQ ID NO: 4803691 - DNA, 22 bp, Homo sapiens
tcccagctacaggggaggctga

SEQ ID NO: 4803692 - DNA, 20 bp, Homo sapiens
tcccagctgtaccggccact

SEQ ID NO: 4803693 - DNA, 14 bp, Homo sapiens
tcccaggaccctgg

SEQ ID NO: 4803694 - DNA, 18 bp, Homo sapiens
tcccaggaccctgggtca

SEQ ID NO: 4803695 - DNA, 11 bp, Homo sapiens
tcccagggccc

SEQ ID NO: 4803696 - DNA, 15 bp, Homo sapiens
tcccagggcccgagc

SEQ ID NO: 4803697 - DNA, 13 bp, Homo sapiens
tcccagggccgct

SEQ ID NO: 4803698 - DNA, 15 bp, Homo sapiens
tcccagtccggtgcc

SEQ ID NO: 4803699 - DNA, 17 bp, Homo sapiens
tcccagtccggtgcctt

SEQ ID NO: 4803700 - DNA, 20 bp, Homo sapiens
tcccagtccggtgccttcca

SEQ ID NO: 4803701 - DNA, 18 bp, Homo sapiens
tcccagtgtctggcccag

SEQ ID NO: 4803702 - DNA, 15 bp, Homo sapiens
tcccatatgcctggg

SEQ ID NO: 4803703 - DNA, 16 bp, Homo sapiens
tcccatatgcctgggc

SEQ ID NO: 4803704 - DNA, 16 bp, Homo sapiens
tcccatctgaagagtg

SEQ ID NO: 4803705 - DNA, 17 bp, Homo sapiens
tcccatctgaagagtgg

SEQ ID NO: 4803706 - DNA, 18 bp, Homo sapiens
tcccatgaccttgacgtg

SEQ ID NO: 4803707 - DNA, 23 bp, Homo sapiens
tcccatggtagactgtgacacag

SEQ ID NO: 4803708 - DNA, 22 bp, Homo sapiens
tcccattactcaaaatgcagga

SEQ ID NO: 4803709 - DNA, 16 bp, Homo sapiens
tcccatttccttgtct

SEQ ID NO: 4803710 - DNA, 23 bp, Homo sapiens
tccccaagtggtttccacatgct

SEQ ID NO: 4803711 - DNA, 12 bp, Homo sapiens
tccccactcccg

SEQ ID NO: 4803712 - DNA, 23 bp, Homo sapiens
tccccagccccctggcatgtttc

SEQ ID NO: 4803713 - DNA, 16 bp, Homo sapiens
tccccagtgccagctg

SEQ ID NO: 4803714 - DNA, 18 bp, Homo sapiens
tccccagttaatgtgcca

SEQ ID NO: 4803715 - DNA, 17 bp, Homo sapiens
tccccataatgcttctt

SEQ ID NO: 4803716 - DNA, 16 bp, Homo sapiens
tccccatcgccttctg

SEQ ID NO: 4803717 - DNA, 17 bp, Homo sapiens
tccccatgctcagctca

SEQ ID NO: 4803718 - DNA, 18 bp, Homo sapiens
tccccatggaacagccct

SEQ ID NO: 4803719 - DNA, 19 bp, Homo sapiens
tccccatggaacagccctg

SEQ ID NO: 4803720 - DNA, 16 bp, Homo sapiens
tccccattgccttctg

SEQ ID NO: 4803721 - DNA, 19 bp, Homo sapiens
tccccattgccttctgggg

SEQ ID NO: 4803722 - DNA, 20 bp, Homo sapiens
tcccccacgcctccatccac

SEQ ID NO: 4803723 - DNA, 13 bp, Homo sapiens
tcccccaggctgc

SEQ ID NO: 4803724 - DNA, 20 bp, Homo sapiens
tcccccaggctgcgcctgcc

SEQ ID NO: 4803725 - DNA, 12 bp, Homo sapiens
tcccccagggtc

SEQ ID NO: 4803726 - DNA, 17 bp, Homo sapiens
tcccccagggtcccctg

SEQ ID NO: 4803727 - DNA, 19 bp, Homo sapiens
tcccccagggtcccctgca

SEQ ID NO: 4803728 - DNA, 21 bp, Homo sapiens
tcccccagggtcccctgcatg

SEQ ID NO: 4803729 - DNA, 14 bp, Homo sapiens
tcccccatgccacc

SEQ ID NO: 4803730 - DNA, 16 bp, Homo sapiens
tcccccatgccaccac

SEQ ID NO: 4803731 - DNA, 19 bp, Homo sapiens
tcccccatgccaccaccca

SEQ ID NO: 4803732 - DNA, 13 bp, Homo sapiens
tcccccctgtggt

SEQ ID NO: 4803733 - DNA, 17 bp, Homo sapiens
tccccctatccttggca

SEQ ID NO: 4803734 - DNA, 14 bp, Homo sapiens
tccccctcctccat

SEQ ID NO: 4803735 - DNA, 15 bp, Homo sapiens
tccccctcctccatg

SEQ ID NO: 4803736 - DNA, 17 bp, Homo sapiens
tccccctcctccatgct

SEQ ID NO: 4803737 - DNA, 12 bp, Homo sapiens
tccccctcctgc

SEQ ID NO: 4803738 - DNA, 16 bp, Homo sapiens
tccccgcccgccctcc

SEQ ID NO: 4803739 - DNA, 23 bp, Homo sapiens
tccccgcccgccctcctctgccc

SEQ ID NO: 4803740 - DNA, 18 bp, Homo sapiens
tcccctcactctgtcagc

SEQ ID NO: 4803741 - DNA, 12 bp, Homo sapiens
tcccctccagac

SEQ ID NO: 4803742 - DNA, 14 bp, Homo sapiens
tcccctccagaccc

SEQ ID NO: 4803743 - DNA, 13 bp, Homo sapiens
tcccctccctttt

SEQ ID NO: 4803744 - DNA, 22 bp, Homo sapiens
tcccctcgcttcataggcagag

SEQ ID NO: 4803745 - DNA, 12 bp, Homo sapiens
tcccctctcctg

SEQ ID NO: 4803746 - DNA, 13 bp, Homo sapiens
tcccctctcctga

SEQ ID NO: 4803747 - DNA, 18 bp, Homo sapiens
tcccctctcctgcatccc

SEQ ID NO: 4803748 - DNA, 16 bp, Homo sapiens
tcccctgcatggctga

SEQ ID NO: 4803749 - DNA, 17 bp, Homo sapiens
tcccctgcatggctgag

SEQ ID NO: 4803750 - DNA, 12 bp, Homo sapiens
tcccctggccct

SEQ ID NO: 4803751 - DNA, 14 bp, Homo sapiens
tcccctggcccttc

SEQ ID NO: 4803752 - DNA, 20 bp, Homo sapiens
tcccctggtcctgcactgtc

SEQ ID NO: 4803753 - DNA, 16 bp, Homo sapiens
tcccctggtgcccctc

SEQ ID NO: 4803754 - DNA, 16 bp, Homo sapiens
tccccttgccacatcg

SEQ ID NO: 4803755 - DNA, 13 bp, Homo sapiens
tcccgaggcagca

SEQ ID NO: 4803756 - DNA, 23 bp, Homo sapiens
tcccgaggcagcaacaggaccag

SEQ ID NO: 4803757 - DNA, 15 bp, Homo sapiens
tcccgcagcaccagc

SEQ ID NO: 4803758 - DNA, 23 bp, Homo sapiens
tcccgcagcaccagcctgagcca

SEQ ID NO: 4803759 - DNA, 23 bp, Homo sapiens
tcccgcagcgggcgcgggacagg

SEQ ID NO: 4803760 - DNA, 14 bp, Homo sapiens
tcccgcatgctgcc

SEQ ID NO: 4803761 - DNA, 20 bp, Homo sapiens
tcccgccagggagtgtgatg

SEQ ID NO: 4803762 - DNA, 15 bp, Homo sapiens
tcccgccattggcct

SEQ ID NO: 4803763 - DNA, 16 bp, Homo sapiens
tcccgccattggcctt

SEQ ID NO: 4803764 - DNA, 17 bp, Homo sapiens
tcccgccattggcctta

SEQ ID NO: 4803765 - DNA, 13 bp, Homo sapiens
tcccgccgcctcg

SEQ ID NO: 4803766 - DNA, 15 bp, Homo sapiens
tcccgccgcctcggg

SEQ ID NO: 4803767 - DNA, 23 bp, Homo sapiens
tcccgccgcctcgggccgcctcc

SEQ ID NO: 4803768 - DNA, 19 bp, Homo sapiens
tcccggctctgaggctgcc

SEQ ID NO: 4803769 - DNA, 19 bp, Homo sapiens
tcccgggaacgcttgctct

SEQ ID NO: 4803770 - DNA, 22 bp, Homo sapiens
tcccgggcactgtcatgcccag

SEQ ID NO: 4803771 - DNA, 22 bp, Homo sapiens
tcccgggtgccccccatgccct

SEQ ID NO: 4803772 - DNA, 14 bp, Homo sapiens
tcccggtgtgcagc

SEQ ID NO: 4803773 - DNA, 18 bp, Homo sapiens
tcccgtccgtccgcccgc

SEQ ID NO: 4803774 - DNA, 23 bp, Homo sapiens
tcccgtccgtccgcccgcccacc

SEQ ID NO: 4803775 - DNA, 15 bp, Homo sapiens
tcccgtctgattgtt

SEQ ID NO: 4803776 - DNA, 20 bp, Homo sapiens
tcccgtgtcgtaacagcagg

SEQ ID NO: 4803777 - DNA, 22 bp, Homo sapiens
tccctaaacatagtggtatttt

SEQ ID NO: 4803778 - DNA, 23 bp, Homo sapiens
tccctaattctcttcgctgtgat

SEQ ID NO: 4803779 - DNA, 16 bp, Homo sapiens
tccctaccctcttctc

SEQ ID NO: 4803780 - DNA, 16 bp, Homo sapiens
tccctacttaggaaat

SEQ ID NO: 4803781 - DNA, 13 bp, Homo sapiens
tccctagcagtga

SEQ ID NO: 4803782 - DNA, 14 bp, Homo sapiens
tccctagggctctc

SEQ ID NO: 4803783 - DNA, 20 bp, Homo sapiens
tccctagggctctccaagca

SEQ ID NO: 4803784 - DNA, 16 bp, Homo sapiens
tccctaggtgggtcaa

SEQ ID NO: 4803785 - DNA, 18 bp, Homo sapiens
tccctcacacctcccttc

SEQ ID NO: 4803786 - DNA, 15 bp, Homo sapiens
tccctcagaaaatga

SEQ ID NO: 4803787 - DNA, 14 bp, Homo sapiens
tccctcagccctca

SEQ ID NO: 4803788 - DNA, 18 bp, Homo sapiens
tgccataacttgtttgta

SEQ ID NO: 4803789 - DNA, 15 bp, Homo sapiens
tgccatcacgcttgt

SEQ ID NO: 4803790 - DNA, 20 bp, Homo sapiens
tgccatgaggaacaaggcaa

SEQ ID NO: 4803791 - DNA, 23 bp, Homo sapiens
tgccatgaggaacaaggcaaggc

SEQ ID NO: 4803792 - DNA, 15 bp, Homo sapiens
tgccatggccaggag

SEQ ID NO: 4803793 - DNA, 17 bp, Homo sapiens
tgccatgtgtgagtcac

SEQ ID NO: 4803794 - DNA, 18 bp, Homo sapiens
tgccatgtgtgagtcact

SEQ ID NO: 4803795 - DNA, 19 bp, Homo sapiens
tgccatgtgtgagtcactt

SEQ ID NO: 4803796 - DNA, 23 bp, Homo sapiens
tgccatttcctcctgggcaacag

SEQ ID NO: 4803797 - DNA, 19 bp, Homo sapiens
tgccattttgtctggctgt

SEQ ID NO: 4803798 - DNA, 23 bp, Homo sapiens
tgccattttttgtctgtgataac

SEQ ID NO: 4803799 - DNA, 18 bp, Homo sapiens
tgcccaaatataacatga

SEQ ID NO: 4803800 - DNA, 21 bp, Homo sapiens
tgcccacccgtgttctcctcc

SEQ ID NO: 4803801 - DNA, 15 bp, Homo sapiens
tgcccaccctgggcc

SEQ ID NO: 4803802 - DNA, 18 bp, Homo sapiens
tgcccacctgccaggctg

SEQ ID NO: 4803803 - DNA, 19 bp, Homo sapiens
tgcccacctgccaggctgc

SEQ ID NO: 4803804 - DNA, 16 bp, Homo sapiens
tgcccacgtcccgggc

SEQ ID NO: 4803805 - DNA, 16 bp, Homo sapiens
tgcccagcttggagtg

SEQ ID NO: 4803806 - DNA, 22 bp, Homo sapiens
tgcccagcttggagtgccacgt

SEQ ID NO: 4803807 - DNA, 20 bp, Homo sapiens
tgcccaggaagtaattttct

SEQ ID NO: 4803808 - DNA, 21 bp, Homo sapiens
tgcccaggaagtaattttctt

SEQ ID NO: 4803809 - DNA, 23 bp, Homo sapiens
tgcccaggaagtaattttcttct

SEQ ID NO: 4803810 - DNA, 15 bp, Homo sapiens
tgcccatttcacaca

SEQ ID NO: 4803811 - DNA, 18 bp, Homo sapiens
tgcccatttcacacaact

SEQ ID NO: 4803812 - DNA, 16 bp, Homo sapiens
tgccccacacaggcct

SEQ ID NO: 4803813 - DNA, 11 bp, Homo sapiens
tgccccagaga

SEQ ID NO: 4803814 - DNA, 11 bp, Homo sapiens
tgcccccacag

SEQ ID NO: 4803815 - DNA, 18 bp, Homo sapiens
tgccccccatgccctccc

SEQ ID NO: 4803816 - DNA, 19 bp, Homo sapiens
tgccccccatgccctccct

SEQ ID NO: 4803817 - DNA, 11 bp, Homo sapiens
tgccccccttc

SEQ ID NO: 4803818 - DNA, 13 bp, Homo sapiens
tgccccccttccc

SEQ ID NO: 4803819 - DNA, 14 bp, Homo sapiens
tgccccctcccccg

SEQ ID NO: 4803820 - DNA, 22 bp, Homo sapiens
tgccccctggggggcacagcca

SEQ ID NO: 4803821 - DNA, 13 bp, Homo sapiens
tgccccgcctccc

SEQ ID NO: 4803822 - DNA, 23 bp, Homo sapiens
tgccccgcctcccggggtgcccg

SEQ ID NO: 4803823 - DNA, 16 bp, Homo sapiens
tgcccctggcagcccc

SEQ ID NO: 4803824 - DNA, 16 bp, Homo sapiens
tgcccgcacaccctca

SEQ ID NO: 4803825 - DNA, 22 bp, Homo sapiens
tgcccgcacaccctcactctgc

SEQ ID NO: 4803826 - DNA, 13 bp, Homo sapiens
tgcccgcacagca

SEQ ID NO: 4803827 - DNA, 20 bp, Homo sapiens
tgcccgcacagcagcctgct

SEQ ID NO: 4803828 - DNA, 21 bp, Homo sapiens
tgcccgcgcccgccgcctccc

SEQ ID NO: 4803829 - DNA, 20 bp, Homo sapiens
tgcccgtgtggcctgggtcc

SEQ ID NO: 4803830 - DNA, 22 bp, Homo sapiens
tgcccgtgtggcctgggtcctc

SEQ ID NO: 4803831 - DNA, 20 bp, Homo sapiens
tgccctattataattgtcat

SEQ ID NO: 4803832 - DNA, 21 bp, Homo sapiens
tgccctattataattgtcatg

SEQ ID NO: 4803833 - DNA, 20 bp, Homo sapiens
tgccctcactccactcccct

SEQ ID NO: 4803834 - DNA, 22 bp, Homo sapiens
tgccctcactccactcccctca

SEQ ID NO: 4803835 - DNA, 14 bp, Homo sapiens
tgccctccctgctg

SEQ ID NO: 4803836 - DNA, 15 bp, Homo sapiens
tgccctccctgctgc

SEQ ID NO: 4803837 - DNA, 16 bp, Homo sapiens
tgccctccctgctgcc

SEQ ID NO: 4803838 - DNA, 20 bp, Homo sapiens
tgccctccctgctgccaggc

SEQ ID NO: 4803839 - DNA, 15 bp, Homo sapiens
tgccctccgcccttc

SEQ ID NO: 4803840 - DNA, 15 bp, Homo sapiens
tgccctctccttcct

SEQ ID NO: 4803841 - DNA, 17 bp, Homo sapiens
tgccctctccttcctta

SEQ ID NO: 4803842 - DNA, 21 bp, Homo sapiens
tgccctctccttccttaccca

SEQ ID NO: 4803843 - DNA, 19 bp, Homo sapiens
tgccctgaccatgcatttt

SEQ ID NO: 4803844 - DNA, 14 bp, Homo sapiens
tgccctgaggaagg

SEQ ID NO: 4803845 - DNA, 23 bp, Homo sapiens
tgccctgatgcgtctacccagac

SEQ ID NO: 4803846 - DNA, 14 bp, Homo sapiens
tgccctgcaccttg

SEQ ID NO: 4803847 - DNA, 16 bp, Homo sapiens
tgccctgcaccttggg

SEQ ID NO: 4803848 - DNA, 17 bp, Homo sapiens
tgccctgcgtcccttct

SEQ ID NO: 4803849 - DNA, 12 bp, Homo sapiens
tgccctgtagct

SEQ ID NO: 4803850 - DNA, 20 bp, Homo sapiens
tgccctgtagctccttagct

SEQ ID NO: 4803851 - DNA, 22 bp, Homo sapiens
tgcccttacctgccaggaagcc

SEQ ID NO: 4803852 - DNA, 17 bp, Homo sapiens
tgccgaggagccaggca

SEQ ID NO: 4803853 - DNA, 13 bp, Homo sapiens
tgccgcctgggaa

SEQ ID NO: 4803854 - DNA, 15 bp, Homo sapiens
tgccgctgcaccacg

SEQ ID NO: 4803855 - DNA, 17 bp, Homo sapiens
tgccgctgcaccacggc

SEQ ID NO: 4803856 - DNA, 18 bp, Homo sapiens
tgccgctgctctcccagg

SEQ ID NO: 4803857 - DNA, 21 bp, Homo sapiens
tgccgctgcttgagtggacag

SEQ ID NO: 4803858 - DNA, 23 bp, Homo sapiens
tgccgctgcttgagtggacagca

SEQ ID NO: 4803859 - DNA, 20 bp, Homo sapiens
tgccgcttaaacatttccct

SEQ ID NO: 4803860 - DNA, 20 bp, Homo sapiens
tgccggtggggccagcgctg

SEQ ID NO: 4803861 - DNA, 14 bp, Homo sapiens
tgccgtggcaactg

SEQ ID NO: 4803862 - DNA, 18 bp, Homo sapiens
tgcctaaatccactctgc

SEQ ID NO: 4803863 - DNA, 17 bp, Homo sapiens
tgcctaactccttacag

SEQ ID NO: 4803864 - DNA, 15 bp, Homo sapiens
tgcctattgtaatat

SEQ ID NO: 4803865 - DNA, 15 bp, Homo sapiens
tgcctcaagagaagg

SEQ ID NO: 4803866 - DNA, 21 bp, Homo sapiens
tgcctcatcttccttctcagc

SEQ ID NO: 4803867 - DNA, 18 bp, Homo sapiens
tgcctcattttgcttccc

SEQ ID NO: 4803868 - DNA, 22 bp, Homo sapiens
tgcctccaagaggaacctctga

SEQ ID NO: 4803869 - DNA, 17 bp, Homo sapiens
tgcctccaagtcatggg

SEQ ID NO: 4803870 - DNA, 20 bp, Homo sapiens
tgcctccaggaccttgcttc

SEQ ID NO: 4803871 - DNA, 16 bp, Homo sapiens
tgcctccggccctgcc

SEQ ID NO: 4803872 - DNA, 17 bp, Homo sapiens
tgcctccggccctgccc

SEQ ID NO: 4803873 - DNA, 16 bp, Homo sapiens
tgcctccgggcctcgg

SEQ ID NO: 4803874 - DNA, 19 bp, Homo sapiens
tgcctccgggcctcggcct

SEQ ID NO: 4803875 - DNA, 12 bp, Homo sapiens
tgcctctcacac

SEQ ID NO: 4803876 - DNA, 15 bp, Homo sapiens
tgcctctcacacaca

SEQ ID NO: 4803877 - DNA, 13 bp, Homo sapiens
tgcctctctcagg

SEQ ID NO: 4803878 - DNA, 14 bp, Homo sapiens
tgcctctctcaggc

SEQ ID NO: 4803879 - DNA, 15 bp, Homo sapiens
tgcctctctcaggcc

SEQ ID NO: 4803880 - DNA, 11 bp, Homo sapiens
tgcctctgcca

SEQ ID NO: 4803881 - DNA, 12 bp, Homo sapiens
tgcctctgccac

SEQ ID NO: 4803882 - DNA, 11 bp, Homo sapiens
tgcctctgcct

SEQ ID NO: 4803883 - DNA, 12 bp, Homo sapiens
tgcctctttaaa

SEQ ID NO: 4803884 - DNA, 17 bp, Homo sapiens
tgcctctttaaattatg

SEQ ID NO: 4803885 - DNA, 19 bp, Homo sapiens
tgcctctttcctcctcatg

SEQ ID NO: 4803886 - DNA, 12 bp, Homo sapiens
tgcctgaagaaa

SEQ ID NO: 4803887 - DNA, 14 bp, Homo sapiens
tgcctgagaccacg

SEQ ID NO: 4803888 - DNA, 21 bp, Homo sapiens
tgcctgccatgtgtgagtcac

SEQ ID NO: 4803889 - DNA, 23 bp, Homo sapiens
tgcctgccatgtgtgagtcactt

SEQ ID NO: 4803890 - DNA, 19 bp, Homo sapiens
tgcctgcccgcacagcagc

SEQ ID NO: 4803891 - DNA, 13 bp, Homo sapiens
tgcctgcctccgg

SEQ ID NO: 4803892 - DNA, 14 bp, Homo sapiens
tgcctgcctccggc

SEQ ID NO: 4803893 - DNA, 21 bp, Homo sapiens
tgcctgcctccggccctgccc

SEQ ID NO: 4803894 - DNA, 14 bp, Homo sapiens
tgcctgctatccag

SEQ ID NO: 4803895 - DNA, 18 bp, Homo sapiens
tgcctgctatccagccgc

SEQ ID NO: 4803896 - DNA, 21 bp, Homo sapiens
tgcctggaggagaaggaggaa

SEQ ID NO: 4803897 - DNA, 17 bp, Homo sapiens
tgcctggagggaatcca

SEQ ID NO: 4803898 - DNA, 13 bp, Homo sapiens
tgcctggcgggca

SEQ ID NO: 4803899 - DNA, 23 bp, Homo sapiens
tgcctggcgggcagcccctgctg

SEQ ID NO: 4803900 - DNA, 21 bp, Homo sapiens
tgcctgtggtgaggtcctgtc

SEQ ID NO: 4803901 - DNA, 21 bp, Homo sapiens
tgcctgtgtttcatgttctgt

SEQ ID NO: 4803902 - DNA, 22 bp, Homo sapiens
tgcctgttgatctatgggaaat

SEQ ID NO: 4803903 - DNA, 18 bp, Homo sapiens
tgccttaattcttacctc

SEQ ID NO: 4803904 - DNA, 20 bp, Homo sapiens
tgccttacagacagaatata

SEQ ID NO: 4803905 - DNA, 20 bp, Homo sapiens
tgccttatattattttctgt

SEQ ID NO: 4803906 - DNA, 20 bp, Homo sapiens
tgccttccaccctgccctgg

SEQ ID NO: 4803907 - DNA, 22 bp, Homo sapiens
tgccttccaccctgccctggcc

SEQ ID NO: 4803908 - DNA, 18 bp, Homo sapiens
tgccttctgacggccctg

SEQ ID NO: 4803909 - DNA, 22 bp, Homo sapiens
tggcaagaaatcccctaactga

SEQ ID NO: 4803910 - DNA, 13 bp, Homo sapiens
tggcacaggactg

SEQ ID NO: 4803911 - DNA, 19 bp, Homo sapiens
tggcaccaaagatgcagcc

SEQ ID NO: 4803912 - DNA, 19 bp, Homo sapiens
tggcaccagatgcaacctc

SEQ ID NO: 4803913 - DNA, 20 bp, Homo sapiens
tggcacccaccactctcagg

SEQ ID NO: 4803914 - DNA, 22 bp, Homo sapiens
tggcacccaccactctcaggac

SEQ ID NO: 4803915 - DNA, 15 bp, Homo sapiens
tggcagagccatcca

SEQ ID NO: 4803916 - DNA, 20 bp, Homo sapiens
tggcagagccatccaccctg

SEQ ID NO: 4803917 - DNA, 19 bp, Homo sapiens
tggcagagttgaagacaga

SEQ ID NO: 4803918 - DNA, 21 bp, Homo sapiens
tggcagagttgaagacagagc

SEQ ID NO: 4803919 - DNA, 22 bp, Homo sapiens
tggcagatgggggcctctctgg

SEQ ID NO: 4803920 - DNA, 17 bp, Homo sapiens
tggcagcacagctactc

SEQ ID NO: 4803921 - DNA, 15 bp, Homo sapiens
tggcagcttccctga

SEQ ID NO: 4803922 - DNA, 19 bp, Homo sapiens
tggcagcttccctgaacac

SEQ ID NO: 4803923 - DNA, 17 bp, Homo sapiens
tggcaggagtgggctct

SEQ ID NO: 4803924 - DNA, 19 bp, Homo sapiens
tggcaggcacacagcagcc

SEQ ID NO: 4803925 - DNA, 22 bp, Homo sapiens
tggcagggaggtcaggccctgg

SEQ ID NO: 4803926 - DNA, 18 bp, Homo sapiens
tggcatcatctcagctca

SEQ ID NO: 4803927 - DNA, 16 bp, Homo sapiens
tggcatttagcacagt

SEQ ID NO: 4803928 - DNA, 21 bp, Homo sapiens
tggcatttgctgaataacaac

SEQ ID NO: 4803929 - DNA, 12 bp, Homo sapiens
tggccagcaccc

SEQ ID NO: 4803930 - DNA, 12 bp, Homo sapiens
tggccagcccgc

SEQ ID NO: 4803931 - DNA, 19 bp, Homo sapiens
tggccagcccgcagaggtg

SEQ ID NO: 4803932 - DNA, 23 bp, Homo sapiens
tggccagcctggggcctggcagg

SEQ ID NO: 4803933 - DNA, 16 bp, Homo sapiens
tggccaggcctcaggg

SEQ ID NO: 4803934 - DNA, 20 bp, Homo sapiens
tggccaggcttgtctcgaac

SEQ ID NO: 4803935 - DNA, 15 bp, Homo sapiens
tggccatccctgggc

SEQ ID NO: 4803936 - DNA, 17 bp, Homo sapiens
tggccatccctgggccc

SEQ ID NO: 4803937 - DNA, 21 bp, Homo sapiens
tggccatccctgggcccctcc

SEQ ID NO: 4803938 - DNA, 17 bp, Homo sapiens
tggcccacccctcttcc

SEQ ID NO: 4803939 - DNA, 20 bp, Homo sapiens
tggcccacccctcttccccc

SEQ ID NO: 4803940 - DNA, 22 bp, Homo sapiens
tggcccacccctcttccccctt

SEQ ID NO: 4803941 - DNA, 12 bp, Homo sapiens
tggcccagcagc

SEQ ID NO: 4803942 - DNA, 19 bp, Homo sapiens
tggcccagcagcggcccag

SEQ ID NO: 4803943 - DNA, 14 bp, Homo sapiens
tggcccagccagca

SEQ ID NO: 4803944 - DNA, 15 bp, Homo sapiens
tggcccagccagcag

SEQ ID NO: 4803945 - DNA, 15 bp, Homo sapiens
tggcccagccatggc

SEQ ID NO: 4803946 - DNA, 18 bp, Homo sapiens
tggcccagccatggctgg

SEQ ID NO: 4803947 - DNA, 22 bp, Homo sapiens
tggcccatagaaacatgacact

SEQ ID NO: 4803948 - DNA, 12 bp, Homo sapiens
tggccccagtga

SEQ ID NO: 4803949 - DNA, 19 bp, Homo sapiens
tggccccctcgcgcccctg

SEQ ID NO: 4803950 - DNA, 21 bp, Homo sapiens
tggccccctcgcgcccctgtc

SEQ ID NO: 4803951 - DNA, 23 bp, Homo sapiens
tggcccctccttctcccctccag

SEQ ID NO: 4803952 - DNA, 16 bp, Homo sapiens
tggcccggtcccagtc

SEQ ID NO: 4803953 - DNA, 16 bp, Homo sapiens
tggccctgccctcccc

SEQ ID NO: 4803954 - DNA, 15 bp, Homo sapiens
tggccctgccctgag

SEQ ID NO: 4803955 - DNA, 16 bp, Homo sapiens
tggccctgtagctctg

SEQ ID NO: 4803956 - DNA, 12 bp, Homo sapiens
tggccctgtggg

SEQ ID NO: 4803957 - DNA, 13 bp, Homo sapiens
tggccctgtggga

SEQ ID NO: 4803958 - DNA, 16 bp, Homo sapiens
tggccctgtgggagtc

SEQ ID NO: 4803959 - DNA, 21 bp, Homo sapiens
tggccctgtgggagtccactt

SEQ ID NO: 4803960 - DNA, 22 bp, Homo sapiens
tggccctgtgggagtccacttt

SEQ ID NO: 4803961 - DNA, 14 bp, Homo sapiens
tggcccttccttca

SEQ ID NO: 4803962 - DNA, 20 bp, Homo sapiens
tggccgctgctgtgacaggc

SEQ ID NO: 4803963 - DNA, 20 bp, Homo sapiens
tggccggcccacgtcctggg

SEQ ID NO: 4803964 - DNA, 14 bp, Homo sapiens
tggccggctggccg

SEQ ID NO: 4803965 - DNA, 16 bp, Homo sapiens
tggccggtccaccccg

SEQ ID NO: 4803966 - DNA, 18 bp, Homo sapiens
tggcctacaaatcagtaa

SEQ ID NO: 4803967 - DNA, 13 bp, Homo sapiens
tggcctaccacag

SEQ ID NO: 4803968 - DNA, 14 bp, Homo sapiens
tggcctaccacagc

SEQ ID NO: 4803969 - DNA, 17 bp, Homo sapiens
tggcctaccacagctgc

SEQ ID NO: 4803970 - DNA, 18 bp, Homo sapiens
tggcctatgaccctgtgc

SEQ ID NO: 4803971 - DNA, 21 bp, Homo sapiens
tggcctatgaccctgtgcctg

SEQ ID NO: 4803972 - DNA, 22 bp, Homo sapiens
tggcctatgaccctgtgcctgt

SEQ ID NO: 4803973 - DNA, 23 bp, Homo sapiens
tggcctattttggacgtgtgagg

SEQ ID NO: 4803974 - DNA, 12 bp, Homo sapiens
tggcctcagccc

SEQ ID NO: 4803975 - DNA, 15 bp, Homo sapiens
tggcctcagccctca

SEQ ID NO: 4803976 - DNA, 16 bp, Homo sapiens
tggcctcagccctcag

SEQ ID NO: 4803977 - DNA, 13 bp, Homo sapiens
tggcctcccagcc

SEQ ID NO: 4803978 - DNA, 14 bp, Homo sapiens
tggcctcccagcca

SEQ ID NO: 4803979 - DNA, 15 bp, Homo sapiens
tggcctcccagccac

SEQ ID NO: 4803980 - DNA, 12 bp, Homo sapiens
tggcctctgccc

SEQ ID NO: 4803981 - DNA, 15 bp, Homo sapiens
tggcctctgtgccat

SEQ ID NO: 4803982 - DNA, 12 bp, Homo sapiens
tggcctgacaca

SEQ ID NO: 4803983 - DNA, 15 bp, Homo sapiens
tggcctgagaagagt

SEQ ID NO: 4803984 - DNA, 10 bp, Homo sapiens
tggcctggcc

SEQ ID NO: 4803985 - DNA, 14 bp, Homo sapiens
tggcctggcctggc

SEQ ID NO: 4803986 - DNA, 19 bp, Homo sapiens
tggcctggcctggccctgc

SEQ ID NO: 4803987 - DNA, 13 bp, Homo sapiens
tggcctgggggct

SEQ ID NO: 4803988 - DNA, 17 bp, Homo sapiens
tggcctgggtcctcggc

SEQ ID NO: 4803989 - DNA, 21 bp, Homo sapiens
tggcctgggtcctcggccctg

SEQ ID NO: 4803990 - DNA, 20 bp, Homo sapiens
tggcctggtaggtctggatt

SEQ ID NO: 4803991 - DNA, 12 bp, Homo sapiens
tggcctgtccct

SEQ ID NO: 4803992 - DNA, 21 bp, Homo sapiens
tggcctgtccctagggctctc

SEQ ID NO: 4803993 - DNA, 22 bp, Homo sapiens
tggcctgtccctagggctctcc

SEQ ID NO: 4803994 - DNA, 15 bp, Homo sapiens
tggccttaactggcc

SEQ ID NO: 4803995 - DNA, 16 bp, Homo sapiens
tggccttaactggccc

SEQ ID NO: 4803996 - DNA, 17 bp, Homo sapiens
tggccttaactggccct

SEQ ID NO: 4803997 - DNA, 14 bp, Homo sapiens
tggcctttcctctc

SEQ ID NO: 4803998 - DNA, 18 bp, Homo sapiens
tggcgcgatctcagctca

SEQ ID NO: 4803999 - DNA, 23 bp, Homo sapiens
tggcgctgcccctggcagcccct

SEQ ID NO: 4804000 - DNA, 19 bp, Homo sapiens
tggcggcggcacttcaagc

SEQ ID NO: 4804001 - DNA, 17 bp, Homo sapiens
tggcgggcagcccctgc

SEQ ID NO: 4804002 - DNA, 20 bp, Homo sapiens
tggcgggcagcccctgctgg

SEQ ID NO: 4804003 - DNA, 14 bp, Homo sapiens
tggcgtggagcagg

SEQ ID NO: 4804004 - DNA, 22 bp, Homo sapiens
tggctagtcacatatcaagtcc

SEQ ID NO: 4804005 - DNA, 18 bp, Homo sapiens
tggctattgtccttgtgt

SEQ ID NO: 4804006 - DNA, 23 bp, Homo sapiens
tggctattgtccttgtgtatcct

SEQ ID NO: 4804007 - DNA, 21 bp, Homo sapiens
tggctgaaattatgtcaaatg

SEQ ID NO: 4804008 - DNA, 17 bp, Homo sapiens
tggctgaagaaacacag

SEQ ID NO: 4804009 - DNA, 18 bp, Homo sapiens
tggctgattggaaaataa

SEQ ID NO: 4804010 - DNA, 21 bp, Homo sapiens
tggctgcagatgactggaaac

SEQ ID NO: 4804011 - DNA, 18 bp, Homo sapiens
tggctgccaatgggagct

SEQ ID NO: 4804012 - DNA, 13 bp, Homo sapiens
tggctggagcccc

SEQ ID NO: 4804013 - DNA, 20 bp, Homo sapiens
tggctggatgtgcatctggc

SEQ ID NO: 4804014 - DNA, 20 bp, Homo sapiens
tggctgggtttgggcagtgg

SEQ ID NO: 4804015 - DNA, 22 bp, Homo sapiens
tggctgtcaaatccatgtgtcc

SEQ ID NO: 4804016 - DNA, 23 bp, Homo sapiens
tggctgttatctgtctttatgat

SEQ ID NO: 4804017 - DNA, 15 bp, Homo sapiens
tggcttaaacatttt

SEQ ID NO: 4804018 - DNA, 18 bp, Homo sapiens
tggcttaagcctgtgtat

SEQ ID NO: 4804019 - DNA, 19 bp, Homo sapiens
tggcttcaccgcattccag

SEQ ID NO: 4804020 - DNA, 15 bp, Homo sapiens
tggcttcagaattgt

SEQ ID NO: 4804021 - DNA, 23 bp, Homo sapiens
tggcttcccaggaccctgggtca

SEQ ID NO: 4804022 - DNA, 19 bp, Homo sapiens
tggcttccgtgagacacaa

SEQ ID NO: 4804023 - DNA, 15 bp, Homo sapiens
tggcttctggcacct

SEQ ID NO: 4804024 - DNA, 14 bp, Homo sapiens
tggcttctgggaca

SEQ ID NO: 4804025 - DNA, 16 bp, Homo sapiens
tggcttgtagggtgag

SEQ ID NO: 4804026 - DNA, 13 bp, Homo sapiens
tggctttgtgctt

SEQ ID NO: 4804027 - DNA, 14 bp, Homo sapiens
tggctttgtgctta

SEQ ID NO: 4804028 - DNA, 17 bp, Homo sapiens
tgggaaaggcagggccc

SEQ ID NO: 4804029 - DNA, 23 bp, Homo sapiens
tgggaaatgagatcccagagtta

SEQ ID NO: 4804030 - DNA, 22 bp, Homo sapiens
tgggaactctgacaagggctga

SEQ ID NO: 4804031 - DNA, 21 bp, Homo sapiens
tgtaactttattggtcttgcc

SEQ ID NO: 4804032 - DNA, 23 bp, Homo sapiens
tgtaagacacgtgcaacagactg

SEQ ID NO: 4804033 - DNA, 18 bp, Homo sapiens
tgtaaggaatgattaatt

SEQ ID NO: 4804034 - DNA, 15 bp, Homo sapiens
tgtaagtttctaaga

SEQ ID NO: 4804035 - DNA, 13 bp, Homo sapiens
tgtaatatcagtt

SEQ ID NO: 4804036 - DNA, 17 bp, Homo sapiens
tgtaatatcagttacag

SEQ ID NO: 4804037 - DNA, 14 bp, Homo sapiens
tgtaatatcatttc

SEQ ID NO: 4804038 - DNA, 15 bp, Homo sapiens
tgtaatatttacaat

SEQ ID NO: 4804039 - DNA, 20 bp, Homo sapiens
tgtaatcacactctcttctt

SEQ ID NO: 4804040 - DNA, 15 bp, Homo sapiens
tgtaatgtatcttat

SEQ ID NO: 4804041 - DNA, 17 bp, Homo sapiens
tgtaattttgtagtagt

SEQ ID NO: 4804042 - DNA, 20 bp, Homo sapiens
tgtacaatggggacttcccg

SEQ ID NO: 4804043 - DNA, 17 bp, Homo sapiens
tgtacaattactgtgag

SEQ ID NO: 4804044 - DNA, 17 bp, Homo sapiens
tgtacagatatcgagag

SEQ ID NO: 4804045 - DNA, 20 bp, Homo sapiens
tgtacagattgctgcttctg

SEQ ID NO: 4804046 - DNA, 17 bp, Homo sapiens
tgtacaggctgagacac

SEQ ID NO: 4804047 - DNA, 18 bp, Homo sapiens
tgtacaggctgagacaca

SEQ ID NO: 4804048 - DNA, 14 bp, Homo sapiens
tgtacagttataca

SEQ ID NO: 4804049 - DNA, 13 bp, Homo sapiens
tgtacagtttgtt

SEQ ID NO: 4804050 - DNA, 16 bp, Homo sapiens
tgtacagtttgtttac

SEQ ID NO: 4804051 - DNA, 16 bp, Homo sapiens
tgtacatagtggtcat

SEQ ID NO: 4804052 - DNA, 23 bp, Homo sapiens
tgtacatagtggtcatttggtgg

SEQ ID NO: 4804053 - DNA, 21 bp, Homo sapiens
tgtacatatggaaatcctgtt

SEQ ID NO: 4804054 - DNA, 17 bp, Homo sapiens
tgtacatgtggaaaact

SEQ ID NO: 4804055 - DNA, 16 bp, Homo sapiens
tgtacatttatgtgtg

SEQ ID NO: 4804056 - DNA, 17 bp, Homo sapiens
tgtacatttatgtgtga

SEQ ID NO: 4804057 - DNA, 19 bp, Homo sapiens
tgtacccttcttgtctctc

SEQ ID NO: 4804058 - DNA, 22 bp, Homo sapiens
tgtacccttcttgtctctctgg

SEQ ID NO: 4804059 - DNA, 16 bp, Homo sapiens
tgtaccggccactgca

SEQ ID NO: 4804060 - DNA, 18 bp, Homo sapiens
tgtaccggccactgcaac

SEQ ID NO: 4804061 - DNA, 16 bp, Homo sapiens
tgtacctaagtaaatt

SEQ ID NO: 4804062 - DNA, 14 bp, Homo sapiens
tgtacgtctggtgt

SEQ ID NO: 4804063 - DNA, 16 bp, Homo sapiens
tgtactacatttgcat

SEQ ID NO: 4804064 - DNA, 14 bp, Homo sapiens
tgtactatctagtg

SEQ ID NO: 4804065 - DNA, 21 bp, Homo sapiens
tgtacttacactgaaatccaa

SEQ ID NO: 4804066 - DNA, 13 bp, Homo sapiens
tgtacttacatgg

SEQ ID NO: 4804067 - DNA, 15 bp, Homo sapiens
tgtacttacatgggt

SEQ ID NO: 4804068 - DNA, 16 bp, Homo sapiens
tgtacttacatgggtg

SEQ ID NO: 4804069 - DNA, 14 bp, Homo sapiens
tgtactttcccagg

SEQ ID NO: 4804070 - DNA, 17 bp, Homo sapiens
tgtagattttatagtgt

SEQ ID NO: 4804071 - DNA, 18 bp, Homo sapiens
tgtagattttatagtgtg

SEQ ID NO: 4804072 - DNA, 14 bp, Homo sapiens
tgtagcatataaat

SEQ ID NO: 4804073 - DNA, 16 bp, Homo sapiens
tgtagcctaatattca

SEQ ID NO: 4804074 - DNA, 23 bp, Homo sapiens
tgtagcctaatattcatgctgcc

SEQ ID NO: 4804075 - DNA, 12 bp, Homo sapiens
tgtagcctggtc

SEQ ID NO: 4804076 - DNA, 21 bp, Homo sapiens
tgtagctagtttaaaattatt

SEQ ID NO: 4804077 - DNA, 13 bp, Homo sapiens
tgtagctgtcctc

SEQ ID NO: 4804078 - DNA, 19 bp, Homo sapiens
tgtagcttcagtcattaaa

SEQ ID NO: 4804079 - DNA, 18 bp, Homo sapiens
tgtaggggaaatcaaggt

SEQ ID NO: 4804080 - DNA, 18 bp, Homo sapiens
tgtaggtcaatgaaatat

SEQ ID NO: 4804081 - DNA, 19 bp, Homo sapiens
tgtagtcccggaggccttc

SEQ ID NO: 4804082 - DNA, 22 bp, Homo sapiens
tgtagtcccggaggccttccct

SEQ ID NO: 4804083 - DNA, 21 bp, Homo sapiens
tgtagtttttgttcaccttct

SEQ ID NO: 4804084 - DNA, 15 bp, Homo sapiens
tgtataaaacagtgt

SEQ ID NO: 4804085 - DNA, 20 bp, Homo sapiens
tgtataaaacagtgtttcca

SEQ ID NO: 4804086 - DNA, 22 bp, Homo sapiens
tgtataatactttgtatacaag

SEQ ID NO: 4804087 - DNA, 13 bp, Homo sapiens
tgtatacaaacag

SEQ ID NO: 4804088 - DNA, 16 bp, Homo sapiens
tgtatacaaacaggtg

SEQ ID NO: 4804089 - DNA, 20 bp, Homo sapiens
tgtatacaaacaggtgctaa

SEQ ID NO: 4804090 - DNA, 13 bp, Homo sapiens
tgtatacatatgt

SEQ ID NO: 4804091 - DNA, 14 bp, Homo sapiens
tgtatacatatgta

SEQ ID NO: 4804092 - DNA, 19 bp, Homo sapiens
tgtatagtgagtgtggctt

SEQ ID NO: 4804093 - DNA, 22 bp, Homo sapiens
tgtatatagatgtctgtgtata

SEQ ID NO: 4804094 - DNA, 14 bp, Homo sapiens
tgtatatattatat

SEQ ID NO: 4804095 - DNA, 21 bp, Homo sapiens
tgtatatattatatatacatt

SEQ ID NO: 4804096 - DNA, 22 bp, Homo sapiens
tgtatatatttattattttcat

SEQ ID NO: 4804097 - DNA, 11 bp, Homo sapiens
tgtatatcagc

SEQ ID NO: 4804098 - DNA, 15 bp, Homo sapiens
tgtatatcagctcta

SEQ ID NO: 4804099 - DNA, 19 bp, Homo sapiens
tgtatatcagctctaaagc

SEQ ID NO: 4804100 - DNA, 23 bp, Homo sapiens
tgtatatcagctctaaagcagag

SEQ ID NO: 4804101 - DNA, 16 bp, Homo sapiens
tgtatatttgtatgat

SEQ ID NO: 4804102 - DNA, 13 bp, Homo sapiens
tgtatcagtgttt

SEQ ID NO: 4804103 - DNA, 23 bp, Homo sapiens
tgtatcagtgtttatgtgctatt

SEQ ID NO: 4804104 - DNA, 15 bp, Homo sapiens
tgtatctgaaagtca

SEQ ID NO: 4804105 - DNA, 13 bp, Homo sapiens
tgtatcttattta

SEQ ID NO: 4804106 - DNA, 20 bp, Homo sapiens
tgtatgatttaggcttctat

SEQ ID NO: 4804107 - DNA, 13 bp, Homo sapiens
tgtatgtatacac

SEQ ID NO: 4804108 - DNA, 15 bp, Homo sapiens
tgtatgtatacacac

SEQ ID NO: 4804109 - DNA, 13 bp, Homo sapiens
tgtatgtctatgt

SEQ ID NO: 4804110 - DNA, 18 bp, Homo sapiens
tgtatgtctatgtgtata

SEQ ID NO: 4804111 - DNA, 20 bp, Homo sapiens
tgtatgtgtgagtgtatgta

SEQ ID NO: 4804112 - DNA, 22 bp, Homo sapiens
tgtatgtgtgagtgtatgtata

SEQ ID NO: 4804113 - DNA, 19 bp, Homo sapiens
tgtatgtgtgtttctgtcc

SEQ ID NO: 4804114 - DNA, 20 bp, Homo sapiens
tgtatgtgtgtttctgtcct

SEQ ID NO: 4804115 - DNA, 15 bp, Homo sapiens
tgtattaagctccag

SEQ ID NO: 4804116 - DNA, 22 bp, Homo sapiens
tgtattagtaataaaacattag

SEQ ID NO: 4804117 - DNA, 12 bp, Homo sapiens
tgtattatcata

SEQ ID NO: 4804118 - DNA, 17 bp, Homo sapiens
tgtattatcatatatgc

SEQ ID NO: 4804119 - DNA, 18 bp, Homo sapiens
tgtattatcatatatgct

SEQ ID NO: 4804120 - DNA, 17 bp, Homo sapiens
tgtattgctttctttca

SEQ ID NO: 4804121 - DNA, 14 bp, Homo sapiens
tgtattggcagcac

SEQ ID NO: 4804122 - DNA, 17 bp, Homo sapiens
tgtattggcagcacagc

SEQ ID NO: 4804123 - DNA, 18 bp, Homo sapiens
tgtattggcagcacagct

SEQ ID NO: 4804124 - DNA, 20 bp, Homo sapiens
tgtattgtgagatcctgtga

SEQ ID NO: 4804125 - DNA, 16 bp, Homo sapiens
tgtattttaataaaga

SEQ ID NO: 4804126 - DNA, 14 bp, Homo sapiens
tgtattttctgtgt

SEQ ID NO: 4804127 - DNA, 20 bp, Homo sapiens
tgtattttcttcccatttgt

SEQ ID NO: 4804128 - DNA, 23 bp, Homo sapiens
tgtatttttagagattaatttgt

SEQ ID NO: 4804129 - DNA, 14 bp, Homo sapiens
tgtatttttgtaat

SEQ ID NO: 4804130 - DNA, 13 bp, Homo sapiens
tgtcaaatggatg

SEQ ID NO: 4804131 - DNA, 19 bp, Homo sapiens
tgtcaaatggatgtaatat

SEQ ID NO: 4804132 - DNA, 21 bp, Homo sapiens
tgtcaacctgaattaaagtct

SEQ ID NO: 4804133 - DNA, 22 bp, Homo sapiens
tgtcaacctgaattaaagtcta

SEQ ID NO: 4804134 - DNA, 15 bp, Homo sapiens
tgtcaatatatagag

SEQ ID NO: 4804135 - DNA, 15 bp, Homo sapiens
tgtcaatcaagatgg

SEQ ID NO: 4804136 - DNA, 15 bp, Homo sapiens
tgtcaattacaggaa

SEQ ID NO: 4804137 - DNA, 22 bp, Homo sapiens
tgtcaatttggtttagaatgct

SEQ ID NO: 4804138 - DNA, 18 bp, Homo sapiens
tgtcacagggtgttcttt

SEQ ID NO: 4804139 - DNA, 20 bp, Homo sapiens
tgtcacagggtgttggaaga

SEQ ID NO: 4804140 - DNA, 19 bp, Homo sapiens
tgtcacatgacatccacat

SEQ ID NO: 4804141 - DNA, 23 bp, Homo sapiens
tgtcacatgacatccacatgcac

SEQ ID NO: 4804142 - DNA, 15 bp, Homo sapiens
tgtcaccagctatct

SEQ ID NO: 4804143 - DNA, 19 bp, Homo sapiens
tgtcaccagctatctgtca

SEQ ID NO: 4804144 - DNA, 17 bp, Homo sapiens
tgtcaccagctgccaaa

SEQ ID NO: 4804145 - DNA, 13 bp, Homo sapiens
tgtcactcacaaa

SEQ ID NO: 4804146 - DNA, 19 bp, Homo sapiens
tgtcactgtccagagtctc

SEQ ID NO: 4804147 - DNA, 19 bp, Homo sapiens
tgtcacttttttcctgtca

SEQ ID NO: 4804148 - DNA, 21 bp, Homo sapiens
tgtcacttttttcctgtcaat

SEQ ID NO: 4804149 - DNA, 12 bp, Homo sapiens
tgtcagaatgtt

SEQ ID NO: 4804150 - DNA, 17 bp, Homo sapiens
tgtcagaatgttgtgtt

SEQ ID NO: 4804151 - DNA, 11 bp, Homo sapiens
tgtcagagatg

SEQ ID NO: 4804152 - DNA, 13 bp, Homo sapiens
tgtcagagatgtt

SEQ ID NO: 4804153 - DNA, 19 bp, Homo sapiens
tgtgtgcactttttttcta

SEQ ID NO: 4804154 - DNA, 16 bp, Homo sapiens
tgtgtgcttcacacaa

SEQ ID NO: 4804155 - DNA, 17 bp, Homo sapiens
tgtgtggcaaacattta

SEQ ID NO: 4804156 - DNA, 12 bp, Homo sapiens
tgtgtgtatgtc

SEQ ID NO: 4804157 - DNA, 14 bp, Homo sapiens
tgtgtgtatgtcta

SEQ ID NO: 4804158 - DNA, 18 bp, Homo sapiens
tgtgtgtatgtctatgtg

SEQ ID NO: 4804159 - DNA, 14 bp, Homo sapiens
tgtgtgtgcaatgt

SEQ ID NO: 4804160 - DNA, 11 bp, Homo sapiens
tgtgtgtttat

SEQ ID NO: 4804161 - DNA, 12 bp, Homo sapiens
tgtgttacaata

SEQ ID NO: 4804162 - DNA, 13 bp, Homo sapiens
tgtgttcaatctg

SEQ ID NO: 4804163 - DNA, 16 bp, Homo sapiens
tgtgttctcaacacac

SEQ ID NO: 4804164 - DNA, 17 bp, Homo sapiens
tgtgttctcaacacaca

SEQ ID NO: 4804165 - DNA, 20 bp, Homo sapiens
tgtgttctgatgaggcattt

SEQ ID NO: 4804166 - DNA, 16 bp, Homo sapiens
tgtgttggtatttact

SEQ ID NO: 4804167 - DNA, 16 bp, Homo sapiens
tgtgtttattgtcaaa

SEQ ID NO: 4804168 - DNA, 18 bp, Homo sapiens
tgtgtttcatgttctgtg

SEQ ID NO: 4804169 - DNA, 21 bp, Homo sapiens
tgtgtttctgtcctgtaactg

SEQ ID NO: 4804170 - DNA, 13 bp, Homo sapiens
tgtgtttgaaaca

SEQ ID NO: 4804171 - DNA, 20 bp, Homo sapiens
tgtgtttgaaacactcgtgt

SEQ ID NO: 4804172 - DNA, 15 bp, Homo sapiens
tgtgtttgctcccat

SEQ ID NO: 4804173 - DNA, 16 bp, Homo sapiens
tgttaaaataattata

SEQ ID NO: 4804174 - DNA, 20 bp, Homo sapiens
tgttaaagaggcgtcttgta

SEQ ID NO: 4804175 - DNA, 18 bp, Homo sapiens
tgttaaatgataaggttt

SEQ ID NO: 4804176 - DNA, 15 bp, Homo sapiens
tgttaaattaattat

SEQ ID NO: 4804177 - DNA, 19 bp, Homo sapiens
tgttaacaatgcctattgt

SEQ ID NO: 4804178 - DNA, 14 bp, Homo sapiens
tgttaacttattca

SEQ ID NO: 4804179 - DNA, 18 bp, Homo sapiens
tgttaacttattcaaaga

SEQ ID NO: 4804180 - DNA, 20 bp, Homo sapiens
tgttaaggacttctgcagct

SEQ ID NO: 4804181 - DNA, 17 bp, Homo sapiens
tgttaagggaagctgat

SEQ ID NO: 4804182 - DNA, 18 bp, Homo sapiens
tgttaatatcactcatta

SEQ ID NO: 4804183 - DNA, 22 bp, Homo sapiens
tgttaatatcactcattaatta

SEQ ID NO: 4804184 - DNA, 13 bp, Homo sapiens
tgttaatccagag

SEQ ID NO: 4804185 - DNA, 14 bp, Homo sapiens
tgttaatccagaga

SEQ ID NO: 4804186 - DNA, 17 bp, Homo sapiens
tgttaatgattcttgtg

SEQ ID NO: 4804187 - DNA, 14 bp, Homo sapiens
tgttacaataagtg

SEQ ID NO: 4804188 - DNA, 14 bp, Homo sapiens
tgttacagtaatgt

SEQ ID NO: 4804189 - DNA, 17 bp, Homo sapiens
tgttacagtaatgtcat

SEQ ID NO: 4804190 - DNA, 20 bp, Homo sapiens
tgttagaaaaaactggaaac

SEQ ID NO: 4804191 - DNA, 15 bp, Homo sapiens
tgttagctcagagga

SEQ ID NO: 4804192 - DNA, 14 bp, Homo sapiens
tgttataaaatctg

SEQ ID NO: 4804193 - DNA, 17 bp, Homo sapiens
tgttatacaaccttcat

SEQ ID NO: 4804194 - DNA, 17 bp, Homo sapiens
tgttatccactacaggt

SEQ ID NO: 4804195 - DNA, 12 bp, Homo sapiens
tgttatctgtct

SEQ ID NO: 4804196 - DNA, 17 bp, Homo sapiens
tgttatgactccagaat

SEQ ID NO: 4804197 - DNA, 16 bp, Homo sapiens
tgttatggtagaaaaa

SEQ ID NO: 4804198 - DNA, 17 bp, Homo sapiens
tgttatggtagaaaaat

SEQ ID NO: 4804199 - DNA, 15 bp, Homo sapiens
tgttatttatgatgt

SEQ ID NO: 4804200 - DNA, 20 bp, Homo sapiens
tgttcaaagaacccccctcc

SEQ ID NO: 4804201 - DNA, 22 bp, Homo sapiens
tgttcaaaggagcaagaacttt

SEQ ID NO: 4804202 - DNA, 15 bp, Homo sapiens
tgttcaaatgcattt

SEQ ID NO: 4804203 - DNA, 16 bp, Homo sapiens
tgttcaaatgcatttt

SEQ ID NO: 4804204 - DNA, 14 bp, Homo sapiens
tgttcaaattctga

SEQ ID NO: 4804205 - DNA, 21 bp, Homo sapiens
tgttcaagcgattctcctgcc

SEQ ID NO: 4804206 - DNA, 15 bp, Homo sapiens
tgttcaccttctgtg

SEQ ID NO: 4804207 - DNA, 19 bp, Homo sapiens
tgttcaccttctgtgcatc

SEQ ID NO: 4804208 - DNA, 17 bp, Homo sapiens
tgttcacgcaacttgaa

SEQ ID NO: 4804209 - DNA, 18 bp, Homo sapiens
tgttcacgcaacttgaaa

SEQ ID NO: 4804210 - DNA, 14 bp, Homo sapiens
tgttcatgttttgc

SEQ ID NO: 4804211 - DNA, 17 bp, Homo sapiens
tgttcatgttttgctaa

SEQ ID NO: 4804212 - DNA, 19 bp, Homo sapiens
tgttcatgttttgctaatg

SEQ ID NO: 4804213 - DNA, 16 bp, Homo sapiens
tgttccaagtgtgtgt

SEQ ID NO: 4804214 - DNA, 22 bp, Homo sapiens
tgttccacttctctagagaaca

SEQ ID NO: 4804215 - DNA, 16 bp, Homo sapiens
tgttccattcagtctg

SEQ ID NO: 4804216 - DNA, 14 bp, Homo sapiens
tgttccgcctcact

SEQ ID NO: 4804217 - DNA, 16 bp, Homo sapiens
tgttccgttcatctga

SEQ ID NO: 4804218 - DNA, 16 bp, Homo sapiens
tgttcctgactgttct

SEQ ID NO: 4804219 - DNA, 18 bp, Homo sapiens
tgttctagcatggctgcc

SEQ ID NO: 4804220 - DNA, 14 bp, Homo sapiens
tgttctatggacca

SEQ ID NO: 4804221 - DNA, 20 bp, Homo sapiens
tgttctatggaccaaatgta

SEQ ID NO: 4804222 - DNA, 12 bp, Homo sapiens
tgttctcaacac

SEQ ID NO: 4804223 - DNA, 16 bp, Homo sapiens
tgttctcaacacacag

SEQ ID NO: 4804224 - DNA, 23 bp, Homo sapiens
tgttctcaacacacagtatagat

SEQ ID NO: 4804225 - DNA, 18 bp, Homo sapiens
tgttctcaatgcttttct

SEQ ID NO: 4804226 - DNA, 20 bp, Homo sapiens
tgttctccgggtgtggcctc

SEQ ID NO: 4804227 - DNA, 21 bp, Homo sapiens
tgttctccgggtgtggcctca

SEQ ID NO: 4804228 - DNA, 13 bp, Homo sapiens
tgttctctccgga

SEQ ID NO: 4804229 - DNA, 12 bp, Homo sapiens
tgttctctcttg

SEQ ID NO: 4804230 - DNA, 20 bp, Homo sapiens
tgttctctcttggtctcttt

SEQ ID NO: 4804231 - DNA, 16 bp, Homo sapiens
tgttctgacagcattt

SEQ ID NO: 4804232 - DNA, 13 bp, Homo sapiens
tgttctgcactga

SEQ ID NO: 4804233 - DNA, 16 bp, Homo sapiens
tgttctgcactgaaaa

SEQ ID NO: 4804234 - DNA, 17 bp, Homo sapiens
tgttctgcactgaaaag

SEQ ID NO: 4804235 - DNA, 21 bp, Homo sapiens
tgttcttcaatgtgaaactga

SEQ ID NO: 4804236 - DNA, 16 bp, Homo sapiens
tgttcttgcagcagag

SEQ ID NO: 4804237 - DNA, 17 bp, Homo sapiens
tgttcttgtaaaactgt

SEQ ID NO: 4804238 - DNA, 20 bp, Homo sapiens
tgttcttgtaaaactgtgac

SEQ ID NO: 4804239 - DNA, 22 bp, Homo sapiens
tgttcttgtaaaactgtgacat

SEQ ID NO: 4804240 - DNA, 23 bp, Homo sapiens
tgttcttgtaaaactgtgacatt

SEQ ID NO: 4804241 - DNA, 20 bp, Homo sapiens
tgttgaaaagagtagtactt

SEQ ID NO: 4804242 - DNA, 20 bp, Homo sapiens
tgttgaagtgcatgttaaaa

SEQ ID NO: 4804243 - DNA, 19 bp, Homo sapiens
tgttgataaaaatactgac

SEQ ID NO: 4804244 - DNA, 13 bp, Homo sapiens
tgttgattaaaac

SEQ ID NO: 4804245 - DNA, 14 bp, Homo sapiens
tgttgattctttca

SEQ ID NO: 4804246 - DNA, 16 bp, Homo sapiens
tgttgattctttcaat

SEQ ID NO: 4804247 - DNA, 21 bp, Homo sapiens
tgttgattctttcaatccaca

SEQ ID NO: 4804248 - DNA, 22 bp, Homo sapiens
tgttgattctttcaatccacag

SEQ ID NO: 4804249 - DNA, 23 bp, Homo sapiens
tgttgcatgaatccatcgatttg

SEQ ID NO: 4804250 - DNA, 18 bp, Homo sapiens
tgttgccattttgtctgg

SEQ ID NO: 4804251 - DNA, 19 bp, Homo sapiens
tgttgctacatcagagtgt

SEQ ID NO: 4804252 - DNA, 17 bp, Homo sapiens
tgttggccatcatttca

SEQ ID NO: 4804253 - DNA, 17 bp, Homo sapiens
tgttgtaatatcagtta

SEQ ID NO: 4804254 - DNA, 15 bp, Homo sapiens
tgttgtaatattttg

SEQ ID NO: 4804255 - DNA, 17 bp, Homo sapiens
tgttgtaatattttgct

SEQ ID NO: 4804256 - DNA, 17 bp, Homo sapiens
tgttgtattcctgcctt

SEQ ID NO: 4804257 - DNA, 21 bp, Homo sapiens
tgttgtcctgtgtcatctgtc

SEQ ID NO: 4804258 - DNA, 13 bp, Homo sapiens
tgttgtgttacaa

SEQ ID NO: 4804259 - DNA, 18 bp, Homo sapiens
tgtttaaaatggcattta

SEQ ID NO: 4804260 - DNA, 21 bp, Homo sapiens
tgtttaaaatggcatttagca

SEQ ID NO: 4804261 - DNA, 18 bp, Homo sapiens
tgtttaacccaaaagatt

SEQ ID NO: 4804262 - DNA, 17 bp, Homo sapiens
tgtttaacgtgaggttt

SEQ ID NO: 4804263 - DNA, 21 bp, Homo sapiens
tgtttaagaaatgagaaattg

SEQ ID NO: 4804264 - DNA, 15 bp, Homo sapiens
tgtttaagaatcatg

SEQ ID NO: 4804265 - DNA, 16 bp, Homo sapiens
tgtttaagaatcatgg

SEQ ID NO: 4804266 - DNA, 20 bp, Homo sapiens
tgtttagtagctgataaaga

SEQ ID NO: 4804267 - DNA, 17 bp, Homo sapiens
tgtttatgtgctattaa

SEQ ID NO: 4804268 - DNA, 14 bp, Homo sapiens
tgtttattgtcaaa

SEQ ID NO: 4804269 - DNA, 17 bp, Homo sapiens
tgtttattgtcaaagtg

SEQ ID NO: 4804270 - DNA, 16 bp, Homo sapiens
tgtttcatgttctgtg

SEQ ID NO: 4804271 - DNA, 17 bp, Homo sapiens
tgtttcgttaagcagta

SEQ ID NO: 4804272 - DNA, 12 bp, Homo sapiens
tgtttctgtcct

SEQ ID NO: 4804273 - DNA, 24 bp, Homo sapiens
tgtttgaaacactcgtgtgcatga

SEQ ID NO: 4804274 - DNA, 16 bp, Homo sapiens
tgtttgaaacttttca

SEQ ID NO: 4804275 - DNA, 21 bp, Homo sapiens
tgtttgaattgatttttaaac

SEQ ID NO: 4804276 - DNA, 23 bp, Homo sapiens
ttcatagagccctattctctcag

SEQ ID NO: 4804277 - DNA, 18 bp, Homo sapiens
ttcataggcagagcccgc

SEQ ID NO: 4804278 - DNA, 18 bp, Homo sapiens
ttcatatatgctttgcag

SEQ ID NO: 4804279 - DNA, 11 bp, Homo sapiens
ttcatatcatt

SEQ ID NO: 4804280 - DNA, 13 bp, Homo sapiens
ttcatcctcagca

SEQ ID NO: 4804281 - DNA, 15 bp, Homo sapiens
ttcatcctcagcaag

SEQ ID NO: 4804282 - DNA, 19 bp, Homo sapiens
ttcatcctcctcagatctt

SEQ ID NO: 4804283 - DNA, 18 bp, Homo sapiens
ttcatctgaggagtccaa

SEQ ID NO: 4804284 - DNA, 21 bp, Homo sapiens
ttcatctgaggagtccaaaat

SEQ ID NO: 4804285 - DNA, 11 bp, Homo sapiens
ttcatcttgaa

SEQ ID NO: 4804286 - DNA, 21 bp, Homo sapiens
ttcatgaattagaagaaaatg

SEQ ID NO: 4804287 - DNA, 20 bp, Homo sapiens
ttcatgatgctagttcttac

SEQ ID NO: 4804288 - DNA, 15 bp, Homo sapiens
ttcatgattagacaa

SEQ ID NO: 4804289 - DNA, 18 bp, Homo sapiens
ttcatgattagacaatgt

SEQ ID NO: 4804290 - DNA, 15 bp, Homo sapiens
ttcatgcttttctca

SEQ ID NO: 4804291 - DNA, 16 bp, Homo sapiens
ttcatgcttttctcat

SEQ ID NO: 4804292 - DNA, 17 bp, Homo sapiens
ttcatgcttttctcatg

SEQ ID NO: 4804293 - DNA, 14 bp, Homo sapiens
ttcatgtaaataaa

SEQ ID NO: 4804294 - DNA, 17 bp, Homo sapiens
ttcattaaaacaagaga

SEQ ID NO: 4804295 - DNA, 14 bp, Homo sapiens
ttcattagctgtga

SEQ ID NO: 4804296 - DNA, 17 bp, Homo sapiens
ttcattcatacttaaaa

SEQ ID NO: 4804297 - DNA, 13 bp, Homo sapiens
ttcattccatttg

SEQ ID NO: 4804298 - DNA, 14 bp, Homo sapiens
ttcattccatttgc

SEQ ID NO: 4804299 - DNA, 16 bp, Homo sapiens
ttcattccatttgctg

SEQ ID NO: 4804300 - DNA, 23 bp, Homo sapiens
ttcattctggtccttagtaaatt

SEQ ID NO: 4804301 - DNA, 13 bp, Homo sapiens
ttcattgcactgc

SEQ ID NO: 4804302 - DNA, 15 bp, Homo sapiens
ttcattgcactgcag

SEQ ID NO: 4804303 - DNA, 16 bp, Homo sapiens
ttccaagtgtgtgtgc

SEQ ID NO: 4804304 - DNA, 21 bp, Homo sapiens
ttccaagtgtgtgtgcaatgt

SEQ ID NO: 4804305 - DNA, 22 bp, Homo sapiens
ttccaatgccaattcatctcag

SEQ ID NO: 4804306 - DNA, 14 bp, Homo sapiens
ttccacaattttgt

SEQ ID NO: 4804307 - DNA, 12 bp, Homo sapiens
ttccaccctgcc

SEQ ID NO: 4804308 - DNA, 13 bp, Homo sapiens
ttccaccctgccc

SEQ ID NO: 4804309 - DNA, 16 bp, Homo sapiens
ttccaccctgccctgg

SEQ ID NO: 4804310 - DNA, 20 bp, Homo sapiens
ttccaccctgccctggccta

SEQ ID NO: 4804311 - DNA, 18 bp, Homo sapiens
ttccacctggaaagccag

SEQ ID NO: 4804312 - DNA, 17 bp, Homo sapiens
ttccactgcctctgcct

SEQ ID NO: 4804313 - DNA, 14 bp, Homo sapiens
ttccacttctctag

SEQ ID NO: 4804314 - DNA, 11 bp, Homo sapiens
ttccagaattg

SEQ ID NO: 4804315 - DNA, 17 bp, Homo sapiens
ttccagacagagtggat

SEQ ID NO: 4804316 - DNA, 19 bp, Homo sapiens
ttccagctaagcctgatga

SEQ ID NO: 4804317 - DNA, 18 bp, Homo sapiens
ttccagctcagtcccaca

SEQ ID NO: 4804318 - DNA, 22 bp, Homo sapiens
ttccagctcagtcccacagccc

SEQ ID NO: 4804319 - DNA, 13 bp, Homo sapiens
ttccaggacccct

SEQ ID NO: 4804320 - DNA, 19 bp, Homo sapiens
ttccaggttccatccacca

SEQ ID NO: 4804321 - DNA, 21 bp, Homo sapiens
ttccaggttccatccaccacc

SEQ ID NO: 4804322 - DNA, 15 bp, Homo sapiens
ttccaggtttaagta

SEQ ID NO: 4804323 - DNA, 21 bp, Homo sapiens
ttccagtccaattttcctaag

SEQ ID NO: 4804324 - DNA, 19 bp, Homo sapiens
ttccagtgcagtagtgcca

SEQ ID NO: 4804325 - DNA, 18 bp, Homo sapiens
ttccatccaccaccttgc

SEQ ID NO: 4804326 - DNA, 19 bp, Homo sapiens
ttccatccaccaccttgcc

SEQ ID NO: 4804327 - DNA, 20 bp, Homo sapiens
ttccatccaccaccttgcca

SEQ ID NO: 4804328 - DNA, 13 bp, Homo sapiens
ttccatgacagta

SEQ ID NO: 4804329 - DNA, 21 bp, Homo sapiens
ttccatgggttgaacaagcca

SEQ ID NO: 4804330 - DNA, 12 bp, Homo sapiens
ttccattctatg

SEQ ID NO: 4804331 - DNA, 23 bp, Homo sapiens
ttcccaaagcagtgcatgctgtc

SEQ ID NO: 4804332 - DNA, 15 bp, Homo sapiens
ttcccaaatctcaaa

SEQ ID NO: 4804333 - DNA, 21 bp, Homo sapiens
ttcccaacctcccctggtcct

SEQ ID NO: 4804334 - DNA, 21 bp, Homo sapiens
ttcccaagaaaggaaaccttt

SEQ ID NO: 4804335 - DNA, 15 bp, Homo sapiens
ttcccaaggcagctg

SEQ ID NO: 4804336 - DNA, 15 bp, Homo sapiens
ttcccaatcagcact

SEQ ID NO: 4804337 - DNA, 16 bp, Homo sapiens
ttcccaatcagcactg

SEQ ID NO: 4804338 - DNA, 14 bp, Homo sapiens
ttcccacctccctg

SEQ ID NO: 4804339 - DNA, 22 bp, Homo sapiens
ttcccactgcggaacaggagtg

SEQ ID NO: 4804340 - DNA, 23 bp, Homo sapiens
ttcccagaaccttgatggggtga

SEQ ID NO: 4804341 - DNA, 15 bp, Homo sapiens
ttcccaggcagggag

SEQ ID NO: 4804342 - DNA, 22 bp, Homo sapiens
ttcccaggcagggagggaaacc

SEQ ID NO: 4804343 - DNA, 14 bp, Homo sapiens
ttcccagggccgct

SEQ ID NO: 4804344 - DNA, 15 bp, Homo sapiens
ttcccagggccgctt

SEQ ID NO: 4804345 - DNA, 19 bp, Homo sapiens
ttcccatggtagactgtga

SEQ ID NO: 4804346 - DNA, 16 bp, Homo sapiens
ttcccatttgctcctt

SEQ ID NO: 4804347 - DNA, 12 bp, Homo sapiens
ttccccactccc

SEQ ID NO: 4804348 - DNA, 12 bp, Homo sapiens
ttccccatctgt

SEQ ID NO: 4804349 - DNA, 16 bp, Homo sapiens
ttccccattgccttct

SEQ ID NO: 4804350 - DNA, 21 bp, Homo sapiens
ttcccccagcacaaagcactg

SEQ ID NO: 4804351 - DNA, 18 bp, Homo sapiens
ttcccccagggtcccctg

SEQ ID NO: 4804352 - DNA, 11 bp, Homo sapiens
ttcccccttcc

SEQ ID NO: 4804353 - DNA, 22 bp, Homo sapiens
ttccccgcgaagtccgaggcct

SEQ ID NO: 4804354 - DNA, 19 bp, Homo sapiens
ttcccctgcgccctccctc

SEQ ID NO: 4804355 - DNA, 20 bp, Homo sapiens
ttcccctgcgccctccctcc

SEQ ID NO: 4804356 - DNA, 14 bp, Homo sapiens
ttcccgcagcacca

SEQ ID NO: 4804357 - DNA, 19 bp, Homo sapiens
ttcccgcagcaccagcctg

SEQ ID NO: 4804358 - DNA, 20 bp, Homo sapiens
ttcccgtctgattgttcctc

SEQ ID NO: 4804359 - DNA, 14 bp, Homo sapiens
ttccctagttcttt

SEQ ID NO: 4804360 - DNA, 19 bp, Homo sapiens
ttccctccgaacgctgctc

SEQ ID NO: 4804361 - DNA, 15 bp, Homo sapiens
ttccctgacactgtc

SEQ ID NO: 4804362 - DNA, 22 bp, Homo sapiens
ttccctgacactgtctgctgcc

SEQ ID NO: 4804363 - DNA, 14 bp, Homo sapiens
ttccctgcatccct

SEQ ID NO: 4804364 - DNA, 23 bp, Homo sapiens
ttccctgcatcccttggcccctc

SEQ ID NO: 4804365 - DNA, 15 bp, Homo sapiens
ttcccttccactgcc

SEQ ID NO: 4804366 - DNA, 16 bp, Homo sapiens
ttcccttgattcaaat

SEQ ID NO: 4804367 - DNA, 15 bp, Homo sapiens
ttccgagattcagac

SEQ ID NO: 4804368 - DNA, 18 bp, Homo sapiens
ttccgttcatctgaggag

SEQ ID NO: 4804369 - DNA, 18 bp, Homo sapiens
ttcctaaagaaaaagata

SEQ ID NO: 4804370 - DNA, 17 bp, Homo sapiens
ttcctaatcctctagga

SEQ ID NO: 4804371 - DNA, 23 bp, Homo sapiens
ttcctaccattatggctttgtgc

SEQ ID NO: 4804372 - DNA, 15 bp, Homo sapiens
ttcctacttaaacaa

SEQ ID NO: 4804373 - DNA, 22 bp, Homo sapiens
ttcctacttaaacaaaaacttt

SEQ ID NO: 4804374 - DNA, 20 bp, Homo sapiens
ttcctataccggagctccag

SEQ ID NO: 4804375 - DNA, 18 bp, Homo sapiens
ttcctcatcagtgtcatt

SEQ ID NO: 4804376 - DNA, 12 bp, Homo sapiens
ttcctcccctgg

SEQ ID NO: 4804377 - DNA, 12 bp, Homo sapiens
ttcctcctcatg

SEQ ID NO: 4804378 - DNA, 21 bp, Homo sapiens
ttcctcctcatgaaagcagca

SEQ ID NO: 4804379 - DNA, 13 bp, Homo sapiens
ttcctcctctcaa

SEQ ID NO: 4804380 - DNA, 14 bp, Homo sapiens
ttcctcctgtctcc

SEQ ID NO: 4804381 - DNA, 13 bp, Homo sapiens
ttcctctcctctc

SEQ ID NO: 4804382 - DNA, 17 bp, Homo sapiens
ttcctctcctctctgga

SEQ ID NO: 4804383 - DNA, 14 bp, Homo sapiens
ttcctctctctctc

SEQ ID NO: 4804384 - DNA, 19 bp, Homo sapiens
ttcctcttaatgtctcaaa

SEQ ID NO: 4804385 - DNA, 17 bp, Homo sapiens
ttcctgaccctcacttt

SEQ ID NO: 4804386 - DNA, 19 bp, Homo sapiens
ttcctgaggtcatctgtaa

SEQ ID NO: 4804387 - DNA, 12 bp, Homo sapiens
ttcctgccaagt

SEQ ID NO: 4804388 - DNA, 16 bp, Homo sapiens
ttcctgctcctccagt

SEQ ID NO: 4804389 - DNA, 17 bp, Homo sapiens
ttcctgggcagcccaga

SEQ ID NO: 4804390 - DNA, 18 bp, Homo sapiens
ttcctgggcagcccagag

SEQ ID NO: 4804391 - DNA, 13 bp, Homo sapiens
ttcctgtcctgct

SEQ ID NO: 4804392 - DNA, 12 bp, Homo sapiens
ttcctgtgagga

SEQ ID NO: 4804393 - DNA, 17 bp, Homo sapiens
ttcctgttcccatgaga

SEQ ID NO: 4804394 - DNA, 21 bp, Homo sapiens
ttccttaacagctgtattatc

SEQ ID NO: 4804395 - DNA, 12 bp, Homo sapiens
ttccttcaccca

SEQ ID NO: 4804396 - DNA, 21 bp, Homo sapiens
ttccttcacccaccaccccca

SEQ ID NO: 4804397 - DNA, 15 bp, Homo sapiens
ttccttgaccttcct

SEQ ID NO: 4804398 - DNA, 18 bp, Homo sapiens
ttccttgaccttcctctg

SEQ ID NO: 4804399 - DNA, 14 bp, Homo sapiens
ttgtcaacttcagt

SEQ ID NO: 4804400 - DNA, 14 bp, Homo sapiens
ttgtcacttctgct

SEQ ID NO: 4804401 - DNA, 16 bp, Homo sapiens
ttgtcacttctgctgt

SEQ ID NO: 4804402 - DNA, 16 bp, Homo sapiens
ttgtcagaatgttgtg

SEQ ID NO: 4804403 - DNA, 16 bp, Homo sapiens
ttgtccacaaatgtcc

SEQ ID NO: 4804404 - DNA, 17 bp, Homo sapiens
ttgtccacaaatgtcct

SEQ ID NO: 4804405 - DNA, 20 bp, Homo sapiens
ttgtccacaaatgtcctcag

SEQ ID NO: 4804406 - DNA, 22 bp, Homo sapiens
ttgtccacaaatgtcctcagag

SEQ ID NO: 4804407 - DNA, 17 bp, Homo sapiens
ttgtccaccttctgcca

SEQ ID NO: 4804408 - DNA, 17 bp, Homo sapiens
ttgtccccaatgaatat

SEQ ID NO: 4804409 - DNA, 23 bp, Homo sapiens
ttgtccttgtgtatcctgacagc

SEQ ID NO: 4804410 - DNA, 18 bp, Homo sapiens
ttgtcctttctgatcctc

SEQ ID NO: 4804411 - DNA, 17 bp, Homo sapiens
ttgtctcacgattccag

SEQ ID NO: 4804412 - DNA, 11 bp, Homo sapiens
ttgtctctgag

SEQ ID NO: 4804413 - DNA, 18 bp, Homo sapiens
ttgtctgctgcctccaag

SEQ ID NO: 4804414 - DNA, 20 bp, Homo sapiens
ttgtctggctgtggcccctc

SEQ ID NO: 4804415 - DNA, 21 bp, Homo sapiens
ttgtctggctgtggcccctcc

SEQ ID NO: 4804416 - DNA, 22 bp, Homo sapiens
ttgtctggctgtggcccctcct

SEQ ID NO: 4804417 - DNA, 21 bp, Homo sapiens
ttgtctgtgtatttctatttt

SEQ ID NO: 4804418 - DNA, 19 bp, Homo sapiens
ttgtgaaagtggcaagctc

SEQ ID NO: 4804419 - DNA, 22 bp, Homo sapiens
ttgtgaagaaacatttatcttt

SEQ ID NO: 4804420 - DNA, 17 bp, Homo sapiens
ttgtgaagtgattgaca

SEQ ID NO: 4804421 - DNA, 19 bp, Homo sapiens
ttgtgaagtgattgacatt

SEQ ID NO: 4804422 - DNA, 21 bp, Homo sapiens
ttgtgaagtgattgacatttt

SEQ ID NO: 4804423 - DNA, 21 bp, Homo sapiens
ttgtgacaggaaagccctccc

SEQ ID NO: 4804424 - DNA, 22 bp, Homo sapiens
ttgtgacaggaaagccctcccc

SEQ ID NO: 4804425 - DNA, 23 bp, Homo sapiens
ttgtgacaggaaagccctccccc

SEQ ID NO: 4804426 - DNA, 17 bp, Homo sapiens
ttgtgacccaattaagt

SEQ ID NO: 4804427 - DNA, 21 bp, Homo sapiens
ttgtgagatcctgtgattcct

SEQ ID NO: 4804428 - DNA, 10 bp, Homo sapiens
ttgtgccaaa

SEQ ID NO: 4804429 - DNA, 16 bp, Homo sapiens
ttgtgccaaagatagc

SEQ ID NO: 4804430 - DNA, 22 bp, Homo sapiens
ttgtgccctgtagctccttagc

SEQ ID NO: 4804431 - DNA, 20 bp, Homo sapiens
ttgtgcgccggcgccccgga

SEQ ID NO: 4804432 - DNA, 14 bp, Homo sapiens
ttgtgctgtgggca

SEQ ID NO: 4804433 - DNA, 17 bp, Homo sapiens
ttgtgctgtgggcagca

SEQ ID NO: 4804434 - DNA, 15 bp, Homo sapiens
ttgtgcttgttcttc

SEQ ID NO: 4804435 - DNA, 14 bp, Homo sapiens
ttgtggttggttgt

SEQ ID NO: 4804436 - DNA, 22 bp, Homo sapiens
ttgtgtaggaaatctgaagcct

SEQ ID NO: 4804437 - DNA, 13 bp, Homo sapiens
ttgtgtgctattc

SEQ ID NO: 4804438 - DNA, 23 bp, Homo sapiens
ttgtgtggagaagtgtgttctga

SEQ ID NO: 4804439 - DNA, 17 bp, Homo sapiens
ttgtgtgggtttactct

SEQ ID NO: 4804440 - DNA, 19 bp, Homo sapiens
ttgtgtgggtttactctgt

SEQ ID NO: 4804441 - DNA, 20 bp, Homo sapiens
ttgtgtgggtttactctgtg

SEQ ID NO: 4804442 - DNA, 21 bp, Homo sapiens
ttgtgtgggtttactctgtgc

SEQ ID NO: 4804443 - DNA, 19 bp, Homo sapiens
ttgtgtgtatgtctatgtg

SEQ ID NO: 4804444 - DNA, 20 bp, Homo sapiens
ttgtgtgtatgtctatgtgt

SEQ ID NO: 4804445 - DNA, 13 bp, Homo sapiens
ttgtgttacaata

SEQ ID NO: 4804446 - DNA, 21 bp, Homo sapiens
ttgtgtttatatataagccaa

SEQ ID NO: 4804447 - DNA, 17 bp, Homo sapiens
ttgtgttttcttcgtgg

SEQ ID NO: 4804448 - DNA, 18 bp, Homo sapiens
ttgttaatgattcttgtg

SEQ ID NO: 4804449 - DNA, 17 bp, Homo sapiens
ttgttacaggtgtacta

SEQ ID NO: 4804450 - DNA, 14 bp, Homo sapiens
ttgttactttaggt

SEQ ID NO: 4804451 - DNA, 13 bp, Homo sapiens
ttgttaggggtgg

SEQ ID NO: 4804452 - DNA, 17 bp, Homo sapiens
ttgttaggggtggggga

SEQ ID NO: 4804453 - DNA, 20 bp, Homo sapiens
ttgttagtgtgtcttagtgt

SEQ ID NO: 4804454 - DNA, 22 bp, Homo sapiens
ttgttatcagtacaattctttg

SEQ ID NO: 4804455 - DNA, 22 bp, Homo sapiens
ttgttcaaagaacccccctccc

SEQ ID NO: 4804456 - DNA, 15 bp, Homo sapiens
ttgttcaccttctgt

SEQ ID NO: 4804457 - DNA, 18 bp, Homo sapiens
ttgttcagtcacttgttt

SEQ ID NO: 4804458 - DNA, 18 bp, Homo sapiens
ttgttcatgttttgctaa

SEQ ID NO: 4804459 - DNA, 14 bp, Homo sapiens
ttgttcttcaatgt

SEQ ID NO: 4804460 - DNA, 20 bp, Homo sapiens
ttgttcttgtaaaactgtga

SEQ ID NO: 4804461 - DNA, 14 bp, Homo sapiens
ttgttgctgctttg

SEQ ID NO: 4804462 - DNA, 15 bp, Homo sapiens
ttgtttaagaatcat

SEQ ID NO: 4804463 - DNA, 11 bp, Homo sapiens
ttgtttgctgc

SEQ ID NO: 4804464 - DNA, 14 bp, Homo sapiens
ttgtttggcttcct

SEQ ID NO: 4804465 - DNA, 22 bp, Homo sapiens
ttgtttgtaaaagagctgttct

SEQ ID NO: 4804466 - DNA, 11 bp, Homo sapiens
ttgtttgtgct

SEQ ID NO: 4804467 - DNA, 12 bp, Homo sapiens
ttgtttgtgctt

SEQ ID NO: 4804468 - DNA, 22 bp, Homo sapiens
ttgtttttatatattataagtt

SEQ ID NO: 4804469 - DNA, 19 bp, Homo sapiens
tttaaaaaaaatattctgt

SEQ ID NO: 4804470 - DNA, 14 bp, Homo sapiens
tttaaaaaaataat

SEQ ID NO: 4804471 - DNA, 13 bp, Homo sapiens
tttaaaaaataca

SEQ ID NO: 4804472 - DNA, 20 bp, Homo sapiens
tttaaaaaatacagtattat

SEQ ID NO: 4804473 - DNA, 15 bp, Homo sapiens
tttaaaacaagctga

SEQ ID NO: 4804474 - DNA, 21 bp, Homo sapiens
tttaaaacaagctgatagtgt

SEQ ID NO: 4804475 - DNA, 20 bp, Homo sapiens
tttaaaactagttagattca

SEQ ID NO: 4804476 - DNA, 20 bp, Homo sapiens
tttaaaagaaggtaaataat

SEQ ID NO: 4804477 - DNA, 19 bp, Homo sapiens
tttaaaagccctttccaaa

SEQ ID NO: 4804478 - DNA, 21 bp, Homo sapiens
tttaaaatggcatttagcaca

SEQ ID NO: 4804479 - DNA, 13 bp, Homo sapiens
tttaaaattatta

SEQ ID NO: 4804480 - DNA, 18 bp, Homo sapiens
tttaaagcaatcttggca

SEQ ID NO: 4804481 - DNA, 13 bp, Homo sapiens
tttaaaggaaagt

SEQ ID NO: 4804482 - DNA, 16 bp, Homo sapiens
tttaaatctttgttaa

SEQ ID NO: 4804483 - DNA, 13 bp, Homo sapiens
tttaaatgtctat

SEQ ID NO: 4804484 - DNA, 12 bp, Homo sapiens
tttaaattatga

SEQ ID NO: 4804485 - DNA, 11 bp, Homo sapiens
tttaacagaaa

SEQ ID NO: 4804486 - DNA, 18 bp, Homo sapiens
tttaacatatcattcaga

SEQ ID NO: 4804487 - DNA, 23 bp, Homo sapiens
tttaactttaccatgctcaatga

SEQ ID NO: 4804488 - DNA, 12 bp, Homo sapiens
tttaagaatcat

SEQ ID NO: 4804489 - DNA, 17 bp, Homo sapiens
tttaagaatcatggatt

SEQ ID NO: 4804490 - DNA, 17 bp, Homo sapiens
tttaagcacaaaaaatt

SEQ ID NO: 4804491 - DNA, 14 bp, Homo sapiens
tttaagctcaaaat

SEQ ID NO: 4804492 - DNA, 23 bp, Homo sapiens
tttaagtcagaagcccattaaaa

SEQ ID NO: 4804493 - DNA, 18 bp, Homo sapiens
tttaagtgtactggattt

SEQ ID NO: 4804494 - DNA, 13 bp, Homo sapiens
tttaagtgttctg

SEQ ID NO: 4804495 - DNA, 14 bp, Homo sapiens
tttaagtgttctgt

SEQ ID NO: 4804496 - DNA, 21 bp, Homo sapiens
tttaataattattaagctgtt

SEQ ID NO: 4804497 - DNA, 16 bp, Homo sapiens
tttaatagtttctaaa

SEQ ID NO: 4804498 - DNA, 13 bp, Homo sapiens
tttaatcatttcc

SEQ ID NO: 4804499 - DNA, 13 bp, Homo sapiens
tttaatctcttgt

SEQ ID NO: 4804500 - DNA, 21 bp, Homo sapiens
tttaatctcttgtcattctca

SEQ ID NO: 4804501 - DNA, 20 bp, Homo sapiens
tttaatgcaaatgaaggaat

SEQ ID NO: 4804502 - DNA, 19 bp, Homo sapiens
tttaatgtttgtaagcaat

SEQ ID NO: 4804503 - DNA, 12 bp, Homo sapiens
tttaattcagtt

SEQ ID NO: 4804504 - DNA, 15 bp, Homo sapiens
tttaattttgacact

SEQ ID NO: 4804505 - DNA, 22 bp, Homo sapiens
tttacaacttccagatttgagc

SEQ ID NO: 4804506 - DNA, 14 bp, Homo sapiens
tttacaatgtatta

SEQ ID NO: 4804507 - DNA, 21 bp, Homo sapiens
tttacacacgtgcaatttgtt

SEQ ID NO: 4804508 - DNA, 19 bp, Homo sapiens
tttacagtgaagaaagcct

SEQ ID NO: 4804509 - DNA, 13 bp, Homo sapiens
tttacatagtctg

SEQ ID NO: 4804510 - DNA, 23 bp, Homo sapiens
tttacatagtctgaagtgaagta

SEQ ID NO: 4804511 - DNA, 18 bp, Homo sapiens
tttacatatagctttgca

SEQ ID NO: 4804512 - DNA, 21 bp, Homo sapiens
tttaccagaagtttaaatctt

SEQ ID NO: 4804513 - DNA, 15 bp, Homo sapiens
tttaccatcaaacaa

SEQ ID NO: 4804514 - DNA, 19 bp, Homo sapiens
tttaccatcaaacaaatca

SEQ ID NO: 4804515 - DNA, 14 bp, Homo sapiens
tttaccctccacac

SEQ ID NO: 4804516 - DNA, 19 bp, Homo sapiens
tttacctctctgtcatgtg

SEQ ID NO: 4804517 - DNA, 22 bp, Homo sapiens
tttacctgaagtctttgtacag

SEQ ID NO: 4804518 - DNA, 18 bp, Homo sapiens
tttactaacagtaactgc

SEQ ID NO: 4804519 - DNA, 21 bp, Homo sapiens
tttactaacagtaactgccat

SEQ ID NO: 4804520 - DNA, 19 bp, Homo sapiens
tttactcaggctttctatt

SEQ ID NO: 4804521 - DNA, 14 bp, Homo sapiens
tttctgtaattctt

SEQ ID NO: 4804522 - DNA, 19 bp, Homo sapiens
tttctgtaattcttctcct

SEQ ID NO: 4804523 - DNA, 21 bp, Homo sapiens
tttctgtatatagatgtctgt

SEQ ID NO: 4804524 - DNA, 22 bp, Homo sapiens
tttctgtatatagatgtctgtg

SEQ ID NO: 4804525 - DNA, 14 bp, Homo sapiens
tttctgttggtctt

SEQ ID NO: 4804526 - DNA, 19 bp, Homo sapiens
tttctgttggtcttaacta

SEQ ID NO: 4804527 - DNA, 19 bp, Homo sapiens
tttctgtttgaattttcaa

SEQ ID NO: 4804528 - DNA, 21 bp, Homo sapiens
tttcttaatagaaagtcagat

SEQ ID NO: 4804529 - DNA, 15 bp, Homo sapiens
tttcttcccatttgt

SEQ ID NO: 4804530 - DNA, 16 bp, Homo sapiens
tttcttcccatttgta

SEQ ID NO: 4804531 - DNA, 12 bp, Homo sapiens
tttcttccttcc

SEQ ID NO: 4804532 - DNA, 14 bp, Homo sapiens
tttcttccttcctt

SEQ ID NO: 4804533 - DNA, 12 bp, Homo sapiens
tttcttctcatt

SEQ ID NO: 4804534 - DNA, 14 bp, Homo sapiens
tttcttgcaagctc

SEQ ID NO: 4804535 - DNA, 12 bp, Homo sapiens
tttcttgtttac

SEQ ID NO: 4804536 - DNA, 16 bp, Homo sapiens
tttctttataatggct

SEQ ID NO: 4804537 - DNA, 14 bp, Homo sapiens
tttcttttttctct

SEQ ID NO: 4804538 - DNA, 16 bp, Homo sapiens
tttgaaaagcccacat

SEQ ID NO: 4804539 - DNA, 19 bp, Homo sapiens
tttgaaaagcccacataag

SEQ ID NO: 4804540 - DNA, 22 bp, Homo sapiens
tttgaaaagcccacataagttt

SEQ ID NO: 4804541 - DNA, 15 bp, Homo sapiens
tttgaacaactcgaa

SEQ ID NO: 4804542 - DNA, 22 bp, Homo sapiens
tttgaacaactcgaatcactca

SEQ ID NO: 4804543 - DNA, 21 bp, Homo sapiens
tttgaagaagggaaattcaca

SEQ ID NO: 4804544 - DNA, 18 bp, Homo sapiens
tttgaagaattaatgaca

SEQ ID NO: 4804545 - DNA, 17 bp, Homo sapiens
tttgaagacttcaaaat

SEQ ID NO: 4804546 - DNA, 23 bp, Homo sapiens
tttgaagacttcaaaatattgag

SEQ ID NO: 4804547 - DNA, 13 bp, Homo sapiens
tttgacattgtca

SEQ ID NO: 4804548 - DNA, 21 bp, Homo sapiens
tttgacctctcacttttttat

SEQ ID NO: 4804549 - DNA, 15 bp, Homo sapiens
tttgactgattgttt

SEQ ID NO: 4804550 - DNA, 20 bp, Homo sapiens
tttgagacagagtcttcctc

SEQ ID NO: 4804551 - DNA, 18 bp, Homo sapiens
tttgagagaagccacgct

SEQ ID NO: 4804552 - DNA, 23 bp, Homo sapiens
tttgagcccacaggagctccctt

SEQ ID NO: 4804553 - DNA, 18 bp, Homo sapiens
tttgagccttattaaaat

SEQ ID NO: 4804554 - DNA, 15 bp, Homo sapiens
tttgaggaaactcat

SEQ ID NO: 4804555 - DNA, 14 bp, Homo sapiens
tttgagtaaaactt

SEQ ID NO: 4804556 - DNA, 15 bp, Homo sapiens
tttgagtgtcaggct

SEQ ID NO: 4804557 - DNA, 21 bp, Homo sapiens
tttgagtgtcaggctctgaat

SEQ ID NO: 4804558 - DNA, 16 bp, Homo sapiens
tttgatacttgtaact

SEQ ID NO: 4804559 - DNA, 17 bp, Homo sapiens
tttgatacttgtaactt

SEQ ID NO: 4804560 - DNA, 16 bp, Homo sapiens
tttgatatacagacct

SEQ ID NO: 4804561 - DNA, 19 bp, Homo sapiens
tttgatattgtgtaggaaa

SEQ ID NO: 4804562 - DNA, 24 bp, Homo sapiens
tttgatctcagcatcctggaaatt

SEQ ID NO: 4804563 - DNA, 22 bp, Homo sapiens
tttgatgtattattatatatgt

SEQ ID NO: 4804564 - DNA, 20 bp, Homo sapiens
tttgcaataaggatttattc

SEQ ID NO: 4804565 - DNA, 16 bp, Homo sapiens
tttgctaatgaatttt

SEQ ID NO: 4804566 - DNA, 24 bp, Homo sapiens
tttgctaatgaattttaaaagcat

SEQ ID NO: 4804567 - DNA, 22 bp, Homo sapiens
tttgctcataagtaaatgtctt

SEQ ID NO: 4804568 - DNA, 15 bp, Homo sapiens
tttgctctgtggtaa

SEQ ID NO: 4804569 - DNA, 19 bp, Homo sapiens
tttgctgattgtctgaaat

SEQ ID NO: 4804570 - DNA, 17 bp, Homo sapiens
tttgctgcttttgatgg

SEQ ID NO: 4804571 - DNA, 11 bp, Homo sapiens
tttgcttccca

SEQ ID NO: 4804572 - DNA, 14 bp, Homo sapiens
tttggcaagaaatc

SEQ ID NO: 4804573 - DNA, 13 bp, Homo sapiens
tttggcattatct

SEQ ID NO: 4804574 - DNA, 24 bp, Homo sapiens
tttggctattgtccttgtgtatcc

SEQ ID NO: 4804575 - DNA, 15 bp, Homo sapiens
tttggctgaaattat

SEQ ID NO: 4804576 - DNA, 19 bp, Homo sapiens
tttggctgaaattatgtca

SEQ ID NO: 4804577 - DNA, 17 bp, Homo sapiens
tttggctgctctccatc

SEQ ID NO: 4804578 - DNA, 18 bp, Homo sapiens
tttggctgctctccatct

SEQ ID NO: 4804579 - DNA, 17 bp, Homo sapiens
tttggcttcagaattgt

SEQ ID NO: 4804580 - DNA, 19 bp, Homo sapiens
tttgggggacgcccagccc

SEQ ID NO: 4804581 - DNA, 22 bp, Homo sapiens
tttggtatgaaacaaatatact

SEQ ID NO: 4804582 - DNA, 23 bp, Homo sapiens
tttggttcctaaagaaaaagata

SEQ ID NO: 4804583 - DNA, 21 bp, Homo sapiens
tttggttcctcatggctgtta

SEQ ID NO: 4804584 - DNA, 14 bp, Homo sapiens
tttgtaaaaatgta

SEQ ID NO: 4804585 - DNA, 13 bp, Homo sapiens
tttgtaaaatgta

SEQ ID NO: 4804586 - DNA, 18 bp, Homo sapiens
tttgtaactattcttcag

SEQ ID NO: 4804587 - DNA, 10 bp, Homo sapiens
tttgtaactc

SEQ ID NO: 4804588 - DNA, 13 bp, Homo sapiens
tttgtaactcttt

SEQ ID NO: 4804589 - DNA, 16 bp, Homo sapiens
tttgtaactctttggc

SEQ ID NO: 4804590 - DNA, 20 bp, Homo sapiens
tttgtaactctttggctatt

SEQ ID NO: 4804591 - DNA, 19 bp, Homo sapiens
tttgtaagcaattctaagt

SEQ ID NO: 4804592 - DNA, 14 bp, Homo sapiens
tttgtacagacaac

SEQ ID NO: 4804593 - DNA, 17 bp, Homo sapiens
tttgtacgttaattaaa

SEQ ID NO: 4804594 - DNA, 20 bp, Homo sapiens
tttgtacgttaattaaacaa

SEQ ID NO: 4804595 - DNA, 21 bp, Homo sapiens
tttgtacgttaattaaacaaa

SEQ ID NO: 4804596 - DNA, 22 bp, Homo sapiens
tttgtagctagtttaaaattat

SEQ ID NO: 4804597 - DNA, 13 bp, Homo sapiens
tttgtataaaatg

SEQ ID NO: 4804598 - DNA, 12 bp, Homo sapiens
tttgtatcctcc

SEQ ID NO: 4804599 - DNA, 19 bp, Homo sapiens
tttgtatgaaatatatgtg

SEQ ID NO: 4804600 - DNA, 13 bp, Homo sapiens
tttgtatttatat

SEQ ID NO: 4804601 - DNA, 18 bp, Homo sapiens
tttgtatttatattagag

SEQ ID NO: 4804602 - DNA, 16 bp, Homo sapiens
tttgtcaaatggtatt

SEQ ID NO: 4804603 - DNA, 17 bp, Homo sapiens
tttgtcaacttcagttg

SEQ ID NO: 4804604 - DNA, 13 bp, Homo sapiens
tttgtcacttctg

SEQ ID NO: 4804605 - DNA, 17 bp, Homo sapiens
tttgtcacttctgctgt

SEQ ID NO: 4804606 - DNA, 17 bp, Homo sapiens
tttgtcctttatgtatt

SEQ ID NO: 4804607 - DNA, 18 bp, Homo sapiens
tttgtcgggttctcccat

SEQ ID NO: 4804608 - DNA, 20 bp, Homo sapiens
tttgtggggcttggcgtgga

SEQ ID NO: 4804609 - DNA, 13 bp, Homo sapiens
tttgtgtaactga

SEQ ID NO: 4804610 - DNA, 18 bp, Homo sapiens
tttgtgtgcttcacacaa

SEQ ID NO: 4804611 - DNA, 13 bp, Homo sapiens
tttgttaatgatt

SEQ ID NO: 4804612 - DNA, 17 bp, Homo sapiens
tttgttcaccttctgtg

SEQ ID NO: 4804613 - DNA, 19 bp, Homo sapiens
tttgttcaccttctgtgca

SEQ ID NO: 4804614 - DNA, 21 bp, Homo sapiens
tttgttcaccttctgtgcatc

SEQ ID NO: 4804615 - DNA, 10 bp, Homo sapiens
tttgttcatt

SEQ ID NO: 4804616 - DNA, 23 bp, Homo sapiens
tttgttgaatctcaggtaaatga

SEQ ID NO: 4804617 - DNA, 12 bp, Homo sapiens
tttgtttgtgct

SEQ ID NO: 4804618 - DNA, 17 bp, Homo sapiens
ttttaaaaaatacagta

SEQ ID NO: 4804619 - DNA, 17 bp, Homo sapiens
ttttaaaaagttgcaca

SEQ ID NO: 4804620 - DNA, 18 bp, Homo sapiens
ttttaaaatgcaaatatt

SEQ ID NO: 4804621 - DNA, 19 bp, Homo sapiens
ttttaaacctgttcctgac

SEQ ID NO: 4804622 - DNA, 12 bp, Homo sapiens
ttttaaatgtct

SEQ ID NO: 4804623 - DNA, 13 bp, Homo sapiens
ttttaacatagca

SEQ ID NO: 4804624 - DNA, 12 bp, Homo sapiens
ttttaatctctt

SEQ ID NO: 4804625 - DNA, 16 bp, Homo sapiens
ttttaatctttgtgac

SEQ ID NO: 4804626 - DNA, 14 bp, Homo sapiens
ttttaattgaaaag

SEQ ID NO: 4804627 - DNA, 15 bp, Homo sapiens
ttttacaaagaaaca

SEQ ID NO: 4804628 - DNA, 14 bp, Homo sapiens
ttttacatatagct

SEQ ID NO: 4804629 - DNA, 21 bp, Homo sapiens
ttttactcaggctttctattg

SEQ ID NO: 4804630 - DNA, 17 bp, Homo sapiens
ttttacttgattaagga

SEQ ID NO: 4804631 - DNA, 18 bp, Homo sapiens
ttttagaaacaatatgga

SEQ ID NO: 4804632 - DNA, 20 bp, Homo sapiens
ttttagcagttctgcaaata

SEQ ID NO: 4804633 - DNA, 12 bp, Homo sapiens
ttttataaatgt

SEQ ID NO: 4804634 - DNA, 13 bp, Homo sapiens
ttttataaatgtt

SEQ ID NO: 4804635 - DNA, 16 bp, Homo sapiens
ttttataaattaaata

SEQ ID NO: 4804636 - DNA, 17 bp, Homo sapiens
ttttataaattataatg

SEQ ID NO: 4804637 - DNA, 20 bp, Homo sapiens
ttttataaggctgactctta

SEQ ID NO: 4804638 - DNA, 19 bp, Homo sapiens
ttttatagaaaaacaaatc

SEQ ID NO: 4804639 - DNA, 14 bp, Homo sapiens
ttttatagaggttc

SEQ ID NO: 4804640 - DNA, 22 bp, Homo sapiens
ttttatataataaagtattcca

SEQ ID NO: 4804641 - DNA, 13 bp, Homo sapiens
ttttatctcagtg

SEQ ID NO: 4804642 - DNA, 20 bp, Homo sapiens
ttttatctgaaatcaattaa

SEQ ID NO: 4804643 - DNA, 21 bp, Homo sapiens
aatccatgatcaaaatgcata

SEQ ID NO: 4804644 - DNA, 22 bp, Homo sapiens
aatccatgatcaaaatgcatac

SEQ ID NO: 4804645 - DNA, 19 bp, Homo sapiens
aatccatgtgctgctgtgg

SEQ ID NO: 4804646 - DNA, 14 bp, Homo sapiens
aatccatgtgtccc

SEQ ID NO: 4804647 - DNA, 19 bp, Homo sapiens
aatccccataatgcttctt

SEQ ID NO: 4804648 - DNA, 20 bp, Homo sapiens
aatcctgttacttaaatagc

SEQ ID NO: 4804649 - DNA, 15 bp, Homo sapiens
aatccttcagcaatc

SEQ ID NO: 4804650 - DNA, 19 bp, Homo sapiens
aatccttcagcaatcctta

SEQ ID NO: 4804651 - DNA, 20 bp, Homo sapiens
aatccttcagcaatccttaa

SEQ ID NO: 4804652 - DNA, 12 bp, Homo sapiens
aatcctttgtac

SEQ ID NO: 4804653 - DNA, 16 bp, Homo sapiens
aatcgacctcactgtc

SEQ ID NO: 4804654 - DNA, 15 bp, Homo sapiens
aatctactagaacct

SEQ ID NO: 4804655 - DNA, 22 bp, Homo sapiens
aatctactcttaaatatacaac

SEQ ID NO: 4804656 - DNA, 12 bp, Homo sapiens
aatctacttaac

SEQ ID NO: 4804657 - DNA, 13 bp, Homo sapiens
aatctagaagagt

SEQ ID NO: 4804658 - DNA, 12 bp, Homo sapiens
aatctagagcta

SEQ ID NO: 4804659 - DNA, 17 bp, Homo sapiens
aatctagagctatgcac

SEQ ID NO: 4804660 - DNA, 19 bp, Homo sapiens
aatctagagctatgcacac

SEQ ID NO: 4804661 - DNA, 23 bp, Homo sapiens
aatctatctctatataaaaaata

SEQ ID NO: 4804662 - DNA, 15 bp, Homo sapiens
aatctctcaaaatgt

SEQ ID NO: 4804663 - DNA, 17 bp, Homo sapiens
aatctctcaaaatgtgc

SEQ ID NO: 4804664 - DNA, 20 bp, Homo sapiens
aatctctgtgactcgcttag

SEQ ID NO: 4804665 - DNA, 19 bp, Homo sapiens
aatctcttcttatacagat

SEQ ID NO: 4804666 - DNA, 12 bp, Homo sapiens
aatctcttgtca

SEQ ID NO: 4804667 - DNA, 18 bp, Homo sapiens
aatctcttgtcattctca

SEQ ID NO: 4804668 - DNA, 19 bp, Homo sapiens
aatctcttgtcattctcat

SEQ ID NO: 4804669 - DNA, 20 bp, Homo sapiens
aatctcttgtcattctcatc

SEQ ID NO: 4804670 - DNA, 14 bp, Homo sapiens
aatctgaatttcta

SEQ ID NO: 4804671 - DNA, 16 bp, Homo sapiens
aatctgaatttctaaa

SEQ ID NO: 4804672 - DNA, 15 bp, Homo sapiens
aatctgtccagacaa

SEQ ID NO: 4804673 - DNA, 22 bp, Homo sapiens
aatctgtccagacaagccctgc

SEQ ID NO: 4804674 - DNA, 20 bp, Homo sapiens
aatctgtcgcatttcatcaa

SEQ ID NO: 4804675 - DNA, 17 bp, Homo sapiens
aatctgttgatggagat

SEQ ID NO: 4804676 - DNA, 14 bp, Homo sapiens
aatcttgctgctta

SEQ ID NO: 4804677 - DNA, 18 bp, Homo sapiens
aatcttgctgtgaaacag

SEQ ID NO: 4804678 - DNA, 23 bp, Homo sapiens
aatcttgctgtgaaacagtgtgg

SEQ ID NO: 4804679 - DNA, 20 bp, Homo sapiens
aatcttggccctattcatta

SEQ ID NO: 4804680 - DNA, 20 bp, Homo sapiens
aatcttgttaatttcattcc

SEQ ID NO: 4804681 - DNA, 19 bp, Homo sapiens
aatctttgttaaaatatag

SEQ ID NO: 4804682 - DNA, 18 bp, Homo sapiens
aatgaaaaatctgaattt

SEQ ID NO: 4804683 - DNA, 17 bp, Homo sapiens
aatgaaacctgtgtctc

SEQ ID NO: 4804684 - DNA, 16 bp, Homo sapiens
aatgaaatacttgaca

SEQ ID NO: 4804685 - DNA, 17 bp, Homo sapiens
aatgaaatataaactgt

SEQ ID NO: 4804686 - DNA, 20 bp, Homo sapiens
aatgaaatataaactgtgag

SEQ ID NO: 4804687 - DNA, 21 bp, Homo sapiens
aatgaaatataaactgtgaga

SEQ ID NO: 4804688 - DNA, 15 bp, Homo sapiens
aatgaaatttaagca

SEQ ID NO: 4804689 - DNA, 18 bp, Homo sapiens
aatgaaatttaagcacaa

SEQ ID NO: 4804690 - DNA, 14 bp, Homo sapiens
aatgaacattaaca

SEQ ID NO: 4804691 - DNA, 13 bp, Homo sapiens
aatgaagaaatac

SEQ ID NO: 4804692 - DNA, 20 bp, Homo sapiens
aatgaataatgcctttgtaa

SEQ ID NO: 4804693 - DNA, 12 bp, Homo sapiens
aatgaatgaaat

SEQ ID NO: 4804694 - DNA, 15 bp, Homo sapiens
aatgaatgaaatata

SEQ ID NO: 4804695 - DNA, 10 bp, Homo sapiens
aatgaatgag

SEQ ID NO: 4804696 - DNA, 21 bp, Homo sapiens
aatgaatgtcagtgtgactga

SEQ ID NO: 4804697 - DNA, 16 bp, Homo sapiens
aatgaattcacccctc

SEQ ID NO: 4804698 - DNA, 18 bp, Homo sapiens
aatgacaagtgacttatt

SEQ ID NO: 4804699 - DNA, 22 bp, Homo sapiens
aatgacaagtgacttatttgct

SEQ ID NO: 4804700 - DNA, 12 bp, Homo sapiens
aatgacatgcac

SEQ ID NO: 4804701 - DNA, 15 bp, Homo sapiens
aatgacatgcactga

SEQ ID NO: 4804702 - DNA, 15 bp, Homo sapiens
aatgacttattgatt

SEQ ID NO: 4804703 - DNA, 14 bp, Homo sapiens
aatgagaaattgtg

SEQ ID NO: 4804704 - DNA, 19 bp, Homo sapiens
aatgagaaattgtgccaaa

SEQ ID NO: 4804705 - DNA, 18 bp, Homo sapiens
aatgagaatctgtgcagt

SEQ ID NO: 4804706 - DNA, 23 bp, Homo sapiens
aatgagccaataaagctcacact

SEQ ID NO: 4804707 - DNA, 15 bp, Homo sapiens
aatgagcttaatgtc

SEQ ID NO: 4804708 - DNA, 21 bp, Homo sapiens
aatgaggcacatgacagtggt

SEQ ID NO: 4804709 - DNA, 20 bp, Homo sapiens
aatgagtttccagctaagcc

SEQ ID NO: 4804710 - DNA, 16 bp, Homo sapiens
aatgatatgtctttaa

SEQ ID NO: 4804711 - DNA, 21 bp, Homo sapiens
aatgatatgtctttaaaatga

SEQ ID NO: 4804712 - DNA, 19 bp, Homo sapiens
aatgatgccatgaggaaca

SEQ ID NO: 4804713 - DNA, 18 bp, Homo sapiens
aatgattgtttaattgta

SEQ ID NO: 4804714 - DNA, 20 bp, Homo sapiens
aatgatttaagcattttact

SEQ ID NO: 4804715 - DNA, 22 bp, Homo sapiens
aatgcaaatgaaggaatgcaat

SEQ ID NO: 4804716 - DNA, 19 bp, Homo sapiens
aatgcacaaacagaggccg

SEQ ID NO: 4804717 - DNA, 17 bp, Homo sapiens
aatgcagtataaaatgt

SEQ ID NO: 4804718 - DNA, 14 bp, Homo sapiens
aatgcagtgtattt

SEQ ID NO: 4804719 - DNA, 21 bp, Homo sapiens
aatgccaagactctatgctct

SEQ ID NO: 4804720 - DNA, 17 bp, Homo sapiens
aatgccagacttctaaa

SEQ ID NO: 4804721 - DNA, 17 bp, Homo sapiens
aatgcctattgtaatat

SEQ ID NO: 4804722 - DNA, 22 bp, Homo sapiens
aatgcgctcttcaccaggaaga

SEQ ID NO: 4804723 - DNA, 12 bp, Homo sapiens
aatgctatggac

SEQ ID NO: 4804724 - DNA, 19 bp, Homo sapiens
aatgctatggactgcacaa

SEQ ID NO: 4804725 - DNA, 17 bp, Homo sapiens
aatgctcaatgtgctgt

SEQ ID NO: 4804726 - DNA, 18 bp, Homo sapiens
aatgctcaatgtgctgtt

SEQ ID NO: 4804727 - DNA, 21 bp, Homo sapiens
aatgctcgtatctccttgatt

SEQ ID NO: 4804728 - DNA, 13 bp, Homo sapiens
aatgctgttctca

SEQ ID NO: 4804729 - DNA, 19 bp, Homo sapiens
aatgctgttggtgagaatc

SEQ ID NO: 4804730 - DNA, 18 bp, Homo sapiens
aatgctttctcatgcata

SEQ ID NO: 4804731 - DNA, 14 bp, Homo sapiens
aatgcttttctagc

SEQ ID NO: 4804732 - DNA, 18 bp, Homo sapiens
aatggaagacagctctta

SEQ ID NO: 4804733 - DNA, 22 bp, Homo sapiens
aatggaccactgagagccacag

SEQ ID NO: 4804734 - DNA, 23 bp, Homo sapiens
aatggacgtgttatgactccaga

SEQ ID NO: 4804735 - DNA, 19 bp, Homo sapiens
aatggacttgcttcttgtg

SEQ ID NO: 4804736 - DNA, 23 bp, Homo sapiens
aatggaggataattgaggctaag

SEQ ID NO: 4804737 - DNA, 13 bp, Homo sapiens
aatggatgtaata

SEQ ID NO: 4804738 - DNA, 17 bp, Homo sapiens
aatggatgtaatatagg

SEQ ID NO: 4804739 - DNA, 20 bp, Homo sapiens
aatggcatttagcacagtat

SEQ ID NO: 4804740 - DNA, 14 bp, Homo sapiens
aatggccaagtgta

SEQ ID NO: 4804741 - DNA, 20 bp, Homo sapiens
aatggcctggtaggtctgga

SEQ ID NO: 4804742 - DNA, 21 bp, Homo sapiens
aatggcctgtccctagggctc

SEQ ID NO: 4804743 - DNA, 17 bp, Homo sapiens
aatggctgaagaaacac

SEQ ID NO: 4804744 - DNA, 16 bp, Homo sapiens
aatggctgggtttggg

SEQ ID NO: 4804745 - DNA, 21 bp, Homo sapiens
aatggggaactcccccagagg

SEQ ID NO: 4804746 - DNA, 16 bp, Homo sapiens
aatgggtagcaacagg

SEQ ID NO: 4804747 - DNA, 20 bp, Homo sapiens
aatggtagctctgaagggag

SEQ ID NO: 4804748 - DNA, 17 bp, Homo sapiens
aatggtgtcataactag

SEQ ID NO: 4804749 - DNA, 17 bp, Homo sapiens
aatggttttcttgtgtg

SEQ ID NO: 4804750 - DNA, 18 bp, Homo sapiens
aatggtttttatttctcg

SEQ ID NO: 4804751 - DNA, 12 bp, Homo sapiens
aatgtaaaatat

SEQ ID NO: 4804752 - DNA, 20 bp, Homo sapiens
aatgtaactgtccgtagtat

SEQ ID NO: 4804753 - DNA, 18 bp, Homo sapiens
aatgtaattaaactgtta

SEQ ID NO: 4804754 - DNA, 19 bp, Homo sapiens
aatgtaattaaactgttaa

SEQ ID NO: 4804755 - DNA, 17 bp, Homo sapiens
aatgtagcttcagtcat

SEQ ID NO: 4804756 - DNA, 22 bp, Homo sapiens
aatgtagcttcagtcattaaat

SEQ ID NO: 4804757 - DNA, 15 bp, Homo sapiens
aatgtagggcagaat

SEQ ID NO: 4804758 - DNA, 13 bp, Homo sapiens
aatgtatcttatt

SEQ ID NO: 4804759 - DNA, 16 bp, Homo sapiens
aatgtatcttatttat

SEQ ID NO: 4804760 - DNA, 18 bp, Homo sapiens
aatgtatcttatttatat

SEQ ID NO: 4804761 - DNA, 23 bp, Homo sapiens
aatgtattaagcccacagtatat

SEQ ID NO: 4804762 - DNA, 13 bp, Homo sapiens
aatgtcatttgct

SEQ ID NO: 4804763 - DNA, 17 bp, Homo sapiens
aatgtcatttgctaatg

SEQ ID NO: 4804764 - DNA, 23 bp, Homo sapiens
aatgtcatttgctaatgaatttt

SEQ ID NO: 4804765 - DNA, 22 bp, Homo sapiens
aatgtcccaaataaatttataa

SEQ ID NO: 4804766 - DNA, 23 bp, Homo sapiens
aatgtcctcagagggtccctagg

SEQ ID NO: 4804767 - DNA, 13 bp, Homo sapiens
aagtttctaagaa

SEQ ID NO: 4804768 - DNA, 22 bp, Homo sapiens
aagttttcagattgtaaaggta

SEQ ID NO: 4804769 - DNA, 21 bp, Homo sapiens
aagttttgatacttgtaactt

SEQ ID NO: 4804770 - DNA, 22 bp, Homo sapiens
aagttttgatacttgtaacttt

SEQ ID NO: 4804771 - DNA, 16 bp, Homo sapiens
aataaaaattctagat

SEQ ID NO: 4804772 - DNA, 18 bp, Homo sapiens
aataaaattcattccatt

SEQ ID NO: 4804773 - DNA, 20 bp, Homo sapiens
aataaagagtaaatatactt

SEQ ID NO: 4804774 - DNA, 13 bp, Homo sapiens
aataaagccacat

SEQ ID NO: 4804775 - DNA, 14 bp, Homo sapiens
aataaagctcacac

SEQ ID NO: 4804776 - DNA, 9 bp, Homo sapiens
aataaagta

SEQ ID NO: 4804777 - DNA, 20 bp, Homo sapiens
aataaagtattccaccttaa

SEQ ID NO: 4804778 - DNA, 16 bp, Homo sapiens
aataaatacattcttg

SEQ ID NO: 4804779 - DNA, 22 bp, Homo sapiens
aataaatgtcccaaataaattt

SEQ ID NO: 4804780 - DNA, 15 bp, Homo sapiens
aataaatgtgtaaat

SEQ ID NO: 4804781 - DNA, 17 bp, Homo sapiens
aataaatgtgtaaatgt

SEQ ID NO: 4804782 - DNA, 15 bp, Homo sapiens
aataaatgttttgga

SEQ ID NO: 4804783 - DNA, 12 bp, Homo sapiens
aataaattttat

SEQ ID NO: 4804784 - DNA, 19 bp, Homo sapiens
aataacaacaatttaggaa

SEQ ID NO: 4804785 - DNA, 14 bp, Homo sapiens
aataacctgtgaat

SEQ ID NO: 4804786 - DNA, 19 bp, Homo sapiens
aataactagatctcctgta

SEQ ID NO: 4804787 - DNA, 20 bp, Homo sapiens
aataagaaacagtttaacag

SEQ ID NO: 4804788 - DNA, 13 bp, Homo sapiens
aataaggatttat

SEQ ID NO: 4804789 - DNA, 15 bp, Homo sapiens
aataaggatttattc

SEQ ID NO: 4804790 - DNA, 16 bp, Homo sapiens
aataaggatttattct

SEQ ID NO: 4804791 - DNA, 22 bp, Homo sapiens
aataaggatttattctcagaac

SEQ ID NO: 4804792 - DNA, 12 bp, Homo sapiens
aataataaaggt

SEQ ID NO: 4804793 - DNA, 15 bp, Homo sapiens
aataataaaggttct

SEQ ID NO: 4804794 - DNA, 16 bp, Homo sapiens
aataataaaggttcta

SEQ ID NO: 4804795 - DNA, 17 bp, Homo sapiens
aataatctgaaatgaca

SEQ ID NO: 4804796 - DNA, 13 bp, Homo sapiens
aataatgaataat

SEQ ID NO: 4804797 - DNA, 15 bp, Homo sapiens
aataatgagaaatgt

SEQ ID NO: 4804798 - DNA, 16 bp, Homo sapiens
aataatgattcaatgt

SEQ ID NO: 4804799 - DNA, 19 bp, Homo sapiens
aataatgattcaatgtgaa

SEQ ID NO: 4804800 - DNA, 12 bp, Homo sapiens
aataatgattta

SEQ ID NO: 4804801 - DNA, 16 bp, Homo sapiens
aataatgtgggaagaa

SEQ ID NO: 4804802 - DNA, 21 bp, Homo sapiens
aataattaaaacaaaatcctt

SEQ ID NO: 4804803 - DNA, 14 bp, Homo sapiens
aataattatatgaa

SEQ ID NO: 4804804 - DNA, 22 bp, Homo sapiens
aatacagtattatttagtaaaa

SEQ ID NO: 4804805 - DNA, 17 bp, Homo sapiens
aatacattattgaaaag

SEQ ID NO: 4804806 - DNA, 14 bp, Homo sapiens
aatactaataaaat

SEQ ID NO: 4804807 - DNA, 23 bp, Homo sapiens
aatactgactccaaccattcaaa

SEQ ID NO: 4804808 - DNA, 21 bp, Homo sapiens
aatacttgaaaacttctcatt

SEQ ID NO: 4804809 - DNA, 14 bp, Homo sapiens
aatactttgtgtct

SEQ ID NO: 4804810 - DNA, 17 bp, Homo sapiens
aatactttgtgtctttt

SEQ ID NO: 4804811 - DNA, 23 bp, Homo sapiens
aatagataacagagaatcttgat

SEQ ID NO: 4804812 - DNA, 15 bp, Homo sapiens
aatagcctttcttat

SEQ ID NO: 4804813 - DNA, 18 bp, Homo sapiens
aatagcttttcacttctt

SEQ ID NO: 4804814 - DNA, 18 bp, Homo sapiens
aataggaggacagaacca

SEQ ID NO: 4804815 - DNA, 12 bp, Homo sapiens
aataggtctgga

SEQ ID NO: 4804816 - DNA, 11 bp, Homo sapiens
aatagtacatg

SEQ ID NO: 4804817 - DNA, 18 bp, Homo sapiens
aatagtcatgtttctgca

SEQ ID NO: 4804818 - DNA, 13 bp, Homo sapiens
aatagtgaaaatt

SEQ ID NO: 4804819 - DNA, 16 bp, Homo sapiens
aatagtgttcttttta

SEQ ID NO: 4804820 - DNA, 23 bp, Homo sapiens
aatagtttctaaaccatgaaaag

SEQ ID NO: 4804821 - DNA, 16 bp, Homo sapiens
aatataaactgtgaga

SEQ ID NO: 4804822 - DNA, 19 bp, Homo sapiens
aatataaactgtgagataa

SEQ ID NO: 4804823 - DNA, 23 bp, Homo sapiens
aatataaataaataaaaatattc

SEQ ID NO: 4804824 - DNA, 21 bp, Homo sapiens
aatataaatcacagatttcca

SEQ ID NO: 4804825 - DNA, 19 bp, Homo sapiens
aatataaatgaatgaaata

SEQ ID NO: 4804826 - DNA, 23 bp, Homo sapiens
aatataaatgtactacatttgca

SEQ ID NO: 4804827 - DNA, 14 bp, Homo sapiens
aatataacatgaaa

SEQ ID NO: 4804828 - DNA, 16 bp, Homo sapiens
aatataacatgaaagt

SEQ ID NO: 4804829 - DNA, 11 bp, Homo sapiens
aatataagaca

SEQ ID NO: 4804830 - DNA, 18 bp, Homo sapiens
aatataatgggctgcaaa

SEQ ID NO: 4804831 - DNA, 16 bp, Homo sapiens
aatatacaaacatgtg

SEQ ID NO: 4804832 - DNA, 18 bp, Homo sapiens
aatatactcatttggata

SEQ ID NO: 4804833 - DNA, 20 bp, Homo sapiens
aatatactcatttggatata

SEQ ID NO: 4804834 - DNA, 19 bp, Homo sapiens
aatatactccttaaaaatg

SEQ ID NO: 4804835 - DNA, 17 bp, Homo sapiens
aatatagtgttgtgtta

SEQ ID NO: 4804836 - DNA, 21 bp, Homo sapiens
aatatagtgttgtgttacaat

SEQ ID NO: 4804837 - DNA, 23 bp, Homo sapiens
aatatatacatattcaaagtata

SEQ ID NO: 4804838 - DNA, 22 bp, Homo sapiens
aatatatatttatcatatttaa

SEQ ID NO: 4804839 - DNA, 20 bp, Homo sapiens
aatatatgtaatatatacat

SEQ ID NO: 4804840 - DNA, 22 bp, Homo sapiens
aatatatgtaatatatacatat

SEQ ID NO: 4804841 - DNA, 21 bp, Homo sapiens
aatatatgtttggctgaaatt

SEQ ID NO: 4804842 - DNA, 15 bp, Homo sapiens
aatatcagttacagt

SEQ ID NO: 4804843 - DNA, 15 bp, Homo sapiens
aatatcattatagca

SEQ ID NO: 4804844 - DNA, 18 bp, Homo sapiens
aatatcattatagcatgt

SEQ ID NO: 4804845 - DNA, 16 bp, Homo sapiens
aatatctagtgctaaa

SEQ ID NO: 4804846 - DNA, 22 bp, Homo sapiens
aatatctatttatctgtctgag

SEQ ID NO: 4804847 - DNA, 23 bp, Homo sapiens
aatatctctatttaattttgaca

SEQ ID NO: 4804848 - DNA, 14 bp, Homo sapiens
aatatctgtgaaat

SEQ ID NO: 4804849 - DNA, 23 bp, Homo sapiens
aatatgtggagttcatcttgaat

SEQ ID NO: 4804850 - DNA, 11 bp, Homo sapiens
aatattaaaaa

SEQ ID NO: 4804851 - DNA, 23 bp, Homo sapiens
aatattaaaaattaattctttat

SEQ ID NO: 4804852 - DNA, 20 bp, Homo sapiens
aatattaagtgttgtacaat

SEQ ID NO: 4804853 - DNA, 18 bp, Homo sapiens
aatattgagcaatatgtc

SEQ ID NO: 4804854 - DNA, 16 bp, Homo sapiens
aatattgatctgtatt

SEQ ID NO: 4804855 - DNA, 17 bp, Homo sapiens
aatattgcttggactac

SEQ ID NO: 4804856 - DNA, 22 bp, Homo sapiens
aatattgtattgttagatgttt

SEQ ID NO: 4804857 - DNA, 12 bp, Homo sapiens
aatattgtttaa

SEQ ID NO: 4804858 - DNA, 16 bp, Homo sapiens
aatatttacaatgtat

SEQ ID NO: 4804859 - DNA, 19 bp, Homo sapiens
aatatttataaatgaagat

SEQ ID NO: 4804860 - DNA, 12 bp, Homo sapiens
aatatttattgc

SEQ ID NO: 4804861 - DNA, 17 bp, Homo sapiens
aatatttattgctttat

SEQ ID NO: 4804862 - DNA, 16 bp, Homo sapiens
aatatttcttcaaata

SEQ ID NO: 4804863 - DNA, 20 bp, Homo sapiens
aatatttcttcaaatatctc

SEQ ID NO: 4804864 - DNA, 16 bp, Homo sapiens
aatattttctacttta

SEQ ID NO: 4804865 - DNA, 16 bp, Homo sapiens
aatcaactagtatttg

SEQ ID NO: 4804866 - DNA, 17 bp, Homo sapiens
aatcacaaaagtatatt

SEQ ID NO: 4804867 - DNA, 21 bp, Homo sapiens
aatcacaaaagtatattcaaa

SEQ ID NO: 4804868 - DNA, 12 bp, Homo sapiens
aatcacagccaa

SEQ ID NO: 4804869 - DNA, 14 bp, Homo sapiens
aatcacagccaata

SEQ ID NO: 4804870 - DNA, 16 bp, Homo sapiens
aatcactaaatatcta

SEQ ID NO: 4804871 - DNA, 17 bp, Homo sapiens
aatcactcatttatttc

SEQ ID NO: 4804872 - DNA, 13 bp, Homo sapiens
aatcagcactgaa

SEQ ID NO: 4804873 - DNA, 14 bp, Homo sapiens
aatcagcactgaaa

SEQ ID NO: 4804874 - DNA, 15 bp, Homo sapiens
aatcagcactgaaaa

SEQ ID NO: 4804875 - DNA, 14 bp, Homo sapiens
aatcataaatactg

SEQ ID NO: 4804876 - DNA, 13 bp, Homo sapiens
aatcataatcatc

SEQ ID NO: 4804877 - DNA, 14 bp, Homo sapiens
aatcatcaaagtgt

SEQ ID NO: 4804878 - DNA, 15 bp, Homo sapiens
aatcatggatttatt

SEQ ID NO: 4804879 - DNA, 22 bp, Homo sapiens
aatcatgggcattgctggactg

SEQ ID NO: 4804880 - DNA, 12 bp, Homo sapiens
aatcattgctta

SEQ ID NO: 4804881 - DNA, 18 bp, Homo sapiens
aatcattgtacagtttgt

SEQ ID NO: 4804882 - DNA, 20 bp, Homo sapiens
aatcattgtacagtttgttt

SEQ ID NO: 4804883 - DNA, 16 bp, Homo sapiens
aatcattttgggaaat

SEQ ID NO: 4804884 - DNA, 20 bp, Homo sapiens
aatccaaaatagtcatgttt

SEQ ID NO: 4804885 - DNA, 17 bp, Homo sapiens
aatccaacccatgcatg

SEQ ID NO: 4804886 - DNA, 15 bp, Homo sapiens
aatccacagtattgt

SEQ ID NO: 4804887 - DNA, 14 bp, Homo sapiens
aatccacctggtgg

SEQ ID NO: 4804888 - DNA, 19 bp, Homo sapiens
aatccacctggtggccctg

SEQ ID NO: 4804889 - DNA, 17 bp, Homo sapiens
aatccataccccctgcc

SEQ ID NO: 4804890 - DNA, 18 bp, Homo sapiens
aatccataccccctgccc

SEQ ID NO: 4804891 - DNA, 15 bp, Homo sapiens
aatccatatcagctc

SEQ ID NO: 4804892 - DNA, 15 bp, Homo sapiens
aacaaagcatgctca

SEQ ID NO: 4804893 - DNA, 21 bp, Homo sapiens
aacaaagcatgctcagtattg

SEQ ID NO: 4804894 - DNA, 22 bp, Homo sapiens
aacaaagcatttgactttctgt

SEQ ID NO: 4804895 - DNA, 17 bp, Homo sapiens
aacaaatatactcattt

SEQ ID NO: 4804896 - DNA, 14 bp, Homo sapiens
aacaaatcattttg

SEQ ID NO: 4804897 - DNA, 16 bp, Homo sapiens
aacaaatcattttgat

SEQ ID NO: 4804898 - DNA, 18 bp, Homo sapiens
aacaaatcctgcatttag

SEQ ID NO: 4804899 - DNA, 12 bp, Homo sapiens
aacaaattcagt

SEQ ID NO: 4804900 - DNA, 12 bp, Homo sapiens
aacaaattttca

SEQ ID NO: 4804901 - DNA, 13 bp, Homo sapiens
aacaacaaagcat

SEQ ID NO: 4804902 - DNA, 17 bp, Homo sapiens
aacaacaaagcatgctc

SEQ ID NO: 4804903 - DNA, 15 bp, Homo sapiens
aacaacagtcagcca

SEQ ID NO: 4804904 - DNA, 17 bp, Homo sapiens
aacaagaagaatttgaa

SEQ ID NO: 4804905 - DNA, 21 bp, Homo sapiens
aacaagagaccacttccttaa

SEQ ID NO: 4804906 - DNA, 14 bp, Homo sapiens
aacaagcaaactga

SEQ ID NO: 4804907 - DNA, 17 bp, Homo sapiens
aacaagcaaactgaaat

SEQ ID NO: 4804908 - DNA, 18 bp, Homo sapiens
aacaagctgatagtgttt

SEQ ID NO: 4804909 - DNA, 19 bp, Homo sapiens
aacaagctgatagtgtttc

SEQ ID NO: 4804910 - DNA, 18 bp, Homo sapiens
aacaaggaaggacatttc

SEQ ID NO: 4804911 - DNA, 15 bp, Homo sapiens
aacaaggcaaggctg

SEQ ID NO: 4804912 - DNA, 16 bp, Homo sapiens
aacaaggcaaggctgt

SEQ ID NO: 4804913 - DNA, 23 bp, Homo sapiens
aacaaggcaaggctgtcaattac

SEQ ID NO: 4804914 - DNA, 19 bp, Homo sapiens
aacaatttaggaatgctca

SEQ ID NO: 4804915 - DNA, 22 bp, Homo sapiens
aacaatttattttattttagca

SEQ ID NO: 4804916 - DNA, 15 bp, Homo sapiens
aacacaaaccacaac

SEQ ID NO: 4804917 - DNA, 12 bp, Homo sapiens
aacacacagtat

SEQ ID NO: 4804918 - DNA, 13 bp, Homo sapiens
aacacagattatt

SEQ ID NO: 4804919 - DNA, 15 bp, Homo sapiens
aacacagcatgcatt

SEQ ID NO: 4804920 - DNA, 17 bp, Homo sapiens
aacacatagattcacct

SEQ ID NO: 4804921 - DNA, 20 bp, Homo sapiens
aacacattgaaactgtattt

SEQ ID NO: 4804922 - DNA, 14 bp, Homo sapiens
aacaccaagtaaat

SEQ ID NO: 4804923 - DNA, 14 bp, Homo sapiens
aacactaatggcca

SEQ ID NO: 4804924 - DNA, 12 bp, Homo sapiens
aacactcaccat

SEQ ID NO: 4804925 - DNA, 15 bp, Homo sapiens
aacacttctccttaa

SEQ ID NO: 4804926 - DNA, 19 bp, Homo sapiens
aacagaccagcatagttct

SEQ ID NO: 4804927 - DNA, 14 bp, Homo sapiens
aacagacctaagaa

SEQ ID NO: 4804928 - DNA, 15 bp, Homo sapiens
aacagactgccttat

SEQ ID NO: 4804929 - DNA, 21 bp, Homo sapiens
aacagactgccttatattatt

SEQ ID NO: 4804930 - DNA, 13 bp, Homo sapiens
aacagagactgga

SEQ ID NO: 4804931 - DNA, 13 bp, Homo sapiens
aacagagtatata

SEQ ID NO: 4804932 - DNA, 17 bp, Homo sapiens
aacagagtatatatgta

SEQ ID NO: 4804933 - DNA, 18 bp, Homo sapiens
aacagagtatatatgtac

SEQ ID NO: 4804934 - DNA, 11 bp, Homo sapiens
aacagccctgc

SEQ ID NO: 4804935 - DNA, 16 bp, Homo sapiens
aacagctaacaataaa

SEQ ID NO: 4804936 - DNA, 11 bp, Homo sapiens
aacagctgctt

SEQ ID NO: 4804937 - DNA, 15 bp, Homo sapiens
aacagctgtattatc

SEQ ID NO: 4804938 - DNA, 16 bp, Homo sapiens
aacaggaccaggagcc

SEQ ID NO: 4804939 - DNA, 17 bp, Homo sapiens
aacaggaccaggagcca

SEQ ID NO: 4804940 - DNA, 22 bp, Homo sapiens
aacaggctgttctgcactgaaa

SEQ ID NO: 4804941 - DNA, 20 bp, Homo sapiens
aacagggacactacaaacat

SEQ ID NO: 4804942 - DNA, 11 bp, Homo sapiens
aacagtaaata

SEQ ID NO: 4804943 - DNA, 22 bp, Homo sapiens
aacagtaaatatacactttaca

SEQ ID NO: 4804944 - DNA, 18 bp, Homo sapiens
aacagtggcaagctacca

SEQ ID NO: 4804945 - DNA, 17 bp, Homo sapiens
aacagtgtggatgtaaa

SEQ ID NO: 4804946 - DNA, 11 bp, Homo sapiens
aacagtgtttc

SEQ ID NO: 4804947 - DNA, 15 bp, Homo sapiens
aacagtttttatgtt

SEQ ID NO: 4804948 - DNA, 16 bp, Homo sapiens
aacataatatcttgaa

SEQ ID NO: 4804949 - DNA, 22 bp, Homo sapiens
aacataatatcttgaagaatat

SEQ ID NO: 4804950 - DNA, 17 bp, Homo sapiens
aacatatcattcagaat

SEQ ID NO: 4804951 - DNA, 22 bp, Homo sapiens
aacatcaattgggttttgatct

SEQ ID NO: 4804952 - DNA, 14 bp, Homo sapiens
aacatcataaatag

SEQ ID NO: 4804953 - DNA, 13 bp, Homo sapiens
aacatgacactga

SEQ ID NO: 4804954 - DNA, 14 bp, Homo sapiens
aacatgacactgac

SEQ ID NO: 4804955 - DNA, 18 bp, Homo sapiens
aacatgcacattcatcct

SEQ ID NO: 4804956 - DNA, 14 bp, Homo sapiens
aacatgtgaaagat

SEQ ID NO: 4804957 - DNA, 15 bp, Homo sapiens
aacatttatctttgt

SEQ ID NO: 4804958 - DNA, 21 bp, Homo sapiens
aacatttgggacctggataat

SEQ ID NO: 4804959 - DNA, 20 bp, Homo sapiens
aacatttgggagactgagct

SEQ ID NO: 4804960 - DNA, 24 bp, Homo sapiens
aaccaagctataaaagcccatgct

SEQ ID NO: 4804961 - DNA, 14 bp, Homo sapiens
aaccacaactgaca

SEQ ID NO: 4804962 - DNA, 16 bp, Homo sapiens
aaccacaactgacaca

SEQ ID NO: 4804963 - DNA, 13 bp, Homo sapiens
aaccagaaagagg

SEQ ID NO: 4804964 - DNA, 17 bp, Homo sapiens
aaccagcactcccaggg

SEQ ID NO: 4804965 - DNA, 18 bp, Homo sapiens
aaccagcactcccagggc

SEQ ID NO: 4804966 - DNA, 20 bp, Homo sapiens
aaccagcactcccagggccc

SEQ ID NO: 4804967 - DNA, 17 bp, Homo sapiens
aaccaggaggcctggga

SEQ ID NO: 4804968 - DNA, 19 bp, Homo sapiens
aaccaggctacagttgata

SEQ ID NO: 4804969 - DNA, 21 bp, Homo sapiens
aaccagtctgaagtttcattt

SEQ ID NO: 4804970 - DNA, 14 bp, Homo sapiens
aaccatgaaaagtt

SEQ ID NO: 4804971 - DNA, 22 bp, Homo sapiens
aaccatgttcttgagcagctga

SEQ ID NO: 4804972 - DNA, 19 bp, Homo sapiens
aaccattcaaaaatttcac

SEQ ID NO: 4804973 - DNA, 13 bp, Homo sapiens
aaccattgcttca

SEQ ID NO: 4804974 - DNA, 15 bp, Homo sapiens
aaccattgcttcact

SEQ ID NO: 4804975 - DNA, 13 bp, Homo sapiens
aacccaaaagatt

SEQ ID NO: 4804976 - DNA, 17 bp, Homo sapiens
aacccaagtggaatcat

SEQ ID NO: 4804977 - DNA, 16 bp, Homo sapiens
aacccatgagcgtcca

SEQ ID NO: 4804978 - DNA, 21 bp, Homo sapiens
aacccatgcatggcctcccag

SEQ ID NO: 4804979 - DNA, 22 bp, Homo sapiens
aacccatgcatggcctcccagc

SEQ ID NO: 4804980 - DNA, 18 bp, Homo sapiens
aaccccaacgcacaggaa

SEQ ID NO: 4804981 - DNA, 12 bp, Homo sapiens
aacccccacctc

SEQ ID NO: 4804982 - DNA, 14 bp, Homo sapiens
aacccccctcccca

SEQ ID NO: 4804983 - DNA, 19 bp, Homo sapiens
aacccctgacaccttttca

SEQ ID NO: 4804984 - DNA, 21 bp, Homo sapiens
aaccctgacaaattttaatta

SEQ ID NO: 4804985 - DNA, 11 bp, Homo sapiens
aaccctgccct

SEQ ID NO: 4804986 - DNA, 15 bp, Homo sapiens
aaccctgccctgcac

SEQ ID NO: 4804987 - DNA, 17 bp, Homo sapiens
aaccctgccctgcacct

SEQ ID NO: 4804988 - DNA, 15 bp, Homo sapiens
aacccttgactgtta

SEQ ID NO: 4804989 - DNA, 18 bp, Homo sapiens
aaccgggactacagaagt

SEQ ID NO: 4804990 - DNA, 22 bp, Homo sapiens
aaccgtaaaggtttatttttct

SEQ ID NO: 4804991 - DNA, 15 bp, Homo sapiens
aaccgtcaatgtgaa

SEQ ID NO: 4804992 - DNA, 16 bp, Homo sapiens
aaccgtcaatgtgaaa

SEQ ID NO: 4804993 - DNA, 23 bp, Homo sapiens
aaccgtgagcaggaaggcctggg

SEQ ID NO: 4804994 - DNA, 22 bp, Homo sapiens
aacctaaataaacacatagatt

SEQ ID NO: 4804995 - DNA, 22 bp, Homo sapiens
aacctaaggcaacatttccgaa

SEQ ID NO: 4804996 - DNA, 19 bp, Homo sapiens
aacctaccttatagagcac

SEQ ID NO: 4804997 - DNA, 17 bp, Homo sapiens
aacctatctgtattggc

SEQ ID NO: 4804998 - DNA, 18 bp, Homo sapiens
aacctatctgtattggca

SEQ ID NO: 4804999 - DNA, 20 bp, Homo sapiens
aacctatctgtattggcagc

SEQ ID NO: 4805000 - DNA, 21 bp, Homo sapiens
aacctatctgtattggcagca

SEQ ID NO: 4805001 - DNA, 22 bp, Homo sapiens
aacctatctgtattggcagcac

SEQ ID NO: 4805002 - DNA, 16 bp, Homo sapiens
aacctcagttggcctc

SEQ ID NO: 4805003 - DNA, 17 bp, Homo sapiens
aacctcagttggcctct

SEQ ID NO: 4805004 - DNA, 18 bp, Homo sapiens
aacctcagttggcctctg

SEQ ID NO: 4805005 - DNA, 22 bp, Homo sapiens
aacctcagttggcctctgcccc

SEQ ID NO: 4805006 - DNA, 15 bp, Homo sapiens
aacctctacaggcat

SEQ ID NO: 4805007 - DNA, 14 bp, Homo sapiens
aacctctatatgtt

SEQ ID NO: 4805008 - DNA, 19 bp, Homo sapiens
aacctctcagatccctcgg

SEQ ID NO: 4805009 - DNA, 23 bp, Homo sapiens
aacctctcagcactaattagtgt

SEQ ID NO: 4805010 - DNA, 22 bp, Homo sapiens
aacctctctgaactgcaacact

SEQ ID NO: 4805011 - DNA, 17 bp, Homo sapiens
aaatagtgttcttttta

SEQ ID NO: 4805012 - DNA, 17 bp, Homo sapiens
aaatagttacaagcatt

SEQ ID NO: 4805013 - DNA, 18 bp, Homo sapiens
aaatagttccattctatg

SEQ ID NO: 4805014 - DNA, 13 bp, Homo sapiens
aaatagttgtagg

SEQ ID NO: 4805015 - DNA, 14 bp, Homo sapiens
aaatataaactgtg

SEQ ID NO: 4805016 - DNA, 18 bp, Homo sapiens
aaatataaactgtgagat

SEQ ID NO: 4805017 - DNA, 12 bp, Homo sapiens
aaatataaatca

SEQ ID NO: 4805018 - DNA, 13 bp, Homo sapiens
aaatataacatga

SEQ ID NO: 4805019 - DNA, 14 bp, Homo sapiens
aaatataacatgaa

SEQ ID NO: 4805020 - DNA, 16 bp, Homo sapiens
aaatatacaaacatgt

SEQ ID NO: 4805021 - DNA, 14 bp, Homo sapiens
aaatatacaacttt

SEQ ID NO: 4805022 - DNA, 17 bp, Homo sapiens
aaatatacactttacat

SEQ ID NO: 4805023 - DNA, 15 bp, Homo sapiens
aaatatagtgttgtg

SEQ ID NO: 4805024 - DNA, 15 bp, Homo sapiens
aaatatatgtaatat

SEQ ID NO: 4805025 - DNA, 16 bp, Homo sapiens
aaatatatgtatgtaa

SEQ ID NO: 4805026 - DNA, 19 bp, Homo sapiens
aaatatatgtatgtaaaaa

SEQ ID NO: 4805027 - DNA, 17 bp, Homo sapiens
aaatatatgtttggctg

SEQ ID NO: 4805028 - DNA, 17 bp, Homo sapiens
aaatatcattatagcat

SEQ ID NO: 4805029 - DNA, 22 bp, Homo sapiens
aaatatcattatagcatgtaat

SEQ ID NO: 4805030 - DNA, 12 bp, Homo sapiens
aaatatgtgtac

SEQ ID NO: 4805031 - DNA, 15 bp, Homo sapiens
aaatattctgtcatt

SEQ ID NO: 4805032 - DNA, 17 bp, Homo sapiens
aaatattgatctgtatt

SEQ ID NO: 4805033 - DNA, 13 bp, Homo sapiens
aaatattgctgtc

SEQ ID NO: 4805034 - DNA, 20 bp, Homo sapiens
aaatattttcttaattatgg

SEQ ID NO: 4805035 - DNA, 15 bp, Homo sapiens
aaatcaaatttttct

SEQ ID NO: 4805036 - DNA, 17 bp, Homo sapiens
aaatcaaatttttctgg

SEQ ID NO: 4805037 - DNA, 18 bp, Homo sapiens
aaatcacaaactcatcca

SEQ ID NO: 4805038 - DNA, 16 bp, Homo sapiens
aaatcacagatttcca

SEQ ID NO: 4805039 - DNA, 18 bp, Homo sapiens
aaatcacagatttccaaa

SEQ ID NO: 4805040 - DNA, 15 bp, Homo sapiens
aaatcagtaatctgt

SEQ ID NO: 4805041 - DNA, 16 bp, Homo sapiens
aaatcatgggcattgc

SEQ ID NO: 4805042 - DNA, 16 bp, Homo sapiens
aaatcattttgatgta

SEQ ID NO: 4805043 - DNA, 21 bp, Homo sapiens
aaatccaatagtctgccacaa

SEQ ID NO: 4805044 - DNA, 16 bp, Homo sapiens
aaatccacccagccca

SEQ ID NO: 4805045 - DNA, 19 bp, Homo sapiens
aaatccataccccctgccc

SEQ ID NO: 4805046 - DNA, 22 bp, Homo sapiens
aaatccataccccctgccccag

SEQ ID NO: 4805047 - DNA, 21 bp, Homo sapiens
aaatcccctaactgatttcca

SEQ ID NO: 4805048 - DNA, 19 bp, Homo sapiens
aaatccctcttcctccaaa

SEQ ID NO: 4805049 - DNA, 15 bp, Homo sapiens
aaatctacaaacttt

SEQ ID NO: 4805050 - DNA, 18 bp, Homo sapiens
aaatctacaaacttttat

SEQ ID NO: 4805051 - DNA, 20 bp, Homo sapiens
aaatctaggcgaaagtaatg

SEQ ID NO: 4805052 - DNA, 21 bp, Homo sapiens
aaatctcaaaagatctcctgt

SEQ ID NO: 4805053 - DNA, 14 bp, Homo sapiens
aaatctcactgtat

SEQ ID NO: 4805054 - DNA, 17 bp, Homo sapiens
aaatctcactgtattaa

SEQ ID NO: 4805055 - DNA, 16 bp, Homo sapiens
aaatctgaatttctaa

SEQ ID NO: 4805056 - DNA, 12 bp, Homo sapiens
aaatgaaatact

SEQ ID NO: 4805057 - DNA, 15 bp, Homo sapiens
aaatgaaatttaagc

SEQ ID NO: 4805058 - DNA, 21 bp, Homo sapiens
aaatgaagacaccagagtgta

SEQ ID NO: 4805059 - DNA, 14 bp, Homo sapiens
aaatgaatagtaca

SEQ ID NO: 4805060 - DNA, 23 bp, Homo sapiens
aaatgaatgaaatataaactgtg

SEQ ID NO: 4805061 - DNA, 15 bp, Homo sapiens
aaatgacttattgat

SEQ ID NO: 4805062 - DNA, 12 bp, Homo sapiens
aaatgagaaatt

SEQ ID NO: 4805063 - DNA, 14 bp, Homo sapiens
aaatgagaaattgt

SEQ ID NO: 4805064 - DNA, 22 bp, Homo sapiens
aaatgagatcccagagttattt

SEQ ID NO: 4805065 - DNA, 12 bp, Homo sapiens
aaatgataaggt

SEQ ID NO: 4805066 - DNA, 15 bp, Homo sapiens
aaatgcaaacactgt

SEQ ID NO: 4805067 - DNA, 17 bp, Homo sapiens
aaatgcaaagcacacct

SEQ ID NO: 4805068 - DNA, 22 bp, Homo sapiens
aaatgcagtgtatttaatgttt

SEQ ID NO: 4805069 - DNA, 17 bp, Homo sapiens
aaatgccaagactctat

SEQ ID NO: 4805070 - DNA, 18 bp, Homo sapiens
aaatgctttctcatgcat

SEQ ID NO: 4805071 - DNA, 21 bp, Homo sapiens
aaatgctttctcatgcataga

SEQ ID NO: 4805072 - DNA, 20 bp, Homo sapiens
aaatggaaaggtcctgctgt

SEQ ID NO: 4805073 - DNA, 17 bp, Homo sapiens
aaatggacgtgttatga

SEQ ID NO: 4805074 - DNA, 20 bp, Homo sapiens
aaatggacgtgttatgactc

SEQ ID NO: 4805075 - DNA, 18 bp, Homo sapiens
aaatggaggaaaccacaa

SEQ ID NO: 4805076 - DNA, 23 bp, Homo sapiens
aaatggatgacaaagaaaatgag

SEQ ID NO: 4805077 - DNA, 13 bp, Homo sapiens
aaatggatgtaat

SEQ ID NO: 4805078 - DNA, 15 bp, Homo sapiens
aaatggcatttagca

SEQ ID NO: 4805079 - DNA, 17 bp, Homo sapiens
aaatggcatttagcaca

SEQ ID NO: 4805080 - DNA, 16 bp, Homo sapiens
aaatggctgaagaaac

SEQ ID NO: 4805081 - DNA, 20 bp, Homo sapiens
aaatggctgaagaaacacag

SEQ ID NO: 4805082 - DNA, 12 bp, Homo sapiens
aaatggtatttt

SEQ ID NO: 4805083 - DNA, 20 bp, Homo sapiens
aaatggtattttttgtgaat

SEQ ID NO: 4805084 - DNA, 12 bp, Homo sapiens
aaatgtaaaata

SEQ ID NO: 4805085 - DNA, 18 bp, Homo sapiens
aaatgtaaaatatttata

SEQ ID NO: 4805086 - DNA, 19 bp, Homo sapiens
aaatgtagcttcagtcatt

SEQ ID NO: 4805087 - DNA, 21 bp, Homo sapiens
aaatgtatatgttatttttgg

SEQ ID NO: 4805088 - DNA, 15 bp, Homo sapiens
aaatgtcttcatgtt

SEQ ID NO: 4805089 - DNA, 16 bp, Homo sapiens
aaatgtgctgcaaaga

SEQ ID NO: 4805090 - DNA, 12 bp, Homo sapiens
aaatgtgtaaat

SEQ ID NO: 4805091 - DNA, 18 bp, Homo sapiens
aaatgtgtgcttggaaaa

SEQ ID NO: 4805092 - DNA, 12 bp, Homo sapiens
aaatgttcattc

SEQ ID NO: 4805093 - DNA, 20 bp, Homo sapiens
aaatgtttatattgttttta

SEQ ID NO: 4805094 - DNA, 21 bp, Homo sapiens
aaatgttttacaatggctggg

SEQ ID NO: 4805095 - DNA, 13 bp, Homo sapiens
aaatgttttggaa

SEQ ID NO: 4805096 - DNA, 12 bp, Homo sapiens
aaattaaatata

SEQ ID NO: 4805097 - DNA, 12 bp, Homo sapiens
aaattagtattt

SEQ ID NO: 4805098 - DNA, 15 bp, Homo sapiens
aaattatcattgttt

SEQ ID NO: 4805099 - DNA, 16 bp, Homo sapiens
aaattatctgttctat

SEQ ID NO: 4805100 - DNA, 20 bp, Homo sapiens
aaattatctgttctatggac

SEQ ID NO: 4805101 - DNA, 13 bp, Homo sapiens
aaattatctttaa

SEQ ID NO: 4805102 - DNA, 14 bp, Homo sapiens
aaattatctttaaa

SEQ ID NO: 4805103 - DNA, 17 bp, Homo sapiens
aaattatgacgtgcaca

SEQ ID NO: 4805104 - DNA, 13 bp, Homo sapiens
aaattattaaaaa

SEQ ID NO: 4805105 - DNA, 14 bp, Homo sapiens
aaattatttctaaa

SEQ ID NO: 4805106 - DNA, 13 bp, Homo sapiens
aaattccaataca

SEQ ID NO: 4805107 - DNA, 11 bp, Homo sapiens
aaattcctaat

SEQ ID NO: 4805108 - DNA, 12 bp, Homo sapiens
aaattcctgttg

SEQ ID NO: 4805109 - DNA, 15 bp, Homo sapiens
aaattctataagaga

SEQ ID NO: 4805110 - DNA, 14 bp, Homo sapiens
aaattctgattatt

SEQ ID NO: 4805111 - DNA, 17 bp, Homo sapiens
aaattgaagagagatat

SEQ ID NO: 4805112 - DNA, 14 bp, Homo sapiens
aaattgactgtact

SEQ ID NO: 4805113 - DNA, 22 bp, Homo sapiens
aaattgcatttttacctttcat

SEQ ID NO: 4805114 - DNA, 18 bp, Homo sapiens
aaattgctgagatgttta

SEQ ID NO: 4805115 - DNA, 20 bp, Homo sapiens
aaattgctgagatgtttagt

SEQ ID NO: 4805116 - DNA, 19 bp, Homo sapiens
aaattggttaatgaaaaat

SEQ ID NO: 4805117 - DNA, 21 bp, Homo sapiens
aaattgtcttttgtcatgtgg

SEQ ID NO: 4805118 - DNA, 11 bp, Homo sapiens
aaattgtggat

SEQ ID NO: 4805119 - DNA, 14 bp, Homo sapiens
aaattgtggatgaa

SEQ ID NO: 4805120 - DNA, 21 bp, Homo sapiens
aaattgtttggcttcctcctg

SEQ ID NO: 4805121 - DNA, 21 bp, Homo sapiens
aaatttaagagattttatgtt

SEQ ID NO: 4805122 - DNA, 15 bp, Homo sapiens
aaatttatgtcattt

SEQ ID NO: 4805123 - DNA, 12 bp, Homo sapiens
aaatttattaaa

SEQ ID NO: 4805124 - DNA, 15 bp, Homo sapiens
aaatttgacattgtc

SEQ ID NO: 4805125 - DNA, 21 bp, Homo sapiens
aaatttgacattgtcagaatg

SEQ ID NO: 4805126 - DNA, 19 bp, Homo sapiens
aaattttctagaatactaa

SEQ ID NO: 4805127 - DNA, 16 bp, Homo sapiens
aaaccttttcttgtat

SEQ ID NO: 4805128 - DNA, 17 bp, Homo sapiens
aaacgtctaacttcatg

SEQ ID NO: 4805129 - DNA, 13 bp, Homo sapiens
aaactaattaaac

SEQ ID NO: 4805130 - DNA, 20 bp, Homo sapiens
aaactaccaccctcgctgcc

SEQ ID NO: 4805131 - DNA, 23 bp, Homo sapiens
aaactaccaccctcgctgccacc

SEQ ID NO: 4805132 - DNA, 15 bp, Homo sapiens
aaactcatacagtct

SEQ ID NO: 4805133 - DNA, 20 bp, Homo sapiens
aaactcctgttttcacacct

SEQ ID NO: 4805134 - DNA, 12 bp, Homo sapiens
aaactgaaatta

SEQ ID NO: 4805135 - DNA, 13 bp, Homo sapiens
aaactgagaccaa

SEQ ID NO: 4805136 - DNA, 19 bp, Homo sapiens
aaactgagaccaagtctct

SEQ ID NO: 4805137 - DNA, 13 bp, Homo sapiens
aaactgatgcttt

SEQ ID NO: 4805138 - DNA, 12 bp, Homo sapiens
aaactgcatttg

SEQ ID NO: 4805139 - DNA, 14 bp, Homo sapiens
aaactgcatttgtg

SEQ ID NO: 4805140 - DNA, 14 bp, Homo sapiens
aaactgccacaagc

SEQ ID NO: 4805141 - DNA, 17 bp, Homo sapiens
aaactgccacaagcaca

SEQ ID NO: 4805142 - DNA, 18 bp, Homo sapiens
aaactgccacaagcacaa

SEQ ID NO: 4805143 - DNA, 19 bp, Homo sapiens
aaactgccacaagcacaat

SEQ ID NO: 4805144 - DNA, 18 bp, Homo sapiens
aaactgcgtaggagagaa

SEQ ID NO: 4805145 - DNA, 18 bp, Homo sapiens
aaactggaaacatctgat

SEQ ID NO: 4805146 - DNA, 22 bp, Homo sapiens
aaactggaaacatctgatttct

SEQ ID NO: 4805147 - DNA, 14 bp, Homo sapiens
aaactggaataaga

SEQ ID NO: 4805148 - DNA, 15 bp, Homo sapiens
aaactgggaaatgag

SEQ ID NO: 4805149 - DNA, 12 bp, Homo sapiens
aaactgtagtaa

SEQ ID NO: 4805150 - DNA, 20 bp, Homo sapiens
aaactgtatttacttgttat

SEQ ID NO: 4805151 - DNA, 14 bp, Homo sapiens
aaactgtgagataa

SEQ ID NO: 4805152 - DNA, 17 bp, Homo sapiens
aaactgtgagataaata

SEQ ID NO: 4805153 - DNA, 19 bp, Homo sapiens
aaactgtgagataaatatc

SEQ ID NO: 4805154 - DNA, 22 bp, Homo sapiens
aaactgttaacttattcaaaga

SEQ ID NO: 4805155 - DNA, 16 bp, Homo sapiens
aaactgtttatggtat

SEQ ID NO: 4805156 - DNA, 11 bp, Homo sapiens
aaacttcagca

SEQ ID NO: 4805157 - DNA, 16 bp, Homo sapiens
aaacttctactgagca

SEQ ID NO: 4805158 - DNA, 13 bp, Homo sapiens
aaacttctcattt

SEQ ID NO: 4805159 - DNA, 20 bp, Homo sapiens
aaacttgtacttacactgaa

SEQ ID NO: 4805160 - DNA, 19 bp, Homo sapiens
aaactttattttatataat

SEQ ID NO: 4805161 - DNA, 16 bp, Homo sapiens
aaagaaagaaaaaagt

SEQ ID NO: 4805162 - DNA, 16 bp, Homo sapiens
aaagaacccccctccc

SEQ ID NO: 4805163 - DNA, 18 bp, Homo sapiens
aaagaacccccctcccca

SEQ ID NO: 4805164 - DNA, 14 bp, Homo sapiens
aaagaattagccaa

SEQ ID NO: 4805165 - DNA, 13 bp, Homo sapiens
aaagacagtttct

SEQ ID NO: 4805166 - DNA, 17 bp, Homo sapiens
aaagacagtttcttgca

SEQ ID NO: 4805167 - DNA, 13 bp, Homo sapiens
aaagacatccaca

SEQ ID NO: 4805168 - DNA, 15 bp, Homo sapiens
aaagaccatgcattc

SEQ ID NO: 4805169 - DNA, 15 bp, Homo sapiens
aaagagaaaatgctt

SEQ ID NO: 4805170 - DNA, 15 bp, Homo sapiens
aaagagctgttttgg

SEQ ID NO: 4805171 - DNA, 16 bp, Homo sapiens
aaagagctgttttgga

SEQ ID NO: 4805172 - DNA, 19 bp, Homo sapiens
aaagaggcgtcttgtattt

SEQ ID NO: 4805173 - DNA, 20 bp, Homo sapiens
aaagaggcgtcttgtatttt

SEQ ID NO: 4805174 - DNA, 18 bp, Homo sapiens
aaagaggctatgtgagca

SEQ ID NO: 4805175 - DNA, 17 bp, Homo sapiens
aaagagtaaatatactt

SEQ ID NO: 4805176 - DNA, 22 bp, Homo sapiens
aaagagtagaactttaaaagaa

SEQ ID NO: 4805177 - DNA, 22 bp, Homo sapiens
aaagagttctccttgtacttga

SEQ ID NO: 4805178 - DNA, 16 bp, Homo sapiens
aaagatattgtattat

SEQ ID NO: 4805179 - DNA, 19 bp, Homo sapiens
aaagatattgtattatcat

SEQ ID NO: 4805180 - DNA, 21 bp, Homo sapiens
aaagatattgtattatcatat

SEQ ID NO: 4805181 - DNA, 23 bp, Homo sapiens
aaagatattgtattatcatatat

SEQ ID NO: 4805182 - DNA, 20 bp, Homo sapiens
aaagatccatttaaaacaag

SEQ ID NO: 4805183 - DNA, 18 bp, Homo sapiens
aaagatctttttttaagt

SEQ ID NO: 4805184 - DNA, 20 bp, Homo sapiens
aaagatggatttgacacact

SEQ ID NO: 4805185 - DNA, 13 bp, Homo sapiens
aaagattgttggc

SEQ ID NO: 4805186 - DNA, 19 bp, Homo sapiens
aaagcagcacacattgtgt

SEQ ID NO: 4805187 - DNA, 13 bp, Homo sapiens
aaagcagtatgta

SEQ ID NO: 4805188 - DNA, 22 bp, Homo sapiens
aaagcagtcagcggagaggacc

SEQ ID NO: 4805189 - DNA, 14 bp, Homo sapiens
aaagcatatataaa

SEQ ID NO: 4805190 - DNA, 18 bp, Homo sapiens
aaagcatatataaaacaa

SEQ ID NO: 4805191 - DNA, 17 bp, Homo sapiens
aaagcatgccaatttct

SEQ ID NO: 4805192 - DNA, 12 bp, Homo sapiens
aaagcatggact

SEQ ID NO: 4805193 - DNA, 20 bp, Homo sapiens
aaagcatttgagctgtggtt

SEQ ID NO: 4805194 - DNA, 18 bp, Homo sapiens
aaagccctccctgtctgt

SEQ ID NO: 4805195 - DNA, 15 bp, Homo sapiens
aaagctatttaagtg

SEQ ID NO: 4805196 - DNA, 12 bp, Homo sapiens
aaagctgccagc

SEQ ID NO: 4805197 - DNA, 17 bp, Homo sapiens
aaaggaaagttctatta

SEQ ID NO: 4805198 - DNA, 17 bp, Homo sapiens
aaaggagattggaagga

SEQ ID NO: 4805199 - DNA, 19 bp, Homo sapiens
aaaggcaaaccaatttgtt

SEQ ID NO: 4805200 - DNA, 17 bp, Homo sapiens
aaaggcatctaagacat

SEQ ID NO: 4805201 - DNA, 13 bp, Homo sapiens
aaaggccccttcc

SEQ ID NO: 4805202 - DNA, 14 bp, Homo sapiens
aaaggcttctccac

SEQ ID NO: 4805203 - DNA, 16 bp, Homo sapiens
aaaggtgatgaattta

SEQ ID NO: 4805204 - DNA, 14 bp, Homo sapiens
aaaggttcttcatc

SEQ ID NO: 4805205 - DNA, 16 bp, Homo sapiens
aaaggtttatttttct

SEQ ID NO: 4805206 - DNA, 19 bp, Homo sapiens
aaaggtttcactgttcatg

SEQ ID NO: 4805207 - DNA, 23 bp, Homo sapiens
aaagtatattcaaaaattatatt

SEQ ID NO: 4805208 - DNA, 16 bp, Homo sapiens
aaagtcagaacaaatt

SEQ ID NO: 4805209 - DNA, 17 bp, Homo sapiens
aaagtcaggccattcag

SEQ ID NO: 4805210 - DNA, 17 bp, Homo sapiens
aaagtccgaaaagcaaa

SEQ ID NO: 4805211 - DNA, 17 bp, Homo sapiens
aaagtctcctgtatcat

SEQ ID NO: 4805212 - DNA, 22 bp, Homo sapiens
aaagtgatgtgatttatgcatt

SEQ ID NO: 4805213 - DNA, 15 bp, Homo sapiens
aaagtgtatttgtta

SEQ ID NO: 4805214 - DNA, 19 bp, Homo sapiens
aaagtgttattttgtataa

SEQ ID NO: 4805215 - DNA, 22 bp, Homo sapiens
aaagtgttgtcttattcctaat

SEQ ID NO: 4805216 - DNA, 14 bp, Homo sapiens
aaagtgtttttaca

SEQ ID NO: 4805217 - DNA, 20 bp, Homo sapiens
aaagttctattatctgggtt

SEQ ID NO: 4805218 - DNA, 21 bp, Homo sapiens
aaagttgtgatctgttgtaat

SEQ ID NO: 4805219 - DNA, 15 bp, Homo sapiens
aaagttttcaagcat

SEQ ID NO: 4805220 - DNA, 14 bp, Homo sapiens
aaataaaaatattc

SEQ ID NO: 4805221 - DNA, 22 bp, Homo sapiens
aaataaaaccagaaagaggaat

SEQ ID NO: 4805222 - DNA, 16 bp, Homo sapiens
aaataaataatctcat

SEQ ID NO: 4805223 - DNA, 12 bp, Homo sapiens
aaataaatctaa

SEQ ID NO: 4805224 - DNA, 11 bp, Homo sapiens
aaataaatgct

SEQ ID NO: 4805225 - DNA, 16 bp, Homo sapiens
aaataaatgctgcttt

SEQ ID NO: 4805226 - DNA, 11 bp, Homo sapiens
aaataaatgtg

SEQ ID NO: 4805227 - DNA, 15 bp, Homo sapiens
aaataaatgtgtaaa

SEQ ID NO: 4805228 - DNA, 18 bp, Homo sapiens
aaataaccctgaatcaga

SEQ ID NO: 4805229 - DNA, 12 bp, Homo sapiens
aaataagtaaat

SEQ ID NO: 4805230 - DNA, 17 bp, Homo sapiens
aaataataaaggttcta

SEQ ID NO: 4805231 - DNA, 18 bp, Homo sapiens
aaataataaaggttctat

SEQ ID NO: 4805232 - DNA, 13 bp, Homo sapiens
aaataatataaat

SEQ ID NO: 4805233 - DNA, 20 bp, Homo sapiens
aaataatgattcaatgtgaa

SEQ ID NO: 4805234 - DNA, 13 bp, Homo sapiens
aaataattaaaac

SEQ ID NO: 4805235 - DNA, 15 bp, Homo sapiens
aaatacagtattatt

SEQ ID NO: 4805236 - DNA, 14 bp, Homo sapiens
aaatacatgatgat

SEQ ID NO: 4805237 - DNA, 20 bp, Homo sapiens
aaatacatgatgatttcaga

SEQ ID NO: 4805238 - DNA, 21 bp, Homo sapiens
aaatacatgcctttccagtgc

SEQ ID NO: 4805239 - DNA, 12 bp, Homo sapiens
aaatacattatt

SEQ ID NO: 4805240 - DNA, 12 bp, Homo sapiens
acatgacactga

SEQ ID NO: 4805241 - DNA, 16 bp, Homo sapiens
acatgacactgacctt

SEQ ID NO: 4805242 - DNA, 23 bp, Homo sapiens
acatgacagtggttatatttcaa

SEQ ID NO: 4805243 - DNA, 16 bp, Homo sapiens
acatgacatccacatg

SEQ ID NO: 4805244 - DNA, 18 bp, Homo sapiens
acatgacatccacatgca

SEQ ID NO: 4805245 - DNA, 21 bp, Homo sapiens
acatgactctttattgtctgt

SEQ ID NO: 4805246 - DNA, 16 bp, Homo sapiens
acatgatgatttcaga

SEQ ID NO: 4805247 - DNA, 14 bp, Homo sapiens
acatgcacatgtat

SEQ ID NO: 4805248 - DNA, 23 bp, Homo sapiens
acatgcacattcatcctcacatg

SEQ ID NO: 4805249 - DNA, 12 bp, Homo sapiens
acatgcactgac

SEQ ID NO: 4805250 - DNA, 14 bp, Homo sapiens
acatgcactgaccc

SEQ ID NO: 4805251 - DNA, 15 bp, Homo sapiens
acatgcctctctcag

SEQ ID NO: 4805252 - DNA, 18 bp, Homo sapiens
acatgcctctctcaggcc

SEQ ID NO: 4805253 - DNA, 17 bp, Homo sapiens
acatgcctttccagtgc

SEQ ID NO: 4805254 - DNA, 19 bp, Homo sapiens
acatgctcatcccaaaagc

SEQ ID NO: 4805255 - DNA, 19 bp, Homo sapiens
acatgctggccagcctggg

SEQ ID NO: 4805256 - DNA, 13 bp, Homo sapiens
acatgctgtctta

SEQ ID NO: 4805257 - DNA, 14 bp, Homo sapiens
acatggaagtacta

SEQ ID NO: 4805258 - DNA, 17 bp, Homo sapiens
acatggccaatagtcat

SEQ ID NO: 4805259 - DNA, 21 bp, Homo sapiens
acatggccaatagtcatatgt

SEQ ID NO: 4805260 - DNA, 18 bp, Homo sapiens
acatggggcccctctcat

SEQ ID NO: 4805261 - DNA, 23 bp, Homo sapiens
acatggggcccctctcatcactg

SEQ ID NO: 4805262 - DNA, 15 bp, Homo sapiens
acatgggttcaattg

SEQ ID NO: 4805263 - DNA, 16 bp, Homo sapiens
acatgtgaaagatagg

SEQ ID NO: 4805264 - DNA, 14 bp, Homo sapiens
acatgtgctcgctc

SEQ ID NO: 4805265 - DNA, 19 bp, Homo sapiens
acatgtggaaaactcacag

SEQ ID NO: 4805266 - DNA, 20 bp, Homo sapiens
acatgtggaaaactcacaga

SEQ ID NO: 4805267 - DNA, 12 bp, Homo sapiens
acattaaataat

SEQ ID NO: 4805268 - DNA, 16 bp, Homo sapiens
acattaattgaggctt

SEQ ID NO: 4805269 - DNA, 13 bp, Homo sapiens
acattagacacac

SEQ ID NO: 4805270 - DNA, 15 bp, Homo sapiens
acattatagattttc

SEQ ID NO: 4805271 - DNA, 12 bp, Homo sapiens
acattattactt

SEQ ID NO: 4805272 - DNA, 19 bp, Homo sapiens
acattattggacttccatt

SEQ ID NO: 4805273 - DNA, 13 bp, Homo sapiens
acattatttctgt

SEQ ID NO: 4805274 - DNA, 13 bp, Homo sapiens
acattcaccaaca

SEQ ID NO: 4805275 - DNA, 14 bp, Homo sapiens
acattcaccaacaa

SEQ ID NO: 4805276 - DNA, 16 bp, Homo sapiens
acattcaccaacaaca

SEQ ID NO: 4805277 - DNA, 17 bp, Homo sapiens
acattcaccaacaacag

SEQ ID NO: 4805278 - DNA, 20 bp, Homo sapiens
acattccagtgtattttctg

SEQ ID NO: 4805279 - DNA, 14 bp, Homo sapiens
acattctatctact

SEQ ID NO: 4805280 - DNA, 18 bp, Homo sapiens
acattctatctactgatt

SEQ ID NO: 4805281 - DNA, 14 bp, Homo sapiens
acattcttgctctg

SEQ ID NO: 4805282 - DNA, 18 bp, Homo sapiens
acattcttggtcacaaag

SEQ ID NO: 4805283 - DNA, 23 bp, Homo sapiens
acattgcaggaagagatgctcta

SEQ ID NO: 4805284 - DNA, 16 bp, Homo sapiens
acattgtagcctaata

SEQ ID NO: 4805285 - DNA, 17 bp, Homo sapiens
acattgtcagaatgttg

SEQ ID NO: 4805286 - DNA, 19 bp, Homo sapiens
acattgtgccctgtagctc

SEQ ID NO: 4805287 - DNA, 21 bp, Homo sapiens
acattgtgccctgtagctcct

SEQ ID NO: 4805288 - DNA, 14 bp, Homo sapiens
acatttatgtgtga

SEQ ID NO: 4805289 - DNA, 13 bp, Homo sapiens
acatttccctgct

SEQ ID NO: 4805290 - DNA, 12 bp, Homo sapiens
acatttccttta

SEQ ID NO: 4805291 - DNA, 24 bp, Homo sapiens
acatttctggccatttaactagca

SEQ ID NO: 4805292 - DNA, 23 bp, Homo sapiens
acatttgaacagggcaaaatgaa

SEQ ID NO: 4805293 - DNA, 21 bp, Homo sapiens
acatttgatttgatatacaga

SEQ ID NO: 4805294 - DNA, 12 bp, Homo sapiens
acatttgcatgc

SEQ ID NO: 4805295 - DNA, 19 bp, Homo sapiens
acatttgctttttgcttgt

SEQ ID NO: 4805296 - DNA, 17 bp, Homo sapiens
acatttgttaatgattc

SEQ ID NO: 4805297 - DNA, 12 bp, Homo sapiens
acatttgttctg

SEQ ID NO: 4805298 - DNA, 17 bp, Homo sapiens
acatttgttctgggtta

SEQ ID NO: 4805299 - DNA, 19 bp, Homo sapiens
acattttttgtttcttggt

SEQ ID NO: 4805300 - DNA, 13 bp, Homo sapiens
accaaagaagagt

SEQ ID NO: 4805301 - DNA, 16 bp, Homo sapiens
accaaagaagagttta

SEQ ID NO: 4805302 - DNA, 17 bp, Homo sapiens
accaaatataaacttgt

SEQ ID NO: 4805303 - DNA, 15 bp, Homo sapiens
accaaatgtaaaata

SEQ ID NO: 4805304 - DNA, 13 bp, Homo sapiens
accaaattgctga

SEQ ID NO: 4805305 - DNA, 15 bp, Homo sapiens
accaaattgctgaga

SEQ ID NO: 4805306 - DNA, 22 bp, Homo sapiens
accaacaggctgttctgcactg

SEQ ID NO: 4805307 - DNA, 23 bp, Homo sapiens
accaacaggctgttctgcactga

SEQ ID NO: 4805308 - DNA, 22 bp, Homo sapiens
accaacgggtctgtgggactgg

SEQ ID NO: 4805309 - DNA, 22 bp, Homo sapiens
accaactaagttgtattttaat

SEQ ID NO: 4805310 - DNA, 21 bp, Homo sapiens
accaagaattctccaaaacaa

SEQ ID NO: 4805311 - DNA, 22 bp, Homo sapiens
accaagaattctccaaaacaat

SEQ ID NO: 4805312 - DNA, 19 bp, Homo sapiens
accaagctataaaagccca

SEQ ID NO: 4805313 - DNA, 19 bp, Homo sapiens
accaagtaaatctatctct

SEQ ID NO: 4805314 - DNA, 18 bp, Homo sapiens
accacaaccctgttgcta

SEQ ID NO: 4805315 - DNA, 15 bp, Homo sapiens
accacaactgacaca

SEQ ID NO: 4805316 - DNA, 16 bp, Homo sapiens
accacaactgacacag

SEQ ID NO: 4805317 - DNA, 22 bp, Homo sapiens
accacacctaaattaacaaatt

SEQ ID NO: 4805318 - DNA, 18 bp, Homo sapiens
accacagctgcctccggg

SEQ ID NO: 4805319 - DNA, 20 bp, Homo sapiens
accacagctgcctccgggcc

SEQ ID NO: 4805320 - DNA, 13 bp, Homo sapiens
accacatttctgg

SEQ ID NO: 4805321 - DNA, 15 bp, Homo sapiens
accaccactgtgtcc

SEQ ID NO: 4805322 - DNA, 14 bp, Homo sapiens
accacccctgtgcg

SEQ ID NO: 4805323 - DNA, 18 bp, Homo sapiens
accaccctcgctgccacc

SEQ ID NO: 4805324 - DNA, 14 bp, Homo sapiens
accaccctgccaag

SEQ ID NO: 4805325 - DNA, 12 bp, Homo sapiens
accaccttgcca

SEQ ID NO: 4805326 - DNA, 20 bp, Homo sapiens
accaccttgccaatggtgta

SEQ ID NO: 4805327 - DNA, 16 bp, Homo sapiens
accacgcccctgcctg

SEQ ID NO: 4805328 - DNA, 23 bp, Homo sapiens
accacggtccaatccagccttct

SEQ ID NO: 4805329 - DNA, 14 bp, Homo sapiens
accacgtctccctg

SEQ ID NO: 4805330 - DNA, 24 bp, Homo sapiens
accacgtctccctggccccagtga

SEQ ID NO: 4805331 - DNA, 14 bp, Homo sapiens
accactctcaggac

SEQ ID NO: 4805332 - DNA, 15 bp, Homo sapiens
accactgggcctgct

SEQ ID NO: 4805333 - DNA, 19 bp, Homo sapiens
accactgtgtcccagtgtc

SEQ ID NO: 4805334 - DNA, 16 bp, Homo sapiens
accacttgatgtctga

SEQ ID NO: 4805335 - DNA, 15 bp, Homo sapiens
accagaaagaggaat

SEQ ID NO: 4805336 - DNA, 21 bp, Homo sapiens
accagaatgaggcacatgaca

SEQ ID NO: 4805337 - DNA, 23 bp, Homo sapiens
accagaatgaggcacatgacagt

SEQ ID NO: 4805338 - DNA, 13 bp, Homo sapiens
accagatgagaat

SEQ ID NO: 4805339 - DNA, 16 bp, Homo sapiens
accagatgagaattag

SEQ ID NO: 4805340 - DNA, 14 bp, Homo sapiens
accagcaacattat

SEQ ID NO: 4805341 - DNA, 12 bp, Homo sapiens
accagcactccc

SEQ ID NO: 4805342 - DNA, 17 bp, Homo sapiens
accagcactcccagggc

SEQ ID NO: 4805343 - DNA, 18 bp, Homo sapiens
accagcactcccagggcc

SEQ ID NO: 4805344 - DNA, 19 bp, Homo sapiens
accagcactcccagggccc

SEQ ID NO: 4805345 - DNA, 16 bp, Homo sapiens
accagccctggggctg

SEQ ID NO: 4805346 - DNA, 13 bp, Homo sapiens
accagcctgagcc

SEQ ID NO: 4805347 - DNA, 15 bp, Homo sapiens
accagctatctgtca

SEQ ID NO: 4805348 - DNA, 19 bp, Homo sapiens
accagctatctgtcatctc

SEQ ID NO: 4805349 - DNA, 18 bp, Homo sapiens
accagctattggaacaga

SEQ ID NO: 4805350 - DNA, 14 bp, Homo sapiens
accagctgccaaaa

SEQ ID NO: 4805351 - DNA, 15 bp, Homo sapiens
accaggaagaaggcc

SEQ ID NO: 4805352 - DNA, 16 bp, Homo sapiens
accaggaggcctggga

SEQ ID NO: 4805353 - DNA, 18 bp, Homo sapiens
accaggctacagttgata

SEQ ID NO: 4805354 - DNA, 14 bp, Homo sapiens
accagggtttagtt

SEQ ID NO: 4805355 - DNA, 20 bp, Homo sapiens
accaggttacctcactttta

SEQ ID NO: 4805356 - DNA, 17 bp, Homo sapiens
accagtccacgccgggt

SEQ ID NO: 4805357 - DNA, 21 bp, Homo sapiens
accagtccacgccgggtcgcc

SEQ ID NO: 4805358 - DNA, 13 bp, Homo sapiens
accagtctgaagt

SEQ ID NO: 4805359 - DNA, 21 bp, Homo sapiens
accagtctgaagtttcattta

SEQ ID NO: 4805360 - DNA, 21 bp, Homo sapiens
accagttccctcagccctcat

SEQ ID NO: 4805361 - DNA, 14 bp, Homo sapiens
accagttcttgcaa

SEQ ID NO: 4805362 - DNA, 16 bp, Homo sapiens
accagttcttgcaata

SEQ ID NO: 4805363 - DNA, 16 bp, Homo sapiens
acacaaaacaacagca

SEQ ID NO: 4805364 - DNA, 19 bp, Homo sapiens
acacaaaccacaactgaca

SEQ ID NO: 4805365 - DNA, 20 bp, Homo sapiens
acacaaaccacaactgacac

SEQ ID NO: 4805366 - DNA, 15 bp, Homo sapiens
acacaaagtgaaatt

SEQ ID NO: 4805367 - DNA, 16 bp, Homo sapiens
acacaaatattgcttg

SEQ ID NO: 4805368 - DNA, 23 bp, Homo sapiens
acacaaatattgcttggactacc

SEQ ID NO: 4805369 - DNA, 23 bp, Homo sapiens
acacaactcatccagaactgtct

SEQ ID NO: 4805370 - DNA, 19 bp, Homo sapiens
acacaagaccagtgcttag

SEQ ID NO: 4805371 - DNA, 9 bp, Homo sapiens
acacacaaa

SEQ ID NO: 4805372 - DNA, 12 bp, Homo sapiens
acacacaaaaca

SEQ ID NO: 4805373 - DNA, 13 bp, Homo sapiens
acacacacacaca

SEQ ID NO: 4805374 - DNA, 15 bp, Homo sapiens
acacacacacacaaa

SEQ ID NO: 4805375 - DNA, 15 bp, Homo sapiens
acacacacacacaca

SEQ ID NO: 4805376 - DNA, 14 bp, Homo sapiens
acacacacccttcc

SEQ ID NO: 4805377 - DNA, 12 bp, Homo sapiens
acacacagcagc

SEQ ID NO: 4805378 - DNA, 16 bp, Homo sapiens
acacacagcagctcca

SEQ ID NO: 4805379 - DNA, 20 bp, Homo sapiens
acacacagcagctccaacct

SEQ ID NO: 4805380 - DNA, 18 bp, Homo sapiens
acacacaggccatttcat

SEQ ID NO: 4805381 - DNA, 20 bp, Homo sapiens
acacacagtgaccaagggaa

SEQ ID NO: 4805382 - DNA, 13 bp, Homo sapiens
acacacctgagaa

SEQ ID NO: 4805383 - DNA, 13 bp, Homo sapiens
acacacctgcctg

SEQ ID NO: 4805384 - DNA, 18 bp, Homo sapiens
aacctgaattaaagtcta

SEQ ID NO: 4805385 - DNA, 20 bp, Homo sapiens
aacctgccacaatgtgatat

SEQ ID NO: 4805386 - DNA, 15 bp, Homo sapiens
aacctgcgcaccccg

SEQ ID NO: 4805387 - DNA, 17 bp, Homo sapiens
aacctggaggctggacc

SEQ ID NO: 4805388 - DNA, 19 bp, Homo sapiens
aacctggcataggactctt

SEQ ID NO: 4805389 - DNA, 17 bp, Homo sapiens
aacctggtggcaccaga

SEQ ID NO: 4805390 - DNA, 17 bp, Homo sapiens
aacctgtgctttcatgt

SEQ ID NO: 4805391 - DNA, 23 bp, Homo sapiens
aacctgtgctttcatgtttaaga

SEQ ID NO: 4805392 - DNA, 21 bp, Homo sapiens
aacctgttcctgactgttctc

SEQ ID NO: 4805393 - DNA, 15 bp, Homo sapiens
aaccttaatttgaaa

SEQ ID NO: 4805394 - DNA, 16 bp, Homo sapiens
aaccttagctccctcc

SEQ ID NO: 4805395 - DNA, 19 bp, Homo sapiens
aaccttcttttcaatgcaa

SEQ ID NO: 4805396 - DNA, 16 bp, Homo sapiens
aaccttgtactttaca

SEQ ID NO: 4805397 - DNA, 18 bp, Homo sapiens
aacctttccgctgtcgcc

SEQ ID NO: 4805398 - DNA, 13 bp, Homo sapiens
aaccttttcttgt

SEQ ID NO: 4805399 - DNA, 22 bp, Homo sapiens
aaccttttcttgtatctggatt

SEQ ID NO: 4805400 - DNA, 18 bp, Homo sapiens
aacctttttatttcaaac

SEQ ID NO: 4805401 - DNA, 17 bp, Homo sapiens
aacgatcatatctgtat

SEQ ID NO: 4805402 - DNA, 17 bp, Homo sapiens
aacgtccttccacttca

SEQ ID NO: 4805403 - DNA, 23 bp, Homo sapiens
aacgtgatgtgctcatcagaaac

SEQ ID NO: 4805404 - DNA, 23 bp, Homo sapiens
aacgtgggagttcagctgcttct

SEQ ID NO: 4805405 - DNA, 20 bp, Homo sapiens
aactaaggtacggtgagact

SEQ ID NO: 4805406 - DNA, 16 bp, Homo sapiens
aactaagttgtatttt

SEQ ID NO: 4805407 - DNA, 11 bp, Homo sapiens
aactaatgtaa

SEQ ID NO: 4805408 - DNA, 14 bp, Homo sapiens
aactagagtatgtg

SEQ ID NO: 4805409 - DNA, 15 bp, Homo sapiens
aactagatctcctgt

SEQ ID NO: 4805410 - DNA, 16 bp, Homo sapiens
aactagatctcctgta

SEQ ID NO: 4805411 - DNA, 21 bp, Homo sapiens
aactagatctcctgtaatttt

SEQ ID NO: 4805412 - DNA, 17 bp, Homo sapiens
aactatcagggcaagct

SEQ ID NO: 4805413 - DNA, 21 bp, Homo sapiens
aactatggtaaataactgtga

SEQ ID NO: 4805414 - DNA, 16 bp, Homo sapiens
aactatttctacacag

SEQ ID NO: 4805415 - DNA, 17 bp, Homo sapiens
aactatttctttcatca

SEQ ID NO: 4805416 - DNA, 19 bp, Homo sapiens
aactatttctttcatcaga

SEQ ID NO: 4805417 - DNA, 15 bp, Homo sapiens
aactcacctgcccct

SEQ ID NO: 4805418 - DNA, 15 bp, Homo sapiens
aactcatacagtctc

SEQ ID NO: 4805419 - DNA, 20 bp, Homo sapiens
aactcatacagtctctattt

SEQ ID NO: 4805420 - DNA, 21 bp, Homo sapiens
aactccagtgttcccttctgg

SEQ ID NO: 4805421 - DNA, 13 bp, Homo sapiens
aactcccccagag

SEQ ID NO: 4805422 - DNA, 18 bp, Homo sapiens
aactcccccagaggtgga

SEQ ID NO: 4805423 - DNA, 13 bp, Homo sapiens
aactcccttcctt

SEQ ID NO: 4805424 - DNA, 12 bp, Homo sapiens
aactccttggcc

SEQ ID NO: 4805425 - DNA, 18 bp, Homo sapiens
aactcgggattacagaaa

SEQ ID NO: 4805426 - DNA, 22 bp, Homo sapiens
aactcgggattacagaaacacg

SEQ ID NO: 4805427 - DNA, 19 bp, Homo sapiens
aactctatctgggcctggg

SEQ ID NO: 4805428 - DNA, 17 bp, Homo sapiens
aactctgacaagggctg

SEQ ID NO: 4805429 - DNA, 12 bp, Homo sapiens
aactctgcatag

SEQ ID NO: 4805430 - DNA, 11 bp, Homo sapiens
aactctttggc

SEQ ID NO: 4805431 - DNA, 17 bp, Homo sapiens
aactctttggctattgt

SEQ ID NO: 4805432 - DNA, 21 bp, Homo sapiens
aactctttggctattgtcctt

SEQ ID NO: 4805433 - DNA, 18 bp, Homo sapiens
aactgaaattagtgtttt

SEQ ID NO: 4805434 - DNA, 21 bp, Homo sapiens
aactgaaattagtgttttcat

SEQ ID NO: 4805435 - DNA, 13 bp, Homo sapiens
aactgacacagga

SEQ ID NO: 4805436 - DNA, 15 bp, Homo sapiens
aactgagaccaagtc

SEQ ID NO: 4805437 - DNA, 12 bp, Homo sapiens
aactgcaacact

SEQ ID NO: 4805438 - DNA, 18 bp, Homo sapiens
aactgccattttttgtct

SEQ ID NO: 4805439 - DNA, 16 bp, Homo sapiens
aactgccgctggaggc

SEQ ID NO: 4805440 - DNA, 19 bp, Homo sapiens
aactgctaatctactttct

SEQ ID NO: 4805441 - DNA, 20 bp, Homo sapiens
aactgctgcttaaaatgcaa

SEQ ID NO: 4805442 - DNA, 23 bp, Homo sapiens
aactgctttgttttggctgctct

SEQ ID NO: 4805443 - DNA, 20 bp, Homo sapiens
aactggaaggctttattctt

SEQ ID NO: 4805444 - DNA, 14 bp, Homo sapiens
aactggccccaggc

SEQ ID NO: 4805445 - DNA, 23 bp, Homo sapiens
aactggccccaggcggaggggct

SEQ ID NO: 4805446 - DNA, 11 bp, Homo sapiens
aactggccctc

SEQ ID NO: 4805447 - DNA, 12 bp, Homo sapiens
aactggccctcg

SEQ ID NO: 4805448 - DNA, 17 bp, Homo sapiens
aactgggaaatgagatc

SEQ ID NO: 4805449 - DNA, 15 bp, Homo sapiens
aactgtagtaattgt

SEQ ID NO: 4805450 - DNA, 15 bp, Homo sapiens
aactgtattgaaaaa

SEQ ID NO: 4805451 - DNA, 17 bp, Homo sapiens
aactgtgacattccaca

SEQ ID NO: 4805452 - DNA, 18 bp, Homo sapiens
aactgtgacattccacag

SEQ ID NO: 4805453 - DNA, 14 bp, Homo sapiens
aactgtgagataaa

SEQ ID NO: 4805454 - DNA, 20 bp, Homo sapiens
aactgtgagataaatatcat

SEQ ID NO: 4805455 - DNA, 19 bp, Homo sapiens
aactgtggataaattttgg

SEQ ID NO: 4805456 - DNA, 20 bp, Homo sapiens
aactgtggataaattttgga

SEQ ID NO: 4805457 - DNA, 21 bp, Homo sapiens
aactgttaagggaagctgata

SEQ ID NO: 4805458 - DNA, 14 bp, Homo sapiens
aactgttacagtaa

SEQ ID NO: 4805459 - DNA, 17 bp, Homo sapiens
aacttaaacctgtgctt

SEQ ID NO: 4805460 - DNA, 12 bp, Homo sapiens
aacttaatgaag

SEQ ID NO: 4805461 - DNA, 14 bp, Homo sapiens
aacttatgtctctt

SEQ ID NO: 4805462 - DNA, 14 bp, Homo sapiens
aacttattttgatt

SEQ ID NO: 4805463 - DNA, 17 bp, Homo sapiens
aacttattttgattgtt

SEQ ID NO: 4805464 - DNA, 12 bp, Homo sapiens
aacttcagcaac

SEQ ID NO: 4805465 - DNA, 15 bp, Homo sapiens
aacttcagcaaccct

SEQ ID NO: 4805466 - DNA, 13 bp, Homo sapiens
aacttcagtcctg

SEQ ID NO: 4805467 - DNA, 15 bp, Homo sapiens
aacttcagtcctggg

SEQ ID NO: 4805468 - DNA, 22 bp, Homo sapiens
aacttcctataccggagctcca

SEQ ID NO: 4805469 - DNA, 16 bp, Homo sapiens
aacttctcatttatgt

SEQ ID NO: 4805470 - DNA, 19 bp, Homo sapiens
aacttctgaactttggaag

SEQ ID NO: 4805471 - DNA, 19 bp, Homo sapiens
aacttgaaattatatctgt

SEQ ID NO: 4805472 - DNA, 20 bp, Homo sapiens
aacttgctcctttccatcag

SEQ ID NO: 4805473 - DNA, 12 bp, Homo sapiens
aacttgctgtga

SEQ ID NO: 4805474 - DNA, 15 bp, Homo sapiens
aacttgctgtgaaat

SEQ ID NO: 4805475 - DNA, 16 bp, Homo sapiens
aacttggggaaggggc

SEQ ID NO: 4805476 - DNA, 23 bp, Homo sapiens
aacttggttcccatttgctcctt

SEQ ID NO: 4805477 - DNA, 20 bp, Homo sapiens
aacttgtacttacactgaaa

SEQ ID NO: 4805478 - DNA, 18 bp, Homo sapiens
aacttgtgttcaatctgt

SEQ ID NO: 4805479 - DNA, 20 bp, Homo sapiens
aactttagaaataaacctta

SEQ ID NO: 4805480 - DNA, 17 bp, Homo sapiens
aactttcacctcagatt

SEQ ID NO: 4805481 - DNA, 10 bp, Homo sapiens
aactttccat

SEQ ID NO: 4805482 - DNA, 13 bp, Homo sapiens
aactttccatgac

SEQ ID NO: 4805483 - DNA, 17 bp, Homo sapiens
aactttccatgacagta

SEQ ID NO: 4805484 - DNA, 13 bp, Homo sapiens
aactttggaagtt

SEQ ID NO: 4805485 - DNA, 21 bp, Homo sapiens
aacttttttttagtatttgcc

SEQ ID NO: 4805486 - DNA, 21 bp, Homo sapiens
aagaaaaaagtgcaacttgag

SEQ ID NO: 4805487 - DNA, 14 bp, Homo sapiens
aagaaaaactgttt

SEQ ID NO: 4805488 - DNA, 12 bp, Homo sapiens
aagaaaaagata

SEQ ID NO: 4805489 - DNA, 12 bp, Homo sapiens
aagaaaagaatc

SEQ ID NO: 4805490 - DNA, 15 bp, Homo sapiens
aagaaaatccttcag

SEQ ID NO: 4805491 - DNA, 16 bp, Homo sapiens
aagaaacaaacccgtt

SEQ ID NO: 4805492 - DNA, 14 bp, Homo sapiens
aagaaacaaggcat

SEQ ID NO: 4805493 - DNA, 21 bp, Homo sapiens
aagaaacacagcatgcattta

SEQ ID NO: 4805494 - DNA, 16 bp, Homo sapiens
aagaaacatttatctt

SEQ ID NO: 4805495 - DNA, 13 bp, Homo sapiens
aagaaacctttta

SEQ ID NO: 4805496 - DNA, 13 bp, Homo sapiens
aagaaagaaaaaa

SEQ ID NO: 4805497 - DNA, 22 bp, Homo sapiens
aagaaagggagaaggattcttt

SEQ ID NO: 4805498 - DNA, 15 bp, Homo sapiens
aagaaatatctgtga

SEQ ID NO: 4805499 - DNA, 21 bp, Homo sapiens
aagaaatgagaaattgtgcca

SEQ ID NO: 4805500 - DNA, 23 bp, Homo sapiens
aagaaatgagaaattgtgccaaa

SEQ ID NO: 4805501 - DNA, 21 bp, Homo sapiens
aagaaattagggctctaattt

SEQ ID NO: 4805502 - DNA, 12 bp, Homo sapiens
aagaacataaac

SEQ ID NO: 4805503 - DNA, 21 bp, Homo sapiens
aagaaccaggaggcctgggag

SEQ ID NO: 4805504 - DNA, 16 bp, Homo sapiens
aagaacccccctcccc

SEQ ID NO: 4805505 - DNA, 14 bp, Homo sapiens
aagaagagtttaca

SEQ ID NO: 4805506 - DNA, 16 bp, Homo sapiens
aagaaggactgaagaa

SEQ ID NO: 4805507 - DNA, 14 bp, Homo sapiens
agagctcaggagaa

SEQ ID NO: 4805508 - DNA, 21 bp, Homo sapiens
agagctgagtcggctgggcag

SEQ ID NO: 4805509 - DNA, 20 bp, Homo sapiens
agagctgatggagaaggaag

SEQ ID NO: 4805510 - DNA, 21 bp, Homo sapiens
agagctgatggagaaggaagg

SEQ ID NO: 4805511 - DNA, 18 bp, Homo sapiens
agagctgccacctgcctg

SEQ ID NO: 4805512 - DNA, 20 bp, Homo sapiens
agagctggcaaactgtgaat

SEQ ID NO: 4805513 - DNA, 19 bp, Homo sapiens
agaggaaagcaaaggagat

SEQ ID NO: 4805514 - DNA, 23 bp, Homo sapiens
agaggacagcttccccatcgcct

SEQ ID NO: 4805515 - DNA, 20 bp, Homo sapiens
agaggaccccattctgggac

SEQ ID NO: 4805516 - DNA, 14 bp, Homo sapiens
agaggagcaaacag

SEQ ID NO: 4805517 - DNA, 18 bp, Homo sapiens
agaggagcaaacaggaaa

SEQ ID NO: 4805518 - DNA, 15 bp, Homo sapiens
agaggagccctcatc

SEQ ID NO: 4805519 - DNA, 15 bp, Homo sapiens
agaggagcgtgtcct

SEQ ID NO: 4805520 - DNA, 16 bp, Homo sapiens
agaggagcgtgtccta

SEQ ID NO: 4805521 - DNA, 17 bp, Homo sapiens
agaggaggtgtggagtg

SEQ ID NO: 4805522 - DNA, 21 bp, Homo sapiens
agaggaggtgtggagtggagg

SEQ ID NO: 4805523 - DNA, 16 bp, Homo sapiens
agaggagtgcgctaga

SEQ ID NO: 4805524 - DNA, 21 bp, Homo sapiens
agaggattgtccaccttctgc

SEQ ID NO: 4805525 - DNA, 15 bp, Homo sapiens
agaggatttctgctt

SEQ ID NO: 4805526 - DNA, 21 bp, Homo sapiens
agaggcagagacctcctgatg

SEQ ID NO: 4805527 - DNA, 20 bp, Homo sapiens
agaggcctgggtgtgacctg

SEQ ID NO: 4805528 - DNA, 16 bp, Homo sapiens
agaggcggcctcgtgc

SEQ ID NO: 4805529 - DNA, 17 bp, Homo sapiens
agaggcgtcttgtattt

SEQ ID NO: 4805530 - DNA, 19 bp, Homo sapiens
agaggcgtcttgtattttc

SEQ ID NO: 4805531 - DNA, 13 bp, Homo sapiens
agaggctgctgtc

SEQ ID NO: 4805532 - DNA, 17 bp, Homo sapiens
agagggactccaagccc

SEQ ID NO: 4805533 - DNA, 16 bp, Homo sapiens
agagggaggggccctg

SEQ ID NO: 4805534 - DNA, 20 bp, Homo sapiens
agagggatgaaatgccaaga

SEQ ID NO: 4805535 - DNA, 14 bp, Homo sapiens
agagggctgagccc

SEQ ID NO: 4805536 - DNA, 22 bp, Homo sapiens
agaggggacttggataggagct

SEQ ID NO: 4805537 - DNA, 17 bp, Homo sapiens
agaggtcttgatctttg

SEQ ID NO: 4805538 - DNA, 22 bp, Homo sapiens
agaggtggggtgctggggctgc

SEQ ID NO: 4805539 - DNA, 23 bp, Homo sapiens
agaggtggggtgctggggctgca

SEQ ID NO: 4805540 - DNA, 16 bp, Homo sapiens
agagtaaatatacttg

SEQ ID NO: 4805541 - DNA, 20 bp, Homo sapiens
agagtagaactttaaaagaa

SEQ ID NO: 4805542 - DNA, 14 bp, Homo sapiens
agagtatatatgta

SEQ ID NO: 4805543 - DNA, 20 bp, Homo sapiens
agagtatgcaagaagaatat

SEQ ID NO: 4805544 - DNA, 21 bp, Homo sapiens
agagtatgcaagaagaatata

SEQ ID NO: 4805545 - DNA, 15 bp, Homo sapiens
agagtatggattgaa

SEQ ID NO: 4805546 - DNA, 17 bp, Homo sapiens
agagtatgtgtatgtac

SEQ ID NO: 4805547 - DNA, 15 bp, Homo sapiens
agagtcaagctgatg

SEQ ID NO: 4805548 - DNA, 14 bp, Homo sapiens
agagtcaggagaaa

SEQ ID NO: 4805549 - DNA, 21 bp, Homo sapiens
agagtcgagtgatatggcttg

SEQ ID NO: 4805550 - DNA, 23 bp, Homo sapiens
agagtgatttgtaaaacagtggt

SEQ ID NO: 4805551 - DNA, 21 bp, Homo sapiens
agagtgcccttaaaataatga

SEQ ID NO: 4805552 - DNA, 18 bp, Homo sapiens
agagtggactcttccctc

SEQ ID NO: 4805553 - DNA, 22 bp, Homo sapiens
agagtggatctggagtctgaag

SEQ ID NO: 4805554 - DNA, 13 bp, Homo sapiens
agagtgtatgcat

SEQ ID NO: 4805555 - DNA, 14 bp, Homo sapiens
agagtgtatgcata

SEQ ID NO: 4805556 - DNA, 15 bp, Homo sapiens
agagttgcagtaaag

SEQ ID NO: 4805557 - DNA, 17 bp, Homo sapiens
agagtttctttacattg

SEQ ID NO: 4805558 - DNA, 20 bp, Homo sapiens
agataaagcactgtttggat

SEQ ID NO: 4805559 - DNA, 18 bp, Homo sapiens
agataaatccaactctga

SEQ ID NO: 4805560 - DNA, 18 bp, Homo sapiens
agataagtgctcagtatt

SEQ ID NO: 4805561 - DNA, 18 bp, Homo sapiens
agataattaaatgaaata

SEQ ID NO: 4805562 - DNA, 22 bp, Homo sapiens
agataattaaatgaaatacttg

SEQ ID NO: 4805563 - DNA, 20 bp, Homo sapiens
agataccattttgaaatatt

SEQ ID NO: 4805564 - DNA, 14 bp, Homo sapiens
agatacctgtgagg

SEQ ID NO: 4805565 - DNA, 16 bp, Homo sapiens
agatagccaaggccaa

SEQ ID NO: 4805566 - DNA, 13 bp, Homo sapiens
agatagttgtaaa

SEQ ID NO: 4805567 - DNA, 17 bp, Homo sapiens
agcaggctctcaggcca

SEQ ID NO: 4805568 - DNA, 21 bp, Homo sapiens
agcaggctctcaggccagctg

SEQ ID NO: 4805569 - DNA, 22 bp, Homo sapiens
agcaggctctcaggccagctgc

SEQ ID NO: 4805570 - DNA, 19 bp, Homo sapiens
agcagggcgggccaggaga

SEQ ID NO: 4805571 - DNA, 19 bp, Homo sapiens
agcagtacatcttgtgcat

SEQ ID NO: 4805572 - DNA, 21 bp, Homo sapiens
agcagtacatcttgtgcatgc

SEQ ID NO: 4805573 - DNA, 15 bp, Homo sapiens
agcagtacatgggaa

SEQ ID NO: 4805574 - DNA, 18 bp, Homo sapiens
agcagtaccatcccactg

SEQ ID NO: 4805575 - DNA, 16 bp, Homo sapiens
agcagtccatttttga

SEQ ID NO: 4805576 - DNA, 24 bp, Homo sapiens
agcagtccatttttgagtaaaact

SEQ ID NO: 4805577 - DNA, 13 bp, Homo sapiens
agcagtgcatgct

SEQ ID NO: 4805578 - DNA, 16 bp, Homo sapiens
agcagtgcatgctgtc

SEQ ID NO: 4805579 - DNA, 17 bp, Homo sapiens
agcagtgcatgctgtcc

SEQ ID NO: 4805580 - DNA, 18 bp, Homo sapiens
agcagtgcatgctgtccc

SEQ ID NO: 4805581 - DNA, 20 bp, Homo sapiens
agcagtgcatgctgtccctt

SEQ ID NO: 4805582 - DNA, 20 bp, Homo sapiens
agcagtggccgggctgggga

SEQ ID NO: 4805583 - DNA, 23 bp, Homo sapiens
agcagtggcctacaaatcagtaa

SEQ ID NO: 4805584 - DNA, 15 bp, Homo sapiens
agcagtggggagcgg

SEQ ID NO: 4805585 - DNA, 13 bp, Homo sapiens
agcagttctgcaa

SEQ ID NO: 4805586 - DNA, 23 bp, Homo sapiens
agcagttctgcaaatagaaaaca

SEQ ID NO: 4805587 - DNA, 15 bp, Homo sapiens
agcagtttcagataa

SEQ ID NO: 4805588 - DNA, 20 bp, Homo sapiens
agcagttttcttttaatttt

SEQ ID NO: 4805589 - DNA, 21 bp, Homo sapiens
agcataccagttcttgcaata

SEQ ID NO: 4805590 - DNA, 12 bp, Homo sapiens
agcatactgatg

SEQ ID NO: 4805591 - DNA, 20 bp, Homo sapiens
agcatactgatgagacaaca

SEQ ID NO: 4805592 - DNA, 15 bp, Homo sapiens
agcataggctgggga

SEQ ID NO: 4805593 - DNA, 16 bp, Homo sapiens
agcatagttctgcaat

SEQ ID NO: 4805594 - DNA, 22 bp, Homo sapiens
agcatccaaggaacttcatgct

SEQ ID NO: 4805595 - DNA, 14 bp, Homo sapiens
agcatcctggaaat

SEQ ID NO: 4805596 - DNA, 15 bp, Homo sapiens
agcatcctggaaatt

SEQ ID NO: 4805597 - DNA, 21 bp, Homo sapiens
agcatcctggaaatttgtgtg

SEQ ID NO: 4805598 - DNA, 19 bp, Homo sapiens
agcatgcatttagcatgag

SEQ ID NO: 4805599 - DNA, 22 bp, Homo sapiens
agcatgcccaaatataacatga

SEQ ID NO: 4805600 - DNA, 11 bp, Homo sapiens
agcatgctcag

SEQ ID NO: 4805601 - DNA, 16 bp, Homo sapiens
agcatgctcagtattg

SEQ ID NO: 4805602 - DNA, 17 bp, Homo sapiens
agcatgctcagtattga

SEQ ID NO: 4805603 - DNA, 12 bp, Homo sapiens
agcatgtaatat

SEQ ID NO: 4805604 - DNA, 16 bp, Homo sapiens
agcatgtaatattaaa

SEQ ID NO: 4805605 - DNA, 17 bp, Homo sapiens
agcatgtaatattaaat

SEQ ID NO: 4805606 - DNA, 19 bp, Homo sapiens
agcatgtcctatccctgga

SEQ ID NO: 4805607 - DNA, 16 bp, Homo sapiens
agcatgtcttatttaa

SEQ ID NO: 4805608 - DNA, 16 bp, Homo sapiens
agcatgtgttaatctt

SEQ ID NO: 4805609 - DNA, 16 bp, Homo sapiens
agcattctgcagcccg

SEQ ID NO: 4805610 - DNA, 20 bp, Homo sapiens
agcattctggggtggggctt

SEQ ID NO: 4805611 - DNA, 17 bp, Homo sapiens
agcattgaaataataat

SEQ ID NO: 4805612 - DNA, 19 bp, Homo sapiens
agcattgaaataataatat

SEQ ID NO: 4805613 - DNA, 18 bp, Homo sapiens
agcattttactgtctgta

SEQ ID NO: 4805614 - DNA, 13 bp, Homo sapiens
agccaaagagaaa

SEQ ID NO: 4805615 - DNA, 16 bp, Homo sapiens
agccaaggtctgaacc

SEQ ID NO: 4805616 - DNA, 13 bp, Homo sapiens
agccaagtgcagg

SEQ ID NO: 4805617 - DNA, 17 bp, Homo sapiens
agccaataaagctcaca

SEQ ID NO: 4805618 - DNA, 18 bp, Homo sapiens
agccaataaagctcacac

SEQ ID NO: 4805619 - DNA, 13 bp, Homo sapiens
agccaccacctgg

SEQ ID NO: 4805620 - DNA, 16 bp, Homo sapiens
agccaccacctggatg

SEQ ID NO: 4805621 - DNA, 20 bp, Homo sapiens
agccacccggatctccaggc

SEQ ID NO: 4805622 - DNA, 17 bp, Homo sapiens
agcttgatgctgtttct

SEQ ID NO: 4805623 - DNA, 16 bp, Homo sapiens
agcttggagggatgga

SEQ ID NO: 4805624 - DNA, 17 bp, Homo sapiens
agcttggagtgccacgt

SEQ ID NO: 4805625 - DNA, 16 bp, Homo sapiens
agcttgtattatcagt

SEQ ID NO: 4805626 - DNA, 19 bp, Homo sapiens
agctttagagaagccataa

SEQ ID NO: 4805627 - DNA, 20 bp, Homo sapiens
agctttagagaagccataac

SEQ ID NO: 4805628 - DNA, 19 bp, Homo sapiens
agctttataataaactgtt

SEQ ID NO: 4805629 - DNA, 21 bp, Homo sapiens
agctttataataaactgttta

SEQ ID NO: 4805630 - DNA, 18 bp, Homo sapiens
agctttctctttgttctt

SEQ ID NO: 4805631 - DNA, 15 bp, Homo sapiens
agctttgaggctggc

SEQ ID NO: 4805632 - DNA, 17 bp, Homo sapiens
agcttttcacttcttaa

SEQ ID NO: 4805633 - DNA, 18 bp, Homo sapiens
agcttttcacttcttaag

SEQ ID NO: 4805634 - DNA, 16 bp, Homo sapiens
aggaaaaaaactttta

SEQ ID NO: 4805635 - DNA, 21 bp, Homo sapiens
aggaaaaaaacttttataaat

SEQ ID NO: 4805636 - DNA, 15 bp, Homo sapiens
aggaaaagagaaaca

SEQ ID NO: 4805637 - DNA, 13 bp, Homo sapiens
aggaaaccaacac

SEQ ID NO: 4805638 - DNA, 17 bp, Homo sapiens
aggaaaccttttcttgt

SEQ ID NO: 4805639 - DNA, 13 bp, Homo sapiens
aggaaagaggctc

SEQ ID NO: 4805640 - DNA, 14 bp, Homo sapiens
aggaaagccctccc

SEQ ID NO: 4805641 - DNA, 20 bp, Homo sapiens
aggaaagcctcactgatata

SEQ ID NO: 4805642 - DNA, 20 bp, Homo sapiens
aggaaaggagagtactttgg

SEQ ID NO: 4805643 - DNA, 22 bp, Homo sapiens
aggaaagttctattatctgggt

SEQ ID NO: 4805644 - DNA, 15 bp, Homo sapiens
aggaaatactcagca

SEQ ID NO: 4805645 - DNA, 23 bp, Homo sapiens
aggaaatctgaagccttttcctg

SEQ ID NO: 4805646 - DNA, 13 bp, Homo sapiens
aggaacaaggcaa

SEQ ID NO: 4805647 - DNA, 23 bp, Homo sapiens
aggaacaaggcaaggctgtcaat

SEQ ID NO: 4805648 - DNA, 14 bp, Homo sapiens
aggaaccgaggact

SEQ ID NO: 4805649 - DNA, 15 bp, Homo sapiens
aggaacttcatgctt

SEQ ID NO: 4805650 - DNA, 13 bp, Homo sapiens
aggaagacttcat

SEQ ID NO: 4805651 - DNA, 13 bp, Homo sapiens
aggaagacttcca

SEQ ID NO: 4805652 - DNA, 12 bp, Homo sapiens
aggaagagaagg

SEQ ID NO: 4805653 - DNA, 17 bp, Homo sapiens
aggaagagaaggagcag

SEQ ID NO: 4805654 - DNA, 16 bp, Homo sapiens
aggaagagatgctcta

SEQ ID NO: 4805655 - DNA, 16 bp, Homo sapiens
aggaagaggggcgctg

SEQ ID NO: 4805656 - DNA, 23 bp, Homo sapiens
aggaagcacatgcctctctcagg

SEQ ID NO: 4805657 - DNA, 14 bp, Homo sapiens
aggaagccagcagg

SEQ ID NO: 4805658 - DNA, 17 bp, Homo sapiens
aggaagccagcaggctc

SEQ ID NO: 4805659 - DNA, 19 bp, Homo sapiens
aggaagggatgtatttgta

SEQ ID NO: 4805660 - DNA, 13 bp, Homo sapiens
aggaagggccccc

SEQ ID NO: 4805661 - DNA, 17 bp, Homo sapiens
aggaagtcatcctgcaa

SEQ ID NO: 4805662 - DNA, 17 bp, Homo sapiens
aggaatcaaaaattgaa

SEQ ID NO: 4805663 - DNA, 16 bp, Homo sapiens
aggaatgctcaatgtg

SEQ ID NO: 4805664 - DNA, 13 bp, Homo sapiens
aggacaaggggtg

SEQ ID NO: 4805665 - DNA, 20 bp, Homo sapiens
aggacactgatgggtcctgc

SEQ ID NO: 4805666 - DNA, 12 bp, Homo sapiens
aggacagggagg

SEQ ID NO: 4805667 - DNA, 14 bp, Homo sapiens
aggacagtttagga

SEQ ID NO: 4805668 - DNA, 19 bp, Homo sapiens
aggaccaccctgccaaggc

SEQ ID NO: 4805669 - DNA, 22 bp, Homo sapiens
aggaccaccctgccaaggcaga

SEQ ID NO: 4805670 - DNA, 18 bp, Homo sapiens
aggaccccattctgggac

SEQ ID NO: 4805671 - DNA, 16 bp, Homo sapiens
aggaccctgggtcacc

SEQ ID NO: 4805672 - DNA, 11 bp, Homo sapiens
aggaccttgct

SEQ ID NO: 4805673 - DNA, 18 bp, Homo sapiens
aggaccttgcttccttct

SEQ ID NO: 4805674 - DNA, 19 bp, Homo sapiens
aggaccttgcttccttctc

SEQ ID NO: 4805675 - DNA, 18 bp, Homo sapiens
aggacgcatgcagggccc

SEQ ID NO: 4805676 - DNA, 17 bp, Homo sapiens
aggacggggcagagctg

SEQ ID NO: 4805677 - DNA, 21 bp, Homo sapiens
aggacgtcatcggaggctggg

SEQ ID NO: 4805678 - DNA, 23 bp, Homo sapiens
aggactgttggctgattggaaaa

SEQ ID NO: 4805679 - DNA, 18 bp, Homo sapiens
aggacttaatttagcagt

SEQ ID NO: 4805680 - DNA, 23 bp, Homo sapiens
aggacttggtgattacctgaaag

SEQ ID NO: 4805681 - DNA, 14 bp, Homo sapiens
aggagaccctgtct

SEQ ID NO: 4805682 - DNA, 15 bp, Homo sapiens
aggagaccctgtctt

SEQ ID NO: 4805683 - DNA, 19 bp, Homo sapiens
aggagagccctctgctgct

SEQ ID NO: 4805684 - DNA, 13 bp, Homo sapiens
aggagaggagtgc

SEQ ID NO: 4805685 - DNA, 23 bp, Homo sapiens
aggagatgaggctggataggaga

SEQ ID NO: 4805686 - DNA, 17 bp, Homo sapiens
aggagattggaaggaac

SEQ ID NO: 4805687 - DNA, 10 bp, Homo sapiens
aggagcaccc

SEQ ID NO: 4805688 - DNA, 14 bp, Homo sapiens
aggagcacccccag

SEQ ID NO: 4805689 - DNA, 15 bp, Homo sapiens
aggagcacccccagc

SEQ ID NO: 4805690 - DNA, 16 bp, Homo sapiens
aggagcacccccagcc

SEQ ID NO: 4805691 - DNA, 19 bp, Homo sapiens
aggagcacccccagcctcc

SEQ ID NO: 4805692 - DNA, 20 bp, Homo sapiens
aggagcactagaatgagaaa

SEQ ID NO: 4805693 - DNA, 13 bp, Homo sapiens
aggagccagcagg

SEQ ID NO: 4805694 - DNA, 14 bp, Homo sapiens
aggagccagcaggg

SEQ ID NO: 4805695 - DNA, 13 bp, Homo sapiens
aggagccaggcaa

SEQ ID NO: 4805696 - DNA, 13 bp, Homo sapiens
aggagccctcatc

SEQ ID NO: 4805697 - DNA, 16 bp, Homo sapiens
aggagcctcctgccct

SEQ ID NO: 4805698 - DNA, 13 bp, Homo sapiens
aggagcgtgtcct

SEQ ID NO: 4805699 - DNA, 15 bp, Homo sapiens
aggagcgtgtcctat

SEQ ID NO: 4805700 - DNA, 23 bp, Homo sapiens
cacatccccaccctcccctctcc

SEQ ID NO: 4805701 - DNA, 16 bp, Homo sapiens
cacatgacatccacat

SEQ ID NO: 4805702 - DNA, 15 bp, Homo sapiens
cacatgcacatgtat

SEQ ID NO: 4805703 - DNA, 17 bp, Homo sapiens
cacatgcctctctcagg

SEQ ID NO: 4805704 - DNA, 18 bp, Homo sapiens
cacatgcctctctcaggc

SEQ ID NO: 4805705 - DNA, 20 bp, Homo sapiens
cacatgcctctctcaggcca

SEQ ID NO: 4805706 - DNA, 21 bp, Homo sapiens
cacatgcctctctcaggccaa

SEQ ID NO: 4805707 - DNA, 14 bp, Homo sapiens
cacatgcgctcctg

SEQ ID NO: 4805708 - DNA, 16 bp, Homo sapiens
cacatgcgctcctggc

SEQ ID NO: 4805709 - DNA, 16 bp, Homo sapiens
cacatgctggccagcc

SEQ ID NO: 4805710 - DNA, 19 bp, Homo sapiens
cacatgctggccagcctgg

SEQ ID NO: 4805711 - DNA, 16 bp, Homo sapiens
cacatgttttacaaag

SEQ ID NO: 4805712 - DNA, 17 bp, Homo sapiens
cacattgaaactgtatt

SEQ ID NO: 4805713 - DNA, 23 bp, Homo sapiens
cacattgtagcctaatattcatg

SEQ ID NO: 4805714 - DNA, 20 bp, Homo sapiens
cacatttctggccatttaac

SEQ ID NO: 4805715 - DNA, 12 bp, Homo sapiens
cacatttgttaa

SEQ ID NO: 4805716 - DNA, 19 bp, Homo sapiens
cacatttgttaatgattct

SEQ ID NO: 4805717 - DNA, 20 bp, Homo sapiens
cacatttgttaatgattctt

SEQ ID NO: 4805718 - DNA, 15 bp, Homo sapiens
caccaaagatgcagc

SEQ ID NO: 4805719 - DNA, 17 bp, Homo sapiens
caccaaagatgcagccg

SEQ ID NO: 4805720 - DNA, 18 bp, Homo sapiens
caccaaagatgcagccgc

SEQ ID NO: 4805721 - DNA, 23 bp, Homo sapiens
caccaaatagcttttcacttctt

SEQ ID NO: 4805722 - DNA, 18 bp, Homo sapiens
caccaaattgctgagatg

SEQ ID NO: 4805723 - DNA, 22 bp, Homo sapiens
caccaagctgctctccttcact

SEQ ID NO: 4805724 - DNA, 14 bp, Homo sapiens
caccaagctgttcc

SEQ ID NO: 4805725 - DNA, 19 bp, Homo sapiens
caccaagtaaatctatctc

SEQ ID NO: 4805726 - DNA, 19 bp, Homo sapiens
caccacaactaacaatgcc

SEQ ID NO: 4805727 - DNA, 15 bp, Homo sapiens
caccacacacaccct

SEQ ID NO: 4805728 - DNA, 20 bp, Homo sapiens
caccacctggatggatctgc

SEQ ID NO: 4805729 - DNA, 15 bp, Homo sapiens
caccactgtgtccca

SEQ ID NO: 4805730 - DNA, 21 bp, Homo sapiens
caccactgtgtcccagtgtct

SEQ ID NO: 4805731 - DNA, 16 bp, Homo sapiens
caccagagtgtatgca

SEQ ID NO: 4805732 - DNA, 14 bp, Homo sapiens
caccagcctgagcc

SEQ ID NO: 4805733 - DNA, 15 bp, Homo sapiens
caccagcctgagcca

SEQ ID NO: 4805734 - DNA, 15 bp, Homo sapiens
caccagcttgcttct

SEQ ID NO: 4805735 - DNA, 19 bp, Homo sapiens
caccagtccacgccgggtc

SEQ ID NO: 4805736 - DNA, 15 bp, Homo sapiens
caccatgctgggccg

SEQ ID NO: 4805737 - DNA, 20 bp, Homo sapiens
caccatttaatcatttccag

SEQ ID NO: 4805738 - DNA, 22 bp, Homo sapiens
caccatttaatcatttccagca

SEQ ID NO: 4805739 - DNA, 21 bp, Homo sapiens
caccatttcccctgtggtttg

SEQ ID NO: 4805740 - DNA, 17 bp, Homo sapiens
cacccaaagcatggact

SEQ ID NO: 4805741 - DNA, 13 bp, Homo sapiens
cacccacaccccg

SEQ ID NO: 4805742 - DNA, 14 bp, Homo sapiens
cacccaccactctc

SEQ ID NO: 4805743 - DNA, 16 bp, Homo sapiens
cacccaccccaagctg

SEQ ID NO: 4805744 - DNA, 15 bp, Homo sapiens
cacccacccctgccc

SEQ ID NO: 4805745 - DNA, 22 bp, Homo sapiens
cacccactagccctctttctct

SEQ ID NO: 4805746 - DNA, 19 bp, Homo sapiens
cacccagcagcgcccgagg

SEQ ID NO: 4805747 - DNA, 21 bp, Homo sapiens
cacccagcagcgcccgaggcc

SEQ ID NO: 4805748 - DNA, 23 bp, Homo sapiens
cacccagcagcgcccgaggccag

SEQ ID NO: 4805749 - DNA, 17 bp, Homo sapiens
cacccagcccaaccggg

SEQ ID NO: 4805750 - DNA, 20 bp, Homo sapiens
cacccaggttggagtgcagt

SEQ ID NO: 4805751 - DNA, 16 bp, Homo sapiens
caccccaaacttccag

SEQ ID NO: 4805752 - DNA, 14 bp, Homo sapiens
caccccagtccccg

SEQ ID NO: 4805753 - DNA, 17 bp, Homo sapiens
caccccagtccccggga

SEQ ID NO: 4805754 - DNA, 10 bp, Homo sapiens
cacccccagc

SEQ ID NO: 4805755 - DNA, 11 bp, Homo sapiens
cacccccagcc

SEQ ID NO: 4805756 - DNA, 12 bp, Homo sapiens
cacccccagcct

SEQ ID NO: 4805757 - DNA, 15 bp, Homo sapiens
cacccccagcctccc

SEQ ID NO: 4805758 - DNA, 13 bp, Homo sapiens
cacccccatcatc

SEQ ID NO: 4805759 - DNA, 14 bp, Homo sapiens
caccccccgacctg

SEQ ID NO: 4805760 - DNA, 17 bp, Homo sapiens
caccccccgacctggct

SEQ ID NO: 4805761 - DNA, 18 bp, Homo sapiens
caccccgctgcctggcgg

SEQ ID NO: 4805762 - DNA, 13 bp, Homo sapiens
caccccggcaggc

SEQ ID NO: 4805763 - DNA, 18 bp, Homo sapiens
caccccggcaggccctgc

SEQ ID NO: 4805764 - DNA, 12 bp, Homo sapiens
caccccgtcccg

SEQ ID NO: 4805765 - DNA, 15 bp, Homo sapiens
caccccgtctgcccc

SEQ ID NO: 4805766 - DNA, 15 bp, Homo sapiens
caccccgttgttgtc

SEQ ID NO: 4805767 - DNA, 22 bp, Homo sapiens
caccccgttgttgtccctgcag

SEQ ID NO: 4805768 - DNA, 23 bp, Homo sapiens
cacccctaaaagaaaccctgcac

SEQ ID NO: 4805769 - DNA, 21 bp, Homo sapiens
cacccctacagcctgcacaca

SEQ ID NO: 4805770 - DNA, 18 bp, Homo sapiens
cacccctcccacctcttt

SEQ ID NO: 4805771 - DNA, 13 bp, Homo sapiens
cacccctcttccc

SEQ ID NO: 4805772 - DNA, 22 bp, Homo sapiens
cacccctgcccaggcagtcttt

SEQ ID NO: 4805773 - DNA, 12 bp, Homo sapiens
cacccctgtgcg

SEQ ID NO: 4805774 - DNA, 19 bp, Homo sapiens
cacccgccagcacaccctt

SEQ ID NO: 4805775 - DNA, 13 bp, Homo sapiens
cacccgccccaga

SEQ ID NO: 4805776 - DNA, 16 bp, Homo sapiens
cacccgccccagagac

SEQ ID NO: 4805777 - DNA, 22 bp, Homo sapiens
cacccgccccagagactgccca

SEQ ID NO: 4805778 - DNA, 23 bp, Homo sapiens
cacccgccccagagactgcccac

SEQ ID NO: 4805779 - DNA, 14 bp, Homo sapiens
cacccgccctttcc

SEQ ID NO: 4805780 - DNA, 19 bp, Homo sapiens
cacccggatctccaggccc

SEQ ID NO: 4805781 - DNA, 17 bp, Homo sapiens
cacccgtcctggggtgg

SEQ ID NO: 4805782 - DNA, 15 bp, Homo sapiens
caccctcactctgcc

SEQ ID NO: 4805783 - DNA, 14 bp, Homo sapiens
caccctccacagga

SEQ ID NO: 4805784 - DNA, 23 bp, Homo sapiens
caccctccacaggagccgcagag

SEQ ID NO: 4805785 - DNA, 17 bp, Homo sapiens
caccctcccctctcctg

SEQ ID NO: 4805786 - DNA, 18 bp, Homo sapiens
caccctcccctctcctga

SEQ ID NO: 4805787 - DNA, 23 bp, Homo sapiens
caccctctgctatgtctgtgatg

SEQ ID NO: 4805788 - DNA, 13 bp, Homo sapiens
caccctctgctgc

SEQ ID NO: 4805789 - DNA, 22 bp, Homo sapiens
cactctcaggaccaccctgcca

SEQ ID NO: 4805790 - DNA, 23 bp, Homo sapiens
cactctcaggaccaccctgccaa

SEQ ID NO: 4805791 - DNA, 17 bp, Homo sapiens
cactctcttcttactgt

SEQ ID NO: 4805792 - DNA, 14 bp, Homo sapiens
cactctgaccgggc

SEQ ID NO: 4805793 - DNA, 16 bp, Homo sapiens
cactctgccagggcag

SEQ ID NO: 4805794 - DNA, 12 bp, Homo sapiens
cactctgtcagc

SEQ ID NO: 4805795 - DNA, 22 bp, Homo sapiens
cactgaaaataccatcaggcct

SEQ ID NO: 4805796 - DNA, 13 bp, Homo sapiens
cactgaataaata

SEQ ID NO: 4805797 - DNA, 21 bp, Homo sapiens
cactgacccttccagacatac

SEQ ID NO: 4805798 - DNA, 13 bp, Homo sapiens
cactgacttctcc

SEQ ID NO: 4805799 - DNA, 18 bp, Homo sapiens
cactgacttctcccgggt

SEQ ID NO: 4805800 - DNA, 16 bp, Homo sapiens
cactgatgggtcctgc

SEQ ID NO: 4805801 - DNA, 19 bp, Homo sapiens
cactgatgggtcctgctgc

SEQ ID NO: 4805802 - DNA, 22 bp, Homo sapiens
cactgatgggtcctgctgctcg

SEQ ID NO: 4805803 - DNA, 14 bp, Homo sapiens
cactgcaacctcca

SEQ ID NO: 4805804 - DNA, 19 bp, Homo sapiens
cactgcagttatttaccag

SEQ ID NO: 4805805 - DNA, 16 bp, Homo sapiens
cactgcccacctgcca

SEQ ID NO: 4805806 - DNA, 22 bp, Homo sapiens
cactgcccacctgccaggctgc

SEQ ID NO: 4805807 - DNA, 17 bp, Homo sapiens
cactgcccgcacaccct

SEQ ID NO: 4805808 - DNA, 18 bp, Homo sapiens
cactgcccgcacaccctc

SEQ ID NO: 4805809 - DNA, 14 bp, Homo sapiens
cactgccctccgcc

SEQ ID NO: 4805810 - DNA, 18 bp, Homo sapiens
cactgccctctgccactg

SEQ ID NO: 4805811 - DNA, 12 bp, Homo sapiens
cactgcctctgc

SEQ ID NO: 4805812 - DNA, 18 bp, Homo sapiens
cactgcggaacaggagtg

SEQ ID NO: 4805813 - DNA, 19 bp, Homo sapiens
cactgcggaacaggagtga

SEQ ID NO: 4805814 - DNA, 14 bp, Homo sapiens
cactggccggccca

SEQ ID NO: 4805815 - DNA, 23 bp, Homo sapiens
cactggccttctgatgaaatgtt

SEQ ID NO: 4805816 - DNA, 14 bp, Homo sapiens
cactggctttacat

SEQ ID NO: 4805817 - DNA, 13 bp, Homo sapiens
cactggctttggg

SEQ ID NO: 4805818 - DNA, 17 bp, Homo sapiens
cactggtttgtttctca

SEQ ID NO: 4805819 - DNA, 17 bp, Homo sapiens
cactgtagtcagacctc

SEQ ID NO: 4805820 - DNA, 14 bp, Homo sapiens
cactgtcatgccca

SEQ ID NO: 4805821 - DNA, 17 bp, Homo sapiens
cactgtcatgcccagct

SEQ ID NO: 4805822 - DNA, 21 bp, Homo sapiens
cactgtcatgcccagcttgga

SEQ ID NO: 4805823 - DNA, 16 bp, Homo sapiens
cactgtgcactctact

SEQ ID NO: 4805824 - DNA, 18 bp, Homo sapiens
cactgtgcgttttagagt

SEQ ID NO: 4805825 - DNA, 11 bp, Homo sapiens
cactgtgtccc

SEQ ID NO: 4805826 - DNA, 15 bp, Homo sapiens
cactgtgtcccagtg

SEQ ID NO: 4805827 - DNA, 17 bp, Homo sapiens
cactgtgtcccagtgtc

SEQ ID NO: 4805828 - DNA, 23 bp, Homo sapiens
cactgtgtcccagtgtctggccc

SEQ ID NO: 4805829 - DNA, 22 bp, Homo sapiens
cacttaaactttgtcacttctg

SEQ ID NO: 4805830 - DNA, 13 bp, Homo sapiens
cacttcattgaaa

SEQ ID NO: 4805831 - DNA, 22 bp, Homo sapiens
cacttccccatctgtgtgtgaa

SEQ ID NO: 4805832 - DNA, 23 bp, Homo sapiens
cacttccctgcaaggtgcacctg

SEQ ID NO: 4805833 - DNA, 14 bp, Homo sapiens
cacttccttaacag

SEQ ID NO: 4805834 - DNA, 18 bp, Homo sapiens
cacttccttaacagctgt

SEQ ID NO: 4805835 - DNA, 19 bp, Homo sapiens
cacttccttaacagctgta

SEQ ID NO: 4805836 - DNA, 23 bp, Homo sapiens
cacttccttaacagctgtattat

SEQ ID NO: 4805837 - DNA, 12 bp, Homo sapiens
cacttctgttat

SEQ ID NO: 4805838 - DNA, 13 bp, Homo sapiens
cacttctgttatc

SEQ ID NO: 4805839 - DNA, 19 bp, Homo sapiens
cacttgacatcaactgcat

SEQ ID NO: 4805840 - DNA, 17 bp, Homo sapiens
cacttgatgtctgagga

SEQ ID NO: 4805841 - DNA, 16 bp, Homo sapiens
cacttgggctggcacc

SEQ ID NO: 4805842 - DNA, 23 bp, Homo sapiens
cacttgggctggcacccactgga

SEQ ID NO: 4805843 - DNA, 22 bp, Homo sapiens
cacttgggtgtggctcctctgt

SEQ ID NO: 4805844 - DNA, 14 bp, Homo sapiens
cactttacattctt

SEQ ID NO: 4805845 - DNA, 20 bp, Homo sapiens
cactttacattcttgctctg

SEQ ID NO: 4805846 - DNA, 13 bp, Homo sapiens
cactttcccacac

SEQ ID NO: 4805847 - DNA, 18 bp, Homo sapiens
cactttctagccagagga

SEQ ID NO: 4805848 - DNA, 20 bp, Homo sapiens
cactttctagccagaggaga

SEQ ID NO: 4805849 - DNA, 13 bp, Homo sapiens
cactttgacactt

SEQ ID NO: 4805850 - DNA, 14 bp, Homo sapiens
cactttggccacag

SEQ ID NO: 4805851 - DNA, 16 bp, Homo sapiens
cactttgggaggctga

SEQ ID NO: 4805852 - DNA, 17 bp, Homo sapiens
cacttttcatatcattt

SEQ ID NO: 4805853 - DNA, 13 bp, Homo sapiens
cacttttgagctc

SEQ ID NO: 4805854 - DNA, 16 bp, Homo sapiens
cacttttttcctgtca

SEQ ID NO: 4805855 - DNA, 22 bp, Homo sapiens
cacttttttcctgtcaatatat

SEQ ID NO: 4805856 - DNA, 14 bp, Homo sapiens
cagaaaaaaataaa

SEQ ID NO: 4805857 - DNA, 13 bp, Homo sapiens
cagaaaaacaaaa

SEQ ID NO: 4805858 - DNA, 15 bp, Homo sapiens
cagaaaaacaaaaaa

SEQ ID NO: 4805859 - DNA, 21 bp, Homo sapiens
cagaaaaatcaatcattttct

SEQ ID NO: 4805860 - DNA, 20 bp, Homo sapiens
cagaaaaatgaaatttaagc

SEQ ID NO: 4805861 - DNA, 19 bp, Homo sapiens
cagaaacacggagtttcca

SEQ ID NO: 4805862 - DNA, 23 bp, Homo sapiens
cagaaacacggagtttccatttg

SEQ ID NO: 4805863 - DNA, 19 bp, Homo sapiens
cagaaactgaactggccgc

SEQ ID NO: 4805864 - DNA, 22 bp, Homo sapiens
cagaaagaggaataaaatgatt

SEQ ID NO: 4805865 - DNA, 16 bp, Homo sapiens
cagaaagggcagcccc

SEQ ID NO: 4805866 - DNA, 18 bp, Homo sapiens
cagaaatgtgctgcaaag

SEQ ID NO: 4805867 - DNA, 16 bp, Homo sapiens
cagaacaccaagtaaa

SEQ ID NO: 4805868 - DNA, 20 bp, Homo sapiens
cagaaccaacgggtctgtgg

SEQ ID NO: 4805869 - DNA, 15 bp, Homo sapiens
cagaaccagcactcc

SEQ ID NO: 4805870 - DNA, 19 bp, Homo sapiens
cagaaccagcactcccagg

SEQ ID NO: 4805871 - DNA, 21 bp, Homo sapiens
cagaaccagcactcccagggc

SEQ ID NO: 4805872 - DNA, 19 bp, Homo sapiens
cagaacctttgtcaacttc

SEQ ID NO: 4805873 - DNA, 16 bp, Homo sapiens
cagaacgggcctcccc

SEQ ID NO: 4805874 - DNA, 18 bp, Homo sapiens
cagaacgggcctccccgg

SEQ ID NO: 4805875 - DNA, 21 bp, Homo sapiens
cagaagcagcagctagaaaga

SEQ ID NO: 4805876 - DNA, 16 bp, Homo sapiens
cagaaggaagacttca

SEQ ID NO: 4805877 - DNA, 20 bp, Homo sapiens
cagaaggaaggcagggagga

SEQ ID NO: 4805878 - DNA, 14 bp, Homo sapiens
cagaagtgaaaaag

SEQ ID NO: 4805879 - DNA, 23 bp, Homo sapiens
cagaagtttaaatctttgttaaa

SEQ ID NO: 4805880 - DNA, 21 bp, Homo sapiens
cagaagtttctgccgcagccc

SEQ ID NO: 4805881 - DNA, 15 bp, Homo sapiens
cagaatcattgctta

SEQ ID NO: 4805882 - DNA, 22 bp, Homo sapiens
cagaatgagatgatttaattct

SEQ ID NO: 4805883 - DNA, 15 bp, Homo sapiens
cagaatggaagagag

SEQ ID NO: 4805884 - DNA, 19 bp, Homo sapiens
cagaatggtgggctccaga

SEQ ID NO: 4805885 - DNA, 20 bp, Homo sapiens
cagaatggtgggctccagag

SEQ ID NO: 4805886 - DNA, 22 bp, Homo sapiens
cagaattcattcatacttaaaa

SEQ ID NO: 4805887 - DNA, 17 bp, Homo sapiens
cagaatttcccaaagca

SEQ ID NO: 4805888 - DNA, 14 bp, Homo sapiens
cagacaccatcacc

SEQ ID NO: 4805889 - DNA, 15 bp, Homo sapiens
cagacaccatcacca

SEQ ID NO: 4805890 - DNA, 12 bp, Homo sapiens
cagacagagatc

SEQ ID NO: 4805891 - DNA, 12 bp, Homo sapiens
cagacagagtgg

SEQ ID NO: 4805892 - DNA, 14 bp, Homo sapiens
cagacagagtggat

SEQ ID NO: 4805893 - DNA, 18 bp, Homo sapiens
cagacagtggatgagaca

SEQ ID NO: 4805894 - DNA, 18 bp, Homo sapiens
cagacccctaccctttcc

SEQ ID NO: 4805895 - DNA, 14 bp, Homo sapiens
cagaccctgccagg

SEQ ID NO: 4805896 - DNA, 15 bp, Homo sapiens
cagaccctgccaggg

SEQ ID NO: 4805897 - DNA, 16 bp, Homo sapiens
cagaccctgccagggg

SEQ ID NO: 4805898 - DNA, 17 bp, Homo sapiens
cagacggacgggacagc

SEQ ID NO: 4805899 - DNA, 21 bp, Homo sapiens
cagacggacgggacagcggcc

SEQ ID NO: 4805900 - DNA, 23 bp, Homo sapiens
cagactcagagaccgtgagcgcc

SEQ ID NO: 4805901 - DNA, 22 bp, Homo sapiens
cagactctctcctctctctccc

SEQ ID NO: 4805902 - DNA, 12 bp, Homo sapiens
cagactctgtga

SEQ ID NO: 4805903 - DNA, 12 bp, Homo sapiens
cagactgcctta

SEQ ID NO: 4805904 - DNA, 17 bp, Homo sapiens
cagactgccttatatta

SEQ ID NO: 4805905 - DNA, 21 bp, Homo sapiens
cagactgcttcattgggaagt

SEQ ID NO: 4805906 - DNA, 19 bp, Homo sapiens
cagacttcgctattcccag

SEQ ID NO: 4805907 - DNA, 22 bp, Homo sapiens
cagacttcgctattcccaggca

SEQ ID NO: 4805908 - DNA, 23 bp, Homo sapiens
cagacttcgctattcccaggcag

SEQ ID NO: 4805909 - DNA, 15 bp, Homo sapiens
cagacttctaaaata

SEQ ID NO: 4805910 - DNA, 16 bp, Homo sapiens
cagacttctaaaataa

SEQ ID NO: 4805911 - DNA, 15 bp, Homo sapiens
cagccccatccttcc

SEQ ID NO: 4805912 - DNA, 21 bp, Homo sapiens
cagccccatccttcccgcagc

SEQ ID NO: 4805913 - DNA, 17 bp, Homo sapiens
cagcccccacccccgtc

SEQ ID NO: 4805914 - DNA, 21 bp, Homo sapiens
cagccccgcgaccacccctgt

SEQ ID NO: 4805915 - DNA, 14 bp, Homo sapiens
cagcccctccccat

SEQ ID NO: 4805916 - DNA, 13 bp, Homo sapiens
cagcccctgctgg

SEQ ID NO: 4805917 - DNA, 20 bp, Homo sapiens
cagcccctgttctggcagag

SEQ ID NO: 4805918 - DNA, 22 bp, Homo sapiens
cagcccgagccccttggggagc

SEQ ID NO: 4805919 - DNA, 15 bp, Homo sapiens
cagcccgatgtccct

SEQ ID NO: 4805920 - DNA, 17 bp, Homo sapiens
cagcccgatgtccctgt

SEQ ID NO: 4805921 - DNA, 14 bp, Homo sapiens
cagcccgcagaggt

SEQ ID NO: 4805922 - DNA, 16 bp, Homo sapiens
cagcccgcagaggtgg

SEQ ID NO: 4805923 - DNA, 19 bp, Homo sapiens
cagccctcattaaactaat

SEQ ID NO: 4805924 - DNA, 13 bp, Homo sapiens
cagccctccgcca

SEQ ID NO: 4805925 - DNA, 17 bp, Homo sapiens
cagccctgcacgcccag

SEQ ID NO: 4805926 - DNA, 13 bp, Homo sapiens
cagccctgcagag

SEQ ID NO: 4805927 - DNA, 14 bp, Homo sapiens
cagccctgcagagg

SEQ ID NO: 4805928 - DNA, 15 bp, Homo sapiens
cagccctgcagaggg

SEQ ID NO: 4805929 - DNA, 16 bp, Homo sapiens
cagccctgcagagggc

SEQ ID NO: 4805930 - DNA, 15 bp, Homo sapiens
cagccctgcccagag

SEQ ID NO: 4805931 - DNA, 12 bp, Homo sapiens
cagccctgggca

SEQ ID NO: 4805932 - DNA, 13 bp, Homo sapiens
cagccctgggcac

SEQ ID NO: 4805933 - DNA, 18 bp, Homo sapiens
cagccctggggctgggcc

SEQ ID NO: 4805934 - DNA, 19 bp, Homo sapiens
cagccctggggctgggccc

SEQ ID NO: 4805935 - DNA, 18 bp, Homo sapiens
cagccctgttccgcctca

SEQ ID NO: 4805936 - DNA, 21 bp, Homo sapiens
cagccctgttccgcctcactg

SEQ ID NO: 4805937 - DNA, 19 bp, Homo sapiens
cagccgagatagccaaggc

SEQ ID NO: 4805938 - DNA, 23 bp, Homo sapiens
cagccgcaaatccataccccctg

SEQ ID NO: 4805939 - DNA, 15 bp, Homo sapiens
cagccgccctgggct

SEQ ID NO: 4805940 - DNA, 15 bp, Homo sapiens
cagccgccttccttg

SEQ ID NO: 4805941 - DNA, 14 bp, Homo sapiens
cagccgcgctctgc

SEQ ID NO: 4805942 - DNA, 12 bp, Homo sapiens
cagcctccccca

SEQ ID NO: 4805943 - DNA, 16 bp, Homo sapiens
cagcctcccccaggct

SEQ ID NO: 4805944 - DNA, 17 bp, Homo sapiens
cagcctcccccaggctg

SEQ ID NO: 4805945 - DNA, 21 bp, Homo sapiens
cagcctcccccaggctgcgcc

SEQ ID NO: 4805946 - DNA, 14 bp, Homo sapiens
cagcctgagccaca

SEQ ID NO: 4805947 - DNA, 15 bp, Homo sapiens
cagcctgagccacag

SEQ ID NO: 4805948 - DNA, 18 bp, Homo sapiens
cagcctgcacacacctgc

SEQ ID NO: 4805949 - DNA, 22 bp, Homo sapiens
cagcctgcacacacctgcctgc

SEQ ID NO: 4805950 - DNA, 23 bp, Homo sapiens
cagcctgcacagtggtccagggt

SEQ ID NO: 4805951 - DNA, 12 bp, Homo sapiens
cagcctggcccc

SEQ ID NO: 4805952 - DNA, 14 bp, Homo sapiens
cagcctggccccaa

SEQ ID NO: 4805953 - DNA, 17 bp, Homo sapiens
cagcctggccccaagca

SEQ ID NO: 4805954 - DNA, 17 bp, Homo sapiens
cagcctggggcctggca

SEQ ID NO: 4805955 - DNA, 18 bp, Homo sapiens
cagcctggggcctggcag

SEQ ID NO: 4805956 - DNA, 18 bp, Homo sapiens
cagcctgtgggtccttgc

SEQ ID NO: 4805957 - DNA, 15 bp, Homo sapiens
cagccttggttcctg

SEQ ID NO: 4805958 - DNA, 20 bp, Homo sapiens
cagcctttgcgctctgggtt

SEQ ID NO: 4805959 - DNA, 15 bp, Homo sapiens
cagcgccatgtgtgt

SEQ ID NO: 4805960 - DNA, 22 bp, Homo sapiens
cagcgccatgtgtgtcagccca

SEQ ID NO: 4805961 - DNA, 20 bp, Homo sapiens
cagcgcccgaggccagggcc

SEQ ID NO: 4805962 - DNA, 13 bp, Homo sapiens
cagcgcctcccgc

SEQ ID NO: 4805963 - DNA, 14 bp, Homo sapiens
cagcgcctcccgcc

SEQ ID NO: 4805964 - DNA, 17 bp, Homo sapiens
cagcgcctcccgccgcc

SEQ ID NO: 4805965 - DNA, 22 bp, Homo sapiens
cagcgcctcccgccgcctcggg

SEQ ID NO: 4805966 - DNA, 17 bp, Homo sapiens
cagcgctgaacagaccg

SEQ ID NO: 4805967 - DNA, 13 bp, Homo sapiens
cagcggcccagat

SEQ ID NO: 4805968 - DNA, 18 bp, Homo sapiens
cagcggccccgcggagcc

SEQ ID NO: 4805969 - DNA, 12 bp, Homo sapiens
cagcggcccggc

SEQ ID NO: 4805970 - DNA, 15 bp, Homo sapiens
cagcggctcttcctg

SEQ ID NO: 4805971 - DNA, 17 bp, Homo sapiens
cagcggctcttcctgga

SEQ ID NO: 4805972 - DNA, 14 bp, Homo sapiens
cagcgggagtctcc

SEQ ID NO: 4805973 - DNA, 15 bp, Homo sapiens
cagcggggcttctgg

SEQ ID NO: 4805974 - DNA, 18 bp, Homo sapiens
cagcgtccctagcagtga

SEQ ID NO: 4805975 - DNA, 15 bp, Homo sapiens
cagctaacaagtagc

SEQ ID NO: 4805976 - DNA, 14 bp, Homo sapiens
cagctaacaataaa

SEQ ID NO: 4805977 - DNA, 17 bp, Homo sapiens
cagctaagcctgatgat

SEQ ID NO: 4805978 - DNA, 18 bp, Homo sapiens
cagctaagcctgatgatg

SEQ ID NO: 4805979 - DNA, 19 bp, Homo sapiens
cagctactcagatctgcac

SEQ ID NO: 4805980 - DNA, 14 bp, Homo sapiens
cagctagaaagaga

SEQ ID NO: 4805981 - DNA, 15 bp, Homo sapiens
cagctagaaagagaa

SEQ ID NO: 4805982 - DNA, 16 bp, Homo sapiens
acagcacatttgttaa

SEQ ID NO: 4805983 - DNA, 19 bp, Homo sapiens
acagcacatttgttaatga

SEQ ID NO: 4805984 - DNA, 13 bp, Homo sapiens
acagcagcctgct

SEQ ID NO: 4805985 - DNA, 19 bp, Homo sapiens
acagcagcctgcttcccac

SEQ ID NO: 4805986 - DNA, 21 bp, Homo sapiens
acagcagctggactgggtggg

SEQ ID NO: 4805987 - DNA, 20 bp, Homo sapiens
acagcatgcatttagcatga

SEQ ID NO: 4805988 - DNA, 17 bp, Homo sapiens
acagcatgtgctcagcc

SEQ ID NO: 4805989 - DNA, 16 bp, Homo sapiens
acagcatgtgttaatc

SEQ ID NO: 4805990 - DNA, 18 bp, Homo sapiens
acagcatttcagctgtga

SEQ ID NO: 4805991 - DNA, 19 bp, Homo sapiens
acagcatttcagctgtgag

SEQ ID NO: 4805992 - DNA, 16 bp, Homo sapiens
acagccaccacctgga

SEQ ID NO: 4805993 - DNA, 10 bp, Homo sapiens
acagccagaa

SEQ ID NO: 4805994 - DNA, 20 bp, Homo sapiens
acagccccaaacaagcgcca

SEQ ID NO: 4805995 - DNA, 21 bp, Homo sapiens
acagcctccaccttgagcact

SEQ ID NO: 4805996 - DNA, 16 bp, Homo sapiens
acagcctgaaggaatt

SEQ ID NO: 4805997 - DNA, 15 bp, Homo sapiens
acagcctgcacacac

SEQ ID NO: 4805998 - DNA, 13 bp, Homo sapiens
acagcctgcacag

SEQ ID NO: 4805999 - DNA, 20 bp, Homo sapiens
acagcggcccggcccacgca

SEQ ID NO: 4806000 - DNA, 19 bp, Homo sapiens
acagcgtaacggagggtga

SEQ ID NO: 4806001 - DNA, 21 bp, Homo sapiens
acagcgtccctagcagtgaac

SEQ ID NO: 4806002 - DNA, 14 bp, Homo sapiens
acagctaacatgga

SEQ ID NO: 4806003 - DNA, 14 bp, Homo sapiens
acagctccccaagt

SEQ ID NO: 4806004 - DNA, 14 bp, Homo sapiens
acagctctcctcca

SEQ ID NO: 4806005 - DNA, 11 bp, Homo sapiens
acagctgcctc

SEQ ID NO: 4806006 - DNA, 15 bp, Homo sapiens
acagctgcctccggg

SEQ ID NO: 4806007 - DNA, 22 bp, Homo sapiens
cagagctacacaggggaaaaga

SEQ ID NO: 4806008 - DNA, 22 bp, Homo sapiens
cagagctcatttcggggtcagg

SEQ ID NO: 4806009 - DNA, 19 bp, Homo sapiens
cagagctgagtcggctggg

SEQ ID NO: 4806010 - DNA, 20 bp, Homo sapiens
cagagctgagtcggctgggc

SEQ ID NO: 4806011 - DNA, 23 bp, Homo sapiens
cagagctgagtcggctgggcagg

SEQ ID NO: 4806012 - DNA, 16 bp, Homo sapiens
cagagctgccacctgc

SEQ ID NO: 4806013 - DNA, 17 bp, Homo sapiens
cagagctgctggaggtg

SEQ ID NO: 4806014 - DNA, 21 bp, Homo sapiens
cagagctggcatctatctggt

SEQ ID NO: 4806015 - DNA, 17 bp, Homo sapiens
cagaggaaagcaaagga

SEQ ID NO: 4806016 - DNA, 20 bp, Homo sapiens
cagaggacagcttccccatc

SEQ ID NO: 4806017 - DNA, 18 bp, Homo sapiens
cagaggcccgaggcaccg

SEQ ID NO: 4806018 - DNA, 22 bp, Homo sapiens
cagaggctgagttttctctttg

SEQ ID NO: 4806019 - DNA, 19 bp, Homo sapiens
cagagggatgaaatgccaa

SEQ ID NO: 4806020 - DNA, 16 bp, Homo sapiens
cagaggtggatactgg

SEQ ID NO: 4806021 - DNA, 23 bp, Homo sapiens
cagaggtggatactggggggcag

SEQ ID NO: 4806022 - DNA, 18 bp, Homo sapiens
cagaggtggggtgctggg

SEQ ID NO: 4806023 - DNA, 21 bp, Homo sapiens
cagaggttctttgagggactg

SEQ ID NO: 4806024 - DNA, 16 bp, Homo sapiens
cagagtatatatgtac

SEQ ID NO: 4806025 - DNA, 22 bp, Homo sapiens
cagagtcagaattaggcacttg

SEQ ID NO: 4806026 - DNA, 12 bp, Homo sapiens
cagagtcattgt

SEQ ID NO: 4806027 - DNA, 22 bp, Homo sapiens
cagagtgatttgtaaaacagtg

SEQ ID NO: 4806028 - DNA, 20 bp, Homo sapiens
cagagtggactcttccctct

SEQ ID NO: 4806029 - DNA, 21 bp, Homo sapiens
cagagtggactcttccctctc

SEQ ID NO: 4806030 - DNA, 20 bp, Homo sapiens
cagagtgtatgcatacaaat

SEQ ID NO: 4806031 - DNA, 16 bp, Homo sapiens
cagagtgtcctgctac

SEQ ID NO: 4806032 - DNA, 19 bp, Homo sapiens
cagagtgtcctgctacctt

SEQ ID NO: 4806033 - DNA, 16 bp, Homo sapiens
cagagttgaagacaga

SEQ ID NO: 4806034 - DNA, 20 bp, Homo sapiens
cagagttgaagacagagcta

SEQ ID NO: 4806035 - DNA, 16 bp, Homo sapiens
cagataaatcatgggc

SEQ ID NO: 4806036 - DNA, 14 bp, Homo sapiens
cagatacctgtgag

SEQ ID NO: 4806037 - DNA, 17 bp, Homo sapiens
cagatacctgtgaggac

SEQ ID NO: 4806038 - DNA, 20 bp, Homo sapiens
cagatatctatggcagcaca

SEQ ID NO: 4806039 - DNA, 14 bp, Homo sapiens
cagatcaatgacat

SEQ ID NO: 4806040 - DNA, 17 bp, Homo sapiens
cagatcacatgcccctc

SEQ ID NO: 4806041 - DNA, 21 bp, Homo sapiens
cagatcacatgcccctcttag

SEQ ID NO: 4806042 - DNA, 14 bp, Homo sapiens
cagatccctcggtc

SEQ ID NO: 4806043 - DNA, 19 bp, Homo sapiens
cagatcctctttccccact

SEQ ID NO: 4806044 - DNA, 18 bp, Homo sapiens
cagatctagccaggcctc

SEQ ID NO: 4806045 - DNA, 19 bp, Homo sapiens
cagatctgcactcctgtct

SEQ ID NO: 4806046 - DNA, 12 bp, Homo sapiens
cagatcttgagc

SEQ ID NO: 4806047 - DNA, 21 bp, Homo sapiens
cagatgacagggagctgggga

SEQ ID NO: 4806048 - DNA, 19 bp, Homo sapiens
cagatgcaacctcactatg

SEQ ID NO: 4806049 - DNA, 21 bp, Homo sapiens
cagatggaaagacgtttttgt

SEQ ID NO: 4806050 - DNA, 16 bp, Homo sapiens
cagatgggggcctctc

SEQ ID NO: 4806051 - DNA, 17 bp, Homo sapiens
cagatgggggcctctct

SEQ ID NO: 4806052 - DNA, 23 bp, Homo sapiens
cagatgggggcctctctggaaga

SEQ ID NO: 4806053 - DNA, 15 bp, Homo sapiens
cagattattttctat

SEQ ID NO: 4806054 - DNA, 16 bp, Homo sapiens
cagattattttctata

SEQ ID NO: 4806055 - DNA, 19 bp, Homo sapiens
cagcaaaaccattgcttca

SEQ ID NO: 4806056 - DNA, 18 bp, Homo sapiens
cagcaaaatatatgtttg

SEQ ID NO: 4806057 - DNA, 15 bp, Homo sapiens
cagcaaagttttcag

SEQ ID NO: 4806058 - DNA, 16 bp, Homo sapiens
cagcaaagttttcaga

SEQ ID NO: 4806059 - DNA, 10 bp, Homo sapiens
cagcaaccct

SEQ ID NO: 4806060 - DNA, 23 bp, Homo sapiens
cagcaagtgctgagtctgtgaat

SEQ ID NO: 4806061 - DNA, 15 bp, Homo sapiens
cagcacaaagcactg

SEQ ID NO: 4806062 - DNA, 15 bp, Homo sapiens
cagcacagtcttttc

SEQ ID NO: 4806063 - DNA, 15 bp, Homo sapiens
cagcacatgctggcc

SEQ ID NO: 4806064 - DNA, 17 bp, Homo sapiens
cagcacatgctggccag

SEQ ID NO: 4806065 - DNA, 18 bp, Homo sapiens
cagcaccagcctgagcca

SEQ ID NO: 4806066 - DNA, 19 bp, Homo sapiens
cagcaccagcctgagccac

SEQ ID NO: 4806067 - DNA, 17 bp, Homo sapiens
cagcaccatctctcctc

SEQ ID NO: 4806068 - DNA, 18 bp, Homo sapiens
cagcaccctctcctgggg

SEQ ID NO: 4806069 - DNA, 23 bp, Homo sapiens
cagcaccctctcctgggggtggc

SEQ ID NO: 4806070 - DNA, 21 bp, Homo sapiens
cagcaccgtggtgtgaggccc

SEQ ID NO: 4806071 - DNA, 15 bp, Homo sapiens
cagcacctcctccgt

SEQ ID NO: 4806072 - DNA, 19 bp, Homo sapiens
cagcactaaggccgtgtct

SEQ ID NO: 4806073 - DNA, 21 bp, Homo sapiens
cagcactaaggccgtgtctct

SEQ ID NO: 4806074 - DNA, 22 bp, Homo sapiens
cagcactaaggccgtgtctctg

SEQ ID NO: 4806075 - DNA, 18 bp, Homo sapiens
cagcactaattagtgtcc

SEQ ID NO: 4806076 - DNA, 21 bp, Homo sapiens
cagcactaattagtgtccaac

SEQ ID NO: 4806077 - DNA, 15 bp, Homo sapiens
cagcactcccagggc

SEQ ID NO: 4806078 - DNA, 12 bp, Homo sapiens
cagcagcagcag

SEQ ID NO: 4806079 - DNA, 15 bp, Homo sapiens
cagcagccccccagc

SEQ ID NO: 4806080 - DNA, 15 bp, Homo sapiens
atagtatacacatca

SEQ ID NO: 4806081 - DNA, 20 bp, Homo sapiens
atagtatgcactatatacat

SEQ ID NO: 4806082 - DNA, 17 bp, Homo sapiens
atagtcaatcaaacagg

SEQ ID NO: 4806083 - DNA, 16 bp, Homo sapiens
atagtcatatgtgaag

SEQ ID NO: 4806084 - DNA, 14 bp, Homo sapiens
atagtggtatttta

SEQ ID NO: 4806085 - DNA, 22 bp, Homo sapiens
atagtgtgttgtgctttcaaga

SEQ ID NO: 4806086 - DNA, 13 bp, Homo sapiens
atagtgttgtgtt

SEQ ID NO: 4806087 - DNA, 14 bp, Homo sapiens
atagtgttgtgtta

SEQ ID NO: 4806088 - DNA, 23 bp, Homo sapiens
atagtgtttcgttaagcagtaca

SEQ ID NO: 4806089 - DNA, 15 bp, Homo sapiens
atagttacaagcatt

SEQ ID NO: 4806090 - DNA, 12 bp, Homo sapiens
atagttccattc

SEQ ID NO: 4806091 - DNA, 19 bp, Homo sapiens
atagttccattctatgact

SEQ ID NO: 4806092 - DNA, 12 bp, Homo sapiens
atagttctgcaa

SEQ ID NO: 4806093 - DNA, 15 bp, Homo sapiens
atccagtttgttctc

SEQ ID NO: 4806094 - DNA, 20 bp, Homo sapiens
atccagtttgttctccgggt

SEQ ID NO: 4806095 - DNA, 17 bp, Homo sapiens
atccataccccctgccc

SEQ ID NO: 4806096 - DNA, 20 bp, Homo sapiens
atccataccccctgccccag

SEQ ID NO: 4806097 - DNA, 23 bp, Homo sapiens
atccataccccctgccccagaga

SEQ ID NO: 4806098 - DNA, 15 bp, Homo sapiens
atccatatcagctct

SEQ ID NO: 4806099 - DNA, 19 bp, Homo sapiens
atccatccttttgcttcat

SEQ ID NO: 4806100 - DNA, 18 bp, Homo sapiens
atccatcgatttgtatta

SEQ ID NO: 4806101 - DNA, 17 bp, Homo sapiens
atccatgtgctgctgtg

SEQ ID NO: 4806102 - DNA, 12 bp, Homo sapiens
atccatgtgtcc

SEQ ID NO: 4806103 - DNA, 13 bp, Homo sapiens
atccatgtgtccc

SEQ ID NO: 4806104 - DNA, 20 bp, Homo sapiens
atccatgtgtcccccctgtg

SEQ ID NO: 4806105 - DNA, 14 bp, Homo sapiens
atccatttaaaaca

SEQ ID NO: 4806106 - DNA, 21 bp, Homo sapiens
atccatttaaaacaagctgat

SEQ ID NO: 4806107 - DNA, 19 bp, Homo sapiens
atcccaagttggaagggac

SEQ ID NO: 4806108 - DNA, 18 bp, Homo sapiens
atcccatatgcctgggca

SEQ ID NO: 4806109 - DNA, 24 bp, Homo sapiens
atcccatatgcctgggcagaagga

SEQ ID NO: 4806110 - DNA, 19 bp, Homo sapiens
atcccccaaacagcatgtg

SEQ ID NO: 4806111 - DNA, 19 bp, Homo sapiens
atccccgtgctcacagtag

SEQ ID NO: 4806112 - DNA, 23 bp, Homo sapiens
atcccctaactgatttccatcca

SEQ ID NO: 4806113 - DNA, 17 bp, Homo sapiens
atccctccaccccagtc

SEQ ID NO: 4806114 - DNA, 18 bp, Homo sapiens
atccctccaccccagtcc

SEQ ID NO: 4806115 - DNA, 22 bp, Homo sapiens
atccctccaccccagtccccgg

SEQ ID NO: 4806116 - DNA, 17 bp, Homo sapiens
atccctcggtcagcacc

SEQ ID NO: 4806117 - DNA, 18 bp, Homo sapiens
atccctcggtcagcaccg

SEQ ID NO: 4806118 - DNA, 11 bp, Homo sapiens
atccctgggcc

SEQ ID NO: 4806119 - DNA, 15 bp, Homo sapiens
atccctgggcccctc

SEQ ID NO: 4806120 - DNA, 18 bp, Homo sapiens
atccctggtgaaagagta

SEQ ID NO: 4806121 - DNA, 20 bp, Homo sapiens
atccctggtgaaagagtaaa

SEQ ID NO: 4806122 - DNA, 12 bp, Homo sapiens
atccctgttcat

SEQ ID NO: 4806123 - DNA, 14 bp, Homo sapiens
atccctgttcattg

SEQ ID NO: 4806124 - DNA, 13 bp, Homo sapiens
atcccttctcaca

SEQ ID NO: 4806125 - DNA, 17 bp, Homo sapiens
atcccttctcacagcac

SEQ ID NO: 4806126 - DNA, 17 bp, Homo sapiens
atcccttggcccctctc

SEQ ID NO: 4806127 - DNA, 13 bp, Homo sapiens
atccgagcccctg

SEQ ID NO: 4806128 - DNA, 14 bp, Homo sapiens
atcctcacacagat

SEQ ID NO: 4806129 - DNA, 21 bp, Homo sapiens
atcctcactgagaaggcccca

SEQ ID NO: 4806130 - DNA, 19 bp, Homo sapiens
atcctcagccccagggccc

SEQ ID NO: 4806131 - DNA, 21 bp, Homo sapiens
atcctcagccccagggccctg

SEQ ID NO: 4806132 - DNA, 22 bp, Homo sapiens
atcctcagccccagggccctgc

SEQ ID NO: 4806133 - DNA, 23 bp, Homo sapiens
atcctcagccccagggccctgct

SEQ ID NO: 4806134 - DNA, 16 bp, Homo sapiens
atcctccgcggaggcc

SEQ ID NO: 4806135 - DNA, 20 bp, Homo sapiens
atcctccgcggaggcccctg

SEQ ID NO: 4806136 - DNA, 23 bp, Homo sapiens
atcctctgcttgtcattctgcta

SEQ ID NO: 4806137 - DNA, 12 bp, Homo sapiens
atcctgacagcg

SEQ ID NO: 4806138 - DNA, 13 bp, Homo sapiens
atcctgacagcgc

SEQ ID NO: 4806139 - DNA, 22 bp, Homo sapiens
atcctgacagcgccatgtgtgt

SEQ ID NO: 4806140 - DNA, 17 bp, Homo sapiens
atcctgccttcatggaa

SEQ ID NO: 4806141 - DNA, 21 bp, Homo sapiens
atcctgccttcatggaactca

SEQ ID NO: 4806142 - DNA, 11 bp, Homo sapiens
atcctggcctg

SEQ ID NO: 4806143 - DNA, 14 bp, Homo sapiens
atccttactttatc

SEQ ID NO: 4806144 - DNA, 23 bp, Homo sapiens
atccttcaaagtctcaatgaaat

SEQ ID NO: 4806145 - DNA, 21 bp, Homo sapiens
atccttcaggtcccctggccc

SEQ ID NO: 4806146 - DNA, 22 bp, Homo sapiens
atccttcccaacgtactcctca

SEQ ID NO: 4806147 - DNA, 15 bp, Homo sapiens
atccttcccgcagca

SEQ ID NO: 4806148 - DNA, 18 bp, Homo sapiens
atccttcccgcagcacca

SEQ ID NO: 4806149 - DNA, 19 bp, Homo sapiens
atccttcccgcagcaccag

SEQ ID NO: 4806150 - DNA, 24 bp, Homo sapiens
atccttcccgcagcaccagcctga

SEQ ID NO: 4806151 - DNA, 15 bp, Homo sapiens
atccttgtcagttgt

SEQ ID NO: 4806152 - DNA, 15 bp, Homo sapiens
atccttttttccttt

SEQ ID NO: 4806153 - DNA, 14 bp, Homo sapiens
atcgacctcactgt

SEQ ID NO: 4806154 - DNA, 21 bp, Homo sapiens
atcgatgggggatgcttcatg

SEQ ID NO: 4806155 - DNA, 13 bp, Homo sapiens
atcgccctgagct

SEQ ID NO: 4806156 - DNA, 17 bp, Homo sapiens
atcggtgtccatttata

SEQ ID NO: 4806157 - DNA, 15 bp, Homo sapiens
atcgttatcactgtg

SEQ ID NO: 4806158 - DNA, 17 bp, Homo sapiens
atcgtttcacatctgta

SEQ ID NO: 4806159 - DNA, 16 bp, Homo sapiens
atctaacattattact

SEQ ID NO: 4806160 - DNA, 19 bp, Homo sapiens
atctaacattattactttt

SEQ ID NO: 4806161 - DNA, 16 bp, Homo sapiens
atctaatttttattaa

SEQ ID NO: 4806162 - DNA, 18 bp, Homo sapiens
atctaatttttattaatt

SEQ ID NO: 4806163 - DNA, 12 bp, Homo sapiens
atctacaaactt

SEQ ID NO: 4806164 - DNA, 15 bp, Homo sapiens
atctacaaactttta

SEQ ID NO: 4806165 - DNA, 22 bp, Homo sapiens
atctaccttccagtcaggatga

SEQ ID NO: 4806166 - DNA, 17 bp, Homo sapiens
atctactcttaaatata

SEQ ID NO: 4806167 - DNA, 20 bp, Homo sapiens
atctagaagagtctattgtc

SEQ ID NO: 4806168 - DNA, 18 bp, Homo sapiens
atctagagctatgcacac

SEQ ID NO: 4806169 - DNA, 15 bp, Homo sapiens
atctagccaggcctc

SEQ ID NO: 4806170 - DNA, 16 bp, Homo sapiens
atctagtgctaaacct

SEQ ID NO: 4806171 - DNA, 14 bp, Homo sapiens
atctatatatacat

SEQ ID NO: 4806172 - DNA, 16 bp, Homo sapiens
atctatatatacatat

SEQ ID NO: 4806173 - DNA, 16 bp, Homo sapiens
atctatctggtgattt

SEQ ID NO: 4806174 - DNA, 20 bp, Homo sapiens
atctatctggtgatttctag

SEQ ID NO: 4806175 - DNA, 16 bp, Homo sapiens
atctatgggaaatcta

SEQ ID NO: 4806176 - DNA, 17 bp, Homo sapiens
atctatgggaaatctag

SEQ ID NO: 4806177 - DNA, 18 bp, Homo sapiens
atctatgggaaatctagg

SEQ ID NO: 4806178 - DNA, 23 bp, Homo sapiens
atctattcccatcgctggaaaac

SEQ ID NO: 4806179 - DNA, 17 bp, Homo sapiens
atctcaaacactgctta

SEQ ID NO: 4806180 - DNA, 14 bp, Homo sapiens
atctcactgtatta

SEQ ID NO: 4806181 - DNA, 17 bp, Homo sapiens
atctcactgtattaaag

SEQ ID NO: 4806182 - DNA, 10 bp, Homo sapiens
atctcagcac

SEQ ID NO: 4806183 - DNA, 20 bp, Homo sapiens
atctcagcatcctggaaatt

SEQ ID NO: 4806184 - DNA, 18 bp, Homo sapiens
atctcaggtggcatttgc

SEQ ID NO: 4806185 - DNA, 19 bp, Homo sapiens
atctcaggtggcatttgca

SEQ ID NO: 4806186 - DNA, 18 bp, Homo sapiens
atctcatacctctgacca

SEQ ID NO: 4806187 - DNA, 13 bp, Homo sapiens
atctcatcatgtc

SEQ ID NO: 4806188 - DNA, 19 bp, Homo sapiens
atctcatcatgtctattgt

SEQ ID NO: 4806189 - DNA, 19 bp, Homo sapiens
atctcatccccaaactgta

SEQ ID NO: 4806190 - DNA, 17 bp, Homo sapiens
atctccagccaatttca

SEQ ID NO: 4806191 - DNA, 21 bp, Homo sapiens
atctccagccaatttcaaaga

SEQ ID NO: 4806192 - DNA, 15 bp, Homo sapiens
atctccaggcccagc

SEQ ID NO: 4806193 - DNA, 16 bp, Homo sapiens
atctccaggcccagcc

SEQ ID NO: 4806194 - DNA, 13 bp, Homo sapiens
atctcctgtaatt

SEQ ID NO: 4806195 - DNA, 21 bp, Homo sapiens
atctctaaaatgctgttctca

SEQ ID NO: 4806196 - DNA, 13 bp, Homo sapiens
atctctatataaa

SEQ ID NO: 4806197 - DNA, 16 bp, Homo sapiens
atctctcaaaatgtgc

SEQ ID NO: 4806198 - DNA, 20 bp, Homo sapiens
atctctccacggtagcactt

SEQ ID NO: 4806199 - DNA, 12 bp, Homo sapiens
atctctgtaaaa

SEQ ID NO: 4806200 - DNA, 21 bp, Homo sapiens
atctctgtgactcgcttagct

SEQ ID NO: 4806201 - DNA, 20 bp, Homo sapiens
atctcttaagacagcatgtg

SEQ ID NO: 4806202 - DNA, 23 bp, Homo sapiens
atctcttaagacagcatgtgtta

SEQ ID NO: 4806203 - DNA, 15 bp, Homo sapiens
atctcttcttataca

SEQ ID NO: 4806204 - DNA, 17 bp, Homo sapiens
atctcttcttatacaga

SEQ ID NO: 4806205 - DNA, 22 bp, Homo sapiens
atctctttctaaagacaggaga

SEQ ID NO: 4806206 - DNA, 14 bp, Homo sapiens
atctgaaaactgga

SEQ ID NO: 4806207 - DNA, 15 bp, Homo sapiens
atctgaaaactggaa

SEQ ID NO: 4806208 - DNA, 23 bp, Homo sapiens
atctgaaagttttgatacttgta

SEQ ID NO: 4806209 - DNA, 13 bp, Homo sapiens
atctgaaatctac

SEQ ID NO: 4806210 - DNA, 14 bp, Homo sapiens
atctgaaatctaca

SEQ ID NO: 4806211 - DNA, 23 bp, Homo sapiens
atctgaagccttttcctgaggtc

SEQ ID NO: 4806212 - DNA, 16 bp, Homo sapiens
atctgaggagtccaaa

SEQ ID NO: 4806213 - DNA, 17 bp, Homo sapiens
atctgatgatgttctga

SEQ ID NO: 4806214 - DNA, 13 bp, Homo sapiens
atctgatttctga

SEQ ID NO: 4806215 - DNA, 21 bp, Homo sapiens
atctgctatttttaatttcct

SEQ ID NO: 4806216 - DNA, 22 bp, Homo sapiens
atctggagtccctcctccccca

SEQ ID NO: 4806217 - DNA, 18 bp, Homo sapiens
atctggcctatgaccctg

SEQ ID NO: 4806218 - DNA, 23 bp, Homo sapiens
atctggcctatgaccctgtgcct

SEQ ID NO: 4806219 - DNA, 17 bp, Homo sapiens
atctggcctggcctggc

SEQ ID NO: 4806220 - DNA, 18 bp, Homo sapiens
atctggcctggcctggcc

SEQ ID NO: 4806221 - DNA, 14 bp, Homo sapiens
atctggcttctgca

SEQ ID NO: 4806222 - DNA, 19 bp, Homo sapiens
atctggcttctgcattact

SEQ ID NO: 4806223 - DNA, 16 bp, Homo sapiens
atctgggttttagaaa

SEQ ID NO: 4806224 - DNA, 21 bp, Homo sapiens
atctgggttttagaaattcta

SEQ ID NO: 4806225 - DNA, 22 bp, Homo sapiens
atctgggttttagaaattctat

SEQ ID NO: 4806226 - DNA, 17 bp, Homo sapiens
atctggtgcgtgtggcc

SEQ ID NO: 4806227 - DNA, 23 bp, Homo sapiens
atctggtgcgtgtggccctgtgg

SEQ ID NO: 4806228 - DNA, 16 bp, Homo sapiens
atctgtaaaaccaggc

SEQ ID NO: 4806229 - DNA, 12 bp, Homo sapiens
atctgtaaaata

SEQ ID NO: 4806230 - DNA, 16 bp, Homo sapiens
atctgtaaaatagtct

SEQ ID NO: 4806231 - DNA, 16 bp, Homo sapiens
atctgtataaatgtga

SEQ ID NO: 4806232 - DNA, 18 bp, Homo sapiens
atctgtataatactttgt

SEQ ID NO: 4806233 - DNA, 15 bp, Homo sapiens
atctgtatatcagct

SEQ ID NO: 4806234 - DNA, 21 bp, Homo sapiens
atctgtatatcagctctaaag

SEQ ID NO: 4806235 - DNA, 13 bp, Homo sapiens
atctgtattggca

SEQ ID NO: 4806236 - DNA, 18 bp, Homo sapiens
atctgtattggcagcaca

SEQ ID NO: 4806237 - DNA, 22 bp, Homo sapiens
atctgtattggcagcacagcta

SEQ ID NO: 4806238 - DNA, 22 bp, Homo sapiens
atctgtatttaatggtttttat

SEQ ID NO: 4806239 - DNA, 14 bp, Homo sapiens
atctgtcagcttcc

SEQ ID NO: 4806240 - DNA, 18 bp, Homo sapiens
atctgtcagcttcccaac

SEQ ID NO: 4806241 - DNA, 22 bp, Homo sapiens
atctgtcagcttcccaacaata

SEQ ID NO: 4806242 - DNA, 20 bp, Homo sapiens
atctgtccagacaagccctg

SEQ ID NO: 4806243 - DNA, 19 bp, Homo sapiens
atctgtccgacagtcaaga

SEQ ID NO: 4806244 - DNA, 13 bp, Homo sapiens
atctgtctgagcc

SEQ ID NO: 4806245 - DNA, 18 bp, Homo sapiens
atctgtctgagccctgcc

SEQ ID NO: 4806246 - DNA, 19 bp, Homo sapiens
atctgtctgagccctgccc

SEQ ID NO: 4806247 - DNA, 11 bp, Homo sapiens
atctgtcttta

SEQ ID NO: 4806248 - DNA, 19 bp, Homo sapiens
atctgtctttatgatttca

SEQ ID NO: 4806249 - DNA, 21 bp, Homo sapiens
atctgtctttatgatttcatg

SEQ ID NO: 4806250 - DNA, 20 bp, Homo sapiens
atctgtgaagcctttatcta

SEQ ID NO: 4806251 - DNA, 21 bp, Homo sapiens
atctgtgcagtcatcaacaaa

SEQ ID NO: 4806252 - DNA, 14 bp, Homo sapiens
atctgtgtgtgaat

SEQ ID NO: 4806253 - DNA, 21 bp, Homo sapiens
atctgttctatggaccaaatg

SEQ ID NO: 4806254 - DNA, 11 bp, Homo sapiens
atctgttgtaa

SEQ ID NO: 4806255 - DNA, 14 bp, Homo sapiens
atctgttgtaatat

SEQ ID NO: 4806256 - DNA, 19 bp, Homo sapiens
atctgttgtaatatcagtt

SEQ ID NO: 4806257 - DNA, 22 bp, Homo sapiens
atctgttgtaatatcagttaca

SEQ ID NO: 4806258 - DNA, 23 bp, Homo sapiens
atctgttgtaatatcagttacag

SEQ ID NO: 4806259 - DNA, 19 bp, Homo sapiens
atcttaaaagctatcttca

SEQ ID NO: 4806260 - DNA, 22 bp, Homo sapiens
atcttaaaattggttaatgaaa

SEQ ID NO: 4806261 - DNA, 18 bp, Homo sapiens
atcttaaacccacataaa

SEQ ID NO: 4806262 - DNA, 18 bp, Homo sapiens
atcttacccttcaatgtt

SEQ ID NO: 4806263 - DNA, 14 bp, Homo sapiens
atcttatttatata

SEQ ID NO: 4806264 - DNA, 21 bp, Homo sapiens
atcttcgttagtaatctgtat

SEQ ID NO: 4806265 - DNA, 22 bp, Homo sapiens
atcttcgttagtaatctgtata

SEQ ID NO: 4806266 - DNA, 15 bp, Homo sapiens
atcttgaagaatatt

SEQ ID NO: 4806267 - DNA, 16 bp, Homo sapiens
atcttgaagggcccag

SEQ ID NO: 4806268 - DNA, 17 bp, Homo sapiens
atcttgaagggcccagg

SEQ ID NO: 4806269 - DNA, 18 bp, Homo sapiens
atcttgaattgtaaggaa

SEQ ID NO: 4806270 - DNA, 22 bp, Homo sapiens
atcttgacaggcgccgcctcgc

SEQ ID NO: 4806271 - DNA, 14 bp, Homo sapiens
atcttgagcaaggc

SEQ ID NO: 4806272 - DNA, 12 bp, Homo sapiens
atcttgcctcat

SEQ ID NO: 4806273 - DNA, 19 bp, Homo sapiens
atcttgcctctttcctcct

SEQ ID NO: 4806274 - DNA, 13 bp, Homo sapiens
atcttgctgctta

SEQ ID NO: 4806275 - DNA, 12 bp, Homo sapiens
atcttgctgtga

SEQ ID NO: 4806276 - DNA, 12 bp, Homo sapiens
atcttgtaaata

SEQ ID NO: 4806277 - DNA, 22 bp, Homo sapiens
atcttgtaaataatgcttaaca

SEQ ID NO: 4806278 - DNA, 16 bp, Homo sapiens
atcttgtgcatgcaaa

SEQ ID NO: 4806279 - DNA, 16 bp, Homo sapiens
atcttgttaatttcat

SEQ ID NO: 4806280 - DNA, 20 bp, Homo sapiens
atctttcatcaatcattgta

SEQ ID NO: 4806281 - DNA, 15 bp, Homo sapiens
atctttgatttagag

SEQ ID NO: 4806282 - DNA, 18 bp, Homo sapiens
atctttgttaaaatatag

SEQ ID NO: 4806283 - DNA, 22 bp, Homo sapiens
atcttttcatttaggtgaggaa

SEQ ID NO: 4806284 - DNA, 20 bp, Homo sapiens
atcttttggggtcatctttg

SEQ ID NO: 4806285 - DNA, 15 bp, Homo sapiens
atctttttttaagtg

SEQ ID NO: 4806286 - DNA, 18 bp, Homo sapiens
atgaaaaatctgaatttc

SEQ ID NO: 4806287 - DNA, 15 bp, Homo sapiens
atgaaaagttttcaa

SEQ ID NO: 4806288 - DNA, 16 bp, Homo sapiens
atgaaacaaatatact

SEQ ID NO: 4806289 - DNA, 21 bp, Homo sapiens
atgaaacaaatatactcattt

SEQ ID NO: 4806290 - DNA, 22 bp, Homo sapiens
atgaaagagaaaatgctttctc

SEQ ID NO: 4806291 - DNA, 22 bp, Homo sapiens
atgaaataggagggaaaccttt

SEQ ID NO: 4806292 - DNA, 19 bp, Homo sapiens
atgaaatataaactgtgag

SEQ ID NO: 4806293 - DNA, 15 bp, Homo sapiens
atgaaatatttgctt

SEQ ID NO: 4806294 - DNA, 17 bp, Homo sapiens
atgaaatatttgcttat

SEQ ID NO: 4806295 - DNA, 22 bp, Homo sapiens
atgaaatatttgcttatttata

SEQ ID NO: 4806296 - DNA, 18 bp, Homo sapiens
atgaacgttttctcttca

SEQ ID NO: 4806297 - DNA, 15 bp, Homo sapiens
atgaactaactgcca

SEQ ID NO: 4806298 - DNA, 18 bp, Homo sapiens
atgaactaactgccatgt

SEQ ID NO: 4806299 - DNA, 22 bp, Homo sapiens
atgaagatgcattttaaatgtc

SEQ ID NO: 4806300 - DNA, 20 bp, Homo sapiens
atgaagccctaagtaaatct

SEQ ID NO: 4806301 - DNA, 17 bp, Homo sapiens
atgaaggaatgcaataa

SEQ ID NO: 4806302 - DNA, 22 bp, Homo sapiens
atgaaggggccagaccacgccc

SEQ ID NO: 4806303 - DNA, 15 bp, Homo sapiens
atgaataaaatgttt

SEQ ID NO: 4806304 - DNA, 18 bp, Homo sapiens
atgaataatgcctttgta

SEQ ID NO: 4806305 - DNA, 17 bp, Homo sapiens
atgaatagtacatgcag

SEQ ID NO: 4806306 - DNA, 24 bp, Homo sapiens
atgaatccatcgatttgtattaat

SEQ ID NO: 4806307 - DNA, 23 bp, Homo sapiens
atgaatcgcagacgcaagaggtt

SEQ ID NO: 4806308 - DNA, 13 bp, Homo sapiens
atgaatgaaatat

SEQ ID NO: 4806309 - DNA, 23 bp, Homo sapiens
atgaatgaaatataaactgtgag

SEQ ID NO: 4806310 - DNA, 14 bp, Homo sapiens
atgaatgcagtata

SEQ ID NO: 4806311 - DNA, 20 bp, Homo sapiens
atgaatgcagtataaaatgt

SEQ ID NO: 4806312 - DNA, 20 bp, Homo sapiens
atgaattttaaaagcatata

SEQ ID NO: 4806313 - DNA, 14 bp, Homo sapiens
atgacaagtgactt

SEQ ID NO: 4806314 - DNA, 21 bp, Homo sapiens
atgacaggaacccatcactgt

SEQ ID NO: 4806315 - DNA, 20 bp, Homo sapiens
atgacaggcatccaaggaag

SEQ ID NO: 4806316 - DNA, 16 bp, Homo sapiens
atgacagggagctggg

SEQ ID NO: 4806317 - DNA, 14 bp, Homo sapiens
atgacagtagcata

SEQ ID NO: 4806318 - DNA, 20 bp, Homo sapiens
atgacagtggttatatttca

SEQ ID NO: 4806319 - DNA, 21 bp, Homo sapiens
atgacagtggttatatttcaa

SEQ ID NO: 4806320 - DNA, 14 bp, Homo sapiens
atgacatccacatg

SEQ ID NO: 4806321 - DNA, 15 bp, Homo sapiens
atgacatgcactgac

SEQ ID NO: 4806322 - DNA, 19 bp, Homo sapiens
atgacatgcactgaccctt

SEQ ID NO: 4806323 - DNA, 16 bp, Homo sapiens
atgaccaatctctgtg

SEQ ID NO: 4806324 - DNA, 17 bp, Homo sapiens
atgaccaatctctgtga

SEQ ID NO: 4806325 - DNA, 18 bp, Homo sapiens
atgaccactgggcctgct

SEQ ID NO: 4806326 - DNA, 14 bp, Homo sapiens
atgacgtgcacaaa

SEQ ID NO: 4806327 - DNA, 17 bp, Homo sapiens
atgacgtgcacaaacct

SEQ ID NO: 4806328 - DNA, 14 bp, Homo sapiens
atgactaatcctta

SEQ ID NO: 4806329 - DNA, 23 bp, Homo sapiens
atgactaatccttaataactatg

SEQ ID NO: 4806330 - DNA, 12 bp, Homo sapiens
atgactccagaa

SEQ ID NO: 4806331 - DNA, 14 bp, Homo sapiens
atgactctttattg

SEQ ID NO: 4806332 - DNA, 21 bp, Homo sapiens
atgactggaaacaaggaagga

SEQ ID NO: 4806333 - DNA, 22 bp, Homo sapiens
atgacttaagcacacttgacat

SEQ ID NO: 4806334 - DNA, 20 bp, Homo sapiens
atgacttctttactaacact

SEQ ID NO: 4806335 - DNA, 18 bp, Homo sapiens
atgactttcagattgtat

SEQ ID NO: 4806336 - DNA, 16 bp, Homo sapiens
atgagaaatataaaaa

SEQ ID NO: 4806337 - DNA, 15 bp, Homo sapiens
atgagaaatcatgtt

SEQ ID NO: 4806338 - DNA, 12 bp, Homo sapiens
atgagaaattgt

SEQ ID NO: 4806339 - DNA, 17 bp, Homo sapiens
atgagaactaaatagat

SEQ ID NO: 4806340 - DNA, 18 bp, Homo sapiens
atgagaagtaaattattt

SEQ ID NO: 4806341 - DNA, 16 bp, Homo sapiens
atgagaatctgtgcag

SEQ ID NO: 4806342 - DNA, 15 bp, Homo sapiens
atgagaatgtcattt

SEQ ID NO: 4806343 - DNA, 18 bp, Homo sapiens
atgagaatgtcatttgct

SEQ ID NO: 4806344 - DNA, 15 bp, Homo sapiens
atgagacaacacaca

SEQ ID NO: 4806345 - DNA, 18 bp, Homo sapiens
atgagacctcccccaggg

SEQ ID NO: 4806346 - DNA, 22 bp, Homo sapiens
atgagatactttgcattgtctg

SEQ ID NO: 4806347 - DNA, 16 bp, Homo sapiens
atgagatcccagagtt

SEQ ID NO: 4806348 - DNA, 23 bp, Homo sapiens
atgagatcccagagttatttccc

SEQ ID NO: 4806349 - DNA, 21 bp, Homo sapiens
atgagccaataaagctcacac

SEQ ID NO: 4806350 - DNA, 23 bp, Homo sapiens
atgagcttaatgtctttgtgttt

SEQ ID NO: 4806351 - DNA, 22 bp, Homo sapiens
atgaggaacctcaaactgggta

SEQ ID NO: 4806352 - DNA, 19 bp, Homo sapiens
atgaggctggataggagag

SEQ ID NO: 4806353 - DNA, 16 bp, Homo sapiens
atgagttctgcacata

SEQ ID NO: 4806354 - DNA, 22 bp, Homo sapiens
atgagttctgcacatacagatg

SEQ ID NO: 4806355 - DNA, 15 bp, Homo sapiens
atgagtttatgggaa

SEQ ID NO: 4806356 - DNA, 16 bp, Homo sapiens
atgataaggtttagaa

SEQ ID NO: 4806357 - DNA, 22 bp, Homo sapiens
atgataatagctcacagcacat

SEQ ID NO: 4806358 - DNA, 21 bp, Homo sapiens
atgatactgaattgttatgta

SEQ ID NO: 4806359 - DNA, 12 bp, Homo sapiens
atgatataaaca

SEQ ID NO: 4806360 - DNA, 12 bp, Homo sapiens
atgatatgtgct

SEQ ID NO: 4806361 - DNA, 15 bp, Homo sapiens
atgatatgtgcttgt

SEQ ID NO: 4806362 - DNA, 17 bp, Homo sapiens
atgatattgctgaagaa

SEQ ID NO: 4806363 - DNA, 16 bp, Homo sapiens
atgatcaaaatgcata

SEQ ID NO: 4806364 - DNA, 17 bp, Homo sapiens
atgatccaagtatttta

SEQ ID NO: 4806365 - DNA, 22 bp, Homo sapiens
atgatctgtatttaatggtttt

SEQ ID NO: 4806366 - DNA, 15 bp, Homo sapiens
atgatgattcaatca

SEQ ID NO: 4806367 - DNA, 15 bp, Homo sapiens
atgatgctagttctt

SEQ ID NO: 4806368 - DNA, 22 bp, Homo sapiens
atgatggaagggccttctccac

SEQ ID NO: 4806369 - DNA, 12 bp, Homo sapiens
atgatgttctga

SEQ ID NO: 4806370 - DNA, 17 bp, Homo sapiens
atgatgttctgaaatgg

SEQ ID NO: 4806371 - DNA, 22 bp, Homo sapiens
atgattaaactgggaaatgaga

SEQ ID NO: 4806372 - DNA, 14 bp, Homo sapiens
atgattagacaatg

SEQ ID NO: 4806373 - DNA, 16 bp, Homo sapiens
atgattagacaatgtg

SEQ ID NO: 4806374 - DNA, 22 bp, Homo sapiens
atgattaggcccgccaaacttc

SEQ ID NO: 4806375 - DNA, 14 bp, Homo sapiens
atgattcaatgtga

SEQ ID NO: 4806376 - DNA, 22 bp, Homo sapiens
atgattcaatgtgaattttaaa

SEQ ID NO: 4806377 - DNA, 21 bp, Homo sapiens
atgattccaattactactttg

SEQ ID NO: 4806378 - DNA, 14 bp, Homo sapiens
atgattgtctaacc

SEQ ID NO: 4806379 - DNA, 13 bp, Homo sapiens
atgatttaacatt

SEQ ID NO: 4806380 - DNA, 15 bp, Homo sapiens
atgatttaattctta

SEQ ID NO: 4806381 - DNA, 20 bp, Homo sapiens
atgatttcaatgattgttta

SEQ ID NO: 4806382 - DNA, 13 bp, Homo sapiens
atgcaaaaatgaa

SEQ ID NO: 4806383 - DNA, 15 bp, Homo sapiens
atgcaaaaatgaatt

SEQ ID NO: 4806384 - DNA, 16 bp, Homo sapiens
atgcaaaaatgaattc

SEQ ID NO: 4806385 - DNA, 22 bp, Homo sapiens
atgcaaaaatgaattcacccct

SEQ ID NO: 4806386 - DNA, 17 bp, Homo sapiens
atgcaaagcacacctcg

SEQ ID NO: 4806387 - DNA, 16 bp, Homo sapiens
atgcaaatattgctat

SEQ ID NO: 4806388 - DNA, 15 bp, Homo sapiens
atgcaagaagaatat

SEQ ID NO: 4806389 - DNA, 18 bp, Homo sapiens
atgcaataaagagtaaat

SEQ ID NO: 4806390 - DNA, 19 bp, Homo sapiens
atgcaatttacttggaatt

SEQ ID NO: 4806391 - DNA, 13 bp, Homo sapiens
atgcacaccaaat

SEQ ID NO: 4806392 - DNA, 20 bp, Homo sapiens
atgcacaccaaattgctgag

SEQ ID NO: 4806393 - DNA, 21 bp, Homo sapiens
atgcacaccaaattgctgaga

SEQ ID NO: 4806394 - DNA, 17 bp, Homo sapiens
atgcacacccattcaca

SEQ ID NO: 4806395 - DNA, 16 bp, Homo sapiens
atgcacatgtattctg

SEQ ID NO: 4806396 - DNA, 23 bp, Homo sapiens
atgcacattcatcctcacatgtg

SEQ ID NO: 4806397 - DNA, 17 bp, Homo sapiens
atgcactgacccttcca

SEQ ID NO: 4806398 - DNA, 22 bp, Homo sapiens
atgcactgacccttccagacat

SEQ ID NO: 4806399 - DNA, 23 bp, Homo sapiens
atgcagaccccaccctgtctgca

SEQ ID NO: 4806400 - DNA, 17 bp, Homo sapiens
atgcagatctagccagg

SEQ ID NO: 4806401 - DNA, 14 bp, Homo sapiens
atgcaggttttcta

SEQ ID NO: 4806402 - DNA, 21 bp, Homo sapiens
atgcaggttttctaattgtac

SEQ ID NO: 4806403 - DNA, 16 bp, Homo sapiens
atgcagtataaaatgt

SEQ ID NO: 4806404 - DNA, 18 bp, Homo sapiens
atgcagtataaaatgtaa

SEQ ID NO: 4806405 - DNA, 14 bp, Homo sapiens
atgcatctgaaagt

SEQ ID NO: 4806406 - DNA, 18 bp, Homo sapiens
atgcatctgtggcctggg

SEQ ID NO: 4806407 - DNA, 17 bp, Homo sapiens
atgcatgagaactaaat

SEQ ID NO: 4806408 - DNA, 18 bp, Homo sapiens
atgcatgagaactaaata

SEQ ID NO: 4806409 - DNA, 14 bp, Homo sapiens
atgcatgagcacct

SEQ ID NO: 4806410 - DNA, 22 bp, Homo sapiens
atgcatgagcacctttctggct

SEQ ID NO: 4806411 - DNA, 13 bp, Homo sapiens
atgcatgagctcc

SEQ ID NO: 4806412 - DNA, 14 bp, Homo sapiens
atgcatgagctccc

SEQ ID NO: 4806413 - DNA, 16 bp, Homo sapiens
atgcatgagctccctc

SEQ ID NO: 4806414 - DNA, 13 bp, Homo sapiens
atgcatggcctcc

SEQ ID NO: 4806415 - DNA, 20 bp, Homo sapiens
atgcatggcctcccagccac

SEQ ID NO: 4806416 - DNA, 13 bp, Homo sapiens
atgcatgtagcat

SEQ ID NO: 4806417 - DNA, 14 bp, Homo sapiens
atgcatgtagcata

SEQ ID NO: 4806418 - DNA, 16 bp, Homo sapiens
atgcatttatgcatga

SEQ ID NO: 4806419 - DNA, 17 bp, Homo sapiens
atgcattttaaatgtct

SEQ ID NO: 4806420 - DNA, 18 bp, Homo sapiens
atgcattttaaatgtcta

SEQ ID NO: 4806421 - DNA, 21 bp, Homo sapiens
atgcattttaaatgtctataa

SEQ ID NO: 4806422 - DNA, 19 bp, Homo sapiens
atgccaagactctatgctc

SEQ ID NO: 4806423 - DNA, 16 bp, Homo sapiens
atgccaagcacttcag

SEQ ID NO: 4806424 - DNA, 22 bp, Homo sapiens
atgccaaggaccttttgctgcc

SEQ ID NO: 4806425 - DNA, 13 bp, Homo sapiens
atgccaatgtcca

SEQ ID NO: 4806426 - DNA, 15 bp, Homo sapiens
atgccaccacccacc

SEQ ID NO: 4806427 - DNA, 18 bp, Homo sapiens
atgccaccacccacccca

SEQ ID NO: 4806428 - DNA, 21 bp, Homo sapiens
atgccagacttctaaaataaa

SEQ ID NO: 4806429 - DNA, 22 bp, Homo sapiens
atgccagacttctaaaataaat

SEQ ID NO: 4806430 - DNA, 13 bp, Homo sapiens
atgccagggacat

SEQ ID NO: 4806431 - DNA, 21 bp, Homo sapiens
atgccatgaggaacaaggcaa

SEQ ID NO: 4806432 - DNA, 21 bp, Homo sapiens
atgcccagcttggagtgccac

SEQ ID NO: 4806433 - DNA, 22 bp, Homo sapiens
atgcccaggaagtaattttctt

SEQ ID NO: 4806434 - DNA, 21 bp, Homo sapiens
atgccctccctgctgccaggc

SEQ ID NO: 4806435 - DNA, 13 bp, Homo sapiens
atgccgtgcgggc

SEQ ID NO: 4806436 - DNA, 13 bp, Homo sapiens
atgcctctctcag

SEQ ID NO: 4806437 - DNA, 15 bp, Homo sapiens
atgcctctctcaggc

SEQ ID NO: 4806438 - DNA, 17 bp, Homo sapiens
atgcctctctcaggcca

SEQ ID NO: 4806439 - DNA, 19 bp, Homo sapiens
atgcctctctcaggccaaa

SEQ ID NO: 4806440 - DNA, 21 bp, Homo sapiens
atgcctctgatatgggactga

SEQ ID NO: 4806441 - DNA, 15 bp, Homo sapiens
atgcgcaatgtggca

SEQ ID NO: 4806442 - DNA, 16 bp, Homo sapiens
atgcgcaatgtggcat

SEQ ID NO: 4806443 - DNA, 20 bp, Homo sapiens
atgctaaatgcaaacactgt

SEQ ID NO: 4806444 - DNA, 14 bp, Homo sapiens
atgctaacctgtgg

SEQ ID NO: 4806445 - DNA, 19 bp, Homo sapiens
atgctaacctgtggaaagt

SEQ ID NO: 4806446 - DNA, 21 bp, Homo sapiens
atgctatctcgctagccatat

SEQ ID NO: 4806447 - DNA, 17 bp, Homo sapiens
atgctatggactgcaca

SEQ ID NO: 4806448 - DNA, 20 bp, Homo sapiens
atgctcaatgtgctgttgat

SEQ ID NO: 4806449 - DNA, 21 bp, Homo sapiens
atgctcaatgtgctgttgatt

SEQ ID NO: 4806450 - DNA, 18 bp, Homo sapiens
atgctcagtattgagaca

SEQ ID NO: 4806451 - DNA, 22 bp, Homo sapiens
atgctctggaaaacctgaggcc

SEQ ID NO: 4806452 - DNA, 17 bp, Homo sapiens
atgctctttcaccctgc

SEQ ID NO: 4806453 - DNA, 20 bp, Homo sapiens
atgctgcctgccatgtgtga

SEQ ID NO: 4806454 - DNA, 23 bp, Homo sapiens
atgctgcctgcctccggccctgc

SEQ ID NO: 4806455 - DNA, 15 bp, Homo sapiens
atgctgctgagcaca

SEQ ID NO: 4806456 - DNA, 11 bp, Homo sapiens
atgctgctttg

SEQ ID NO: 4806457 - DNA, 17 bp, Homo sapiens
atgctggccagcaccct

SEQ ID NO: 4806458 - DNA, 12 bp, Homo sapiens
attaaatttatt

SEQ ID NO: 4806459 - DNA, 14 bp, Homo sapiens
attaacaaattcag

SEQ ID NO: 4806460 - DNA, 18 bp, Homo sapiens
attaacaattaattgtct

SEQ ID NO: 4806461 - DNA, 13 bp, Homo sapiens
attaactctgcat

SEQ ID NO: 4806462 - DNA, 23 bp, Homo sapiens
attaactctgcatagacaaaggc

SEQ ID NO: 4806463 - DNA, 18 bp, Homo sapiens
attaagcacattattgta

SEQ ID NO: 4806464 - DNA, 23 bp, Homo sapiens
attaagcacattattgtagagaa

SEQ ID NO: 4806465 - DNA, 22 bp, Homo sapiens
attaagtattccttggcccagc

SEQ ID NO: 4806466 - DNA, 17 bp, Homo sapiens
attaagtgttgtacaat

SEQ ID NO: 4806467 - DNA, 18 bp, Homo sapiens
attaagttataccagcaa

SEQ ID NO: 4806468 - DNA, 16 bp, Homo sapiens
attaagttattaacat

SEQ ID NO: 4806469 - DNA, 22 bp, Homo sapiens
attaatagtaggattattccta

SEQ ID NO: 4806470 - DNA, 23 bp, Homo sapiens
attaatagtaggattattcctag

SEQ ID NO: 4806471 - DNA, 17 bp, Homo sapiens
attaatatttgtttagt

SEQ ID NO: 4806472 - DNA, 17 bp, Homo sapiens
attaatggaaaactgtt

SEQ ID NO: 4806473 - DNA, 13 bp, Homo sapiens
attaatttctgcc

SEQ ID NO: 4806474 - DNA, 21 bp, Homo sapiens
attaatttctgccatttcatg

SEQ ID NO: 4806475 - DNA, 22 bp, Homo sapiens
attaatttctgccatttcatgt

SEQ ID NO: 4806476 - DNA, 12 bp, Homo sapiens
attaatttgtgt

SEQ ID NO: 4806477 - DNA, 20 bp, Homo sapiens
attacaacaagcaaactgaa

SEQ ID NO: 4806478 - DNA, 23 bp, Homo sapiens
attacaacaagcaaactgaaatt

SEQ ID NO: 4806479 - DNA, 17 bp, Homo sapiens
attacaggaagtactgg

SEQ ID NO: 4806480 - DNA, 22 bp, Homo sapiens
attacataaataaattaaataa

SEQ ID NO: 4806481 - DNA, 15 bp, Homo sapiens
attacataacaggca

SEQ ID NO: 4806482 - DNA, 14 bp, Homo sapiens
attacatcctctgc

SEQ ID NO: 4806483 - DNA, 12 bp, Homo sapiens
attacatgcatg

SEQ ID NO: 4806484 - DNA, 13 bp, Homo sapiens
attacatgcatga

SEQ ID NO: 4806485 - DNA, 18 bp, Homo sapiens
attacatgcatgagcacc

SEQ ID NO: 4806486 - DNA, 13 bp, Homo sapiens
attaccctcagaa

SEQ ID NO: 4806487 - DNA, 14 bp, Homo sapiens
attaccctcagaat

SEQ ID NO: 4806488 - DNA, 16 bp, Homo sapiens
attacctgaaagccct

SEQ ID NO: 4806489 - DNA, 22 bp, Homo sapiens
attacctgaattttggctgtgt

SEQ ID NO: 4806490 - DNA, 18 bp, Homo sapiens
attactaaagacagaaaa

SEQ ID NO: 4806491 - DNA, 15 bp, Homo sapiens
attactattaactct

SEQ ID NO: 4806492 - DNA, 16 bp, Homo sapiens
attactattaactctg

SEQ ID NO: 4806493 - DNA, 17 bp, Homo sapiens
attactgtgagaactgt

SEQ ID NO: 4806494 - DNA, 18 bp, Homo sapiens
attactgtgagaactgtg

SEQ ID NO: 4806495 - DNA, 19 bp, Homo sapiens
attactgtgagaactgtga

SEQ ID NO: 4806496 - DNA, 23 bp, Homo sapiens
attactgtttgaaacttttcaag

SEQ ID NO: 4806497 - DNA, 13 bp, Homo sapiens
attagaagaaaat

SEQ ID NO: 4806498 - DNA, 19 bp, Homo sapiens
attagaattaccatttgtt

SEQ ID NO: 4806499 - DNA, 16 bp, Homo sapiens
attagacacacatata

SEQ ID NO: 4806500 - DNA, 19 bp, Homo sapiens
attagacacacatatacat

SEQ ID NO: 4806501 - DNA, 20 bp, Homo sapiens
attagacacacatatacatt

SEQ ID NO: 4806502 - DNA, 15 bp, Homo sapiens
attagatgactgaat

SEQ ID NO: 4806503 - DNA, 22 bp, Homo sapiens
attagcaccagcttgcttctct

SEQ ID NO: 4806504 - DNA, 18 bp, Homo sapiens
attagcagtccctccaca

SEQ ID NO: 4806505 - DNA, 15 bp, Homo sapiens
attagctgtgatttt

SEQ ID NO: 4806506 - DNA, 21 bp, Homo sapiens
attaggaacagagtatatatg

SEQ ID NO: 4806507 - DNA, 22 bp, Homo sapiens
attaggaacagagtatatatgt

SEQ ID NO: 4806508 - DNA, 17 bp, Homo sapiens
attagggctctaatttc

SEQ ID NO: 4806509 - DNA, 14 bp, Homo sapiens
attaggttaagtct

SEQ ID NO: 4806510 - DNA, 16 bp, Homo sapiens
attaggttaagtctca

SEQ ID NO: 4806511 - DNA, 16 bp, Homo sapiens
attaggtttagaatca

SEQ ID NO: 4806512 - DNA, 20 bp, Homo sapiens
attagtgagatttgtattta

SEQ ID NO: 4806513 - DNA, 12 bp, Homo sapiens
attagtgttttc

SEQ ID NO: 4806514 - DNA, 19 bp, Homo sapiens
attagtgttttcattctgg

SEQ ID NO: 4806515 - DNA, 15 bp, Homo sapiens
attataatgcatcta

SEQ ID NO: 4806516 - DNA, 17 bp, Homo sapiens
attatacatgaaattca

SEQ ID NO: 4806517 - DNA, 16 bp, Homo sapiens
attatactgtgtgtga

SEQ ID NO: 4806518 - DNA, 18 bp, Homo sapiens
attatacttctttattca

SEQ ID NO: 4806519 - DNA, 20 bp, Homo sapiens
attatatatacattagacac

SEQ ID NO: 4806520 - DNA, 23 bp, Homo sapiens
attatattcccaaatctcaaaag

SEQ ID NO: 4806521 - DNA, 19 bp, Homo sapiens
attatattgttttataaat

SEQ ID NO: 4806522 - DNA, 20 bp, Homo sapiens
attatattgttttataaatg

SEQ ID NO: 4806523 - DNA, 14 bp, Homo sapiens
attatattttataa

SEQ ID NO: 4806524 - DNA, 19 bp, Homo sapiens
attatcaaaaaacagaaaa

SEQ ID NO: 4806525 - DNA, 16 bp, Homo sapiens
attatcagtgaatata

SEQ ID NO: 4806526 - DNA, 12 bp, Homo sapiens
attatcattgtt

SEQ ID NO: 4806527 - DNA, 21 bp, Homo sapiens
attatcctcaagttgtgtgct

SEQ ID NO: 4806528 - DNA, 23 bp, Homo sapiens
attatctagtaggtctgcacaca

SEQ ID NO: 4806529 - DNA, 14 bp, Homo sapiens
attatctgttctat

SEQ ID NO: 4806530 - DNA, 19 bp, Homo sapiens
attatcttaaacccacata

SEQ ID NO: 4806531 - DNA, 15 bp, Homo sapiens
attatctttaaaact

SEQ ID NO: 4806532 - DNA, 15 bp, Homo sapiens
attatgcttcttgga

SEQ ID NO: 4806533 - DNA, 16 bp, Homo sapiens
attatgtcaaatggat

SEQ ID NO: 4806534 - DNA, 17 bp, Homo sapiens
attattaaaaattatag

SEQ ID NO: 4806535 - DNA, 21 bp, Homo sapiens
attattacaacaagcaaactg

SEQ ID NO: 4806536 - DNA, 13 bp, Homo sapiens
attattactttaa

SEQ ID NO: 4806537 - DNA, 11 bp, Homo sapiens
attattatatt

SEQ ID NO: 4806538 - DNA, 14 bp, Homo sapiens
attattttaaaaat

SEQ ID NO: 4806539 - DNA, 14 bp, Homo sapiens
attattttctatat

SEQ ID NO: 4806540 - DNA, 14 bp, Homo sapiens
attcaaaaattata

SEQ ID NO: 4806541 - DNA, 19 bp, Homo sapiens
attcaaaaattatattttg

SEQ ID NO: 4806542 - DNA, 15 bp, Homo sapiens
attcaaaaatttcac

SEQ ID NO: 4806543 - DNA, 15 bp, Homo sapiens
attcaaacctaagtt

SEQ ID NO: 4806544 - DNA, 14 bp, Homo sapiens
attcaaagagaaaa

SEQ ID NO: 4806545 - DNA, 22 bp, Homo sapiens
attcaaataaccctgaatcaga

SEQ ID NO: 4806546 - DNA, 23 bp, Homo sapiens
attcaaataaccctgaatcagag

SEQ ID NO: 4806547 - DNA, 12 bp, Homo sapiens
attcaaatttat

SEQ ID NO: 4806548 - DNA, 18 bp, Homo sapiens
attcaataactattgctg

SEQ ID NO: 4806549 - DNA, 20 bp, Homo sapiens
attcaatgggtaaataaatg

SEQ ID NO: 4806550 - DNA, 22 bp, Homo sapiens
attcaatgggtaaataaatgct

SEQ ID NO: 4806551 - DNA, 12 bp, Homo sapiens
attcaatgtgaa

SEQ ID NO: 4806552 - DNA, 13 bp, Homo sapiens
attcaatgtgaat

SEQ ID NO: 4806553 - DNA, 23 bp, Homo sapiens
attcaattaagttattaacattt

SEQ ID NO: 4806554 - DNA, 22 bp, Homo sapiens
attcaattttctttaaccagtc

SEQ ID NO: 4806555 - DNA, 11 bp, Homo sapiens
attcacacaca

SEQ ID NO: 4806556 - DNA, 15 bp, Homo sapiens
attcacacacacaca

SEQ ID NO: 4806557 - DNA, 17 bp, Homo sapiens
attcacctgtaaaactt

SEQ ID NO: 4806558 - DNA, 18 bp, Homo sapiens
attcacctgtaaaacttt

SEQ ID NO: 4806559 - DNA, 22 bp, Homo sapiens
attcactttaccttcagcagtt

SEQ ID NO: 4806560 - DNA, 14 bp, Homo sapiens
attcagagatgtac

SEQ ID NO: 4806561 - DNA, 15 bp, Homo sapiens
attcagtggacattt

SEQ ID NO: 4806562 - DNA, 18 bp, Homo sapiens
attcagtttctaaaattg

SEQ ID NO: 4806563 - DNA, 23 bp, Homo sapiens
attcatatattttatgaatcaga

SEQ ID NO: 4806564 - DNA, 17 bp, Homo sapiens
attcatcctcacatgtg

SEQ ID NO: 4806565 - DNA, 18 bp, Homo sapiens
attcatcctcacatgtgg

SEQ ID NO: 4806566 - DNA, 19 bp, Homo sapiens
attcatgatgctagttctt

SEQ ID NO: 4806567 - DNA, 17 bp, Homo sapiens
attcattcatcctctta

SEQ ID NO: 4806568 - DNA, 13 bp, Homo sapiens
attcattctttat

SEQ ID NO: 4806569 - DNA, 16 bp, Homo sapiens
attcattctttataaa

SEQ ID NO: 4806570 - DNA, 22 bp, Homo sapiens
attcatttttgaaactgcattt

SEQ ID NO: 4806571 - DNA, 14 bp, Homo sapiens
attccaatacatta

SEQ ID NO: 4806572 - DNA, 16 bp, Homo sapiens
attccaatacattatt

SEQ ID NO: 4806573 - DNA, 19 bp, Homo sapiens
attccacctggaaagccag

SEQ ID NO: 4806574 - DNA, 14 bp, Homo sapiens
attccaccttaaat

SEQ ID NO: 4806575 - DNA, 19 bp, Homo sapiens
attccaccttaaattaaac

SEQ ID NO: 4806576 - DNA, 20 bp, Homo sapiens
attccaccttaaattaaaca

SEQ ID NO: 4806577 - DNA, 22 bp, Homo sapiens
attccaccttaaattaaacaat

SEQ ID NO: 4806578 - DNA, 17 bp, Homo sapiens
attccagggaaccagag

SEQ ID NO: 4806579 - DNA, 22 bp, Homo sapiens
attccaggggcctcaggtccta

SEQ ID NO: 4806580 - DNA, 23 bp, Homo sapiens
attttaaaacttcatctgtctgt

SEQ ID NO: 4806581 - DNA, 24 bp, Homo sapiens
attttaaaatgcaaatattgctat

SEQ ID NO: 4806582 - DNA, 19 bp, Homo sapiens
attttaaacaaaatttatg

SEQ ID NO: 4806583 - DNA, 13 bp, Homo sapiens
attttaaatgatc

SEQ ID NO: 4806584 - DNA, 13 bp, Homo sapiens
attttaacatagc

SEQ ID NO: 4806585 - DNA, 20 bp, Homo sapiens
attttaacatagcagctggt

SEQ ID NO: 4806586 - DNA, 15 bp, Homo sapiens
attttaattcagttg

SEQ ID NO: 4806587 - DNA, 14 bp, Homo sapiens
attttagcagttct

SEQ ID NO: 4806588 - DNA, 20 bp, Homo sapiens
attttataaggctgactctt

SEQ ID NO: 4806589 - DNA, 17 bp, Homo sapiens
attttatataataaagt

SEQ ID NO: 4806590 - DNA, 22 bp, Homo sapiens
attttatataataaagtattcc

SEQ ID NO: 4806591 - DNA, 21 bp, Homo sapiens
attttatctgtgttgtctctc

SEQ ID NO: 4806592 - DNA, 12 bp, Homo sapiens
attttatgttta

SEQ ID NO: 4806593 - DNA, 13 bp, Homo sapiens
attttattgaata

SEQ ID NO: 4806594 - DNA, 15 bp, Homo sapiens
attttattgaatata

SEQ ID NO: 4806595 - DNA, 16 bp, Homo sapiens
attttattgaatataa

SEQ ID NO: 4806596 - DNA, 23 bp, Homo sapiens
attttattgaatataatggcctc

SEQ ID NO: 4806597 - DNA, 14 bp, Homo sapiens
attttatttcaatg

SEQ ID NO: 4806598 - DNA, 18 bp, Homo sapiens
attttatttcaatgtaat

SEQ ID NO: 4806599 - DNA, 19 bp, Homo sapiens
attttatttcaatgtaatt

SEQ ID NO: 4806600 - DNA, 15 bp, Homo sapiens
attttattttagcag

SEQ ID NO: 4806601 - DNA, 19 bp, Homo sapiens
attttcaaagattgttggc

SEQ ID NO: 4806602 - DNA, 16 bp, Homo sapiens
attttcaagtggaaac

SEQ ID NO: 4806603 - DNA, 20 bp, Homo sapiens
attttcaagtggaaaccttg

SEQ ID NO: 4806604 - DNA, 11 bp, Homo sapiens
attttcatgtt

SEQ ID NO: 4806605 - DNA, 18 bp, Homo sapiens
attttcgtgcatttgtga

SEQ ID NO: 4806606 - DNA, 20 bp, Homo sapiens
attttctagaatactaataa

SEQ ID NO: 4806607 - DNA, 17 bp, Homo sapiens
attttctgagtagcata

SEQ ID NO: 4806608 - DNA, 17 bp, Homo sapiens
attttctgtaattcttc

SEQ ID NO: 4806609 - DNA, 16 bp, Homo sapiens
attttcttcccatttg

SEQ ID NO: 4806610 - DNA, 22 bp, Homo sapiens
attttcttcccatttgtaatgt

SEQ ID NO: 4806611 - DNA, 18 bp, Homo sapiens
attttcttctttaatttt

SEQ ID NO: 4806612 - DNA, 19 bp, Homo sapiens
attttggaagaattcatga

SEQ ID NO: 4806613 - DNA, 22 bp, Homo sapiens
attttggaagaattcatgatgc

SEQ ID NO: 4806614 - DNA, 22 bp, Homo sapiens
attttgggaaattcttgcactg

SEQ ID NO: 4806615 - DNA, 12 bp, Homo sapiens
attttgtaaaat

SEQ ID NO: 4806616 - DNA, 14 bp, Homo sapiens
attttgtaaaatgt

SEQ ID NO: 4806617 - DNA, 19 bp, Homo sapiens
attttgtaaaatgtattat

SEQ ID NO: 4806618 - DNA, 21 bp, Homo sapiens
attttgtaaaatgtattatgt

SEQ ID NO: 4806619 - DNA, 14 bp, Homo sapiens
attttgtagctagt

SEQ ID NO: 4806620 - DNA, 21 bp, Homo sapiens
attttgtatgaaatatatgtg

SEQ ID NO: 4806621 - DNA, 15 bp, Homo sapiens
atttttaatttatga

SEQ ID NO: 4806622 - DNA, 15 bp, Homo sapiens
atttttgagtaaaac

SEQ ID NO: 4806623 - DNA, 14 bp, Homo sapiens
attttttcctgaga

SEQ ID NO: 4806624 - DNA, 13 bp, Homo sapiens
attttttgtaact

SEQ ID NO: 4806625 - DNA, 14 bp, Homo sapiens
attttttgtaactc

SEQ ID NO: 4806626 - DNA, 20 bp, Homo sapiens
attttttgtaactctttggc

SEQ ID NO: 4806627 - DNA, 16 bp, Homo sapiens
attttttgtctgtgat

SEQ ID NO: 4806628 - DNA, 14 bp, Homo sapiens
attttttgtgaatg

SEQ ID NO: 4806629 - DNA, 15 bp, Homo sapiens
caaaaaaaagaaaga

SEQ ID NO: 4806630 - DNA, 20 bp, Homo sapiens
caaaaaaaagaaagaaaaaa

SEQ ID NO: 4806631 - DNA, 21 bp, Homo sapiens
caaaaactttccatgacagta

SEQ ID NO: 4806632 - DNA, 13 bp, Homo sapiens
caaaaatcatcaa

SEQ ID NO: 4806633 - DNA, 11 bp, Homo sapiens
caaaaatgaat

SEQ ID NO: 4806634 - DNA, 15 bp, Homo sapiens
caaaaatttgacatt

SEQ ID NO: 4806635 - DNA, 21 bp, Homo sapiens
caaaacaaaaaaacccagggg

SEQ ID NO: 4806636 - DNA, 17 bp, Homo sapiens
caaaacaaattcaagaa

SEQ ID NO: 4806637 - DNA, 16 bp, Homo sapiens
caaaacaacagcaaca

SEQ ID NO: 4806638 - DNA, 18 bp, Homo sapiens
caaaacaacagcaacaac

SEQ ID NO: 4806639 - DNA, 16 bp, Homo sapiens
caaaaccattgcttca

SEQ ID NO: 4806640 - DNA, 14 bp, Homo sapiens
caaaagataaaact

SEQ ID NO: 4806641 - DNA, 15 bp, Homo sapiens
caaaagatctcctgt

SEQ ID NO: 4806642 - DNA, 23 bp, Homo sapiens
caaaaggctggatgtgctttcat

SEQ ID NO: 4806643 - DNA, 20 bp, Homo sapiens
caaaagtctcaatgttccat

SEQ ID NO: 4806644 - DNA, 22 bp, Homo sapiens
caaaagtgcagtagtgtcactt

SEQ ID NO: 4806645 - DNA, 19 bp, Homo sapiens
caaaatacatgatgatttc

SEQ ID NO: 4806646 - DNA, 18 bp, Homo sapiens
caaaatattgagcagaat

SEQ ID NO: 4806647 - DNA, 11 bp, Homo sapiens
caaaatgaaac

SEQ ID NO: 4806648 - DNA, 14 bp, Homo sapiens
caaaatgcaggaca

SEQ ID NO: 4806649 - DNA, 21 bp, Homo sapiens
caaaatgtgccgtctttggtt

SEQ ID NO: 4806650 - DNA, 20 bp, Homo sapiens
caaaatttatgtcattttca

SEQ ID NO: 4806651 - DNA, 21 bp, Homo sapiens
caaaatttatgtcattttcag

SEQ ID NO: 4806652 - DNA, 23 bp, Homo sapiens
caaaatttatgtcattttcagat

SEQ ID NO: 4806653 - DNA, 18 bp, Homo sapiens
caaacaaatcattttgat

SEQ ID NO: 4806654 - DNA, 14 bp, Homo sapiens
caaacaacaaagca

SEQ ID NO: 4806655 - DNA, 14 bp, Homo sapiens
caaacaacctgcca

SEQ ID NO: 4806656 - DNA, 18 bp, Homo sapiens
caaacacacagactctgt

SEQ ID NO: 4806657 - DNA, 19 bp, Homo sapiens
caaacacacagactctgtg

SEQ ID NO: 4806658 - DNA, 19 bp, Homo sapiens
caaacactgcttaaggaaa

SEQ ID NO: 4806659 - DNA, 20 bp, Homo sapiens
caaacactgcttaaggaaaa

SEQ ID NO: 4806660 - DNA, 15 bp, Homo sapiens
caaacaggaaaatga

SEQ ID NO: 4806661 - DNA, 23 bp, Homo sapiens
caaacagtgtggcttaaacattt

SEQ ID NO: 4806662 - DNA, 11 bp, Homo sapiens
caaacatgtgg

SEQ ID NO: 4806663 - DNA, 18 bp, Homo sapiens
caaaccaatttgttctgt

SEQ ID NO: 4806664 - DNA, 15 bp, Homo sapiens
caaaccacaactgac

SEQ ID NO: 4806665 - DNA, 13 bp, Homo sapiens
caaaccaggctgc

SEQ ID NO: 4806666 - DNA, 21 bp, Homo sapiens
caaaccttcttttcaatgcaa

SEQ ID NO: 4806667 - DNA, 22 bp, Homo sapiens
caaaccttcttttcaatgcaat

SEQ ID NO: 4806668 - DNA, 15 bp, Homo sapiens
caaacctttaactaa

SEQ ID NO: 4806669 - DNA, 17 bp, Homo sapiens
caaactcatccattaat

SEQ ID NO: 4806670 - DNA, 15 bp, Homo sapiens
caaactgaaattagt

SEQ ID NO: 4806671 - DNA, 16 bp, Homo sapiens
caaactggttatttaa

SEQ ID NO: 4806672 - DNA, 22 bp, Homo sapiens
caaacttctgaactttggaagc

SEQ ID NO: 4806673 - DNA, 13 bp, Homo sapiens
caaagaaaacaga

SEQ ID NO: 4806674 - DNA, 21 bp, Homo sapiens
caaagaaacaaaatataaatc

SEQ ID NO: 4806675 - DNA, 15 bp, Homo sapiens
caaagaaccaggagg

SEQ ID NO: 4806676 - DNA, 22 bp, Homo sapiens
caaagaaccaggaggcctggga

SEQ ID NO: 4806677 - DNA, 16 bp, Homo sapiens
caaagaacccccctcc

SEQ ID NO: 4806678 - DNA, 11 bp, Homo sapiens
caaagaagagt

SEQ ID NO: 4806679 - DNA, 18 bp, Homo sapiens
caaagacagtttcttgca

SEQ ID NO: 4806680 - DNA, 14 bp, Homo sapiens
caaagagaaaacat

SEQ ID NO: 4806681 - DNA, 18 bp, Homo sapiens
caaagagtagaactttaa

SEQ ID NO: 4806682 - DNA, 23 bp, Homo sapiens
caaagagttatatgacttcttgt

SEQ ID NO: 4806683 - DNA, 12 bp, Homo sapiens
caaagatattat

SEQ ID NO: 4806684 - DNA, 19 bp, Homo sapiens
caaagatattatttatcga

SEQ ID NO: 4806685 - DNA, 17 bp, Homo sapiens
caaagcactggccttgc

SEQ ID NO: 4806686 - DNA, 17 bp, Homo sapiens
caaagcagtgcatgctg

SEQ ID NO: 4806687 - DNA, 18 bp, Homo sapiens
caaagcagtgcatgctgt

SEQ ID NO: 4806688 - DNA, 22 bp, Homo sapiens
caaagcagtgcatgctgtccct

SEQ ID NO: 4806689 - DNA, 19 bp, Homo sapiens
caaagcatgctcagtattg

SEQ ID NO: 4806690 - DNA, 14 bp, Homo sapiens
caaagcatggacta

SEQ ID NO: 4806691 - DNA, 17 bp, Homo sapiens
caaagccagctctgagc

SEQ ID NO: 4806692 - DNA, 16 bp, Homo sapiens
caaagccctccctgtc

SEQ ID NO: 4806693 - DNA, 15 bp, Homo sapiens
caaagctatttaagt

SEQ ID NO: 4806694 - DNA, 18 bp, Homo sapiens
caaagctatttaagtgga

SEQ ID NO: 4806695 - DNA, 20 bp, Homo sapiens
caaaggagattggaaggaac

SEQ ID NO: 4806696 - DNA, 15 bp, Homo sapiens
caaaggttgtacata

SEQ ID NO: 4806697 - DNA, 17 bp, Homo sapiens
caaaggttgtacatagt

SEQ ID NO: 4806698 - DNA, 21 bp, Homo sapiens
caaagtagtacttcttctgta

SEQ ID NO: 4806699 - DNA, 22 bp, Homo sapiens
caaagtagtacttcttctgtaa

SEQ ID NO: 4806700 - DNA, 17 bp, Homo sapiens
caaagtatatacagagc

SEQ ID NO: 4806701 - DNA, 13 bp, Homo sapiens
caaagtgaaatta

SEQ ID NO: 4806702 - DNA, 14 bp, Homo sapiens
caatccagccttct

SEQ ID NO: 4806703 - DNA, 13 bp, Homo sapiens
caatctggcttct

SEQ ID NO: 4806704 - DNA, 14 bp, Homo sapiens
caatctgtccagac

SEQ ID NO: 4806705 - DNA, 15 bp, Homo sapiens
caatctgtccagaca

SEQ ID NO: 4806706 - DNA, 23 bp, Homo sapiens
caatctgtgaagcctttatctat

SEQ ID NO: 4806707 - DNA, 11 bp, Homo sapiens
caatcttgctg

SEQ ID NO: 4806708 - DNA, 18 bp, Homo sapiens
caatgaatatactcatta

SEQ ID NO: 4806709 - DNA, 18 bp, Homo sapiens
caatgcaatgcatctgaa

SEQ ID NO: 4806710 - DNA, 15 bp, Homo sapiens
caatgcctgcctgaa

SEQ ID NO: 4806711 - DNA, 15 bp, Homo sapiens
caatgctatggactg

SEQ ID NO: 4806712 - DNA, 17 bp, Homo sapiens
caatgctatggactgca

SEQ ID NO: 4806713 - DNA, 19 bp, Homo sapiens
caatggacaagcagtggat

SEQ ID NO: 4806714 - DNA, 17 bp, Homo sapiens
caatggctattaacaat

SEQ ID NO: 4806715 - DNA, 21 bp, Homo sapiens
caatggctgggtttgggcagt

SEQ ID NO: 4806716 - DNA, 17 bp, Homo sapiens
caatgggtaaataaatg

SEQ ID NO: 4806717 - DNA, 22 bp, Homo sapiens
caatggtagctctgaagggagg

SEQ ID NO: 4806718 - DNA, 21 bp, Homo sapiens
caatggtgtagctgtcctctc

SEQ ID NO: 4806719 - DNA, 18 bp, Homo sapiens
caatggttttcttgtgtg

SEQ ID NO: 4806720 - DNA, 18 bp, Homo sapiens
caatgtaattaaactgtt

SEQ ID NO: 4806721 - DNA, 12 bp, Homo sapiens
caatgtccaggt

SEQ ID NO: 4806722 - DNA, 21 bp, Homo sapiens
caatgtctgtccctaaacata

SEQ ID NO: 4806723 - DNA, 19 bp, Homo sapiens
caatgtgatatgtgtaata

SEQ ID NO: 4806724 - DNA, 17 bp, Homo sapiens
caatgtggaattacata

SEQ ID NO: 4806725 - DNA, 19 bp, Homo sapiens
caatgtggaattacataac

SEQ ID NO: 4806726 - DNA, 16 bp, Homo sapiens
caatgttaaatctaca

SEQ ID NO: 4806727 - DNA, 18 bp, Homo sapiens
caatgttccgttcatctg

SEQ ID NO: 4806728 - DNA, 12 bp, Homo sapiens
caatgtttcaag

SEQ ID NO: 4806729 - DNA, 12 bp, Homo sapiens
caattactgtga

SEQ ID NO: 4806730 - DNA, 17 bp, Homo sapiens
caattactgtgagaact

SEQ ID NO: 4806731 - DNA, 15 bp, Homo sapiens
caattagatttctca

SEQ ID NO: 4806732 - DNA, 14 bp, Homo sapiens
caattatcaaaaaa

SEQ ID NO: 4806733 - DNA, 19 bp, Homo sapiens
caattatcaaaaaacagaa

SEQ ID NO: 4806734 - DNA, 22 bp, Homo sapiens
caattctgaaggggaaaacctc

SEQ ID NO: 4806735 - DNA, 10 bp, Homo sapiens
caattctgtg

SEQ ID NO: 4806736 - DNA, 20 bp, Homo sapiens
caattgagttaaatcagtaa

SEQ ID NO: 4806737 - DNA, 17 bp, Homo sapiens
caattggacaattattt

SEQ ID NO: 4806738 - DNA, 20 bp, Homo sapiens
caattgtgagaattactgtt

SEQ ID NO: 4806739 - DNA, 21 bp, Homo sapiens
caattgtgagaattactgttt

SEQ ID NO: 4806740 - DNA, 20 bp, Homo sapiens
caattgtttaagaatcatgg

SEQ ID NO: 4806741 - DNA, 23 bp, Homo sapiens
caatttatcttccatatgctctt

SEQ ID NO: 4806742 - DNA, 18 bp, Homo sapiens
caatttcaaagaaaacag

SEQ ID NO: 4806743 - DNA, 16 bp, Homo sapiens
caatttgtataaaatg

SEQ ID NO: 4806744 - DNA, 13 bp, Homo sapiens
caattttcctaag

SEQ ID NO: 4806745 - DNA, 13 bp, Homo sapiens
caattttgtctct

SEQ ID NO: 4806746 - DNA, 21 bp, Homo sapiens
caatttttaacttatctccag

SEQ ID NO: 4806747 - DNA, 16 bp, Homo sapiens
cacaaaaaatttaaga

SEQ ID NO: 4806748 - DNA, 16 bp, Homo sapiens
cacaaaacaacagcaa

SEQ ID NO: 4806749 - DNA, 13 bp, Homo sapiens
cacaaaaggctgg

SEQ ID NO: 4806750 - DNA, 15 bp, Homo sapiens
cacaaacagaggccg

SEQ ID NO: 4806751 - DNA, 21 bp, Homo sapiens
cacaaagcctgtgttactgat

SEQ ID NO: 4806752 - DNA, 19 bp, Homo sapiens
cacaaatattgcttggact

SEQ ID NO: 4806753 - DNA, 11 bp, Homo sapiens
cacaaatgtcc

SEQ ID NO: 4806754 - DNA, 18 bp, Homo sapiens
cacaacctcctcctccag

SEQ ID NO: 4806755 - DNA, 17 bp, Homo sapiens
cacaactaacaatgcct

SEQ ID NO: 4806756 - DNA, 19 bp, Homo sapiens
cacaactaacaatgccttg

SEQ ID NO: 4806757 - DNA, 12 bp, Homo sapiens
cacaactgacac

SEQ ID NO: 4806758 - DNA, 17 bp, Homo sapiens
cacaactgacacaggaa

SEQ ID NO: 4806759 - DNA, 18 bp, Homo sapiens
cacaagagcccaggcctc

SEQ ID NO: 4806760 - DNA, 19 bp, Homo sapiens
cacaagagcccaggcctcc

SEQ ID NO: 4806761 - DNA, 22 bp, Homo sapiens
cacaagtagatgcctgaacttg

SEQ ID NO: 4806762 - DNA, 16 bp, Homo sapiens
cacaataatgaataat

SEQ ID NO: 4806763 - DNA, 15 bp, Homo sapiens
cacaatcactaaata

SEQ ID NO: 4806764 - DNA, 12 bp, Homo sapiens
cacaatgtgata

SEQ ID NO: 4806765 - DNA, 20 bp, Homo sapiens
cacaattgatctctttttat

SEQ ID NO: 4806766 - DNA, 14 bp, Homo sapiens
cacacaaaacaaca

SEQ ID NO: 4806767 - DNA, 23 bp, Homo sapiens
cacacaaaacaacagcaacaaca

SEQ ID NO: 4806768 - DNA, 16 bp, Homo sapiens
cacacaattagatttc

SEQ ID NO: 4806769 - DNA, 12 bp, Homo sapiens
cacacacaaaac

SEQ ID NO: 4806770 - DNA, 18 bp, Homo sapiens
cacacacaaatattgctt

SEQ ID NO: 4806771 - DNA, 11 bp, Homo sapiens
cacacacacac

SEQ ID NO: 4806772 - DNA, 14 bp, Homo sapiens
cacacacacacact

SEQ ID NO: 4806773 - DNA, 16 bp, Homo sapiens
cacacacacccttccc

SEQ ID NO: 4806774 - DNA, 15 bp, Homo sapiens
cacacacagcagctc

SEQ ID NO: 4806775 - DNA, 13 bp, Homo sapiens
cacacacatagat

SEQ ID NO: 4806776 - DNA, 14 bp, Homo sapiens
cacacacccttccc

SEQ ID NO: 4806777 - DNA, 15 bp, Homo sapiens
cacacacccttcccc

SEQ ID NO: 4806778 - DNA, 12 bp, Homo sapiens
cacacacctgcc

SEQ ID NO: 4806779 - DNA, 13 bp, Homo sapiens
cacacacttttgc

SEQ ID NO: 4806780 - DNA, 12 bp, Homo sapiens
cacacagcagcc

SEQ ID NO: 4806781 - DNA, 21 bp, Homo sapiens
cacacagcagccccccagcac

SEQ ID NO: 4806782 - DNA, 12 bp, Homo sapiens
cacacagcagct

SEQ ID NO: 4806783 - DNA, 23 bp, Homo sapiens
cacacaggcctggcccagccagc

SEQ ID NO: 4806784 - DNA, 14 bp, Homo sapiens
cacacagtgaccaa

SEQ ID NO: 4806785 - DNA, 15 bp, Homo sapiens
cacacataacacaca

SEQ ID NO: 4806786 - DNA, 23 bp, Homo sapiens
cacacatccaagagggactccaa

SEQ ID NO: 4806787 - DNA, 19 bp, Homo sapiens
cacaccaaattgctgagat

SEQ ID NO: 4806788 - DNA, 20 bp, Homo sapiens
cacaccagtccacgccgggt

SEQ ID NO: 4806789 - DNA, 17 bp, Homo sapiens
cacaccccgtctgcccc

SEQ ID NO: 4806790 - DNA, 20 bp, Homo sapiens
cacaccccgtctgccccttg

SEQ ID NO: 4806791 - DNA, 21 bp, Homo sapiens
cacaccccgtctgccccttga

SEQ ID NO: 4806792 - DNA, 20 bp, Homo sapiens
cacaccctcactctgccagg

SEQ ID NO: 4806793 - DNA, 15 bp, Homo sapiens
cacaccctgcaaggc

SEQ ID NO: 4806794 - DNA, 16 bp, Homo sapiens
cacaccctgcaaggcc

SEQ ID NO: 4806795 - DNA, 11 bp, Homo sapiens
cacacccttcc

SEQ ID NO: 4806796 - DNA, 13 bp, Homo sapiens
cacacccttcccc

SEQ ID NO: 4806797 - DNA, 17 bp, Homo sapiens
cacacccttccccactc

SEQ ID NO: 4806798 - DNA, 18 bp, Homo sapiens
cacaccggcactgtgcac

SEQ ID NO: 4806799 - DNA, 16 bp, Homo sapiens
cacacctaaattaaca

SEQ ID NO: 4806800 - DNA, 19 bp, Homo sapiens
cacacgccggggctggccc

SEQ ID NO: 4806801 - DNA, 18 bp, Homo sapiens
cacacggggcacccagcc

SEQ ID NO: 4806802 - DNA, 20 bp, Homo sapiens
cacacggggcacccagccca

SEQ ID NO: 4806803 - DNA, 17 bp, Homo sapiens
cacactgagtttgaaca

SEQ ID NO: 4806804 - DNA, 19 bp, Homo sapiens
cacagaaaatggaagacag

SEQ ID NO: 4806805 - DNA, 16 bp, Homo sapiens
cacagaacctttgtca

SEQ ID NO: 4806806 - DNA, 22 bp, Homo sapiens
cacagaacctttgtcaacttca

SEQ ID NO: 4806807 - DNA, 17 bp, Homo sapiens
cacagacccctggggga

SEQ ID NO: 4806808 - DNA, 21 bp, Homo sapiens
cacagacccctgggggaggct

SEQ ID NO: 4806809 - DNA, 15 bp, Homo sapiens
cacagactgctgtct

SEQ ID NO: 4806810 - DNA, 16 bp, Homo sapiens
cacagagagcggcttc

SEQ ID NO: 4806811 - DNA, 16 bp, Homo sapiens
cacagaggatggcttc

SEQ ID NO: 4806812 - DNA, 23 bp, Homo sapiens
cacagatccatccttttgcttca

SEQ ID NO: 4806813 - DNA, 12 bp, Homo sapiens
cacagcagcccc

SEQ ID NO: 4806814 - DNA, 20 bp, Homo sapiens
cacagcagccccccagcact

SEQ ID NO: 4806815 - DNA, 18 bp, Homo sapiens
cacagcagcctctgaagt

SEQ ID NO: 4806816 - DNA, 15 bp, Homo sapiens
cacagcagctccaac

SEQ ID NO: 4806817 - DNA, 19 bp, Homo sapiens
cacagcatgcatttagcat

SEQ ID NO: 4806818 - DNA, 20 bp, Homo sapiens
cacagcatgcatttagcatg

SEQ ID NO: 4806819 - DNA, 21 bp, Homo sapiens
cacagcatgcatttagcatga

SEQ ID NO: 4806820 - DNA, 20 bp, Homo sapiens
cacagccagaaactgaactg

SEQ ID NO: 4806821 - DNA, 15 bp, Homo sapiens
cacagcccagagact

SEQ ID NO: 4806822 - DNA, 16 bp, Homo sapiens
cacagctaacatggaa

SEQ ID NO: 4806823 - DNA, 22 bp, Homo sapiens
cacagctgcagccaaccccatc

SEQ ID NO: 4806824 - DNA, 14 bp, Homo sapiens
cacagctgcctccg

SEQ ID NO: 4806825 - DNA, 19 bp, Homo sapiens
cctcggccctgtagccctg

SEQ ID NO: 4806826 - DNA, 21 bp, Homo sapiens
cctcggccctgtagccctggc

SEQ ID NO: 4806827 - DNA, 13 bp, Homo sapiens
cctcggcctggct

SEQ ID NO: 4806828 - DNA, 12 bp, Homo sapiens
cctcgggccgcc

SEQ ID NO: 4806829 - DNA, 15 bp, Homo sapiens
cctcgggccgcctcc

SEQ ID NO: 4806830 - DNA, 21 bp, Homo sapiens
cctcgggccgcctcctccaga

SEQ ID NO: 4806831 - DNA, 14 bp, Homo sapiens
cctcgggcgcctgc

SEQ ID NO: 4806832 - DNA, 20 bp, Homo sapiens
cctcgggcgcctgcgctcct

SEQ ID NO: 4806833 - DNA, 14 bp, Homo sapiens
cctcggtcagcacc

SEQ ID NO: 4806834 - DNA, 21 bp, Homo sapiens
cctcgtccggcctgcagccca

SEQ ID NO: 4806835 - DNA, 20 bp, Homo sapiens
cctctaagatcttgcctctt

SEQ ID NO: 4806836 - DNA, 18 bp, Homo sapiens
cctctatccttttttcct

SEQ ID NO: 4806837 - DNA, 19 bp, Homo sapiens
cctctatccttttttcctt

SEQ ID NO: 4806838 - DNA, 17 bp, Homo sapiens
cctctcaaacctggcag

SEQ ID NO: 4806839 - DNA, 16 bp, Homo sapiens
cctctcactgacttct

SEQ ID NO: 4806840 - DNA, 14 bp, Homo sapiens
cctctcactttttt

SEQ ID NO: 4806841 - DNA, 16 bp, Homo sapiens
cctctcagaactcctg

SEQ ID NO: 4806842 - DNA, 17 bp, Homo sapiens
cctctcagaactcctgt

SEQ ID NO: 4806843 - DNA, 14 bp, Homo sapiens
cctctcccaaataa

SEQ ID NO: 4806844 - DNA, 20 bp, Homo sapiens
cctctcctcgtccggcctgc

SEQ ID NO: 4806845 - DNA, 22 bp, Homo sapiens
cctctcctcgtccggcctgcag

SEQ ID NO: 4806846 - DNA, 12 bp, Homo sapiens
cctctcctctct

SEQ ID NO: 4806847 - DNA, 17 bp, Homo sapiens
cctctccttccttaccc

SEQ ID NO: 4806848 - DNA, 15 bp, Homo sapiens
cctctcgagcccaga

SEQ ID NO: 4806849 - DNA, 16 bp, Homo sapiens
cctctcgagcccagat

SEQ ID NO: 4806850 - DNA, 14 bp, Homo sapiens
cctctcgctcccct

SEQ ID NO: 4806851 - DNA, 19 bp, Homo sapiens
cctctcgctcccctctgcc

SEQ ID NO: 4806852 - DNA, 14 bp, Homo sapiens
cctctctcaggcca

SEQ ID NO: 4806853 - DNA, 13 bp, Homo sapiens
cctctctctccct

SEQ ID NO: 4806854 - DNA, 18 bp, Homo sapiens
cctctctctccctccact

SEQ ID NO: 4806855 - DNA, 21 bp, Homo sapiens
cctctctctctctctctctgt

SEQ ID NO: 4806856 - DNA, 20 bp, Homo sapiens
cctctctgtttaccctccct

SEQ ID NO: 4806857 - DNA, 21 bp, Homo sapiens
cctctctgtttaccctccctg

SEQ ID NO: 4806858 - DNA, 16 bp, Homo sapiens
cctctcttaccccgtc

SEQ ID NO: 4806859 - DNA, 18 bp, Homo sapiens
cctctcttaccccgtccc

SEQ ID NO: 4806860 - DNA, 20 bp, Homo sapiens
cctctgaccaacaggctgtt

SEQ ID NO: 4806861 - DNA, 12 bp, Homo sapiens
cctctgcagcct

SEQ ID NO: 4806862 - DNA, 13 bp, Homo sapiens
cctctgcagcctg

SEQ ID NO: 4806863 - DNA, 14 bp, Homo sapiens
cctctgcagcctga

SEQ ID NO: 4806864 - DNA, 16 bp, Homo sapiens
cctctgcagcctgagc

SEQ ID NO: 4806865 - DNA, 18 bp, Homo sapiens
cctctgcagcctgagctc

SEQ ID NO: 4806866 - DNA, 18 bp, Homo sapiens
cctctgccacactctgac

SEQ ID NO: 4806867 - DNA, 17 bp, Homo sapiens
cctctgccactgacagg

SEQ ID NO: 4806868 - DNA, 15 bp, Homo sapiens
cctctgccccctccc

SEQ ID NO: 4806869 - DNA, 19 bp, Homo sapiens
cctctgccccctcccccgc

SEQ ID NO: 4806870 - DNA, 21 bp, Homo sapiens
cctctgccccctcccccgcag

SEQ ID NO: 4806871 - DNA, 20 bp, Homo sapiens
cctctgcctacccacgtgcc

SEQ ID NO: 4806872 - DNA, 15 bp, Homo sapiens
cctctgcgccccagc

SEQ ID NO: 4806873 - DNA, 17 bp, Homo sapiens
cctctgcgccccagcga

SEQ ID NO: 4806874 - DNA, 19 bp, Homo sapiens
cctctgctatgtctgtgat

SEQ ID NO: 4806875 - DNA, 13 bp, Homo sapiens
cctctgtccttcc

SEQ ID NO: 4806876 - DNA, 14 bp, Homo sapiens
cctcttagaagaaa

SEQ ID NO: 4806877 - DNA, 21 bp, Homo sapiens
cctcttagaagaatattgtat

SEQ ID NO: 4806878 - DNA, 15 bp, Homo sapiens
cctcttcaatcccca

SEQ ID NO: 4806879 - DNA, 20 bp, Homo sapiens
cctcttcaccccggcaggcc

SEQ ID NO: 4806880 - DNA, 15 bp, Homo sapiens
cctcttctcagctcc

SEQ ID NO: 4806881 - DNA, 16 bp, Homo sapiens
cctcttctcagctcca

SEQ ID NO: 4806882 - DNA, 14 bp, Homo sapiens
cctctttaaattat

SEQ ID NO: 4806883 - DNA, 17 bp, Homo sapiens
cctctttccccactgaa

SEQ ID NO: 4806884 - DNA, 19 bp, Homo sapiens
cctctttcctcctcatgaa

SEQ ID NO: 4806885 - DNA, 13 bp, Homo sapiens
cctctttctctct

SEQ ID NO: 4806886 - DNA, 16 bp, Homo sapiens
cctctttctctctgtg

SEQ ID NO: 4806887 - DNA, 23 bp, Homo sapiens
cctctttctctctgtgtggcaaa

SEQ ID NO: 4806888 - DNA, 14 bp, Homo sapiens
cctctttcttcaat

SEQ ID NO: 4806889 - DNA, 21 bp, Homo sapiens
cctctttcttcaattaatgga

SEQ ID NO: 4806890 - DNA, 14 bp, Homo sapiens
cctgaaataaaact

SEQ ID NO: 4806891 - DNA, 15 bp, Homo sapiens
cctgaaatggcctgt

SEQ ID NO: 4806892 - DNA, 20 bp, Homo sapiens
cctgaaatggcctgtcccta

SEQ ID NO: 4806893 - DNA, 15 bp, Homo sapiens
cctgaatcagaggca

SEQ ID NO: 4806894 - DNA, 22 bp, Homo sapiens
cctgaattaaagtctacactgc

SEQ ID NO: 4806895 - DNA, 22 bp, Homo sapiens
cctgacacaatggtagctctga

SEQ ID NO: 4806896 - DNA, 14 bp, Homo sapiens
cctgacacctgccg

SEQ ID NO: 4806897 - DNA, 12 bp, Homo sapiens
cctgacaggcct

SEQ ID NO: 4806898 - DNA, 23 bp, Homo sapiens
cctgaccctccaccgcagaagga

SEQ ID NO: 4806899 - DNA, 16 bp, Homo sapiens
cctgactccctgtggg

SEQ ID NO: 4806900 - DNA, 16 bp, Homo sapiens
cctgacttcccagctg

SEQ ID NO: 4806901 - DNA, 22 bp, Homo sapiens
cctgagaattgaggggaggtgg

SEQ ID NO: 4806902 - DNA, 17 bp, Homo sapiens
cctgagccacagtgggg

SEQ ID NO: 4806903 - DNA, 18 bp, Homo sapiens
cctgagcccccacccggg

SEQ ID NO: 4806904 - DNA, 14 bp, Homo sapiens
cctgagccccctgc

SEQ ID NO: 4806905 - DNA, 15 bp, Homo sapiens
cctgagccccctgca

SEQ ID NO: 4806906 - DNA, 17 bp, Homo sapiens
cctgagccccctgcacc

SEQ ID NO: 4806907 - DNA, 23 bp, Homo sapiens
cctgagccccctgcacccacccc

SEQ ID NO: 4806908 - DNA, 14 bp, Homo sapiens
cctgagcctgtctc

SEQ ID NO: 4806909 - DNA, 13 bp, Homo sapiens
cctgagctccacc

SEQ ID NO: 4806910 - DNA, 16 bp, Homo sapiens
cctgagctccaccctc

SEQ ID NO: 4806911 - DNA, 21 bp, Homo sapiens
cctgaggaaggaggggaagct

SEQ ID NO: 4806912 - DNA, 17 bp, Homo sapiens
cctgaggccaaatattg

SEQ ID NO: 4806913 - DNA, 24 bp, Homo sapiens
cctgaggccaaatattgatctgta

SEQ ID NO: 4806914 - DNA, 23 bp, Homo sapiens
cctgaggccaagaaagaaaccag

SEQ ID NO: 4806915 - DNA, 19 bp, Homo sapiens
cctgagggaagcccacccg

SEQ ID NO: 4806916 - DNA, 17 bp, Homo sapiens
cctgagggacgagcaga

SEQ ID NO: 4806917 - DNA, 22 bp, Homo sapiens
cctgagggacgagcagagcgca

SEQ ID NO: 4806918 - DNA, 15 bp, Homo sapiens
cctgagggcccttcc

SEQ ID NO: 4806919 - DNA, 16 bp, Homo sapiens
cctgaggttaagggga

SEQ ID NO: 4806920 - DNA, 18 bp, Homo sapiens
cctgagtcagggcccaga

SEQ ID NO: 4806921 - DNA, 23 bp, Homo sapiens
cctgagtcagggcccagaggctg

SEQ ID NO: 4806922 - DNA, 17 bp, Homo sapiens
cctgatcaaggtgctct

SEQ ID NO: 4806923 - DNA, 17 bp, Homo sapiens
cctgatgcgtctaccca

SEQ ID NO: 4806924 - DNA, 19 bp, Homo sapiens
cctgcaacaccttgtttcc

SEQ ID NO: 4806925 - DNA, 15 bp, Homo sapiens
cctgcaaggcccaca

SEQ ID NO: 4806926 - DNA, 16 bp, Homo sapiens
cctgcaaggcccacag

SEQ ID NO: 4806927 - DNA, 16 bp, Homo sapiens
cctgcaaggtgcacct

SEQ ID NO: 4806928 - DNA, 17 bp, Homo sapiens
cctgcaaggtgcacctg

SEQ ID NO: 4806929 - DNA, 17 bp, Homo sapiens
cctgcaagtggacgtgg

SEQ ID NO: 4806930 - DNA, 17 bp, Homo sapiens
cctgcacacacctgcct

SEQ ID NO: 4806931 - DNA, 20 bp, Homo sapiens
cctgcacagtggtccagggt

SEQ ID NO: 4806932 - DNA, 20 bp, Homo sapiens
cctgcacccacccctgccca

SEQ ID NO: 4806933 - DNA, 12 bp, Homo sapiens
cctgcaccctct

SEQ ID NO: 4806934 - DNA, 22 bp, Homo sapiens
cctgcagaccacactctgcctg

SEQ ID NO: 4806935 - DNA, 15 bp, Homo sapiens
cctgcagaccctgcc

SEQ ID NO: 4806936 - DNA, 16 bp, Homo sapiens
cctgcagaccctgcca

SEQ ID NO: 4806937 - DNA, 17 bp, Homo sapiens
cctgcagaccctgccag

SEQ ID NO: 4806938 - DNA, 12 bp, Homo sapiens
cctgcagagggc

SEQ ID NO: 4806939 - DNA, 16 bp, Homo sapiens
cctgcagcccagaacg

SEQ ID NO: 4806940 - DNA, 22 bp, Homo sapiens
cctgcagctttgaggctggcgg

SEQ ID NO: 4806941 - DNA, 19 bp, Homo sapiens
cctgcaggaaagaaatcag

SEQ ID NO: 4806942 - DNA, 21 bp, Homo sapiens
cctgcagtgttcgcttggctc

SEQ ID NO: 4806943 - DNA, 14 bp, Homo sapiens
cctgcatcatcttg

SEQ ID NO: 4806944 - DNA, 13 bp, Homo sapiens
cctgcatccctcc

SEQ ID NO: 4806945 - DNA, 18 bp, Homo sapiens
cctgcatcccttggcccc

SEQ ID NO: 4806946 - DNA, 19 bp, Homo sapiens
cctgcatcccttggcccct

SEQ ID NO: 4806947 - DNA, 23 bp, Homo sapiens
cctgcatcccttggcccctctct

SEQ ID NO: 4806948 - DNA, 20 bp, Homo sapiens
cctgcatgtcggggcccctg

SEQ ID NO: 4806949 - DNA, 22 bp, Homo sapiens
cctgcatgtcggggcccctgcg

SEQ ID NO: 4806950 - DNA, 24 bp, Homo sapiens
cctgcatgtcggggcccctgcgtg

SEQ ID NO: 4806951 - DNA, 15 bp, Homo sapiens
cctgccaactttcca

SEQ ID NO: 4806952 - DNA, 16 bp, Homo sapiens
cctgccaactttccag

SEQ ID NO: 4806953 - DNA, 22 bp, Homo sapiens
cctgccaccctctgctgcacag

SEQ ID NO: 4806954 - DNA, 19 bp, Homo sapiens
cctgccaggaagccagcag

SEQ ID NO: 4806955 - DNA, 13 bp, Homo sapiens
cctgccaggctgc

SEQ ID NO: 4806956 - DNA, 16 bp, Homo sapiens
cctgccaggctgcagg

SEQ ID NO: 4806957 - DNA, 17 bp, Homo sapiens
cctgcccagcacctcct

SEQ ID NO: 4806958 - DNA, 19 bp, Homo sapiens
cctgcccagcacctcctcc

SEQ ID NO: 4806959 - DNA, 21 bp, Homo sapiens
cctgcccaggcagtctttgct

SEQ ID NO: 4806960 - DNA, 22 bp, Homo sapiens
cctgcccaggccggccagcctc

SEQ ID NO: 4806961 - DNA, 23 bp, Homo sapiens
cctgcccaggccggccagcctca

SEQ ID NO: 4806962 - DNA, 22 bp, Homo sapiens
cctgcccatgtgtcccctcact

SEQ ID NO: 4806963 - DNA, 17 bp, Homo sapiens
cctgccccacacaggcc

SEQ ID NO: 4806964 - DNA, 18 bp, Homo sapiens
cctgccccacacaggcct

SEQ ID NO: 4806965 - DNA, 19 bp, Homo sapiens
cctgccccacacaggcctg

SEQ ID NO: 4806966 - DNA, 13 bp, Homo sapiens
cctgccccagaga

SEQ ID NO: 4806967 - DNA, 16 bp, Homo sapiens
cctgccccagagaagc

SEQ ID NO: 4806968 - DNA, 22 bp, Homo sapiens
cctgccccagagaagcctcagt

SEQ ID NO: 4806969 - DNA, 23 bp, Homo sapiens
cctgccccagagaagcctcagtc

SEQ ID NO: 4806970 - DNA, 19 bp, Homo sapiens
cctgccccccttcccaccc

SEQ ID NO: 4806971 - DNA, 22 bp, Homo sapiens
cctgccccccttcccaccccta

SEQ ID NO: 4806972 - DNA, 22 bp, Homo sapiens
cctgcccctcaactctcctcca

SEQ ID NO: 4806973 - DNA, 15 bp, Homo sapiens
cctgcccgcacagca

SEQ ID NO: 4806974 - DNA, 20 bp, Homo sapiens
cctgcccgcacagcagcctg

SEQ ID NO: 4806975 - DNA, 22 bp, Homo sapiens
cctgcccgcacagcagcctgct

SEQ ID NO: 4806976 - DNA, 13 bp, Homo sapiens
cctgcccgcccgc

SEQ ID NO: 4806977 - DNA, 20 bp, Homo sapiens
cctgcccgcgcccgccgcct

SEQ ID NO: 4806978 - DNA, 16 bp, Homo sapiens
cctgccctcccccacg

SEQ ID NO: 4806979 - DNA, 17 bp, Homo sapiens
cctgccctcccccacgg

SEQ ID NO: 4806980 - DNA, 19 bp, Homo sapiens
cctgccctcccccacggcc

SEQ ID NO: 4806981 - DNA, 16 bp, Homo sapiens
cctgccctggcctacc

SEQ ID NO: 4806982 - DNA, 19 bp, Homo sapiens
cctgccctggcctaccaca

SEQ ID NO: 4806983 - DNA, 19 bp, Homo sapiens
cctgcccttacctgccagg

SEQ ID NO: 4806984 - DNA, 22 bp, Homo sapiens
cctgcccttacctgccaggaag

SEQ ID NO: 4806985 - DNA, 22 bp, Homo sapiens
cctgcctcaccagccctggcaa

SEQ ID NO: 4806986 - DNA, 22 bp, Homo sapiens
cctgcctcatcttccttctcag

SEQ ID NO: 4806987 - DNA, 17 bp, Homo sapiens
cctgcctccggccctgc

SEQ ID NO: 4806988 - DNA, 21 bp, Homo sapiens
cctgcctccggccctgcccca

SEQ ID NO: 4806989 - DNA, 23 bp, Homo sapiens
cctgcctctctcatggcttgggc

SEQ ID NO: 4806990 - DNA, 13 bp, Homo sapiens
cctgcctgggaca

SEQ ID NO: 4806991 - DNA, 20 bp, Homo sapiens
cctgcctgttgggccaggag

SEQ ID NO: 4806992 - DNA, 13 bp, Homo sapiens
cctgcctttgatg

SEQ ID NO: 4806993 - DNA, 15 bp, Homo sapiens
cctgcgcaccccgtt

SEQ ID NO: 4806994 - DNA, 22 bp, Homo sapiens
cctgcgcaccccgttcccagcg

SEQ ID NO: 4806995 - DNA, 19 bp, Homo sapiens
cctgcgccccccagtggac

SEQ ID NO: 4806996 - DNA, 13 bp, Homo sapiens
cctgcgcccctgc

SEQ ID NO: 4806997 - DNA, 18 bp, Homo sapiens
cctgcgcccctgcccagc

SEQ ID NO: 4806998 - DNA, 22 bp, Homo sapiens
cctgcgcccctgcccagcacct

SEQ ID NO: 4806999 - DNA, 15 bp, Homo sapiens
cctgcgccctccctc

SEQ ID NO: 4807000 - DNA, 21 bp, Homo sapiens
cctgcgccctgacatgctaac

SEQ ID NO: 4807001 - DNA, 19 bp, Homo sapiens
cctgcgcctcctcctgcat

SEQ ID NO: 4807002 - DNA, 20 bp, Homo sapiens
cctgcgcctcctcctgcatg

SEQ ID NO: 4807003 - DNA, 16 bp, Homo sapiens
cctgcgcctgcgcctc

SEQ ID NO: 4807004 - DNA, 13 bp, Homo sapiens
cctgcgcgcagct

SEQ ID NO: 4807005 - DNA, 17 bp, Homo sapiens
cctgcgctcctctgcag

SEQ ID NO: 4807006 - DNA, 19 bp, Homo sapiens
cctgcgctcctctgcagcc

SEQ ID NO: 4807007 - DNA, 20 bp, Homo sapiens
cctgcgctcctctgcagcct

SEQ ID NO: 4807008 - DNA, 23 bp, Homo sapiens
cctgcggggcggcatccgagccc

SEQ ID NO: 4807009 - DNA, 20 bp, Homo sapiens
cctgcggggttccctgcgcg

SEQ ID NO: 4807010 - DNA, 14 bp, Homo sapiens
cctgcgtgtgttct

SEQ ID NO: 4807011 - DNA, 21 bp, Homo sapiens
cctgcgtgtgttctctccgga

SEQ ID NO: 4807012 - DNA, 15 bp, Homo sapiens
cctgctacctttgtc

SEQ ID NO: 4807013 - DNA, 16 bp, Homo sapiens
cctgctcacgtctgtg

SEQ ID NO: 4807014 - DNA, 12 bp, Homo sapiens
cctgctcaggcc

SEQ ID NO: 4807015 - DNA, 15 bp, Homo sapiens
cctgctcaggcctca

SEQ ID NO: 4807016 - DNA, 11 bp, Homo sapiens
cctgctccctg

SEQ ID NO: 4807017 - DNA, 16 bp, Homo sapiens
cctgctccctgctccc

SEQ ID NO: 4807018 - DNA, 12 bp, Homo sapiens
cctgctcgccct

SEQ ID NO: 4807019 - DNA, 14 bp, Homo sapiens
cctgctcgccctgt

SEQ ID NO: 4807020 - DNA, 17 bp, Homo sapiens
cctgctcgccctgtgcc

SEQ ID NO: 4807021 - DNA, 21 bp, Homo sapiens
cctgctcgccctgtgccctct

SEQ ID NO: 4807022 - DNA, 22 bp, Homo sapiens
cctgctgccttctgacggccct

SEQ ID NO: 4807023 - DNA, 18 bp, Homo sapiens
cctgctgctcgggaaggc

SEQ ID NO: 4807024 - DNA, 18 bp, Homo sapiens
cctgcttcccacctccct

SEQ ID NO: 4807025 - DNA, 17 bp, Homo sapiens
cctgcttctcccgccat

SEQ ID NO: 4807026 - DNA, 12 bp, Homo sapiens
cctgcttctgct

SEQ ID NO: 4807027 - DNA, 15 bp, Homo sapiens
cctgcttgctggaaa

SEQ ID NO: 4807028 - DNA, 13 bp, Homo sapiens
cctggaaagccct

SEQ ID NO: 4807029 - DNA, 22 bp, Homo sapiens
cctggaagttgtcctttctgat

SEQ ID NO: 4807030 - DNA, 19 bp, Homo sapiens
cctggaggagaaggaggaa

SEQ ID NO: 4807031 - DNA, 15 bp, Homo sapiens
cctggagttctggtt

SEQ ID NO: 4807032 - DNA, 21 bp, Homo sapiens
cctggatggatctgctccatg

SEQ ID NO: 4807033 - DNA, 22 bp, Homo sapiens
cctggatggatctgctccatgc

SEQ ID NO: 4807034 - DNA, 16 bp, Homo sapiens
cctggcagatgggggc

SEQ ID NO: 4807035 - DNA, 22 bp, Homo sapiens
cctggcagggaggtcaggccct

SEQ ID NO: 4807036 - DNA, 13 bp, Homo sapiens
cctggcatgggaa

SEQ ID NO: 4807037 - DNA, 14 bp, Homo sapiens
cctggcatgggaat

SEQ ID NO: 4807038 - DNA, 13 bp, Homo sapiens
cctggccagacgc

SEQ ID NO: 4807039 - DNA, 21 bp, Homo sapiens
cctggccaggggcttctcccc

SEQ ID NO: 4807040 - DNA, 13 bp, Homo sapiens
cctggcccagcca

SEQ ID NO: 4807041 - DNA, 15 bp, Homo sapiens
cctggcccagccagc

SEQ ID NO: 4807042 - DNA, 19 bp, Homo sapiens
cctggcccagccagcaggt

SEQ ID NO: 4807043 - DNA, 23 bp, Homo sapiens
cctggcccatagaaacatgacac

SEQ ID NO: 4807044 - DNA, 15 bp, Homo sapiens
cctggccccagtgac

SEQ ID NO: 4807045 - DNA, 16 bp, Homo sapiens
cctggccccagtgacc

SEQ ID NO: 4807046 - DNA, 13 bp, Homo sapiens
cctggccccctcg

SEQ ID NO: 4807047 - DNA, 20 bp, Homo sapiens
cctggccccctcgcgcccct

SEQ ID NO: 4807048 - DNA, 12 bp, Homo sapiens
cctggccctgcc

SEQ ID NO: 4807049 - DNA, 16 bp, Homo sapiens
cctggccctgccctga

SEQ ID NO: 4807050 - DNA, 15 bp, Homo sapiens
cctggcccttccttc

SEQ ID NO: 4807051 - DNA, 21 bp, Homo sapiens
cctggcccttccttcacccac

SEQ ID NO: 4807052 - DNA, 15 bp, Homo sapiens
cctggcctaccacag

SEQ ID NO: 4807053 - DNA, 22 bp, Homo sapiens
cctggcctaccacagctgcctc

SEQ ID NO: 4807054 - DNA, 15 bp, Homo sapiens
cctggcctggccctg

SEQ ID NO: 4807055 - DNA, 16 bp, Homo sapiens
cctggcctggccctgc

SEQ ID NO: 4807056 - DNA, 12 bp, Homo sapiens
cctggccttgag

SEQ ID NO: 4807057 - DNA, 13 bp, Homo sapiens
cctggcgggcagc

SEQ ID NO: 4807058 - DNA, 16 bp, Homo sapiens
cctggcgggctggtga

SEQ ID NO: 4807059 - DNA, 17 bp, Homo sapiens
cctggcgggctggtgac

SEQ ID NO: 4807060 - DNA, 12 bp, Homo sapiens
cctggctcacag

SEQ ID NO: 4807061 - DNA, 13 bp, Homo sapiens
cctggctcacagc

SEQ ID NO: 4807062 - DNA, 14 bp, Homo sapiens
cctggctcacagcc

SEQ ID NO: 4807063 - DNA, 22 bp, Homo sapiens
cctggctcacagccaccacctg

SEQ ID NO: 4807064 - DNA, 14 bp, Homo sapiens
cctggctctggagc

SEQ ID NO: 4807065 - DNA, 17 bp, Homo sapiens
cctggcttcaccgcatt

SEQ ID NO: 4807066 - DNA, 21 bp, Homo sapiens
cctggcttcaccgcattccag

SEQ ID NO: 4807067 - DNA, 13 bp, Homo sapiens
cctggcttcccag

SEQ ID NO: 4807068 - DNA, 16 bp, Homo sapiens
cctggcttctgggaca

SEQ ID NO: 4807069 - DNA, 23 bp, Homo sapiens
cctgggaaattgctccattcctg

SEQ ID NO: 4807070 - DNA, 18 bp, Homo sapiens
cctgggacagccactgga

SEQ ID NO: 4807071 - DNA, 18 bp, Homo sapiens
cctgggagatgcagctgg

SEQ ID NO: 4807072 - DNA, 19 bp, Homo sapiens
cctgggagatgcagctgga

SEQ ID NO: 4807073 - DNA, 16 bp, Homo sapiens
cctgggatgggaccag

SEQ ID NO: 4807074 - DNA, 16 bp, Homo sapiens
cctcactctgtcagcc

SEQ ID NO: 4807075 - DNA, 18 bp, Homo sapiens
cctcactctgtcagccag

SEQ ID NO: 4807076 - DNA, 22 bp, Homo sapiens
cctcactctgtcagccagccgc

SEQ ID NO: 4807077 - DNA, 12 bp, Homo sapiens
cctcactgccac

SEQ ID NO: 4807078 - DNA, 15 bp, Homo sapiens
cctcactgcccgcac

SEQ ID NO: 4807079 - DNA, 22 bp, Homo sapiens
cctcactgcccgcacaccctca

SEQ ID NO: 4807080 - DNA, 22 bp, Homo sapiens
cctcactgggtgtggcctggct

SEQ ID NO: 4807081 - DNA, 20 bp, Homo sapiens
cctcagacgggctgagagga

SEQ ID NO: 4807082 - DNA, 18 bp, Homo sapiens
cctcagagggtccctagg

SEQ ID NO: 4807083 - DNA, 16 bp, Homo sapiens
cctcagatcttctgtg

SEQ ID NO: 4807084 - DNA, 21 bp, Homo sapiens
cctcagatgatctctccacgg

SEQ ID NO: 4807085 - DNA, 20 bp, Homo sapiens
cctcagcaatataggaggca

SEQ ID NO: 4807086 - DNA, 18 bp, Homo sapiens
cctcagccccagggccct

SEQ ID NO: 4807087 - DNA, 21 bp, Homo sapiens
cctcagccccagggccctgct

SEQ ID NO: 4807088 - DNA, 22 bp, Homo sapiens
cctcagccccagggccctgctc

SEQ ID NO: 4807089 - DNA, 23 bp, Homo sapiens
cctcagccccagggccctgctca

SEQ ID NO: 4807090 - DNA, 11 bp, Homo sapiens
cctcagccctc

SEQ ID NO: 4807091 - DNA, 13 bp, Homo sapiens
cctcagccctcag

SEQ ID NO: 4807092 - DNA, 14 bp, Homo sapiens
cctcagccctcaga

SEQ ID NO: 4807093 - DNA, 18 bp, Homo sapiens
cctcagctctccctcaca

SEQ ID NO: 4807094 - DNA, 23 bp, Homo sapiens
cctcagggaccaaggagatgggg

SEQ ID NO: 4807095 - DNA, 13 bp, Homo sapiens
cctcagtccctcc

SEQ ID NO: 4807096 - DNA, 23 bp, Homo sapiens
cctcagttcaacctggtggcacc

SEQ ID NO: 4807097 - DNA, 17 bp, Homo sapiens
cctcagttggcctctgc

SEQ ID NO: 4807098 - DNA, 20 bp, Homo sapiens
cctcagttggcctctgcccc

SEQ ID NO: 4807099 - DNA, 14 bp, Homo sapiens
cctcatctccatgc

SEQ ID NO: 4807100 - DNA, 13 bp, Homo sapiens
cctcatggctgtt

SEQ ID NO: 4807101 - DNA, 17 bp, Homo sapiens
cctcatggctgttatct

SEQ ID NO: 4807102 - DNA, 12 bp, Homo sapiens
cctcatttgcat

SEQ ID NO: 4807103 - DNA, 23 bp, Homo sapiens
cctcattttgcttcccatctgaa

SEQ ID NO: 4807104 - DNA, 14 bp, Homo sapiens
cctccaaagcctgg

SEQ ID NO: 4807105 - DNA, 20 bp, Homo sapiens
cctccaaagcctgggcagaa

SEQ ID NO: 4807106 - DNA, 13 bp, Homo sapiens
cctccaaatgctg

SEQ ID NO: 4807107 - DNA, 19 bp, Homo sapiens
cctccaccccagtccccgg

SEQ ID NO: 4807108 - DNA, 14 bp, Homo sapiens
cctccacccgtcct

SEQ ID NO: 4807109 - DNA, 17 bp, Homo sapiens
cctccacgcctcctggc

SEQ ID NO: 4807110 - DNA, 19 bp, Homo sapiens
cctccacgcctcctggcca

SEQ ID NO: 4807111 - DNA, 14 bp, Homo sapiens
cctccactcctccc

SEQ ID NO: 4807112 - DNA, 17 bp, Homo sapiens
cctccagacccctaccc

SEQ ID NO: 4807113 - DNA, 19 bp, Homo sapiens
cctccaggaccttgcttcc

SEQ ID NO: 4807114 - DNA, 22 bp, Homo sapiens
cctccaggaccttgcttccttc

SEQ ID NO: 4807115 - DNA, 23 bp, Homo sapiens
cctccaggaccttgcttccttct

SEQ ID NO: 4807116 - DNA, 14 bp, Homo sapiens
cctccagtccccct

SEQ ID NO: 4807117 - DNA, 12 bp, Homo sapiens
cctccatgctgt

SEQ ID NO: 4807118 - DNA, 15 bp, Homo sapiens
cctccatgctgtccc

SEQ ID NO: 4807119 - DNA, 18 bp, Homo sapiens
cctccatgctgtccctgt

SEQ ID NO: 4807120 - DNA, 23 bp, Homo sapiens
cctccatgctgtccctgtgggct

SEQ ID NO: 4807121 - DNA, 16 bp, Homo sapiens
cctcccaactctggcc

SEQ ID NO: 4807122 - DNA, 13 bp, Homo sapiens
cctcccacctcca

SEQ ID NO: 4807123 - DNA, 14 bp, Homo sapiens
cctcccacctcttt

SEQ ID NO: 4807124 - DNA, 19 bp, Homo sapiens
cctcccacctctttcttca

SEQ ID NO: 4807125 - DNA, 11 bp, Homo sapiens
cctcccagcca

SEQ ID NO: 4807126 - DNA, 23 bp, Homo sapiens
cctcccagccacccggatctcca

SEQ ID NO: 4807127 - DNA, 19 bp, Homo sapiens
cctcccagccctgcccaga

SEQ ID NO: 4807128 - DNA, 22 bp, Homo sapiens
cctccccatggtgcagtgaaga

SEQ ID NO: 4807129 - DNA, 16 bp, Homo sapiens
cctcccccaaaccctg

SEQ ID NO: 4807130 - DNA, 16 bp, Homo sapiens
cctcccccacgcctcc

SEQ ID NO: 4807131 - DNA, 13 bp, Homo sapiens
cctcccccgcaga

SEQ ID NO: 4807132 - DNA, 17 bp, Homo sapiens
cctcccccgcagacaga

SEQ ID NO: 4807133 - DNA, 12 bp, Homo sapiens
cctcccctctcc

SEQ ID NO: 4807134 - DNA, 19 bp, Homo sapiens
cctcccctggtcctgcact

SEQ ID NO: 4807135 - DNA, 15 bp, Homo sapiens
cctcccgcaccccga

SEQ ID NO: 4807136 - DNA, 19 bp, Homo sapiens
cctcccgcatgctgcctgc

SEQ ID NO: 4807137 - DNA, 21 bp, Homo sapiens
cctcccgcatgctgcctgcct

SEQ ID NO: 4807138 - DNA, 15 bp, Homo sapiens
cctccctccacacct

SEQ ID NO: 4807139 - DNA, 14 bp, Homo sapiens
cctccctccctcca

SEQ ID NO: 4807140 - DNA, 16 bp, Homo sapiens
cctccctccctccaca

SEQ ID NO: 4807141 - DNA, 15 bp, Homo sapiens
cctccctccctgctc

SEQ ID NO: 4807142 - DNA, 18 bp, Homo sapiens
cctccctccctgctccct

SEQ ID NO: 4807143 - DNA, 13 bp, Homo sapiens
cctccctcctggc

SEQ ID NO: 4807144 - DNA, 14 bp, Homo sapiens
cctccctcctgtgt

SEQ ID NO: 4807145 - DNA, 15 bp, Homo sapiens
cctccctgcccaggc

SEQ ID NO: 4807146 - DNA, 15 bp, Homo sapiens
cctccctgctccctg

SEQ ID NO: 4807147 - DNA, 18 bp, Homo sapiens
cctccgaacgctgctcca

SEQ ID NO: 4807148 - DNA, 16 bp, Homo sapiens
cctccgccagccctgt

SEQ ID NO: 4807149 - DNA, 13 bp, Homo sapiens
cctccgcccttcc

SEQ ID NO: 4807150 - DNA, 16 bp, Homo sapiens
cctccgcggaggcccc

SEQ ID NO: 4807151 - DNA, 21 bp, Homo sapiens
cctccgcggaggcccctgagg

SEQ ID NO: 4807152 - DNA, 19 bp, Homo sapiens
cctccgggcagagaccacc

SEQ ID NO: 4807153 - DNA, 16 bp, Homo sapiens
cctccgggcctcggcc

SEQ ID NO: 4807154 - DNA, 20 bp, Homo sapiens
cctccgggcctcggcctggc

SEQ ID NO: 4807155 - DNA, 13 bp, Homo sapiens
cctccgtccccag

SEQ ID NO: 4807156 - DNA, 16 bp, Homo sapiens
cctccgtccccagggt

SEQ ID NO: 4807157 - DNA, 14 bp, Homo sapiens
cctcctcagatctt

SEQ ID NO: 4807158 - DNA, 13 bp, Homo sapiens
cctcctccagact

SEQ ID NO: 4807159 - DNA, 16 bp, Homo sapiens
cctcctccagagcctg

SEQ ID NO: 4807160 - DNA, 21 bp, Homo sapiens
cctcctccagttctgatgagg

SEQ ID NO: 4807161 - DNA, 22 bp, Homo sapiens
cctcctccatgctgtccctgtg

SEQ ID NO: 4807162 - DNA, 21 bp, Homo sapiens
cctcctcccccacgcctccat

SEQ ID NO: 4807163 - DNA, 12 bp, Homo sapiens
cctcctcctgca

SEQ ID NO: 4807164 - DNA, 14 bp, Homo sapiens
cctcctcgggcgcc

SEQ ID NO: 4807165 - DNA, 21 bp, Homo sapiens
cctcctcgggcgcctgcgctc

SEQ ID NO: 4807166 - DNA, 22 bp, Homo sapiens
cctcctcgggcgcctgcgctcc

SEQ ID NO: 4807167 - DNA, 14 bp, Homo sapiens
cctcctctcctcgt

SEQ ID NO: 4807168 - DNA, 15 bp, Homo sapiens
cctcctctcctcgtc

SEQ ID NO: 4807169 - DNA, 23 bp, Homo sapiens
cctcctctcctcgtccggcctgc

SEQ ID NO: 4807170 - DNA, 20 bp, Homo sapiens
cctcctctgccccctccccc

SEQ ID NO: 4807171 - DNA, 23 bp, Homo sapiens
cctcctctgccccctcccccgca

SEQ ID NO: 4807172 - DNA, 14 bp, Homo sapiens
cctcctcttcaccc

SEQ ID NO: 4807173 - DNA, 22 bp, Homo sapiens
cctcctcttcaccccggcaggc

SEQ ID NO: 4807174 - DNA, 13 bp, Homo sapiens
cctcctgcacgcg

SEQ ID NO: 4807175 - DNA, 23 bp, Homo sapiens
cctcctgcatgtcggggcccctg

SEQ ID NO: 4807176 - DNA, 11 bp, Homo sapiens
cctcctggcca

SEQ ID NO: 4807177 - DNA, 22 bp, Homo sapiens
cctcctggccagacgctgccgc

SEQ ID NO: 4807178 - DNA, 20 bp, Homo sapiens
cctcctgggtgccagtccat

SEQ ID NO: 4807179 - DNA, 17 bp, Homo sapiens
cctcctgtctcctctgt

SEQ ID NO: 4807180 - DNA, 21 bp, Homo sapiens
cctcctgtctcctctgtcagt

SEQ ID NO: 4807181 - DNA, 12 bp, Homo sapiens
cctccttctccc

SEQ ID NO: 4807182 - DNA, 18 bp, Homo sapiens
cctccttctcccctccag

SEQ ID NO: 4807183 - DNA, 21 bp, Homo sapiens
cctccttctcccctccagacc

SEQ ID NO: 4807184 - DNA, 15 bp, Homo sapiens
cctccttctgcagtc

SEQ ID NO: 4807185 - DNA, 22 bp, Homo sapiens
cctccttctgcagtcagactga

SEQ ID NO: 4807186 - DNA, 19 bp, Homo sapiens
cctcgaatgtgtgggccca

SEQ ID NO: 4807187 - DNA, 23 bp, Homo sapiens
cctcgagctctgtagcctggtct

SEQ ID NO: 4807188 - DNA, 19 bp, Homo sapiens
cctcgagtggcgagtccag

SEQ ID NO: 4807189 - DNA, 14 bp, Homo sapiens
cctcgccccccgcc

SEQ ID NO: 4807190 - DNA, 22 bp, Homo sapiens
cctcgccccccgcccggcctcc

SEQ ID NO: 4807191 - DNA, 13 bp, Homo sapiens
cctcgcccccggg

SEQ ID NO: 4807192 - DNA, 15 bp, Homo sapiens
cctcgcgcccctgtc

SEQ ID NO: 4807193 - DNA, 12 bp, Homo sapiens
cctcgctgccac

SEQ ID NO: 4807194 - DNA, 16 bp, Homo sapiens
cctcgctgccacccac

SEQ ID NO: 4807195 - DNA, 17 bp, Homo sapiens
cctcgcttcataggcag

SEQ ID NO: 4807196 - DNA, 19 bp, Homo sapiens
cctcgcttcataggcagag

SEQ ID NO: 4807197 - DNA, 20 bp, Homo sapiens
cctcgcttcataggcagagc

SEQ ID NO: 4807198 - DNA, 18 bp, Homo sapiens
cctcggcagctccggaag

SEQ ID NO: 4807199 - DNA, 15 bp, Homo sapiens
caggaaggcctgggt

SEQ ID NO: 4807200 - DNA, 15 bp, Homo sapiens
caggaaggctaaagg

SEQ ID NO: 4807201 - DNA, 18 bp, Homo sapiens
caggaagtcaggagccag

SEQ ID NO: 4807202 - DNA, 23 bp, Homo sapiens
caggaagtcaggagccagcaggg

SEQ ID NO: 4807203 - DNA, 19 bp, Homo sapiens
caggaagtcatcctgcaat

SEQ ID NO: 4807204 - DNA, 17 bp, Homo sapiens
caggaccaccctgccaa

SEQ ID NO: 4807205 - DNA, 14 bp, Homo sapiens
caggaccaggagcc

SEQ ID NO: 4807206 - DNA, 20 bp, Homo sapiens
caggacccccccagtccgcc

SEQ ID NO: 4807207 - DNA, 22 bp, Homo sapiens
caggacccccccagtccgcccc

SEQ ID NO: 4807208 - DNA, 23 bp, Homo sapiens
caggacccccccagtccgccccg

SEQ ID NO: 4807209 - DNA, 13 bp, Homo sapiens
caggacccctggg

SEQ ID NO: 4807210 - DNA, 15 bp, Homo sapiens
caggagaaggcctgc

SEQ ID NO: 4807211 - DNA, 19 bp, Homo sapiens
caggagaaggcctgccccc

SEQ ID NO: 4807212 - DNA, 16 bp, Homo sapiens
caggagcatgtcctat

SEQ ID NO: 4807213 - DNA, 17 bp, Homo sapiens
caggagcatgtcctatc

SEQ ID NO: 4807214 - DNA, 15 bp, Homo sapiens
caggagccagcaggg

SEQ ID NO: 4807215 - DNA, 12 bp, Homo sapiens
caggagccaggt

SEQ ID NO: 4807216 - DNA, 23 bp, Homo sapiens
caggagccaggtgtcctgactgt

SEQ ID NO: 4807217 - DNA, 17 bp, Homo sapiens
caggagccgcagaggcc

SEQ ID NO: 4807218 - DNA, 18 bp, Homo sapiens
caggagccgcagaggccc

SEQ ID NO: 4807219 - DNA, 14 bp, Homo sapiens
caggagcctcctgc

SEQ ID NO: 4807220 - DNA, 20 bp, Homo sapiens
caggagcctcctgcccttac

SEQ ID NO: 4807221 - DNA, 14 bp, Homo sapiens
caggagcgtgtact

SEQ ID NO: 4807222 - DNA, 14 bp, Homo sapiens
caggagcgtgtcct

SEQ ID NO: 4807223 - DNA, 17 bp, Homo sapiens
caggagcgtgtcctatc

SEQ ID NO: 4807224 - DNA, 13 bp, Homo sapiens
caggagctccctt

SEQ ID NO: 4807225 - DNA, 21 bp, Homo sapiens
caggagctccctttttgaatt

SEQ ID NO: 4807226 - DNA, 23 bp, Homo sapiens
caggagctccctttttgaattgt

SEQ ID NO: 4807227 - DNA, 14 bp, Homo sapiens
caggaggcctggga

SEQ ID NO: 4807228 - DNA, 16 bp, Homo sapiens
caggaggcctgggaga

SEQ ID NO: 4807229 - DNA, 14 bp, Homo sapiens
caggagtgactctg

SEQ ID NO: 4807230 - DNA, 21 bp, Homo sapiens
caggagtgactctggctgcca

SEQ ID NO: 4807231 - DNA, 23 bp, Homo sapiens
caggagtgactctggctgccaag

SEQ ID NO: 4807232 - DNA, 14 bp, Homo sapiens
caggagttcctttc

SEQ ID NO: 4807233 - DNA, 15 bp, Homo sapiens
caggatcctggcctg

SEQ ID NO: 4807234 - DNA, 16 bp, Homo sapiens
caggatcctggcctga

SEQ ID NO: 4807235 - DNA, 23 bp, Homo sapiens
caggatgaaggggccagaccacg

SEQ ID NO: 4807236 - DNA, 18 bp, Homo sapiens
caggatggtctccatctc

SEQ ID NO: 4807237 - DNA, 21 bp, Homo sapiens
caggatgttcaacttaatgaa

SEQ ID NO: 4807238 - DNA, 20 bp, Homo sapiens
caggattgtccacaaatgtc

SEQ ID NO: 4807239 - DNA, 16 bp, Homo sapiens
caggattgtctgctgc

SEQ ID NO: 4807240 - DNA, 21 bp, Homo sapiens
caggattgtctgctgcctcca

SEQ ID NO: 4807241 - DNA, 20 bp, Homo sapiens
caggcaacttcagtcctggg

SEQ ID NO: 4807242 - DNA, 23 bp, Homo sapiens
caggcaagacaccttcccagctg

SEQ ID NO: 4807243 - DNA, 15 bp, Homo sapiens
caggcaatagtgttg

SEQ ID NO: 4807244 - DNA, 21 bp, Homo sapiens
caggcaatagtgttgaggagg

SEQ ID NO: 4807245 - DNA, 16 bp, Homo sapiens
caggcacacagcagcc

SEQ ID NO: 4807246 - DNA, 17 bp, Homo sapiens
caggcacacagcagccc

SEQ ID NO: 4807247 - DNA, 15 bp, Homo sapiens
caggcaccgccagag

SEQ ID NO: 4807248 - DNA, 22 bp, Homo sapiens
caggcaccgccagagtgtcctg

SEQ ID NO: 4807249 - DNA, 16 bp, Homo sapiens
caggcacggaggctcg

SEQ ID NO: 4807250 - DNA, 13 bp, Homo sapiens
caggcagcctgtg

SEQ ID NO: 4807251 - DNA, 18 bp, Homo sapiens
caggcagcctgtgggtcc

SEQ ID NO: 4807252 - DNA, 19 bp, Homo sapiens
caggcagcctgtgggtcct

SEQ ID NO: 4807253 - DNA, 22 bp, Homo sapiens
caggcagggagggaaacccggg

SEQ ID NO: 4807254 - DNA, 20 bp, Homo sapiens
caggcatccgctgcgctccc

SEQ ID NO: 4807255 - DNA, 17 bp, Homo sapiens
caggcatttagctagtt

SEQ ID NO: 4807256 - DNA, 15 bp, Homo sapiens
caggccagctgcttg

SEQ ID NO: 4807257 - DNA, 21 bp, Homo sapiens
caggccatcaccacagctgca

SEQ ID NO: 4807258 - DNA, 18 bp, Homo sapiens
caggccccatcagcatcc

SEQ ID NO: 4807259 - DNA, 21 bp, Homo sapiens
caggccccatcagcatcccac

SEQ ID NO: 4807260 - DNA, 15 bp, Homo sapiens
caggcccgccctgcc

SEQ ID NO: 4807261 - DNA, 10 bp, Homo sapiens
caggccctgg

SEQ ID NO: 4807262 - DNA, 13 bp, Homo sapiens
caggccggccagc

SEQ ID NO: 4807263 - DNA, 14 bp, Homo sapiens
caggccggccagcc

SEQ ID NO: 4807264 - DNA, 19 bp, Homo sapiens
ccggcggagctctggcttt

SEQ ID NO: 4807265 - DNA, 22 bp, Homo sapiens
ccgggagcctccccctcagatg

SEQ ID NO: 4807266 - DNA, 15 bp, Homo sapiens
ccgggcaggtcctgc

SEQ ID NO: 4807267 - DNA, 19 bp, Homo sapiens
ccgggccccatggtcacag

SEQ ID NO: 4807268 - DNA, 17 bp, Homo sapiens
ccgggcctcggcctggc

SEQ ID NO: 4807269 - DNA, 19 bp, Homo sapiens
ccgggcctcggcctggctt

SEQ ID NO: 4807270 - DNA, 18 bp, Homo sapiens
ccggggtgcccgtgtggc

SEQ ID NO: 4807271 - DNA, 14 bp, Homo sapiens
ccggggtgtggaat

SEQ ID NO: 4807272 - DNA, 17 bp, Homo sapiens
ccgggtactcagtcagc

SEQ ID NO: 4807273 - DNA, 21 bp, Homo sapiens
ccgggtactcagtcagcccag

SEQ ID NO: 4807274 - DNA, 22 bp, Homo sapiens
ccgggtgccccccatgccctcc

SEQ ID NO: 4807275 - DNA, 22 bp, Homo sapiens
ccgggtgcgtgaccggcccgcc

SEQ ID NO: 4807276 - DNA, 13 bp, Homo sapiens
ccgggtgtggcct

SEQ ID NO: 4807277 - DNA, 16 bp, Homo sapiens
ccgggtgtggcctcag

SEQ ID NO: 4807278 - DNA, 20 bp, Homo sapiens
ccgggtgtggcctcagccct

SEQ ID NO: 4807279 - DNA, 22 bp, Homo sapiens
ccgggtgtggcctcagccctca

SEQ ID NO: 4807280 - DNA, 13 bp, Homo sapiens
ccggtccaccccg

SEQ ID NO: 4807281 - DNA, 14 bp, Homo sapiens
ccggtgccttccac

SEQ ID NO: 4807282 - DNA, 17 bp, Homo sapiens
ccggtgccttccaccct

SEQ ID NO: 4807283 - DNA, 20 bp, Homo sapiens
ccggtggcttctggcacctg

SEQ ID NO: 4807284 - DNA, 18 bp, Homo sapiens
ccggttggccggctggcc

SEQ ID NO: 4807285 - DNA, 19 bp, Homo sapiens
ccggttggccggctggccg

SEQ ID NO: 4807286 - DNA, 13 bp, Homo sapiens
ccgtcaccccgct

SEQ ID NO: 4807287 - DNA, 12 bp, Homo sapiens
ccgtcacgcttt

SEQ ID NO: 4807288 - DNA, 16 bp, Homo sapiens
ccgtcacgctttcatg

SEQ ID NO: 4807289 - DNA, 12 bp, Homo sapiens
ccgtccccaggg

SEQ ID NO: 4807290 - DNA, 13 bp, Homo sapiens
ccgtccccagggt

SEQ ID NO: 4807291 - DNA, 13 bp, Homo sapiens
ccgtccctttccc

SEQ ID NO: 4807292 - DNA, 12 bp, Homo sapiens
ccgtccgcccgc

SEQ ID NO: 4807293 - DNA, 17 bp, Homo sapiens
ccgtccgcccgcccacc

SEQ ID NO: 4807294 - DNA, 18 bp, Homo sapiens
ccgtccgcccgcccaccc

SEQ ID NO: 4807295 - DNA, 16 bp, Homo sapiens
ccgtccgtccgcccgc

SEQ ID NO: 4807296 - DNA, 14 bp, Homo sapiens
ccgtcctgctcgcc

SEQ ID NO: 4807297 - DNA, 19 bp, Homo sapiens
ccgtcctgctcgccctgtg

SEQ ID NO: 4807298 - DNA, 21 bp, Homo sapiens
ccgtctgccccttgaccccac

SEQ ID NO: 4807299 - DNA, 12 bp, Homo sapiens
ccgtctgtcctg

SEQ ID NO: 4807300 - DNA, 15 bp, Homo sapiens
ccgtctgtcctgcgc

SEQ ID NO: 4807301 - DNA, 18 bp, Homo sapiens
ccgtctttggttcctcat

SEQ ID NO: 4807302 - DNA, 21 bp, Homo sapiens
ccgtctttggttcctcatggc

SEQ ID NO: 4807303 - DNA, 21 bp, Homo sapiens
ccgtgagcaggaaggcctggg

SEQ ID NO: 4807304 - DNA, 20 bp, Homo sapiens
ccgtggccctgccctctcct

SEQ ID NO: 4807305 - DNA, 15 bp, Homo sapiens
ccgtggtgtcctctg

SEQ ID NO: 4807306 - DNA, 18 bp, Homo sapiens
ccgtggtgtcctctgtcc

SEQ ID NO: 4807307 - DNA, 16 bp, Homo sapiens
ccgtggtgtgaggccc

SEQ ID NO: 4807308 - DNA, 18 bp, Homo sapiens
ccgtggtgtgaggccccc

SEQ ID NO: 4807309 - DNA, 23 bp, Homo sapiens
ccgtggtgtgaggcccccggagg

SEQ ID NO: 4807310 - DNA, 12 bp, Homo sapiens
ccgttcatctga

SEQ ID NO: 4807311 - DNA, 19 bp, Homo sapiens
cctaaaagaaaccctgcac

SEQ ID NO: 4807312 - DNA, 21 bp, Homo sapiens
cctaaacatagtggtatttta

SEQ ID NO: 4807313 - DNA, 23 bp, Homo sapiens
cctaaataaacacatagattcac

SEQ ID NO: 4807314 - DNA, 19 bp, Homo sapiens
cctaagtaaatctaaatta

SEQ ID NO: 4807315 - DNA, 15 bp, Homo sapiens
cctaatattcatgct

SEQ ID NO: 4807316 - DNA, 23 bp, Homo sapiens
cctaatccacctggtggccctgc

SEQ ID NO: 4807317 - DNA, 18 bp, Homo sapiens
cctaatctcatacctctg

SEQ ID NO: 4807318 - DNA, 21 bp, Homo sapiens
cctaatctcatacctctgacc

SEQ ID NO: 4807319 - DNA, 17 bp, Homo sapiens
cctaattcctgtatgtt

SEQ ID NO: 4807320 - DNA, 15 bp, Homo sapiens
cctacaaatcagtaa

SEQ ID NO: 4807321 - DNA, 14 bp, Homo sapiens
cctacagcctgcac

SEQ ID NO: 4807322 - DNA, 15 bp, Homo sapiens
cctacagcctgcaca

SEQ ID NO: 4807323 - DNA, 16 bp, Homo sapiens
cctacagcctgcacac

SEQ ID NO: 4807324 - DNA, 19 bp, Homo sapiens
cctacagcttgaccgtgag

SEQ ID NO: 4807325 - DNA, 12 bp, Homo sapiens
cctacatctgaa

SEQ ID NO: 4807326 - DNA, 14 bp, Homo sapiens
cctaccaaatataa

SEQ ID NO: 4807327 - DNA, 18 bp, Homo sapiens
cctaccaaatataaactt

SEQ ID NO: 4807328 - DNA, 17 bp, Homo sapiens
cctaccacagctgcctc

SEQ ID NO: 4807329 - DNA, 15 bp, Homo sapiens
cctaccctcttctca

SEQ ID NO: 4807330 - DNA, 14 bp, Homo sapiens
cctaccctttccca

SEQ ID NO: 4807331 - DNA, 16 bp, Homo sapiens
cctaccttatagagca

SEQ ID NO: 4807332 - DNA, 20 bp, Homo sapiens
cctaccttatagagcacaat

SEQ ID NO: 4807333 - DNA, 23 bp, Homo sapiens
cctactcctccccctcctccatg

SEQ ID NO: 4807334 - DNA, 15 bp, Homo sapiens
cctacttaaacaaaa

SEQ ID NO: 4807335 - DNA, 21 bp, Homo sapiens
cctagaggggacaagccaggc

SEQ ID NO: 4807336 - DNA, 21 bp, Homo sapiens
cctagcactttgggaggctga

SEQ ID NO: 4807337 - DNA, 12 bp, Homo sapiens
cctagcagtgaa

SEQ ID NO: 4807338 - DNA, 20 bp, Homo sapiens
cctagcccaccctgctgcct

SEQ ID NO: 4807339 - DNA, 14 bp, Homo sapiens
cctagcctctccgc

SEQ ID NO: 4807340 - DNA, 19 bp, Homo sapiens
cctagcttattttgtggct

SEQ ID NO: 4807341 - DNA, 17 bp, Homo sapiens
cctaggcatactctcca

SEQ ID NO: 4807342 - DNA, 15 bp, Homo sapiens
cctaggtctccaccc

SEQ ID NO: 4807343 - DNA, 18 bp, Homo sapiens
cctaggtctccacccctc

SEQ ID NO: 4807344 - DNA, 21 bp, Homo sapiens
cctaggtctccacccctcaag

SEQ ID NO: 4807345 - DNA, 12 bp, Homo sapiens
cctaggtgctca

SEQ ID NO: 4807346 - DNA, 24 bp, Homo sapiens
cctaggtgggtcaactccaaggca

SEQ ID NO: 4807347 - DNA, 13 bp, Homo sapiens
cctagttctttgc

SEQ ID NO: 4807348 - DNA, 15 bp, Homo sapiens
cctagtttgacctca

SEQ ID NO: 4807349 - DNA, 11 bp, Homo sapiens
cctataaatgg

SEQ ID NO: 4807350 - DNA, 15 bp, Homo sapiens
cctataaatggactt

SEQ ID NO: 4807351 - DNA, 23 bp, Homo sapiens
cctatcatcagttaggattaggt

SEQ ID NO: 4807352 - DNA, 13 bp, Homo sapiens
cctatccctggac

SEQ ID NO: 4807353 - DNA, 16 bp, Homo sapiens
cctatcctgcaccctc

SEQ ID NO: 4807354 - DNA, 14 bp, Homo sapiens
cctatccttggcac

SEQ ID NO: 4807355 - DNA, 16 bp, Homo sapiens
cctatccttggcacca

SEQ ID NO: 4807356 - DNA, 14 bp, Homo sapiens
cctatctcccacaa

SEQ ID NO: 4807357 - DNA, 14 bp, Homo sapiens
cctatctcttcctg

SEQ ID NO: 4807358 - DNA, 18 bp, Homo sapiens
cctatctcttcctgtcta

SEQ ID NO: 4807359 - DNA, 20 bp, Homo sapiens
cctatctgtattggcagcac

SEQ ID NO: 4807360 - DNA, 15 bp, Homo sapiens
cctatgaccctgtgc

SEQ ID NO: 4807361 - DNA, 17 bp, Homo sapiens
cctatgaccctgtgcct

SEQ ID NO: 4807362 - DNA, 18 bp, Homo sapiens
cctatggaaagggtgtgg

SEQ ID NO: 4807363 - DNA, 21 bp, Homo sapiens
cctattgctgtaaataaaaat

SEQ ID NO: 4807364 - DNA, 24 bp, Homo sapiens
cctattgctgtaaataaaaatagc

SEQ ID NO: 4807365 - DNA, 20 bp, Homo sapiens
cctattttggacgtgtgagg

SEQ ID NO: 4807366 - DNA, 17 bp, Homo sapiens
cctcaaaaatcatcaaa

SEQ ID NO: 4807367 - DNA, 21 bp, Homo sapiens
cctcaactctcctccagagtc

SEQ ID NO: 4807368 - DNA, 15 bp, Homo sapiens
cctcaagccaggaga

SEQ ID NO: 4807369 - DNA, 19 bp, Homo sapiens
cctcaagccaggagaccct

SEQ ID NO: 4807370 - DNA, 20 bp, Homo sapiens
cctcaagccaggagaccctg

SEQ ID NO: 4807371 - DNA, 19 bp, Homo sapiens
cctcaccccgttacagctc

SEQ ID NO: 4807372 - DNA, 20 bp, Homo sapiens
cctcacctggcttcccagga

SEQ ID NO: 4807373 - DNA, 24 bp, Homo sapiens
cctcacctggcttcccaggaccct

SEQ ID NO: 4807374 - DNA, 20 bp, Homo sapiens
cctcactatggtatgctggc

SEQ ID NO: 4807375 - DNA, 22 bp, Homo sapiens
cctcactatggtatgctggcca

SEQ ID NO: 4807376 - DNA, 23 bp, Homo sapiens
cctcactatggtatgctggccag

SEQ ID NO: 4807377 - DNA, 17 bp, Homo sapiens
cctcactccactcccct

SEQ ID NO: 4807378 - DNA, 23 bp, Homo sapiens
cctcactccactcccctcatcca

SEQ ID NO: 4807379 - DNA, 12 bp, Homo sapiens
cctcactctgcc

SEQ ID NO: 4807380 - DNA, 14 bp, Homo sapiens
cctcactctgccag

SEQ ID NO: 4807381 - DNA, 15 bp, Homo sapiens
cctcactctgccagg

SEQ ID NO: 4807382 - DNA, 18 bp, Homo sapiens
cctcactctgccagggca

SEQ ID NO: 4807383 - DNA, 13 bp, Homo sapiens
ccttccttgacct

SEQ ID NO: 4807384 - DNA, 22 bp, Homo sapiens
ccttctaatccatgtgctgctg

SEQ ID NO: 4807385 - DNA, 14 bp, Homo sapiens
ccttctcacagcac

SEQ ID NO: 4807386 - DNA, 20 bp, Homo sapiens
ccttctcagccttggttcct

SEQ ID NO: 4807387 - DNA, 16 bp, Homo sapiens
ccttctcatcttgcct

SEQ ID NO: 4807388 - DNA, 15 bp, Homo sapiens
ccttctcccctccag

SEQ ID NO: 4807389 - DNA, 18 bp, Homo sapiens
ccttctcccctccagacc

SEQ ID NO: 4807390 - DNA, 16 bp, Homo sapiens
ccttctgaagatctca

SEQ ID NO: 4807391 - DNA, 17 bp, Homo sapiens
ccttctgacggccctgc

SEQ ID NO: 4807392 - DNA, 18 bp, Homo sapiens
ccttctgcagtcagactg

SEQ ID NO: 4807393 - DNA, 21 bp, Homo sapiens
ccttctgccaaggccagccca

SEQ ID NO: 4807394 - DNA, 22 bp, Homo sapiens
ccttctggaataaggagaatga

SEQ ID NO: 4807395 - DNA, 18 bp, Homo sapiens
ccttctggccgctgcagt

SEQ ID NO: 4807396 - DNA, 20 bp, Homo sapiens
ccttctggccgctgcagtca

SEQ ID NO: 4807397 - DNA, 18 bp, Homo sapiens
ccttctggctgctgcagt

SEQ ID NO: 4807398 - DNA, 23 bp, Homo sapiens
ccttctgtgcatctggcctgggg

SEQ ID NO: 4807399 - DNA, 14 bp, Homo sapiens
ccttcttgctcagt

SEQ ID NO: 4807400 - DNA, 15 bp, Homo sapiens
ccttcttgctcagtc

SEQ ID NO: 4807401 - DNA, 18 bp, Homo sapiens
ccttcttgctcagtccct

SEQ ID NO: 4807402 - DNA, 16 bp, Homo sapiens
ccttcttgtctctctg

SEQ ID NO: 4807403 - DNA, 15 bp, Homo sapiens
ccttctttccttcct

SEQ ID NO: 4807404 - DNA, 16 bp, Homo sapiens
ccttcttttcaatgca

SEQ ID NO: 4807405 - DNA, 18 bp, Homo sapiens
ccttcttttcaatgcaat

SEQ ID NO: 4807406 - DNA, 19 bp, Homo sapiens
ccttcttttcaatgcaatg

SEQ ID NO: 4807407 - DNA, 16 bp, Homo sapiens
ccttcttttcctgggt

SEQ ID NO: 4807408 - DNA, 21 bp, Homo sapiens
ccttcttttcctgggtgctca

SEQ ID NO: 4807409 - DNA, 22 bp, Homo sapiens
ccttcttttcctgggtgctcag

SEQ ID NO: 4807410 - DNA, 18 bp, Homo sapiens
ccttgaaaccagctcagg

SEQ ID NO: 4807411 - DNA, 17 bp, Homo sapiens
ccttgaaatttctcagc

SEQ ID NO: 4807412 - DNA, 13 bp, Homo sapiens
ccttgaccttcct

SEQ ID NO: 4807413 - DNA, 12 bp, Homo sapiens
ccttgagcacta

SEQ ID NO: 4807414 - DNA, 21 bp, Homo sapiens
ccttgagccgtgacctccagg

SEQ ID NO: 4807415 - DNA, 17 bp, Homo sapiens
ccttgagctggttttct

SEQ ID NO: 4807416 - DNA, 19 bp, Homo sapiens
ccttgagtagtttttatct

SEQ ID NO: 4807417 - DNA, 12 bp, Homo sapiens
ccttgagtctct

SEQ ID NO: 4807418 - DNA, 19 bp, Homo sapiens
ccttgcctccaggaccttg

SEQ ID NO: 4807419 - DNA, 18 bp, Homo sapiens
ccttgctcaccaagctgt

SEQ ID NO: 4807420 - DNA, 16 bp, Homo sapiens
ccttgcttccttctca

SEQ ID NO: 4807421 - DNA, 17 bp, Homo sapiens
ccttggagagacacagc

SEQ ID NO: 4807422 - DNA, 22 bp, Homo sapiens
ccttggcccagcagcggcccag

SEQ ID NO: 4807423 - DNA, 13 bp, Homo sapiens
ccttggcccctct

SEQ ID NO: 4807424 - DNA, 14 bp, Homo sapiens
ccttggcccctctc

SEQ ID NO: 4807425 - DNA, 20 bp, Homo sapiens
ccttggcctagcccaccctg

SEQ ID NO: 4807426 - DNA, 14 bp, Homo sapiens
ccttgggcgggcca

SEQ ID NO: 4807427 - DNA, 14 bp, Homo sapiens
ccttggggagcagg

SEQ ID NO: 4807428 - DNA, 18 bp, Homo sapiens
ccttggggagcagtggcc

SEQ ID NO: 4807429 - DNA, 13 bp, Homo sapiens
ccttggttcctcc

SEQ ID NO: 4807430 - DNA, 14 bp, Homo sapiens
ccttggttcctcca

SEQ ID NO: 4807431 - DNA, 16 bp, Homo sapiens
ccttggttcctccagc

SEQ ID NO: 4807432 - DNA, 17 bp, Homo sapiens
ccttggttcctccagca

SEQ ID NO: 4807433 - DNA, 12 bp, Homo sapiens
ccttggttcctg

SEQ ID NO: 4807434 - DNA, 16 bp, Homo sapiens
ccttggttttgcctct

SEQ ID NO: 4807435 - DNA, 21 bp, Homo sapiens
ccttggttttgcctctttaaa

SEQ ID NO: 4807436 - DNA, 19 bp, Homo sapiens
ccttgtagacgcacctgct

SEQ ID NO: 4807437 - DNA, 20 bp, Homo sapiens
ccttgtgatcactttctgaa

SEQ ID NO: 4807438 - DNA, 14 bp, Homo sapiens
ccttgtgtatcctg

SEQ ID NO: 4807439 - DNA, 17 bp, Homo sapiens
ccttgtgtatcctgaca

SEQ ID NO: 4807440 - DNA, 21 bp, Homo sapiens
ccttgtttctcttcctttctt

SEQ ID NO: 4807441 - DNA, 22 bp, Homo sapiens
ccttgtttgcctttaggcagga

SEQ ID NO: 4807442 - DNA, 14 bp, Homo sapiens
ccttgtttttttct

SEQ ID NO: 4807443 - DNA, 20 bp, Homo sapiens
cctttagaatattaaaaatt

SEQ ID NO: 4807444 - DNA, 16 bp, Homo sapiens
cctttaggcaggaagt

SEQ ID NO: 4807445 - DNA, 19 bp, Homo sapiens
cctttatttattaaacttc

SEQ ID NO: 4807446 - DNA, 16 bp, Homo sapiens
cctttcaaagtgcaca

SEQ ID NO: 4807447 - DNA, 21 bp, Homo sapiens
cctttcccgatgcgtggctcc

SEQ ID NO: 4807448 - DNA, 17 bp, Homo sapiens
cctttccctgcatccct

SEQ ID NO: 4807449 - DNA, 21 bp, Homo sapiens
cctttccgctgtcgccccagg

SEQ ID NO: 4807450 - DNA, 18 bp, Homo sapiens
cctttccgtgccgggagc

SEQ ID NO: 4807451 - DNA, 16 bp, Homo sapiens
cctttcctctcctctc

SEQ ID NO: 4807452 - DNA, 16 bp, Homo sapiens
cctttccttgccttct

SEQ ID NO: 4807453 - DNA, 14 bp, Homo sapiens
cctttctcttgctg

SEQ ID NO: 4807454 - DNA, 18 bp, Homo sapiens
cctttcttccttcctttc

SEQ ID NO: 4807455 - DNA, 12 bp, Homo sapiens
cctttgtaacca

SEQ ID NO: 4807456 - DNA, 16 bp, Homo sapiens
cctttgtcaacttcag

SEQ ID NO: 4807457 - DNA, 22 bp, Homo sapiens
cctttgtctcacgattccagtg

SEQ ID NO: 4807458 - DNA, 23 bp, Homo sapiens
ccttttaaaaaaataatataaat

SEQ ID NO: 4807459 - DNA, 19 bp, Homo sapiens
ccttttcctgaggtcatct

SEQ ID NO: 4807460 - DNA, 14 bp, Homo sapiens
cctttttgaattgt

SEQ ID NO: 4807461 - DNA, 18 bp, Homo sapiens
cgaaacccttgactgtta

SEQ ID NO: 4807462 - DNA, 15 bp, Homo sapiens
cgaacaaaccaagga

SEQ ID NO: 4807463 - DNA, 16 bp, Homo sapiens
cgaagaccttctgaag

SEQ ID NO: 4807464 - DNA, 22 bp, Homo sapiens
cgaagaccttctgaagatctca

SEQ ID NO: 4807465 - DNA, 12 bp, Homo sapiens
cgaatggctttt

SEQ ID NO: 4807466 - DNA, 21 bp, Homo sapiens
cgaatgtgtgggcccaaggcc

SEQ ID NO: 4807467 - DNA, 17 bp, Homo sapiens
cgacacaggctgccgct

SEQ ID NO: 4807468 - DNA, 18 bp, Homo sapiens
cgaccgacgcccctccgg

SEQ ID NO: 4807469 - DNA, 16 bp, Homo sapiens
cgacctacatctgaaa

SEQ ID NO: 4807470 - DNA, 13 bp, Homo sapiens
cgacgcccctccg

SEQ ID NO: 4807471 - DNA, 14 bp, Homo sapiens
cgacgcccctccgg

SEQ ID NO: 4807472 - DNA, 15 bp, Homo sapiens
cgacgcccctccggg

SEQ ID NO: 4807473 - DNA, 23 bp, Homo sapiens
cgacttgggacggaagtggcctg

SEQ ID NO: 4807474 - DNA, 13 bp, Homo sapiens
cgagaagctctcg

SEQ ID NO: 4807475 - DNA, 18 bp, Homo sapiens
cgagagggctgagcccct

SEQ ID NO: 4807476 - DNA, 22 bp, Homo sapiens
cgagagggctgagcccctcctc

SEQ ID NO: 4807477 - DNA, 13 bp, Homo sapiens
cgagattcagact

SEQ ID NO: 4807478 - DNA, 17 bp, Homo sapiens
cgagcgcgtgccttccc

SEQ ID NO: 4807479 - DNA, 18 bp, Homo sapiens
cgagcgcgtgccttcccc

SEQ ID NO: 4807480 - DNA, 11 bp, Homo sapiens
cgagctctgta

SEQ ID NO: 4807481 - DNA, 20 bp, Homo sapiens
cgagctctgtagcctggtct

SEQ ID NO: 4807482 - DNA, 16 bp, Homo sapiens
cgaggactccaggggc

SEQ ID NO: 4807483 - DNA, 20 bp, Homo sapiens
cgaggcaccggacgctggag

SEQ ID NO: 4807484 - DNA, 17 bp, Homo sapiens
cgaggcagaatggtggg

SEQ ID NO: 4807485 - DNA, 20 bp, Homo sapiens
cgaggcagaatggtgggctc

SEQ ID NO: 4807486 - DNA, 19 bp, Homo sapiens
cgaggcagcaacaggacca

SEQ ID NO: 4807487 - DNA, 18 bp, Homo sapiens
cgaggcctggctctggag

SEQ ID NO: 4807488 - DNA, 20 bp, Homo sapiens
cgaggcggcaaagatccagc

SEQ ID NO: 4807489 - DNA, 13 bp, Homo sapiens
cgagggaagcagt

SEQ ID NO: 4807490 - DNA, 18 bp, Homo sapiens
cgagggcgcctgggtcct

SEQ ID NO: 4807491 - DNA, 14 bp, Homo sapiens
cgagtcaccttcca

SEQ ID NO: 4807492 - DNA, 18 bp, Homo sapiens
cctgggatgggaccaggg

SEQ ID NO: 4807493 - DNA, 15 bp, Homo sapiens
cctgggcagcccaga

SEQ ID NO: 4807494 - DNA, 17 bp, Homo sapiens
cctgggcagcccagaga

SEQ ID NO: 4807495 - DNA, 18 bp, Homo sapiens
cctgggcagcccagagag

SEQ ID NO: 4807496 - DNA, 18 bp, Homo sapiens
cctgggcccctccacgcc

SEQ ID NO: 4807497 - DNA, 22 bp, Homo sapiens
cctgggcctcagttcaacctgg

SEQ ID NO: 4807498 - DNA, 12 bp, Homo sapiens
cctgggcctccc

SEQ ID NO: 4807499 - DNA, 22 bp, Homo sapiens
cctgggcgcaagcgacacaggc

SEQ ID NO: 4807500 - DNA, 14 bp, Homo sapiens
cctgggctgtgagg

SEQ ID NO: 4807501 - DNA, 16 bp, Homo sapiens
cctgggctgtgaggac

SEQ ID NO: 4807502 - DNA, 15 bp, Homo sapiens
cctggggaggacccc

SEQ ID NO: 4807503 - DNA, 21 bp, Homo sapiens
cctggggcagggtggggggcc

SEQ ID NO: 4807504 - DNA, 16 bp, Homo sapiens
cctggggcctggcagg

SEQ ID NO: 4807505 - DNA, 13 bp, Homo sapiens
cctggggctgggc

SEQ ID NO: 4807506 - DNA, 18 bp, Homo sapiens
cctgggggaggcttccag

SEQ ID NO: 4807507 - DNA, 20 bp, Homo sapiens
cctgggggaggcttccagct

SEQ ID NO: 4807508 - DNA, 13 bp, Homo sapiens
cctgggggctgct

SEQ ID NO: 4807509 - DNA, 20 bp, Homo sapiens
cctgggggctgggcagagga

SEQ ID NO: 4807510 - DNA, 20 bp, Homo sapiens
cctggggggcacagccagaa

SEQ ID NO: 4807511 - DNA, 22 bp, Homo sapiens
cctgggggtggcaggcacacag

SEQ ID NO: 4807512 - DNA, 21 bp, Homo sapiens
cctggggtggttggaggcctg

SEQ ID NO: 4807513 - DNA, 19 bp, Homo sapiens
cctgggtcaccttcctggg

SEQ ID NO: 4807514 - DNA, 19 bp, Homo sapiens
cctgggtcctcccagctga

SEQ ID NO: 4807515 - DNA, 18 bp, Homo sapiens
cctgggtcctcggccctg

SEQ ID NO: 4807516 - DNA, 13 bp, Homo sapiens
cctgggtgctcag

SEQ ID NO: 4807517 - DNA, 18 bp, Homo sapiens
cctgggtgctcagggcat

SEQ ID NO: 4807518 - DNA, 20 bp, Homo sapiens
cctgggtgctgtcatgccca

SEQ ID NO: 4807519 - DNA, 18 bp, Homo sapiens
cctgggtggatcggcctc

SEQ ID NO: 4807520 - DNA, 22 bp, Homo sapiens
cctgggtggatcggcctcctct

SEQ ID NO: 4807521 - DNA, 16 bp, Homo sapiens
cctgggtgggccctgc

SEQ ID NO: 4807522 - DNA, 17 bp, Homo sapiens
cctgggtgggccctgcc

SEQ ID NO: 4807523 - DNA, 13 bp, Homo sapiens
cctggtaattatc

SEQ ID NO: 4807524 - DNA, 13 bp, Homo sapiens
cctggtaggtctg

SEQ ID NO: 4807525 - DNA, 14 bp, Homo sapiens
cctggtaggtctgg

SEQ ID NO: 4807526 - DNA, 21 bp, Homo sapiens
cctggtaggtctggattttca

SEQ ID NO: 4807527 - DNA, 20 bp, Homo sapiens
cctggtatgtctcaccagga

SEQ ID NO: 4807528 - DNA, 20 bp, Homo sapiens
cctggtcctgcactgtcccg

SEQ ID NO: 4807529 - DNA, 17 bp, Homo sapiens
cctggtctggagcccct

SEQ ID NO: 4807530 - DNA, 13 bp, Homo sapiens
cctggtctgtgca

SEQ ID NO: 4807531 - DNA, 15 bp, Homo sapiens
cctggtctgtgcatt

SEQ ID NO: 4807532 - DNA, 17 bp, Homo sapiens
cctggtctgtgcattgt

SEQ ID NO: 4807533 - DNA, 22 bp, Homo sapiens
cctggtgaaagagtaaaaccaa

SEQ ID NO: 4807534 - DNA, 14 bp, Homo sapiens
cctggtggccctgc

SEQ ID NO: 4807535 - DNA, 15 bp, Homo sapiens
cctggtggccctgcg

SEQ ID NO: 4807536 - DNA, 16 bp, Homo sapiens
cctgtagccctggccc

SEQ ID NO: 4807537 - DNA, 17 bp, Homo sapiens
cctgtagctccttagct

SEQ ID NO: 4807538 - DNA, 18 bp, Homo sapiens
cctgtcaacctgaattaa

SEQ ID NO: 4807539 - DNA, 20 bp, Homo sapiens
cctgtcaacctgaattaaag

SEQ ID NO: 4807540 - DNA, 23 bp, Homo sapiens
cctgtcaatatatagagacttct

SEQ ID NO: 4807541 - DNA, 18 bp, Homo sapiens
cctgtccatccgtctctg

SEQ ID NO: 4807542 - DNA, 22 bp, Homo sapiens
cctgtccatccgtctctgtccg

SEQ ID NO: 4807543 - DNA, 18 bp, Homo sapiens
cctgtccctagggctctc

SEQ ID NO: 4807544 - DNA, 13 bp, Homo sapiens
cctgtcctgctca

SEQ ID NO: 4807545 - DNA, 14 bp, Homo sapiens
cctgtcctggctcc

SEQ ID NO: 4807546 - DNA, 15 bp, Homo sapiens
cctgtcgggcccgca

SEQ ID NO: 4807547 - DNA, 21 bp, Homo sapiens
cctgtctctacaaaaaaaatc

SEQ ID NO: 4807548 - DNA, 13 bp, Homo sapiens
cctgtctctccct

SEQ ID NO: 4807549 - DNA, 21 bp, Homo sapiens
cctgtctctccctaccctctt

SEQ ID NO: 4807550 - DNA, 15 bp, Homo sapiens
cctgtctgcaggcca

SEQ ID NO: 4807551 - DNA, 15 bp, Homo sapiens
cctgtgaactgccag

SEQ ID NO: 4807552 - DNA, 14 bp, Homo sapiens
cctgtgagatgtgt

SEQ ID NO: 4807553 - DNA, 13 bp, Homo sapiens
cctgtgaggactg

SEQ ID NO: 4807554 - DNA, 11 bp, Homo sapiens
cctgtgaggat

SEQ ID NO: 4807555 - DNA, 16 bp, Homo sapiens
cctgtgccccgcctcc

SEQ ID NO: 4807556 - DNA, 17 bp, Homo sapiens
cctgtgccccgcctccc

SEQ ID NO: 4807557 - DNA, 13 bp, Homo sapiens
cctgtgcctgtgt

SEQ ID NO: 4807558 - DNA, 13 bp, Homo sapiens
cctgtgctttcat

SEQ ID NO: 4807559 - DNA, 17 bp, Homo sapiens
cctgtgggagtccactt

SEQ ID NO: 4807560 - DNA, 18 bp, Homo sapiens
cctgtgggctcacaccgg

SEQ ID NO: 4807561 - DNA, 15 bp, Homo sapiens
cctgtgggggtggcc

SEQ ID NO: 4807562 - DNA, 17 bp, Homo sapiens
cctgtgggggtggccat

SEQ ID NO: 4807563 - DNA, 22 bp, Homo sapiens
cctgtgggggtggccatccctg

SEQ ID NO: 4807564 - DNA, 17 bp, Homo sapiens
cctgtggtttgttatca

SEQ ID NO: 4807565 - DNA, 16 bp, Homo sapiens
cctgtgtcatctgtca

SEQ ID NO: 4807566 - DNA, 17 bp, Homo sapiens
cctgtgtcatctgtcag

SEQ ID NO: 4807567 - DNA, 21 bp, Homo sapiens
cctgtgtttcatgttctgtgt

SEQ ID NO: 4807568 - DNA, 22 bp, Homo sapiens
cctgtgtttcatgttctgtgtc

SEQ ID NO: 4807569 - DNA, 23 bp, Homo sapiens
cctgtgtttcatgttctgtgtca

SEQ ID NO: 4807570 - DNA, 22 bp, Homo sapiens
cctgttacttaaatagcatctg

SEQ ID NO: 4807571 - DNA, 24 bp, Homo sapiens
cctgttacttaaatagcatctgct

SEQ ID NO: 4807572 - DNA, 18 bp, Homo sapiens
cctgttccgcctcactgg

SEQ ID NO: 4807573 - DNA, 16 bp, Homo sapiens
cctgttgacctaccct

SEQ ID NO: 4807574 - DNA, 22 bp, Homo sapiens
cctgttgattaatttctgccat

SEQ ID NO: 4807575 - DNA, 19 bp, Homo sapiens
cctgttgggccaggagcct

SEQ ID NO: 4807576 - DNA, 16 bp, Homo sapiens
cctgtttctcctccat

SEQ ID NO: 4807577 - DNA, 22 bp, Homo sapiens
ccttaactggccctcgggccct

SEQ ID NO: 4807578 - DNA, 15 bp, Homo sapiens
ccttaatatttcttc

SEQ ID NO: 4807579 - DNA, 15 bp, Homo sapiens
ccttacaaagccagc

SEQ ID NO: 4807580 - DNA, 21 bp, Homo sapiens
ccttacatagctttagagaag

SEQ ID NO: 4807581 - DNA, 14 bp, Homo sapiens
ccttacctgccagg

SEQ ID NO: 4807582 - DNA, 19 bp, Homo sapiens
ccttacctgccaggaagcc

SEQ ID NO: 4807583 - DNA, 12 bp, Homo sapiens
ccttagaatgtg

SEQ ID NO: 4807584 - DNA, 14 bp, Homo sapiens
ccttcatcccaggg

SEQ ID NO: 4807585 - DNA, 18 bp, Homo sapiens
ccttcatgcttttctcat

SEQ ID NO: 4807586 - DNA, 21 bp, Homo sapiens
ccttcatgcttttctcatggt

SEQ ID NO: 4807587 - DNA, 11 bp, Homo sapiens
ccttcatttaa

SEQ ID NO: 4807588 - DNA, 20 bp, Homo sapiens
ccttccaccctgccctggcc

SEQ ID NO: 4807589 - DNA, 22 bp, Homo sapiens
ccttccaccctgccctggccta

SEQ ID NO: 4807590 - DNA, 21 bp, Homo sapiens
ccttccactgcctctgcctta

SEQ ID NO: 4807591 - DNA, 14 bp, Homo sapiens
ccttccagacatac

SEQ ID NO: 4807592 - DNA, 22 bp, Homo sapiens
ccttccagacatacgaaacaca

SEQ ID NO: 4807593 - DNA, 23 bp, Homo sapiens
ccttcccaacgtactcctcagac

SEQ ID NO: 4807594 - DNA, 20 bp, Homo sapiens
ccttcccaatcagcactgaa

SEQ ID NO: 4807595 - DNA, 14 bp, Homo sapiens
ccttcccaccccta

SEQ ID NO: 4807596 - DNA, 20 bp, Homo sapiens
ccttcccacgtccctcgagc

SEQ ID NO: 4807597 - DNA, 18 bp, Homo sapiens
ccttcccagctgctccta

SEQ ID NO: 4807598 - DNA, 12 bp, Homo sapiens
ccttccccactc

SEQ ID NO: 4807599 - DNA, 13 bp, Homo sapiens
ccttcccccagca

SEQ ID NO: 4807600 - DNA, 21 bp, Homo sapiens
ccttcccctgcgccctccctc

SEQ ID NO: 4807601 - DNA, 23 bp, Homo sapiens
ccttcccctgcgccctccctccc

SEQ ID NO: 4807602 - DNA, 17 bp, Homo sapiens
ccttccccttctgtgtc

SEQ ID NO: 4807603 - DNA, 15 bp, Homo sapiens
ccttcccgcagcacc

SEQ ID NO: 4807604 - DNA, 22 bp, Homo sapiens
ccttcccgcagcaccagcctga

SEQ ID NO: 4807605 - DNA, 20 bp, Homo sapiens
ccttccctagttctttgcat

SEQ ID NO: 4807606 - DNA, 21 bp, Homo sapiens
ccttccctgacactgtctgct

SEQ ID NO: 4807607 - DNA, 23 bp, Homo sapiens
ccttcccttcttttcctgggtgc

SEQ ID NO: 4807608 - DNA, 19 bp, Homo sapiens
ccttccctttacagctctc

SEQ ID NO: 4807609 - DNA, 19 bp, Homo sapiens
ccttcctgggcagcccaga

SEQ ID NO: 4807610 - DNA, 21 bp, Homo sapiens
ccttcctgggcagcccagaga

SEQ ID NO: 4807611 - DNA, 22 bp, Homo sapiens
ccttcctgggcagcccagagag

SEQ ID NO: 4807612 - DNA, 23 bp, Homo sapiens
ccttcctgggcagcccagagaga

SEQ ID NO: 4807613 - DNA, 14 bp, Homo sapiens
ccttcctgtcctgc

SEQ ID NO: 4807614 - DNA, 15 bp, Homo sapiens
ccttcctgtcctgct

SEQ ID NO: 4807615 - DNA, 18 bp, Homo sapiens
ccttcctgtcctgctcac

SEQ ID NO: 4807616 - DNA, 13 bp, Homo sapiens
cgcaccgcccaac

SEQ ID NO: 4807617 - DNA, 22 bp, Homo sapiens
cgcaccgggctggcctgacaca

SEQ ID NO: 4807618 - DNA, 14 bp, Homo sapiens
cgcactcaggagca

SEQ ID NO: 4807619 - DNA, 22 bp, Homo sapiens
cgcactcaggagcacagccata

SEQ ID NO: 4807620 - DNA, 12 bp, Homo sapiens
cgcagaaggaag

SEQ ID NO: 4807621 - DNA, 17 bp, Homo sapiens
cgcagagccccggagca

SEQ ID NO: 4807622 - DNA, 19 bp, Homo sapiens
cgcagagccccggagcacc

SEQ ID NO: 4807623 - DNA, 20 bp, Homo sapiens
cgcagagccccggagcacca

SEQ ID NO: 4807624 - DNA, 17 bp, Homo sapiens
cgcagaggtggggtgct

SEQ ID NO: 4807625 - DNA, 13 bp, Homo sapiens
cgcagcaccagcc

SEQ ID NO: 4807626 - DNA, 21 bp, Homo sapiens
cgcagcaccagcctgagccac

SEQ ID NO: 4807627 - DNA, 22 bp, Homo sapiens
cgcagcaccagcctgagccaca

SEQ ID NO: 4807628 - DNA, 21 bp, Homo sapiens
cgcagccccccacgcttctgg

SEQ ID NO: 4807629 - DNA, 14 bp, Homo sapiens
cgcagcccctgttg

SEQ ID NO: 4807630 - DNA, 19 bp, Homo sapiens
cgcagccctgcagagggca

SEQ ID NO: 4807631 - DNA, 16 bp, Homo sapiens
cgcagccgcgctctgc

SEQ ID NO: 4807632 - DNA, 17 bp, Homo sapiens
cgcagccgcgctctgcc

SEQ ID NO: 4807633 - DNA, 21 bp, Homo sapiens
cgcagcgggcgcgggacagga

SEQ ID NO: 4807634 - DNA, 23 bp, Homo sapiens
cgcagctggcgcgtgtgtggcct

SEQ ID NO: 4807635 - DNA, 18 bp, Homo sapiens
cgcaggaaccgaggactc

SEQ ID NO: 4807636 - DNA, 22 bp, Homo sapiens
cgcagggcgctccggcagaggc

SEQ ID NO: 4807637 - DNA, 21 bp, Homo sapiens
cgcatgcagggcccccacagg

SEQ ID NO: 4807638 - DNA, 21 bp, Homo sapiens
cgcatgcagggcccccactgg

SEQ ID NO: 4807639 - DNA, 13 bp, Homo sapiens
cgcatttcatcaa

SEQ ID NO: 4807640 - DNA, 19 bp, Homo sapiens
cgcccaacccccacctccc

SEQ ID NO: 4807641 - DNA, 12 bp, Homo sapiens
cgcccacccagc

SEQ ID NO: 4807642 - DNA, 20 bp, Homo sapiens
cgcccaccccgctgcctggc

SEQ ID NO: 4807643 - DNA, 11 bp, Homo sapiens
cgcccacctgc

SEQ ID NO: 4807644 - DNA, 20 bp, Homo sapiens
cgcccacctgggccctaggc

SEQ ID NO: 4807645 - DNA, 21 bp, Homo sapiens
cgcccacctgggccctaggca

SEQ ID NO: 4807646 - DNA, 11 bp, Homo sapiens
cgcccagcccc

SEQ ID NO: 4807647 - DNA, 13 bp, Homo sapiens
cgcccagcctggc

SEQ ID NO: 4807648 - DNA, 22 bp, Homo sapiens
cgcccaggatgaaggggccaga

SEQ ID NO: 4807649 - DNA, 13 bp, Homo sapiens
cgccccagagact

SEQ ID NO: 4807650 - DNA, 21 bp, Homo sapiens
cgccccagagactgcccaccc

SEQ ID NO: 4807651 - DNA, 14 bp, Homo sapiens
cgccccaggcccca

SEQ ID NO: 4807652 - DNA, 16 bp, Homo sapiens
cgccccaggccccagc

SEQ ID NO: 4807653 - DNA, 19 bp, Homo sapiens
cgccccaggccccagcagt

SEQ ID NO: 4807654 - DNA, 14 bp, Homo sapiens
cgccccaggccctc

SEQ ID NO: 4807655 - DNA, 11 bp, Homo sapiens
cgcccccagga

SEQ ID NO: 4807656 - DNA, 14 bp, Homo sapiens
cgcccccaggaccc

SEQ ID NO: 4807657 - DNA, 15 bp, Homo sapiens
cgccccccggcctgg

SEQ ID NO: 4807658 - DNA, 18 bp, Homo sapiens
cgcccccgccctcgctcc

SEQ ID NO: 4807659 - DNA, 18 bp, Homo sapiens
cgccccggacgccgcgat

SEQ ID NO: 4807660 - DNA, 12 bp, Homo sapiens
cgcccctcctcg

SEQ ID NO: 4807661 - DNA, 12 bp, Homo sapiens
cgcccctctgcg

SEQ ID NO: 4807662 - DNA, 19 bp, Homo sapiens
cgcccctctgcgccccagc

SEQ ID NO: 4807663 - DNA, 13 bp, Homo sapiens
cgcccctgcctga

SEQ ID NO: 4807664 - DNA, 17 bp, Homo sapiens
cgcccctgcctgagacc

SEQ ID NO: 4807665 - DNA, 17 bp, Homo sapiens
cgcccctttctcttgct

SEQ ID NO: 4807666 - DNA, 14 bp, Homo sapiens
cgcccgcccccgcc

SEQ ID NO: 4807667 - DNA, 16 bp, Homo sapiens
cgcccgccctcctctg

SEQ ID NO: 4807668 - DNA, 19 bp, Homo sapiens
cgcccgccctcctctgccc

SEQ ID NO: 4807669 - DNA, 22 bp, Homo sapiens
cgcccgccctcctctgccccct

SEQ ID NO: 4807670 - DNA, 21 bp, Homo sapiens
cgcccggcctcctagcctctc

SEQ ID NO: 4807671 - DNA, 17 bp, Homo sapiens
cgccctccctccctcca

SEQ ID NO: 4807672 - DNA, 18 bp, Homo sapiens
cgccctccctccctccac

SEQ ID NO: 4807673 - DNA, 13 bp, Homo sapiens
cgccctcctctgc

SEQ ID NO: 4807674 - DNA, 15 bp, Homo sapiens
cgccctcctctgccc

SEQ ID NO: 4807675 - DNA, 14 bp, Homo sapiens
cgccctgcccgcgc

SEQ ID NO: 4807676 - DNA, 20 bp, Homo sapiens
cgccctgtgccctctcactg

SEQ ID NO: 4807677 - DNA, 16 bp, Homo sapiens
cgccctttccttgcct

SEQ ID NO: 4807678 - DNA, 17 bp, Homo sapiens
cgccctttccttgcctt

SEQ ID NO: 4807679 - DNA, 18 bp, Homo sapiens
cgccgaagggcagccccg

SEQ ID NO: 4807680 - DNA, 15 bp, Homo sapiens
cgccgcctcgccccc

SEQ ID NO: 4807681 - DNA, 18 bp, Homo sapiens
cgccgcctcgggccgcct

SEQ ID NO: 4807682 - DNA, 15 bp, Homo sapiens
cgccggggctggccc

SEQ ID NO: 4807683 - DNA, 23 bp, Homo sapiens
cgccggggctggccctgccctcc

SEQ ID NO: 4807684 - DNA, 16 bp, Homo sapiens
cgccggttggccggct

SEQ ID NO: 4807685 - DNA, 19 bp, Homo sapiens
cgccggttggccggctggc

SEQ ID NO: 4807686 - DNA, 20 bp, Homo sapiens
cgccggttggccggctggcc

SEQ ID NO: 4807687 - DNA, 14 bp, Homo sapiens
cgcctcaccttcct

SEQ ID NO: 4807688 - DNA, 16 bp, Homo sapiens
cgcctcaccttccttg

SEQ ID NO: 4807689 - DNA, 13 bp, Homo sapiens
cgcctcactgggt

SEQ ID NO: 4807690 - DNA, 14 bp, Homo sapiens
cgcctcactgggtg

SEQ ID NO: 4807691 - DNA, 14 bp, Homo sapiens
cgcctccatccaca

SEQ ID NO: 4807692 - DNA, 16 bp, Homo sapiens
cgcctcccgccgcctc

SEQ ID NO: 4807693 - DNA, 17 bp, Homo sapiens
cgcctcccggggtgccc

SEQ ID NO: 4807694 - DNA, 13 bp, Homo sapiens
cgcctcctcctgc

SEQ ID NO: 4807695 - DNA, 14 bp, Homo sapiens
cgcctcctcctgca

SEQ ID NO: 4807696 - DNA, 15 bp, Homo sapiens
cgcctcctcctgcat

SEQ ID NO: 4807697 - DNA, 12 bp, Homo sapiens
cgcctcctggcc

SEQ ID NO: 4807698 - DNA, 13 bp, Homo sapiens
cgcctcctggcca

SEQ ID NO: 4807699 - DNA, 16 bp, Homo sapiens
cgcctcctggccagac

SEQ ID NO: 4807700 - DNA, 21 bp, Homo sapiens
cgcctcgggccgcctcctcca

SEQ ID NO: 4807701 - DNA, 23 bp, Homo sapiens
cgcctcgggccgcctcctccaga

SEQ ID NO: 4807702 - DNA, 14 bp, Homo sapiens
cgcctctgtcctgg

SEQ ID NO: 4807703 - DNA, 15 bp, Homo sapiens
cgcctctgtcctggc

SEQ ID NO: 4807704 - DNA, 13 bp, Homo sapiens
cgcctgcccgccc

SEQ ID NO: 4807705 - DNA, 18 bp, Homo sapiens
cgcctgcgccccccagtg

SEQ ID NO: 4807706 - DNA, 21 bp, Homo sapiens
cgcctgcgccccccagtggac

SEQ ID NO: 4807707 - DNA, 13 bp, Homo sapiens
cgcctgcgcctcc

SEQ ID NO: 4807708 - DNA, 15 bp, Homo sapiens
cgcctgcgctcctct

SEQ ID NO: 4807709 - DNA, 18 bp, Homo sapiens
cgcctgcgctcctctgca

SEQ ID NO: 4807710 - DNA, 19 bp, Homo sapiens
cgccttccttgaccttcct

SEQ ID NO: 4807711 - DNA, 19 bp, Homo sapiens
cgccttctggccgctgcag

SEQ ID NO: 4807712 - DNA, 19 bp, Homo sapiens
cgccttctggctgctgcag

SEQ ID NO: 4807713 - DNA, 18 bp, Homo sapiens
cgcgaagtccgaggcctg

SEQ ID NO: 4807714 - DNA, 12 bp, Homo sapiens
cgcgaccacccc

SEQ ID NO: 4807715 - DNA, 16 bp, Homo sapiens
cgcgaccacccctgtg

SEQ ID NO: 4807716 - DNA, 18 bp, Homo sapiens
cgcgaccacccctgtgcg

SEQ ID NO: 4807717 - DNA, 15 bp, Homo sapiens
cgcgatctcagctca

SEQ ID NO: 4807718 - DNA, 13 bp, Homo sapiens
cgcgcccccagga

SEQ ID NO: 4807719 - DNA, 22 bp, Homo sapiens
cgcgcccccaggacccccccag

SEQ ID NO: 4807720 - DNA, 18 bp, Homo sapiens
cgcgcccctctgcgcccc

SEQ ID NO: 4807721 - DNA, 18 bp, Homo sapiens
cgcgcccgccgcctccct

SEQ ID NO: 4807722 - DNA, 17 bp, Homo sapiens
ctaaatgcaaacactgt

SEQ ID NO: 4807723 - DNA, 20 bp, Homo sapiens
ctaaatgcaaacactgtgta

SEQ ID NO: 4807724 - DNA, 12 bp, Homo sapiens
ctaaatgcaaag

SEQ ID NO: 4807725 - DNA, 14 bp, Homo sapiens
ctaaatgcaaagca

SEQ ID NO: 4807726 - DNA, 17 bp, Homo sapiens
ctaaatgcctaataaac

SEQ ID NO: 4807727 - DNA, 18 bp, Homo sapiens
ctaaatgcctaataaaca

SEQ ID NO: 4807728 - DNA, 19 bp, Homo sapiens
ctaaatgcctaataaacaa

SEQ ID NO: 4807729 - DNA, 17 bp, Homo sapiens
ctaaattaacaaattca

SEQ ID NO: 4807730 - DNA, 13 bp, Homo sapiens
ctaaattaacttc

SEQ ID NO: 4807731 - DNA, 18 bp, Homo sapiens
ctaaattaacttctattt

SEQ ID NO: 4807732 - DNA, 17 bp, Homo sapiens
ctaacattattactttt

SEQ ID NO: 4807733 - DNA, 18 bp, Homo sapiens
ctaaccccaacgcacagg

SEQ ID NO: 4807734 - DNA, 20 bp, Homo sapiens
ctaacctgggttgttgcaga

SEQ ID NO: 4807735 - DNA, 22 bp, Homo sapiens
ctaacgaccgacgcccctccgg

SEQ ID NO: 4807736 - DNA, 14 bp, Homo sapiens
ctaactcaaggaat

SEQ ID NO: 4807737 - DNA, 19 bp, Homo sapiens
ctaactccttgaggtcttg

SEQ ID NO: 4807738 - DNA, 12 bp, Homo sapiens
ctaactggcccc

SEQ ID NO: 4807739 - DNA, 15 bp, Homo sapiens
ctaacttattttgat

SEQ ID NO: 4807740 - DNA, 22 bp, Homo sapiens
ctaacttggggaaggggcctgg

SEQ ID NO: 4807741 - DNA, 13 bp, Homo sapiens
ctaagaaagaaat

SEQ ID NO: 4807742 - DNA, 17 bp, Homo sapiens
ctaagaaagaaatgcta

SEQ ID NO: 4807743 - DNA, 14 bp, Homo sapiens
ctaagaatttagag

SEQ ID NO: 4807744 - DNA, 15 bp, Homo sapiens
ctaagacaaatgcag

SEQ ID NO: 4807745 - DNA, 21 bp, Homo sapiens
ctaagacattcaccaacaaca

SEQ ID NO: 4807746 - DNA, 11 bp, Homo sapiens
ctaagaggctg

SEQ ID NO: 4807747 - DNA, 12 bp, Homo sapiens
ctaagaggctgc

SEQ ID NO: 4807748 - DNA, 21 bp, Homo sapiens
ctaagatcttgcctctttcct

SEQ ID NO: 4807749 - DNA, 22 bp, Homo sapiens
ctaaggagcaaataccttagct

SEQ ID NO: 4807750 - DNA, 22 bp, Homo sapiens
ctatatttataaaccagcagca

SEQ ID NO: 4807751 - DNA, 21 bp, Homo sapiens
ctatcagcagcggcagcagca

SEQ ID NO: 4807752 - DNA, 17 bp, Homo sapiens
ctatcagggcaagctca

SEQ ID NO: 4807753 - DNA, 22 bp, Homo sapiens
ctatcagggcaagctcatagca

SEQ ID NO: 4807754 - DNA, 24 bp, Homo sapiens
ctatcagggcaagctcatagcaca

SEQ ID NO: 4807755 - DNA, 18 bp, Homo sapiens
ctatccacagaacctttg

SEQ ID NO: 4807756 - DNA, 20 bp, Homo sapiens
ctatccacagaacctttgtc

SEQ ID NO: 4807757 - DNA, 11 bp, Homo sapiens
ctatccagccg

SEQ ID NO: 4807758 - DNA, 13 bp, Homo sapiens
ctatccagccgca

SEQ ID NO: 4807759 - DNA, 15 bp, Homo sapiens
ctatccatgcaccaa

SEQ ID NO: 4807760 - DNA, 17 bp, Homo sapiens
ctatccatgcaccaaac

SEQ ID NO: 4807761 - DNA, 23 bp, Homo sapiens
ctatccccggacgcatgcagggc

SEQ ID NO: 4807762 - DNA, 14 bp, Homo sapiens
ctatcctgcaccct

SEQ ID NO: 4807763 - DNA, 20 bp, Homo sapiens
ctatccttggcaccaaagat

SEQ ID NO: 4807764 - DNA, 16 bp, Homo sapiens
ctatccttttttcctt

SEQ ID NO: 4807765 - DNA, 18 bp, Homo sapiens
ctatcgatctggaaagag

SEQ ID NO: 4807766 - DNA, 19 bp, Homo sapiens
ctatctctatataaaaaat

SEQ ID NO: 4807767 - DNA, 16 bp, Homo sapiens
ctatctcttcctgtct

SEQ ID NO: 4807768 - DNA, 12 bp, Homo sapiens
ctatctggaaaa

SEQ ID NO: 4807769 - DNA, 14 bp, Homo sapiens
ctatctggaaaaaa

SEQ ID NO: 4807770 - DNA, 22 bp, Homo sapiens
ctatctggaaaaaaaaaaatat

SEQ ID NO: 4807771 - DNA, 16 bp, Homo sapiens
ctatctgggcctgggc

SEQ ID NO: 4807772 - DNA, 17 bp, Homo sapiens
ctatctgggcctgggct

SEQ ID NO: 4807773 - DNA, 21 bp, Homo sapiens
ctatctgggcctgggctaggg

SEQ ID NO: 4807774 - DNA, 17 bp, Homo sapiens
ctatctggtattaaatg

SEQ ID NO: 4807775 - DNA, 16 bp, Homo sapiens
ctatcttcatgtaaat

SEQ ID NO: 4807776 - DNA, 20 bp, Homo sapiens
ctatcttcatgtaaattgac

SEQ ID NO: 4807777 - DNA, 20 bp, Homo sapiens
ctatgaagagctagagaaat

SEQ ID NO: 4807778 - DNA, 22 bp, Homo sapiens
ctatgaagtttattttctattt

SEQ ID NO: 4807779 - DNA, 16 bp, Homo sapiens
ctatgagacctccccc

SEQ ID NO: 4807780 - DNA, 18 bp, Homo sapiens
ctatgagacctcccccag

SEQ ID NO: 4807781 - DNA, 19 bp, Homo sapiens
ctatgagacctcccccagg

SEQ ID NO: 4807782 - DNA, 13 bp, Homo sapiens
ctatgatatgtgc

SEQ ID NO: 4807783 - DNA, 17 bp, Homo sapiens
ctatgatatgtgcttgt

SEQ ID NO: 4807784 - DNA, 22 bp, Homo sapiens
ctatgatatgtgcttgtgtgta

SEQ ID NO: 4807785 - DNA, 16 bp, Homo sapiens
ctatgatgtccaaact

SEQ ID NO: 4807786 - DNA, 19 bp, Homo sapiens
ctatgattaaactgggaaa

SEQ ID NO: 4807787 - DNA, 17 bp, Homo sapiens
ctatgcacaccaaattg

SEQ ID NO: 4807788 - DNA, 20 bp, Homo sapiens
ctatggaccaaatgtaaaat

SEQ ID NO: 4807789 - DNA, 23 bp, Homo sapiens
ctatggagcctggcacaggactg

SEQ ID NO: 4807790 - DNA, 16 bp, Homo sapiens
ctatggattcacttct

SEQ ID NO: 4807791 - DNA, 22 bp, Homo sapiens
ctatggattcacttctatttat

SEQ ID NO: 4807792 - DNA, 15 bp, Homo sapiens
ctatggctgtatttt

SEQ ID NO: 4807793 - DNA, 18 bp, Homo sapiens
ctatggtatgctggccag

SEQ ID NO: 4807794 - DNA, 22 bp, Homo sapiens
ctatggtatgctggccagcacc

SEQ ID NO: 4807795 - DNA, 20 bp, Homo sapiens
ctatgtccaacagagtggac

SEQ ID NO: 4807796 - DNA, 15 bp, Homo sapiens
ctatgtgtatatatt

SEQ ID NO: 4807797 - DNA, 14 bp, Homo sapiens
ctatgtgtgtgctt

SEQ ID NO: 4807798 - DNA, 19 bp, Homo sapiens
ctattaacaattaattgtc

SEQ ID NO: 4807799 - DNA, 20 bp, Homo sapiens
ctattaacaattaattgtct

SEQ ID NO: 4807800 - DNA, 22 bp, Homo sapiens
ctattaatatttgtttagttca

SEQ ID NO: 4807801 - DNA, 21 bp, Homo sapiens
ctattagcttactgattaact

SEQ ID NO: 4807802 - DNA, 23 bp, Homo sapiens
ctattatctgggttttagaaatt

SEQ ID NO: 4807803 - DNA, 16 bp, Homo sapiens
ctattcattacatcct

SEQ ID NO: 4807804 - DNA, 22 bp, Homo sapiens
ctattcattacatcctctgctt

SEQ ID NO: 4807805 - DNA, 15 bp, Homo sapiens
ctattcgtaagttct

SEQ ID NO: 4807806 - DNA, 20 bp, Homo sapiens
ctattcgtaagttctgtgca

SEQ ID NO: 4807807 - DNA, 15 bp, Homo sapiens
ctattgctgtaaata

SEQ ID NO: 4807808 - DNA, 20 bp, Homo sapiens
ctattgctgtaaataaaaat

SEQ ID NO: 4807809 - DNA, 12 bp, Homo sapiens
ctattggacaga

SEQ ID NO: 4807810 - DNA, 16 bp, Homo sapiens
ctattggacagacaca

SEQ ID NO: 4807811 - DNA, 21 bp, Homo sapiens
ctattggcatggatttccttt

SEQ ID NO: 4807812 - DNA, 19 bp, Homo sapiens
ctattgtaatatagaaaaa

SEQ ID NO: 4807813 - DNA, 17 bp, Homo sapiens
ctattgtccttgtgtat

SEQ ID NO: 4807814 - DNA, 22 bp, Homo sapiens
ctatttaagtggactgtatttc

SEQ ID NO: 4807815 - DNA, 12 bp, Homo sapiens
ctatttaatttt

SEQ ID NO: 4807816 - DNA, 18 bp, Homo sapiens
ctatttcaacttcaggaa

SEQ ID NO: 4807817 - DNA, 22 bp, Homo sapiens
ctatttctacacagtgggaact

SEQ ID NO: 4807818 - DNA, 20 bp, Homo sapiens
ctatttgtgtaactgaaagg

SEQ ID NO: 4807819 - DNA, 22 bp, Homo sapiens
ctatttttaatttcctgtgagg

SEQ ID NO: 4807820 - DNA, 18 bp, Homo sapiens
ctcaaacctggcagatgg

SEQ ID NO: 4807821 - DNA, 13 bp, Homo sapiens
ctcaaactgggta

SEQ ID NO: 4807822 - DNA, 15 bp, Homo sapiens
ctcaaagaagtactg

SEQ ID NO: 4807823 - DNA, 21 bp, Homo sapiens
ctcaaataatatttttttcct

SEQ ID NO: 4807824 - DNA, 16 bp, Homo sapiens
ctcaaatgctaaatgc

SEQ ID NO: 4807825 - DNA, 17 bp, Homo sapiens
ctcaaatgctaaatgca

SEQ ID NO: 4807826 - DNA, 15 bp, Homo sapiens
ctcaactaaatccaa

SEQ ID NO: 4807827 - DNA, 16 bp, Homo sapiens
ctcaactctcctccag

SEQ ID NO: 4807828 - DNA, 12 bp, Homo sapiens
ctcaagccagga

SEQ ID NO: 4807829 - DNA, 13 bp, Homo sapiens
ctcaagccaggag

SEQ ID NO: 4807830 - DNA, 22 bp, Homo sapiens
ctcaagccaggagaccctgtct

SEQ ID NO: 4807831 - DNA, 14 bp, Homo sapiens
ctcaaggcctccag

SEQ ID NO: 4807832 - DNA, 18 bp, Homo sapiens
ctcaataaggcagtgcag

SEQ ID NO: 4807833 - DNA, 22 bp, Homo sapiens
ctcaatcattgtcagagatgtt

SEQ ID NO: 4807834 - DNA, 20 bp, Homo sapiens
ctcaatgccaggcagtgcag

SEQ ID NO: 4807835 - DNA, 13 bp, Homo sapiens
ctcaatgtgctgt

SEQ ID NO: 4807836 - DNA, 20 bp, Homo sapiens
gaatcaatctggcttctgca

SEQ ID NO: 4807837 - DNA, 12 bp, Homo sapiens
gaatcacagcca

SEQ ID NO: 4807838 - DNA, 16 bp, Homo sapiens
gaatcactcatttatt

SEQ ID NO: 4807839 - DNA, 15 bp, Homo sapiens
gaatcagaggcagag

SEQ ID NO: 4807840 - DNA, 17 bp, Homo sapiens
gaatcatggatttattt

SEQ ID NO: 4807841 - DNA, 18 bp, Homo sapiens
gaatcattgagaaataaa

SEQ ID NO: 4807842 - DNA, 18 bp, Homo sapiens
gaatcccctcgcttcata

SEQ ID NO: 4807843 - DNA, 17 bp, Homo sapiens
gaatccctgttcattgt

SEQ ID NO: 4807844 - DNA, 18 bp, Homo sapiens
gaatcgacctcactgtca

SEQ ID NO: 4807845 - DNA, 22 bp, Homo sapiens
gaatcgatgggggatgcttcat

SEQ ID NO: 4807846 - DNA, 20 bp, Homo sapiens
gaatctaacttgatcttgtt

SEQ ID NO: 4807847 - DNA, 23 bp, Homo sapiens
gaatctgagagatgctgtagaca

SEQ ID NO: 4807848 - DNA, 20 bp, Homo sapiens
gaatctgtgcagtcatcaac

SEQ ID NO: 4807849 - DNA, 23 bp, Homo sapiens
gaatctgtgcagtcatcaacaaa

SEQ ID NO: 4807850 - DNA, 13 bp, Homo sapiens
gaatgaaatataa

SEQ ID NO: 4807851 - DNA, 18 bp, Homo sapiens
gaatgaaatataaactgt

SEQ ID NO: 4807852 - DNA, 24 bp, Homo sapiens
gaatgaaatataaactgtgagata

SEQ ID NO: 4807853 - DNA, 21 bp, Homo sapiens
cttatgcatactgagatagct

SEQ ID NO: 4807854 - DNA, 22 bp, Homo sapiens
cttatggagtgtgcctctctct

SEQ ID NO: 4807855 - DNA, 16 bp, Homo sapiens
cttattatttttgaga

SEQ ID NO: 4807856 - DNA, 17 bp, Homo sapiens
cttattcaaagagaaaa

SEQ ID NO: 4807857 - DNA, 13 bp, Homo sapiens
cttattcctaatt

SEQ ID NO: 4807858 - DNA, 15 bp, Homo sapiens
cttattcctaattcc

SEQ ID NO: 4807859 - DNA, 16 bp, Homo sapiens
cttattcctaattcct

SEQ ID NO: 4807860 - DNA, 19 bp, Homo sapiens
cttattgatattctaagaa

SEQ ID NO: 4807861 - DNA, 23 bp, Homo sapiens
cttattgatattctaagaaatat

SEQ ID NO: 4807862 - DNA, 18 bp, Homo sapiens
cttattgattaagtatat

SEQ ID NO: 4807863 - DNA, 23 bp, Homo sapiens
cttatttgctcataagtaaatgt

SEQ ID NO: 4807864 - DNA, 22 bp, Homo sapiens
cttattttataattttaaaatt

SEQ ID NO: 4807865 - DNA, 19 bp, Homo sapiens
cttattttcttattttaga

SEQ ID NO: 4807866 - DNA, 20 bp, Homo sapiens
cttcaaagtctcaatgaaat

SEQ ID NO: 4807867 - DNA, 19 bp, Homo sapiens
cttcaaatgtgtaacttta

SEQ ID NO: 4807868 - DNA, 14 bp, Homo sapiens
cttcaacatgtgct

SEQ ID NO: 4807869 - DNA, 16 bp, Homo sapiens
cttcaagcaaagacag

SEQ ID NO: 4807870 - DNA, 17 bp, Homo sapiens
cttcaagcaaagacagt

SEQ ID NO: 4807871 - DNA, 22 bp, Homo sapiens
cttcaagcaaagacagtttctt

SEQ ID NO: 4807872 - DNA, 13 bp, Homo sapiens
cttcaatgtgaaa

SEQ ID NO: 4807873 - DNA, 13 bp, Homo sapiens
cttcaatgttaaa

SEQ ID NO: 4807874 - DNA, 16 bp, Homo sapiens
cttcaattaatggaaa

SEQ ID NO: 4807875 - DNA, 17 bp, Homo sapiens
cttcacacaaagtgaaa

SEQ ID NO: 4807876 - DNA, 20 bp, Homo sapiens
cttcacacaaagtgaaatta

SEQ ID NO: 4807877 - DNA, 14 bp, Homo sapiens
cttcaccaggaaga

SEQ ID NO: 4807878 - DNA, 22 bp, Homo sapiens
cttcacccaccacccccatcat

SEQ ID NO: 4807879 - DNA, 22 bp, Homo sapiens
cttcaccccggcaggccctgca

SEQ ID NO: 4807880 - DNA, 15 bp, Homo sapiens
cttcaccgcattcca

SEQ ID NO: 4807881 - DNA, 18 bp, Homo sapiens
cttcaccgcattccaggg

SEQ ID NO: 4807882 - DNA, 19 bp, Homo sapiens
cttcaccgtgacattccag

SEQ ID NO: 4807883 - DNA, 14 bp, Homo sapiens
cttcacctccttct

SEQ ID NO: 4807884 - DNA, 17 bp, Homo sapiens
cttcactctgacagtat

SEQ ID NO: 4807885 - DNA, 12 bp, Homo sapiens
cttcagactctc

SEQ ID NO: 4807886 - DNA, 14 bp, Homo sapiens
cttcagactctctc

SEQ ID NO: 4807887 - DNA, 19 bp, Homo sapiens
cttcagggttctaaccttt

SEQ ID NO: 4807888 - DNA, 20 bp, Homo sapiens
cttcagggttctaacctttc

SEQ ID NO: 4807889 - DNA, 18 bp, Homo sapiens
cttcaggtcccctggccc

SEQ ID NO: 4807890 - DNA, 16 bp, Homo sapiens
cttcagtcattaaatt

SEQ ID NO: 4807891 - DNA, 19 bp, Homo sapiens
cttcagttctcatcttgta

SEQ ID NO: 4807892 - DNA, 17 bp, Homo sapiens
ctttattcttccaagtt

SEQ ID NO: 4807893 - DNA, 20 bp, Homo sapiens
ctttattgtccattccaata

SEQ ID NO: 4807894 - DNA, 14 bp, Homo sapiens
ctttattgtctgta

SEQ ID NO: 4807895 - DNA, 18 bp, Homo sapiens
ctttattgtctgtaaatc

SEQ ID NO: 4807896 - DNA, 20 bp, Homo sapiens
ctttattttatataataaag

SEQ ID NO: 4807897 - DNA, 22 bp, Homo sapiens
ctttattttatataataaagta

SEQ ID NO: 4807898 - DNA, 20 bp, Homo sapiens
ctttcaaagtgcacacacac

SEQ ID NO: 4807899 - DNA, 16 bp, Homo sapiens
ctttcaagatctaaat

SEQ ID NO: 4807900 - DNA, 14 bp, Homo sapiens
ctttcaatccacag

SEQ ID NO: 4807901 - DNA, 23 bp, Homo sapiens
ctttcaatccacagtattgttct

SEQ ID NO: 4807902 - DNA, 12 bp, Homo sapiens
ctttcaccctgc

SEQ ID NO: 4807903 - DNA, 14 bp, Homo sapiens
ctttcaccctgcca

SEQ ID NO: 4807904 - DNA, 22 bp, Homo sapiens
ctttcacctcttcccacaagaa

SEQ ID NO: 4807905 - DNA, 20 bp, Homo sapiens
ctttcactataatgtgaaat

SEQ ID NO: 4807906 - DNA, 17 bp, Homo sapiens
ctttcagattgtatctg

SEQ ID NO: 4807907 - DNA, 23 bp, Homo sapiens
ctttcagccaagaattcttaaat

SEQ ID NO: 4807908 - DNA, 22 bp, Homo sapiens
ctttcatcaatcattgtacagt

SEQ ID NO: 4807909 - DNA, 15 bp, Homo sapiens
ctttcatcctcagca

SEQ ID NO: 4807910 - DNA, 22 bp, Homo sapiens
ctttcatgaccactgggcctgc

SEQ ID NO: 4807911 - DNA, 14 bp, Homo sapiens
ctttccaacacaca

SEQ ID NO: 4807912 - DNA, 18 bp, Homo sapiens
ctttccaacttttcatcc

SEQ ID NO: 4807913 - DNA, 13 bp, Homo sapiens
ctttccagttaag

SEQ ID NO: 4807914 - DNA, 15 bp, Homo sapiens
ctttccatcagcttt

SEQ ID NO: 4807915 - DNA, 18 bp, Homo sapiens
ctttccatcagctttata

SEQ ID NO: 4807916 - DNA, 18 bp, Homo sapiens
ctttccatgacagtagca

SEQ ID NO: 4807917 - DNA, 21 bp, Homo sapiens
ctttcccacccactagccctc

SEQ ID NO: 4807918 - DNA, 13 bp, Homo sapiens
ctttcccctctca

SEQ ID NO: 4807919 - DNA, 14 bp, Homo sapiens
ctttcccctctcat

SEQ ID NO: 4807920 - DNA, 15 bp, Homo sapiens
ctttccctgcatccc

SEQ ID NO: 4807921 - DNA, 15 bp, Homo sapiens
ctttccgctgtcgcc

SEQ ID NO: 4807922 - DNA, 14 bp, Homo sapiens
ctttcctctctctc

SEQ ID NO: 4807923 - DNA, 17 bp, Homo sapiens
ctttccttgagtagttt

SEQ ID NO: 4807924 - DNA, 21 bp, Homo sapiens
ctttcgtgtttttggttttct

SEQ ID NO: 4807925 - DNA, 17 bp, Homo sapiens
ctttcgttaatcttgct

SEQ ID NO: 4807926 - DNA, 20 bp, Homo sapiens
ctttctaacccactaagtaa

SEQ ID NO: 4807927 - DNA, 12 bp, Homo sapiens
ctttctacatgc

SEQ ID NO: 4807928 - DNA, 10 bp, Homo sapiens
ctttctcatg

SEQ ID NO: 4807929 - DNA, 22 bp, Homo sapiens
ctttctctctttccatctccct

SEQ ID NO: 4807930 - DNA, 22 bp, Homo sapiens
ctttctctctttcttttgtgca

SEQ ID NO: 4807931 - DNA, 11 bp, Homo sapiens
ctttctcttgc

SEQ ID NO: 4807932 - DNA, 15 bp, Homo sapiens
ctttcttccttcctt

SEQ ID NO: 4807933 - DNA, 16 bp, Homo sapiens
ctttcttccttccttt

SEQ ID NO: 4807934 - DNA, 14 bp, Homo sapiens
ctttctttaacata

SEQ ID NO: 4807935 - DNA, 23 bp, Homo sapiens
ctttcttttgaatcaatctggct

SEQ ID NO: 4807936 - DNA, 15 bp, Homo sapiens
ctttcttttgtgcat

SEQ ID NO: 4807937 - DNA, 18 bp, Homo sapiens
ctttcttttgtgcatatg

SEQ ID NO: 4807938 - DNA, 20 bp, Homo sapiens
ctttgacgagtcaccttcca

SEQ ID NO: 4807939 - DNA, 23 bp, Homo sapiens
ctttgagagcctccaggttcctc

SEQ ID NO: 4807940 - DNA, 16 bp, Homo sapiens
ctttgagcccacagga

SEQ ID NO: 4807941 - DNA, 21 bp, Homo sapiens
ctttgctcagtggatcacaca

SEQ ID NO: 4807942 - DNA, 14 bp, Homo sapiens
ctttggaatttgaa

SEQ ID NO: 4807943 - DNA, 16 bp, Homo sapiens
ctttggcttaattcca

SEQ ID NO: 4807944 - DNA, 17 bp, Homo sapiens
ctttgggtttcttgttt

SEQ ID NO: 4807945 - DNA, 17 bp, Homo sapiens
ctttggttcctcatggc

SEQ ID NO: 4807946 - DNA, 13 bp, Homo sapiens
ctttgtcaaatgg

SEQ ID NO: 4807947 - DNA, 16 bp, Homo sapiens
ctttgtcaatgctcta

SEQ ID NO: 4807948 - DNA, 23 bp, Homo sapiens
ctttgtcacagggtgttggaaga

SEQ ID NO: 4807949 - DNA, 19 bp, Homo sapiens
ctttgtctcacgattccag

SEQ ID NO: 4807950 - DNA, 23 bp, Homo sapiens
ctttgtctcacgattccagtgca

SEQ ID NO: 4807951 - DNA, 16 bp, Homo sapiens
ctttgtggggcttggc

SEQ ID NO: 4807952 - DNA, 15 bp, Homo sapiens
ctttgttaaaatata

SEQ ID NO: 4807953 - DNA, 22 bp, Homo sapiens
ctttgttaaaatatagtgttgt

SEQ ID NO: 4807954 - DNA, 22 bp, Homo sapiens
ctttgttattgtacctaagtaa

SEQ ID NO: 4807955 - DNA, 21 bp, Homo sapiens
ctttgttttggctgctctcca

SEQ ID NO: 4807956 - DNA, 12 bp, Homo sapiens
cttttaaaaaaa

SEQ ID NO: 4807957 - DNA, 17 bp, Homo sapiens
cttttaaacctgttcct

SEQ ID NO: 4807958 - DNA, 21 bp, Homo sapiens
cttttaaacctgttcctgact

SEQ ID NO: 4807959 - DNA, 24 bp, Homo sapiens
cttttataaattaaatatatgtat

SEQ ID NO: 4807960 - DNA, 18 bp, Homo sapiens
cttttattcattagctgt

SEQ ID NO: 4807961 - DNA, 17 bp, Homo sapiens
cttttcaaggcacattg

SEQ ID NO: 4807962 - DNA, 22 bp, Homo sapiens
cttttcaaggcacattgaaata

SEQ ID NO: 4807963 - DNA, 15 bp, Homo sapiens
cttttcatatcattt

SEQ ID NO: 4807964 - DNA, 14 bp, Homo sapiens
cttttcatttttgc

SEQ ID NO: 4807965 - DNA, 13 bp, Homo sapiens
cttttcccatcac

SEQ ID NO: 4807966 - DNA, 20 bp, Homo sapiens
cttttcctacggtacaagct

SEQ ID NO: 4807967 - DNA, 19 bp, Homo sapiens
cttttcctcttagaagaat

SEQ ID NO: 4807968 - DNA, 15 bp, Homo sapiens
cttttcctgaggtca

SEQ ID NO: 4807969 - DNA, 22 bp, Homo sapiens
cttttcctgggtgctcagggca

SEQ ID NO: 4807970 - DNA, 16 bp, Homo sapiens
cttttctagcaactgt

SEQ ID NO: 4807971 - DNA, 13 bp, Homo sapiens
cttttctcatggt

SEQ ID NO: 4807972 - DNA, 11 bp, Homo sapiens
cttttcttgta

SEQ ID NO: 4807973 - DNA, 23 bp, Homo sapiens
cttttctttgaaggatgactaca

SEQ ID NO: 4807974 - DNA, 22 bp, Homo sapiens
cttttgaatcaatctggcttct

SEQ ID NO: 4807975 - DNA, 20 bp, Homo sapiens
cttttgatggctatgttttg

SEQ ID NO: 4807976 - DNA, 17 bp, Homo sapiens
cttttgggtttgcctta

SEQ ID NO: 4807977 - DNA, 14 bp, Homo sapiens
cttttgtatcctcc

SEQ ID NO: 4807978 - DNA, 13 bp, Homo sapiens
cttttgtcctgca

SEQ ID NO: 4807979 - DNA, 23 bp, Homo sapiens
cttttgttctctcttggtctctt

SEQ ID NO: 4807980 - DNA, 14 bp, Homo sapiens
ctttttaatccagg

SEQ ID NO: 4807981 - DNA, 14 bp, Homo sapiens
cttttttaaaaaaa

SEQ ID NO: 4807982 - DNA, 20 bp, Homo sapiens
cttttttataaattataatg

SEQ ID NO: 4807983 - DNA, 15 bp, Homo sapiens
cttttttcaatgtac

SEQ ID NO: 4807984 - DNA, 22 bp, Homo sapiens
cttttttggggggagaaacctc

SEQ ID NO: 4807985 - DNA, 14 bp, Homo sapiens
ctttttttaagtgt

SEQ ID NO: 4807986 - DNA, 19 bp, Homo sapiens
ctgtattaaagatgcaggt

SEQ ID NO: 4807987 - DNA, 20 bp, Homo sapiens
ctgtattgaaaaaatattgt

SEQ ID NO: 4807988 - DNA, 11 bp, Homo sapiens
ctgtattgcta

SEQ ID NO: 4807989 - DNA, 15 bp, Homo sapiens
ctgtattggcagcac

SEQ ID NO: 4807990 - DNA, 20 bp, Homo sapiens
ctgtatttaatggtttttat

SEQ ID NO: 4807991 - DNA, 15 bp, Homo sapiens
ctgtatttgaggaaa

SEQ ID NO: 4807992 - DNA, 17 bp, Homo sapiens
ctgtcaaatccatgtgt

SEQ ID NO: 4807993 - DNA, 21 bp, Homo sapiens
ctgtcaaatccatgtgtcccc

SEQ ID NO: 4807994 - DNA, 19 bp, Homo sapiens
ctgtcaagattaagttata

SEQ ID NO: 4807995 - DNA, 19 bp, Homo sapiens
ctgtcaattacaggaagta

SEQ ID NO: 4807996 - DNA, 23 bp, Homo sapiens
ctgtcaattacaggaagtactgg

SEQ ID NO: 4807997 - DNA, 17 bp, Homo sapiens
ctgtcagccagccgccc

SEQ ID NO: 4807998 - DNA, 21 bp, Homo sapiens
ctgtcagccagccgccctggg

SEQ ID NO: 4807999 - DNA, 18 bp, Homo sapiens
ctgtcagccattcctgtt

SEQ ID NO: 4808000 - DNA, 14 bp, Homo sapiens
ctgtcagcttccca

SEQ ID NO: 4808001 - DNA, 15 bp, Homo sapiens
ctgtcagcttcccaa

SEQ ID NO: 4808002 - DNA, 20 bp, Homo sapiens
ctgtcagtttgtgaagtgat

SEQ ID NO: 4808003 - DNA, 16 bp, Homo sapiens
ctgtcatctctctggg

SEQ ID NO: 4808004 - DNA, 17 bp, Homo sapiens
ctgtcatctctctgggg

SEQ ID NO: 4808005 - DNA, 21 bp, Homo sapiens
ctgtcatgcccagcttggagt

SEQ ID NO: 4808006 - DNA, 11 bp, Homo sapiens
ctgtccagaca

SEQ ID NO: 4808007 - DNA, 19 bp, Homo sapiens
ctgtccagacaagccctgc

SEQ ID NO: 4808008 - DNA, 20 bp, Homo sapiens
ctgtccagacaagccctgct

SEQ ID NO: 4808009 - DNA, 17 bp, Homo sapiens
ctgtccatccgtctctg

SEQ ID NO: 4808010 - DNA, 19 bp, Homo sapiens
ctgtccatccgtctctgtc

SEQ ID NO: 4808011 - DNA, 15 bp, Homo sapiens
ctgtcccaccgggag

SEQ ID NO: 4808012 - DNA, 22 bp, Homo sapiens
ctgtcccaccgggagcctcccc

SEQ ID NO: 4808013 - DNA, 19 bp, Homo sapiens
ctgtccccgcactgggctt

SEQ ID NO: 4808014 - DNA, 17 bp, Homo sapiens
ctgtcccggagctcagg

SEQ ID NO: 4808015 - DNA, 15 bp, Homo sapiens
ctgtccctagggctc

SEQ ID NO: 4808016 - DNA, 21 bp, Homo sapiens
ctgtccctagggctctccaag

SEQ ID NO: 4808017 - DNA, 17 bp, Homo sapiens
ctgtccctgtgggctca

SEQ ID NO: 4808018 - DNA, 20 bp, Homo sapiens
ctgtccctgtgggctcacac

SEQ ID NO: 4808019 - DNA, 23 bp, Homo sapiens
ctgtccctgtgggctcacaccgg

SEQ ID NO: 4808020 - DNA, 22 bp, Homo sapiens
ctgtcccttacgtgagtcctgg

SEQ ID NO: 4808021 - DNA, 17 bp, Homo sapiens
ctgtccgacagtcaaga

SEQ ID NO: 4808022 - DNA, 15 bp, Homo sapiens
ctgtccgtcctgctc

SEQ ID NO: 4808023 - DNA, 22 bp, Homo sapiens
ctgtccgtcctgctcgccctgt

SEQ ID NO: 4808024 - DNA, 17 bp, Homo sapiens
ctgtccgtctgtcctgc

SEQ ID NO: 4808025 - DNA, 14 bp, Homo sapiens
ctgtcctgagcccc

SEQ ID NO: 4808026 - DNA, 17 bp, Homo sapiens
ctgtcctgcgcctgcgc

SEQ ID NO: 4808027 - DNA, 20 bp, Homo sapiens
ctgtcctgcgcctgcgcctc

SEQ ID NO: 4808028 - DNA, 12 bp, Homo sapiens
ctgtcctgctca

SEQ ID NO: 4808029 - DNA, 18 bp, Homo sapiens
ctgtcctgctcacgtctg

SEQ ID NO: 4808030 - DNA, 18 bp, Homo sapiens
ctgtcctggcccgggagc

SEQ ID NO: 4808031 - DNA, 20 bp, Homo sapiens
ctgtcctggcccgggagccg

SEQ ID NO: 4808032 - DNA, 22 bp, Homo sapiens
ctgtttaccgcccacccagcag

SEQ ID NO: 4808033 - DNA, 16 bp, Homo sapiens
ctgtttatggtatttt

SEQ ID NO: 4808034 - DNA, 16 bp, Homo sapiens
ctgtttcccttccctt

SEQ ID NO: 4808035 - DNA, 21 bp, Homo sapiens
ctgtttcccttcccttccact

SEQ ID NO: 4808036 - DNA, 11 bp, Homo sapiens
ctgtttgaatt

SEQ ID NO: 4808037 - DNA, 19 bp, Homo sapiens
ctgtttgctaagtgaggat

SEQ ID NO: 4808038 - DNA, 13 bp, Homo sapiens
ctgtttgcttcta

SEQ ID NO: 4808039 - DNA, 24 bp, Homo sapiens
ctgttttaaaaaatacagtattat

SEQ ID NO: 4808040 - DNA, 21 bp, Homo sapiens
ctgttttattttaattcagtt

SEQ ID NO: 4808041 - DNA, 18 bp, Homo sapiens
ctgttttggatgaatgca

SEQ ID NO: 4808042 - DNA, 12 bp, Homo sapiens
ctgttttgtgcg

SEQ ID NO: 4808043 - DNA, 20 bp, Homo sapiens
cttaaaaattatctttaaaa

SEQ ID NO: 4808044 - DNA, 16 bp, Homo sapiens
cttaaaataatgattt

SEQ ID NO: 4808045 - DNA, 13 bp, Homo sapiens
cttaaaatgcaag

SEQ ID NO: 4808046 - DNA, 16 bp, Homo sapiens
cttaaaattggttaat

SEQ ID NO: 4808047 - DNA, 21 bp, Homo sapiens
cttaaaattggttaatgaaaa

SEQ ID NO: 4808048 - DNA, 23 bp, Homo sapiens
cttaaaattggttaatgaaaaat

SEQ ID NO: 4808049 - DNA, 15 bp, Homo sapiens
cttaaacaaaaactt

SEQ ID NO: 4808050 - DNA, 22 bp, Homo sapiens
cttaaacaaaaactttccatga

SEQ ID NO: 4808051 - DNA, 16 bp, Homo sapiens
cttaaacattttttgt

SEQ ID NO: 4808052 - DNA, 22 bp, Homo sapiens
cttaaacccacataaacacttc

SEQ ID NO: 4808053 - DNA, 19 bp, Homo sapiens
cttaaacctgtgctttcat

SEQ ID NO: 4808054 - DNA, 14 bp, Homo sapiens
cttaaactttgtca

SEQ ID NO: 4808055 - DNA, 22 bp, Homo sapiens
cttaaatagcatctgctcttct

SEQ ID NO: 4808056 - DNA, 14 bp, Homo sapiens
cttaaatatacaac

SEQ ID NO: 4808057 - DNA, 22 bp, Homo sapiens
cttaaattaaacaatttatttt

SEQ ID NO: 4808058 - DNA, 13 bp, Homo sapiens
cttaaatttctaa

SEQ ID NO: 4808059 - DNA, 20 bp, Homo sapiens
cttaaatttctaaaaacagt

SEQ ID NO: 4808060 - DNA, 18 bp, Homo sapiens
cttaacctttccgctgtc

SEQ ID NO: 4808061 - DNA, 18 bp, Homo sapiens
cttaactggccctcgggc

SEQ ID NO: 4808062 - DNA, 21 bp, Homo sapiens
cttaactggccctcgggccct

SEQ ID NO: 4808063 - DNA, 15 bp, Homo sapiens
cttaagacagcatgt

SEQ ID NO: 4808064 - DNA, 18 bp, Homo sapiens
cttaagacagcatgtgtt

SEQ ID NO: 4808065 - DNA, 12 bp, Homo sapiens
cttaagctgccc

SEQ ID NO: 4808066 - DNA, 14 bp, Homo sapiens
cttaagctgcccaa

SEQ ID NO: 4808067 - DNA, 23 bp, Homo sapiens
cttaaggacagtgttcaaattct

SEQ ID NO: 4808068 - DNA, 19 bp, Homo sapiens
cttaataactatggtaaat

SEQ ID NO: 4808069 - DNA, 21 bp, Homo sapiens
cttaatagaaagtcagatgac

SEQ ID NO: 4808070 - DNA, 22 bp, Homo sapiens
cttaatagaaagtcagatgact

SEQ ID NO: 4808071 - DNA, 15 bp, Homo sapiens
cttaatataaatcgt

SEQ ID NO: 4808072 - DNA, 15 bp, Homo sapiens
cttaatatttcttca

SEQ ID NO: 4808073 - DNA, 20 bp, Homo sapiens
cttaatatttcttcaaatat

SEQ ID NO: 4808074 - DNA, 15 bp, Homo sapiens
cttaattcttacctc

SEQ ID NO: 4808075 - DNA, 23 bp, Homo sapiens
cttaattcttacctcatttgcat

SEQ ID NO: 4808076 - DNA, 21 bp, Homo sapiens
cttaatttagcagtccatttt

SEQ ID NO: 4808077 - DNA, 18 bp, Homo sapiens
cttacaaagccagctctg

SEQ ID NO: 4808078 - DNA, 17 bp, Homo sapiens
cttacaactgactgact

SEQ ID NO: 4808079 - DNA, 23 bp, Homo sapiens
cttacagtaggagtgagaaattt

SEQ ID NO: 4808080 - DNA, 18 bp, Homo sapiens
cttacatgggtgttttga

SEQ ID NO: 4808081 - DNA, 24 bp, Homo sapiens
cttacatgggtgttttgatctctg

SEQ ID NO: 4808082 - DNA, 19 bp, Homo sapiens
cttaccccgtccctttccc

SEQ ID NO: 4808083 - DNA, 20 bp, Homo sapiens
cttaccccgtccctttccct

SEQ ID NO: 4808084 - DNA, 16 bp, Homo sapiens
cttacccttcaatgtt

SEQ ID NO: 4808085 - DNA, 11 bp, Homo sapiens
cttacctgaca

SEQ ID NO: 4808086 - DNA, 12 bp, Homo sapiens
cttacctgacac

SEQ ID NO: 4808087 - DNA, 19 bp, Homo sapiens
cttacctgacacaagagga

SEQ ID NO: 4808088 - DNA, 13 bp, Homo sapiens
cttacctgccagg

SEQ ID NO: 4808089 - DNA, 12 bp, Homo sapiens
cttacgctctct

SEQ ID NO: 4808090 - DNA, 13 bp, Homo sapiens
cttactaaatcta

SEQ ID NO: 4808091 - DNA, 16 bp, Homo sapiens
cttactaataggtctg

SEQ ID NO: 4808092 - DNA, 20 bp, Homo sapiens
cttactttacctctctgtca

SEQ ID NO: 4808093 - DNA, 16 bp, Homo sapiens
cttagaagaaatatga

SEQ ID NO: 4808094 - DNA, 21 bp, Homo sapiens
cttagaagaatattgtattgt

SEQ ID NO: 4808095 - DNA, 15 bp, Homo sapiens
cttagaatgtgaaaa

SEQ ID NO: 4808096 - DNA, 18 bp, Homo sapiens
cttagaatttatccttta

SEQ ID NO: 4808097 - DNA, 19 bp, Homo sapiens
cttagaccgtggtgtcctc

SEQ ID NO: 4808098 - DNA, 22 bp, Homo sapiens
cttagctagttagctcacaagc

SEQ ID NO: 4808099 - DNA, 17 bp, Homo sapiens
cttagctccctcccgca

SEQ ID NO: 4808100 - DNA, 23 bp, Homo sapiens
cttaggcaatggtgaactgtcat

SEQ ID NO: 4808101 - DNA, 19 bp, Homo sapiens
cttagggtacagcccaggc

SEQ ID NO: 4808102 - DNA, 17 bp, Homo sapiens
cttagtaaattcctaat

SEQ ID NO: 4808103 - DNA, 18 bp, Homo sapiens
cttagtaaattcctaatt

SEQ ID NO: 4808104 - DNA, 17 bp, Homo sapiens
cttagtgtcccttacct

SEQ ID NO: 4808105 - DNA, 19 bp, Homo sapiens
cttagtttattgtggttgg

SEQ ID NO: 4808106 - DNA, 12 bp, Homo sapiens
cttatagaaagt

SEQ ID NO: 4808107 - DNA, 16 bp, Homo sapiens
cttatattattttctg

SEQ ID NO: 4808108 - DNA, 18 bp, Homo sapiens
cttatattattttctgta

SEQ ID NO: 4808109 - DNA, 14 bp, Homo sapiens
cttatctccagcca

SEQ ID NO: 4808110 - DNA, 22 bp, Homo sapiens
cttatctccagccaatttcaaa

SEQ ID NO: 4808111 - DNA, 14 bp, Homo sapiens
cttatgactatgta

SEQ ID NO: 4808112 - DNA, 16 bp, Homo sapiens
cttatgcatactgaga

SEQ ID NO: 4808113 - DNA, 21 bp, Homo sapiens
ctcacttgtggcagcttccct

SEQ ID NO: 4808114 - DNA, 19 bp, Homo sapiens
ctcagaacaccaagtaaat

SEQ ID NO: 4808115 - DNA, 22 bp, Homo sapiens
ctcagaagtgaaaaagacttca

SEQ ID NO: 4808116 - DNA, 18 bp, Homo sapiens
ctcagaatattaagcaca

SEQ ID NO: 4808117 - DNA, 16 bp, Homo sapiens
ctcagacacctagact

SEQ ID NO: 4808118 - DNA, 17 bp, Homo sapiens
ctcagagggtccctagg

SEQ ID NO: 4808119 - DNA, 20 bp, Homo sapiens
ctcagatctgcactcctgtc

SEQ ID NO: 4808120 - DNA, 17 bp, Homo sapiens
ctcagatgatctctcca

SEQ ID NO: 4808121 - DNA, 20 bp, Homo sapiens
ctcagatgatctctccacgg

SEQ ID NO: 4808122 - DNA, 23 bp, Homo sapiens
ctcagcaaattcttgaataaact

SEQ ID NO: 4808123 - DNA, 23 bp, Homo sapiens
ctcagcaactgttagctgggaag

SEQ ID NO: 4808124 - DNA, 18 bp, Homo sapiens
ctcagcatcctggaaatt

SEQ ID NO: 4808125 - DNA, 12 bp, Homo sapiens
ctcagccccaga

SEQ ID NO: 4808126 - DNA, 19 bp, Homo sapiens
ctcagccccagacctgccg

SEQ ID NO: 4808127 - DNA, 16 bp, Homo sapiens
ctcagccccagggccc

SEQ ID NO: 4808128 - DNA, 17 bp, Homo sapiens
ctcagccctcagaacaa

SEQ ID NO: 4808129 - DNA, 14 bp, Homo sapiens
ctcagctcactgca

SEQ ID NO: 4808130 - DNA, 14 bp, Homo sapiens
ctcagctccactct

SEQ ID NO: 4808131 - DNA, 15 bp, Homo sapiens
ctcagctccactctg

SEQ ID NO: 4808132 - DNA, 17 bp, Homo sapiens
ctcagctccactctgaa

SEQ ID NO: 4808133 - DNA, 16 bp, Homo sapiens
ctcagctctccctcac

SEQ ID NO: 4808134 - DNA, 20 bp, Homo sapiens
ctcaggaccaccctgccaag

SEQ ID NO: 4808135 - DNA, 17 bp, Homo sapiens
ctcaggagcacagccat

SEQ ID NO: 4808136 - DNA, 21 bp, Homo sapiens
ctcaggagcacagccatagca

SEQ ID NO: 4808137 - DNA, 14 bp, Homo sapiens
ctcaggcagcctgt

SEQ ID NO: 4808138 - DNA, 20 bp, Homo sapiens
ctcaggccaaactcacctgc

SEQ ID NO: 4808139 - DNA, 15 bp, Homo sapiens
ctcaggcctcacctg

SEQ ID NO: 4808140 - DNA, 17 bp, Homo sapiens
ctcaggcctcacctggc

SEQ ID NO: 4808141 - DNA, 22 bp, Homo sapiens
ctcaggcctgggggctgggcag

SEQ ID NO: 4808142 - DNA, 15 bp, Homo sapiens
ctcaggctccccaag

SEQ ID NO: 4808143 - DNA, 14 bp, Homo sapiens
ctcaggctttctat

SEQ ID NO: 4808144 - DNA, 14 bp, Homo sapiens
ctcaggggcagctc

SEQ ID NO: 4808145 - DNA, 23 bp, Homo sapiens
ctcaggtaaatgaggtctttgca

SEQ ID NO: 4808146 - DNA, 14 bp, Homo sapiens
ctcaggtgaataac

SEQ ID NO: 4808147 - DNA, 16 bp, Homo sapiens
ctcaggtgcgtgccac

SEQ ID NO: 4808148 - DNA, 18 bp, Homo sapiens
ctcagtaaatcagtgcag

SEQ ID NO: 4808149 - DNA, 18 bp, Homo sapiens
ctcagtaatacagtacag

SEQ ID NO: 4808150 - DNA, 14 bp, Homo sapiens
ctcagtatcttaaa

SEQ ID NO: 4808151 - DNA, 17 bp, Homo sapiens
ctcagtattgacgacct

SEQ ID NO: 4808152 - DNA, 22 bp, Homo sapiens
ctcagtattgagacactgtcaa

SEQ ID NO: 4808153 - DNA, 15 bp, Homo sapiens
ctcagtcagcccagt

SEQ ID NO: 4808154 - DNA, 20 bp, Homo sapiens
ctcagtccctccctcctggc

SEQ ID NO: 4808155 - DNA, 22 bp, Homo sapiens
ctcagtccctccctcctggctc

SEQ ID NO: 4808156 - DNA, 23 bp, Homo sapiens
ctcagtccctccctcctggctca

SEQ ID NO: 4808157 - DNA, 19 bp, Homo sapiens
ctcagtgcagggacagcct

SEQ ID NO: 4808158 - DNA, 21 bp, Homo sapiens
ctcagttcaacctggtggcac

SEQ ID NO: 4808159 - DNA, 23 bp, Homo sapiens
ctcagttcaacctggtggcacca

SEQ ID NO: 4808160 - DNA, 17 bp, Homo sapiens
ctcagttggcctctgcc

SEQ ID NO: 4808161 - DNA, 18 bp, Homo sapiens
ctcagttggcctctgccc

SEQ ID NO: 4808162 - DNA, 23 bp, Homo sapiens
ctcataactagagtatgtgtatg

SEQ ID NO: 4808163 - DNA, 15 bp, Homo sapiens
ctcatacctctgacc

SEQ ID NO: 4808164 - DNA, 13 bp, Homo sapiens
ctcatcactgaaa

SEQ ID NO: 4808165 - DNA, 20 bp, Homo sapiens
ctcatcagaaacaatttctg

SEQ ID NO: 4808166 - DNA, 17 bp, Homo sapiens
ctcatcatgtctattgt

SEQ ID NO: 4808167 - DNA, 21 bp, Homo sapiens
ctcatccactaggtgcccagt

SEQ ID NO: 4808168 - DNA, 22 bp, Homo sapiens
ctcatccagaactgtcttagtc

SEQ ID NO: 4808169 - DNA, 19 bp, Homo sapiens
ctcatccattaatgtagat

SEQ ID NO: 4808170 - DNA, 15 bp, Homo sapiens
ctcatccccaaactg

SEQ ID NO: 4808171 - DNA, 17 bp, Homo sapiens
ctcatcccccatcagat

SEQ ID NO: 4808172 - DNA, 14 bp, Homo sapiens
ctcatctacacata

SEQ ID NO: 4808173 - DNA, 22 bp, Homo sapiens
ctcatctagtttgatgactaaa

SEQ ID NO: 4808174 - DNA, 20 bp, Homo sapiens
ctcatctgtaaaaccaggct

SEQ ID NO: 4808175 - DNA, 21 bp, Homo sapiens
ctcatctgtaaaaccaggctg

SEQ ID NO: 4808176 - DNA, 22 bp, Homo sapiens
ctcatcttccttctcagccttg

SEQ ID NO: 4808177 - DNA, 21 bp, Homo sapiens
ctcatcttgtaaataatgctt

SEQ ID NO: 4808178 - DNA, 20 bp, Homo sapiens
ctcatggcttgggctggagt

SEQ ID NO: 4808179 - DNA, 20 bp, Homo sapiens
ctcatggtcccacttcccca

SEQ ID NO: 4808180 - DNA, 13 bp, Homo sapiens
ctcatgttttata

SEQ ID NO: 4808181 - DNA, 22 bp, Homo sapiens
ctcattgttcagaaaagcacct

SEQ ID NO: 4808182 - DNA, 18 bp, Homo sapiens
ctcatttatgttatttat

SEQ ID NO: 4808183 - DNA, 12 bp, Homo sapiens
ctcatttgccag

SEQ ID NO: 4808184 - DNA, 14 bp, Homo sapiens
ctcattttttcctg

SEQ ID NO: 4808185 - DNA, 19 bp, Homo sapiens
ctcattttttcctgagaac

SEQ ID NO: 4808186 - DNA, 17 bp, Homo sapiens
ctccaaatcttgccatt

SEQ ID NO: 4808187 - DNA, 13 bp, Homo sapiens
ctccaacctggag

SEQ ID NO: 4808188 - DNA, 14 bp, Homo sapiens
ctccaacctggagg

SEQ ID NO: 4808189 - DNA, 15 bp, Homo sapiens
ctccaacctggaggc

SEQ ID NO: 4808190 - DNA, 20 bp, Homo sapiens
ctccaacctggaggctggac

SEQ ID NO: 4808191 - DNA, 20 bp, Homo sapiens
ctccaagcactagccttccc

SEQ ID NO: 4808192 - DNA, 19 bp, Homo sapiens
ctccaagccctggggcagg

SEQ ID NO: 4808193 - DNA, 17 bp, Homo sapiens
ctccaaggcaaatgtcc

SEQ ID NO: 4808194 - DNA, 21 bp, Homo sapiens
ctccaaggcaaatgtccaagc

SEQ ID NO: 4808195 - DNA, 21 bp, Homo sapiens
ctgcgccccccagtggactcg

SEQ ID NO: 4808196 - DNA, 16 bp, Homo sapiens
ctgcgcccctgcccag

SEQ ID NO: 4808197 - DNA, 17 bp, Homo sapiens
ctgcgcccctgcccagc

SEQ ID NO: 4808198 - DNA, 15 bp, Homo sapiens
ctgcgccctccctcc

SEQ ID NO: 4808199 - DNA, 21 bp, Homo sapiens
ctgcgccctccctccctccac

SEQ ID NO: 4808200 - DNA, 16 bp, Homo sapiens
ctgcgcctcctcctgc

SEQ ID NO: 4808201 - DNA, 12 bp, Homo sapiens
ctgcgcctgccc

SEQ ID NO: 4808202 - DNA, 16 bp, Homo sapiens
ctgcgcctgcgcctcc

SEQ ID NO: 4808203 - DNA, 18 bp, Homo sapiens
ctgcgcctgcgcctcctc

SEQ ID NO: 4808204 - DNA, 19 bp, Homo sapiens
ctgcgctcccacctcggac

SEQ ID NO: 4808205 - DNA, 14 bp, Homo sapiens
ctgcgctcctctgc

SEQ ID NO: 4808206 - DNA, 20 bp, Homo sapiens
ctgcgctcctctgcagcctg

SEQ ID NO: 4808207 - DNA, 21 bp, Homo sapiens
ctgcgctcctctgcagcctga

SEQ ID NO: 4808208 - DNA, 22 bp, Homo sapiens
ctgcgctcctctgcagcctgag

SEQ ID NO: 4808209 - DNA, 15 bp, Homo sapiens
ctgcgtcccttctct

SEQ ID NO: 4808210 - DNA, 18 bp, Homo sapiens
ctgctaagtggaagacag

SEQ ID NO: 4808211 - DNA, 20 bp, Homo sapiens
ctgctaagtggaagacagag

SEQ ID NO: 4808212 - DNA, 15 bp, Homo sapiens
ctgctacctttgtct

SEQ ID NO: 4808213 - DNA, 24 bp, Homo sapiens
ctgctacctttgtctcacgattcc

SEQ ID NO: 4808214 - DNA, 22 bp, Homo sapiens
ctgctatgctgttcattgatga

SEQ ID NO: 4808215 - DNA, 18 bp, Homo sapiens
ctgctatgtctgtgatgt

SEQ ID NO: 4808216 - DNA, 22 bp, Homo sapiens
ctgctatttttaatttcctgtg

SEQ ID NO: 4808217 - DNA, 12 bp, Homo sapiens
ctgctcaggcct

SEQ ID NO: 4808218 - DNA, 19 bp, Homo sapiens
ctgctcaggctccccaaga

SEQ ID NO: 4808219 - DNA, 17 bp, Homo sapiens
ctgctcatctacacata

SEQ ID NO: 4808220 - DNA, 13 bp, Homo sapiens
ctgctccagatcc

SEQ ID NO: 4808221 - DNA, 17 bp, Homo sapiens
ctgctccatgcagatct

SEQ ID NO: 4808222 - DNA, 14 bp, Homo sapiens
ctgctcccggtgtg

SEQ ID NO: 4808223 - DNA, 15 bp, Homo sapiens
ctgctcccggtgtgc

SEQ ID NO: 4808224 - DNA, 17 bp, Homo sapiens
ctgctcccggtgtgcag

SEQ ID NO: 4808225 - DNA, 23 bp, Homo sapiens
ctgctcctccagtacaataaata

SEQ ID NO: 4808226 - DNA, 14 bp, Homo sapiens
ctgctcgccctgtg

SEQ ID NO: 4808227 - DNA, 15 bp, Homo sapiens
ctgctcgccctgtgc

SEQ ID NO: 4808228 - DNA, 12 bp, Homo sapiens
ctgctcgggaag

SEQ ID NO: 4808229 - DNA, 13 bp, Homo sapiens
ctgctcgggaagg

SEQ ID NO: 4808230 - DNA, 21 bp, Homo sapiens
ctgctcgggaaggcctgaggg

SEQ ID NO: 4808231 - DNA, 14 bp, Homo sapiens
ctgctctccatctc

SEQ ID NO: 4808232 - DNA, 13 bp, Homo sapiens
ctgctctcccagg

SEQ ID NO: 4808233 - DNA, 13 bp, Homo sapiens
ctgctgagcacat

SEQ ID NO: 4808234 - DNA, 13 bp, Homo sapiens
ctgctgcactgcc

SEQ ID NO: 4808235 - DNA, 17 bp, Homo sapiens
ctgctgcactgccctcc

SEQ ID NO: 4808236 - DNA, 18 bp, Homo sapiens
ctgctgcactgccctccg

SEQ ID NO: 4808237 - DNA, 12 bp, Homo sapiens
ctgctgccaggc

SEQ ID NO: 4808238 - DNA, 14 bp, Homo sapiens
ctgctgcctccaag

SEQ ID NO: 4808239 - DNA, 23 bp, Homo sapiens
ctgctgccttctgacggccctgc

SEQ ID NO: 4808240 - DNA, 21 bp, Homo sapiens
ctgctgctcgggaaggcctga

SEQ ID NO: 4808241 - DNA, 16 bp, Homo sapiens
ctgctgcttctccctg

SEQ ID NO: 4808242 - DNA, 14 bp, Homo sapiens
ctgctggtcttcaa

SEQ ID NO: 4808243 - DNA, 17 bp, Homo sapiens
ctgctggtcttcaatta

SEQ ID NO: 4808244 - DNA, 14 bp, Homo sapiens
ctgctgtggcatca

SEQ ID NO: 4808245 - DNA, 11 bp, Homo sapiens
ctgcttcccac

SEQ ID NO: 4808246 - DNA, 20 bp, Homo sapiens
ctgcttcccacctccctgcc

SEQ ID NO: 4808247 - DNA, 22 bp, Homo sapiens
ctgcttcccacctccctgccca

SEQ ID NO: 4808248 - DNA, 11 bp, Homo sapiens
ctgcttctcca

SEQ ID NO: 4808249 - DNA, 15 bp, Homo sapiens
ctgcttctcccgcca

SEQ ID NO: 4808250 - DNA, 10 bp, Homo sapiens
ctgcttctgc

SEQ ID NO: 4808251 - DNA, 18 bp, Homo sapiens
ctgcttgagtggacagca

SEQ ID NO: 4808252 - DNA, 21 bp, Homo sapiens
ctgcttgagtggacagcagct

SEQ ID NO: 4808253 - DNA, 22 bp, Homo sapiens
ctgcttgctggaaaactgccac

SEQ ID NO: 4808254 - DNA, 15 bp, Homo sapiens
ctgcttgggcttcat

SEQ ID NO: 4808255 - DNA, 17 bp, Homo sapiens
ctgcttgggcttcatcc

SEQ ID NO: 4808256 - DNA, 20 bp, Homo sapiens
ctgcttgtcattctgctaat

SEQ ID NO: 4808257 - DNA, 19 bp, Homo sapiens
ctgctttctgatacatctg

SEQ ID NO: 4808258 - DNA, 16 bp, Homo sapiens
ctgctttggggatatt

SEQ ID NO: 4808259 - DNA, 23 bp, Homo sapiens
ctgctttggggcttatcagaact

SEQ ID NO: 4808260 - DNA, 19 bp, Homo sapiens
ctgctttgttttggctgct

SEQ ID NO: 4808261 - DNA, 15 bp, Homo sapiens
ctgctttttccttag

SEQ ID NO: 4808262 - DNA, 15 bp, Homo sapiens
gccagggcagtgcta

SEQ ID NO: 4808263 - DNA, 17 bp, Homo sapiens
gccagggggtttgagga

SEQ ID NO: 4808264 - DNA, 13 bp, Homo sapiens
gccagggttccag

SEQ ID NO: 4808265 - DNA, 15 bp, Homo sapiens
gccagggttccagac

SEQ ID NO: 4808266 - DNA, 16 bp, Homo sapiens
gccagggttccagaca

SEQ ID NO: 4808267 - DNA, 23 bp, Homo sapiens
gccagggttccagacagggtggg

SEQ ID NO: 4808268 - DNA, 23 bp, Homo sapiens
gccaggttgttttatagaggttc

SEQ ID NO: 4808269 - DNA, 17 bp, Homo sapiens
gccagtggtggaggtgg

SEQ ID NO: 4808270 - DNA, 14 bp, Homo sapiens
gccatagccccagg

SEQ ID NO: 4808271 - DNA, 17 bp, Homo sapiens
gccatagccccaggccc

SEQ ID NO: 4808272 - DNA, 19 bp, Homo sapiens
gccatagccccaggcccgc

SEQ ID NO: 4808273 - DNA, 20 bp, Homo sapiens
gccatcagatgaggctcctt

SEQ ID NO: 4808274 - DNA, 21 bp, Homo sapiens
gccatccctgggcccctccac

SEQ ID NO: 4808275 - DNA, 16 bp, Homo sapiens
gccatcctaaggtgct

SEQ ID NO: 4808276 - DNA, 19 bp, Homo sapiens
gccatggctggatgtgcat

SEQ ID NO: 4808277 - DNA, 22 bp, Homo sapiens
gccatggctggatgtgcatctg

SEQ ID NO: 4808278 - DNA, 16 bp, Homo sapiens
gccatgtatgttgcat

SEQ ID NO: 4808279 - DNA, 17 bp, Homo sapiens
gccatgtgtttatccta

SEQ ID NO: 4808280 - DNA, 14 bp, Homo sapiens
gccatgttcccaga

SEQ ID NO: 4808281 - DNA, 15 bp, Homo sapiens
gccatgttcccagaa

SEQ ID NO: 4808282 - DNA, 18 bp, Homo sapiens
gccattgaacactgcacc

SEQ ID NO: 4808283 - DNA, 19 bp, Homo sapiens
gccattgaacactgcaccc

SEQ ID NO: 4808284 - DNA, 21 bp, Homo sapiens
gccattgaacactgcaccctc

SEQ ID NO: 4808285 - DNA, 21 bp, Homo sapiens
gccatttcacattcctgaccc

SEQ ID NO: 4808286 - DNA, 11 bp, Homo sapiens
gccatttcatg

SEQ ID NO: 4808287 - DNA, 19 bp, Homo sapiens
gactcgagagggctgagcc

SEQ ID NO: 4808288 - DNA, 20 bp, Homo sapiens
gactcgagagggctgagccc

SEQ ID NO: 4808289 - DNA, 21 bp, Homo sapiens
gactcgagagggctgagcccc

SEQ ID NO: 4808290 - DNA, 15 bp, Homo sapiens
gactctatgctctgg

SEQ ID NO: 4808291 - DNA, 14 bp, Homo sapiens
gactctctcctctc

SEQ ID NO: 4808292 - DNA, 21 bp, Homo sapiens
gactctctcctctctctccct

SEQ ID NO: 4808293 - DNA, 14 bp, Homo sapiens
gactctggctgcca

SEQ ID NO: 4808294 - DNA, 16 bp, Homo sapiens
gactctggctgccaag

SEQ ID NO: 4808295 - DNA, 17 bp, Homo sapiens
gactctgtaacatcact

SEQ ID NO: 4808296 - DNA, 20 bp, Homo sapiens
gactcttccctctcgctccc

SEQ ID NO: 4808297 - DNA, 13 bp, Homo sapiens
gattctcctctcc

SEQ ID NO: 4808298 - DNA, 23 bp, Homo sapiens
gattcttatggacaatgacccag

SEQ ID NO: 4808299 - DNA, 18 bp, Homo sapiens
gattgacattttgtagct

SEQ ID NO: 4808300 - DNA, 22 bp, Homo sapiens
gattggaaaataataaaagaat

SEQ ID NO: 4808301 - DNA, 16 bp, Homo sapiens
gattgggggggcttgg

SEQ ID NO: 4808302 - DNA, 14 bp, Homo sapiens
gattggtaccagag

SEQ ID NO: 4808303 - DNA, 16 bp, Homo sapiens
gattgtatctgaactc

SEQ ID NO: 4808304 - DNA, 18 bp, Homo sapiens
gattgtctaaccaattgt

SEQ ID NO: 4808305 - DNA, 17 bp, Homo sapiens
gattgtctgaaattttc

SEQ ID NO: 4808306 - DNA, 13 bp, Homo sapiens
gattgttcctccc

SEQ ID NO: 4808307 - DNA, 14 bp, Homo sapiens
gattgttcctcccc

SEQ ID NO: 4808308 - DNA, 13 bp, Homo sapiens
gattgttggcagt

SEQ ID NO: 4808309 - DNA, 14 bp, Homo sapiens
gatttaaatttaag

SEQ ID NO: 4808310 - DNA, 13 bp, Homo sapiens
gatttatgcattt

SEQ ID NO: 4808311 - DNA, 14 bp, Homo sapiens
gatttattctcaga

SEQ ID NO: 4808312 - DNA, 15 bp, Homo sapiens
gatttattctcagaa

SEQ ID NO: 4808313 - DNA, 21 bp, Homo sapiens
gatttattttgtatgaaatat

SEQ ID NO: 4808314 - DNA, 18 bp, Homo sapiens
gatttattttttgtaact

SEQ ID NO: 4808315 - DNA, 21 bp, Homo sapiens
gatttattttttgtaactctt

SEQ ID NO: 4808316 - DNA, 15 bp, Homo sapiens
gatttccatccaaac

SEQ ID NO: 4808317 - DNA, 15 bp, Homo sapiens
gatttccatttgcaa

SEQ ID NO: 4808318 - DNA, 21 bp, Homo sapiens
gatttctcacactctaactgt

SEQ ID NO: 4808319 - DNA, 22 bp, Homo sapiens
gatttctcaccctctgtccttc

SEQ ID NO: 4808320 - DNA, 16 bp, Homo sapiens
gatttgaccactgaca

SEQ ID NO: 4808321 - DNA, 19 bp, Homo sapiens
gatttgggctgaatgtatg

SEQ ID NO: 4808322 - DNA, 16 bp, Homo sapiens
gatttgtaaaacagtg

SEQ ID NO: 4808323 - DNA, 20 bp, Homo sapiens
gatttgtatttatattagag

SEQ ID NO: 4808324 - DNA, 22 bp, Homo sapiens
gatttgtatttatattagagtg

SEQ ID NO: 4808325 - DNA, 13 bp, Homo sapiens
gattttaaacaaa

SEQ ID NO: 4808326 - DNA, 21 bp, Homo sapiens
gattttatgtttaaaatggca

SEQ ID NO: 4808327 - DNA, 14 bp, Homo sapiens
gattttcatgttct

SEQ ID NO: 4808328 - DNA, 14 bp, Homo sapiens
gatttttgttgatt

SEQ ID NO: 4808329 - DNA, 19 bp, Homo sapiens
gcaaaaatgaattcacccc

SEQ ID NO: 4808330 - DNA, 18 bp, Homo sapiens
gcaaaatacatgatgatt

SEQ ID NO: 4808331 - DNA, 22 bp, Homo sapiens
gcaaaatgaactaactgccatg

SEQ ID NO: 4808332 - DNA, 19 bp, Homo sapiens
gcaaacacacagactctgt

SEQ ID NO: 4808333 - DNA, 20 bp, Homo sapiens
gcaaacactttggccacagc

SEQ ID NO: 4808334 - DNA, 15 bp, Homo sapiens
gcaaacatttaaaaa

SEQ ID NO: 4808335 - DNA, 21 bp, Homo sapiens
gcaaactgaaattagtgtttt

SEQ ID NO: 4808336 - DNA, 14 bp, Homo sapiens
gcaaagaatcaaca

SEQ ID NO: 4808337 - DNA, 23 bp, Homo sapiens
gcaaagacagtttcttgcaagct

SEQ ID NO: 4808338 - DNA, 14 bp, Homo sapiens
gcaaagtagtactt

SEQ ID NO: 4808339 - DNA, 23 bp, Homo sapiens
gcaaagtagtacttcttctgtaa

SEQ ID NO: 4808340 - DNA, 22 bp, Homo sapiens
gcaaatccataccccctgcccc

SEQ ID NO: 4808341 - DNA, 19 bp, Homo sapiens
gcaaatcgtacattgtgcc

SEQ ID NO: 4808342 - DNA, 22 bp, Homo sapiens
gcaaatcgtacattgtgccctg

SEQ ID NO: 4808343 - DNA, 21 bp, Homo sapiens
gcaaatgtccaagcatcagca

SEQ ID NO: 4808344 - DNA, 17 bp, Homo sapiens
gcaaattcttgaataaa

SEQ ID NO: 4808345 - DNA, 18 bp, Homo sapiens
gcaacaacaacagaacaa

SEQ ID NO: 4808346 - DNA, 22 bp, Homo sapiens
gcaaccctacagtatataagct

SEQ ID NO: 4808347 - DNA, 13 bp, Homo sapiens
gcaacctgttctt

SEQ ID NO: 4808348 - DNA, 15 bp, Homo sapiens
gcaacttgaaattat

SEQ ID NO: 4808349 - DNA, 12 bp, Homo sapiens
gcaagaaatccc

SEQ ID NO: 4808350 - DNA, 17 bp, Homo sapiens
gcaagacaatgacactg

SEQ ID NO: 4808351 - DNA, 16 bp, Homo sapiens
gcaagaggtttcagca

SEQ ID NO: 4808352 - DNA, 20 bp, Homo sapiens
gcaagaggtttcagcattcc

SEQ ID NO: 4808353 - DNA, 21 bp, Homo sapiens
gcaagaggtttcagcattccc

SEQ ID NO: 4808354 - DNA, 19 bp, Homo sapiens
gcaagagtgatgggaaaga

SEQ ID NO: 4808355 - DNA, 21 bp, Homo sapiens
gcaagagtgatgggaaagacc

SEQ ID NO: 4808356 - DNA, 19 bp, Homo sapiens
gcaagcgacacaggctgcc

SEQ ID NO: 4808357 - DNA, 22 bp, Homo sapiens
gcaagcgacacaggctgccgct

SEQ ID NO: 4808358 - DNA, 22 bp, Homo sapiens
gcaagctcatagcacatgtttt

SEQ ID NO: 4808359 - DNA, 17 bp, Homo sapiens
gcaagctccagtagctc

SEQ ID NO: 4808360 - DNA, 16 bp, Homo sapiens
gcaaggatacccggtg

SEQ ID NO: 4808361 - DNA, 19 bp, Homo sapiens
gcaaggcaagaagtgggat

SEQ ID NO: 4808362 - DNA, 16 bp, Homo sapiens
gcaaggcccacaggag

SEQ ID NO: 4808363 - DNA, 11 bp, Homo sapiens
gcaaggctgct

SEQ ID NO: 4808364 - DNA, 14 bp, Homo sapiens
gcaaggctgtcaat

SEQ ID NO: 4808365 - DNA, 18 bp, Homo sapiens
gcaaggctgtcaattaca

SEQ ID NO: 4808366 - DNA, 21 bp, Homo sapiens
gcaaggggcgcgcgcccccag

SEQ ID NO: 4808367 - DNA, 23 bp, Homo sapiens
gcaaggtattggtaggttactca

SEQ ID NO: 4808368 - DNA, 16 bp, Homo sapiens
gcaagtttttggtaat

SEQ ID NO: 4808369 - DNA, 17 bp, Homo sapiens
gcaataaactcagtcaa

SEQ ID NO: 4808370 - DNA, 21 bp, Homo sapiens
gcaataaactcagtcaaatgt

SEQ ID NO: 4808371 - DNA, 18 bp, Homo sapiens
gcaataaatgtcccaaat

SEQ ID NO: 4808372 - DNA, 21 bp, Homo sapiens
gcaataaggatttattctcag

SEQ ID NO: 4808373 - DNA, 16 bp, Homo sapiens
gcaataagttgaatga

SEQ ID NO: 4808374 - DNA, 22 bp, Homo sapiens
gcaataggtttgggggacgccc

SEQ ID NO: 4808375 - DNA, 17 bp, Homo sapiens
gcaatagtgttgaggag

SEQ ID NO: 4808376 - DNA, 19 bp, Homo sapiens
gcaatatcttcgttagtaa

SEQ ID NO: 4808377 - DNA, 20 bp, Homo sapiens
gcaatcctcccacttcagcc

SEQ ID NO: 4808378 - DNA, 16 bp, Homo sapiens
gcaatcttgctgtgaa

SEQ ID NO: 4808379 - DNA, 17 bp, Homo sapiens
gcaatcttgctgtgaaa

SEQ ID NO: 4808380 - DNA, 11 bp, Homo sapiens
gcaattcaact

SEQ ID NO: 4808381 - DNA, 16 bp, Homo sapiens
gcaatttacttggaat

SEQ ID NO: 4808382 - DNA, 15 bp, Homo sapiens
gcacaaaaaatttaa

SEQ ID NO: 4808383 - DNA, 19 bp, Homo sapiens
gcacaaaccttcttttcaa

SEQ ID NO: 4808384 - DNA, 14 bp, Homo sapiens
gcacaacatgcaca

SEQ ID NO: 4808385 - DNA, 19 bp, Homo sapiens
gcacacacacgcaaataca

SEQ ID NO: 4808386 - DNA, 21 bp, Homo sapiens
gcacacacacgcgtccacata

SEQ ID NO: 4808387 - DNA, 16 bp, Homo sapiens
gcacacacagtctgtt

SEQ ID NO: 4808388 - DNA, 22 bp, Homo sapiens
gcacacaccaccacgcctggct

SEQ ID NO: 4808389 - DNA, 15 bp, Homo sapiens
gcacacacctgcctg

SEQ ID NO: 4808390 - DNA, 15 bp, Homo sapiens
gcacacagcagcccc

SEQ ID NO: 4808391 - DNA, 16 bp, Homo sapiens
gcacacagcagccccc

SEQ ID NO: 4808392 - DNA, 21 bp, Homo sapiens
gcacacagcagccccccagca

SEQ ID NO: 4808393 - DNA, 18 bp, Homo sapiens
gcacaccaaattgctgag

SEQ ID NO: 4808394 - DNA, 20 bp, Homo sapiens
gcacagaaaatggaagacag

SEQ ID NO: 4808395 - DNA, 21 bp, Homo sapiens
gcacagaaaatggaagacagc

SEQ ID NO: 4808396 - DNA, 23 bp, Homo sapiens
gcacagaaaatggaagacagctc

SEQ ID NO: 4808397 - DNA, 14 bp, Homo sapiens
gcacagcagcctgc

SEQ ID NO: 4808398 - DNA, 11 bp, Homo sapiens
gcacagccaga

SEQ ID NO: 4808399 - DNA, 12 bp, Homo sapiens
gcacagccagaa

SEQ ID NO: 4808400 - DNA, 14 bp, Homo sapiens
gcacagccagaaac

SEQ ID NO: 4808401 - DNA, 14 bp, Homo sapiens
gcacagctactcag

SEQ ID NO: 4808402 - DNA, 21 bp, Homo sapiens
gcacagctactcagatctgca

SEQ ID NO: 4808403 - DNA, 11 bp, Homo sapiens
gcacagtattt

SEQ ID NO: 4808404 - DNA, 13 bp, Homo sapiens
gcacagtatttaa

SEQ ID NO: 4808405 - DNA, 16 bp, Homo sapiens
gcacagtatttaacat

SEQ ID NO: 4808406 - DNA, 15 bp, Homo sapiens
gcacatacagatggt

SEQ ID NO: 4808407 - DNA, 18 bp, Homo sapiens
gcacatgcctctctcagg

SEQ ID NO: 4808408 - DNA, 20 bp, Homo sapiens
gcacatgcctctctcaggcc

SEQ ID NO: 4808409 - DNA, 14 bp, Homo sapiens
gcacatgctggcca

SEQ ID NO: 4808410 - DNA, 12 bp, Homo sapiens
gcagcccctccc

SEQ ID NO: 4808411 - DNA, 14 bp, Homo sapiens
gcagcccctcccca

SEQ ID NO: 4808412 - DNA, 15 bp, Homo sapiens
gcagccctgcagagg

SEQ ID NO: 4808413 - DNA, 20 bp, Homo sapiens
gcagccgcgctctgcccctc

SEQ ID NO: 4808414 - DNA, 12 bp, Homo sapiens
gcagcctgagct

SEQ ID NO: 4808415 - DNA, 15 bp, Homo sapiens
gcagcctgagctcca

SEQ ID NO: 4808416 - DNA, 21 bp, Homo sapiens
gcagcctgagctccaccctcc

SEQ ID NO: 4808417 - DNA, 22 bp, Homo sapiens
gcagcctgagctccaccctccc

SEQ ID NO: 4808418 - DNA, 22 bp, Homo sapiens
gcagcctgcttcccacctccct

SEQ ID NO: 4808419 - DNA, 14 bp, Homo sapiens
gcagcgaggtccac

SEQ ID NO: 4808420 - DNA, 16 bp, Homo sapiens
gcagctaatttgtgaa

SEQ ID NO: 4808421 - DNA, 17 bp, Homo sapiens
gcagctaatttgtgaaa

SEQ ID NO: 4808422 - DNA, 15 bp, Homo sapiens
gcagctagaaagaga

SEQ ID NO: 4808423 - DNA, 23 bp, Homo sapiens
gcagctcatagagtcccccctcc

SEQ ID NO: 4808424 - DNA, 16 bp, Homo sapiens
gcagctccaacctgga

SEQ ID NO: 4808425 - DNA, 17 bp, Homo sapiens
gcagctccaacctggag

SEQ ID NO: 4808426 - DNA, 23 bp, Homo sapiens
gaggagcttccccggccgggaga

SEQ ID NO: 4808427 - DNA, 13 bp, Homo sapiens
gaggaggatccgg

SEQ ID NO: 4808428 - DNA, 16 bp, Homo sapiens
gaggaggtgtggagtg

SEQ ID NO: 4808429 - DNA, 20 bp, Homo sapiens
gaggaggtgtggagtggagg

SEQ ID NO: 4808430 - DNA, 18 bp, Homo sapiens
gaggagtgatgggcaagg

SEQ ID NO: 4808431 - DNA, 19 bp, Homo sapiens
gaggataaataataaaggt

SEQ ID NO: 4808432 - DNA, 23 bp, Homo sapiens
gaggatccaagcgacctaaacag

SEQ ID NO: 4808433 - DNA, 17 bp, Homo sapiens
gaggatgaacatctttt

SEQ ID NO: 4808434 - DNA, 17 bp, Homo sapiens
gaggatggacgagtgag

SEQ ID NO: 4808435 - DNA, 19 bp, Homo sapiens
gaggatggacgagtgagct

SEQ ID NO: 4808436 - DNA, 22 bp, Homo sapiens
gaggcagaatggtgggctccag

SEQ ID NO: 4808437 - DNA, 19 bp, Homo sapiens
gaggcagggcaaatgacat

SEQ ID NO: 4808438 - DNA, 12 bp, Homo sapiens
gaggcagggccc

SEQ ID NO: 4808439 - DNA, 15 bp, Homo sapiens
gaggcagggccctgg

SEQ ID NO: 4808440 - DNA, 16 bp, Homo sapiens
gaggcagggccctggg

SEQ ID NO: 4808441 - DNA, 19 bp, Homo sapiens
gaggcccccggaggcgccc

SEQ ID NO: 4808442 - DNA, 16 bp, Homo sapiens
gaggcctggctctgga

SEQ ID NO: 4808443 - DNA, 17 bp, Homo sapiens
gaggcctgggagatgca

SEQ ID NO: 4808444 - DNA, 12 bp, Homo sapiens
gaggcctggtct

SEQ ID NO: 4808445 - DNA, 15 bp, Homo sapiens
gaggcctggtctgga

SEQ ID NO: 4808446 - DNA, 19 bp, Homo sapiens
gaggcctggtctggagccc

SEQ ID NO: 4808447 - DNA, 13 bp, Homo sapiens
gaggcgcccacct

SEQ ID NO: 4808448 - DNA, 16 bp, Homo sapiens
gaggcgcccacctgcc

SEQ ID NO: 4808449 - DNA, 17 bp, Homo sapiens
gaggcgcccacctgccc

SEQ ID NO: 4808450 - DNA, 16 bp, Homo sapiens
gaggcgtgggatccag

SEQ ID NO: 4808451 - DNA, 21 bp, Homo sapiens
gaggcgtgggatccagagaga

SEQ ID NO: 4808452 - DNA, 16 bp, Homo sapiens
gaggctggaccaactg

SEQ ID NO: 4808453 - DNA, 14 bp, Homo sapiens
gaggctgggcccct

SEQ ID NO: 4808454 - DNA, 13 bp, Homo sapiens
gaggcttccagct

SEQ ID NO: 4808455 - DNA, 23 bp, Homo sapiens
gaggcttccagctcagtcccaca

SEQ ID NO: 4808456 - DNA, 22 bp, Homo sapiens
gaggcttcctactataaaatgt

SEQ ID NO: 4808457 - DNA, 16 bp, Homo sapiens
gagggaacaaattttc

SEQ ID NO: 4808458 - DNA, 20 bp, Homo sapiens
gagggaagcccacccgcccc

SEQ ID NO: 4808459 - DNA, 22 bp, Homo sapiens
gagggaagcccacccgccccag

SEQ ID NO: 4808460 - DNA, 14 bp, Homo sapiens
gagggacacagagg

SEQ ID NO: 4808461 - DNA, 19 bp, Homo sapiens
gagggacgactttctttaa

SEQ ID NO: 4808462 - DNA, 15 bp, Homo sapiens
gagggactccaagcc

SEQ ID NO: 4808463 - DNA, 18 bp, Homo sapiens
gagggactgcctctgcca

SEQ ID NO: 4808464 - DNA, 12 bp, Homo sapiens
gagggaggggcc

SEQ ID NO: 4808465 - DNA, 14 bp, Homo sapiens
gagggcacagaaaa

SEQ ID NO: 4808466 - DNA, 16 bp, Homo sapiens
gagggcccttcccaac

SEQ ID NO: 4808467 - DNA, 13 bp, Homo sapiens
gagggcctctgga

SEQ ID NO: 4808468 - DNA, 23 bp, Homo sapiens
gagggcgcctgggtcctcccagc

SEQ ID NO: 4808469 - DNA, 12 bp, Homo sapiens
gagggctgagcc

SEQ ID NO: 4808470 - DNA, 13 bp, Homo sapiens
gagggctgagccc

SEQ ID NO: 4808471 - DNA, 20 bp, Homo sapiens
gagggctgagcccctcctct

SEQ ID NO: 4808472 - DNA, 13 bp, Homo sapiens
gaggggaagagag

SEQ ID NO: 4808473 - DNA, 17 bp, Homo sapiens
gaggggaagagagaggc

SEQ ID NO: 4808474 - DNA, 23 bp, Homo sapiens
gaggggcaactgatgaacacagg

SEQ ID NO: 4808475 - DNA, 22 bp, Homo sapiens
gaggggccctgtcactgtccag

SEQ ID NO: 4808476 - DNA, 15 bp, Homo sapiens
gaggggcttggagca

SEQ ID NO: 4808477 - DNA, 17 bp, Homo sapiens
gagggtctatggggaga

SEQ ID NO: 4808478 - DNA, 22 bp, Homo sapiens
gaggtcctgtcctggctcccag

SEQ ID NO: 4808479 - DNA, 18 bp, Homo sapiens
gaggtggatactgggggg

SEQ ID NO: 4808480 - DNA, 22 bp, Homo sapiens
gaggtggatactggggggcagg

SEQ ID NO: 4808481 - DNA, 23 bp, Homo sapiens
gaggtggatactggggggcaggc

SEQ ID NO: 4808482 - DNA, 14 bp, Homo sapiens
gaggtggggagggc

SEQ ID NO: 4808483 - DNA, 21 bp, Homo sapiens
gaggtggggagggcctctgga

SEQ ID NO: 4808484 - DNA, 12 bp, Homo sapiens
gaggtggggtgc

SEQ ID NO: 4808485 - DNA, 14 bp, Homo sapiens
gaggtggggtgctg

SEQ ID NO: 4808486 - DNA, 21 bp, Homo sapiens
gaggtgggtgtttgggaaagg

SEQ ID NO: 4808487 - DNA, 14 bp, Homo sapiens
gaggtgtggagtgg

SEQ ID NO: 4808488 - DNA, 18 bp, Homo sapiens
gaggtgtggagtggaggg

SEQ ID NO: 4808489 - DNA, 19 bp, Homo sapiens
gaggtgtggagtggagggg

SEQ ID NO: 4808490 - DNA, 17 bp, Homo sapiens
gaggttgggaggccatt

SEQ ID NO: 4808491 - DNA, 14 bp, Homo sapiens
gagtaaaaccaaag

SEQ ID NO: 4808492 - DNA, 18 bp, Homo sapiens
gagtagggccctgacagg

SEQ ID NO: 4808493 - DNA, 17 bp, Homo sapiens
gagtatacaagtgtttc

SEQ ID NO: 4808494 - DNA, 20 bp, Homo sapiens
gagtatacaagtgtttctag

SEQ ID NO: 4808495 - DNA, 14 bp, Homo sapiens
gagtatgtgtatgt

SEQ ID NO: 4808496 - DNA, 15 bp, Homo sapiens
gagtcaccttccagg

SEQ ID NO: 4808497 - DNA, 21 bp, Homo sapiens
gagtcaccttccaggacccct

SEQ ID NO: 4808498 - DNA, 17 bp, Homo sapiens
gagtcactacgcctggc

SEQ ID NO: 4808499 - DNA, 12 bp, Homo sapiens
gagtcaggagaa

SEQ ID NO: 4808500 - DNA, 15 bp, Homo sapiens
gagtcagggcccaga

SEQ ID NO: 4808501 - DNA, 16 bp, Homo sapiens
gagtcagggctgtgct

SEQ ID NO: 4808502 - DNA, 20 bp, Homo sapiens
gagtccactttcctctctct

SEQ ID NO: 4808503 - DNA, 21 bp, Homo sapiens
gagtccctcctcccccacgcc

SEQ ID NO: 4808504 - DNA, 22 bp, Homo sapiens
gagtccctcctcccccacgcct

SEQ ID NO: 4808505 - DNA, 21 bp, Homo sapiens
gagtcctcattgttcagaaaa

SEQ ID NO: 4808506 - DNA, 12 bp, Homo sapiens
gagtcggctggg

SEQ ID NO: 4808507 - DNA, 23 bp, Homo sapiens
gagtcggctgggcagggccgcag

SEQ ID NO: 4808508 - DNA, 15 bp, Homo sapiens
gagtctctgaatttg

SEQ ID NO: 4808509 - DNA, 15 bp, Homo sapiens
gagtctgaaggagag

SEQ ID NO: 4808510 - DNA, 19 bp, Homo sapiens
gagtctgaaggagaggagt

SEQ ID NO: 4808511 - DNA, 12 bp, Homo sapiens
gagtctgtcctt

SEQ ID NO: 4808512 - DNA, 21 bp, Homo sapiens
gagtctgtgaataaagccaca

SEQ ID NO: 4808513 - DNA, 16 bp, Homo sapiens
gagtgactctggctgc

SEQ ID NO: 4808514 - DNA, 18 bp, Homo sapiens
gagtgactctggctgcca

SEQ ID NO: 4808515 - DNA, 19 bp, Homo sapiens
gagtgagctaccaggaaga

SEQ ID NO: 4808516 - DNA, 20 bp, Homo sapiens
gagtgagctaccaggaagag

SEQ ID NO: 4808517 - DNA, 22 bp, Homo sapiens
gagtgatatggcttgtagggtg

SEQ ID NO: 4808518 - DNA, 13 bp, Homo sapiens
gagtgatgggcaa

SEQ ID NO: 4808519 - DNA, 22 bp, Homo sapiens
gagtgatgggcaaggggccagg

SEQ ID NO: 4808520 - DNA, 23 bp, Homo sapiens
gagtgatgggcaaggggccagga

SEQ ID NO: 4808521 - DNA, 19 bp, Homo sapiens
gagtgccacgtggccgctg

SEQ ID NO: 4808522 - DNA, 22 bp, Homo sapiens
gagtgcccttaaaataatgatt

SEQ ID NO: 4808523 - DNA, 13 bp, Homo sapiens
gagtggacagcag

SEQ ID NO: 4808524 - DNA, 16 bp, Homo sapiens
gagtggacagcagctg

SEQ ID NO: 4808525 - DNA, 18 bp, Homo sapiens
gagtggacagcagctgga

SEQ ID NO: 4808526 - DNA, 22 bp, Homo sapiens
gagtggacagcagctggactgg

SEQ ID NO: 4808527 - DNA, 19 bp, Homo sapiens
gagtggaggggtcagcagg

SEQ ID NO: 4808528 - DNA, 17 bp, Homo sapiens
gagtggcgagtccagac

SEQ ID NO: 4808529 - DNA, 13 bp, Homo sapiens
gagtggctcccgt

SEQ ID NO: 4808530 - DNA, 17 bp, Homo sapiens
gagtgtagtcccggagg

SEQ ID NO: 4808531 - DNA, 14 bp, Homo sapiens
gagtgtatgcatac

SEQ ID NO: 4808532 - DNA, 14 bp, Homo sapiens
gagtgtatgtatac

SEQ ID NO: 4808533 - DNA, 18 bp, Homo sapiens
gagtgtatgtatacacac

SEQ ID NO: 4808534 - DNA, 20 bp, Homo sapiens
gagttatatgacttcttgtt

SEQ ID NO: 4808535 - DNA, 16 bp, Homo sapiens
gagttcagctgcttct

SEQ ID NO: 4808536 - DNA, 15 bp, Homo sapiens
gagttcccaagaaag

SEQ ID NO: 4808537 - DNA, 13 bp, Homo sapiens
gagttcctttccc

SEQ ID NO: 4808538 - DNA, 12 bp, Homo sapiens
gagttctgcaca

SEQ ID NO: 4808539 - DNA, 14 bp, Homo sapiens
gagttgaagacaga

SEQ ID NO: 4808540 - DNA, 15 bp, Homo sapiens
gagtttccatttgga

SEQ ID NO: 4808541 - DNA, 14 bp, Homo sapiens
gataaagaaaagaa

SEQ ID NO: 4808542 - DNA, 14 bp, Homo sapiens
gataaagtgaccag

SEQ ID NO: 4808543 - DNA, 15 bp, Homo sapiens
gataaagtgaccagg

SEQ ID NO: 4808544 - DNA, 22 bp, Homo sapiens
gataaatatcattatagcatgt

SEQ ID NO: 4808545 - DNA, 20 bp, Homo sapiens
gataacagagtgatttgtaa

SEQ ID NO: 4808546 - DNA, 13 bp, Homo sapiens
gataactctgtac

SEQ ID NO: 4808547 - DNA, 14 bp, Homo sapiens
gataataaaattca

SEQ ID NO: 4808548 - DNA, 17 bp, Homo sapiens
gataataactagatctc

SEQ ID NO: 4808549 - DNA, 22 bp, Homo sapiens
gataatgagatgtaatacacca

SEQ ID NO: 4808550 - DNA, 18 bp, Homo sapiens
gataattaaatgaaatac

SEQ ID NO: 4808551 - DNA, 17 bp, Homo sapiens
gataccattttgaaata

SEQ ID NO: 4808552 - DNA, 12 bp, Homo sapiens
gatacctgtgag

SEQ ID NO: 4808553 - DNA, 21 bp, Homo sapiens
gatactgaattgttatgtaaa

SEQ ID NO: 4808554 - DNA, 21 bp, Homo sapiens
gatactggggggcaggcctcc

SEQ ID NO: 4808555 - DNA, 13 bp, Homo sapiens
gatacttgtaact

SEQ ID NO: 4808556 - DNA, 21 bp, Homo sapiens
gatagaagaaggactgaagaa

SEQ ID NO: 4808557 - DNA, 22 bp, Homo sapiens
gatagaagaaggactgaagaaa

SEQ ID NO: 4808558 - DNA, 23 bp, Homo sapiens
gatagaagaaggactgaagaaaa

SEQ ID NO: 4808559 - DNA, 22 bp, Homo sapiens
gatagccaaggccaaaggaagc

SEQ ID NO: 4808560 - DNA, 18 bp, Homo sapiens
gatagcttagtgtctcgt

SEQ ID NO: 4808561 - DNA, 20 bp, Homo sapiens
gatagtgtcccacggtgcct

SEQ ID NO: 4808562 - DNA, 23 bp, Homo sapiens
gatagtgtttcgttaagcagtac

SEQ ID NO: 4808563 - DNA, 17 bp, Homo sapiens
gatatacagacctccag

SEQ ID NO: 4808564 - DNA, 20 bp, Homo sapiens
gatatacagacctccagatt

SEQ ID NO: 4808565 - DNA, 16 bp, Homo sapiens
gatatcacctgaatta

SEQ ID NO: 4808566 - DNA, 22 bp, Homo sapiens
gatatcacctgaattattaatg

SEQ ID NO: 4808567 - DNA, 15 bp, Homo sapiens
gatatcacgggcccg

SEQ ID NO: 4808568 - DNA, 15 bp, Homo sapiens
gatatgaaagagaaa

SEQ ID NO: 4808569 - DNA, 20 bp, Homo sapiens
gatatgcatgtagcatataa

SEQ ID NO: 4808570 - DNA, 13 bp, Homo sapiens
gatatgggactga

SEQ ID NO: 4808571 - DNA, 18 bp, Homo sapiens
gatatgtgcttgtgtgta

SEQ ID NO: 4808572 - DNA, 18 bp, Homo sapiens
gatatgtgtaatatcatt

SEQ ID NO: 4808573 - DNA, 19 bp, Homo sapiens
gatatgtgtaatatcattt

SEQ ID NO: 4808574 - DNA, 23 bp, Homo sapiens
gatattctaagaaatatctgtga

SEQ ID NO: 4808575 - DNA, 19 bp, Homo sapiens
gatattggttctatttatt

SEQ ID NO: 4808576 - DNA, 17 bp, Homo sapiens
gatattgtattatcata

SEQ ID NO: 4808577 - DNA, 17 bp, Homo sapiens
gatattttgtaaaatgt

SEQ ID NO: 4808578 - DNA, 13 bp, Homo sapiens
gatcaagtattac

SEQ ID NO: 4808579 - DNA, 18 bp, Homo sapiens
gatcactatgcattttaa

SEQ ID NO: 4808580 - DNA, 15 bp, Homo sapiens
gatcaggaagagaag

SEQ ID NO: 4808581 - DNA, 17 bp, Homo sapiens
gatccagagacctgctc

SEQ ID NO: 4808582 - DNA, 15 bp, Homo sapiens
gatccagcggggctt

SEQ ID NO: 4808583 - DNA, 19 bp, Homo sapiens
gatccattaatttaaatga

SEQ ID NO: 4808584 - DNA, 16 bp, Homo sapiens
gatccatttaaaacaa

SEQ ID NO: 4808585 - DNA, 22 bp, Homo sapiens
gatcccaagtcaaacagtgtgg

SEQ ID NO: 4808586 - DNA, 18 bp, Homo sapiens
gatcccccaaacagcatg

SEQ ID NO: 4808587 - DNA, 18 bp, Homo sapiens
gatccctcggtcagcacc

SEQ ID NO: 4808588 - DNA, 20 bp, Homo sapiens
gatcctccgcggaggcccct

SEQ ID NO: 4808589 - DNA, 15 bp, Homo sapiens
gatcctctttcccca

SEQ ID NO: 4808590 - DNA, 21 bp, Homo sapiens
gatcctctttccccactgaag

SEQ ID NO: 4808591 - DNA, 16 bp, Homo sapiens
gatccttcaaagtctc

SEQ ID NO: 4808592 - DNA, 13 bp, Homo sapiens
gatctccaggccc

SEQ ID NO: 4808593 - DNA, 17 bp, Homo sapiens
gatctccaggcccagcc

SEQ ID NO: 4808594 - DNA, 16 bp, Homo sapiens
gatctcctgtgcacct

SEQ ID NO: 4808595 - DNA, 12 bp, Homo sapiens
gatctcttaaga

SEQ ID NO: 4808596 - DNA, 20 bp, Homo sapiens
gatctctttctaaagacagg

SEQ ID NO: 4808597 - DNA, 17 bp, Homo sapiens
gatctgcactcctgtct

SEQ ID NO: 4808598 - DNA, 20 bp, Homo sapiens
gatctgcttgatatcccaag

SEQ ID NO: 4808599 - DNA, 15 bp, Homo sapiens
gatctggagtctgaa

SEQ ID NO: 4808600 - DNA, 16 bp, Homo sapiens
gatctggtgcgtgtgg

SEQ ID NO: 4808601 - DNA, 14 bp, Homo sapiens
gatctgtccttcca

SEQ ID NO: 4808602 - DNA, 17 bp, Homo sapiens
gatctgttgtaatatca

SEQ ID NO: 4808603 - DNA, 16 bp, Homo sapiens
gatcttacccacttcc

SEQ ID NO: 4808604 - DNA, 13 bp, Homo sapiens
gatcttgcctctt

SEQ ID NO: 4808605 - DNA, 15 bp, Homo sapiens
gatcttgctggagaa

SEQ ID NO: 4808606 - DNA, 22 bp, Homo sapiens
gatctttttttaagtgttctgt

SEQ ID NO: 4808607 - DNA, 20 bp, Homo sapiens
gatgaaaaaaagggaaaaca

SEQ ID NO: 4808608 - DNA, 15 bp, Homo sapiens
gatgaaaaaataaca

SEQ ID NO: 4808609 - DNA, 14 bp, Homo sapiens
gatgaataaaatgt

SEQ ID NO: 4808610 - DNA, 17 bp, Homo sapiens
gatgaataaaatgttta

SEQ ID NO: 4808611 - DNA, 16 bp, Homo sapiens
gatgaatgcagtataa

SEQ ID NO: 4808612 - DNA, 16 bp, Homo sapiens
gatgacaaagaaaatg

SEQ ID NO: 4808613 - DNA, 21 bp, Homo sapiens
gatgacaaagaaaatgagaat

SEQ ID NO: 4808614 - DNA, 18 bp, Homo sapiens
gatgaccttgaatgatgc

SEQ ID NO: 4808615 - DNA, 19 bp, Homo sapiens
gatgacggtattatgcttc

SEQ ID NO: 4808616 - DNA, 14 bp, Homo sapiens
gatgagacaacaca

SEQ ID NO: 4808617 - DNA, 15 bp, Homo sapiens
gatgatgttctgaaa

SEQ ID NO: 4808618 - DNA, 13 bp, Homo sapiens
gatgattgtacag

SEQ ID NO: 4808619 - DNA, 18 bp, Homo sapiens
gatgcaacctcactatgg

SEQ ID NO: 4808620 - DNA, 20 bp, Homo sapiens
gatgcagccgccttccttga

SEQ ID NO: 4808621 - DNA, 22 bp, Homo sapiens
gatgcagccgccttccttgacc

SEQ ID NO: 4808622 - DNA, 15 bp, Homo sapiens
gatgcatctgtggcc

SEQ ID NO: 4808623 - DNA, 16 bp, Homo sapiens
gatgcatgcagggccc

SEQ ID NO: 4808624 - DNA, 18 bp, Homo sapiens
gatgcattttaaatgtct

SEQ ID NO: 4808625 - DNA, 16 bp, Homo sapiens
gatgctagttcttacg

SEQ ID NO: 4808626 - DNA, 18 bp, Homo sapiens
gatgctgtagacatctgt

SEQ ID NO: 4808627 - DNA, 14 bp, Homo sapiens
gatggaatcacagc

SEQ ID NO: 4808628 - DNA, 23 bp, Homo sapiens
gatggacagttcacaccctgcaa

SEQ ID NO: 4808629 - DNA, 15 bp, Homo sapiens
gatggagaggcggcc

SEQ ID NO: 4808630 - DNA, 15 bp, Homo sapiens
gatggatctgctcca

SEQ ID NO: 4808631 - DNA, 20 bp, Homo sapiens
gatggatctgctccatgcag

SEQ ID NO: 4808632 - DNA, 10 bp, Homo sapiens
gatggcactt

SEQ ID NO: 4808633 - DNA, 13 bp, Homo sapiens
gatggcagagcca

SEQ ID NO: 4808634 - DNA, 14 bp, Homo sapiens
gatggcagagccat

SEQ ID NO: 4808635 - DNA, 12 bp, Homo sapiens
gatggccaggcc

SEQ ID NO: 4808636 - DNA, 19 bp, Homo sapiens
gatgggcaaggggccagga

SEQ ID NO: 4808637 - DNA, 12 bp, Homo sapiens
gatgggccaggg

SEQ ID NO: 4808638 - DNA, 14 bp, Homo sapiens
gatggggagggcgc

SEQ ID NO: 4808639 - DNA, 17 bp, Homo sapiens
gatgggggatgggccag

SEQ ID NO: 4808640 - DNA, 21 bp, Homo sapiens
gatggggtgagaagtacaggg

SEQ ID NO: 4808641 - DNA, 23 bp, Homo sapiens
gatggggtgagaagtacagggca

SEQ ID NO: 4808642 - DNA, 17 bp, Homo sapiens
gatgggtgattatgaaa

SEQ ID NO: 4808643 - DNA, 18 bp, Homo sapiens
gatgggtgattatgaaat

SEQ ID NO: 4808644 - DNA, 21 bp, Homo sapiens
gatgggttttgttaggggtgg

SEQ ID NO: 4808645 - DNA, 23 bp, Homo sapiens
gatgggttttgttaggggtgggg

SEQ ID NO: 4808646 - DNA, 17 bp, Homo sapiens
gatggtgccccctgggg

SEQ ID NO: 4808647 - DNA, 15 bp, Homo sapiens
gatggttgctttgag

SEQ ID NO: 4808648 - DNA, 18 bp, Homo sapiens
gatggttggttagtgcat

SEQ ID NO: 4808649 - DNA, 20 bp, Homo sapiens
gatggttggttagtgcatgt

SEQ ID NO: 4808650 - DNA, 15 bp, Homo sapiens
gatgtattattatat

SEQ ID NO: 4808651 - DNA, 15 bp, Homo sapiens
gatgtccctgtcccc

SEQ ID NO: 4808652 - DNA, 15 bp, Homo sapiens
gatgtctgtgtatac

SEQ ID NO: 4808653 - DNA, 16 bp, Homo sapiens
gatgtgcatctggcct

SEQ ID NO: 4808654 - DNA, 15 bp, Homo sapiens
gatgtgtatcagtgt

SEQ ID NO: 4808655 - DNA, 17 bp, Homo sapiens
gatgtttagatgaggtt

SEQ ID NO: 4808656 - DNA, 14 bp, Homo sapiens
gattaattaaaatt

SEQ ID NO: 4808657 - DNA, 14 bp, Homo sapiens
gattacagaaacac

SEQ ID NO: 4808658 - DNA, 14 bp, Homo sapiens
gattacctgaaagc

SEQ ID NO: 4808659 - DNA, 21 bp, Homo sapiens
gattatttacaagaagaactc

SEQ ID NO: 4808660 - DNA, 17 bp, Homo sapiens
gattcaattttctttaa

SEQ ID NO: 4808661 - DNA, 13 bp, Homo sapiens
gattcacctgtaa

SEQ ID NO: 4808662 - DNA, 14 bp, Homo sapiens
gattcacctgtaaa

SEQ ID NO: 4808663 - DNA, 15 bp, Homo sapiens
gattcacctgtaaaa

SEQ ID NO: 4808664 - DNA, 16 bp, Homo sapiens
gattcagactgcttca

SEQ ID NO: 4808665 - DNA, 18 bp, Homo sapiens
gattcagactgcttcatt

SEQ ID NO: 4808666 - DNA, 19 bp, Homo sapiens
gattcagtttctaaaattg

SEQ ID NO: 4808667 - DNA, 21 bp, Homo sapiens
gattccaacccaggtctgctt

SEQ ID NO: 4808668 - DNA, 13 bp, Homo sapiens
gattccagtgcag

SEQ ID NO: 4808669 - DNA, 21 bp, Homo sapiens
tacaccaaatagcttttcact

SEQ ID NO: 4808670 - DNA, 18 bp, Homo sapiens
tacacttcacctccttct

SEQ ID NO: 4808671 - DNA, 18 bp, Homo sapiens
tacacttgagatgatttc

SEQ ID NO: 4808672 - DNA, 22 bp, Homo sapiens
tacagaaccagcactcccaggg

SEQ ID NO: 4808673 - DNA, 23 bp, Homo sapiens
tacagaaccagcactcccagggc

SEQ ID NO: 4808674 - DNA, 18 bp, Homo sapiens
tacagaatcattgcttat

SEQ ID NO: 4808675 - DNA, 14 bp, Homo sapiens
tacagacaaagcgt

SEQ ID NO: 4808676 - DNA, 19 bp, Homo sapiens
tacagacaaagcgtggtgg

SEQ ID NO: 4808677 - DNA, 15 bp, Homo sapiens
tacagagcctgtttt

SEQ ID NO: 4808678 - DNA, 16 bp, Homo sapiens
tacagagcctgtttta

SEQ ID NO: 4808679 - DNA, 17 bp, Homo sapiens
tacagagcctgttttaa

SEQ ID NO: 4808680 - DNA, 20 bp, Homo sapiens
tacagagcctgttttaaaaa

SEQ ID NO: 4808681 - DNA, 16 bp, Homo sapiens
tacagatcctccgcgg

SEQ ID NO: 4808682 - DNA, 15 bp, Homo sapiens
tacagatggtgtcct

SEQ ID NO: 4808683 - DNA, 17 bp, Homo sapiens
tacagattgctgcttct

SEQ ID NO: 4808684 - DNA, 21 bp, Homo sapiens
tacagcctgcacacacctgcc

SEQ ID NO: 4808685 - DNA, 16 bp, Homo sapiens
tacagctctcctccag

SEQ ID NO: 4808686 - DNA, 17 bp, Homo sapiens
tacagctctcctccagc

SEQ ID NO: 4808687 - DNA, 20 bp, Homo sapiens
tacagctgaaagacagtaaa

SEQ ID NO: 4808688 - DNA, 20 bp, Homo sapiens
tacagcttgaccgtgaggcc

SEQ ID NO: 4808689 - DNA, 13 bp, Homo sapiens
tacaggaagtact

SEQ ID NO: 4808690 - DNA, 14 bp, Homo sapiens
tacaggaagtactg

SEQ ID NO: 4808691 - DNA, 15 bp, Homo sapiens
tacaggctgagacac

SEQ ID NO: 4808692 - DNA, 15 bp, Homo sapiens
tacaggggaggctga

SEQ ID NO: 4808693 - DNA, 15 bp, Homo sapiens
tacagtaatgtcata

SEQ ID NO: 4808694 - DNA, 12 bp, Homo sapiens
tacagtatataa

SEQ ID NO: 4808695 - DNA, 17 bp, Homo sapiens
tacagtatataagcttt

SEQ ID NO: 4808696 - DNA, 18 bp, Homo sapiens
tacagtattatttagtaa

SEQ ID NO: 4808697 - DNA, 17 bp, Homo sapiens
tacagtggcagtattga

SEQ ID NO: 4808698 - DNA, 20 bp, Homo sapiens
tacataacaggcattgcact

SEQ ID NO: 4808699 - DNA, 21 bp, Homo sapiens
tacataacaggcattgcacta

SEQ ID NO: 4808700 - DNA, 14 bp, Homo sapiens
tacatacctctctc

SEQ ID NO: 4808701 - DNA, 21 bp, Homo sapiens
tacatactatagattctttat

SEQ ID NO: 4808702 - DNA, 21 bp, Homo sapiens
tacatagctttagagaagcca

SEQ ID NO: 4808703 - DNA, 16 bp, Homo sapiens
tacatagtctgaagtg

SEQ ID NO: 4808704 - DNA, 15 bp, Homo sapiens
tacatagtggtcatt

SEQ ID NO: 4808705 - DNA, 18 bp, Homo sapiens
tacatatagctttgcaac

SEQ ID NO: 4808706 - DNA, 17 bp, Homo sapiens
tacatatgctttaagaa

SEQ ID NO: 4808707 - DNA, 16 bp, Homo sapiens
tacatcacgttaaagt

SEQ ID NO: 4808708 - DNA, 16 bp, Homo sapiens
tacatctgaaatctac

SEQ ID NO: 4808709 - DNA, 13 bp, Homo sapiens
tacatctgatatc

SEQ ID NO: 4808710 - DNA, 16 bp, Homo sapiens
tacatctgatatcagg

SEQ ID NO: 4808711 - DNA, 13 bp, Homo sapiens
tacatctgtcagt

SEQ ID NO: 4808712 - DNA, 14 bp, Homo sapiens
tacatgaaattcaa

SEQ ID NO: 4808713 - DNA, 15 bp, Homo sapiens
tacatgcagaaattg

SEQ ID NO: 4808714 - DNA, 16 bp, Homo sapiens
tacatgggtgttttga

SEQ ID NO: 4808715 - DNA, 23 bp, Homo sapiens
tacatgggtgttttgatctctgt

SEQ ID NO: 4808716 - DNA, 14 bp, Homo sapiens
tacatgtatagtga

SEQ ID NO: 4808717 - DNA, 16 bp, Homo sapiens
tacatgtatagtgagt

SEQ ID NO: 4808718 - DNA, 16 bp, Homo sapiens
tacattagacacacat

SEQ ID NO: 4808719 - DNA, 22 bp, Homo sapiens
tacattagacacacatatacat

SEQ ID NO: 4808720 - DNA, 15 bp, Homo sapiens
tacattattggactt

SEQ ID NO: 4808721 - DNA, 17 bp, Homo sapiens
tacattatttctgtata

SEQ ID NO: 4808722 - DNA, 22 bp, Homo sapiens
tacattgccgtggcatcttaaa

SEQ ID NO: 4808723 - DNA, 22 bp, Homo sapiens
tacatttgatttgatatacaga

SEQ ID NO: 4808724 - DNA, 17 bp, Homo sapiens
tacatttttttaaacaa

SEQ ID NO: 4808725 - DNA, 23 bp, Homo sapiens
taccaaatataaacttgtgtatg

SEQ ID NO: 4808726 - DNA, 16 bp, Homo sapiens
taccaactaagttgta

SEQ ID NO: 4808727 - DNA, 22 bp, Homo sapiens
taccaactaagttgtattttaa

SEQ ID NO: 4808728 - DNA, 17 bp, Homo sapiens
taccacagctgcctccg

SEQ ID NO: 4808729 - DNA, 17 bp, Homo sapiens
taccaccctcgctgcca

SEQ ID NO: 4808730 - DNA, 16 bp, Homo sapiens
taccacgaaatactta

SEQ ID NO: 4808731 - DNA, 22 bp, Homo sapiens
taccagaagtttaaatctttgt

SEQ ID NO: 4808732 - DNA, 13 bp, Homo sapiens
taccagcccaggc

SEQ ID NO: 4808733 - DNA, 22 bp, Homo sapiens
taccaggaagaggggcgctgcc

SEQ ID NO: 4808734 - DNA, 18 bp, Homo sapiens
taccatcaaacaaatcat

SEQ ID NO: 4808735 - DNA, 14 bp, Homo sapiens
taccatcccactga

SEQ ID NO: 4808736 - DNA, 16 bp, Homo sapiens
taccatcggtcagcag

SEQ ID NO: 4808737 - DNA, 14 bp, Homo sapiens
taccatgttaaaga

SEQ ID NO: 4808738 - DNA, 16 bp, Homo sapiens
taccattttgaaatat

SEQ ID NO: 4808739 - DNA, 19 bp, Homo sapiens
tacccacttccctgcaagg

SEQ ID NO: 4808740 - DNA, 15 bp, Homo sapiens
taccccctgccccag

SEQ ID NO: 4808741 - DNA, 18 bp, Homo sapiens
taccccctgccccagaga

SEQ ID NO: 4808742 - DNA, 19 bp, Homo sapiens
tacccggtggcttctggca

SEQ ID NO: 4808743 - DNA, 18 bp, Homo sapiens
taccctaggtctccaccc

SEQ ID NO: 4808744 - DNA, 23 bp, Homo sapiens
taccctcagaatattaagcacat

SEQ ID NO: 4808745 - DNA, 22 bp, Homo sapiens
taccctccacacacttcttcca

SEQ ID NO: 4808746 - DNA, 17 bp, Homo sapiens
taccctccctgtcccct

SEQ ID NO: 4808747 - DNA, 20 bp, Homo sapiens
taccctggacagtgcctaac

SEQ ID NO: 4808748 - DNA, 12 bp, Homo sapiens
taccctttccca

SEQ ID NO: 4808749 - DNA, 15 bp, Homo sapiens
taccgaaatgaaaat

SEQ ID NO: 4808750 - DNA, 19 bp, Homo sapiens
taccgaggagctaaacatg

SEQ ID NO: 4808751 - DNA, 18 bp, Homo sapiens
taccgcccacccagcagc

SEQ ID NO: 4808752 - DNA, 19 bp, Homo sapiens
taccgcccacccagcagcg

SEQ ID NO: 4808753 - DNA, 16 bp, Homo sapiens
taccggatgcagaccc

SEQ ID NO: 4808754 - DNA, 18 bp, Homo sapiens
tacctaagtaaattttct

SEQ ID NO: 4808755 - DNA, 22 bp, Homo sapiens
tacctattcaagaagatagttg

SEQ ID NO: 4808756 - DNA, 14 bp, Homo sapiens
tacctgaaagccct

SEQ ID NO: 4808757 - DNA, 20 bp, Homo sapiens
tacctgaaagcccttctcaa

SEQ ID NO: 4808758 - DNA, 14 bp, Homo sapiens
tacctgaagtcttt

SEQ ID NO: 4808759 - DNA, 17 bp, Homo sapiens
tacctgtgaatcaaaac

SEQ ID NO: 4808760 - DNA, 13 bp, Homo sapiens
tacctgtgaggac

SEQ ID NO: 4808761 - DNA, 20 bp, Homo sapiens
taccttagctcccttgagct

SEQ ID NO: 4808762 - DNA, 16 bp, Homo sapiens
taccttatagagcaca

SEQ ID NO: 4808763 - DNA, 19 bp, Homo sapiens
taccttatagagcacaata

SEQ ID NO: 4808764 - DNA, 18 bp, Homo sapiens
taccttctgatgaagttg

SEQ ID NO: 4808765 - DNA, 19 bp, Homo sapiens
taccttctgatgaagttgt

SEQ ID NO: 4808766 - DNA, 18 bp, Homo sapiens
tacgaaaagaggggaaga

SEQ ID NO: 4808767 - DNA, 14 bp, Homo sapiens
tacgctctctgtct

SEQ ID NO: 4808768 - DNA, 21 bp, Homo sapiens
tacggctatctagttgtctga

SEQ ID NO: 4808769 - DNA, 16 bp, Homo sapiens
tacggtgagactctga

SEQ ID NO: 4808770 - DNA, 14 bp, Homo sapiens
tacgtctggtgttc

SEQ ID NO: 4808771 - DNA, 17 bp, Homo sapiens
tacgtgtcaatgtgtgc

SEQ ID NO: 4808772 - DNA, 15 bp, Homo sapiens
tactaaccaccattt

SEQ ID NO: 4808773 - DNA, 21 bp, Homo sapiens
tactacatttgaacagggcaa

SEQ ID NO: 4808774 - DNA, 13 bp, Homo sapiens
tactacatttgca

SEQ ID NO: 4808775 - DNA, 16 bp, Homo sapiens
tactagaaccttctaa

SEQ ID NO: 4808776 - DNA, 18 bp, Homo sapiens
tactagagatattttgta

SEQ ID NO: 4808777 - DNA, 20 bp, Homo sapiens
tactagagatattttgtaaa

SEQ ID NO: 4808778 - DNA, 15 bp, Homo sapiens
tactagcaataagtt

SEQ ID NO: 4808779 - DNA, 17 bp, Homo sapiens
tactatagcaaagtagt

SEQ ID NO: 4808780 - DNA, 22 bp, Homo sapiens
tactatgcctgttgatctatgg

SEQ ID NO: 4808781 - DNA, 20 bp, Homo sapiens
tactatggtatatattttga

SEQ ID NO: 4808782 - DNA, 19 bp, Homo sapiens
tactattggacagacacag

SEQ ID NO: 4808783 - DNA, 15 bp, Homo sapiens
tactcaaagaggcca

SEQ ID NO: 4808784 - DNA, 19 bp, Homo sapiens
tagcgctatagttactgtc

SEQ ID NO: 4808785 - DNA, 15 bp, Homo sapiens
tagctataaatagtg

SEQ ID NO: 4808786 - DNA, 14 bp, Homo sapiens
tagctatgctgtat

SEQ ID NO: 4808787 - DNA, 14 bp, Homo sapiens
tagctattactgga

SEQ ID NO: 4808788 - DNA, 23 bp, Homo sapiens
tagctcacaagccgtgttttatg

SEQ ID NO: 4808789 - DNA, 20 bp, Homo sapiens
tagctcacagcacatttgtt

SEQ ID NO: 4808790 - DNA, 22 bp, Homo sapiens
tagctccttggttttgcctctt

SEQ ID NO: 4808791 - DNA, 14 bp, Homo sapiens
tagctcgtgtgctt

SEQ ID NO: 4808792 - DNA, 15 bp, Homo sapiens
tagctcgtgtgctta

SEQ ID NO: 4808793 - DNA, 19 bp, Homo sapiens
tagctctgaagggagggga

SEQ ID NO: 4808794 - DNA, 20 bp, Homo sapiens
tagctgataaagaaaccttt

SEQ ID NO: 4808795 - DNA, 15 bp, Homo sapiens
tagctgatagaagaa

SEQ ID NO: 4808796 - DNA, 15 bp, Homo sapiens
tagcttacctgacac

SEQ ID NO: 4808797 - DNA, 20 bp, Homo sapiens
tagctttagagaagccataa

SEQ ID NO: 4808798 - DNA, 17 bp, Homo sapiens
taaatgtttatattgtt

SEQ ID NO: 4808799 - DNA, 13 bp, Homo sapiens
taaatgttttgga

SEQ ID NO: 4808800 - DNA, 14 bp, Homo sapiens
taaatgttttggaa

SEQ ID NO: 4808801 - DNA, 19 bp, Homo sapiens
taaatgttttggaattcaa

SEQ ID NO: 4808802 - DNA, 21 bp, Homo sapiens
taaatgttttggaattcaatg

SEQ ID NO: 4808803 - DNA, 12 bp, Homo sapiens
taaattaaacaa

SEQ ID NO: 4808804 - DNA, 13 bp, Homo sapiens
taaattaaacaat

SEQ ID NO: 4808805 - DNA, 16 bp, Homo sapiens
taaattaaacaattta

SEQ ID NO: 4808806 - DNA, 22 bp, Homo sapiens
taaattaaacaatttattttat

SEQ ID NO: 4808807 - DNA, 13 bp, Homo sapiens
taaattaaatata

SEQ ID NO: 4808808 - DNA, 14 bp, Homo sapiens
taaattaacaaatt

SEQ ID NO: 4808809 - DNA, 17 bp, Homo sapiens
taaattacatgcatgag

SEQ ID NO: 4808810 - DNA, 21 bp, Homo sapiens
taaattatatgatatgcatgt

SEQ ID NO: 4808811 - DNA, 17 bp, Homo sapiens
taaattatcattgtttg

SEQ ID NO: 4808812 - DNA, 19 bp, Homo sapiens
taaattatgacgtgcacaa

SEQ ID NO: 4808813 - DNA, 14 bp, Homo sapiens
taaattattttatg

SEQ ID NO: 4808814 - DNA, 15 bp, Homo sapiens
taaattcctaattct

SEQ ID NO: 4808815 - DNA, 17 bp, Homo sapiens
taaattcctaattctat

SEQ ID NO: 4808816 - DNA, 19 bp, Homo sapiens
taaattcctaattctatga

SEQ ID NO: 4808817 - DNA, 12 bp, Homo sapiens
taaattgactgt

SEQ ID NO: 4808818 - DNA, 12 bp, Homo sapiens
taaattgtggat

SEQ ID NO: 4808819 - DNA, 13 bp, Homo sapiens
taaattgtggatg

SEQ ID NO: 4808820 - DNA, 22 bp, Homo sapiens
taaatttaagtaagttttataa

SEQ ID NO: 4808821 - DNA, 23 bp, Homo sapiens
taaatttaagtaagttttataag

SEQ ID NO: 4808822 - DNA, 18 bp, Homo sapiens
taaatttattaaatgttg

SEQ ID NO: 4808823 - DNA, 20 bp, Homo sapiens
taaattttggaagaattcat

SEQ ID NO: 4808824 - DNA, 22 bp, Homo sapiens
taacaaacgtaatttgttatat

SEQ ID NO: 4808825 - DNA, 17 bp, Homo sapiens
taacaacaatttaggaa

SEQ ID NO: 4808826 - DNA, 22 bp, Homo sapiens
taacaacaatttaggaatgctc

SEQ ID NO: 4808827 - DNA, 17 bp, Homo sapiens
taacaattaattgtctt

SEQ ID NO: 4808828 - DNA, 20 bp, Homo sapiens
taacaattaattgtcttgca

SEQ ID NO: 4808829 - DNA, 23 bp, Homo sapiens
taacagaaaaatgaaatttaagc

SEQ ID NO: 4808830 - DNA, 23 bp, Homo sapiens
taacagagtgatttgtaaaacag

SEQ ID NO: 4808831 - DNA, 14 bp, Homo sapiens
taacagctgtatta

SEQ ID NO: 4808832 - DNA, 15 bp, Homo sapiens
taacagtatttccat

SEQ ID NO: 4808833 - DNA, 14 bp, Homo sapiens
taacataaacttgt

SEQ ID NO: 4808834 - DNA, 19 bp, Homo sapiens
taacatcactatccatgca

SEQ ID NO: 4808835 - DNA, 20 bp, Homo sapiens
taacatgaaagtcaagtcta

SEQ ID NO: 4808836 - DNA, 14 bp, Homo sapiens
taacatggaagtac

SEQ ID NO: 4808837 - DNA, 23 bp, Homo sapiens
taacattatattcccaaatctca

SEQ ID NO: 4808838 - DNA, 15 bp, Homo sapiens
taacattctatttca

SEQ ID NO: 4808839 - DNA, 15 bp, Homo sapiens
taacatttttcaata

SEQ ID NO: 4808840 - DNA, 22 bp, Homo sapiens
taaccaattgtgagaattactg

SEQ ID NO: 4808841 - DNA, 23 bp, Homo sapiens
taaccaattgtgagaattactgt

SEQ ID NO: 4808842 - DNA, 21 bp, Homo sapiens
taaccagtctgaagtttcatt

SEQ ID NO: 4808843 - DNA, 13 bp, Homo sapiens
taacccagtgttc

SEQ ID NO: 4808844 - DNA, 17 bp, Homo sapiens
taaccttatcataaatt

SEQ ID NO: 4808845 - DNA, 13 bp, Homo sapiens
taactaatgtaaa

SEQ ID NO: 4808846 - DNA, 16 bp, Homo sapiens
taactaatgtaaatat

SEQ ID NO: 4808847 - DNA, 22 bp, Homo sapiens
taactaatgtaaatattgctgt

SEQ ID NO: 4808848 - DNA, 15 bp, Homo sapiens
taactagagtatgtg

SEQ ID NO: 4808849 - DNA, 17 bp, Homo sapiens
taactagagtatgtgta

SEQ ID NO: 4808850 - DNA, 15 bp, Homo sapiens
taactagatctcctg

SEQ ID NO: 4808851 - DNA, 16 bp, Homo sapiens
taactagatctcctgt

SEQ ID NO: 4808852 - DNA, 20 bp, Homo sapiens
taactatgattccaattact

SEQ ID NO: 4808853 - DNA, 22 bp, Homo sapiens
taactatggtaaataactgtga

SEQ ID NO: 4808854 - DNA, 16 bp, Homo sapiens
taactctgcatagaca

SEQ ID NO: 4808855 - DNA, 18 bp, Homo sapiens
taactctttggctattgt

SEQ ID NO: 4808856 - DNA, 15 bp, Homo sapiens
taactggccccaggc

SEQ ID NO: 4808857 - DNA, 14 bp, Homo sapiens
taactggccctcgg

SEQ ID NO: 4808858 - DNA, 23 bp, Homo sapiens
taactgtcctttttcttccctta

SEQ ID NO: 4808859 - DNA, 21 bp, Homo sapiens
taactgttaacccagtgttca

SEQ ID NO: 4808860 - DNA, 13 bp, Homo sapiens
taacttaattata

SEQ ID NO: 4808861 - DNA, 20 bp, Homo sapiens
taacttatgtctcttgttaa

SEQ ID NO: 4808862 - DNA, 17 bp, Homo sapiens
taacttattcaaagaga

SEQ ID NO: 4808863 - DNA, 17 bp, Homo sapiens
taacttattttgattgt

SEQ ID NO: 4808864 - DNA, 20 bp, Homo sapiens
taacttgctgtgaaatgact

SEQ ID NO: 4808865 - DNA, 15 bp, Homo sapiens
taacttggggaaggg

SEQ ID NO: 4808866 - DNA, 15 bp, Homo sapiens
taacttgtttgtaaa

SEQ ID NO: 4808867 - DNA, 18 bp, Homo sapiens
taagaaacagtttaacag

SEQ ID NO: 4808868 - DNA, 19 bp, Homo sapiens
taagaaatatctgtgaaat

SEQ ID NO: 4808869 - DNA, 15 bp, Homo sapiens
taagaaatgagaaat

SEQ ID NO: 4808870 - DNA, 16 bp, Homo sapiens
taagaaatgagaaatt

SEQ ID NO: 4808871 - DNA, 20 bp, Homo sapiens
taagaaatggctttccacat

SEQ ID NO: 4808872 - DNA, 23 bp, Homo sapiens
taagaacccatggaaaaatgcca

SEQ ID NO: 4808873 - DNA, 12 bp, Homo sapiens
taagaatcatgg

SEQ ID NO: 4808874 - DNA, 17 bp, Homo sapiens
taagaatcatggattta

SEQ ID NO: 4808875 - DNA, 13 bp, Homo sapiens
taagacaaatgca

SEQ ID NO: 4808876 - DNA, 15 bp, Homo sapiens
taagacaagtctgag

SEQ ID NO: 4808877 - DNA, 17 bp, Homo sapiens
taagacacgtgcaacag

SEQ ID NO: 4808878 - DNA, 19 bp, Homo sapiens
taagacacgtgcaacagac

SEQ ID NO: 4808879 - DNA, 17 bp, Homo sapiens
taagacagcatgtgtta

SEQ ID NO: 4808880 - DNA, 15 bp, Homo sapiens
taagagaaatgagct

SEQ ID NO: 4808881 - DNA, 22 bp, Homo sapiens
taagagaattctaagattgtac

SEQ ID NO: 4808882 - DNA, 23 bp, Homo sapiens
taagagattttatgtttaaaatg

SEQ ID NO: 4808883 - DNA, 17 bp, Homo sapiens
taagataattaaatgaa

SEQ ID NO: 4808884 - DNA, 20 bp, Homo sapiens
taagataattaaatgaaata

SEQ ID NO: 4808885 - DNA, 22 bp, Homo sapiens
taagataattaaatgaaatact

SEQ ID NO: 4808886 - DNA, 12 bp, Homo sapiens
taagatactgtt

SEQ ID NO: 4808887 - DNA, 17 bp, Homo sapiens
taagatattaccctcag

SEQ ID NO: 4808888 - DNA, 19 bp, Homo sapiens
taagatattaccctcagaa

SEQ ID NO: 4808889 - DNA, 20 bp, Homo sapiens
taagatcttgcctctttcct

SEQ ID NO: 4808890 - DNA, 22 bp, Homo sapiens
taagatgggcatagggtttgga

SEQ ID NO: 4808891 - DNA, 23 bp, Homo sapiens
taagatgggcatagggtttggaa

SEQ ID NO: 4808892 - DNA, 17 bp, Homo sapiens
taagattatatacaaag

SEQ ID NO: 4808893 - DNA, 16 bp, Homo sapiens
taagattccattttgg

SEQ ID NO: 4808894 - DNA, 15 bp, Homo sapiens
taagattgtacatat

SEQ ID NO: 4808895 - DNA, 16 bp, Homo sapiens
taagattgtacatatg

SEQ ID NO: 4808896 - DNA, 18 bp, Homo sapiens
taagattgtacatatgga

SEQ ID NO: 4808897 - DNA, 18 bp, Homo sapiens
taagattgttattaaatg

SEQ ID NO: 4808898 - DNA, 13 bp, Homo sapiens
taagcaattctaa

SEQ ID NO: 4808899 - DNA, 11 bp, Homo sapiens
taagcacaaaa

SEQ ID NO: 4808900 - DNA, 19 bp, Homo sapiens
taagcacaaccatgttctt

SEQ ID NO: 4808901 - DNA, 23 bp, Homo sapiens
taagcagtacatcttgtgcatgc

SEQ ID NO: 4808902 - DNA, 20 bp, Homo sapiens
taagcattttactgtctgta

SEQ ID NO: 4808903 - DNA, 14 bp, Homo sapiens
taagccaatataat

SEQ ID NO: 4808904 - DNA, 13 bp, Homo sapiens
taagcctgatgat

SEQ ID NO: 4808905 - DNA, 16 bp, Homo sapiens
taagctccagtgcttt

SEQ ID NO: 4808906 - DNA, 15 bp, Homo sapiens
taagctgaataaagt

SEQ ID NO: 4808907 - DNA, 18 bp, Homo sapiens
taagctgccagccttccc

SEQ ID NO: 4808908 - DNA, 19 bp, Homo sapiens
taagctggtatcagtggtt

SEQ ID NO: 4808909 - DNA, 14 bp, Homo sapiens
taaggaaaagagaa

SEQ ID NO: 4808910 - DNA, 17 bp, Homo sapiens
taaggaaaagagaaaca

SEQ ID NO: 4808911 - DNA, 23 bp, Homo sapiens
taaggacagtgttcaaattctga

SEQ ID NO: 4808912 - DNA, 15 bp, Homo sapiens
taaggactacagaat

SEQ ID NO: 4808913 - DNA, 16 bp, Homo sapiens
taaggactacagaatt

SEQ ID NO: 4808914 - DNA, 16 bp, Homo sapiens
taaggatgttctagca

SEQ ID NO: 4808915 - DNA, 16 bp, Homo sapiens
taaggccgtgtctctg

SEQ ID NO: 4808916 - DNA, 13 bp, Homo sapiens
taaggctgactct

SEQ ID NO: 4808917 - DNA, 17 bp, Homo sapiens
taagggatccagagacc

SEQ ID NO: 4808918 - DNA, 19 bp, Homo sapiens
taagggatccagagacctg

SEQ ID NO: 4808919 - DNA, 18 bp, Homo sapiens
taaggggaattaacaatt

SEQ ID NO: 4808920 - DNA, 18 bp, Homo sapiens
gttcttgcagcagagaga

SEQ ID NO: 4808921 - DNA, 18 bp, Homo sapiens
gttcttggtgactgtccc

SEQ ID NO: 4808922 - DNA, 15 bp, Homo sapiens
gttctttcttttctt

SEQ ID NO: 4808923 - DNA, 14 bp, Homo sapiens
gttgaagtgcatgt

SEQ ID NO: 4808924 - DNA, 15 bp, Homo sapiens
gttgaagtgcatgtt

SEQ ID NO: 4808925 - DNA, 20 bp, Homo sapiens
gttgaatgataatagctcac

SEQ ID NO: 4808926 - DNA, 16 bp, Homo sapiens
gttgaggaggggagca

SEQ ID NO: 4808927 - DNA, 23 bp, Homo sapiens
gttgatattggttctatttattt

SEQ ID NO: 4808928 - DNA, 15 bp, Homo sapiens
gttgatatttaaaag

SEQ ID NO: 4808929 - DNA, 13 bp, Homo sapiens
gttgatgaccaat

SEQ ID NO: 4808930 - DNA, 19 bp, Homo sapiens
gttgattaatttctgccat

SEQ ID NO: 4808931 - DNA, 16 bp, Homo sapiens
gttgcaaagtgttgtc

SEQ ID NO: 4808932 - DNA, 18 bp, Homo sapiens
gttgcaattgtttaagaa

SEQ ID NO: 4808933 - DNA, 19 bp, Homo sapiens
gttgcaattgtttaagaat

SEQ ID NO: 4808934 - DNA, 17 bp, Homo sapiens
gttgctacatcagagtg

SEQ ID NO: 4808935 - DNA, 20 bp, Homo sapiens
gttgctccagtataaattac

SEQ ID NO: 4808936 - DNA, 13 bp, Homo sapiens
gttggaggcctgg

SEQ ID NO: 4808937 - DNA, 19 bp, Homo sapiens
gttggaggcctggtctgga

SEQ ID NO: 4808938 - DNA, 14 bp, Homo sapiens
gttggagtgcagtg

SEQ ID NO: 4808939 - DNA, 15 bp, Homo sapiens
gttggccagcacgtt

SEQ ID NO: 4808940 - DNA, 15 bp, Homo sapiens
gttggcctctgcccc

SEQ ID NO: 4808941 - DNA, 19 bp, Homo sapiens
gttggctgattggaaaata

SEQ ID NO: 4808942 - DNA, 13 bp, Homo sapiens
gttgggttccaga

SEQ ID NO: 4808943 - DNA, 14 bp, Homo sapiens
gttgggttccagac

SEQ ID NO: 4808944 - DNA, 22 bp, Homo sapiens
gttgggttccagacagagtgga

SEQ ID NO: 4808945 - DNA, 14 bp, Homo sapiens
gttgtaatatcagt

SEQ ID NO: 4808946 - DNA, 15 bp, Homo sapiens
gttgtacatagtggt

SEQ ID NO: 4808947 - DNA, 12 bp, Homo sapiens
gttgtccctgca

SEQ ID NO: 4808948 - DNA, 14 bp, Homo sapiens
gttgtccctgcagg

SEQ ID NO: 4808949 - DNA, 17 bp, Homo sapiens
gttgtgatctgttgtaa

SEQ ID NO: 4808950 - DNA, 18 bp, Homo sapiens
gttgttttatagaggttc

SEQ ID NO: 4808951 - DNA, 18 bp, Homo sapiens
gtttaagaaatgagaaat

SEQ ID NO: 4808952 - DNA, 15 bp, Homo sapiens
gtttaagaatcatgg

SEQ ID NO: 4808953 - DNA, 16 bp, Homo sapiens
gtttaagaatcatgga

SEQ ID NO: 4808954 - DNA, 18 bp, Homo sapiens
gtttaagtagatttcatg

SEQ ID NO: 4808955 - DNA, 23 bp, Homo sapiens
gtttaattgtataaaacagtgtt

SEQ ID NO: 4808956 - DNA, 21 bp, Homo sapiens
gtttacacacgtgcaatttgt

SEQ ID NO: 4808957 - DNA, 13 bp, Homo sapiens
gtttacagtgaag

SEQ ID NO: 4808958 - DNA, 17 bp, Homo sapiens
gtttacagtgaagaaag

SEQ ID NO: 4808959 - DNA, 13 bp, Homo sapiens
gtttaccctccct

SEQ ID NO: 4808960 - DNA, 23 bp, Homo sapiens
gtttaccctccctgtcccctgag

SEQ ID NO: 4808961 - DNA, 12 bp, Homo sapiens
gtttactctgtg

SEQ ID NO: 4808962 - DNA, 21 bp, Homo sapiens
gtttagaatcaagtctgtgaa

SEQ ID NO: 4808963 - DNA, 18 bp, Homo sapiens
gtttagtagctgataaag

SEQ ID NO: 4808964 - DNA, 16 bp, Homo sapiens
gtttagtttgcattta

SEQ ID NO: 4808965 - DNA, 22 bp, Homo sapiens
gtttataggaaataaatctaaa

SEQ ID NO: 4808966 - DNA, 22 bp, Homo sapiens
gtttatgtgctattaatatttg

SEQ ID NO: 4808967 - DNA, 13 bp, Homo sapiens
gtttcacatctgt

SEQ ID NO: 4808968 - DNA, 15 bp, Homo sapiens
gtttcactgttcatg

SEQ ID NO: 4808969 - DNA, 15 bp, Homo sapiens
gtttcagataaatca

SEQ ID NO: 4808970 - DNA, 20 bp, Homo sapiens
gtttcagataaatcatgggc

SEQ ID NO: 4808971 - DNA, 23 bp, Homo sapiens
gtttcagataaatcatgggcatt

SEQ ID NO: 4808972 - DNA, 16 bp, Homo sapiens
gtttcagtagctcctt

SEQ ID NO: 4808973 - DNA, 15 bp, Homo sapiens
gtttcatgttctgtg

SEQ ID NO: 4808974 - DNA, 21 bp, Homo sapiens
gtttcatttttcattttctct

SEQ ID NO: 4808975 - DNA, 23 bp, Homo sapiens
gtttccaatgccaattcatctca

SEQ ID NO: 4808976 - DNA, 14 bp, Homo sapiens
gtttccacatgctc

SEQ ID NO: 4808977 - DNA, 22 bp, Homo sapiens
gtttccagctaagcctgatgat

SEQ ID NO: 4808978 - DNA, 11 bp, Homo sapiens
gtttccatttg

SEQ ID NO: 4808979 - DNA, 16 bp, Homo sapiens
gtttcgttaagcagta

SEQ ID NO: 4808980 - DNA, 15 bp, Homo sapiens
gtttctatggattca

SEQ ID NO: 4808981 - DNA, 21 bp, Homo sapiens
gtttctatggattcacttcta

SEQ ID NO: 4808982 - DNA, 22 bp, Homo sapiens
gtttctatggattcacttctat

SEQ ID NO: 4808983 - DNA, 22 bp, Homo sapiens
gtttctcaagcgctatccacag

SEQ ID NO: 4808984 - DNA, 14 bp, Homo sapiens
gtttctgccgcagc

SEQ ID NO: 4808985 - DNA, 18 bp, Homo sapiens
gtttctgccgcagccctg

SEQ ID NO: 4808986 - DNA, 23 bp, Homo sapiens
gtttctgtcctcaggtgaataac

SEQ ID NO: 4808987 - DNA, 11 bp, Homo sapiens
gtttcttgcaa

SEQ ID NO: 4808988 - DNA, 11 bp, Homo sapiens
gtttgaaacac

SEQ ID NO: 4808989 - DNA, 18 bp, Homo sapiens
gtttgaaacactcgtgtg

SEQ ID NO: 4808990 - DNA, 21 bp, Homo sapiens
gtttgatgaataaaatgttta

SEQ ID NO: 4808991 - DNA, 16 bp, Homo sapiens
gtttgccttaattctt

SEQ ID NO: 4808992 - DNA, 20 bp, Homo sapiens
gtttgctaatgtttccatag

SEQ ID NO: 4808993 - DNA, 14 bp, Homo sapiens
gtttggcttcctcc

SEQ ID NO: 4808994 - DNA, 19 bp, Homo sapiens
gtttgggaaaggcagggcc

SEQ ID NO: 4808995 - DNA, 15 bp, Homo sapiens
gtttgtcctttatgt

SEQ ID NO: 4808996 - DNA, 17 bp, Homo sapiens
gtttgtgaagtgattga

SEQ ID NO: 4808997 - DNA, 12 bp, Homo sapiens
gtttgttctccg

SEQ ID NO: 4808998 - DNA, 21 bp, Homo sapiens
gtttgttgagctggtaacatc

SEQ ID NO: 4808999 - DNA, 16 bp, Homo sapiens
gttttaaaaaatacag

SEQ ID NO: 4809000 - DNA, 17 bp, Homo sapiens
gttttaaaaaatacagt

SEQ ID NO: 4809001 - DNA, 22 bp, Homo sapiens
gttttacaaagaaacaaaatat

SEQ ID NO: 4809002 - DNA, 18 bp, Homo sapiens
gttttacaatggctgggt

SEQ ID NO: 4809003 - DNA, 15 bp, Homo sapiens
gttttatagaggttc

SEQ ID NO: 4809004 - DNA, 13 bp, Homo sapiens
gttttatatgatt

SEQ ID NO: 4809005 - DNA, 16 bp, Homo sapiens
gttttcaagcattgct

SEQ ID NO: 4809006 - DNA, 14 bp, Homo sapiens
gttttcaagttgca

SEQ ID NO: 4809007 - DNA, 15 bp, Homo sapiens
gttttcattctggtc

SEQ ID NO: 4809008 - DNA, 13 bp, Homo sapiens
gttttcctgaaga

SEQ ID NO: 4809009 - DNA, 15 bp, Homo sapiens
gttttctaattgtac

SEQ ID NO: 4809010 - DNA, 12 bp, Homo sapiens
gttttctccttc

SEQ ID NO: 4809011 - DNA, 17 bp, Homo sapiens
gttttctctttgtgggg

SEQ ID NO: 4809012 - DNA, 23 bp, Homo sapiens
gttttgacttgccactgccataa

SEQ ID NO: 4809013 - DNA, 17 bp, Homo sapiens
gttttgcctctttaaat

SEQ ID NO: 4809014 - DNA, 14 bp, Homo sapiens
gttttgtaaaattc

SEQ ID NO: 4809015 - DNA, 17 bp, Homo sapiens
gttttgtgaagaaacat

SEQ ID NO: 4809016 - DNA, 21 bp, Homo sapiens
gtttttatctgaaatcaatta

SEQ ID NO: 4809017 - DNA, 12 bp, Homo sapiens
gtttttgtgctg

SEQ ID NO: 4809018 - DNA, 14 bp, Homo sapiens
gtttttttctaata

SEQ ID NO: 4809019 - DNA, 21 bp, Homo sapiens
taaaaaaatcccatttatgca

SEQ ID NO: 4809020 - DNA, 21 bp, Homo sapiens
taaaaaagatggatttgacac

SEQ ID NO: 4809021 - DNA, 12 bp, Homo sapiens
taaaaaatacag

SEQ ID NO: 4809022 - DNA, 15 bp, Homo sapiens
taaaaaatacagtat

SEQ ID NO: 4809023 - DNA, 15 bp, Homo sapiens
taaaaaatatatgta

SEQ ID NO: 4809024 - DNA, 12 bp, Homo sapiens
taaaaagttaat

SEQ ID NO: 4809025 - DNA, 17 bp, Homo sapiens
taaaacaagctgatagt

SEQ ID NO: 4809026 - DNA, 17 bp, Homo sapiens
taaaacacaacatcttt

SEQ ID NO: 4809027 - DNA, 19 bp, Homo sapiens
taaaacacaagactgtcat

SEQ ID NO: 4809028 - DNA, 22 bp, Homo sapiens
taaaacacaagactgtcattag

SEQ ID NO: 4809029 - DNA, 21 bp, Homo sapiens
taaaacagtggttgttttttc

SEQ ID NO: 4809030 - DNA, 18 bp, Homo sapiens
taaaacagtgtttccagt

SEQ ID NO: 4809031 - DNA, 14 bp, Homo sapiens
taaaaccttactta

SEQ ID NO: 4809032 - DNA, 12 bp, Homo sapiens
taaaactgtgac

SEQ ID NO: 4809033 - DNA, 16 bp, Homo sapiens
taaaactgtgacattc

SEQ ID NO: 4809034 - DNA, 18 bp, Homo sapiens
taaaacttgtattggaag

SEQ ID NO: 4809035 - DNA, 15 bp, Homo sapiens
gtatgcagtgtagat

SEQ ID NO: 4809036 - DNA, 19 bp, Homo sapiens
gtatgcagtgtagatttta

SEQ ID NO: 4809037 - DNA, 14 bp, Homo sapiens
gtatgctggccagc

SEQ ID NO: 4809038 - DNA, 15 bp, Homo sapiens
gtatgctggccagca

SEQ ID NO: 4809039 - DNA, 16 bp, Homo sapiens
gtatgtaaataggttt

SEQ ID NO: 4809040 - DNA, 16 bp, Homo sapiens
gtatgtacaggctgag

SEQ ID NO: 4809041 - DNA, 17 bp, Homo sapiens
gtatgtatacacacaca

SEQ ID NO: 4809042 - DNA, 15 bp, Homo sapiens
gtatgtctatgtgta

SEQ ID NO: 4809043 - DNA, 17 bp, Homo sapiens
gtatgtgtatgtactta

SEQ ID NO: 4809044 - DNA, 14 bp, Homo sapiens
gtattaaagatgca

SEQ ID NO: 4809045 - DNA, 13 bp, Homo sapiens
gtattaaatgcca

SEQ ID NO: 4809046 - DNA, 21 bp, Homo sapiens
gtattaagcccacagtatatt

SEQ ID NO: 4809047 - DNA, 14 bp, Homo sapiens
gtattatgcttctt

SEQ ID NO: 4809048 - DNA, 17 bp, Homo sapiens
gtattatgcttcttgga

SEQ ID NO: 4809049 - DNA, 23 bp, Homo sapiens
gtattatgtcctgtgagatgtgt

SEQ ID NO: 4809050 - DNA, 14 bp, Homo sapiens
gtattccaccttaa

SEQ ID NO: 4809051 - DNA, 22 bp, Homo sapiens
gtattccaccttaaattaaaca

SEQ ID NO: 4809052 - DNA, 16 bp, Homo sapiens
gtattgacaataagaa

SEQ ID NO: 4809053 - DNA, 19 bp, Homo sapiens
gtattgagacactgtcaag

SEQ ID NO: 4809054 - DNA, 22 bp, Homo sapiens
gtattgagacactgtcaagatt

SEQ ID NO: 4809055 - DNA, 19 bp, Homo sapiens
gtattggtttctgtttgaa

SEQ ID NO: 4809056 - DNA, 17 bp, Homo sapiens
gtattgttagatgtttg

SEQ ID NO: 4809057 - DNA, 17 bp, Homo sapiens
gtattgttcttgtaaaa

SEQ ID NO: 4809058 - DNA, 18 bp, Homo sapiens
gtatttactgcaatgtct

SEQ ID NO: 4809059 - DNA, 22 bp, Homo sapiens
gtatttacttgttatgttgtaa

SEQ ID NO: 4809060 - DNA, 18 bp, Homo sapiens
gtatttcggctatgtctc

SEQ ID NO: 4809061 - DNA, 18 bp, Homo sapiens
gtatttgaggaaactcat

SEQ ID NO: 4809062 - DNA, 23 bp, Homo sapiens
gtattttaataaagattccatgg

SEQ ID NO: 4809063 - DNA, 18 bp, Homo sapiens
gtatttttagagattaat

SEQ ID NO: 4809064 - DNA, 14 bp, Homo sapiens
gtattttttgtgaa

SEQ ID NO: 4809065 - DNA, 15 bp, Homo sapiens
gtattttttgtgaat

SEQ ID NO: 4809066 - DNA, 10 bp, Homo sapiens
gtcaaaggct

SEQ ID NO: 4809067 - DNA, 15 bp, Homo sapiens
gtgcctgtgtttcat

SEQ ID NO: 4809068 - DNA, 21 bp, Homo sapiens
gtgccttggggacaagagcag

SEQ ID NO: 4809069 - DNA, 20 bp, Homo sapiens
gtgcgcagccgcgctctgcc

SEQ ID NO: 4809070 - DNA, 16 bp, Homo sapiens
gtgcgccggcgccccg

SEQ ID NO: 4809071 - DNA, 18 bp, Homo sapiens
gtgcgccggcgccccgga

SEQ ID NO: 4809072 - DNA, 12 bp, Homo sapiens
gtgcgtgtggcc

SEQ ID NO: 4809073 - DNA, 18 bp, Homo sapiens
gtgcgtgtggccctgtgg

SEQ ID NO: 4809074 - DNA, 14 bp, Homo sapiens
gtgcgttttagagt

SEQ ID NO: 4809075 - DNA, 14 bp, Homo sapiens
gtgctaagttgtct

SEQ ID NO: 4809076 - DNA, 20 bp, Homo sapiens
gtgctattcgtaagttctgt

SEQ ID NO: 4809077 - DNA, 20 bp, Homo sapiens
gtgctcacagtagcttccta

SEQ ID NO: 4809078 - DNA, 12 bp, Homo sapiens
gtgctcctctgc

SEQ ID NO: 4809079 - DNA, 15 bp, Homo sapiens
gtgctcctgctgacc

SEQ ID NO: 4809080 - DNA, 18 bp, Homo sapiens
gtgctccttttctctttg

SEQ ID NO: 4809081 - DNA, 13 bp, Homo sapiens
gtgctcggacaca

SEQ ID NO: 4809082 - DNA, 14 bp, Homo sapiens
gtgctcttctcatt

SEQ ID NO: 4809083 - DNA, 18 bp, Homo sapiens
gtgctgcccgagggcagg

SEQ ID NO: 4809084 - DNA, 14 bp, Homo sapiens
gtgctgggtcctta

SEQ ID NO: 4809085 - DNA, 17 bp, Homo sapiens
gtgctgtcatgcccagc

SEQ ID NO: 4809086 - DNA, 20 bp, Homo sapiens
gtgtcttttgttctctcttg

SEQ ID NO: 4809087 - DNA, 19 bp, Homo sapiens
gtgtgacaccaccactgtg

SEQ ID NO: 4809088 - DNA, 23 bp, Homo sapiens
gtgtgacaccaccactgtgtccc

SEQ ID NO: 4809089 - DNA, 14 bp, Homo sapiens
gtgtgaggctccct

SEQ ID NO: 4809090 - DNA, 14 bp, Homo sapiens
gtgtgagggcaaac

SEQ ID NO: 4809091 - DNA, 15 bp, Homo sapiens
gtgtgagtgtatgta

SEQ ID NO: 4809092 - DNA, 17 bp, Homo sapiens
gtgtgagtgtatgtata

SEQ ID NO: 4809093 - DNA, 19 bp, Homo sapiens
gtgtgatgcaggaagacca

SEQ ID NO: 4809094 - DNA, 21 bp, Homo sapiens
gtgtgcagagtatacaagtgt

SEQ ID NO: 4809095 - DNA, 18 bp, Homo sapiens
gtgtgcctctctctccca

SEQ ID NO: 4809096 - DNA, 20 bp, Homo sapiens
gtgtgcctgctatccagccg

SEQ ID NO: 4809097 - DNA, 15 bp, Homo sapiens
gtgtgcttcacacaa

SEQ ID NO: 4809098 - DNA, 13 bp, Homo sapiens
gtgtggaatcacc

SEQ ID NO: 4809099 - DNA, 18 bp, Homo sapiens
gtgtggagaagtgtgttc

SEQ ID NO: 4809100 - DNA, 12 bp, Homo sapiens
gtgtggcctcag

SEQ ID NO: 4809101 - DNA, 11 bp, Homo sapiens
gtgtggcctgg

SEQ ID NO: 4809102 - DNA, 16 bp, Homo sapiens
gtgtggctcctctgtt

SEQ ID NO: 4809103 - DNA, 12 bp, Homo sapiens
gtgtggcttgga

SEQ ID NO: 4809104 - DNA, 15 bp, Homo sapiens
gtgtggcttggaaca

SEQ ID NO: 4809105 - DNA, 16 bp, Homo sapiens
gtgtgggtgccctgtt

SEQ ID NO: 4809106 - DNA, 16 bp, Homo sapiens
gtgtgtagatagtatg

SEQ ID NO: 4809107 - DNA, 15 bp, Homo sapiens
gtgttaatccagaga

SEQ ID NO: 4809108 - DNA, 20 bp, Homo sapiens
gtgttaatcttaatgtatat

SEQ ID NO: 4809109 - DNA, 18 bp, Homo sapiens
gtgttatgactccagaat

SEQ ID NO: 4809110 - DNA, 14 bp, Homo sapiens
gtgttcaaattctg

SEQ ID NO: 4809111 - DNA, 22 bp, Homo sapiens
gtgttcctatattccaggttta

SEQ ID NO: 4809112 - DNA, 14 bp, Homo sapiens
gtgttcgcttggct

SEQ ID NO: 4809113 - DNA, 13 bp, Homo sapiens
gtgttctcctcca

SEQ ID NO: 4809114 - DNA, 14 bp, Homo sapiens
gtgttctctccgga

SEQ ID NO: 4809115 - DNA, 20 bp, Homo sapiens
gtgttgaaactcaagtcccg

SEQ ID NO: 4809116 - DNA, 19 bp, Homo sapiens
gtgtttcatgttctgtgtc

SEQ ID NO: 4809117 - DNA, 20 bp, Homo sapiens
gtgtttcgttaagcagtaca

SEQ ID NO: 4809118 - DNA, 13 bp, Homo sapiens
gtgtttctgtcct

SEQ ID NO: 4809119 - DNA, 17 bp, Homo sapiens
gtgtttgaattgatttt

SEQ ID NO: 4809120 - DNA, 16 bp, Homo sapiens
gtgtttgagtgttcat

SEQ ID NO: 4809121 - DNA, 15 bp, Homo sapiens
gttaaaatatagtgt

SEQ ID NO: 4809122 - DNA, 20 bp, Homo sapiens
gttaaatctacaaactttta

SEQ ID NO: 4809123 - DNA, 15 bp, Homo sapiens
gttaacccagtgttc

SEQ ID NO: 4809124 - DNA, 13 bp, Homo sapiens
gttaagacaacag

SEQ ID NO: 4809125 - DNA, 22 bp, Homo sapiens
gttaagcacaaccatgttcttg

SEQ ID NO: 4809126 - DNA, 16 bp, Homo sapiens
gttaagcagtacatct

SEQ ID NO: 4809127 - DNA, 22 bp, Homo sapiens
gttaaggaccgtggccctgccc

SEQ ID NO: 4809128 - DNA, 16 bp, Homo sapiens
gttaagggaagctgat

SEQ ID NO: 4809129 - DNA, 17 bp, Homo sapiens
gttaagggaagctgata

SEQ ID NO: 4809130 - DNA, 18 bp, Homo sapiens
gttaagtctatctggtat

SEQ ID NO: 4809131 - DNA, 21 bp, Homo sapiens
gttaagtctatctggtattaa

SEQ ID NO: 4809132 - DNA, 16 bp, Homo sapiens
gttaataggaggacag

SEQ ID NO: 4809133 - DNA, 14 bp, Homo sapiens
gttaatcttcatgg

SEQ ID NO: 4809134 - DNA, 17 bp, Homo sapiens
gttaatcttgctgctta

SEQ ID NO: 4809135 - DNA, 17 bp, Homo sapiens
gttaatgaaaaatctga

SEQ ID NO: 4809136 - DNA, 13 bp, Homo sapiens
gttacagacaaag

SEQ ID NO: 4809137 - DNA, 13 bp, Homo sapiens
gttacagctcccc

SEQ ID NO: 4809138 - DNA, 14 bp, Homo sapiens
gttagacccctggg

SEQ ID NO: 4809139 - DNA, 18 bp, Homo sapiens
gttagcccggccaaggac

SEQ ID NO: 4809140 - DNA, 14 bp, Homo sapiens
gttagctgggaaga

SEQ ID NO: 4809141 - DNA, 16 bp, Homo sapiens
gttaggggtgggggag

SEQ ID NO: 4809142 - DNA, 15 bp, Homo sapiens
gttagtaatctgtat

SEQ ID NO: 4809143 - DNA, 16 bp, Homo sapiens
gttataccagcaaaag

SEQ ID NO: 4809144 - DNA, 21 bp, Homo sapiens
gttatatgacttcttgttcat

SEQ ID NO: 4809145 - DNA, 12 bp, Homo sapiens
gttatattcatt

SEQ ID NO: 4809146 - DNA, 12 bp, Homo sapiens
gttatatttcaa

SEQ ID NO: 4809147 - DNA, 20 bp, Homo sapiens
gttatccacctgccttggct

SEQ ID NO: 4809148 - DNA, 19 bp, Homo sapiens
gttatctgtctttatgatt

SEQ ID NO: 4809149 - DNA, 17 bp, Homo sapiens
gttatgtaagtttctaa

SEQ ID NO: 4809150 - DNA, 13 bp, Homo sapiens
gttatgttgtaat

SEQ ID NO: 4809151 - DNA, 12 bp, Homo sapiens
gttattaaatgt

SEQ ID NO: 4809152 - DNA, 13 bp, Homo sapiens
gttattaaatgta

SEQ ID NO: 4809153 - DNA, 16 bp, Homo sapiens
gttattattattatat

SEQ ID NO: 4809154 - DNA, 13 bp, Homo sapiens
gttatttatgatg

SEQ ID NO: 4809155 - DNA, 18 bp, Homo sapiens
gttcaaagaacccccctc

SEQ ID NO: 4809156 - DNA, 22 bp, Homo sapiens
gttcaaatgcattttgggggtt

SEQ ID NO: 4809157 - DNA, 20 bp, Homo sapiens
gttcaacctggtggcaccag

SEQ ID NO: 4809158 - DNA, 17 bp, Homo sapiens
gttcaacttaatgaaga

SEQ ID NO: 4809159 - DNA, 16 bp, Homo sapiens
gttcaatctgtgaagc

SEQ ID NO: 4809160 - DNA, 21 bp, Homo sapiens
gttcaatctgtgaagccttta

SEQ ID NO: 4809161 - DNA, 14 bp, Homo sapiens
gttcacaccctgca

SEQ ID NO: 4809162 - DNA, 17 bp, Homo sapiens
gttcacaccctgcaagg

SEQ ID NO: 4809163 - DNA, 19 bp, Homo sapiens
gttcacccagcgccctcta

SEQ ID NO: 4809164 - DNA, 17 bp, Homo sapiens
gttcaccttctgtgcat

SEQ ID NO: 4809165 - DNA, 18 bp, Homo sapiens
gttcacgtgactcctcaa

SEQ ID NO: 4809166 - DNA, 20 bp, Homo sapiens
gttcatagtcaatcaaacag

SEQ ID NO: 4809167 - DNA, 18 bp, Homo sapiens
gttcatctgaggagtcca

SEQ ID NO: 4809168 - DNA, 18 bp, Homo sapiens
gttcatcttgaattgtaa

SEQ ID NO: 4809169 - DNA, 16 bp, Homo sapiens
gttcatgttttgctaa

SEQ ID NO: 4809170 - DNA, 18 bp, Homo sapiens
gttcatgttttgctaatg

SEQ ID NO: 4809171 - DNA, 22 bp, Homo sapiens
gttcattcatactcaaagaggc

SEQ ID NO: 4809172 - DNA, 20 bp, Homo sapiens
gttcattctatgacaataaa

SEQ ID NO: 4809173 - DNA, 21 bp, Homo sapiens
gttcattctatgacaataaat

SEQ ID NO: 4809174 - DNA, 18 bp, Homo sapiens
gttccaagtgtgtgtgca

SEQ ID NO: 4809175 - DNA, 14 bp, Homo sapiens
gttccacttctcta

SEQ ID NO: 4809176 - DNA, 19 bp, Homo sapiens
gttccagacagagtggatc

SEQ ID NO: 4809177 - DNA, 13 bp, Homo sapiens
gttccatccacca

SEQ ID NO: 4809178 - DNA, 15 bp, Homo sapiens
gttccatccaccacc

SEQ ID NO: 4809179 - DNA, 17 bp, Homo sapiens
gttccatccaccacctt

SEQ ID NO: 4809180 - DNA, 19 bp, Homo sapiens
gttccatccaccaccttgc

SEQ ID NO: 4809181 - DNA, 22 bp, Homo sapiens
gttcccaagaaaggaaaccttt

SEQ ID NO: 4809182 - DNA, 16 bp, Homo sapiens
gttcccatttgctcct

SEQ ID NO: 4809183 - DNA, 11 bp, Homo sapiens
gttcctccagc

SEQ ID NO: 4809184 - DNA, 19 bp, Homo sapiens
gttcctccagcaatgcctg

SEQ ID NO: 4809185 - DNA, 15 bp, Homo sapiens
gttcctttttctttt

SEQ ID NO: 4809186 - DNA, 12 bp, Homo sapiens
gttcgcttggct

SEQ ID NO: 4809187 - DNA, 21 bp, Homo sapiens
gttctagaaggggcgaggctt

SEQ ID NO: 4809188 - DNA, 19 bp, Homo sapiens
gttctagcatggctgccaa

SEQ ID NO: 4809189 - DNA, 13 bp, Homo sapiens
gttctatatttac

SEQ ID NO: 4809190 - DNA, 13 bp, Homo sapiens
gttctatgatata

SEQ ID NO: 4809191 - DNA, 15 bp, Homo sapiens
gttctcaacacacag

SEQ ID NO: 4809192 - DNA, 23 bp, Homo sapiens
gttctcaatcattgtcagagatg

SEQ ID NO: 4809193 - DNA, 19 bp, Homo sapiens
gttctccagactctagatg

SEQ ID NO: 4809194 - DNA, 18 bp, Homo sapiens
gttctcctccaaatgctg

SEQ ID NO: 4809195 - DNA, 13 bp, Homo sapiens
gttctgaaatgga

SEQ ID NO: 4809196 - DNA, 14 bp, Homo sapiens
gttctgcaaataga

SEQ ID NO: 4809197 - DNA, 14 bp, Homo sapiens
gcccaaataacagt

SEQ ID NO: 4809198 - DNA, 16 bp, Homo sapiens
gcccaacccccacctc

SEQ ID NO: 4809199 - DNA, 19 bp, Homo sapiens
gcccaacccccacctcccg

SEQ ID NO: 4809200 - DNA, 20 bp, Homo sapiens
gcccaaggcccccacctctg

SEQ ID NO: 4809201 - DNA, 21 bp, Homo sapiens
gcccacaataatgaataatca

SEQ ID NO: 4809202 - DNA, 18 bp, Homo sapiens
gcccacacagcccgagcc

SEQ ID NO: 4809203 - DNA, 18 bp, Homo sapiens
gcccacaggagctccctt

SEQ ID NO: 4809204 - DNA, 22 bp, Homo sapiens
gcccacaggagctccctttttg

SEQ ID NO: 4809205 - DNA, 24 bp, Homo sapiens
gcccacaggaggcaagcaagctct

SEQ ID NO: 4809206 - DNA, 17 bp, Homo sapiens
gcccacagtatatttta

SEQ ID NO: 4809207 - DNA, 13 bp, Homo sapiens
gcccacccacacc

SEQ ID NO: 4809208 - DNA, 14 bp, Homo sapiens
gcccacccagcagc

SEQ ID NO: 4809209 - DNA, 16 bp, Homo sapiens
gcccacccagcagcgc

SEQ ID NO: 4809210 - DNA, 19 bp, Homo sapiens
gcccacccagcagcgcccg

SEQ ID NO: 4809211 - DNA, 15 bp, Homo sapiens
gcccaccccgctgcc

SEQ ID NO: 4809212 - DNA, 18 bp, Homo sapiens
gcccaccccgctgcctgg

SEQ ID NO: 4809213 - DNA, 21 bp, Homo sapiens
gcccaccccgctgcctggcgg

SEQ ID NO: 4809214 - DNA, 16 bp, Homo sapiens
gcccacccctcttccc

SEQ ID NO: 4809215 - DNA, 21 bp, Homo sapiens
gcccacccctcttcccccttc

SEQ ID NO: 4809216 - DNA, 22 bp, Homo sapiens
gcccacccctcttcccccttcc

SEQ ID NO: 4809217 - DNA, 23 bp, Homo sapiens
gcccacccctcttcccccttccc

SEQ ID NO: 4809218 - DNA, 13 bp, Homo sapiens
gcccacccgcccc

SEQ ID NO: 4809219 - DNA, 18 bp, Homo sapiens
gcccacccgccccagaga

SEQ ID NO: 4809220 - DNA, 15 bp, Homo sapiens
gcccaccctgctgcc

SEQ ID NO: 4809221 - DNA, 13 bp, Homo sapiens
gcccaccctgggc

SEQ ID NO: 4809222 - DNA, 19 bp, Homo sapiens
gcccaccctgggcctcccg

SEQ ID NO: 4809223 - DNA, 20 bp, Homo sapiens
gcccaccctgggcctcccgt

SEQ ID NO: 4809224 - DNA, 21 bp, Homo sapiens
gcccaccctgggcctcccgtc

SEQ ID NO: 4809225 - DNA, 23 bp, Homo sapiens
gcccacctaaagggaagccctga

SEQ ID NO: 4809226 - DNA, 16 bp, Homo sapiens
gcccacctgccaggct

SEQ ID NO: 4809227 - DNA, 20 bp, Homo sapiens
gcccacctgccaggctgcag

SEQ ID NO: 4809228 - DNA, 13 bp, Homo sapiens
gcccacgcagagc

SEQ ID NO: 4809229 - DNA, 20 bp, Homo sapiens
gcccacgcggctgctgcttc

SEQ ID NO: 4809230 - DNA, 23 bp, Homo sapiens
gcccacgcggctgctgcttctcc

SEQ ID NO: 4809231 - DNA, 21 bp, Homo sapiens
gcccacggctaagaggctgct

SEQ ID NO: 4809232 - DNA, 23 bp, Homo sapiens
gcccacggctaagaggctgctga

SEQ ID NO: 4809233 - DNA, 15 bp, Homo sapiens
gcccacgtcctgggt

SEQ ID NO: 4809234 - DNA, 14 bp, Homo sapiens
gcccactctgaccg

SEQ ID NO: 4809235 - DNA, 17 bp, Homo sapiens
gcccagaacgggcctcc

SEQ ID NO: 4809236 - DNA, 16 bp, Homo sapiens
gcccagagagaccctg

SEQ ID NO: 4809237 - DNA, 16 bp, Homo sapiens
gcccagcacctcctcc

SEQ ID NO: 4809238 - DNA, 11 bp, Homo sapiens
gcccagccagc

SEQ ID NO: 4809239 - DNA, 12 bp, Homo sapiens
gcccagccagca

SEQ ID NO: 4809240 - DNA, 15 bp, Homo sapiens
gcccagccagcaggt

SEQ ID NO: 4809241 - DNA, 11 bp, Homo sapiens
gcccagccccc

SEQ ID NO: 4809242 - DNA, 21 bp, Homo sapiens
gcccagcctatctctcttctg

SEQ ID NO: 4809243 - DNA, 13 bp, Homo sapiens
gcccagcctggcc

SEQ ID NO: 4809244 - DNA, 14 bp, Homo sapiens
gcccagcctggccc

SEQ ID NO: 4809245 - DNA, 17 bp, Homo sapiens
gcccagcctggccccaa

SEQ ID NO: 4809246 - DNA, 15 bp, Homo sapiens
gcccaggaagtaatt

SEQ ID NO: 4809247 - DNA, 19 bp, Homo sapiens
gcccaggatggagtgcagt

SEQ ID NO: 4809248 - DNA, 14 bp, Homo sapiens
gcccaggccggcca

SEQ ID NO: 4809249 - DNA, 16 bp, Homo sapiens
gcccaggccggccagc

SEQ ID NO: 4809250 - DNA, 15 bp, Homo sapiens
gcccaggcggtcact

SEQ ID NO: 4809251 - DNA, 23 bp, Homo sapiens
gcccagtcttgagtgggccccct

SEQ ID NO: 4809252 - DNA, 18 bp, Homo sapiens
gcccatagaaacatgaca

SEQ ID NO: 4809253 - DNA, 23 bp, Homo sapiens
gcccatagaaacatgacactgac

SEQ ID NO: 4809254 - DNA, 14 bp, Homo sapiens
gcccatttcacaca

SEQ ID NO: 4809255 - DNA, 13 bp, Homo sapiens
gccccacctgagc

SEQ ID NO: 4809256 - DNA, 12 bp, Homo sapiens
gccccagagact

SEQ ID NO: 4809257 - DNA, 17 bp, Homo sapiens
gccccagagactgccca

SEQ ID NO: 4809258 - DNA, 18 bp, Homo sapiens
gccccagagactgcccac

SEQ ID NO: 4809259 - DNA, 20 bp, Homo sapiens
gccccagagactgcccaccc

SEQ ID NO: 4809260 - DNA, 22 bp, Homo sapiens
gccccagagactgcccaccctg

SEQ ID NO: 4809261 - DNA, 23 bp, Homo sapiens
gccccagagactgcccaccctgg

SEQ ID NO: 4809262 - DNA, 16 bp, Homo sapiens
gccccagctcctcttc

SEQ ID NO: 4809263 - DNA, 20 bp, Homo sapiens
gccccagctcctcttcctgc

SEQ ID NO: 4809264 - DNA, 14 bp, Homo sapiens
gccccagctggctg

SEQ ID NO: 4809265 - DNA, 15 bp, Homo sapiens
gccccaggcaccgcc

SEQ ID NO: 4809266 - DNA, 23 bp, Homo sapiens
gccccaggcaccgccagagtgtc

SEQ ID NO: 4809267 - DNA, 14 bp, Homo sapiens
gccccaggccccag

SEQ ID NO: 4809268 - DNA, 15 bp, Homo sapiens
gccccaggcccgccc

SEQ ID NO: 4809269 - DNA, 18 bp, Homo sapiens
gccccaggcccgccctgc

SEQ ID NO: 4809270 - DNA, 17 bp, Homo sapiens
gccccaggccctccctg

SEQ ID NO: 4809271 - DNA, 17 bp, Homo sapiens
gccccaggcggaggggc

SEQ ID NO: 4809272 - DNA, 17 bp, Homo sapiens
gccccaggctcaggctg

SEQ ID NO: 4809273 - DNA, 19 bp, Homo sapiens
gccccagggccctgctcag

SEQ ID NO: 4809274 - DNA, 20 bp, Homo sapiens
gccccagggccctgctcagg

SEQ ID NO: 4809275 - DNA, 21 bp, Homo sapiens
gccccagggccctgctcaggc

SEQ ID NO: 4809276 - DNA, 15 bp, Homo sapiens
gccccatccttcccg

SEQ ID NO: 4809277 - DNA, 23 bp, Homo sapiens
gccccatccttcccgcagcacca

SEQ ID NO: 4809278 - DNA, 17 bp, Homo sapiens
gccccatggtcacagac

SEQ ID NO: 4809279 - DNA, 19 bp, Homo sapiens
gccccatggtcacagaccc

SEQ ID NO: 4809280 - DNA, 20 bp, Homo sapiens
gccccatggtcacagacccc

SEQ ID NO: 4809281 - DNA, 21 bp, Homo sapiens
gccccatggtcacagacccct

SEQ ID NO: 4809282 - DNA, 14 bp, Homo sapiens
gcccccacaggagc

SEQ ID NO: 4809283 - DNA, 15 bp, Homo sapiens
gcccccacaggagcg

SEQ ID NO: 4809284 - DNA, 13 bp, Homo sapiens
gcccccaccccta

SEQ ID NO: 4809285 - DNA, 12 bp, Homo sapiens
gcccccactgga

SEQ ID NO: 4809286 - DNA, 13 bp, Homo sapiens
gcccccaggaccc

SEQ ID NO: 4809287 - DNA, 14 bp, Homo sapiens
gcccccatgcaggc

SEQ ID NO: 4809288 - DNA, 19 bp, Homo sapiens
gccccccacgcttctggag

SEQ ID NO: 4809289 - DNA, 12 bp, Homo sapiens
gccccccagcac

SEQ ID NO: 4809290 - DNA, 15 bp, Homo sapiens
gccccccagctcagg

SEQ ID NO: 4809291 - DNA, 16 bp, Homo sapiens
gccccccagctcaggg

SEQ ID NO: 4809292 - DNA, 14 bp, Homo sapiens
gccccccatgccct

SEQ ID NO: 4809293 - DNA, 21 bp, Homo sapiens
gccccccatgccctccctgct

SEQ ID NO: 4809294 - DNA, 14 bp, Homo sapiens
ggtcctgctgctcg

SEQ ID NO: 4809295 - DNA, 20 bp, Homo sapiens
ggtcctgctgctcgggaagg

SEQ ID NO: 4809296 - DNA, 15 bp, Homo sapiens
ggtcctgggggctgc

SEQ ID NO: 4809297 - DNA, 17 bp, Homo sapiens
ggtcctgggggctgctg

SEQ ID NO: 4809298 - DNA, 15 bp, Homo sapiens
ggtccttagtaaatt

SEQ ID NO: 4809299 - DNA, 14 bp, Homo sapiens
ggtcgcccctcctc

SEQ ID NO: 4809300 - DNA, 12 bp, Homo sapiens
ggtcgcctgccc

SEQ ID NO: 4809301 - DNA, 15 bp, Homo sapiens
ggtcgggggaggagc

SEQ ID NO: 4809302 - DNA, 11 bp, Homo sapiens
ggtctccaccc

SEQ ID NO: 4809303 - DNA, 14 bp, Homo sapiens
ggtctccacccctc

SEQ ID NO: 4809304 - DNA, 18 bp, Homo sapiens
ggtctccacccctcaagc

SEQ ID NO: 4809305 - DNA, 20 bp, Homo sapiens
ggtctgcacacataacacac

SEQ ID NO: 4809306 - DNA, 22 bp, Homo sapiens
ggtctgcacacataacacacat

SEQ ID NO: 4809307 - DNA, 21 bp, Homo sapiens
ggtctggcattataaagaaca

SEQ ID NO: 4809308 - DNA, 18 bp, Homo sapiens
ggtctgtgcattgtggct

SEQ ID NO: 4809309 - DNA, 21 bp, Homo sapiens
ggtctgtgcattgtggctgtc

SEQ ID NO: 4809310 - DNA, 19 bp, Homo sapiens
ggtctgttgaagtgcatgt

SEQ ID NO: 4809311 - DNA, 17 bp, Homo sapiens
ggtcttgccctattata

SEQ ID NO: 4809312 - DNA, 16 bp, Homo sapiens
ggtcttggagaggagg

SEQ ID NO: 4809313 - DNA, 20 bp, Homo sapiens
ggtcttggagaggaggtgtg

SEQ ID NO: 4809314 - DNA, 14 bp, Homo sapiens
ggtctttcagaaca

SEQ ID NO: 4809315 - DNA, 23 bp, Homo sapiens
ggtgaaagagtaaaaccaaaggt

SEQ ID NO: 4809316 - DNA, 17 bp, Homo sapiens
ggtgaactgaagcagag

SEQ ID NO: 4809317 - DNA, 14 bp, Homo sapiens
ggtgaagatggcct

SEQ ID NO: 4809318 - DNA, 14 bp, Homo sapiens
ggtgaaggggctgg

SEQ ID NO: 4809319 - DNA, 12 bp, Homo sapiens
ggtgactgtccc

SEQ ID NO: 4809320 - DNA, 17 bp, Homo sapiens
ggtgagaagtacagggc

SEQ ID NO: 4809321 - DNA, 19 bp, Homo sapiens
ggtgagaagtacagggcag

SEQ ID NO: 4809322 - DNA, 20 bp, Homo sapiens
ggtgaggcgtgggatccaga

SEQ ID NO: 4809323 - DNA, 21 bp, Homo sapiens
ggtgatttctcaccctctgtc

SEQ ID NO: 4809324 - DNA, 21 bp, Homo sapiens
ggtgcaggcgcgcaccgccca

SEQ ID NO: 4809325 - DNA, 13 bp, Homo sapiens
ggtgcccgtgtgg

SEQ ID NO: 4809326 - DNA, 24 bp, Homo sapiens
ggtgcccgtgtggcctgggtcctc

SEQ ID NO: 4809327 - DNA, 17 bp, Homo sapiens
ggtgcctcccagccctg

SEQ ID NO: 4809328 - DNA, 22 bp, Homo sapiens
ggtgcctcccagccctgcccag

SEQ ID NO: 4809329 - DNA, 23 bp, Homo sapiens
ggtgcctcccagccctgcccaga

SEQ ID NO: 4809330 - DNA, 16 bp, Homo sapiens
ggtgccttccaccctg

SEQ ID NO: 4809331 - DNA, 14 bp, Homo sapiens
ggtgcggaccggag

SEQ ID NO: 4809332 - DNA, 24 bp, Homo sapiens
ggtgcggaccggagcggctgagga

SEQ ID NO: 4809333 - DNA, 17 bp, Homo sapiens
gtaacctctacaggcat

SEQ ID NO: 4809334 - DNA, 16 bp, Homo sapiens
gtaacttaattataag

SEQ ID NO: 4809335 - DNA, 23 bp, Homo sapiens
gtaactttattggtcttgcccta

SEQ ID NO: 4809336 - DNA, 23 bp, Homo sapiens
gtaacttttttttagtatttgcc

SEQ ID NO: 4809337 - DNA, 17 bp, Homo sapiens
gtaagacagtgcagtgc

SEQ ID NO: 4809338 - DNA, 18 bp, Homo sapiens
gtaagcaattctaagtga

SEQ ID NO: 4809339 - DNA, 20 bp, Homo sapiens
gtaagggactccagaagcag

SEQ ID NO: 4809340 - DNA, 12 bp, Homo sapiens
gtaagttctgtg

SEQ ID NO: 4809341 - DNA, 14 bp, Homo sapiens
gtaagttctgtgca

SEQ ID NO: 4809342 - DNA, 12 bp, Homo sapiens
gtaagtttctaa

SEQ ID NO: 4809343 - DNA, 18 bp, Homo sapiens
gtaataactgttagaatt

SEQ ID NO: 4809344 - DNA, 15 bp, Homo sapiens
gtaatagcctcacct

SEQ ID NO: 4809345 - DNA, 14 bp, Homo sapiens
gtaatataagacaa

SEQ ID NO: 4809346 - DNA, 15 bp, Homo sapiens
gtaatataagacaag

SEQ ID NO: 4809347 - DNA, 20 bp, Homo sapiens
gtaatataagacaagtctga

SEQ ID NO: 4809348 - DNA, 21 bp, Homo sapiens
gtaatataagacaagtctgag

SEQ ID NO: 4809349 - DNA, 13 bp, Homo sapiens
gtaatatatacat

SEQ ID NO: 4809350 - DNA, 14 bp, Homo sapiens
gtaatatatacata

SEQ ID NO: 4809351 - DNA, 15 bp, Homo sapiens
gtaatatatacatat

SEQ ID NO: 4809352 - DNA, 18 bp, Homo sapiens
gtaatatcagttacagtg

SEQ ID NO: 4809353 - DNA, 16 bp, Homo sapiens
gtaatatcatttcata

SEQ ID NO: 4809354 - DNA, 14 bp, Homo sapiens
gtaatattaaattc

SEQ ID NO: 4809355 - DNA, 12 bp, Homo sapiens
gtaatatttaca

SEQ ID NO: 4809356 - DNA, 17 bp, Homo sapiens
gtaatatttacaatgta

SEQ ID NO: 4809357 - DNA, 16 bp, Homo sapiens
gtaatctgtataatac

SEQ ID NO: 4809358 - DNA, 17 bp, Homo sapiens
gtaatgtatcttattta

SEQ ID NO: 4809359 - DNA, 20 bp, Homo sapiens
gtaatgtatcttatttatat

SEQ ID NO: 4809360 - DNA, 14 bp, Homo sapiens
gtaattcttctcct

SEQ ID NO: 4809361 - DNA, 17 bp, Homo sapiens
gtaattgttacaatttt

SEQ ID NO: 4809362 - DNA, 23 bp, Homo sapiens
gtaattttgggtggggagaagag

SEQ ID NO: 4809363 - DNA, 21 bp, Homo sapiens
gtaattttgtagtagttgatg

SEQ ID NO: 4809364 - DNA, 15 bp, Homo sapiens
gtacaattactgtga

SEQ ID NO: 4809365 - DNA, 16 bp, Homo sapiens
gtacaattactgtgag

SEQ ID NO: 4809366 - DNA, 17 bp, Homo sapiens
gtacaattactgtgaga

SEQ ID NO: 4809367 - DNA, 18 bp, Homo sapiens
gtacaattctttgttgct

SEQ ID NO: 4809368 - DNA, 21 bp, Homo sapiens
gtcccccctgtggtctgtgtg

SEQ ID NO: 4809369 - DNA, 17 bp, Homo sapiens
gtccccctatccttggc

SEQ ID NO: 4809370 - DNA, 13 bp, Homo sapiens
gtccccctcctgc

SEQ ID NO: 4809371 - DNA, 19 bp, Homo sapiens
gtccccggacgctggctcg

SEQ ID NO: 4809372 - DNA, 16 bp, Homo sapiens
gtccccgggaaaggcc

SEQ ID NO: 4809373 - DNA, 18 bp, Homo sapiens
gtccccgggaaaggccgg

SEQ ID NO: 4809374 - DNA, 18 bp, Homo sapiens
gtcccctcactctgtcag

SEQ ID NO: 4809375 - DNA, 19 bp, Homo sapiens
gtcccctcactctgtcagc

SEQ ID NO: 4809376 - DNA, 17 bp, Homo sapiens
gtcccctggtgcccctc

SEQ ID NO: 4809377 - DNA, 21 bp, Homo sapiens
gtcccggccccgcgcgtgccc

SEQ ID NO: 4809378 - DNA, 20 bp, Homo sapiens
gtccctaagcacaataaaag

SEQ ID NO: 4809379 - DNA, 16 bp, Homo sapiens
gtccctagggctctcc

SEQ ID NO: 4809380 - DNA, 20 bp, Homo sapiens
gtccctagggctctccaagc

SEQ ID NO: 4809381 - DNA, 14 bp, Homo sapiens
gtccctccctcctg

SEQ ID NO: 4809382 - DNA, 15 bp, Homo sapiens
gtccctccctcctgg

SEQ ID NO: 4809383 - DNA, 19 bp, Homo sapiens
gtccctccctcctggctca

SEQ ID NO: 4809384 - DNA, 21 bp, Homo sapiens
gtccctccctcctggctcaca

SEQ ID NO: 4809385 - DNA, 22 bp, Homo sapiens
gtccctccctcctggctcacag

SEQ ID NO: 4809386 - DNA, 24 bp, Homo sapiens
gtccctccctcctggctcacagcc

SEQ ID NO: 4809387 - DNA, 14 bp, Homo sapiens
gtccctgtgggctc

SEQ ID NO: 4809388 - DNA, 17 bp, Homo sapiens
gtcccttacctggctta

SEQ ID NO: 4809389 - DNA, 18 bp, Homo sapiens
gtcccttacgtgagtcct

SEQ ID NO: 4809390 - DNA, 19 bp, Homo sapiens
gtccgaggcctggctctgg

SEQ ID NO: 4809391 - DNA, 22 bp, Homo sapiens
gtccgaggcctggctctggagc

SEQ ID NO: 4809392 - DNA, 15 bp, Homo sapiens
gtccgcccgcccacc

SEQ ID NO: 4809393 - DNA, 16 bp, Homo sapiens
gtccgcgtcctttcct

SEQ ID NO: 4809394 - DNA, 19 bp, Homo sapiens
gtccggacccacctcaccc

SEQ ID NO: 4809395 - DNA, 13 bp, Homo sapiens
gtccggcctgcag

SEQ ID NO: 4809396 - DNA, 15 bp, Homo sapiens
gtccggcctgcagcc

SEQ ID NO: 4809397 - DNA, 18 bp, Homo sapiens
gtccggcctgcagcccag

SEQ ID NO: 4809398 - DNA, 15 bp, Homo sapiens
gtccggtgccttcca

SEQ ID NO: 4809399 - DNA, 22 bp, Homo sapiens
gtccgtagtatcagagatgtcc

SEQ ID NO: 4809400 - DNA, 13 bp, Homo sapiens
gtccgtcctgctc

SEQ ID NO: 4809401 - DNA, 22 bp, Homo sapiens
gtccgtcctgctcgccctgtgc

SEQ ID NO: 4809402 - DNA, 13 bp, Homo sapiens
gtccgtctgtcct

SEQ ID NO: 4809403 - DNA, 14 bp, Homo sapiens
gtccgtctgtcctg

SEQ ID NO: 4809404 - DNA, 17 bp, Homo sapiens
gtcctactggggaaact

SEQ ID NO: 4809405 - DNA, 21 bp, Homo sapiens
gtcctactggggaaacttcct

SEQ ID NO: 4809406 - DNA, 22 bp, Homo sapiens
gtcctatccccggaccggacgc

SEQ ID NO: 4809407 - DNA, 22 bp, Homo sapiens
gtcctatccctggacgcatgca

SEQ ID NO: 4809408 - DNA, 17 bp, Homo sapiens
gtcctcaccttctgttt

SEQ ID NO: 4809409 - DNA, 18 bp, Homo sapiens
gtcctcagagggtcccta

SEQ ID NO: 4809410 - DNA, 17 bp, Homo sapiens
gtcctcaggtgaataac

SEQ ID NO: 4809411 - DNA, 17 bp, Homo sapiens
gtcctcattgttcagaa

SEQ ID NO: 4809412 - DNA, 23 bp, Homo sapiens
gtcctcattgttcagaaaagcac

SEQ ID NO: 4809413 - DNA, 20 bp, Homo sapiens
gtcctcgccccccgcccggc

SEQ ID NO: 4809414 - DNA, 14 bp, Homo sapiens
gtcctcggcagctc

SEQ ID NO: 4809415 - DNA, 15 bp, Homo sapiens
gtcctcggccctgta

SEQ ID NO: 4809416 - DNA, 18 bp, Homo sapiens
gtcctcggccctgtagcc

SEQ ID NO: 4809417 - DNA, 15 bp, Homo sapiens
gtcctctcagaactc

SEQ ID NO: 4809418 - DNA, 18 bp, Homo sapiens
gtcctctcagaactcctg

SEQ ID NO: 4809419 - DNA, 20 bp, Homo sapiens
gtcctctcagaactcctgtg

SEQ ID NO: 4809420 - DNA, 21 bp, Homo sapiens
gtcctctcgtagaacctgcgc

SEQ ID NO: 4809421 - DNA, 17 bp, Homo sapiens
gtcctgagccccctgca

SEQ ID NO: 4809422 - DNA, 23 bp, Homo sapiens
gtcctgagccccctgcacccacc

SEQ ID NO: 4809423 - DNA, 13 bp, Homo sapiens
gtcctgcactgtc

SEQ ID NO: 4809424 - DNA, 12 bp, Homo sapiens
gtcctgcatgta

SEQ ID NO: 4809425 - DNA, 18 bp, Homo sapiens
gtcctgcatgtatgccat

SEQ ID NO: 4809426 - DNA, 13 bp, Homo sapiens
gtcctgcccatgt

SEQ ID NO: 4809427 - DNA, 14 bp, Homo sapiens
gtcctgcccatgtg

SEQ ID NO: 4809428 - DNA, 17 bp, Homo sapiens
gtcctgctacctttgtc

SEQ ID NO: 4809429 - DNA, 13 bp, Homo sapiens
gtcctgctcacgt

SEQ ID NO: 4809430 - DNA, 19 bp, Homo sapiens
gtcctgctcgccctgtgcc

SEQ ID NO: 4809431 - DNA, 11 bp, Homo sapiens
gtcctgctgct

SEQ ID NO: 4809432 - DNA, 14 bp, Homo sapiens
gtcctgctgctcgg

SEQ ID NO: 4809433 - DNA, 14 bp, Homo sapiens
gtcctgctgtggaa

SEQ ID NO: 4809434 - DNA, 17 bp, Homo sapiens
gtcctgggagacccatg

SEQ ID NO: 4809435 - DNA, 15 bp, Homo sapiens
gtcctgggggctgct

SEQ ID NO: 4809436 - DNA, 20 bp, Homo sapiens
gtcctgggggctgctgcact

SEQ ID NO: 4809437 - DNA, 13 bp, Homo sapiens
gtcctggggtggt

SEQ ID NO: 4809438 - DNA, 21 bp, Homo sapiens
gtcctgtcctggctcccaggg

SEQ ID NO: 4809439 - DNA, 14 bp, Homo sapiens
gtcctgtgctttct

SEQ ID NO: 4809440 - DNA, 16 bp, Homo sapiens
gtcctgtgtcatctgt

SEQ ID NO: 4809441 - DNA, 18 bp, Homo sapiens
gtccttagaatactgtat

SEQ ID NO: 4809442 - DNA, 13 bp, Homo sapiens
gtcctttatgtat

SEQ ID NO: 4809443 - DNA, 17 bp, Homo sapiens
gtcctttatgtattctc

SEQ ID NO: 4809444 - DNA, 21 bp, Homo sapiens
gtcctttattgtccattccaa

SEQ ID NO: 4809445 - DNA, 22 bp, Homo sapiens
gtcctttgagtgtcaggctctg

SEQ ID NO: 4809446 - DNA, 17 bp, Homo sapiens
gtcgatattcccagggc

SEQ ID NO: 4809447 - DNA, 13 bp, Homo sapiens
gtcgccccaggcc

SEQ ID NO: 4809448 - DNA, 11 bp, Homo sapiens
gtcgcccctcc

SEQ ID NO: 4809449 - DNA, 16 bp, Homo sapiens
gtcgcccctcctcggg

SEQ ID NO: 4809450 - DNA, 15 bp, Homo sapiens
gtcgctgtccgtcct

SEQ ID NO: 4809451 - DNA, 16 bp, Homo sapiens
gtcggctgggcagggc

SEQ ID NO: 4809452 - DNA, 23 bp, Homo sapiens
gtcggctgggcagggccgcaggg

SEQ ID NO: 4809453 - DNA, 19 bp, Homo sapiens
gtcgggcccgcactcagga

SEQ ID NO: 4809454 - DNA, 12 bp, Homo sapiens
gtcgggggagga

SEQ ID NO: 4809455 - DNA, 15 bp, Homo sapiens
gtctaaatttattat

SEQ ID NO: 4809456 - DNA, 21 bp, Homo sapiens
gtctaacttggggaaggggcc

SEQ ID NO: 4809457 - DNA, 16 bp, Homo sapiens
gtctatgctgtgtgca

SEQ ID NO: 4809458 - DNA, 13 bp, Homo sapiens
gtctatgtgtata

SEQ ID NO: 4809459 - DNA, 16 bp, Homo sapiens
gtctatgtgtatatat

SEQ ID NO: 4809460 - DNA, 11 bp, Homo sapiens
gtctattgtct

SEQ ID NO: 4809461 - DNA, 19 bp, Homo sapiens
gtctcacgattccagtgca

SEQ ID NO: 4809462 - DNA, 23 bp, Homo sapiens
gtctcagcaaattcttgaataaa

SEQ ID NO: 4809463 - DNA, 17 bp, Homo sapiens
gtctccacccctcaagc

SEQ ID NO: 4809464 - DNA, 16 bp, Homo sapiens
gtctccctggccccag

SEQ ID NO: 4809465 - DNA, 17 bp, Homo sapiens
gtctcctcactgccact

SEQ ID NO: 4809466 - DNA, 21 bp, Homo sapiens
gtctcctctgtcagtttgtga

SEQ ID NO: 4809467 - DNA, 23 bp, Homo sapiens
gtctcctctgtcagtttgtgaag

SEQ ID NO: 4809468 - DNA, 13 bp, Homo sapiens
gtctcctgcccac

SEQ ID NO: 4809469 - DNA, 20 bp, Homo sapiens
gtctccttaaactaccaccc

SEQ ID NO: 4809470 - DNA, 15 bp, Homo sapiens
gtctctgagcagtgg

SEQ ID NO: 4809471 - DNA, 14 bp, Homo sapiens
gtctctttctttcc

SEQ ID NO: 4809472 - DNA, 15 bp, Homo sapiens
gtctctttctttcca

SEQ ID NO: 4809473 - DNA, 19 bp, Homo sapiens
gtctctttctttccaaagg

SEQ ID NO: 4809474 - DNA, 23 bp, Homo sapiens
gtctgaaaaagtgtttttacata

SEQ ID NO: 4809475 - DNA, 14 bp, Homo sapiens
gtctgaaggagagg

SEQ ID NO: 4809476 - DNA, 24 bp, Homo sapiens
gtctgacatcagaggtatcttact

SEQ ID NO: 4809477 - DNA, 15 bp, Homo sapiens
gtctgagccctgccc

SEQ ID NO: 4809478 - DNA, 13 bp, Homo sapiens
gtctgagctgctg

SEQ ID NO: 4809479 - DNA, 11 bp, Homo sapiens
gtctgattgtt

SEQ ID NO: 4809480 - DNA, 18 bp, Homo sapiens
gtctgattgttcctcccc

SEQ ID NO: 4809481 - DNA, 11 bp, Homo sapiens
gtctgcacaca

SEQ ID NO: 4809482 - DNA, 21 bp, Homo sapiens
gtctgcacacataacacacat

SEQ ID NO: 4809483 - DNA, 22 bp, Homo sapiens
gtctgcagctattcacacacac

SEQ ID NO: 4809484 - DNA, 16 bp, Homo sapiens
gtctgccccttgaccc

SEQ ID NO: 4809485 - DNA, 21 bp, Homo sapiens
gtctgccccttgaccccacac

SEQ ID NO: 4809486 - DNA, 20 bp, Homo sapiens
gtctggaaggtcacgctgaa

SEQ ID NO: 4809487 - DNA, 24 bp, Homo sapiens
gtctggagcccctatcctgcaccc

SEQ ID NO: 4809488 - DNA, 16 bp, Homo sapiens
gtctggataatttgta

SEQ ID NO: 4809489 - DNA, 22 bp, Homo sapiens
gtctggattcccgtggctttgt

SEQ ID NO: 4809490 - DNA, 16 bp, Homo sapiens
gtctggattttcaaag

SEQ ID NO: 4809491 - DNA, 17 bp, Homo sapiens
gtctggattttcaaaga

SEQ ID NO: 4809492 - DNA, 12 bp, Homo sapiens
gtctggcccagc

SEQ ID NO: 4809493 - DNA, 17 bp, Homo sapiens
gtctggcccagccatgg

SEQ ID NO: 4809494 - DNA, 19 bp, Homo sapiens
gtctggcccagccatggct

SEQ ID NO: 4809495 - DNA, 16 bp, Homo sapiens
gtctggctgtggcccc

SEQ ID NO: 4809496 - DNA, 21 bp, Homo sapiens
gtctgggagccagagcctctg

SEQ ID NO: 4809497 - DNA, 18 bp, Homo sapiens
gtctgtccctaaacatag

SEQ ID NO: 4809498 - DNA, 19 bp, Homo sapiens
gtctgtgaataaagccaca

SEQ ID NO: 4809499 - DNA, 15 bp, Homo sapiens
gtctgtgagtctgtc

SEQ ID NO: 4809500 - DNA, 20 bp, Homo sapiens
gtctgtgatgtcagtagtgc

SEQ ID NO: 4809501 - DNA, 16 bp, Homo sapiens
gtctgtgcattgtggc

SEQ ID NO: 4809502 - DNA, 15 bp, Homo sapiens
gtctgtgcctcagtg

SEQ ID NO: 4809503 - DNA, 12 bp, Homo sapiens
gtctgtgggact

SEQ ID NO: 4809504 - DNA, 18 bp, Homo sapiens
gtctgtgggactggccca

SEQ ID NO: 4809505 - DNA, 16 bp, Homo sapiens
gtctgtgtatacatat

SEQ ID NO: 4809506 - DNA, 11 bp, Homo sapiens
gtctgtgttct

SEQ ID NO: 4809507 - DNA, 18 bp, Homo sapiens
gtctgtgttctcaacaca

SEQ ID NO: 4809508 - DNA, 20 bp, Homo sapiens
gtcttagggtacagcccagg

SEQ ID NO: 4809509 - DNA, 22 bp, Homo sapiens
gtcttagggtacagcccaggcg

SEQ ID NO: 4809510 - DNA, 21 bp, Homo sapiens
gtcttcaaccctgccctgcac

SEQ ID NO: 4809511 - DNA, 22 bp, Homo sapiens
gtcttcaaccctgccctgcacc

SEQ ID NO: 4809512 - DNA, 23 bp, Homo sapiens
gtcttcaaccctgccctgcacct

SEQ ID NO: 4809513 - DNA, 21 bp, Homo sapiens
gtcttcaatttgtataaaatg

SEQ ID NO: 4809514 - DNA, 12 bp, Homo sapiens
gtcttctccatc

SEQ ID NO: 4809515 - DNA, 16 bp, Homo sapiens
gtcttgagtgggcccc

SEQ ID NO: 4809516 - DNA, 14 bp, Homo sapiens
gtcttgccctatta

SEQ ID NO: 4809517 - DNA, 16 bp, Homo sapiens
gtctttagctattact

SEQ ID NO: 4809518 - DNA, 20 bp, Homo sapiens
gtctttagtgatgcaataaa

SEQ ID NO: 4809519 - DNA, 16 bp, Homo sapiens
gtctttgctgtttata

SEQ ID NO: 4809520 - DNA, 19 bp, Homo sapiens
gtcttttaaaaactcctgt

SEQ ID NO: 4809521 - DNA, 13 bp, Homo sapiens
gtcttttgttctc

SEQ ID NO: 4809522 - DNA, 18 bp, Homo sapiens
gtcttttgttctctcttg

SEQ ID NO: 4809523 - DNA, 20 bp, Homo sapiens
gtcttttgttctctcttggt

SEQ ID NO: 4809524 - DNA, 17 bp, Homo sapiens
gtgaaaattttattgaa

SEQ ID NO: 4809525 - DNA, 17 bp, Homo sapiens
gtgaaacagtgtggatg

SEQ ID NO: 4809526 - DNA, 17 bp, Homo sapiens
gtgaaagtggcaagctc

SEQ ID NO: 4809527 - DNA, 21 bp, Homo sapiens
gtgaaatttttatttgtatta

SEQ ID NO: 4809528 - DNA, 11 bp, Homo sapiens
gtgaacagctt

SEQ ID NO: 4809529 - DNA, 15 bp, Homo sapiens
gtgaactgaagcaga

SEQ ID NO: 4809530 - DNA, 21 bp, Homo sapiens
gtgaagaatttatctgtgaat

SEQ ID NO: 4809531 - DNA, 19 bp, Homo sapiens
gtgaagacagagcagatca

SEQ ID NO: 4809532 - DNA, 16 bp, Homo sapiens
gtgaagcccaggagga

SEQ ID NO: 4809533 - DNA, 17 bp, Homo sapiens
gtgaaggatctgtccga

SEQ ID NO: 4809534 - DNA, 12 bp, Homo sapiens
gtgaaggggctg

SEQ ID NO: 4809535 - DNA, 17 bp, Homo sapiens
gtgaatataaatgtact

SEQ ID NO: 4809536 - DNA, 16 bp, Homo sapiens
gtgaatataaatgtgt

SEQ ID NO: 4809537 - DNA, 15 bp, Homo sapiens
gtgaatatgtgtaac

SEQ ID NO: 4809538 - DNA, 21 bp, Homo sapiens
gtgaatgttgtcctgtgtcat

SEQ ID NO: 4809539 - DNA, 16 bp, Homo sapiens
gtgacacaactcatcc

SEQ ID NO: 4809540 - DNA, 14 bp, Homo sapiens
gtgacaccaccact

SEQ ID NO: 4809541 - DNA, 18 bp, Homo sapiens
gtgacaggaaagccctcc

SEQ ID NO: 4809542 - DNA, 13 bp, Homo sapiens
gtgaccagaatga

SEQ ID NO: 4809543 - DNA, 18 bp, Homo sapiens
gtgaccagcaccatctct

SEQ ID NO: 4809544 - DNA, 21 bp, Homo sapiens
gtgaccagcaccatctctcct

SEQ ID NO: 4809545 - DNA, 14 bp, Homo sapiens
gtgaccctgtgccc

SEQ ID NO: 4809546 - DNA, 16 bp, Homo sapiens
gtgacctgacacctgc

SEQ ID NO: 4809547 - DNA, 15 bp, Homo sapiens
gtgacgaaaacattg

SEQ ID NO: 4809548 - DNA, 18 bp, Homo sapiens
gtgactctggctgccaag

SEQ ID NO: 4809549 - DNA, 23 bp, Homo sapiens
gtgactgtcccaccgggagcctc

SEQ ID NO: 4809550 - DNA, 15 bp, Homo sapiens
gtgagaaaactgtga

SEQ ID NO: 4809551 - DNA, 16 bp, Homo sapiens
gtgagaagtacagggc

SEQ ID NO: 4809552 - DNA, 13 bp, Homo sapiens
gtgagatcagtca

SEQ ID NO: 4809553 - DNA, 14 bp, Homo sapiens
gtgagatcagtcag

SEQ ID NO: 4809554 - DNA, 12 bp, Homo sapiens
gtgagatgtttg

SEQ ID NO: 4809555 - DNA, 20 bp, Homo sapiens
gtgagcaggaaggcctgggt

SEQ ID NO: 4809556 - DNA, 11 bp, Homo sapiens
gtgagcgcccc

SEQ ID NO: 4809557 - DNA, 19 bp, Homo sapiens
gtgagctaccaggaagagg

SEQ ID NO: 4809558 - DNA, 12 bp, Homo sapiens
gtgaggacaggg

SEQ ID NO: 4809559 - DNA, 18 bp, Homo sapiens
gtgaggacagggccccca

SEQ ID NO: 4809560 - DNA, 20 bp, Homo sapiens
gtgaggatagagacttgcag

SEQ ID NO: 4809561 - DNA, 17 bp, Homo sapiens
gtgaggatgaaaaaata

SEQ ID NO: 4809562 - DNA, 22 bp, Homo sapiens
gtgaggccagagacacaagcct

SEQ ID NO: 4809563 - DNA, 16 bp, Homo sapiens
gtgaggcccccggagg

SEQ ID NO: 4809564 - DNA, 21 bp, Homo sapiens
gtgaggcccccggaggcgccc

SEQ ID NO: 4809565 - DNA, 22 bp, Homo sapiens
gtgaggcccccggaggcgccca

SEQ ID NO: 4809566 - DNA, 21 bp, Homo sapiens
gtgaggctccctccctccctg

SEQ ID NO: 4809567 - DNA, 23 bp, Homo sapiens
gtgaggctccctccctccctgct

SEQ ID NO: 4809568 - DNA, 16 bp, Homo sapiens
gtgaggttgtgctgcc

SEQ ID NO: 4809569 - DNA, 20 bp, Homo sapiens
gtgaggtttcagtagctcct

SEQ ID NO: 4809570 - DNA, 14 bp, Homo sapiens
gtgagtcacttcta

SEQ ID NO: 4809571 - DNA, 14 bp, Homo sapiens
gtgagtctgtcctt

SEQ ID NO: 4809572 - DNA, 14 bp, Homo sapiens
gtgatatgtgtaat

SEQ ID NO: 4809573 - DNA, 14 bp, Homo sapiens
gtgatcactttctg

SEQ ID NO: 4809574 - DNA, 14 bp, Homo sapiens
gtgatctcagctca

SEQ ID NO: 4809575 - DNA, 13 bp, Homo sapiens
gtgatctgtcctt

SEQ ID NO: 4809576 - DNA, 14 bp, Homo sapiens
gtgatctgtccttc

SEQ ID NO: 4809577 - DNA, 21 bp, Homo sapiens
gtgatctgttgtaatatcagt

SEQ ID NO: 4809578 - DNA, 18 bp, Homo sapiens
gtgatgggcaaggggcca

SEQ ID NO: 4809579 - DNA, 17 bp, Homo sapiens
gtgatgtgatttatgca

SEQ ID NO: 4809580 - DNA, 19 bp, Homo sapiens
gtgattacctgaaagccct

SEQ ID NO: 4809581 - DNA, 19 bp, Homo sapiens
gtgattatgaaatgccaga

SEQ ID NO: 4809582 - DNA, 22 bp, Homo sapiens
gtgatttatgcatttatgcatg

SEQ ID NO: 4809583 - DNA, 16 bp, Homo sapiens
gtgcacaaaccttctt

SEQ ID NO: 4809584 - DNA, 17 bp, Homo sapiens
gtgcacaaaccttcttt

SEQ ID NO: 4809585 - DNA, 11 bp, Homo sapiens
gtgcacacaca

SEQ ID NO: 4809586 - DNA, 16 bp, Homo sapiens
gtgcactctactctgc

SEQ ID NO: 4809587 - DNA, 14 bp, Homo sapiens
gtgcaggcgcgcac

SEQ ID NO: 4809588 - DNA, 19 bp, Homo sapiens
gtgcaggcgcgcaccgccc

SEQ ID NO: 4809589 - DNA, 15 bp, Homo sapiens
gtgcagtagtgtcac

SEQ ID NO: 4809590 - DNA, 24 bp, Homo sapiens
gtgcagtggcgcgatctcagctca

SEQ ID NO: 4809591 - DNA, 24 bp, Homo sapiens
gtgcagtggcgtgatctcagctca

SEQ ID NO: 4809592 - DNA, 21 bp, Homo sapiens
gtgcatatggcaacgttcatg

SEQ ID NO: 4809593 - DNA, 15 bp, Homo sapiens
gtgcatctggcctat

SEQ ID NO: 4809594 - DNA, 12 bp, Homo sapiens
gtgcatgttaaa

SEQ ID NO: 4809595 - DNA, 19 bp, Homo sapiens
gtgcatttgagagaagcca

SEQ ID NO: 4809596 - DNA, 22 bp, Homo sapiens
gtgcatttgagagaagccacgc

SEQ ID NO: 4809597 - DNA, 23 bp, Homo sapiens
gtgcatttgtgagccaaagagaa

SEQ ID NO: 4809598 - DNA, 23 bp, Homo sapiens
gtgccaaaaacaacaacaaaatg

SEQ ID NO: 4809599 - DNA, 18 bp, Homo sapiens
gtgccaaaaggccccttc

SEQ ID NO: 4809600 - DNA, 22 bp, Homo sapiens
gtgccaaactaccgttcccaaa

SEQ ID NO: 4809601 - DNA, 17 bp, Homo sapiens
gtgccacatggccgctg

SEQ ID NO: 4809602 - DNA, 17 bp, Homo sapiens
gtgccacgtggccgctg

SEQ ID NO: 4809603 - DNA, 21 bp, Homo sapiens
gtgccacgtggccgctgccca

SEQ ID NO: 4809604 - DNA, 11 bp, Homo sapiens
gtgccagctgg

SEQ ID NO: 4809605 - DNA, 22 bp, Homo sapiens
gtgcccacccgtgttctcctcc

SEQ ID NO: 4809606 - DNA, 12 bp, Homo sapiens
gtgcccccagcg

SEQ ID NO: 4809607 - DNA, 12 bp, Homo sapiens
gtgccccctggg

SEQ ID NO: 4809608 - DNA, 15 bp, Homo sapiens
gtgcccgtgtggcct

SEQ ID NO: 4809609 - DNA, 19 bp, Homo sapiens
gtgcccgtgtggcctgggt

SEQ ID NO: 4809610 - DNA, 21 bp, Homo sapiens
gtgcccgtgtggcctgggtcc

SEQ ID NO: 4809611 - DNA, 14 bp, Homo sapiens
gtgccctctcactg

SEQ ID NO: 4809612 - DNA, 22 bp, Homo sapiens
gtgccctctcactgacttctcc

SEQ ID NO: 4809613 - DNA, 13 bp, Homo sapiens
gtgccctgtagct

SEQ ID NO: 4809614 - DNA, 17 bp, Homo sapiens
gtgccctgtagctcctt

SEQ ID NO: 4809615 - DNA, 17 bp, Homo sapiens
gtgccgcgggcgagaag

SEQ ID NO: 4809616 - DNA, 20 bp, Homo sapiens
gtgcctgaaggctatccact

SEQ ID NO: 4809617 - DNA, 17 bp, Homo sapiens
gtgcctgctatccagcc

SEQ ID NO: 4809618 - DNA, 18 bp, Homo sapiens
tatacatatgtatgtgtg

SEQ ID NO: 4809619 - DNA, 19 bp, Homo sapiens
tatacattagacacacata

SEQ ID NO: 4809620 - DNA, 21 bp, Homo sapiens
tatacattatttctgtatata

SEQ ID NO: 4809621 - DNA, 16 bp, Homo sapiens
tataccagcaaaagtg

SEQ ID NO: 4809622 - DNA, 22 bp, Homo sapiens
tataccggagctccagtttctc

SEQ ID NO: 4809623 - DNA, 15 bp, Homo sapiens
tatactcattagaat

SEQ ID NO: 4809624 - DNA, 19 bp, Homo sapiens
tatactccttaaaaatgta

SEQ ID NO: 4809625 - DNA, 14 bp, Homo sapiens
tatactgtgtgtga

SEQ ID NO: 4809626 - DNA, 22 bp, Homo sapiens
tatagaataaagcctctgtgct

SEQ ID NO: 4809627 - DNA, 10 bp, Homo sapiens
tatagagcac

SEQ ID NO: 4809628 - DNA, 22 bp, Homo sapiens
tatagataaatccaatagtctg

SEQ ID NO: 4809629 - DNA, 14 bp, Homo sapiens
tatagatataaata

SEQ ID NO: 4809630 - DNA, 14 bp, Homo sapiens
tatagatgtctgtg

SEQ ID NO: 4809631 - DNA, 20 bp, Homo sapiens
tatagatgtctgtgtataca

SEQ ID NO: 4809632 - DNA, 21 bp, Homo sapiens
tatagatgtctgtgtatacat

SEQ ID NO: 4809633 - DNA, 23 bp, Homo sapiens
tatagatgtctgtgtatacatat

SEQ ID NO: 4809634 - DNA, 14 bp, Homo sapiens
tatagtctgtactt

SEQ ID NO: 4809635 - DNA, 15 bp, Homo sapiens
tatagtctgtacttc

SEQ ID NO: 4809636 - DNA, 16 bp, Homo sapiens
tatagtgtgttgtgct

SEQ ID NO: 4809637 - DNA, 17 bp, Homo sapiens
tatataaaaaatatatg

SEQ ID NO: 4809638 - DNA, 18 bp, Homo sapiens
tatataaaaaatatatgt

SEQ ID NO: 4809639 - DNA, 22 bp, Homo sapiens
tatataaaaaatatatgtaata

SEQ ID NO: 4809640 - DNA, 13 bp, Homo sapiens
tatataaaacaaa

SEQ ID NO: 4809641 - DNA, 19 bp, Homo sapiens
tatataaatatctatttat

SEQ ID NO: 4809642 - DNA, 14 bp, Homo sapiens
tatataataaagta

SEQ ID NO: 4809643 - DNA, 13 bp, Homo sapiens
tatataataaatt

SEQ ID NO: 4809644 - DNA, 14 bp, Homo sapiens
tatatacagagcct

SEQ ID NO: 4809645 - DNA, 21 bp, Homo sapiens
tatatacatattcaaagtata

SEQ ID NO: 4809646 - DNA, 17 bp, Homo sapiens
tatatacattagacaca

SEQ ID NO: 4809647 - DNA, 21 bp, Homo sapiens
tatatagagacttctaaatca

SEQ ID NO: 4809648 - DNA, 16 bp, Homo sapiens
tatatatagcagcttt

SEQ ID NO: 4809649 - DNA, 15 bp, Homo sapiens
tatatatatgtatat

SEQ ID NO: 4809650 - DNA, 12 bp, Homo sapiens
tatatattatat

SEQ ID NO: 4809651 - DNA, 13 bp, Homo sapiens
tatatattatata

SEQ ID NO: 4809652 - DNA, 20 bp, Homo sapiens
tatatatttattattttcat

SEQ ID NO: 4809653 - DNA, 22 bp, Homo sapiens
tatatatttattattttcatat

SEQ ID NO: 4809654 - DNA, 14 bp, Homo sapiens
tatatattttgaaa

SEQ ID NO: 4809655 - DNA, 17 bp, Homo sapiens
tatatattttgaaagga

SEQ ID NO: 4809656 - DNA, 15 bp, Homo sapiens
tatatcagactgctt

SEQ ID NO: 4809657 - DNA, 13 bp, Homo sapiens
tatatcagcagac

SEQ ID NO: 4809658 - DNA, 11 bp, Homo sapiens
tatatcagctc

SEQ ID NO: 4809659 - DNA, 16 bp, Homo sapiens
tatatcagctctaaag

SEQ ID NO: 4809660 - DNA, 21 bp, Homo sapiens
tatatctatctatatatacat

SEQ ID NO: 4809661 - DNA, 17 bp, Homo sapiens
tatatctgaaaactgga

SEQ ID NO: 4809662 - DNA, 18 bp, Homo sapiens
tatatctgaaaactggaa

SEQ ID NO: 4809663 - DNA, 18 bp, Homo sapiens
tatatctgtggtcttcaa

SEQ ID NO: 4809664 - DNA, 17 bp, Homo sapiens
tatatgaagcagaatga

SEQ ID NO: 4809665 - DNA, 20 bp, Homo sapiens
tatatgacttcttgttcatg

SEQ ID NO: 4809666 - DNA, 13 bp, Homo sapiens
tatatgatatgca

SEQ ID NO: 4809667 - DNA, 14 bp, Homo sapiens
tatatgatatgcat

SEQ ID NO: 4809668 - DNA, 21 bp, Homo sapiens
tatatgatatgcatgtagcat

SEQ ID NO: 4809669 - DNA, 16 bp, Homo sapiens
tatatgcttttttgca

SEQ ID NO: 4809670 - DNA, 13 bp, Homo sapiens
tatatgtaatata

SEQ ID NO: 4809671 - DNA, 19 bp, Homo sapiens
tatatgtaatatatacata

SEQ ID NO: 4809672 - DNA, 12 bp, Homo sapiens
tatatgtacagt

SEQ ID NO: 4809673 - DNA, 14 bp, Homo sapiens
tatatgtatatctg

SEQ ID NO: 4809674 - DNA, 11 bp, Homo sapiens
tatatgtatgt

SEQ ID NO: 4809675 - DNA, 12 bp, Homo sapiens
tatatgtatgta

SEQ ID NO: 4809676 - DNA, 15 bp, Homo sapiens
tatattaaggcagta

SEQ ID NO: 4809677 - DNA, 12 bp, Homo sapiens
tatattatatat

SEQ ID NO: 4809678 - DNA, 13 bp, Homo sapiens
tatattatatata

SEQ ID NO: 4809679 - DNA, 17 bp, Homo sapiens
tatattatatatacatt

SEQ ID NO: 4809680 - DNA, 16 bp, Homo sapiens
tatattcaaaaattat

SEQ ID NO: 4809681 - DNA, 18 bp, Homo sapiens
tatattcaaaaattatat

SEQ ID NO: 4809682 - DNA, 23 bp, Homo sapiens
tatattcagagatgtaccatgtt

SEQ ID NO: 4809683 - DNA, 22 bp, Homo sapiens
tatattccaggtttaagtagat

SEQ ID NO: 4809684 - DNA, 17 bp, Homo sapiens
tatattctgcagaaaat

SEQ ID NO: 4809685 - DNA, 17 bp, Homo sapiens
tatattgttttataaat

SEQ ID NO: 4809686 - DNA, 18 bp, Homo sapiens
tatattgttttataaatg

SEQ ID NO: 4809687 - DNA, 15 bp, Homo sapiens
tatatttattatttt

SEQ ID NO: 4809688 - DNA, 18 bp, Homo sapiens
tatattttatttcaatgt

SEQ ID NO: 4809689 - DNA, 21 bp, Homo sapiens
tatattttgaacaactcgaat

SEQ ID NO: 4809690 - DNA, 22 bp, Homo sapiens
tatcaaaaaacagaaaaacaaa

SEQ ID NO: 4809691 - DNA, 17 bp, Homo sapiens
tatcaagtcccgaggca

SEQ ID NO: 4809692 - DNA, 18 bp, Homo sapiens
tatcaagtcccgaggcag

SEQ ID NO: 4809693 - DNA, 13 bp, Homo sapiens
tatcacatgttgt

SEQ ID NO: 4809694 - DNA, 15 bp, Homo sapiens
tatcacgggcccgct

SEQ ID NO: 4809695 - DNA, 13 bp, Homo sapiens
tatcactcattaa

SEQ ID NO: 4809696 - DNA, 19 bp, Homo sapiens
tatcactcattaattaacc

SEQ ID NO: 4809697 - DNA, 19 bp, Homo sapiens
tatcagaactcctttctaa

SEQ ID NO: 4809698 - DNA, 14 bp, Homo sapiens
tatcagagatgtcc

SEQ ID NO: 4809699 - DNA, 17 bp, Homo sapiens
tatcagagtatgtcagt

SEQ ID NO: 4809700 - DNA, 16 bp, Homo sapiens
tatcagctctgcataa

SEQ ID NO: 4809701 - DNA, 22 bp, Homo sapiens
tatcagctctgcataagattat

SEQ ID NO: 4809702 - DNA, 17 bp, Homo sapiens
tatcagtacaattcttt

SEQ ID NO: 4809703 - DNA, 22 bp, Homo sapiens
tatcagtggttcgggggaaata

SEQ ID NO: 4809704 - DNA, 21 bp, Homo sapiens
tatcagttacagtggcagtat

SEQ ID NO: 4809705 - DNA, 13 bp, Homo sapiens
tatcagtttgcta

SEQ ID NO: 4809706 - DNA, 20 bp, Homo sapiens
tatcatcacgtatgttatac

SEQ ID NO: 4809707 - DNA, 15 bp, Homo sapiens
tatcatttcataaaa

SEQ ID NO: 4809708 - DNA, 24 bp, Homo sapiens
tatccctgatttattctggtgtct

SEQ ID NO: 4809709 - DNA, 19 bp, Homo sapiens
tatccctggacgcatgcag

SEQ ID NO: 4809710 - DNA, 18 bp, Homo sapiens
tatcccttctcacagcac

SEQ ID NO: 4809711 - DNA, 23 bp, Homo sapiens
tatcctgacagcgccatgtgtgt

SEQ ID NO: 4809712 - DNA, 14 bp, Homo sapiens
tatcctgcaccctc

SEQ ID NO: 4809713 - DNA, 16 bp, Homo sapiens
tatcctgcaccctctg

SEQ ID NO: 4809714 - DNA, 15 bp, Homo sapiens
tatcgatctggaaag

SEQ ID NO: 4809715 - DNA, 16 bp, Homo sapiens
tatcgatctggaaaga

SEQ ID NO: 4809716 - DNA, 18 bp, Homo sapiens
tatcgttatcactgtgca

SEQ ID NO: 4809717 - DNA, 15 bp, Homo sapiens
tatctaaataatggc

SEQ ID NO: 4809718 - DNA, 20 bp, Homo sapiens
tatctagtgctaaacctatc

SEQ ID NO: 4809719 - DNA, 17 bp, Homo sapiens
tatctatttatctgtct

SEQ ID NO: 4809720 - DNA, 12 bp, Homo sapiens
tatctcccacaa

SEQ ID NO: 4809721 - DNA, 16 bp, Homo sapiens
tatctcctttaatata

SEQ ID NO: 4809722 - DNA, 17 bp, Homo sapiens
tatctcgctagccatat

SEQ ID NO: 4809723 - DNA, 14 bp, Homo sapiens
tcccacttccccat

SEQ ID NO: 4809724 - DNA, 18 bp, Homo sapiens
tcccacttccccatctgt

SEQ ID NO: 4809725 - DNA, 11 bp, Homo sapiens
tcccagaagag

SEQ ID NO: 4809726 - DNA, 13 bp, Homo sapiens
tcccagctggcag

SEQ ID NO: 4809727 - DNA, 16 bp, Homo sapiens
tcccagctggcagcgc

SEQ ID NO: 4809728 - DNA, 17 bp, Homo sapiens
tcccagctggcagcgcc

SEQ ID NO: 4809729 - DNA, 20 bp, Homo sapiens
tcccagctggcagcgcctcc

SEQ ID NO: 4809730 - DNA, 22 bp, Homo sapiens
tcccagctggcagcgcctcccg

SEQ ID NO: 4809731 - DNA, 14 bp, Homo sapiens
tcccaggcagggag

SEQ ID NO: 4809732 - DNA, 17 bp, Homo sapiens
tcccatcgctggaaaac

SEQ ID NO: 4809733 - DNA, 13 bp, Homo sapiens
tcccatctgaaga

SEQ ID NO: 4809734 - DNA, 14 bp, Homo sapiens
tcccatctgaagag

SEQ ID NO: 4809735 - DNA, 17 bp, Homo sapiens
tcccatggtagactgtg

SEQ ID NO: 4809736 - DNA, 20 bp, Homo sapiens
tcccatggtagactgtgaca

SEQ ID NO: 4809737 - DNA, 14 bp, Homo sapiens
tcccatgttcaagc

SEQ ID NO: 4809738 - DNA, 12 bp, Homo sapiens
tcccatttgtaa

SEQ ID NO: 4809739 - DNA, 19 bp, Homo sapiens
tcccatttgtaatgtatct

SEQ ID NO: 4809740 - DNA, 13 bp, Homo sapiens
tccccaaggaaga

SEQ ID NO: 4809741 - DNA, 17 bp, Homo sapiens
tccccaaggcactgagc

SEQ ID NO: 4809742 - DNA, 18 bp, Homo sapiens
tccccaaggcactgagcg

SEQ ID NO: 4809743 - DNA, 20 bp, Homo sapiens
tccccaaggcactgagcgcc

SEQ ID NO: 4809744 - DNA, 20 bp, Homo sapiens
tccccaatccaacccatgca

SEQ ID NO: 4809745 - DNA, 22 bp, Homo sapiens
tccccaatccaacccatgcatg

SEQ ID NO: 4809746 - DNA, 21 bp, Homo sapiens
tccccaccctcccctctcctg

SEQ ID NO: 4809747 - DNA, 17 bp, Homo sapiens
tccccactcccgtgatg

SEQ ID NO: 4809748 - DNA, 17 bp, Homo sapiens
tccccagtgccagctgg

SEQ ID NO: 4809749 - DNA, 20 bp, Homo sapiens
tccccagttaatgtgccaaa

SEQ ID NO: 4809750 - DNA, 17 bp, Homo sapiens
tccccatatataaatta

SEQ ID NO: 4809751 - DNA, 18 bp, Homo sapiens
tccccatcgccttctggg

SEQ ID NO: 4809752 - DNA, 15 bp, Homo sapiens
tccccatctgtgtgt

SEQ ID NO: 4809753 - DNA, 21 bp, Homo sapiens
tccccatggaacagccctgca

SEQ ID NO: 4809754 - DNA, 20 bp, Homo sapiens
tccccatggtgcagtgaaga

SEQ ID NO: 4809755 - DNA, 18 bp, Homo sapiens
tcccccaaacagcatgtg

SEQ ID NO: 4809756 - DNA, 18 bp, Homo sapiens
tcccccaaaccctgcttc

SEQ ID NO: 4809757 - DNA, 19 bp, Homo sapiens
tcccccaaaccctgcttct

SEQ ID NO: 4809758 - DNA, 21 bp, Homo sapiens
tcccccaaaccctgcttctgc

SEQ ID NO: 4809759 - DNA, 20 bp, Homo sapiens
tcccccacggccgtccctga

SEQ ID NO: 4809760 - DNA, 15 bp, Homo sapiens
tcccccagaggtgga

SEQ ID NO: 4809761 - DNA, 16 bp, Homo sapiens
tcccccaggctgcgcc

SEQ ID NO: 4809762 - DNA, 22 bp, Homo sapiens
tcccccaggctgcgcctgcccg

SEQ ID NO: 4809763 - DNA, 12 bp, Homo sapiens
tcccccatgcca

SEQ ID NO: 4809764 - DNA, 13 bp, Homo sapiens
tcccccatgggct

SEQ ID NO: 4809765 - DNA, 12 bp, Homo sapiens
tcccccctgtgg

SEQ ID NO: 4809766 - DNA, 14 bp, Homo sapiens
tcccccctgtggtc

SEQ ID NO: 4809767 - DNA, 19 bp, Homo sapiens
tcccccctgtggtctgtgt

SEQ ID NO: 4809768 - DNA, 15 bp, Homo sapiens
tccccctaattctta

SEQ ID NO: 4809769 - DNA, 21 bp, Homo sapiens
tccccctacagatcctccgcg

SEQ ID NO: 4809770 - DNA, 15 bp, Homo sapiens
tccccctatccttgg

SEQ ID NO: 4809771 - DNA, 16 bp, Homo sapiens
tccccctcagctctcc

SEQ ID NO: 4809772 - DNA, 17 bp, Homo sapiens
tccccctcagctctccc

SEQ ID NO: 4809773 - DNA, 22 bp, Homo sapiens
taaggtcagtgttataaaatct

SEQ ID NO: 4809774 - DNA, 17 bp, Homo sapiens
taagtaaatacattatt

SEQ ID NO: 4809775 - DNA, 14 bp, Homo sapiens
taagtaaatgtctt

SEQ ID NO: 4809776 - DNA, 22 bp, Homo sapiens
taagtaacctctacaggcattt

SEQ ID NO: 4809777 - DNA, 19 bp, Homo sapiens
taagtatttcagatgcttt

SEQ ID NO: 4809778 - DNA, 17 bp, Homo sapiens
taagtcaaaataatctg

SEQ ID NO: 4809779 - DNA, 23 bp, Homo sapiens
taagtcaaaataatctgaaatga

SEQ ID NO: 4809780 - DNA, 15 bp, Homo sapiens
taagtgctcagtatt

SEQ ID NO: 4809781 - DNA, 17 bp, Homo sapiens
taagtggaagacagaga

SEQ ID NO: 4809782 - DNA, 14 bp, Homo sapiens
taagtggactgtat

SEQ ID NO: 4809783 - DNA, 22 bp, Homo sapiens
taagtgttggccatcatttcat

SEQ ID NO: 4809784 - DNA, 21 bp, Homo sapiens
taagtgttgtacaattactgt

SEQ ID NO: 4809785 - DNA, 19 bp, Homo sapiens
taagttataccagcaaaag

SEQ ID NO: 4809786 - DNA, 17 bp, Homo sapiens
taagttcccatttcctt

SEQ ID NO: 4809787 - DNA, 23 bp, Homo sapiens
taagttcccatttccttgtctaa

SEQ ID NO: 4809788 - DNA, 22 bp, Homo sapiens
taagttctgtgcagtttggtat

SEQ ID NO: 4809789 - DNA, 19 bp, Homo sapiens
taagttgaagggaaatcaa

SEQ ID NO: 4809790 - DNA, 14 bp, Homo sapiens
taagttgaccttta

SEQ ID NO: 4809791 - DNA, 15 bp, Homo sapiens
taagttgacctttat

SEQ ID NO: 4809792 - DNA, 17 bp, Homo sapiens
taagttgacctttattt

SEQ ID NO: 4809793 - DNA, 18 bp, Homo sapiens
taagttgacctttattta

SEQ ID NO: 4809794 - DNA, 23 bp, Homo sapiens
taagttgacctttatttattaaa

SEQ ID NO: 4809795 - DNA, 15 bp, Homo sapiens
taataaaagaatcat

SEQ ID NO: 4809796 - DNA, 16 bp, Homo sapiens
taataaaatacatact

SEQ ID NO: 4809797 - DNA, 12 bp, Homo sapiens
taataaactgtt

SEQ ID NO: 4809798 - DNA, 13 bp, Homo sapiens
taataaaggttct

SEQ ID NO: 4809799 - DNA, 17 bp, Homo sapiens
taataaaggttctatga

SEQ ID NO: 4809800 - DNA, 18 bp, Homo sapiens
taataaaggttctatgat

SEQ ID NO: 4809801 - DNA, 13 bp, Homo sapiens
taataaagtattc

SEQ ID NO: 4809802 - DNA, 16 bp, Homo sapiens
taataactagatctcc

SEQ ID NO: 4809803 - DNA, 19 bp, Homo sapiens
taataactagatctcctgt

SEQ ID NO: 4809804 - DNA, 15 bp, Homo sapiens
taataactatggtaa

SEQ ID NO: 4809805 - DNA, 18 bp, Homo sapiens
taataactatggtaaata

SEQ ID NO: 4809806 - DNA, 20 bp, Homo sapiens
taataattattaagctgttt

SEQ ID NO: 4809807 - DNA, 17 bp, Homo sapiens
taatagaaagtcagatg

SEQ ID NO: 4809808 - DNA, 14 bp, Homo sapiens
taatagcctcacct

SEQ ID NO: 4809809 - DNA, 23 bp, Homo sapiens
taatagctcacagcacatttgtt

SEQ ID NO: 4809810 - DNA, 21 bp, Homo sapiens
taatataaatgaatgaaatat

SEQ ID NO: 4809811 - DNA, 16 bp, Homo sapiens
taatatactccttaaa

SEQ ID NO: 4809812 - DNA, 21 bp, Homo sapiens
taatatactccttaaaaatgt

SEQ ID NO: 4809813 - DNA, 23 bp, Homo sapiens
taatatagaaaaaaacattctat

SEQ ID NO: 4809814 - DNA, 17 bp, Homo sapiens
taatatcagttacagtg

SEQ ID NO: 4809815 - DNA, 22 bp, Homo sapiens
taatatcagttacagtggcagt

SEQ ID NO: 4809816 - DNA, 17 bp, Homo sapiens
taatatttattgcttta

SEQ ID NO: 4809817 - DNA, 18 bp, Homo sapiens
taatatttattgctttat

SEQ ID NO: 4809818 - DNA, 20 bp, Homo sapiens
taatccacctggtggccctg

SEQ ID NO: 4809819 - DNA, 21 bp, Homo sapiens
taatccacctggtggccctgc

SEQ ID NO: 4809820 - DNA, 16 bp, Homo sapiens
taatccttaataacta

SEQ ID NO: 4809821 - DNA, 19 bp, Homo sapiens
taatccttaataactatgg

SEQ ID NO: 4809822 - DNA, 20 bp, Homo sapiens
taatctcatacctctgacca

SEQ ID NO: 4809823 - DNA, 18 bp, Homo sapiens
taatctgtataatacttt

SEQ ID NO: 4809824 - DNA, 14 bp, Homo sapiens
taatgaaaaatctg

SEQ ID NO: 4809825 - DNA, 22 bp, Homo sapiens
taatgaattttaaaagcatata

SEQ ID NO: 4809826 - DNA, 15 bp, Homo sapiens
taatgattcaatgtg

SEQ ID NO: 4809827 - DNA, 18 bp, Homo sapiens
taatgattcttgtgtcat

SEQ ID NO: 4809828 - DNA, 20 bp, Homo sapiens
taatgatttaagcattttac

SEQ ID NO: 4809829 - DNA, 20 bp, Homo sapiens
taatgcaaatgaaggaatgc

SEQ ID NO: 4809830 - DNA, 15 bp, Homo sapiens
taatgcctttgtaac

SEQ ID NO: 4809831 - DNA, 16 bp, Homo sapiens
taatggaaaactgtta

SEQ ID NO: 4809832 - DNA, 14 bp, Homo sapiens
taatggccaagtgt

SEQ ID NO: 4809833 - DNA, 20 bp, Homo sapiens
taatggccaagtgtacattt

SEQ ID NO: 4809834 - DNA, 14 bp, Homo sapiens
taatggtaaatctt

SEQ ID NO: 4809835 - DNA, 22 bp, Homo sapiens
taatggtttttatttctcgggt

SEQ ID NO: 4809836 - DNA, 21 bp, Homo sapiens
taatgtagggcagaatagctg

SEQ ID NO: 4809837 - DNA, 18 bp, Homo sapiens
taatgtatcttatttata

SEQ ID NO: 4809838 - DNA, 17 bp, Homo sapiens
taatgtcataaagtgag

SEQ ID NO: 4809839 - DNA, 14 bp, Homo sapiens
taatgtgaaatgta

SEQ ID NO: 4809840 - DNA, 18 bp, Homo sapiens
taatgtgggaagaaacaa

SEQ ID NO: 4809841 - DNA, 17 bp, Homo sapiens
taatgtttgtaagcaat

SEQ ID NO: 4809842 - DNA, 22 bp, Homo sapiens
taattaaatgaaatacttgaca

SEQ ID NO: 4809843 - DNA, 18 bp, Homo sapiens
taattagatccattaatt

SEQ ID NO: 4809844 - DNA, 20 bp, Homo sapiens
taattagatccattaattta

SEQ ID NO: 4809845 - DNA, 20 bp, Homo sapiens
taattatcctcaagttgtgt

SEQ ID NO: 4809846 - DNA, 19 bp, Homo sapiens
taattcctctagctaccat

SEQ ID NO: 4809847 - DNA, 15 bp, Homo sapiens
taattcctgtatgtt

SEQ ID NO: 4809848 - DNA, 21 bp, Homo sapiens
taattcttacctcatttgcat

SEQ ID NO: 4809849 - DNA, 17 bp, Homo sapiens
taattcttctcctttgt

SEQ ID NO: 4809850 - DNA, 20 bp, Homo sapiens
taattcttctcctttgtcaa

SEQ ID NO: 4809851 - DNA, 17 bp, Homo sapiens
taattctttatcacatg

SEQ ID NO: 4809852 - DNA, 20 bp, Homo sapiens
taattctttatcacatgttg

SEQ ID NO: 4809853 - DNA, 12 bp, Homo sapiens
taattgtataaa

SEQ ID NO: 4809854 - DNA, 22 bp, Homo sapiens
taattgtcatgactttcagatt

SEQ ID NO: 4809855 - DNA, 16 bp, Homo sapiens
taattgttacaatttt

SEQ ID NO: 4809856 - DNA, 20 bp, Homo sapiens
taatttaggagttttgagaa

SEQ ID NO: 4809857 - DNA, 16 bp, Homo sapiens
taatttatgaagatag

SEQ ID NO: 4809858 - DNA, 17 bp, Homo sapiens
taatttcctgtgaggat

SEQ ID NO: 4809859 - DNA, 18 bp, Homo sapiens
taatttctgccatttcat

SEQ ID NO: 4809860 - DNA, 16 bp, Homo sapiens
taatttgccagacaga

SEQ ID NO: 4809861 - DNA, 21 bp, Homo sapiens
taatttgctctgtggtaagag

SEQ ID NO: 4809862 - DNA, 21 bp, Homo sapiens
taatttgtataagatgctgct

SEQ ID NO: 4809863 - DNA, 15 bp, Homo sapiens
taatttgtgaaagtg

SEQ ID NO: 4809864 - DNA, 23 bp, Homo sapiens
taatttgtgaaagtggcaagctc

SEQ ID NO: 4809865 - DNA, 15 bp, Homo sapiens
taatttgttatatca

SEQ ID NO: 4809866 - DNA, 16 bp, Homo sapiens
taattttcttctcatt

SEQ ID NO: 4809867 - DNA, 17 bp, Homo sapiens
taattttgacactgaaa

SEQ ID NO: 4809868 - DNA, 15 bp, Homo sapiens
taattttgtagtagt

SEQ ID NO: 4809869 - DNA, 9 bp, Homo sapiens
tacaaacat

SEQ ID NO: 4809870 - DNA, 19 bp, Homo sapiens
tacaaacttttataaatgt

SEQ ID NO: 4809871 - DNA, 22 bp, Homo sapiens
tacaaacttttataaatgtttt

SEQ ID NO: 4809872 - DNA, 21 bp, Homo sapiens
tacaaagaaacaaaatataaa

SEQ ID NO: 4809873 - DNA, 13 bp, Homo sapiens
tacaaagccagct

SEQ ID NO: 4809874 - DNA, 19 bp, Homo sapiens
tacaaatctcactgtatta

SEQ ID NO: 4809875 - DNA, 15 bp, Homo sapiens
tacaaatttttactc

SEQ ID NO: 4809876 - DNA, 18 bp, Homo sapiens
tacaacacattgaaactg

SEQ ID NO: 4809877 - DNA, 19 bp, Homo sapiens
tacaacacattgaaactgt

SEQ ID NO: 4809878 - DNA, 20 bp, Homo sapiens
tacaacacattgaaactgta

SEQ ID NO: 4809879 - DNA, 12 bp, Homo sapiens
tacaaccttcat

SEQ ID NO: 4809880 - DNA, 17 bp, Homo sapiens
tacaactgactgactta

SEQ ID NO: 4809881 - DNA, 12 bp, Homo sapiens
tacaagctacat

SEQ ID NO: 4809882 - DNA, 16 bp, Homo sapiens
tacaagctacatatgt

SEQ ID NO: 4809883 - DNA, 18 bp, Homo sapiens
tacaagtactggtaagat

SEQ ID NO: 4809884 - DNA, 22 bp, Homo sapiens
tacaagtgtttctagtaacagt

SEQ ID NO: 4809885 - DNA, 18 bp, Homo sapiens
tacaatacaacacattga

SEQ ID NO: 4809886 - DNA, 16 bp, Homo sapiens
tacaattactgtgaga

SEQ ID NO: 4809887 - DNA, 14 bp, Homo sapiens
tacacacacacaca

SEQ ID NO: 4809888 - DNA, 18 bp, Homo sapiens
tacacacctgagaatgtg

SEQ ID NO: 4809889 - DNA, 16 bp, Homo sapiens
tacacacgtgcaattt

SEQ ID NO: 4809890 - DNA, 23 bp, Homo sapiens
tacacacgtgcaatttgtttgtg

SEQ ID NO: 4809891 - DNA, 17 bp, Homo sapiens
tacacacgtttgtttct

SEQ ID NO: 4809892 - DNA, 17 bp, Homo sapiens
tacacagaaatcctaac

SEQ ID NO: 4809893 - DNA, 22 bp, Homo sapiens
tacacagtgggaactctgacaa

SEQ ID NO: 4809894 - DNA, 14 bp, Homo sapiens
tacacatataaaca

SEQ ID NO: 4809895 - DNA, 19 bp, Homo sapiens
tacacatataaacacagta

SEQ ID NO: 4809896 - DNA, 20 bp, Homo sapiens
tacaccaaatagcttttcac

SEQ ID NO: 4809897 - DNA, 14 bp, Homo sapiens
tcctttctctcttt

SEQ ID NO: 4809898 - DNA, 15 bp, Homo sapiens
tcctttcttccttcc

SEQ ID NO: 4809899 - DNA, 18 bp, Homo sapiens
tcctttgacctctcactt

SEQ ID NO: 4809900 - DNA, 15 bp, Homo sapiens
tcctttgtcaaatgg

SEQ ID NO: 4809901 - DNA, 17 bp, Homo sapiens
tccttttgcttcatctg

SEQ ID NO: 4809902 - DNA, 16 bp, Homo sapiens
tccttttgtatcctcc

SEQ ID NO: 4809903 - DNA, 23 bp, Homo sapiens
tcgaatcactcatttatttccat

SEQ ID NO: 4809904 - DNA, 22 bp, Homo sapiens
tcgaatgtgtgggcccaaggcc

SEQ ID NO: 4809905 - DNA, 15 bp, Homo sapiens
tcgacctcactgtca

SEQ ID NO: 4809906 - DNA, 17 bp, Homo sapiens
tcgagagggctgagccc

SEQ ID NO: 4809907 - DNA, 15 bp, Homo sapiens
tcgagttacagacaa

SEQ ID NO: 4809908 - DNA, 17 bp, Homo sapiens
tcgagttacagacaaag

SEQ ID NO: 4809909 - DNA, 15 bp, Homo sapiens
tcgatattcccaggg

SEQ ID NO: 4809910 - DNA, 14 bp, Homo sapiens
tcgcatttcatcaa

SEQ ID NO: 4809911 - DNA, 23 bp, Homo sapiens
tcgcccacctaaagggaagccct

SEQ ID NO: 4809912 - DNA, 17 bp, Homo sapiens
tcgccccccgcccggcc

SEQ ID NO: 4809913 - DNA, 21 bp, Homo sapiens
tcgccccccgcccggcctcct

SEQ ID NO: 4809914 - DNA, 12 bp, Homo sapiens
tcgcccctcctc

SEQ ID NO: 4809915 - DNA, 13 bp, Homo sapiens
tcgcccctcctcg

SEQ ID NO: 4809916 - DNA, 14 bp, Homo sapiens
tcgcccctcctcgg

SEQ ID NO: 4809917 - DNA, 19 bp, Homo sapiens
tcgccctgtgccctctcac

SEQ ID NO: 4809918 - DNA, 20 bp, Homo sapiens
tcgcctgggaaattgctcca

SEQ ID NO: 4809919 - DNA, 17 bp, Homo sapiens
tcgcctgggacgcccct

SEQ ID NO: 4809920 - DNA, 14 bp, Homo sapiens
tcgccttctggctg

SEQ ID NO: 4809921 - DNA, 13 bp, Homo sapiens
tcgccttctgggg

SEQ ID NO: 4809922 - DNA, 19 bp, Homo sapiens
tcgctattcccaggcaggg

SEQ ID NO: 4809923 - DNA, 22 bp, Homo sapiens
tcgctattcccaggcagggagg

SEQ ID NO: 4809924 - DNA, 14 bp, Homo sapiens
tcgctgccacccac

SEQ ID NO: 4809925 - DNA, 16 bp, Homo sapiens
tcgctgtatgatttag

SEQ ID NO: 4809926 - DNA, 19 bp, Homo sapiens
tcgctgtatgatttaggct

SEQ ID NO: 4809927 - DNA, 17 bp, Homo sapiens
tcgctgtccgtcctgct

SEQ ID NO: 4809928 - DNA, 17 bp, Homo sapiens
tcgctgtgatgcatgag

SEQ ID NO: 4809929 - DNA, 19 bp, Homo sapiens
tcgctgtgatgcatgagct

SEQ ID NO: 4809930 - DNA, 17 bp, Homo sapiens
tcgcttcataggcagag

SEQ ID NO: 4809931 - DNA, 11 bp, Homo sapiens
tcggacacagt

SEQ ID NO: 4809932 - DNA, 16 bp, Homo sapiens
tcggactttgcaggag

SEQ ID NO: 4809933 - DNA, 22 bp, Homo sapiens
tcggactttgcaggagttcctt

SEQ ID NO: 4809934 - DNA, 13 bp, Homo sapiens
tcggaggctgggc

SEQ ID NO: 4809935 - DNA, 14 bp, Homo sapiens
tcggaggctgggcc

SEQ ID NO: 4809936 - DNA, 14 bp, Homo sapiens
tcggcaccttcccc

SEQ ID NO: 4809937 - DNA, 22 bp, Homo sapiens
tcggccattgaacactgcaccc

SEQ ID NO: 4809938 - DNA, 16 bp, Homo sapiens
tcggccctgtagccct

SEQ ID NO: 4809939 - DNA, 20 bp, Homo sapiens
tcggcctcttgagagcccca

SEQ ID NO: 4809940 - DNA, 15 bp, Homo sapiens
tcgggaaggcctgag

SEQ ID NO: 4809941 - DNA, 16 bp, Homo sapiens
tcgggaaggcctgagg

SEQ ID NO: 4809942 - DNA, 21 bp, Homo sapiens
tcgggaaggcctgagggaagc

SEQ ID NO: 4809943 - DNA, 15 bp, Homo sapiens
tcgggattacagaaa

SEQ ID NO: 4809944 - DNA, 18 bp, Homo sapiens
tcgggccagggcgtggct

SEQ ID NO: 4809945 - DNA, 12 bp, Homo sapiens
tcgggcccgcac

SEQ ID NO: 4809946 - DNA, 21 bp, Homo sapiens
tcgggcccgcactcaggagca

SEQ ID NO: 4809947 - DNA, 18 bp, Homo sapiens
tcgggccctctctccgcc

SEQ ID NO: 4809948 - DNA, 19 bp, Homo sapiens
tcgggccctctctccgccc

SEQ ID NO: 4809949 - DNA, 20 bp, Homo sapiens
tcgggccctctctccgcccc

SEQ ID NO: 4809950 - DNA, 20 bp, Homo sapiens
tcgggccgcctcctccagac

SEQ ID NO: 4809951 - DNA, 18 bp, Homo sapiens
tcgggggaggagcacccc

SEQ ID NO: 4809952 - DNA, 17 bp, Homo sapiens
tcgggggcggctctggg

SEQ ID NO: 4809953 - DNA, 13 bp, Homo sapiens
tcggtcagcaccg

SEQ ID NO: 4809954 - DNA, 12 bp, Homo sapiens
tcggtcagcagg

SEQ ID NO: 4809955 - DNA, 22 bp, Homo sapiens
tcggtgtccatttatagaataa

SEQ ID NO: 4809956 - DNA, 16 bp, Homo sapiens
tggaggggtcagcagg

SEQ ID NO: 4809957 - DNA, 15 bp, Homo sapiens
tggaggtacaggata

SEQ ID NO: 4809958 - DNA, 15 bp, Homo sapiens
tggaggtggggaggg

SEQ ID NO: 4809959 - DNA, 13 bp, Homo sapiens
tggaggtgggtgt

SEQ ID NO: 4809960 - DNA, 18 bp, Homo sapiens
tggagtagagtcaggaga

SEQ ID NO: 4809961 - DNA, 19 bp, Homo sapiens
tggagtcagggctgtgctt

SEQ ID NO: 4809962 - DNA, 16 bp, Homo sapiens
tggagtctgaaggaga

SEQ ID NO: 4809963 - DNA, 20 bp, Homo sapiens
tggagtctgaaggagaggag

SEQ ID NO: 4809964 - DNA, 21 bp, Homo sapiens
tggagtgccacgtggccgctg

SEQ ID NO: 4809965 - DNA, 20 bp, Homo sapiens
tggataataactagatctcc

SEQ ID NO: 4809966 - DNA, 17 bp, Homo sapiens
tggatacgtgtcaatgt

SEQ ID NO: 4809967 - DNA, 16 bp, Homo sapiens
tggatagattgtttta

SEQ ID NO: 4809968 - DNA, 14 bp, Homo sapiens
tggataggagagga

SEQ ID NO: 4809969 - DNA, 17 bp, Homo sapiens
tggatatgaaagagaaa

SEQ ID NO: 4809970 - DNA, 16 bp, Homo sapiens
tggatcacacacatgg

SEQ ID NO: 4809971 - DNA, 20 bp, Homo sapiens
tggatcaggaacccttacag

SEQ ID NO: 4809972 - DNA, 19 bp, Homo sapiens
tggatctgctccatgcaga

SEQ ID NO: 4809973 - DNA, 20 bp, Homo sapiens
tggatctgctccatgcagat

SEQ ID NO: 4809974 - DNA, 19 bp, Homo sapiens
tggatggggcggcctgcag

SEQ ID NO: 4809975 - DNA, 19 bp, Homo sapiens
tggattcctctaagatctt

SEQ ID NO: 4809976 - DNA, 20 bp, Homo sapiens
tggatttattttttgtaact

SEQ ID NO: 4809977 - DNA, 23 bp, Homo sapiens
tggatttcctttgacctctcact

SEQ ID NO: 4809978 - DNA, 15 bp, Homo sapiens
tggatttgacacact

SEQ ID NO: 4809979 - DNA, 23 bp, Homo sapiens
tggatttgacacactcaccattt

SEQ ID NO: 4809980 - DNA, 23 bp, Homo sapiens
tggattttaaacaaaatttatgt

SEQ ID NO: 4809981 - DNA, 14 bp, Homo sapiens
tggcaaccaatggc

SEQ ID NO: 4809982 - DNA, 14 bp, Homo sapiens
tggcaacctgttct

SEQ ID NO: 4809983 - DNA, 21 bp, Homo sapiens
tggcaataaatgtcccaaata

SEQ ID NO: 4809984 - DNA, 20 bp, Homo sapiens
tggcaatcttgcccttaata

SEQ ID NO: 4809985 - DNA, 15 bp, Homo sapiens
tggcacaggactgat

SEQ ID NO: 4809986 - DNA, 13 bp, Homo sapiens
tggcacccaccac

SEQ ID NO: 4809987 - DNA, 13 bp, Homo sapiens
tggcacccactgg

SEQ ID NO: 4809988 - DNA, 20 bp, Homo sapiens
tggcacccactggaggtggg

SEQ ID NO: 4809989 - DNA, 19 bp, Homo sapiens
tggcagaagcagttgcaat

SEQ ID NO: 4809990 - DNA, 11 bp, Homo sapiens
tggcagagcca

SEQ ID NO: 4809991 - DNA, 16 bp, Homo sapiens
tggcagagccatccac

SEQ ID NO: 4809992 - DNA, 21 bp, Homo sapiens
tggcagagtggattcttgaac

SEQ ID NO: 4809993 - DNA, 16 bp, Homo sapiens
tggcagatgggggcct

SEQ ID NO: 4809994 - DNA, 13 bp, Homo sapiens
tggcagcacagct

SEQ ID NO: 4809995 - DNA, 22 bp, Homo sapiens
tggcagcacagctactcagatc

SEQ ID NO: 4809996 - DNA, 16 bp, Homo sapiens
tggcagcgcccagcct

SEQ ID NO: 4809997 - DNA, 15 bp, Homo sapiens
tggcagcgcctcccg

SEQ ID NO: 4809998 - DNA, 24 bp, Homo sapiens
tggcagcgcctcccgccgcctcgg

SEQ ID NO: 4809999 - DNA, 14 bp, Homo sapiens
tggcagcttccctg

SEQ ID NO: 4810000 - DNA, 22 bp, Homo sapiens
tggcaggcacacagcagccccc

SEQ ID NO: 4810001 - DNA, 23 bp, Homo sapiens
tggcaggcacacagcagcccccc

SEQ ID NO: 4810002 - DNA, 19 bp, Homo sapiens
tggcagggaggtcaggccc

SEQ ID NO: 4810003 - DNA, 21 bp, Homo sapiens
tggcagggaggtcaggccctg

SEQ ID NO: 4810004 - DNA, 14 bp, Homo sapiens
tggcagtttcctcc

SEQ ID NO: 4810005 - DNA, 19 bp, Homo sapiens
tggcatgtgaaaagtaaaa

SEQ ID NO: 4810006 - DNA, 20 bp, Homo sapiens
tggcattgaccttcatgacc

SEQ ID NO: 4810007 - DNA, 15 bp, Homo sapiens
tggcatttagcacag

SEQ ID NO: 4810008 - DNA, 19 bp, Homo sapiens
tggcatttagcacagtatt

SEQ ID NO: 4810009 - DNA, 15 bp, Homo sapiens
tggccaaacaacagt

SEQ ID NO: 4810010 - DNA, 15 bp, Homo sapiens
tggccagacgctgcc

SEQ ID NO: 4810011 - DNA, 19 bp, Homo sapiens
tggccagacgctgccgctg

SEQ ID NO: 4810012 - DNA, 20 bp, Homo sapiens
tggccagcaccctctcctgg

SEQ ID NO: 4810013 - DNA, 20 bp, Homo sapiens
tggccagcccgcagaggtgg

SEQ ID NO: 4810014 - DNA, 18 bp, Homo sapiens
tggccagcctggggcctg

SEQ ID NO: 4810015 - DNA, 20 bp, Homo sapiens
tggccagcctggggcctggc

SEQ ID NO: 4810016 - DNA, 21 bp, Homo sapiens
tggccagcctggggcctggca

SEQ ID NO: 4810017 - DNA, 22 bp, Homo sapiens
tggccagcctggggcctggcag

SEQ ID NO: 4810018 - DNA, 23 bp, Homo sapiens
tggccaggggcttctccccctca

SEQ ID NO: 4810019 - DNA, 21 bp, Homo sapiens
tggccagtatcctggattcct

SEQ ID NO: 4810020 - DNA, 13 bp, Homo sapiens
tggccatccctgg

SEQ ID NO: 4810021 - DNA, 19 bp, Homo sapiens
tggccatccctgggcccct

SEQ ID NO: 4810022 - DNA, 20 bp, Homo sapiens
tggcccaacatacgcactgg

SEQ ID NO: 4810023 - DNA, 21 bp, Homo sapiens
tggcccagcagcggcccagat

SEQ ID NO: 4810024 - DNA, 13 bp, Homo sapiens
tggcccagccagc

SEQ ID NO: 4810025 - DNA, 16 bp, Homo sapiens
tggcccagccagcagg

SEQ ID NO: 4810026 - DNA, 17 bp, Homo sapiens
tggcccagccagcaggt

SEQ ID NO: 4810027 - DNA, 16 bp, Homo sapiens
tggcccagccatggct

SEQ ID NO: 4810028 - DNA, 22 bp, Homo sapiens
tggcccagccatggctggatgt

SEQ ID NO: 4810029 - DNA, 21 bp, Homo sapiens
tggcccagtgcaatctgtcca

SEQ ID NO: 4810030 - DNA, 24 bp, Homo sapiens
tggcccatagaaacatgacactga

SEQ ID NO: 4810031 - DNA, 17 bp, Homo sapiens
tggccccagctggctgg

SEQ ID NO: 4810032 - DNA, 12 bp, Homo sapiens
tggccccaggcg

SEQ ID NO: 4810033 - DNA, 11 bp, Homo sapiens
tggccccctcg

SEQ ID NO: 4810034 - DNA, 14 bp, Homo sapiens
tggccccctcgcgc

SEQ ID NO: 4810035 - DNA, 23 bp, Homo sapiens
tggccccctcgcgcccctgtcca

SEQ ID NO: 4810036 - DNA, 17 bp, Homo sapiens
tggcccctccttctccc

SEQ ID NO: 4810037 - DNA, 20 bp, Homo sapiens
tggcccctccttctcccctc

SEQ ID NO: 4810038 - DNA, 21 bp, Homo sapiens
tggcccctccttctcccctcc

SEQ ID NO: 4810039 - DNA, 10 bp, Homo sapiens
tggcccctct

SEQ ID NO: 4810040 - DNA, 15 bp, Homo sapiens
tggccctcgggccct

SEQ ID NO: 4810041 - DNA, 17 bp, Homo sapiens
tggccctgccctccccc

SEQ ID NO: 4810042 - DNA, 18 bp, Homo sapiens
tggccctgccctccccca

SEQ ID NO: 4810043 - DNA, 18 bp, Homo sapiens
tggccctgccctctcctt

SEQ ID NO: 4810044 - DNA, 14 bp, Homo sapiens
tggccctgtgggag

SEQ ID NO: 4810045 - DNA, 13 bp, Homo sapiens
tggcccttccttc

SEQ ID NO: 4810046 - DNA, 16 bp, Homo sapiens
tggcccttccttcacc

SEQ ID NO: 4810047 - DNA, 21 bp, Homo sapiens
tggccgctgcagtcagcacag

SEQ ID NO: 4810048 - DNA, 14 bp, Homo sapiens
tggccgctgcccac

SEQ ID NO: 4810049 - DNA, 22 bp, Homo sapiens
tggccgctgggagaaaagccag

SEQ ID NO: 4810050 - DNA, 23 bp, Homo sapiens
tggccgctgggagaaaagccaga

SEQ ID NO: 4810051 - DNA, 13 bp, Homo sapiens
tggccggctggcc

SEQ ID NO: 4810052 - DNA, 15 bp, Homo sapiens
tggcctaccacagct

SEQ ID NO: 4810053 - DNA, 19 bp, Homo sapiens
tggcctaccacagctgcct

SEQ ID NO: 4810054 - DNA, 20 bp, Homo sapiens
tggcctaccacagctgcctc

SEQ ID NO: 4810055 - DNA, 21 bp, Homo sapiens
tggcctaccacagctgcctcc

SEQ ID NO: 4810056 - DNA, 22 bp, Homo sapiens
tggcctaccacagctgcctccg

SEQ ID NO: 4810057 - DNA, 14 bp, Homo sapiens
tggcctagcccacc

SEQ ID NO: 4810058 - DNA, 19 bp, Homo sapiens
tggcctagcccaccctgct

SEQ ID NO: 4810059 - DNA, 17 bp, Homo sapiens
tggcctatgaccctgtg

SEQ ID NO: 4810060 - DNA, 20 bp, Homo sapiens
tggcctatgaccctgtgcct

SEQ ID NO: 4810061 - DNA, 14 bp, Homo sapiens
tggcctcagccctc

SEQ ID NO: 4810062 - DNA, 19 bp, Homo sapiens
tggcctcccagccacccgg

SEQ ID NO: 4810063 - DNA, 14 bp, Homo sapiens
tggcctctgcccct

SEQ ID NO: 4810064 - DNA, 16 bp, Homo sapiens
tggcctctgcccctct

SEQ ID NO: 4810065 - DNA, 17 bp, Homo sapiens
tggcctgacacaatggt

SEQ ID NO: 4810066 - DNA, 14 bp, Homo sapiens
tggcctgagaagag

SEQ ID NO: 4810067 - DNA, 18 bp, Homo sapiens
tctattagcttactgatt

SEQ ID NO: 4810068 - DNA, 15 bp, Homo sapiens
tctattatctgggtt

SEQ ID NO: 4810069 - DNA, 13 bp, Homo sapiens
tctatttaatttt

SEQ ID NO: 4810070 - DNA, 16 bp, Homo sapiens
tctatttgatttgcaa

SEQ ID NO: 4810071 - DNA, 14 bp, Homo sapiens
tctcaaaatgtgcc

SEQ ID NO: 4810072 - DNA, 18 bp, Homo sapiens
tctcaaaatgtgccgtct

SEQ ID NO: 4810073 - DNA, 17 bp, Homo sapiens
tctcaaacactgcttaa

SEQ ID NO: 4810074 - DNA, 21 bp, Homo sapiens
tctcaaacctggcagatgggg

SEQ ID NO: 4810075 - DNA, 17 bp, Homo sapiens
tctcaaatgctaaatgc

SEQ ID NO: 4810076 - DNA, 13 bp, Homo sapiens
tctcaacacacag

SEQ ID NO: 4810077 - DNA, 15 bp, Homo sapiens
tctcaacacacagta

SEQ ID NO: 4810078 - DNA, 23 bp, Homo sapiens
tctcaacacacagtatagataaa

SEQ ID NO: 4810079 - DNA, 13 bp, Homo sapiens
tctcaatgaaata

SEQ ID NO: 4810080 - DNA, 16 bp, Homo sapiens
tctcaatgcttttcta

SEQ ID NO: 4810081 - DNA, 15 bp, Homo sapiens
tctcaatgttccatt

SEQ ID NO: 4810082 - DNA, 23 bp, Homo sapiens
tctcaattctgaaggggaaaacc

SEQ ID NO: 4810083 - DNA, 17 bp, Homo sapiens
tctcaattgagttaaat

SEQ ID NO: 4810084 - DNA, 20 bp, Homo sapiens
tctcaattgagttaaatcag

SEQ ID NO: 4810085 - DNA, 20 bp, Homo sapiens
tctcacagcacatgctggcc

SEQ ID NO: 4810086 - DNA, 18 bp, Homo sapiens
tctcacaggttcacccag

SEQ ID NO: 4810087 - DNA, 12 bp, Homo sapiens
tctcactgtatt

SEQ ID NO: 4810088 - DNA, 13 bp, Homo sapiens
tctcactgtatta

SEQ ID NO: 4810089 - DNA, 23 bp, Homo sapiens
tctcagaacaccaagtaaatcta

SEQ ID NO: 4810090 - DNA, 15 bp, Homo sapiens
tctcagaactcctgt

SEQ ID NO: 4810091 - DNA, 18 bp, Homo sapiens
tctcagataaagtgacca

SEQ ID NO: 4810092 - DNA, 21 bp, Homo sapiens
tctcagcactaattagtgtcc

SEQ ID NO: 4810093 - DNA, 22 bp, Homo sapiens
tctcagcatcctggaaatttgt

SEQ ID NO: 4810094 - DNA, 19 bp, Homo sapiens
tctcagcgggagtctcctc

SEQ ID NO: 4810095 - DNA, 20 bp, Homo sapiens
tctcagctccactctgaagt

SEQ ID NO: 4810096 - DNA, 16 bp, Homo sapiens
tctcaggaccaccctg

SEQ ID NO: 4810097 - DNA, 17 bp, Homo sapiens
tctcaggaccaccctgc

SEQ ID NO: 4810098 - DNA, 12 bp, Homo sapiens
tctcaggccagc

SEQ ID NO: 4810099 - DNA, 17 bp, Homo sapiens
tctcaggccagctgctt

SEQ ID NO: 4810100 - DNA, 18 bp, Homo sapiens
tctcaggtggcatttgca

SEQ ID NO: 4810101 - DNA, 19 bp, Homo sapiens
tctcagtatcttaaaattg

SEQ ID NO: 4810102 - DNA, 15 bp, Homo sapiens
tctcagtcagtgtca

SEQ ID NO: 4810103 - DNA, 14 bp, Homo sapiens
tctcatacataaaa

SEQ ID NO: 4810104 - DNA, 19 bp, Homo sapiens
tctcatacctctgaccaac

SEQ ID NO: 4810105 - DNA, 15 bp, Homo sapiens
tctcatcatgtctat

SEQ ID NO: 4810106 - DNA, 18 bp, Homo sapiens
tctcatcatgtctattgt

SEQ ID NO: 4810107 - DNA, 18 bp, Homo sapiens
tctcatccccaaactgta

SEQ ID NO: 4810108 - DNA, 22 bp, Homo sapiens
tctcatctgtaaaaccaggctg

SEQ ID NO: 4810109 - DNA, 13 bp, Homo sapiens
tctcatcttgcct

SEQ ID NO: 4810110 - DNA, 18 bp, Homo sapiens
tctcatgcatagacaagt

SEQ ID NO: 4810111 - DNA, 12 bp, Homo sapiens
tctcatggtatt

SEQ ID NO: 4810112 - DNA, 23 bp, Homo sapiens
tctcatggtattatctagtaggt

SEQ ID NO: 4810113 - DNA, 17 bp, Homo sapiens
tctcatgttttatatga

SEQ ID NO: 4810114 - DNA, 20 bp, Homo sapiens
tctcatgttttatatgatta

SEQ ID NO: 4810115 - DNA, 16 bp, Homo sapiens
tctcattcttctaaaa

SEQ ID NO: 4810116 - DNA, 19 bp, Homo sapiens
tctcattcttctaaaacta

SEQ ID NO: 4810117 - DNA, 17 bp, Homo sapiens
tctcattgccaaggcat

SEQ ID NO: 4810118 - DNA, 23 bp, Homo sapiens
tctcattgccaaggcatccccag

SEQ ID NO: 4810119 - DNA, 14 bp, Homo sapiens
tctcatttgccagg

SEQ ID NO: 4810120 - DNA, 15 bp, Homo sapiens
tctcatttgccagga

SEQ ID NO: 4810121 - DNA, 14 bp, Homo sapiens
tctcattttttcct

SEQ ID NO: 4810122 - DNA, 17 bp, Homo sapiens
tcctgctgaccttctgc

SEQ ID NO: 4810123 - DNA, 10 bp, Homo sapiens
tcctgctgtg

SEQ ID NO: 4810124 - DNA, 19 bp, Homo sapiens
tcctggaaatttgtgtgct

SEQ ID NO: 4810125 - DNA, 20 bp, Homo sapiens
tcctggaaatttgtgtgctt

SEQ ID NO: 4810126 - DNA, 22 bp, Homo sapiens
tcctggaaatttgtgtgcttca

SEQ ID NO: 4810127 - DNA, 18 bp, Homo sapiens
tcctggacagtgagagca

SEQ ID NO: 4810128 - DNA, 19 bp, Homo sapiens
tcctggacagtgagagcag

SEQ ID NO: 4810129 - DNA, 10 bp, Homo sapiens
tcctggccag

SEQ ID NO: 4810130 - DNA, 19 bp, Homo sapiens
tcctggcccgggagccgca

SEQ ID NO: 4810131 - DNA, 15 bp, Homo sapiens
tcctggctcacagcc

SEQ ID NO: 4810132 - DNA, 18 bp, Homo sapiens
tcctggctcacagccacc

SEQ ID NO: 4810133 - DNA, 19 bp, Homo sapiens
tcctggctcacagccacca

SEQ ID NO: 4810134 - DNA, 13 bp, Homo sapiens
tcctggcttttaa

SEQ ID NO: 4810135 - DNA, 23 bp, Homo sapiens
tcctggcttttaaacctgttcct

SEQ ID NO: 4810136 - DNA, 18 bp, Homo sapiens
tcctgggcagcccagaga

SEQ ID NO: 4810137 - DNA, 16 bp, Homo sapiens
tcctgggggtggcagg

SEQ ID NO: 4810138 - DNA, 18 bp, Homo sapiens
tcctggggtggttggagg

SEQ ID NO: 4810139 - DNA, 13 bp, Homo sapiens
tcctgggtgctca

SEQ ID NO: 4810140 - DNA, 22 bp, Homo sapiens
tcctgggtgctgtcatgcccag

SEQ ID NO: 4810141 - DNA, 15 bp, Homo sapiens
tcctgtaattttgta

SEQ ID NO: 4810142 - DNA, 19 bp, Homo sapiens
tcctgtaattttgtagtag

SEQ ID NO: 4810143 - DNA, 11 bp, Homo sapiens
tcctgtatgtt

SEQ ID NO: 4810144 - DNA, 17 bp, Homo sapiens
tcctgtcctggctccca

SEQ ID NO: 4810145 - DNA, 22 bp, Homo sapiens
tcctgtctaacttggggaaggg

SEQ ID NO: 4810146 - DNA, 12 bp, Homo sapiens
tcctgtctcctc

SEQ ID NO: 4810147 - DNA, 15 bp, Homo sapiens
tcctgtctcctctgt

SEQ ID NO: 4810148 - DNA, 16 bp, Homo sapiens
tcctgtctcctctgtc

SEQ ID NO: 4810149 - DNA, 19 bp, Homo sapiens
tcctgtctcctctgtcagt

SEQ ID NO: 4810150 - DNA, 22 bp, Homo sapiens
tcctgtctcttgggaagcagtt

SEQ ID NO: 4810151 - DNA, 14 bp, Homo sapiens
tcctgtgagctccc

SEQ ID NO: 4810152 - DNA, 23 bp, Homo sapiens
tcctgtgaggatagagacttgca

SEQ ID NO: 4810153 - DNA, 17 bp, Homo sapiens
tcctgtgattcctggtg

SEQ ID NO: 4810154 - DNA, 18 bp, Homo sapiens
tcctgtgtcatctgtcag

SEQ ID NO: 4810155 - DNA, 19 bp, Homo sapiens
tccttaaaaaaaaaaatga

SEQ ID NO: 4810156 - DNA, 14 bp, Homo sapiens
tccttagtaaattc

SEQ ID NO: 4810157 - DNA, 13 bp, Homo sapiens
tccttcactctga

SEQ ID NO: 4810158 - DNA, 17 bp, Homo sapiens
tccttcatgcttttctc

SEQ ID NO: 4810159 - DNA, 21 bp, Homo sapiens
tccttcatgcttttctcatgg

SEQ ID NO: 4810160 - DNA, 22 bp, Homo sapiens
tccttcccccagcacaaagcac

SEQ ID NO: 4810161 - DNA, 16 bp, Homo sapiens
tccttcccgcagcacc

SEQ ID NO: 4810162 - DNA, 16 bp, Homo sapiens
tccttctcccctccag

SEQ ID NO: 4810163 - DNA, 17 bp, Homo sapiens
tccttctcccctccaga

SEQ ID NO: 4810164 - DNA, 16 bp, Homo sapiens
tccttctgatctgaga

SEQ ID NO: 4810165 - DNA, 14 bp, Homo sapiens
tccttgaccttcct

SEQ ID NO: 4810166 - DNA, 15 bp, Homo sapiens
tccttgcacttctgt

SEQ ID NO: 4810167 - DNA, 13 bp, Homo sapiens
tccttgccttctt

SEQ ID NO: 4810168 - DNA, 14 bp, Homo sapiens
tccttggcaccaaa

SEQ ID NO: 4810169 - DNA, 14 bp, Homo sapiens
tccttggcccagca

SEQ ID NO: 4810170 - DNA, 20 bp, Homo sapiens
tccttggcccagcagcggcc

SEQ ID NO: 4810171 - DNA, 23 bp, Homo sapiens
tccttggcctagcccaccctgct

SEQ ID NO: 4810172 - DNA, 16 bp, Homo sapiens
tccttggttatatttt

SEQ ID NO: 4810173 - DNA, 19 bp, Homo sapiens
tccttggttttgcctcttt

SEQ ID NO: 4810174 - DNA, 12 bp, Homo sapiens
tccttgtacttg

SEQ ID NO: 4810175 - DNA, 13 bp, Homo sapiens
tccttgtcagttg

SEQ ID NO: 4810176 - DNA, 20 bp, Homo sapiens
tcctttaatatactccttaa

SEQ ID NO: 4810177 - DNA, 17 bp, Homo sapiens
tcctttaccctccacac

SEQ ID NO: 4810178 - DNA, 15 bp, Homo sapiens
tcctttatgtattct

SEQ ID NO: 4810179 - DNA, 17 bp, Homo sapiens
tcctttcatcctcagca

SEQ ID NO: 4810180 - DNA, 20 bp, Homo sapiens
tcctttcatcctcagcaagt

SEQ ID NO: 4810181 - DNA, 22 bp, Homo sapiens
tcctttccatcagctttataat

SEQ ID NO: 4810182 - DNA, 19 bp, Homo sapiens
tcctttccctccgaacgct

SEQ ID NO: 4810183 - DNA, 18 bp, Homo sapiens
tgtaaaggtaggtgcatg

SEQ ID NO: 4810184 - DNA, 19 bp, Homo sapiens
tgtaaaggtgatgaattta

SEQ ID NO: 4810185 - DNA, 12 bp, Homo sapiens
tgtaaataggtt

SEQ ID NO: 4810186 - DNA, 13 bp, Homo sapiens
tgtaaataggttt

SEQ ID NO: 4810187 - DNA, 19 bp, Homo sapiens
tgtaaatctaacattatta

SEQ ID NO: 4810188 - DNA, 16 bp, Homo sapiens
tgtaaatgatatgtct

SEQ ID NO: 4810189 - DNA, 22 bp, Homo sapiens
tgtaacatcactatccatgcac

SEQ ID NO: 4810190 - DNA, 17 bp, Homo sapiens
tgtaacattctatttca

SEQ ID NO: 4810191 - DNA, 17 bp, Homo sapiens
tgtaaccacaactttca

SEQ ID NO: 4810192 - DNA, 12 bp, Homo sapiens
tgtaactgttac

SEQ ID NO: 4810193 - DNA, 21 bp, Homo sapiens
tgtaacttaattataagctat

SEQ ID NO: 4810194 - DNA, 22 bp, Homo sapiens
tgtaagaagctaaaatgaaaaa

SEQ ID NO: 4810195 - DNA, 13 bp, Homo sapiens
tgtaagagaattc

SEQ ID NO: 4810196 - DNA, 15 bp, Homo sapiens
tgtaaggaatgatta

SEQ ID NO: 4810197 - DNA, 14 bp, Homo sapiens
tgtaagtttctaag

SEQ ID NO: 4810198 - DNA, 16 bp, Homo sapiens
tgtaagtttctaagaa

SEQ ID NO: 4810199 - DNA, 16 bp, Homo sapiens
tgtaatagcctcacct

SEQ ID NO: 4810200 - DNA, 23 bp, Homo sapiens
tgtaatatagaaaaaaacattct

SEQ ID NO: 4810201 - DNA, 18 bp, Homo sapiens
tgtaatatcagttacagt

SEQ ID NO: 4810202 - DNA, 22 bp, Homo sapiens
tgtaatatcagttacagtggca

SEQ ID NO: 4810203 - DNA, 15 bp, Homo sapiens
tgtaatatcatttca

SEQ ID NO: 4810204 - DNA, 18 bp, Homo sapiens
tgtaatatcatttcataa

SEQ ID NO: 4810205 - DNA, 19 bp, Homo sapiens
tgtaatatcatttcataaa

SEQ ID NO: 4810206 - DNA, 19 bp, Homo sapiens
tgtaatcacactctcttct

SEQ ID NO: 4810207 - DNA, 23 bp, Homo sapiens
tgtaatcacactctcttcttact

SEQ ID NO: 4810208 - DNA, 19 bp, Homo sapiens
tgtaatcttgttgataaaa

SEQ ID NO: 4810209 - DNA, 17 bp, Homo sapiens
tgtaatgtatcttattt

SEQ ID NO: 4810210 - DNA, 21 bp, Homo sapiens
tgtaatgtatcttatttatat

SEQ ID NO: 4810211 - DNA, 15 bp, Homo sapiens
tgtaattcctctagc

SEQ ID NO: 4810212 - DNA, 15 bp, Homo sapiens
tgtaattttgtagta

SEQ ID NO: 4810213 - DNA, 22 bp, Homo sapiens
tgtacaacaccagcaacattat

SEQ ID NO: 4810214 - DNA, 23 bp, Homo sapiens
tgtacaatggggacttcccggga

SEQ ID NO: 4810215 - DNA, 14 bp, Homo sapiens
tgtacagacaacaa

SEQ ID NO: 4810216 - DNA, 13 bp, Homo sapiens
tgtacaggctgag

SEQ ID NO: 4810217 - DNA, 14 bp, Homo sapiens
tgtacagtttgttt

SEQ ID NO: 4810218 - DNA, 18 bp, Homo sapiens
tgtacatttatgtgtgaa

SEQ ID NO: 4810219 - DNA, 20 bp, Homo sapiens
tgtacatttatgtgtgaagc

SEQ ID NO: 4810220 - DNA, 16 bp, Homo sapiens
tgtacatttgatttga

SEQ ID NO: 4810221 - DNA, 16 bp, Homo sapiens
tgtaccagcccaggca

SEQ ID NO: 4810222 - DNA, 15 bp, Homo sapiens
tgtactacatttgca

SEQ ID NO: 4810223 - DNA, 16 bp, Homo sapiens
tgtactaccccaggac

SEQ ID NO: 4810224 - DNA, 18 bp, Homo sapiens
tgtacttcagttctcatc

SEQ ID NO: 4810225 - DNA, 15 bp, Homo sapiens
tgtacttcttcatcc

SEQ ID NO: 4810226 - DNA, 22 bp, Homo sapiens
tgtacttcttcatccatagaca

SEQ ID NO: 4810227 - DNA, 23 bp, Homo sapiens
tgtacttgccctgaccatgcatt

SEQ ID NO: 4810228 - DNA, 14 bp, Homo sapiens
tgtactttacaatc

SEQ ID NO: 4810229 - DNA, 15 bp, Homo sapiens
tgtactttcccaggt

SEQ ID NO: 4810230 - DNA, 22 bp, Homo sapiens
tgtagagaaaaaaaaatatgtg

SEQ ID NO: 4810231 - DNA, 23 bp, Homo sapiens
tgtagagaaaaaaaaatatgtgt

SEQ ID NO: 4810232 - DNA, 20 bp, Homo sapiens
tgtagatcaactcatgttaa

SEQ ID NO: 4810233 - DNA, 23 bp, Homo sapiens
tgtagcaaattccaatacattat

SEQ ID NO: 4810234 - DNA, 22 bp, Homo sapiens
tgtagccctggcccggtcccag

SEQ ID NO: 4810235 - DNA, 18 bp, Homo sapiens
tgtagcctaatattcatg

SEQ ID NO: 4810236 - DNA, 16 bp, Homo sapiens
tgtagcctggtctgtg

SEQ ID NO: 4810237 - DNA, 17 bp, Homo sapiens
tgtagcctggtctgtgc

SEQ ID NO: 4810238 - DNA, 18 bp, Homo sapiens
tgtagcctggtctgtgca

SEQ ID NO: 4810239 - DNA, 21 bp, Homo sapiens
tgtagggaacggcctgagagg

SEQ ID NO: 4810240 - DNA, 15 bp, Homo sapiens
tgtaggtcaatgaaa

SEQ ID NO: 4810241 - DNA, 21 bp, Homo sapiens
tgtaggtcaatgaaatatttg

SEQ ID NO: 4810242 - DNA, 14 bp, Homo sapiens
tgtagtaattgtta

SEQ ID NO: 4810243 - DNA, 20 bp, Homo sapiens
tgtagtcccggaggccttcc

SEQ ID NO: 4810244 - DNA, 14 bp, Homo sapiens
tgtataaaacagtg

SEQ ID NO: 4810245 - DNA, 16 bp, Homo sapiens
tgtataaaacagtgtt

SEQ ID NO: 4810246 - DNA, 17 bp, Homo sapiens
tgtataaaacagtgttt

SEQ ID NO: 4810247 - DNA, 18 bp, Homo sapiens
tgtataaaacagtgtttc

SEQ ID NO: 4810248 - DNA, 19 bp, Homo sapiens
tgtataaaacagtgtttcc

SEQ ID NO: 4810249 - DNA, 13 bp, Homo sapiens
tgtataaatgtga

SEQ ID NO: 4810250 - DNA, 19 bp, Homo sapiens
tgtatacaaacaggtgcta

SEQ ID NO: 4810251 - DNA, 18 bp, Homo sapiens
tgtatacaagtactggta

SEQ ID NO: 4810252 - DNA, 18 bp, Homo sapiens
tgtatacatatgtatgtg

SEQ ID NO: 4810253 - DNA, 19 bp, Homo sapiens
tgtatacatatgtatgtgt

SEQ ID NO: 4810254 - DNA, 15 bp, Homo sapiens
tgtatatagatgtct

SEQ ID NO: 4810255 - DNA, 20 bp, Homo sapiens
tgtatatattatatatacat

SEQ ID NO: 4810256 - DNA, 22 bp, Homo sapiens
tgtatatattatatatacatta

SEQ ID NO: 4810257 - DNA, 23 bp, Homo sapiens
tgtatatatttattattttcata

SEQ ID NO: 4810258 - DNA, 15 bp, Homo sapiens
tgtatatctgtgtaa

SEQ ID NO: 4810259 - DNA, 21 bp, Homo sapiens
tgtatatctgtgtaagacacg

SEQ ID NO: 4810260 - DNA, 12 bp, Homo sapiens
tgtatatttgta

SEQ ID NO: 4810261 - DNA, 15 bp, Homo sapiens
tgtatatttgtatga

SEQ ID NO: 4810262 - DNA, 21 bp, Homo sapiens
tgtatccaagttatttgatct

SEQ ID NO: 4810263 - DNA, 14 bp, Homo sapiens
tgtatcctgacagc

SEQ ID NO: 4810264 - DNA, 21 bp, Homo sapiens
tgtatctgaactcacagactg

SEQ ID NO: 4810265 - DNA, 14 bp, Homo sapiens
tgtatctgtgcttt

SEQ ID NO: 4810266 - DNA, 18 bp, Homo sapiens
tgtatgatttaggcttct

SEQ ID NO: 4810267 - DNA, 17 bp, Homo sapiens
tgtatgccatgtatgtt

SEQ ID NO: 4810268 - DNA, 14 bp, Homo sapiens
tgtatgtacttaca

SEQ ID NO: 4810269 - DNA, 12 bp, Homo sapiens
tgtatgtataca

SEQ ID NO: 4810270 - DNA, 17 bp, Homo sapiens
tgtatgtatacacacac

SEQ ID NO: 4810271 - DNA, 18 bp, Homo sapiens
tgtatgtatacacacaca

SEQ ID NO: 4810272 - DNA, 15 bp, Homo sapiens
tgtatgttgcatgaa

SEQ ID NO: 4810273 - DNA, 16 bp, Homo sapiens
tgtattaaagatgcag

SEQ ID NO: 4810274 - DNA, 22 bp, Homo sapiens
tgtattaagcccacagtatatt

SEQ ID NO: 4810275 - DNA, 13 bp, Homo sapiens
tgtattaagctcc

SEQ ID NO: 4810276 - DNA, 15 bp, Homo sapiens
tgtattacataaata

SEQ ID NO: 4810277 - DNA, 19 bp, Homo sapiens
tgtattatcatatatgctt

SEQ ID NO: 4810278 - DNA, 18 bp, Homo sapiens
tgtattatcttaaaccca

SEQ ID NO: 4810279 - DNA, 15 bp, Homo sapiens
tgtattattatatat

SEQ ID NO: 4810280 - DNA, 15 bp, Homo sapiens
tgtattctgttggcc

SEQ ID NO: 4810281 - DNA, 22 bp, Homo sapiens
tgtattctgttggccagcacgt

SEQ ID NO: 4810282 - DNA, 13 bp, Homo sapiens
tgtattgctttct

SEQ ID NO: 4810283 - DNA, 13 bp, Homo sapiens
tgtattggcagca

SEQ ID NO: 4810284 - DNA, 16 bp, Homo sapiens
tgtattggcagcacag

SEQ ID NO: 4810285 - DNA, 19 bp, Homo sapiens
tgtattggcagcacagcta

SEQ ID NO: 4810286 - DNA, 17 bp, Homo sapiens
tgtattgttagatgttt

SEQ ID NO: 4810287 - DNA, 19 bp, Homo sapiens
tgtattgttagatgtttgt

SEQ ID NO: 4810288 - DNA, 12 bp, Homo sapiens
tgtatttaatgt

SEQ ID NO: 4810289 - DNA, 16 bp, Homo sapiens
tgtatttaatgtttgt

SEQ ID NO: 4810290 - DNA, 22 bp, Homo sapiens
tgtatttacttgttatgttgta

SEQ ID NO: 4810291 - DNA, 14 bp, Homo sapiens
tgtatttgaggaaa

SEQ ID NO: 4810292 - DNA, 21 bp, Homo sapiens
tgtattttctgtgttgttcat

SEQ ID NO: 4810293 - DNA, 14 bp, Homo sapiens
tgtatttttagaga

SEQ ID NO: 4810294 - DNA, 21 bp, Homo sapiens
tgtatttttgtaattcctcta

SEQ ID NO: 4810295 - DNA, 14 bp, Homo sapiens
tgtcaaagtggtga

SEQ ID NO: 4810296 - DNA, 15 bp, Homo sapiens
tgtcaaatccatgtg

SEQ ID NO: 4810297 - DNA, 15 bp, Homo sapiens
tgtcaaatggtattt

SEQ ID NO: 4810298 - DNA, 18 bp, Homo sapiens
tgtcaacctgaattaaag

SEQ ID NO: 4810299 - DNA, 12 bp, Homo sapiens
tgtcaatgtgtg

SEQ ID NO: 4810300 - DNA, 14 bp, Homo sapiens
tgtcaattacagga

SEQ ID NO: 4810301 - DNA, 17 bp, Homo sapiens
tgtcaattacaggaagt

SEQ ID NO: 4810302 - DNA, 21 bp, Homo sapiens
tgtcaattacaggaagtactg

SEQ ID NO: 4810303 - DNA, 20 bp, Homo sapiens
tgtcacatgacatccacatg

SEQ ID NO: 4810304 - DNA, 22 bp, Homo sapiens
tgtcacatgacatccacatgca

SEQ ID NO: 4810305 - DNA, 18 bp, Homo sapiens
tgtcaccagctgccaaaa

SEQ ID NO: 4810306 - DNA, 16 bp, Homo sapiens
tgtcacccaacctggc

SEQ ID NO: 4810307 - DNA, 22 bp, Homo sapiens
tgtcacccaggttggagtgcag

SEQ ID NO: 4810308 - DNA, 21 bp, Homo sapiens
tgtcacgtgaccctgtgcccc

SEQ ID NO: 4810309 - DNA, 23 bp, Homo sapiens
tgtcacgtgaccctgtgccccgc

SEQ ID NO: 4810310 - DNA, 20 bp, Homo sapiens
tgtcacttttttcctgtcaa

SEQ ID NO: 4810311 - DNA, 14 bp, Homo sapiens
tgtcagaatgttgt

SEQ ID NO: 4810312 - DNA, 11 bp, Homo sapiens
tgtcagccagc

SEQ ID NO: 4810313 - DNA, 13 bp, Homo sapiens
tgtcagccagccg

SEQ ID NO: 4810314 - DNA, 15 bp, Homo sapiens
tgtcagccagccgcc

SEQ ID NO: 4810315 - DNA, 18 bp, Homo sapiens
tgtcagccagccgccctg

SEQ ID NO: 4810316 - DNA, 19 bp, Homo sapiens
tgtcagccagccgccctgg

SEQ ID NO: 4810317 - DNA, 13 bp, Homo sapiens
tgtcagcttccca

SEQ ID NO: 4810318 - DNA, 17 bp, Homo sapiens
tgtcaggagagccctct

SEQ ID NO: 4810319 - DNA, 15 bp, Homo sapiens
tgtcaggctctgaat

SEQ ID NO: 4810320 - DNA, 14 bp, Homo sapiens
tgtcagtcactaaa

SEQ ID NO: 4810321 - DNA, 16 bp, Homo sapiens
tgtcagtcgtgttgct

SEQ ID NO: 4810322 - DNA, 17 bp, Homo sapiens
tgtcatatcttctttgt

SEQ ID NO: 4810323 - DNA, 21 bp, Homo sapiens
tgtcatcaagtagtagtactt

SEQ ID NO: 4810324 - DNA, 13 bp, Homo sapiens
tgtcatctgtcag

SEQ ID NO: 4810325 - DNA, 15 bp, Homo sapiens
tgtcatctgtcagct

SEQ ID NO: 4810326 - DNA, 18 bp, Homo sapiens
tgtcatctgtcagcttcc

SEQ ID NO: 4810327 - DNA, 15 bp, Homo sapiens
tgtcatgactttcag

SEQ ID NO: 4810328 - DNA, 16 bp, Homo sapiens
tgtcatgactttcaga

SEQ ID NO: 4810329 - DNA, 19 bp, Homo sapiens
tgtcatgatttcaatgatt

SEQ ID NO: 4810330 - DNA, 13 bp, Homo sapiens
tgtcatgcccagc

SEQ ID NO: 4810331 - DNA, 15 bp, Homo sapiens
tgtcattctcatcca

SEQ ID NO: 4810332 - DNA, 16 bp, Homo sapiens
tgtcattggttacaaa

SEQ ID NO: 4810333 - DNA, 15 bp, Homo sapiens
tgtcatttgctaatg

SEQ ID NO: 4810334 - DNA, 14 bp, Homo sapiens
tgtcattttcagat

SEQ ID NO: 4810335 - DNA, 22 bp, Homo sapiens
tgtcattttcagatccttccaa

SEQ ID NO: 4810336 - DNA, 23 bp, Homo sapiens
tgtcattttctgttatacacagt

SEQ ID NO: 4810337 - DNA, 18 bp, Homo sapiens
tgtccaagcatcagcaag

SEQ ID NO: 4810338 - DNA, 22 bp, Homo sapiens
tgtccacaaatgtcctcagagg

SEQ ID NO: 4810339 - DNA, 15 bp, Homo sapiens
tgtccaccttctgcc

SEQ ID NO: 4810340 - DNA, 16 bp, Homo sapiens
tgtccagacaagccct

SEQ ID NO: 4810341 - DNA, 19 bp, Homo sapiens
tgtccatccgtctctgtcc

SEQ ID NO: 4810342 - DNA, 16 bp, Homo sapiens
tgtccattccaataca

SEQ ID NO: 4810343 - DNA, 13 bp, Homo sapiens
tgtcccaaataaa

SEQ ID NO: 4810344 - DNA, 16 bp, Homo sapiens
tgtcccaccgggagcc

SEQ ID NO: 4810345 - DNA, 11 bp, Homo sapiens
tgtcccagtgt

SEQ ID NO: 4810346 - DNA, 23 bp, Homo sapiens
tgtcccagtgtctggcccagcca

SEQ ID NO: 4810347 - DNA, 16 bp, Homo sapiens
tgtcccccctgtggtc

SEQ ID NO: 4810348 - DNA, 19 bp, Homo sapiens
tgtcccccctgtggtctgt

SEQ ID NO: 4810349 - DNA, 19 bp, Homo sapiens
tgtccccgcactgggcttg

SEQ ID NO: 4810350 - DNA, 18 bp, Homo sapiens
tgtcccctcactctgtca

SEQ ID NO: 4810351 - DNA, 23 bp, Homo sapiens
tgtcccctcactctgtcagccag

SEQ ID NO: 4810352 - DNA, 15 bp, Homo sapiens
tgtcccctcctcgcc

SEQ ID NO: 4810353 - DNA, 18 bp, Homo sapiens
tgtcccctggtgcccctc

SEQ ID NO: 4810354 - DNA, 20 bp, Homo sapiens
tgtcccggagctcaggccct

SEQ ID NO: 4810355 - DNA, 15 bp, Homo sapiens
tgtccctaaacatag

SEQ ID NO: 4810356 - DNA, 22 bp, Homo sapiens
tgtccctagggctctccaagca

SEQ ID NO: 4810357 - DNA, 17 bp, Homo sapiens
tgtccctgtcccctcct

SEQ ID NO: 4810358 - DNA, 13 bp, Homo sapiens
tgtcccttcccca

SEQ ID NO: 4810359 - DNA, 14 bp, Homo sapiens
tgtccgtcctgctc

SEQ ID NO: 4810360 - DNA, 19 bp, Homo sapiens
tgtccgtgaaagttgtgat

SEQ ID NO: 4810361 - DNA, 22 bp, Homo sapiens
tgtcctaaatgcaaagcacacc

SEQ ID NO: 4810362 - DNA, 15 bp, Homo sapiens
tgtcctatccccgga

SEQ ID NO: 4810363 - DNA, 16 bp, Homo sapiens
tgtcctatccccggac

SEQ ID NO: 4810364 - DNA, 16 bp, Homo sapiens
tgtcctctgtccgtct

SEQ ID NO: 4810365 - DNA, 15 bp, Homo sapiens
tgtcctgactgtcct

SEQ ID NO: 4810366 - DNA, 17 bp, Homo sapiens
tgtcctgagccccctgc

SEQ ID NO: 4810367 - DNA, 18 bp, Homo sapiens
tgtcctgagccccctgca

SEQ ID NO: 4810368 - DNA, 20 bp, Homo sapiens
tgtcctgagccccctgcacc

SEQ ID NO: 4810369 - DNA, 21 bp, Homo sapiens
tgtcctgagccccctgcaccc

SEQ ID NO: 4810370 - DNA, 22 bp, Homo sapiens
tgtcctgagccccctgcaccca

SEQ ID NO: 4810371 - DNA, 13 bp, Homo sapiens
tgtcctgcatgta

SEQ ID NO: 4810372 - DNA, 21 bp, Homo sapiens
tgtcctggctcccagggtcct

SEQ ID NO: 4810373 - DNA, 16 bp, Homo sapiens
tgtcctgtaactgtta

SEQ ID NO: 4810374 - DNA, 15 bp, Homo sapiens
tgtcctgtgagatgt

SEQ ID NO: 4810375 - DNA, 20 bp, Homo sapiens
tgtcctgtgagatgtgtatc

SEQ ID NO: 4810376 - DNA, 12 bp, Homo sapiens
tgtcctgtgtca

SEQ ID NO: 4810377 - DNA, 14 bp, Homo sapiens
tgtccttcccccag

SEQ ID NO: 4810378 - DNA, 20 bp, Homo sapiens
tgtccttgtgtatcctgaca

SEQ ID NO: 4810379 - DNA, 17 bp, Homo sapiens
tgtcctttatgtattct

SEQ ID NO: 4810380 - DNA, 21 bp, Homo sapiens
tgtcgggcaagatagctcctt

SEQ ID NO: 4810381 - DNA, 14 bp, Homo sapiens
tgtctaatgaaacc

SEQ ID NO: 4810382 - DNA, 13 bp, Homo sapiens
tgtctataggact

SEQ ID NO: 4810383 - DNA, 14 bp, Homo sapiens
tgtctatgtgtata

SEQ ID NO: 4810384 - DNA, 21 bp, Homo sapiens
tgtctatgtgtatatattata

SEQ ID NO: 4810385 - DNA, 12 bp, Homo sapiens
tgtctattgtcc

SEQ ID NO: 4810386 - DNA, 18 bp, Homo sapiens
tgtctattgtccaaagtt

SEQ ID NO: 4810387 - DNA, 15 bp, Homo sapiens
tgtctcatgttttat

SEQ ID NO: 4810388 - DNA, 17 bp, Homo sapiens
tgtctccttggttatat

SEQ ID NO: 4810389 - DNA, 20 bp, Homo sapiens
tgtctctacaaaaaaaatca

SEQ ID NO: 4810390 - DNA, 21 bp, Homo sapiens
tgtctctacaaaaaaaatcaa

SEQ ID NO: 4810391 - DNA, 22 bp, Homo sapiens
tgtctctcttcggtggccttga

SEQ ID NO: 4810392 - DNA, 18 bp, Homo sapiens
tgtctcttgggaagcagt

SEQ ID NO: 4810393 - DNA, 15 bp, Homo sapiens
tgtctgagccctgcc

SEQ ID NO: 4810394 - DNA, 22 bp, Homo sapiens
tgtctgagccctgccctcactc

SEQ ID NO: 4810395 - DNA, 14 bp, Homo sapiens
tgtctgagctgctg

SEQ ID NO: 4810396 - DNA, 21 bp, Homo sapiens
tgtctgcacaccttgaatctg

SEQ ID NO: 4810397 - DNA, 14 bp, Homo sapiens
tgtctggatcagta

SEQ ID NO: 4810398 - DNA, 15 bp, Homo sapiens
tgtctggatcagtaa

SEQ ID NO: 4810399 - DNA, 20 bp, Homo sapiens
tgtctggatcagtaaaatta

SEQ ID NO: 4810400 - DNA, 18 bp, Homo sapiens
tgtctggcccagccatgg

SEQ ID NO: 4810401 - DNA, 19 bp, Homo sapiens
tgtctggcccagccatggc

SEQ ID NO: 4810402 - DNA, 14 bp, Homo sapiens
tgtctggctgtacg

SEQ ID NO: 4810403 - DNA, 17 bp, Homo sapiens
tgtctggtccacacacc

SEQ ID NO: 4810404 - DNA, 21 bp, Homo sapiens
tgtctgtaaatctaacattat

SEQ ID NO: 4810405 - DNA, 23 bp, Homo sapiens
tgtctgtaatcacactctcttct

SEQ ID NO: 4810406 - DNA, 11 bp, Homo sapiens
tgtctgtcacc

SEQ ID NO: 4810407 - DNA, 21 bp, Homo sapiens
tgtctgtcaccagctatctgt

SEQ ID NO: 4810408 - DNA, 24 bp, Homo sapiens
tgtctgtcaccagctatctgtcat

SEQ ID NO: 4810409 - DNA, 20 bp, Homo sapiens
tgtctgtccctaaacatagt

SEQ ID NO: 4810410 - DNA, 18 bp, Homo sapiens
tgtcttagggaattctga

SEQ ID NO: 4810411 - DNA, 18 bp, Homo sapiens
tgtcttagtcataccatc

SEQ ID NO: 4810412 - DNA, 19 bp, Homo sapiens
tgtcttattcctaattcct

SEQ ID NO: 4810413 - DNA, 18 bp, Homo sapiens
tgtcttcaaccctgccct

SEQ ID NO: 4810414 - DNA, 21 bp, Homo sapiens
tgtcttcaaccctgccctgca

SEQ ID NO: 4810415 - DNA, 11 bp, Homo sapiens
tgtctttaaaa

SEQ ID NO: 4810416 - DNA, 14 bp, Homo sapiens
tgtctttatgattt

SEQ ID NO: 4810417 - DNA, 19 bp, Homo sapiens
tgtctttctccaaagttat

SEQ ID NO: 4810418 - DNA, 12 bp, Homo sapiens
tgtctttgctgt

SEQ ID NO: 4810419 - DNA, 21 bp, Homo sapiens
tgtctttgctgtttatatata

SEQ ID NO: 4810420 - DNA, 13 bp, Homo sapiens
tgtgaaacagtgt

SEQ ID NO: 4810421 - DNA, 18 bp, Homo sapiens
tgtgaaacagtgtggatg

SEQ ID NO: 4810422 - DNA, 15 bp, Homo sapiens
tgtgaaagtctcctg

SEQ ID NO: 4810423 - DNA, 15 bp, Homo sapiens
tgtgaactaatgaca

SEQ ID NO: 4810424 - DNA, 14 bp, Homo sapiens
tgtgaactatgttt

SEQ ID NO: 4810425 - DNA, 14 bp, Homo sapiens
tgtgaactgccagg

SEQ ID NO: 4810426 - DNA, 19 bp, Homo sapiens
tgtgaagaaacatttatct

SEQ ID NO: 4810427 - DNA, 19 bp, Homo sapiens
tgtgaagtgattgacattt

SEQ ID NO: 4810428 - DNA, 20 bp, Homo sapiens
tgtgaatggttgcaaagtgt

SEQ ID NO: 4810429 - DNA, 21 bp, Homo sapiens
tgtgaattttaaaatgcaaat

SEQ ID NO: 4810430 - DNA, 14 bp, Homo sapiens
tgtgacattccaca

SEQ ID NO: 4810431 - DNA, 14 bp, Homo sapiens
tggcctggccctgc

SEQ ID NO: 4810432 - DNA, 16 bp, Homo sapiens
tggcctggcttctggg

SEQ ID NO: 4810433 - DNA, 23 bp, Homo sapiens
tggcctgggtcctcggccctgta

SEQ ID NO: 4810434 - DNA, 24 bp, Homo sapiens
tggcctgggtcctcggccctgtag

SEQ ID NO: 4810435 - DNA, 16 bp, Homo sapiens
tggcctggtaggtctg

SEQ ID NO: 4810436 - DNA, 18 bp, Homo sapiens
tggcctggtaggtctgga

SEQ ID NO: 4810437 - DNA, 14 bp, Homo sapiens
tggcctgtccctag

SEQ ID NO: 4810438 - DNA, 15 bp, Homo sapiens
tggcctgtccctagg

SEQ ID NO: 4810439 - DNA, 23 bp, Homo sapiens
tggcctgtccctagggctctcca

SEQ ID NO: 4810440 - DNA, 12 bp, Homo sapiens
tggggcctggca

SEQ ID NO: 4810441 - DNA, 15 bp, Homo sapiens
tggggcggcctgcag

SEQ ID NO: 4810442 - DNA, 12 bp, Homo sapiens
tggggcttggcg

SEQ ID NO: 4810443 - DNA, 18 bp, Homo sapiens
tggggcttggcgtggagc

SEQ ID NO: 4810444 - DNA, 21 bp, Homo sapiens
tgggggaggcttccagctcag

SEQ ID NO: 4810445 - DNA, 18 bp, Homo sapiens
tgggggatgggccagggt

SEQ ID NO: 4810446 - DNA, 19 bp, Homo sapiens
tgggggctgggcagaggaa

SEQ ID NO: 4810447 - DNA, 16 bp, Homo sapiens
tggggggcacagccag

SEQ ID NO: 4810448 - DNA, 12 bp, Homo sapiens
tggggggcaggc

SEQ ID NO: 4810449 - DNA, 14 bp, Homo sapiens
tgggggggcttggg

SEQ ID NO: 4810450 - DNA, 20 bp, Homo sapiens
tggggtaagttgaagggaaa

SEQ ID NO: 4810451 - DNA, 16 bp, Homo sapiens
tggggtagagaggaca

SEQ ID NO: 4810452 - DNA, 18 bp, Homo sapiens
tggggtgctggggctgca

SEQ ID NO: 4810453 - DNA, 17 bp, Homo sapiens
tggggttttcacttcct

SEQ ID NO: 4810454 - DNA, 20 bp, Homo sapiens
tggggttttcacttcctagg

SEQ ID NO: 4810455 - DNA, 23 bp, Homo sapiens
tggggttttgacttgccactgcc

SEQ ID NO: 4810456 - DNA, 14 bp, Homo sapiens
tgggtaaataaatg

SEQ ID NO: 4810457 - DNA, 19 bp, Homo sapiens
tgggtaaataaatgctgct

SEQ ID NO: 4810458 - DNA, 16 bp, Homo sapiens
tgggtagtgccatggc

SEQ ID NO: 4810459 - DNA, 18 bp, Homo sapiens
tgggtagtgccatggcca

SEQ ID NO: 4810460 - DNA, 23 bp, Homo sapiens
tgggtcaactccaaggcaaatgt

SEQ ID NO: 4810461 - DNA, 16 bp, Homo sapiens
tgggtcaattccttag

SEQ ID NO: 4810462 - DNA, 17 bp, Homo sapiens
tgggtccccctcctgca

SEQ ID NO: 4810463 - DNA, 21 bp, Homo sapiens
tgggtcccgggtgccccccat

SEQ ID NO: 4810464 - DNA, 13 bp, Homo sapiens
tgggtcctcccag

SEQ ID NO: 4810465 - DNA, 14 bp, Homo sapiens
tgggtcctcggccc

SEQ ID NO: 4810466 - DNA, 15 bp, Homo sapiens
tgggtgattatgaaa

SEQ ID NO: 4810467 - DNA, 13 bp, Homo sapiens
tgggtgccctgtt

SEQ ID NO: 4810468 - DNA, 15 bp, Homo sapiens
tgggtgccctgttga

SEQ ID NO: 4810469 - DNA, 10 bp, Homo sapiens
tgggtgctca

SEQ ID NO: 4810470 - DNA, 14 bp, Homo sapiens
tgggtgggccctgc

SEQ ID NO: 4810471 - DNA, 15 bp, Homo sapiens
tgggtgtcccctggt

SEQ ID NO: 4810472 - DNA, 18 bp, Homo sapiens
tgggtgtttgggaaaggc

SEQ ID NO: 4810473 - DNA, 15 bp, Homo sapiens
tgggttccagacaga

SEQ ID NO: 4810474 - DNA, 19 bp, Homo sapiens
tgggttccagacagagtgg

SEQ ID NO: 4810475 - DNA, 20 bp, Homo sapiens
tgggttccagacagagtgga

SEQ ID NO: 4810476 - DNA, 21 bp, Homo sapiens
tgggttccagacagagtggat

SEQ ID NO: 4810477 - DNA, 14 bp, Homo sapiens
tgggttgttgcaga

SEQ ID NO: 4810478 - DNA, 18 bp, Homo sapiens
tgggtttctaaagctgcc

SEQ ID NO: 4810479 - DNA, 21 bp, Homo sapiens
tgggtttgggcagtggagagg

SEQ ID NO: 4810480 - DNA, 18 bp, Homo sapiens
tgggttttagaaattcta

SEQ ID NO: 4810481 - DNA, 15 bp, Homo sapiens
tgggttttcttccct

SEQ ID NO: 4810482 - DNA, 16 bp, Homo sapiens
tgggttttgttcttgt

SEQ ID NO: 4810483 - DNA, 16 bp, Homo sapiens
tggtaaataactgtga

SEQ ID NO: 4810484 - DNA, 16 bp, Homo sapiens
tggtaacttgctgtga

SEQ ID NO: 4810485 - DNA, 20 bp, Homo sapiens
tggtaagattgttattaaat

SEQ ID NO: 4810486 - DNA, 15 bp, Homo sapiens
tggtaccagccctgg

SEQ ID NO: 4810487 - DNA, 20 bp, Homo sapiens
tggtaccagccctggggctg

SEQ ID NO: 4810488 - DNA, 22 bp, Homo sapiens
tggtagctctgaagggagggga

SEQ ID NO: 4810489 - DNA, 13 bp, Homo sapiens
tggtaggtctgga

SEQ ID NO: 4810490 - DNA, 13 bp, Homo sapiens
tggtatgaaacaa

SEQ ID NO: 4810491 - DNA, 19 bp, Homo sapiens
tggtatgctggccagcacc

SEQ ID NO: 4810492 - DNA, 21 bp, Homo sapiens
tggtatgctggccagcaccct

SEQ ID NO: 4810493 - DNA, 21 bp, Homo sapiens
tggtatggagttggcagacag

SEQ ID NO: 4810494 - DNA, 14 bp, Homo sapiens
tggtatttactgca

SEQ ID NO: 4810495 - DNA, 20 bp, Homo sapiens
tggtatttactgcaatgtct

SEQ ID NO: 4810496 - DNA, 17 bp, Homo sapiens
tggtattttaacatagc

SEQ ID NO: 4810497 - DNA, 20 bp, Homo sapiens
tggtattttaacatagcagc

SEQ ID NO: 4810498 - DNA, 21 bp, Homo sapiens
tggtattttaacatagcagct

SEQ ID NO: 4810499 - DNA, 20 bp, Homo sapiens
tggtattttcgtgcatttgt

SEQ ID NO: 4810500 - DNA, 16 bp, Homo sapiens
tggtattttttgtgaa

SEQ ID NO: 4810501 - DNA, 16 bp, Homo sapiens
tggtcacaaagctatt

SEQ ID NO: 4810502 - DNA, 13 bp, Homo sapiens
tggtcacagaccc

SEQ ID NO: 4810503 - DNA, 14 bp, Homo sapiens
tggtcacagacccc

SEQ ID NO: 4810504 - DNA, 17 bp, Homo sapiens
tggtcacagacccctgg

SEQ ID NO: 4810505 - DNA, 22 bp, Homo sapiens
tggtcccacttccccatctgtg

SEQ ID NO: 4810506 - DNA, 17 bp, Homo sapiens
tggtccttagtaaattc

SEQ ID NO: 4810507 - DNA, 16 bp, Homo sapiens
tggtctggagccccta

SEQ ID NO: 4810508 - DNA, 20 bp, Homo sapiens
tggtctggagcccctatcct

SEQ ID NO: 4810509 - DNA, 11 bp, Homo sapiens
tggtctgtgtg

SEQ ID NO: 4810510 - DNA, 12 bp, Homo sapiens
tggtctgtgtgt

SEQ ID NO: 4810511 - DNA, 18 bp, Homo sapiens
tggtctgtgtgtgacacc

SEQ ID NO: 4810512 - DNA, 22 bp, Homo sapiens
tggtctgtgtgtgacaccacca

SEQ ID NO: 4810513 - DNA, 13 bp, Homo sapiens
tggtctgtgttct

SEQ ID NO: 4810514 - DNA, 23 bp, Homo sapiens
tggtctgtgttctcaacacacag

SEQ ID NO: 4810515 - DNA, 22 bp, Homo sapiens
tggtcttgccctattataattg

SEQ ID NO: 4810516 - DNA, 11 bp, Homo sapiens
tggtcttggag

SEQ ID NO: 4810517 - DNA, 18 bp, Homo sapiens
tggtcttggagaggaggt

SEQ ID NO: 4810518 - DNA, 12 bp, Homo sapiens
tggtgaaagagt

SEQ ID NO: 4810519 - DNA, 13 bp, Homo sapiens
tggtgaaagagta

SEQ ID NO: 4810520 - DNA, 19 bp, Homo sapiens
tggtgaacagaacaaaagg

SEQ ID NO: 4810521 - DNA, 16 bp, Homo sapiens
tggtgaactgaagcag

SEQ ID NO: 4810522 - DNA, 18 bp, Homo sapiens
tggtgaactgaagcagag

SEQ ID NO: 4810523 - DNA, 16 bp, Homo sapiens
tggtgaaggggctggt

SEQ ID NO: 4810524 - DNA, 19 bp, Homo sapiens
tggtgaaggggctggtgga

SEQ ID NO: 4810525 - DNA, 15 bp, Homo sapiens
tggtgacctttttaa

SEQ ID NO: 4810526 - DNA, 13 bp, Homo sapiens
tggtgactgtccc

SEQ ID NO: 4810527 - DNA, 19 bp, Homo sapiens
tggtgactgtcccaccggg

SEQ ID NO: 4810528 - DNA, 17 bp, Homo sapiens
tggtgcgtgtggccctg

SEQ ID NO: 4810529 - DNA, 16 bp, Homo sapiens
tggtggcaccagatgc

SEQ ID NO: 4810530 - DNA, 16 bp, Homo sapiens
tggtggccctgcgggg

SEQ ID NO: 4810531 - DNA, 22 bp, Homo sapiens
tggtggccgtcacgctttcatg

SEQ ID NO: 4810532 - DNA, 13 bp, Homo sapiens
tggtggtgaaggg

SEQ ID NO: 4810533 - DNA, 17 bp, Homo sapiens
tggtggtttcagaaagg

SEQ ID NO: 4810534 - DNA, 15 bp, Homo sapiens
tggtgtagctgtcct

SEQ ID NO: 4810535 - DNA, 12 bp, Homo sapiens
tggtgtcctctg

SEQ ID NO: 4810536 - DNA, 13 bp, Homo sapiens
tggtgtgaggccc

SEQ ID NO: 4810537 - DNA, 18 bp, Homo sapiens
tggttaatgaaaaatctg

SEQ ID NO: 4810538 - DNA, 19 bp, Homo sapiens
tggttacctattgctgtaa

SEQ ID NO: 4810539 - DNA, 14 bp, Homo sapiens
tggttagtgcatgt

SEQ ID NO: 4810540 - DNA, 16 bp, Homo sapiens
tggttagtgcatgtca

SEQ ID NO: 4810541 - DNA, 13 bp, Homo sapiens
tggttcctccagc

SEQ ID NO: 4810542 - DNA, 17 bp, Homo sapiens
tggttctttcttttctt

SEQ ID NO: 4810543 - DNA, 20 bp, Homo sapiens
tggttgcaattgtttaagaa

SEQ ID NO: 4810544 - DNA, 15 bp, Homo sapiens
tggttgctttgagcc

SEQ ID NO: 4810545 - DNA, 23 bp, Homo sapiens
tggttggaggcctggtctggagc

SEQ ID NO: 4810546 - DNA, 15 bp, Homo sapiens
tggttgtgacttccc

SEQ ID NO: 4810547 - DNA, 14 bp, Homo sapiens
tggtttcagaaagg

SEQ ID NO: 4810548 - DNA, 22 bp, Homo sapiens
tggtttcagaaagggcagcccc

SEQ ID NO: 4810549 - DNA, 23 bp, Homo sapiens
tggtttgaaaatattttcattat

SEQ ID NO: 4810550 - DNA, 19 bp, Homo sapiens
tggttttctctgatggcac

SEQ ID NO: 4810551 - DNA, 15 bp, Homo sapiens
tggttttgcctcttt

SEQ ID NO: 4810552 - DNA, 20 bp, Homo sapiens
tgtaaaacacaagactgtca

SEQ ID NO: 4810553 - DNA, 13 bp, Homo sapiens
tgtaaaactgtga

SEQ ID NO: 4810554 - DNA, 15 bp, Homo sapiens
tgtaaaactgtgaca

SEQ ID NO: 4810555 - DNA, 12 bp, Homo sapiens
tgtaaaacttta

SEQ ID NO: 4810556 - DNA, 23 bp, Homo sapiens
tgtaaaactttattttatataat

SEQ ID NO: 4810557 - DNA, 17 bp, Homo sapiens
tgtaaaatatttataaa

SEQ ID NO: 4810558 - DNA, 14 bp, Homo sapiens
tgtaaaatgtatta

SEQ ID NO: 4810559 - DNA, 19 bp, Homo sapiens
tgtaaaatgtattatgtcc

SEQ ID NO: 4810560 - DNA, 20 bp, Homo sapiens
tttccgtgagagtcatctca

SEQ ID NO: 4810561 - DNA, 14 bp, Homo sapiens
tttcctcctgggca

SEQ ID NO: 4810562 - DNA, 12 bp, Homo sapiens
tttcctctctct

SEQ ID NO: 4810563 - DNA, 14 bp, Homo sapiens
tttcctctctctct

SEQ ID NO: 4810564 - DNA, 23 bp, Homo sapiens
tttcctctctctctctctctctg

SEQ ID NO: 4810565 - DNA, 24 bp, Homo sapiens
tttcctctctctctctctctctgt

SEQ ID NO: 4810566 - DNA, 23 bp, Homo sapiens
tttcctctgaggatgatgtactt

SEQ ID NO: 4810567 - DNA, 18 bp, Homo sapiens
tttcctgaggtcatctgt

SEQ ID NO: 4810568 - DNA, 22 bp, Homo sapiens
tttcctgggagtgggagtcaag

SEQ ID NO: 4810569 - DNA, 21 bp, Homo sapiens
tttccttagcttaatgactta

SEQ ID NO: 4810570 - DNA, 18 bp, Homo sapiens
tttccttctgatctgaga

SEQ ID NO: 4810571 - DNA, 19 bp, Homo sapiens
tttcctttcttccttcctt

SEQ ID NO: 4810572 - DNA, 21 bp, Homo sapiens
tttccttttctattccttctg

SEQ ID NO: 4810573 - DNA, 17 bp, Homo sapiens
tgggtcaccttcctggg

SEQ ID NO: 4810574 - DNA, 12 bp, Homo sapiens
tgggtccctgcg

SEQ ID NO: 4810575 - DNA, 16 bp, Homo sapiens
tgggtcctcccagctg

SEQ ID NO: 4810576 - DNA, 17 bp, Homo sapiens
tgggtcctcggccctgt

SEQ ID NO: 4810577 - DNA, 15 bp, Homo sapiens
tgggtcctgctgctc

SEQ ID NO: 4810578 - DNA, 16 bp, Homo sapiens
tgggtcctgctgctcg

SEQ ID NO: 4810579 - DNA, 13 bp, Homo sapiens
tgggtcgcccctc

SEQ ID NO: 4810580 - DNA, 17 bp, Homo sapiens
tgggtcgcccctcctcg

SEQ ID NO: 4810581 - DNA, 17 bp, Homo sapiens
tgggtgctcagggcatg

SEQ ID NO: 4810582 - DNA, 21 bp, Homo sapiens
tgggtgctcagggcatgctta

SEQ ID NO: 4810583 - DNA, 20 bp, Homo sapiens
tgggtgggccccacagtggt

SEQ ID NO: 4810584 - DNA, 23 bp, Homo sapiens
tgggttgggcacggcttatacca

SEQ ID NO: 4810585 - DNA, 16 bp, Homo sapiens
tgggttttagaaattc

SEQ ID NO: 4810586 - DNA, 21 bp, Homo sapiens
tgggttttagaaattctataa

SEQ ID NO: 4810587 - DNA, 19 bp, Homo sapiens
tgggttttgatctcagcat

SEQ ID NO: 4810588 - DNA, 17 bp, Homo sapiens
tggtaaataactgtgac

SEQ ID NO: 4810589 - DNA, 12 bp, Homo sapiens
tggtaagattgt

SEQ ID NO: 4810590 - DNA, 14 bp, Homo sapiens
tggtaagattgtta

SEQ ID NO: 4810591 - DNA, 14 bp, Homo sapiens
tggtaccagccctg

SEQ ID NO: 4810592 - DNA, 18 bp, Homo sapiens
tggtaccagccctggggc

SEQ ID NO: 4810593 - DNA, 19 bp, Homo sapiens
tggtaccagccctggggct

SEQ ID NO: 4810594 - DNA, 16 bp, Homo sapiens
tggtacctctgtctat

SEQ ID NO: 4810595 - DNA, 16 bp, Homo sapiens
tggtatgctggccagc

SEQ ID NO: 4810596 - DNA, 17 bp, Homo sapiens
tggtatgctggccagca

SEQ ID NO: 4810597 - DNA, 22 bp, Homo sapiens
tggtatgctggccagcaccctc

SEQ ID NO: 4810598 - DNA, 22 bp, Homo sapiens
tggtatgcttgcatatatttca

SEQ ID NO: 4810599 - DNA, 15 bp, Homo sapiens
tggtattaaatgcca

SEQ ID NO: 4810600 - DNA, 22 bp, Homo sapiens
tggtatttactgcaatgtctgt

SEQ ID NO: 4810601 - DNA, 18 bp, Homo sapiens
tggtattttaacatagca

SEQ ID NO: 4810602 - DNA, 18 bp, Homo sapiens
tggtcacaaagctattta

SEQ ID NO: 4810603 - DNA, 21 bp, Homo sapiens
tggtcacagacccctggggga

SEQ ID NO: 4810604 - DNA, 22 bp, Homo sapiens
tggtcagtgaagcccaggagga

SEQ ID NO: 4810605 - DNA, 24 bp, Homo sapiens
tggtcagtgaagcccaggaggacc

SEQ ID NO: 4810606 - DNA, 21 bp, Homo sapiens
tggtcatttggtggctctaac

SEQ ID NO: 4810607 - DNA, 20 bp, Homo sapiens
tggtccacacaccacagaag

SEQ ID NO: 4810608 - DNA, 19 bp, Homo sapiens
tggtccagggtccagccct

SEQ ID NO: 4810609 - DNA, 20 bp, Homo sapiens
tggtccagggtccagccctc

SEQ ID NO: 4810610 - DNA, 21 bp, Homo sapiens
tggtcccccatgggctgctgg

SEQ ID NO: 4810611 - DNA, 17 bp, Homo sapiens
tggtcctaatcttctga

SEQ ID NO: 4810612 - DNA, 19 bp, Homo sapiens
tggtcctaatcttctgaac

SEQ ID NO: 4810613 - DNA, 12 bp, Homo sapiens
tggtcctgcact

SEQ ID NO: 4810614 - DNA, 13 bp, Homo sapiens
tggtctctttctt

SEQ ID NO: 4810615 - DNA, 16 bp, Homo sapiens
tggtctctttctttcc

SEQ ID NO: 4810616 - DNA, 17 bp, Homo sapiens
tggtctctttctttcca

SEQ ID NO: 4810617 - DNA, 20 bp, Homo sapiens
tggtctctttctttccaaag

SEQ ID NO: 4810618 - DNA, 14 bp, Homo sapiens
tggtctgtgtgtga

SEQ ID NO: 4810619 - DNA, 22 bp, Homo sapiens
tggtctgtgttctcaacacaca

SEQ ID NO: 4810620 - DNA, 22 bp, Homo sapiens
tggtcttaactaatgtaaatat

SEQ ID NO: 4810621 - DNA, 19 bp, Homo sapiens
tggtcttcaaattgtcttt

SEQ ID NO: 4810622 - DNA, 21 bp, Homo sapiens
tggtgaaagagtaaaaccaaa

SEQ ID NO: 4810623 - DNA, 21 bp, Homo sapiens
tggtgaactgaagcagagtca

SEQ ID NO: 4810624 - DNA, 19 bp, Homo sapiens
tggtgaggttgtgctgcct

SEQ ID NO: 4810625 - DNA, 12 bp, Homo sapiens
tggtgcagtgaa

SEQ ID NO: 4810626 - DNA, 14 bp, Homo sapiens
tggtgcagtgaaga

SEQ ID NO: 4810627 - DNA, 13 bp, Homo sapiens
tggtggaggtggg

SEQ ID NO: 4810628 - DNA, 16 bp, Homo sapiens
tggtggcaataaatgt

SEQ ID NO: 4810629 - DNA, 21 bp, Homo sapiens
tggtggcaccagatgcaacct

SEQ ID NO: 4810630 - DNA, 16 bp, Homo sapiens
tggtgggctccagagt

SEQ ID NO: 4810631 - DNA, 14 bp, Homo sapiens
tggtggtttcagaa

SEQ ID NO: 4810632 - DNA, 13 bp, Homo sapiens
tggtgtcctctgt

SEQ ID NO: 4810633 - DNA, 18 bp, Homo sapiens
tggtgtgaggcccccgga

SEQ ID NO: 4810634 - DNA, 17 bp, Homo sapiens
tggttaaaggtctccca

SEQ ID NO: 4810635 - DNA, 14 bp, Homo sapiens
tggttaatgaaaaa

SEQ ID NO: 4810636 - DNA, 19 bp, Homo sapiens
tggttaatgaaaaatctga

SEQ ID NO: 4810637 - DNA, 20 bp, Homo sapiens
tggttaatgaaaaatctgaa

SEQ ID NO: 4810638 - DNA, 13 bp, Homo sapiens
tggttatatttca

SEQ ID NO: 4810639 - DNA, 14 bp, Homo sapiens
tggttatgtcccat

SEQ ID NO: 4810640 - DNA, 16 bp, Homo sapiens
tggttatgtcccatga

SEQ ID NO: 4810641 - DNA, 14 bp, Homo sapiens
tggttgcaattgtt

SEQ ID NO: 4810642 - DNA, 14 bp, Homo sapiens
tggttggaggcctg

SEQ ID NO: 4810643 - DNA, 23 bp, Homo sapiens
tggttgtctctcttcggtggcct

SEQ ID NO: 4810644 - DNA, 21 bp, Homo sapiens
tggtttagaatgctgcgctta

SEQ ID NO: 4810645 - DNA, 22 bp, Homo sapiens
tggtttagcgttgttttgtgga

SEQ ID NO: 4810646 - DNA, 12 bp, Homo sapiens
tggttttctcct

SEQ ID NO: 4810647 - DNA, 19 bp, Homo sapiens
tggttttcttgtgtgttta

SEQ ID NO: 4810648 - DNA, 17 bp, Homo sapiens
tggttttgcctctttaa

SEQ ID NO: 4810649 - DNA, 21 bp, Homo sapiens
tggttttgcctctttaaatta

SEQ ID NO: 4810650 - DNA, 14 bp, Homo sapiens
tgtaaaactgtgac

SEQ ID NO: 4810651 - DNA, 22 bp, Homo sapiens
tgtaaaactgtgacattccaca

SEQ ID NO: 4810652 - DNA, 23 bp, Homo sapiens
tgtaaaactgtgacattccacag

SEQ ID NO: 4810653 - DNA, 16 bp, Homo sapiens
tgtaaaactttatttt

SEQ ID NO: 4810654 - DNA, 13 bp, Homo sapiens
tgtaaaagagctg

SEQ ID NO: 4810655 - DNA, 20 bp, Homo sapiens
tgtaaaatatttataaatga

SEQ ID NO: 4810656 - DNA, 13 bp, Homo sapiens
tgtaaaatgtatt

SEQ ID NO: 4810657 - DNA, 18 bp, Homo sapiens
tgtaaagatattgtatct

SEQ ID NO: 4810658 - DNA, 22 bp, Homo sapiens
tgtaaagatattgtatctcctt

SEQ ID NO: 4810659 - DNA, 17 bp, Homo sapiens
tgtaaaggtaggtgcat

SEQ ID NO: 4810660 - DNA, 20 bp, Homo sapiens
tgtaaaggtaggtgcatgcc

SEQ ID NO: 4810661 - DNA, 18 bp, Homo sapiens
tgtaaaggtgatgaattt

SEQ ID NO: 4810662 - DNA, 14 bp, Homo sapiens
tgtaaataatgctt

SEQ ID NO: 4810663 - DNA, 15 bp, Homo sapiens
tgtaaataatgctta

SEQ ID NO: 4810664 - DNA, 11 bp, Homo sapiens
tgtaaatatag

SEQ ID NO: 4810665 - DNA, 22 bp, Homo sapiens
tgtaaatattgctgtctgaaaa

SEQ ID NO: 4810666 - DNA, 20 bp, Homo sapiens
tgtaaatgatatgtctttaa

SEQ ID NO: 4810667 - DNA, 21 bp, Homo sapiens
tgtaaatgatatgtctttaaa

SEQ ID NO: 4810668 - DNA, 22 bp, Homo sapiens
tgtaaatgatatgtctttaaaa

SEQ ID NO: 4810669 - DNA, 16 bp, Homo sapiens
tgtaaattcctgttgt

SEQ ID NO: 4810670 - DNA, 22 bp, Homo sapiens
tgtaaattgactgtactaggcc

SEQ ID NO: 4810671 - DNA, 11 bp, Homo sapiens
tgtaacacaag

SEQ ID NO: 4810672 - DNA, 11 bp, Homo sapiens
tgtaactcttt

SEQ ID NO: 4810673 - DNA, 16 bp, Homo sapiens
tgtaactgttacagta

SEQ ID NO: 4810674 - DNA, 18 bp, Homo sapiens
tgtaactgttacagtaat

SEQ ID NO: 4810675 - DNA, 22 bp, Homo sapiens
tgtaactttattggtcttgccc

SEQ ID NO: 4810676 - DNA, 18 bp, Homo sapiens
tgtaagacacgtgcaaca

SEQ ID NO: 4810677 - DNA, 16 bp, Homo sapiens
tgtaagcaattctaag

SEQ ID NO: 4810678 - DNA, 14 bp, Homo sapiens
tgtaaggaatgatt

SEQ ID NO: 4810679 - DNA, 18 bp, Homo sapiens
tgtaatacaccaaatagc

SEQ ID NO: 4810680 - DNA, 14 bp, Homo sapiens
tgtaatataagaca

SEQ ID NO: 4810681 - DNA, 17 bp, Homo sapiens
tgtaatataagacaagt

SEQ ID NO: 4810682 - DNA, 12 bp, Homo sapiens
tgtaatatcagt

SEQ ID NO: 4810683 - DNA, 16 bp, Homo sapiens
tgtaatatcagttaca

SEQ ID NO: 4810684 - DNA, 17 bp, Homo sapiens
tgtaatattaaattcct

SEQ ID NO: 4810685 - DNA, 14 bp, Homo sapiens
tgtaatatttacaa

SEQ ID NO: 4810686 - DNA, 17 bp, Homo sapiens
tgtaatatttacaatgt

SEQ ID NO: 4810687 - DNA, 19 bp, Homo sapiens
tgtaatatttacaatgtat

SEQ ID NO: 4810688 - DNA, 21 bp, Homo sapiens
tgtaatatttacaatgtatta

SEQ ID NO: 4810689 - DNA, 16 bp, Homo sapiens
tgtaatcataaatact

SEQ ID NO: 4810690 - DNA, 14 bp, Homo sapiens
tgtaatcttgttga

SEQ ID NO: 4810691 - DNA, 19 bp, Homo sapiens
tgtaattcttctcctttgt

SEQ ID NO: 4810692 - DNA, 22 bp, Homo sapiens
tgtaattcttctcctttgtcaa

SEQ ID NO: 4810693 - DNA, 23 bp, Homo sapiens
tgtaattcttctcctttgtcaaa

SEQ ID NO: 4810694 - DNA, 17 bp, Homo sapiens
tgtaatttcctgctcct

SEQ ID NO: 4810695 - DNA, 21 bp, Homo sapiens
tgtacaattactgtgagaact

SEQ ID NO: 4810696 - DNA, 13 bp, Homo sapiens
tgtacacatatga

SEQ ID NO: 4810697 - DNA, 21 bp, Homo sapiens
tgtacagaaccagcactccca

SEQ ID NO: 4810698 - DNA, 22 bp, Homo sapiens
tgtacagaaccagcactcccag

SEQ ID NO: 4810699 - DNA, 23 bp, Homo sapiens
tgtacagaaccagcactcccagg

SEQ ID NO: 4810700 - DNA, 24 bp, Homo sapiens
tgtacagaaccagcactcccaggg

SEQ ID NO: 4810701 - DNA, 17 bp, Homo sapiens
tgtacagaatcattgct

SEQ ID NO: 4810702 - DNA, 16 bp, Homo sapiens
tgtacaggctgagaca

SEQ ID NO: 4810703 - DNA, 15 bp, Homo sapiens
tgtacagttatacat

SEQ ID NO: 4810704 - DNA, 17 bp, Homo sapiens
tgtacatagtggtcatt

SEQ ID NO: 4810705 - DNA, 17 bp, Homo sapiens
tgtacatatggaaatcc

SEQ ID NO: 4810706 - DNA, 22 bp, Homo sapiens
tgtacatatggaaatcctgtta

SEQ ID NO: 4810707 - DNA, 24 bp, Homo sapiens
tgtacatttgatttgatatacaga

SEQ ID NO: 4810708 - DNA, 13 bp, Homo sapiens
tgtaccagcccag

SEQ ID NO: 4810709 - DNA, 13 bp, Homo sapiens
tgtaccatgttaa

SEQ ID NO: 4810710 - DNA, 14 bp, Homo sapiens
tgtaccatgttaaa

SEQ ID NO: 4810711 - DNA, 17 bp, Homo sapiens
tgtaccatgttaaagag

SEQ ID NO: 4810712 - DNA, 17 bp, Homo sapiens
tgtacgttaattaaaca

SEQ ID NO: 4810713 - DNA, 17 bp, Homo sapiens
tgtacgttcttctattg

SEQ ID NO: 4810714 - DNA, 19 bp, Homo sapiens
tgtactatggctgtatttt

SEQ ID NO: 4810715 - DNA, 23 bp, Homo sapiens
tgtacttacactgaaatccaaaa

SEQ ID NO: 4810716 - DNA, 17 bp, Homo sapiens
tgtacttcagttctcat

SEQ ID NO: 4810717 - DNA, 14 bp, Homo sapiens
tgtacttgaataat

SEQ ID NO: 4810718 - DNA, 16 bp, Homo sapiens
tgtacttgaataataa

SEQ ID NO: 4810719 - DNA, 18 bp, Homo sapiens
tgtagaaacacagcctat

SEQ ID NO: 4810720 - DNA, 17 bp, Homo sapiens
tgtagacgcacctgctg

SEQ ID NO: 4810721 - DNA, 16 bp, Homo sapiens
tgtagattgtgtaaat

SEQ ID NO: 4810722 - DNA, 17 bp, Homo sapiens
tgtagcaaattccaata

SEQ ID NO: 4810723 - DNA, 20 bp, Homo sapiens
tgtagcaaattccaatacat

SEQ ID NO: 4810724 - DNA, 22 bp, Homo sapiens
tgtagcaaattccaatacatta

SEQ ID NO: 4810725 - DNA, 12 bp, Homo sapiens
tgtagccctggc

SEQ ID NO: 4810726 - DNA, 13 bp, Homo sapiens
tgtagccctggcc

SEQ ID NO: 4810727 - DNA, 19 bp, Homo sapiens
tgtagcctaatattcatgc

SEQ ID NO: 4810728 - DNA, 21 bp, Homo sapiens
tgtagcctaatattcatgctg

SEQ ID NO: 4810729 - DNA, 13 bp, Homo sapiens
tgtagcctggtct

SEQ ID NO: 4810730 - DNA, 14 bp, Homo sapiens
tgtagcctggtctg

SEQ ID NO: 4810731 - DNA, 23 bp, Homo sapiens
tgtagctctgaatgctatttgtg

SEQ ID NO: 4810732 - DNA, 12 bp, Homo sapiens
tgtagctgtcct

SEQ ID NO: 4810733 - DNA, 16 bp, Homo sapiens
tgtagcttcagtcatt

SEQ ID NO: 4810734 - DNA, 18 bp, Homo sapiens
tgtagcttcagtcattaa

SEQ ID NO: 4810735 - DNA, 15 bp, Homo sapiens
tgtaggaaatctgaa

SEQ ID NO: 4810736 - DNA, 21 bp, Homo sapiens
tgtaggaaatctgaagccttt

SEQ ID NO: 4810737 - DNA, 18 bp, Homo sapiens
tgtagtaattgttacaat

SEQ ID NO: 4810738 - DNA, 15 bp, Homo sapiens
tgtagtagttgatga

SEQ ID NO: 4810739 - DNA, 17 bp, Homo sapiens
tgtagtcccggaggcct

SEQ ID NO: 4810740 - DNA, 15 bp, Homo sapiens
tgtataaaaaagaaa

SEQ ID NO: 4810741 - DNA, 22 bp, Homo sapiens
tgtataagatgctgctgagcac

SEQ ID NO: 4810742 - DNA, 21 bp, Homo sapiens
tgtataaggtaataaaactct

SEQ ID NO: 4810743 - DNA, 20 bp, Homo sapiens
tgtataatactttgtataca

SEQ ID NO: 4810744 - DNA, 17 bp, Homo sapiens
tgtatacaaacaggtgc

SEQ ID NO: 4810745 - DNA, 19 bp, Homo sapiens
tgtatacaagtactggtaa

SEQ ID NO: 4810746 - DNA, 13 bp, Homo sapiens
tgtatacacacac

SEQ ID NO: 4810747 - DNA, 16 bp, Homo sapiens
tgtatacatatgtatg

SEQ ID NO: 4810748 - DNA, 20 bp, Homo sapiens
tgtatacatatgtatgtgtg

SEQ ID NO: 4810749 - DNA, 20 bp, Homo sapiens
tgtatagtgagtgtggctta

SEQ ID NO: 4810750 - DNA, 12 bp, Homo sapiens
tgtatatagatg

SEQ ID NO: 4810751 - DNA, 17 bp, Homo sapiens
tgtatatagatgtctgt

SEQ ID NO: 4810752 - DNA, 21 bp, Homo sapiens
tgtatatagatgtctgtgtat

SEQ ID NO: 4810753 - DNA, 23 bp, Homo sapiens
tgtatatagatgtctgtgtatac

SEQ ID NO: 4810754 - DNA, 18 bp, Homo sapiens
tgtatatattatatatac

SEQ ID NO: 4810755 - DNA, 19 bp, Homo sapiens
tgtatatattatatataca

SEQ ID NO: 4810756 - DNA, 18 bp, Homo sapiens
tgtatatatttattattt

SEQ ID NO: 4810757 - DNA, 16 bp, Homo sapiens
tgtatatcagctctaa

SEQ ID NO: 4810758 - DNA, 13 bp, Homo sapiens
tgtatatcgttat

SEQ ID NO: 4810759 - DNA, 19 bp, Homo sapiens
tgtatatcgttatcactgt

SEQ ID NO: 4810760 - DNA, 13 bp, Homo sapiens
tgtatatctgtgt

SEQ ID NO: 4810761 - DNA, 14 bp, Homo sapiens
tgtatatctgtgta

SEQ ID NO: 4810762 - DNA, 21 bp, Homo sapiens
tgtatattgatgtaactgtgt

SEQ ID NO: 4810763 - DNA, 13 bp, Homo sapiens
tgtatatttgtat

SEQ ID NO: 4810764 - DNA, 17 bp, Homo sapiens
tgtatatttgtatgata

SEQ ID NO: 4810765 - DNA, 18 bp, Homo sapiens
tgtatatttgtatgatat

SEQ ID NO: 4810766 - DNA, 15 bp, Homo sapiens
tgtatcaaactagtg

SEQ ID NO: 4810767 - DNA, 18 bp, Homo sapiens
tgtatcagtgtttatgtg

SEQ ID NO: 4810768 - DNA, 14 bp, Homo sapiens
tgtatgaaatatat

SEQ ID NO: 4810769 - DNA, 16 bp, Homo sapiens
tgtatgcggaattcca

SEQ ID NO: 4810770 - DNA, 15 bp, Homo sapiens
tgtatgtacttacat

SEQ ID NO: 4810771 - DNA, 14 bp, Homo sapiens
tgtatgtatacaca

SEQ ID NO: 4810772 - DNA, 20 bp, Homo sapiens
tgtatgtctatgtgtatata

SEQ ID NO: 4810773 - DNA, 18 bp, Homo sapiens
tgtatgtgtgagtgtatg

SEQ ID NO: 4810774 - DNA, 21 bp, Homo sapiens
tgtatgtgtgagtgtatgtat

SEQ ID NO: 4810775 - DNA, 20 bp, Homo sapiens
tgtatgttttttactgtttg

SEQ ID NO: 4810776 - DNA, 16 bp, Homo sapiens
tgtattaagctccagt

SEQ ID NO: 4810777 - DNA, 18 bp, Homo sapiens
tgtattacataaataaat

SEQ ID NO: 4810778 - DNA, 15 bp, Homo sapiens
tgtattatcagtgaa

SEQ ID NO: 4810779 - DNA, 17 bp, Homo sapiens
tgtattatcagtgaata

SEQ ID NO: 4810780 - DNA, 20 bp, Homo sapiens
tgtattatgtcctgtgagat

SEQ ID NO: 4810781 - DNA, 18 bp, Homo sapiens
tgtattggaagtatagat

SEQ ID NO: 4810782 - DNA, 20 bp, Homo sapiens
tgtattggtttctgtttgaa

SEQ ID NO: 4810783 - DNA, 23 bp, Homo sapiens
tgtatttacttgttatgttgtaa

SEQ ID NO: 4810784 - DNA, 15 bp, Homo sapiens
tgtatttgaggaaac

SEQ ID NO: 4810785 - DNA, 23 bp, Homo sapiens
tgtatttgaggaaactcatacag

SEQ ID NO: 4810786 - DNA, 14 bp, Homo sapiens
tgtatttgtagtgt

SEQ ID NO: 4810787 - DNA, 22 bp, Homo sapiens
tgtattttcttcccatttgtaa

SEQ ID NO: 4810788 - DNA, 21 bp, Homo sapiens
tgtatttttcctctttcactt

SEQ ID NO: 4810789 - DNA, 15 bp, Homo sapiens
tgtcaaagtggtgag

SEQ ID NO: 4810790 - DNA, 16 bp, Homo sapiens
tgtcaaatccatgtgt

SEQ ID NO: 4810791 - DNA, 23 bp, Homo sapiens
tgtcaaatggtattttttgtgaa

SEQ ID NO: 4810792 - DNA, 19 bp, Homo sapiens
tgtcaacctgaattaaagt

SEQ ID NO: 4810793 - DNA, 14 bp, Homo sapiens
tgtcaacttcagtt

SEQ ID NO: 4810794 - DNA, 22 bp, Homo sapiens
tgtcaacttcagttgaaaagag

SEQ ID NO: 4810795 - DNA, 19 bp, Homo sapiens
tgtcaatatatagagactt

SEQ ID NO: 4810796 - DNA, 13 bp, Homo sapiens
tgtcaatgtgtgc

SEQ ID NO: 4810797 - DNA, 19 bp, Homo sapiens
tgtcaattacaggaagtac

SEQ ID NO: 4810798 - DNA, 21 bp, Homo sapiens
tgtcaatttggtttagaatgc

SEQ ID NO: 4810799 - DNA, 20 bp, Homo sapiens
tgtcaatttttaacttatct

SEQ ID NO: 4810800 - DNA, 12 bp, Homo sapiens
tgtcacagttct

SEQ ID NO: 4810801 - DNA, 18 bp, Homo sapiens
tgtcacatgacatccaca

SEQ ID NO: 4810802 - DNA, 14 bp, Homo sapiens
tgtcaccagctatc

SEQ ID NO: 4810803 - DNA, 22 bp, Homo sapiens
tgtcaccagctgccaaaatcgt

SEQ ID NO: 4810804 - DNA, 14 bp, Homo sapiens
tgtcacgtgaccct

SEQ ID NO: 4810805 - DNA, 17 bp, Homo sapiens
tgtcacgtgaccctgtg

SEQ ID NO: 4810806 - DNA, 19 bp, Homo sapiens
tgtcacgtgaccctgtgcc

SEQ ID NO: 4810807 - DNA, 20 bp, Homo sapiens
tgtcacgtgaccctgtgccc

SEQ ID NO: 4810808 - DNA, 23 bp, Homo sapiens
tgtcactaccctcctgtaaaata

SEQ ID NO: 4810809 - DNA, 15 bp, Homo sapiens
tgtcacttttttcct

SEQ ID NO: 4810810 - DNA, 22 bp, Homo sapiens
tgtcacttttttcctgtcaata

SEQ ID NO: 4810811 - DNA, 12 bp, Homo sapiens
tgtcagagatgt

SEQ ID NO: 4810812 - DNA, 20 bp, Homo sapiens
tgtcagccagccgccctggg

SEQ ID NO: 4810813 - DNA, 15 bp, Homo sapiens
tgtcagcttcccaac

SEQ ID NO: 4810814 - DNA, 23 bp, Homo sapiens
tgtcaggctctgaatctctcaaa

SEQ ID NO: 4810815 - DNA, 17 bp, Homo sapiens
tgtcagtcgtgttgctt

SEQ ID NO: 4810816 - DNA, 14 bp, Homo sapiens
tgtcagtgtgactg

SEQ ID NO: 4810817 - DNA, 15 bp, Homo sapiens
tgtcagtgtgactga

SEQ ID NO: 4810818 - DNA, 16 bp, Homo sapiens
tgtcagtgtgactgat

SEQ ID NO: 4810819 - DNA, 19 bp, Homo sapiens
tgtcagtgtgactgatctc

SEQ ID NO: 4810820 - DNA, 15 bp, Homo sapiens
tgtcagtttgtgaag

SEQ ID NO: 4810821 - DNA, 19 bp, Homo sapiens
tggccccagctggctgggt

SEQ ID NO: 4810822 - DNA, 20 bp, Homo sapiens
tggccccagctggctgggtc

SEQ ID NO: 4810823 - DNA, 13 bp, Homo sapiens
tggccccagtgac

SEQ ID NO: 4810824 - DNA, 18 bp, Homo sapiens
tggccccctcgcgcccct

SEQ ID NO: 4810825 - DNA, 18 bp, Homo sapiens
tggcccctccttctcccc

SEQ ID NO: 4810826 - DNA, 17 bp, Homo sapiens
tggccctcgggccctct

SEQ ID NO: 4810827 - DNA, 21 bp, Homo sapiens
tggccctcgggccctctctcc

SEQ ID NO: 4810828 - DNA, 19 bp, Homo sapiens
tggccctgtgggagtccac

SEQ ID NO: 4810829 - DNA, 20 bp, Homo sapiens
tggccctgtgggagtccact

SEQ ID NO: 4810830 - DNA, 12 bp, Homo sapiens
tggcccttcctt

SEQ ID NO: 4810831 - DNA, 15 bp, Homo sapiens
tggcccttccttcac

SEQ ID NO: 4810832 - DNA, 19 bp, Homo sapiens
tggccgcaacttcccaggc

SEQ ID NO: 4810833 - DNA, 12 bp, Homo sapiens
tggccggctggc

SEQ ID NO: 4810834 - DNA, 15 bp, Homo sapiens
tggcctaatccacct

SEQ ID NO: 4810835 - DNA, 16 bp, Homo sapiens
tggcctaatccacctg

SEQ ID NO: 4810836 - DNA, 19 bp, Homo sapiens
tggcctacaaatcagtaat

SEQ ID NO: 4810837 - DNA, 18 bp, Homo sapiens
tggcctaccacagctgcc

SEQ ID NO: 4810838 - DNA, 17 bp, Homo sapiens
tggcctagcccaccctg

SEQ ID NO: 4810839 - DNA, 23 bp, Homo sapiens
tggcctagcccaccctgctgcct

SEQ ID NO: 4810840 - DNA, 14 bp, Homo sapiens
tggcctatgaccct

SEQ ID NO: 4810841 - DNA, 15 bp, Homo sapiens
tggcctatgaccctg

SEQ ID NO: 4810842 - DNA, 19 bp, Homo sapiens
tggcctatgaccctgtgcc

SEQ ID NO: 4810843 - DNA, 23 bp, Homo sapiens
tggcctatgaccctgtgcctgtg

SEQ ID NO: 4810844 - DNA, 13 bp, Homo sapiens
tggcctcagccct

SEQ ID NO: 4810845 - DNA, 17 bp, Homo sapiens
tggcctcagccctcaga

SEQ ID NO: 4810846 - DNA, 13 bp, Homo sapiens
tggcctctgcccc

SEQ ID NO: 4810847 - DNA, 20 bp, Homo sapiens
tggcctgagaattgagggga

SEQ ID NO: 4810848 - DNA, 13 bp, Homo sapiens
tggcctggcctgg

SEQ ID NO: 4810849 - DNA, 17 bp, Homo sapiens
tggcctggcctggccct

SEQ ID NO: 4810850 - DNA, 18 bp, Homo sapiens
tggcctggcctggccctg

SEQ ID NO: 4810851 - DNA, 14 bp, Homo sapiens
tggcctgggtcctc

SEQ ID NO: 4810852 - DNA, 20 bp, Homo sapiens
tggcctgggtcctcggccct

SEQ ID NO: 4810853 - DNA, 18 bp, Homo sapiens
tggcctgtccctagggct

SEQ ID NO: 4810854 - DNA, 18 bp, Homo sapiens
tggccttggttcctccag

SEQ ID NO: 4810855 - DNA, 20 bp, Homo sapiens
tggccttggttcctccagca

SEQ ID NO: 4810856 - DNA, 15 bp, Homo sapiens
tggcgagtccagaca

SEQ ID NO: 4810857 - DNA, 19 bp, Homo sapiens
tggcgagtccagacaccat

SEQ ID NO: 4810858 - DNA, 16 bp, Homo sapiens
tggcgctgcccctggc

SEQ ID NO: 4810859 - DNA, 12 bp, Homo sapiens
tggcgggcagcc

SEQ ID NO: 4810860 - DNA, 14 bp, Homo sapiens
tggcgggcagcccc

SEQ ID NO: 4810861 - DNA, 18 bp, Homo sapiens
tggcgggctggtgacctt

SEQ ID NO: 4810862 - DNA, 21 bp, Homo sapiens
tggcggggtctgctcctggga

SEQ ID NO: 4810863 - DNA, 22 bp, Homo sapiens
tggctatgttttggagagagca

SEQ ID NO: 4810864 - DNA, 21 bp, Homo sapiens
tggctattgtccttgtgtatc

SEQ ID NO: 4810865 - DNA, 12 bp, Homo sapiens
tggctcacagcc

SEQ ID NO: 4810866 - DNA, 15 bp, Homo sapiens
tggctcacagccacc

SEQ ID NO: 4810867 - DNA, 17 bp, Homo sapiens
tggctcacagccaccac

SEQ ID NO: 4810868 - DNA, 22 bp, Homo sapiens
tggctcacagccaccacctgga

SEQ ID NO: 4810869 - DNA, 18 bp, Homo sapiens
tggctcccagggtcctgg

SEQ ID NO: 4810870 - DNA, 17 bp, Homo sapiens
tggctctaactccttga

SEQ ID NO: 4810871 - DNA, 19 bp, Homo sapiens
tggctgaaattatgtcaaa

SEQ ID NO: 4810872 - DNA, 11 bp, Homo sapiens
tggctgaagaa

SEQ ID NO: 4810873 - DNA, 15 bp, Homo sapiens
tggctggatgtgcat

SEQ ID NO: 4810874 - DNA, 23 bp, Homo sapiens
tggctggatgtgcatctggccta

SEQ ID NO: 4810875 - DNA, 19 bp, Homo sapiens
tggctgggtcgcccctcct

SEQ ID NO: 4810876 - DNA, 17 bp, Homo sapiens
tggctgggtttgggcag

SEQ ID NO: 4810877 - DNA, 13 bp, Homo sapiens
tggctgtattttt

SEQ ID NO: 4810878 - DNA, 16 bp, Homo sapiens
tggctgtcccctgcaa

SEQ ID NO: 4810879 - DNA, 17 bp, Homo sapiens
tggctgtcccctgcaag

SEQ ID NO: 4810880 - DNA, 14 bp, Homo sapiens
tggcttaaacattt

SEQ ID NO: 4810881 - DNA, 11 bp, Homo sapiens
tggcttaattc

SEQ ID NO: 4810882 - DNA, 21 bp, Homo sapiens
tggcttcaccgcattccaggg

SEQ ID NO: 4810883 - DNA, 13 bp, Homo sapiens
tggcttcagaatt

SEQ ID NO: 4810884 - DNA, 18 bp, Homo sapiens
tggcttcccaggaccctg

SEQ ID NO: 4810885 - DNA, 20 bp, Homo sapiens
tggcttcccaggaccctggg

SEQ ID NO: 4810886 - DNA, 15 bp, Homo sapiens
tggcttcccatgtct

SEQ ID NO: 4810887 - DNA, 18 bp, Homo sapiens
tggcttccgtgagacaca

SEQ ID NO: 4810888 - DNA, 14 bp, Homo sapiens
tggcttcctcctga

SEQ ID NO: 4810889 - DNA, 21 bp, Homo sapiens
tggcttctgggacaggcacca

SEQ ID NO: 4810890 - DNA, 22 bp, Homo sapiens
tgggaaagaccctaggtgctca

SEQ ID NO: 4810891 - DNA, 16 bp, Homo sapiens
tgggaaaggcagggcc

SEQ ID NO: 4810892 - DNA, 15 bp, Homo sapiens
tgggaaattcttgca

SEQ ID NO: 4810893 - DNA, 19 bp, Homo sapiens
tgggaaattcttgcactgt

SEQ ID NO: 4810894 - DNA, 12 bp, Homo sapiens
tgggaagaaaca

SEQ ID NO: 4810895 - DNA, 12 bp, Homo sapiens
tgggaagcagtt

SEQ ID NO: 4810896 - DNA, 22 bp, Homo sapiens
tgggaatgaatgtcagtgtgac

SEQ ID NO: 4810897 - DNA, 18 bp, Homo sapiens
tgggaccagggatggggg

SEQ ID NO: 4810898 - DNA, 17 bp, Homo sapiens
tgggaccccattccagt

SEQ ID NO: 4810899 - DNA, 19 bp, Homo sapiens
tgggacctgcttcattcaa

SEQ ID NO: 4810900 - DNA, 12 bp, Homo sapiens
tgggacgcccct

SEQ ID NO: 4810901 - DNA, 14 bp, Homo sapiens
tgggacggaagtgg

SEQ ID NO: 4810902 - DNA, 20 bp, Homo sapiens
tgggacggaagtggcctgag

SEQ ID NO: 4810903 - DNA, 22 bp, Homo sapiens
tgggacggaagtggcctgagaa

SEQ ID NO: 4810904 - DNA, 12 bp, Homo sapiens
tgggactggccc

SEQ ID NO: 4810905 - DNA, 16 bp, Homo sapiens
tgggagaaaagccaga

SEQ ID NO: 4810906 - DNA, 21 bp, Homo sapiens
tgggagaaccaaaaagaggct

SEQ ID NO: 4810907 - DNA, 21 bp, Homo sapiens
tgggagagaagagaatgcaca

SEQ ID NO: 4810908 - DNA, 16 bp, Homo sapiens
tgggagagcccctggg

SEQ ID NO: 4810909 - DNA, 15 bp, Homo sapiens
tgggagatgcagctg

SEQ ID NO: 4810910 - DNA, 17 bp, Homo sapiens
tgggaggaacaaagaca

SEQ ID NO: 4810911 - DNA, 18 bp, Homo sapiens
tgggagtccactttcctc

SEQ ID NO: 4810912 - DNA, 17 bp, Homo sapiens
tgggagttcagctgctt

SEQ ID NO: 4810913 - DNA, 19 bp, Homo sapiens
tgggagttcagctgcttct

SEQ ID NO: 4810914 - DNA, 12 bp, Homo sapiens
tgggatgctcct

SEQ ID NO: 4810915 - DNA, 16 bp, Homo sapiens
tgggcaaggcctttgg

SEQ ID NO: 4810916 - DNA, 15 bp, Homo sapiens
tgggcaaggggccag

SEQ ID NO: 4810917 - DNA, 21 bp, Homo sapiens
tgggcacatagcataggctgg

SEQ ID NO: 4810918 - DNA, 15 bp, Homo sapiens
tgggcacgggagagc

SEQ ID NO: 4810919 - DNA, 18 bp, Homo sapiens
tgggcacgggagagcgcc

SEQ ID NO: 4810920 - DNA, 15 bp, Homo sapiens
tgggcagaaatgtgc

SEQ ID NO: 4810921 - DNA, 12 bp, Homo sapiens
tgggcagcaccc

SEQ ID NO: 4810922 - DNA, 15 bp, Homo sapiens
tgggcagcaccctcc

SEQ ID NO: 4810923 - DNA, 18 bp, Homo sapiens
tgggcagcaccctccccc

SEQ ID NO: 4810924 - DNA, 17 bp, Homo sapiens
tgggcagtggagagggg

SEQ ID NO: 4810925 - DNA, 20 bp, Homo sapiens
tgggcatggtaccagccctg

SEQ ID NO: 4810926 - DNA, 22 bp, Homo sapiens
tgggcatggtaccagccctggg

SEQ ID NO: 4810927 - DNA, 18 bp, Homo sapiens
tgggcattgctggactga

SEQ ID NO: 4810928 - DNA, 14 bp, Homo sapiens
tgggccaagccagg

SEQ ID NO: 4810929 - DNA, 23 bp, Homo sapiens
tgggccaagccagggttccagac

SEQ ID NO: 4810930 - DNA, 14 bp, Homo sapiens
tgggccaggagcct

SEQ ID NO: 4810931 - DNA, 16 bp, Homo sapiens
tgggccaggagcctcc

SEQ ID NO: 4810932 - DNA, 13 bp, Homo sapiens
tgggcccaaggcc

SEQ ID NO: 4810933 - DNA, 19 bp, Homo sapiens
tgggccccacagtggtcag

SEQ ID NO: 4810934 - DNA, 19 bp, Homo sapiens
tgggccccccagctcaggg

SEQ ID NO: 4810935 - DNA, 21 bp, Homo sapiens
tgggcccttagaatgtgaaaa

SEQ ID NO: 4810936 - DNA, 14 bp, Homo sapiens
tgggcctggctccc

SEQ ID NO: 4810937 - DNA, 18 bp, Homo sapiens
tgggcctgggctagggga

SEQ ID NO: 4810938 - DNA, 13 bp, Homo sapiens
tgggcgtgacttc

SEQ ID NO: 4810939 - DNA, 15 bp, Homo sapiens
tgggctcacaccggc

SEQ ID NO: 4810940 - DNA, 21 bp, Homo sapiens
tgggctcacaccggcactgtg

SEQ ID NO: 4810941 - DNA, 14 bp, Homo sapiens
tgggctccagagta

SEQ ID NO: 4810942 - DNA, 18 bp, Homo sapiens
tgggctgaatgtatgtaa

SEQ ID NO: 4810943 - DNA, 14 bp, Homo sapiens
tgggctggcaccca

SEQ ID NO: 4810944 - DNA, 15 bp, Homo sapiens
tgggctgtctgtcac

SEQ ID NO: 4810945 - DNA, 15 bp, Homo sapiens
tgggctgtgaggaca

SEQ ID NO: 4810946 - DNA, 19 bp, Homo sapiens
tgggctgtgaggacagggc

SEQ ID NO: 4810947 - DNA, 23 bp, Homo sapiens
tgggcttggggaccagagctgcc

SEQ ID NO: 4810948 - DNA, 18 bp, Homo sapiens
tggggaactcccccagag

SEQ ID NO: 4810949 - DNA, 23 bp, Homo sapiens
tggggaactcccccagaggtgga

SEQ ID NO: 4810950 - DNA, 18 bp, Homo sapiens
tggggacacaggatcctg

SEQ ID NO: 4810951 - DNA, 15 bp, Homo sapiens
tggggaccagagctg

SEQ ID NO: 4810952 - DNA, 17 bp, Homo sapiens
tggggaccagagctgcc

SEQ ID NO: 4810953 - DNA, 15 bp, Homo sapiens
tggggacctcaggcc

SEQ ID NO: 4810954 - DNA, 21 bp, Homo sapiens
tggggacgggggctgcttctc

SEQ ID NO: 4810955 - DNA, 20 bp, Homo sapiens
tggggagaggaactccttgg

SEQ ID NO: 4810956 - DNA, 15 bp, Homo sapiens
tggggagcagtggcc

SEQ ID NO: 4810957 - DNA, 23 bp, Homo sapiens
tggggagcgggggctaactggcc

SEQ ID NO: 4810958 - DNA, 23 bp, Homo sapiens
tggggagggacacagaggacggc

SEQ ID NO: 4810959 - DNA, 14 bp, Homo sapiens
tggggagggcctct

SEQ ID NO: 4810960 - DNA, 16 bp, Homo sapiens
tggggagggcctctgg

SEQ ID NO: 4810961 - DNA, 20 bp, Homo sapiens
tggggagggcctctggacag

SEQ ID NO: 4810962 - DNA, 17 bp, Homo sapiens
tggggagggtgggcgtg

SEQ ID NO: 4810963 - DNA, 20 bp, Homo sapiens
tggggcactgtttcttctca

SEQ ID NO: 4810964 - DNA, 13 bp, Homo sapiens
tggggccagcgct

SEQ ID NO: 4810965 - DNA, 16 bp, Homo sapiens
tggggcccatggcccc

SEQ ID NO: 4810966 - DNA, 14 bp, Homo sapiens
tggggcctgcgggg

SEQ ID NO: 4810967 - DNA, 22 bp, Homo sapiens
tggggcggcctgcagaccctgc

SEQ ID NO: 4810968 - DNA, 16 bp, Homo sapiens
tggggctcctttcccc

SEQ ID NO: 4810969 - DNA, 23 bp, Homo sapiens
tggggctctagggttgctggagc

SEQ ID NO: 4810970 - DNA, 21 bp, Homo sapiens
tggggcttagaatggggcttc

SEQ ID NO: 4810971 - DNA, 16 bp, Homo sapiens
tggggcttggcgtgga

SEQ ID NO: 4810972 - DNA, 18 bp, Homo sapiens
tgggggacgcccagcccc

SEQ ID NO: 4810973 - DNA, 19 bp, Homo sapiens
tgggggagaatggctctgg

SEQ ID NO: 4810974 - DNA, 15 bp, Homo sapiens
tgggggaggcttcca

SEQ ID NO: 4810975 - DNA, 13 bp, Homo sapiens
tgggggcatgggt

SEQ ID NO: 4810976 - DNA, 12 bp, Homo sapiens
tgggggcctctc

SEQ ID NO: 4810977 - DNA, 22 bp, Homo sapiens
tgggggctgctgcactgccctc

SEQ ID NO: 4810978 - DNA, 22 bp, Homo sapiens
tgggggctgttagctcagagga

SEQ ID NO: 4810979 - DNA, 17 bp, Homo sapiens
tggggggcacagccaga

SEQ ID NO: 4810980 - DNA, 16 bp, Homo sapiens
tggggggcaggcctcc

SEQ ID NO: 4810981 - DNA, 14 bp, Homo sapiens
tggggggccgggca

SEQ ID NO: 4810982 - DNA, 20 bp, Homo sapiens
tggggggccgggcaggtcct

SEQ ID NO: 4810983 - DNA, 15 bp, Homo sapiens
tgggggtggcaggca

SEQ ID NO: 4810984 - DNA, 23 bp, Homo sapiens
tgggggtggccatccctgggccc

SEQ ID NO: 4810985 - DNA, 15 bp, Homo sapiens
tggggtatgggagag

SEQ ID NO: 4810986 - DNA, 15 bp, Homo sapiens
tggggtctctgagca

SEQ ID NO: 4810987 - DNA, 16 bp, Homo sapiens
tggggtctctgagcag

SEQ ID NO: 4810988 - DNA, 17 bp, Homo sapiens
tggggtctctgagcagt

SEQ ID NO: 4810989 - DNA, 17 bp, Homo sapiens
tggggtggggacctcag

SEQ ID NO: 4810990 - DNA, 14 bp, Homo sapiens
tggggttttcactt

SEQ ID NO: 4810991 - DNA, 18 bp, Homo sapiens
tggggttttcacttccta

SEQ ID NO: 4810992 - DNA, 22 bp, Homo sapiens
tggggttttgacttgccactgc

SEQ ID NO: 4810993 - DNA, 13 bp, Homo sapiens
tgggtaaataaat

SEQ ID NO: 4810994 - DNA, 15 bp, Homo sapiens
tgggtaaataaatgc

SEQ ID NO: 4810995 - DNA, 16 bp, Homo sapiens
tgggtaaataaatgct

SEQ ID NO: 4810996 - DNA, 18 bp, Homo sapiens
tgggtaaataaatgctgc

SEQ ID NO: 4810997 - DNA, 17 bp, Homo sapiens
tgggtcaactccaaggc

SEQ ID NO: 4810998 - DNA, 22 bp, Homo sapiens
tgccagataaccaagtgagatg

SEQ ID NO: 4810999 - DNA, 18 bp, Homo sapiens
tgccaggaagccagcagg

SEQ ID NO: 4811000 - DNA, 19 bp, Homo sapiens
tgccaggaagccagcaggc

SEQ ID NO: 4811001 - DNA, 20 bp, Homo sapiens
tgccaggaagccagcaggct

SEQ ID NO: 4811002 - DNA, 15 bp, Homo sapiens
tgccaggcagctgca

SEQ ID NO: 4811003 - DNA, 19 bp, Homo sapiens
tgccaggctcccactgccc

SEQ ID NO: 4811004 - DNA, 16 bp, Homo sapiens
tgccaggctgcaggga

SEQ ID NO: 4811005 - DNA, 18 bp, Homo sapiens
tgccagtggtggaggtgg

SEQ ID NO: 4811006 - DNA, 20 bp, Homo sapiens
tgccataacttgtttgtaaa

SEQ ID NO: 4811007 - DNA, 17 bp, Homo sapiens
tgccatgatctgtattt

SEQ ID NO: 4811008 - DNA, 16 bp, Homo sapiens
tgccatgtaggctaag

SEQ ID NO: 4811009 - DNA, 18 bp, Homo sapiens
tgccatgtaggctaagaa

SEQ ID NO: 4811010 - DNA, 16 bp, Homo sapiens
tgccatgtatgttgca

SEQ ID NO: 4811011 - DNA, 19 bp, Homo sapiens
tgccatgtatgttgcatga

SEQ ID NO: 4811012 - DNA, 14 bp, Homo sapiens
tgccatgtgtgagt

SEQ ID NO: 4811013 - DNA, 14 bp, Homo sapiens
tgccattttgtctg

SEQ ID NO: 4811014 - DNA, 16 bp, Homo sapiens
tgccattttgtctggc

SEQ ID NO: 4811015 - DNA, 20 bp, Homo sapiens
tgccattttgtctggctgtg

SEQ ID NO: 4811016 - DNA, 22 bp, Homo sapiens
tgccattttgtctggctgtggc

SEQ ID NO: 4811017 - DNA, 19 bp, Homo sapiens
tgccattttttgtctgtga

SEQ ID NO: 4811018 - DNA, 20 bp, Homo sapiens
tgccattttttgtctgtgat

SEQ ID NO: 4811019 - DNA, 16 bp, Homo sapiens
tgcccaccctgggcct

SEQ ID NO: 4811020 - DNA, 17 bp, Homo sapiens
tgcccaccctgggcctc

SEQ ID NO: 4811021 - DNA, 20 bp, Homo sapiens
tgcccaccctgggcctcccg

SEQ ID NO: 4811022 - DNA, 16 bp, Homo sapiens
tgcccagcacctcctc

SEQ ID NO: 4811023 - DNA, 17 bp, Homo sapiens
tgcccagcacctcctcc

SEQ ID NO: 4811024 - DNA, 24 bp, Homo sapiens
tgcccagcggctcttcctggacag

SEQ ID NO: 4811025 - DNA, 19 bp, Homo sapiens
tgcccaggcagtctttgct

SEQ ID NO: 4811026 - DNA, 15 bp, Homo sapiens
tgcccaggccggcca

SEQ ID NO: 4811027 - DNA, 21 bp, Homo sapiens
tgcccaggccggccagcctca

SEQ ID NO: 4811028 - DNA, 22 bp, Homo sapiens
tgcccatgtgtcccctcactct

SEQ ID NO: 4811029 - DNA, 22 bp, Homo sapiens
tgccccacacaggcctggccca

SEQ ID NO: 4811030 - DNA, 12 bp, Homo sapiens
tgccccagagaa

SEQ ID NO: 4811031 - DNA, 18 bp, Homo sapiens
tgcccccacagatccatc

SEQ ID NO: 4811032 - DNA, 11 bp, Homo sapiens
tgcccccagcg

SEQ ID NO: 4811033 - DNA, 20 bp, Homo sapiens
tgccccccatgccctccctg

SEQ ID NO: 4811034 - DNA, 11 bp, Homo sapiens
tgccccctccc

SEQ ID NO: 4811035 - DNA, 15 bp, Homo sapiens
tgccccctcccccgc

SEQ ID NO: 4811036 - DNA, 20 bp, Homo sapiens
tgccccctcccccgcagaca

SEQ ID NO: 4811037 - DNA, 19 bp, Homo sapiens
tgcccctccgtccccaggg

SEQ ID NO: 4811038 - DNA, 13 bp, Homo sapiens
tgcccctgcacct

SEQ ID NO: 4811039 - DNA, 19 bp, Homo sapiens
tgcccctgcacctgcttct

SEQ ID NO: 4811040 - DNA, 18 bp, Homo sapiens
tgccccttccccatgctc

SEQ ID NO: 4811041 - DNA, 19 bp, Homo sapiens
tgccccttccccatgctca

SEQ ID NO: 4811042 - DNA, 18 bp, Homo sapiens
tgccccttgaccccacac

SEQ ID NO: 4811043 - DNA, 15 bp, Homo sapiens
tgcccgcacagcagc

SEQ ID NO: 4811044 - DNA, 22 bp, Homo sapiens
tgcccgcgcccgccgcctccct

SEQ ID NO: 4811045 - DNA, 23 bp, Homo sapiens
tgcccgtggtgaggttgtgctgc

SEQ ID NO: 4811046 - DNA, 17 bp, Homo sapiens
tgcccgtgtggcctggg

SEQ ID NO: 4811047 - DNA, 19 bp, Homo sapiens
tgccctcaaaatctttaga

SEQ ID NO: 4811048 - DNA, 15 bp, Homo sapiens
tgccctcccccacgg

SEQ ID NO: 4811049 - DNA, 17 bp, Homo sapiens
tgccctcccccacggcc

SEQ ID NO: 4811050 - DNA, 17 bp, Homo sapiens
tgccctccctgctgcca

SEQ ID NO: 4811051 - DNA, 22 bp, Homo sapiens
tgccctccctgctgccaggctc

SEQ ID NO: 4811052 - DNA, 17 bp, Homo sapiens
tgccctccgcccttccc

SEQ ID NO: 4811053 - DNA, 22 bp, Homo sapiens
tgccctctcactgacttctccc

SEQ ID NO: 4811054 - DNA, 18 bp, Homo sapiens
tgccctgaccatgcattt

SEQ ID NO: 4811055 - DNA, 11 bp, Homo sapiens
tgccctggcct

SEQ ID NO: 4811056 - DNA, 12 bp, Homo sapiens
tgccctggccta

SEQ ID NO: 4811057 - DNA, 14 bp, Homo sapiens
tgccctgtagctcc

SEQ ID NO: 4811058 - DNA, 19 bp, Homo sapiens
tgcccttaaaataatgatt

SEQ ID NO: 4811059 - DNA, 12 bp, Homo sapiens
tgccgcagccct

SEQ ID NO: 4811060 - DNA, 12 bp, Homo sapiens
tgccgctgcacc

SEQ ID NO: 4811061 - DNA, 14 bp, Homo sapiens
tgccgctgcaccac

SEQ ID NO: 4811062 - DNA, 13 bp, Homo sapiens
tgccgctgcttga

SEQ ID NO: 4811063 - DNA, 23 bp, Homo sapiens
tgccgcttaaacatttccctgct

SEQ ID NO: 4811064 - DNA, 17 bp, Homo sapiens
tgccggtggggccagcg

SEQ ID NO: 4811065 - DNA, 12 bp, Homo sapiens
tgccgtctttgg

SEQ ID NO: 4811066 - DNA, 17 bp, Homo sapiens
tgccgtctttggttcct

SEQ ID NO: 4811067 - DNA, 23 bp, Homo sapiens
tgccgtctttggttcctcatggc

SEQ ID NO: 4811068 - DNA, 20 bp, Homo sapiens
tgcctacattagtgagattt

SEQ ID NO: 4811069 - DNA, 15 bp, Homo sapiens
tgcctatatttataa

SEQ ID NO: 4811070 - DNA, 16 bp, Homo sapiens
tgcctatatttataaa

SEQ ID NO: 4811071 - DNA, 13 bp, Homo sapiens
tgcctccagaacc

SEQ ID NO: 4811072 - DNA, 22 bp, Homo sapiens
tgcctcccagccctgcccagag

SEQ ID NO: 4811073 - DNA, 18 bp, Homo sapiens
tgcctccggccctgcccc

SEQ ID NO: 4811074 - DNA, 19 bp, Homo sapiens
tgcctccggccctgcccca

SEQ ID NO: 4811075 - DNA, 13 bp, Homo sapiens
tgcctccgggcct

SEQ ID NO: 4811076 - DNA, 14 bp, Homo sapiens
tgcctccgggcctc

SEQ ID NO: 4811077 - DNA, 21 bp, Homo sapiens
tgcctccgggcctcggcctgg

SEQ ID NO: 4811078 - DNA, 13 bp, Homo sapiens
tgcctctcacaca

SEQ ID NO: 4811079 - DNA, 17 bp, Homo sapiens
tgcctctctcaggccaa

SEQ ID NO: 4811080 - DNA, 20 bp, Homo sapiens
tgcctctgatatgggactga

SEQ ID NO: 4811081 - DNA, 16 bp, Homo sapiens
tgcctctgccacactc

SEQ ID NO: 4811082 - DNA, 22 bp, Homo sapiens
tgcctctgccttagaggagccc

SEQ ID NO: 4811083 - DNA, 16 bp, Homo sapiens
tgcctctttaaattat

SEQ ID NO: 4811084 - DNA, 15 bp, Homo sapiens
tggacagcagctgga

SEQ ID NO: 4811085 - DNA, 16 bp, Homo sapiens
tggacagcagctggac

SEQ ID NO: 4811086 - DNA, 11 bp, Homo sapiens
tggacagtgag

SEQ ID NO: 4811087 - DNA, 12 bp, Homo sapiens
tggacagtgaga

SEQ ID NO: 4811088 - DNA, 18 bp, Homo sapiens
tggaccaaatgtaaaata

SEQ ID NO: 4811089 - DNA, 19 bp, Homo sapiens
tggaccagttccctcagcc

SEQ ID NO: 4811090 - DNA, 24 bp, Homo sapiens
tggaccagttccctcagccctcat

SEQ ID NO: 4811091 - DNA, 17 bp, Homo sapiens
tggaccgagtggaccac

SEQ ID NO: 4811092 - DNA, 16 bp, Homo sapiens
tggacctggcccagtg

SEQ ID NO: 4811093 - DNA, 16 bp, Homo sapiens
tggacgtgggctccag

SEQ ID NO: 4811094 - DNA, 23 bp, Homo sapiens
tggacgtgttatgactccagaat

SEQ ID NO: 4811095 - DNA, 19 bp, Homo sapiens
tggactacctataaatgga

SEQ ID NO: 4811096 - DNA, 18 bp, Homo sapiens
tggactcgcgagagggtg

SEQ ID NO: 4811097 - DNA, 20 bp, Homo sapiens
tggactgatggttgctttga

SEQ ID NO: 4811098 - DNA, 20 bp, Homo sapiens
tggactgcacaaaagtctca

SEQ ID NO: 4811099 - DNA, 14 bp, Homo sapiens
tggacttccatttg

SEQ ID NO: 4811100 - DNA, 13 bp, Homo sapiens
tggagaaggaagg

SEQ ID NO: 4811101 - DNA, 16 bp, Homo sapiens
tggagaccctgcgccc

SEQ ID NO: 4811102 - DNA, 20 bp, Homo sapiens
tggagaccctgcgcccctgc

SEQ ID NO: 4811103 - DNA, 19 bp, Homo sapiens
tggagactaacttattttg

SEQ ID NO: 4811104 - DNA, 21 bp, Homo sapiens
tggagactaacttattttgat

SEQ ID NO: 4811105 - DNA, 21 bp, Homo sapiens
tggagaggaggtgtggagtgg

SEQ ID NO: 4811106 - DNA, 18 bp, Homo sapiens
tggagcctggcacaggac

SEQ ID NO: 4811107 - DNA, 20 bp, Homo sapiens
tggagcgtttttgctggctt

SEQ ID NO: 4811108 - DNA, 13 bp, Homo sapiens
tggaggagaagga

SEQ ID NO: 4811109 - DNA, 14 bp, Homo sapiens
tggaggagaaggag

SEQ ID NO: 4811110 - DNA, 15 bp, Homo sapiens
tggaggagaaggagg

SEQ ID NO: 4811111 - DNA, 17 bp, Homo sapiens
tggaggagaaggaggaa

SEQ ID NO: 4811112 - DNA, 11 bp, Homo sapiens
tggaggagcac

SEQ ID NO: 4811113 - DNA, 14 bp, Homo sapiens
tggaggatggacga

SEQ ID NO: 4811114 - DNA, 19 bp, Homo sapiens
tggaggatggacgagtgag

SEQ ID NO: 4811115 - DNA, 21 bp, Homo sapiens
tggaggatggacgagtgagct

SEQ ID NO: 4811116 - DNA, 21 bp, Homo sapiens
tggaggccaccaagctgctct

SEQ ID NO: 4811117 - DNA, 18 bp, Homo sapiens
tggaggcctggtctggag

SEQ ID NO: 4811118 - DNA, 19 bp, Homo sapiens
tggaggcctggtctggagc

SEQ ID NO: 4811119 - DNA, 21 bp, Homo sapiens
tggaggcctggtctggagccc

SEQ ID NO: 4811120 - DNA, 13 bp, Homo sapiens
tggagtagagtca

SEQ ID NO: 4811121 - DNA, 14 bp, Homo sapiens
tggagtcagggctg

SEQ ID NO: 4811122 - DNA, 13 bp, Homo sapiens
tggagtgcagtgg

SEQ ID NO: 4811123 - DNA, 16 bp, Homo sapiens
tggagttcatcttgaa

SEQ ID NO: 4811124 - DNA, 17 bp, Homo sapiens
tggagttcatcttgaat

SEQ ID NO: 4811125 - DNA, 20 bp, Homo sapiens
tggagttcatcttgaattgt

SEQ ID NO: 4811126 - DNA, 19 bp, Homo sapiens
tggagttcctcatcagtgt

SEQ ID NO: 4811127 - DNA, 16 bp, Homo sapiens
tggatactggggggca

SEQ ID NO: 4811128 - DNA, 18 bp, Homo sapiens
tggataggagcttccaga

SEQ ID NO: 4811129 - DNA, 12 bp, Homo sapiens
tggatataaatc

SEQ ID NO: 4811130 - DNA, 20 bp, Homo sapiens
tggatatgaaagagaaaatg

SEQ ID NO: 4811131 - DNA, 12 bp, Homo sapiens
tgcaaggcccac

SEQ ID NO: 4811132 - DNA, 22 bp, Homo sapiens
tgcaagtggacgtgggctccag

SEQ ID NO: 4811133 - DNA, 22 bp, Homo sapiens
tgcaataaactcagtcaaatgt

SEQ ID NO: 4811134 - DNA, 10 bp, Homo sapiens
tgcaataaag

SEQ ID NO: 4811135 - DNA, 23 bp, Homo sapiens
tgcaataaagagtaaatatactt

SEQ ID NO: 4811136 - DNA, 16 bp, Homo sapiens
tgcaataacagtttta

SEQ ID NO: 4811137 - DNA, 19 bp, Homo sapiens
tgcaataacagttttaaga

SEQ ID NO: 4811138 - DNA, 22 bp, Homo sapiens
tgcaataaggatttattctcag

SEQ ID NO: 4811139 - DNA, 13 bp, Homo sapiens
tgcaatctgtcca

SEQ ID NO: 4811140 - DNA, 19 bp, Homo sapiens
tgcaatgtatcccttctca

SEQ ID NO: 4811141 - DNA, 20 bp, Homo sapiens
tgcaatgttccgttcatctg

SEQ ID NO: 4811142 - DNA, 16 bp, Homo sapiens
tgcaattgtttaagaa

SEQ ID NO: 4811143 - DNA, 17 bp, Homo sapiens
tgcaatttacttggaat

SEQ ID NO: 4811144 - DNA, 19 bp, Homo sapiens
tgcaatttgtttgtgcttc

SEQ ID NO: 4811145 - DNA, 15 bp, Homo sapiens
tgcacaaacagaggc

SEQ ID NO: 4811146 - DNA, 16 bp, Homo sapiens
tgcacaaacagaggcc

SEQ ID NO: 4811147 - DNA, 24 bp, Homo sapiens
tgcacaaaccttcttttcaatgca

SEQ ID NO: 4811148 - DNA, 22 bp, Homo sapiens
tgcacacacacgcgtccacata

SEQ ID NO: 4811149 - DNA, 13 bp, Homo sapiens
tgcacacacctgc

SEQ ID NO: 4811150 - DNA, 16 bp, Homo sapiens
tgcacacacctgcctg

SEQ ID NO: 4811151 - DNA, 17 bp, Homo sapiens
tgcacacacctgcctgc

SEQ ID NO: 4811152 - DNA, 20 bp, Homo sapiens
tgcacacataacacacatca

SEQ ID NO: 4811153 - DNA, 19 bp, Homo sapiens
tgcacacattaggcattga

SEQ ID NO: 4811154 - DNA, 19 bp, Homo sapiens
tgcacaccaaattgctgag

SEQ ID NO: 4811155 - DNA, 22 bp, Homo sapiens
tgcacaccaaattgctgagatg

SEQ ID NO: 4811156 - DNA, 18 bp, Homo sapiens
tgcacagctaacatggaa

SEQ ID NO: 4811157 - DNA, 23 bp, Homo sapiens
tgcacagctaacatggaagtact

SEQ ID NO: 4811158 - DNA, 19 bp, Homo sapiens
tgcacagtagtgttgggtg

SEQ ID NO: 4811159 - DNA, 22 bp, Homo sapiens
tgcacagtagtgttgggtggag

SEQ ID NO: 4811160 - DNA, 16 bp, Homo sapiens
tgcacatgtattctgt

SEQ ID NO: 4811161 - DNA, 21 bp, Homo sapiens
tgcacattaggaacagagtat

SEQ ID NO: 4811162 - DNA, 15 bp, Homo sapiens
tgcacattcatcctc

SEQ ID NO: 4811163 - DNA, 21 bp, Homo sapiens
tgcacattcatcctcacatgt

SEQ ID NO: 4811164 - DNA, 23 bp, Homo sapiens
tgcacattcatcctcacatgtgg

SEQ ID NO: 4811165 - DNA, 13 bp, Homo sapiens
tgcacccacccct

SEQ ID NO: 4811166 - DNA, 19 bp, Homo sapiens
tgcacccacccctgcccag

SEQ ID NO: 4811167 - DNA, 21 bp, Homo sapiens
tgcacccacccctgcccaggc

SEQ ID NO: 4811168 - DNA, 15 bp, Homo sapiens
tgcaccctccacagg

SEQ ID NO: 4811169 - DNA, 23 bp, Homo sapiens
tgcaccctctgctatgtctgtga

SEQ ID NO: 4811170 - DNA, 24 bp, Homo sapiens
tgcaccctctgctatgtctgtgat

SEQ ID NO: 4811171 - DNA, 14 bp, Homo sapiens
tgcaccttgggcac

SEQ ID NO: 4811172 - DNA, 17 bp, Homo sapiens
tgcacgcggactccggg

SEQ ID NO: 4811173 - DNA, 20 bp, Homo sapiens
tgcacgtgctcttctgttct

SEQ ID NO: 4811174 - DNA, 16 bp, Homo sapiens
tgcactaaaagtgatg

SEQ ID NO: 4811175 - DNA, 21 bp, Homo sapiens
tgcactaaaagtgatgtgatt

SEQ ID NO: 4811176 - DNA, 17 bp, Homo sapiens
tgcactcctgtctcttg

SEQ ID NO: 4811177 - DNA, 20 bp, Homo sapiens
tgcactcctgtctcttggga

SEQ ID NO: 4811178 - DNA, 21 bp, Homo sapiens
tgcactcctgtctcttgggaa

SEQ ID NO: 4811179 - DNA, 17 bp, Homo sapiens
tgcactctactctgcga

SEQ ID NO: 4811180 - DNA, 16 bp, Homo sapiens
tgcactgacccttcca

SEQ ID NO: 4811181 - DNA, 20 bp, Homo sapiens
tgcactgcagttatttacca

SEQ ID NO: 4811182 - DNA, 21 bp, Homo sapiens
tgcactggccttctgatgaaa

SEQ ID NO: 4811183 - DNA, 16 bp, Homo sapiens
tgcactgtatccaagt

SEQ ID NO: 4811184 - DNA, 14 bp, Homo sapiens
tgcacttctgttat

SEQ ID NO: 4811185 - DNA, 17 bp, Homo sapiens
tgcagatctagccaggc

SEQ ID NO: 4811186 - DNA, 20 bp, Homo sapiens
tgcagatgactggaaacaag

SEQ ID NO: 4811187 - DNA, 19 bp, Homo sapiens
tgcagcccagaacgggcct

SEQ ID NO: 4811188 - DNA, 15 bp, Homo sapiens
tgcagccccctgctt

SEQ ID NO: 4811189 - DNA, 18 bp, Homo sapiens
tgcagcccgatgtccctg

SEQ ID NO: 4811190 - DNA, 22 bp, Homo sapiens
tgcagcccgatgtccctgtccc

SEQ ID NO: 4811191 - DNA, 23 bp, Homo sapiens
tgcagcccgatgtccctgtcccc

SEQ ID NO: 4811192 - DNA, 20 bp, Homo sapiens
tgcagcctgagctccaccct

SEQ ID NO: 4811193 - DNA, 16 bp, Homo sapiens
tgcagctaatttgtga

SEQ ID NO: 4811194 - DNA, 18 bp, Homo sapiens
tgcagcttgggagagccc

SEQ ID NO: 4811195 - DNA, 22 bp, Homo sapiens
tgcagcttgggagagcccctgg

SEQ ID NO: 4811196 - DNA, 19 bp, Homo sapiens
tgcaggaaaaggctgcagc

SEQ ID NO: 4811197 - DNA, 18 bp, Homo sapiens
tgcaggaagaccacatgc

SEQ ID NO: 4811198 - DNA, 20 bp, Homo sapiens
tgcaggcaagacaccttccc

SEQ ID NO: 4811199 - DNA, 13 bp, Homo sapiens
tgcaggcagcctg

SEQ ID NO: 4811200 - DNA, 14 bp, Homo sapiens
tgcaggcagcctgc

SEQ ID NO: 4811201 - DNA, 21 bp, Homo sapiens
tgcaggcgcgcaccgcccaac

SEQ ID NO: 4811202 - DNA, 15 bp, Homo sapiens
tgcaggctaaagtga

SEQ ID NO: 4811203 - DNA, 15 bp, Homo sapiens
tgcagggacagcctg

SEQ ID NO: 4811204 - DNA, 16 bp, Homo sapiens
tgcagggacagcctgc

SEQ ID NO: 4811205 - DNA, 23 bp, Homo sapiens
tgcaggtggggttttcacttcct

SEQ ID NO: 4811206 - DNA, 16 bp, Homo sapiens
tgcaggttggacccca

SEQ ID NO: 4811207 - DNA, 16 bp, Homo sapiens
tgcagtagtgtcactt

SEQ ID NO: 4811208 - DNA, 19 bp, Homo sapiens
tgcagtcagaagatctttc

SEQ ID NO: 4811209 - DNA, 14 bp, Homo sapiens
tgcagtcagcacag

SEQ ID NO: 4811210 - DNA, 16 bp, Homo sapiens
tgcagtcagcacagag

SEQ ID NO: 4811211 - DNA, 15 bp, Homo sapiens
tgcagtcatcagaag

SEQ ID NO: 4811212 - DNA, 14 bp, Homo sapiens
tgcagtctgtggag

SEQ ID NO: 4811213 - DNA, 22 bp, Homo sapiens
tgcagtggcatcatctcagctc

SEQ ID NO: 4811214 - DNA, 22 bp, Homo sapiens
tgcagtggcgcgatctcagctc

SEQ ID NO: 4811215 - DNA, 14 bp, Homo sapiens
tgcagtgtagattt

SEQ ID NO: 4811216 - DNA, 20 bp, Homo sapiens
tgcagtgtatttaatgtttg

SEQ ID NO: 4811217 - DNA, 17 bp, Homo sapiens
tgcagtgttcgcttggc

SEQ ID NO: 4811218 - DNA, 18 bp, Homo sapiens
tgcagtgttcgcttggct

SEQ ID NO: 4811219 - DNA, 20 bp, Homo sapiens
tgcagttatttaccagaagt

SEQ ID NO: 4811220 - DNA, 12 bp, Homo sapiens
tgcagttgctgt

SEQ ID NO: 4811221 - DNA, 22 bp, Homo sapiens
tgcatacgtattgttaaatgat

SEQ ID NO: 4811222 - DNA, 22 bp, Homo sapiens
tgcatatggcaacgttcatgtt

SEQ ID NO: 4811223 - DNA, 14 bp, Homo sapiens
tgcatccctccacc

SEQ ID NO: 4811224 - DNA, 15 bp, Homo sapiens
tgcatccctccaccc

SEQ ID NO: 4811225 - DNA, 16 bp, Homo sapiens
tgcatccctccacccc

SEQ ID NO: 4811226 - DNA, 17 bp, Homo sapiens
tgcatcccttggcccct

SEQ ID NO: 4811227 - DNA, 13 bp, Homo sapiens
tgcatcctcagcc

SEQ ID NO: 4811228 - DNA, 14 bp, Homo sapiens
tgcatcctcagccc

SEQ ID NO: 4811229 - DNA, 17 bp, Homo sapiens
tgcatcctcagccccag

SEQ ID NO: 4811230 - DNA, 18 bp, Homo sapiens
tgcatcctcagccccagg

SEQ ID NO: 4811231 - DNA, 18 bp, Homo sapiens
tgcatctgaaagttttga

SEQ ID NO: 4811232 - DNA, 12 bp, Homo sapiens
tgcatctggcct

SEQ ID NO: 4811233 - DNA, 22 bp, Homo sapiens
tgcatctggcctatgaccctgt

SEQ ID NO: 4811234 - DNA, 14 bp, Homo sapiens
tgcatctggcctgg

SEQ ID NO: 4811235 - DNA, 13 bp, Homo sapiens
tgcatctgtggcc

SEQ ID NO: 4811236 - DNA, 21 bp, Homo sapiens
tgcatgagaatgtcatttgct

SEQ ID NO: 4811237 - DNA, 22 bp, Homo sapiens
tgcatgagaatgtcatttgcta

SEQ ID NO: 4811238 - DNA, 23 bp, Homo sapiens
tgcatgagaatgtcatttgctaa

SEQ ID NO: 4811239 - DNA, 22 bp, Homo sapiens
tgcatgagcacctttctggctt

SEQ ID NO: 4811240 - DNA, 17 bp, Homo sapiens
tgcatgcaaaaatgaat

SEQ ID NO: 4811241 - DNA, 15 bp, Homo sapiens
tgcatgctgtccctt

SEQ ID NO: 4811242 - DNA, 18 bp, Homo sapiens
tgcatgtagcatataaat

SEQ ID NO: 4811243 - DNA, 16 bp, Homo sapiens
tgcatgtcacatgaca

SEQ ID NO: 4811244 - DNA, 17 bp, Homo sapiens
tgcatgtcacatgacat

SEQ ID NO: 4811245 - DNA, 18 bp, Homo sapiens
tgcatgtcggggcccctg

SEQ ID NO: 4811246 - DNA, 13 bp, Homo sapiens
tgcatgttaaaat

SEQ ID NO: 4811247 - DNA, 18 bp, Homo sapiens
tgcattcgttgctccagt

SEQ ID NO: 4811248 - DNA, 12 bp, Homo sapiens
tgcattgtctgt

SEQ ID NO: 4811249 - DNA, 17 bp, Homo sapiens
tgcattgtctgtctgca

SEQ ID NO: 4811250 - DNA, 14 bp, Homo sapiens
tgcattgtggctgt

SEQ ID NO: 4811251 - DNA, 23 bp, Homo sapiens
tgcatttgagagaagccacgctg

SEQ ID NO: 4811252 - DNA, 15 bp, Homo sapiens
tgagaagtaaattat

SEQ ID NO: 4811253 - DNA, 19 bp, Homo sapiens
tgagaataaaaccagctat

SEQ ID NO: 4811254 - DNA, 18 bp, Homo sapiens
tgagaatgtcatttgcta

SEQ ID NO: 4811255 - DNA, 19 bp, Homo sapiens
tgagaatgtcatttgctaa

SEQ ID NO: 4811256 - DNA, 14 bp, Homo sapiens
tgagaattactgtt

SEQ ID NO: 4811257 - DNA, 15 bp, Homo sapiens
tgagaattactgttt

SEQ ID NO: 4811258 - DNA, 19 bp, Homo sapiens
tgagaattactgtttgaaa

SEQ ID NO: 4811259 - DNA, 14 bp, Homo sapiens
tgagacaacacaca

SEQ ID NO: 4811260 - DNA, 17 bp, Homo sapiens
tgagacacagcccagag

SEQ ID NO: 4811261 - DNA, 23 bp, Homo sapiens
tgagacacagcccagagactgaa

SEQ ID NO: 4811262 - DNA, 14 bp, Homo sapiens
tgagacactgtcaa

SEQ ID NO: 4811263 - DNA, 15 bp, Homo sapiens
tgagacactgtcaag

SEQ ID NO: 4811264 - DNA, 21 bp, Homo sapiens
tgagaccaagtctctctaaga

SEQ ID NO: 4811265 - DNA, 22 bp, Homo sapiens
tgagaccaagtctctctaagac

SEQ ID NO: 4811266 - DNA, 15 bp, Homo sapiens
tgagacctcccccag

SEQ ID NO: 4811267 - DNA, 18 bp, Homo sapiens
tgagacctcccccaggga

SEQ ID NO: 4811268 - DNA, 19 bp, Homo sapiens
tgagacctcccccagggag

SEQ ID NO: 4811269 - DNA, 16 bp, Homo sapiens
tgagactaaatgagag

SEQ ID NO: 4811270 - DNA, 16 bp, Homo sapiens
tgagagaagccacgct

SEQ ID NO: 4811271 - DNA, 14 bp, Homo sapiens
tgagagatgctgta

SEQ ID NO: 4811272 - DNA, 19 bp, Homo sapiens
tgagagcagggctgggcgc

SEQ ID NO: 4811273 - DNA, 18 bp, Homo sapiens
tgagaggatgaacatctt

SEQ ID NO: 4811274 - DNA, 20 bp, Homo sapiens
tgagagggtgtgggtgccct

SEQ ID NO: 4811275 - DNA, 21 bp, Homo sapiens
tgagagggtgtgggtgccctg

SEQ ID NO: 4811276 - DNA, 23 bp, Homo sapiens
tgagagggtgtgggtgccctgtt

SEQ ID NO: 4811277 - DNA, 17 bp, Homo sapiens
tgagagtagagtcactg

SEQ ID NO: 4811278 - DNA, 18 bp, Homo sapiens
tgagagtagggccctgac

SEQ ID NO: 4811279 - DNA, 13 bp, Homo sapiens
tgagagtcatctc

SEQ ID NO: 4811280 - DNA, 16 bp, Homo sapiens
tgagagtcatctcaaa

SEQ ID NO: 4811281 - DNA, 16 bp, Homo sapiens
tgagataaatatcatt

SEQ ID NO: 4811282 - DNA, 21 bp, Homo sapiens
tgagatactttgcattgtctg

SEQ ID NO: 4811283 - DNA, 22 bp, Homo sapiens
tgagatcccagagttatttccc

SEQ ID NO: 4811284 - DNA, 17 bp, Homo sapiens
tgagatgatttaattct

SEQ ID NO: 4811285 - DNA, 18 bp, Homo sapiens
tgagatgatttaattctt

SEQ ID NO: 4811286 - DNA, 16 bp, Homo sapiens
tgagatgatttccaag

SEQ ID NO: 4811287 - DNA, 21 bp, Homo sapiens
tgagatgtagcaaattccaat

SEQ ID NO: 4811288 - DNA, 18 bp, Homo sapiens
tgagattggaaaaaatta

SEQ ID NO: 4811289 - DNA, 19 bp, Homo sapiens
tgagatttagggttctata

SEQ ID NO: 4811290 - DNA, 12 bp, Homo sapiens
tgagatttgtat

SEQ ID NO: 4811291 - DNA, 21 bp, Homo sapiens
tgagcaaggcaagaagtggga

SEQ ID NO: 4811292 - DNA, 15 bp, Homo sapiens
tgagcaatcctgcaa

SEQ ID NO: 4811293 - DNA, 17 bp, Homo sapiens
tgagcacatctcttcat

SEQ ID NO: 4811294 - DNA, 21 bp, Homo sapiens
tgagcacctttctggctttta

SEQ ID NO: 4811295 - DNA, 20 bp, Homo sapiens
tgagcagacagggcgtcctc

SEQ ID NO: 4811296 - DNA, 22 bp, Homo sapiens
tgagcatgcccaaatataacat

SEQ ID NO: 4811297 - DNA, 14 bp, Homo sapiens
tgagcatgctccct

SEQ ID NO: 4811298 - DNA, 18 bp, Homo sapiens
tgagcattctgcagcccg

SEQ ID NO: 4811299 - DNA, 15 bp, Homo sapiens
tgagccacagtgggg

SEQ ID NO: 4811300 - DNA, 16 bp, Homo sapiens
tgagccccctgcaccc

SEQ ID NO: 4811301 - DNA, 20 bp, Homo sapiens
tgagcccctccctcctgtgt

SEQ ID NO: 4811302 - DNA, 12 bp, Homo sapiens
tgagcccctcct

SEQ ID NO: 4811303 - DNA, 15 bp, Homo sapiens
tgagcccctcctctc

SEQ ID NO: 4811304 - DNA, 13 bp, Homo sapiens
tgagccctgccct

SEQ ID NO: 4811305 - DNA, 15 bp, Homo sapiens
tgagccctgccctca

SEQ ID NO: 4811306 - DNA, 22 bp, Homo sapiens
tgagccctgccctcactccact

SEQ ID NO: 4811307 - DNA, 14 bp, Homo sapiens
tgagccgtgacctc

SEQ ID NO: 4811308 - DNA, 23 bp, Homo sapiens
tgagccgtgacctccaggaaggg

SEQ ID NO: 4811309 - DNA, 14 bp, Homo sapiens
tgagcctgtctctc

SEQ ID NO: 4811310 - DNA, 14 bp, Homo sapiens
tgagccttattaaa

SEQ ID NO: 4811311 - DNA, 16 bp, Homo sapiens
tgagccttattaaaat

SEQ ID NO: 4811312 - DNA, 18 bp, Homo sapiens
tgagccttattaaaatat

SEQ ID NO: 4811313 - DNA, 22 bp, Homo sapiens
tgagcgacatctctgactttct

SEQ ID NO: 4811314 - DNA, 21 bp, Homo sapiens
tgagcgccccgcccccacccc

SEQ ID NO: 4811315 - DNA, 22 bp, Homo sapiens
tgagcgccccgcccccacccct

SEQ ID NO: 4811316 - DNA, 21 bp, Homo sapiens
tgagcgttcagttgacacatt

SEQ ID NO: 4811317 - DNA, 14 bp, Homo sapiens
tgagctatgatatg

SEQ ID NO: 4811318 - DNA, 20 bp, Homo sapiens
tgagctccaccctcccctct

SEQ ID NO: 4811319 - DNA, 16 bp, Homo sapiens
tgagctccctcgctgt

SEQ ID NO: 4811320 - DNA, 20 bp, Homo sapiens
tgagctcctaagctgccagc

SEQ ID NO: 4811321 - DNA, 14 bp, Homo sapiens
tgagctgggcatgg

SEQ ID NO: 4811322 - DNA, 15 bp, Homo sapiens
tgagcttgattctaa

SEQ ID NO: 4811323 - DNA, 21 bp, Homo sapiens
tgagcttgattctaaagggga

SEQ ID NO: 4811324 - DNA, 19 bp, Homo sapiens
tgaggacggggcagagctg

SEQ ID NO: 4811325 - DNA, 20 bp, Homo sapiens
tgaggacggggcagagctga

SEQ ID NO: 4811326 - DNA, 17 bp, Homo sapiens
tgaggactgttggctga

SEQ ID NO: 4811327 - DNA, 23 bp, Homo sapiens
tgaggaggggagcaaggctgcta

SEQ ID NO: 4811328 - DNA, 12 bp, Homo sapiens
tgaggagtccaa

SEQ ID NO: 4811329 - DNA, 15 bp, Homo sapiens
tgaggagtccaaaat

SEQ ID NO: 4811330 - DNA, 13 bp, Homo sapiens
tgaggatgatgta

SEQ ID NO: 4811331 - DNA, 16 bp, Homo sapiens
tgaggcacatgacagt

SEQ ID NO: 4811332 - DNA, 13 bp, Homo sapiens
tgaggcagggcaa

SEQ ID NO: 4811333 - DNA, 14 bp, Homo sapiens
tgaggccaaatatt

SEQ ID NO: 4811334 - DNA, 16 bp, Homo sapiens
tgaggcccactctgtt

SEQ ID NO: 4811335 - DNA, 15 bp, Homo sapiens
tgaggcccccggagg

SEQ ID NO: 4811336 - DNA, 19 bp, Homo sapiens
tgaggcgtgggatccagag

SEQ ID NO: 4811337 - DNA, 20 bp, Homo sapiens
tgaggcgtgggatccagaga

SEQ ID NO: 4811338 - DNA, 22 bp, Homo sapiens
tgaggcgtgggatccagagaga

SEQ ID NO: 4811339 - DNA, 13 bp, Homo sapiens
tgagggaagccca

SEQ ID NO: 4811340 - DNA, 16 bp, Homo sapiens
tgagggaagcccaccc

SEQ ID NO: 4811341 - DNA, 19 bp, Homo sapiens
tgagggacgagcagagcgc

SEQ ID NO: 4811342 - DNA, 16 bp, Homo sapiens
tgagggcagggttcta

SEQ ID NO: 4811343 - DNA, 16 bp, Homo sapiens
tgagggctgacaaggc

SEQ ID NO: 4811344 - DNA, 14 bp, Homo sapiens
tgaggggaggtggc

SEQ ID NO: 4811345 - DNA, 19 bp, Homo sapiens
tgaggtcttgagtttcatt

SEQ ID NO: 4811346 - DNA, 21 bp, Homo sapiens
tgaggtcttgagtttcatttt

SEQ ID NO: 4811347 - DNA, 12 bp, Homo sapiens
tgagtagcatat

SEQ ID NO: 4811348 - DNA, 18 bp, Homo sapiens
tgagtcagggcccagagg

SEQ ID NO: 4811349 - DNA, 18 bp, Homo sapiens
tgagtcctggcatgggaa

SEQ ID NO: 4811350 - DNA, 19 bp, Homo sapiens
tgagtcctggcatgggaat

SEQ ID NO: 4811351 - DNA, 17 bp, Homo sapiens
tgagtcggctgggcagg

SEQ ID NO: 4811352 - DNA, 19 bp, Homo sapiens
tgagtcggctgggcagggc

SEQ ID NO: 4811353 - DNA, 20 bp, Homo sapiens
tgagtcggctgggcagggcc

SEQ ID NO: 4811354 - DNA, 12 bp, Homo sapiens
tgagtctgtcct

SEQ ID NO: 4811355 - DNA, 20 bp, Homo sapiens
tgagtgcgaccaccacttga

SEQ ID NO: 4811356 - DNA, 17 bp, Homo sapiens
tgagtggacagcagctg

SEQ ID NO: 4811357 - DNA, 15 bp, Homo sapiens
tgagtgggccccctc

SEQ ID NO: 4811358 - DNA, 16 bp, Homo sapiens
tgagtgtatgtataca

SEQ ID NO: 4811359 - DNA, 18 bp, Homo sapiens
tgagtgtatgtatacaca

SEQ ID NO: 4811360 - DNA, 17 bp, Homo sapiens
tgagttctgcacataca

SEQ ID NO: 4811361 - DNA, 22 bp, Homo sapiens
tgagtttatgggaatgcctttt

SEQ ID NO: 4811362 - DNA, 18 bp, Homo sapiens
tgagtttccagctaagcc

SEQ ID NO: 4811363 - DNA, 17 bp, Homo sapiens
tgagtttccagctgctc

SEQ ID NO: 4811364 - DNA, 17 bp, Homo sapiens
tgagttttatccaagac

SEQ ID NO: 4811365 - DNA, 23 bp, Homo sapiens
tgagttttctctttgtggggctt

SEQ ID NO: 4811366 - DNA, 13 bp, Homo sapiens
tgataaaaatact

SEQ ID NO: 4811367 - DNA, 20 bp, Homo sapiens
tgataaggtttagaatgaca

SEQ ID NO: 4811368 - DNA, 16 bp, Homo sapiens
tgataataaaattcat

SEQ ID NO: 4811369 - DNA, 18 bp, Homo sapiens
tgataatagctcacagca

SEQ ID NO: 4811370 - DNA, 19 bp, Homo sapiens
tgataatagctcacagcac

SEQ ID NO: 4811371 - DNA, 15 bp, Homo sapiens
tgatacttgtaactt

SEQ ID NO: 4811372 - DNA, 22 bp, Homo sapiens
tgatagaagaaggactgaagaa

SEQ ID NO: 4811373 - DNA, 21 bp, Homo sapiens
tgatagcactggtttgtttct

SEQ ID NO: 4811374 - DNA, 23 bp, Homo sapiens
tgatagcactggtttgtttctca

SEQ ID NO: 4811375 - DNA, 20 bp, Homo sapiens
tgatagtgtttcgttaagca

SEQ ID NO: 4811376 - DNA, 15 bp, Homo sapiens
tccagccctccgcca

SEQ ID NO: 4811377 - DNA, 16 bp, Homo sapiens
tccagccctccgccag

SEQ ID NO: 4811378 - DNA, 22 bp, Homo sapiens
tccagccctccgccagccctgt

SEQ ID NO: 4811379 - DNA, 13 bp, Homo sapiens
tccagccctgggc

SEQ ID NO: 4811380 - DNA, 15 bp, Homo sapiens
tccagccctgggcac

SEQ ID NO: 4811381 - DNA, 22 bp, Homo sapiens
tccagccgcaaatccatacccc

SEQ ID NO: 4811382 - DNA, 19 bp, Homo sapiens
tccagctaagcctgatgat

SEQ ID NO: 4811383 - DNA, 14 bp, Homo sapiens
tccagctcagtccc

SEQ ID NO: 4811384 - DNA, 16 bp, Homo sapiens
tccagctcagtcccac

SEQ ID NO: 4811385 - DNA, 21 bp, Homo sapiens
tccagctcagtcccacagccc

SEQ ID NO: 4811386 - DNA, 18 bp, Homo sapiens
tccagctttctctttgtt

SEQ ID NO: 4811387 - DNA, 18 bp, Homo sapiens
tccaggaccttgcttcct

SEQ ID NO: 4811388 - DNA, 18 bp, Homo sapiens
tccaggaggactgttcta

SEQ ID NO: 4811389 - DNA, 16 bp, Homo sapiens
tccaggattgtccaca

SEQ ID NO: 4811390 - DNA, 13 bp, Homo sapiens
tccaggcccagcc

SEQ ID NO: 4811391 - DNA, 14 bp, Homo sapiens
tccaggcccagcct

SEQ ID NO: 4811392 - DNA, 20 bp, Homo sapiens
tccaggctagtccggaccca

SEQ ID NO: 4811393 - DNA, 13 bp, Homo sapiens
tccaggggctgca

SEQ ID NO: 4811394 - DNA, 15 bp, Homo sapiens
tcccccatgccacca

SEQ ID NO: 4811395 - DNA, 13 bp, Homo sapiens
tcccccctcccac

SEQ ID NO: 4811396 - DNA, 18 bp, Homo sapiens
tcccccctgtggtctgtg

SEQ ID NO: 4811397 - DNA, 21 bp, Homo sapiens
tccccctcagctctccctcac

SEQ ID NO: 4811398 - DNA, 10 bp, Homo sapiens
tccccctcct

SEQ ID NO: 4811399 - DNA, 10 bp, Homo sapiens
tcccccttcc

SEQ ID NO: 4811400 - DNA, 20 bp, Homo sapiens
tccccgcccgccctcctctg

SEQ ID NO: 4811401 - DNA, 22 bp, Homo sapiens
tccccggaccggacgcatgcag

SEQ ID NO: 4811402 - DNA, 17 bp, Homo sapiens
tccccggacgcatgcag

SEQ ID NO: 4811403 - DNA, 17 bp, Homo sapiens
tccccggacgctggctc

SEQ ID NO: 4811404 - DNA, 16 bp, Homo sapiens
tccccgtgctcacagt

SEQ ID NO: 4811405 - DNA, 17 bp, Homo sapiens
tcccctcactctgtcag

SEQ ID NO: 4811406 - DNA, 21 bp, Homo sapiens
tcccctcactctgtcagccag

SEQ ID NO: 4811407 - DNA, 22 bp, Homo sapiens
tcccctcactctgtcagccagc

SEQ ID NO: 4811408 - DNA, 13 bp, Homo sapiens
tcccctcagccaa

SEQ ID NO: 4811409 - DNA, 14 bp, Homo sapiens
tcccctctcctgag

SEQ ID NO: 4811410 - DNA, 15 bp, Homo sapiens
tcccctctcctgagc

SEQ ID NO: 4811411 - DNA, 20 bp, Homo sapiens
tcccctgaggttaaggggat

SEQ ID NO: 4811412 - DNA, 17 bp, Homo sapiens
tcccctgcgccctccct

SEQ ID NO: 4811413 - DNA, 17 bp, Homo sapiens
tcccctggcccttcctt

SEQ ID NO: 4811414 - DNA, 18 bp, Homo sapiens
tcccctggcccttccttc

SEQ ID NO: 4811415 - DNA, 20 bp, Homo sapiens
tcccctggcccttccttcac

SEQ ID NO: 4811416 - DNA, 23 bp, Homo sapiens
tcccctggcccttccttcaccca

SEQ ID NO: 4811417 - DNA, 14 bp, Homo sapiens
tcccctggtcctgc

SEQ ID NO: 4811418 - DNA, 15 bp, Homo sapiens
tcccctggtcctgca

SEQ ID NO: 4811419 - DNA, 16 bp, Homo sapiens
tcccctggtcctgcac

SEQ ID NO: 4811420 - DNA, 15 bp, Homo sapiens
tcccctggtgcccct

SEQ ID NO: 4811421 - DNA, 22 bp, Homo sapiens
tcccctggtgcccctccactct

SEQ ID NO: 4811422 - DNA, 15 bp, Homo sapiens
tccccttgccacatc

SEQ ID NO: 4811423 - DNA, 22 bp, Homo sapiens
tcccgatgcgtggctcccagca

SEQ ID NO: 4811424 - DNA, 14 bp, Homo sapiens
tcccgcagcaccag

SEQ ID NO: 4811425 - DNA, 19 bp, Homo sapiens
tcccgcagcaccagcctga

SEQ ID NO: 4811426 - DNA, 21 bp, Homo sapiens
tcccgcagcaccagcctgagc

SEQ ID NO: 4811427 - DNA, 12 bp, Homo sapiens
tcccgcatgctg

SEQ ID NO: 4811428 - DNA, 18 bp, Homo sapiens
tcccgcatgctgcctgcc

SEQ ID NO: 4811429 - DNA, 20 bp, Homo sapiens
tcccgcatgctgcctgcctc

SEQ ID NO: 4811430 - DNA, 21 bp, Homo sapiens
tcccgcatgctgcctgcctcc

SEQ ID NO: 4811431 - DNA, 22 bp, Homo sapiens
tcccgccagggagtgtgatgca

SEQ ID NO: 4811432 - DNA, 14 bp, Homo sapiens
tcccgccctggctc

SEQ ID NO: 4811433 - DNA, 15 bp, Homo sapiens
tcccgccgccccccc

SEQ ID NO: 4811434 - DNA, 21 bp, Homo sapiens
tcccgccgccccccctatctc

SEQ ID NO: 4811435 - DNA, 22 bp, Homo sapiens
tcccgccgcctcgggccgcctc

SEQ ID NO: 4811436 - DNA, 18 bp, Homo sapiens
tcccggagctcaggccct

SEQ ID NO: 4811437 - DNA, 15 bp, Homo sapiens
tcccggccccgcgcg

SEQ ID NO: 4811438 - DNA, 23 bp, Homo sapiens
tcccggccccgcgcgtgccccca

SEQ ID NO: 4811439 - DNA, 12 bp, Homo sapiens
tcccgggcactg

SEQ ID NO: 4811440 - DNA, 14 bp, Homo sapiens
tcccgtccgtccgc

SEQ ID NO: 4811441 - DNA, 17 bp, Homo sapiens
tcccgtgccctgtttcc

SEQ ID NO: 4811442 - DNA, 18 bp, Homo sapiens
tcccgtggctttgtgctt

SEQ ID NO: 4811443 - DNA, 15 bp, Homo sapiens
tccctaattctcttc

SEQ ID NO: 4811444 - DNA, 17 bp, Homo sapiens
tccctaccctcttctca

SEQ ID NO: 4811445 - DNA, 19 bp, Homo sapiens
tccctaccctcttctcagc

SEQ ID NO: 4811446 - DNA, 21 bp, Homo sapiens
tccctagcttattttgtggct

SEQ ID NO: 4811447 - DNA, 21 bp, Homo sapiens
tccctcacacctcccttcatc

SEQ ID NO: 4811448 - DNA, 17 bp, Homo sapiens
tccctcagccctcatta

SEQ ID NO: 4811449 - DNA, 23 bp, Homo sapiens
tccctccaccccagtccccggga

SEQ ID NO: 4811450 - DNA, 22 bp, Homo sapiens
tccctccactcctcccaactct

SEQ ID NO: 4811451 - DNA, 19 bp, Homo sapiens
tccctccccttgccacatc

SEQ ID NO: 4811452 - DNA, 16 bp, Homo sapiens
tccctccctccacacc

SEQ ID NO: 4811453 - DNA, 16 bp, Homo sapiens
tccctccctcctggct

SEQ ID NO: 4811454 - DNA, 19 bp, Homo sapiens
tccctccctcctggctcac

SEQ ID NO: 4811455 - DNA, 19 bp, Homo sapiens
tccctccgaacgctgctcc

SEQ ID NO: 4811456 - DNA, 14 bp, Homo sapiens
tccctcctggctca

SEQ ID NO: 4811457 - DNA, 23 bp, Homo sapiens
tccctcctggctcacagccacca

SEQ ID NO: 4811458 - DNA, 16 bp, Homo sapiens
tccctctcgctcccct

SEQ ID NO: 4811459 - DNA, 20 bp, Homo sapiens
tccctctcgctcccctctgc

SEQ ID NO: 4811460 - DNA, 13 bp, Homo sapiens
tccctctggggct

SEQ ID NO: 4811461 - DNA, 22 bp, Homo sapiens
tccctgacttcccagctggcag

SEQ ID NO: 4811462 - DNA, 11 bp, Homo sapiens
tccctgcagct

SEQ ID NO: 4811463 - DNA, 13 bp, Homo sapiens
tccctgcccaggc

SEQ ID NO: 4811464 - DNA, 17 bp, Homo sapiens
tccctgcgtctcctgcc

SEQ ID NO: 4811465 - DNA, 22 bp, Homo sapiens
tccctgctgccaggctcccact

SEQ ID NO: 4811466 - DNA, 20 bp, Homo sapiens
tccctgcttcacgattctta

SEQ ID NO: 4811467 - DNA, 18 bp, Homo sapiens
tccctggacgcatgcagg

SEQ ID NO: 4811468 - DNA, 20 bp, Homo sapiens
tccctggacgcatgcagggc

SEQ ID NO: 4811469 - DNA, 12 bp, Homo sapiens
tccctggcccca

SEQ ID NO: 4811470 - DNA, 13 bp, Homo sapiens
tccctggccccag

SEQ ID NO: 4811471 - DNA, 15 bp, Homo sapiens
tccctggccccagtg

SEQ ID NO: 4811472 - DNA, 17 bp, Homo sapiens
tccctggccccagtgac

SEQ ID NO: 4811473 - DNA, 16 bp, Homo sapiens
tccctgggcccctcca

SEQ ID NO: 4811474 - DNA, 18 bp, Homo sapiens
tccctgggcccctccacg

SEQ ID NO: 4811475 - DNA, 17 bp, Homo sapiens
tccctggggaggacccc

SEQ ID NO: 4811476 - DNA, 20 bp, Homo sapiens
tccctggggaggacccctgc

SEQ ID NO: 4811477 - DNA, 23 bp, Homo sapiens
tccctggggaggacccctgccct

SEQ ID NO: 4811478 - DNA, 21 bp, Homo sapiens
tccctggtgaaagagtaaaac

SEQ ID NO: 4811479 - DNA, 13 bp, Homo sapiens
tccctgtcatagt

SEQ ID NO: 4811480 - DNA, 11 bp, Homo sapiens
tccctgtcccc

SEQ ID NO: 4811481 - DNA, 16 bp, Homo sapiens
tccctgtcccctcctc

SEQ ID NO: 4811482 - DNA, 15 bp, Homo sapiens
tccctgtgggctcac

SEQ ID NO: 4811483 - DNA, 16 bp, Homo sapiens
tccctgtgggctcaca

SEQ ID NO: 4811484 - DNA, 18 bp, Homo sapiens
tccctgtgggctcacacc

SEQ ID NO: 4811485 - DNA, 22 bp, Homo sapiens
tccctgtgggctcacaccggca

SEQ ID NO: 4811486 - DNA, 21 bp, Homo sapiens
tccctgtgggggtggccatcc

SEQ ID NO: 4811487 - DNA, 18 bp, Homo sapiens
tcccttacgtgagtcctg

SEQ ID NO: 4811488 - DNA, 22 bp, Homo sapiens
tcccttacgtgagtcctggcat

SEQ ID NO: 4811489 - DNA, 19 bp, Homo sapiens
tcccttccactgcctctgc

SEQ ID NO: 4811490 - DNA, 15 bp, Homo sapiens
tcccttccttatgca

SEQ ID NO: 4811491 - DNA, 16 bp, Homo sapiens
tcccttctcacagcac

SEQ ID NO: 4811492 - DNA, 14 bp, Homo sapiens
tcccttctttcctt

SEQ ID NO: 4811493 - DNA, 16 bp, Homo sapiens
tcccttctttccttcc

SEQ ID NO: 4811494 - DNA, 17 bp, Homo sapiens
tcccttctttccttcct

SEQ ID NO: 4811495 - DNA, 18 bp, Homo sapiens
tcccttctttccttcctt

SEQ ID NO: 4811496 - DNA, 16 bp, Homo sapiens
tcccttgattcaaata

SEQ ID NO: 4811497 - DNA, 21 bp, Homo sapiens
tccctttacagctctcctcca

SEQ ID NO: 4811498 - DNA, 12 bp, Homo sapiens
tcccttttcctt

SEQ ID NO: 4811499 - DNA, 14 bp, Homo sapiens
tccgagaagctctc

SEQ ID NO: 4811500 - DNA, 22 bp, Homo sapiens
tccgagattcagactgcttcat

SEQ ID NO: 4811501 - DNA, 11 bp, Homo sapiens
tccgagcccct

SEQ ID NO: 4811502 - DNA, 20 bp, Homo sapiens
tccgaggcctggctctggag

SEQ ID NO: 4811503 - DNA, 16 bp, Homo sapiens
tccgccccgtgctcct

SEQ ID NO: 4811504 - DNA, 21 bp, Homo sapiens
tccgcccgcccaccccgctgc

SEQ ID NO: 4811505 - DNA, 13 bp, Homo sapiens
tccgcctcactgg

SEQ ID NO: 4811506 - DNA, 15 bp, Homo sapiens
tccgcctcactgggt

SEQ ID NO: 4811507 - DNA, 14 bp, Homo sapiens
tccgcggaggcccc

SEQ ID NO: 4811508 - DNA, 20 bp, Homo sapiens
tccgcgtcctttcctctcct

SEQ ID NO: 4811509 - DNA, 21 bp, Homo sapiens
tccgcgtcctttcctctcctc

SEQ ID NO: 4811510 - DNA, 18 bp, Homo sapiens
tccgctgcgctcccacct

SEQ ID NO: 4811511 - DNA, 20 bp, Homo sapiens
tccgctgtcgccccaggccc

SEQ ID NO: 4811512 - DNA, 18 bp, Homo sapiens
tccggaaaaatggggttt

SEQ ID NO: 4811513 - DNA, 20 bp, Homo sapiens
tccggaaggacacagtcagg

SEQ ID NO: 4811514 - DNA, 14 bp, Homo sapiens
tccggcagaggcag

SEQ ID NO: 4811515 - DNA, 16 bp, Homo sapiens
tccggcagaggcaggg

SEQ ID NO: 4811516 - DNA, 18 bp, Homo sapiens
tattttcttacagtattt

SEQ ID NO: 4811517 - DNA, 18 bp, Homo sapiens
tattttcttcccatttgt

SEQ ID NO: 4811518 - DNA, 12 bp, Homo sapiens
tattttgaacaa

SEQ ID NO: 4811519 - DNA, 16 bp, Homo sapiens
tattttgtaaaatgta

SEQ ID NO: 4811520 - DNA, 17 bp, Homo sapiens
tattttgtaaaatgtat

SEQ ID NO: 4811521 - DNA, 19 bp, Homo sapiens
tattttgtaaaatgtatta

SEQ ID NO: 4811522 - DNA, 15 bp, Homo sapiens
tattttgtatgaaat

SEQ ID NO: 4811523 - DNA, 14 bp, Homo sapiens
tatttttctgttac

SEQ ID NO: 4811524 - DNA, 15 bp, Homo sapiens
tatttttctgttacc

SEQ ID NO: 4811525 - DNA, 12 bp, Homo sapiens
tattttttgtga

SEQ ID NO: 4811526 - DNA, 20 bp, Homo sapiens
tatttttttaactttaccat

SEQ ID NO: 4811527 - DNA, 17 bp, Homo sapiens
tcaaaaaacagaaaaac

SEQ ID NO: 4811528 - DNA, 19 bp, Homo sapiens
tcaaaaaacagaaaaacaa

SEQ ID NO: 4811529 - DNA, 14 bp, Homo sapiens
tcaaaaatcatcaa

SEQ ID NO: 4811530 - DNA, 21 bp, Homo sapiens
tcaaaaattgaagagagatat

SEQ ID NO: 4811531 - DNA, 14 bp, Homo sapiens
tcaaaataaaacca

SEQ ID NO: 4811532 - DNA, 15 bp, Homo sapiens
tcaaaataaaaccag

SEQ ID NO: 4811533 - DNA, 17 bp, Homo sapiens
tcaaaataaaaccagaa

SEQ ID NO: 4811534 - DNA, 20 bp, Homo sapiens
tcaaaatataaaatgccaag

SEQ ID NO: 4811535 - DNA, 13 bp, Homo sapiens
tcaaaatgcaaaa

SEQ ID NO: 4811536 - DNA, 13 bp, Homo sapiens
tcaaaatgcatac

SEQ ID NO: 4811537 - DNA, 12 bp, Homo sapiens
tcaaaatgtgcc

SEQ ID NO: 4811538 - DNA, 13 bp, Homo sapiens
tcaaacaaatcat

SEQ ID NO: 4811539 - DNA, 23 bp, Homo sapiens
tcaaacagtgtggcttaaacatt

SEQ ID NO: 4811540 - DNA, 18 bp, Homo sapiens
tcaaagaacccccctccc

SEQ ID NO: 4811541 - DNA, 23 bp, Homo sapiens
tcaaagaatcacctaattaattt

SEQ ID NO: 4811542 - DNA, 14 bp, Homo sapiens
tcaaagtatataca

SEQ ID NO: 4811543 - DNA, 19 bp, Homo sapiens
tcaaagtatatacagagcc

SEQ ID NO: 4811544 - DNA, 20 bp, Homo sapiens
tcaaagtatatacagagcct

SEQ ID NO: 4811545 - DNA, 13 bp, Homo sapiens
tcaaagtgcacac

SEQ ID NO: 4811546 - DNA, 16 bp, Homo sapiens
tcaaagtgcacacaca

SEQ ID NO: 4811547 - DNA, 15 bp, Homo sapiens
tcaaataaaaattct

SEQ ID NO: 4811548 - DNA, 22 bp, Homo sapiens
tcaaatgaataatgcctttgta

SEQ ID NO: 4811549 - DNA, 13 bp, Homo sapiens
ggcctcacctggc

SEQ ID NO: 4811550 - DNA, 14 bp, Homo sapiens
ggcctcacctggct

SEQ ID NO: 4811551 - DNA, 15 bp, Homo sapiens
ggcctcacctggctt

SEQ ID NO: 4811552 - DNA, 19 bp, Homo sapiens
ggcctcacctggcttccca

SEQ ID NO: 4811553 - DNA, 21 bp, Homo sapiens
ggcctcacctggcttcccagg

SEQ ID NO: 4811554 - DNA, 10 bp, Homo sapiens
ggcctcagcc

SEQ ID NO: 4811555 - DNA, 12 bp, Homo sapiens
ggcctcagccct

SEQ ID NO: 4811556 - DNA, 12 bp, Homo sapiens
ggcctcccaagc

SEQ ID NO: 4811557 - DNA, 14 bp, Homo sapiens
ggcctcccaagctg

SEQ ID NO: 4811558 - DNA, 14 bp, Homo sapiens
ggcctcccagccac

SEQ ID NO: 4811559 - DNA, 22 bp, Homo sapiens
ggcctccccgggggtccccgga

SEQ ID NO: 4811560 - DNA, 22 bp, Homo sapiens
ggcctcccgcatgctgcctgcc

SEQ ID NO: 4811561 - DNA, 21 bp, Homo sapiens
ggcctcccgtccgtccgcccg

SEQ ID NO: 4811562 - DNA, 13 bp, Homo sapiens
ggcctcctagcct

SEQ ID NO: 4811563 - DNA, 16 bp, Homo sapiens
tatggtatgctggcca

SEQ ID NO: 4811564 - DNA, 23 bp, Homo sapiens
tatggtatgctggccagcaccct

SEQ ID NO: 4811565 - DNA, 16 bp, Homo sapiens
tatggtgatactccaa

SEQ ID NO: 4811566 - DNA, 15 bp, Homo sapiens
tatgtatacacacac

SEQ ID NO: 4811567 - DNA, 16 bp, Homo sapiens
tatgtatggtttgaaa

SEQ ID NO: 4811568 - DNA, 14 bp, Homo sapiens
tatgtatgtaaaaa

SEQ ID NO: 4811569 - DNA, 16 bp, Homo sapiens
tatgtatgtaaaaatg

SEQ ID NO: 4811570 - DNA, 13 bp, Homo sapiens
tatgtatgtgtga

SEQ ID NO: 4811571 - DNA, 22 bp, Homo sapiens
tatgtatgtgtgagtgtatgta

SEQ ID NO: 4811572 - DNA, 13 bp, Homo sapiens
tatgtcaaatgga

SEQ ID NO: 4811573 - DNA, 20 bp, Homo sapiens
tatgtcaaatggatgtaata

SEQ ID NO: 4811574 - DNA, 17 bp, Homo sapiens
tatgtcagtccaataaa

SEQ ID NO: 4811575 - DNA, 12 bp, Homo sapiens
tatgtcagttat

SEQ ID NO: 4811576 - DNA, 13 bp, Homo sapiens
tatgtcccatgac

SEQ ID NO: 4811577 - DNA, 22 bp, Homo sapiens
tatgtcctgtgagatgtgtatc

SEQ ID NO: 4811578 - DNA, 12 bp, Homo sapiens
tatgtctatgtg

SEQ ID NO: 4811579 - DNA, 14 bp, Homo sapiens
tatgtctatgtgta

SEQ ID NO: 4811580 - DNA, 16 bp, Homo sapiens
tatgtctatgtgtata

SEQ ID NO: 4811581 - DNA, 14 bp, Homo sapiens
tatgtgaaaggata

SEQ ID NO: 4811582 - DNA, 17 bp, Homo sapiens
tatgtgccataaacaga

SEQ ID NO: 4811583 - DNA, 16 bp, Homo sapiens
tatgtgtaactttttt

SEQ ID NO: 4811584 - DNA, 18 bp, Homo sapiens
tatgtgtacacatatgaa

SEQ ID NO: 4811585 - DNA, 16 bp, Homo sapiens
tatgtgtatgtactta

SEQ ID NO: 4811586 - DNA, 12 bp, Homo sapiens
tatgtgtcatga

SEQ ID NO: 4811587 - DNA, 18 bp, Homo sapiens
tatgtgtgagtgtatgta

SEQ ID NO: 4811588 - DNA, 18 bp, Homo sapiens
tatgtgtgtttctgtcct

SEQ ID NO: 4811589 - DNA, 19 bp, Homo sapiens
tatgtttaaaatggcattt

SEQ ID NO: 4811590 - DNA, 20 bp, Homo sapiens
tatgtttggctgaaattatg

SEQ ID NO: 4811591 - DNA, 19 bp, Homo sapiens
tatgttttggagagagcaa

SEQ ID NO: 4811592 - DNA, 19 bp, Homo sapiens
tattaaaaattaattcttt

SEQ ID NO: 4811593 - DNA, 21 bp, Homo sapiens
tattaaaaattaattctttat

SEQ ID NO: 4811594 - DNA, 14 bp, Homo sapiens
tattaacaattaat

SEQ ID NO: 4811595 - DNA, 23 bp, Homo sapiens
tattaagcacattattgtagaga

SEQ ID NO: 4811596 - DNA, 24 bp, Homo sapiens
tattaagcacattattgtagagaa

SEQ ID NO: 4811597 - DNA, 18 bp, Homo sapiens
tattaagtgttgtacaat

SEQ ID NO: 4811598 - DNA, 21 bp, Homo sapiens
tattaatgtagggcagaatag

SEQ ID NO: 4811599 - DNA, 17 bp, Homo sapiens
tattactaaattgacct

SEQ ID NO: 4811600 - DNA, 13 bp, Homo sapiens
tattactgttctt

SEQ ID NO: 4811601 - DNA, 14 bp, Homo sapiens
taatttgctctgtg

SEQ ID NO: 4811602 - DNA, 18 bp, Homo sapiens
taatttgctctgtggtaa

SEQ ID NO: 4811603 - DNA, 14 bp, Homo sapiens
taatttgtgaaagt

SEQ ID NO: 4811604 - DNA, 15 bp, Homo sapiens
taattttcttctcat

SEQ ID NO: 4811605 - DNA, 20 bp, Homo sapiens
taattttgacactgaaataa

SEQ ID NO: 4811606 - DNA, 15 bp, Homo sapiens
tacaaaaaaaatcaa

SEQ ID NO: 4811607 - DNA, 16 bp, Homo sapiens
tacaaaagaagatgaa

SEQ ID NO: 4811608 - DNA, 14 bp, Homo sapiens
tacaaaatgtgtgc

SEQ ID NO: 4811609 - DNA, 21 bp, Homo sapiens
tacaaaatgtgtgcttggaaa

SEQ ID NO: 4811610 - DNA, 14 bp, Homo sapiens
tacaaacaggtgct

SEQ ID NO: 4811611 - DNA, 14 bp, Homo sapiens
tacaaagaaacaaa

SEQ ID NO: 4811612 - DNA, 20 bp, Homo sapiens
tacaaagaaacaaaatataa

SEQ ID NO: 4811613 - DNA, 16 bp, Homo sapiens
tacaaagctgtcactc

SEQ ID NO: 4811614 - DNA, 22 bp, Homo sapiens
tacaaatttttactcaggcttt

SEQ ID NO: 4811615 - DNA, 17 bp, Homo sapiens
tacaacaagcaaactga

SEQ ID NO: 4811616 - DNA, 18 bp, Homo sapiens
tacaacaagcaaactgaa

SEQ ID NO: 4811617 - DNA, 22 bp, Homo sapiens
tacaacacattgaaactgtatt

SEQ ID NO: 4811618 - DNA, 23 bp, Homo sapiens
tacaacacattgaaactgtattt

SEQ ID NO: 4811619 - DNA, 20 bp, Homo sapiens
tacaacaccagcaacattat

SEQ ID NO: 4811620 - DNA, 17 bp, Homo sapiens
tacaacattcaacttta

SEQ ID NO: 4811621 - DNA, 14 bp, Homo sapiens
tacaaccacatttc

SEQ ID NO: 4811622 - DNA, 15 bp, Homo sapiens
tacaaccttcattta

SEQ ID NO: 4811623 - DNA, 13 bp, Homo sapiens
tacaagtgtttct

SEQ ID NO: 4811624 - DNA, 24 bp, Homo sapiens
tacaagtgtttctagtaacagtat

SEQ ID NO: 4811625 - DNA, 20 bp, Homo sapiens
tacaatatcattttcctggg

SEQ ID NO: 4811626 - DNA, 22 bp, Homo sapiens
tacaatggctgggtttgggcag

SEQ ID NO: 4811627 - DNA, 17 bp, Homo sapiens
tacaattactgtgagaa

SEQ ID NO: 4811628 - DNA, 19 bp, Homo sapiens
tacaattactgtgagaact

SEQ ID NO: 4811629 - DNA, 18 bp, Homo sapiens
tacaattctttgttgctt

SEQ ID NO: 4811630 - DNA, 18 bp, Homo sapiens
tacacaaagatattattt

SEQ ID NO: 4811631 - DNA, 17 bp, Homo sapiens
tacacaatggttttctt

SEQ ID NO: 4811632 - DNA, 21 bp, Homo sapiens
tacacaatggttttcttgtgt

SEQ ID NO: 4811633 - DNA, 10 bp, Homo sapiens
tacacacaca

SEQ ID NO: 4811634 - DNA, 16 bp, Homo sapiens
tacacacacacacaca

SEQ ID NO: 4811635 - DNA, 15 bp, Homo sapiens
tacacagttccacaa

SEQ ID NO: 4811636 - DNA, 21 bp, Homo sapiens
tacacatatgaacgcacaaca

SEQ ID NO: 4811637 - DNA, 18 bp, Homo sapiens
tacaccactttcccacac

SEQ ID NO: 4811638 - DNA, 17 bp, Homo sapiens
tacacccccaaacagaa

SEQ ID NO: 4811639 - DNA, 14 bp, Homo sapiens
tacactgaaatcca

SEQ ID NO: 4811640 - DNA, 16 bp, Homo sapiens
tacactgtattacata

SEQ ID NO: 4811641 - DNA, 16 bp, Homo sapiens
tacagaatcattgctt

SEQ ID NO: 4811642 - DNA, 17 bp, Homo sapiens
tacagaatcattgctta

SEQ ID NO: 4811643 - DNA, 15 bp, Homo sapiens
tacagacaaagcgtg

SEQ ID NO: 4811644 - DNA, 14 bp, Homo sapiens
tacagacagaatat

SEQ ID NO: 4811645 - DNA, 22 bp, Homo sapiens
tacagagagacaacttgctcct

SEQ ID NO: 4811646 - DNA, 22 bp, Homo sapiens
tacagatggtgtcctgcatgta

SEQ ID NO: 4811647 - DNA, 13 bp, Homo sapiens
tacagcccaggcg

SEQ ID NO: 4811648 - DNA, 20 bp, Homo sapiens
tacagcccagtggaggaggg

SEQ ID NO: 4811649 - DNA, 13 bp, Homo sapiens
tacagcctgcaca

SEQ ID NO: 4811650 - DNA, 14 bp, Homo sapiens
tacagcctgcacac

SEQ ID NO: 4811651 - DNA, 11 bp, Homo sapiens
tacagctcccc

SEQ ID NO: 4811652 - DNA, 15 bp, Homo sapiens
tacagctccccaagt

SEQ ID NO: 4811653 - DNA, 23 bp, Homo sapiens
tacagctctcctccagccctggg

SEQ ID NO: 4811654 - DNA, 22 bp, Homo sapiens
tacagcttgaccgtgaggccag

SEQ ID NO: 4811655 - DNA, 14 bp, Homo sapiens
tagctctgaaggga

SEQ ID NO: 4811656 - DNA, 17 bp, Homo sapiens
tagctctgaatgctatt

SEQ ID NO: 4811657 - DNA, 18 bp, Homo sapiens
tagctctgaatgctattt

SEQ ID NO: 4811658 - DNA, 22 bp, Homo sapiens
tagctgtcctctcagaactcct

SEQ ID NO: 4811659 - DNA, 15 bp, Homo sapiens
tagcttaatgactta

SEQ ID NO: 4811660 - DNA, 22 bp, Homo sapiens
tagcttagaccgtggtgtcctc

SEQ ID NO: 4811661 - DNA, 13 bp, Homo sapiens
tagcttttcactt

SEQ ID NO: 4811662 - DNA, 19 bp, Homo sapiens
tagcttttcacttcttaag

SEQ ID NO: 4811663 - DNA, 12 bp, Homo sapiens
taggaaaatttt

SEQ ID NO: 4811664 - DNA, 19 bp, Homo sapiens
taggaaataaatctaaata

SEQ ID NO: 4811665 - DNA, 17 bp, Homo sapiens
taggaacagagtatata

SEQ ID NO: 4811666 - DNA, 16 bp, Homo sapiens
taggaggacagaacca

SEQ ID NO: 4811667 - DNA, 12 bp, Homo sapiens
taggcagagccc

SEQ ID NO: 4811668 - DNA, 17 bp, Homo sapiens
taggcaggaagtcagga

SEQ ID NO: 4811669 - DNA, 20 bp, Homo sapiens
taggcaggaagtcaggagcc

SEQ ID NO: 4811670 - DNA, 14 bp, Homo sapiens
taggctggggacac

SEQ ID NO: 4811671 - DNA, 17 bp, Homo sapiens
tagggaaatccaactcc

SEQ ID NO: 4811672 - DNA, 19 bp, Homo sapiens
tagggaaatccaactccag

SEQ ID NO: 4811673 - DNA, 16 bp, Homo sapiens
tagggctctaatttcc

SEQ ID NO: 4811674 - DNA, 19 bp, Homo sapiens
tagggctctccaagcacta

SEQ ID NO: 4811675 - DNA, 11 bp, Homo sapiens
taggggtgggg

SEQ ID NO: 4811676 - DNA, 19 bp, Homo sapiens
taggggtgggggagaatgg

SEQ ID NO: 4811677 - DNA, 18 bp, Homo sapiens
tagggttgctggagcctg

SEQ ID NO: 4811678 - DNA, 14 bp, Homo sapiens
taggtctccacccc

SEQ ID NO: 4811679 - DNA, 16 bp, Homo sapiens
taggtctccacccctc

SEQ ID NO: 4811680 - DNA, 14 bp, Homo sapiens
taggtctgcacaca

SEQ ID NO: 4811681 - DNA, 16 bp, Homo sapiens
taggtctgcacacata

SEQ ID NO: 4811682 - DNA, 21 bp, Homo sapiens
taggtctggaaggtcacgctg

SEQ ID NO: 4811683 - DNA, 22 bp, Homo sapiens
taggtctgttgaagtgcatgtt

SEQ ID NO: 4811684 - DNA, 21 bp, Homo sapiens
taggtgctcataactagagta

SEQ ID NO: 4811685 - DNA, 16 bp, Homo sapiens
taggtgggtcttggat

SEQ ID NO: 4811686 - DNA, 14 bp, Homo sapiens
taggtgtgccaaac

SEQ ID NO: 4811687 - DNA, 16 bp, Homo sapiens
taggttaataggagga

SEQ ID NO: 4811688 - DNA, 17 bp, Homo sapiens
taggttaataggaggac

SEQ ID NO: 4811689 - DNA, 19 bp, Homo sapiens
taggttaataggaggacag

SEQ ID NO: 4811690 - DNA, 21 bp, Homo sapiens
taggttctgctttctgataca

SEQ ID NO: 4811691 - DNA, 21 bp, Homo sapiens
taggtttagaatcaagtctgt

SEQ ID NO: 4811692 - DNA, 23 bp, Homo sapiens
taggtttagaatcaagtctgtga

SEQ ID NO: 4811693 - DNA, 20 bp, Homo sapiens
taggtttctaaaaagtcaga

SEQ ID NO: 4811694 - DNA, 14 bp, Homo sapiens
tagtaaaattatct

SEQ ID NO: 4811695 - DNA, 15 bp, Homo sapiens
tagtaaaattatctg

SEQ ID NO: 4811696 - DNA, 18 bp, Homo sapiens
tagtaaaattatctgttc

SEQ ID NO: 4811697 - DNA, 19 bp, Homo sapiens
tagtaaaattatctgttct

SEQ ID NO: 4811698 - DNA, 20 bp, Homo sapiens
tagtaaataatgattcaatg

SEQ ID NO: 4811699 - DNA, 22 bp, Homo sapiens
tagtaaataatgattcaatgtg

SEQ ID NO: 4811700 - DNA, 13 bp, Homo sapiens
tagtaagatactg

SEQ ID NO: 4811701 - DNA, 14 bp, Homo sapiens
tagtaagatctctt

SEQ ID NO: 4811702 - DNA, 21 bp, Homo sapiens
tagtaagatctctttctaaag

SEQ ID NO: 4811703 - DNA, 17 bp, Homo sapiens
tagtaccactgcacatc

SEQ ID NO: 4811704 - DNA, 21 bp, Homo sapiens
tagtacccaacctggtaatta

SEQ ID NO: 4811705 - DNA, 17 bp, Homo sapiens
tagtagaatctcagcac

SEQ ID NO: 4811706 - DNA, 14 bp, Homo sapiens
tagtagctgataaa

SEQ ID NO: 4811707 - DNA, 15 bp, Homo sapiens
tagtagctgataaag

SEQ ID NO: 4811708 - DNA, 17 bp, Homo sapiens
tagtagttgatgaccaa

SEQ ID NO: 4811709 - DNA, 12 bp, Homo sapiens
tagtattttgag

SEQ ID NO: 4811710 - DNA, 16 bp, Homo sapiens
tagtcatatgtgaaga

SEQ ID NO: 4811711 - DNA, 21 bp, Homo sapiens
tagtcatgtttctgcagtatt

SEQ ID NO: 4811712 - DNA, 13 bp, Homo sapiens
tagtcctcacctt

SEQ ID NO: 4811713 - DNA, 20 bp, Homo sapiens
tagtcctcaccttctgtttt

SEQ ID NO: 4811714 - DNA, 13 bp, Homo sapiens
tagtctcaagaat

SEQ ID NO: 4811715 - DNA, 14 bp, Homo sapiens
tagtctcattgcca

SEQ ID NO: 4811716 - DNA, 16 bp, Homo sapiens
tagtctcattgccaag

SEQ ID NO: 4811717 - DNA, 21 bp, Homo sapiens
tagtctgaagtgaagtacaga

SEQ ID NO: 4811718 - DNA, 15 bp, Homo sapiens
tagtctgtacttcag

SEQ ID NO: 4811719 - DNA, 18 bp, Homo sapiens
tagtctgtcagggccttg

SEQ ID NO: 4811720 - DNA, 15 bp, Homo sapiens
tagtgagatttaggg

SEQ ID NO: 4811721 - DNA, 20 bp, Homo sapiens
tagtgcatgtcacatgacat

SEQ ID NO: 4811722 - DNA, 24 bp, Homo sapiens
tagtgcctgtgatcgtgtgttgcc

SEQ ID NO: 4811723 - DNA, 14 bp, Homo sapiens
tagtgctaaaccta

SEQ ID NO: 4811724 - DNA, 17 bp, Homo sapiens
tagtgctaaacctatct

SEQ ID NO: 4811725 - DNA, 21 bp, Homo sapiens
tagtgctaaacctatctgtat

SEQ ID NO: 4811726 - DNA, 13 bp, Homo sapiens
tagtggtatttta

SEQ ID NO: 4811727 - DNA, 21 bp, Homo sapiens
tagtgtcacttttttcctgtc

SEQ ID NO: 4811728 - DNA, 18 bp, Homo sapiens
tagtgtctggatcagtaa

SEQ ID NO: 4811729 - DNA, 17 bp, Homo sapiens
tagtgttgaggagggga

SEQ ID NO: 4811730 - DNA, 19 bp, Homo sapiens
gtggcgtgatctcagctca

SEQ ID NO: 4811731 - DNA, 22 bp, Homo sapiens
gtggctgatttactaacagtaa

SEQ ID NO: 4811732 - DNA, 23 bp, Homo sapiens
gtggctgtcaaatccatgtgtcc

SEQ ID NO: 4811733 - DNA, 19 bp, Homo sapiens
gtggcttctggcacctggc

SEQ ID NO: 4811734 - DNA, 20 bp, Homo sapiens
gtggcttctggcacctggcg

SEQ ID NO: 4811735 - DNA, 17 bp, Homo sapiens
gtggcttttaaagaagt

SEQ ID NO: 4811736 - DNA, 17 bp, Homo sapiens
gtgggacagaggagcaa

SEQ ID NO: 4811737 - DNA, 21 bp, Homo sapiens
gtgggactggcccacccctct

SEQ ID NO: 4811738 - DNA, 14 bp, Homo sapiens
gtgggagccacagg

SEQ ID NO: 4811739 - DNA, 21 bp, Homo sapiens
gtgggagtccactttcctctc

SEQ ID NO: 4811740 - DNA, 15 bp, Homo sapiens
gtgggatccagagag

SEQ ID NO: 4811741 - DNA, 14 bp, Homo sapiens
gtgggcagcaccct

SEQ ID NO: 4811742 - DNA, 15 bp, Homo sapiens
gtgggcagcaccctc

SEQ ID NO: 4811743 - DNA, 17 bp, Homo sapiens
gtgggcagcaccctccc

SEQ ID NO: 4811744 - DNA, 13 bp, Homo sapiens
gtgggccccacag

SEQ ID NO: 4811745 - DNA, 14 bp, Homo sapiens
gtgggccccacagt

SEQ ID NO: 4811746 - DNA, 22 bp, Homo sapiens
gtgggcgcctgtcgggcccgca

SEQ ID NO: 4811747 - DNA, 18 bp, Homo sapiens
gtgggcggcttccctgcg

SEQ ID NO: 4811748 - DNA, 14 bp, Homo sapiens
gtgggctccagagt

SEQ ID NO: 4811749 - DNA, 17 bp, Homo sapiens
gtgggctccagggactg

SEQ ID NO: 4811750 - DNA, 24 bp, Homo sapiens
gtgggctctctggacctgaccaga

SEQ ID NO: 4811751 - DNA, 16 bp, Homo sapiens
gtggggagggcctctg

SEQ ID NO: 4811752 - DNA, 14 bp, Homo sapiens
gtggggagggtggg

SEQ ID NO: 4811753 - DNA, 15 bp, Homo sapiens
gtggggagggtgggc

SEQ ID NO: 4811754 - DNA, 16 bp, Homo sapiens
gtggggcccatggccc

SEQ ID NO: 4811755 - DNA, 18 bp, Homo sapiens
gtggggcttagaatgggg

SEQ ID NO: 4811756 - DNA, 12 bp, Homo sapiens
gtgggggtggcc

SEQ ID NO: 4811757 - DNA, 14 bp, Homo sapiens
gtgggggtggccat

SEQ ID NO: 4811758 - DNA, 21 bp, Homo sapiens
gtggggtgctggggctgcatg

SEQ ID NO: 4811759 - DNA, 14 bp, Homo sapiens
gtgggtacgggagg

SEQ ID NO: 4811760 - DNA, 18 bp, Homo sapiens
gtgggtcaactccaaggc

SEQ ID NO: 4811761 - DNA, 14 bp, Homo sapiens
gtgggtgccctgtt

SEQ ID NO: 4811762 - DNA, 17 bp, Homo sapiens
gtgggtttccctgcgtc

SEQ ID NO: 4811763 - DNA, 23 bp, Homo sapiens
gtggtcacaggattctcttctca

SEQ ID NO: 4811764 - DNA, 17 bp, Homo sapiens
gtggtcagcgattcctg

SEQ ID NO: 4811765 - DNA, 15 bp, Homo sapiens
gtggtccagggtcca

SEQ ID NO: 4811766 - DNA, 18 bp, Homo sapiens
gtggtcctaatcttctga

SEQ ID NO: 4811767 - DNA, 20 bp, Homo sapiens
gtggtcttggagaggaggtg

SEQ ID NO: 4811768 - DNA, 21 bp, Homo sapiens
gtggtgagaggcatccagtat

SEQ ID NO: 4811769 - DNA, 15 bp, Homo sapiens
gtggtgatgcctaaa

SEQ ID NO: 4811770 - DNA, 13 bp, Homo sapiens
gtggtggaggtgg

SEQ ID NO: 4811771 - DNA, 22 bp, Homo sapiens
gtggtggccgtcacgctttcat

SEQ ID NO: 4811772 - DNA, 15 bp, Homo sapiens
gtggtggtgaagggg

SEQ ID NO: 4811773 - DNA, 20 bp, Homo sapiens
gtggtggtgaaggggctggt

SEQ ID NO: 4811774 - DNA, 18 bp, Homo sapiens
gtggtgtgaggcccccgg

SEQ ID NO: 4811775 - DNA, 14 bp, Homo sapiens
gtggttatgtccca

SEQ ID NO: 4811776 - DNA, 15 bp, Homo sapiens
gtggttggaggcctg

SEQ ID NO: 4811777 - DNA, 16 bp, Homo sapiens
gtgtaactttttttta

SEQ ID NO: 4811778 - DNA, 24 bp, Homo sapiens
gtgtaagacacgtgcaacagactg

SEQ ID NO: 4811779 - DNA, 20 bp, Homo sapiens
gtgtactatggctgtatttt

SEQ ID NO: 4811780 - DNA, 15 bp, Homo sapiens
gtgtactctgagtcc

SEQ ID NO: 4811781 - DNA, 21 bp, Homo sapiens
gtgtatatattatatatacat

SEQ ID NO: 4811782 - DNA, 22 bp, Homo sapiens
gtgtatatattatatatacatt

SEQ ID NO: 4811783 - DNA, 15 bp, Homo sapiens
gtgtatcagtgttta

SEQ ID NO: 4811784 - DNA, 19 bp, Homo sapiens
gtgtatcagtgtttatgtg

SEQ ID NO: 4811785 - DNA, 17 bp, Homo sapiens
gtgtatcctgacagcgc

SEQ ID NO: 4811786 - DNA, 13 bp, Homo sapiens
gtgtatgtataca

SEQ ID NO: 4811787 - DNA, 14 bp, Homo sapiens
gtgtatgtatacac

SEQ ID NO: 4811788 - DNA, 14 bp, Homo sapiens
gtgtatgtctatgt

SEQ ID NO: 4811789 - DNA, 17 bp, Homo sapiens
gtgtatgtctatgtgta

SEQ ID NO: 4811790 - DNA, 19 bp, Homo sapiens
gtgtatgtctatgtgtata

SEQ ID NO: 4811791 - DNA, 14 bp, Homo sapiens
gtgtcacgtgaccc

SEQ ID NO: 4811792 - DNA, 19 bp, Homo sapiens
gtgtcacgtgaccctgtgc

SEQ ID NO: 4811793 - DNA, 15 bp, Homo sapiens
gtgtcacttttttcc

SEQ ID NO: 4811794 - DNA, 19 bp, Homo sapiens
gtgtcaggattgaggatga

SEQ ID NO: 4811795 - DNA, 14 bp, Homo sapiens
gtgtcatctgtcag

SEQ ID NO: 4811796 - DNA, 16 bp, Homo sapiens
gtgtcatctgtcagct

SEQ ID NO: 4811797 - DNA, 21 bp, Homo sapiens
gtgtcattttctgttatacac

SEQ ID NO: 4811798 - DNA, 21 bp, Homo sapiens
gtgtcccagtgtctggcccag

SEQ ID NO: 4811799 - DNA, 13 bp, Homo sapiens
gtgtcccccctgt

SEQ ID NO: 4811800 - DNA, 20 bp, Homo sapiens
gtgtcccccctgtggtctgt

SEQ ID NO: 4811801 - DNA, 21 bp, Homo sapiens
gtgtcccctcactctgtcagc

SEQ ID NO: 4811802 - DNA, 12 bp, Homo sapiens
gtgtcccctggt

SEQ ID NO: 4811803 - DNA, 15 bp, Homo sapiens
gtgtcctaaatgcaa

SEQ ID NO: 4811804 - DNA, 16 bp, Homo sapiens
gtgtctggatcagtaa

SEQ ID NO: 4811805 - DNA, 17 bp, Homo sapiens
gtgtctggcccagccat

SEQ ID NO: 4811806 - DNA, 21 bp, Homo sapiens
gtgtctggcccagccatggct

SEQ ID NO: 4811807 - DNA, 21 bp, Homo sapiens
gtgtcttttgttctctcttgg

SEQ ID NO: 4811808 - DNA, 23 bp, Homo sapiens
gtgtcttttgttctctcttggtc

SEQ ID NO: 4811809 - DNA, 22 bp, Homo sapiens
gtgtgacaccaccactgtgtcc

SEQ ID NO: 4811810 - DNA, 22 bp, Homo sapiens
gtgtgagatggtgccccctggg

SEQ ID NO: 4811811 - DNA, 17 bp, Homo sapiens
gtgtgaggcccccggag

SEQ ID NO: 4811812 - DNA, 14 bp, Homo sapiens
gtgtgagtgtatgt

SEQ ID NO: 4811813 - DNA, 20 bp, Homo sapiens
gtgtgcccacccgtgttctc

SEQ ID NO: 4811814 - DNA, 15 bp, Homo sapiens
gtgtgcctgctatcc

SEQ ID NO: 4811815 - DNA, 19 bp, Homo sapiens
gtgtgcctgctatccagcc

SEQ ID NO: 4811816 - DNA, 12 bp, Homo sapiens
gtgtggagtgga

SEQ ID NO: 4811817 - DNA, 14 bp, Homo sapiens
gtgtggagtggagg

SEQ ID NO: 4811818 - DNA, 19 bp, Homo sapiens
gtgtggagtggaggggtca

SEQ ID NO: 4811819 - DNA, 14 bp, Homo sapiens
gtgtggcaaacatt

SEQ ID NO: 4811820 - DNA, 16 bp, Homo sapiens
gtgtggcaaacattta

SEQ ID NO: 4811821 - DNA, 20 bp, Homo sapiens
gtgtggcctaatccacctgg

SEQ ID NO: 4811822 - DNA, 15 bp, Homo sapiens
gtgtggcctcagccc

SEQ ID NO: 4811823 - DNA, 17 bp, Homo sapiens
gtgtggcctcagccctc

SEQ ID NO: 4811824 - DNA, 15 bp, Homo sapiens
gtgtggcctgggtcc

SEQ ID NO: 4811825 - DNA, 17 bp, Homo sapiens
gtgtggcttaaacattt

SEQ ID NO: 4811826 - DNA, 13 bp, Homo sapiens
gtgtggcttggaa

SEQ ID NO: 4811827 - DNA, 23 bp, Homo sapiens
gtgtggcttggaacatttgggag

SEQ ID NO: 4811828 - DNA, 13 bp, Homo sapiens
gtgtggggagggt

SEQ ID NO: 4811829 - DNA, 14 bp, Homo sapiens
gtgtggggagggtg

SEQ ID NO: 4811830 - DNA, 17 bp, Homo sapiens
gtgtggggagggtgggc

SEQ ID NO: 4811831 - DNA, 17 bp, Homo sapiens
gtgtgggtttactctgt

SEQ ID NO: 4811832 - DNA, 18 bp, Homo sapiens
gtgtgggtttactctgtg

SEQ ID NO: 4811833 - DNA, 21 bp, Homo sapiens
gtgtgtatgtctatgtgtata

SEQ ID NO: 4811834 - DNA, 23 bp, Homo sapiens
gtgtgtatgtctatgtgtatata

SEQ ID NO: 4811835 - DNA, 13 bp, Homo sapiens
gtgtgttctgatg

SEQ ID NO: 4811836 - DNA, 21 bp, Homo sapiens
gtgtgttctgatgaggcattt

SEQ ID NO: 4811837 - DNA, 19 bp, Homo sapiens
gtgtgtttctgtcctgtaa

SEQ ID NO: 4811838 - DNA, 18 bp, Homo sapiens
gtgttagaaaaaactgga

SEQ ID NO: 4811839 - DNA, 14 bp, Homo sapiens
gtgttattattatt

SEQ ID NO: 4811840 - DNA, 14 bp, Homo sapiens
gtgttcacacacac

SEQ ID NO: 4811841 - DNA, 14 bp, Homo sapiens
gtgttctcaacaca

SEQ ID NO: 4811842 - DNA, 16 bp, Homo sapiens
gtgttctcaacacaca

SEQ ID NO: 4811843 - DNA, 17 bp, Homo sapiens
gtgttctcaacacacag

SEQ ID NO: 4811844 - DNA, 12 bp, Homo sapiens
gtgttctcctcc

SEQ ID NO: 4811845 - DNA, 17 bp, Homo sapiens
gtgttctttttaaaaag

SEQ ID NO: 4811846 - DNA, 13 bp, Homo sapiens
gtgttgaggaggg

SEQ ID NO: 4811847 - DNA, 17 bp, Homo sapiens
gtgttgaggaggggagc

SEQ ID NO: 4811848 - DNA, 20 bp, Homo sapiens
gtgttgaggaggggagcaag

SEQ ID NO: 4811849 - DNA, 12 bp, Homo sapiens
gtgtttaactga

SEQ ID NO: 4811850 - DNA, 15 bp, Homo sapiens
gtgtttaattgtata

SEQ ID NO: 4811851 - DNA, 17 bp, Homo sapiens
gtgtttaattgtataaa

SEQ ID NO: 4811852 - DNA, 13 bp, Homo sapiens
gtgtttattgtca

SEQ ID NO: 4811853 - DNA, 18 bp, Homo sapiens
gtgtttcatgttctgtgt

SEQ ID NO: 4811854 - DNA, 13 bp, Homo sapiens
gtgtttccagtga

SEQ ID NO: 4811855 - DNA, 15 bp, Homo sapiens
gtgtttcgggccagg

SEQ ID NO: 4811856 - DNA, 22 bp, Homo sapiens
gtgtttcgttaagcagtacatc

SEQ ID NO: 4811857 - DNA, 20 bp, Homo sapiens
gtgtttctgtcctgtaactg

SEQ ID NO: 4811858 - DNA, 15 bp, Homo sapiens
gtgtttgggaaaggc

SEQ ID NO: 4811859 - DNA, 13 bp, Homo sapiens
gtgttttgctttg

SEQ ID NO: 4811860 - DNA, 13 bp, Homo sapiens
gtgttttgggttt

SEQ ID NO: 4811861 - DNA, 14 bp, Homo sapiens
gtgttttgtccaaa

SEQ ID NO: 4811862 - DNA, 19 bp, Homo sapiens
gtgtttttggttttctcct

SEQ ID NO: 4811863 - DNA, 12 bp, Homo sapiens
gttaaaatatag

SEQ ID NO: 4811864 - DNA, 22 bp, Homo sapiens
gttaaaatatagtgttgtgtta

SEQ ID NO: 4811865 - DNA, 18 bp, Homo sapiens
gttaaaggtctcccacaa

SEQ ID NO: 4811866 - DNA, 17 bp, Homo sapiens
gttaaatctacaaactt

SEQ ID NO: 4811867 - DNA, 19 bp, Homo sapiens
gttaacaatgcctattgta

SEQ ID NO: 4811868 - DNA, 12 bp, Homo sapiens
gttaagagaaat

SEQ ID NO: 4811869 - DNA, 20 bp, Homo sapiens
gttaaggggatctaaaagga

SEQ ID NO: 4811870 - DNA, 18 bp, Homo sapiens
gttaatatcactcattaa

SEQ ID NO: 4811871 - DNA, 17 bp, Homo sapiens
gttaatcttaatgtata

SEQ ID NO: 4811872 - DNA, 19 bp, Homo sapiens
gttaatcttaatgtatatc

SEQ ID NO: 4811873 - DNA, 16 bp, Homo sapiens
gttaatgattcttgtg

SEQ ID NO: 4811874 - DNA, 14 bp, Homo sapiens
gttaatgtgccaaa

SEQ ID NO: 4811875 - DNA, 12 bp, Homo sapiens
gttaatttcatt

SEQ ID NO: 4811876 - DNA, 16 bp, Homo sapiens
gttacaaatttttact

SEQ ID NO: 4811877 - DNA, 17 bp, Homo sapiens
gttacagacaaagcgtg

SEQ ID NO: 4811878 - DNA, 12 bp, Homo sapiens
gttacagctgaa

SEQ ID NO: 4811879 - DNA, 16 bp, Homo sapiens
gttacaggtgtactat

SEQ ID NO: 4811880 - DNA, 22 bp, Homo sapiens
gttacagtaatgtcataaagtg

SEQ ID NO: 4811881 - DNA, 16 bp, Homo sapiens
gttacagtggcagtat

SEQ ID NO: 4811882 - DNA, 14 bp, Homo sapiens
gttacatagaaagt

SEQ ID NO: 4811883 - DNA, 17 bp, Homo sapiens
gttactgtttttatcct

SEQ ID NO: 4811884 - DNA, 17 bp, Homo sapiens
gttagaaaaaactggaa

SEQ ID NO: 4811885 - DNA, 21 bp, Homo sapiens
gttagacccctgggtgggccc

SEQ ID NO: 4811886 - DNA, 14 bp, Homo sapiens
gttagagactcgcc

SEQ ID NO: 4811887 - DNA, 17 bp, Homo sapiens
gttaggggaaaatagta

SEQ ID NO: 4811888 - DNA, 13 bp, Homo sapiens
gttagtaatctgt

SEQ ID NO: 4811889 - DNA, 13 bp, Homo sapiens
gttataaaatctg

SEQ ID NO: 4811890 - DNA, 21 bp, Homo sapiens
gttataaaatctgtattgcta

SEQ ID NO: 4811891 - DNA, 18 bp, Homo sapiens
gttatacaaccttcattt

SEQ ID NO: 4811892 - DNA, 16 bp, Homo sapiens
gttatcactgtgcagt

SEQ ID NO: 4811893 - DNA, 21 bp, Homo sapiens
gttatctcggactttgcagga

SEQ ID NO: 4811894 - DNA, 14 bp, Homo sapiens
gttatctgtcttta

SEQ ID NO: 4811895 - DNA, 18 bp, Homo sapiens
gttatctgtctttatgat

SEQ ID NO: 4811896 - DNA, 19 bp, Homo sapiens
gttatgaatcgcagacgca

SEQ ID NO: 4811897 - DNA, 19 bp, Homo sapiens
gttattattattatattgt

SEQ ID NO: 4811898 - DNA, 18 bp, Homo sapiens
gttcaattggacaattat

SEQ ID NO: 4811899 - DNA, 15 bp, Homo sapiens
gttcacaccctgcaa

SEQ ID NO: 4811900 - DNA, 16 bp, Homo sapiens
gttcacaccctgcaag

SEQ ID NO: 4811901 - DNA, 16 bp, Homo sapiens
gttcaccttctgtgca

SEQ ID NO: 4811902 - DNA, 21 bp, Homo sapiens
gttcactgaataaataagtaa

SEQ ID NO: 4811903 - DNA, 13 bp, Homo sapiens
gttcagcatagag

SEQ ID NO: 4811904 - DNA, 12 bp, Homo sapiens
gttcatcttgaa

SEQ ID NO: 4811905 - DNA, 13 bp, Homo sapiens
gttcatcttgaat

SEQ ID NO: 4811906 - DNA, 17 bp, Homo sapiens
gttcatgttttgctaat

SEQ ID NO: 4811907 - DNA, 19 bp, Homo sapiens
gttccacttctctagagaa

SEQ ID NO: 4811908 - DNA, 10 bp, Homo sapiens
gttccagaca

SEQ ID NO: 4811909 - DNA, 11 bp, Homo sapiens
gttccagacag

SEQ ID NO: 4811910 - DNA, 13 bp, Homo sapiens
gttccagacagag

SEQ ID NO: 4811911 - DNA, 22 bp, Homo sapiens
gttccagacagagtggatctgg

SEQ ID NO: 4811912 - DNA, 12 bp, Homo sapiens
gttccagacagg

SEQ ID NO: 4811913 - DNA, 20 bp, Homo sapiens
gttccagacagggtggggct

SEQ ID NO: 4811914 - DNA, 16 bp, Homo sapiens
gttccatgaagacaaa

SEQ ID NO: 4811915 - DNA, 15 bp, Homo sapiens
gttccctcagccctc

SEQ ID NO: 4811916 - DNA, 16 bp, Homo sapiens
gttccctcagccctca

SEQ ID NO: 4811917 - DNA, 17 bp, Homo sapiens
gttccctgcgcgcagct

SEQ ID NO: 4811918 - DNA, 18 bp, Homo sapiens
gttccgttcatctgagga

SEQ ID NO: 4811919 - DNA, 23 bp, Homo sapiens
gttccgttcatctgaggagtcca

SEQ ID NO: 4811920 - DNA, 14 bp, Homo sapiens
gttcctaatcctct

SEQ ID NO: 4811921 - DNA, 13 bp, Homo sapiens
gttcctccagcaa

SEQ ID NO: 4811922 - DNA, 22 bp, Homo sapiens
gttcctccccagccccctggca

SEQ ID NO: 4811923 - DNA, 15 bp, Homo sapiens
gttcctgactgttct

SEQ ID NO: 4811924 - DNA, 21 bp, Homo sapiens
gttctagttagcaggaaatag

SEQ ID NO: 4811925 - DNA, 16 bp, Homo sapiens
gttctatatttactgt

SEQ ID NO: 4811926 - DNA, 16 bp, Homo sapiens
gttctatgatatacaa

SEQ ID NO: 4811927 - DNA, 21 bp, Homo sapiens
gttctcaatcattgtcagaga

SEQ ID NO: 4811928 - DNA, 17 bp, Homo sapiens
gttctcatcttgtaaat

SEQ ID NO: 4811929 - DNA, 20 bp, Homo sapiens
gttctccgggtgtggcctca

SEQ ID NO: 4811930 - DNA, 22 bp, Homo sapiens
gttctccgggtgtggcctcagc

SEQ ID NO: 4811931 - DNA, 23 bp, Homo sapiens
gttctccgggtgtggcctcagcc

SEQ ID NO: 4811932 - DNA, 22 bp, Homo sapiens
gttctctacctaatatgttctg

SEQ ID NO: 4811933 - DNA, 13 bp, Homo sapiens
gttctctccttct

SEQ ID NO: 4811934 - DNA, 22 bp, Homo sapiens
gttctctcttggtctctttctt

SEQ ID NO: 4811935 - DNA, 15 bp, Homo sapiens
gttctgaaaactgtt

SEQ ID NO: 4811936 - DNA, 19 bp, Homo sapiens
gttctgcaaatagaaaaca

SEQ ID NO: 4811937 - DNA, 21 bp, Homo sapiens
gttctgcaaatagaaaacagg

SEQ ID NO: 4811938 - DNA, 19 bp, Homo sapiens
gttctgcacatacagatgg

SEQ ID NO: 4811939 - DNA, 16 bp, Homo sapiens
gttctgcactgaaaag

SEQ ID NO: 4811940 - DNA, 14 bp, Homo sapiens
gttctgctttctga

SEQ ID NO: 4811941 - DNA, 21 bp, Homo sapiens
gttctgtgtcacgtgaccctg

SEQ ID NO: 4811942 - DNA, 23 bp, Homo sapiens
gttctgtgtcacgtgaccctgtg

SEQ ID NO: 4811943 - DNA, 15 bp, Homo sapiens
gttcttcaatgtgaa

SEQ ID NO: 4811944 - DNA, 15 bp, Homo sapiens
gttcttgagcagctg

SEQ ID NO: 4811945 - DNA, 17 bp, Homo sapiens
gttcttgcagcagagag

SEQ ID NO: 4811946 - DNA, 16 bp, Homo sapiens
gttcttgtaaaactgt

SEQ ID NO: 4811947 - DNA, 17 bp, Homo sapiens
gttcttgtaaaactgtg

SEQ ID NO: 4811948 - DNA, 19 bp, Homo sapiens
gttcttgtaaaactgtgac

SEQ ID NO: 4811949 - DNA, 21 bp, Homo sapiens
gttcttgtaaaactgtgacat

SEQ ID NO: 4811950 - DNA, 14 bp, Homo sapiens
gttctttcttttct

SEQ ID NO: 4811951 - DNA, 21 bp, Homo sapiens
gttctttgagggactgcctct

SEQ ID NO: 4811952 - DNA, 22 bp, Homo sapiens
gttctttgagggactgcctctg

SEQ ID NO: 4811953 - DNA, 16 bp, Homo sapiens
gttgaagacagagcta

SEQ ID NO: 4811954 - DNA, 17 bp, Homo sapiens
gttgaagggaaatcaat

SEQ ID NO: 4811955 - DNA, 16 bp, Homo sapiens
gttgaagtgcatgtta

SEQ ID NO: 4811956 - DNA, 11 bp, Homo sapiens
gttgaccttta

SEQ ID NO: 4811957 - DNA, 21 bp, Homo sapiens
gttgaggcagggcaaatgaca

SEQ ID NO: 4811958 - DNA, 13 bp, Homo sapiens
gttgcaattgttt

SEQ ID NO: 4811959 - DNA, 15 bp, Homo sapiens
gttgcagtcagaaga

SEQ ID NO: 4811960 - DNA, 19 bp, Homo sapiens
gttgcttacggtttctttg

SEQ ID NO: 4811961 - DNA, 18 bp, Homo sapiens
gttggaagggaccccaga

SEQ ID NO: 4811962 - DNA, 23 bp, Homo sapiens
gttggacagcaaaaccattgctt

SEQ ID NO: 4811963 - DNA, 15 bp, Homo sapiens
gttggccggctggcc

SEQ ID NO: 4811964 - DNA, 17 bp, Homo sapiens
gttggccggctggccgg

SEQ ID NO: 4811965 - DNA, 12 bp, Homo sapiens
gttggcctctgc

SEQ ID NO: 4811966 - DNA, 15 bp, Homo sapiens
gttgggccaggagcc

SEQ ID NO: 4811967 - DNA, 17 bp, Homo sapiens
gttgggccaggagcctc

SEQ ID NO: 4811968 - DNA, 23 bp, Homo sapiens
gttggtagatattcaggaaatgt

SEQ ID NO: 4811969 - DNA, 14 bp, Homo sapiens
gttggtatttactg

SEQ ID NO: 4811970 - DNA, 18 bp, Homo sapiens
gttggttacctattgctg

SEQ ID NO: 4811971 - DNA, 20 bp, Homo sapiens
gttggttttgcatgtctgca

SEQ ID NO: 4811972 - DNA, 23 bp, Homo sapiens
gttgtaaagatattgtatctcct

SEQ ID NO: 4811973 - DNA, 20 bp, Homo sapiens
gttgtaatatcagttacagt

SEQ ID NO: 4811974 - DNA, 17 bp, Homo sapiens
gttgtacatagtggtca

SEQ ID NO: 4811975 - DNA, 18 bp, Homo sapiens
taaaatggcatttagcac

SEQ ID NO: 4811976 - DNA, 19 bp, Homo sapiens
taaaatggcatttagcaca

SEQ ID NO: 4811977 - DNA, 16 bp, Homo sapiens
taaaatggtgttttca

SEQ ID NO: 4811978 - DNA, 13 bp, Homo sapiens
taaaatgtaaaaa

SEQ ID NO: 4811979 - DNA, 20 bp, Homo sapiens
taaaatgtattatgtcctgt

SEQ ID NO: 4811980 - DNA, 19 bp, Homo sapiens
taaaattatactgtgtgtg

SEQ ID NO: 4811981 - DNA, 13 bp, Homo sapiens
taaaattatctgt

SEQ ID NO: 4811982 - DNA, 16 bp, Homo sapiens
taaaattatctgttct

SEQ ID NO: 4811983 - DNA, 18 bp, Homo sapiens
taaaattatctgttctat

SEQ ID NO: 4811984 - DNA, 21 bp, Homo sapiens
taaaattattaaaaattatag

SEQ ID NO: 4811985 - DNA, 22 bp, Homo sapiens
taaaattattaaaaattataga

SEQ ID NO: 4811986 - DNA, 18 bp, Homo sapiens
taaaattccatggatctt

SEQ ID NO: 4811987 - DNA, 23 bp, Homo sapiens
taaaattgagttcttcctgtaat

SEQ ID NO: 4811988 - DNA, 13 bp, Homo sapiens
taaaattgcagca

SEQ ID NO: 4811989 - DNA, 14 bp, Homo sapiens
taaacaaaaacttt

SEQ ID NO: 4811990 - DNA, 22 bp, Homo sapiens
taaacaaaatttatgtcatttt

SEQ ID NO: 4811991 - DNA, 22 bp, Homo sapiens
taaacaaagagtagaactttaa

SEQ ID NO: 4811992 - DNA, 11 bp, Homo sapiens
taaacaaatgg

SEQ ID NO: 4811993 - DNA, 16 bp, Homo sapiens
taaacaattcaagtga

SEQ ID NO: 4811994 - DNA, 17 bp, Homo sapiens
taaacacagattatttg

SEQ ID NO: 4811995 - DNA, 16 bp, Homo sapiens
taaacacatagattca

SEQ ID NO: 4811996 - DNA, 16 bp, Homo sapiens
taaacacttctcctta

SEQ ID NO: 4811997 - DNA, 19 bp, Homo sapiens
taaacacttctccttaacc

SEQ ID NO: 4811998 - DNA, 12 bp, Homo sapiens
taaacagctgct

SEQ ID NO: 4811999 - DNA, 15 bp, Homo sapiens
taaacagctgcttta

SEQ ID NO: 4812000 - DNA, 16 bp, Homo sapiens
taaacatagtggtatt

SEQ ID NO: 4812001 - DNA, 20 bp, Homo sapiens
taaacattttttgtttcttg

SEQ ID NO: 4812002 - DNA, 22 bp, Homo sapiens
taaaccagcagcaggggaaaga

SEQ ID NO: 4812003 - DNA, 22 bp, Homo sapiens
taaacccacataaacacttctc

SEQ ID NO: 4812004 - DNA, 14 bp, Homo sapiens
taaacctatctgta

SEQ ID NO: 4812005 - DNA, 21 bp, Homo sapiens
taaacctatctgtattggcag

SEQ ID NO: 4812006 - DNA, 22 bp, Homo sapiens
taaacctgttcctgactgttct

SEQ ID NO: 4812007 - DNA, 23 bp, Homo sapiens
taaacctgttcctgactgttctc

SEQ ID NO: 4812008 - DNA, 12 bp, Homo sapiens
taaactgggaaa

SEQ ID NO: 4812009 - DNA, 14 bp, Homo sapiens
taaactgttaactt

SEQ ID NO: 4812010 - DNA, 20 bp, Homo sapiens
taaacttcagagttctctgt

SEQ ID NO: 4812011 - DNA, 14 bp, Homo sapiens
taaacttcagcaac

SEQ ID NO: 4812012 - DNA, 20 bp, Homo sapiens
taaacttgtgtatgatccaa

SEQ ID NO: 4812013 - DNA, 13 bp, Homo sapiens
taaagaaaccttt

SEQ ID NO: 4812014 - DNA, 15 bp, Homo sapiens
taaagaaaggcagag

SEQ ID NO: 4812015 - DNA, 15 bp, Homo sapiens
taaagaagtccatgt

SEQ ID NO: 4812016 - DNA, 23 bp, Homo sapiens
taaagaagtccatgtgataattg

SEQ ID NO: 4812017 - DNA, 23 bp, Homo sapiens
taaagaccatttagtcctcacct

SEQ ID NO: 4812018 - DNA, 22 bp, Homo sapiens
taaagagttctccttgtacttg

SEQ ID NO: 4812019 - DNA, 19 bp, Homo sapiens
taaagatattgtatctcct

SEQ ID NO: 4812020 - DNA, 22 bp, Homo sapiens
taaagatattgtatctccttta

SEQ ID NO: 4812021 - DNA, 13 bp, Homo sapiens
taaagatcttttt

SEQ ID NO: 4812022 - DNA, 16 bp, Homo sapiens
taaaggaaagttctat

SEQ ID NO: 4812023 - DNA, 19 bp, Homo sapiens
taaagggagccatgctctt

SEQ ID NO: 4812024 - DNA, 20 bp, Homo sapiens
taaaggggacagatcttgag

SEQ ID NO: 4812025 - DNA, 17 bp, Homo sapiens
taaaggtgatgaattta

SEQ ID NO: 4812026 - DNA, 15 bp, Homo sapiens
taaaggttctatgat

SEQ ID NO: 4812027 - DNA, 14 bp, Homo sapiens
taaagtaatttaca

SEQ ID NO: 4812028 - DNA, 15 bp, Homo sapiens
taaagtattccacct

SEQ ID NO: 4812029 - DNA, 19 bp, Homo sapiens
taaagtatttgggttttgt

SEQ ID NO: 4812030 - DNA, 16 bp, Homo sapiens
taaagtctacactgcc

SEQ ID NO: 4812031 - DNA, 18 bp, Homo sapiens
taaagtctacactgcctt

SEQ ID NO: 4812032 - DNA, 13 bp, Homo sapiens
taaagtgaccagg

SEQ ID NO: 4812033 - DNA, 15 bp, Homo sapiens
taaagtgaccaggct

SEQ ID NO: 4812034 - DNA, 13 bp, Homo sapiens
taaagtgattcct

SEQ ID NO: 4812035 - DNA, 18 bp, Homo sapiens
taaagttaaacattttta

SEQ ID NO: 4812036 - DNA, 11 bp, Homo sapiens
taaataaaata

SEQ ID NO: 4812037 - DNA, 20 bp, Homo sapiens
taaataaacacatagattca

SEQ ID NO: 4812038 - DNA, 22 bp, Homo sapiens
taaataaatgctgctttgggga

SEQ ID NO: 4812039 - DNA, 18 bp, Homo sapiens
taaataactgtgactgtg

SEQ ID NO: 4812040 - DNA, 14 bp, Homo sapiens
taaataagtaaata

SEQ ID NO: 4812041 - DNA, 18 bp, Homo sapiens
taaataagtaaatacatt

SEQ ID NO: 4812042 - DNA, 18 bp, Homo sapiens
taaataataaaggttcta

SEQ ID NO: 4812043 - DNA, 13 bp, Homo sapiens
taaataatctcat

SEQ ID NO: 4812044 - DNA, 14 bp, Homo sapiens
taaataatgcttaa

SEQ ID NO: 4812045 - DNA, 18 bp, Homo sapiens
taaatatacactttacat

SEQ ID NO: 4812046 - DNA, 20 bp, Homo sapiens
taaatatatatatatttctc

SEQ ID NO: 4812047 - DNA, 20 bp, Homo sapiens
taaatatatatttatcatat

SEQ ID NO: 4812048 - DNA, 22 bp, Homo sapiens
taaatattgctgtctgaaaaag

SEQ ID NO: 4812049 - DNA, 12 bp, Homo sapiens
taaatcacagat

SEQ ID NO: 4812050 - DNA, 13 bp, Homo sapiens
taaatcacagatt

SEQ ID NO: 4812051 - DNA, 20 bp, Homo sapiens
taaatcatatataataaatt

SEQ ID NO: 4812052 - DNA, 15 bp, Homo sapiens
taaatccacagtgag

SEQ ID NO: 4812053 - DNA, 15 bp, Homo sapiens
taaatcccacgacat

SEQ ID NO: 4812054 - DNA, 13 bp, Homo sapiens
taaatctaacatt

SEQ ID NO: 4812055 - DNA, 19 bp, Homo sapiens
taaatctactcttaaatat

SEQ ID NO: 4812056 - DNA, 13 bp, Homo sapiens
taaatctatctct

SEQ ID NO: 4812057 - DNA, 22 bp, Homo sapiens
taaatcttacccttcaatgtta

SEQ ID NO: 4812058 - DNA, 18 bp, Homo sapiens
taaatctttgttaaaata

SEQ ID NO: 4812059 - DNA, 19 bp, Homo sapiens
taaatctttgttaaaatat

SEQ ID NO: 4812060 - DNA, 14 bp, Homo sapiens
taaatcttttgggg

SEQ ID NO: 4812061 - DNA, 12 bp, Homo sapiens
taaatgaatgaa

SEQ ID NO: 4812062 - DNA, 24 bp, Homo sapiens
taaatgatctgtactatctagtgt

SEQ ID NO: 4812063 - DNA, 20 bp, Homo sapiens
taaatgcaaacactgtgtat

SEQ ID NO: 4812064 - DNA, 13 bp, Homo sapiens
taaatgctgcttt

SEQ ID NO: 4812065 - DNA, 15 bp, Homo sapiens
taaatgctgctttgg

SEQ ID NO: 4812066 - DNA, 20 bp, Homo sapiens
taaatggaggtacaggatat

SEQ ID NO: 4812067 - DNA, 14 bp, Homo sapiens
taaatgtatattga

SEQ ID NO: 4812068 - DNA, 19 bp, Homo sapiens
taaatgtatattgatgtaa

SEQ ID NO: 4812069 - DNA, 12 bp, Homo sapiens
taaatgtctata

SEQ ID NO: 4812070 - DNA, 23 bp, Homo sapiens
taaatgtcttcatgttgatgtgt

SEQ ID NO: 4812071 - DNA, 16 bp, Homo sapiens
taaatgtgaaattttt

SEQ ID NO: 4812072 - DNA, 14 bp, Homo sapiens
taaatgtgtaaatg

SEQ ID NO: 4812073 - DNA, 17 bp, Homo sapiens
taaatgtgtaaatgtgg

SEQ ID NO: 4812074 - DNA, 11 bp, Homo sapiens
taaatgtgtgt

SEQ ID NO: 4812075 - DNA, 13 bp, Homo sapiens
taaatgtgtgtat

SEQ ID NO: 4812076 - DNA, 14 bp, Homo sapiens
taaatgtgtgtatg

SEQ ID NO: 4812077 - DNA, 15 bp, Homo sapiens
taaattaaataaaat

SEQ ID NO: 4812078 - DNA, 14 bp, Homo sapiens
taaattaaatatat

SEQ ID NO: 4812079 - DNA, 16 bp, Homo sapiens
taaattaacaaattca

SEQ ID NO: 4812080 - DNA, 21 bp, Homo sapiens
taaattaatgagttttatcca

SEQ ID NO: 4812081 - DNA, 15 bp, Homo sapiens
taaattacatgcatg

SEQ ID NO: 4812082 - DNA, 16 bp, Homo sapiens
taaattatatgatatg

SEQ ID NO: 4812083 - DNA, 15 bp, Homo sapiens
taaattcaaacctaa

SEQ ID NO: 4812084 - DNA, 14 bp, Homo sapiens
taaattcctaattc

SEQ ID NO: 4812085 - DNA, 23 bp, Homo sapiens
taaattgtttggcttcctcctga

SEQ ID NO: 4812086 - DNA, 16 bp, Homo sapiens
taaatttattaaatgt

SEQ ID NO: 4812087 - DNA, 17 bp, Homo sapiens
taaatttattaaatgtt

SEQ ID NO: 4812088 - DNA, 13 bp, Homo sapiens
taacaaattcagt

SEQ ID NO: 4812089 - DNA, 18 bp, Homo sapiens
taacaatgcctattgtaa

SEQ ID NO: 4812090 - DNA, 13 bp, Homo sapiens
taacaatgccttg

SEQ ID NO: 4812091 - DNA, 21 bp, Homo sapiens
taacagaaaaatgaaatttaa

SEQ ID NO: 4812092 - DNA, 15 bp, Homo sapiens
taacagtaaatatac

SEQ ID NO: 4812093 - DNA, 14 bp, Homo sapiens
taacagtaactgcc

SEQ ID NO: 4812094 - DNA, 22 bp, Homo sapiens
taacagtaactgccattttttg

SEQ ID NO: 4812095 - DNA, 14 bp, Homo sapiens
taacagtatttcca

SEQ ID NO: 4812096 - DNA, 19 bp, Homo sapiens
taacataaacttgtactta

SEQ ID NO: 4812097 - DNA, 15 bp, Homo sapiens
taacatggaagtact

SEQ ID NO: 4812098 - DNA, 17 bp, Homo sapiens
ggctgggcgcctctgtc

SEQ ID NO: 4812099 - DNA, 22 bp, Homo sapiens
ggctgggcgcctctgtcctggc

SEQ ID NO: 4812100 - DNA, 14 bp, Homo sapiens
ggctgggtcgcccc

SEQ ID NO: 4812101 - DNA, 17 bp, Homo sapiens
ggctgggtcgcccctcc

SEQ ID NO: 4812102 - DNA, 21 bp, Homo sapiens
ggctgggtcgcccctcctcgg

SEQ ID NO: 4812103 - DNA, 22 bp, Homo sapiens
ggctgtcaaatccatgtgtccc

SEQ ID NO: 4812104 - DNA, 20 bp, Homo sapiens
ggctgtgaggacagggcccc

SEQ ID NO: 4812105 - DNA, 14 bp, Homo sapiens
ggctgtggcccctc

SEQ ID NO: 4812106 - DNA, 16 bp, Homo sapiens
ggctgtggcccctcct

SEQ ID NO: 4812107 - DNA, 21 bp, Homo sapiens
ggctgtggcccctccttctcc

SEQ ID NO: 4812108 - DNA, 15 bp, Homo sapiens
ggctgttagctcaga

SEQ ID NO: 4812109 - DNA, 20 bp, Homo sapiens
ggctgttagctcagaggaga

SEQ ID NO: 4812110 - DNA, 19 bp, Homo sapiens
ggctgttctgcactgaaaa

SEQ ID NO: 4812111 - DNA, 13 bp, Homo sapiens
ggcttaaacattt

SEQ ID NO: 4812112 - DNA, 16 bp, Homo sapiens
ggcttatcagaactcc

SEQ ID NO: 4812113 - DNA, 17 bp, Homo sapiens
ggcttcaccgcattcca

SEQ ID NO: 4812114 - DNA, 19 bp, Homo sapiens
ggcttcaccgcattccagg

SEQ ID NO: 4812115 - DNA, 18 bp, Homo sapiens
ggcttcatcctcctcaga

SEQ ID NO: 4812116 - DNA, 22 bp, Homo sapiens
ggcttcatcctcctcagatctt

SEQ ID NO: 4812117 - DNA, 21 bp, Homo sapiens
ggcttccagctcagtcccaca

SEQ ID NO: 4812118 - DNA, 15 bp, Homo sapiens
ggcttccatggtggt

SEQ ID NO: 4812119 - DNA, 17 bp, Homo sapiens
ggcttccatggtggttt

SEQ ID NO: 4812120 - DNA, 22 bp, Homo sapiens
ggcttccatggtggtttcagaa

SEQ ID NO: 4812121 - DNA, 16 bp, Homo sapiens
ggcttcctccctccac

SEQ ID NO: 4812122 - DNA, 19 bp, Homo sapiens
ggcttcctccctccacgct

SEQ ID NO: 4812123 - DNA, 24 bp, Homo sapiens
ggcttctgggacaggcaccatgct

SEQ ID NO: 4812124 - DNA, 13 bp, Homo sapiens
ggcttctgggcgc

SEQ ID NO: 4812125 - DNA, 16 bp, Homo sapiens
ggcttggaagggcgct

SEQ ID NO: 4812126 - DNA, 18 bp, Homo sapiens
ggcttggcgtggagcagg

SEQ ID NO: 4812127 - DNA, 18 bp, Homo sapiens
ggcttggggaccagagct

SEQ ID NO: 4812128 - DNA, 21 bp, Homo sapiens
ggcttggggaccagagctgcc

SEQ ID NO: 4812129 - DNA, 21 bp, Homo sapiens
ggcttggggtagagaggacag

SEQ ID NO: 4812130 - DNA, 16 bp, Homo sapiens
ggcttgtagggtgagg

SEQ ID NO: 4812131 - DNA, 12 bp, Homo sapiens
ggctttctattg

SEQ ID NO: 4812132 - DNA, 20 bp, Homo sapiens
ggctttgggtagtgccatgg

SEQ ID NO: 4812133 - DNA, 22 bp, Homo sapiens
ggcttttaaacctgttcctgac

SEQ ID NO: 4812134 - DNA, 11 bp, Homo sapiens
gggaaaaagat

SEQ ID NO: 4812135 - DNA, 16 bp, Homo sapiens
gggaaaacataatatc

SEQ ID NO: 4812136 - DNA, 16 bp, Homo sapiens
gggaaaacctcagttg

SEQ ID NO: 4812137 - DNA, 23 bp, Homo sapiens
gggaaaacctcagttggcctctg

SEQ ID NO: 4812138 - DNA, 16 bp, Homo sapiens
gggaactcccccagag

SEQ ID NO: 4812139 - DNA, 17 bp, Homo sapiens
gggaactcccccagagg

SEQ ID NO: 4812140 - DNA, 20 bp, Homo sapiens
gggaactcccccagaggtgg

SEQ ID NO: 4812141 - DNA, 14 bp, Homo sapiens
gggaactctgacaa

SEQ ID NO: 4812142 - DNA, 17 bp, Homo sapiens
gggaagagagaggcctg

SEQ ID NO: 4812143 - DNA, 18 bp, Homo sapiens
gggaagagagaggcctgg

SEQ ID NO: 4812144 - DNA, 16 bp, Homo sapiens
gggaagcccacccgcc

SEQ ID NO: 4812145 - DNA, 22 bp, Homo sapiens
gggaagcccacccgccccagag

SEQ ID NO: 4812146 - DNA, 23 bp, Homo sapiens
gggaagcccacccgccccagaga

SEQ ID NO: 4812147 - DNA, 13 bp, Homo sapiens
gggaagctgcagc

SEQ ID NO: 4812148 - DNA, 14 bp, Homo sapiens
gggaaggcctgagg

SEQ ID NO: 4812149 - DNA, 22 bp, Homo sapiens
gggaaggcctgagggaagccca

SEQ ID NO: 4812150 - DNA, 17 bp, Homo sapiens
gggaaggggcctgggct

SEQ ID NO: 4812151 - DNA, 19 bp, Homo sapiens
gggaaggggcctgggctgt

SEQ ID NO: 4812152 - DNA, 14 bp, Homo sapiens
gggaagtgaccaag

SEQ ID NO: 4812153 - DNA, 23 bp, Homo sapiens
gggacaagccaggccctctctgc

SEQ ID NO: 4812154 - DNA, 20 bp, Homo sapiens
gggacagatcttgagcaagg

SEQ ID NO: 4812155 - DNA, 16 bp, Homo sapiens
gggacagcggccccgc

SEQ ID NO: 4812156 - DNA, 22 bp, Homo sapiens
gggacagcggccccgcggagcc

SEQ ID NO: 4812157 - DNA, 17 bp, Homo sapiens
gggacaggcaccatgct

SEQ ID NO: 4812158 - DNA, 22 bp, Homo sapiens
gggaccccagatacctgtgagg

SEQ ID NO: 4812159 - DNA, 20 bp, Homo sapiens
gggacctactcctccccctc

SEQ ID NO: 4812160 - DNA, 12 bp, Homo sapiens
gggacctcaggc

SEQ ID NO: 4812161 - DNA, 21 bp, Homo sapiens
gggacgagcagagcgcagccc

SEQ ID NO: 4812162 - DNA, 17 bp, Homo sapiens
gggacgcccagccccca

SEQ ID NO: 4812163 - DNA, 20 bp, Homo sapiens
gggacggggcccgccccagg

SEQ ID NO: 4812164 - DNA, 19 bp, Homo sapiens
gggactccaagccctgggg

SEQ ID NO: 4812165 - DNA, 21 bp, Homo sapiens
gggactccaagccctggggca

SEQ ID NO: 4812166 - DNA, 16 bp, Homo sapiens
gggactccagaagcag

SEQ ID NO: 4812167 - DNA, 22 bp, Homo sapiens
gggactccagaagcagcagcta

SEQ ID NO: 4812168 - DNA, 14 bp, Homo sapiens
gggactgctcaggc

SEQ ID NO: 4812169 - DNA, 21 bp, Homo sapiens
gggactggcccacccctcttc

SEQ ID NO: 4812170 - DNA, 21 bp, Homo sapiens
gggagaaccaaaaagaggcta

SEQ ID NO: 4812171 - DNA, 13 bp, Homo sapiens
gggagagcgccac

SEQ ID NO: 4812172 - DNA, 17 bp, Homo sapiens
gggagagcgccacccgc

SEQ ID NO: 4812173 - DNA, 18 bp, Homo sapiens
gggagagcgccacccgcc

SEQ ID NO: 4812174 - DNA, 17 bp, Homo sapiens
gggagattaaaaccaga

SEQ ID NO: 4812175 - DNA, 15 bp, Homo sapiens
gggagccatgctctt

SEQ ID NO: 4812176 - DNA, 23 bp, Homo sapiens
gggagccctcaggcacctgcact

SEQ ID NO: 4812177 - DNA, 15 bp, Homo sapiens
gggagccgcaggggc

SEQ ID NO: 4812178 - DNA, 19 bp, Homo sapiens
gggagccgcaggggcccct

SEQ ID NO: 4812179 - DNA, 21 bp, Homo sapiens
gggaggacagttagacccctg

SEQ ID NO: 4812180 - DNA, 21 bp, Homo sapiens
gggaggagcacccccagcctc

SEQ ID NO: 4812181 - DNA, 16 bp, Homo sapiens
gggagggaacagacct

SEQ ID NO: 4812182 - DNA, 16 bp, Homo sapiens
gggagggacacagagg

SEQ ID NO: 4812183 - DNA, 14 bp, Homo sapiens
gggagggcctctgg

SEQ ID NO: 4812184 - DNA, 13 bp, Homo sapiens
gggaggggaagag

SEQ ID NO: 4812185 - DNA, 13 bp, Homo sapiens
gggaggggccctg

SEQ ID NO: 4812186 - DNA, 15 bp, Homo sapiens
gggagggtgggcgtg

SEQ ID NO: 4812187 - DNA, 17 bp, Homo sapiens
gggaggtcaggccctgg

SEQ ID NO: 4812188 - DNA, 22 bp, Homo sapiens
gggaggtcaggccctggaactc

SEQ ID NO: 4812189 - DNA, 13 bp, Homo sapiens
gggaggtggccag

SEQ ID NO: 4812190 - DNA, 18 bp, Homo sapiens
gggagtcaagtgtgcctg

SEQ ID NO: 4812191 - DNA, 19 bp, Homo sapiens
gggagtcaagtgtgcctgc

SEQ ID NO: 4812192 - DNA, 20 bp, Homo sapiens
gggagtccactttcctctct

SEQ ID NO: 4812193 - DNA, 23 bp, Homo sapiens
gggagtccactttcctctctctc

SEQ ID NO: 4812194 - DNA, 18 bp, Homo sapiens
gggagtctcctcactgcc

SEQ ID NO: 4812195 - DNA, 20 bp, Homo sapiens
gggagtctcctcactgccac

SEQ ID NO: 4812196 - DNA, 21 bp, Homo sapiens
gggagtctcctcactgccact

SEQ ID NO: 4812197 - DNA, 13 bp, Homo sapiens
gggagtggccaca

SEQ ID NO: 4812198 - DNA, 19 bp, Homo sapiens
gggatcttacccacttccc

SEQ ID NO: 4812199 - DNA, 21 bp, Homo sapiens
gggatgctatctcgctagcca

SEQ ID NO: 4812200 - DNA, 12 bp, Homo sapiens
gggatgcttcat

SEQ ID NO: 4812201 - DNA, 14 bp, Homo sapiens
gggatgggccaggg

SEQ ID NO: 4812202 - DNA, 11 bp, Homo sapiens
gggattacaga

SEQ ID NO: 4812203 - DNA, 20 bp, Homo sapiens
gggattcctcccctggaagt

SEQ ID NO: 4812204 - DNA, 14 bp, Homo sapiens
gggcaaaccaggct

SEQ ID NO: 4812205 - DNA, 22 bp, Homo sapiens
gggcaaatgacatgcactgacc

SEQ ID NO: 4812206 - DNA, 18 bp, Homo sapiens
gggcaaccctggtgacca

SEQ ID NO: 4812207 - DNA, 20 bp, Homo sapiens
gggcaaggatacccggtggc

SEQ ID NO: 4812208 - DNA, 13 bp, Homo sapiens
gggcaaggggcca

SEQ ID NO: 4812209 - DNA, 16 bp, Homo sapiens
gggcaaggggccagga

SEQ ID NO: 4812210 - DNA, 20 bp, Homo sapiens
gggcacatagcataggctgg

SEQ ID NO: 4812211 - DNA, 17 bp, Homo sapiens
gggcacgggagagcgcc

SEQ ID NO: 4812212 - DNA, 22 bp, Homo sapiens
gggcacgggagagcgccacccg

SEQ ID NO: 4812213 - DNA, 14 bp, Homo sapiens
gggcagaatagctg

SEQ ID NO: 4812214 - DNA, 16 bp, Homo sapiens
gggcagaccagagagc

SEQ ID NO: 4812215 - DNA, 22 bp, Homo sapiens
gggcagagaccaccgcgcccct

SEQ ID NO: 4812216 - DNA, 12 bp, Homo sapiens
gggcagcaccct

SEQ ID NO: 4812217 - DNA, 15 bp, Homo sapiens
gggcagcccagagag

SEQ ID NO: 4812218 - DNA, 22 bp, Homo sapiens
gggcagcccagagagaccctgc

SEQ ID NO: 4812219 - DNA, 20 bp, Homo sapiens
gggcagccccgcgaccaccc

SEQ ID NO: 4812220 - DNA, 21 bp, Homo sapiens
gggcagccccgcgaccacccc

SEQ ID NO: 4812221 - DNA, 23 bp, Homo sapiens
gggcagccccgcgaccacccctg

SEQ ID NO: 4812222 - DNA, 11 bp, Homo sapiens
gggcagcccct

SEQ ID NO: 4812223 - DNA, 12 bp, Homo sapiens
gggcagcccctg

SEQ ID NO: 4812224 - DNA, 16 bp, Homo sapiens
gggcaggcctcccaag

SEQ ID NO: 4812225 - DNA, 11 bp, Homo sapiens
gggcagggccg

SEQ ID NO: 4812226 - DNA, 17 bp, Homo sapiens
gggcagggccgcagggc

SEQ ID NO: 4812227 - DNA, 20 bp, Homo sapiens
gggcagggccgcagggcgct

SEQ ID NO: 4812228 - DNA, 18 bp, Homo sapiens
gggcagggtggggggcca

SEQ ID NO: 4812229 - DNA, 14 bp, Homo sapiens
gggcagtggagagg

SEQ ID NO: 4812230 - DNA, 17 bp, Homo sapiens
gggcagtggagagggga

SEQ ID NO: 4812231 - DNA, 19 bp, Homo sapiens
gggcagtggagaggggact

SEQ ID NO: 4812232 - DNA, 23 bp, Homo sapiens
gggccactcaccgacccgacact

SEQ ID NO: 4812233 - DNA, 16 bp, Homo sapiens
gggccaggaaggggac

SEQ ID NO: 4812234 - DNA, 11 bp, Homo sapiens
gggccaggagc

SEQ ID NO: 4812235 - DNA, 20 bp, Homo sapiens
gggccagtcatggctgtccc

SEQ ID NO: 4812236 - DNA, 13 bp, Homo sapiens
gggcccaggaggg

SEQ ID NO: 4812237 - DNA, 17 bp, Homo sapiens
gggccccatggtcacag

SEQ ID NO: 4812238 - DNA, 22 bp, Homo sapiens
gggccccccagctcaggggcag

SEQ ID NO: 4812239 - DNA, 13 bp, Homo sapiens
gggcccctccacg

SEQ ID NO: 4812240 - DNA, 23 bp, Homo sapiens
gggcccctcctccagagcctggg

SEQ ID NO: 4812241 - DNA, 11 bp, Homo sapiens
gggcccctgcg

SEQ ID NO: 4812242 - DNA, 13 bp, Homo sapiens
gggcccgagcgcg

SEQ ID NO: 4812243 - DNA, 16 bp, Homo sapiens
gggcccgcactcagga

SEQ ID NO: 4812244 - DNA, 20 bp, Homo sapiens
gggcccgctcaacctctcag

SEQ ID NO: 4812245 - DNA, 23 bp, Homo sapiens
gggccctaggcatactctccagg

SEQ ID NO: 4812246 - DNA, 17 bp, Homo sapiens
gggccctctctccgccc

SEQ ID NO: 4812247 - DNA, 21 bp, Homo sapiens
gggccctctctccgccccgga

SEQ ID NO: 4812248 - DNA, 23 bp, Homo sapiens
gggccctgaaatggcctgtccct

SEQ ID NO: 4812249 - DNA, 12 bp, Homo sapiens
gggccctgccgt

SEQ ID NO: 4812250 - DNA, 11 bp, Homo sapiens
gggccctgctc

SEQ ID NO: 4812251 - DNA, 16 bp, Homo sapiens
gggccctgctcaggcc

SEQ ID NO: 4812252 - DNA, 19 bp, Homo sapiens
gggccctgctcaggcctca

SEQ ID NO: 4812253 - DNA, 11 bp, Homo sapiens
gggccctgggc

SEQ ID NO: 4812254 - DNA, 14 bp, Homo sapiens
gggccctgggcctc

SEQ ID NO: 4812255 - DNA, 21 bp, Homo sapiens
gggccctggggtctctgagca

SEQ ID NO: 4812256 - DNA, 20 bp, Homo sapiens
gggcccttcccaacctcccc

SEQ ID NO: 4812257 - DNA, 21 bp, Homo sapiens
gggcccttcccaacctcccct

SEQ ID NO: 4812258 - DNA, 22 bp, Homo sapiens
gggccgccgaagggcagccccg

SEQ ID NO: 4812259 - DNA, 13 bp, Homo sapiens
gggccgcctcctc

SEQ ID NO: 4812260 - DNA, 15 bp, Homo sapiens
gggcctcggcctggc

SEQ ID NO: 4812261 - DNA, 16 bp, Homo sapiens
gggcctcggcctggct

SEQ ID NO: 4812262 - DNA, 11 bp, Homo sapiens
gggcctgggct

SEQ ID NO: 4812263 - DNA, 22 bp, Homo sapiens
gggcctgggctgtgaggacagg

SEQ ID NO: 4812264 - DNA, 20 bp, Homo sapiens
gggcctgggtccccctcctg

SEQ ID NO: 4812265 - DNA, 21 bp, Homo sapiens
gggcctgggtccccctcctgc

SEQ ID NO: 4812266 - DNA, 15 bp, Homo sapiens
gggcgagaagggcgc

SEQ ID NO: 4812267 - DNA, 19 bp, Homo sapiens
gggcgagaagggcgcagga

SEQ ID NO: 4812268 - DNA, 18 bp, Homo sapiens
gggcgcctgcgctcctct

SEQ ID NO: 4812269 - DNA, 19 bp, Homo sapiens
gggcgcgcgcccccaggac

SEQ ID NO: 4812270 - DNA, 18 bp, Homo sapiens
gggcgcgggacaggactt

SEQ ID NO: 4812271 - DNA, 16 bp, Homo sapiens
gggcgctccggcagag

SEQ ID NO: 4812272 - DNA, 17 bp, Homo sapiens
gggcgctccggcagagg

SEQ ID NO: 4812273 - DNA, 20 bp, Homo sapiens
gggcgctccggcagaggcag

SEQ ID NO: 4812274 - DNA, 19 bp, Homo sapiens
gggcgctcctcccagctgt

SEQ ID NO: 4812275 - DNA, 16 bp, Homo sapiens
gggcgctgagggcagg

SEQ ID NO: 4812276 - DNA, 17 bp, Homo sapiens
gggcgctgcccccacag

SEQ ID NO: 4812277 - DNA, 15 bp, Homo sapiens
gggcgggccaggaga

SEQ ID NO: 4812278 - DNA, 23 bp, Homo sapiens
gggcgttatgtaagtttctaaga

SEQ ID NO: 4812279 - DNA, 18 bp, Homo sapiens
gggctaactggccccagg

SEQ ID NO: 4812280 - DNA, 19 bp, Homo sapiens
gggctaactggccccaggc

SEQ ID NO: 4812281 - DNA, 20 bp, Homo sapiens
gggctaactggccccaggcg

SEQ ID NO: 4812282 - DNA, 20 bp, Homo sapiens
gggctctctcacccagcctg

SEQ ID NO: 4812283 - DNA, 15 bp, Homo sapiens
gggctgaatgtatgt

SEQ ID NO: 4812284 - DNA, 12 bp, Homo sapiens
gggctgagcccc

SEQ ID NO: 4812285 - DNA, 19 bp, Homo sapiens
gggctgagcccctcctctc

SEQ ID NO: 4812286 - DNA, 20 bp, Homo sapiens
gggctgagcccctcctctcc

SEQ ID NO: 4812287 - DNA, 20 bp, Homo sapiens
gggctgcatcctcagcccca

SEQ ID NO: 4812288 - DNA, 21 bp, Homo sapiens
gggctgcatcctcagccccag

SEQ ID NO: 4812289 - DNA, 22 bp, Homo sapiens
gggctgcatcctcagccccagg

SEQ ID NO: 4812290 - DNA, 23 bp, Homo sapiens
gggctgcatgatttttgccctgc

SEQ ID NO: 4812291 - DNA, 17 bp, Homo sapiens
gggctgcttctccacct

SEQ ID NO: 4812292 - DNA, 15 bp, Homo sapiens
gggctggccctgccc

SEQ ID NO: 4812293 - DNA, 21 bp, Homo sapiens
gggctggccctgccctccccc

SEQ ID NO: 4812294 - DNA, 15 bp, Homo sapiens
gggctgggcgcctct

SEQ ID NO: 4812295 - DNA, 14 bp, Homo sapiens
gggctgtctgtcac

SEQ ID NO: 4812296 - DNA, 15 bp, Homo sapiens
gggcttctccccctc

SEQ ID NO: 4812297 - DNA, 16 bp, Homo sapiens
gggcttggaagggcgc

SEQ ID NO: 4812298 - DNA, 13 bp, Homo sapiens
gggcttggggtag

SEQ ID NO: 4812299 - DNA, 19 bp, Homo sapiens
gggcttggggtagagagga

SEQ ID NO: 4812300 - DNA, 15 bp, Homo sapiens
ggggaactcccccag

SEQ ID NO: 4812301 - DNA, 17 bp, Homo sapiens
ggggaactcccccagag

SEQ ID NO: 4812302 - DNA, 22 bp, Homo sapiens
ggggaactcccccagaggtgga

SEQ ID NO: 4812303 - DNA, 14 bp, Homo sapiens
ggggaagagagagg

SEQ ID NO: 4812304 - DNA, 15 bp, Homo sapiens
ggggaagctgcagct

SEQ ID NO: 4812305 - DNA, 12 bp, Homo sapiens
ggggaaggggcc

SEQ ID NO: 4812306 - DNA, 14 bp, Homo sapiens
ggggaaggggcctg

SEQ ID NO: 4812307 - DNA, 15 bp, Homo sapiens
ggggaaggggcctgg

SEQ ID NO: 4812308 - DNA, 17 bp, Homo sapiens
ggggacacaggatcctg

SEQ ID NO: 4812309 - DNA, 12 bp, Homo sapiens
ggggaccagagc

SEQ ID NO: 4812310 - DNA, 13 bp, Homo sapiens
ggggaccagagct

SEQ ID NO: 4812311 - DNA, 23 bp, Homo sapiens
ggggacttcgggggcggctctgg

SEQ ID NO: 4812312 - DNA, 14 bp, Homo sapiens
ggggagaatggctc

SEQ ID NO: 4812313 - DNA, 13 bp, Homo sapiens
ggggaggagcacc

SEQ ID NO: 4812314 - DNA, 18 bp, Homo sapiens
ggggaggagcacccccag

SEQ ID NO: 4812315 - DNA, 17 bp, Homo sapiens
ggggaggcttccagctc

SEQ ID NO: 4812316 - DNA, 12 bp, Homo sapiens
ggggagggcgct

SEQ ID NO: 4812317 - DNA, 12 bp, Homo sapiens
ggggatgcaggc

SEQ ID NO: 4812318 - DNA, 23 bp, Homo sapiens
ggggcaagagctcaggagaaggc

SEQ ID NO: 4812319 - DNA, 14 bp, Homo sapiens
ggggcacagccaga

SEQ ID NO: 4812320 - DNA, 15 bp, Homo sapiens
ggggcacagccagaa

SEQ ID NO: 4812321 - DNA, 16 bp, Homo sapiens
ggggcagaccagagag

SEQ ID NO: 4812322 - DNA, 23 bp, Homo sapiens
ggtccaccccgttgttgtccctg

SEQ ID NO: 4812323 - DNA, 12 bp, Homo sapiens
ggtccaggagat

SEQ ID NO: 4812324 - DNA, 19 bp, Homo sapiens
ggtccagggtccagccctc

SEQ ID NO: 4812325 - DNA, 22 bp, Homo sapiens
ggtcccagctacaggggaggct

SEQ ID NO: 4812326 - DNA, 19 bp, Homo sapiens
ggtcccagtccggtgcctt

SEQ ID NO: 4812327 - DNA, 20 bp, Homo sapiens
ggtcccccatgccaccaccc

SEQ ID NO: 4812328 - DNA, 16 bp, Homo sapiens
ggtcccccatgggctg

SEQ ID NO: 4812329 - DNA, 12 bp, Homo sapiens
ggtccccctcct

SEQ ID NO: 4812330 - DNA, 19 bp, Homo sapiens
ggtccccggacgctggctc

SEQ ID NO: 4812331 - DNA, 12 bp, Homo sapiens
ggtcctcccagc

SEQ ID NO: 4812332 - DNA, 21 bp, Homo sapiens
ggtcctgctgctcgggaaggc

SEQ ID NO: 4812333 - DNA, 21 bp, Homo sapiens
ggtcctgtcctggctcccagg

SEQ ID NO: 4812334 - DNA, 17 bp, Homo sapiens
ggtcctttgagtgtcag

SEQ ID NO: 4812335 - DNA, 12 bp, Homo sapiens
ggtcgcccctcc

SEQ ID NO: 4812336 - DNA, 13 bp, Homo sapiens
ggtcgcccctcct

SEQ ID NO: 4812337 - DNA, 18 bp, Homo sapiens
ggtcgggggaggagcacc

SEQ ID NO: 4812338 - DNA, 15 bp, Homo sapiens
ggtctccacccctca

SEQ ID NO: 4812339 - DNA, 21 bp, Homo sapiens
ggtctgagaagattcaattta

SEQ ID NO: 4812340 - DNA, 19 bp, Homo sapiens
ggtctgctgcctcaggaat

SEQ ID NO: 4812341 - DNA, 15 bp, Homo sapiens
ggtctggagccccta

SEQ ID NO: 4812342 - DNA, 19 bp, Homo sapiens
ggtctgtgcattgtggctg

SEQ ID NO: 4812343 - DNA, 16 bp, Homo sapiens
ggtctgtgggactggc

SEQ ID NO: 4812344 - DNA, 22 bp, Homo sapiens
ggtctgtgttctcaacacacag

SEQ ID NO: 4812345 - DNA, 22 bp, Homo sapiens
ggtcttggattggtaccagagc

SEQ ID NO: 4812346 - DNA, 13 bp, Homo sapiens
ggtgaacagaaca

SEQ ID NO: 4812347 - DNA, 20 bp, Homo sapiens
ggtgaactgaagcagagtca

SEQ ID NO: 4812348 - DNA, 17 bp, Homo sapiens
ggtgaagagcatagtta

SEQ ID NO: 4812349 - DNA, 13 bp, Homo sapiens
ggtgaaggggctg

SEQ ID NO: 4812350 - DNA, 20 bp, Homo sapiens
ggtgagactctgaggtgtca

SEQ ID NO: 4812351 - DNA, 23 bp, Homo sapiens
ggtgatcccccaaacagcatgtg

SEQ ID NO: 4812352 - DNA, 16 bp, Homo sapiens
ggtgattatgaaatgc

SEQ ID NO: 4812353 - DNA, 20 bp, Homo sapiens
ggtgcaggcgcgcaccgccc

SEQ ID NO: 4812354 - DNA, 21 bp, Homo sapiens
ggtgcatttgagagaagccac

SEQ ID NO: 4812355 - DNA, 15 bp, Homo sapiens
ggtgccatcacgctt

SEQ ID NO: 4812356 - DNA, 21 bp, Homo sapiens
ggtgcccagactcaaggcctc

SEQ ID NO: 4812357 - DNA, 19 bp, Homo sapiens
ggtgccccccatgccctcc

SEQ ID NO: 4812358 - DNA, 22 bp, Homo sapiens
ggtgccccccatgccctccctg

SEQ ID NO: 4812359 - DNA, 18 bp, Homo sapiens
ggtgccccctggggggca

SEQ ID NO: 4812360 - DNA, 16 bp, Homo sapiens
ggtgcccgtgtggcct

SEQ ID NO: 4812361 - DNA, 19 bp, Homo sapiens
ggtgcccgtgtggcctggg

SEQ ID NO: 4812362 - DNA, 21 bp, Homo sapiens
ggtgcccgtgtggcctgggtc

SEQ ID NO: 4812363 - DNA, 23 bp, Homo sapiens
ggtgccctgttgacctaccctgg

SEQ ID NO: 4812364 - DNA, 18 bp, Homo sapiens
ggtgccttccaccctgcc

SEQ ID NO: 4812365 - DNA, 20 bp, Homo sapiens
ggtgccttccaccctgccct

SEQ ID NO: 4812366 - DNA, 23 bp, Homo sapiens
ggtgccttccaccctgccctggc

SEQ ID NO: 4812367 - DNA, 20 bp, Homo sapiens
ggtgcggaccggagcggctg

SEQ ID NO: 4812368 - DNA, 17 bp, Homo sapiens
ggtgctggggctgcatg

SEQ ID NO: 4812369 - DNA, 18 bp, Homo sapiens
ggtgctgggtccttaaaa

SEQ ID NO: 4812370 - DNA, 20 bp, Homo sapiens
ggtgctgtcatgcccagctt

SEQ ID NO: 4812371 - DNA, 21 bp, Homo sapiens
ggtgcttctcacactggagga

SEQ ID NO: 4812372 - DNA, 22 bp, Homo sapiens
ggtgcttctcacactggaggag

SEQ ID NO: 4812373 - DNA, 13 bp, Homo sapiens
ggtggaagggcag

SEQ ID NO: 4812374 - DNA, 13 bp, Homo sapiens
ggtggaggtgggt

SEQ ID NO: 4812375 - DNA, 12 bp, Homo sapiens
ggtggcaccaga

SEQ ID NO: 4812376 - DNA, 21 bp, Homo sapiens
ggtggcaccagatgcaacctc

SEQ ID NO: 4812377 - DNA, 18 bp, Homo sapiens
ggtggcacccaccactct

SEQ ID NO: 4812378 - DNA, 23 bp, Homo sapiens
ggtggcacccaccactctcagga

SEQ ID NO: 4812379 - DNA, 15 bp, Homo sapiens
ggtggcagcgcccag

SEQ ID NO: 4812380 - DNA, 21 bp, Homo sapiens
ggtggcaggcacacagcagcc

SEQ ID NO: 4812381 - DNA, 23 bp, Homo sapiens
ggtggcaggcacacagcagcccc

SEQ ID NO: 4812382 - DNA, 16 bp, Homo sapiens
ggtggccagtatcctg

SEQ ID NO: 4812383 - DNA, 18 bp, Homo sapiens
ggtggccatccctgggcc

SEQ ID NO: 4812384 - DNA, 22 bp, Homo sapiens
ggtggccccacctgagccccca

SEQ ID NO: 4812385 - DNA, 15 bp, Homo sapiens
ggtggccttgagtct

SEQ ID NO: 4812386 - DNA, 17 bp, Homo sapiens
ggtggccttgagtctct

SEQ ID NO: 4812387 - DNA, 20 bp, Homo sapiens
ggtggcttctggcacctggc

SEQ ID NO: 4812388 - DNA, 15 bp, Homo sapiens
ggtgggagccacagg

SEQ ID NO: 4812389 - DNA, 23 bp, Homo sapiens
ggtgggccccacagtggtcagcg

SEQ ID NO: 4812390 - DNA, 13 bp, Homo sapiens
ggtgggctccaga

SEQ ID NO: 4812391 - DNA, 18 bp, Homo sapiens
ggtgggctccagagtagg

SEQ ID NO: 4812392 - DNA, 20 bp, Homo sapiens
ggtggggagggcctctggac

SEQ ID NO: 4812393 - DNA, 15 bp, Homo sapiens
ggtggggctgcatcc

SEQ ID NO: 4812394 - DNA, 22 bp, Homo sapiens
ggtggggcttggaagggcgctg

SEQ ID NO: 4812395 - DNA, 13 bp, Homo sapiens
ggtggggtgctgg

SEQ ID NO: 4812396 - DNA, 17 bp, Homo sapiens
ggtggtcttggagagga

SEQ ID NO: 4812397 - DNA, 20 bp, Homo sapiens
ggtggtcttggagaggaggt

SEQ ID NO: 4812398 - DNA, 16 bp, Homo sapiens
ggtggtgaaggggctg

SEQ ID NO: 4812399 - DNA, 18 bp, Homo sapiens
ggtggtgaaggggctggt

SEQ ID NO: 4812400 - DNA, 19 bp, Homo sapiens
ggtggtgaaggggctggtg

SEQ ID NO: 4812401 - DNA, 15 bp, Homo sapiens
ggtggttggaggcct

SEQ ID NO: 4812402 - DNA, 18 bp, Homo sapiens
ggtggtttcagaaagggc

SEQ ID NO: 4812403 - DNA, 10 bp, Homo sapiens
ggtgtaaata

SEQ ID NO: 4812404 - DNA, 14 bp, Homo sapiens
ggtgtagctgtcct

SEQ ID NO: 4812405 - DNA, 20 bp, Homo sapiens
ggtgtagggaacggcctgag

SEQ ID NO: 4812406 - DNA, 21 bp, Homo sapiens
ggtgtcccctggtgcccctcc

SEQ ID NO: 4812407 - DNA, 13 bp, Homo sapiens
ggtgtcctctgtc

SEQ ID NO: 4812408 - DNA, 22 bp, Homo sapiens
ggtgtgacctgacacctgccgc

SEQ ID NO: 4812409 - DNA, 12 bp, Homo sapiens
ggtgtggaagag

SEQ ID NO: 4812410 - DNA, 13 bp, Homo sapiens
ggtgtggcctcag

SEQ ID NO: 4812411 - DNA, 18 bp, Homo sapiens
ggtgtggcctcagccctc

SEQ ID NO: 4812412 - DNA, 15 bp, Homo sapiens
ggtgtggcctggctt

SEQ ID NO: 4812413 - DNA, 13 bp, Homo sapiens
ggtgtttgagtgt

SEQ ID NO: 4812414 - DNA, 12 bp, Homo sapiens
ggttaaaatgga

SEQ ID NO: 4812415 - DNA, 12 bp, Homo sapiens
ggttaaggggat

SEQ ID NO: 4812416 - DNA, 18 bp, Homo sapiens
ggttccagacagagtgga

SEQ ID NO: 4812417 - DNA, 14 bp, Homo sapiens
ggttccagacaggg

SEQ ID NO: 4812418 - DNA, 18 bp, Homo sapiens
ggttctagaaggggcgag

SEQ ID NO: 4812419 - DNA, 16 bp, Homo sapiens
ggttctatatttactg

SEQ ID NO: 4812420 - DNA, 16 bp, Homo sapiens
ggttctgctttctgat

SEQ ID NO: 4812421 - DNA, 13 bp, Homo sapiens
ggttgcaaagtgt

SEQ ID NO: 4812422 - DNA, 14 bp, Homo sapiens
ggttgggttccaga

SEQ ID NO: 4812423 - DNA, 15 bp, Homo sapiens
ggttgggttccagac

SEQ ID NO: 4812424 - DNA, 15 bp, Homo sapiens
ggttggttagtgcat

SEQ ID NO: 4812425 - DNA, 14 bp, Homo sapiens
ggttgttccttttt

SEQ ID NO: 4812426 - DNA, 21 bp, Homo sapiens
ggtttaaaactagttagattc

SEQ ID NO: 4812427 - DNA, 16 bp, Homo sapiens
ggtttaagtagatttc

SEQ ID NO: 4812428 - DNA, 22 bp, Homo sapiens
ggtttactctgtgctaagttgt

SEQ ID NO: 4812429 - DNA, 19 bp, Homo sapiens
ggtttcaccatgttggcca

SEQ ID NO: 4812430 - DNA, 15 bp, Homo sapiens
ggtttcagaaagggc

SEQ ID NO: 4812431 - DNA, 22 bp, Homo sapiens
ggtttctaaagctgccagccga

SEQ ID NO: 4812432 - DNA, 21 bp, Homo sapiens
ggtttgaggaccctcccaggt

SEQ ID NO: 4812433 - DNA, 22 bp, Homo sapiens
ggtttgggcagtggagagggga

SEQ ID NO: 4812434 - DNA, 19 bp, Homo sapiens
ggtttgtgggtccaggaga

SEQ ID NO: 4812435 - DNA, 14 bp, Homo sapiens
ggttttcacttcct

SEQ ID NO: 4812436 - DNA, 12 bp, Homo sapiens
ggttttctcctt

SEQ ID NO: 4812437 - DNA, 17 bp, Homo sapiens
ggttttctccttcccaa

SEQ ID NO: 4812438 - DNA, 21 bp, Homo sapiens
ggttttgtttctttccttctg

SEQ ID NO: 4812439 - DNA, 21 bp, Homo sapiens
ggtttttaatctttgtgacag

SEQ ID NO: 4812440 - DNA, 21 bp, Homo sapiens
ggtttttatttctcgggtgca

SEQ ID NO: 4812441 - DNA, 20 bp, Homo sapiens
ggtttttctgttccctgctg

SEQ ID NO: 4812442 - DNA, 14 bp, Homo sapiens
gtaaaaccaggctg

SEQ ID NO: 4812443 - DNA, 13 bp, Homo sapiens
gtatataagcttt

SEQ ID NO: 4812444 - DNA, 16 bp, Homo sapiens
gtatatagatgtctgt

SEQ ID NO: 4812445 - DNA, 20 bp, Homo sapiens
gtatatagatgtctgtgtat

SEQ ID NO: 4812446 - DNA, 13 bp, Homo sapiens
gtatatatgtaca

SEQ ID NO: 4812447 - DNA, 14 bp, Homo sapiens
gtatatatttatta

SEQ ID NO: 4812448 - DNA, 12 bp, Homo sapiens
gtatatcgttat

SEQ ID NO: 4812449 - DNA, 16 bp, Homo sapiens
gtatattcaaaaatta

SEQ ID NO: 4812450 - DNA, 23 bp, Homo sapiens
gtatattcaaaaattatattttg

SEQ ID NO: 4812451 - DNA, 15 bp, Homo sapiens
gtatatttgtatgat

SEQ ID NO: 4812452 - DNA, 18 bp, Homo sapiens
gtatatttgtatgatatt

SEQ ID NO: 4812453 - DNA, 20 bp, Homo sapiens
gtatattttatttcaatgta

SEQ ID NO: 4812454 - DNA, 14 bp, Homo sapiens
gtatcatgcttcta

SEQ ID NO: 4812455 - DNA, 21 bp, Homo sapiens
gtatcattttgcacgtgctct

SEQ ID NO: 4812456 - DNA, 14 bp, Homo sapiens
gtatctattttcaa

SEQ ID NO: 4812457 - DNA, 16 bp, Homo sapiens
gtatctcctttaatat

SEQ ID NO: 4812458 - DNA, 22 bp, Homo sapiens
gtatctttgggtctttgataaa

SEQ ID NO: 4812459 - DNA, 17 bp, Homo sapiens
gtatgaaccaccgcgcc

SEQ ID NO: 4812460 - DNA, 20 bp, Homo sapiens
gtatgcaagaagaatataaa

SEQ ID NO: 4812461 - DNA, 22 bp, Homo sapiens
gtatgcactaatcaatactttg

SEQ ID NO: 4812462 - DNA, 14 bp, Homo sapiens
gtatgcatacaaat

SEQ ID NO: 4812463 - DNA, 18 bp, Homo sapiens
gtatgctggccagcaccc

SEQ ID NO: 4812464 - DNA, 19 bp, Homo sapiens
gtatgctggccagcaccct

SEQ ID NO: 4812465 - DNA, 23 bp, Homo sapiens
gtatgctggccagcaccctctcc

SEQ ID NO: 4812466 - DNA, 15 bp, Homo sapiens
gtatggtgctgggtc

SEQ ID NO: 4812467 - DNA, 11 bp, Homo sapiens
gtatgtaaaaa

SEQ ID NO: 4812468 - DNA, 23 bp, Homo sapiens
gtatgtacaggctgagacacagc

SEQ ID NO: 4812469 - DNA, 13 bp, Homo sapiens
gtatgtatacaca

SEQ ID NO: 4812470 - DNA, 16 bp, Homo sapiens
gtatgtatacacacac

SEQ ID NO: 4812471 - DNA, 17 bp, Homo sapiens
gtatgtctatgtgtata

SEQ ID NO: 4812472 - DNA, 23 bp, Homo sapiens
gtatgtctatgtgtatatattat

SEQ ID NO: 4812473 - DNA, 20 bp, Homo sapiens
gtatgtgtatgtacttacat

SEQ ID NO: 4812474 - DNA, 18 bp, Homo sapiens
gtatgtgtgagtgtatgt

SEQ ID NO: 4812475 - DNA, 13 bp, Homo sapiens
gtatgttatccac

SEQ ID NO: 4812476 - DNA, 13 bp, Homo sapiens
gtatgttgcatga

SEQ ID NO: 4812477 - DNA, 19 bp, Homo sapiens
gtattaagcccacagtata

SEQ ID NO: 4812478 - DNA, 19 bp, Homo sapiens
gtattaagctccagtgctt

SEQ ID NO: 4812479 - DNA, 15 bp, Homo sapiens
gcttgtagggtgagg

SEQ ID NO: 4812480 - DNA, 18 bp, Homo sapiens
gcttgtagggtgaggcgt

SEQ ID NO: 4812481 - DNA, 20 bp, Homo sapiens
gcttgtagggtgaggcgtgg

SEQ ID NO: 4812482 - DNA, 17 bp, Homo sapiens
gcttgtattatcagtga

SEQ ID NO: 4812483 - DNA, 22 bp, Homo sapiens
gcttgtgtaatttcctgctcct

SEQ ID NO: 4812484 - DNA, 14 bp, Homo sapiens
gcttgtgtgtatgt

SEQ ID NO: 4812485 - DNA, 22 bp, Homo sapiens
gcttgttcttcctcttacctgt

SEQ ID NO: 4812486 - DNA, 21 bp, Homo sapiens
gctttactctgaatttccagt

SEQ ID NO: 4812487 - DNA, 10 bp, Homo sapiens
gctttataaa

SEQ ID NO: 4812488 - DNA, 14 bp, Homo sapiens
gctttataaataaa

SEQ ID NO: 4812489 - DNA, 16 bp, Homo sapiens
gctttataataaactg

SEQ ID NO: 4812490 - DNA, 19 bp, Homo sapiens
gctttatgcaggattctct

SEQ ID NO: 4812491 - DNA, 11 bp, Homo sapiens
gctttctattg

SEQ ID NO: 4812492 - DNA, 11 bp, Homo sapiens
gctttctcatg

SEQ ID NO: 4812493 - DNA, 16 bp, Homo sapiens
gctttgaggctggcgg

SEQ ID NO: 4812494 - DNA, 20 bp, Homo sapiens
gctttggggcttatcagaac

SEQ ID NO: 4812495 - DNA, 19 bp, Homo sapiens
gctttgttttggctgctct

SEQ ID NO: 4812496 - DNA, 13 bp, Homo sapiens
gcttttcacttct

SEQ ID NO: 4812497 - DNA, 15 bp, Homo sapiens
gcttttctcatggta

SEQ ID NO: 4812498 - DNA, 20 bp, Homo sapiens
gcttttgtacgttaattaaa

SEQ ID NO: 4812499 - DNA, 17 bp, Homo sapiens
gcttttttgcaataagg

SEQ ID NO: 4812500 - DNA, 22 bp, Homo sapiens
ggaaaacctcagttggcctctg

SEQ ID NO: 4812501 - DNA, 11 bp, Homo sapiens
ggaaaactgtt

SEQ ID NO: 4812502 - DNA, 13 bp, Homo sapiens
ggaaaaggcttga

SEQ ID NO: 4812503 - DNA, 21 bp, Homo sapiens
ggaaaaggcttgagtctggat

SEQ ID NO: 4812504 - DNA, 16 bp, Homo sapiens
ggaaaataataaaaga

SEQ ID NO: 4812505 - DNA, 18 bp, Homo sapiens
ggaaaataataaaagaat

SEQ ID NO: 4812506 - DNA, 16 bp, Homo sapiens
ggaaacaaagcaatag

SEQ ID NO: 4812507 - DNA, 21 bp, Homo sapiens
ggaaacccggggaactggttt

SEQ ID NO: 4812508 - DNA, 22 bp, Homo sapiens
ggaaactcatacagtctctatt

SEQ ID NO: 4812509 - DNA, 20 bp, Homo sapiens
ggaaagaccctaggtgctca

SEQ ID NO: 4812510 - DNA, 20 bp, Homo sapiens
ggaaagatcccaagtcaaac

SEQ ID NO: 4812511 - DNA, 14 bp, Homo sapiens
ggaaagattatatt

SEQ ID NO: 4812512 - DNA, 19 bp, Homo sapiens
ggaaagcaaaggagattgg

SEQ ID NO: 4812513 - DNA, 21 bp, Homo sapiens
ggaaagcagtcagcggagagg

SEQ ID NO: 4812514 - DNA, 13 bp, Homo sapiens
ggaaagccaggtt

SEQ ID NO: 4812515 - DNA, 11 bp, Homo sapiens
ggaaaggcatc

SEQ ID NO: 4812516 - DNA, 14 bp, Homo sapiens
ggaaagttctatta

SEQ ID NO: 4812517 - DNA, 14 bp, Homo sapiens
ggaaatatctgtga

SEQ ID NO: 4812518 - DNA, 15 bp, Homo sapiens
ggaaatatctgtgaa

SEQ ID NO: 4812519 - DNA, 22 bp, Homo sapiens
ggaaatcaatttaaaggaaagt

SEQ ID NO: 4812520 - DNA, 14 bp, Homo sapiens
ggaaatgctgattt

SEQ ID NO: 4812521 - DNA, 12 bp, Homo sapiens
ggaaatggggaa

SEQ ID NO: 4812522 - DNA, 22 bp, Homo sapiens
ggaaatttgtgtgcttcacaca

SEQ ID NO: 4812523 - DNA, 15 bp, Homo sapiens
ggaacaaggcaaggc

SEQ ID NO: 4812524 - DNA, 17 bp, Homo sapiens
ggaacaaggcaaggctg

SEQ ID NO: 4812525 - DNA, 23 bp, Homo sapiens
ggaacaaggcaaggctgtcaatt

SEQ ID NO: 4812526 - DNA, 16 bp, Homo sapiens
ggaacagacctcggct

SEQ ID NO: 4812527 - DNA, 20 bp, Homo sapiens
ggaacagagtatatatgtac

SEQ ID NO: 4812528 - DNA, 23 bp, Homo sapiens
ggaaccagagcgatgtgttcttt

SEQ ID NO: 4812529 - DNA, 19 bp, Homo sapiens
ggaaccgaggactccaggg

SEQ ID NO: 4812530 - DNA, 18 bp, Homo sapiens
ggaacctcaaactgggta

SEQ ID NO: 4812531 - DNA, 15 bp, Homo sapiens
ggaaccttccctcca

SEQ ID NO: 4812532 - DNA, 16 bp, Homo sapiens
ggaacgttctctacct

SEQ ID NO: 4812533 - DNA, 15 bp, Homo sapiens
ggaactcccccagag

SEQ ID NO: 4812534 - DNA, 12 bp, Homo sapiens
ggaactctgaca

SEQ ID NO: 4812535 - DNA, 19 bp, Homo sapiens
ggaactggtttttctgttc

SEQ ID NO: 4812536 - DNA, 12 bp, Homo sapiens
ggaagacagaga

SEQ ID NO: 4812537 - DNA, 13 bp, Homo sapiens
ggaagacagagat

SEQ ID NO: 4812538 - DNA, 23 bp, Homo sapiens
ggaagacagagatggcagagcca

SEQ ID NO: 4812539 - DNA, 13 bp, Homo sapiens
ggaagacagctct

SEQ ID NO: 4812540 - DNA, 18 bp, Homo sapiens
ggaagaccctcagttatt

SEQ ID NO: 4812541 - DNA, 20 bp, Homo sapiens
ggaagacttcatccctctgg

SEQ ID NO: 4812542 - DNA, 13 bp, Homo sapiens
ggaagacttccag

SEQ ID NO: 4812543 - DNA, 13 bp, Homo sapiens
ggaagagagaaag

SEQ ID NO: 4812544 - DNA, 18 bp, Homo sapiens
ggaagagagaggcctggg

SEQ ID NO: 4812545 - DNA, 20 bp, Homo sapiens
ggaagagagaggcctgggtg

SEQ ID NO: 4812546 - DNA, 15 bp, Homo sapiens
ggaagagatgctcta

SEQ ID NO: 4812547 - DNA, 15 bp, Homo sapiens
ggaagagggaggggc

SEQ ID NO: 4812548 - DNA, 14 bp, Homo sapiens
ggaagcacatgcct

SEQ ID NO: 4812549 - DNA, 17 bp, Homo sapiens
ggaagcacatgcctctc

SEQ ID NO: 4812550 - DNA, 21 bp, Homo sapiens
ggaagcacatgcctctctcag

SEQ ID NO: 4812551 - DNA, 13 bp, Homo sapiens
ggaagccagcagg

SEQ ID NO: 4812552 - DNA, 18 bp, Homo sapiens
ggaagccagcaggctctc

SEQ ID NO: 4812553 - DNA, 16 bp, Homo sapiens
ggaagcccacccgccc

SEQ ID NO: 4812554 - DNA, 17 bp, Homo sapiens
ggaagcccacccgcccc

SEQ ID NO: 4812555 - DNA, 21 bp, Homo sapiens
ggaagcccacccgccccagag

SEQ ID NO: 4812556 - DNA, 24 bp, Homo sapiens
ggaagcccacccgccccagagact

SEQ ID NO: 4812557 - DNA, 12 bp, Homo sapiens
ggaagctgagcc

SEQ ID NO: 4812558 - DNA, 19 bp, Homo sapiens
ggaagctgatacagagaga

SEQ ID NO: 4812559 - DNA, 13 bp, Homo sapiens
ggaagctgcagct

SEQ ID NO: 4812560 - DNA, 14 bp, Homo sapiens
ggaagctgcagctt

SEQ ID NO: 4812561 - DNA, 15 bp, Homo sapiens
ggaagctgcagcttg

SEQ ID NO: 4812562 - DNA, 18 bp, Homo sapiens
ggaagctgcagcttggga

SEQ ID NO: 4812563 - DNA, 19 bp, Homo sapiens
ggaaggaggggaagctgca

SEQ ID NO: 4812564 - DNA, 21 bp, Homo sapiens
ggaaggcagggaggaggcaga

SEQ ID NO: 4812565 - DNA, 21 bp, Homo sapiens
ggaaggcctgagggaagccca

SEQ ID NO: 4812566 - DNA, 23 bp, Homo sapiens
ggaaggcctgagggaagcccacc

SEQ ID NO: 4812567 - DNA, 14 bp, Homo sapiens
ggaaggcctgggtg

SEQ ID NO: 4812568 - DNA, 13 bp, Homo sapiens
ggaaggctttatt

SEQ ID NO: 4812569 - DNA, 12 bp, Homo sapiens
ggaaggggcctg

SEQ ID NO: 4812570 - DNA, 18 bp, Homo sapiens
ggaaggggcctgggctgt

SEQ ID NO: 4812571 - DNA, 23 bp, Homo sapiens
ggaaggggcctgggctgtgagga

SEQ ID NO: 4812572 - DNA, 15 bp, Homo sapiens
ggaagtaattttctt

SEQ ID NO: 4812573 - DNA, 15 bp, Homo sapiens
ggaagtcaggagcca

SEQ ID NO: 4812574 - DNA, 16 bp, Homo sapiens
ggaagtcaggagccag

SEQ ID NO: 4812575 - DNA, 21 bp, Homo sapiens
ggaagtcaggagccagcaggg

SEQ ID NO: 4812576 - DNA, 20 bp, Homo sapiens
ggaataagaagcaaataaat

SEQ ID NO: 4812577 - DNA, 21 bp, Homo sapiens
ggaataagaagcaaataaata

SEQ ID NO: 4812578 - DNA, 14 bp, Homo sapiens
ggaatgattaatta

SEQ ID NO: 4812579 - DNA, 21 bp, Homo sapiens
ggaatgcgctcttcaccagga

SEQ ID NO: 4812580 - DNA, 16 bp, Homo sapiens
ggaatgctcaatgtgc

SEQ ID NO: 4812581 - DNA, 21 bp, Homo sapiens
ggaattacataacaggcattg

SEQ ID NO: 4812582 - DNA, 21 bp, Homo sapiens
ggaattattagcaccagcttg

SEQ ID NO: 4812583 - DNA, 22 bp, Homo sapiens
ggaattattagcaccagcttgc

SEQ ID NO: 4812584 - DNA, 16 bp, Homo sapiens
ggaattccacctggaa

SEQ ID NO: 4812585 - DNA, 23 bp, Homo sapiens
ggaattccacctggaaagccagg

SEQ ID NO: 4812586 - DNA, 15 bp, Homo sapiens
ggaattgggctccgt

SEQ ID NO: 4812587 - DNA, 17 bp, Homo sapiens
ggacaagccaggccctc

SEQ ID NO: 4812588 - DNA, 18 bp, Homo sapiens
ggacaaggggtggaaggg

SEQ ID NO: 4812589 - DNA, 21 bp, Homo sapiens
ggacaaggggtggaagggcag

SEQ ID NO: 4812590 - DNA, 24 bp, Homo sapiens
ggacactgatgggtcctgctgctc

SEQ ID NO: 4812591 - DNA, 17 bp, Homo sapiens
ggacagaggatttctgc

SEQ ID NO: 4812592 - DNA, 23 bp, Homo sapiens
ggacagatgggtgtcccctggtg

SEQ ID NO: 4812593 - DNA, 15 bp, Homo sapiens
ggacagcaaaaccat

SEQ ID NO: 4812594 - DNA, 20 bp, Homo sapiens
ggacagcaaaaccattgctt

SEQ ID NO: 4812595 - DNA, 22 bp, Homo sapiens
ggacagcaaaaccattgcttca

SEQ ID NO: 4812596 - DNA, 11 bp, Homo sapiens
ggacagcagct

SEQ ID NO: 4812597 - DNA, 14 bp, Homo sapiens
ggacagcctgcaca

SEQ ID NO: 4812598 - DNA, 21 bp, Homo sapiens
ggacagcggccccgcggagcc

SEQ ID NO: 4812599 - DNA, 19 bp, Homo sapiens
ggacagcggcccggcccac

SEQ ID NO: 4812600 - DNA, 20 bp, Homo sapiens
ggacagcggcccggcccacg

SEQ ID NO: 4812601 - DNA, 21 bp, Homo sapiens
ggacagggcccccacagggga

SEQ ID NO: 4812602 - DNA, 19 bp, Homo sapiens
ggacagttagacccctggg

SEQ ID NO: 4812603 - DNA, 20 bp, Homo sapiens
ggacagttcacaccctgcaa

SEQ ID NO: 4812604 - DNA, 18 bp, Homo sapiens
ggacagttgggtgtgaga

SEQ ID NO: 4812605 - DNA, 15 bp, Homo sapiens
ggacatgagagtagg

SEQ ID NO: 4812606 - DNA, 22 bp, Homo sapiens
ggacatgagagtagggccctga

SEQ ID NO: 4812607 - DNA, 15 bp, Homo sapiens
ggaccaaatgtaaaa

SEQ ID NO: 4812608 - DNA, 15 bp, Homo sapiens
ggaccaactgctttg

SEQ ID NO: 4812609 - DNA, 22 bp, Homo sapiens
ggaccaaggtgcggaccggagc

SEQ ID NO: 4812610 - DNA, 11 bp, Homo sapiens
ggaccaccctg

SEQ ID NO: 4812611 - DNA, 14 bp, Homo sapiens
ggaccaccctgcca

SEQ ID NO: 4812612 - DNA, 22 bp, Homo sapiens
ggaccacgtctccctggcccca

SEQ ID NO: 4812613 - DNA, 16 bp, Homo sapiens
ggaccagggatggggg

SEQ ID NO: 4812614 - DNA, 12 bp, Homo sapiens
ggaccccagaga

SEQ ID NO: 4812615 - DNA, 21 bp, Homo sapiens
ggaccccagagattcccaagc

SEQ ID NO: 4812616 - DNA, 21 bp, Homo sapiens
ggaccccagatacctgtgagg

SEQ ID NO: 4812617 - DNA, 14 bp, Homo sapiens
ggacccccccagtc

SEQ ID NO: 4812618 - DNA, 12 bp, Homo sapiens
ggaccccctgaa

SEQ ID NO: 4812619 - DNA, 14 bp, Homo sapiens
ggacccctgccctc

SEQ ID NO: 4812620 - DNA, 22 bp, Homo sapiens
ggaccctcccaggtttcccact

SEQ ID NO: 4812621 - DNA, 11 bp, Homo sapiens
ggaccctgggt

SEQ ID NO: 4812622 - DNA, 11 bp, Homo sapiens
ggaccggacgc

SEQ ID NO: 4812623 - DNA, 22 bp, Homo sapiens
ggaccggagcggctgaggacgg

SEQ ID NO: 4812624 - DNA, 13 bp, Homo sapiens
ggacctcaggcct

SEQ ID NO: 4812625 - DNA, 14 bp, Homo sapiens
ggacgagcagagcg

SEQ ID NO: 4812626 - DNA, 22 bp, Homo sapiens
ggacgagtgagctaccaggaag

SEQ ID NO: 4812627 - DNA, 23 bp, Homo sapiens
ggacgatagcttggagggatgga

SEQ ID NO: 4812628 - DNA, 17 bp, Homo sapiens
ggacgcatgcagggccc

SEQ ID NO: 4812629 - DNA, 15 bp, Homo sapiens
ggacgcccagccccc

SEQ ID NO: 4812630 - DNA, 19 bp, Homo sapiens
ggacgcccagcccccaccc

SEQ ID NO: 4812631 - DNA, 20 bp, Homo sapiens
ggacgcccagcccccacccc

SEQ ID NO: 4812632 - DNA, 12 bp, Homo sapiens
ggacgccgcgat

SEQ ID NO: 4812633 - DNA, 12 bp, Homo sapiens
ggacgctggaga

SEQ ID NO: 4812634 - DNA, 18 bp, Homo sapiens
ggacgctggagaccctgc

SEQ ID NO: 4812635 - DNA, 12 bp, Homo sapiens
ggacgctggctc

SEQ ID NO: 4812636 - DNA, 13 bp, Homo sapiens
ggacggggcccgc

SEQ ID NO: 4812637 - DNA, 18 bp, Homo sapiens
ggacgggggctgcttctc

SEQ ID NO: 4812638 - DNA, 22 bp, Homo sapiens
ggacgtcatcggaggctgggcc

SEQ ID NO: 4812639 - DNA, 17 bp, Homo sapiens
ggacgtcgctgtccgtc

SEQ ID NO: 4812640 - DNA, 20 bp, Homo sapiens
ggacgtcgctgtccgtcctg

SEQ ID NO: 4812641 - DNA, 16 bp, Homo sapiens
ggacgtgggctccagg

SEQ ID NO: 4812642 - DNA, 22 bp, Homo sapiens
ggactaaccccaacgcacagga

SEQ ID NO: 4812643 - DNA, 13 bp, Homo sapiens
ggactacagaagt

SEQ ID NO: 4812644 - DNA, 14 bp, Homo sapiens
ggactacagaagtg

SEQ ID NO: 4812645 - DNA, 15 bp, Homo sapiens
ggactccaagccctg

SEQ ID NO: 4812646 - DNA, 23 bp, Homo sapiens
ggactccaagccctggggcaggg

SEQ ID NO: 4812647 - DNA, 16 bp, Homo sapiens
ggactccagaagcagc

SEQ ID NO: 4812648 - DNA, 18 bp, Homo sapiens
ggactcgcgagagggtgc

SEQ ID NO: 4812649 - DNA, 21 bp, Homo sapiens
ggactcttcagcacaaaagga

SEQ ID NO: 4812650 - DNA, 19 bp, Homo sapiens
ggactgatggttgctttga

SEQ ID NO: 4812651 - DNA, 11 bp, Homo sapiens
ggactgcacaa

SEQ ID NO: 4812652 - DNA, 14 bp, Homo sapiens
ggactgcacaaaag

SEQ ID NO: 4812653 - DNA, 23 bp, Homo sapiens
ggactgcagctgcaccagcaggt

SEQ ID NO: 4812654 - DNA, 20 bp, Homo sapiens
ggactgctcaggctccccaa

SEQ ID NO: 4812655 - DNA, 17 bp, Homo sapiens
ggactgggtgggcccca

SEQ ID NO: 4812656 - DNA, 21 bp, Homo sapiens
ggactgtcttcaaccctgccc

SEQ ID NO: 4812657 - DNA, 16 bp, Homo sapiens
ggacttaatttagcag

SEQ ID NO: 4812658 - DNA, 13 bp, Homo sapiens
ggacttccatttg

SEQ ID NO: 4812659 - DNA, 18 bp, Homo sapiens
ggacttctgcagctatgc

SEQ ID NO: 4812660 - DNA, 22 bp, Homo sapiens
ggacttgcttcttgtgtttgaa

SEQ ID NO: 4812661 - DNA, 14 bp, Homo sapiens
ggagaaacctcgga

SEQ ID NO: 4812662 - DNA, 16 bp, Homo sapiens
ggagaaaggaagggct

SEQ ID NO: 4812663 - DNA, 12 bp, Homo sapiens
ggagaaggaagg

SEQ ID NO: 4812664 - DNA, 16 bp, Homo sapiens
ggagaaggcctgcccc

SEQ ID NO: 4812665 - DNA, 13 bp, Homo sapiens
ggagaccctgcgc

SEQ ID NO: 4812666 - DNA, 23 bp, Homo sapiens
ggagaccctgcgcccctgcccag

SEQ ID NO: 4812667 - DNA, 20 bp, Homo sapiens
ggagactaacttattttgat

SEQ ID NO: 4812668 - DNA, 14 bp, Homo sapiens
ggagactgagcttg

SEQ ID NO: 4812669 - DNA, 16 bp, Homo sapiens
ggagagaagagaatgc

SEQ ID NO: 4812670 - DNA, 17 bp, Homo sapiens
ggagagcgccacccgcc

SEQ ID NO: 4812671 - DNA, 17 bp, Homo sapiens
ggagaggagaggctgct

SEQ ID NO: 4812672 - DNA, 18 bp, Homo sapiens
ggagaggagaggctgctg

SEQ ID NO: 4812673 - DNA, 14 bp, Homo sapiens
ggagaggagtgcgc

SEQ ID NO: 4812674 - DNA, 13 bp, Homo sapiens
ggagaggcggcct

SEQ ID NO: 4812675 - DNA, 14 bp, Homo sapiens
ggagaggcggcctc

SEQ ID NO: 4812676 - DNA, 17 bp, Homo sapiens
ggagaggctgctgtcac

SEQ ID NO: 4812677 - DNA, 14 bp, Homo sapiens
ggagatgaggctgg

SEQ ID NO: 4812678 - DNA, 14 bp, Homo sapiens
ggagattgctctgg

SEQ ID NO: 4812679 - DNA, 15 bp, Homo sapiens
ggagattgctctggg

SEQ ID NO: 4812680 - DNA, 19 bp, Homo sapiens
ggagcaaggctgctaagtg

SEQ ID NO: 4812681 - DNA, 15 bp, Homo sapiens
ggagcacccccagcc

SEQ ID NO: 4812682 - DNA, 18 bp, Homo sapiens
ggagcacccccagcctcc

SEQ ID NO: 4812683 - DNA, 21 bp, Homo sapiens
ggagcacccccagcctccccc

SEQ ID NO: 4812684 - DNA, 20 bp, Homo sapiens
ggagcactagaatgagaaat

SEQ ID NO: 4812685 - DNA, 17 bp, Homo sapiens
ggagcagagacggcagc

SEQ ID NO: 4812686 - DNA, 18 bp, Homo sapiens
ggagcagagacggcagcc

SEQ ID NO: 4812687 - DNA, 20 bp, Homo sapiens
ggagcagagacggcagcccc

SEQ ID NO: 4812688 - DNA, 18 bp, Homo sapiens
ggagcaggcggtggggag

SEQ ID NO: 4812689 - DNA, 16 bp, Homo sapiens
ggagccaggtgtcctg

SEQ ID NO: 4812690 - DNA, 23 bp, Homo sapiens
ggagccccccgtgttcacacaca

SEQ ID NO: 4812691 - DNA, 18 bp, Homo sapiens
ggagcccgcctgcgcccc

SEQ ID NO: 4812692 - DNA, 20 bp, Homo sapiens
ggagcccgcctgcgcccccc

SEQ ID NO: 4812693 - DNA, 13 bp, Homo sapiens
ggagccctcatct

SEQ ID NO: 4812694 - DNA, 17 bp, Homo sapiens
ggagccgcagaggcccg

SEQ ID NO: 4812695 - DNA, 14 bp, Homo sapiens
ggagcctccccctc

SEQ ID NO: 4812696 - DNA, 16 bp, Homo sapiens
ggagcctccccctcag

SEQ ID NO: 4812697 - DNA, 15 bp, Homo sapiens
ggagcctcctgccct

SEQ ID NO: 4812698 - DNA, 22 bp, Homo sapiens
ggagcctgagtcagggcccaga

SEQ ID NO: 4812699 - DNA, 13 bp, Homo sapiens
ggagcctggcaca

SEQ ID NO: 4812700 - DNA, 21 bp, Homo sapiens
ggagcgggggctaactggccc

SEQ ID NO: 4812701 - DNA, 16 bp, Homo sapiens
ggagctcacaccgcac

SEQ ID NO: 4812702 - DNA, 23 bp, Homo sapiens
ggagctcacaccgcaccgggctg

SEQ ID NO: 4812703 - DNA, 15 bp, Homo sapiens
ggagcttccagatgg

SEQ ID NO: 4812704 - DNA, 11 bp, Homo sapiens
ggaggacagaa

SEQ ID NO: 4812705 - DNA, 13 bp, Homo sapiens
ggaggacagggag

SEQ ID NO: 4812706 - DNA, 14 bp, Homo sapiens
ggaggacagggagg

SEQ ID NO: 4812707 - DNA, 15 bp, Homo sapiens
ggaggacccctgccc

SEQ ID NO: 4812708 - DNA, 13 bp, Homo sapiens
ggaggactgttct

SEQ ID NO: 4812709 - DNA, 17 bp, Homo sapiens
ggaggagaaggaggaac

SEQ ID NO: 4812710 - DNA, 14 bp, Homo sapiens
ggaggcagagaaga

SEQ ID NO: 4812711 - DNA, 22 bp, Homo sapiens
ggaggccaccaagctgctctcc

SEQ ID NO: 4812712 - DNA, 12 bp, Homo sapiens
ggaggcccctga

SEQ ID NO: 4812713 - DNA, 13 bp, Homo sapiens
ggaggcctgggag

SEQ ID NO: 4812714 - DNA, 21 bp, Homo sapiens
ggaggcctgggagatgcagct

SEQ ID NO: 4812715 - DNA, 16 bp, Homo sapiens
ggaggcctggtctgga

SEQ ID NO: 4812716 - DNA, 20 bp, Homo sapiens
ggaggcctggtctggagccc

SEQ ID NO: 4812717 - DNA, 21 bp, Homo sapiens
ggaggctgagacgcaaggatc

SEQ ID NO: 4812718 - DNA, 12 bp, Homo sapiens
ggaggctgagat

SEQ ID NO: 4812719 - DNA, 19 bp, Homo sapiens
ggaggctggaccaactgct

SEQ ID NO: 4812720 - DNA, 14 bp, Homo sapiens
ggaggctgggcccc

SEQ ID NO: 4812721 - DNA, 17 bp, Homo sapiens
ggaggctgggcccctgg

SEQ ID NO: 4812722 - DNA, 17 bp, Homo sapiens
ggagggaaacccgggga

SEQ ID NO: 4812723 - DNA, 19 bp, Homo sapiens
ggagggaaacccggggaac

SEQ ID NO: 4812724 - DNA, 13 bp, Homo sapiens
ttgaccactgaca

SEQ ID NO: 4812725 - DNA, 14 bp, Homo sapiens
ttgaccactgacag

SEQ ID NO: 4812726 - DNA, 23 bp, Homo sapiens
ttgaccactgacagcctccacct

SEQ ID NO: 4812727 - DNA, 13 bp, Homo sapiens
ttgaccctgaaat

SEQ ID NO: 4812728 - DNA, 22 bp, Homo sapiens
ttgacctctcacttttttataa

SEQ ID NO: 4812729 - DNA, 17 bp, Homo sapiens
ttgacctttatttatta

SEQ ID NO: 4812730 - DNA, 19 bp, Homo sapiens
ttgacgcagccccccacgc

SEQ ID NO: 4812731 - DNA, 16 bp, Homo sapiens
ttgactgattgtttta

SEQ ID NO: 4812732 - DNA, 15 bp, Homo sapiens
ttgactgttatctcg

SEQ ID NO: 4812733 - DNA, 15 bp, Homo sapiens
ttgacttgccactgc

SEQ ID NO: 4812734 - DNA, 17 bp, Homo sapiens
ttgagacactgtcaaga

SEQ ID NO: 4812735 - DNA, 13 bp, Homo sapiens
ttgagagaagcca

SEQ ID NO: 4812736 - DNA, 22 bp, Homo sapiens
ttgagagcctccaggttcctca

SEQ ID NO: 4812737 - DNA, 21 bp, Homo sapiens
ttgagccttattaaaatattt

SEQ ID NO: 4812738 - DNA, 16 bp, Homo sapiens
ttgagctatgatatgt

SEQ ID NO: 4812739 - DNA, 14 bp, Homo sapiens
ttgagctggtaaca

SEQ ID NO: 4812740 - DNA, 17 bp, Homo sapiens
ttgagctggttttctct

SEQ ID NO: 4812741 - DNA, 17 bp, Homo sapiens
ttgaggaggggagcaag

SEQ ID NO: 4812742 - DNA, 19 bp, Homo sapiens
ttgaggaggggagcaaggc

SEQ ID NO: 4812743 - DNA, 18 bp, Homo sapiens
ttgagggaaaacataata

SEQ ID NO: 4812744 - DNA, 16 bp, Homo sapiens
ttgagtctctgaattt

SEQ ID NO: 4812745 - DNA, 20 bp, Homo sapiens
ttgagtgaagctgggagaac

SEQ ID NO: 4812746 - DNA, 13 bp, Homo sapiens
ttgatacttgtaa

SEQ ID NO: 4812747 - DNA, 15 bp, Homo sapiens
ttgatatacagacct

SEQ ID NO: 4812748 - DNA, 19 bp, Homo sapiens
ttgatatttaaaagatcca

SEQ ID NO: 4812749 - DNA, 16 bp, Homo sapiens
ttgatctatgggaaat

SEQ ID NO: 4812750 - DNA, 18 bp, Homo sapiens
tttaactagcactttata

SEQ ID NO: 4812751 - DNA, 15 bp, Homo sapiens
tttaacttatctcca

SEQ ID NO: 4812752 - DNA, 17 bp, Homo sapiens
tttaagaaatgagaaat

SEQ ID NO: 4812753 - DNA, 18 bp, Homo sapiens
tttaagaaatgagaaatt

SEQ ID NO: 4812754 - DNA, 14 bp, Homo sapiens
tttaagaatcatgg

SEQ ID NO: 4812755 - DNA, 18 bp, Homo sapiens
tttaagaatcatggattt

SEQ ID NO: 4812756 - DNA, 12 bp, Homo sapiens
tttaagagaaat

SEQ ID NO: 4812757 - DNA, 22 bp, Homo sapiens
tttaagatgtgtcttcaatttg

SEQ ID NO: 4812758 - DNA, 16 bp, Homo sapiens
tttaatatactcctta

SEQ ID NO: 4812759 - DNA, 15 bp, Homo sapiens
tttaatcatttccag

SEQ ID NO: 4812760 - DNA, 20 bp, Homo sapiens
tttaattcttaccgaaatga

SEQ ID NO: 4812761 - DNA, 21 bp, Homo sapiens
tttaattgtaggtcaatgaaa

SEQ ID NO: 4812762 - DNA, 21 bp, Homo sapiens
tttacaaagaaacaaaatata

SEQ ID NO: 4812763 - DNA, 13 bp, Homo sapiens
tttacaatgtatt

SEQ ID NO: 4812764 - DNA, 14 bp, Homo sapiens
tttacattcttgct

SEQ ID NO: 4812765 - DNA, 16 bp, Homo sapiens
tttaccacttgctgca

SEQ ID NO: 4812766 - DNA, 17 bp, Homo sapiens
tttacccagtgggacag

SEQ ID NO: 4812767 - DNA, 13 bp, Homo sapiens
tttaccctccctg

SEQ ID NO: 4812768 - DNA, 14 bp, Homo sapiens
tcctggcctgagaa

SEQ ID NO: 4812769 - DNA, 16 bp, Homo sapiens
tcctggctcccagggt

SEQ ID NO: 4812770 - DNA, 20 bp, Homo sapiens
tcctgggagtgggagtcaag

SEQ ID NO: 4812771 - DNA, 15 bp, Homo sapiens
tcctgggcagcccag

SEQ ID NO: 4812772 - DNA, 16 bp, Homo sapiens
tgcacaaaccttcttt

SEQ ID NO: 4812773 - DNA, 15 bp, Homo sapiens
tgcacacaattagat

SEQ ID NO: 4812774 - DNA, 17 bp, Homo sapiens
tgcacacaattagattt

SEQ ID NO: 4812775 - DNA, 14 bp, Homo sapiens
tgcacacacctgcc

SEQ ID NO: 4812776 - DNA, 17 bp, Homo sapiens
tgcacacataacacaca

SEQ ID NO: 4812777 - DNA, 13 bp, Homo sapiens
tgcacaccaaatt

SEQ ID NO: 4812778 - DNA, 17 bp, Homo sapiens
tgcacaccaaattgctg

SEQ ID NO: 4812779 - DNA, 17 bp, Homo sapiens
tgcacagctaacatgga

SEQ ID NO: 4812780 - DNA, 21 bp, Homo sapiens
tgcacagtagtgttgggtgga

SEQ ID NO: 4812781 - DNA, 20 bp, Homo sapiens
tgcacattaggaacagagta

SEQ ID NO: 4812782 - DNA, 23 bp, Homo sapiens
tgcacattaggaacagagtatat

SEQ ID NO: 4812783 - DNA, 22 bp, Homo sapiens
tgcaccacggcgtttttttaca

SEQ ID NO: 4812784 - DNA, 15 bp, Homo sapiens
tgcacccacccctgc

SEQ ID NO: 4812785 - DNA, 22 bp, Homo sapiens
tgcaccctccacaggagccgca

SEQ ID NO: 4812786 - DNA, 21 bp, Homo sapiens
tgcacctaatccccataactt

SEQ ID NO: 4812787 - DNA, 14 bp, Homo sapiens
tgcacctgcttctc

SEQ ID NO: 4812788 - DNA, 15 bp, Homo sapiens
tgcactaaaagtgat

SEQ ID NO: 4812789 - DNA, 18 bp, Homo sapiens
tgcactaaaagtgatgtg

SEQ ID NO: 4812790 - DNA, 14 bp, Homo sapiens
tgcactatatacat

SEQ ID NO: 4812791 - DNA, 21 bp, Homo sapiens
tgcactcttttgagcagtaaa

SEQ ID NO: 4812792 - DNA, 15 bp, Homo sapiens
tgcactgacccttcc

SEQ ID NO: 4812793 - DNA, 23 bp, Homo sapiens
tgcactgacccttccagacatac

SEQ ID NO: 4812794 - DNA, 16 bp, Homo sapiens
tgcactggccttctga

SEQ ID NO: 4812795 - DNA, 15 bp, Homo sapiens
tgcacttctgttatc

SEQ ID NO: 4812796 - DNA, 17 bp, Homo sapiens
tgcagaaaaagagcttc

SEQ ID NO: 4812797 - DNA, 17 bp, Homo sapiens
tgcagacatattttctt

SEQ ID NO: 4812798 - DNA, 14 bp, Homo sapiens
tgcagaccctgcca

SEQ ID NO: 4812799 - DNA, 15 bp, Homo sapiens
tgcagaccctgccag

SEQ ID NO: 4812800 - DNA, 16 bp, Homo sapiens
tgcagaccctgccagg

SEQ ID NO: 4812801 - DNA, 17 bp, Homo sapiens
tgcagaccctgccaggg

SEQ ID NO: 4812802 - DNA, 23 bp, Homo sapiens
tgcagagtaaatcccacgacata

SEQ ID NO: 4812803 - DNA, 18 bp, Homo sapiens
tgcagagtatacaagtgt

SEQ ID NO: 4812804 - DNA, 15 bp, Homo sapiens
tgccaccctctgctg

SEQ ID NO: 4812805 - DNA, 19 bp, Homo sapiens
tgccaccctctgctgcaca

SEQ ID NO: 4812806 - DNA, 15 bp, Homo sapiens
tgccacgtggccgct

SEQ ID NO: 4812807 - DNA, 19 bp, Homo sapiens
tgccacgtggccgctgccc

SEQ ID NO: 4812808 - DNA, 18 bp, Homo sapiens
tgccactgccataacttg

SEQ ID NO: 4812809 - DNA, 20 bp, Homo sapiens
tgccactgccataacttgtt

SEQ ID NO: 4812810 - DNA, 20 bp, Homo sapiens
tgccagacagagatcagaat

SEQ ID NO: 4812811 - DNA, 17 bp, Homo sapiens
tgccagacgtgctcctg

SEQ ID NO: 4812812 - DNA, 18 bp, Homo sapiens
tgccagacttctaaaata

SEQ ID NO: 4812813 - DNA, 21 bp, Homo sapiens
tgccagacttctaaaataaat

SEQ ID NO: 4812814 - DNA, 17 bp, Homo sapiens
tgccagccgagatagcc

SEQ ID NO: 4812815 - DNA, 22 bp, Homo sapiens
tgccagccgagatagccaaggc

SEQ ID NO: 4812816 - DNA, 16 bp, Homo sapiens
tgccagctggtgaatc

SEQ ID NO: 4812817 - DNA, 22 bp, Homo sapiens
tgccaggaaaggagagtacttt

SEQ ID NO: 4812818 - DNA, 12 bp, Homo sapiens
tgccaggaagcc

SEQ ID NO: 4812819 - DNA, 22 bp, Homo sapiens
tgccaggaagccagcaggctct

SEQ ID NO: 4812820 - DNA, 16 bp, Homo sapiens
tgccaggcagctgcag

SEQ ID NO: 4812821 - DNA, 14 bp, Homo sapiens
tgccaggctgcagg

SEQ ID NO: 4812822 - DNA, 19 bp, Homo sapiens
tgccaggctgcagggacag

SEQ ID NO: 4812823 - DNA, 20 bp, Homo sapiens
tgccaggctggagtgcagtg

SEQ ID NO: 4812824 - DNA, 22 bp, Homo sapiens
tgccagggacattttcaagaca

SEQ ID NO: 4812825 - DNA, 19 bp, Homo sapiens
tgccagggcagtgctagtg

SEQ ID NO: 4812826 - DNA, 23 bp, Homo sapiens
tgccagggggtttgaggaccctc

SEQ ID NO: 4812827 - DNA, 14 bp, Homo sapiens
tgccataacttgtt

SEQ ID NO: 4812828 - DNA, 21 bp, Homo sapiens
tgccataacttgtttgtaaaa

SEQ ID NO: 4812829 - DNA, 13 bp, Homo sapiens
tgccatcaaatga

SEQ ID NO: 4812830 - DNA, 15 bp, Homo sapiens
tgccatcaaatgaat

SEQ ID NO: 4812831 - DNA, 17 bp, Homo sapiens
tgcctttaggcaggaag

SEQ ID NO: 4812832 - DNA, 13 bp, Homo sapiens
tgcctttcaaagt

SEQ ID NO: 4812833 - DNA, 14 bp, Homo sapiens
tgcctttggttccc

SEQ ID NO: 4812834 - DNA, 12 bp, Homo sapiens
tgcctttgtaac

SEQ ID NO: 4812835 - DNA, 21 bp, Homo sapiens
tgcgcaccccgttcccagcgc

SEQ ID NO: 4812836 - DNA, 17 bp, Homo sapiens
tgcgccccccagtggac

SEQ ID NO: 4812837 - DNA, 11 bp, Homo sapiens
tgcgcccctgc

SEQ ID NO: 4812838 - DNA, 13 bp, Homo sapiens
tgcgcccctgccc

SEQ ID NO: 4812839 - DNA, 18 bp, Homo sapiens
tgcgcctgcccgcccgcc

SEQ ID NO: 4812840 - DNA, 16 bp, Homo sapiens
tgcgcgcagctggcgc

SEQ ID NO: 4812841 - DNA, 12 bp, Homo sapiens
tgcgctcctctg

SEQ ID NO: 4812842 - DNA, 14 bp, Homo sapiens
tgcgctcctctgca

SEQ ID NO: 4812843 - DNA, 15 bp, Homo sapiens
tgcgctcctctgcag

SEQ ID NO: 4812844 - DNA, 17 bp, Homo sapiens
tgcgctcctctgcagcc

SEQ ID NO: 4812845 - DNA, 15 bp, Homo sapiens
tgcgctcctggcttt

SEQ ID NO: 4812846 - DNA, 15 bp, Homo sapiens
tgcgctcttcaccag

SEQ ID NO: 4812847 - DNA, 15 bp, Homo sapiens
tgcggaacaggagtg

SEQ ID NO: 4812848 - DNA, 20 bp, Homo sapiens
tgcggaccggagcggctgag

SEQ ID NO: 4812849 - DNA, 15 bp, Homo sapiens
tgcggcaccgcccac

SEQ ID NO: 4812850 - DNA, 18 bp, Homo sapiens
tgcggcccgtgcgcagcc

SEQ ID NO: 4812851 - DNA, 16 bp, Homo sapiens
tgcgtatgcagtgtag

SEQ ID NO: 4812852 - DNA, 16 bp, Homo sapiens
tgcgtctcctgcccac

SEQ ID NO: 4812853 - DNA, 12 bp, Homo sapiens
tgcgtgtggccc

SEQ ID NO: 4812854 - DNA, 16 bp, Homo sapiens
tgcgtgtggccctgtg

SEQ ID NO: 4812855 - DNA, 15 bp, Homo sapiens
tgctaaacctatctg

SEQ ID NO: 4812856 - DNA, 16 bp, Homo sapiens
tgctaaacctatctgt

SEQ ID NO: 4812857 - DNA, 14 bp, Homo sapiens
tgctaagtggaaga

SEQ ID NO: 4812858 - DNA, 22 bp, Homo sapiens
tgctaagtggaagacagagatg

SEQ ID NO: 4812859 - DNA, 13 bp, Homo sapiens
tgctaatgaattt

SEQ ID NO: 4812860 - DNA, 15 bp, Homo sapiens
tgctaattaaaaagt

SEQ ID NO: 4812861 - DNA, 16 bp, Homo sapiens
tgctacaaaatgtgtg

SEQ ID NO: 4812862 - DNA, 16 bp, Homo sapiens
tgctacatcagagtgt

SEQ ID NO: 4812863 - DNA, 18 bp, Homo sapiens
tgctagcaacaacttact

SEQ ID NO: 4812864 - DNA, 17 bp, Homo sapiens
tgctatctcgctagcca

SEQ ID NO: 4812865 - DNA, 12 bp, Homo sapiens
tgctattaatat

SEQ ID NO: 4812866 - DNA, 17 bp, Homo sapiens
tgctattcgtaagttct

SEQ ID NO: 4812867 - DNA, 19 bp, Homo sapiens
tgctattcgtaagttctgt

SEQ ID NO: 4812868 - DNA, 20 bp, Homo sapiens
tgctattcgtaagttctgtg

SEQ ID NO: 4812869 - DNA, 13 bp, Homo sapiens
tgctattgtttat

SEQ ID NO: 4812870 - DNA, 15 bp, Homo sapiens
tgctatttgtgtaac

SEQ ID NO: 4812871 - DNA, 19 bp, Homo sapiens
tgctcaatgtgctgttgat

SEQ ID NO: 4812872 - DNA, 20 bp, Homo sapiens
tgctcaatgtgctgttgatt

SEQ ID NO: 4812873 - DNA, 22 bp, Homo sapiens
tgctcaatgtgctgttgattct

SEQ ID NO: 4812874 - DNA, 17 bp, Homo sapiens
tgctcagccccagacct

SEQ ID NO: 4812875 - DNA, 19 bp, Homo sapiens
tgctcagccccagacctgc

SEQ ID NO: 4812876 - DNA, 21 bp, Homo sapiens
tgctcagccccagacctgccg

SEQ ID NO: 4812877 - DNA, 17 bp, Homo sapiens
tgctcaggcctcacctg

SEQ ID NO: 4812878 - DNA, 18 bp, Homo sapiens
tgctcagtccctctgggt

SEQ ID NO: 4812879 - DNA, 12 bp, Homo sapiens
tgctccagatcc

SEQ ID NO: 4812880 - DNA, 17 bp, Homo sapiens
tgctccagatcctcttt

SEQ ID NO: 4812881 - DNA, 14 bp, Homo sapiens
tgctccagtataaa

SEQ ID NO: 4812882 - DNA, 17 bp, Homo sapiens
tgctccagtataaatta

SEQ ID NO: 4812883 - DNA, 18 bp, Homo sapiens
tgctccagtataaattac

SEQ ID NO: 4812884 - DNA, 14 bp, Homo sapiens
tgctccatgcacag

SEQ ID NO: 4812885 - DNA, 13 bp, Homo sapiens
tgctccattcctg

SEQ ID NO: 4812886 - DNA, 13 bp, Homo sapiens
tgctcctctgccc

SEQ ID NO: 4812887 - DNA, 14 bp, Homo sapiens
tgctcctctgcccg

SEQ ID NO: 4812888 - DNA, 15 bp, Homo sapiens
tgctcctttccatca

SEQ ID NO: 4812889 - DNA, 18 bp, Homo sapiens
tgctcctttccatcagct

SEQ ID NO: 4812890 - DNA, 20 bp, Homo sapiens
tgctcctttccatcagcttt

SEQ ID NO: 4812891 - DNA, 15 bp, Homo sapiens
tgctcgccctgtgcc

SEQ ID NO: 4812892 - DNA, 18 bp, Homo sapiens
tgctcgccctgtgccctc

SEQ ID NO: 4812893 - DNA, 19 bp, Homo sapiens
tgctcgccctgtgccctct

SEQ ID NO: 4812894 - DNA, 22 bp, Homo sapiens
tgctcgccctgtgccctctcac

SEQ ID NO: 4812895 - DNA, 16 bp, Homo sapiens
tgctctccattctttt

SEQ ID NO: 4812896 - DNA, 13 bp, Homo sapiens
tgctctcccaggt

SEQ ID NO: 4812897 - DNA, 22 bp, Homo sapiens
tgctctgagaagaggagccctc

SEQ ID NO: 4812898 - DNA, 17 bp, Homo sapiens
tgctcttaagtaccaga

SEQ ID NO: 4812899 - DNA, 19 bp, Homo sapiens
tgctctttcaccctgccac

SEQ ID NO: 4812900 - DNA, 23 bp, Homo sapiens
tgctgaaacacacaggccatttc

SEQ ID NO: 4812901 - DNA, 19 bp, Homo sapiens
tgctgagatgtttagtagc

SEQ ID NO: 4812902 - DNA, 20 bp, Homo sapiens
tgctgcagtcagcacagaga

SEQ ID NO: 4812903 - DNA, 21 bp, Homo sapiens
tgctgcagtcagcacagagag

SEQ ID NO: 4812904 - DNA, 16 bp, Homo sapiens
tgctgccaggctccca

SEQ ID NO: 4812905 - DNA, 13 bp, Homo sapiens
tgctgcctccaag

SEQ ID NO: 4812906 - DNA, 11 bp, Homo sapiens
tgctgcctgcc

SEQ ID NO: 4812907 - DNA, 23 bp, Homo sapiens
tgctgcctgcctccggccctgcc

SEQ ID NO: 4812908 - DNA, 21 bp, Homo sapiens
tgctgccttctgacggccctg

SEQ ID NO: 4812909 - DNA, 22 bp, Homo sapiens
tgctgccttctgacggccctgc

SEQ ID NO: 4812910 - DNA, 20 bp, Homo sapiens
tgctgctcgggaaggcctga

SEQ ID NO: 4812911 - DNA, 14 bp, Homo sapiens
tgctgctttccaac

SEQ ID NO: 4812912 - DNA, 11 bp, Homo sapiens
tgctgctttgg

SEQ ID NO: 4812913 - DNA, 12 bp, Homo sapiens
tgctgctttggg

SEQ ID NO: 4812914 - DNA, 15 bp, Homo sapiens
tgctgctttggggat

SEQ ID NO: 4812915 - DNA, 20 bp, Homo sapiens
tgctgcttttgatggctatg

SEQ ID NO: 4812916 - DNA, 17 bp, Homo sapiens
tgctggaaaactgccac

SEQ ID NO: 4812917 - DNA, 21 bp, Homo sapiens
tgctggaccaaggtgcggacc

SEQ ID NO: 4812918 - DNA, 12 bp, Homo sapiens
tgctggagcctg

SEQ ID NO: 4812919 - DNA, 22 bp, Homo sapiens
tgctggccagcaccctctcctg

SEQ ID NO: 4812920 - DNA, 17 bp, Homo sapiens
tgctggccagcctgggg

SEQ ID NO: 4812921 - DNA, 13 bp, Homo sapiens
tgctggggctgca

SEQ ID NO: 4812922 - DNA, 15 bp, Homo sapiens
tgctgggtgggaatg

SEQ ID NO: 4812923 - DNA, 16 bp, Homo sapiens
tgctgtaaataaaaat

SEQ ID NO: 4812924 - DNA, 20 bp, Homo sapiens
tgctgtaaataaaaatagct

SEQ ID NO: 4812925 - DNA, 18 bp, Homo sapiens
tgctgtatacaaacaggt

SEQ ID NO: 4812926 - DNA, 19 bp, Homo sapiens
tgctgtatacaaacaggtg

SEQ ID NO: 4812927 - DNA, 22 bp, Homo sapiens
tgctgtatacaaacaggtgcta

SEQ ID NO: 4812928 - DNA, 19 bp, Homo sapiens
tgctgtatttgaggaaact

SEQ ID NO: 4812929 - DNA, 21 bp, Homo sapiens
tgctgtatttgaggaaactca

SEQ ID NO: 4812930 - DNA, 17 bp, Homo sapiens
tgctgtcatgcccagct

SEQ ID NO: 4812931 - DNA, 17 bp, Homo sapiens
tgctgtccctgtgggct

SEQ ID NO: 4812932 - DNA, 16 bp, Homo sapiens
tgagtggacagcagct

SEQ ID NO: 4812933 - DNA, 12 bp, Homo sapiens
tgagtgggcccc

SEQ ID NO: 4812934 - DNA, 13 bp, Homo sapiens
tgagtgtatgtat

SEQ ID NO: 4812935 - DNA, 14 bp, Homo sapiens
tgagtgttagaaaa

SEQ ID NO: 4812936 - DNA, 21 bp, Homo sapiens
tgagttctgcacatacagatg

SEQ ID NO: 4812937 - DNA, 21 bp, Homo sapiens
tgagttggttacctattgctg

SEQ ID NO: 4812938 - DNA, 17 bp, Homo sapiens
tgataaatttgactgtt

SEQ ID NO: 4812939 - DNA, 17 bp, Homo sapiens
tgataataaaattcatt

SEQ ID NO: 4812940 - DNA, 22 bp, Homo sapiens
tgataataaaattcattccatt

SEQ ID NO: 4812941 - DNA, 14 bp, Homo sapiens
tgataattgtaaag

SEQ ID NO: 4812942 - DNA, 17 bp, Homo sapiens
tgatacctgcctgggac

SEQ ID NO: 4812943 - DNA, 21 bp, Homo sapiens
tgatactgaattgttatgtaa

SEQ ID NO: 4812944 - DNA, 22 bp, Homo sapiens
tgatactgaattgttatgtaaa

SEQ ID NO: 4812945 - DNA, 12 bp, Homo sapiens
tgatacttgtaa

SEQ ID NO: 4812946 - DNA, 13 bp, Homo sapiens
tgatacttgtaac

SEQ ID NO: 4812947 - DNA, 14 bp, Homo sapiens
tgatacttgtaact

SEQ ID NO: 4812948 - DNA, 17 bp, Homo sapiens
tgatataactttagaaa

SEQ ID NO: 4812949 - DNA, 14 bp, Homo sapiens
tgatatacagacct

SEQ ID NO: 4812950 - DNA, 18 bp, Homo sapiens
tgatatcacgggcccgct

SEQ ID NO: 4812951 - DNA, 22 bp, Homo sapiens
tgatatcaggaaatatctgtga

SEQ ID NO: 4812952 - DNA, 19 bp, Homo sapiens
tgatatctgtttgcttcta

SEQ ID NO: 4812953 - DNA, 10 bp, Homo sapiens
tgatatgcat

SEQ ID NO: 4812954 - DNA, 14 bp, Homo sapiens
tgatatgggactga

SEQ ID NO: 4812955 - DNA, 15 bp, Homo sapiens
tgatatgtctttaaa

SEQ ID NO: 4812956 - DNA, 16 bp, Homo sapiens
tgatatgtctttaaaa

SEQ ID NO: 4812957 - DNA, 15 bp, Homo sapiens
tgatatgtgcttgtg

SEQ ID NO: 4812958 - DNA, 19 bp, Homo sapiens
tgatatgtgcttgtgtgta

SEQ ID NO: 4812959 - DNA, 22 bp, Homo sapiens
tgatatgtgcttgtgtgtatgt

SEQ ID NO: 4812960 - DNA, 23 bp, Homo sapiens
tgatatgtgcttgtgtgtatgtc

SEQ ID NO: 4812961 - DNA, 16 bp, Homo sapiens
tgatatgtgtaatatc

SEQ ID NO: 4812962 - DNA, 18 bp, Homo sapiens
tgatatgtgtaatatcat

SEQ ID NO: 4812963 - DNA, 20 bp, Homo sapiens
tgatatgtgtaatatcattt

SEQ ID NO: 4812964 - DNA, 22 bp, Homo sapiens
tgatatgtgtaatatcatttca

SEQ ID NO: 4812965 - DNA, 13 bp, Homo sapiens
tgatatttaaaag

SEQ ID NO: 4812966 - DNA, 14 bp, Homo sapiens
tgatcaaggtgctc

SEQ ID NO: 4812967 - DNA, 13 bp, Homo sapiens
acttgtaactttt

SEQ ID NO: 4812968 - DNA, 21 bp, Homo sapiens
acttgtacttacactgaaatc

SEQ ID NO: 4812969 - DNA, 16 bp, Homo sapiens
acttgtgttcaatctg

SEQ ID NO: 4812970 - DNA, 16 bp, Homo sapiens
acttgtttgtgtttga

SEQ ID NO: 4812971 - DNA, 15 bp, Homo sapiens
actttaaattatatg

SEQ ID NO: 4812972 - DNA, 18 bp, Homo sapiens
actttaaattatatgata

SEQ ID NO: 4812973 - DNA, 13 bp, Homo sapiens
actttaaattgtg

SEQ ID NO: 4812974 - DNA, 24 bp, Homo sapiens
actttaggtagtagaatctcagca

SEQ ID NO: 4812975 - DNA, 15 bp, Homo sapiens
actttataagccaat

SEQ ID NO: 4812976 - DNA, 17 bp, Homo sapiens
actttataagccaatga

SEQ ID NO: 4812977 - DNA, 17 bp, Homo sapiens
actttattggtcttgcc

SEQ ID NO: 4812978 - DNA, 20 bp, Homo sapiens
actttattggtcttgcccta

SEQ ID NO: 4812979 - DNA, 21 bp, Homo sapiens
actttcactataatgtgaaat

SEQ ID NO: 4812980 - DNA, 13 bp, Homo sapiens
actttcagattgt

SEQ ID NO: 4812981 - DNA, 13 bp, Homo sapiens
actttccatgaca

SEQ ID NO: 4812982 - DNA, 17 bp, Homo sapiens
actttccatgacagtag

SEQ ID NO: 4812983 - DNA, 19 bp, Homo sapiens
actttccatgacagtagca

SEQ ID NO: 4812984 - DNA, 22 bp, Homo sapiens
actttccatgacagtagcatac

SEQ ID NO: 4812985 - DNA, 15 bp, Homo sapiens
actttcccacactgt

SEQ ID NO: 4812986 - DNA, 21 bp, Homo sapiens
actttccttttctattccttc

SEQ ID NO: 4812987 - DNA, 16 bp, Homo sapiens
actttctagccagagg

SEQ ID NO: 4812988 - DNA, 18 bp, Homo sapiens
actttgacacttttcata

SEQ ID NO: 4812989 - DNA, 14 bp, Homo sapiens
actttgccatcctt

SEQ ID NO: 4812990 - DNA, 14 bp, Homo sapiens
actttgggaggctg

SEQ ID NO: 4812991 - DNA, 14 bp, Homo sapiens
actttgtatacaag

SEQ ID NO: 4812992 - DNA, 23 bp, Homo sapiens
actttgtgtcttttgttctctct

SEQ ID NO: 4812993 - DNA, 13 bp, Homo sapiens
acttttaattagt

SEQ ID NO: 4812994 - DNA, 14 bp, Homo sapiens
acttttataaatgt

SEQ ID NO: 4812995 - DNA, 16 bp, Homo sapiens
acttttataaattaaa

SEQ ID NO: 4812996 - DNA, 17 bp, Homo sapiens
acttttataaattaaat

SEQ ID NO: 4812997 - DNA, 18 bp, Homo sapiens
acttttataaattaaata

SEQ ID NO: 4812998 - DNA, 22 bp, Homo sapiens
acttttattgtataattatgaa

SEQ ID NO: 4812999 - DNA, 19 bp, Homo sapiens
acttttcaaggcacattga

SEQ ID NO: 4813000 - DNA, 13 bp, Homo sapiens
acttttcctctta

SEQ ID NO: 4813001 - DNA, 20 bp, Homo sapiens
acttttcctcttagaagaat

SEQ ID NO: 4813002 - DNA, 14 bp, Homo sapiens
acttttctttgaag

SEQ ID NO: 4813003 - DNA, 12 bp, Homo sapiens
acttttttataa

SEQ ID NO: 4813004 - DNA, 17 bp, Homo sapiens
acttttttcctgtcaat

SEQ ID NO: 4813005 - DNA, 19 bp, Homo sapiens
actttttttctatattatt

SEQ ID NO: 4813006 - DNA, 20 bp, Homo sapiens
agaaaaaaaaatatgtgtac

SEQ ID NO: 4813007 - DNA, 18 bp, Homo sapiens
agaaaaaaacattctatc

SEQ ID NO: 4813008 - DNA, 18 bp, Homo sapiens
agaaaaaactggaaacat

SEQ ID NO: 4813009 - DNA, 13 bp, Homo sapiens
agaaaaacaaatc

SEQ ID NO: 4813010 - DNA, 15 bp, Homo sapiens
agaaaaagccctctt

SEQ ID NO: 4813011 - DNA, 18 bp, Homo sapiens
agaaaacagaccagcata

SEQ ID NO: 4813012 - DNA, 13 bp, Homo sapiens
agaaaagccagat

SEQ ID NO: 4813013 - DNA, 18 bp, Homo sapiens
agaaaagccagatgacag

SEQ ID NO: 4813014 - DNA, 23 bp, Homo sapiens
agaaaagccagatgacagggagc

SEQ ID NO: 4813015 - DNA, 18 bp, Homo sapiens
agaaaatccttcagcaat

SEQ ID NO: 4813016 - DNA, 13 bp, Homo sapiens
agaaaatgctttc

SEQ ID NO: 4813017 - DNA, 17 bp, Homo sapiens
agaaaatgctttctcat

SEQ ID NO: 4813018 - DNA, 18 bp, Homo sapiens
agaaaatgctttctcatg

SEQ ID NO: 4813019 - DNA, 22 bp, Homo sapiens
agaaaatggacgtgttatgact

SEQ ID NO: 4813020 - DNA, 22 bp, Homo sapiens
agaaaatggatgacaaagaaaa

SEQ ID NO: 4813021 - DNA, 12 bp, Homo sapiens
agaaacaacaaa

SEQ ID NO: 4813022 - DNA, 15 bp, Homo sapiens
agaaacaatttctgt

SEQ ID NO: 4813023 - DNA, 19 bp, Homo sapiens
agaaacacagcatgcattt

SEQ ID NO: 4813024 - DNA, 16 bp, Homo sapiens
agaaacagtttaacag

SEQ ID NO: 4813025 - DNA, 17 bp, Homo sapiens
agaaacagtttaacaga

SEQ ID NO: 4813026 - DNA, 13 bp, Homo sapiens
agaaacatgacac

SEQ ID NO: 4813027 - DNA, 15 bp, Homo sapiens
agaaacatgacactg

SEQ ID NO: 4813028 - DNA, 18 bp, Homo sapiens
agaaacatgacactgacc

SEQ ID NO: 4813029 - DNA, 22 bp, Homo sapiens
agaaacccctgacaccttttca

SEQ ID NO: 4813030 - DNA, 16 bp, Homo sapiens
agaaaccgacgacaaa

SEQ ID NO: 4813031 - DNA, 17 bp, Homo sapiens
agaaactaaaacaaata

SEQ ID NO: 4813032 - DNA, 22 bp, Homo sapiens
agaaactcgggcactccctaag

SEQ ID NO: 4813033 - DNA, 20 bp, Homo sapiens
agaaagaacggaagaagaga

SEQ ID NO: 4813034 - DNA, 17 bp, Homo sapiens
agaaagcatattgactt

SEQ ID NO: 4813035 - DNA, 18 bp, Homo sapiens
agaaagcctgttgtttaa

SEQ ID NO: 4813036 - DNA, 13 bp, Homo sapiens
agaaaggagggca

SEQ ID NO: 4813037 - DNA, 15 bp, Homo sapiens
agaaaggagggcaac

SEQ ID NO: 4813038 - DNA, 13 bp, Homo sapiens
agaaaggcagaga

SEQ ID NO: 4813039 - DNA, 21 bp, Homo sapiens
agaaggcctgccccccttccc

SEQ ID NO: 4813040 - DNA, 12 bp, Homo sapiens
agaagggaaatt

SEQ ID NO: 4813041 - DNA, 20 bp, Homo sapiens
agaagggaaattcacactgt

SEQ ID NO: 4813042 - DNA, 14 bp, Homo sapiens
agaaggggcgaggc

SEQ ID NO: 4813043 - DNA, 17 bp, Homo sapiens
agaaggtgaaatggagg

SEQ ID NO: 4813044 - DNA, 14 bp, Homo sapiens
agaagtaactcccc

SEQ ID NO: 4813045 - DNA, 23 bp, Homo sapiens
agaagtatccctgatttattctg

SEQ ID NO: 4813046 - DNA, 15 bp, Homo sapiens
agaagtcaacatcct

SEQ ID NO: 4813047 - DNA, 15 bp, Homo sapiens
agaagtgtgttctga

SEQ ID NO: 4813048 - DNA, 19 bp, Homo sapiens
agaagttaaaggttactgt

SEQ ID NO: 4813049 - DNA, 23 bp, Homo sapiens
agaagtttctgccgcagccctgc

SEQ ID NO: 4813050 - DNA, 12 bp, Homo sapiens
agaagtttcttc

SEQ ID NO: 4813051 - DNA, 20 bp, Homo sapiens
agaataaaccggatcctgtt

SEQ ID NO: 4813052 - DNA, 23 bp, Homo sapiens
agaataaagccttgtgatcactt

SEQ ID NO: 4813053 - DNA, 20 bp, Homo sapiens
agaatactaataaaatacat

SEQ ID NO: 4813054 - DNA, 14 bp, Homo sapiens
agaatatggacaaa

SEQ ID NO: 4813055 - DNA, 16 bp, Homo sapiens
agaatattaagcacat

SEQ ID NO: 4813056 - DNA, 24 bp, Homo sapiens
agaatattaagcacattattgtag

SEQ ID NO: 4813057 - DNA, 13 bp, Homo sapiens
agaatattgtatt

SEQ ID NO: 4813058 - DNA, 16 bp, Homo sapiens
agaatattgtattgtt

SEQ ID NO: 4813059 - DNA, 18 bp, Homo sapiens
agaatattgttaaaacct

SEQ ID NO: 4813060 - DNA, 13 bp, Homo sapiens
agaatcattgctt

SEQ ID NO: 4813061 - DNA, 18 bp, Homo sapiens
agaatccccgtgctcaca

SEQ ID NO: 4813062 - DNA, 14 bp, Homo sapiens
agaatccctgttca

SEQ ID NO: 4813063 - DNA, 16 bp, Homo sapiens
agaatccctgttcatt

SEQ ID NO: 4813064 - DNA, 17 bp, Homo sapiens
agaatcgacctcactgt

SEQ ID NO: 4813065 - DNA, 23 bp, Homo sapiens
agaatcgatgggggatgcttcat

SEQ ID NO: 4813066 - DNA, 13 bp, Homo sapiens
agaatctcagcac

SEQ ID NO: 4813067 - DNA, 18 bp, Homo sapiens
agaatgagatgatttaat

SEQ ID NO: 4813068 - DNA, 21 bp, Homo sapiens
agaatgagatgatttaattct

SEQ ID NO: 4813069 - DNA, 22 bp, Homo sapiens
agaatgagatgatttaattctt

SEQ ID NO: 4813070 - DNA, 23 bp, Homo sapiens
agaatggtgggctccagagtagg

SEQ ID NO: 4813071 - DNA, 14 bp, Homo sapiens
agaatgtcatttgc

SEQ ID NO: 4813072 - DNA, 15 bp, Homo sapiens
agaatgtcatttgct

SEQ ID NO: 4813073 - DNA, 16 bp, Homo sapiens
agaatgtcatttgcta

SEQ ID NO: 4813074 - DNA, 23 bp, Homo sapiens
agaatgtcatttgctaatgaatt

SEQ ID NO: 4813075 - DNA, 12 bp, Homo sapiens
agaattactgtt

SEQ ID NO: 4813076 - DNA, 13 bp, Homo sapiens
agaattagccaac

SEQ ID NO: 4813077 - DNA, 17 bp, Homo sapiens
agaattcagtagcattt

SEQ ID NO: 4813078 - DNA, 14 bp, Homo sapiens
agaattcatgatgc

SEQ ID NO: 4813079 - DNA, 21 bp, Homo sapiens
agaattctaagattgtacata

SEQ ID NO: 4813080 - DNA, 19 bp, Homo sapiens
agaattgaaccgtcaatgt

SEQ ID NO: 4813081 - DNA, 21 bp, Homo sapiens
agaattgaaccgtcaatgtga

SEQ ID NO: 4813082 - DNA, 14 bp, Homo sapiens
agaattgaattatt

SEQ ID NO: 4813083 - DNA, 21 bp, Homo sapiens
agaattgggcccttagaatgt

SEQ ID NO: 4813084 - DNA, 12 bp, Homo sapiens
agaatttagagg

SEQ ID NO: 4813085 - DNA, 17 bp, Homo sapiens
agaatttcccaaagcag

SEQ ID NO: 4813086 - DNA, 22 bp, Homo sapiens
agaatttgaagacttcaaaata

SEQ ID NO: 4813087 - DNA, 18 bp, Homo sapiens
agaattttaaaaaagatg

SEQ ID NO: 4813088 - DNA, 19 bp, Homo sapiens
agacaaatgcagtgtattt

SEQ ID NO: 4813089 - DNA, 20 bp, Homo sapiens
agacaaatgcagtgtattta

SEQ ID NO: 4813090 - DNA, 14 bp, Homo sapiens
agacaacacacaca

SEQ ID NO: 4813091 - DNA, 13 bp, Homo sapiens
agacaacaggcat

SEQ ID NO: 4813092 - DNA, 18 bp, Homo sapiens
agacaacaggcattttct

SEQ ID NO: 4813093 - DNA, 16 bp, Homo sapiens
agacaacttgctcctt

SEQ ID NO: 4813094 - DNA, 13 bp, Homo sapiens
agacaagtctgag

SEQ ID NO: 4813095 - DNA, 14 bp, Homo sapiens
agacaagtctgagt

SEQ ID NO: 4813096 - DNA, 18 bp, Homo sapiens
agacaagtctgagtagtt

SEQ ID NO: 4813097 - DNA, 13 bp, Homo sapiens
agacacacatata

SEQ ID NO: 4813098 - DNA, 16 bp, Homo sapiens
agacacacatatacat

SEQ ID NO: 4813099 - DNA, 17 bp, Homo sapiens
agacacacatatacatt

SEQ ID NO: 4813100 - DNA, 20 bp, Homo sapiens
agacacagcccagagactga

SEQ ID NO: 4813101 - DNA, 17 bp, Homo sapiens
agacactccagtttgcc

SEQ ID NO: 4813102 - DNA, 21 bp, Homo sapiens
agacactccagtttgcccacc

SEQ ID NO: 4813103 - DNA, 12 bp, Homo sapiens
agacactgtcaa

SEQ ID NO: 4813104 - DNA, 15 bp, Homo sapiens
agacacttttaccga

SEQ ID NO: 4813105 - DNA, 13 bp, Homo sapiens
agacagagctaca

SEQ ID NO: 4813106 - DNA, 19 bp, Homo sapiens
actgccatttcctcctggg

SEQ ID NO: 4813107 - DNA, 14 bp, Homo sapiens
actgccattttttg

SEQ ID NO: 4813108 - DNA, 17 bp, Homo sapiens
actgcccaccctgggcc

SEQ ID NO: 4813109 - DNA, 17 bp, Homo sapiens
actgcccacctgccagg

SEQ ID NO: 4813110 - DNA, 23 bp, Homo sapiens
actgcccctgcacctgcttctca

SEQ ID NO: 4813111 - DNA, 14 bp, Homo sapiens
actgcccgcacacc

SEQ ID NO: 4813112 - DNA, 22 bp, Homo sapiens
actgccctctgccactgacagg

SEQ ID NO: 4813113 - DNA, 15 bp, Homo sapiens
actgcctctgcctta

SEQ ID NO: 4813114 - DNA, 19 bp, Homo sapiens
actgctcaggctccccaag

SEQ ID NO: 4813115 - DNA, 14 bp, Homo sapiens
actgctttgagaaa

SEQ ID NO: 4813116 - DNA, 23 bp, Homo sapiens
actgctttgttttggctgctctc

SEQ ID NO: 4813117 - DNA, 16 bp, Homo sapiens
actgctttttccttag

SEQ ID NO: 4813118 - DNA, 15 bp, Homo sapiens
actggaaacatctga

SEQ ID NO: 4813119 - DNA, 18 bp, Homo sapiens
actggaaacatctgattt

SEQ ID NO: 4813120 - DNA, 23 bp, Homo sapiens
actggaataagaagcaaataaat

SEQ ID NO: 4813121 - DNA, 12 bp, Homo sapiens
actggactaagt

SEQ ID NO: 4813122 - DNA, 16 bp, Homo sapiens
actggactaagtggaa

SEQ ID NO: 4813123 - DNA, 15 bp, Homo sapiens
actggagaaaatgga

SEQ ID NO: 4813124 - DNA, 23 bp, Homo sapiens
actggaggagcacacatccaaga

SEQ ID NO: 4813125 - DNA, 18 bp, Homo sapiens
actggatctcttaagaca

SEQ ID NO: 4813126 - DNA, 14 bp, Homo sapiens
actggcccacccct

SEQ ID NO: 4813127 - DNA, 13 bp, Homo sapiens
actggccccaggc

SEQ ID NO: 4813128 - DNA, 20 bp, Homo sapiens
actggccctcgggccctctc

SEQ ID NO: 4813129 - DNA, 21 bp, Homo sapiens
actggccctcgggccctctct

SEQ ID NO: 4813130 - DNA, 16 bp, Homo sapiens
actggccgctgggaga

SEQ ID NO: 4813131 - DNA, 23 bp, Homo sapiens
actggccttctgatgaaatgtta

SEQ ID NO: 4813132 - DNA, 14 bp, Homo sapiens
actggccttgcctc

SEQ ID NO: 4813133 - DNA, 17 bp, Homo sapiens
actggctagctatatta

SEQ ID NO: 4813134 - DNA, 12 bp, Homo sapiens
actgggaaatga

SEQ ID NO: 4813135 - DNA, 14 bp, Homo sapiens
actgggaaatgaga

SEQ ID NO: 4813136 - DNA, 15 bp, Homo sapiens
actggggggcaggcc

SEQ ID NO: 4813137 - DNA, 13 bp, Homo sapiens
actgggtgtggcc

SEQ ID NO: 4813138 - DNA, 14 bp, Homo sapiens
actggtttgtttct

SEQ ID NO: 4813139 - DNA, 17 bp, Homo sapiens
actgtaaaatacttctt

SEQ ID NO: 4813140 - DNA, 22 bp, Homo sapiens
actgtacagattgctgcttctg

SEQ ID NO: 4813141 - DNA, 23 bp, Homo sapiens
actgtagtttttgttcaccttct

SEQ ID NO: 4813142 - DNA, 14 bp, Homo sapiens
actgtatatttgta

SEQ ID NO: 4813143 - DNA, 17 bp, Homo sapiens
actgtatatttgtatga

SEQ ID NO: 4813144 - DNA, 19 bp, Homo sapiens
actgtatatttgtatgata

SEQ ID NO: 4813145 - DNA, 17 bp, Homo sapiens
actgtattaaagatgca

SEQ ID NO: 4813146 - DNA, 15 bp, Homo sapiens
actgtatttacttgt

SEQ ID NO: 4813147 - DNA, 20 bp, Homo sapiens
actgtatttacttgttatgt

SEQ ID NO: 4813148 - DNA, 15 bp, Homo sapiens
actgtcatgcccagc

SEQ ID NO: 4813149 - DNA, 18 bp, Homo sapiens
actgtcatgcccagcttg

SEQ ID NO: 4813150 - DNA, 19 bp, Homo sapiens
actgtcatgcccagcttgg

SEQ ID NO: 4813151 - DNA, 16 bp, Homo sapiens
actgtccagagtctct

SEQ ID NO: 4813152 - DNA, 22 bp, Homo sapiens
actgtcctgttgattaatttct

SEQ ID NO: 4813153 - DNA, 18 bp, Homo sapiens
actgtcttactcaagata

SEQ ID NO: 4813154 - DNA, 20 bp, Homo sapiens
actgtcttcaaccctgccct

SEQ ID NO: 4813155 - DNA, 18 bp, Homo sapiens
actgtgaatatgtgtaac

SEQ ID NO: 4813156 - DNA, 20 bp, Homo sapiens
actgtgacacagctgagctg

SEQ ID NO: 4813157 - DNA, 14 bp, Homo sapiens
actgtgacattcca

SEQ ID NO: 4813158 - DNA, 16 bp, Homo sapiens
actgtgaccaagtata

SEQ ID NO: 4813159 - DNA, 20 bp, Homo sapiens
actgtgaggtgggcctttga

SEQ ID NO: 4813160 - DNA, 16 bp, Homo sapiens
actgtgccatgtgttt

SEQ ID NO: 4813161 - DNA, 18 bp, Homo sapiens
actgtgcgttttagagta

SEQ ID NO: 4813162 - DNA, 17 bp, Homo sapiens
actgtggggtttttaat

SEQ ID NO: 4813163 - DNA, 15 bp, Homo sapiens
actgtgtcccagtgt

SEQ ID NO: 4813164 - DNA, 21 bp, Homo sapiens
actgtgtcccagtgtctggcc

SEQ ID NO: 4813165 - DNA, 23 bp, Homo sapiens
actgtgtctcatggtcccacttc

SEQ ID NO: 4813166 - DNA, 16 bp, Homo sapiens
actgttaacccagtgt

SEQ ID NO: 4813167 - DNA, 17 bp, Homo sapiens
actgttaacccagtgtt

SEQ ID NO: 4813168 - DNA, 20 bp, Homo sapiens
actgttaagggaagctgata

SEQ ID NO: 4813169 - DNA, 12 bp, Homo sapiens
actgttctaact

SEQ ID NO: 4813170 - DNA, 21 bp, Homo sapiens
actgttggctgattggaaaat

SEQ ID NO: 4813171 - DNA, 12 bp, Homo sapiens
actgtttataat

SEQ ID NO: 4813172 - DNA, 15 bp, Homo sapiens
actgtttttgaagaa

SEQ ID NO: 4813173 - DNA, 14 bp, Homo sapiens
acttaaacaaaaac

SEQ ID NO: 4813174 - DNA, 18 bp, Homo sapiens
acttaaacaaaaactttc

SEQ ID NO: 4813175 - DNA, 20 bp, Homo sapiens
acttaaacaaaaactttcca

SEQ ID NO: 4813176 - DNA, 15 bp, Homo sapiens
acttaaacctgtgct

SEQ ID NO: 4813177 - DNA, 18 bp, Homo sapiens
acttaaacctgtgctttc

SEQ ID NO: 4813178 - DNA, 19 bp, Homo sapiens
acttaaacctgtgctttca

SEQ ID NO: 4813179 - DNA, 23 bp, Homo sapiens
acttaaccctgacaaattttaat

SEQ ID NO: 4813180 - DNA, 13 bp, Homo sapiens
acttaagcacact

SEQ ID NO: 4813181 - DNA, 23 bp, Homo sapiens
acttaatatcttcatttctaaat

SEQ ID NO: 4813182 - DNA, 16 bp, Homo sapiens
actctggctgccaaga

SEQ ID NO: 4813183 - DNA, 16 bp, Homo sapiens
actcttaaatatacaa

SEQ ID NO: 4813184 - DNA, 20 bp, Homo sapiens
actcttcaaggtctgctttt

SEQ ID NO: 4813185 - DNA, 17 bp, Homo sapiens
actcttccctctcgctc

SEQ ID NO: 4813186 - DNA, 16 bp, Homo sapiens
actctttattgtctgt

SEQ ID NO: 4813187 - DNA, 19 bp, Homo sapiens
actctttattgtctgtaaa

SEQ ID NO: 4813188 - DNA, 14 bp, Homo sapiens
actctttggctatt

SEQ ID NO: 4813189 - DNA, 16 bp, Homo sapiens
actctttggctattgt

SEQ ID NO: 4813190 - DNA, 23 bp, Homo sapiens
actcttttgagcagtaaatgtat

SEQ ID NO: 4813191 - DNA, 19 bp, Homo sapiens
actgaaaggttgcactcta

SEQ ID NO: 4813192 - DNA, 15 bp, Homo sapiens
actgaaattagtgtt

SEQ ID NO: 4813193 - DNA, 19 bp, Homo sapiens
actgaaattgtttaaaagc

SEQ ID NO: 4813194 - DNA, 13 bp, Homo sapiens
actgaagcagagt

SEQ ID NO: 4813195 - DNA, 15 bp, Homo sapiens
actgaagcagagtca

SEQ ID NO: 4813196 - DNA, 13 bp, Homo sapiens
actgaatttctat

SEQ ID NO: 4813197 - DNA, 19 bp, Homo sapiens
actgaatttctatggcata

SEQ ID NO: 4813198 - DNA, 20 bp, Homo sapiens
actgacacaggaaaccaaca

SEQ ID NO: 4813199 - DNA, 16 bp, Homo sapiens
actgacatcagcactg

SEQ ID NO: 4813200 - DNA, 19 bp, Homo sapiens
actgacccttccagacata

SEQ ID NO: 4813201 - DNA, 20 bp, Homo sapiens
actgaccttggagagacaca

SEQ ID NO: 4813202 - DNA, 21 bp, Homo sapiens
actgaccttggagagacacag

SEQ ID NO: 4813203 - DNA, 22 bp, Homo sapiens
actgaccttggagagacacagc

SEQ ID NO: 4813204 - DNA, 18 bp, Homo sapiens
actgacttctcccgggtc

SEQ ID NO: 4813205 - DNA, 19 bp, Homo sapiens
actgagttagaatgttgaa

SEQ ID NO: 4813206 - DNA, 18 bp, Homo sapiens
actgatatcacgggcccg

SEQ ID NO: 4813207 - DNA, 20 bp, Homo sapiens
actgatatcacgggcccgct

SEQ ID NO: 4813208 - DNA, 21 bp, Homo sapiens
actgatatcacgggcccgctc

SEQ ID NO: 4813209 - DNA, 14 bp, Homo sapiens
actgatgagacaac

SEQ ID NO: 4813210 - DNA, 16 bp, Homo sapiens
actgatggttgctttg

SEQ ID NO: 4813211 - DNA, 19 bp, Homo sapiens
actgatttccatccaaacc

SEQ ID NO: 4813212 - DNA, 20 bp, Homo sapiens
actgattttgtacataaaca

SEQ ID NO: 4813213 - DNA, 12 bp, Homo sapiens
actgcaacactg

SEQ ID NO: 4813214 - DNA, 16 bp, Homo sapiens
actgcaacccatgagc

SEQ ID NO: 4813215 - DNA, 23 bp, Homo sapiens
actgcaacccatgagcgtccagg

SEQ ID NO: 4813216 - DNA, 16 bp, Homo sapiens
actgcaacctccacct

SEQ ID NO: 4813217 - DNA, 17 bp, Homo sapiens
actgcaacctccacctc

SEQ ID NO: 4813218 - DNA, 16 bp, Homo sapiens
actgcaacctctgcct

SEQ ID NO: 4813219 - DNA, 12 bp, Homo sapiens
actgcagctgca

SEQ ID NO: 4813220 - DNA, 19 bp, Homo sapiens
actgcaggttggaccccag

SEQ ID NO: 4813221 - DNA, 16 bp, Homo sapiens
actgcattcgttgctc

SEQ ID NO: 4813222 - DNA, 22 bp, Homo sapiens
actgcattcgttgctccagtat

SEQ ID NO: 4813223 - DNA, 12 bp, Homo sapiens
actgccacaagc

SEQ ID NO: 4813224 - DNA, 15 bp, Homo sapiens
actgccacaagcaca

SEQ ID NO: 4813225 - DNA, 23 bp, Homo sapiens
actgccactaaaatccacccagc

SEQ ID NO: 4813226 - DNA, 17 bp, Homo sapiens
actgccataacttgttt

SEQ ID NO: 4813227 - DNA, 19 bp, Homo sapiens
tcgaatgtgtgggcccaag

SEQ ID NO: 4813228 - DNA, 13 bp, Homo sapiens
tcgagagggctga

SEQ ID NO: 4813229 - DNA, 19 bp, Homo sapiens
tcgagctctgtagcctggt

SEQ ID NO: 4813230 - DNA, 21 bp, Homo sapiens
tcgagtgatatggcttgtagg

SEQ ID NO: 4813231 - DNA, 15 bp, Homo sapiens
tcgatcgtttcacat

SEQ ID NO: 4813232 - DNA, 22 bp, Homo sapiens
tcgcactacatctgatatcagg

SEQ ID NO: 4813233 - DNA, 10 bp, Homo sapiens
tcgcagcccc

SEQ ID NO: 4813234 - DNA, 17 bp, Homo sapiens
tcgcagcccctgttgga

SEQ ID NO: 4813235 - DNA, 15 bp, Homo sapiens
tcgccctgtgccctc

SEQ ID NO: 4813236 - DNA, 17 bp, Homo sapiens
tcgccctgtgccctctc

SEQ ID NO: 4813237 - DNA, 15 bp, Homo sapiens
tcgccttctggctgc

SEQ ID NO: 4813238 - DNA, 12 bp, Homo sapiens
tcgccttctggg

SEQ ID NO: 4813239 - DNA, 15 bp, Homo sapiens
tcgctattcccaggc

SEQ ID NO: 4813240 - DNA, 13 bp, Homo sapiens
tcgctctgcatga

SEQ ID NO: 4813241 - DNA, 11 bp, Homo sapiens
tcgctgccacc

SEQ ID NO: 4813242 - DNA, 12 bp, Homo sapiens
tcgctggaaaac

SEQ ID NO: 4813243 - DNA, 22 bp, Homo sapiens
tcgctgtgatgcatgagctccc

SEQ ID NO: 4813244 - DNA, 17 bp, Homo sapiens
tcgcttagctgaaacct

SEQ ID NO: 4813245 - DNA, 16 bp, Homo sapiens
tcgcttcataggcaga

SEQ ID NO: 4813246 - DNA, 16 bp, Homo sapiens
tcgcttggctccatgc

SEQ ID NO: 4813247 - DNA, 17 bp, Homo sapiens
tcggactttgcaggagt

SEQ ID NO: 4813248 - DNA, 21 bp, Homo sapiens
tcggaggctgggcccctggga

SEQ ID NO: 4813249 - DNA, 14 bp, Homo sapiens
tcggatcgctccgc

SEQ ID NO: 4813250 - DNA, 22 bp, Homo sapiens
tcggccactagtggggtcctga

SEQ ID NO: 4813251 - DNA, 21 bp, Homo sapiens
tcggccctgtagccctggccc

SEQ ID NO: 4813252 - DNA, 13 bp, Homo sapiens
tcggccgaggcct

SEQ ID NO: 4813253 - DNA, 13 bp, Homo sapiens
tcggcctggcttc

SEQ ID NO: 4813254 - DNA, 17 bp, Homo sapiens
tcggctatgtctcatgt

SEQ ID NO: 4813255 - DNA, 13 bp, Homo sapiens
tcggctgggcagg

SEQ ID NO: 4813256 - DNA, 15 bp, Homo sapiens
tcggctgggcagggc

SEQ ID NO: 4813257 - DNA, 19 bp, Homo sapiens
tcggctgggcagggccgca

SEQ ID NO: 4813258 - DNA, 21 bp, Homo sapiens
tcggctgggcagggccgcagg

SEQ ID NO: 4813259 - DNA, 23 bp, Homo sapiens
tcgggccctctctccgccccgga

SEQ ID NO: 4813260 - DNA, 15 bp, Homo sapiens
tcgggccgcctcctc

SEQ ID NO: 4813261 - DNA, 16 bp, Homo sapiens
tcgggccgcctcctcc

SEQ ID NO: 4813262 - DNA, 17 bp, Homo sapiens
tcgggccgcctcctcca

SEQ ID NO: 4813263 - DNA, 21 bp, Homo sapiens
tcgggcgcctgcgctcctctg

SEQ ID NO: 4813264 - DNA, 22 bp, Homo sapiens
tcgggcgcctgcgctcctctgc

SEQ ID NO: 4813265 - DNA, 22 bp, Homo sapiens
tcgggctctctcacccagcctg

SEQ ID NO: 4813266 - DNA, 11 bp, Homo sapiens
tcgggggagga

SEQ ID NO: 4813267 - DNA, 14 bp, Homo sapiens
tcgggttctcccat

SEQ ID NO: 4813268 - DNA, 18 bp, Homo sapiens
tcggtggcatttgctgaa

SEQ ID NO: 4813269 - DNA, 23 bp, Homo sapiens
tcggtgggagccgtcagcctgtg

SEQ ID NO: 4813270 - DNA, 16 bp, Homo sapiens
tcgtacattgtgccct

SEQ ID NO: 4813271 - DNA, 22 bp, Homo sapiens
tcgtacattgtgccctgtagct

SEQ ID NO: 4813272 - DNA, 19 bp, Homo sapiens
tcgtccggcctgcagccca

SEQ ID NO: 4813273 - DNA, 21 bp, Homo sapiens
tcgtgtgcatgagaatgtcat

SEQ ID NO: 4813274 - DNA, 19 bp, Homo sapiens
tcgttaagcagtacatctt

SEQ ID NO: 4813275 - DNA, 18 bp, Homo sapiens
tcgttagtaatctgtata

SEQ ID NO: 4813276 - DNA, 15 bp, Homo sapiens
tcgtttgcctccaga

SEQ ID NO: 4813277 - DNA, 20 bp, Homo sapiens
tctaaaactactgcctttca

SEQ ID NO: 4813278 - DNA, 23 bp, Homo sapiens
tctaaaactactgcctttcaaag

SEQ ID NO: 4813279 - DNA, 13 bp, Homo sapiens
tctaaaataaatg

SEQ ID NO: 4813280 - DNA, 14 bp, Homo sapiens
tctaaaataaatgt

SEQ ID NO: 4813281 - DNA, 18 bp, Homo sapiens
tctaaaatgctgttctca

SEQ ID NO: 4813282 - DNA, 14 bp, Homo sapiens
tctaaaccatgaaa

SEQ ID NO: 4813283 - DNA, 23 bp, Homo sapiens
tctaaacccaaataaatgtgtaa

SEQ ID NO: 4813284 - DNA, 22 bp, Homo sapiens
tctaaagatctttttttaagtg

SEQ ID NO: 4813285 - DNA, 15 bp, Homo sapiens
tctaaagctgccagc

SEQ ID NO: 4813286 - DNA, 16 bp, Homo sapiens
tctaaagctgccagcc

SEQ ID NO: 4813287 - DNA, 22 bp, Homo sapiens
tctaagaaatatctgtgaaata

SEQ ID NO: 4813288 - DNA, 23 bp, Homo sapiens
tctaagaaatatctgtgaaatat

SEQ ID NO: 4813289 - DNA, 21 bp, Homo sapiens
tctaagaaatggctttccaca

SEQ ID NO: 4813290 - DNA, 14 bp, Homo sapiens
tctaagaattcagt

SEQ ID NO: 4813291 - DNA, 15 bp, Homo sapiens
tctaagacaaatgca

SEQ ID NO: 4813292 - DNA, 16 bp, Homo sapiens
tctaagacaaatgcag

SEQ ID NO: 4813293 - DNA, 21 bp, Homo sapiens
tctaagacaaatgcagtgtat

SEQ ID NO: 4813294 - DNA, 15 bp, Homo sapiens
tctaaggagcaaata

SEQ ID NO: 4813295 - DNA, 17 bp, Homo sapiens
tctaagtgagatgtttg

SEQ ID NO: 4813296 - DNA, 22 bp, Homo sapiens
tctaatatttattgctttataa

SEQ ID NO: 4813297 - DNA, 16 bp, Homo sapiens
tctaatccatgtgctg

SEQ ID NO: 4813298 - DNA, 18 bp, Homo sapiens
tctacaaacttttataaa

SEQ ID NO: 4813299 - DNA, 22 bp, Homo sapiens
tctacaacataatgatactgaa

SEQ ID NO: 4813300 - DNA, 18 bp, Homo sapiens
tctacacagtgggaactc

SEQ ID NO: 4813301 - DNA, 12 bp, Homo sapiens
tctacaggcatt

SEQ ID NO: 4813302 - DNA, 13 bp, Homo sapiens
tctacatgcaaat

SEQ ID NO: 4813303 - DNA, 20 bp, Homo sapiens
tctacatgcaaatctggctt

SEQ ID NO: 4813304 - DNA, 14 bp, Homo sapiens
tctacatttttgtt

SEQ ID NO: 4813305 - DNA, 14 bp, Homo sapiens
tctaccttcctgca

SEQ ID NO: 4813306 - DNA, 20 bp, Homo sapiens
tctactccatggtgaactga

SEQ ID NO: 4813307 - DNA, 20 bp, Homo sapiens
tctacttcatgtaatccaaa

SEQ ID NO: 4813308 - DNA, 15 bp, Homo sapiens
tctactttaaattgt

SEQ ID NO: 4813309 - DNA, 21 bp, Homo sapiens
tctagaagagtctattgtctc

SEQ ID NO: 4813310 - DNA, 16 bp, Homo sapiens
tctagaaggggcgagg

SEQ ID NO: 4813311 - DNA, 18 bp, Homo sapiens
tctagaatactaataaaa

SEQ ID NO: 4813312 - DNA, 18 bp, Homo sapiens
tctagagctatgcacacc

SEQ ID NO: 4813313 - DNA, 22 bp, Homo sapiens
tctagagctatgcacaccaaat

SEQ ID NO: 4813314 - DNA, 17 bp, Homo sapiens
tctagattaccatgaag

SEQ ID NO: 4813315 - DNA, 23 bp, Homo sapiens
tctagcaactgttggataataac

SEQ ID NO: 4813316 - DNA, 11 bp, Homo sapiens
tctagccaggc

SEQ ID NO: 4813317 - DNA, 15 bp, Homo sapiens
tctagctatgctgta

SEQ ID NO: 4813318 - DNA, 14 bp, Homo sapiens
tctagtaacagtat

SEQ ID NO: 4813319 - DNA, 20 bp, Homo sapiens
tctagtgctaaacctatctg

SEQ ID NO: 4813320 - DNA, 21 bp, Homo sapiens
tctagttagcaggaaatagtg

SEQ ID NO: 4813321 - DNA, 13 bp, Homo sapiens
tctataaatggtg

SEQ ID NO: 4813322 - DNA, 16 bp, Homo sapiens
tctataagagacaaag

SEQ ID NO: 4813323 - DNA, 23 bp, Homo sapiens
tctataggacttaatttagcagt

SEQ ID NO: 4813324 - DNA, 13 bp, Homo sapiens
tctatataaaaaa

SEQ ID NO: 4813325 - DNA, 20 bp, Homo sapiens
tctatataaaaaatatatgt

SEQ ID NO: 4813326 - DNA, 22 bp, Homo sapiens
tctatataaaaaatatatgtaa

SEQ ID NO: 4813327 - DNA, 15 bp, Homo sapiens
tctatatatacatgt

SEQ ID NO: 4813328 - DNA, 21 bp, Homo sapiens
tctatatatacatgtatagtg

SEQ ID NO: 4813329 - DNA, 22 bp, Homo sapiens
tctatattattgcccatgatat

SEQ ID NO: 4813330 - DNA, 13 bp, Homo sapiens
tctatatttactg

SEQ ID NO: 4813331 - DNA, 20 bp, Homo sapiens
tctatctatatatacatata

SEQ ID NO: 4813332 - DNA, 12 bp, Homo sapiens
tctatctgggcc

SEQ ID NO: 4813333 - DNA, 15 bp, Homo sapiens
tctatgatatacaac

SEQ ID NO: 4813334 - DNA, 23 bp, Homo sapiens
tctatgatgtccaaacttaacag

SEQ ID NO: 4813335 - DNA, 14 bp, Homo sapiens
tctatgattaaact

SEQ ID NO: 4813336 - DNA, 12 bp, Homo sapiens
tctatgctctgg

SEQ ID NO: 4813337 - DNA, 14 bp, Homo sapiens
tctatgctgtgtgc

SEQ ID NO: 4813338 - DNA, 15 bp, Homo sapiens
tctatgctgtgtgca

SEQ ID NO: 4813339 - DNA, 17 bp, Homo sapiens
tctatgctgtgtgcaga

SEQ ID NO: 4813340 - DNA, 23 bp, Homo sapiens
tctatgctgtgtgcagagtatac

SEQ ID NO: 4813341 - DNA, 12 bp, Homo sapiens
tctatggaccaa

SEQ ID NO: 4813342 - DNA, 15 bp, Homo sapiens
tctatggattcactt

SEQ ID NO: 4813343 - DNA, 16 bp, Homo sapiens
tctatggattcacttc

SEQ ID NO: 4813344 - DNA, 18 bp, Homo sapiens
tctatggattcacttcta

SEQ ID NO: 4813345 - DNA, 19 bp, Homo sapiens
tctatggattcacttctat

SEQ ID NO: 4813346 - DNA, 22 bp, Homo sapiens
tctatggcatattgataataaa

SEQ ID NO: 4813347 - DNA, 16 bp, Homo sapiens
tctatgtccaacagag

SEQ ID NO: 4813348 - DNA, 11 bp, Homo sapiens
tctatgtgtat

SEQ ID NO: 4813349 - DNA, 16 bp, Homo sapiens
tcttctcagctccact

SEQ ID NO: 4813350 - DNA, 15 bp, Homo sapiens
tcttctctctgtgct

SEQ ID NO: 4813351 - DNA, 20 bp, Homo sapiens
tcttctcttacgctctctgt

SEQ ID NO: 4813352 - DNA, 20 bp, Homo sapiens
tcttctgtgggtttctaaag

SEQ ID NO: 4813353 - DNA, 22 bp, Homo sapiens
tcttcttatacagataaaacat

SEQ ID NO: 4813354 - DNA, 20 bp, Homo sapiens
tcttcttgcggcaccgccca

SEQ ID NO: 4813355 - DNA, 23 bp, Homo sapiens
tcttcttgcggcaccgcccaccc

SEQ ID NO: 4813356 - DNA, 21 bp, Homo sapiens
tcttctttaatttttctgttg

SEQ ID NO: 4813357 - DNA, 11 bp, Homo sapiens
tcttgaagaat

SEQ ID NO: 4813358 - DNA, 19 bp, Homo sapiens
tcttgagtgggccccctct

SEQ ID NO: 4813359 - DNA, 19 bp, Homo sapiens
tcttgatgaaacaaaaata

SEQ ID NO: 4813360 - DNA, 15 bp, Homo sapiens
tcttgcaagctccag

SEQ ID NO: 4813361 - DNA, 12 bp, Homo sapiens
tcttgcaataag

SEQ ID NO: 4813362 - DNA, 20 bp, Homo sapiens
tcttgcctaagtattccttt

SEQ ID NO: 4813363 - DNA, 16 bp, Homo sapiens
tcttgcctctttcctc

SEQ ID NO: 4813364 - DNA, 19 bp, Homo sapiens
tcttgcggcaccgcccacc

SEQ ID NO: 4813365 - DNA, 19 bp, Homo sapiens
tcttgctgtttaccgccca

SEQ ID NO: 4813366 - DNA, 22 bp, Homo sapiens
tcttgctgtttaccgcccaccc

SEQ ID NO: 4813367 - DNA, 13 bp, Homo sapiens
tcttggagaggag

SEQ ID NO: 4813368 - DNA, 19 bp, Homo sapiens
tcttggagaggaggtgtgg

SEQ ID NO: 4813369 - DNA, 14 bp, Homo sapiens
tcttggagtcttcc

SEQ ID NO: 4813370 - DNA, 23 bp, Homo sapiens
tcttgggattcctcccctggaag

SEQ ID NO: 4813371 - DNA, 19 bp, Homo sapiens
tcttggtcacaaagctatt

SEQ ID NO: 4813372 - DNA, 13 bp, Homo sapiens
tcttgtattttct

SEQ ID NO: 4813373 - DNA, 14 bp, Homo sapiens
tcttgtattttctt

SEQ ID NO: 4813374 - DNA, 15 bp, Homo sapiens
tcttgtcattctcat

SEQ ID NO: 4813375 - DNA, 14 bp, Homo sapiens
tcttgtgcatgcaa

SEQ ID NO: 4813376 - DNA, 19 bp, Homo sapiens
tcttgtgcatgcaaaaatg

SEQ ID NO: 4813377 - DNA, 14 bp, Homo sapiens
tcttgtgtttgaaa

SEQ ID NO: 4813378 - DNA, 22 bp, Homo sapiens
tcttgttcatgttttgctaatg

SEQ ID NO: 4813379 - DNA, 15 bp, Homo sapiens
tctttaaattatgac

SEQ ID NO: 4813380 - DNA, 22 bp, Homo sapiens
tctttaaattatgacgtgcaca

SEQ ID NO: 4813381 - DNA, 16 bp, Homo sapiens
tctttaatttttctgt

SEQ ID NO: 4813382 - DNA, 17 bp, Homo sapiens
tctttactcggcgtgct

SEQ ID NO: 4813383 - DNA, 13 bp, Homo sapiens
tctttagtattat

SEQ ID NO: 4813384 - DNA, 17 bp, Homo sapiens
tctttataatggctctg

SEQ ID NO: 4813385 - DNA, 14 bp, Homo sapiens
tctttattgtctgt

SEQ ID NO: 4813386 - DNA, 16 bp, Homo sapiens
tctttattgtctgtaa

SEQ ID NO: 4813387 - DNA, 17 bp, Homo sapiens
tctttattgtctgtaaa

SEQ ID NO: 4813388 - DNA, 21 bp, Homo sapiens
tctttcaatccacagtattgt

SEQ ID NO: 4813389 - DNA, 14 bp, Homo sapiens
tctttcaccctgcc

SEQ ID NO: 4813390 - DNA, 16 bp, Homo sapiens
tctttcaccctgccac

SEQ ID NO: 4813391 - DNA, 21 bp, Homo sapiens
tctttcagccaagaattctta

SEQ ID NO: 4813392 - DNA, 15 bp, Homo sapiens
tctttcatactacat

SEQ ID NO: 4813393 - DNA, 17 bp, Homo sapiens
tctttcctcctcatgaa

SEQ ID NO: 4813394 - DNA, 21 bp, Homo sapiens
tctttctccaaagttatccag

SEQ ID NO: 4813395 - DNA, 12 bp, Homo sapiens
tctttctttcca

SEQ ID NO: 4813396 - DNA, 15 bp, Homo sapiens
tctttctttccaaag

SEQ ID NO: 4813397 - DNA, 21 bp, Homo sapiens
tctttgagggactgcctctgc

SEQ ID NO: 4813398 - DNA, 18 bp, Homo sapiens
tctttgagggttccatgg

SEQ ID NO: 4813399 - DNA, 15 bp, Homo sapiens
tctttggttcctcat

SEQ ID NO: 4813400 - DNA, 22 bp, Homo sapiens
tctttgtgacaggaaagccctc

SEQ ID NO: 4813401 - DNA, 23 bp, Homo sapiens
tctttgtgacaggaaagccctcc

SEQ ID NO: 4813402 - DNA, 14 bp, Homo sapiens
tcttttcaatgcaa

SEQ ID NO: 4813403 - DNA, 18 bp, Homo sapiens
tcttttcctgggtgctca

SEQ ID NO: 4813404 - DNA, 15 bp, Homo sapiens
tcttttgtgcatatg

SEQ ID NO: 4813405 - DNA, 22 bp, Homo sapiens
tctttttaaaaagttgcacatt

SEQ ID NO: 4813406 - DNA, 14 bp, Homo sapiens
tctttttatcgcca

SEQ ID NO: 4813407 - DNA, 16 bp, Homo sapiens
tctttttatcgccatt

SEQ ID NO: 4813408 - DNA, 15 bp, Homo sapiens
tctttttgactgatt

SEQ ID NO: 4813409 - DNA, 13 bp, Homo sapiens
tcttttttcaatg

SEQ ID NO: 4813410 - DNA, 22 bp, Homo sapiens
tctttttttaagtgttctgtgg

SEQ ID NO: 4813411 - DNA, 18 bp, Homo sapiens
tgaaaaaaagggaaaaca

SEQ ID NO: 4813412 - DNA, 12 bp, Homo sapiens
tgaaaaaatatt

SEQ ID NO: 4813413 - DNA, 18 bp, Homo sapiens
tgaaaaagacttcaaatg

SEQ ID NO: 4813414 - DNA, 15 bp, Homo sapiens
tgaaaaagtgttttt

SEQ ID NO: 4813415 - DNA, 20 bp, Homo sapiens
tgaaaaccatctggcctggc

SEQ ID NO: 4813416 - DNA, 12 bp, Homo sapiens
tgaaaactggaa

SEQ ID NO: 4813417 - DNA, 17 bp, Homo sapiens
tgaaaactgtttatggt

SEQ ID NO: 4813418 - DNA, 16 bp, Homo sapiens
tgaaaatggctgaaga

SEQ ID NO: 4813419 - DNA, 21 bp, Homo sapiens
tgaaacacacaggccatttca

SEQ ID NO: 4813420 - DNA, 20 bp, Homo sapiens
tgaaacactcgtgtgcatga

SEQ ID NO: 4813421 - DNA, 14 bp, Homo sapiens
tgaaactgagacca

SEQ ID NO: 4813422 - DNA, 23 bp, Homo sapiens
tgaaactgagaccaagtctctct

SEQ ID NO: 4813423 - DNA, 15 bp, Homo sapiens
tgaaactgcatttgt

SEQ ID NO: 4813424 - DNA, 16 bp, Homo sapiens
tgaaactgcatttgtg

SEQ ID NO: 4813425 - DNA, 21 bp, Homo sapiens
tgaaactgtatttacttgtta

SEQ ID NO: 4813426 - DNA, 15 bp, Homo sapiens
tgaaacttttcaagg

SEQ ID NO: 4813427 - DNA, 11 bp, Homo sapiens
tgaaagagaaa

SEQ ID NO: 4813428 - DNA, 15 bp, Homo sapiens
tgaaagtcaagtcta

SEQ ID NO: 4813429 - DNA, 16 bp, Homo sapiens
tgaaagtggcaagctc

SEQ ID NO: 4813430 - DNA, 17 bp, Homo sapiens
tgaaagtggcaagctct

SEQ ID NO: 4813431 - DNA, 11 bp, Homo sapiens
tgaaagttgtg

SEQ ID NO: 4813432 - DNA, 13 bp, Homo sapiens
tgaaagttgtgat

SEQ ID NO: 4813433 - DNA, 18 bp, Homo sapiens
tgaaagttttgatacttg

SEQ ID NO: 4813434 - DNA, 12 bp, Homo sapiens
tgaaataaaact

SEQ ID NO: 4813435 - DNA, 12 bp, Homo sapiens
tgaaatacctat

SEQ ID NO: 4813436 - DNA, 14 bp, Homo sapiens
tgaaatacttgaaa

SEQ ID NO: 4813437 - DNA, 21 bp, Homo sapiens
tgaaataggagggaaaccttt

SEQ ID NO: 4813438 - DNA, 20 bp, Homo sapiens
tgaaatataaactgtgagat

SEQ ID NO: 4813439 - DNA, 21 bp, Homo sapiens
tgaaatataaactgtgagata

SEQ ID NO: 4813440 - DNA, 17 bp, Homo sapiens
tgaaatatatgtgaaag

SEQ ID NO: 4813441 - DNA, 16 bp, Homo sapiens
tgaaatatttgcttat

SEQ ID NO: 4813442 - DNA, 19 bp, Homo sapiens
tgaaatatttgcttattta

SEQ ID NO: 4813443 - DNA, 22 bp, Homo sapiens
tgaaatatttgcttatttatat

SEQ ID NO: 4813444 - DNA, 22 bp, Homo sapiens
tgaaatccaaaatagtcatgtt

SEQ ID NO: 4813445 - DNA, 14 bp, Homo sapiens
tgaaatccctctac

SEQ ID NO: 4813446 - DNA, 12 bp, Homo sapiens
tgaaatctacaa

SEQ ID NO: 4813447 - DNA, 13 bp, Homo sapiens
tgaaatctacaac

SEQ ID NO: 4813448 - DNA, 12 bp, Homo sapiens
tgaaatgccaga

SEQ ID NO: 4813449 - DNA, 21 bp, Homo sapiens
tgaaatggatagattgtttta

SEQ ID NO: 4813450 - DNA, 12 bp, Homo sapiens
tgaaattagtat

SEQ ID NO: 4813451 - DNA, 18 bp, Homo sapiens
tgaaattagtattttgag

SEQ ID NO: 4813452 - DNA, 19 bp, Homo sapiens
tgaaattagtgttttcatt

SEQ ID NO: 4813453 - DNA, 22 bp, Homo sapiens
tgaaattatgtcaaatggatgt

SEQ ID NO: 4813454 - DNA, 12 bp, Homo sapiens
tgaaatttaagc

SEQ ID NO: 4813455 - DNA, 14 bp, Homo sapiens
tgaaatttaagcac

SEQ ID NO: 4813456 - DNA, 18 bp, Homo sapiens
tgaaattttctagaatac

SEQ ID NO: 4813457 - DNA, 23 bp, Homo sapiens
tgaacaactcgaatcactcattt

SEQ ID NO: 4813458 - DNA, 15 bp, Homo sapiens
tgaacactgcaccct

SEQ ID NO: 4813459 - DNA, 22 bp, Homo sapiens
tgaaccaagaactttccaggaa

SEQ ID NO: 4813460 - DNA, 21 bp, Homo sapiens
tgaaccgtcaatgtgaaataa

SEQ ID NO: 4813461 - DNA, 19 bp, Homo sapiens
tgaacgcacaacatgcaca

SEQ ID NO: 4813462 - DNA, 12 bp, Homo sapiens
tgaactcacaga

SEQ ID NO: 4813463 - DNA, 16 bp, Homo sapiens
tgaagaaacacagcat

SEQ ID NO: 4813464 - DNA, 18 bp, Homo sapiens
tgaagaaacatttatctt

SEQ ID NO: 4813465 - DNA, 21 bp, Homo sapiens
tgaagaaagcctgttgtttaa

SEQ ID NO: 4813466 - DNA, 15 bp, Homo sapiens
tgaagaaatacagct

SEQ ID NO: 4813467 - DNA, 15 bp, Homo sapiens
tgaagaagggaaatt

SEQ ID NO: 4813468 - DNA, 14 bp, Homo sapiens
tgaagacttttctt

SEQ ID NO: 4813469 - DNA, 11 bp, Homo sapiens
tgaagagtgga

SEQ ID NO: 4813470 - DNA, 13 bp, Homo sapiens
tgaagcaaacaca

SEQ ID NO: 4813471 - DNA, 22 bp, Homo sapiens
tgaagcaaacacacagactctg

SEQ ID NO: 4813472 - DNA, 21 bp, Homo sapiens
gattccagtgcagtagtgcca

SEQ ID NO: 4813473 - DNA, 16 bp, Homo sapiens
gattccattttggaaa

SEQ ID NO: 4813474 - DNA, 18 bp, Homo sapiens
gattccattttggaaaat

SEQ ID NO: 4813475 - DNA, 15 bp, Homo sapiens
gattcctacttaaac

SEQ ID NO: 4813476 - DNA, 16 bp, Homo sapiens
gattcctgccaagtag

SEQ ID NO: 4813477 - DNA, 14 bp, Homo sapiens
gattccttcttgct

SEQ ID NO: 4813478 - DNA, 18 bp, Homo sapiens
gattccttcttgctcagt

SEQ ID NO: 4813479 - DNA, 20 bp, Homo sapiens
acacacgcgtccacatacac

SEQ ID NO: 4813480 - DNA, 22 bp, Homo sapiens
acacacgtgcaatttgtttgtg

SEQ ID NO: 4813481 - DNA, 18 bp, Homo sapiens
acacacttcttccaaaag

SEQ ID NO: 4813482 - DNA, 21 bp, Homo sapiens
acacacttcttccaaaaggaa

SEQ ID NO: 4813483 - DNA, 13 bp, Homo sapiens
acacagcagctcc

SEQ ID NO: 4813484 - DNA, 14 bp, Homo sapiens
acacagcagctcca

SEQ ID NO: 4813485 - DNA, 20 bp, Homo sapiens
acacagcagctccaacctgg

SEQ ID NO: 4813486 - DNA, 13 bp, Homo sapiens
acacagcccgagc

SEQ ID NO: 4813487 - DNA, 21 bp, Homo sapiens
acacagcgtccctagcagtga

SEQ ID NO: 4813488 - DNA, 11 bp, Homo sapiens
acacaggcctg

SEQ ID NO: 4813489 - DNA, 16 bp, Homo sapiens
acacaggcctggccca

SEQ ID NO: 4813490 - DNA, 22 bp, Homo sapiens
acacaggcctggcccagccagc

SEQ ID NO: 4813491 - DNA, 23 bp, Homo sapiens
acacaggcctggcccagccagca

SEQ ID NO: 4813492 - DNA, 20 bp, Homo sapiens
acacagtaagataggttctg

SEQ ID NO: 4813493 - DNA, 17 bp, Homo sapiens
acacagtatagataaat

SEQ ID NO: 4813494 - DNA, 22 bp, Homo sapiens
acacagtgggaactctgacaag

SEQ ID NO: 4813495 - DNA, 15 bp, Homo sapiens
acacagttccacaat

SEQ ID NO: 4813496 - DNA, 16 bp, Homo sapiens
acacagttggaagcag

SEQ ID NO: 4813497 - DNA, 21 bp, Homo sapiens
acacatagattaatggcactg

SEQ ID NO: 4813498 - DNA, 23 bp, Homo sapiens
acacatagattaatggcactgat

SEQ ID NO: 4813499 - DNA, 14 bp, Homo sapiens
acacatataaacac

SEQ ID NO: 4813500 - DNA, 13 bp, Homo sapiens
acacatatacatt

SEQ ID NO: 4813501 - DNA, 14 bp, Homo sapiens
acacatatacatta

SEQ ID NO: 4813502 - DNA, 22 bp, Homo sapiens
acacatatgaacgcacaacatg

SEQ ID NO: 4813503 - DNA, 14 bp, Homo sapiens
acacattatcttct

SEQ ID NO: 4813504 - DNA, 17 bp, Homo sapiens
acacattgaaactgtat

SEQ ID NO: 4813505 - DNA, 19 bp, Homo sapiens
acacattgaaactgtattt

SEQ ID NO: 4813506 - DNA, 23 bp, Homo sapiens
acaccaccaaatgacaagtcaca

SEQ ID NO: 4813507 - DNA, 19 bp, Homo sapiens
acaccactttgtctctgag

SEQ ID NO: 4813508 - DNA, 22 bp, Homo sapiens
acacccaaagcatggactaacc

SEQ ID NO: 4813509 - DNA, 17 bp, Homo sapiens
acaccccgtctgcccct

SEQ ID NO: 4813510 - DNA, 20 bp, Homo sapiens
acaccctcactctgccaggg

SEQ ID NO: 4813511 - DNA, 11 bp, Homo sapiens
acaccctgcaa

SEQ ID NO: 4813512 - DNA, 13 bp, Homo sapiens
acaccctgcaagg

SEQ ID NO: 4813513 - DNA, 20 bp, Homo sapiens
acaccctgcaaggcccacag

SEQ ID NO: 4813514 - DNA, 23 bp, Homo sapiens
acaccctgcaaggcccacaggag

SEQ ID NO: 4813515 - DNA, 14 bp, Homo sapiens
acaccggcactgtg

SEQ ID NO: 4813516 - DNA, 17 bp, Homo sapiens
acaccggcactgtgcac

SEQ ID NO: 4813517 - DNA, 20 bp, Homo sapiens
acaccggcactgtgcactct

SEQ ID NO: 4813518 - DNA, 13 bp, Homo sapiens
acacctccacccg

SEQ ID NO: 4813519 - DNA, 23 bp, Homo sapiens
acacctcccttcatcccagggta

SEQ ID NO: 4813520 - DNA, 15 bp, Homo sapiens
acacgacagaaacag

SEQ ID NO: 4813521 - DNA, 18 bp, Homo sapiens
acacgcgtccacatacac

SEQ ID NO: 4813522 - DNA, 23 bp, Homo sapiens
acacgcgtccacatacactgcat

SEQ ID NO: 4813523 - DNA, 15 bp, Homo sapiens
acacgttggagtata

SEQ ID NO: 4813524 - DNA, 15 bp, Homo sapiens
acactaatgaggaaa

SEQ ID NO: 4813525 - DNA, 16 bp, Homo sapiens
acactattctccagaa

SEQ ID NO: 4813526 - DNA, 17 bp, Homo sapiens
acactcaccgagaggaa

SEQ ID NO: 4813527 - DNA, 15 bp, Homo sapiens
acactcgtgtgcatg

SEQ ID NO: 4813528 - DNA, 16 bp, Homo sapiens
acactgatgggtcctg

SEQ ID NO: 4813529 - DNA, 17 bp, Homo sapiens
acactgatgggtcctgc

SEQ ID NO: 4813530 - DNA, 20 bp, Homo sapiens
acactgatgggtcctgctgc

SEQ ID NO: 4813531 - DNA, 22 bp, Homo sapiens
acactgatgggtcctgctgctc

SEQ ID NO: 4813532 - DNA, 14 bp, Homo sapiens
acactgcaccctcc

SEQ ID NO: 4813533 - DNA, 18 bp, Homo sapiens
acactgcaccctccacag

SEQ ID NO: 4813534 - DNA, 23 bp, Homo sapiens
acactgcaccctccacaggagcc

SEQ ID NO: 4813535 - DNA, 15 bp, Homo sapiens
acactgcattcgttg

SEQ ID NO: 4813536 - DNA, 22 bp, Homo sapiens
acactgcttaaggaaaagagaa

SEQ ID NO: 4813537 - DNA, 18 bp, Homo sapiens
acactgtctgctgcccca

SEQ ID NO: 4813538 - DNA, 19 bp, Homo sapiens
acactgtgcgttttagagt

SEQ ID NO: 4813539 - DNA, 15 bp, Homo sapiens
acacttctccttaac

SEQ ID NO: 4813540 - DNA, 15 bp, Homo sapiens
acacttgggctggca

SEQ ID NO: 4813541 - DNA, 16 bp, Homo sapiens
acacttgggctggcac

SEQ ID NO: 4813542 - DNA, 17 bp, Homo sapiens
acacttgggctggcacc

SEQ ID NO: 4813543 - DNA, 20 bp, Homo sapiens
acacttgggctggcacccac

SEQ ID NO: 4813544 - DNA, 15 bp, Homo sapiens
acactttggccacag

SEQ ID NO: 4813545 - DNA, 17 bp, Homo sapiens
acacttttcatatcatt

SEQ ID NO: 4813546 - DNA, 13 bp, Homo sapiens
acagaaaaacaaa

SEQ ID NO: 4813547 - DNA, 20 bp, Homo sapiens
acagaaaatggaagacagct

SEQ ID NO: 4813548 - DNA, 17 bp, Homo sapiens
acagaaaattcttctcc

SEQ ID NO: 4813549 - DNA, 14 bp, Homo sapiens
acagaacaacaaca

SEQ ID NO: 4813550 - DNA, 17 bp, Homo sapiens
acagaacaacaacaaag

SEQ ID NO: 4813551 - DNA, 14 bp, Homo sapiens
acagaaccagcact

SEQ ID NO: 4813552 - DNA, 16 bp, Homo sapiens
acagaatcattgctta

SEQ ID NO: 4813553 - DNA, 13 bp, Homo sapiens
acagacaaagcgt

SEQ ID NO: 4813554 - DNA, 18 bp, Homo sapiens
acagacctccagattatt

SEQ ID NO: 4813555 - DNA, 19 bp, Homo sapiens
acagacctccagattattt

SEQ ID NO: 4813556 - DNA, 21 bp, Homo sapiens
acagacctccagattattttc

SEQ ID NO: 4813557 - DNA, 18 bp, Homo sapiens
acagacggacgggacagc

SEQ ID NO: 4813558 - DNA, 22 bp, Homo sapiens
acagagactggaggcatttctt

SEQ ID NO: 4813559 - DNA, 16 bp, Homo sapiens
acagagatggcagagc

SEQ ID NO: 4813560 - DNA, 17 bp, Homo sapiens
acagagatggcagagcc

SEQ ID NO: 4813561 - DNA, 13 bp, Homo sapiens
acagagcctgttt

SEQ ID NO: 4813562 - DNA, 21 bp, Homo sapiens
acagagcctgttttaaaaaat

SEQ ID NO: 4813563 - DNA, 16 bp, Homo sapiens
acagagctacacaggg

SEQ ID NO: 4813564 - DNA, 18 bp, Homo sapiens
acagagctacacagggga

SEQ ID NO: 4813565 - DNA, 20 bp, Homo sapiens
acagagtatatatgtacagt

SEQ ID NO: 4813566 - DNA, 22 bp, Homo sapiens
acagagtatatatgtacagtta

SEQ ID NO: 4813567 - DNA, 17 bp, Homo sapiens
acagagtgatttgtaaa

SEQ ID NO: 4813568 - DNA, 17 bp, Homo sapiens
acagagtggactcttcc

SEQ ID NO: 4813569 - DNA, 21 bp, Homo sapiens
acagagtggactcttccctct

SEQ ID NO: 4813570 - DNA, 11 bp, Homo sapiens
acagagtggat

SEQ ID NO: 4813571 - DNA, 19 bp, Homo sapiens
acagatgggtgtcccctgg

SEQ ID NO: 4813572 - DNA, 21 bp, Homo sapiens
acagatgggtgtcccctggtg

SEQ ID NO: 4813573 - DNA, 22 bp, Homo sapiens
acagatggtgtcctgcatgtat

SEQ ID NO: 4813574 - DNA, 17 bp, Homo sapiens
acagattgctgcttctg

SEQ ID NO: 4813575 - DNA, 16 bp, Homo sapiens
acagatttgttcattc

SEQ ID NO: 4813576 - DNA, 13 bp, Homo sapiens
acagcaacaacaa

SEQ ID NO: 4813577 - DNA, 15 bp, Homo sapiens
acagcaacaacaaca

SEQ ID NO: 4813578 - DNA, 15 bp, Homo sapiens
acagcacatgctggc

SEQ ID NO: 4813579 - DNA, 22 bp, Homo sapiens
acccagacgtggtgcttctcac

SEQ ID NO: 4813580 - DNA, 13 bp, Homo sapiens
acccagcagcgcc

SEQ ID NO: 4813581 - DNA, 11 bp, Homo sapiens
acccagcctgg

SEQ ID NO: 4813582 - DNA, 15 bp, Homo sapiens
acccagtgggacaga

SEQ ID NO: 4813583 - DNA, 16 bp, Homo sapiens
acccatcactgtgtct

SEQ ID NO: 4813584 - DNA, 20 bp, Homo sapiens
acccatgcatggcctcccag

SEQ ID NO: 4813585 - DNA, 23 bp, Homo sapiens
acccatgcatggcctcccagcca

SEQ ID NO: 4813586 - DNA, 23 bp, Homo sapiens
accccacacgccggggctggccc

SEQ ID NO: 4813587 - DNA, 20 bp, Homo sapiens
accccaccacacacaccctt

SEQ ID NO: 4813588 - DNA, 11 bp, Homo sapiens
accccactgga

SEQ ID NO: 4813589 - DNA, 22 bp, Homo sapiens
accccagaacgcatgcagggcc

SEQ ID NO: 4813590 - DNA, 19 bp, Homo sapiens
accccagatacctgtgagg

SEQ ID NO: 4813591 - DNA, 16 bp, Homo sapiens
accccattctgggact

SEQ ID NO: 4813592 - DNA, 18 bp, Homo sapiens
accccattctgggactgc

SEQ ID NO: 4813593 - DNA, 16 bp, Homo sapiens
acccccagcagctcac

SEQ ID NO: 4813594 - DNA, 14 bp, Homo sapiens
acccccagcctccc

SEQ ID NO: 4813595 - DNA, 20 bp, Homo sapiens
acccccagcctcccccaggc

SEQ ID NO: 4813596 - DNA, 19 bp, Homo sapiens
acccccatgccaatgtcca

SEQ ID NO: 4813597 - DNA, 14 bp, Homo sapiens
acccccattgtgaa

SEQ ID NO: 4813598 - DNA, 14 bp, Homo sapiens
acccccctccccaa

SEQ ID NO: 4813599 - DNA, 11 bp, Homo sapiens
accccctgaat

SEQ ID NO: 4813600 - DNA, 14 bp, Homo sapiens
accccctgccccag

SEQ ID NO: 4813601 - DNA, 17 bp, Homo sapiens
accccctgccccagaga

SEQ ID NO: 4813602 - DNA, 18 bp, Homo sapiens
accccctgccccagagaa

SEQ ID NO: 4813603 - DNA, 14 bp, Homo sapiens
accccgctgcctgg

SEQ ID NO: 4813604 - DNA, 13 bp, Homo sapiens
accccggcaggcc

SEQ ID NO: 4813605 - DNA, 15 bp, Homo sapiens
accccggcaggccct

SEQ ID NO: 4813606 - DNA, 20 bp, Homo sapiens
accccggcaggccctgcagt

SEQ ID NO: 4813607 - DNA, 22 bp, Homo sapiens
accccggcaggccctgcagtgt

SEQ ID NO: 4813608 - DNA, 18 bp, Homo sapiens
accccgtcccggccccgc

SEQ ID NO: 4813609 - DNA, 15 bp, Homo sapiens
accccgtccctttcc

SEQ ID NO: 4813610 - DNA, 15 bp, Homo sapiens
accccgtctgcccct

SEQ ID NO: 4813611 - DNA, 15 bp, Homo sapiens
accccgttacagctc

SEQ ID NO: 4813612 - DNA, 20 bp, Homo sapiens
accccgttacagctccccaa

SEQ ID NO: 4813613 - DNA, 22 bp, Homo sapiens
accccgttgttgtccctgcagg

SEQ ID NO: 4813614 - DNA, 21 bp, Homo sapiens
acccctaaaagaaaccctgca

SEQ ID NO: 4813615 - DNA, 14 bp, Homo sapiens
acccctacagcctg

SEQ ID NO: 4813616 - DNA, 16 bp, Homo sapiens
acccctacagcctgca

SEQ ID NO: 4813617 - DNA, 16 bp, Homo sapiens
acccctcaagccagga

SEQ ID NO: 4813618 - DNA, 19 bp, Homo sapiens
acccctcttcccccttccc

SEQ ID NO: 4813619 - DNA, 19 bp, Homo sapiens
acccctgaactggccccag

SEQ ID NO: 4813620 - DNA, 23 bp, Homo sapiens
acccctgaactggccccagctcc

SEQ ID NO: 4813621 - DNA, 14 bp, Homo sapiens
acccctgcccaggc

SEQ ID NO: 4813622 - DNA, 15 bp, Homo sapiens
acccctgccctcggc

SEQ ID NO: 4813623 - DNA, 13 bp, Homo sapiens
acccctgggggag

SEQ ID NO: 4813624 - DNA, 17 bp, Homo sapiens
acccctgggggaggctt

SEQ ID NO: 4813625 - DNA, 23 bp, Homo sapiens
acccctgggggaggcttccagct

SEQ ID NO: 4813626 - DNA, 16 bp, Homo sapiens
acccgccccagagact

SEQ ID NO: 4813627 - DNA, 21 bp, Homo sapiens
acccgccccagagactgccca

SEQ ID NO: 4813628 - DNA, 17 bp, Homo sapiens
acccgcccgcccccgcc

SEQ ID NO: 4813629 - DNA, 15 bp, Homo sapiens
acccggatctccagg

SEQ ID NO: 4813630 - DNA, 18 bp, Homo sapiens
acccggggaactggtttt

SEQ ID NO: 4813631 - DNA, 21 bp, Homo sapiens
acccggtggcttctggcacct

SEQ ID NO: 4813632 - DNA, 19 bp, Homo sapiens
acccgtcctggggtggttg

SEQ ID NO: 4813633 - DNA, 16 bp, Homo sapiens
acccgtgttctcctcc

SEQ ID NO: 4813634 - DNA, 22 bp, Homo sapiens
acccgttttatgatttactcat

SEQ ID NO: 4813635 - DNA, 16 bp, Homo sapiens
accctacagtatataa

SEQ ID NO: 4813636 - DNA, 18 bp, Homo sapiens
accctaggtctccacccc

SEQ ID NO: 4813637 - DNA, 20 bp, Homo sapiens
accctaggtctccacccctc

SEQ ID NO: 4813638 - DNA, 14 bp, Homo sapiens
accctaggtgctca

SEQ ID NO: 4813639 - DNA, 14 bp, Homo sapiens
accctatcatcagt

SEQ ID NO: 4813640 - DNA, 16 bp, Homo sapiens
accctatctcccacaa

SEQ ID NO: 4813641 - DNA, 14 bp, Homo sapiens
accctcactctgcc

SEQ ID NO: 4813642 - DNA, 18 bp, Homo sapiens
accctcactctgccaggg

SEQ ID NO: 4813643 - DNA, 21 bp, Homo sapiens
accctcactctgccagggcag

SEQ ID NO: 4813644 - DNA, 13 bp, Homo sapiens
accctcagttatt

SEQ ID NO: 4813645 - DNA, 16 bp, Homo sapiens
accctccacaggagcc

SEQ ID NO: 4813646 - DNA, 18 bp, Homo sapiens
accctccaccgcagaagg

SEQ ID NO: 4813647 - DNA, 12 bp, Homo sapiens
accctcccaggt

SEQ ID NO: 4813648 - DNA, 15 bp, Homo sapiens
accctcccccgcagc

SEQ ID NO: 4813649 - DNA, 17 bp, Homo sapiens
accctccctgtcccctg

SEQ ID NO: 4813650 - DNA, 18 bp, Homo sapiens
accctccctgtcccctga

SEQ ID NO: 4813651 - DNA, 19 bp, Homo sapiens
accctccctgtcccctgag

SEQ ID NO: 4813652 - DNA, 15 bp, Homo sapiens
accctcgctgccacc

SEQ ID NO: 4813653 - DNA, 20 bp, Homo sapiens
accctcgctgccacccaccc

SEQ ID NO: 4813654 - DNA, 20 bp, Homo sapiens
accctctcctgggggtggca

SEQ ID NO: 4813655 - DNA, 21 bp, Homo sapiens
accctctcctgggggtggcag

SEQ ID NO: 4813656 - DNA, 12 bp, Homo sapiens
accctctgctgc

SEQ ID NO: 4813657 - DNA, 16 bp, Homo sapiens
accctctgtccttccc

SEQ ID NO: 4813658 - DNA, 14 bp, Homo sapiens
accctgaatcagag

SEQ ID NO: 4813659 - DNA, 18 bp, Homo sapiens
accctgaatcagaggcag

SEQ ID NO: 4813660 - DNA, 21 bp, Homo sapiens
accctgacaaattttaattat

SEQ ID NO: 4813661 - DNA, 18 bp, Homo sapiens
accctgaggagtgatggg

SEQ ID NO: 4813662 - DNA, 16 bp, Homo sapiens
accctgcaaggcccac

SEQ ID NO: 4813663 - DNA, 23 bp, Homo sapiens
accctgcaaggcccacaggaggc

SEQ ID NO: 4813664 - DNA, 12 bp, Homo sapiens
accctgccaagg

SEQ ID NO: 4813665 - DNA, 16 bp, Homo sapiens
accctgccaccctctg

SEQ ID NO: 4813666 - DNA, 21 bp, Homo sapiens
accctgccaccctctgctgca

SEQ ID NO: 4813667 - DNA, 12 bp, Homo sapiens
accctgccaggg

SEQ ID NO: 4813668 - DNA, 12 bp, Homo sapiens
accctgccctgc

SEQ ID NO: 4813669 - DNA, 13 bp, Homo sapiens
accctgccctgca

SEQ ID NO: 4813670 - DNA, 14 bp, Homo sapiens
accttaaattaaac

SEQ ID NO: 4813671 - DNA, 21 bp, Homo sapiens
accttaaattaaacaatttat

SEQ ID NO: 4813672 - DNA, 14 bp, Homo sapiens
accttaatatttct

SEQ ID NO: 4813673 - DNA, 20 bp, Homo sapiens
accttacaaagccagctctg

SEQ ID NO: 4813674 - DNA, 19 bp, Homo sapiens
accttacttaaagcttgtt

SEQ ID NO: 4813675 - DNA, 20 bp, Homo sapiens
accttacttaaagcttgttt

SEQ ID NO: 4813676 - DNA, 15 bp, Homo sapiens
accttagccatcaga

SEQ ID NO: 4813677 - DNA, 23 bp, Homo sapiens
accttagctccctcccgcacccc

SEQ ID NO: 4813678 - DNA, 20 bp, Homo sapiens
accttagctcccttgagctg

SEQ ID NO: 4813679 - DNA, 19 bp, Homo sapiens
accttatagagcacaatat

SEQ ID NO: 4813680 - DNA, 14 bp, Homo sapiens
accttcagcagtta

SEQ ID NO: 4813681 - DNA, 17 bp, Homo sapiens
accttcccagctgctcc

SEQ ID NO: 4813682 - DNA, 15 bp, Homo sapiens
accttcctctggggc

SEQ ID NO: 4813683 - DNA, 19 bp, Homo sapiens
accttcctgggcagcccag

SEQ ID NO: 4813684 - DNA, 20 bp, Homo sapiens
accttccttgaaatttctca

SEQ ID NO: 4813685 - DNA, 19 bp, Homo sapiens
accttctgatgaagttgta

SEQ ID NO: 4813686 - DNA, 20 bp, Homo sapiens
accttcttttcaatgcaatg

SEQ ID NO: 4813687 - DNA, 15 bp, Homo sapiens
accttgaatgatgcc

SEQ ID NO: 4813688 - DNA, 20 bp, Homo sapiens
accttgagcactattctaag

SEQ ID NO: 4813689 - DNA, 15 bp, Homo sapiens
accttgcttccttct

SEQ ID NO: 4813690 - DNA, 17 bp, Homo sapiens
accttggagagacacag

SEQ ID NO: 4813691 - DNA, 23 bp, Homo sapiens
accttgggcacgggagagcgcca

SEQ ID NO: 4813692 - DNA, 14 bp, Homo sapiens
acctttctgaggag

SEQ ID NO: 4813693 - DNA, 22 bp, Homo sapiens
acctttctgaggagtaaaaaga

SEQ ID NO: 4813694 - DNA, 13 bp, Homo sapiens
acctttgtcaact

SEQ ID NO: 4813695 - DNA, 21 bp, Homo sapiens
acctttgtctcacgattccag

SEQ ID NO: 4813696 - DNA, 17 bp, Homo sapiens
accttttaaaaaaataa

SEQ ID NO: 4813697 - DNA, 17 bp, Homo sapiens
accttttcttgtatctg

SEQ ID NO: 4813698 - DNA, 17 bp, Homo sapiens
accttttgagtgcctta

SEQ ID NO: 4813699 - DNA, 12 bp, Homo sapiens
acctttttaatc

SEQ ID NO: 4813700 - DNA, 17 bp, Homo sapiens
acgaacatggcatgtga

SEQ ID NO: 4813701 - DNA, 17 bp, Homo sapiens
acgaccgacgcccctcc

SEQ ID NO: 4813702 - DNA, 15 bp, Homo sapiens
acgaggcggcaaaga

SEQ ID NO: 4813703 - DNA, 16 bp, Homo sapiens
acgaggcttctctaac

SEQ ID NO: 4813704 - DNA, 16 bp, Homo sapiens
acgagtcaccttccag

SEQ ID NO: 4813705 - DNA, 15 bp, Homo sapiens
acgatccttcaaagt

SEQ ID NO: 4813706 - DNA, 19 bp, Homo sapiens
acgattcatttttgaaact

SEQ ID NO: 4813707 - DNA, 11 bp, Homo sapiens
acgattccagt

SEQ ID NO: 4813708 - DNA, 14 bp, Homo sapiens
acgattccagtgca

SEQ ID NO: 4813709 - DNA, 19 bp, Homo sapiens
acaaaaaaaaaatttgcca

SEQ ID NO: 4813710 - DNA, 17 bp, Homo sapiens
acaaaaaaaagaaagaa

SEQ ID NO: 4813711 - DNA, 19 bp, Homo sapiens
acaaaaactttccatgaca

SEQ ID NO: 4813712 - DNA, 20 bp, Homo sapiens
acaaaaactttccatgacag

SEQ ID NO: 4813713 - DNA, 18 bp, Homo sapiens
acaaaaaggaaatgaata

SEQ ID NO: 4813714 - DNA, 14 bp, Homo sapiens
acaaaacaacagca

SEQ ID NO: 4813715 - DNA, 17 bp, Homo sapiens
acaaaacaacagcaaca

SEQ ID NO: 4813716 - DNA, 21 bp, Homo sapiens
acaaaacaacagcaacaacaa

SEQ ID NO: 4813717 - DNA, 23 bp, Homo sapiens
acaaaagtatattcaaaaattat

SEQ ID NO: 4813718 - DNA, 11 bp, Homo sapiens
acaaaatataa

SEQ ID NO: 4813719 - DNA, 15 bp, Homo sapiens
acaaaatataaatca

SEQ ID NO: 4813720 - DNA, 20 bp, Homo sapiens
acaaaatccttgccttcaaa

SEQ ID NO: 4813721 - DNA, 11 bp, Homo sapiens
acaaaatgcaa

SEQ ID NO: 4813722 - DNA, 16 bp, Homo sapiens
acaaaatgcaaacttt

SEQ ID NO: 4813723 - DNA, 22 bp, Homo sapiens
acaaaatttatgtcattttcag

SEQ ID NO: 4813724 - DNA, 16 bp, Homo sapiens
acaaacaacaaagcag

SEQ ID NO: 4813725 - DNA, 19 bp, Homo sapiens
acaaaccacaactgacaca

SEQ ID NO: 4813726 - DNA, 22 bp, Homo sapiens
acaaacctctatatgttgctga

SEQ ID NO: 4813727 - DNA, 17 bp, Homo sapiens
acaaaccttcttttcaa

SEQ ID NO: 4813728 - DNA, 21 bp, Homo sapiens
acaaaccttcttttcaatgca

SEQ ID NO: 4813729 - DNA, 22 bp, Homo sapiens
acaaaccttcttttcaatgcaa

SEQ ID NO: 4813730 - DNA, 24 bp, Homo sapiens
acaaaccttcttttcaatgcaatg

SEQ ID NO: 4813731 - DNA, 19 bp, Homo sapiens
acaaacgtaatttgttata

SEQ ID NO: 4813732 - DNA, 15 bp, Homo sapiens
acaaacttttataaa

SEQ ID NO: 4813733 - DNA, 10 bp, Homo sapiens
acaaagaaaa

SEQ ID NO: 4813734 - DNA, 11 bp, Homo sapiens
acaaagaaaat

SEQ ID NO: 4813735 - DNA, 16 bp, Homo sapiens
acaaagaaggcacagg

SEQ ID NO: 4813736 - DNA, 12 bp, Homo sapiens
acaaagcatgct

SEQ ID NO: 4813737 - DNA, 15 bp, Homo sapiens
acaaagcatgctcag

SEQ ID NO: 4813738 - DNA, 21 bp, Homo sapiens
acaaagcatgctcagtattga

SEQ ID NO: 4813739 - DNA, 17 bp, Homo sapiens
acaaagctatttaagtg

SEQ ID NO: 4813740 - DNA, 19 bp, Homo sapiens
acaaagctatttaagtgga

SEQ ID NO: 4813741 - DNA, 14 bp, Homo sapiens
acaaagctgtcact

SEQ ID NO: 4813742 - DNA, 22 bp, Homo sapiens
acaaaggatgcccaaagatgca

SEQ ID NO: 4813743 - DNA, 19 bp, Homo sapiens
acaaatatactcatttgga

SEQ ID NO: 4813744 - DNA, 20 bp, Homo sapiens
acaaatatgattctcctctc

SEQ ID NO: 4813745 - DNA, 23 bp, Homo sapiens
acaaatattgcttggactaccta

SEQ ID NO: 4813746 - DNA, 15 bp, Homo sapiens
acaaatatttcactt

SEQ ID NO: 4813747 - DNA, 16 bp, Homo sapiens
acaaatcagtaatttt

SEQ ID NO: 4813748 - DNA, 15 bp, Homo sapiens
acaaatcattttgat

SEQ ID NO: 4813749 - DNA, 17 bp, Homo sapiens
acaaatcattttgatgt

SEQ ID NO: 4813750 - DNA, 21 bp, Homo sapiens
acaaatcattttgatgtatta

SEQ ID NO: 4813751 - DNA, 20 bp, Homo sapiens
acaaatgcagtgtatttaat

SEQ ID NO: 4813752 - DNA, 21 bp, Homo sapiens
acaaatgcagtgtatttaatg

SEQ ID NO: 4813753 - DNA, 15 bp, Homo sapiens
acaaatgtcctcaga

SEQ ID NO: 4813754 - DNA, 18 bp, Homo sapiens
acaaattcagtggacatt

SEQ ID NO: 4813755 - DNA, 17 bp, Homo sapiens
acaaatttttactcagg

SEQ ID NO: 4813756 - DNA, 18 bp, Homo sapiens
acaaatttttactcaggc

SEQ ID NO: 4813757 - DNA, 18 bp, Homo sapiens
acaacaaagcatgctcag

SEQ ID NO: 4813758 - DNA, 14 bp, Homo sapiens
acaacaacagaaca

SEQ ID NO: 4813759 - DNA, 20 bp, Homo sapiens
acaacaagcaaactgaaatt

SEQ ID NO: 4813760 - DNA, 21 bp, Homo sapiens
acaacaagcaaactgaaatta

SEQ ID NO: 4813761 - DNA, 14 bp, Homo sapiens
acaacacacacaca

SEQ ID NO: 4813762 - DNA, 18 bp, Homo sapiens
acaacagtcttcattttt

SEQ ID NO: 4813763 - DNA, 17 bp, Homo sapiens
acaacatctttttctac

SEQ ID NO: 4813764 - DNA, 19 bp, Homo sapiens
acaacatgcacattcatcc

SEQ ID NO: 4813765 - DNA, 22 bp, Homo sapiens
acaacatgcacattcatcctca

SEQ ID NO: 4813766 - DNA, 15 bp, Homo sapiens
acaaccacatttctg

SEQ ID NO: 4813767 - DNA, 18 bp, Homo sapiens
acaaccactgggatcagc

SEQ ID NO: 4813768 - DNA, 20 bp, Homo sapiens
acaaccactgggatcagctg

SEQ ID NO: 4813769 - DNA, 14 bp, Homo sapiens
acaacctgccacaa

SEQ ID NO: 4813770 - DNA, 18 bp, Homo sapiens
acaacctgccacaatgtg

SEQ ID NO: 4813771 - DNA, 21 bp, Homo sapiens
acaacctgccacaatgtgata

SEQ ID NO: 4813772 - DNA, 18 bp, Homo sapiens
acaacgaacatggcatgt

SEQ ID NO: 4813773 - DNA, 14 bp, Homo sapiens
acaactgacacagg

SEQ ID NO: 4813774 - DNA, 15 bp, Homo sapiens
acaactgacacagga

SEQ ID NO: 4813775 - DNA, 18 bp, Homo sapiens
acaactgtggataaattt

SEQ ID NO: 4813776 - DNA, 18 bp, Homo sapiens
acaactgtttttgaagaa

SEQ ID NO: 4813777 - DNA, 18 bp, Homo sapiens
acaacttgctcctttcca

SEQ ID NO: 4813778 - DNA, 19 bp, Homo sapiens
acaactttggaatttgaag

SEQ ID NO: 4813779 - DNA, 20 bp, Homo sapiens
acaagagaccacttccttaa

SEQ ID NO: 4813780 - DNA, 17 bp, Homo sapiens
acaagagcccaggcctc

SEQ ID NO: 4813781 - DNA, 22 bp, Homo sapiens
acaagagcccaggcctcctaca

SEQ ID NO: 4813782 - DNA, 20 bp, Homo sapiens
acaagatggagaaacaacaa

SEQ ID NO: 4813783 - DNA, 17 bp, Homo sapiens
acaagccaggccctctc

SEQ ID NO: 4813784 - DNA, 23 bp, Homo sapiens
acaagccaggccctctctgcagt

SEQ ID NO: 4813785 - DNA, 16 bp, Homo sapiens
acaagccgtgttttat

SEQ ID NO: 4813786 - DNA, 17 bp, Homo sapiens
acaagctgatagtgttt

SEQ ID NO: 4813787 - DNA, 21 bp, Homo sapiens
acaagggctgacctgcctctc

SEQ ID NO: 4813788 - DNA, 14 bp, Homo sapiens
acaaggggtggaag

SEQ ID NO: 4813789 - DNA, 11 bp, Homo sapiens
acaagtactgg

SEQ ID NO: 4813790 - DNA, 20 bp, Homo sapiens
acaagtagatgcctgaactt

SEQ ID NO: 4813791 - DNA, 11 bp, Homo sapiens
acaagtgtttc

SEQ ID NO: 4813792 - DNA, 14 bp, Homo sapiens
acaataaattttat

SEQ ID NO: 4813793 - DNA, 21 bp, Homo sapiens
acaataagaaacagtttaaca

SEQ ID NO: 4813794 - DNA, 22 bp, Homo sapiens
acaataagaaacagtttaacag

SEQ ID NO: 4813795 - DNA, 18 bp, Homo sapiens
acaatactttgtgtcttt

SEQ ID NO: 4813796 - DNA, 17 bp, Homo sapiens
acaatattaagtgttgt

SEQ ID NO: 4813797 - DNA, 18 bp, Homo sapiens
acaatattaagtgttgta

SEQ ID NO: 4813798 - DNA, 23 bp, Homo sapiens
acaatcactaaatatctagtgct

SEQ ID NO: 4813799 - DNA, 17 bp, Homo sapiens
acaatcatctattgagt

SEQ ID NO: 4813800 - DNA, 22 bp, Homo sapiens
acaatcatgcctacattagtga

SEQ ID NO: 4813801 - DNA, 14 bp, Homo sapiens
acaatggggacttc

SEQ ID NO: 4813802 - DNA, 22 bp, Homo sapiens
acaatggtagctctgaagggag

SEQ ID NO: 4813803 - DNA, 15 bp, Homo sapiens
acaatggttttcttg

SEQ ID NO: 4813804 - DNA, 19 bp, Homo sapiens
acaatgtgatatgtgtaat

SEQ ID NO: 4813805 - DNA, 20 bp, Homo sapiens
acaatgtggaattacataac

SEQ ID NO: 4813806 - DNA, 21 bp, Homo sapiens
acaatgtggaattacataaca

SEQ ID NO: 4813807 - DNA, 23 bp, Homo sapiens
acaatgtggaattacataacagg

SEQ ID NO: 4813808 - DNA, 19 bp, Homo sapiens
acaatttaggaatgctcaa

SEQ ID NO: 4813809 - DNA, 20 bp, Homo sapiens
acaatttaggaatgctcaat

SEQ ID NO: 4813810 - DNA, 12 bp, Homo sapiens
acaatttatttt

SEQ ID NO: 4813811 - DNA, 13 bp, Homo sapiens
acaatttctgtgt

SEQ ID NO: 4813812 - DNA, 20 bp, Homo sapiens
aatgtctgtccctaaacata

SEQ ID NO: 4813813 - DNA, 21 bp, Homo sapiens
aatgtcttcatgttgatgtgt

SEQ ID NO: 4813814 - DNA, 16 bp, Homo sapiens
aatgtgaaatgtaact

SEQ ID NO: 4813815 - DNA, 14 bp, Homo sapiens
aatgtgaattttaa

SEQ ID NO: 4813816 - DNA, 19 bp, Homo sapiens
aatgtgcctctcagtatct

SEQ ID NO: 4813817 - DNA, 22 bp, Homo sapiens
aatgtgctgttgattctttcaa

SEQ ID NO: 4813818 - DNA, 15 bp, Homo sapiens
aatgtggaattacat

SEQ ID NO: 4813819 - DNA, 21 bp, Homo sapiens
aatgttaaggacttctgcagc

SEQ ID NO: 4813820 - DNA, 19 bp, Homo sapiens
aatgttcacgcaacttgaa

SEQ ID NO: 4813821 - DNA, 16 bp, Homo sapiens
aatgttcactgaataa

SEQ ID NO: 4813822 - DNA, 22 bp, Homo sapiens
aatgttccattcagtctgcagc

SEQ ID NO: 4813823 - DNA, 18 bp, Homo sapiens
aatgttccgttcatctga

SEQ ID NO: 4813824 - DNA, 17 bp, Homo sapiens
aatgttgtcctgtgtca

SEQ ID NO: 4813825 - DNA, 22 bp, Homo sapiens
aatgttgtgttggtatttactg

SEQ ID NO: 4813826 - DNA, 15 bp, Homo sapiens
aatgtttcatttgca

SEQ ID NO: 4813827 - DNA, 14 bp, Homo sapiens
aatgtttgtaagca

SEQ ID NO: 4813828 - DNA, 19 bp, Homo sapiens
aattaaacaaattccttcc

SEQ ID NO: 4813829 - DNA, 12 bp, Homo sapiens
aattaaactgat

SEQ ID NO: 4813830 - DNA, 15 bp, Homo sapiens
aattaaagtctacac

SEQ ID NO: 4813831 - DNA, 23 bp, Homo sapiens
aattaaagtctacactgcctttg

SEQ ID NO: 4813832 - DNA, 14 bp, Homo sapiens
aattaaatgaaata

SEQ ID NO: 4813833 - DNA, 19 bp, Homo sapiens
aattaagaggatacacacg

SEQ ID NO: 4813834 - DNA, 18 bp, Homo sapiens
aattaagttattaacatt

SEQ ID NO: 4813835 - DNA, 18 bp, Homo sapiens
aattaatggaaaactgtt

SEQ ID NO: 4813836 - DNA, 17 bp, Homo sapiens
aattacaggaagtactg

SEQ ID NO: 4813837 - DNA, 18 bp, Homo sapiens
aattacataacaggcatt

SEQ ID NO: 4813838 - DNA, 19 bp, Homo sapiens
aattacataacaggcattg

SEQ ID NO: 4813839 - DNA, 14 bp, Homo sapiens
aattacatgcatga

SEQ ID NO: 4813840 - DNA, 17 bp, Homo sapiens
aattactatagcaaagt

SEQ ID NO: 4813841 - DNA, 15 bp, Homo sapiens
aattactgtgagaac

SEQ ID NO: 4813842 - DNA, 13 bp, Homo sapiens
aattactgtttga

SEQ ID NO: 4813843 - DNA, 23 bp, Homo sapiens
aattactgtttgaaacttttcaa

SEQ ID NO: 4813844 - DNA, 14 bp, Homo sapiens
aattagaagaaaat

SEQ ID NO: 4813845 - DNA, 16 bp, Homo sapiens
aattagatccattaat

SEQ ID NO: 4813846 - DNA, 21 bp, Homo sapiens
aattagatccattaatttaaa

SEQ ID NO: 4813847 - DNA, 23 bp, Homo sapiens
aattagatccattaatttaaatg

SEQ ID NO: 4813848 - DNA, 13 bp, Homo sapiens
aattagatttctc

SEQ ID NO: 4813849 - DNA, 21 bp, Homo sapiens
aattagattttaaaacttcat

SEQ ID NO: 4813850 - DNA, 18 bp, Homo sapiens
aattagccaaccaggcta

SEQ ID NO: 4813851 - DNA, 14 bp, Homo sapiens
aattaggtaatgga

SEQ ID NO: 4813852 - DNA, 16 bp, Homo sapiens
aattaggtaatggata

SEQ ID NO: 4813853 - DNA, 16 bp, Homo sapiens
aattagtgagatttgt

SEQ ID NO: 4813854 - DNA, 14 bp, Homo sapiens
aattagtgttttca

SEQ ID NO: 4813855 - DNA, 15 bp, Homo sapiens
aattagtgttttcat

SEQ ID NO: 4813856 - DNA, 12 bp, Homo sapiens
aattatatctgt

SEQ ID NO: 4813857 - DNA, 14 bp, Homo sapiens
aattatatgaagca

SEQ ID NO: 4813858 - DNA, 13 bp, Homo sapiens
aattatatgatat

SEQ ID NO: 4813859 - DNA, 15 bp, Homo sapiens
aattatatgatatgc

SEQ ID NO: 4813860 - DNA, 15 bp, Homo sapiens
aattatcaaaaaaca

SEQ ID NO: 4813861 - DNA, 21 bp, Homo sapiens
aattatcattgtttgtccttt

SEQ ID NO: 4813862 - DNA, 23 bp, Homo sapiens
aattatcattgtttgtcctttat

SEQ ID NO: 4813863 - DNA, 18 bp, Homo sapiens
aattatcctcaagttgtg

SEQ ID NO: 4813864 - DNA, 12 bp, Homo sapiens
aattatctttaa

SEQ ID NO: 4813865 - DNA, 15 bp, Homo sapiens
aattatctttaaaac

SEQ ID NO: 4813866 - DNA, 22 bp, Homo sapiens
aattatgacgtgcacaaacctt

SEQ ID NO: 4813867 - DNA, 23 bp, Homo sapiens
aattatgacgtgcacaaaccttc

SEQ ID NO: 4813868 - DNA, 18 bp, Homo sapiens
aattattactttaaatta

SEQ ID NO: 4813869 - DNA, 13 bp, Homo sapiens
aattattttatgt

SEQ ID NO: 4813870 - DNA, 13 bp, Homo sapiens
aattcaaacctaa

SEQ ID NO: 4813871 - DNA, 19 bp, Homo sapiens
aattcaatgggtaaataaa

SEQ ID NO: 4813872 - DNA, 22 bp, Homo sapiens
aattcaatgggtaaataaatgc

SEQ ID NO: 4813873 - DNA, 14 bp, Homo sapiens
aattcacccctccc

SEQ ID NO: 4813874 - DNA, 22 bp, Homo sapiens
aattcacccctcccacctcttt

SEQ ID NO: 4813875 - DNA, 17 bp, Homo sapiens
aattcagtagcatttta

SEQ ID NO: 4813876 - DNA, 18 bp, Homo sapiens
aattcagtagcattttaa

SEQ ID NO: 4813877 - DNA, 19 bp, Homo sapiens
aattcagtagcattttaat

SEQ ID NO: 4813878 - DNA, 19 bp, Homo sapiens
aattcagtggacatttgtt

SEQ ID NO: 4813879 - DNA, 11 bp, Homo sapiens
aattcagttgt

SEQ ID NO: 4813880 - DNA, 17 bp, Homo sapiens
aattcagttgttagtgt

SEQ ID NO: 4813881 - DNA, 22 bp, Homo sapiens
aattcagttgttagtgtgtctt

SEQ ID NO: 4813882 - DNA, 13 bp, Homo sapiens
aattcatgatgct

SEQ ID NO: 4813883 - DNA, 19 bp, Homo sapiens
aattcatgatgctagttct

SEQ ID NO: 4813884 - DNA, 19 bp, Homo sapiens
aattcattcatacttaaaa

SEQ ID NO: 4813885 - DNA, 18 bp, Homo sapiens
aattccagggaaccagag

SEQ ID NO: 4813886 - DNA, 15 bp, Homo sapiens
aattcctaattctat

SEQ ID NO: 4813887 - DNA, 18 bp, Homo sapiens
aattctaagattgtacat

SEQ ID NO: 4813888 - DNA, 19 bp, Homo sapiens
aattctataagagacaaag

SEQ ID NO: 4813889 - DNA, 23 bp, Homo sapiens
aattctatgattaaactgggaaa

SEQ ID NO: 4813890 - DNA, 18 bp, Homo sapiens
aattctcttcgctgtgat

SEQ ID NO: 4813891 - DNA, 22 bp, Homo sapiens
aattcttaccgaaatgaaaatg

SEQ ID NO: 4813892 - DNA, 22 bp, Homo sapiens
aattcttattttataattttaa

SEQ ID NO: 4813893 - DNA, 21 bp, Homo sapiens
aattcttctcctttgtcaaat

SEQ ID NO: 4813894 - DNA, 23 bp, Homo sapiens
aattcttctcctttgtcaaatgg

SEQ ID NO: 4813895 - DNA, 15 bp, Homo sapiens
aattcttgcactgta

SEQ ID NO: 4813896 - DNA, 15 bp, Homo sapiens
aattgaaaagaagta

SEQ ID NO: 4813897 - DNA, 20 bp, Homo sapiens
aattgagttaaatcagtaat

SEQ ID NO: 4813898 - DNA, 13 bp, Homo sapiens
aattgctgagatg

SEQ ID NO: 4813899 - DNA, 14 bp, Homo sapiens
aattgcttctctaa

SEQ ID NO: 4813900 - DNA, 20 bp, Homo sapiens
aattgcttctctaaaacagc

SEQ ID NO: 4813901 - DNA, 14 bp, Homo sapiens
aattgggttttgat

SEQ ID NO: 4813902 - DNA, 15 bp, Homo sapiens
aattggttaatgaaa

SEQ ID NO: 4813903 - DNA, 22 bp, Homo sapiens
aattggttaatgaaaaatctga

SEQ ID NO: 4813904 - DNA, 14 bp, Homo sapiens
aattgtcatgactt

SEQ ID NO: 4813905 - DNA, 23 bp, Homo sapiens
aattgtcatgactttcagattgt

SEQ ID NO: 4813906 - DNA, 20 bp, Homo sapiens
aattgtcttttgtcatgtgg

SEQ ID NO: 4813907 - DNA, 12 bp, Homo sapiens
aattgtgccaaa

SEQ ID NO: 4813908 - DNA, 11 bp, Homo sapiens
aattgtggatg

SEQ ID NO: 4813909 - DNA, 13 bp, Homo sapiens
aattgttacaatt

SEQ ID NO: 4813910 - DNA, 13 bp, Homo sapiens
aattgtttaagaa

SEQ ID NO: 4813911 - DNA, 14 bp, Homo sapiens
aattgtttaagaat

SEQ ID NO: 4813912 - DNA, 19 bp, Homo sapiens
aattgtttggcttcctcct

SEQ ID NO: 4813913 - DNA, 20 bp, Homo sapiens
aattgtttggcttcctcctg

SEQ ID NO: 4813914 - DNA, 13 bp, Homo sapiens
aatttaattaggt

SEQ ID NO: 4813915 - DNA, 23 bp, Homo sapiens
aatttaccatcaaacaaatcatt

SEQ ID NO: 4813916 - DNA, 19 bp, Homo sapiens
aatttaggaatgctcaatg

SEQ ID NO: 4813917 - DNA, 15 bp, Homo sapiens
aatttatgtcatttt

SEQ ID NO: 4813918 - DNA, 14 bp, Homo sapiens
aatttattaaatgt

SEQ ID NO: 4813919 - DNA, 23 bp, Homo sapiens
aatttatttccaatgtttcaagc

SEQ ID NO: 4813920 - DNA, 16 bp, Homo sapiens
aatttcaaagtatgtt

SEQ ID NO: 4813921 - DNA, 16 bp, Homo sapiens
aatttcagtaagatca

SEQ ID NO: 4813922 - DNA, 15 bp, Homo sapiens
aatttcccaaagcag

SEQ ID NO: 4813923 - DNA, 14 bp, Homo sapiens
aatttcctgtgagg

SEQ ID NO: 4813924 - DNA, 20 bp, Homo sapiens
aatttctagatatgagaaat

SEQ ID NO: 4813925 - DNA, 20 bp, Homo sapiens
aatttctgccatttcatgtc

SEQ ID NO: 4813926 - DNA, 20 bp, Homo sapiens
aatttgacattgtcagaatg

SEQ ID NO: 4813927 - DNA, 18 bp, Homo sapiens
aatttgccagacagagat

SEQ ID NO: 4813928 - DNA, 14 bp, Homo sapiens
aatttgtataaaat

SEQ ID NO: 4813929 - DNA, 21 bp, Homo sapiens
aatttgtgaaagtggcaagct

SEQ ID NO: 4813930 - DNA, 16 bp, Homo sapiens
aatttgttctgtgcaa

SEQ ID NO: 4813931 - DNA, 14 bp, Homo sapiens
aatttgtttgtgct

SEQ ID NO: 4813932 - DNA, 16 bp, Homo sapiens
aatttgtttgtgcttc

SEQ ID NO: 4813933 - DNA, 15 bp, Homo sapiens
aattttaaaagcata

SEQ ID NO: 4813934 - DNA, 23 bp, Homo sapiens
aattttaaaagcatatataaaac

SEQ ID NO: 4813935 - DNA, 12 bp, Homo sapiens
aattttgacact

SEQ ID NO: 4813936 - DNA, 22 bp, Homo sapiens
aatttttctgttggtcttaact

SEQ ID NO: 4813937 - DNA, 23 bp, Homo sapiens
agtgccacatggccgctgcccac

SEQ ID NO: 4813938 - DNA, 17 bp, Homo sapiens
agtgccacgtggccgct

SEQ ID NO: 4813939 - DNA, 23 bp, Homo sapiens
agtgccacgtggccgctgcccac

SEQ ID NO: 4813940 - DNA, 16 bp, Homo sapiens
agtgccagctggtgaa

SEQ ID NO: 4813941 - DNA, 22 bp, Homo sapiens
agtgccagctggtgaatccatg

SEQ ID NO: 4813942 - DNA, 16 bp, Homo sapiens
agtgccatggccagga

SEQ ID NO: 4813943 - DNA, 23 bp, Homo sapiens
agtgcccttaaaataatgattta

SEQ ID NO: 4813944 - DNA, 17 bp, Homo sapiens
agtgccttacacaatgg

SEQ ID NO: 4813945 - DNA, 15 bp, Homo sapiens
agtgcgaccaccact

SEQ ID NO: 4813946 - DNA, 19 bp, Homo sapiens
agtgcgtgtgaaacagcgt

SEQ ID NO: 4813947 - DNA, 16 bp, Homo sapiens
agtgctgctcccttta

SEQ ID NO: 4813948 - DNA, 14 bp, Homo sapiens
agtgcttgaggcca

SEQ ID NO: 4813949 - DNA, 23 bp, Homo sapiens
agtggaaatggggaactccccca

SEQ ID NO: 4813950 - DNA, 13 bp, Homo sapiens
agtggaagacaga

SEQ ID NO: 4813951 - DNA, 17 bp, Homo sapiens
agtggacagcagctgga

SEQ ID NO: 4813952 - DNA, 19 bp, Homo sapiens
agtggacagcagctggact

SEQ ID NO: 4813953 - DNA, 15 bp, Homo sapiens
agtggactcttccct

SEQ ID NO: 4813954 - DNA, 22 bp, Homo sapiens
agtggactcttccctctcgctc

SEQ ID NO: 4813955 - DNA, 17 bp, Homo sapiens
agtggattgtattgtga

SEQ ID NO: 4813956 - DNA, 12 bp, Homo sapiens
agtggcaagcta

SEQ ID NO: 4813957 - DNA, 15 bp, Homo sapiens
agtggcctgagaaga

SEQ ID NO: 4813958 - DNA, 17 bp, Homo sapiens
agtggcctgagaagagt

SEQ ID NO: 4813959 - DNA, 21 bp, Homo sapiens
agtggcctgagaagagtcgag

SEQ ID NO: 4813960 - DNA, 15 bp, Homo sapiens
agtggcgagtccaga

SEQ ID NO: 4813961 - DNA, 19 bp, Homo sapiens
agtggcgcgatctcagctc

SEQ ID NO: 4813962 - DNA, 22 bp, Homo sapiens
agtggctcgtgtttcacagtgg

SEQ ID NO: 4813963 - DNA, 18 bp, Homo sapiens
agtgggattcaggaatgg

SEQ ID NO: 4813964 - DNA, 16 bp, Homo sapiens
agtgggccccctctct

SEQ ID NO: 4813965 - DNA, 19 bp, Homo sapiens
agtgggcggcttccctgcg

SEQ ID NO: 4813966 - DNA, 15 bp, Homo sapiens
agtgggctctgagca

SEQ ID NO: 4813967 - DNA, 19 bp, Homo sapiens
agtggggacgggggctgct

SEQ ID NO: 4813968 - DNA, 21 bp, Homo sapiens
agtggggacgggggctgcttc

SEQ ID NO: 4813969 - DNA, 22 bp, Homo sapiens
agtggggacgggggctgcttct

SEQ ID NO: 4813970 - DNA, 20 bp, Homo sapiens
agtgggggagtggccacaga

SEQ ID NO: 4813971 - DNA, 16 bp, Homo sapiens
agtggtattttaacat

SEQ ID NO: 4813972 - DNA, 21 bp, Homo sapiens
agtggtattttaacatagcag

SEQ ID NO: 4813973 - DNA, 23 bp, Homo sapiens
agtggtattttaacatagcagct

SEQ ID NO: 4813974 - DNA, 16 bp, Homo sapiens
agtggtccagggtcca

SEQ ID NO: 4813975 - DNA, 21 bp, Homo sapiens
agtggtccagggtccagccct

SEQ ID NO: 4813976 - DNA, 17 bp, Homo sapiens
agtggtggaggtgggtg

SEQ ID NO: 4813977 - DNA, 20 bp, Homo sapiens
agtggtttccacatgctctg

SEQ ID NO: 4813978 - DNA, 12 bp, Homo sapiens
agtgtacatttg

SEQ ID NO: 4813979 - DNA, 14 bp, Homo sapiens
agtgtatgcataca

SEQ ID NO: 4813980 - DNA, 14 bp, Homo sapiens
agtgtatgtataca

SEQ ID NO: 4813981 - DNA, 17 bp, Homo sapiens
agtgtcaggctctgaat

SEQ ID NO: 4813982 - DNA, 18 bp, Homo sapiens
agtgtcctgtgctttctg

SEQ ID NO: 4813983 - DNA, 20 bp, Homo sapiens
agtgtcctgtgctttctgca

SEQ ID NO: 4813984 - DNA, 23 bp, Homo sapiens
agtgtctggatcagtaaaattat

SEQ ID NO: 4813985 - DNA, 22 bp, Homo sapiens
agtgtctggcccagccatggct

SEQ ID NO: 4813986 - DNA, 23 bp, Homo sapiens
agtgtctggcccagccatggctg

SEQ ID NO: 4813987 - DNA, 24 bp, Homo sapiens
agtgtctggcccagccatggctgg

SEQ ID NO: 4813988 - DNA, 21 bp, Homo sapiens
agtgtgaatataaatgtgtgt

SEQ ID NO: 4813989 - DNA, 20 bp, Homo sapiens
agtgtgactgatctctcgtg

SEQ ID NO: 4813990 - DNA, 14 bp, Homo sapiens
agtgtgcctctctc

SEQ ID NO: 4813991 - DNA, 15 bp, Homo sapiens
agtgtgccttgggcg

SEQ ID NO: 4813992 - DNA, 20 bp, Homo sapiens
agtgtggatgtaaattttat

SEQ ID NO: 4813993 - DNA, 18 bp, Homo sapiens
agtgtggcttaaacattt

SEQ ID NO: 4813994 - DNA, 12 bp, Homo sapiens
agtgtgtgtgca

SEQ ID NO: 4813995 - DNA, 13 bp, Homo sapiens
agtgtgtgtgcaa

SEQ ID NO: 4813996 - DNA, 16 bp, Homo sapiens
agtgtgttctgatgag

SEQ ID NO: 4813997 - DNA, 14 bp, Homo sapiens
agtgttaatccaga

SEQ ID NO: 4813998 - DNA, 17 bp, Homo sapiens
agtgttataaaatctgt

SEQ ID NO: 4813999 - DNA, 15 bp, Homo sapiens
agtgttcgcttggct

SEQ ID NO: 4814000 - DNA, 14 bp, Homo sapiens
agtgttctgtggct

SEQ ID NO: 4814001 - DNA, 14 bp, Homo sapiens
agtgttgaggaggg

SEQ ID NO: 4814002 - DNA, 18 bp, Homo sapiens
agtgttgaggaggggagc

SEQ ID NO: 4814003 - DNA, 22 bp, Homo sapiens
agtgttggccatcatttcattc

SEQ ID NO: 4814004 - DNA, 24 bp, Homo sapiens
agtgttggccatcatttcattcgt

SEQ ID NO: 4814005 - DNA, 14 bp, Homo sapiens
agtgttgggtggag

SEQ ID NO: 4814006 - DNA, 16 bp, Homo sapiens
agtgttgggtggagga

SEQ ID NO: 4814007 - DNA, 20 bp, Homo sapiens
agtgttgggtggaggatgga

SEQ ID NO: 4814008 - DNA, 16 bp, Homo sapiens
agtgttgtgttacaat

SEQ ID NO: 4814009 - DNA, 16 bp, Homo sapiens
agtgtttaattgtata

SEQ ID NO: 4814010 - DNA, 19 bp, Homo sapiens
agtgtttaattgtataaaa

SEQ ID NO: 4814011 - DNA, 16 bp, Homo sapiens
agtgtttatgtgctat

SEQ ID NO: 4814012 - DNA, 19 bp, Homo sapiens
agtgtttctagtaacagta

SEQ ID NO: 4814013 - DNA, 13 bp, Homo sapiens
agtgttttcattc

SEQ ID NO: 4814014 - DNA, 23 bp, Homo sapiens
agtgttttcattctggtccttag

SEQ ID NO: 4814015 - DNA, 18 bp, Homo sapiens
agttaagacaacaggcat

SEQ ID NO: 4814016 - DNA, 22 bp, Homo sapiens
agttaagtctatctggtattaa

SEQ ID NO: 4814017 - DNA, 16 bp, Homo sapiens
agttaatgtgccaaaa

SEQ ID NO: 4814018 - DNA, 14 bp, Homo sapiens
agttacagtggcag

SEQ ID NO: 4814019 - DNA, 15 bp, Homo sapiens
agttacagtggcagt

SEQ ID NO: 4814020 - DNA, 18 bp, Homo sapiens
agttacagtggcagtatt

SEQ ID NO: 4814021 - DNA, 20 bp, Homo sapiens
agttacctggaatcaaataa

SEQ ID NO: 4814022 - DNA, 21 bp, Homo sapiens
agttactgtcctgttgattaa

SEQ ID NO: 4814023 - DNA, 15 bp, Homo sapiens
agttacttacacacc

SEQ ID NO: 4814024 - DNA, 13 bp, Homo sapiens
agttagactcaaa

SEQ ID NO: 4814025 - DNA, 14 bp, Homo sapiens
agttagcacagagg

SEQ ID NO: 4814026 - DNA, 18 bp, Homo sapiens
agttagcaggaaatagtg

SEQ ID NO: 4814027 - DNA, 21 bp, Homo sapiens
agttagcccggccaaggacac

SEQ ID NO: 4814028 - DNA, 14 bp, Homo sapiens
agttaggtgtgcca

SEQ ID NO: 4814029 - DNA, 17 bp, Homo sapiens
agttaggtgtgccaaac

SEQ ID NO: 4814030 - DNA, 23 bp, Homo sapiens
agttatttaccagaagtttaaat

SEQ ID NO: 4814031 - DNA, 14 bp, Homo sapiens
agttattttgtcac

SEQ ID NO: 4814032 - DNA, 16 bp, Homo sapiens
agttattttgtgtcct

SEQ ID NO: 4814033 - DNA, 15 bp, Homo sapiens
agttcacaccctgca

SEQ ID NO: 4814034 - DNA, 16 bp, Homo sapiens
agttcacaccctgcaa

SEQ ID NO: 4814035 - DNA, 18 bp, Homo sapiens
agttcacaccctgcaagg

SEQ ID NO: 4814036 - DNA, 22 bp, Homo sapiens
agttcatcttgaattgtaagga

SEQ ID NO: 4814037 - DNA, 16 bp, Homo sapiens
agttccacaattttgt

SEQ ID NO: 4814038 - DNA, 20 bp, Homo sapiens
agttccacaattttgtctct

SEQ ID NO: 4814039 - DNA, 14 bp, Homo sapiens
agttcccaagaaag

SEQ ID NO: 4814040 - DNA, 16 bp, Homo sapiens
agttcccatttccttg

SEQ ID NO: 4814041 - DNA, 18 bp, Homo sapiens
agttcccttgattcaaat

SEQ ID NO: 4814042 - DNA, 14 bp, Homo sapiens
agttcctttccctc

SEQ ID NO: 4814043 - DNA, 13 bp, Homo sapiens
agttctacagaaa

SEQ ID NO: 4814044 - DNA, 16 bp, Homo sapiens
agttctattatctggg

SEQ ID NO: 4814045 - DNA, 19 bp, Homo sapiens
agttctattatctgggttt

SEQ ID NO: 4814046 - DNA, 13 bp, Homo sapiens
agttctccttgta

SEQ ID NO: 4814047 - DNA, 16 bp, Homo sapiens
agttctccttgtactt

SEQ ID NO: 4814048 - DNA, 16 bp, Homo sapiens
agttctgcaataacag

SEQ ID NO: 4814049 - DNA, 16 bp, Homo sapiens
agttctgcacatacag

SEQ ID NO: 4814050 - DNA, 14 bp, Homo sapiens
agttctggttccta

SEQ ID NO: 4814051 - DNA, 18 bp, Homo sapiens
agttcttacgcttgacag

SEQ ID NO: 4814052 - DNA, 14 bp, Homo sapiens
agttcttcctgtaa

SEQ ID NO: 4814053 - DNA, 19 bp, Homo sapiens
agttcttggtgactgtccc

SEQ ID NO: 4814054 - DNA, 20 bp, Homo sapiens
agttcttggtgactgtccca

SEQ ID NO: 4814055 - DNA, 23 bp, Homo sapiens
agttgacctttatttattaaact

SEQ ID NO: 4814056 - DNA, 18 bp, Homo sapiens
agttgacttcaaatgtgt

SEQ ID NO: 4814057 - DNA, 21 bp, Homo sapiens
agttgacttcaaatgtgtaac

SEQ ID NO: 4814058 - DNA, 20 bp, Homo sapiens
agttgatgaccaatctctgt

SEQ ID NO: 4814059 - DNA, 16 bp, Homo sapiens
agttgccacattgctt

SEQ ID NO: 4814060 - DNA, 18 bp, Homo sapiens
agttgccgtggcaactgt

SEQ ID NO: 4814061 - DNA, 12 bp, Homo sapiens
agtcagcacaga

SEQ ID NO: 4814062 - DNA, 14 bp, Homo sapiens
agtcagcacagaga

SEQ ID NO: 4814063 - DNA, 15 bp, Homo sapiens
agtcagccagcttgg

SEQ ID NO: 4814064 - DNA, 11 bp, Homo sapiens
agtcaggatga

SEQ ID NO: 4814065 - DNA, 15 bp, Homo sapiens
agtcagggcccagag

SEQ ID NO: 4814066 - DNA, 14 bp, Homo sapiens
agtcatatgtgaag

SEQ ID NO: 4814067 - DNA, 18 bp, Homo sapiens
agtcatcaacaaaaggga

SEQ ID NO: 4814068 - DNA, 13 bp, Homo sapiens
agtcatcatctca

SEQ ID NO: 4814069 - DNA, 12 bp, Homo sapiens
agtcatctcaaa

SEQ ID NO: 4814070 - DNA, 13 bp, Homo sapiens
agtcatctcaaac

SEQ ID NO: 4814071 - DNA, 15 bp, Homo sapiens
agtcatggctgtccc

SEQ ID NO: 4814072 - DNA, 23 bp, Homo sapiens
agtcatggctgtcccctgcaagt

SEQ ID NO: 4814073 - DNA, 15 bp, Homo sapiens
agtcatgggagaaga

SEQ ID NO: 4814074 - DNA, 17 bp, Homo sapiens
agtcatgtttctgcagt

SEQ ID NO: 4814075 - DNA, 16 bp, Homo sapiens
agtcattctagaggga

SEQ ID NO: 4814076 - DNA, 23 bp, Homo sapiens
agtcattgttacaggtgtactat

SEQ ID NO: 4814077 - DNA, 15 bp, Homo sapiens
agtccaataaattat

SEQ ID NO: 4814078 - DNA, 20 bp, Homo sapiens
agtccacccccattgtgaat

SEQ ID NO: 4814079 - DNA, 12 bp, Homo sapiens
agtccactttcc

SEQ ID NO: 4814080 - DNA, 17 bp, Homo sapiens
agtccactttcctctct

SEQ ID NO: 4814081 - DNA, 11 bp, Homo sapiens
agtccagacac

SEQ ID NO: 4814082 - DNA, 18 bp, Homo sapiens
agtccagacaccatcacc

SEQ ID NO: 4814083 - DNA, 19 bp, Homo sapiens
agtccatgtgataattgta

SEQ ID NO: 4814084 - DNA, 17 bp, Homo sapiens
agtccatttttgagtaa

SEQ ID NO: 4814085 - DNA, 20 bp, Homo sapiens
agtcccccctcccacctcca

SEQ ID NO: 4814086 - DNA, 19 bp, Homo sapiens
agtccccgggaaaggccgg

SEQ ID NO: 4814087 - DNA, 15 bp, Homo sapiens
agtcccgaggcagca

SEQ ID NO: 4814088 - DNA, 22 bp, Homo sapiens
agtccctccctcctggctcaca

SEQ ID NO: 4814089 - DNA, 13 bp, Homo sapiens
agtccctcctccc

SEQ ID NO: 4814090 - DNA, 16 bp, Homo sapiens
agtccctcctccccca

SEQ ID NO: 4814091 - DNA, 19 bp, Homo sapiens
agtccctcctcccccacgc

SEQ ID NO: 4814092 - DNA, 13 bp, Homo sapiens
agtcccttcctgt

SEQ ID NO: 4814093 - DNA, 16 bp, Homo sapiens
agtccgaaaagcaaac

SEQ ID NO: 4814094 - DNA, 12 bp, Homo sapiens
agtccgaggcct

SEQ ID NO: 4814095 - DNA, 22 bp, Homo sapiens
agtccggacccacctcaccccg

SEQ ID NO: 4814096 - DNA, 13 bp, Homo sapiens
agtccggtgcctt

SEQ ID NO: 4814097 - DNA, 17 bp, Homo sapiens
agtccggtgccttccac

SEQ ID NO: 4814098 - DNA, 22 bp, Homo sapiens
agtcctactttacatatgcttt

SEQ ID NO: 4814099 - DNA, 18 bp, Homo sapiens
agtcctcgccccccgccc

SEQ ID NO: 4814100 - DNA, 16 bp, Homo sapiens
agtcctcggcagctcc

SEQ ID NO: 4814101 - DNA, 16 bp, Homo sapiens
agtcctgggagaccca

SEQ ID NO: 4814102 - DNA, 18 bp, Homo sapiens
agtcgatattcccagggc

SEQ ID NO: 4814103 - DNA, 13 bp, Homo sapiens
agtcggctgggca

SEQ ID NO: 4814104 - DNA, 14 bp, Homo sapiens
agtctatgctgtgt

SEQ ID NO: 4814105 - DNA, 17 bp, Homo sapiens
agtctatgctgtgtgca

SEQ ID NO: 4814106 - DNA, 21 bp, Homo sapiens
agtctcaattctgaaggggaa

SEQ ID NO: 4814107 - DNA, 21 bp, Homo sapiens
agtctcagtgctagcttattt

SEQ ID NO: 4814108 - DNA, 16 bp, Homo sapiens
agtctccacgtgtttc

SEQ ID NO: 4814109 - DNA, 14 bp, Homo sapiens
agtctcctcactgc

SEQ ID NO: 4814110 - DNA, 16 bp, Homo sapiens
agtctcctgtatcatt

SEQ ID NO: 4814111 - DNA, 20 bp, Homo sapiens
agtctctatttgatttgcaa

SEQ ID NO: 4814112 - DNA, 17 bp, Homo sapiens
agtctgaaggagaggag

SEQ ID NO: 4814113 - DNA, 19 bp, Homo sapiens
agtctgaaggagaggagtg

SEQ ID NO: 4814114 - DNA, 18 bp, Homo sapiens
agtctggataatttgtat

SEQ ID NO: 4814115 - DNA, 12 bp, Homo sapiens
agtctgtacttc

SEQ ID NO: 4814116 - DNA, 23 bp, Homo sapiens
agtctgtcagggccttggcccag

SEQ ID NO: 4814117 - DNA, 11 bp, Homo sapiens
agtctgtcctt

SEQ ID NO: 4814118 - DNA, 14 bp, Homo sapiens
agtctgtcctttcc

SEQ ID NO: 4814119 - DNA, 12 bp, Homo sapiens
agtctgtgcctc

SEQ ID NO: 4814120 - DNA, 15 bp, Homo sapiens
agtctgtgcctcagt

SEQ ID NO: 4814121 - DNA, 21 bp, Homo sapiens
agtctgtggagcgtccttgtc

SEQ ID NO: 4814122 - DNA, 22 bp, Homo sapiens
agtctgtggagcgtccttgtcc

SEQ ID NO: 4814123 - DNA, 21 bp, Homo sapiens
agtctgttttgggaaacactt

SEQ ID NO: 4814124 - DNA, 18 bp, Homo sapiens
agtcttactctgttgcca

SEQ ID NO: 4814125 - DNA, 14 bp, Homo sapiens
agtcttgagtgggc

SEQ ID NO: 4814126 - DNA, 23 bp, Homo sapiens
agtcttgagtgggccccctctct

SEQ ID NO: 4814127 - DNA, 15 bp, Homo sapiens
agtcttgttgttcat

SEQ ID NO: 4814128 - DNA, 17 bp, Homo sapiens
agtcttgttgttcatat

SEQ ID NO: 4814129 - DNA, 19 bp, Homo sapiens
agtgaaaacctctttcgga

SEQ ID NO: 4814130 - DNA, 19 bp, Homo sapiens
agtgaaattagtattttga

SEQ ID NO: 4814131 - DNA, 15 bp, Homo sapiens
agtgaacagcttcac

SEQ ID NO: 4814132 - DNA, 13 bp, Homo sapiens
agtgaagaaaatg

SEQ ID NO: 4814133 - DNA, 20 bp, Homo sapiens
agtgaagcccaggaggacct

SEQ ID NO: 4814134 - DNA, 16 bp, Homo sapiens
agtgaagtatgcacta

SEQ ID NO: 4814135 - DNA, 23 bp, Homo sapiens
agtgaccaggctcacaactgttt

SEQ ID NO: 4814136 - DNA, 21 bp, Homo sapiens
agtgacccttcccaatcagca

SEQ ID NO: 4814137 - DNA, 19 bp, Homo sapiens
agtgacgaaaacattgtcc

SEQ ID NO: 4814138 - DNA, 16 bp, Homo sapiens
agtgactctggctgcc

SEQ ID NO: 4814139 - DNA, 18 bp, Homo sapiens
agtgactctggctgccaa

SEQ ID NO: 4814140 - DNA, 19 bp, Homo sapiens
agtgactctggctgccaag

SEQ ID NO: 4814141 - DNA, 20 bp, Homo sapiens
agtgactctggctgccaaga

SEQ ID NO: 4814142 - DNA, 16 bp, Homo sapiens
agtgagaagataaaaa

SEQ ID NO: 4814143 - DNA, 15 bp, Homo sapiens
agtgagatgtttggc

SEQ ID NO: 4814144 - DNA, 19 bp, Homo sapiens
agtgagatttgtatttata

SEQ ID NO: 4814145 - DNA, 21 bp, Homo sapiens
agtgagctgggcatggtacca

SEQ ID NO: 4814146 - DNA, 23 bp, Homo sapiens
agtgatatggcttgtagggtgag

SEQ ID NO: 4814147 - DNA, 18 bp, Homo sapiens
agtgatgggaaagaccct

SEQ ID NO: 4814148 - DNA, 20 bp, Homo sapiens
agtgatgggcaaggggccag

SEQ ID NO: 4814149 - DNA, 14 bp, Homo sapiens
agtgattgacattt

SEQ ID NO: 4814150 - DNA, 18 bp, Homo sapiens
agtgcagggacagcctgc

SEQ ID NO: 4814151 - DNA, 17 bp, Homo sapiens
agtgcatgttaaaataa

SEQ ID NO: 4814152 - DNA, 23 bp, Homo sapiens
agtgcattcattcatcctcttat

SEQ ID NO: 4814153 - DNA, 16 bp, Homo sapiens
agtgccaaaaacaaca

SEQ ID NO: 4814154 - DNA, 17 bp, Homo sapiens
agtgccaaaaggcccct

SEQ ID NO: 4814155 - DNA, 20 bp, Homo sapiens
agtgccaaaaggccccttcc

SEQ ID NO: 4814156 - DNA, 22 bp, Homo sapiens
agcctgtgaactgccaggcagc

SEQ ID NO: 4814157 - DNA, 23 bp, Homo sapiens
agcctgttttaaaaaatacagta

SEQ ID NO: 4814158 - DNA, 22 bp, Homo sapiens
agccttaagtcttactgttttg

SEQ ID NO: 4814159 - DNA, 18 bp, Homo sapiens
agccttattaaaatattt

SEQ ID NO: 4814160 - DNA, 23 bp, Homo sapiens
agccttgtgatcactttctgaaa

SEQ ID NO: 4814161 - DNA, 15 bp, Homo sapiens
agcctttaataggct

SEQ ID NO: 4814162 - DNA, 18 bp, Homo sapiens
agcctttatctatgggag

SEQ ID NO: 4814163 - DNA, 17 bp, Homo sapiens
agcctttgcgctctggg

SEQ ID NO: 4814164 - DNA, 20 bp, Homo sapiens
agcctttgcgctctgggttt

SEQ ID NO: 4814165 - DNA, 15 bp, Homo sapiens
agcgaggcagaatgg

SEQ ID NO: 4814166 - DNA, 14 bp, Homo sapiens
agcgcagcccccac

SEQ ID NO: 4814167 - DNA, 15 bp, Homo sapiens
agcgcatggcgcccc

SEQ ID NO: 4814168 - DNA, 17 bp, Homo sapiens
agcgcatggcgccccgg

SEQ ID NO: 4814169 - DNA, 20 bp, Homo sapiens
agcgcatggcgccccgggcc

SEQ ID NO: 4814170 - DNA, 16 bp, Homo sapiens
agcgccatgtgtgtca

SEQ ID NO: 4814171 - DNA, 21 bp, Homo sapiens
agcgccatgtgtgtcagccca

SEQ ID NO: 4814172 - DNA, 12 bp, Homo sapiens
agcgcctcccgc

SEQ ID NO: 4814173 - DNA, 15 bp, Homo sapiens
agcgcctcccgccgc

SEQ ID NO: 4814174 - DNA, 13 bp, Homo sapiens
agcggagaggacc

SEQ ID NO: 4814175 - DNA, 15 bp, Homo sapiens
agcggagaggacccc

SEQ ID NO: 4814176 - DNA, 13 bp, Homo sapiens
agcggccccgcgg

SEQ ID NO: 4814177 - DNA, 18 bp, Homo sapiens
agcggccccgcggagccc

SEQ ID NO: 4814178 - DNA, 17 bp, Homo sapiens
agcggcccggcccacgc

SEQ ID NO: 4814179 - DNA, 22 bp, Homo sapiens
agcggcccggcccacgcagagc

SEQ ID NO: 4814180 - DNA, 21 bp, Homo sapiens
agcggctgaggacggggcaga

SEQ ID NO: 4814181 - DNA, 22 bp, Homo sapiens
agcggctgaggacggggcagag

SEQ ID NO: 4814182 - DNA, 15 bp, Homo sapiens
agcgggagtctcctc

SEQ ID NO: 4814183 - DNA, 21 bp, Homo sapiens
agcgggggctaactggcccca

SEQ ID NO: 4814184 - DNA, 22 bp, Homo sapiens
agcgggggctaactggccccag

SEQ ID NO: 4814185 - DNA, 14 bp, Homo sapiens
agcgtccaggtgat

SEQ ID NO: 4814186 - DNA, 16 bp, Homo sapiens
agcgtccctagcagtg

SEQ ID NO: 4814187 - DNA, 18 bp, Homo sapiens
agcgtccctagcagtgaa

SEQ ID NO: 4814188 - DNA, 18 bp, Homo sapiens
agcgttgttttgtggata

SEQ ID NO: 4814189 - DNA, 21 bp, Homo sapiens
agctaaaataaaccagactca

SEQ ID NO: 4814190 - DNA, 14 bp, Homo sapiens
agctaacaataaag

SEQ ID NO: 4814191 - DNA, 15 bp, Homo sapiens
agctaagcctgatga

SEQ ID NO: 4814192 - DNA, 17 bp, Homo sapiens
agctacaactaataaca

SEQ ID NO: 4814193 - DNA, 18 bp, Homo sapiens
agctacaggggaggctga

SEQ ID NO: 4814194 - DNA, 19 bp, Homo sapiens
agctacatatgtaggaaaa

SEQ ID NO: 4814195 - DNA, 12 bp, Homo sapiens
agctaccaggaa

SEQ ID NO: 4814196 - DNA, 17 bp, Homo sapiens
agctactcagatctgca

SEQ ID NO: 4814197 - DNA, 15 bp, Homo sapiens
agctagttagctcac

SEQ ID NO: 4814198 - DNA, 19 bp, Homo sapiens
agctagttagctcacaagc

SEQ ID NO: 4814199 - DNA, 20 bp, Homo sapiens
agctagtttaaaattattaa

SEQ ID NO: 4814200 - DNA, 19 bp, Homo sapiens
agctataaaagcccatgct

SEQ ID NO: 4814201 - DNA, 23 bp, Homo sapiens
agctatatatatatatatatgta

SEQ ID NO: 4814202 - DNA, 18 bp, Homo sapiens
agctatcttcatgtaaat

SEQ ID NO: 4814203 - DNA, 15 bp, Homo sapiens
agctatgatatgtgc

SEQ ID NO: 4814204 - DNA, 19 bp, Homo sapiens
agctatgatatgtgcttgt

SEQ ID NO: 4814205 - DNA, 14 bp, Homo sapiens
agctatgcacacca

SEQ ID NO: 4814206 - DNA, 15 bp, Homo sapiens
agctatgctgtatct

SEQ ID NO: 4814207 - DNA, 16 bp, Homo sapiens
agctattcacacacac

SEQ ID NO: 4814208 - DNA, 21 bp, Homo sapiens
agctatttaagtggactgtat

SEQ ID NO: 4814209 - DNA, 17 bp, Homo sapiens
agctcacaccgcaccgg

SEQ ID NO: 4814210 - DNA, 22 bp, Homo sapiens
agctcacagcacatttgttaat

SEQ ID NO: 4814211 - DNA, 12 bp, Homo sapiens
agctcaggagaa

SEQ ID NO: 4814212 - DNA, 16 bp, Homo sapiens
agctcaggccctggtg

SEQ ID NO: 4814213 - DNA, 16 bp, Homo sapiens
agctcagtcccacagc

SEQ ID NO: 4814214 - DNA, 20 bp, Homo sapiens
agctcatagcacatgtttta

SEQ ID NO: 4814215 - DNA, 15 bp, Homo sapiens
agctccaacctggag

SEQ ID NO: 4814216 - DNA, 21 bp, Homo sapiens
agctccaacctggaggctgga

SEQ ID NO: 4814217 - DNA, 16 bp, Homo sapiens
agctccaccctcccct

SEQ ID NO: 4814218 - DNA, 16 bp, Homo sapiens
agctccactctgaagt

SEQ ID NO: 4814219 - DNA, 21 bp, Homo sapiens
agctccagtgctttatccaca

SEQ ID NO: 4814220 - DNA, 15 bp, Homo sapiens
agctccctcgctgta

SEQ ID NO: 4814221 - DNA, 18 bp, Homo sapiens
agctccctcgctgtatga

SEQ ID NO: 4814222 - DNA, 14 bp, Homo sapiens
agctcccttgagct

SEQ ID NO: 4814223 - DNA, 23 bp, Homo sapiens
agctccgcgtgtctcatttgcca

SEQ ID NO: 4814224 - DNA, 21 bp, Homo sapiens
agctcctcgggtggggcctgc

SEQ ID NO: 4814225 - DNA, 21 bp, Homo sapiens
agctccttcatgcttttctca

SEQ ID NO: 4814226 - DNA, 17 bp, Homo sapiens
agctcgtgtgcttagaa

SEQ ID NO: 4814227 - DNA, 21 bp, Homo sapiens
agctcgtgtgcttagaaacct

SEQ ID NO: 4814228 - DNA, 15 bp, Homo sapiens
acagctgctttatga

SEQ ID NO: 4814229 - DNA, 16 bp, Homo sapiens
acagctgtattatctt

SEQ ID NO: 4814230 - DNA, 20 bp, Homo sapiens
acagcttgaccgtgaggcca

SEQ ID NO: 4814231 - DNA, 23 bp, Homo sapiens
acagcttgaccgtgaggccagag

SEQ ID NO: 4814232 - DNA, 23 bp, Homo sapiens
acaggaaaaaaacttttataaat

SEQ ID NO: 4814233 - DNA, 17 bp, Homo sapiens
acaggaaaagggcattt

SEQ ID NO: 4814234 - DNA, 15 bp, Homo sapiens
acaggaaagccctcc

SEQ ID NO: 4814235 - DNA, 16 bp, Homo sapiens
acaggaaagccctccc

SEQ ID NO: 4814236 - DNA, 19 bp, Homo sapiens
acaggaaagccctccccct

SEQ ID NO: 4814237 - DNA, 18 bp, Homo sapiens
acaggaaagtggatgcca

SEQ ID NO: 4814238 - DNA, 14 bp, Homo sapiens
acaggaacccatca

SEQ ID NO: 4814239 - DNA, 20 bp, Homo sapiens
acaggaacccatcactgtgt

SEQ ID NO: 4814240 - DNA, 13 bp, Homo sapiens
acaggaagtactg

SEQ ID NO: 4814241 - DNA, 14 bp, Homo sapiens
acaggaccaggagc

SEQ ID NO: 4814242 - DNA, 20 bp, Homo sapiens
acaggagccgcagaggcccg

SEQ ID NO: 4814243 - DNA, 16 bp, Homo sapiens
acaggagcgtgtccta

SEQ ID NO: 4814244 - DNA, 14 bp, Homo sapiens
acaggagctccctt

SEQ ID NO: 4814245 - DNA, 22 bp, Homo sapiens
acaggagtgactctggctgcca

SEQ ID NO: 4814246 - DNA, 16 bp, Homo sapiens
acaggatcctggcctg

SEQ ID NO: 4814247 - DNA, 17 bp, Homo sapiens
acaggatcctggcctga

SEQ ID NO: 4814248 - DNA, 18 bp, Homo sapiens
acaggatcctggcctgag

SEQ ID NO: 4814249 - DNA, 17 bp, Homo sapiens
acaggattctcttctca

SEQ ID NO: 4814250 - DNA, 17 bp, Homo sapiens
acaggcacacaccacca

SEQ ID NO: 4814251 - DNA, 22 bp, Homo sapiens
acaggcatccgctgcgctccca

SEQ ID NO: 4814252 - DNA, 18 bp, Homo sapiens
acaggcctggcccagcca

SEQ ID NO: 4814253 - DNA, 17 bp, Homo sapiens
acaggccttcctcctct

SEQ ID NO: 4814254 - DNA, 13 bp, Homo sapiens
acaggcgccgcct

SEQ ID NO: 4814255 - DNA, 22 bp, Homo sapiens
acaggctgccgctgctctccca

SEQ ID NO: 4814256 - DNA, 13 bp, Homo sapiens
acagggcgtcctc

SEQ ID NO: 4814257 - DNA, 17 bp, Homo sapiens
acagggcgtcctctcgt

SEQ ID NO: 4814258 - DNA, 14 bp, Homo sapiens
acaggggaggctga

SEQ ID NO: 4814259 - DNA, 12 bp, Homo sapiens
acaggtgtaaat

SEQ ID NO: 4814260 - DNA, 15 bp, Homo sapiens
acagtaaatatacac

SEQ ID NO: 4814261 - DNA, 19 bp, Homo sapiens
acagtaaatatacacttta

SEQ ID NO: 4814262 - DNA, 22 bp, Homo sapiens
acagtaaatatacactttacat

SEQ ID NO: 4814263 - DNA, 13 bp, Homo sapiens
acagtaatcagtt

SEQ ID NO: 4814264 - DNA, 18 bp, Homo sapiens
acagtagcttcctagacc

SEQ ID NO: 4814265 - DNA, 14 bp, Homo sapiens
acagtagtgttggg

SEQ ID NO: 4814266 - DNA, 15 bp, Homo sapiens
acagtatattttatt

SEQ ID NO: 4814267 - DNA, 21 bp, Homo sapiens
acagtatattttatttcaatg

SEQ ID NO: 4814268 - DNA, 23 bp, Homo sapiens
acagtattatttagtaaaattat

SEQ ID NO: 4814269 - DNA, 19 bp, Homo sapiens
acagtattgttcttgtaaa

SEQ ID NO: 4814270 - DNA, 21 bp, Homo sapiens
acagtcaagacggatccacag

SEQ ID NO: 4814271 - DNA, 18 bp, Homo sapiens
acagtctctgagaactgg

SEQ ID NO: 4814272 - DNA, 21 bp, Homo sapiens
acagtgagagcagggctgggc

SEQ ID NO: 4814273 - DNA, 20 bp, Homo sapiens
acagtggcaagctaccaact

SEQ ID NO: 4814274 - DNA, 14 bp, Homo sapiens
acagtggcagtatt

SEQ ID NO: 4814275 - DNA, 15 bp, Homo sapiens
acagtggggcccatg

SEQ ID NO: 4814276 - DNA, 18 bp, Homo sapiens
acagtggttatatttcaa

SEQ ID NO: 4814277 - DNA, 20 bp, Homo sapiens
acagtgtggcttaaacattt

SEQ ID NO: 4814278 - DNA, 15 bp, Homo sapiens
acagttaagagaaat

SEQ ID NO: 4814279 - DNA, 15 bp, Homo sapiens
acagttcacaccctg

SEQ ID NO: 4814280 - DNA, 20 bp, Homo sapiens
acagttcacaccctgcaagg

SEQ ID NO: 4814281 - DNA, 17 bp, Homo sapiens
acagttctctccttctt

SEQ ID NO: 4814282 - DNA, 17 bp, Homo sapiens
acagttcttggtgactg

SEQ ID NO: 4814283 - DNA, 19 bp, Homo sapiens
acagttcttggtgactgtc

SEQ ID NO: 4814284 - DNA, 18 bp, Homo sapiens
acagtttaacagaaaaat

SEQ ID NO: 4814285 - DNA, 15 bp, Homo sapiens
acagtttgtttacac

SEQ ID NO: 4814286 - DNA, 16 bp, Homo sapiens
acagtttgtttacaca

SEQ ID NO: 4814287 - DNA, 22 bp, Homo sapiens
acagtttgtttacacacgtgca

SEQ ID NO: 4814288 - DNA, 12 bp, Homo sapiens
acagttttgtct

SEQ ID NO: 4814289 - DNA, 13 bp, Homo sapiens
acataaaatatac

SEQ ID NO: 4814290 - DNA, 19 bp, Homo sapiens
acataaaatatacaaacat

SEQ ID NO: 4814291 - DNA, 20 bp, Homo sapiens
acataaaatatacaaacatg

SEQ ID NO: 4814292 - DNA, 12 bp, Homo sapiens
acataaacactt

SEQ ID NO: 4814293 - DNA, 17 bp, Homo sapiens
acataaacacttctcct

SEQ ID NO: 4814294 - DNA, 22 bp, Homo sapiens
acataacataagctagaaaaat

SEQ ID NO: 4814295 - DNA, 18 bp, Homo sapiens
acataagctagaaaaatt

SEQ ID NO: 4814296 - DNA, 22 bp, Homo sapiens
acataagctggtatcagtggtt

SEQ ID NO: 4814297 - DNA, 15 bp, Homo sapiens
acataatatcttgaa

SEQ ID NO: 4814298 - DNA, 17 bp, Homo sapiens
acataatatcttgaaga

SEQ ID NO: 4814299 - DNA, 21 bp, Homo sapiens
acataatatcttgaagaatat

SEQ ID NO: 4814300 - DNA, 21 bp, Homo sapiens
acataatgttagtagcactga

SEQ ID NO: 4814301 - DNA, 15 bp, Homo sapiens
acatacacaaatggg

SEQ ID NO: 4814302 - DNA, 12 bp, Homo sapiens
acatacactgca

SEQ ID NO: 4814303 - DNA, 20 bp, Homo sapiens
acatacctctctctatatat

SEQ ID NO: 4814304 - DNA, 16 bp, Homo sapiens
acatagcagctggtta

SEQ ID NO: 4814305 - DNA, 20 bp, Homo sapiens
acatagtgggaccctgtctc

SEQ ID NO: 4814306 - DNA, 17 bp, Homo sapiens
acatagtggtattttaa

SEQ ID NO: 4814307 - DNA, 13 bp, Homo sapiens
acatataaacaca

SEQ ID NO: 4814308 - DNA, 17 bp, Homo sapiens
acatatacacaaagata

SEQ ID NO: 4814309 - DNA, 20 bp, Homo sapiens
acatatgctttaagaatcga

SEQ ID NO: 4814310 - DNA, 19 bp, Homo sapiens
acatatggaaatcctgtta

SEQ ID NO: 4814311 - DNA, 16 bp, Homo sapiens
acatatgtaggaaaat

SEQ ID NO: 4814312 - DNA, 20 bp, Homo sapiens
acatatgtaggaaaattttc

SEQ ID NO: 4814313 - DNA, 21 bp, Homo sapiens
acatattaaaggttctgaaaa

SEQ ID NO: 4814314 - DNA, 13 bp, Homo sapiens
acatcaacattcc

SEQ ID NO: 4814315 - DNA, 22 bp, Homo sapiens
acatcactatccatgcaccaaa

SEQ ID NO: 4814316 - DNA, 23 bp, Homo sapiens
acatcagtccacccccattgtga

SEQ ID NO: 4814317 - DNA, 18 bp, Homo sapiens
acatcataaatagtaaat

SEQ ID NO: 4814318 - DNA, 16 bp, Homo sapiens
acatctctgactttct

SEQ ID NO: 4814319 - DNA, 12 bp, Homo sapiens
acatctcttcat

SEQ ID NO: 4814320 - DNA, 20 bp, Homo sapiens
acatctgtatatcagctcta

SEQ ID NO: 4814321 - DNA, 22 bp, Homo sapiens
acatctgtatatcagctctaaa

SEQ ID NO: 4814322 - DNA, 14 bp, Homo sapiens
acatcttgtgcatg

SEQ ID NO: 4814323 - DNA, 16 bp, Homo sapiens
acatcttgtgcatgca

SEQ ID NO: 4814324 - DNA, 15 bp, Homo sapiens
acatcttttaactgc

SEQ ID NO: 4814325 - DNA, 22 bp, Homo sapiens
agccacccggatctccaggccc

SEQ ID NO: 4814326 - DNA, 23 bp, Homo sapiens
agccacccggatctccaggccca

SEQ ID NO: 4814327 - DNA, 14 bp, Homo sapiens
agccacgctgtcct

SEQ ID NO: 4814328 - DNA, 15 bp, Homo sapiens
agccacgctgtcctc

SEQ ID NO: 4814329 - DNA, 19 bp, Homo sapiens
agccacttatttccatgga

SEQ ID NO: 4814330 - DNA, 13 bp, Homo sapiens
agccagaggagag

SEQ ID NO: 4814331 - DNA, 17 bp, Homo sapiens
agccagaggagagagga

SEQ ID NO: 4814332 - DNA, 14 bp, Homo sapiens
agccagcaggctct

SEQ ID NO: 4814333 - DNA, 22 bp, Homo sapiens
agccagcaggctctcaggccag

SEQ ID NO: 4814334 - DNA, 22 bp, Homo sapiens
agccagcagggcgggccaggag

SEQ ID NO: 4814335 - DNA, 23 bp, Homo sapiens
agccagcagggcgggccaggaga

SEQ ID NO: 4814336 - DNA, 24 bp, Homo sapiens
agccagcagggcgggccaggagaa

SEQ ID NO: 4814337 - DNA, 21 bp, Homo sapiens
agccagcaggttctctcctgt

SEQ ID NO: 4814338 - DNA, 22 bp, Homo sapiens
agccagcaggttctctcctgtg

SEQ ID NO: 4814339 - DNA, 14 bp, Homo sapiens
agccagccgccctg

SEQ ID NO: 4814340 - DNA, 17 bp, Homo sapiens
agccagccgccctgggc

SEQ ID NO: 4814341 - DNA, 21 bp, Homo sapiens
agccagccgccctgggctgtc

SEQ ID NO: 4814342 - DNA, 13 bp, Homo sapiens
agccagctctgag

SEQ ID NO: 4814343 - DNA, 14 bp, Homo sapiens
agccagctctgagc

SEQ ID NO: 4814344 - DNA, 11 bp, Homo sapiens
agccaggagac

SEQ ID NO: 4814345 - DNA, 17 bp, Homo sapiens
agccaggagaccctgtc

SEQ ID NO: 4814346 - DNA, 19 bp, Homo sapiens
agccaggccctctctgcag

SEQ ID NO: 4814347 - DNA, 20 bp, Homo sapiens
agccaggccctctctgcagt

SEQ ID NO: 4814348 - DNA, 21 bp, Homo sapiens
agccaggccctctctgcagtc

SEQ ID NO: 4814349 - DNA, 21 bp, Homo sapiens
agccaggcctcccgcatgctg

SEQ ID NO: 4814350 - DNA, 17 bp, Homo sapiens
agccagggttccagaca

SEQ ID NO: 4814351 - DNA, 18 bp, Homo sapiens
agccagggttccagacag

SEQ ID NO: 4814352 - DNA, 20 bp, Homo sapiens
agccagggttccagacaggg

SEQ ID NO: 4814353 - DNA, 14 bp, Homo sapiens
agccaggtgtcctg

SEQ ID NO: 4814354 - DNA, 20 bp, Homo sapiens
agccataacgttagactgca

SEQ ID NO: 4814355 - DNA, 14 bp, Homo sapiens
agccatccaccctg

SEQ ID NO: 4814356 - DNA, 16 bp, Homo sapiens
agccatccaccctgag

SEQ ID NO: 4814357 - DNA, 15 bp, Homo sapiens
agccattcatttaca

SEQ ID NO: 4814358 - DNA, 19 bp, Homo sapiens
agccattgcttctccctca

SEQ ID NO: 4814359 - DNA, 16 bp, Homo sapiens
agcccacccgccccag

SEQ ID NO: 4814360 - DNA, 17 bp, Homo sapiens
agcccacccgccccaga

SEQ ID NO: 4814361 - DNA, 18 bp, Homo sapiens
agcccacccgccccagag

SEQ ID NO: 4814362 - DNA, 19 bp, Homo sapiens
agcccacccgccccagaga

SEQ ID NO: 4814363 - DNA, 20 bp, Homo sapiens
agcccacccgccccagagac

SEQ ID NO: 4814364 - DNA, 16 bp, Homo sapiens
agcccaccctgctgcc

SEQ ID NO: 4814365 - DNA, 20 bp, Homo sapiens
agcccacggctaagaggctg

SEQ ID NO: 4814366 - DNA, 14 bp, Homo sapiens
agcccactgcctgg

SEQ ID NO: 4814367 - DNA, 19 bp, Homo sapiens
agcccagaacgggcctccc

SEQ ID NO: 4814368 - DNA, 20 bp, Homo sapiens
agcccagaacgggcctcccc

SEQ ID NO: 4814369 - DNA, 21 bp, Homo sapiens
agcccagaagctcaaggctgc

SEQ ID NO: 4814370 - DNA, 10 bp, Homo sapiens
agcccagaga

SEQ ID NO: 4814371 - DNA, 12 bp, Homo sapiens
agcccagagaga

SEQ ID NO: 4814372 - DNA, 12 bp, Homo sapiens
agcccaggagga

SEQ ID NO: 4814373 - DNA, 16 bp, Homo sapiens
agcccaggaggacctg

SEQ ID NO: 4814374 - DNA, 14 bp, Homo sapiens
agcccaggcaatag

SEQ ID NO: 4814375 - DNA, 12 bp, Homo sapiens
agcccaggcctc

SEQ ID NO: 4814376 - DNA, 14 bp, Homo sapiens
agcccaggcctcct

SEQ ID NO: 4814377 - DNA, 21 bp, Homo sapiens
agcccaggcctcctacagctt

SEQ ID NO: 4814378 - DNA, 17 bp, Homo sapiens
agccccagacctgccgc

SEQ ID NO: 4814379 - DNA, 15 bp, Homo sapiens
agccccatccttccc

SEQ ID NO: 4814380 - DNA, 21 bp, Homo sapiens
agccccatccttcccgcagca

SEQ ID NO: 4814381 - DNA, 19 bp, Homo sapiens
agccccatctctcctgctc

SEQ ID NO: 4814382 - DNA, 22 bp, Homo sapiens
agccccatctctcctgctcacc

SEQ ID NO: 4814383 - DNA, 14 bp, Homo sapiens
agcccccacccggg

SEQ ID NO: 4814384 - DNA, 14 bp, Homo sapiens
agcccccgcccctc

SEQ ID NO: 4814385 - DNA, 21 bp, Homo sapiens
agccccctgcacccacccctg

SEQ ID NO: 4814386 - DNA, 22 bp, Homo sapiens
agccccctgcacccacccctgc

SEQ ID NO: 4814387 - DNA, 12 bp, Homo sapiens
agccccctgctt

SEQ ID NO: 4814388 - DNA, 19 bp, Homo sapiens
agccccggagcaccacggg

SEQ ID NO: 4814389 - DNA, 23 bp, Homo sapiens
agcccctatcctgcaccctctgc

SEQ ID NO: 4814390 - DNA, 12 bp, Homo sapiens
agcccctgctgg

SEQ ID NO: 4814391 - DNA, 22 bp, Homo sapiens
agcccctggggcctagactctg

SEQ ID NO: 4814392 - DNA, 15 bp, Homo sapiens
agccccttgcttcta

SEQ ID NO: 4814393 - DNA, 18 bp, Homo sapiens
agcccgatgtccctgtcc

SEQ ID NO: 4814394 - DNA, 17 bp, Homo sapiens
caccctctgctgcacag

SEQ ID NO: 4814395 - DNA, 20 bp, Homo sapiens
caccctgaggagtgatgggc

SEQ ID NO: 4814396 - DNA, 14 bp, Homo sapiens
caccctgcaaggcc

SEQ ID NO: 4814397 - DNA, 21 bp, Homo sapiens
caccctgcaaggcccacagga

SEQ ID NO: 4814398 - DNA, 23 bp, Homo sapiens
caccctgcaaggcccacaggagg

SEQ ID NO: 4814399 - DNA, 12 bp, Homo sapiens
caccctgccacc

SEQ ID NO: 4814400 - DNA, 22 bp, Homo sapiens
caccctgccaccctctgctgca

SEQ ID NO: 4814401 - DNA, 10 bp, Homo sapiens
caccctgccc

SEQ ID NO: 4814402 - DNA, 12 bp, Homo sapiens
caccctgccctg

SEQ ID NO: 4814403 - DNA, 13 bp, Homo sapiens
caccctgccctgg

SEQ ID NO: 4814404 - DNA, 17 bp, Homo sapiens
caccctgccctggccta

SEQ ID NO: 4814405 - DNA, 13 bp, Homo sapiens
caccctgggcctc

SEQ ID NO: 4814406 - DNA, 15 bp, Homo sapiens
caccctgggcctccc

SEQ ID NO: 4814407 - DNA, 12 bp, Homo sapiens
cacccttcccca

SEQ ID NO: 4814408 - DNA, 13 bp, Homo sapiens
cacccttccccac

SEQ ID NO: 4814409 - DNA, 15 bp, Homo sapiens
cacccttccccactc

SEQ ID NO: 4814410 - DNA, 22 bp, Homo sapiens
caccgagaggaaaaaggcttct

SEQ ID NO: 4814411 - DNA, 13 bp, Homo sapiens
caccgattcttcc

SEQ ID NO: 4814412 - DNA, 17 bp, Homo sapiens
caccgattcttccttgc

SEQ ID NO: 4814413 - DNA, 19 bp, Homo sapiens
caccgcaccgggctggcct

SEQ ID NO: 4814414 - DNA, 14 bp, Homo sapiens
caccgcagaaggaa

SEQ ID NO: 4814415 - DNA, 15 bp, Homo sapiens
caccgcagaaggaag

SEQ ID NO: 4814416 - DNA, 16 bp, Homo sapiens
caccgcattccagggg

SEQ ID NO: 4814417 - DNA, 21 bp, Homo sapiens
caccgcccaacccccacctcc

SEQ ID NO: 4814418 - DNA, 14 bp, Homo sapiens
caccgcccacccac

SEQ ID NO: 4814419 - DNA, 22 bp, Homo sapiens
caccgcccacccacaccccgtc

SEQ ID NO: 4814420 - DNA, 20 bp, Homo sapiens
caccggacgctggagaccct

SEQ ID NO: 4814421 - DNA, 14 bp, Homo sapiens
caccggcactgtgc

SEQ ID NO: 4814422 - DNA, 21 bp, Homo sapiens
caccgtggtgtgaggcccccg

SEQ ID NO: 4814423 - DNA, 23 bp, Homo sapiens
caccgtggtgtgaggcccccgga

SEQ ID NO: 4814424 - DNA, 13 bp, Homo sapiens
cacctccagtccc

SEQ ID NO: 4814425 - DNA, 11 bp, Homo sapiens
cacctccccca

SEQ ID NO: 4814426 - DNA, 19 bp, Homo sapiens
cacctcccccaaaccctgc

SEQ ID NO: 4814427 - DNA, 16 bp, Homo sapiens
cacctccctgcagctt

SEQ ID NO: 4814428 - DNA, 16 bp, Homo sapiens
cacctccctgcccagg

SEQ ID NO: 4814429 - DNA, 23 bp, Homo sapiens
cacctccctgcccaggccggcca

SEQ ID NO: 4814430 - DNA, 22 bp, Homo sapiens
cacctcccttcatcccagggta

SEQ ID NO: 4814431 - DNA, 13 bp, Homo sapiens
cacctcctccgtg

SEQ ID NO: 4814432 - DNA, 15 bp, Homo sapiens
cacctcctccgtggg

SEQ ID NO: 4814433 - DNA, 23 bp, Homo sapiens
cacctcctccgtgggcagctcct

SEQ ID NO: 4814434 - DNA, 16 bp, Homo sapiens
cacctccttctgcagt

SEQ ID NO: 4814435 - DNA, 18 bp, Homo sapiens
cacctcttcccacaagaa

SEQ ID NO: 4814436 - DNA, 13 bp, Homo sapiens
cacctctttgtca

SEQ ID NO: 4814437 - DNA, 11 bp, Homo sapiens
cacctgcccag

SEQ ID NO: 4814438 - DNA, 12 bp, Homo sapiens
cacctgccccag

SEQ ID NO: 4814439 - DNA, 18 bp, Homo sapiens
cacctgccccaggctcag

SEQ ID NO: 4814440 - DNA, 14 bp, Homo sapiens
cacctgccgctgct

SEQ ID NO: 4814441 - DNA, 15 bp, Homo sapiens
cacctgccgctgctt

SEQ ID NO: 4814442 - DNA, 22 bp, Homo sapiens
cacctgccgctgcttgagtgga

SEQ ID NO: 4814443 - DNA, 15 bp, Homo sapiens
cacctgcctgcagag

SEQ ID NO: 4814444 - DNA, 18 bp, Homo sapiens
cacctgcctgcagagcag

SEQ ID NO: 4814445 - DNA, 17 bp, Homo sapiens
cacctgcctgttgggcc

SEQ ID NO: 4814446 - DNA, 24 bp, Homo sapiens
cacctgcctgttgggccaggagcc

SEQ ID NO: 4814447 - DNA, 16 bp, Homo sapiens
cacctggaaagccagg

SEQ ID NO: 4814448 - DNA, 23 bp, Homo sapiens
cacctggatggatctgctccatg

SEQ ID NO: 4814449 - DNA, 18 bp, Homo sapiens
cacctggcttcccaggac

SEQ ID NO: 4814450 - DNA, 18 bp, Homo sapiens
cacctggtggccctgcgg

SEQ ID NO: 4814451 - DNA, 15 bp, Homo sapiens
cacctgtaaaacttt

SEQ ID NO: 4814452 - DNA, 13 bp, Homo sapiens
caccttaaattaa

SEQ ID NO: 4814453 - DNA, 14 bp, Homo sapiens
caccttaaattaaa

SEQ ID NO: 4814454 - DNA, 18 bp, Homo sapiens
caccttaaattaaacaat

SEQ ID NO: 4814455 - DNA, 19 bp, Homo sapiens
caccttacaaagccagctc

SEQ ID NO: 4814456 - DNA, 21 bp, Homo sapiens
caccttacaaagccagctctg

SEQ ID NO: 4814457 - DNA, 21 bp, Homo sapiens
caccttccctagttctttgca

SEQ ID NO: 4814458 - DNA, 13 bp, Homo sapiens
caccttctgccaa

SEQ ID NO: 4814459 - DNA, 22 bp, Homo sapiens
caccttctgtgcatctggcctg

SEQ ID NO: 4814460 - DNA, 21 bp, Homo sapiens
caccttgtacagaaccagcac

SEQ ID NO: 4814461 - DNA, 22 bp, Homo sapiens
caccttgtacagaaccagcact

SEQ ID NO: 4814462 - DNA, 20 bp, Homo sapiens
caccttttttcaccccacac

SEQ ID NO: 4814463 - DNA, 20 bp, Homo sapiens
cacgattccaacccaggtct

SEQ ID NO: 4814464 - DNA, 14 bp, Homo sapiens
cacgattccagtgc

SEQ ID NO: 4814465 - DNA, 18 bp, Homo sapiens
cacgattccagtgcagta

SEQ ID NO: 4814466 - DNA, 11 bp, Homo sapiens
cacgcagagcc

SEQ ID NO: 4814467 - DNA, 20 bp, Homo sapiens
cacgcagagccccggagcac

SEQ ID NO: 4814468 - DNA, 15 bp, Homo sapiens
cacgcccctgcctga

SEQ ID NO: 4814469 - DNA, 17 bp, Homo sapiens
cacgccgatataagcca

SEQ ID NO: 4814470 - DNA, 19 bp, Homo sapiens
cacgccgatataagccata

SEQ ID NO: 4814471 - DNA, 23 bp, Homo sapiens
cacgccgatataagccatagccc

SEQ ID NO: 4814472 - DNA, 19 bp, Homo sapiens
cacgccgggtcgcctgccc

SEQ ID NO: 4814473 - DNA, 18 bp, Homo sapiens
cacgctgtcctctcgagc

SEQ ID NO: 4814474 - DNA, 14 bp, Homo sapiens
cacgcttctggagg

SEQ ID NO: 4814475 - DNA, 21 bp, Homo sapiens
cacggaggctcgtgcatgtaa

SEQ ID NO: 4814476 - DNA, 14 bp, Homo sapiens
cacggagtttccat

SEQ ID NO: 4814477 - DNA, 16 bp, Homo sapiens
cacggccgtccctgac

SEQ ID NO: 4814478 - DNA, 23 bp, Homo sapiens
cacggccgtccctgacttcccag

SEQ ID NO: 4814479 - DNA, 20 bp, Homo sapiens
cacggctaagaggctgctga

SEQ ID NO: 4814480 - DNA, 19 bp, Homo sapiens
cacgggagagcgccacccg

SEQ ID NO: 4814481 - DNA, 17 bp, Homo sapiens
cacggggtcgggggagg

SEQ ID NO: 4814482 - DNA, 20 bp, Homo sapiens
cacggtccaatccagccttc

SEQ ID NO: 4814483 - DNA, 19 bp, Homo sapiens
cacggtcctttgagtgtca

SEQ ID NO: 4814484 - DNA, 17 bp, Homo sapiens
cacgtaaggtctcattt

SEQ ID NO: 4814485 - DNA, 23 bp, Homo sapiens
cacgtagcaaatcgtacattgtg

SEQ ID NO: 4814486 - DNA, 19 bp, Homo sapiens
cacgtccctcgagctctgt

SEQ ID NO: 4814487 - DNA, 23 bp, Homo sapiens
cacgtccctcgagctctgtagcc

SEQ ID NO: 4814488 - DNA, 21 bp, Homo sapiens
cacgtctgtgagtctgtcctt

SEQ ID NO: 4814489 - DNA, 19 bp, Homo sapiens
cacgtgctcttctgttctc

SEQ ID NO: 4814490 - DNA, 16 bp, Homo sapiens
cacgtggtcctaatct

SEQ ID NO: 4814491 - DNA, 18 bp, Homo sapiens
cacgtgtttcgggccagg

SEQ ID NO: 4814492 - DNA, 17 bp, Homo sapiens
cactaaaagtgatgtga

SEQ ID NO: 4814493 - DNA, 15 bp, Homo sapiens
cactaaaatccaccc

SEQ ID NO: 4814494 - DNA, 16 bp, Homo sapiens
cactaaatatctagtg

SEQ ID NO: 4814495 - DNA, 17 bp, Homo sapiens
cactaaatatctagtgc

SEQ ID NO: 4814496 - DNA, 16 bp, Homo sapiens
cactaagtaacctcta

SEQ ID NO: 4814497 - DNA, 13 bp, Homo sapiens
cactaatcaatac

SEQ ID NO: 4814498 - DNA, 13 bp, Homo sapiens
cactacaacctcc

SEQ ID NO: 4814499 - DNA, 14 bp, Homo sapiens
cactacaacctccg

SEQ ID NO: 4814500 - DNA, 19 bp, Homo sapiens
cactaccctcctgtaaaat

SEQ ID NO: 4814501 - DNA, 13 bp, Homo sapiens
cactatccatgca

SEQ ID NO: 4814502 - DNA, 20 bp, Homo sapiens
cactatggtatgctggccag

SEQ ID NO: 4814503 - DNA, 15 bp, Homo sapiens
cactattctccagaa

SEQ ID NO: 4814504 - DNA, 23 bp, Homo sapiens
cactcaggagcacagccatagca

SEQ ID NO: 4814505 - DNA, 18 bp, Homo sapiens
cactcatcccccatcaga

SEQ ID NO: 4814506 - DNA, 16 bp, Homo sapiens
cactccactcccctca

SEQ ID NO: 4814507 - DNA, 17 bp, Homo sapiens
cactccactcccctcat

SEQ ID NO: 4814508 - DNA, 12 bp, Homo sapiens
cactcccagggc

SEQ ID NO: 4814509 - DNA, 16 bp, Homo sapiens
cactcccctcatccac

SEQ ID NO: 4814510 - DNA, 20 bp, Homo sapiens
cactccctaagtccactcta

SEQ ID NO: 4814511 - DNA, 16 bp, Homo sapiens
cactctaactgtatat

SEQ ID NO: 4814512 - DNA, 22 bp, Homo sapiens
cactctcaccccccgacctggc

SEQ ID NO: 4814513 - DNA, 12 bp, Homo sapiens
cactctcaggac

SEQ ID NO: 4814514 - DNA, 19 bp, Homo sapiens
cactctcaggaccaccctg

SEQ ID NO: 4814515 - DNA, 21 bp, Homo sapiens
cactctcaggaccaccctgcc

SEQ ID NO: 4814516 - DNA, 20 bp, Homo sapiens
cagactttctacatgcaaat

SEQ ID NO: 4814517 - DNA, 14 bp, Homo sapiens
cagagaagaaagaa

SEQ ID NO: 4814518 - DNA, 14 bp, Homo sapiens
cagagaagcctcag

SEQ ID NO: 4814519 - DNA, 22 bp, Homo sapiens
cagagaagcctcagtccctccc

SEQ ID NO: 4814520 - DNA, 14 bp, Homo sapiens
cagagacacaagcc

SEQ ID NO: 4814521 - DNA, 22 bp, Homo sapiens
cagagaccaccgcgcccctctg

SEQ ID NO: 4814522 - DNA, 23 bp, Homo sapiens
cagagaccaccgcgcccctctgc

SEQ ID NO: 4814523 - DNA, 18 bp, Homo sapiens
cagagacctgctccagat

SEQ ID NO: 4814524 - DNA, 16 bp, Homo sapiens
cagagacggcagcccc

SEQ ID NO: 4814525 - DNA, 12 bp, Homo sapiens
cagagactgccc

SEQ ID NO: 4814526 - DNA, 17 bp, Homo sapiens
cagagactgcccaccct

SEQ ID NO: 4814527 - DNA, 19 bp, Homo sapiens
cagagactgcccaccctgg

SEQ ID NO: 4814528 - DNA, 22 bp, Homo sapiens
cagagactgcccaccctgggcc

SEQ ID NO: 4814529 - DNA, 23 bp, Homo sapiens
cagagactgcccaccctgggcct

SEQ ID NO: 4814530 - DNA, 24 bp, Homo sapiens
cagagactgcccaccctgggcctc

SEQ ID NO: 4814531 - DNA, 19 bp, Homo sapiens
cagagagaagcaccccacc

SEQ ID NO: 4814532 - DNA, 22 bp, Homo sapiens
cagagagacaacttgctccttt

SEQ ID NO: 4814533 - DNA, 15 bp, Homo sapiens
cagagagaccctgcc

SEQ ID NO: 4814534 - DNA, 21 bp, Homo sapiens
cagagaggggaggtgggagga

SEQ ID NO: 4814535 - DNA, 13 bp, Homo sapiens
cagagatggcaga

SEQ ID NO: 4814536 - DNA, 14 bp, Homo sapiens
cagagatggcagag

SEQ ID NO: 4814537 - DNA, 16 bp, Homo sapiens
cagagatggcagagcc

SEQ ID NO: 4814538 - DNA, 11 bp, Homo sapiens
cagagatgtac

SEQ ID NO: 4814539 - DNA, 14 bp, Homo sapiens
cagagatgtaccat

SEQ ID NO: 4814540 - DNA, 15 bp, Homo sapiens
cagagatgtattatg

SEQ ID NO: 4814541 - DNA, 22 bp, Homo sapiens
cagagatgtccatttttacaag

SEQ ID NO: 4814542 - DNA, 21 bp, Homo sapiens
cagagatgttttcaagttgca

SEQ ID NO: 4814543 - DNA, 16 bp, Homo sapiens
cagagattcccaagcc

SEQ ID NO: 4814544 - DNA, 15 bp, Homo sapiens
cagagcactgctcca

SEQ ID NO: 4814545 - DNA, 17 bp, Homo sapiens
cagagccatccaccctg

SEQ ID NO: 4814546 - DNA, 18 bp, Homo sapiens
cagagccatccaccctga

SEQ ID NO: 4814547 - DNA, 14 bp, Homo sapiens
cagagccccggagc

SEQ ID NO: 4814548 - DNA, 15 bp, Homo sapiens
cagagccccggagca

SEQ ID NO: 4814549 - DNA, 12 bp, Homo sapiens
cagagcccgccc

SEQ ID NO: 4814550 - DNA, 18 bp, Homo sapiens
cagagcccgcccacctgg

SEQ ID NO: 4814551 - DNA, 14 bp, Homo sapiens
cagagcctgtttta

SEQ ID NO: 4814552 - DNA, 17 bp, Homo sapiens
cagagcctgttttaaaa

SEQ ID NO: 4814553 - DNA, 20 bp, Homo sapiens
cagagcctgttttaaaaaat

SEQ ID NO: 4814554 - DNA, 17 bp, Homo sapiens
cagagcgatgtgttctt

SEQ ID NO: 4814555 - DNA, 14 bp, Homo sapiens
cagagcgcagcccc

SEQ ID NO: 4814556 - DNA, 15 bp, Homo sapiens
cagagcgcagccccc

SEQ ID NO: 4814557 - DNA, 16 bp, Homo sapiens
cagctagaaagagaaa

SEQ ID NO: 4814558 - DNA, 23 bp, Homo sapiens
cagctagaaagagaaaaagccct

SEQ ID NO: 4814559 - DNA, 18 bp, Homo sapiens
cagctaggttaataggag

SEQ ID NO: 4814560 - DNA, 23 bp, Homo sapiens
cagctaggttaataggaggacag

SEQ ID NO: 4814561 - DNA, 22 bp, Homo sapiens
cagctatctgtcatctctctgg

SEQ ID NO: 4814562 - DNA, 15 bp, Homo sapiens
cagctattcacacac

SEQ ID NO: 4814563 - DNA, 18 bp, Homo sapiens
cagctcagcattgtgtac

SEQ ID NO: 4814564 - DNA, 17 bp, Homo sapiens
cagctcaggggcagctc

SEQ ID NO: 4814565 - DNA, 14 bp, Homo sapiens
cagctcagtcccac

SEQ ID NO: 4814566 - DNA, 16 bp, Homo sapiens
cagctcagtcccacag

SEQ ID NO: 4814567 - DNA, 23 bp, Homo sapiens
cagctccaacctggaggctggac

SEQ ID NO: 4814568 - DNA, 15 bp, Homo sapiens
cagctcctcttcctg

SEQ ID NO: 4814569 - DNA, 17 bp, Homo sapiens
cagctcctcttcctgcc

SEQ ID NO: 4814570 - DNA, 14 bp, Homo sapiens
cagctctccctcac

SEQ ID NO: 4814571 - DNA, 14 bp, Homo sapiens
cagctctcctccag

SEQ ID NO: 4814572 - DNA, 15 bp, Homo sapiens
cagctctcctccagc

SEQ ID NO: 4814573 - DNA, 20 bp, Homo sapiens
cagctctcctccagccctgg

SEQ ID NO: 4814574 - DNA, 22 bp, Homo sapiens
cagctctcctccagccctgggc

SEQ ID NO: 4814575 - DNA, 23 bp, Homo sapiens
cagctctcctccagccctgggca

SEQ ID NO: 4814576 - DNA, 20 bp, Homo sapiens
cagctgagcattctcatttt

SEQ ID NO: 4814577 - DNA, 21 bp, Homo sapiens
cagctgcagttagcacagagg

SEQ ID NO: 4814578 - DNA, 17 bp, Homo sapiens
cagctgcctccgggcct

SEQ ID NO: 4814579 - DNA, 20 bp, Homo sapiens
cagctgcctccgggcctcgg

SEQ ID NO: 4814580 - DNA, 15 bp, Homo sapiens
cagctgcttgggctt

SEQ ID NO: 4814581 - DNA, 16 bp, Homo sapiens
cagctgcttgggcttc

SEQ ID NO: 4814582 - DNA, 21 bp, Homo sapiens
cagctgcttgggcttcatcct

SEQ ID NO: 4814583 - DNA, 22 bp, Homo sapiens
cagctgcttgggcttcatcctc

SEQ ID NO: 4814584 - DNA, 13 bp, Homo sapiens
cagctggactggg

SEQ ID NO: 4814585 - DNA, 17 bp, Homo sapiens
cagctggcagcgcctcc

SEQ ID NO: 4814586 - DNA, 23 bp, Homo sapiens
cagctggcagcgcctcccgccgc

SEQ ID NO: 4814587 - DNA, 14 bp, Homo sapiens
cagctgtgagcttt

SEQ ID NO: 4814588 - DNA, 23 bp, Homo sapiens
cagcttagaagttcgaaaactca

SEQ ID NO: 4814589 - DNA, 14 bp, Homo sapiens
cagcttcacttaaa

SEQ ID NO: 4814590 - DNA, 16 bp, Homo sapiens
cagcttcccaacaata

SEQ ID NO: 4814591 - DNA, 14 bp, Homo sapiens
cagcttgcttctct

SEQ ID NO: 4814592 - DNA, 17 bp, Homo sapiens
cagcttggagtgccaca

SEQ ID NO: 4814593 - DNA, 14 bp, Homo sapiens
cagcttgggagagc

SEQ ID NO: 4814594 - DNA, 23 bp, Homo sapiens
cagcttgggagagcccctggggc

SEQ ID NO: 4814595 - DNA, 23 bp, Homo sapiens
cagcttgtccaacaactccagga

SEQ ID NO: 4814596 - DNA, 14 bp, Homo sapiens
cagctttagccaag

SEQ ID NO: 4814597 - DNA, 15 bp, Homo sapiens
caggaaaaaaacttt

SEQ ID NO: 4814598 - DNA, 16 bp, Homo sapiens
caggaaaaaaactttt

SEQ ID NO: 4814599 - DNA, 11 bp, Homo sapiens
caggaaaatga

SEQ ID NO: 4814600 - DNA, 17 bp, Homo sapiens
caggaaagatcccaagt

SEQ ID NO: 4814601 - DNA, 23 bp, Homo sapiens
caggaaagccctcccccttcccc

SEQ ID NO: 4814602 - DNA, 15 bp, Homo sapiens
caggaaatgagagat

SEQ ID NO: 4814603 - DNA, 20 bp, Homo sapiens
caggaaatgagagatagagg

SEQ ID NO: 4814604 - DNA, 13 bp, Homo sapiens
caggaacccatca

SEQ ID NO: 4814605 - DNA, 15 bp, Homo sapiens
caggaacccatcact

SEQ ID NO: 4814606 - DNA, 19 bp, Homo sapiens
caggaacccatcactgtgt

SEQ ID NO: 4814607 - DNA, 22 bp, Homo sapiens
caggaagacttccagctttctc

SEQ ID NO: 4814608 - DNA, 23 bp, Homo sapiens
caggaagacttccagctttctct

SEQ ID NO: 4814609 - DNA, 19 bp, Homo sapiens
caggaagaggggcgctgcc

SEQ ID NO: 4814610 - DNA, 18 bp, Homo sapiens
caggaagccagcaggctc

SEQ ID NO: 4814611 - DNA, 21 bp, Homo sapiens
aggcagcaacaggaccaggag

SEQ ID NO: 4814612 - DNA, 16 bp, Homo sapiens
aggcaggaagtcagga

SEQ ID NO: 4814613 - DNA, 18 bp, Homo sapiens
aggcaggaagtcaggagc

SEQ ID NO: 4814614 - DNA, 21 bp, Homo sapiens
aggcaggaagtcaggagccag

SEQ ID NO: 4814615 - DNA, 22 bp, Homo sapiens
aggcaggaagtcaggagccagc

SEQ ID NO: 4814616 - DNA, 24 bp, Homo sapiens
aggcaggaagtcaggagccagcag

SEQ ID NO: 4814617 - DNA, 21 bp, Homo sapiens
aggcagggagggaaacccggg

SEQ ID NO: 4814618 - DNA, 23 bp, Homo sapiens
aggcagggagggaaacccgggga

SEQ ID NO: 4814619 - DNA, 15 bp, Homo sapiens
aggcagggccctgaa

SEQ ID NO: 4814620 - DNA, 19 bp, Homo sapiens
aggcagttcaaagcaggat

SEQ ID NO: 4814621 - DNA, 14 bp, Homo sapiens
aggcatactctcca

SEQ ID NO: 4814622 - DNA, 16 bp, Homo sapiens
aggcatactctccagg

SEQ ID NO: 4814623 - DNA, 17 bp, Homo sapiens
aggcatactctccagga

SEQ ID NO: 4814624 - DNA, 18 bp, Homo sapiens
aggcatactctccaggat

SEQ ID NO: 4814625 - DNA, 19 bp, Homo sapiens
aggcatactctccaggatt

SEQ ID NO: 4814626 - DNA, 17 bp, Homo sapiens
aggcatccccagtgcca

SEQ ID NO: 4814627 - DNA, 20 bp, Homo sapiens
aggcatccccagtgccagct

SEQ ID NO: 4814628 - DNA, 21 bp, Homo sapiens
aggcatccccagtgccagctg

SEQ ID NO: 4814629 - DNA, 23 bp, Homo sapiens
aggcatgcctctgatatgggact

SEQ ID NO: 4814630 - DNA, 17 bp, Homo sapiens
aggcattgcactaaaag

SEQ ID NO: 4814631 - DNA, 19 bp, Homo sapiens
aggcattgcactaaaagtg

SEQ ID NO: 4814632 - DNA, 21 bp, Homo sapiens
aggcattgcactaaaagtgat

SEQ ID NO: 4814633 - DNA, 23 bp, Homo sapiens
aggccaaaggaagcacatgcctc

SEQ ID NO: 4814634 - DNA, 21 bp, Homo sapiens
aggccaaatattgatctgtat

SEQ ID NO: 4814635 - DNA, 12 bp, Homo sapiens
aggccagagaca

SEQ ID NO: 4814636 - DNA, 13 bp, Homo sapiens
aggccagagacac

SEQ ID NO: 4814637 - DNA, 22 bp, Homo sapiens
aggccagcccacacagcccgag

SEQ ID NO: 4814638 - DNA, 13 bp, Homo sapiens
aggccagtacttt

SEQ ID NO: 4814639 - DNA, 19 bp, Homo sapiens
aggcccaaccaccagatga

SEQ ID NO: 4814640 - DNA, 12 bp, Homo sapiens
aggcccacagga

SEQ ID NO: 4814641 - DNA, 19 bp, Homo sapiens
aggcccacaggaggcaagc

SEQ ID NO: 4814642 - DNA, 15 bp, Homo sapiens
aggcccagcctggcc

SEQ ID NO: 4814643 - DNA, 17 bp, Homo sapiens
aggcccagcctggcccc

SEQ ID NO: 4814644 - DNA, 13 bp, Homo sapiens
aggcccctgaggg

SEQ ID NO: 4814645 - DNA, 15 bp, Homo sapiens
aggcccgaggcaccg

SEQ ID NO: 4814646 - DNA, 15 bp, Homo sapiens
aggcccgccctgccc

SEQ ID NO: 4814647 - DNA, 16 bp, Homo sapiens
aggcccgccctgcccg

SEQ ID NO: 4814648 - DNA, 15 bp, Homo sapiens
aggcccggagatgca

SEQ ID NO: 4814649 - DNA, 15 bp, Homo sapiens
aggcccgggaggagg

SEQ ID NO: 4814650 - DNA, 16 bp, Homo sapiens
aggcccgggaggagga

SEQ ID NO: 4814651 - DNA, 17 bp, Homo sapiens
aggccctctctgcagtc

SEQ ID NO: 4814652 - DNA, 11 bp, Homo sapiens
aggccctgcag

SEQ ID NO: 4814653 - DNA, 15 bp, Homo sapiens
aggccggccagcctc

SEQ ID NO: 4814654 - DNA, 16 bp, Homo sapiens
aggccggccagcctca

SEQ ID NO: 4814655 - DNA, 19 bp, Homo sapiens
aggccggtgggaagagggc

SEQ ID NO: 4814656 - DNA, 15 bp, Homo sapiens
aggcctcacctggct

SEQ ID NO: 4814657 - DNA, 15 bp, Homo sapiens
aggcctcccaagctg

SEQ ID NO: 4814658 - DNA, 15 bp, Homo sapiens
aggcctgagggaagc

SEQ ID NO: 4814659 - DNA, 18 bp, Homo sapiens
aggcctgagggaagccca

SEQ ID NO: 4814660 - DNA, 19 bp, Homo sapiens
aggcctgagggaagcccac

SEQ ID NO: 4814661 - DNA, 20 bp, Homo sapiens
aggcctgagggaagcccacc

SEQ ID NO: 4814662 - DNA, 15 bp, Homo sapiens
aggcctgcccccctt

SEQ ID NO: 4814663 - DNA, 16 bp, Homo sapiens
aggcctgccccccttc

SEQ ID NO: 4814664 - DNA, 22 bp, Homo sapiens
aggcctgccccccttcccaccc

SEQ ID NO: 4814665 - DNA, 14 bp, Homo sapiens
aggcctggcccagc

SEQ ID NO: 4814666 - DNA, 20 bp, Homo sapiens
aggcctggcccagccagcag

SEQ ID NO: 4814667 - DNA, 16 bp, Homo sapiens
aggcctgggagatgca

SEQ ID NO: 4814668 - DNA, 19 bp, Homo sapiens
aggcctgggagatgcagct

SEQ ID NO: 4814669 - DNA, 23 bp, Homo sapiens
aggcctgggtggatcggcctcct

SEQ ID NO: 4814670 - DNA, 12 bp, Homo sapiens
aggcctgggtgt

SEQ ID NO: 4814671 - DNA, 15 bp, Homo sapiens
aggccttcctcctct

SEQ ID NO: 4814672 - DNA, 23 bp, Homo sapiens
aggccttcctcctctcaaacctg

SEQ ID NO: 4814673 - DNA, 12 bp, Homo sapiens
aggcgcccacct

SEQ ID NO: 4814674 - DNA, 13 bp, Homo sapiens
aggcgcccacctg

SEQ ID NO: 4814675 - DNA, 19 bp, Homo sapiens
aggcgcccacctgcccagt

SEQ ID NO: 4814676 - DNA, 21 bp, Homo sapiens
aggcggaggggcttggagcag

SEQ ID NO: 4814677 - DNA, 13 bp, Homo sapiens
aggcgtcttgtat

SEQ ID NO: 4814678 - DNA, 16 bp, Homo sapiens
aggcgtcttgtatttt

SEQ ID NO: 4814679 - DNA, 17 bp, Homo sapiens
aggcgtgggatccagag

SEQ ID NO: 4814680 - DNA, 14 bp, Homo sapiens
aggctaaatgtaaa

SEQ ID NO: 4814681 - DNA, 14 bp, Homo sapiens
aggctactgccact

SEQ ID NO: 4814682 - DNA, 21 bp, Homo sapiens
aggctcacaactgtttttgaa

SEQ ID NO: 4814683 - DNA, 17 bp, Homo sapiens
aggctcaggctgcccag

SEQ ID NO: 4814684 - DNA, 17 bp, Homo sapiens
aggctcccactgcccct

SEQ ID NO: 4814685 - DNA, 18 bp, Homo sapiens
aggctcccactgcccctg

SEQ ID NO: 4814686 - DNA, 20 bp, Homo sapiens
aggctccctccctccctgct

SEQ ID NO: 4814687 - DNA, 19 bp, Homo sapiens
aggctctgaatctctcaaa

SEQ ID NO: 4814688 - DNA, 14 bp, Homo sapiens
aggctctgagacta

SEQ ID NO: 4814689 - DNA, 15 bp, Homo sapiens
aggctgagacacagc

SEQ ID NO: 4814690 - DNA, 19 bp, Homo sapiens
aggctgagacgcaaggatc

SEQ ID NO: 4814691 - DNA, 23 bp, Homo sapiens
aggctgcagctaatttgtgaaag

SEQ ID NO: 4814692 - DNA, 13 bp, Homo sapiens
cagcagcctctga

SEQ ID NO: 4814693 - DNA, 16 bp, Homo sapiens
cagcagcctctgaagt

SEQ ID NO: 4814694 - DNA, 23 bp, Homo sapiens
cagcagcctctgaagttggacag

SEQ ID NO: 4814695 - DNA, 12 bp, Homo sapiens
cagcagcctgct

SEQ ID NO: 4814696 - DNA, 19 bp, Homo sapiens
cagcagcggcagcagcagc

SEQ ID NO: 4814697 - DNA, 14 bp, Homo sapiens
cagcagcggcccag

SEQ ID NO: 4814698 - DNA, 19 bp, Homo sapiens
cagcagctagaaagagaaa

SEQ ID NO: 4814699 - DNA, 14 bp, Homo sapiens
cagcagctccaacc

SEQ ID NO: 4814700 - DNA, 21 bp, Homo sapiens
cagcagctccaacctggaggc

SEQ ID NO: 4814701 - DNA, 13 bp, Homo sapiens
cagcagctggact

SEQ ID NO: 4814702 - DNA, 14 bp, Homo sapiens
cagcagctggactg

SEQ ID NO: 4814703 - DNA, 18 bp, Homo sapiens
cagcagctggactgggtg

SEQ ID NO: 4814704 - DNA, 16 bp, Homo sapiens
cagcaggagcatggcc

SEQ ID NO: 4814705 - DNA, 12 bp, Homo sapiens
cagcaggctctc

SEQ ID NO: 4814706 - DNA, 18 bp, Homo sapiens
cagcagggcgggccagga

SEQ ID NO: 4814707 - DNA, 19 bp, Homo sapiens
cagcagggcgggccaggag

SEQ ID NO: 4814708 - DNA, 14 bp, Homo sapiens
cagcaggggaaaga

SEQ ID NO: 4814709 - DNA, 19 bp, Homo sapiens
cagcaggttctctcctgtg

SEQ ID NO: 4814710 - DNA, 20 bp, Homo sapiens
cagcaggttctctcctgtga

SEQ ID NO: 4814711 - DNA, 17 bp, Homo sapiens
cagcagtaccatcccac

SEQ ID NO: 4814712 - DNA, 18 bp, Homo sapiens
cagcagtaccatcccact

SEQ ID NO: 4814713 - DNA, 20 bp, Homo sapiens
cagcagtttgtgatctgtcc

SEQ ID NO: 4814714 - DNA, 22 bp, Homo sapiens
cagcataccagttcttgcaata

SEQ ID NO: 4814715 - DNA, 21 bp, Homo sapiens
cagcatcccacgatcggcctt

SEQ ID NO: 4814716 - DNA, 17 bp, Homo sapiens
cagcatgcatttagcat

SEQ ID NO: 4814717 - DNA, 23 bp, Homo sapiens
cagcattcccaattatcaaaaaa

SEQ ID NO: 4814718 - DNA, 15 bp, Homo sapiens
cagccaatatttaaa

SEQ ID NO: 4814719 - DNA, 12 bp, Homo sapiens
cagccaatttca

SEQ ID NO: 4814720 - DNA, 13 bp, Homo sapiens
cagccaatttcaa

SEQ ID NO: 4814721 - DNA, 15 bp, Homo sapiens
cagccaatttcaaag

SEQ ID NO: 4814722 - DNA, 22 bp, Homo sapiens
cagccaatttcaaagaaaacag

SEQ ID NO: 4814723 - DNA, 13 bp, Homo sapiens
cagccaccacctg

SEQ ID NO: 4814724 - DNA, 14 bp, Homo sapiens
cagccaccacctgg

SEQ ID NO: 4814725 - DNA, 18 bp, Homo sapiens
cagccacccggatctcca

SEQ ID NO: 4814726 - DNA, 20 bp, Homo sapiens
cagccacccggatctccagg

SEQ ID NO: 4814727 - DNA, 22 bp, Homo sapiens
cagccacccggatctccaggcc

SEQ ID NO: 4814728 - DNA, 21 bp, Homo sapiens
cagccacggggactcagccct

SEQ ID NO: 4814729 - DNA, 23 bp, Homo sapiens
cagccagaaactgaactggccgc

SEQ ID NO: 4814730 - DNA, 11 bp, Homo sapiens
cagccagcagg

SEQ ID NO: 4814731 - DNA, 19 bp, Homo sapiens
cagccagcaggttctctcc

SEQ ID NO: 4814732 - DNA, 20 bp, Homo sapiens
cagccagcaggttctctcct

SEQ ID NO: 4814733 - DNA, 14 bp, Homo sapiens
cagccagccgccct

SEQ ID NO: 4814734 - DNA, 16 bp, Homo sapiens
cagccagccgccctgg

SEQ ID NO: 4814735 - DNA, 19 bp, Homo sapiens
cagccagccgccctgggct

SEQ ID NO: 4814736 - DNA, 23 bp, Homo sapiens
cagccagccgccctgggctgtct

SEQ ID NO: 4814737 - DNA, 13 bp, Homo sapiens
cagccatggctgg

SEQ ID NO: 4814738 - DNA, 23 bp, Homo sapiens
cagccatggctggatgtgcatct

SEQ ID NO: 4814739 - DNA, 23 bp, Homo sapiens
cagcccagaacgggcctccccgg

SEQ ID NO: 4814740 - DNA, 15 bp, Homo sapiens
cagccccagacctgc

SEQ ID NO: 4814741 - DNA, 20 bp, Homo sapiens
cagccccagggccctgctca

SEQ ID NO: 4814742 - DNA, 22 bp, Homo sapiens
cagccccagggccctgctcagg

SEQ ID NO: 4814743 - DNA, 14 bp, Homo sapiens
agttgctgtttact

SEQ ID NO: 4814744 - DNA, 20 bp, Homo sapiens
agttggaagggaccccagat

SEQ ID NO: 4814745 - DNA, 13 bp, Homo sapiens
agttggcagacag

SEQ ID NO: 4814746 - DNA, 13 bp, Homo sapiens
agttggcctctgc

SEQ ID NO: 4814747 - DNA, 15 bp, Homo sapiens
agttggcctctgccc

SEQ ID NO: 4814748 - DNA, 14 bp, Homo sapiens
agttgggcccccat

SEQ ID NO: 4814749 - DNA, 23 bp, Homo sapiens
agttggttttgcatgtctgcatg

SEQ ID NO: 4814750 - DNA, 21 bp, Homo sapiens
agttggttttgtaaaattcca

SEQ ID NO: 4814751 - DNA, 17 bp, Homo sapiens
agttgtcctttctgatc

SEQ ID NO: 4814752 - DNA, 19 bp, Homo sapiens
agttgtcctttctgatcct

SEQ ID NO: 4814753 - DNA, 17 bp, Homo sapiens
agttgttagtgtgtctt

SEQ ID NO: 4814754 - DNA, 17 bp, Homo sapiens
agtttaaatctttgtta

SEQ ID NO: 4814755 - DNA, 19 bp, Homo sapiens
agtttaaatctttgttaaa

SEQ ID NO: 4814756 - DNA, 23 bp, Homo sapiens
agtttattttttttcttccaaca

SEQ ID NO: 4814757 - DNA, 14 bp, Homo sapiens
agtttcatttttca

SEQ ID NO: 4814758 - DNA, 14 bp, Homo sapiens
agtttccatttgga

SEQ ID NO: 4814759 - DNA, 16 bp, Homo sapiens
agtttccatttggatt

SEQ ID NO: 4814760 - DNA, 21 bp, Homo sapiens
agtttccatttggattttaaa

SEQ ID NO: 4814761 - DNA, 21 bp, Homo sapiens
agtttctatggattcacttct

SEQ ID NO: 4814762 - DNA, 19 bp, Homo sapiens
agtttctcttaagctgccc

SEQ ID NO: 4814763 - DNA, 18 bp, Homo sapiens
agtttcttgcaagctcca

SEQ ID NO: 4814764 - DNA, 21 bp, Homo sapiens
agtttcttgcaagctccagta

SEQ ID NO: 4814765 - DNA, 15 bp, Homo sapiens
atgtaggaaaatttt

SEQ ID NO: 4814766 - DNA, 18 bp, Homo sapiens
atgtaggaaaattttctt

SEQ ID NO: 4814767 - DNA, 19 bp, Homo sapiens
atgtagggcagaatagctg

SEQ ID NO: 4814768 - DNA, 21 bp, Homo sapiens
atgtatcccttctcacagcac

SEQ ID NO: 4814769 - DNA, 16 bp, Homo sapiens
atgtatcttatttata

SEQ ID NO: 4814770 - DNA, 15 bp, Homo sapiens
atgtatgccatgtat

SEQ ID NO: 4814771 - DNA, 12 bp, Homo sapiens
atgtatgtaaaa

SEQ ID NO: 4814772 - DNA, 14 bp, Homo sapiens
atgtatgtaaaaat

SEQ ID NO: 4814773 - DNA, 15 bp, Homo sapiens
atgtatgtaaaaatg

SEQ ID NO: 4814774 - DNA, 23 bp, Homo sapiens
atgtattaagcccacagtatatt

SEQ ID NO: 4814775 - DNA, 15 bp, Homo sapiens
atgtatttgtagtgt

SEQ ID NO: 4814776 - DNA, 16 bp, Homo sapiens
atgtcagtgtgactga

SEQ ID NO: 4814777 - DNA, 21 bp, Homo sapiens
atgtcagtgtgactgatctct

SEQ ID NO: 4814778 - DNA, 15 bp, Homo sapiens
atgtcatatcttctt

SEQ ID NO: 4814779 - DNA, 14 bp, Homo sapiens
atgtcatttgctaa

SEQ ID NO: 4814780 - DNA, 16 bp, Homo sapiens
atgtcatttgctaatg

SEQ ID NO: 4814781 - DNA, 13 bp, Homo sapiens
atgtcattttcag

SEQ ID NO: 4814782 - DNA, 16 bp, Homo sapiens
atgtccataaaagaga

SEQ ID NO: 4814783 - DNA, 18 bp, Homo sapiens
atgtccataaaagagacc

SEQ ID NO: 4814784 - DNA, 18 bp, Homo sapiens
atgtcccaaataaattta

SEQ ID NO: 4814785 - DNA, 21 bp, Homo sapiens
atgtccctgtcccctcctcgc

SEQ ID NO: 4814786 - DNA, 16 bp, Homo sapiens
atgtctatgtgtatat

SEQ ID NO: 4814787 - DNA, 17 bp, Homo sapiens
atgtctatgtgtatata

SEQ ID NO: 4814788 - DNA, 13 bp, Homo sapiens
atgtctattgtcc

SEQ ID NO: 4814789 - DNA, 22 bp, Homo sapiens
atgtctcaaaataaaaccagaa

SEQ ID NO: 4814790 - DNA, 22 bp, Homo sapiens
atgtctgtccctaaacatagtg

SEQ ID NO: 4814791 - DNA, 13 bp, Homo sapiens
atgtctgtgtata

SEQ ID NO: 4814792 - DNA, 19 bp, Homo sapiens
atgtctgtgtatacatatg

SEQ ID NO: 4814793 - DNA, 15 bp, Homo sapiens
atgtctttaaaatga

SEQ ID NO: 4814794 - DNA, 18 bp, Homo sapiens
atgtctttctccaaagtt

SEQ ID NO: 4814795 - DNA, 19 bp, Homo sapiens
atgtgaaaaaaaaaagtaa

SEQ ID NO: 4814796 - DNA, 20 bp, Homo sapiens
atgtgaaactgagaccaagt

SEQ ID NO: 4814797 - DNA, 17 bp, Homo sapiens
atgtgaaatgtaactgt

SEQ ID NO: 4814798 - DNA, 13 bp, Homo sapiens
atgtgataattgt

SEQ ID NO: 4814799 - DNA, 19 bp, Homo sapiens
atgtgataattgtaaaggt

SEQ ID NO: 4814800 - DNA, 16 bp, Homo sapiens
atgtgatatgtgtaat

SEQ ID NO: 4814801 - DNA, 13 bp, Homo sapiens
atgtgatttatgc

SEQ ID NO: 4814802 - DNA, 16 bp, Homo sapiens
atgtgcaaagcagtat

SEQ ID NO: 4814803 - DNA, 18 bp, Homo sapiens
atgtgcatctggcctatg

SEQ ID NO: 4814804 - DNA, 14 bp, Homo sapiens
atgtgccgtctttg

SEQ ID NO: 4814805 - DNA, 16 bp, Homo sapiens
atgtgctattaatatt

SEQ ID NO: 4814806 - DNA, 17 bp, Homo sapiens
atgtgctattaatattt

SEQ ID NO: 4814807 - DNA, 14 bp, Homo sapiens
atgtgctgcaaaga

SEQ ID NO: 4814808 - DNA, 14 bp, Homo sapiens
atgtgctgctgtgg

SEQ ID NO: 4814809 - DNA, 21 bp, Homo sapiens
atgtgcttccgagattcagac

SEQ ID NO: 4814810 - DNA, 21 bp, Homo sapiens
atgtgcttgtgtgtatgtcta

SEQ ID NO: 4814811 - DNA, 17 bp, Homo sapiens
atgtggaattacataac

SEQ ID NO: 4814812 - DNA, 20 bp, Homo sapiens
atgtggagttcatcttgaat

SEQ ID NO: 4814813 - DNA, 24 bp, Homo sapiens
atgtggagttcatcttgaattgta

SEQ ID NO: 4814814 - DNA, 14 bp, Homo sapiens
atgtggatgctctt

SEQ ID NO: 4814815 - DNA, 16 bp, Homo sapiens
atgtggcttcttcaac

SEQ ID NO: 4814816 - DNA, 15 bp, Homo sapiens
atgtgggaagaaaca

SEQ ID NO: 4814817 - DNA, 20 bp, Homo sapiens
atgtgggaagaaacaaaccc

SEQ ID NO: 4814818 - DNA, 20 bp, Homo sapiens
atgtggtggcaataaatgtc

SEQ ID NO: 4814819 - DNA, 11 bp, Homo sapiens
atgtgtaaatg

SEQ ID NO: 4814820 - DNA, 22 bp, Homo sapiens
atgtgtaacttttttttagtat

SEQ ID NO: 4814821 - DNA, 16 bp, Homo sapiens
atgtgtacacatatga

SEQ ID NO: 4814822 - DNA, 20 bp, Homo sapiens
atgtgtatatattatatata

SEQ ID NO: 4814823 - DNA, 21 bp, Homo sapiens
atgtgtatcagtgtttatgtg

SEQ ID NO: 4814824 - DNA, 15 bp, Homo sapiens
atgtgtcatgatttc

SEQ ID NO: 4814825 - DNA, 17 bp, Homo sapiens
atgtgtcatgatttcaa

SEQ ID NO: 4814826 - DNA, 19 bp, Homo sapiens
atgtgtcccccctgtggtc

SEQ ID NO: 4814827 - DNA, 11 bp, Homo sapiens
atgtgtcccct

SEQ ID NO: 4814828 - DNA, 15 bp, Homo sapiens
atgtgtcccctcact

SEQ ID NO: 4814829 - DNA, 19 bp, Homo sapiens
atgtgtcccctcactctgt

SEQ ID NO: 4814830 - DNA, 24 bp, Homo sapiens
atgtgtcccctcactctgtcagcc

SEQ ID NO: 4814831 - DNA, 20 bp, Homo sapiens
atgtgtccgtgaaagttgtg

SEQ ID NO: 4814832 - DNA, 13 bp, Homo sapiens
atgtgtcttcaat

SEQ ID NO: 4814833 - DNA, 19 bp, Homo sapiens
atgtgtgagtgtatgtata

SEQ ID NO: 4814834 - DNA, 21 bp, Homo sapiens
atgtgtgagtgtatgtataca

SEQ ID NO: 4814835 - DNA, 23 bp, Homo sapiens
atgtgtgagtgtatgtatacaca

SEQ ID NO: 4814836 - DNA, 14 bp, Homo sapiens
atgtgtgtatgtgt

SEQ ID NO: 4814837 - DNA, 22 bp, Homo sapiens
atgtgtgtcagcccatgtcaat

SEQ ID NO: 4814838 - DNA, 14 bp, Homo sapiens
atgtgttaatctta

SEQ ID NO: 4814839 - DNA, 13 bp, Homo sapiens
atgttaaaataat

SEQ ID NO: 4814840 - DNA, 18 bp, Homo sapiens
atgttaaaataattatat

SEQ ID NO: 4814841 - DNA, 22 bp, Homo sapiens
atgttaaagaggcgtcttgtat

SEQ ID NO: 4814842 - DNA, 23 bp, Homo sapiens
atgttaacaatgcctattgtaat

SEQ ID NO: 4814843 - DNA, 16 bp, Homo sapiens
atgttattttgtacgt

SEQ ID NO: 4814844 - DNA, 13 bp, Homo sapiens
atgttctgtgtca

SEQ ID NO: 4814845 - DNA, 23 bp, Homo sapiens
atgttctgtgtcacgtgaccctg

SEQ ID NO: 4814846 - DNA, 19 bp, Homo sapiens
atgttcttgcagtcatcag

SEQ ID NO: 4814847 - DNA, 17 bp, Homo sapiens
atgttcttggaacatgg

SEQ ID NO: 4814848 - DNA, 22 bp, Homo sapiens
atgttctttcctttcatcctca

SEQ ID NO: 4814849 - DNA, 17 bp, Homo sapiens
atgttgcatgaatccat

SEQ ID NO: 4814850 - DNA, 13 bp, Homo sapiens
atgttgctgaaac

SEQ ID NO: 4814851 - DNA, 17 bp, Homo sapiens
atgttgtcctgtgtcat

SEQ ID NO: 4814852 - DNA, 20 bp, Homo sapiens
atgttgtgttggtatttact

SEQ ID NO: 4814853 - DNA, 20 bp, Homo sapiens
atgttgttcaaatgcatttt

SEQ ID NO: 4814854 - DNA, 19 bp, Homo sapiens
atgttgttcgatcgtttca

SEQ ID NO: 4814855 - DNA, 13 bp, Homo sapiens
atgtttaaaatgg

SEQ ID NO: 4814856 - DNA, 19 bp, Homo sapiens
atgtttaagaaatgagaaa

SEQ ID NO: 4814857 - DNA, 20 bp, Homo sapiens
atgtttaagaaatgagaaat

SEQ ID NO: 4814858 - DNA, 15 bp, Homo sapiens
atgtttccatagttt

SEQ ID NO: 4814859 - DNA, 22 bp, Homo sapiens
atgtttcccgctccaagagaat

SEQ ID NO: 4814860 - DNA, 17 bp, Homo sapiens
atgtttgcgaatggctt

SEQ ID NO: 4814861 - DNA, 15 bp, Homo sapiens
atgtttggcaagaaa

SEQ ID NO: 4814862 - DNA, 16 bp, Homo sapiens
atgtttgtaagcaatt

SEQ ID NO: 4814863 - DNA, 22 bp, Homo sapiens
atgtttgtaagcaattctaagt

SEQ ID NO: 4814864 - DNA, 18 bp, Homo sapiens
atgttttacaatggctgg

SEQ ID NO: 4814865 - DNA, 16 bp, Homo sapiens
atgttttcaagttgca

SEQ ID NO: 4814866 - DNA, 21 bp, Homo sapiens
atgttttccccaattatcctc

SEQ ID NO: 4814867 - DNA, 13 bp, Homo sapiens
atgttttgctaat

SEQ ID NO: 4814868 - DNA, 14 bp, Homo sapiens
atgttttggaattc

SEQ ID NO: 4814869 - DNA, 22 bp, Homo sapiens
atgttttggagagagcaatctt

SEQ ID NO: 4814870 - DNA, 14 bp, Homo sapiens
attaaaaattaatt

SEQ ID NO: 4814871 - DNA, 15 bp, Homo sapiens
attaaaaattataga

SEQ ID NO: 4814872 - DNA, 19 bp, Homo sapiens
attaaaacacaacatcttt

SEQ ID NO: 4814873 - DNA, 13 bp, Homo sapiens
attaaaatcacaa

SEQ ID NO: 4814874 - DNA, 16 bp, Homo sapiens
attaaaatcacaaact

SEQ ID NO: 4814875 - DNA, 15 bp, Homo sapiens
attaaactgatgggt

SEQ ID NO: 4814876 - DNA, 15 bp, Homo sapiens
attaaactgggaaat

SEQ ID NO: 4814877 - DNA, 18 bp, Homo sapiens
attaaactgggaaatgag

SEQ ID NO: 4814878 - DNA, 14 bp, Homo sapiens
attaaacttcagca

SEQ ID NO: 4814879 - DNA, 19 bp, Homo sapiens
attaaacttctactgagca

SEQ ID NO: 4814880 - DNA, 20 bp, Homo sapiens
attaaacttctactgagcaa

SEQ ID NO: 4814881 - DNA, 12 bp, Homo sapiens
attaaagtctac

SEQ ID NO: 4814882 - DNA, 13 bp, Homo sapiens
attaaatgaaata

SEQ ID NO: 4814883 - DNA, 15 bp, Homo sapiens
attaaatgaaatact

SEQ ID NO: 4814884 - DNA, 23 bp, Homo sapiens
attaaatgaaatacttgacaaca

SEQ ID NO: 4814885 - DNA, 19 bp, Homo sapiens
attaaattatcattgtttg

SEQ ID NO: 4814886 - DNA, 23 bp, Homo sapiens
attaaattcctcctgtctcctct

SEQ ID NO: 4814887 - DNA, 19 bp, Homo sapiens
atttaagagattttatgtt

SEQ ID NO: 4814888 - DNA, 14 bp, Homo sapiens
atttaagcacaaaa

SEQ ID NO: 4814889 - DNA, 13 bp, Homo sapiens
atttaagcatttt

SEQ ID NO: 4814890 - DNA, 15 bp, Homo sapiens
atttaagcattttac

SEQ ID NO: 4814891 - DNA, 14 bp, Homo sapiens
atttaatcatttcc

SEQ ID NO: 4814892 - DNA, 20 bp, Homo sapiens
atttaatggtttttatttct

SEQ ID NO: 4814893 - DNA, 12 bp, Homo sapiens
atttaattctta

SEQ ID NO: 4814894 - DNA, 14 bp, Homo sapiens
atttaattcttacc

SEQ ID NO: 4814895 - DNA, 20 bp, Homo sapiens
atttaattttgacactgaaa

SEQ ID NO: 4814896 - DNA, 14 bp, Homo sapiens
atttacaatgtatt

SEQ ID NO: 4814897 - DNA, 16 bp, Homo sapiens
atttacaatgtattaa

SEQ ID NO: 4814898 - DNA, 15 bp, Homo sapiens
atttaccagaagttt

SEQ ID NO: 4814899 - DNA, 21 bp, Homo sapiens
atttaccagaagtttaaatct

SEQ ID NO: 4814900 - DNA, 15 bp, Homo sapiens
atttactaacagtaa

SEQ ID NO: 4814901 - DNA, 13 bp, Homo sapiens
atttactcattat

SEQ ID NO: 4814902 - DNA, 14 bp, Homo sapiens
atttactgcaatgt

SEQ ID NO: 4814903 - DNA, 15 bp, Homo sapiens
atttactgcaatgtc

SEQ ID NO: 4814904 - DNA, 21 bp, Homo sapiens
atttactgtttataataggtg

SEQ ID NO: 4814905 - DNA, 14 bp, Homo sapiens
atttagcacagtat

SEQ ID NO: 4814906 - DNA, 18 bp, Homo sapiens
atttagcacagtatttaa

SEQ ID NO: 4814907 - DNA, 13 bp, Homo sapiens
atttagcatgagt

SEQ ID NO: 4814908 - DNA, 17 bp, Homo sapiens
atttagcatgagttctg

SEQ ID NO: 4814909 - DNA, 18 bp, Homo sapiens
atttagcatgagttctgc

SEQ ID NO: 4814910 - DNA, 16 bp, Homo sapiens
atttaggaatgctcaa

SEQ ID NO: 4814911 - DNA, 19 bp, Homo sapiens
atttaggaatgctcaatgt

SEQ ID NO: 4814912 - DNA, 22 bp, Homo sapiens
atttaggaatgctcaatgtgct

SEQ ID NO: 4814913 - DNA, 22 bp, Homo sapiens
atttaggcatgagctcttggca

SEQ ID NO: 4814914 - DNA, 13 bp, Homo sapiens
atttagtaaaatt

SEQ ID NO: 4814915 - DNA, 24 bp, Homo sapiens
atttagtaaaattatctgttctat

SEQ ID NO: 4814916 - DNA, 15 bp, Homo sapiens
atttagtcctcacct

SEQ ID NO: 4814917 - DNA, 16 bp, Homo sapiens
atttataaaccagcag

SEQ ID NO: 4814918 - DNA, 20 bp, Homo sapiens
atttataaatgaagatgcat

SEQ ID NO: 4814919 - DNA, 16 bp, Homo sapiens
atttataacattgtaa

SEQ ID NO: 4814920 - DNA, 20 bp, Homo sapiens
atttatattagagtgccctt

SEQ ID NO: 4814921 - DNA, 23 bp, Homo sapiens
atttatattcagagatgtaccat

SEQ ID NO: 4814922 - DNA, 18 bp, Homo sapiens
atttatcgaaagtaaaaa

SEQ ID NO: 4814923 - DNA, 11 bp, Homo sapiens
atttatctttg

SEQ ID NO: 4814924 - DNA, 15 bp, Homo sapiens
atttatgaagatagt

SEQ ID NO: 4814925 - DNA, 18 bp, Homo sapiens
atttatgatgcagcagat

SEQ ID NO: 4814926 - DNA, 14 bp, Homo sapiens
atttatgatgttat

SEQ ID NO: 4814927 - DNA, 20 bp, Homo sapiens
atttatgatgttattttgta

SEQ ID NO: 4814928 - DNA, 12 bp, Homo sapiens
atttatgcattt

SEQ ID NO: 4814929 - DNA, 13 bp, Homo sapiens
atttatgcattta

SEQ ID NO: 4814930 - DNA, 15 bp, Homo sapiens
atttatgtgtgaagc

SEQ ID NO: 4814931 - DNA, 18 bp, Homo sapiens
atttattaaacttcagca

SEQ ID NO: 4814932 - DNA, 19 bp, Homo sapiens
atttattaaacttcagcaa

SEQ ID NO: 4814933 - DNA, 19 bp, Homo sapiens
atttattagccctgcattt

SEQ ID NO: 4814934 - DNA, 10 bp, Homo sapiens
atttattatg

SEQ ID NO: 4814935 - DNA, 15 bp, Homo sapiens
atttattattttcat

SEQ ID NO: 4814936 - DNA, 13 bp, Homo sapiens
atttatttattgt

SEQ ID NO: 4814937 - DNA, 18 bp, Homo sapiens
atttatttccaatgtttc

SEQ ID NO: 4814938 - DNA, 22 bp, Homo sapiens
atttatttccatattaaaatca

SEQ ID NO: 4814939 - DNA, 12 bp, Homo sapiens
atttattttatt

SEQ ID NO: 4814940 - DNA, 20 bp, Homo sapiens
atttattttattttagcagt

SEQ ID NO: 4814941 - DNA, 16 bp, Homo sapiens
atttattttttgtaac

SEQ ID NO: 4814942 - DNA, 22 bp, Homo sapiens
atttattttttgtaactctttg

SEQ ID NO: 4814943 - DNA, 18 bp, Homo sapiens
atttcaatagccccatct

SEQ ID NO: 4814944 - DNA, 23 bp, Homo sapiens
atttcaatagccccatctctcct

SEQ ID NO: 4814945 - DNA, 17 bp, Homo sapiens
atttcaatgattgttta

SEQ ID NO: 4814946 - DNA, 18 bp, Homo sapiens
atttcaatgattgtttaa

SEQ ID NO: 4814947 - DNA, 19 bp, Homo sapiens
atttcaccatgttgccaat

SEQ ID NO: 4814948 - DNA, 16 bp, Homo sapiens
atttcacgattcattt

SEQ ID NO: 4814949 - DNA, 21 bp, Homo sapiens
atttcacttaaactttgtcac

SEQ ID NO: 4814950 - DNA, 22 bp, Homo sapiens
atttcaggttaaattaaaccaa

SEQ ID NO: 4814951 - DNA, 21 bp, Homo sapiens
atttcagtaagatcaagctcc

SEQ ID NO: 4814952 - DNA, 16 bp, Homo sapiens
atttcatgattagaca

SEQ ID NO: 4814953 - DNA, 17 bp, Homo sapiens
atttccagcaaaatata

SEQ ID NO: 4814954 - DNA, 21 bp, Homo sapiens
atttccatggattcccctgga

SEQ ID NO: 4814955 - DNA, 23 bp, Homo sapiens
atttcccaacccaggattcaaca

SEQ ID NO: 4814956 - DNA, 23 bp, Homo sapiens
atttccgaagaccttctgaagat

SEQ ID NO: 4814957 - DNA, 16 bp, Homo sapiens
atttccgtgagagtca

SEQ ID NO: 4814958 - DNA, 21 bp, Homo sapiens
atttccgtgagagtcatctca

SEQ ID NO: 4814959 - DNA, 15 bp, Homo sapiens
atttcctgctcctcc

SEQ ID NO: 4814960 - DNA, 19 bp, Homo sapiens
atttccttgtctaaagatc

SEQ ID NO: 4814961 - DNA, 15 bp, Homo sapiens
atttcggctatgtct

SEQ ID NO: 4814962 - DNA, 20 bp, Homo sapiens
atttctaaaacattaattga

SEQ ID NO: 4814963 - DNA, 21 bp, Homo sapiens
atttctatgagacctccccca

SEQ ID NO: 4814964 - DNA, 23 bp, Homo sapiens
atttctcacactctaactgtata

SEQ ID NO: 4814965 - DNA, 18 bp, Homo sapiens
atttctcatttagcattg

SEQ ID NO: 4814966 - DNA, 16 bp, Homo sapiens
atttctgccatttcat

SEQ ID NO: 4814967 - DNA, 17 bp, Homo sapiens
atttctggccatttaac

SEQ ID NO: 4814968 - DNA, 15 bp, Homo sapiens
atttctgtatataga

SEQ ID NO: 4814969 - DNA, 18 bp, Homo sapiens
atttctgtatatagatgt

SEQ ID NO: 4814970 - DNA, 21 bp, Homo sapiens
atttctgtatatagatgtctg

SEQ ID NO: 4814971 - DNA, 15 bp, Homo sapiens
atttgagagaagcca

SEQ ID NO: 4814972 - DNA, 21 bp, Homo sapiens
atttgatatacagacctccag

SEQ ID NO: 4814973 - DNA, 13 bp, Homo sapiens
atttgcaacactg

SEQ ID NO: 4814974 - DNA, 23 bp, Homo sapiens
atttgcaacactgccaaacatca

SEQ ID NO: 4814975 - DNA, 21 bp, Homo sapiens
atttgcaggtgaccagaatga

SEQ ID NO: 4814976 - DNA, 14 bp, Homo sapiens
atttgcatgccttt

SEQ ID NO: 4814977 - DNA, 22 bp, Homo sapiens
atttgccagacagagatcagaa

SEQ ID NO: 4814978 - DNA, 23 bp, Homo sapiens
atttgccagacagagatcagaat

SEQ ID NO: 4814979 - DNA, 16 bp, Homo sapiens
atttgctcataagtaa

SEQ ID NO: 4814980 - DNA, 19 bp, Homo sapiens
atttgctcataagtaaatg

SEQ ID NO: 4814981 - DNA, 21 bp, Homo sapiens
atttgctcataagtaaatgtc

SEQ ID NO: 4814982 - DNA, 20 bp, Homo sapiens
atttgctctgtggtaagaga

SEQ ID NO: 4814983 - DNA, 20 bp, Homo sapiens
atttgctgattgtctgaaat

SEQ ID NO: 4814984 - DNA, 13 bp, Homo sapiens
atttgcttattta

SEQ ID NO: 4814985 - DNA, 15 bp, Homo sapiens
atttgcttatttata

SEQ ID NO: 4814986 - DNA, 17 bp, Homo sapiens
atttggatataaatctt

SEQ ID NO: 4814987 - DNA, 13 bp, Homo sapiens
atttggattcaca

SEQ ID NO: 4814988 - DNA, 18 bp, Homo sapiens
atttgggctgaatgtatg

SEQ ID NO: 4814989 - DNA, 22 bp, Homo sapiens
atttggggctacttatattctg

SEQ ID NO: 4814990 - DNA, 14 bp, Homo sapiens
atttggtggctcta

SEQ ID NO: 4814991 - DNA, 11 bp, Homo sapiens
atttgtaaaac

SEQ ID NO: 4814992 - DNA, 16 bp, Homo sapiens
atttgtaatgtatctt

SEQ ID NO: 4814993 - DNA, 14 bp, Homo sapiens
atttgtatgatatt

SEQ ID NO: 4814994 - DNA, 15 bp, Homo sapiens
atttgtatgatattt

SEQ ID NO: 4814995 - DNA, 22 bp, Homo sapiens
atttgtattagtaataaaacat

SEQ ID NO: 4814996 - DNA, 21 bp, Homo sapiens
atttgtatttatattagagtg

SEQ ID NO: 4814997 - DNA, 20 bp, Homo sapiens
atttgtcgggttctcccatg

SEQ ID NO: 4814998 - DNA, 21 bp, Homo sapiens
atttgtgagccaaagagaaaa

SEQ ID NO: 4814999 - DNA, 22 bp, Homo sapiens
atttgtgagccaaagagaaaag

SEQ ID NO: 4815000 - DNA, 23 bp, Homo sapiens
atttgtgagccaaagagaaaaga

SEQ ID NO: 4815001 - DNA, 15 bp, Homo sapiens
atttgtgatacttcc

SEQ ID NO: 4815002 - DNA, 12 bp, Homo sapiens
atttgtgtaact

SEQ ID NO: 4815003 - DNA, 21 bp, Homo sapiens
atttgtgtagattgtgtaaat

SEQ ID NO: 4815004 - DNA, 15 bp, Homo sapiens
atttgttaatgattc

SEQ ID NO: 4815005 - DNA, 16 bp, Homo sapiens
atttgttaatgattct

SEQ ID NO: 4815006 - DNA, 17 bp, Homo sapiens
atttgttaatgattctt

SEQ ID NO: 4815007 - DNA, 15 bp, Homo sapiens
atttgttcctttctg

SEQ ID NO: 4815008 - DNA, 18 bp, Homo sapiens
atttgtttgtgcttctaa

SEQ ID NO: 4815009 - DNA, 13 bp, Homo sapiens
caacttcccaggc

SEQ ID NO: 4815010 - DNA, 23 bp, Homo sapiens
caacttgaaattatatctgtggt

SEQ ID NO: 4815011 - DNA, 24 bp, Homo sapiens
caacttgaaattatatctgtggtc

SEQ ID NO: 4815012 - DNA, 14 bp, Homo sapiens
caacttgctccttt

SEQ ID NO: 4815013 - DNA, 14 bp, Homo sapiens
caactttccagact

SEQ ID NO: 4815014 - DNA, 17 bp, Homo sapiens
caagaaaggaaaccttt

SEQ ID NO: 4815015 - DNA, 12 bp, Homo sapiens
caagaagaatat

SEQ ID NO: 4815016 - DNA, 13 bp, Homo sapiens
caagaagaatata

SEQ ID NO: 4815017 - DNA, 17 bp, Homo sapiens
caagaagaatttgaaga

SEQ ID NO: 4815018 - DNA, 20 bp, Homo sapiens
caagaagatagttgtaaaga

SEQ ID NO: 4815019 - DNA, 12 bp, Homo sapiens
caagaatgcagt

SEQ ID NO: 4815020 - DNA, 21 bp, Homo sapiens
caagaattctccaaaacaatt

SEQ ID NO: 4815021 - DNA, 18 bp, Homo sapiens
caagacggatccacagta

SEQ ID NO: 4815022 - DNA, 16 bp, Homo sapiens
caagactctatgctct

SEQ ID NO: 4815023 - DNA, 20 bp, Homo sapiens
caagactctatgctctggaa

SEQ ID NO: 4815024 - DNA, 17 bp, Homo sapiens
caagacttgacgcagcc

SEQ ID NO: 4815025 - DNA, 19 bp, Homo sapiens
caagacttgacgcagcccc

SEQ ID NO: 4815026 - DNA, 15 bp, Homo sapiens
caagagaccacttcc

SEQ ID NO: 4815027 - DNA, 18 bp, Homo sapiens
caagagctcaggagaagg

SEQ ID NO: 4815028 - DNA, 21 bp, Homo sapiens
caagagggactccaagccctg

SEQ ID NO: 4815029 - DNA, 22 bp, Homo sapiens
caagagggactccaagccctgg

SEQ ID NO: 4815030 - DNA, 14 bp, Homo sapiens
caagaggtttcagc

SEQ ID NO: 4815031 - DNA, 18 bp, Homo sapiens
caagagtgatgggaaaga

SEQ ID NO: 4815032 - DNA, 17 bp, Homo sapiens
caagcaaactgaaatta

SEQ ID NO: 4815033 - DNA, 22 bp, Homo sapiens
caagcaagctctcttgccgagg

SEQ ID NO: 4815034 - DNA, 14 bp, Homo sapiens
caagcaatcctccc

SEQ ID NO: 4815035 - DNA, 16 bp, Homo sapiens
caagcacaattgatct

SEQ ID NO: 4815036 - DNA, 23 bp, Homo sapiens
caagcagtggatacgtgtcaatg

SEQ ID NO: 4815037 - DNA, 16 bp, Homo sapiens
caagcatcagcaagac

SEQ ID NO: 4815038 - DNA, 21 bp, Homo sapiens
caagcatgaagataaacacag

SEQ ID NO: 4815039 - DNA, 19 bp, Homo sapiens
caagcattgctaaagtcag

SEQ ID NO: 4815040 - DNA, 13 bp, Homo sapiens
caagccaggagac

SEQ ID NO: 4815041 - DNA, 22 bp, Homo sapiens
caagccaggccctctctgcagt

SEQ ID NO: 4815042 - DNA, 20 bp, Homo sapiens
caagccagggttccagacag

SEQ ID NO: 4815043 - DNA, 11 bp, Homo sapiens
caagccctggg

SEQ ID NO: 4815044 - DNA, 12 bp, Homo sapiens
caagccctgggg

SEQ ID NO: 4815045 - DNA, 14 bp, Homo sapiens
caagccctggggca

SEQ ID NO: 4815046 - DNA, 17 bp, Homo sapiens
caagccctggggcaggg

SEQ ID NO: 4815047 - DNA, 18 bp, Homo sapiens
caagccctggggcagggt

SEQ ID NO: 4815048 - DNA, 17 bp, Homo sapiens
caagctataaaagccca

SEQ ID NO: 4815049 - DNA, 18 bp, Homo sapiens
caagctcacttgctttag

SEQ ID NO: 4815050 - DNA, 19 bp, Homo sapiens
caagctcatagcacatgtt

SEQ ID NO: 4815051 - DNA, 14 bp, Homo sapiens
caagctctcttgcc

SEQ ID NO: 4815052 - DNA, 15 bp, Homo sapiens
caagctcttcattgc

SEQ ID NO: 4815053 - DNA, 14 bp, Homo sapiens
caagctgatagtgt

SEQ ID NO: 4815054 - DNA, 16 bp, Homo sapiens
caagctgatagtgttt

SEQ ID NO: 4815055 - DNA, 23 bp, Homo sapiens
caagctgatgaagttaagcacaa

SEQ ID NO: 4815056 - DNA, 19 bp, Homo sapiens
caagctgctctccttcact

SEQ ID NO: 4815057 - DNA, 12 bp, Homo sapiens
caagctgctgcc

SEQ ID NO: 4815058 - DNA, 13 bp, Homo sapiens
caagctgctgccg

SEQ ID NO: 4815059 - DNA, 17 bp, Homo sapiens
caaggaacttcatgctt

SEQ ID NO: 4815060 - DNA, 17 bp, Homo sapiens
caaggaaggacatttcc

SEQ ID NO: 4815061 - DNA, 22 bp, Homo sapiens
caaggaatgaattttttcctac

SEQ ID NO: 4815062 - DNA, 20 bp, Homo sapiens
caaggacaagcaattagaag

SEQ ID NO: 4815063 - DNA, 15 bp, Homo sapiens
caaggagggagaaag

SEQ ID NO: 4815064 - DNA, 15 bp, Homo sapiens
caaggcaaatgtcca

SEQ ID NO: 4815065 - DNA, 17 bp, Homo sapiens
caaggcaaatgtccaag

SEQ ID NO: 4815066 - DNA, 20 bp, Homo sapiens
caaggcaaatgtccaagcat

SEQ ID NO: 4815067 - DNA, 15 bp, Homo sapiens
caaggcaagaagtgg

SEQ ID NO: 4815068 - DNA, 16 bp, Homo sapiens
caaggcaagaagtggg

SEQ ID NO: 4815069 - DNA, 16 bp, Homo sapiens
caaggcaaggctgtca

SEQ ID NO: 4815070 - DNA, 21 bp, Homo sapiens
caaggcactgagcgcctgcag

SEQ ID NO: 4815071 - DNA, 15 bp, Homo sapiens
caaggccaaaggaag

SEQ ID NO: 4815072 - DNA, 18 bp, Homo sapiens
caaggccaaaggaagcac

SEQ ID NO: 4815073 - DNA, 21 bp, Homo sapiens
caaggccaaaggaagcacatg

SEQ ID NO: 4815074 - DNA, 18 bp, Homo sapiens
caaggcccccacctctgt

SEQ ID NO: 4815075 - DNA, 22 bp, Homo sapiens
caaggcccttacacccttgtcc

SEQ ID NO: 4815076 - DNA, 11 bp, Homo sapiens
caaggctgcta

SEQ ID NO: 4815077 - DNA, 15 bp, Homo sapiens
caaggctgctaagtg

SEQ ID NO: 4815078 - DNA, 17 bp, Homo sapiens
caagggaagtgaccaag

SEQ ID NO: 4815079 - DNA, 23 bp, Homo sapiens
caaggggaccgccccaggcaccg

SEQ ID NO: 4815080 - DNA, 13 bp, Homo sapiens
caaggggtggaag

SEQ ID NO: 4815081 - DNA, 22 bp, Homo sapiens
caaggggtggaagggcaggagc

SEQ ID NO: 4815082 - DNA, 13 bp, Homo sapiens
caaggtctgcttt

SEQ ID NO: 4815083 - DNA, 15 bp, Homo sapiens
caaggtgaaggatct

SEQ ID NO: 4815084 - DNA, 22 bp, Homo sapiens
caaggtgaaggatctgtccgac

SEQ ID NO: 4815085 - DNA, 22 bp, Homo sapiens
caaggtgcacctgccccaggct

SEQ ID NO: 4815086 - DNA, 17 bp, Homo sapiens
caaggtggtcttggaga

SEQ ID NO: 4815087 - DNA, 20 bp, Homo sapiens
caaggtggtcttggagagga

SEQ ID NO: 4815088 - DNA, 14 bp, Homo sapiens
caagtagcacactg

SEQ ID NO: 4815089 - DNA, 13 bp, Homo sapiens
caagtcatgggag

SEQ ID NO: 4815090 - DNA, 21 bp, Homo sapiens
caagtcccgaggcagcaacag

SEQ ID NO: 4815091 - DNA, 17 bp, Homo sapiens
caagtcctcgccccccg

SEQ ID NO: 4815092 - DNA, 21 bp, Homo sapiens
caagtcctcgccccccgcccg

SEQ ID NO: 4815093 - DNA, 23 bp, Homo sapiens
caagtctacctgccttgcctgtt

SEQ ID NO: 4815094 - DNA, 11 bp, Homo sapiens
caagtctgtga

SEQ ID NO: 4815095 - DNA, 12 bp, Homo sapiens
caagtctgtgaa

SEQ ID NO: 4815096 - DNA, 13 bp, Homo sapiens
caagtctgtgaaa

SEQ ID NO: 4815097 - DNA, 22 bp, Homo sapiens
caagtgcagggcctgtaatccc

SEQ ID NO: 4815098 - DNA, 17 bp, Homo sapiens
caagtggacgtgggctc

SEQ ID NO: 4815099 - DNA, 11 bp, Homo sapiens
caagtgtcctg

SEQ ID NO: 4815100 - DNA, 13 bp, Homo sapiens
caagtgtgcctgc

SEQ ID NO: 4815101 - DNA, 14 bp, Homo sapiens
caagtgtgtgtgca

SEQ ID NO: 4815102 - DNA, 20 bp, Homo sapiens
caagttgccacattgcttca

SEQ ID NO: 4815103 - DNA, 21 bp, Homo sapiens
caagttgccacattgcttcat

SEQ ID NO: 4815104 - DNA, 21 bp, Homo sapiens
caataaacgctgacttgcaga

SEQ ID NO: 4815105 - DNA, 22 bp, Homo sapiens
caataaagagtaaatatacttg

SEQ ID NO: 4815106 - DNA, 13 bp, Homo sapiens
caataaagcaatg

SEQ ID NO: 4815107 - DNA, 16 bp, Homo sapiens
caataaagctcacact

SEQ ID NO: 4815108 - DNA, 13 bp, Homo sapiens
caataacagtttt

SEQ ID NO: 4815109 - DNA, 22 bp, Homo sapiens
caataaggatttattctcagaa

SEQ ID NO: 4815110 - DNA, 14 bp, Homo sapiens
caataagttgaatg

SEQ ID NO: 4815111 - DNA, 21 bp, Homo sapiens
caatacattattggacttcca

SEQ ID NO: 4815112 - DNA, 16 bp, Homo sapiens
caatactttgtgtctt

SEQ ID NO: 4815113 - DNA, 18 bp, Homo sapiens
caatagcgtgtgtagata

SEQ ID NO: 4815114 - DNA, 16 bp, Homo sapiens
caatagtcatatgtga

SEQ ID NO: 4815115 - DNA, 17 bp, Homo sapiens
caatagtcatatgtgaa

SEQ ID NO: 4815116 - DNA, 17 bp, Homo sapiens
caatagtgttgaggagg

SEQ ID NO: 4815117 - DNA, 14 bp, Homo sapiens
caatatgggaggaa

SEQ ID NO: 4815118 - DNA, 21 bp, Homo sapiens
caatatgggaggaacaaagac

SEQ ID NO: 4815119 - DNA, 22 bp, Homo sapiens
caatatgggaggaacaaagaca

SEQ ID NO: 4815120 - DNA, 14 bp, Homo sapiens
caatattaagtgtt

SEQ ID NO: 4815121 - DNA, 13 bp, Homo sapiens
caatcaaacaggg

SEQ ID NO: 4815122 - DNA, 14 bp, Homo sapiens
caatcactaaatat

SEQ ID NO: 4815123 - DNA, 21 bp, Homo sapiens
caatcattgtacagtttgttt

SEQ ID NO: 4815124 - DNA, 20 bp, Homo sapiens
caatcattgtcagagatgtt

SEQ ID NO: 4815125 - DNA, 18 bp, Homo sapiens
caatcattttctagccct

SEQ ID NO: 4815126 - DNA, 23 bp, Homo sapiens
caatcattttctagccctctccc

SEQ ID NO: 4815127 - DNA, 15 bp, Homo sapiens
caatccaacccatgc

SEQ ID NO: 4815128 - DNA, 18 bp, Homo sapiens
caatccaacccatgcatg

SEQ ID NO: 4815129 - DNA, 20 bp, Homo sapiens
caatccaacccatgcatggc

SEQ ID NO: 4815130 - DNA, 13 bp, Homo sapiens
caatccagccttc

SEQ ID NO: 4815131 - DNA, 22 bp, Homo sapiens
cacagctggggtggggacctca

SEQ ID NO: 4815132 - DNA, 21 bp, Homo sapiens
cacaggactgattctgggatg

SEQ ID NO: 4815133 - DNA, 22 bp, Homo sapiens
cacaggagcgtgtcctatcccc

SEQ ID NO: 4815134 - DNA, 20 bp, Homo sapiens
cacaggaggcaagcaagctc

SEQ ID NO: 4815135 - DNA, 16 bp, Homo sapiens
cacaggatcctggcct

SEQ ID NO: 4815136 - DNA, 16 bp, Homo sapiens
cacaggcctggcccag

SEQ ID NO: 4815137 - DNA, 20 bp, Homo sapiens
cacaggcctggcccagccag

SEQ ID NO: 4815138 - DNA, 12 bp, Homo sapiens
cacaggctgccg

SEQ ID NO: 4815139 - DNA, 19 bp, Homo sapiens
cacaggctgccgctgctct

SEQ ID NO: 4815140 - DNA, 13 bp, Homo sapiens
cacaggtgtaaat

SEQ ID NO: 4815141 - DNA, 21 bp, Homo sapiens
cacagtagtgttgggtggagg

SEQ ID NO: 4815142 - DNA, 17 bp, Homo sapiens
cacagtgacccttccca

SEQ ID NO: 4815143 - DNA, 19 bp, Homo sapiens
cacagtgggaactctgaca

SEQ ID NO: 4815144 - DNA, 16 bp, Homo sapiens
cacagtgggcggcttc

SEQ ID NO: 4815145 - DNA, 20 bp, Homo sapiens
cacagtggggcccatggccc

SEQ ID NO: 4815146 - DNA, 22 bp, Homo sapiens
cacagtggggcccatggcccca

SEQ ID NO: 4815147 - DNA, 13 bp, Homo sapiens
cacagtggtcagc

SEQ ID NO: 4815148 - DNA, 23 bp, Homo sapiens
cacagtggtcagcgattcctgcc

SEQ ID NO: 4815149 - DNA, 23 bp, Homo sapiens
cacagttccacaattttgtctct

SEQ ID NO: 4815150 - DNA, 15 bp, Homo sapiens
cacagttctctcctt

SEQ ID NO: 4815151 - DNA, 20 bp, Homo sapiens
cacataaacacttctcctta

SEQ ID NO: 4815152 - DNA, 14 bp, Homo sapiens
cacataacacacat

SEQ ID NO: 4815153 - DNA, 15 bp, Homo sapiens
cacataagttttctc

SEQ ID NO: 4815154 - DNA, 13 bp, Homo sapiens
cacatacactgca

SEQ ID NO: 4815155 - DNA, 15 bp, Homo sapiens
cacatacactgcatt

SEQ ID NO: 4815156 - DNA, 14 bp, Homo sapiens
cacatacagatggt

SEQ ID NO: 4815157 - DNA, 20 bp, Homo sapiens
cacatagattaatggcactg

SEQ ID NO: 4815158 - DNA, 16 bp, Homo sapiens
cacatagattcacctg

SEQ ID NO: 4815159 - DNA, 20 bp, Homo sapiens
cacatagcataggctgggga

SEQ ID NO: 4815160 - DNA, 15 bp, Homo sapiens
cacatccccaccctc

SEQ ID NO: 4815161 - DNA, 20 bp, Homo sapiens
cacatccccaccctcccctc

SEQ ID NO: 4815162 - DNA, 21 bp, Homo sapiens
ccaaggaacttcatgcttgat

SEQ ID NO: 4815163 - DNA, 18 bp, Homo sapiens
ccaaggaagaacaaatat

SEQ ID NO: 4815164 - DNA, 14 bp, Homo sapiens
ccaaggcaaatgtc

SEQ ID NO: 4815165 - DNA, 15 bp, Homo sapiens
ccaaggcaaatgtcc

SEQ ID NO: 4815166 - DNA, 18 bp, Homo sapiens
ccaaggcaaatgtccaag

SEQ ID NO: 4815167 - DNA, 23 bp, Homo sapiens
ccaaggcagaataaaccggatcc

SEQ ID NO: 4815168 - DNA, 16 bp, Homo sapiens
ccaaggcatccccagt

SEQ ID NO: 4815169 - DNA, 20 bp, Homo sapiens
ccaaggcatccccagtgcca

SEQ ID NO: 4815170 - DNA, 22 bp, Homo sapiens
ccaaggtgaagatggcctagga

SEQ ID NO: 4815171 - DNA, 21 bp, Homo sapiens
ccaaggtggtcttggagagga

SEQ ID NO: 4815172 - DNA, 22 bp, Homo sapiens
ccaaggtggtcttggagaggag

SEQ ID NO: 4815173 - DNA, 20 bp, Homo sapiens
ccaagtagctgagactacag

SEQ ID NO: 4815174 - DNA, 20 bp, Homo sapiens
ccaagtcaaacagtgtggct

SEQ ID NO: 4815175 - DNA, 15 bp, Homo sapiens
ccaagtcatgggaga

SEQ ID NO: 4815176 - DNA, 12 bp, Homo sapiens
ccaagtctctct

SEQ ID NO: 4815177 - DNA, 21 bp, Homo sapiens
ccaagtctctctaagacaaat

SEQ ID NO: 4815178 - DNA, 15 bp, Homo sapiens
ccaagtgtgtgtgca

SEQ ID NO: 4815179 - DNA, 16 bp, Homo sapiens
ccaagtgtgtgtgcaa

SEQ ID NO: 4815180 - DNA, 15 bp, Homo sapiens
ccaataaagctcaca

SEQ ID NO: 4815181 - DNA, 13 bp, Homo sapiens
ccaatacattatt

SEQ ID NO: 4815182 - DNA, 12 bp, Homo sapiens
ccaatagtcata

SEQ ID NO: 4815183 - DNA, 23 bp, Homo sapiens
ccaatagtctgccacaagggcag

SEQ ID NO: 4815184 - DNA, 13 bp, Homo sapiens
ccaatcagcactg

SEQ ID NO: 4815185 - DNA, 18 bp, Homo sapiens
ccaatcagcactgaaaat

SEQ ID NO: 4815186 - DNA, 21 bp, Homo sapiens
ccaatccaacccatgcatggc

SEQ ID NO: 4815187 - DNA, 11 bp, Homo sapiens
ccaatctctgt

SEQ ID NO: 4815188 - DNA, 13 bp, Homo sapiens
ccaatctctgtga

SEQ ID NO: 4815189 - DNA, 22 bp, Homo sapiens
ccaatgtccaggtcacaggcat

SEQ ID NO: 4815190 - DNA, 22 bp, Homo sapiens
ccaattatcaaaaaacagaaaa

SEQ ID NO: 4815191 - DNA, 13 bp, Homo sapiens
ccaatttcacaga

SEQ ID NO: 4815192 - DNA, 14 bp, Homo sapiens
ccacaaatgtcctc

SEQ ID NO: 4815193 - DNA, 14 bp, Homo sapiens
ccacaaccctgttg

SEQ ID NO: 4815194 - DNA, 19 bp, Homo sapiens
ccacaactaacaatgcctt

SEQ ID NO: 4815195 - DNA, 17 bp, Homo sapiens
ccacaactgacacagga

SEQ ID NO: 4815196 - DNA, 19 bp, Homo sapiens
ccacaactgacacaggaaa

SEQ ID NO: 4815197 - DNA, 20 bp, Homo sapiens
ccacaagactggtattctct

SEQ ID NO: 4815198 - DNA, 17 bp, Homo sapiens
ccacaagagcccaggcc

SEQ ID NO: 4815199 - DNA, 12 bp, Homo sapiens
ccacaagcacaa

SEQ ID NO: 4815200 - DNA, 18 bp, Homo sapiens
ccacaagggcagtggaag

SEQ ID NO: 4815201 - DNA, 20 bp, Homo sapiens
ccacaagggtgcccacctct

SEQ ID NO: 4815202 - DNA, 12 bp, Homo sapiens
ccacaataggct

SEQ ID NO: 4815203 - DNA, 21 bp, Homo sapiens
ccacaatcactaaatatctag

SEQ ID NO: 4815204 - DNA, 21 bp, Homo sapiens
ccacacacagcagctccaacc

SEQ ID NO: 4815205 - DNA, 20 bp, Homo sapiens
ccacacaggcctggcccagc

SEQ ID NO: 4815206 - DNA, 23 bp, Homo sapiens
ccacacaggcctggcccagccag

SEQ ID NO: 4815207 - DNA, 17 bp, Homo sapiens
ccacaccccgtctgccc

SEQ ID NO: 4815208 - DNA, 18 bp, Homo sapiens
ccacacgccggggctggc

SEQ ID NO: 4815209 - DNA, 21 bp, Homo sapiens
ccacacgccggggctggccct

SEQ ID NO: 4815210 - DNA, 23 bp, Homo sapiens
ccacacgccggggctggccctgc

SEQ ID NO: 4815211 - DNA, 20 bp, Homo sapiens
ccacacttgcagagctgctg

SEQ ID NO: 4815212 - DNA, 22 bp, Homo sapiens
ccacagagttactgccacggtc

SEQ ID NO: 4815213 - DNA, 20 bp, Homo sapiens
ccacagcagcctctgaagtt

SEQ ID NO: 4815214 - DNA, 17 bp, Homo sapiens
ccacagctgcctccggg

SEQ ID NO: 4815215 - DNA, 18 bp, Homo sapiens
ccacaggagcatgtccta

SEQ ID NO: 4815216 - DNA, 22 bp, Homo sapiens
ccacaggagccgcagaggcccg

SEQ ID NO: 4815217 - DNA, 16 bp, Homo sapiens
ccacaggagcgtgtac

SEQ ID NO: 4815218 - DNA, 18 bp, Homo sapiens
ccacaggagcgtgtccta

SEQ ID NO: 4815219 - DNA, 16 bp, Homo sapiens
ccacaggagctccctt

SEQ ID NO: 4815220 - DNA, 22 bp, Homo sapiens
ccacaggagctccctttttgaa

SEQ ID NO: 4815221 - DNA, 21 bp, Homo sapiens
ccacaggaggcaagcaagctc

SEQ ID NO: 4815222 - DNA, 23 bp, Homo sapiens
ccacagtatattttatttcaatg

SEQ ID NO: 4815223 - DNA, 11 bp, Homo sapiens
ccacagtattg

SEQ ID NO: 4815224 - DNA, 20 bp, Homo sapiens
ccacagtggggcccatggcc

SEQ ID NO: 4815225 - DNA, 21 bp, Homo sapiens
ccacagtggggcccatggccc

SEQ ID NO: 4815226 - DNA, 21 bp, Homo sapiens
ccacataaacacttctcctta

SEQ ID NO: 4815227 - DNA, 16 bp, Homo sapiens
ccacatcgcagcccct

SEQ ID NO: 4815228 - DNA, 17 bp, Homo sapiens
ccacatgcacatgtatt

SEQ ID NO: 4815229 - DNA, 23 bp, Homo sapiens
ccacatgcacatgtattctgttg

SEQ ID NO: 4815230 - DNA, 16 bp, Homo sapiens
ccacatgcgctcctgg

SEQ ID NO: 4815231 - DNA, 18 bp, Homo sapiens
ccacatggccgctgccca

SEQ ID NO: 4815232 - DNA, 20 bp, Homo sapiens
ccacattgcttcattaaaac

SEQ ID NO: 4815233 - DNA, 16 bp, Homo sapiens
ccaccaaaaactgggt

SEQ ID NO: 4815234 - DNA, 19 bp, Homo sapiens
ccaccacacacacccttcc

SEQ ID NO: 4815235 - DNA, 17 bp, Homo sapiens
ccaccactctcaggacc

SEQ ID NO: 4815236 - DNA, 19 bp, Homo sapiens
ccaccactgtgtcccagtg

SEQ ID NO: 4815237 - DNA, 13 bp, Homo sapiens
ccaccacttgatg

SEQ ID NO: 4815238 - DNA, 14 bp, Homo sapiens
ccacccagcagcgc

SEQ ID NO: 4815239 - DNA, 12 bp, Homo sapiens
ccaccccagtcc

SEQ ID NO: 4815240 - DNA, 17 bp, Homo sapiens
ccacccccattgtgaat

SEQ ID NO: 4815241 - DNA, 20 bp, Homo sapiens
ccacccccgtcaccccgctc

SEQ ID NO: 4815242 - DNA, 17 bp, Homo sapiens
ccaccccgctgcctggc

SEQ ID NO: 4815243 - DNA, 18 bp, Homo sapiens
ccaccccgctgcctggcg

SEQ ID NO: 4815244 - DNA, 14 bp, Homo sapiens
ccaccccgtcccgg

SEQ ID NO: 4815245 - DNA, 22 bp, Homo sapiens
ccaccccgtcccggccccgcgc

SEQ ID NO: 4815246 - DNA, 20 bp, Homo sapiens
ccaccccgttgttgtccctg

SEQ ID NO: 4815247 - DNA, 21 bp, Homo sapiens
ccacccctacagcctgcacac

SEQ ID NO: 4815248 - DNA, 13 bp, Homo sapiens
ccacccctcaagc

SEQ ID NO: 4815249 - DNA, 14 bp, Homo sapiens
ccacccctcttccc

SEQ ID NO: 4815250 - DNA, 11 bp, Homo sapiens
ccacccctgtg

SEQ ID NO: 4815251 - DNA, 13 bp, Homo sapiens
ccacccctgtgcg

SEQ ID NO: 4815252 - DNA, 15 bp, Homo sapiens
ccacccgccccagag

SEQ ID NO: 4815253 - DNA, 20 bp, Homo sapiens
ccacccgccccagagactgc

SEQ ID NO: 4815254 - DNA, 12 bp, Homo sapiens
ccacccgcccgc

SEQ ID NO: 4815255 - DNA, 19 bp, Homo sapiens
ccacccggatctccaggcc

SEQ ID NO: 4815256 - DNA, 23 bp, Homo sapiens
ccacccggatctccaggcccagc

SEQ ID NO: 4815257 - DNA, 16 bp, Homo sapiens
ccacccgggagcagtg

SEQ ID NO: 4815258 - DNA, 18 bp, Homo sapiens
ccaccctcccctctcctg

SEQ ID NO: 4815259 - DNA, 15 bp, Homo sapiens
ccaccctcgctgcca

SEQ ID NO: 4815260 - DNA, 21 bp, Homo sapiens
ccaccctctgctgcacagtag

SEQ ID NO: 4815261 - DNA, 13 bp, Homo sapiens
ccaccctgaggag

SEQ ID NO: 4815262 - DNA, 12 bp, Homo sapiens
ccaccctgccaa

SEQ ID NO: 4815263 - DNA, 16 bp, Homo sapiens
ccaccctgccctggcc

SEQ ID NO: 4815264 - DNA, 15 bp, Homo sapiens
ccaccctgggcctcc

SEQ ID NO: 4815265 - DNA, 15 bp, Homo sapiens
ccaccgcagaaggaa

SEQ ID NO: 4815266 - DNA, 21 bp, Homo sapiens
ccacctaaagggaagccctga

SEQ ID NO: 4815267 - DNA, 15 bp, Homo sapiens
ccacctcccccaaac

SEQ ID NO: 4815268 - DNA, 14 bp, Homo sapiens
ccacctccctgcag

SEQ ID NO: 4815269 - DNA, 16 bp, Homo sapiens
ccacctccctgcagct

SEQ ID NO: 4815270 - DNA, 17 bp, Homo sapiens
ccacctcggacaccatc

SEQ ID NO: 4815271 - DNA, 13 bp, Homo sapiens
ccacctctttctt

SEQ ID NO: 4815272 - DNA, 18 bp, Homo sapiens
ccacctctttcttcaatt

SEQ ID NO: 4815273 - DNA, 20 bp, Homo sapiens
ccacctgaagtgatgatgga

SEQ ID NO: 4815274 - DNA, 12 bp, Homo sapiens
ccacctgccagg

SEQ ID NO: 4815275 - DNA, 21 bp, Homo sapiens
ccacctgccaggctgcaggga

SEQ ID NO: 4815276 - DNA, 22 bp, Homo sapiens
ccacctgcccagttagcccggc

SEQ ID NO: 4815277 - DNA, 20 bp, Homo sapiens
ccacctgcctgttgggccag

SEQ ID NO: 4815278 - DNA, 12 bp, Homo sapiens
ccacctggaaag

SEQ ID NO: 4815279 - DNA, 18 bp, Homo sapiens
ccacctggaaagccaggt

SEQ ID NO: 4815280 - DNA, 19 bp, Homo sapiens
ccacctggatggatctgct

SEQ ID NO: 4815281 - DNA, 13 bp, Homo sapiens
ccacctggtggcc

SEQ ID NO: 4815282 - DNA, 16 bp, Homo sapiens
ccacctggtggccctg

SEQ ID NO: 4815283 - DNA, 17 bp, Homo sapiens
ccacctggtggccctgc

SEQ ID NO: 4815284 - DNA, 23 bp, Homo sapiens
ccacctgttactacttctttttg

SEQ ID NO: 4815285 - DNA, 20 bp, Homo sapiens
ccaccttaaattaaacaatt

SEQ ID NO: 4815286 - DNA, 15 bp, Homo sapiens
caggccggccagcct

SEQ ID NO: 4815287 - DNA, 19 bp, Homo sapiens
caggcctaatctcatacct

SEQ ID NO: 4815288 - DNA, 15 bp, Homo sapiens
caggcctcacctggc

SEQ ID NO: 4815289 - DNA, 19 bp, Homo sapiens
caggcctcacctggcttcc

SEQ ID NO: 4815290 - DNA, 23 bp, Homo sapiens
caggcctcacctggcttcccagg

SEQ ID NO: 4815291 - DNA, 13 bp, Homo sapiens
caggcctcaggga

SEQ ID NO: 4815292 - DNA, 14 bp, Homo sapiens
caggcctcccaagc

SEQ ID NO: 4815293 - DNA, 18 bp, Homo sapiens
caggcctcccgcatgctg

SEQ ID NO: 4815294 - DNA, 12 bp, Homo sapiens
caggcctcctac

SEQ ID NO: 4815295 - DNA, 11 bp, Homo sapiens
caggcctggcc

SEQ ID NO: 4815296 - DNA, 17 bp, Homo sapiens
caggcctggcccagcca

SEQ ID NO: 4815297 - DNA, 18 bp, Homo sapiens
caggcctggcccagccag

SEQ ID NO: 4815298 - DNA, 21 bp, Homo sapiens
caggcctggcccagccagcag

SEQ ID NO: 4815299 - DNA, 22 bp, Homo sapiens
caggcctggcccagccagcagg

SEQ ID NO: 4815300 - DNA, 18 bp, Homo sapiens
caggccttcctcctctca

SEQ ID NO: 4815301 - DNA, 20 bp, Homo sapiens
caggcgccgcctcgcccccg

SEQ ID NO: 4815302 - DNA, 21 bp, Homo sapiens
caggcgcgcaccgcccaaccc

SEQ ID NO: 4815303 - DNA, 22 bp, Homo sapiens
caggcggaggggcttggagcag

SEQ ID NO: 4815304 - DNA, 18 bp, Homo sapiens
caggcggtcactgcccac

SEQ ID NO: 4815305 - DNA, 14 bp, Homo sapiens
caggctacagttga

SEQ ID NO: 4815306 - DNA, 17 bp, Homo sapiens
caggctacagttgatat

SEQ ID NO: 4815307 - DNA, 18 bp, Homo sapiens
caggctagtccggaccca

SEQ ID NO: 4815308 - DNA, 23 bp, Homo sapiens
caggctagtccggacccacctca

SEQ ID NO: 4815309 - DNA, 14 bp, Homo sapiens
caggctcaggctgc

SEQ ID NO: 4815310 - DNA, 17 bp, Homo sapiens
caggctcaggctgccca

SEQ ID NO: 4815311 - DNA, 15 bp, Homo sapiens
caggctcccactgcc

SEQ ID NO: 4815312 - DNA, 22 bp, Homo sapiens
caggctcccactgcccctgcac

SEQ ID NO: 4815313 - DNA, 20 bp, Homo sapiens
caggctcgggctccccagcc

SEQ ID NO: 4815314 - DNA, 23 bp, Homo sapiens
caggctctcaggccagctgcttg

SEQ ID NO: 4815315 - DNA, 16 bp, Homo sapiens
caggctctgaatctct

SEQ ID NO: 4815316 - DNA, 23 bp, Homo sapiens
caggctgagacacagcccagaga

SEQ ID NO: 4815317 - DNA, 16 bp, Homo sapiens
caggctgcgcctgccc

SEQ ID NO: 4815318 - DNA, 23 bp, Homo sapiens
caggctgcgcctgcccgcccgcc

SEQ ID NO: 4815319 - DNA, 19 bp, Homo sapiens
caggctgttctgcactgaa

SEQ ID NO: 4815320 - DNA, 22 bp, Homo sapiens
caggctgttctgcactgaaaag

SEQ ID NO: 4815321 - DNA, 16 bp, Homo sapiens
caggcttcgtttgcct

SEQ ID NO: 4815322 - DNA, 20 bp, Homo sapiens
cagggacactacaaacatgg

SEQ ID NO: 4815323 - DNA, 15 bp, Homo sapiens
cagggaggaggcaga

SEQ ID NO: 4815324 - DNA, 19 bp, Homo sapiens
cagggaggtcaggccctgg

SEQ ID NO: 4815325 - DNA, 23 bp, Homo sapiens
cagggaggtcaggccctggaact

SEQ ID NO: 4815326 - DNA, 21 bp, Homo sapiens
cagggatgggggatgggccag

SEQ ID NO: 4815327 - DNA, 22 bp, Homo sapiens
cagggcaaatgacatgcactga

SEQ ID NO: 4815328 - DNA, 23 bp, Homo sapiens
cagggcaaatgacatgcactgac

SEQ ID NO: 4815329 - DNA, 13 bp, Homo sapiens
cagggcccagagg

SEQ ID NO: 4815330 - DNA, 18 bp, Homo sapiens
cagggcccccacaggagc

SEQ ID NO: 4815331 - DNA, 16 bp, Homo sapiens
cagggcccccacaggg

SEQ ID NO: 4815332 - DNA, 20 bp, Homo sapiens
cagggcccccacaggggatg

SEQ ID NO: 4815333 - DNA, 17 bp, Homo sapiens
cagggcccccatgcagg

SEQ ID NO: 4815334 - DNA, 12 bp, Homo sapiens
cagggcccgagc

SEQ ID NO: 4815335 - DNA, 11 bp, Homo sapiens
cagggccctga

SEQ ID NO: 4815336 - DNA, 12 bp, Homo sapiens
cagggccctgct

SEQ ID NO: 4815337 - DNA, 13 bp, Homo sapiens
cagggccctgctc

SEQ ID NO: 4815338 - DNA, 17 bp, Homo sapiens
cagggccctgctcaggc

SEQ ID NO: 4815339 - DNA, 20 bp, Homo sapiens
cagggccctgctcaggcctc

SEQ ID NO: 4815340 - DNA, 21 bp, Homo sapiens
cagggccctggggtctctgag

SEQ ID NO: 4815341 - DNA, 23 bp, Homo sapiens
cagggccctggggtctctgagca

SEQ ID NO: 4815342 - DNA, 15 bp, Homo sapiens
cagggccgcagggcg

SEQ ID NO: 4815343 - DNA, 18 bp, Homo sapiens
cagggccgcagggcgctc

SEQ ID NO: 4815344 - DNA, 20 bp, Homo sapiens
cagggccgccgaagggcagc

SEQ ID NO: 4815345 - DNA, 16 bp, Homo sapiens
cagggccgcttctcct

SEQ ID NO: 4815346 - DNA, 22 bp, Homo sapiens
cagggcgctccggcagaggcag

SEQ ID NO: 4815347 - DNA, 23 bp, Homo sapiens
cagggcgctccggcagaggcagg

SEQ ID NO: 4815348 - DNA, 14 bp, Homo sapiens
cagggcgggccagg

SEQ ID NO: 4815349 - DNA, 12 bp, Homo sapiens
caggggaggctg

SEQ ID NO: 4815350 - DNA, 16 bp, Homo sapiens
caggggaggctgagac

SEQ ID NO: 4815351 - DNA, 17 bp, Homo sapiens
caggggcactgtgttct

SEQ ID NO: 4815352 - DNA, 21 bp, Homo sapiens
caggggcctcaggtcctactg

SEQ ID NO: 4815353 - DNA, 17 bp, Homo sapiens
caggggctgcagccccc

SEQ ID NO: 4815354 - DNA, 18 bp, Homo sapiens
caggggctgcagccccct

SEQ ID NO: 4815355 - DNA, 14 bp, Homo sapiens
caggggctgcatcc

SEQ ID NO: 4815356 - DNA, 15 bp, Homo sapiens
caggggctggggact

SEQ ID NO: 4815357 - DNA, 16 bp, Homo sapiens
caggggctggggactt

SEQ ID NO: 4815358 - DNA, 18 bp, Homo sapiens
caggggcttctccccctc

SEQ ID NO: 4815359 - DNA, 21 bp, Homo sapiens
caggggcttctccccctcagc

SEQ ID NO: 4815360 - DNA, 23 bp, Homo sapiens
caggggcttctccccctcagctc

SEQ ID NO: 4815361 - DNA, 13 bp, Homo sapiens
caggggggttggg

SEQ ID NO: 4815362 - DNA, 21 bp, Homo sapiens
caggggggttgggttccagac

SEQ ID NO: 4815363 - DNA, 19 bp, Homo sapiens
cagggtcctgggggctgct

SEQ ID NO: 4815364 - DNA, 11 bp, Homo sapiens
cagggtgcagg

SEQ ID NO: 4815365 - DNA, 23 bp, Homo sapiens
cagggtgcaggcgcgcaccgccc

SEQ ID NO: 4815366 - DNA, 14 bp, Homo sapiens
cagggtggcaccca

SEQ ID NO: 4815367 - DNA, 22 bp, Homo sapiens
cagggtggcacccaccactctc

SEQ ID NO: 4815368 - DNA, 13 bp, Homo sapiens
cagggttccagac

SEQ ID NO: 4815369 - DNA, 14 bp, Homo sapiens
cagggttccagaca

SEQ ID NO: 4815370 - DNA, 15 bp, Homo sapiens
cagggttccagacag

SEQ ID NO: 4815371 - DNA, 17 bp, Homo sapiens
cagggttccagacaggg

SEQ ID NO: 4815372 - DNA, 21 bp, Homo sapiens
cagggttccagacagggtggg

SEQ ID NO: 4815373 - DNA, 23 bp, Homo sapiens
caggtaaactgatgctttcagat

SEQ ID NO: 4815374 - DNA, 13 bp, Homo sapiens
caggtcagagccc

SEQ ID NO: 4815375 - DNA, 14 bp, Homo sapiens
caggtcagagccca

SEQ ID NO: 4815376 - DNA, 15 bp, Homo sapiens
caggtcagagcccag

SEQ ID NO: 4815377 - DNA, 17 bp, Homo sapiens
caggtcagagcccagga

SEQ ID NO: 4815378 - DNA, 17 bp, Homo sapiens
caggtgaaatccacacc

SEQ ID NO: 4815379 - DNA, 15 bp, Homo sapiens
caggtgaccagaatg

SEQ ID NO: 4815380 - DNA, 17 bp, Homo sapiens
caggtgaccagaatgag

SEQ ID NO: 4815381 - DNA, 19 bp, Homo sapiens
caggtggcatttgcaggtg

SEQ ID NO: 4815382 - DNA, 13 bp, Homo sapiens
caggtgggaaagc

SEQ ID NO: 4815383 - DNA, 15 bp, Homo sapiens
caggtgtcctgactg

SEQ ID NO: 4815384 - DNA, 19 bp, Homo sapiens
caggtgtcctgactgtcct

SEQ ID NO: 4815385 - DNA, 16 bp, Homo sapiens
caggttccatccacca

SEQ ID NO: 4815386 - DNA, 19 bp, Homo sapiens
caggttctctcctgtgagc

SEQ ID NO: 4815387 - DNA, 21 bp, Homo sapiens
caggtttaagtagatttcatg

SEQ ID NO: 4815388 - DNA, 16 bp, Homo sapiens
caggttttcctgaaga

SEQ ID NO: 4815389 - DNA, 21 bp, Homo sapiens
cagtaagataggttctgcttt

SEQ ID NO: 4815390 - DNA, 13 bp, Homo sapiens
cagtacaattctt

SEQ ID NO: 4815391 - DNA, 16 bp, Homo sapiens
cagtacatcttgtgca

SEQ ID NO: 4815392 - DNA, 13 bp, Homo sapiens
cagtaccatccca

SEQ ID NO: 4815393 - DNA, 17 bp, Homo sapiens
cagtagtgttgggtgga

SEQ ID NO: 4815394 - DNA, 19 bp, Homo sapiens
cagtagtgttgggtggagg

SEQ ID NO: 4815395 - DNA, 14 bp, Homo sapiens
cagtatattttatt

SEQ ID NO: 4815396 - DNA, 18 bp, Homo sapiens
cagtatattttatttcaa

SEQ ID NO: 4815397 - DNA, 15 bp, Homo sapiens
cagtatcctggattc

SEQ ID NO: 4815398 - DNA, 14 bp, Homo sapiens
cagtatcttaaaat

SEQ ID NO: 4815399 - DNA, 15 bp, Homo sapiens
cagtatcttaaaatt

SEQ ID NO: 4815400 - DNA, 12 bp, Homo sapiens
cagtatcttgaa

SEQ ID NO: 4815401 - DNA, 18 bp, Homo sapiens
cagtatcttgaagacttt

SEQ ID NO: 4815402 - DNA, 21 bp, Homo sapiens
cagtatcttgaagacttttct

SEQ ID NO: 4815403 - DNA, 20 bp, Homo sapiens
cagtattaacatcaaagact

SEQ ID NO: 4815404 - DNA, 14 bp, Homo sapiens
cagtattatttagt

SEQ ID NO: 4815405 - DNA, 17 bp, Homo sapiens
cagtattatttagtaaa

SEQ ID NO: 4815406 - DNA, 17 bp, Homo sapiens
cagtattctgtagccaa

SEQ ID NO: 4815407 - DNA, 19 bp, Homo sapiens
cagtattctgtagccaact

SEQ ID NO: 4815408 - DNA, 21 bp, Homo sapiens
cagtattgacgacctacatct

SEQ ID NO: 4815409 - DNA, 22 bp, Homo sapiens
cagtattgacgacctacatctg

SEQ ID NO: 4815410 - DNA, 17 bp, Homo sapiens
cagtattgagacactgt

SEQ ID NO: 4815411 - DNA, 21 bp, Homo sapiens
cagtattgagacactgtcaag

SEQ ID NO: 4815412 - DNA, 23 bp, Homo sapiens
cagtattgttcttgtaaaactgt

SEQ ID NO: 4815413 - DNA, 21 bp, Homo sapiens
cagtcaagacggatccacagt

SEQ ID NO: 4815414 - DNA, 21 bp, Homo sapiens
cagtcagaagatctttcttaa

SEQ ID NO: 4815415 - DNA, 14 bp, Homo sapiens
cagtcagactgaaa

SEQ ID NO: 4815416 - DNA, 13 bp, Homo sapiens
cagtcagcacaga

SEQ ID NO: 4815417 - DNA, 15 bp, Homo sapiens
cagtcagccagcttg

SEQ ID NO: 4815418 - DNA, 21 bp, Homo sapiens
cagtcagccagcttggtggtt

SEQ ID NO: 4815419 - DNA, 16 bp, Homo sapiens
cagtcagcggagagga

SEQ ID NO: 4815420 - DNA, 18 bp, Homo sapiens
cagtcagcggagaggacc

SEQ ID NO: 4815421 - DNA, 22 bp, Homo sapiens
cagtcatggctgtcccctgcaa

SEQ ID NO: 4815422 - DNA, 21 bp, Homo sapiens
cagtccacccccattgtgaat

SEQ ID NO: 4815423 - DNA, 13 bp, Homo sapiens
cagtcccacagcc

SEQ ID NO: 4815424 - DNA, 16 bp, Homo sapiens
cagtcccacagcccct

SEQ ID NO: 4815425 - DNA, 13 bp, Homo sapiens
cagtccctccaca

SEQ ID NO: 4815426 - DNA, 16 bp, Homo sapiens
cagtccctccctcctg

SEQ ID NO: 4815427 - DNA, 17 bp, Homo sapiens
cagtccctccctcctgg

SEQ ID NO: 4815428 - DNA, 19 bp, Homo sapiens
cagtccctccctcctggct

SEQ ID NO: 4815429 - DNA, 20 bp, Homo sapiens
cagtccgccccgtgctcctc

SEQ ID NO: 4815430 - DNA, 14 bp, Homo sapiens
cagtccggtgcctt

SEQ ID NO: 4815431 - DNA, 19 bp, Homo sapiens
cagtccggtgccttccacc

SEQ ID NO: 4815432 - DNA, 15 bp, Homo sapiens
cagtctatgctgtgt

SEQ ID NO: 4815433 - DNA, 22 bp, Homo sapiens
cagtctgtggagcgtccttgtc

SEQ ID NO: 4815434 - DNA, 20 bp, Homo sapiens
cagtcttgagtgggccccct

SEQ ID NO: 4815435 - DNA, 13 bp, Homo sapiens
cagtgaacagctt

SEQ ID NO: 4815436 - DNA, 14 bp, Homo sapiens
cagtgaagaaagcc

SEQ ID NO: 4815437 - DNA, 22 bp, Homo sapiens
cagtgaagcccaggaggacctg

SEQ ID NO: 4815438 - DNA, 12 bp, Homo sapiens
cagtgaccaagg

SEQ ID NO: 4815439 - DNA, 17 bp, Homo sapiens
cagtgagagcagggctg

SEQ ID NO: 4815440 - DNA, 18 bp, Homo sapiens
cagtgagtcagaggcaga

SEQ ID NO: 4815441 - DNA, 17 bp, Homo sapiens
cagtgcaatctgtccag

SEQ ID NO: 4815442 - DNA, 15 bp, Homo sapiens
cagtgcagggacagc

SEQ ID NO: 4815443 - DNA, 16 bp, Homo sapiens
cagtgcagtagtgcca

SEQ ID NO: 4815444 - DNA, 23 bp, Homo sapiens
cagtgcagtagtgccaaaaggcc

SEQ ID NO: 4815445 - DNA, 16 bp, Homo sapiens
cagtgcatgctgtccc

SEQ ID NO: 4815446 - DNA, 17 bp, Homo sapiens
cagtgcatgctgtccct

SEQ ID NO: 4815447 - DNA, 14 bp, Homo sapiens
cagtgcttagcaaa

SEQ ID NO: 4815448 - DNA, 18 bp, Homo sapiens
cagtggaagagctgctgt

SEQ ID NO: 4815449 - DNA, 19 bp, Homo sapiens
cagtggaagagctgctgta

SEQ ID NO: 4815450 - DNA, 22 bp, Homo sapiens
cagtggaagagctgctgtattt

SEQ ID NO: 4815451 - DNA, 12 bp, Homo sapiens
cagtggagaggg

SEQ ID NO: 4815452 - DNA, 17 bp, Homo sapiens
cagtggagaggggactt

SEQ ID NO: 4815453 - DNA, 14 bp, Homo sapiens
cagtggcagtattg

SEQ ID NO: 4815454 - DNA, 24 bp, Homo sapiens
cagtggccgggctggggaggcctg

SEQ ID NO: 4815455 - DNA, 22 bp, Homo sapiens
cagtgggaactctgacaagggc

SEQ ID NO: 4815456 - DNA, 22 bp, Homo sapiens
cagtgggatcttacccacttcc

SEQ ID NO: 4815457 - DNA, 14 bp, Homo sapiens
cagtggggcccatg

SEQ ID NO: 4815458 - DNA, 22 bp, Homo sapiens
cagtggggcccatggccccagc

SEQ ID NO: 4815459 - DNA, 23 bp, Homo sapiens
cagtggggcccatggccccagct

SEQ ID NO: 4815460 - DNA, 22 bp, Homo sapiens
cagtggtccagggtccagccct

SEQ ID NO: 4815461 - DNA, 15 bp, Homo sapiens
cagtggtggaggtgg

SEQ ID NO: 4815462 - DNA, 20 bp, Homo sapiens
cagtggttcgggggaaatag

SEQ ID NO: 4815463 - DNA, 19 bp, Homo sapiens
cagtgtatttaatgtttgt

SEQ ID NO: 4815464 - DNA, 16 bp, Homo sapiens
cagtgtcattttctgt

SEQ ID NO: 4815465 - DNA, 18 bp, Homo sapiens
cagtgtcattttctgtta

SEQ ID NO: 4815466 - DNA, 19 bp, Homo sapiens
cagtgtcctgtgctttctg

SEQ ID NO: 4815467 - DNA, 12 bp, Homo sapiens
cagtgtgactga

SEQ ID NO: 4815468 - DNA, 19 bp, Homo sapiens
cagtgtggatgtaaatttt

SEQ ID NO: 4815469 - DNA, 11 bp, Homo sapiens
cagtgtggctt

SEQ ID NO: 4815470 - DNA, 21 bp, Homo sapiens
catcaacaaaagggagaacat

SEQ ID NO: 4815471 - DNA, 16 bp, Homo sapiens
catcaacaaagaaata

SEQ ID NO: 4815472 - DNA, 20 bp, Homo sapiens
catcaagattaattaaaatt

SEQ ID NO: 4815473 - DNA, 15 bp, Homo sapiens
catcaagtctccacg

SEQ ID NO: 4815474 - DNA, 16 bp, Homo sapiens
catcaatcattgtaca

SEQ ID NO: 4815475 - DNA, 19 bp, Homo sapiens
catcaccgattcttccttg

SEQ ID NO: 4815476 - DNA, 21 bp, Homo sapiens
catcactatccatgcaccaaa

SEQ ID NO: 4815477 - DNA, 22 bp, Homo sapiens
catcactatccatgcaccaaac

SEQ ID NO: 4815478 - DNA, 19 bp, Homo sapiens
catcactgaaatccctcta

SEQ ID NO: 4815479 - DNA, 13 bp, Homo sapiens
catcactgtgtct

SEQ ID NO: 4815480 - DNA, 15 bp, Homo sapiens
catcactgtgtctca

SEQ ID NO: 4815481 - DNA, 22 bp, Homo sapiens
catcagagtgtatttttgtaat

SEQ ID NO: 4815482 - DNA, 17 bp, Homo sapiens
catcagctttataataa

SEQ ID NO: 4815483 - DNA, 14 bp, Homo sapiens
catcagtgtcattt

SEQ ID NO: 4815484 - DNA, 21 bp, Homo sapiens
catcataaacaaagagtagaa

SEQ ID NO: 4815485 - DNA, 16 bp, Homo sapiens
catccaaaagtgacca

SEQ ID NO: 4815486 - DNA, 18 bp, Homo sapiens
catccaactggaaggctt

SEQ ID NO: 4815487 - DNA, 23 bp, Homo sapiens
catccaactggaaggctttattc

SEQ ID NO: 4815488 - DNA, 15 bp, Homo sapiens
catccacacacagca

SEQ ID NO: 4815489 - DNA, 20 bp, Homo sapiens
catccacacacagcagctcc

SEQ ID NO: 4815490 - DNA, 22 bp, Homo sapiens
catccacacacagcagctccaa

SEQ ID NO: 4815491 - DNA, 13 bp, Homo sapiens
catccacatgcac

SEQ ID NO: 4815492 - DNA, 14 bp, Homo sapiens
catccacatgcaca

SEQ ID NO: 4815493 - DNA, 14 bp, Homo sapiens
catccaccctgagg

SEQ ID NO: 4815494 - DNA, 14 bp, Homo sapiens
catccagtttgttc

SEQ ID NO: 4815495 - DNA, 18 bp, Homo sapiens
catccatagacacagtat

SEQ ID NO: 4815496 - DNA, 17 bp, Homo sapiens
catccatccctggtgaa

SEQ ID NO: 4815497 - DNA, 23 bp, Homo sapiens
catccatccctggtgaaagagta

SEQ ID NO: 4815498 - DNA, 20 bp, Homo sapiens
catccattaatgtagataaa

SEQ ID NO: 4815499 - DNA, 20 bp, Homo sapiens
catcccaaacccttcagtgc

SEQ ID NO: 4815500 - DNA, 22 bp, Homo sapiens
catcccactgatatcacgggcc

SEQ ID NO: 4815501 - DNA, 14 bp, Homo sapiens
catccccagtgcca

SEQ ID NO: 4815502 - DNA, 11 bp, Homo sapiens
catccctgggc

SEQ ID NO: 4815503 - DNA, 13 bp, Homo sapiens
catccctgggccc

SEQ ID NO: 4815504 - DNA, 17 bp, Homo sapiens
catccctgggcccctcc

SEQ ID NO: 4815505 - DNA, 22 bp, Homo sapiens
catccctgggcccctccacgcc

SEQ ID NO: 4815506 - DNA, 23 bp, Homo sapiens
catccctggtgaaagagtaaaac

SEQ ID NO: 4815507 - DNA, 17 bp, Homo sapiens
catcccttggcccctct

SEQ ID NO: 4815508 - DNA, 13 bp, Homo sapiens
catccctttccag

SEQ ID NO: 4815509 - DNA, 18 bp, Homo sapiens
catcctatcgatctggaa

SEQ ID NO: 4815510 - DNA, 17 bp, Homo sapiens
catcctcacacagattc

SEQ ID NO: 4815511 - DNA, 11 bp, Homo sapiens
catcctcagca

SEQ ID NO: 4815512 - DNA, 11 bp, Homo sapiens
catcctcagcc

SEQ ID NO: 4815513 - DNA, 12 bp, Homo sapiens
catcctcagccc

SEQ ID NO: 4815514 - DNA, 21 bp, Homo sapiens
catcctcagccccagggccct

SEQ ID NO: 4815515 - DNA, 22 bp, Homo sapiens
catcctcagccccagggccctg

SEQ ID NO: 4815516 - DNA, 19 bp, Homo sapiens
catcctcctcagatcttct

SEQ ID NO: 4815517 - DNA, 11 bp, Homo sapiens
catcctcttat

SEQ ID NO: 4815518 - DNA, 21 bp, Homo sapiens
catcctcttatatgtgcccct

SEQ ID NO: 4815519 - DNA, 16 bp, Homo sapiens
catcctgccttcatgg

SEQ ID NO: 4815520 - DNA, 22 bp, Homo sapiens
catcctgccttcatggaactca

SEQ ID NO: 4815521 - DNA, 15 bp, Homo sapiens
catcctggaaatttg

SEQ ID NO: 4815522 - DNA, 16 bp, Homo sapiens
catcctggaaatttgt

SEQ ID NO: 4815523 - DNA, 13 bp, Homo sapiens
catccttcccgca

SEQ ID NO: 4815524 - DNA, 14 bp, Homo sapiens
catccttcccgcag

SEQ ID NO: 4815525 - DNA, 18 bp, Homo sapiens
catccttcccgcagcacc

SEQ ID NO: 4815526 - DNA, 19 bp, Homo sapiens
catccttgcacttctgtta

SEQ ID NO: 4815527 - DNA, 15 bp, Homo sapiens
catccttttgcttca

SEQ ID NO: 4815528 - DNA, 17 bp, Homo sapiens
catccttttgcttcatc

SEQ ID NO: 4815529 - DNA, 23 bp, Homo sapiens
catccttttgcttcatctggagt

SEQ ID NO: 4815530 - DNA, 18 bp, Homo sapiens
catccttttttaaaaaaa

SEQ ID NO: 4815531 - DNA, 12 bp, Homo sapiens
catcgatgcgag

SEQ ID NO: 4815532 - DNA, 12 bp, Homo sapiens
catcgccttctg

SEQ ID NO: 4815533 - DNA, 14 bp, Homo sapiens
catcgccttctggc

SEQ ID NO: 4815534 - DNA, 17 bp, Homo sapiens
catcggaggctgggccc

SEQ ID NO: 4815535 - DNA, 22 bp, Homo sapiens
catcggaggctgggcccctggg

SEQ ID NO: 4815536 - DNA, 20 bp, Homo sapiens
catcggggctaacagagact

SEQ ID NO: 4815537 - DNA, 13 bp, Homo sapiens
catctaagacatt

SEQ ID NO: 4815538 - DNA, 17 bp, Homo sapiens
catctcaaacactgctt

SEQ ID NO: 4815539 - DNA, 19 bp, Homo sapiens
catctcagctcactgcaac

SEQ ID NO: 4815540 - DNA, 12 bp, Homo sapiens
catctcatcatg

SEQ ID NO: 4815541 - DNA, 14 bp, Homo sapiens
catctctcctgctc

SEQ ID NO: 4815542 - DNA, 13 bp, Homo sapiens
catctctctgggg

SEQ ID NO: 4815543 - DNA, 20 bp, Homo sapiens
catctcttgtaccagcccag

SEQ ID NO: 4815544 - DNA, 23 bp, Homo sapiens
catctcttgtaccagcccaggca

SEQ ID NO: 4815545 - DNA, 16 bp, Homo sapiens
catctgaggagtccaa

SEQ ID NO: 4815546 - DNA, 14 bp, Homo sapiens
catctgatatcagg

SEQ ID NO: 4815547 - DNA, 21 bp, Homo sapiens
catctggcctatgaccctgtg

SEQ ID NO: 4815548 - DNA, 22 bp, Homo sapiens
catctggcctatgaccctgtgc

SEQ ID NO: 4815549 - DNA, 13 bp, Homo sapiens
catctggcctggc

SEQ ID NO: 4815550 - DNA, 15 bp, Homo sapiens
catctggcctggcct

SEQ ID NO: 4815551 - DNA, 17 bp, Homo sapiens
catctggcctgggggct

SEQ ID NO: 4815552 - DNA, 19 bp, Homo sapiens
catctgtaaaaccaggctg

SEQ ID NO: 4815553 - DNA, 16 bp, Homo sapiens
catctgtaaaatagtc

SEQ ID NO: 4815554 - DNA, 18 bp, Homo sapiens
catctgtatatcagctct

SEQ ID NO: 4815555 - DNA, 19 bp, Homo sapiens
catctgtatatcagctcta

SEQ ID NO: 4815556 - DNA, 11 bp, Homo sapiens
catctgtcagc

SEQ ID NO: 4815557 - DNA, 17 bp, Homo sapiens
catctgtcagcttccca

SEQ ID NO: 4815558 - DNA, 15 bp, Homo sapiens
catctgtggcctggg

SEQ ID NO: 4815559 - DNA, 13 bp, Homo sapiens
catcttaaaagct

SEQ ID NO: 4815560 - DNA, 16 bp, Homo sapiens
catcttgaattgtaag

SEQ ID NO: 4815561 - DNA, 12 bp, Homo sapiens
catcttgcctca

SEQ ID NO: 4815562 - DNA, 20 bp, Homo sapiens
catcttgtgcatgcaaaaat

SEQ ID NO: 4815563 - DNA, 17 bp, Homo sapiens
catctttcatcaatcat

SEQ ID NO: 4815564 - DNA, 21 bp, Homo sapiens
catctttcatcaatcattgta

SEQ ID NO: 4815565 - DNA, 22 bp, Homo sapiens
catctttcatcaatcattgtac

SEQ ID NO: 4815566 - DNA, 20 bp, Homo sapiens
catgaaggtctacctgaaaa

SEQ ID NO: 4815567 - DNA, 18 bp, Homo sapiens
catgaattagaagaaaat

SEQ ID NO: 4815568 - DNA, 15 bp, Homo sapiens
catgacactgacctt

SEQ ID NO: 4815569 - DNA, 13 bp, Homo sapiens
catgacagtggtt

SEQ ID NO: 4815570 - DNA, 22 bp, Homo sapiens
catgacagtggttatatttcaa

SEQ ID NO: 4815571 - DNA, 20 bp, Homo sapiens
catgacatccacatgcacat

SEQ ID NO: 4815572 - DNA, 15 bp, Homo sapiens
catgaccactgggcc

SEQ ID NO: 4815573 - DNA, 16 bp, Homo sapiens
catgaccttacatagc

SEQ ID NO: 4815574 - DNA, 17 bp, Homo sapiens
catgactctttattgtc

SEQ ID NO: 4815575 - DNA, 19 bp, Homo sapiens
catgactctttattgtctg

SEQ ID NO: 4815576 - DNA, 15 bp, Homo sapiens
catgactttcagatt

SEQ ID NO: 4815577 - DNA, 20 bp, Homo sapiens
catgactttcagattgtatc

SEQ ID NO: 4815578 - DNA, 20 bp, Homo sapiens
catgagaatgtcatttgcta

SEQ ID NO: 4815579 - DNA, 22 bp, Homo sapiens
catgagaatgtcatttgctaat

SEQ ID NO: 4815580 - DNA, 17 bp, Homo sapiens
catgagagtagggccct

SEQ ID NO: 4815581 - DNA, 19 bp, Homo sapiens
catgagagtagggccctga

SEQ ID NO: 4815582 - DNA, 16 bp, Homo sapiens
catgagcgtccaggtg

SEQ ID NO: 4815583 - DNA, 16 bp, Homo sapiens
catgaggaacaaggca

SEQ ID NO: 4815584 - DNA, 17 bp, Homo sapiens
catgaggaacaaggcaa

SEQ ID NO: 4815585 - DNA, 20 bp, Homo sapiens
catgaggaacaaggcaaggc

SEQ ID NO: 4815586 - DNA, 21 bp, Homo sapiens
catgaggaacaaggcaaggct

SEQ ID NO: 4815587 - DNA, 12 bp, Homo sapiens
catgagttctgc

SEQ ID NO: 4815588 - DNA, 19 bp, Homo sapiens
catgagttctgcacataca

SEQ ID NO: 4815589 - DNA, 15 bp, Homo sapiens
catgatataacttta

SEQ ID NO: 4815590 - DNA, 19 bp, Homo sapiens
catgatataactttagaaa

SEQ ID NO: 4815591 - DNA, 16 bp, Homo sapiens
catgatcaaaatgcat

SEQ ID NO: 4815592 - DNA, 12 bp, Homo sapiens
catgatctgtat

SEQ ID NO: 4815593 - DNA, 17 bp, Homo sapiens
catgatgctagttctta

SEQ ID NO: 4815594 - DNA, 15 bp, Homo sapiens
catgattagtgcaat

SEQ ID NO: 4815595 - DNA, 16 bp, Homo sapiens
cagtgtggcttaaaca

SEQ ID NO: 4815596 - DNA, 18 bp, Homo sapiens
cagtgtggcttaaacatt

SEQ ID NO: 4815597 - DNA, 20 bp, Homo sapiens
cagtgtggcttaaacatttt

SEQ ID NO: 4815598 - DNA, 15 bp, Homo sapiens
cagtgtgtacttctt

SEQ ID NO: 4815599 - DNA, 16 bp, Homo sapiens
cagtgttcaaattctg

SEQ ID NO: 4815600 - DNA, 23 bp, Homo sapiens
cagtgtttatgtgctattaatat

SEQ ID NO: 4815601 - DNA, 14 bp, Homo sapiens
cagtgtttccagtg

SEQ ID NO: 4815602 - DNA, 19 bp, Homo sapiens
cagtgtttccagtgacaca

SEQ ID NO: 4815603 - DNA, 15 bp, Homo sapiens
cagttaatgtgccaa

SEQ ID NO: 4815604 - DNA, 14 bp, Homo sapiens
cagttacttacaca

SEQ ID NO: 4815605 - DNA, 13 bp, Homo sapiens
cagttagcacaga

SEQ ID NO: 4815606 - DNA, 19 bp, Homo sapiens
cagttagcacagaggatgg

SEQ ID NO: 4815607 - DNA, 18 bp, Homo sapiens
cagttagcccggccaagg

SEQ ID NO: 4815608 - DNA, 23 bp, Homo sapiens
cagttcaacctggtggcaccaga

SEQ ID NO: 4815609 - DNA, 18 bp, Homo sapiens
cagttcacaccctgcaag

SEQ ID NO: 4815610 - DNA, 17 bp, Homo sapiens
cagttctacagaaaaac

SEQ ID NO: 4815611 - DNA, 21 bp, Homo sapiens
cagttctcatcttgtaaataa

SEQ ID NO: 4815612 - DNA, 17 bp, Homo sapiens
cagttctgcaaatagaa

SEQ ID NO: 4815613 - DNA, 16 bp, Homo sapiens
cagttcttgcaataag

SEQ ID NO: 4815614 - DNA, 20 bp, Homo sapiens
cagttcttgcaataagatat

SEQ ID NO: 4815615 - DNA, 16 bp, Homo sapiens
cagttcttggtgactg

SEQ ID NO: 4815616 - DNA, 19 bp, Homo sapiens
cagttgatatttaaaagat

SEQ ID NO: 4815617 - DNA, 20 bp, Homo sapiens
cagttgctagcaacaactta

SEQ ID NO: 4815618 - DNA, 17 bp, Homo sapiens
cagttggcctctgcccc

SEQ ID NO: 4815619 - DNA, 18 bp, Homo sapiens
cagttgttagtgtgtctt

SEQ ID NO: 4815620 - DNA, 19 bp, Homo sapiens
cagtttaacagaaaaatga

SEQ ID NO: 4815621 - DNA, 13 bp, Homo sapiens
cagtttcagataa

SEQ ID NO: 4815622 - DNA, 18 bp, Homo sapiens
cagtttcagataaatcat

SEQ ID NO: 4815623 - DNA, 19 bp, Homo sapiens
cagtttcagataaatcatg

SEQ ID NO: 4815624 - DNA, 21 bp, Homo sapiens
cagtttctcttaagctgccca

SEQ ID NO: 4815625 - DNA, 11 bp, Homo sapiens
cagtttgccca

SEQ ID NO: 4815626 - DNA, 12 bp, Homo sapiens
cagtttgtgaag

SEQ ID NO: 4815627 - DNA, 16 bp, Homo sapiens
cagtttgtttacacac

SEQ ID NO: 4815628 - DNA, 9 bp, Homo sapiens
cataaaata

SEQ ID NO: 4815629 - DNA, 20 bp, Homo sapiens
cataaaatatacaaacatgt

SEQ ID NO: 4815630 - DNA, 19 bp, Homo sapiens
cataaacacttctccttaa

SEQ ID NO: 4815631 - DNA, 16 bp, Homo sapiens
cataaaccctccaagg

SEQ ID NO: 4815632 - DNA, 14 bp, Homo sapiens
cataaagtaataac

SEQ ID NO: 4815633 - DNA, 22 bp, Homo sapiens
cataaataaattaaataaaata

SEQ ID NO: 4815634 - DNA, 11 bp, Homo sapiens
cataacacaca

SEQ ID NO: 4815635 - DNA, 21 bp, Homo sapiens
cataacaggcattgcactaaa

SEQ ID NO: 4815636 - DNA, 22 bp, Homo sapiens
cataacaggcattgcactaaaa

SEQ ID NO: 4815637 - DNA, 15 bp, Homo sapiens
cataactagagcacg

SEQ ID NO: 4815638 - DNA, 20 bp, Homo sapiens
cataactagagtatgtgtat

SEQ ID NO: 4815639 - DNA, 14 bp, Homo sapiens
cataacttgtttgt

SEQ ID NO: 4815640 - DNA, 16 bp, Homo sapiens
cataacttgtttgtaa

SEQ ID NO: 4815641 - DNA, 16 bp, Homo sapiens
cataagctttttctct

SEQ ID NO: 4815642 - DNA, 16 bp, Homo sapiens
cataagtaaatgtctt

SEQ ID NO: 4815643 - DNA, 18 bp, Homo sapiens
cataagtaaatgtcttca

SEQ ID NO: 4815644 - DNA, 17 bp, Homo sapiens
cataagttttctctttt

SEQ ID NO: 4815645 - DNA, 20 bp, Homo sapiens
cataatatcttgaagaatat

SEQ ID NO: 4815646 - DNA, 21 bp, Homo sapiens
cataatatcttgaagaatatt

SEQ ID NO: 4815647 - DNA, 22 bp, Homo sapiens
cataatgatactgaattgttat

SEQ ID NO: 4815648 - DNA, 20 bp, Homo sapiens
cataatgttagtagcactga

SEQ ID NO: 4815649 - DNA, 21 bp, Homo sapiens
cataatgttagtagcactgag

SEQ ID NO: 4815650 - DNA, 22 bp, Homo sapiens
cataattagatccattaattta

SEQ ID NO: 4815651 - DNA, 16 bp, Homo sapiens
cataattgccaataat

SEQ ID NO: 4815652 - DNA, 14 bp, Homo sapiens
catacagatggtgt

SEQ ID NO: 4815653 - DNA, 20 bp, Homo sapiens
cataccagttcttgcaataa

SEQ ID NO: 4815654 - DNA, 16 bp, Homo sapiens
cataccccctgcccca

SEQ ID NO: 4815655 - DNA, 22 bp, Homo sapiens
catacctctctctatatataca

SEQ ID NO: 4815656 - DNA, 13 bp, Homo sapiens
catacctctgacc

SEQ ID NO: 4815657 - DNA, 17 bp, Homo sapiens
catacctctgaccaaca

SEQ ID NO: 4815658 - DNA, 17 bp, Homo sapiens
catacgtgcccatttca

SEQ ID NO: 4815659 - DNA, 15 bp, Homo sapiens
catactctccaggat

SEQ ID NO: 4815660 - DNA, 16 bp, Homo sapiens
catactgatgagacaa

SEQ ID NO: 4815661 - DNA, 21 bp, Homo sapiens
catacttgctccttgaataag

SEQ ID NO: 4815662 - DNA, 14 bp, Homo sapiens
catagaaacatgac

SEQ ID NO: 4815663 - DNA, 19 bp, Homo sapiens
catagaaacatgacactga

SEQ ID NO: 4815664 - DNA, 15 bp, Homo sapiens
catagacaaaggcct

SEQ ID NO: 4815665 - DNA, 12 bp, Homo sapiens
catagacacagt

SEQ ID NO: 4815666 - DNA, 22 bp, Homo sapiens
catagacacagtattgacttct

SEQ ID NO: 4815667 - DNA, 13 bp, Homo sapiens
catagagtgagtt

SEQ ID NO: 4815668 - DNA, 18 bp, Homo sapiens
catagataccattttgaa

SEQ ID NO: 4815669 - DNA, 20 bp, Homo sapiens
catagataccattttgaaat

SEQ ID NO: 4815670 - DNA, 17 bp, Homo sapiens
catagattaatggcact

SEQ ID NO: 4815671 - DNA, 14 bp, Homo sapiens
catagattcacctg

SEQ ID NO: 4815672 - DNA, 17 bp, Homo sapiens
catagattcacctgtaa

SEQ ID NO: 4815673 - DNA, 21 bp, Homo sapiens
catagattcacctgtaaaact

SEQ ID NO: 4815674 - DNA, 16 bp, Homo sapiens
catagcataggctggg

SEQ ID NO: 4815675 - DNA, 17 bp, Homo sapiens
catagcataggctgggg

SEQ ID NO: 4815676 - DNA, 18 bp, Homo sapiens
catagccccaggcccgcc

SEQ ID NO: 4815677 - DNA, 17 bp, Homo sapiens
catagcttaagaagtat

SEQ ID NO: 4815678 - DNA, 13 bp, Homo sapiens
cataggcagagcc

SEQ ID NO: 4815679 - DNA, 21 bp, Homo sapiens
cataggcagagcccgcccacc

SEQ ID NO: 4815680 - DNA, 15 bp, Homo sapiens
catagggtttggaag

SEQ ID NO: 4815681 - DNA, 16 bp, Homo sapiens
catagggtttggaaga

SEQ ID NO: 4815682 - DNA, 20 bp, Homo sapiens
catagggtttggaagaaagg

SEQ ID NO: 4815683 - DNA, 14 bp, Homo sapiens
catagtggtatttt

SEQ ID NO: 4815684 - DNA, 17 bp, Homo sapiens
catagtggtattttaac

SEQ ID NO: 4815685 - DNA, 20 bp, Homo sapiens
catagtggtattttaacata

SEQ ID NO: 4815686 - DNA, 19 bp, Homo sapiens
catagtgtgctcggacaca

SEQ ID NO: 4815687 - DNA, 21 bp, Homo sapiens
catagtgtgctcggacacagt

SEQ ID NO: 4815688 - DNA, 13 bp, Homo sapiens
catagttctgcaa

SEQ ID NO: 4815689 - DNA, 15 bp, Homo sapiens
catataaacacagta

SEQ ID NO: 4815690 - DNA, 22 bp, Homo sapiens
catataaatgtttatattgttt

SEQ ID NO: 4815691 - DNA, 18 bp, Homo sapiens
catataaggctaaatgta

SEQ ID NO: 4815692 - DNA, 23 bp, Homo sapiens
catataatttgccagacagagat

SEQ ID NO: 4815693 - DNA, 18 bp, Homo sapiens
catatacattatttctgt

SEQ ID NO: 4815694 - DNA, 22 bp, Homo sapiens
catatacattatttctgtatat

SEQ ID NO: 4815695 - DNA, 18 bp, Homo sapiens
catataggggcaaaaatt

SEQ ID NO: 4815696 - DNA, 15 bp, Homo sapiens
catatataaaacaaa

SEQ ID NO: 4815697 - DNA, 16 bp, Homo sapiens
catatataaattatta

SEQ ID NO: 4815698 - DNA, 19 bp, Homo sapiens
catatataaattattactt

SEQ ID NO: 4815699 - DNA, 22 bp, Homo sapiens
catatatgctttgcagagaact

SEQ ID NO: 4815700 - DNA, 21 bp, Homo sapiens
catatcaagtcccgaggcagc

SEQ ID NO: 4815701 - DNA, 15 bp, Homo sapiens
catatcagctctgca

SEQ ID NO: 4815702 - DNA, 17 bp, Homo sapiens
catatcagctctgcata

SEQ ID NO: 4815703 - DNA, 24 bp, Homo sapiens
catatgaacgcacaacatgcacat

SEQ ID NO: 4815704 - DNA, 13 bp, Homo sapiens
catatgcctgggc

SEQ ID NO: 4815705 - DNA, 20 bp, Homo sapiens
catatggcaacgttcatgtt

SEQ ID NO: 4815706 - DNA, 18 bp, Homo sapiens
catatgtatgtgtgagtg

SEQ ID NO: 4815707 - DNA, 23 bp, Homo sapiens
catattatatcagactgctttga

SEQ ID NO: 4815708 - DNA, 16 bp, Homo sapiens
catattcaaagtatat

SEQ ID NO: 4815709 - DNA, 13 bp, Homo sapiens
catattgactttt

SEQ ID NO: 4815710 - DNA, 18 bp, Homo sapiens
catattgataataaaatt

SEQ ID NO: 4815711 - DNA, 19 bp, Homo sapiens
catattgataataaaattc

SEQ ID NO: 4815712 - DNA, 22 bp, Homo sapiens
catatttaataggataaattaa

SEQ ID NO: 4815713 - DNA, 19 bp, Homo sapiens
catatttggtgatgagact

SEQ ID NO: 4815714 - DNA, 21 bp, Homo sapiens
catatttggtgatgagactta

SEQ ID NO: 4815715 - DNA, 18 bp, Homo sapiens
catcaaacaaatcatttt

SEQ ID NO: 4815716 - DNA, 11 bp, Homo sapiens
catcaaagact

SEQ ID NO: 4815717 - DNA, 19 bp, Homo sapiens
catcaaagactccgagaag

SEQ ID NO: 4815718 - DNA, 15 bp, Homo sapiens
catcaaagtgtttaa

SEQ ID NO: 4815719 - DNA, 15 bp, Homo sapiens
catgatttttgccct

SEQ ID NO: 4815720 - DNA, 16 bp, Homo sapiens
catgatttttgccctg

SEQ ID NO: 4815721 - DNA, 22 bp, Homo sapiens
catgcacacaattagatttctc

SEQ ID NO: 4815722 - DNA, 15 bp, Homo sapiens
catgcacaggaaaag

SEQ ID NO: 4815723 - DNA, 20 bp, Homo sapiens
catgcacattcatcctcaca

SEQ ID NO: 4815724 - DNA, 12 bp, Homo sapiens
catgcaccaaac

SEQ ID NO: 4815725 - DNA, 21 bp, Homo sapiens
catgcagatagtatacacatc

SEQ ID NO: 4815726 - DNA, 17 bp, Homo sapiens
catgcagatctagccag

SEQ ID NO: 4815727 - DNA, 18 bp, Homo sapiens
catgcagatctagccagg

SEQ ID NO: 4815728 - DNA, 20 bp, Homo sapiens
catgcagatctagccaggcc

SEQ ID NO: 4815729 - DNA, 15 bp, Homo sapiens
catgcagggccccca

SEQ ID NO: 4815730 - DNA, 17 bp, Homo sapiens
catgcagggcccccaca

SEQ ID NO: 4815731 - DNA, 20 bp, Homo sapiens
catgcagggcccccacagga

SEQ ID NO: 4815732 - DNA, 21 bp, Homo sapiens
catgcagggcccccacaggag

SEQ ID NO: 4815733 - DNA, 14 bp, Homo sapiens
catgcatgagcacc

SEQ ID NO: 4815734 - DNA, 13 bp, Homo sapiens
catgcatggcctc

SEQ ID NO: 4815735 - DNA, 15 bp, Homo sapiens
catgcatggcctccc

SEQ ID NO: 4815736 - DNA, 16 bp, Homo sapiens
catgcatggcctccca

SEQ ID NO: 4815737 - DNA, 21 bp, Homo sapiens
catgcatggcctcccagccac

SEQ ID NO: 4815738 - DNA, 16 bp, Homo sapiens
catgcatttagcatga

SEQ ID NO: 4815739 - DNA, 13 bp, Homo sapiens
catgcccagcttg

SEQ ID NO: 4815740 - DNA, 20 bp, Homo sapiens
catgcctacattagtgagat

SEQ ID NO: 4815741 - DNA, 18 bp, Homo sapiens
catgcctctctcaggcca

SEQ ID NO: 4815742 - DNA, 19 bp, Homo sapiens
catgcctctctcaggccaa

SEQ ID NO: 4815743 - DNA, 21 bp, Homo sapiens
catgcctctgatatgggactg

SEQ ID NO: 4815744 - DNA, 14 bp, Homo sapiens
catgcgctcctggc

SEQ ID NO: 4815745 - DNA, 17 bp, Homo sapiens
catgcgctcctggcttt

SEQ ID NO: 4815746 - DNA, 19 bp, Homo sapiens
catgctaacctctctgaac

SEQ ID NO: 4815747 - DNA, 9 bp, Homo sapiens
catgctcag

SEQ ID NO: 4815748 - DNA, 15 bp, Homo sapiens
catgctcctcactgc

SEQ ID NO: 4815749 - DNA, 22 bp, Homo sapiens
catgctctgagaagaggagccc

SEQ ID NO: 4815750 - DNA, 18 bp, Homo sapiens
catgctctttcaccctgc

SEQ ID NO: 4815751 - DNA, 13 bp, Homo sapiens
catgctgcctgcc

SEQ ID NO: 4815752 - DNA, 16 bp, Homo sapiens
catgctgcctgcctcc

SEQ ID NO: 4815753 - DNA, 13 bp, Homo sapiens
catgctggccagc

SEQ ID NO: 4815754 - DNA, 15 bp, Homo sapiens
catgctggccagcct

SEQ ID NO: 4815755 - DNA, 17 bp, Homo sapiens
catgctgtccctgtggg

SEQ ID NO: 4815756 - DNA, 18 bp, Homo sapiens
catgctgtccctgtgggc

SEQ ID NO: 4815757 - DNA, 20 bp, Homo sapiens
catgctgtccctgtgggctc

SEQ ID NO: 4815758 - DNA, 13 bp, Homo sapiens
catgcttagagca

SEQ ID NO: 4815759 - DNA, 17 bp, Homo sapiens
catgcttagagcatgtt

SEQ ID NO: 4815760 - DNA, 14 bp, Homo sapiens
catgcttttctcat

SEQ ID NO: 4815761 - DNA, 17 bp, Homo sapiens
catgcttttctcatggt

SEQ ID NO: 4815762 - DNA, 23 bp, Homo sapiens
catggaacagccctgcacgccca

SEQ ID NO: 4815763 - DNA, 20 bp, Homo sapiens
catggaaccatggaggagga

SEQ ID NO: 4815764 - DNA, 13 bp, Homo sapiens
catggatcttgct

SEQ ID NO: 4815765 - DNA, 23 bp, Homo sapiens
catggatttcctttgacctctca

SEQ ID NO: 4815766 - DNA, 18 bp, Homo sapiens
catggcacactgccctct

SEQ ID NO: 4815767 - DNA, 15 bp, Homo sapiens
catggccaatagtca

SEQ ID NO: 4815768 - DNA, 22 bp, Homo sapiens
catggccaatagtcatatgtga

SEQ ID NO: 4815769 - DNA, 12 bp, Homo sapiens
catggccccagc

SEQ ID NO: 4815770 - DNA, 20 bp, Homo sapiens
catggccccagctggctggg

SEQ ID NO: 4815771 - DNA, 15 bp, Homo sapiens
catggccgctgccca

SEQ ID NO: 4815772 - DNA, 17 bp, Homo sapiens
catggcctcccagccac

SEQ ID NO: 4815773 - DNA, 17 bp, Homo sapiens
catggctggatgtgcat

SEQ ID NO: 4815774 - DNA, 21 bp, Homo sapiens
catggctggatgtgcatctgg

SEQ ID NO: 4815775 - DNA, 15 bp, Homo sapiens
catggctgtcccctg

SEQ ID NO: 4815776 - DNA, 21 bp, Homo sapiens
catggctgttatctgtcttta

SEQ ID NO: 4815777 - DNA, 15 bp, Homo sapiens
catgggaatgaatgt

SEQ ID NO: 4815778 - DNA, 17 bp, Homo sapiens
catgggaatgaatgtca

SEQ ID NO: 4815779 - DNA, 13 bp, Homo sapiens
catgggtggaggg

SEQ ID NO: 4815780 - DNA, 20 bp, Homo sapiens
catgggtgttttgatctctg

SEQ ID NO: 4815781 - DNA, 16 bp, Homo sapiens
catggtaccagccctg

SEQ ID NO: 4815782 - DNA, 14 bp, Homo sapiens
catggtcacagacc

SEQ ID NO: 4815783 - DNA, 15 bp, Homo sapiens
catggtcacagaccc

SEQ ID NO: 4815784 - DNA, 18 bp, Homo sapiens
catggtcacagacccctg

SEQ ID NO: 4815785 - DNA, 21 bp, Homo sapiens
catggtcacagacccctgggg

SEQ ID NO: 4815786 - DNA, 23 bp, Homo sapiens
catggtcacagacccctggggga

SEQ ID NO: 4815787 - DNA, 21 bp, Homo sapiens
catggtcccacttccccatct

SEQ ID NO: 4815788 - DNA, 14 bp, Homo sapiens
catgtaaataaata

SEQ ID NO: 4815789 - DNA, 18 bp, Homo sapiens
catgtaaataccagactg

SEQ ID NO: 4815790 - DNA, 12 bp, Homo sapiens
catgtagcatat

SEQ ID NO: 4815791 - DNA, 16 bp, Homo sapiens
catgtagcatataaat

SEQ ID NO: 4815792 - DNA, 21 bp, Homo sapiens
catgtagcatataaatgttta

SEQ ID NO: 4815793 - DNA, 13 bp, Homo sapiens
catgtatagtgag

SEQ ID NO: 4815794 - DNA, 17 bp, Homo sapiens
catgtcggggcccctgc

SEQ ID NO: 4815795 - DNA, 20 bp, Homo sapiens
catgtctttggcttcagaat

SEQ ID NO: 4815796 - DNA, 17 bp, Homo sapiens
catgtgataattgtaaa

SEQ ID NO: 4815797 - DNA, 21 bp, Homo sapiens
catgtgataattgtaaaggtg

SEQ ID NO: 4815798 - DNA, 18 bp, Homo sapiens
catgtgctcagccccaga

SEQ ID NO: 4815799 - DNA, 15 bp, Homo sapiens
catgtgctgctgtgg

SEQ ID NO: 4815800 - DNA, 17 bp, Homo sapiens
catgtgctgctgtggca

SEQ ID NO: 4815801 - DNA, 15 bp, Homo sapiens
catgtggcaacctgt

SEQ ID NO: 4815802 - DNA, 17 bp, Homo sapiens
catgtgtcccccctgtg

SEQ ID NO: 4815803 - DNA, 14 bp, Homo sapiens
catgtgtcccctca

SEQ ID NO: 4815804 - DNA, 15 bp, Homo sapiens
catgtgtcccctcac

SEQ ID NO: 4815805 - DNA, 15 bp, Homo sapiens
catgtgtttctgtgt

SEQ ID NO: 4815806 - DNA, 22 bp, Homo sapiens
catgttaaagaggcgtcttgta

SEQ ID NO: 4815807 - DNA, 18 bp, Homo sapiens
catgttaattgatagaat

SEQ ID NO: 4815808 - DNA, 14 bp, Homo sapiens
catgttctgtgtca

SEQ ID NO: 4815809 - DNA, 16 bp, Homo sapiens
catgttcttgcagtca

SEQ ID NO: 4815810 - DNA, 17 bp, Homo sapiens
catgttggtaccctgga

SEQ ID NO: 4815811 - DNA, 21 bp, Homo sapiens
catgtttaagaaatgagaaat

SEQ ID NO: 4815812 - DNA, 22 bp, Homo sapiens
catgttttgaatgattgaagat

SEQ ID NO: 4815813 - DNA, 16 bp, Homo sapiens
catgttttgctaatgc

SEQ ID NO: 4815814 - DNA, 19 bp, Homo sapiens
catgttttttaggaatcag

SEQ ID NO: 4815815 - DNA, 19 bp, Homo sapiens
cattaatccacatgtttca

SEQ ID NO: 4815816 - DNA, 17 bp, Homo sapiens
cattacatcctctgctt

SEQ ID NO: 4815817 - DNA, 18 bp, Homo sapiens
cattactattaactctgc

SEQ ID NO: 4815818 - DNA, 13 bp, Homo sapiens
cattatagcatgt

SEQ ID NO: 4815819 - DNA, 21 bp, Homo sapiens
cattatagcatgtaatattaa

SEQ ID NO: 4815820 - DNA, 20 bp, Homo sapiens
cattatcgccttttgacagc

SEQ ID NO: 4815821 - DNA, 22 bp, Homo sapiens
cattatcgccttttgacagctg

SEQ ID NO: 4815822 - DNA, 17 bp, Homo sapiens
cattatctctttctctc

SEQ ID NO: 4815823 - DNA, 13 bp, Homo sapiens
cattatttctgta

SEQ ID NO: 4815824 - DNA, 14 bp, Homo sapiens
cattatttctgtat

SEQ ID NO: 4815825 - DNA, 13 bp, Homo sapiens
cattcaaaaattt

SEQ ID NO: 4815826 - DNA, 22 bp, Homo sapiens
cattcaactttagtatttttac

SEQ ID NO: 4815827 - DNA, 19 bp, Homo sapiens
cattcaccaacaacagtca

SEQ ID NO: 4815828 - DNA, 16 bp, Homo sapiens
cattcagtctgcagct

SEQ ID NO: 4815829 - DNA, 15 bp, Homo sapiens
cattcatcctcacat

SEQ ID NO: 4815830 - DNA, 15 bp, Homo sapiens
cattcatcctcttat

SEQ ID NO: 4815831 - DNA, 17 bp, Homo sapiens
cattcattcatcctctt

SEQ ID NO: 4815832 - DNA, 23 bp, Homo sapiens
cattcatttacaacttccagatt

SEQ ID NO: 4815833 - DNA, 18 bp, Homo sapiens
cattccaggggcctcagg

SEQ ID NO: 4815834 - DNA, 15 bp, Homo sapiens
cattcccaattatca

SEQ ID NO: 4815835 - DNA, 20 bp, Homo sapiens
cattcccaattatcaaaaaa

SEQ ID NO: 4815836 - DNA, 19 bp, Homo sapiens
cattcctgaccctcacttt

SEQ ID NO: 4815837 - DNA, 20 bp, Homo sapiens
cattcgtgggcctgctgctc

SEQ ID NO: 4815838 - DNA, 24 bp, Homo sapiens
cattcgttgctccagtataaatta

SEQ ID NO: 4815839 - DNA, 20 bp, Homo sapiens
cattctagagggatccaccg

SEQ ID NO: 4815840 - DNA, 15 bp, Homo sapiens
cattctatctactga

SEQ ID NO: 4815841 - DNA, 19 bp, Homo sapiens
cattctgattggacctggc

SEQ ID NO: 4815842 - DNA, 22 bp, Homo sapiens
cattctgattggacctggccca

SEQ ID NO: 4815843 - DNA, 16 bp, Homo sapiens
cattctggggtggggc

SEQ ID NO: 4815844 - DNA, 19 bp, Homo sapiens
cattctggtccttagtaaa

SEQ ID NO: 4815845 - DNA, 20 bp, Homo sapiens
cattctggtccttagtaaat

SEQ ID NO: 4815846 - DNA, 21 bp, Homo sapiens
cattctttataaaccataaaa

SEQ ID NO: 4815847 - DNA, 22 bp, Homo sapiens
cattgaaaattattaatcagaa

SEQ ID NO: 4815848 - DNA, 15 bp, Homo sapiens
cattgaaactgtatt

SEQ ID NO: 4815849 - DNA, 16 bp, Homo sapiens
cattgaaactgtattt

SEQ ID NO: 4815850 - DNA, 16 bp, Homo sapiens
cattgaaataataata

SEQ ID NO: 4815851 - DNA, 17 bp, Homo sapiens
cattgaacacatttcct

SEQ ID NO: 4815852 - DNA, 19 bp, Homo sapiens
cattgaacactgcaccctc

SEQ ID NO: 4815853 - DNA, 22 bp, Homo sapiens
cattgagggaaaacataatatc

SEQ ID NO: 4815854 - DNA, 13 bp, Homo sapiens
cattgcactaaaa

SEQ ID NO: 4815855 - DNA, 19 bp, Homo sapiens
cattgcactaaaagtgatg

SEQ ID NO: 4815856 - DNA, 21 bp, Homo sapiens
cattgccgtggcatcttaaaa

SEQ ID NO: 4815857 - DNA, 12 bp, Homo sapiens
cattgccttctg

SEQ ID NO: 4815858 - DNA, 22 bp, Homo sapiens
cattgccttctggggagggaca

SEQ ID NO: 4815859 - DNA, 18 bp, Homo sapiens
cattgctggactgatggt

SEQ ID NO: 4815860 - DNA, 19 bp, Homo sapiens
cattgcttcattaaaacaa

SEQ ID NO: 4815861 - DNA, 18 bp, Homo sapiens
cattgtagcctaatattc

SEQ ID NO: 4815862 - DNA, 16 bp, Homo sapiens
cattgtcagagatgtt

SEQ ID NO: 4815863 - DNA, 19 bp, Homo sapiens
cattgtccccaatgaatat

SEQ ID NO: 4815864 - DNA, 15 bp, Homo sapiens
cattgtgaatgttgt

SEQ ID NO: 4815865 - DNA, 20 bp, Homo sapiens
cattgtgaatgttgtcctgt

SEQ ID NO: 4815866 - DNA, 22 bp, Homo sapiens
cattgtgaatgttgtcctgtgt

SEQ ID NO: 4815867 - DNA, 22 bp, Homo sapiens
cattgtgccctgtagctcctta

SEQ ID NO: 4815868 - DNA, 20 bp, Homo sapiens
cattgttcagaaaagcacct

SEQ ID NO: 4815869 - DNA, 14 bp, Homo sapiens
cattgtttgtcctt

SEQ ID NO: 4815870 - DNA, 12 bp, Homo sapiens
catttaaaacat

SEQ ID NO: 4815871 - DNA, 12 bp, Homo sapiens
catttaatcatt

SEQ ID NO: 4815872 - DNA, 15 bp, Homo sapiens
catttagcacagtat

SEQ ID NO: 4815873 - DNA, 16 bp, Homo sapiens
catttagcacagtatt

SEQ ID NO: 4815874 - DNA, 17 bp, Homo sapiens
catttagcacagtattt

SEQ ID NO: 4815875 - DNA, 20 bp, Homo sapiens
catttagcatgagttctgca

SEQ ID NO: 4815876 - DNA, 21 bp, Homo sapiens
catttagcattgaaataataa

SEQ ID NO: 4815877 - DNA, 14 bp, Homo sapiens
catttagtcctcac

SEQ ID NO: 4815878 - DNA, 15 bp, Homo sapiens
catttagtcctcacc

SEQ ID NO: 4815879 - DNA, 17 bp, Homo sapiens
catttagtcctcacctt

SEQ ID NO: 4815880 - DNA, 21 bp, Homo sapiens
catttatgcaatttacttgga

SEQ ID NO: 4815881 - DNA, 13 bp, Homo sapiens
catttatgcatga

SEQ ID NO: 4815882 - DNA, 15 bp, Homo sapiens
catttatgcatgaga

SEQ ID NO: 4815883 - DNA, 15 bp, Homo sapiens
catttcacacaactg

SEQ ID NO: 4815884 - DNA, 17 bp, Homo sapiens
catttcacattcctgac

SEQ ID NO: 4815885 - DNA, 18 bp, Homo sapiens
catttcacattcctgacc

SEQ ID NO: 4815886 - DNA, 20 bp, Homo sapiens
catttcacattcctgaccct

SEQ ID NO: 4815887 - DNA, 17 bp, Homo sapiens
catttcatcaagattaa

SEQ ID NO: 4815888 - DNA, 19 bp, Homo sapiens
catttccagcaaaatatat

SEQ ID NO: 4815889 - DNA, 21 bp, Homo sapiens
catttccagcaaaatatatgt

SEQ ID NO: 4815890 - DNA, 12 bp, Homo sapiens
catttccctgct

SEQ ID NO: 4815891 - DNA, 15 bp, Homo sapiens
catttccttgtctaa

SEQ ID NO: 4815892 - DNA, 24 bp, Homo sapiens
catttctttttaggctctgagact

SEQ ID NO: 4815893 - DNA, 15 bp, Homo sapiens
catttgagagaagcc

SEQ ID NO: 4815894 - DNA, 20 bp, Homo sapiens
catttgcaggtgaccagaat

SEQ ID NO: 4815895 - DNA, 18 bp, Homo sapiens
catttgcatgccttttgg

SEQ ID NO: 4815896 - DNA, 11 bp, Homo sapiens
catttgctaat

SEQ ID NO: 4815897 - DNA, 12 bp, Homo sapiens
catttgctaatg

SEQ ID NO: 4815898 - DNA, 16 bp, Homo sapiens
catttgctaatgaatt

SEQ ID NO: 4815899 - DNA, 13 bp, Homo sapiens
catttgctccttt

SEQ ID NO: 4815900 - DNA, 11 bp, Homo sapiens
catttgctgaa

SEQ ID NO: 4815901 - DNA, 15 bp, Homo sapiens
catttgctttttgct

SEQ ID NO: 4815902 - DNA, 18 bp, Homo sapiens
catttggatataaatctt

SEQ ID NO: 4815903 - DNA, 18 bp, Homo sapiens
catttgtaatgtatctta

SEQ ID NO: 4815904 - DNA, 21 bp, Homo sapiens
catttgtaatgtatcttattt

SEQ ID NO: 4815905 - DNA, 16 bp, Homo sapiens
catttgtgcgtatgca

SEQ ID NO: 4815906 - DNA, 14 bp, Homo sapiens
catttgttctgggt

SEQ ID NO: 4815907 - DNA, 18 bp, Homo sapiens
cattttaaagttaaacat

SEQ ID NO: 4815908 - DNA, 21 bp, Homo sapiens
cattttactatgcctgttgat

SEQ ID NO: 4815909 - DNA, 22 bp, Homo sapiens
cattttactgtacagattgctg

SEQ ID NO: 4815910 - DNA, 15 bp, Homo sapiens
cattttactgtctgt

SEQ ID NO: 4815911 - DNA, 16 bp, Homo sapiens
cattttagctaattta

SEQ ID NO: 4815912 - DNA, 12 bp, Homo sapiens
cattttctgtta

SEQ ID NO: 4815913 - DNA, 17 bp, Homo sapiens
cattttgatgtattatt

SEQ ID NO: 4815914 - DNA, 16 bp, Homo sapiens
cattttgggaaattct

SEQ ID NO: 4815915 - DNA, 12 bp, Homo sapiens
catttttcaata

SEQ ID NO: 4815916 - DNA, 22 bp, Homo sapiens
catttttgtaatataagacaag

SEQ ID NO: 4815917 - DNA, 22 bp, Homo sapiens
ccaaaagctagaggagattgct

SEQ ID NO: 4815918 - DNA, 22 bp, Homo sapiens
ccaaaagctgctttccatggca

SEQ ID NO: 4815919 - DNA, 18 bp, Homo sapiens
ccaaaaggccccttccca

SEQ ID NO: 4815920 - DNA, 15 bp, Homo sapiens
ccaaaagtactagca

SEQ ID NO: 4815921 - DNA, 13 bp, Homo sapiens
ccaaaatgtcaat

SEQ ID NO: 4815922 - DNA, 16 bp, Homo sapiens
ccaaacccttcagtgc

SEQ ID NO: 4815923 - DNA, 22 bp, Homo sapiens
ccaaacctaccttatagagcac

SEQ ID NO: 4815924 - DNA, 15 bp, Homo sapiens
ccaaactaccgttcc

SEQ ID NO: 4815925 - DNA, 17 bp, Homo sapiens
ccaaactcacctgcccc

SEQ ID NO: 4815926 - DNA, 18 bp, Homo sapiens
ccaaactctctagtgcag

SEQ ID NO: 4815927 - DNA, 13 bp, Homo sapiens
ccaaacttccagg

SEQ ID NO: 4815928 - DNA, 21 bp, Homo sapiens
ccaaacttctgaactttggaa

SEQ ID NO: 4815929 - DNA, 19 bp, Homo sapiens
ccaaagtcctgggattaca

SEQ ID NO: 4815930 - DNA, 13 bp, Homo sapiens
ccaaataaatgtg

SEQ ID NO: 4815931 - DNA, 15 bp, Homo sapiens
ccaaataaatgtgta

SEQ ID NO: 4815932 - DNA, 17 bp, Homo sapiens
ccaaataaatgtgtaaa

SEQ ID NO: 4815933 - DNA, 18 bp, Homo sapiens
ccaaataaatgtgtaaat

SEQ ID NO: 4815934 - DNA, 20 bp, Homo sapiens
ccaaataaatgtgtaaatgt

SEQ ID NO: 4815935 - DNA, 18 bp, Homo sapiens
ccaaatagcttttcactt

SEQ ID NO: 4815936 - DNA, 23 bp, Homo sapiens
ccaaatagcttttcacttcttaa

SEQ ID NO: 4815937 - DNA, 15 bp, Homo sapiens
ccaaatataacatga

SEQ ID NO: 4815938 - DNA, 16 bp, Homo sapiens
ccaaatataacatgaa

SEQ ID NO: 4815939 - DNA, 16 bp, Homo sapiens
ccaaatattgatctgt

SEQ ID NO: 4815940 - DNA, 13 bp, Homo sapiens
ccaaattgctgag

SEQ ID NO: 4815941 - DNA, 15 bp, Homo sapiens
ccaaattgctgagat

SEQ ID NO: 4815942 - DNA, 16 bp, Homo sapiens
ccaacaacagtcagcc

SEQ ID NO: 4815943 - DNA, 17 bp, Homo sapiens
ccaacaacagtcagcca

SEQ ID NO: 4815944 - DNA, 18 bp, Homo sapiens
ccaacaactccaggaaaa

SEQ ID NO: 4815945 - DNA, 13 bp, Homo sapiens
ccaacagagtgga

SEQ ID NO: 4815946 - DNA, 17 bp, Homo sapiens
ccaacccatgcatggcc

SEQ ID NO: 4815947 - DNA, 23 bp, Homo sapiens
ccaacccatgcatggcctcccag

SEQ ID NO: 4815948 - DNA, 18 bp, Homo sapiens
ccaacccccacctcccgg

SEQ ID NO: 4815949 - DNA, 19 bp, Homo sapiens
ccaacgatcatatctgtat

SEQ ID NO: 4815950 - DNA, 21 bp, Homo sapiens
ccaacgggtctgtgggactgg

SEQ ID NO: 4815951 - DNA, 14 bp, Homo sapiens
ccaactaagttgta

SEQ ID NO: 4815952 - DNA, 17 bp, Homo sapiens
ccaactaagttgtattt

SEQ ID NO: 4815953 - DNA, 18 bp, Homo sapiens
ccaactctggccttggtt

SEQ ID NO: 4815954 - DNA, 15 bp, Homo sapiens
ccaactggaaggctt

SEQ ID NO: 4815955 - DNA, 21 bp, Homo sapiens
ccaactggaaggctttattct

SEQ ID NO: 4815956 - DNA, 15 bp, Homo sapiens
ccaacttaaacctgt

SEQ ID NO: 4815957 - DNA, 15 bp, Homo sapiens
ccaactttccagact

SEQ ID NO: 4815958 - DNA, 12 bp, Homo sapiens
ccaactttgtag

SEQ ID NO: 4815959 - DNA, 18 bp, Homo sapiens
ccaagaaaggaaaccttt

SEQ ID NO: 4815960 - DNA, 14 bp, Homo sapiens
ccaagaacataaac

SEQ ID NO: 4815961 - DNA, 20 bp, Homo sapiens
ccaagactctatgctctgga

SEQ ID NO: 4815962 - DNA, 16 bp, Homo sapiens
ccaagagtccaagcca

SEQ ID NO: 4815963 - DNA, 16 bp, Homo sapiens
ccaagcatcagcaaga

SEQ ID NO: 4815964 - DNA, 23 bp, Homo sapiens
ccaagccagggttccagacaggg

SEQ ID NO: 4815965 - DNA, 13 bp, Homo sapiens
ccaagccctgggg

SEQ ID NO: 4815966 - DNA, 24 bp, Homo sapiens
ccaagcgacctaaacagctgcttt

SEQ ID NO: 4815967 - DNA, 22 bp, Homo sapiens
ccaagctgatggacatgagagt

SEQ ID NO: 4815968 - DNA, 15 bp, Homo sapiens
ccaagctgctgccgc

SEQ ID NO: 4815969 - DNA, 16 bp, Homo sapiens
ccacgcagagccccgg

SEQ ID NO: 4815970 - DNA, 20 bp, Homo sapiens
ccacgcagagccccggagca

SEQ ID NO: 4815971 - DNA, 23 bp, Homo sapiens
ccacgccgatataagccatagcc

SEQ ID NO: 4815972 - DNA, 22 bp, Homo sapiens
ccacgccgggtcgcctgccctg

SEQ ID NO: 4815973 - DNA, 23 bp, Homo sapiens
ccacgcctccatccacacacagc

SEQ ID NO: 4815974 - DNA, 16 bp, Homo sapiens
ccacgcctcctggcca

SEQ ID NO: 4815975 - DNA, 17 bp, Homo sapiens
ccacgcctcctggccag

SEQ ID NO: 4815976 - DNA, 13 bp, Homo sapiens
ccacgctgtcctc

SEQ ID NO: 4815977 - DNA, 21 bp, Homo sapiens
ccacgctgtcctctcgagccc

SEQ ID NO: 4815978 - DNA, 16 bp, Homo sapiens
ccacgcttctggaggt

SEQ ID NO: 4815979 - DNA, 23 bp, Homo sapiens
ccacgcttctggaggtggggagg

SEQ ID NO: 4815980 - DNA, 18 bp, Homo sapiens
ccacggctaagaggctgc

SEQ ID NO: 4815981 - DNA, 21 bp, Homo sapiens
ccacggctaagaggctgctga

SEQ ID NO: 4815982 - DNA, 18 bp, Homo sapiens
ccacggggtcgggggagg

SEQ ID NO: 4815983 - DNA, 15 bp, Homo sapiens
ccacgtcctgggtgc

SEQ ID NO: 4815984 - DNA, 15 bp, Homo sapiens
ccacgtctccctggc

SEQ ID NO: 4815985 - DNA, 18 bp, Homo sapiens
ccacgtggccgctgccca

SEQ ID NO: 4815986 - DNA, 15 bp, Homo sapiens
ccacgtggggtggaa

SEQ ID NO: 4815987 - DNA, 15 bp, Homo sapiens
ccactaagtaacctc

SEQ ID NO: 4815988 - DNA, 20 bp, Homo sapiens
ccactagccctctttctctc

SEQ ID NO: 4815989 - DNA, 23 bp, Homo sapiens
ccactagccctctttctctctgt

SEQ ID NO: 4815990 - DNA, 17 bp, Homo sapiens
ccactaggtgcccagtc

SEQ ID NO: 4815991 - DNA, 18 bp, Homo sapiens
ccactaggtgcccagtct

SEQ ID NO: 4815992 - DNA, 21 bp, Homo sapiens
ccactaggtgcccagtcttga

SEQ ID NO: 4815993 - DNA, 18 bp, Homo sapiens
ccactcaggcagcctgtg

SEQ ID NO: 4815994 - DNA, 20 bp, Homo sapiens
ccactcaggcagcctgtggg

SEQ ID NO: 4815995 - DNA, 13 bp, Homo sapiens
ccactcctcccaa

SEQ ID NO: 4815996 - DNA, 13 bp, Homo sapiens
ccactctcaggac

SEQ ID NO: 4815997 - DNA, 16 bp, Homo sapiens
ccactgacagcctcca

SEQ ID NO: 4815998 - DNA, 23 bp, Homo sapiens
ccactgatatcacgggcccgctc

SEQ ID NO: 4815999 - DNA, 13 bp, Homo sapiens
ccactgcctctgc

SEQ ID NO: 4816000 - DNA, 14 bp, Homo sapiens
ccactgggcctgct

SEQ ID NO: 4816001 - DNA, 11 bp, Homo sapiens
ccactgtgtcc

SEQ ID NO: 4816002 - DNA, 17 bp, Homo sapiens
ccactgtgtcccagtgt

SEQ ID NO: 4816003 - DNA, 17 bp, Homo sapiens
ccacttccttaacagct

SEQ ID NO: 4816004 - DNA, 12 bp, Homo sapiens
ccactttcctct

SEQ ID NO: 4816005 - DNA, 15 bp, Homo sapiens
ccactttcctctctc

SEQ ID NO: 4816006 - DNA, 20 bp, Homo sapiens
ccactttctagccagaggag

SEQ ID NO: 4816007 - DNA, 21 bp, Homo sapiens
ccagaaagaggaataaaatga

SEQ ID NO: 4816008 - DNA, 22 bp, Homo sapiens
ccagaaagaggaataaaatgat

SEQ ID NO: 4816009 - DNA, 13 bp, Homo sapiens
ccagaacgggcct

SEQ ID NO: 4816010 - DNA, 15 bp, Homo sapiens
ccagaacgggcctcc

SEQ ID NO: 4816011 - DNA, 16 bp, Homo sapiens
ccagaacgggcctccc

SEQ ID NO: 4816012 - DNA, 14 bp, Homo sapiens
ccagaagagtcttt

SEQ ID NO: 4816013 - DNA, 18 bp, Homo sapiens
ccagaagctcaaggctgc

SEQ ID NO: 4816014 - DNA, 20 bp, Homo sapiens
ccagaagctcaaggctgcag

SEQ ID NO: 4816015 - DNA, 22 bp, Homo sapiens
ccagaatgaggcacatgacagt

SEQ ID NO: 4816016 - DNA, 14 bp, Homo sapiens
ccagacaagccctg

SEQ ID NO: 4816017 - DNA, 16 bp, Homo sapiens
ccagacaagccctgct

SEQ ID NO: 4816018 - DNA, 18 bp, Homo sapiens
ccagacagagatcagaat

SEQ ID NO: 4816019 - DNA, 18 bp, Homo sapiens
ccagacagagtggatctg

SEQ ID NO: 4816020 - DNA, 20 bp, Homo sapiens
ccagacatacgaaacacaaa

SEQ ID NO: 4816021 - DNA, 22 bp, Homo sapiens
ccagacatacgaaacacaaacc

SEQ ID NO: 4816022 - DNA, 18 bp, Homo sapiens
ccagaccacgcccctgcc

SEQ ID NO: 4816023 - DNA, 12 bp, Homo sapiens
ccagacccctac

SEQ ID NO: 4816024 - DNA, 12 bp, Homo sapiens
ccagacctgccg

SEQ ID NO: 4816025 - DNA, 20 bp, Homo sapiens
ccagacgcggaaaccgggtg

SEQ ID NO: 4816026 - DNA, 18 bp, Homo sapiens
ccagacgctgccgctgcc

SEQ ID NO: 4816027 - DNA, 24 bp, Homo sapiens
ccagacgctgccgctgccgctgca

SEQ ID NO: 4816028 - DNA, 19 bp, Homo sapiens
ccagacgtggtgcttctca

SEQ ID NO: 4816029 - DNA, 16 bp, Homo sapiens
ccagactcgagagggc

SEQ ID NO: 4816030 - DNA, 20 bp, Homo sapiens
ccagactcgagagggctgag

SEQ ID NO: 4816031 - DNA, 23 bp, Homo sapiens
ccagactcgagagggctgagccc

SEQ ID NO: 4816032 - DNA, 13 bp, Homo sapiens
ccagactgcaggt

SEQ ID NO: 4816033 - DNA, 23 bp, Homo sapiens
ccagacttcgctattcccaggca

SEQ ID NO: 4816034 - DNA, 23 bp, Homo sapiens
ccagagaaatgaaagtcagttta

SEQ ID NO: 4816035 - DNA, 12 bp, Homo sapiens
ccagagaagcct

SEQ ID NO: 4816036 - DNA, 22 bp, Homo sapiens
ccagagaagcctcagtccctcc

SEQ ID NO: 4816037 - DNA, 12 bp, Homo sapiens
ccagagacctgc

SEQ ID NO: 4816038 - DNA, 18 bp, Homo sapiens
ccagagacctgctccaga

SEQ ID NO: 4816039 - DNA, 13 bp, Homo sapiens
ccagagactgccc

SEQ ID NO: 4816040 - DNA, 16 bp, Homo sapiens
ccagagactgcccacc

SEQ ID NO: 4816041 - DNA, 17 bp, Homo sapiens
ccagagactgcccaccc

SEQ ID NO: 4816042 - DNA, 19 bp, Homo sapiens
ccagagactgcccaccctg

SEQ ID NO: 4816043 - DNA, 12 bp, Homo sapiens
ccagagagaagc

SEQ ID NO: 4816044 - DNA, 14 bp, Homo sapiens
ccagagcctgggcg

SEQ ID NO: 4816045 - DNA, 22 bp, Homo sapiens
ccagagctcatttcggggtcag

SEQ ID NO: 4816046 - DNA, 19 bp, Homo sapiens
ccagagctgccacctgcct

SEQ ID NO: 4816047 - DNA, 22 bp, Homo sapiens
ccagaggtggatactggggggc

SEQ ID NO: 4816048 - DNA, 17 bp, Homo sapiens
ccagagtgtatgcatac

SEQ ID NO: 4816049 - DNA, 12 bp, Homo sapiens
ccagagtgtcct

SEQ ID NO: 4816050 - DNA, 16 bp, Homo sapiens
ccagagttatttccca

SEQ ID NO: 4816051 - DNA, 19 bp, Homo sapiens
ccagatacctgtgaggact

SEQ ID NO: 4816052 - DNA, 23 bp, Homo sapiens
ccagatcctctttccccactgaa

SEQ ID NO: 4816053 - DNA, 17 bp, Homo sapiens
ccagcaatgcctgcctg

SEQ ID NO: 4816054 - DNA, 23 bp, Homo sapiens
ccagcacaaagcactggccttgc

SEQ ID NO: 4816055 - DNA, 12 bp, Homo sapiens
ccagcaccctct

SEQ ID NO: 4816056 - DNA, 23 bp, Homo sapiens
ccagcaccctctcctgggggtgg

SEQ ID NO: 4816057 - DNA, 13 bp, Homo sapiens
ccagcacctcctc

SEQ ID NO: 4816058 - DNA, 18 bp, Homo sapiens
ccagcacctcctccgtgg

SEQ ID NO: 4816059 - DNA, 14 bp, Homo sapiens
ccagcactcccagg

SEQ ID NO: 4816060 - DNA, 16 bp, Homo sapiens
ccagcagcggcccaga

SEQ ID NO: 4816061 - DNA, 12 bp, Homo sapiens
ccagcagctcac

SEQ ID NO: 4816062 - DNA, 16 bp, Homo sapiens
ccagcaggctctcagg

SEQ ID NO: 4816063 - DNA, 19 bp, Homo sapiens
ccagcaggctctcaggcca

SEQ ID NO: 4816064 - DNA, 21 bp, Homo sapiens
ccagcaggctctcaggccagc

SEQ ID NO: 4816065 - DNA, 22 bp, Homo sapiens
ccagcagggcgggccaggagaa

SEQ ID NO: 4816066 - DNA, 20 bp, Homo sapiens
ccagcataccagttcttgca

SEQ ID NO: 4816067 - DNA, 22 bp, Homo sapiens
ccagcataccagttcttgcaat

SEQ ID NO: 4816068 - DNA, 17 bp, Homo sapiens
ccagcatagttctgcaa

SEQ ID NO: 4816069 - DNA, 21 bp, Homo sapiens
ccagccacccggatctccagg

SEQ ID NO: 4816070 - DNA, 13 bp, Homo sapiens
ccagccagcaggt

SEQ ID NO: 4816071 - DNA, 16 bp, Homo sapiens
ccagccagcaggttct

SEQ ID NO: 4816072 - DNA, 20 bp, Homo sapiens
ccagccatggctggatgtgc

SEQ ID NO: 4816073 - DNA, 21 bp, Homo sapiens
ccagcccaaccgggaaaggca

SEQ ID NO: 4816074 - DNA, 15 bp, Homo sapiens
ccagcccacacagcc

SEQ ID NO: 4816075 - DNA, 19 bp, Homo sapiens
ccagcccacacagcccgag

SEQ ID NO: 4816076 - DNA, 22 bp, Homo sapiens
ccagcccgcagaggtggggtgc

SEQ ID NO: 4816077 - DNA, 19 bp, Homo sapiens
ccagccctccgccagccct

SEQ ID NO: 4816078 - DNA, 14 bp, Homo sapiens
ccagccctgcccag

SEQ ID NO: 4816079 - DNA, 13 bp, Homo sapiens
ccagccctgggca

SEQ ID NO: 4816080 - DNA, 21 bp, Homo sapiens
ccagccctgttccgcctcact

SEQ ID NO: 4816081 - DNA, 23 bp, Homo sapiens
ccagccctgttccgcctcactgg

SEQ ID NO: 4816082 - DNA, 22 bp, Homo sapiens
ccagccgagatagccaaggcca

SEQ ID NO: 4816083 - DNA, 23 bp, Homo sapiens
ccagccgagatagccaaggccaa

SEQ ID NO: 4816084 - DNA, 14 bp, Homo sapiens
ccagcctcaccctt

SEQ ID NO: 4816085 - DNA, 17 bp, Homo sapiens
ccagcctcacccttgcg

SEQ ID NO: 4816086 - DNA, 22 bp, Homo sapiens
ccagcctcccccaggctgcgcc

SEQ ID NO: 4816087 - DNA, 15 bp, Homo sapiens
ccagcctgagccaca

SEQ ID NO: 4816088 - DNA, 18 bp, Homo sapiens
ccagcctgagccacagtg

SEQ ID NO: 4816089 - DNA, 14 bp, Homo sapiens
ccagcctggggcct

SEQ ID NO: 4816090 - DNA, 14 bp, Homo sapiens
ccagccttcttccc

SEQ ID NO: 4816091 - DNA, 17 bp, Homo sapiens
ccagcgcatggcgcccc

SEQ ID NO: 4816092 - DNA, 21 bp, Homo sapiens
ccagcgcatggcgccccgggc

SEQ ID NO: 4816093 - DNA, 14 bp, Homo sapiens
ccagcgctgaacag

SEQ ID NO: 4816094 - DNA, 16 bp, Homo sapiens
ccagcgctgaacagac

SEQ ID NO: 4816095 - DNA, 20 bp, Homo sapiens
ccagctcaggctactgccac

SEQ ID NO: 4816096 - DNA, 14 bp, Homo sapiens
ccagctcaggggca

SEQ ID NO: 4816097 - DNA, 20 bp, Homo sapiens
ccagctcagtcccacagccc

SEQ ID NO: 4816098 - DNA, 21 bp, Homo sapiens
ccagctctgagcagacagggc

SEQ ID NO: 4816099 - DNA, 23 bp, Homo sapiens
ccagctgcaggaatcaaaaattg

SEQ ID NO: 4816100 - DNA, 13 bp, Homo sapiens
ccagctgcttggg

SEQ ID NO: 4816101 - DNA, 20 bp, Homo sapiens
ccagctgcttgggcttcatc

SEQ ID NO: 4816102 - DNA, 20 bp, Homo sapiens
ccagctggcagcgcctcccg

SEQ ID NO: 4816103 - DNA, 20 bp, Homo sapiens
ccagctgtaccggccactgc

SEQ ID NO: 4816104 - DNA, 16 bp, Homo sapiens
ccagcttgcttctctg

SEQ ID NO: 4816105 - DNA, 20 bp, Homo sapiens
ccagcttggagtgccacgtg

SEQ ID NO: 4816106 - DNA, 13 bp, Homo sapiens
ccagctttctctt

SEQ ID NO: 4816107 - DNA, 20 bp, Homo sapiens
ccagctttctctttgttctt

SEQ ID NO: 4816108 - DNA, 19 bp, Homo sapiens
ccaggaagaaggcccggga

SEQ ID NO: 4816109 - DNA, 20 bp, Homo sapiens
ccaggaagaaggcccgggag

SEQ ID NO: 4816110 - DNA, 15 bp, Homo sapiens
ccaggaagaggggcg

SEQ ID NO: 4816111 - DNA, 16 bp, Homo sapiens
ccaggaaggggacagg

SEQ ID NO: 4816112 - DNA, 12 bp, Homo sapiens
ccaggaagtaat

SEQ ID NO: 4816113 - DNA, 18 bp, Homo sapiens
ccaggaagtaattttctt

SEQ ID NO: 4816114 - DNA, 23 bp, Homo sapiens
ccaggaagtaattttcttctcat

SEQ ID NO: 4816115 - DNA, 17 bp, Homo sapiens
ccaggaattctcacagg

SEQ ID NO: 4816116 - DNA, 15 bp, Homo sapiens
ccaggacccccccag

SEQ ID NO: 4816117 - DNA, 13 bp, Homo sapiens
ccaggaccctggg

SEQ ID NO: 4816118 - DNA, 15 bp, Homo sapiens
ccaggaccctgggtc

SEQ ID NO: 4816119 - DNA, 12 bp, Homo sapiens
ccaggagaccct

SEQ ID NO: 4816120 - DNA, 16 bp, Homo sapiens
ccaggagaccctgtct

SEQ ID NO: 4816121 - DNA, 19 bp, Homo sapiens
ccaggagccaggtgtcctg

SEQ ID NO: 4816122 - DNA, 14 bp, Homo sapiens
ccaggagcctcctg

SEQ ID NO: 4816123 - DNA, 14 bp, Homo sapiens
ccaggaggcctggg

SEQ ID NO: 4816124 - DNA, 18 bp, Homo sapiens
ccaggatgaaggggccag

SEQ ID NO: 4816125 - DNA, 21 bp, Homo sapiens
ccaggatgaaggggccagacc

SEQ ID NO: 4816126 - DNA, 22 bp, Homo sapiens
ccaggatgaaggggccagacca

SEQ ID NO: 4816127 - DNA, 16 bp, Homo sapiens
ccaggatgcatgcagg

SEQ ID NO: 4816128 - DNA, 17 bp, Homo sapiens
ccaggatgcatgcaggg

SEQ ID NO: 4816129 - DNA, 21 bp, Homo sapiens
ccaggattgtccacaaatgtc

SEQ ID NO: 4816130 - DNA, 21 bp, Homo sapiens
ccaggcaacttcagtcctggg

SEQ ID NO: 4816131 - DNA, 18 bp, Homo sapiens
ccaggcaccgccagagtg

SEQ ID NO: 4816132 - DNA, 15 bp, Homo sapiens
ccaggcagggaggga

SEQ ID NO: 4816133 - DNA, 20 bp, Homo sapiens
ccaggccatcaccacagctg

SEQ ID NO: 4816134 - DNA, 22 bp, Homo sapiens
ccaggccatcaccacagctgca

SEQ ID NO: 4816135 - DNA, 13 bp, Homo sapiens
ccaggcccagcct

SEQ ID NO: 4816136 - DNA, 16 bp, Homo sapiens
ccaggcccagcctggc

SEQ ID NO: 4816137 - DNA, 18 bp, Homo sapiens
ccaggcccagcctggccc

SEQ ID NO: 4816138 - DNA, 14 bp, Homo sapiens
ccaggccccatcag

SEQ ID NO: 4816139 - DNA, 17 bp, Homo sapiens
ccaggcccgccctgccc

SEQ ID NO: 4816140 - DNA, 19 bp, Homo sapiens
ccaggccctctctgcagtc

SEQ ID NO: 4816141 - DNA, 20 bp, Homo sapiens
ccaggccctctctgcagtcc

SEQ ID NO: 4816142 - DNA, 17 bp, Homo sapiens
ccaggccggccagcctc

SEQ ID NO: 4816143 - DNA, 18 bp, Homo sapiens
ccaggccggccagcctca

SEQ ID NO: 4816144 - DNA, 13 bp, Homo sapiens
ccaggcctcctac

SEQ ID NO: 4816145 - DNA, 20 bp, Homo sapiens
ccaggcggaggggcttggag

SEQ ID NO: 4816146 - DNA, 24 bp, Homo sapiens
ccaggcggaggggcttggagcaga

SEQ ID NO: 4816147 - DNA, 23 bp, Homo sapiens
ccaggctagtccggacccacctc

SEQ ID NO: 4816148 - DNA, 14 bp, Homo sapiens
ccaggctcaggctg

SEQ ID NO: 4816149 - DNA, 17 bp, Homo sapiens
ccaggctcaggctgccc

SEQ ID NO: 4816150 - DNA, 20 bp, Homo sapiens
ccaggctcaggctgcccagc

SEQ ID NO: 4816151 - DNA, 21 bp, Homo sapiens
ccaggctcaggctgcccagcg

SEQ ID NO: 4816152 - DNA, 18 bp, Homo sapiens
ccaggctgcgcctgcccg

SEQ ID NO: 4816153 - DNA, 16 bp, Homo sapiens
ccagggaaccagagcg

SEQ ID NO: 4816154 - DNA, 21 bp, Homo sapiens
ccagggatgggggatgggcca

SEQ ID NO: 4816155 - DNA, 22 bp, Homo sapiens
ccagggatgggggatgggccag

SEQ ID NO: 4816156 - DNA, 12 bp, Homo sapiens
ccagggcagtgc

SEQ ID NO: 4816157 - DNA, 17 bp, Homo sapiens
ccagggcagtgctagtg

SEQ ID NO: 4816158 - DNA, 23 bp, Homo sapiens
ccagggcagtgctagtgagctgg

SEQ ID NO: 4816159 - DNA, 20 bp, Homo sapiens
ccagggcccgagcgcgtgcc

SEQ ID NO: 4816160 - DNA, 12 bp, Homo sapiens
ccagggccctgc

SEQ ID NO: 4816161 - DNA, 15 bp, Homo sapiens
ccagggccctgctca

SEQ ID NO: 4816162 - DNA, 14 bp, Homo sapiens
ccaggggcctcagg

SEQ ID NO: 4816163 - DNA, 16 bp, Homo sapiens
ccaggggctgcagccc

SEQ ID NO: 4816164 - DNA, 20 bp, Homo sapiens
ccaggggctgcagccccctg

SEQ ID NO: 4816165 - DNA, 22 bp, Homo sapiens
ccaggggcttctccccctcagc

SEQ ID NO: 4816166 - DNA, 19 bp, Homo sapiens
ccagggggaagatgccaag

SEQ ID NO: 4816167 - DNA, 20 bp, Homo sapiens
ccagggtccagccctccgcc

SEQ ID NO: 4816168 - DNA, 21 bp, Homo sapiens
ccagggtccagccctccgcca

SEQ ID NO: 4816169 - DNA, 22 bp, Homo sapiens
ccagggttccagacagggtggg

SEQ ID NO: 4816170 - DNA, 22 bp, Homo sapiens
ccaggtatctgatgatgttctg

SEQ ID NO: 4816171 - DNA, 15 bp, Homo sapiens
ccaggttccatccac

SEQ ID NO: 4816172 - DNA, 18 bp, Homo sapiens
ccaggttccatccaccac

SEQ ID NO: 4816173 - DNA, 24 bp, Homo sapiens
ccaggttgttttatagaggttctt

SEQ ID NO: 4816174 - DNA, 18 bp, Homo sapiens
ccaggtttcccactgcgg

SEQ ID NO: 4816175 - DNA, 19 bp, Homo sapiens
ccagtataaattacatgca

SEQ ID NO: 4816176 - DNA, 20 bp, Homo sapiens
ccagtataaattacatgcat

SEQ ID NO: 4816177 - DNA, 15 bp, Homo sapiens
ccagtatcctggatt

SEQ ID NO: 4816178 - DNA, 13 bp, Homo sapiens
ccagtatcttgaa

SEQ ID NO: 4816179 - DNA, 19 bp, Homo sapiens
ccagtatcttgaagacttt

SEQ ID NO: 4816180 - DNA, 14 bp, Homo sapiens
ccagtccccgggaa

SEQ ID NO: 4816181 - DNA, 16 bp, Homo sapiens
ccagtccgccccgtgc

SEQ ID NO: 4816182 - DNA, 17 bp, Homo sapiens
ccagtccgccccgtgct

SEQ ID NO: 4816183 - DNA, 21 bp, Homo sapiens
ccagtccgccccgtgctcctc

SEQ ID NO: 4816184 - DNA, 23 bp, Homo sapiens
ccagtccgccccgtgctcctctg

SEQ ID NO: 4816185 - DNA, 17 bp, Homo sapiens
ccagtccggtgccttcc

SEQ ID NO: 4816186 - DNA, 18 bp, Homo sapiens
ccagtccggtgccttcca

SEQ ID NO: 4816187 - DNA, 21 bp, Homo sapiens
ccagtccggtgccttccaccc

SEQ ID NO: 4816188 - DNA, 21 bp, Homo sapiens
ccagtctgaagtttcatttat

SEQ ID NO: 4816189 - DNA, 21 bp, Homo sapiens
ccagtcttgagtgggccccct

SEQ ID NO: 4816190 - DNA, 17 bp, Homo sapiens
ccagtgccagctggtga

SEQ ID NO: 4816191 - DNA, 19 bp, Homo sapiens
ccagtggactcgcgagagg

SEQ ID NO: 4816192 - DNA, 16 bp, Homo sapiens
ccagtgggacagagga

SEQ ID NO: 4816193 - DNA, 22 bp, Homo sapiens
ccagtggttcctaatcctctag

SEQ ID NO: 4816194 - DNA, 19 bp, Homo sapiens
ccagtgtattttctgtgtt

SEQ ID NO: 4816195 - DNA, 16 bp, Homo sapiens
ccagtgtctggcccag

SEQ ID NO: 4816196 - DNA, 13 bp, Homo sapiens
ccagttaaggacc

SEQ ID NO: 4816197 - DNA, 23 bp, Homo sapiens
ccagttccctcagccctcattaa

SEQ ID NO: 4816198 - DNA, 15 bp, Homo sapiens
ccagttcttgcaata

SEQ ID NO: 4816199 - DNA, 21 bp, Homo sapiens
ccagttcttgcaataagatat

SEQ ID NO: 4816200 - DNA, 21 bp, Homo sapiens
ccagtttctcttaagctgccc

SEQ ID NO: 4816201 - DNA, 13 bp, Homo sapiens
ccataaaataaat

SEQ ID NO: 4816202 - DNA, 18 bp, Homo sapiens
ccataacttgtttgtaaa

SEQ ID NO: 4816203 - DNA, 15 bp, Homo sapiens
ccataccccctgccc

SEQ ID NO: 4816204 - DNA, 16 bp, Homo sapiens
ccataccccctgcccc

SEQ ID NO: 4816205 - DNA, 19 bp, Homo sapiens
ccataccccctgccccaga

SEQ ID NO: 4816206 - DNA, 17 bp, Homo sapiens
ccatagaaacatgacac

SEQ ID NO: 4816207 - DNA, 22 bp, Homo sapiens
ccatagaaacatgacactgacc

SEQ ID NO: 4816208 - DNA, 13 bp, Homo sapiens
ccatagacacagt

SEQ ID NO: 4816209 - DNA, 18 bp, Homo sapiens
ccatatataaattattac

SEQ ID NO: 4816210 - DNA, 21 bp, Homo sapiens
ccatatataaattattacttt

SEQ ID NO: 4816211 - DNA, 23 bp, Homo sapiens
ccatatataaattattactttaa

SEQ ID NO: 4816212 - DNA, 14 bp, Homo sapiens
ccatcactgtgtct

SEQ ID NO: 4816213 - DNA, 22 bp, Homo sapiens
ccatcagctttataataaactg

SEQ ID NO: 4816214 - DNA, 23 bp, Homo sapiens
ccatcagctttataataaactgt

SEQ ID NO: 4816215 - DNA, 23 bp, Homo sapiens
ccatcatcaccgattcttccttg

SEQ ID NO: 4816216 - DNA, 17 bp, Homo sapiens
ccatccaccctgaggag

SEQ ID NO: 4816217 - DNA, 13 bp, Homo sapiens
ccatcccactgat

SEQ ID NO: 4816218 - DNA, 14 bp, Homo sapiens
ccatccctgggccc

SEQ ID NO: 4816219 - DNA, 20 bp, Homo sapiens
ccatccctggtgaaagagta

SEQ ID NO: 4816220 - DNA, 15 bp, Homo sapiens
ccatccttcccgcag

SEQ ID NO: 4816221 - DNA, 17 bp, Homo sapiens
ccatccttcccgcagca

SEQ ID NO: 4816222 - DNA, 18 bp, Homo sapiens
ccatccttcccgcagcac

SEQ ID NO: 4816223 - DNA, 21 bp, Homo sapiens
ccatccttcccgcagcaccag

SEQ ID NO: 4816224 - DNA, 13 bp, Homo sapiens
ccatcgccttctg

SEQ ID NO: 4816225 - DNA, 16 bp, Homo sapiens
ccatcgccttctgggg

SEQ ID NO: 4816226 - DNA, 21 bp, Homo sapiens
ccatctcaacctacctcgagt

SEQ ID NO: 4816227 - DNA, 12 bp, Homo sapiens
ccatctgaagag

SEQ ID NO: 4816228 - DNA, 15 bp, Homo sapiens
ccatctggcctggcc

SEQ ID NO: 4816229 - DNA, 18 bp, Homo sapiens
ccatctggcctggcctgg

SEQ ID NO: 4816230 - DNA, 11 bp, Homo sapiens
ccatctgtgtg

SEQ ID NO: 4816231 - DNA, 12 bp, Homo sapiens
ccatcttgggat

SEQ ID NO: 4816232 - DNA, 23 bp, Homo sapiens
ccatcttgggattcctcccctgg

SEQ ID NO: 4816233 - DNA, 20 bp, Homo sapiens
ccatgaccttgacgtgtgtg

SEQ ID NO: 4816234 - DNA, 15 bp, Homo sapiens
ccatgactgcatttt

SEQ ID NO: 4816235 - DNA, 18 bp, Homo sapiens
ccatgagcgtccaggtga

SEQ ID NO: 4816236 - DNA, 23 bp, Homo sapiens
ccatgaggaacaaggcaaggctg

SEQ ID NO: 4816237 - DNA, 19 bp, Homo sapiens
ccatgatctgtatttaatg

SEQ ID NO: 4816238 - DNA, 15 bp, Homo sapiens
ccatgcatggcctcc

SEQ ID NO: 4816239 - DNA, 23 bp, Homo sapiens
ccatgcatggcctcccagccacc

SEQ ID NO: 4816240 - DNA, 16 bp, Homo sapiens
ccatgccaccacccac

SEQ ID NO: 4816241 - DNA, 21 bp, Homo sapiens
ccatgccaccacccaccccaa

SEQ ID NO: 4816242 - DNA, 17 bp, Homo sapiens
ccatgccctccctgctg

SEQ ID NO: 4816243 - DNA, 15 bp, Homo sapiens
ccatgctcctcactg

SEQ ID NO: 4816244 - DNA, 17 bp, Homo sapiens
ccatgctcctcactgcc

SEQ ID NO: 4816245 - DNA, 21 bp, Homo sapiens
ccatgctcctcactgcccgca

SEQ ID NO: 4816246 - DNA, 20 bp, Homo sapiens
ccatgctctttcaccctgcc

SEQ ID NO: 4816247 - DNA, 24 bp, Homo sapiens
ccatgctgggccggggtgtggaat

SEQ ID NO: 4816248 - DNA, 18 bp, Homo sapiens
ccatgctgtccctgtggg

SEQ ID NO: 4816249 - DNA, 16 bp, Homo sapiens
ccatggaaaaatgcca

SEQ ID NO: 4816250 - DNA, 14 bp, Homo sapiens
ccatggatcttgct

SEQ ID NO: 4816251 - DNA, 14 bp, Homo sapiens
ccatggccaggagt

SEQ ID NO: 4816252 - DNA, 23 bp, Homo sapiens
ccatggctggatgtgcatctggc

SEQ ID NO: 4816253 - DNA, 17 bp, Homo sapiens
ccatggtcacagacccc

SEQ ID NO: 4816254 - DNA, 16 bp, Homo sapiens
ccatggtgaactgaag

SEQ ID NO: 4816255 - DNA, 13 bp, Homo sapiens
ccatggtgcagtg

SEQ ID NO: 4816256 - DNA, 20 bp, Homo sapiens
ccatggtggtttcagaaagg

SEQ ID NO: 4816257 - DNA, 22 bp, Homo sapiens
ccatggtggtttcagaaagggc

SEQ ID NO: 4816258 - DNA, 15 bp, Homo sapiens
ccatgtatgttgcat

SEQ ID NO: 4816259 - DNA, 17 bp, Homo sapiens
ccatgtatgttgcatga

SEQ ID NO: 4816260 - DNA, 19 bp, Homo sapiens
ccatgtatgttgcatgaat

SEQ ID NO: 4816261 - DNA, 22 bp, Homo sapiens
ccatgtcctaggggccgaggga

SEQ ID NO: 4816262 - DNA, 15 bp, Homo sapiens
ccatgtctttctcca

SEQ ID NO: 4816263 - DNA, 16 bp, Homo sapiens
ccatgtgtcccccctg

SEQ ID NO: 4816264 - DNA, 20 bp, Homo sapiens
ccatgtgtcccccctgtggt

SEQ ID NO: 4816265 - DNA, 14 bp, Homo sapiens
ccatgtgtcccctc

SEQ ID NO: 4816266 - DNA, 17 bp, Homo sapiens
ccatgtgtcccctcact

SEQ ID NO: 4816267 - DNA, 20 bp, Homo sapiens
ccatgtgtcccctcactctg

SEQ ID NO: 4816268 - DNA, 23 bp, Homo sapiens
ccattaatgtagataaagcactg

SEQ ID NO: 4816269 - DNA, 15 bp, Homo sapiens
ccattagtatcctgt

SEQ ID NO: 4816270 - DNA, 22 bp, Homo sapiens
ccattctccaggggtttacagt

SEQ ID NO: 4816271 - DNA, 22 bp, Homo sapiens
ccattgaccctcacctgaataa

SEQ ID NO: 4816272 - DNA, 13 bp, Homo sapiens
ccattgccttctg

SEQ ID NO: 4816273 - DNA, 16 bp, Homo sapiens
ccattgccttctgggg

SEQ ID NO: 4816274 - DNA, 10 bp, Homo sapiens
ccattgcttc

SEQ ID NO: 4816275 - DNA, 20 bp, Homo sapiens
ccattggccttaactggccc

SEQ ID NO: 4816276 - DNA, 23 bp, Homo sapiens
ccatttaaaacaagctgatagtg

SEQ ID NO: 4816277 - DNA, 22 bp, Homo sapiens
ccatttagtcctcaccttctgt

SEQ ID NO: 4816278 - DNA, 19 bp, Homo sapiens
ccatttcaatagccccatc

SEQ ID NO: 4816279 - DNA, 16 bp, Homo sapiens
ccatttcacattcctg

SEQ ID NO: 4816280 - DNA, 23 bp, Homo sapiens
ccatttcacattcctgaccctca

SEQ ID NO: 4816281 - DNA, 14 bp, Homo sapiens
ccatttcccctgtg

SEQ ID NO: 4816282 - DNA, 15 bp, Homo sapiens
ccatttcctcctggg

SEQ ID NO: 4816283 - DNA, 13 bp, Homo sapiens
ccatttgctcctt

SEQ ID NO: 4816284 - DNA, 12 bp, Homo sapiens
ccatttgctgat

SEQ ID NO: 4816285 - DNA, 15 bp, Homo sapiens
ccatttgtatacttt

SEQ ID NO: 4816286 - DNA, 14 bp, Homo sapiens
ccatttgtgtttat

SEQ ID NO: 4816287 - DNA, 15 bp, Homo sapiens
ccatttgttaatatc

SEQ ID NO: 4816288 - DNA, 17 bp, Homo sapiens
ccatttgttaatatcac

SEQ ID NO: 4816289 - DNA, 12 bp, Homo sapiens
ccattttggaaa

SEQ ID NO: 4816290 - DNA, 23 bp, Homo sapiens
ccattttggattcttatggacaa

SEQ ID NO: 4816291 - DNA, 17 bp, Homo sapiens
ccatttttgagtaaaac

SEQ ID NO: 4816292 - DNA, 16 bp, Homo sapiens
cccaaacagcatgtgc

SEQ ID NO: 4816293 - DNA, 15 bp, Homo sapiens
cccaaagatgcagcc

SEQ ID NO: 4816294 - DNA, 12 bp, Homo sapiens
cccaaataacag

SEQ ID NO: 4816295 - DNA, 20 bp, Homo sapiens
cccaacctcccctggtcctg

SEQ ID NO: 4816296 - DNA, 22 bp, Homo sapiens
cccaaggcactgagcgcctgca

SEQ ID NO: 4816297 - DNA, 21 bp, Homo sapiens
cccaaggcccccacctctgtg

SEQ ID NO: 4816298 - DNA, 18 bp, Homo sapiens
cccaaggtggtcttggag

SEQ ID NO: 4816299 - DNA, 14 bp, Homo sapiens
cccaagtcctcgcc

SEQ ID NO: 4816300 - DNA, 17 bp, Homo sapiens
cccaagttggaagggac

SEQ ID NO: 4816301 - DNA, 17 bp, Homo sapiens
cccaatcagcactgaaa

SEQ ID NO: 4816302 - DNA, 18 bp, Homo sapiens
cccaatccaacccatgca

SEQ ID NO: 4816303 - DNA, 17 bp, Homo sapiens
cccaatttcacagagta

SEQ ID NO: 4816304 - DNA, 18 bp, Homo sapiens
cccacaataatgaataat

SEQ ID NO: 4816305 - DNA, 15 bp, Homo sapiens
cccacacagcccgag

SEQ ID NO: 4816306 - DNA, 13 bp, Homo sapiens
cccacacaggcct

SEQ ID NO: 4816307 - DNA, 17 bp, Homo sapiens
cccacacaggcctggcc

SEQ ID NO: 4816308 - DNA, 19 bp, Homo sapiens
cccacacaggcctggccca

SEQ ID NO: 4816309 - DNA, 20 bp, Homo sapiens
cccacacaggcctggcccag

SEQ ID NO: 4816310 - DNA, 20 bp, Homo sapiens
cccacaccccgtctgcccct

SEQ ID NO: 4816311 - DNA, 22 bp, Homo sapiens
cccacaccccgtctgccccttg

SEQ ID NO: 4816312 - DNA, 22 bp, Homo sapiens
cccacacgccggggctggccct

SEQ ID NO: 4816313 - DNA, 21 bp, Homo sapiens
cccacacttgcagagctgctg

SEQ ID NO: 4816314 - DNA, 17 bp, Homo sapiens
cccacaggagcgtgtcc

SEQ ID NO: 4816315 - DNA, 19 bp, Homo sapiens
cccacaggagctccctttt

SEQ ID NO: 4816316 - DNA, 16 bp, Homo sapiens
cccacaggaggcaagc

SEQ ID NO: 4816317 - DNA, 13 bp, Homo sapiens
cccacataaacac

SEQ ID NO: 4816318 - DNA, 17 bp, Homo sapiens
cccaccacacacaccct

SEQ ID NO: 4816319 - DNA, 15 bp, Homo sapiens
cccaccactctcagg

SEQ ID NO: 4816320 - DNA, 19 bp, Homo sapiens
cccaccactctcaggacca

SEQ ID NO: 4816321 - DNA, 16 bp, Homo sapiens
cccacccacaccccgt

SEQ ID NO: 4816322 - DNA, 21 bp, Homo sapiens
cccacccacaccccgtctgcc

SEQ ID NO: 4816323 - DNA, 12 bp, Homo sapiens
cccacccagcag

SEQ ID NO: 4816324 - DNA, 19 bp, Homo sapiens
cccacccctacagcctgca

SEQ ID NO: 4816325 - DNA, 18 bp, Homo sapiens
cccacccctcttccccct

SEQ ID NO: 4816326 - DNA, 13 bp, Homo sapiens
cccacccctgccc

SEQ ID NO: 4816327 - DNA, 16 bp, Homo sapiens
cccacccgtgttctcc

SEQ ID NO: 4816328 - DNA, 16 bp, Homo sapiens
cccaccctgctgcctt

SEQ ID NO: 4816329 - DNA, 20 bp, Homo sapiens
cccacctaaagggaagccct

SEQ ID NO: 4816330 - DNA, 13 bp, Homo sapiens
cccacctcacccc

SEQ ID NO: 4816331 - DNA, 15 bp, Homo sapiens
cccacctcccggtgt

SEQ ID NO: 4816332 - DNA, 13 bp, Homo sapiens
cccacctccctgc

SEQ ID NO: 4816333 - DNA, 16 bp, Homo sapiens
cccacctccctgcagc

SEQ ID NO: 4816334 - DNA, 14 bp, Homo sapiens
cccacctccctgcc

SEQ ID NO: 4816335 - DNA, 16 bp, Homo sapiens
cccacctccctgccca

SEQ ID NO: 4816336 - DNA, 13 bp, Homo sapiens
cccacctgcccag

SEQ ID NO: 4816337 - DNA, 21 bp, Homo sapiens
cccacctgggccctaggcata

SEQ ID NO: 4816338 - DNA, 15 bp, Homo sapiens
cccacgcagagcccc

SEQ ID NO: 4816339 - DNA, 21 bp, Homo sapiens
cccacgcagagccccggagca

SEQ ID NO: 4816340 - DNA, 20 bp, Homo sapiens
cccacgccgatataagccat

SEQ ID NO: 4816341 - DNA, 22 bp, Homo sapiens
ccctcctcgccgggccattctg

SEQ ID NO: 4816342 - DNA, 15 bp, Homo sapiens
ccctcctctcctcgt

SEQ ID NO: 4816343 - DNA, 14 bp, Homo sapiens
ccctcctggctcac

SEQ ID NO: 4816344 - DNA, 17 bp, Homo sapiens
ccctcctggctcacagc

SEQ ID NO: 4816345 - DNA, 18 bp, Homo sapiens
ccctcctggctcacagcc

SEQ ID NO: 4816346 - DNA, 19 bp, Homo sapiens
ccctcctggctcacagcca

SEQ ID NO: 4816347 - DNA, 20 bp, Homo sapiens
ccctcctggctcacagccac

SEQ ID NO: 4816348 - DNA, 22 bp, Homo sapiens
ccctccttctcccctccagacc

SEQ ID NO: 4816349 - DNA, 14 bp, Homo sapiens
ccctcgagctctgt

SEQ ID NO: 4816350 - DNA, 19 bp, Homo sapiens
ccctcgagctctgtagcct

SEQ ID NO: 4816351 - DNA, 13 bp, Homo sapiens
ccctcgctccggg

SEQ ID NO: 4816352 - DNA, 13 bp, Homo sapiens
ccctcgctgccac

SEQ ID NO: 4816353 - DNA, 14 bp, Homo sapiens
ccctcggtcagcac

SEQ ID NO: 4816354 - DNA, 21 bp, Homo sapiens
ccctcggtcagcaccgtggtg

SEQ ID NO: 4816355 - DNA, 15 bp, Homo sapiens
ccctctccctcagtc

SEQ ID NO: 4816356 - DNA, 14 bp, Homo sapiens
ccctctccttcctt

SEQ ID NO: 4816357 - DNA, 23 bp, Homo sapiens
ccctctctccgccccggacaggg

SEQ ID NO: 4816358 - DNA, 18 bp, Homo sapiens
ccctctctgtttaccctc

SEQ ID NO: 4816359 - DNA, 21 bp, Homo sapiens
ccctctgctatgtctgtgatg

SEQ ID NO: 4816360 - DNA, 15 bp, Homo sapiens
ccctcttcccccttc

SEQ ID NO: 4816361 - DNA, 20 bp, Homo sapiens
ccctcttcccccttcccctg

SEQ ID NO: 4816362 - DNA, 18 bp, Homo sapiens
ccctcttctcagctccac

SEQ ID NO: 4816363 - DNA, 23 bp, Homo sapiens
ccctcttctcagctccactctga

SEQ ID NO: 4816364 - DNA, 22 bp, Homo sapiens
ccctcttcttgcggcaccgccc

SEQ ID NO: 4816365 - DNA, 14 bp, Homo sapiens
ccctctttctctct

SEQ ID NO: 4816366 - DNA, 16 bp, Homo sapiens
ccctctttctctctgt

SEQ ID NO: 4816367 - DNA, 18 bp, Homo sapiens
ccctctttctctctgtgt

SEQ ID NO: 4816368 - DNA, 20 bp, Homo sapiens
ccctctttctctctgtgtgg

SEQ ID NO: 4816369 - DNA, 15 bp, Homo sapiens
ccctgaacactcatc

SEQ ID NO: 4816370 - DNA, 21 bp, Homo sapiens
ccctgacaacaactatcacca

SEQ ID NO: 4816371 - DNA, 13 bp, Homo sapiens
ccctgacaggcct

SEQ ID NO: 4816372 - DNA, 16 bp, Homo sapiens
ccctgacaggccttcc

SEQ ID NO: 4816373 - DNA, 15 bp, Homo sapiens
ccctgacatgctaac

SEQ ID NO: 4816374 - DNA, 20 bp, Homo sapiens
ccctgacatgctaacctctc

SEQ ID NO: 4816375 - DNA, 14 bp, Homo sapiens
ccctgacttcccag

SEQ ID NO: 4816376 - DNA, 18 bp, Homo sapiens
ccctgacttcccagctgg

SEQ ID NO: 4816377 - DNA, 19 bp, Homo sapiens
ccctgacttcccagctggc

SEQ ID NO: 4816378 - DNA, 20 bp, Homo sapiens
ccctgacttcccagctggca

SEQ ID NO: 4816379 - DNA, 22 bp, Homo sapiens
ccctgaggaaggaggggaagct

SEQ ID NO: 4816380 - DNA, 17 bp, Homo sapiens
ccctgagggacgagcag

SEQ ID NO: 4816381 - DNA, 18 bp, Homo sapiens
ccctgagggacgagcaga

SEQ ID NO: 4816382 - DNA, 22 bp, Homo sapiens
ccctgagggacgagcagagcgc

SEQ ID NO: 4816383 - DNA, 13 bp, Homo sapiens
ccctgagggccct

SEQ ID NO: 4816384 - DNA, 23 bp, Homo sapiens
ccctgagggcccttcccaacctc

SEQ ID NO: 4816385 - DNA, 14 bp, Homo sapiens
ccctgcaaggccca

SEQ ID NO: 4816386 - DNA, 21 bp, Homo sapiens
ccctgcaaggcccacaggagg

SEQ ID NO: 4816387 - DNA, 15 bp, Homo sapiens
ccctgcaaggtgcac

SEQ ID NO: 4816388 - DNA, 21 bp, Homo sapiens
ccctgcacccacccctgccca

SEQ ID NO: 4816389 - DNA, 15 bp, Homo sapiens
ccctgcaccttgggc

SEQ ID NO: 4816390 - DNA, 18 bp, Homo sapiens
ccctgcagagggcacaga

SEQ ID NO: 4816391 - DNA, 20 bp, Homo sapiens
ccctgcagagggcacagaaa

SEQ ID NO: 4816392 - DNA, 12 bp, Homo sapiens
ccctgccaaggc

SEQ ID NO: 4816393 - DNA, 20 bp, Homo sapiens
ccctgccaccctctgctgca

SEQ ID NO: 4816394 - DNA, 22 bp, Homo sapiens
ccctgccaccctctgctgcaca

SEQ ID NO: 4816395 - DNA, 16 bp, Homo sapiens
ccctgcccagcacctc

SEQ ID NO: 4816396 - DNA, 18 bp, Homo sapiens
ccctgcccagcacctcct

SEQ ID NO: 4816397 - DNA, 23 bp, Homo sapiens
ccctgcccagcacctcctccgtg

SEQ ID NO: 4816398 - DNA, 12 bp, Homo sapiens
ccctgccccaca

SEQ ID NO: 4816399 - DNA, 13 bp, Homo sapiens
ccctgccccacac

SEQ ID NO: 4816400 - DNA, 19 bp, Homo sapiens
ccctgccccacacaggcct

SEQ ID NO: 4816401 - DNA, 21 bp, Homo sapiens
ccctgccccacacaggcctgg

SEQ ID NO: 4816402 - DNA, 11 bp, Homo sapiens
ccctgccctct

SEQ ID NO: 4816403 - DNA, 12 bp, Homo sapiens
ccctgccctgca

SEQ ID NO: 4816404 - DNA, 13 bp, Homo sapiens
ccctgcgcccctg

SEQ ID NO: 4816405 - DNA, 20 bp, Homo sapiens
ccctgcgcccctgcccagca

SEQ ID NO: 4816406 - DNA, 17 bp, Homo sapiens
ccctgcgccctccctcc

SEQ ID NO: 4816407 - DNA, 14 bp, Homo sapiens
ccctgcggggcggc

SEQ ID NO: 4816408 - DNA, 18 bp, Homo sapiens
ccctgcgtctcctcgtcc

SEQ ID NO: 4816409 - DNA, 14 bp, Homo sapiens
ccctgctcaggcct

SEQ ID NO: 4816410 - DNA, 18 bp, Homo sapiens
ccctgctcaggcctcacc

SEQ ID NO: 4816411 - DNA, 20 bp, Homo sapiens
ccctgctcaggcctcacctg

SEQ ID NO: 4816412 - DNA, 19 bp, Homo sapiens
ccctgctcccggctctgag

SEQ ID NO: 4816413 - DNA, 14 bp, Homo sapiens
ccctgctccctgct

SEQ ID NO: 4816414 - DNA, 13 bp, Homo sapiens
ccctgctgagtgg

SEQ ID NO: 4816415 - DNA, 14 bp, Homo sapiens
ccctgctgccaggc

SEQ ID NO: 4816416 - DNA, 21 bp, Homo sapiens
ccctgctgccaggctcccact

SEQ ID NO: 4816417 - DNA, 19 bp, Homo sapiens
ccctgctgccttctgacgg

SEQ ID NO: 4816418 - DNA, 12 bp, Homo sapiens
ccctgctggacc

SEQ ID NO: 4816419 - DNA, 13 bp, Homo sapiens
ccctgctggacca

SEQ ID NO: 4816420 - DNA, 22 bp, Homo sapiens
ccctgcttctcccgccattggc

SEQ ID NO: 4816421 - DNA, 23 bp, Homo sapiens
ccctgcttctcccgccattggcc

SEQ ID NO: 4816422 - DNA, 12 bp, Homo sapiens
ccctgcttctgc

SEQ ID NO: 4816423 - DNA, 13 bp, Homo sapiens
ccctgcttctgct

SEQ ID NO: 4816424 - DNA, 19 bp, Homo sapiens
ccctgcttctgctgccctg

SEQ ID NO: 4816425 - DNA, 20 bp, Homo sapiens
ccctggacgcatgcagggcc

SEQ ID NO: 4816426 - DNA, 17 bp, Homo sapiens
ccctggagttcctcatc

SEQ ID NO: 4816427 - DNA, 12 bp, Homo sapiens
ccctggcagccc

SEQ ID NO: 4816428 - DNA, 14 bp, Homo sapiens
ccctggcagcccct

SEQ ID NO: 4816429 - DNA, 17 bp, Homo sapiens
ccctggcccttccttca

SEQ ID NO: 4816430 - DNA, 22 bp, Homo sapiens
ccctggcccttccttcacccac

SEQ ID NO: 4816431 - DNA, 20 bp, Homo sapiens
ccctgggatgggaccaggga

SEQ ID NO: 4816432 - DNA, 13 bp, Homo sapiens
ccctgggcacata

SEQ ID NO: 4816433 - DNA, 17 bp, Homo sapiens
ccctgggcccctccacg

SEQ ID NO: 4816434 - DNA, 19 bp, Homo sapiens
ccctgggcccctccacgcc

SEQ ID NO: 4816435 - DNA, 22 bp, Homo sapiens
ccctgggcccctccacgcctcc

SEQ ID NO: 4816436 - DNA, 14 bp, Homo sapiens
ccctgggcctcccg

SEQ ID NO: 4816437 - DNA, 17 bp, Homo sapiens
ccctgggcctcccgtcc

SEQ ID NO: 4816438 - DNA, 18 bp, Homo sapiens
ccctgggctgtctgtcac

SEQ ID NO: 4816439 - DNA, 20 bp, Homo sapiens
ccctgggctgtctgtcacca

SEQ ID NO: 4816440 - DNA, 18 bp, Homo sapiens
ccctggggaggacccctg

SEQ ID NO: 4816441 - DNA, 20 bp, Homo sapiens
ccctggggaggacccctgcc

SEQ ID NO: 4816442 - DNA, 21 bp, Homo sapiens
ccctggggaggacccctgccc

SEQ ID NO: 4816443 - DNA, 22 bp, Homo sapiens
ccctggggaggacccctgccct

SEQ ID NO: 4816444 - DNA, 13 bp, Homo sapiens
ccctggggcaggg

SEQ ID NO: 4816445 - DNA, 14 bp, Homo sapiens
ccctggggtctctg

SEQ ID NO: 4816446 - DNA, 19 bp, Homo sapiens
ccctggggtctctgagcag

SEQ ID NO: 4816447 - DNA, 22 bp, Homo sapiens
ccctggggtctctgagcagtgg

SEQ ID NO: 4816448 - DNA, 16 bp, Homo sapiens
ccctgggtgggccctg

SEQ ID NO: 4816449 - DNA, 16 bp, Homo sapiens
ccctgtagccctggcc

SEQ ID NO: 4816450 - DNA, 18 bp, Homo sapiens
ccctgtagccctggcccg

SEQ ID NO: 4816451 - DNA, 19 bp, Homo sapiens
ccctgtagccctggcccgg

SEQ ID NO: 4816452 - DNA, 9 bp, Homo sapiens
ccctgtcac

SEQ ID NO: 4816453 - DNA, 15 bp, Homo sapiens
ccctgtcccctcctc

SEQ ID NO: 4816454 - DNA, 18 bp, Homo sapiens
ccctgtcccctcctcgcc

SEQ ID NO: 4816455 - DNA, 15 bp, Homo sapiens
ccctgtgccccgcct

SEQ ID NO: 4816456 - DNA, 12 bp, Homo sapiens
ccctgtgcctgt

SEQ ID NO: 4816457 - DNA, 16 bp, Homo sapiens
ccctgtgggagtccac

SEQ ID NO: 4816458 - DNA, 17 bp, Homo sapiens
ccctgtgggagtccact

SEQ ID NO: 4816459 - DNA, 20 bp, Homo sapiens
ccctgtgggagtccactttc

SEQ ID NO: 4816460 - DNA, 22 bp, Homo sapiens
ccctgtgggagtccactttcct

SEQ ID NO: 4816461 - DNA, 15 bp, Homo sapiens
ccctgtgggctcaca

SEQ ID NO: 4816462 - DNA, 17 bp, Homo sapiens
ccctgtgggctcacacc

SEQ ID NO: 4816463 - DNA, 19 bp, Homo sapiens
ccctgtgggctcacaccgg

SEQ ID NO: 4816464 - DNA, 21 bp, Homo sapiens
ccctgtgggctcacaccggca

SEQ ID NO: 4816465 - DNA, 18 bp, Homo sapiens
ccctgtgggggtggccat

SEQ ID NO: 4816466 - DNA, 14 bp, Homo sapiens
ccctgtggtctgtg

SEQ ID NO: 4816467 - DNA, 13 bp, Homo sapiens
ccctgtgtgaatg

SEQ ID NO: 4816468 - DNA, 14 bp, Homo sapiens
ccctgttctggcag

SEQ ID NO: 4816469 - DNA, 17 bp, Homo sapiens
cccttacctgccaggaa

SEQ ID NO: 4816470 - DNA, 23 bp, Homo sapiens
cccttacctgccaggaagccagc

SEQ ID NO: 4816471 - DNA, 14 bp, Homo sapiens
cccttcatcccagg

SEQ ID NO: 4816472 - DNA, 12 bp, Homo sapiens
cccttccactgc

SEQ ID NO: 4816473 - DNA, 13 bp, Homo sapiens
cccttccagacat

SEQ ID NO: 4816474 - DNA, 11 bp, Homo sapiens
cccttcccaac

SEQ ID NO: 4816475 - DNA, 20 bp, Homo sapiens
cccttcccaatcagcactga

SEQ ID NO: 4816476 - DNA, 12 bp, Homo sapiens
cccttccccact

SEQ ID NO: 4816477 - DNA, 14 bp, Homo sapiens
cccttccccactcc

SEQ ID NO: 4816478 - DNA, 17 bp, Homo sapiens
cccttcccctgcgccct

SEQ ID NO: 4816479 - DNA, 19 bp, Homo sapiens
cccttccccttctgtgtca

SEQ ID NO: 4816480 - DNA, 14 bp, Homo sapiens
cccttcccttccac

SEQ ID NO: 4816481 - DNA, 17 bp, Homo sapiens
cccttcctgtcctgctc

SEQ ID NO: 4816482 - DNA, 16 bp, Homo sapiens
cccttctaccttcctg

SEQ ID NO: 4816483 - DNA, 17 bp, Homo sapiens
cccttctgtgtcacagt

SEQ ID NO: 4816484 - DNA, 15 bp, Homo sapiens
cccttctttccttcc

SEQ ID NO: 4816485 - DNA, 13 bp, Homo sapiens
cccttcttttcct

SEQ ID NO: 4816486 - DNA, 13 bp, Homo sapiens
cccttggcccctc

SEQ ID NO: 4816487 - DNA, 12 bp, Homo sapiens
ccctttccctgc

SEQ ID NO: 4816488 - DNA, 21 bp, Homo sapiens
ccgaacgctgctccatgcaca

SEQ ID NO: 4816489 - DNA, 13 bp, Homo sapiens
ccgagattcagac

SEQ ID NO: 4816490 - DNA, 22 bp, Homo sapiens
ccgagcgcgtgccttccccgtg

SEQ ID NO: 4816491 - DNA, 10 bp, Homo sapiens
ccgaggactc

SEQ ID NO: 4816492 - DNA, 21 bp, Homo sapiens
ccgaggcagcaacaggaccag

SEQ ID NO: 4816493 - DNA, 17 bp, Homo sapiens
ccgagggcgcctgggtc

SEQ ID NO: 4816494 - DNA, 17 bp, Homo sapiens
ccgatgtccctgtcccc

SEQ ID NO: 4816495 - DNA, 15 bp, Homo sapiens
ccgattcttccttgc

SEQ ID NO: 4816496 - DNA, 17 bp, Homo sapiens
ccgattcttccttgcca

SEQ ID NO: 4816497 - DNA, 16 bp, Homo sapiens
ccgcaacttcccaggc

SEQ ID NO: 4816498 - DNA, 13 bp, Homo sapiens
ccgcacaccctca

SEQ ID NO: 4816499 - DNA, 22 bp, Homo sapiens
ccgcacaccctcactctgccag

SEQ ID NO: 4816500 - DNA, 14 bp, Homo sapiens
ccgcacagcagcct

SEQ ID NO: 4816501 - DNA, 15 bp, Homo sapiens
ccgcaccgggctggc

SEQ ID NO: 4816502 - DNA, 19 bp, Homo sapiens
ccgcacgcggccgctctcc

SEQ ID NO: 4816503 - DNA, 20 bp, Homo sapiens
ccgcactcaggagcacagcc

SEQ ID NO: 4816504 - DNA, 13 bp, Homo sapiens
ccgcagaaggaag

SEQ ID NO: 4816505 - DNA, 13 bp, Homo sapiens
ccgcagaggcccg

SEQ ID NO: 4816506 - DNA, 15 bp, Homo sapiens
ccgcagcaccagcct

SEQ ID NO: 4816507 - DNA, 17 bp, Homo sapiens
ccgcagcaccagcctga

SEQ ID NO: 4816508 - DNA, 19 bp, Homo sapiens
ccgcagcaccagcctgagc

SEQ ID NO: 4816509 - DNA, 20 bp, Homo sapiens
ccgcagcaccagcctgagcc

SEQ ID NO: 4816510 - DNA, 14 bp, Homo sapiens
ccgcagccctgcag

SEQ ID NO: 4816511 - DNA, 21 bp, Homo sapiens
ccgcagggcgctccggcagag

SEQ ID NO: 4816512 - DNA, 14 bp, Homo sapiens
ccgcaggggcccct

SEQ ID NO: 4816513 - DNA, 17 bp, Homo sapiens
ccgcatgctgcctgcct

SEQ ID NO: 4816514 - DNA, 14 bp, Homo sapiens
ccgccagccctgtt

SEQ ID NO: 4816515 - DNA, 18 bp, Homo sapiens
ccgcccaacccccacctc

SEQ ID NO: 4816516 - DNA, 20 bp, Homo sapiens
ccgcccacccagcagcgccc

SEQ ID NO: 4816517 - DNA, 16 bp, Homo sapiens
ccgcccaccccgctgc

SEQ ID NO: 4816518 - DNA, 18 bp, Homo sapiens
ccgcccaccccgctgcct

SEQ ID NO: 4816519 - DNA, 13 bp, Homo sapiens
ccgcccacctggg

SEQ ID NO: 4816520 - DNA, 20 bp, Homo sapiens
ccgcccacctgggccctagg

SEQ ID NO: 4816521 - DNA, 12 bp, Homo sapiens
ccgccccagaga

SEQ ID NO: 4816522 - DNA, 13 bp, Homo sapiens
ccgccccagagac

SEQ ID NO: 4816523 - DNA, 14 bp, Homo sapiens
ccgccccagagact

SEQ ID NO: 4816524 - DNA, 14 bp, Homo sapiens
ccgccccaggcacc

SEQ ID NO: 4816525 - DNA, 12 bp, Homo sapiens
ccgcccccaccc

SEQ ID NO: 4816526 - DNA, 15 bp, Homo sapiens
ccgcccccaccccta

SEQ ID NO: 4816527 - DNA, 14 bp, Homo sapiens
ccgcccccgccctc

SEQ ID NO: 4816528 - DNA, 11 bp, Homo sapiens
ccgcccctccc

SEQ ID NO: 4816529 - DNA, 13 bp, Homo sapiens
ccgcccgcccacc

SEQ ID NO: 4816530 - DNA, 18 bp, Homo sapiens
ccgcccgcccaccccgct

SEQ ID NO: 4816531 - DNA, 15 bp, Homo sapiens
ccgcccggcctccta

SEQ ID NO: 4816532 - DNA, 11 bp, Homo sapiens
ccgccctcctc

SEQ ID NO: 4816533 - DNA, 13 bp, Homo sapiens
ccgccctcctctg

SEQ ID NO: 4816534 - DNA, 17 bp, Homo sapiens
ccgccctcctctgcccc

SEQ ID NO: 4816535 - DNA, 18 bp, Homo sapiens
ccgccctgggctgtctgt

SEQ ID NO: 4816536 - DNA, 20 bp, Homo sapiens
ccgccctgggctgtctgtca

SEQ ID NO: 4816537 - DNA, 16 bp, Homo sapiens
ccgccctttccttgcc

SEQ ID NO: 4816538 - DNA, 17 bp, Homo sapiens
ccgccgaagggcagccc

SEQ ID NO: 4816539 - DNA, 15 bp, Homo sapiens
ccgccgcctcgggcc

SEQ ID NO: 4816540 - DNA, 21 bp, Homo sapiens
ccgccggttggccggctggcc

SEQ ID NO: 4816541 - DNA, 15 bp, Homo sapiens
ccgcctcactgggtg

SEQ ID NO: 4816542 - DNA, 20 bp, Homo sapiens
ccgcctcactgggtgtggcc

SEQ ID NO: 4816543 - DNA, 16 bp, Homo sapiens
ccgcctcccggggtgc

SEQ ID NO: 4816544 - DNA, 14 bp, Homo sapiens
ccgcctccctcacc

SEQ ID NO: 4816545 - DNA, 16 bp, Homo sapiens
ccgcctcctccagact

SEQ ID NO: 4816546 - DNA, 12 bp, Homo sapiens
ccgcctcgcccc

SEQ ID NO: 4816547 - DNA, 15 bp, Homo sapiens
ccgcctcgcccccgg

SEQ ID NO: 4816548 - DNA, 18 bp, Homo sapiens
ccgcctcgcccccgggcc

SEQ ID NO: 4816549 - DNA, 15 bp, Homo sapiens
ccgcctcgggccgcc

SEQ ID NO: 4816550 - DNA, 17 bp, Homo sapiens
ccgcctcgggccgcctc

SEQ ID NO: 4816551 - DNA, 18 bp, Homo sapiens
ccgcctcgggccgcctcc

SEQ ID NO: 4816552 - DNA, 18 bp, Homo sapiens
ccgcgaagtccgaggcct

SEQ ID NO: 4816553 - DNA, 19 bp, Homo sapiens
ccgcgcccgccgcctccct

SEQ ID NO: 4816554 - DNA, 18 bp, Homo sapiens
ccgcgcgtgcccccagcg

SEQ ID NO: 4816555 - DNA, 15 bp, Homo sapiens
ccgcggaggcccctg

SEQ ID NO: 4816556 - DNA, 16 bp, Homo sapiens
ccgcggaggcccctga

SEQ ID NO: 4816557 - DNA, 21 bp, Homo sapiens
ccgcgggtggctggagcccca

SEQ ID NO: 4816558 - DNA, 15 bp, Homo sapiens
ccgcgtcctttcctc

SEQ ID NO: 4816559 - DNA, 18 bp, Homo sapiens
ccgcgtggttctgccact

SEQ ID NO: 4816560 - DNA, 19 bp, Homo sapiens
ccgctcccgcagcgggcgc

SEQ ID NO: 4816561 - DNA, 14 bp, Homo sapiens
ccgctctccgcccc

SEQ ID NO: 4816562 - DNA, 22 bp, Homo sapiens
ccgctcttcccaagtcctcgcc

SEQ ID NO: 4816563 - DNA, 15 bp, Homo sapiens
ccgctgcaccacggc

SEQ ID NO: 4816564 - DNA, 19 bp, Homo sapiens
ccgctgcagtcagcacaga

SEQ ID NO: 4816565 - DNA, 16 bp, Homo sapiens
ccgctgccgctgcacc

SEQ ID NO: 4816566 - DNA, 18 bp, Homo sapiens
ccgctgccgctgcaccac

SEQ ID NO: 4816567 - DNA, 12 bp, Homo sapiens
ccgctgcctggc

SEQ ID NO: 4816568 - DNA, 19 bp, Homo sapiens
ccgctgcttgagtggacag

SEQ ID NO: 4816569 - DNA, 18 bp, Homo sapiens
ccgctgggagaaaagcca

SEQ ID NO: 4816570 - DNA, 15 bp, Homo sapiens
ccgctgtcgccccag

SEQ ID NO: 4816571 - DNA, 18 bp, Homo sapiens
ccgctgtcgccccaggcc

SEQ ID NO: 4816572 - DNA, 19 bp, Homo sapiens
ccgctgtcgccccaggccc

SEQ ID NO: 4816573 - DNA, 21 bp, Homo sapiens
ccgctgtcgccccaggccctc

SEQ ID NO: 4816574 - DNA, 23 bp, Homo sapiens
ccgcttctcctgcagtctgtgga

SEQ ID NO: 4816575 - DNA, 22 bp, Homo sapiens
ccggaaggggcgctcctcccag

SEQ ID NO: 4816576 - DNA, 20 bp, Homo sapiens
ccggacgctggagaccctgc

SEQ ID NO: 4816577 - DNA, 18 bp, Homo sapiens
ccggacgctggctcggga

SEQ ID NO: 4816578 - DNA, 14 bp, Homo sapiens
ccggagcggctgag

SEQ ID NO: 4816579 - DNA, 17 bp, Homo sapiens
ccggagctccagtttct

SEQ ID NO: 4816580 - DNA, 17 bp, Homo sapiens
ccggaggcgcccacctg

SEQ ID NO: 4816581 - DNA, 18 bp, Homo sapiens
ccggaggcgcccacctgc

SEQ ID NO: 4816582 - DNA, 21 bp, Homo sapiens
ccggatctccaggcccagcct

SEQ ID NO: 4816583 - DNA, 20 bp, Homo sapiens
ccggatggaatcacagccaa

SEQ ID NO: 4816584 - DNA, 16 bp, Homo sapiens
ccggcactgtgcactc

SEQ ID NO: 4816585 - DNA, 13 bp, Homo sapiens
ccggcaggccctg

SEQ ID NO: 4816586 - DNA, 21 bp, Homo sapiens
ccggcaggccctgcagtgttc

SEQ ID NO: 4816587 - DNA, 22 bp, Homo sapiens
ccggcccaccagggactgcagc

SEQ ID NO: 4816588 - DNA, 17 bp, Homo sapiens
ccggcccacgcagagcc

SEQ ID NO: 4816589 - DNA, 13 bp, Homo sapiens
ccggcccccctct

SEQ ID NO: 4816590 - DNA, 17 bp, Homo sapiens
ccggccccgcgcgtgcc

SEQ ID NO: 4816591 - DNA, 20 bp, Homo sapiens
ccggccccgcgcgtgccccc

SEQ ID NO: 4816592 - DNA, 18 bp, Homo sapiens
ccggcctcctagcctctc

SEQ ID NO: 4816593 - DNA, 15 bp, Homo sapiens
cccacgtcccgggca

SEQ ID NO: 4816594 - DNA, 14 bp, Homo sapiens
cccactagccctct

SEQ ID NO: 4816595 - DNA, 15 bp, Homo sapiens
cccactagccctctt

SEQ ID NO: 4816596 - DNA, 23 bp, Homo sapiens
cccactagccctctttctctctg

SEQ ID NO: 4816597 - DNA, 19 bp, Homo sapiens
cccactgcccctgcacctg

SEQ ID NO: 4816598 - DNA, 17 bp, Homo sapiens
cccacttccctgcaagg

SEQ ID NO: 4816599 - DNA, 13 bp, Homo sapiens
cccagacctgccg

SEQ ID NO: 4816600 - DNA, 16 bp, Homo sapiens
cccagactcagagacc

SEQ ID NO: 4816601 - DNA, 18 bp, Homo sapiens
cccagagaagcctcagtc

SEQ ID NO: 4816602 - DNA, 20 bp, Homo sapiens
cccagagaagcctcagtccc

SEQ ID NO: 4816603 - DNA, 14 bp, Homo sapiens
cccagagactgccc

SEQ ID NO: 4816604 - DNA, 15 bp, Homo sapiens
cccagagactgccca

SEQ ID NO: 4816605 - DNA, 18 bp, Homo sapiens
cccagagactgcccaccc

SEQ ID NO: 4816606 - DNA, 22 bp, Homo sapiens
cccagagactgcccaccctggg

SEQ ID NO: 4816607 - DNA, 16 bp, Homo sapiens
cccagagagaccctgc

SEQ ID NO: 4816608 - DNA, 19 bp, Homo sapiens
cccagagagaccctgccaa

SEQ ID NO: 4816609 - DNA, 17 bp, Homo sapiens
cccagagattcccaagc

SEQ ID NO: 4816610 - DNA, 16 bp, Homo sapiens
cccagatacctgtgag

SEQ ID NO: 4816611 - DNA, 16 bp, Homo sapiens
cccagcacaaagcact

SEQ ID NO: 4816612 - DNA, 18 bp, Homo sapiens
cccagcacaaagcactgg

SEQ ID NO: 4816613 - DNA, 22 bp, Homo sapiens
cccagcacaaagcactggcctt

SEQ ID NO: 4816614 - DNA, 23 bp, Homo sapiens
cccagcacaaagcactggccttg

SEQ ID NO: 4816615 - DNA, 17 bp, Homo sapiens
cccagcacctcctccgt

SEQ ID NO: 4816616 - DNA, 13 bp, Homo sapiens
cccagcagcgccc

SEQ ID NO: 4816617 - DNA, 15 bp, Homo sapiens
cccagcagcggccca

SEQ ID NO: 4816618 - DNA, 14 bp, Homo sapiens
cccagccacccgga

SEQ ID NO: 4816619 - DNA, 22 bp, Homo sapiens
cccagcccaaccgggaaaggca

SEQ ID NO: 4816620 - DNA, 14 bp, Homo sapiens
cccagccccatccc

SEQ ID NO: 4816621 - DNA, 13 bp, Homo sapiens
cccagcccccacc

SEQ ID NO: 4816622 - DNA, 15 bp, Homo sapiens
cccagcccccacccc

SEQ ID NO: 4816623 - DNA, 17 bp, Homo sapiens
cccagccctgcccagag

SEQ ID NO: 4816624 - DNA, 17 bp, Homo sapiens
cccagcctcccccaggc

SEQ ID NO: 4816625 - DNA, 18 bp, Homo sapiens
cccagcctcccccaggct

SEQ ID NO: 4816626 - DNA, 20 bp, Homo sapiens
cccagcctggccccaaatgt

SEQ ID NO: 4816627 - DNA, 19 bp, Homo sapiens
cccagcctggccccaagca

SEQ ID NO: 4816628 - DNA, 18 bp, Homo sapiens
cccagcgcatggcgcccc

SEQ ID NO: 4816629 - DNA, 16 bp, Homo sapiens
cccagctcaggggcag

SEQ ID NO: 4816630 - DNA, 18 bp, Homo sapiens
cccagctcaggggcagct

SEQ ID NO: 4816631 - DNA, 20 bp, Homo sapiens
cccagctcaggggcagctca

SEQ ID NO: 4816632 - DNA, 16 bp, Homo sapiens
cccagctcctcttcct

SEQ ID NO: 4816633 - DNA, 15 bp, Homo sapiens
cccagctggcagcgc

SEQ ID NO: 4816634 - DNA, 13 bp, Homo sapiens
cccagcttggagt

SEQ ID NO: 4816635 - DNA, 17 bp, Homo sapiens
cccaggaattctcacag

SEQ ID NO: 4816636 - DNA, 15 bp, Homo sapiens
cccaggaccccccca

SEQ ID NO: 4816637 - DNA, 17 bp, Homo sapiens
cccaggacgcatgcagg

SEQ ID NO: 4816638 - DNA, 20 bp, Homo sapiens
cccaggacgcatgcagggcc

SEQ ID NO: 4816639 - DNA, 22 bp, Homo sapiens
cccaggcagggagggaaacccg

SEQ ID NO: 4816640 - DNA, 13 bp, Homo sapiens
cccaggccccagc

SEQ ID NO: 4816641 - DNA, 17 bp, Homo sapiens
cccaggcccgccctgcc

SEQ ID NO: 4816642 - DNA, 15 bp, Homo sapiens
cccaggccctccctg

SEQ ID NO: 4816643 - DNA, 17 bp, Homo sapiens
cccaggccctccctgac

SEQ ID NO: 4816644 - DNA, 12 bp, Homo sapiens
cccaggccggcc

SEQ ID NO: 4816645 - DNA, 18 bp, Homo sapiens
cccaggcctcctacagct

SEQ ID NO: 4816646 - DNA, 20 bp, Homo sapiens
cccaggctcaggctgcccag

SEQ ID NO: 4816647 - DNA, 21 bp, Homo sapiens
cccaggctcaggctgcccagc

SEQ ID NO: 4816648 - DNA, 17 bp, Homo sapiens
cccaggctgcgcctgcc

SEQ ID NO: 4816649 - DNA, 14 bp, Homo sapiens
cccagggcccgagc

SEQ ID NO: 4816650 - DNA, 14 bp, Homo sapiens
cccagggccctgct

SEQ ID NO: 4816651 - DNA, 17 bp, Homo sapiens
cccagggccctgctcag

SEQ ID NO: 4816652 - DNA, 19 bp, Homo sapiens
cccagggccctgctcaggc

SEQ ID NO: 4816653 - DNA, 20 bp, Homo sapiens
cccagggccctgctcaggcc

SEQ ID NO: 4816654 - DNA, 12 bp, Homo sapiens
cccagggtcctg

SEQ ID NO: 4816655 - DNA, 13 bp, Homo sapiens
cccagggtcctgg

SEQ ID NO: 4816656 - DNA, 16 bp, Homo sapiens
cccagggtgcaggcgc

SEQ ID NO: 4816657 - DNA, 19 bp, Homo sapiens
cccaggttggagtgcagtg

SEQ ID NO: 4816658 - DNA, 14 bp, Homo sapiens
cccagtccggtgcc

SEQ ID NO: 4816659 - DNA, 15 bp, Homo sapiens
cccagtccggtgcct

SEQ ID NO: 4816660 - DNA, 16 bp, Homo sapiens
cccagtccggtgcctt

SEQ ID NO: 4816661 - DNA, 22 bp, Homo sapiens
cccagtccggtgccttccaccc

SEQ ID NO: 4816662 - DNA, 17 bp, Homo sapiens
cccagtcttgagtgggc

SEQ ID NO: 4816663 - DNA, 16 bp, Homo sapiens
cccagtgggacagagg

SEQ ID NO: 4816664 - DNA, 21 bp, Homo sapiens
cccagtgtctggcccagccat

SEQ ID NO: 4816665 - DNA, 22 bp, Homo sapiens
cccagtgtctggcccagccatg

SEQ ID NO: 4816666 - DNA, 16 bp, Homo sapiens
cccagttagcccggcc

SEQ ID NO: 4816667 - DNA, 19 bp, Homo sapiens
cccagttagcccggccaag

SEQ ID NO: 4816668 - DNA, 15 bp, Homo sapiens
cccatagaaacatga

SEQ ID NO: 4816669 - DNA, 16 bp, Homo sapiens
cccatcaccggaggag

SEQ ID NO: 4816670 - DNA, 22 bp, Homo sapiens
cccatcatcaccgattcttcct

SEQ ID NO: 4816671 - DNA, 23 bp, Homo sapiens
cccatcatcaccgattcttcctt

SEQ ID NO: 4816672 - DNA, 19 bp, Homo sapiens
cccatcgctggaaaacagc

SEQ ID NO: 4816673 - DNA, 16 bp, Homo sapiens
cccatgagcgtccagg

SEQ ID NO: 4816674 - DNA, 18 bp, Homo sapiens
cccatgagcgtccaggtg

SEQ ID NO: 4816675 - DNA, 23 bp, Homo sapiens
cccatgaggcttgtggccacagt

SEQ ID NO: 4816676 - DNA, 13 bp, Homo sapiens
cccatgcatggcc

SEQ ID NO: 4816677 - DNA, 21 bp, Homo sapiens
cccatgcatggcctcccagcc

SEQ ID NO: 4816678 - DNA, 14 bp, Homo sapiens
cccatgccaccacc

SEQ ID NO: 4816679 - DNA, 18 bp, Homo sapiens
cccatgccaccacccacc

SEQ ID NO: 4816680 - DNA, 12 bp, Homo sapiens
cccatgccctcc

SEQ ID NO: 4816681 - DNA, 20 bp, Homo sapiens
cccatgccctccctgctgcc

SEQ ID NO: 4816682 - DNA, 16 bp, Homo sapiens
cccatggaacagccct

SEQ ID NO: 4816683 - DNA, 19 bp, Homo sapiens
cccatggaacagccctgca

SEQ ID NO: 4816684 - DNA, 13 bp, Homo sapiens
cccatggccccag

SEQ ID NO: 4816685 - DNA, 14 bp, Homo sapiens
cccatggccccagc

SEQ ID NO: 4816686 - DNA, 15 bp, Homo sapiens
cccatggccccagct

SEQ ID NO: 4816687 - DNA, 20 bp, Homo sapiens
cccatggtcacagacccctg

SEQ ID NO: 4816688 - DNA, 14 bp, Homo sapiens
cccatggtgcagtg

SEQ ID NO: 4816689 - DNA, 17 bp, Homo sapiens
cccatgtgtcccctcac

SEQ ID NO: 4816690 - DNA, 20 bp, Homo sapiens
cccatgtgtcccctcactct

SEQ ID NO: 4816691 - DNA, 22 bp, Homo sapiens
cccatgtgtcccctcactctgt

SEQ ID NO: 4816692 - DNA, 23 bp, Homo sapiens
cccatgtgtcccctcactctgtc

SEQ ID NO: 4816693 - DNA, 22 bp, Homo sapiens
cccattgtgaatgttgtcctgt

SEQ ID NO: 4816694 - DNA, 23 bp, Homo sapiens
cccattgtgaatgttgtcctgtg

SEQ ID NO: 4816695 - DNA, 12 bp, Homo sapiens
cccatttgtaat

SEQ ID NO: 4816696 - DNA, 14 bp, Homo sapiens
ccccaaacagcatg

SEQ ID NO: 4816697 - DNA, 12 bp, Homo sapiens
ccccaaaccctg

SEQ ID NO: 4816698 - DNA, 14 bp, Homo sapiens
ccccaaaccctgct

SEQ ID NO: 4816699 - DNA, 23 bp, Homo sapiens
ccccaaaccctgcttctgctgcc

SEQ ID NO: 4816700 - DNA, 18 bp, Homo sapiens
ccccaaatgttctttcct

SEQ ID NO: 4816701 - DNA, 12 bp, Homo sapiens
ccccaaggaaga

SEQ ID NO: 4816702 - DNA, 16 bp, Homo sapiens
ccccaaggcactgagc

SEQ ID NO: 4816703 - DNA, 18 bp, Homo sapiens
ccccacacaggcctggcc

SEQ ID NO: 4816704 - DNA, 21 bp, Homo sapiens
ccccacacaggcctggcccag

SEQ ID NO: 4816705 - DNA, 14 bp, Homo sapiens
ccccacacgccggg

SEQ ID NO: 4816706 - DNA, 18 bp, Homo sapiens
ccccaccacacacaccct

SEQ ID NO: 4816707 - DNA, 20 bp, Homo sapiens
ccccacccccgtcaccccgc

SEQ ID NO: 4816708 - DNA, 12 bp, Homo sapiens
ccccacccctac

SEQ ID NO: 4816709 - DNA, 23 bp, Homo sapiens
ccccacccctacagcctgcacac

SEQ ID NO: 4816710 - DNA, 16 bp, Homo sapiens
ccccaccctcccctct

SEQ ID NO: 4816711 - DNA, 15 bp, Homo sapiens
ccccacggccgtccc

SEQ ID NO: 4816712 - DNA, 12 bp, Homo sapiens
ccccagacctgc

SEQ ID NO: 4816713 - DNA, 17 bp, Homo sapiens
ccccagagactgcccac

SEQ ID NO: 4816714 - DNA, 19 bp, Homo sapiens
ccccagcacaaagcactgg

SEQ ID NO: 4816715 - DNA, 22 bp, Homo sapiens
ccccagcacaaagcactggcct

SEQ ID NO: 4816716 - DNA, 16 bp, Homo sapiens
ccccagccccatccca

SEQ ID NO: 4816717 - DNA, 18 bp, Homo sapiens
ccccagcctcccccaggc

SEQ ID NO: 4816718 - DNA, 20 bp, Homo sapiens
ccccagcctcccccaggctg

SEQ ID NO: 4816719 - DNA, 11 bp, Homo sapiens
ccccagctcct

SEQ ID NO: 4816720 - DNA, 14 bp, Homo sapiens
ccccaggcccgccc

SEQ ID NO: 4816721 - DNA, 19 bp, Homo sapiens
ccccaggcggaggggcttg

SEQ ID NO: 4816722 - DNA, 18 bp, Homo sapiens
ccccaggctgcgcctgcc

SEQ ID NO: 4816723 - DNA, 20 bp, Homo sapiens
ccccaggctgcgcctgcccg

SEQ ID NO: 4816724 - DNA, 22 bp, Homo sapiens
ccccaggctgcgcctgcccgcc

SEQ ID NO: 4816725 - DNA, 15 bp, Homo sapiens
ccccagggtgcaggc

SEQ ID NO: 4816726 - DNA, 14 bp, Homo sapiens
ccccagtccgcccc

SEQ ID NO: 4816727 - DNA, 17 bp, Homo sapiens
ccccagtgccagctggt

SEQ ID NO: 4816728 - DNA, 15 bp, Homo sapiens
ccccataatgcttct

SEQ ID NO: 4816729 - DNA, 23 bp, Homo sapiens
ccccataatgcttctttcctctt

SEQ ID NO: 4816730 - DNA, 13 bp, Homo sapiens
ccccatccttccc

SEQ ID NO: 4816731 - DNA, 21 bp, Homo sapiens
ccccatccttcccgcagcacc

SEQ ID NO: 4816732 - DNA, 20 bp, Homo sapiens
ccccatcgcctgggacgccc

SEQ ID NO: 4816733 - DNA, 17 bp, Homo sapiens
ccccatcgccttctggg

SEQ ID NO: 4816734 - DNA, 21 bp, Homo sapiens
ccccatctctcctgctcaccc

SEQ ID NO: 4816735 - DNA, 14 bp, Homo sapiens
ccccatgccctccc

SEQ ID NO: 4816736 - DNA, 15 bp, Homo sapiens
ccccatggaacagcc

SEQ ID NO: 4816737 - DNA, 22 bp, Homo sapiens
ccccatggaacagccctgcacg

SEQ ID NO: 4816738 - DNA, 23 bp, Homo sapiens
ccccatggaacagccctgcacgc

SEQ ID NO: 4816739 - DNA, 17 bp, Homo sapiens
ccccatggtcacagacc

SEQ ID NO: 4816740 - DNA, 20 bp, Homo sapiens
ccccattagtatcctgttag

SEQ ID NO: 4816741 - DNA, 13 bp, Homo sapiens
ccccattctggga

SEQ ID NO: 4816742 - DNA, 17 bp, Homo sapiens
ccccattctgggactgc

SEQ ID NO: 4816743 - DNA, 14 bp, Homo sapiens
cccccaaaccctgc

SEQ ID NO: 4816744 - DNA, 12 bp, Homo sapiens
cccccacaggag

SEQ ID NO: 4816745 - DNA, 12 bp, Homo sapiens
cccccaccccta

SEQ ID NO: 4816746 - DNA, 14 bp, Homo sapiens
cccccacctcccgg

SEQ ID NO: 4816747 - DNA, 19 bp, Homo sapiens
cccccacctccctgcagct

SEQ ID NO: 4816748 - DNA, 12 bp, Homo sapiens
cccccagcctcc

SEQ ID NO: 4816749 - DNA, 18 bp, Homo sapiens
cccccagcctcccccagg

SEQ ID NO: 4816750 - DNA, 21 bp, Homo sapiens
cccccagcctcccccaggctg

SEQ ID NO: 4816751 - DNA, 14 bp, Homo sapiens
cccccagctcaggg

SEQ ID NO: 4816752 - DNA, 14 bp, Homo sapiens
cccccagggagggg

SEQ ID NO: 4816753 - DNA, 14 bp, Homo sapiens
cccccagtggactc

SEQ ID NO: 4816754 - DNA, 17 bp, Homo sapiens
cccccatgggctgctgg

SEQ ID NO: 4816755 - DNA, 13 bp, Homo sapiens
cccccattgtgaa

SEQ ID NO: 4816756 - DNA, 13 bp, Homo sapiens
cccccctccccaa

SEQ ID NO: 4816757 - DNA, 12 bp, Homo sapiens
ccccccttccca

SEQ ID NO: 4816758 - DNA, 16 bp, Homo sapiens
cccccgccctcgctcc

SEQ ID NO: 4816759 - DNA, 12 bp, Homo sapiens
cccccggacgcc

SEQ ID NO: 4816760 - DNA, 19 bp, Homo sapiens
cccccggaggcgcccacct

SEQ ID NO: 4816761 - DNA, 23 bp, Homo sapiens
cccccggaggcgcccacctgccc

SEQ ID NO: 4816762 - DNA, 15 bp, Homo sapiens
cccccgggccctttc

SEQ ID NO: 4816763 - DNA, 16 bp, Homo sapiens
ccccctatccttggca

SEQ ID NO: 4816764 - DNA, 17 bp, Homo sapiens
ccccctcgcgcccctgt

SEQ ID NO: 4816765 - DNA, 10 bp, Homo sapiens
ccccctctct

SEQ ID NO: 4816766 - DNA, 21 bp, Homo sapiens
ccccctctcttaccccgtccc

SEQ ID NO: 4816767 - DNA, 12 bp, Homo sapiens
ccccctgcccca

SEQ ID NO: 4816768 - DNA, 13 bp, Homo sapiens
ccccctgccccag

SEQ ID NO: 4816769 - DNA, 15 bp, Homo sapiens
ccccctgccccagag

SEQ ID NO: 4816770 - DNA, 16 bp, Homo sapiens
ccccctgccccagaga

SEQ ID NO: 4816771 - DNA, 12 bp, Homo sapiens
ccccctgcttct

SEQ ID NO: 4816772 - DNA, 16 bp, Homo sapiens
ccccctggggggcaca

SEQ ID NO: 4816773 - DNA, 20 bp, Homo sapiens
ccccctggggggcacagcca

SEQ ID NO: 4816774 - DNA, 22 bp, Homo sapiens
ccccctggggggcacagccaga

SEQ ID NO: 4816775 - DNA, 16 bp, Homo sapiens
cccccttccccttctg

SEQ ID NO: 4816776 - DNA, 14 bp, Homo sapiens
ccccgcactgggct

SEQ ID NO: 4816777 - DNA, 14 bp, Homo sapiens
ccccgcccccaccc

SEQ ID NO: 4816778 - DNA, 18 bp, Homo sapiens
ccccgcccgccctcctct

SEQ ID NO: 4816779 - DNA, 17 bp, Homo sapiens
ccccgcccggcctccta

SEQ ID NO: 4816780 - DNA, 19 bp, Homo sapiens
ccccgcgaccacccctgtg

SEQ ID NO: 4816781 - DNA, 16 bp, Homo sapiens
ccccgcgcgtgccccc

SEQ ID NO: 4816782 - DNA, 14 bp, Homo sapiens
ccccgcggagcccc

SEQ ID NO: 4816783 - DNA, 17 bp, Homo sapiens
ccccgcggagcccccgc

SEQ ID NO: 4816784 - DNA, 12 bp, Homo sapiens
ccccgctgcctg

SEQ ID NO: 4816785 - DNA, 21 bp, Homo sapiens
ccccgctgcctggcgggcagc

SEQ ID NO: 4816786 - DNA, 13 bp, Homo sapiens
ccccgctgctccc

SEQ ID NO: 4816787 - DNA, 20 bp, Homo sapiens
ccccggaggcgcccacctgc

SEQ ID NO: 4816788 - DNA, 21 bp, Homo sapiens
ccccggaggcgcccacctgcc

SEQ ID NO: 4816789 - DNA, 14 bp, Homo sapiens
ccccggcaggccct

SEQ ID NO: 4816790 - DNA, 17 bp, Homo sapiens
ccccgtccctttccctg

SEQ ID NO: 4816791 - DNA, 12 bp, Homo sapiens
ccccgtctgccc

SEQ ID NO: 4816792 - DNA, 13 bp, Homo sapiens
ccccgtgcggccc

SEQ ID NO: 4816793 - DNA, 16 bp, Homo sapiens
ccccgttacagctccc

SEQ ID NO: 4816794 - DNA, 17 bp, Homo sapiens
ccccgttgttgtccctg

SEQ ID NO: 4816795 - DNA, 17 bp, Homo sapiens
cccctacagcctgcaca

SEQ ID NO: 4816796 - DNA, 15 bp, Homo sapiens
cccctagcctgcctc

SEQ ID NO: 4816797 - DNA, 17 bp, Homo sapiens
cccctatcctgcaccct

SEQ ID NO: 4816798 - DNA, 21 bp, Homo sapiens
cccctatcctgcaccctctgc

SEQ ID NO: 4816799 - DNA, 15 bp, Homo sapiens
cccctcactctgtca

SEQ ID NO: 4816800 - DNA, 21 bp, Homo sapiens
cccctcactctgtcagccagc

SEQ ID NO: 4816801 - DNA, 20 bp, Homo sapiens
cccctcagatgatctctcca

SEQ ID NO: 4816802 - DNA, 19 bp, Homo sapiens
cccctccacgcctcctggc

SEQ ID NO: 4816803 - DNA, 11 bp, Homo sapiens
cccctccagac

SEQ ID NO: 4816804 - DNA, 12 bp, Homo sapiens
cccctccagacc

SEQ ID NO: 4816805 - DNA, 14 bp, Homo sapiens
cccctccagacccc

SEQ ID NO: 4816806 - DNA, 14 bp, Homo sapiens
cccctcccccgcag

SEQ ID NO: 4816807 - DNA, 23 bp, Homo sapiens
cccctccctttttaaacaaatgg

SEQ ID NO: 4816808 - DNA, 16 bp, Homo sapiens
cccctccgtccccagg

SEQ ID NO: 4816809 - DNA, 20 bp, Homo sapiens
cccctccgtccccagggtgc

SEQ ID NO: 4816810 - DNA, 13 bp, Homo sapiens
cccctcctccaga

SEQ ID NO: 4816811 - DNA, 22 bp, Homo sapiens
cccctcctccagagcctgggcg

SEQ ID NO: 4816812 - DNA, 22 bp, Homo sapiens
cccctcctccatgctgtccctg

SEQ ID NO: 4816813 - DNA, 11 bp, Homo sapiens
cccctccttct

SEQ ID NO: 4816814 - DNA, 12 bp, Homo sapiens
cccctccttctc

SEQ ID NO: 4816815 - DNA, 20 bp, Homo sapiens
cccctccttctcccctccag

SEQ ID NO: 4816816 - DNA, 15 bp, Homo sapiens
cccctcgcgcccctg

SEQ ID NO: 4816817 - DNA, 14 bp, Homo sapiens
cccctcgcttcata

SEQ ID NO: 4816818 - DNA, 21 bp, Homo sapiens
cccctctcatcactgaaatcc

SEQ ID NO: 4816819 - DNA, 20 bp, Homo sapiens
cccctctcctgcatccctcc

SEQ ID NO: 4816820 - DNA, 21 bp, Homo sapiens
cccctctcgggctctctcacc

SEQ ID NO: 4816821 - DNA, 20 bp, Homo sapiens
cccctctcttaccccgtccc

SEQ ID NO: 4816822 - DNA, 12 bp, Homo sapiens
cccctctgccgg

SEQ ID NO: 4816823 - DNA, 16 bp, Homo sapiens
cccctctgcgccccag

SEQ ID NO: 4816824 - DNA, 11 bp, Homo sapiens
cccctcttccc

SEQ ID NO: 4816825 - DNA, 17 bp, Homo sapiens
cccctcttcccccttcc

SEQ ID NO: 4816826 - DNA, 14 bp, Homo sapiens
cccctgcacccacc

SEQ ID NO: 4816827 - DNA, 16 bp, Homo sapiens
cccctgcccagcacct

SEQ ID NO: 4816828 - DNA, 20 bp, Homo sapiens
cccctgcccagcacctcctc

SEQ ID NO: 4816829 - DNA, 17 bp, Homo sapiens
cccctgccccagagaag

SEQ ID NO: 4816830 - DNA, 23 bp, Homo sapiens
cccctgccccagagaagcctcag

SEQ ID NO: 4816831 - DNA, 14 bp, Homo sapiens
cccctgctggacca

SEQ ID NO: 4816832 - DNA, 13 bp, Homo sapiens
cccctgcttctcc

SEQ ID NO: 4816833 - DNA, 18 bp, Homo sapiens
cccctgcttctcccgcca

SEQ ID NO: 4816834 - DNA, 14 bp, Homo sapiens
cccctgggggaggc

SEQ ID NO: 4816835 - DNA, 21 bp, Homo sapiens
cccctgggggaggcttccagc

SEQ ID NO: 4816836 - DNA, 22 bp, Homo sapiens
cccctggggggcacagccagaa

SEQ ID NO: 4816837 - DNA, 15 bp, Homo sapiens
cccctggtcctgcac

SEQ ID NO: 4816838 - DNA, 17 bp, Homo sapiens
cccctggtcctgcactg

SEQ ID NO: 4816839 - DNA, 22 bp, Homo sapiens
cccctgtccccgcactgggctt

SEQ ID NO: 4816840 - DNA, 16 bp, Homo sapiens
cccctgtggtctgtgt

SEQ ID NO: 4816841 - DNA, 17 bp, Homo sapiens
cccctgtggtctgtgtg

SEQ ID NO: 4816842 - DNA, 20 bp, Homo sapiens
ccccttagccagttgtatat

SEQ ID NO: 4816843 - DNA, 14 bp, Homo sapiens
ccccttcccacccc

SEQ ID NO: 4816844 - DNA, 15 bp, Homo sapiens
ccccttcccctgcgc

SEQ ID NO: 4816845 - DNA, 15 bp, Homo sapiens
cccctttctcttgct

SEQ ID NO: 4816846 - DNA, 20 bp, Homo sapiens
cccgagcgcgtgccttcccc

SEQ ID NO: 4816847 - DNA, 15 bp, Homo sapiens
cccgaggccagggcc

SEQ ID NO: 4816848 - DNA, 18 bp, Homo sapiens
cccgagggcgcctgggtc

SEQ ID NO: 4816849 - DNA, 17 bp, Homo sapiens
cccgatgcgtggctccc

SEQ ID NO: 4816850 - DNA, 21 bp, Homo sapiens
cccgcacaccctcactctgcc

SEQ ID NO: 4816851 - DNA, 12 bp, Homo sapiens
cccgcacagcag

SEQ ID NO: 4816852 - DNA, 14 bp, Homo sapiens
cccgcacagcagcc

SEQ ID NO: 4816853 - DNA, 15 bp, Homo sapiens
cccgcacagcagcct

SEQ ID NO: 4816854 - DNA, 16 bp, Homo sapiens
cccgcacagcagcctg

SEQ ID NO: 4816855 - DNA, 15 bp, Homo sapiens
cccgcactcaggagc

SEQ ID NO: 4816856 - DNA, 20 bp, Homo sapiens
cccgcactcaggagcacagc

SEQ ID NO: 4816857 - DNA, 15 bp, Homo sapiens
cccgcagacagacag

SEQ ID NO: 4816858 - DNA, 20 bp, Homo sapiens
cccgcagaggtggggtgctg

SEQ ID NO: 4816859 - DNA, 12 bp, Homo sapiens
cccgcagcacca

SEQ ID NO: 4816860 - DNA, 15 bp, Homo sapiens
cccgcagcaccagcc

SEQ ID NO: 4816861 - DNA, 22 bp, Homo sapiens
cccgcagcaccagcctgagcca

SEQ ID NO: 4816862 - DNA, 20 bp, Homo sapiens
cccgcatgctgcctgcctcc

SEQ ID NO: 4816863 - DNA, 16 bp, Homo sapiens
cccgccattggcctta

SEQ ID NO: 4816864 - DNA, 16 bp, Homo sapiens
cccgccccagagactg

SEQ ID NO: 4816865 - DNA, 20 bp, Homo sapiens
cccgccccagagactgccca

SEQ ID NO: 4816866 - DNA, 14 bp, Homo sapiens
cccgcccccacccc

SEQ ID NO: 4816867 - DNA, 15 bp, Homo sapiens
cccgcccccacccct

SEQ ID NO: 4816868 - DNA, 18 bp, Homo sapiens
cccgcccccgccccgctg

SEQ ID NO: 4816869 - DNA, 14 bp, Homo sapiens
cccgccccgctgct

SEQ ID NO: 4816870 - DNA, 15 bp, Homo sapiens
cccgcccgccctcct

SEQ ID NO: 4816871 - DNA, 21 bp, Homo sapiens
cccgccctcctctgccccctc

SEQ ID NO: 4816872 - DNA, 14 bp, Homo sapiens
cccgccctggctct

SEQ ID NO: 4816873 - DNA, 18 bp, Homo sapiens
cccgccgcctcgggccgc

SEQ ID NO: 4816874 - DNA, 22 bp, Homo sapiens
cccgccggttggccggctggcc

SEQ ID NO: 4816875 - DNA, 13 bp, Homo sapiens
cccgcctgcgccc

SEQ ID NO: 4816876 - DNA, 21 bp, Homo sapiens
cccgcggagcccccgcccctc

SEQ ID NO: 4816877 - DNA, 15 bp, Homo sapiens
cccgctgcctggcgg

SEQ ID NO: 4816878 - DNA, 19 bp, Homo sapiens
cccgctgcctggcgggcag

SEQ ID NO: 4816879 - DNA, 15 bp, Homo sapiens
cccgctgctcccggt

SEQ ID NO: 4816880 - DNA, 18 bp, Homo sapiens
cccgctgctcccggtgtg

SEQ ID NO: 4816881 - DNA, 19 bp, Homo sapiens
cccgctgtcagccattcct

SEQ ID NO: 4816882 - DNA, 14 bp, Homo sapiens
cccggacagggtgg

SEQ ID NO: 4816883 - DNA, 15 bp, Homo sapiens
cccggacgctggctc

SEQ ID NO: 4816884 - DNA, 15 bp, Homo sapiens
cccggatctccaggc

SEQ ID NO: 4816885 - DNA, 16 bp, Homo sapiens
cccggatctccaggcc

SEQ ID NO: 4816886 - DNA, 19 bp, Homo sapiens
cccggatctccaggcccag

SEQ ID NO: 4816887 - DNA, 20 bp, Homo sapiens
cccggatctccaggcccagc

SEQ ID NO: 4816888 - DNA, 13 bp, Homo sapiens
cccggcaggccct

SEQ ID NO: 4816889 - DNA, 17 bp, Homo sapiens
cccggccaaggacactg

SEQ ID NO: 4816890 - DNA, 19 bp, Homo sapiens
cccggcccacgcagagccc

SEQ ID NO: 4816891 - DNA, 20 bp, Homo sapiens
cccggccccgcgcgtgcccc

SEQ ID NO: 4816892 - DNA, 12 bp, Homo sapiens
cccggcctccta

SEQ ID NO: 4816893 - DNA, 16 bp, Homo sapiens
cccggcctgatggcca

SEQ ID NO: 4816894 - DNA, 17 bp, Homo sapiens
cccggcctggccccctc

SEQ ID NO: 4816895 - DNA, 18 bp, Homo sapiens
cccggcctggccccctcg

SEQ ID NO: 4816896 - DNA, 17 bp, Homo sapiens
cccggctctgaggctgc

SEQ ID NO: 4816897 - DNA, 23 bp, Homo sapiens
cccgggaggaggatccgggcttt

SEQ ID NO: 4816898 - DNA, 21 bp, Homo sapiens
cccgggcaagacttttctttg

SEQ ID NO: 4816899 - DNA, 16 bp, Homo sapiens
cccggggaactggttt

SEQ ID NO: 4816900 - DNA, 16 bp, Homo sapiens
cccgggggtccccgga

SEQ ID NO: 4816901 - DNA, 21 bp, Homo sapiens
cccgggtactcagtcagccca

SEQ ID NO: 4816902 - DNA, 14 bp, Homo sapiens
cccggtggcttctg

SEQ ID NO: 4816903 - DNA, 21 bp, Homo sapiens
cccggtggcttctggcacctg

SEQ ID NO: 4816904 - DNA, 14 bp, Homo sapiens
cccggtgtgcagcg

SEQ ID NO: 4816905 - DNA, 14 bp, Homo sapiens
cccgtccgtccgcc

SEQ ID NO: 4816906 - DNA, 18 bp, Homo sapiens
cccgtccgtccgcccgcc

SEQ ID NO: 4816907 - DNA, 14 bp, Homo sapiens
cccgtctgcccctt

SEQ ID NO: 4816908 - DNA, 22 bp, Homo sapiens
cccgtgcgcagccgcgctctgc

SEQ ID NO: 4816909 - DNA, 22 bp, Homo sapiens
cccgtgcggcccgtgcgcagcc

SEQ ID NO: 4816910 - DNA, 17 bp, Homo sapiens
cccgtgctcacagtagc

SEQ ID NO: 4816911 - DNA, 16 bp, Homo sapiens
cccgtgctcctctgcc

SEQ ID NO: 4816912 - DNA, 15 bp, Homo sapiens
cccgtggctttgtgc

SEQ ID NO: 4816913 - DNA, 15 bp, Homo sapiens
cccgtgtggcctggg

SEQ ID NO: 4816914 - DNA, 19 bp, Homo sapiens
cccgtgtggcctgggtcct

SEQ ID NO: 4816915 - DNA, 16 bp, Homo sapiens
cccgttacagctcccc

SEQ ID NO: 4816916 - DNA, 14 bp, Homo sapiens
cccgttcccagcgc

SEQ ID NO: 4816917 - DNA, 22 bp, Homo sapiens
ccctaagcacaataaaagacat

SEQ ID NO: 4816918 - DNA, 17 bp, Homo sapiens
ccctaattctcttcgct

SEQ ID NO: 4816919 - DNA, 21 bp, Homo sapiens
ccctaattctcttcgctgtga

SEQ ID NO: 4816920 - DNA, 21 bp, Homo sapiens
ccctaattcttattttataat

SEQ ID NO: 4816921 - DNA, 22 bp, Homo sapiens
ccctaattcttattttataatt

SEQ ID NO: 4816922 - DNA, 23 bp, Homo sapiens
ccctacagcctgcacacacctgc

SEQ ID NO: 4816923 - DNA, 16 bp, Homo sapiens
ccctacttagacccag

SEQ ID NO: 4816924 - DNA, 13 bp, Homo sapiens
ccctagcagtgaa

SEQ ID NO: 4816925 - DNA, 20 bp, Homo sapiens
ccctaggcatactctccagg

SEQ ID NO: 4816926 - DNA, 13 bp, Homo sapiens
ccctagggctctc

SEQ ID NO: 4816927 - DNA, 13 bp, Homo sapiens
ccctaggtgctca

SEQ ID NO: 4816928 - DNA, 22 bp, Homo sapiens
ccctaggtgggtcaactccaag

SEQ ID NO: 4816929 - DNA, 15 bp, Homo sapiens
ccctatcctgcaccc

SEQ ID NO: 4816930 - DNA, 20 bp, Homo sapiens
ccctatcctgcaccctctgc

SEQ ID NO: 4816931 - DNA, 14 bp, Homo sapiens
ccctatccttggca

SEQ ID NO: 4816932 - DNA, 16 bp, Homo sapiens
ccctcaactctcctcc

SEQ ID NO: 4816933 - DNA, 20 bp, Homo sapiens
ccctcaactctcctccagag

SEQ ID NO: 4816934 - DNA, 21 bp, Homo sapiens
ccctcaagccaggagaccctg

SEQ ID NO: 4816935 - DNA, 18 bp, Homo sapiens
ccctcacacctcccttca

SEQ ID NO: 4816936 - DNA, 17 bp, Homo sapiens
ccctcactccactcccc

SEQ ID NO: 4816937 - DNA, 22 bp, Homo sapiens
ccctcactccactcccctcatc

SEQ ID NO: 4816938 - DNA, 13 bp, Homo sapiens
ccctcactctgcc

SEQ ID NO: 4816939 - DNA, 15 bp, Homo sapiens
ccctcactctgccag

SEQ ID NO: 4816940 - DNA, 20 bp, Homo sapiens
ccctcactctgccagggcag

SEQ ID NO: 4816941 - DNA, 15 bp, Homo sapiens
ccctcactctgtcag

SEQ ID NO: 4816942 - DNA, 22 bp, Homo sapiens
ccctcagatgatctctccacgg

SEQ ID NO: 4816943 - DNA, 21 bp, Homo sapiens
ccctcagctctccctcacacc

SEQ ID NO: 4816944 - DNA, 23 bp, Homo sapiens
ccctcatcttgaagggcccagga

SEQ ID NO: 4816945 - DNA, 17 bp, Homo sapiens
ccctccacacctccacc

SEQ ID NO: 4816946 - DNA, 16 bp, Homo sapiens
ccctccacaggagccg

SEQ ID NO: 4816947 - DNA, 18 bp, Homo sapiens
ccctccaccgcagaagga

SEQ ID NO: 4816948 - DNA, 19 bp, Homo sapiens
ccctccaccgcagaaggaa

SEQ ID NO: 4816949 - DNA, 13 bp, Homo sapiens
ccctccagacccc

SEQ ID NO: 4816950 - DNA, 19 bp, Homo sapiens
ccctccagacccctaccct

SEQ ID NO: 4816951 - DNA, 15 bp, Homo sapiens
ccctcccacctccag

SEQ ID NO: 4816952 - DNA, 18 bp, Homo sapiens
ccctcccccgcagacaga

SEQ ID NO: 4816953 - DNA, 12 bp, Homo sapiens
ccctccccctac

SEQ ID NO: 4816954 - DNA, 15 bp, Homo sapiens
ccctcccccttcccc

SEQ ID NO: 4816955 - DNA, 17 bp, Homo sapiens
ccctcccctctcctgag

SEQ ID NO: 4816956 - DNA, 22 bp, Homo sapiens
ccctcccctctcctgagcctgt

SEQ ID NO: 4816957 - DNA, 15 bp, Homo sapiens
ccctccctccacacc

SEQ ID NO: 4816958 - DNA, 14 bp, Homo sapiens
ccctccctccctgc

SEQ ID NO: 4816959 - DNA, 15 bp, Homo sapiens
ccctccctccctgct

SEQ ID NO: 4816960 - DNA, 13 bp, Homo sapiens
ccctccctcctgg

SEQ ID NO: 4816961 - DNA, 21 bp, Homo sapiens
ccctccctgactccctgtggg

SEQ ID NO: 4816962 - DNA, 11 bp, Homo sapiens
ccctccctgtc

SEQ ID NO: 4816963 - DNA, 16 bp, Homo sapiens
ccctccctgtcccctg

SEQ ID NO: 4816964 - DNA, 23 bp, Homo sapiens
ccctccctgtctgtctgtctctc

SEQ ID NO: 4816965 - DNA, 16 bp, Homo sapiens
ccctccgccagccctg

SEQ ID NO: 4816966 - DNA, 12 bp, Homo sapiens
ccctcctccaga

SEQ ID NO: 4816967 - DNA, 23 bp, Homo sapiens
ccctcctccatgctgtccctgtg

SEQ ID NO: 4816968 - DNA, 14 bp, Homo sapiens
ccctcctcccccac

SEQ ID NO: 4816969 - DNA, 21 bp, Homo sapiens
ccggcctcctagcctctccgc

SEQ ID NO: 4816970 - DNA, 12 bp, Homo sapiens
ccggcctgcagc

SEQ ID NO: 4816971 - DNA, 13 bp, Homo sapiens
ccggcctgcagcc

SEQ ID NO: 4816972 - DNA, 17 bp, Homo sapiens
ccggcctgcagcccaga

SEQ ID NO: 4816973 - DNA, 13 bp, Homo sapiens
ccggcgccccgga

SEQ ID NO: 4816974 - DNA, 14 bp, Homo sapiens
ccggcggagctctg

SEQ ID NO: 4816975 - DNA, 16 bp, Homo sapiens
ctccaggcccagcctg

SEQ ID NO: 4816976 - DNA, 21 bp, Homo sapiens
ctccaggcccagcctggcccc

SEQ ID NO: 4816977 - DNA, 19 bp, Homo sapiens
ctccagtacaataaataaa

SEQ ID NO: 4816978 - DNA, 18 bp, Homo sapiens
ctccagtagctccgcgtg

SEQ ID NO: 4816979 - DNA, 21 bp, Homo sapiens
ctccagtagctccgcgtgtct

SEQ ID NO: 4816980 - DNA, 22 bp, Homo sapiens
ctccagtataaattacatgcat

SEQ ID NO: 4816981 - DNA, 18 bp, Homo sapiens
ctccagtccccctatcct

SEQ ID NO: 4816982 - DNA, 23 bp, Homo sapiens
ctccagtccccctatccttggca

SEQ ID NO: 4816983 - DNA, 14 bp, Homo sapiens
ctccagtttctctt

SEQ ID NO: 4816984 - DNA, 18 bp, Homo sapiens
ctccatctcttgtaccag

SEQ ID NO: 4816985 - DNA, 23 bp, Homo sapiens
ctccatctcttgtaccagcccag

SEQ ID NO: 4816986 - DNA, 19 bp, Homo sapiens
ctccatgcagatctagcca

SEQ ID NO: 4816987 - DNA, 18 bp, Homo sapiens
ctccatgctcctcactgc

SEQ ID NO: 4816988 - DNA, 20 bp, Homo sapiens
ctccatgctctttcaccctg

SEQ ID NO: 4816989 - DNA, 21 bp, Homo sapiens
ctccatgctctttcaccctgc

SEQ ID NO: 4816990 - DNA, 19 bp, Homo sapiens
ctccatgctgtccctgtgg

SEQ ID NO: 4816991 - DNA, 21 bp, Homo sapiens
ctccatgctgtccctgtgggc

SEQ ID NO: 4816992 - DNA, 22 bp, Homo sapiens
ctccatgctgtccctgtgggct

SEQ ID NO: 4816993 - DNA, 18 bp, Homo sapiens
ctccatggtgaactgaag

SEQ ID NO: 4816994 - DNA, 17 bp, Homo sapiens
ctccattaaacttctac

SEQ ID NO: 4816995 - DNA, 22 bp, Homo sapiens
ctccattaaacttctactgagc

SEQ ID NO: 4816996 - DNA, 23 bp, Homo sapiens
ctccattaaacttctactgagca

SEQ ID NO: 4816997 - DNA, 19 bp, Homo sapiens
ctcccaaataaactcctta

SEQ ID NO: 4816998 - DNA, 22 bp, Homo sapiens
ctcccaagcacctgggattaca

SEQ ID NO: 4816999 - DNA, 14 bp, Homo sapiens
ctcccaagctgatg

SEQ ID NO: 4817000 - DNA, 18 bp, Homo sapiens
ctcccacctctttcttca

SEQ ID NO: 4817001 - DNA, 15 bp, Homo sapiens
ctcccagcagaggcc

SEQ ID NO: 4817002 - DNA, 15 bp, Homo sapiens
ctcccagccacccgg

SEQ ID NO: 4817003 - DNA, 16 bp, Homo sapiens
ctcccagctgacggca

SEQ ID NO: 4817004 - DNA, 22 bp, Homo sapiens
ctcccagctgtaccggccactg

SEQ ID NO: 4817005 - DNA, 13 bp, Homo sapiens
ctcccagggcccg

SEQ ID NO: 4817006 - DNA, 16 bp, Homo sapiens
ctcccagggcccgagc

SEQ ID NO: 4817007 - DNA, 19 bp, Homo sapiens
ctcccagggcccgagcgcg

SEQ ID NO: 4817008 - DNA, 13 bp, Homo sapiens
ctcccagggtcct

SEQ ID NO: 4817009 - DNA, 16 bp, Homo sapiens
ctcccagggtcctggg

SEQ ID NO: 4817010 - DNA, 19 bp, Homo sapiens
ctcccaggtttcccactgc

SEQ ID NO: 4817011 - DNA, 19 bp, Homo sapiens
ctcccatgatttggggtga

SEQ ID NO: 4817012 - DNA, 14 bp, Homo sapiens
ctccccaaggaaga

SEQ ID NO: 4817013 - DNA, 23 bp, Homo sapiens
ctccccaagtggtttccacatgc

SEQ ID NO: 4817014 - DNA, 15 bp, Homo sapiens
ctccccaatccaacc

SEQ ID NO: 4817015 - DNA, 20 bp, Homo sapiens
ctccccagccccatcccaaa

SEQ ID NO: 4817016 - DNA, 17 bp, Homo sapiens
ctccccatatataaatt

SEQ ID NO: 4817017 - DNA, 17 bp, Homo sapiens
ctcccccaaaccctgct

SEQ ID NO: 4817018 - DNA, 21 bp, Homo sapiens
ctcccccacggccgtccctga

SEQ ID NO: 4817019 - DNA, 13 bp, Homo sapiens
ctcccccaggctg

SEQ ID NO: 4817020 - DNA, 13 bp, Homo sapiens
ctcccccagggag

SEQ ID NO: 4817021 - DNA, 15 bp, Homo sapiens
ctcccccgcagacag

SEQ ID NO: 4817022 - DNA, 15 bp, Homo sapiens
ctccccctacagatc

SEQ ID NO: 4817023 - DNA, 12 bp, Homo sapiens
ctccccctcaga

SEQ ID NO: 4817024 - DNA, 22 bp, Homo sapiens
ctccccgcccgccctcctctgc

SEQ ID NO: 4817025 - DNA, 12 bp, Homo sapiens
ctcccctccaga

SEQ ID NO: 4817026 - DNA, 15 bp, Homo sapiens
ctcccctccagaccc

SEQ ID NO: 4817027 - DNA, 16 bp, Homo sapiens
ctcccctccagacccc

SEQ ID NO: 4817028 - DNA, 17 bp, Homo sapiens
ctcccctccagacccct

SEQ ID NO: 4817029 - DNA, 20 bp, Homo sapiens
ctcccctccagacccctacc

SEQ ID NO: 4817030 - DNA, 18 bp, Homo sapiens
ctcccctctcctgagcct

SEQ ID NO: 4817031 - DNA, 18 bp, Homo sapiens
ctccccttaaaatgtcta

SEQ ID NO: 4817032 - DNA, 16 bp, Homo sapiens
ctccccttgccacatc

SEQ ID NO: 4817033 - DNA, 19 bp, Homo sapiens
ctcccgcatgctgcctgcc

SEQ ID NO: 4817034 - DNA, 14 bp, Homo sapiens
ctcccgccattggc

SEQ ID NO: 4817035 - DNA, 17 bp, Homo sapiens
ctcccgccattggcctt

SEQ ID NO: 4817036 - DNA, 16 bp, Homo sapiens
ctcccgccgcctcggg

SEQ ID NO: 4817037 - DNA, 22 bp, Homo sapiens
ctcccgccgcctcgggccgcct

SEQ ID NO: 4817038 - DNA, 14 bp, Homo sapiens
ctcccggctctgag

SEQ ID NO: 4817039 - DNA, 23 bp, Homo sapiens
ctcccggggtgcccgtgtggcct

SEQ ID NO: 4817040 - DNA, 22 bp, Homo sapiens
ctcccgtccgtccgcccgccca

SEQ ID NO: 4817041 - DNA, 23 bp, Homo sapiens
ctcccgtccgtccgcccgcccac

SEQ ID NO: 4817042 - DNA, 14 bp, Homo sapiens
ctccctccactcct

SEQ ID NO: 4817043 - DNA, 15 bp, Homo sapiens
ctccctccactcctc

SEQ ID NO: 4817044 - DNA, 13 bp, Homo sapiens
ctccctccctgct

SEQ ID NO: 4817045 - DNA, 16 bp, Homo sapiens
ctccctcccttctttc

SEQ ID NO: 4817046 - DNA, 16 bp, Homo sapiens
ctccctcctggctcac

SEQ ID NO: 4817047 - DNA, 21 bp, Homo sapiens
ctccctcctggctcacagcca

SEQ ID NO: 4817048 - DNA, 23 bp, Homo sapiens
ctccctcctggctcacagccacc

SEQ ID NO: 4817049 - DNA, 12 bp, Homo sapiens
ctccctcgctgt

SEQ ID NO: 4817050 - DNA, 15 bp, Homo sapiens
ctccctcgctgtatg

SEQ ID NO: 4817051 - DNA, 16 bp, Homo sapiens
ctccctcgctgtatga

SEQ ID NO: 4817052 - DNA, 17 bp, Homo sapiens
ctccctgactccctgtg

SEQ ID NO: 4817053 - DNA, 18 bp, Homo sapiens
ctccctgactccctgtgg

SEQ ID NO: 4817054 - DNA, 21 bp, Homo sapiens
ctctgtcagccagccgccctg

SEQ ID NO: 4817055 - DNA, 18 bp, Homo sapiens
ctctgtcagtttgtgaag

SEQ ID NO: 4817056 - DNA, 20 bp, Homo sapiens
ctctgtccgtctgtcctgcg

SEQ ID NO: 4817057 - DNA, 22 bp, Homo sapiens
ctctgtccgtctgtcctgcgcc

SEQ ID NO: 4817058 - DNA, 21 bp, Homo sapiens
ctctgtcctggcccgggagcc

SEQ ID NO: 4817059 - DNA, 19 bp, Homo sapiens
ctctgtccttcccccagca

SEQ ID NO: 4817060 - DNA, 22 bp, Homo sapiens
ctctgtccttcccccagcacaa

SEQ ID NO: 4817061 - DNA, 20 bp, Homo sapiens
ctctgttccaagtgtgtgtg

SEQ ID NO: 4817062 - DNA, 21 bp, Homo sapiens
ctctgttccaagtgtgtgtgc

SEQ ID NO: 4817063 - DNA, 22 bp, Homo sapiens
ctctgttccaagtgtgtgtgca

SEQ ID NO: 4817064 - DNA, 21 bp, Homo sapiens
ctctgttgccaggctggagtg

SEQ ID NO: 4817065 - DNA, 18 bp, Homo sapiens
ctctgtttaccctccctg

SEQ ID NO: 4817066 - DNA, 16 bp, Homo sapiens
ctcttaagctgcccaa

SEQ ID NO: 4817067 - DNA, 21 bp, Homo sapiens
ctcttaatgtctcaaaataaa

SEQ ID NO: 4817068 - DNA, 13 bp, Homo sapiens
ctcttaccccgtc

SEQ ID NO: 4817069 - DNA, 14 bp, Homo sapiens
ctcttaccccgtcc

SEQ ID NO: 4817070 - DNA, 20 bp, Homo sapiens
ctcttaccccgtccctttcc

SEQ ID NO: 4817071 - DNA, 21 bp, Homo sapiens
ctcttaccccgtccctttccc

SEQ ID NO: 4817072 - DNA, 23 bp, Homo sapiens
ctcttaccccgtccctttccctg

SEQ ID NO: 4817073 - DNA, 18 bp, Homo sapiens
ctcttacggctatctagt

SEQ ID NO: 4817074 - DNA, 16 bp, Homo sapiens
ctcttcaccaggaaga

SEQ ID NO: 4817075 - DNA, 21 bp, Homo sapiens
ctcttcaccccggcaggccct

SEQ ID NO: 4817076 - DNA, 23 bp, Homo sapiens
ctcttcaccccggcaggccctgc

SEQ ID NO: 4817077 - DNA, 19 bp, Homo sapiens
ctcttcaccgccgtggggt

SEQ ID NO: 4817078 - DNA, 23 bp, Homo sapiens
ctcttcagaatatggacaaagaa

SEQ ID NO: 4817079 - DNA, 22 bp, Homo sapiens
ctcttcagacacacggggcacc

SEQ ID NO: 4817080 - DNA, 20 bp, Homo sapiens
ctcttcatgcgcagtcccca

SEQ ID NO: 4817081 - DNA, 16 bp, Homo sapiens
ctcttcccccttcccc

SEQ ID NO: 4817082 - DNA, 19 bp, Homo sapiens
ctcttccctctcgctcccc

SEQ ID NO: 4817083 - DNA, 19 bp, Homo sapiens
ctcttcctccaaagcctgg

SEQ ID NO: 4817084 - DNA, 14 bp, Homo sapiens
ctcttcctgcctct

SEQ ID NO: 4817085 - DNA, 11 bp, Homo sapiens
ctcttcctgtc

SEQ ID NO: 4817086 - DNA, 23 bp, Homo sapiens
ctcttccttgctttctcttctaa

SEQ ID NO: 4817087 - DNA, 13 bp, Homo sapiens
ctcttcctttctt

SEQ ID NO: 4817088 - DNA, 16 bp, Homo sapiens
ctcttcgctgtgatgc

SEQ ID NO: 4817089 - DNA, 18 bp, Homo sapiens
ctcttcggtggccttgag

SEQ ID NO: 4817090 - DNA, 19 bp, Homo sapiens
ctcttcttatacagataaa

SEQ ID NO: 4817091 - DNA, 20 bp, Homo sapiens
ctcttcttccttttgtatcc

SEQ ID NO: 4817092 - DNA, 16 bp, Homo sapiens
ctcttcttgcggcacc

SEQ ID NO: 4817093 - DNA, 20 bp, Homo sapiens
ctcttgccgaggagccaggc

SEQ ID NO: 4817094 - DNA, 14 bp, Homo sapiens
ctcttggcaggagt

SEQ ID NO: 4817095 - DNA, 15 bp, Homo sapiens
ctcttgggaagcagt

SEQ ID NO: 4817096 - DNA, 19 bp, Homo sapiens
ctcttgggaagcagtttca

SEQ ID NO: 4817097 - DNA, 22 bp, Homo sapiens
ctcttgggaagcagtttcagat

SEQ ID NO: 4817098 - DNA, 15 bp, Homo sapiens
ctcttggtctctttc

SEQ ID NO: 4817099 - DNA, 22 bp, Homo sapiens
ctcttggtctctttctttccaa

SEQ ID NO: 4817100 - DNA, 15 bp, Homo sapiens
ctcttgtaccagccc

SEQ ID NO: 4817101 - DNA, 16 bp, Homo sapiens
ctcttgtcattctcat

SEQ ID NO: 4817102 - DNA, 16 bp, Homo sapiens
ctctttcaccctgcca

SEQ ID NO: 4817103 - DNA, 13 bp, Homo sapiens
ctctttctctctg

SEQ ID NO: 4817104 - DNA, 17 bp, Homo sapiens
ctctttctctctgtgtg

SEQ ID NO: 4817105 - DNA, 12 bp, Homo sapiens
ctctttctttcc

SEQ ID NO: 4817106 - DNA, 15 bp, Homo sapiens
ctctttcttttgtgc

SEQ ID NO: 4817107 - DNA, 16 bp, Homo sapiens
ctgcccgcacagcagc

SEQ ID NO: 4817108 - DNA, 13 bp, Homo sapiens
ctgcccgcccgcc

SEQ ID NO: 4817109 - DNA, 22 bp, Homo sapiens
ctgcccgcgggtggctggagcc

SEQ ID NO: 4817110 - DNA, 13 bp, Homo sapiens
ctgccctccccca

SEQ ID NO: 4817111 - DNA, 22 bp, Homo sapiens
ctgccctcccccacggccgtcc

SEQ ID NO: 4817112 - DNA, 16 bp, Homo sapiens
ctgccctccgcccttc

SEQ ID NO: 4817113 - DNA, 19 bp, Homo sapiens
ctgccctccgcccttccct

SEQ ID NO: 4817114 - DNA, 11 bp, Homo sapiens
ctgccctggcc

SEQ ID NO: 4817115 - DNA, 14 bp, Homo sapiens
ctgccctggcctac

SEQ ID NO: 4817116 - DNA, 19 bp, Homo sapiens
ctgccctggcctaccacag

SEQ ID NO: 4817117 - DNA, 21 bp, Homo sapiens
ctgccctggcctaccacagct

SEQ ID NO: 4817118 - DNA, 16 bp, Homo sapiens
ctgcccttacctgcca

SEQ ID NO: 4817119 - DNA, 17 bp, Homo sapiens
ctgcccttacctgccag

SEQ ID NO: 4817120 - DNA, 22 bp, Homo sapiens
ctgcccttacctgccaggaagc

SEQ ID NO: 4817121 - DNA, 14 bp, Homo sapiens
ctgccgcagccctg

SEQ ID NO: 4817122 - DNA, 20 bp, Homo sapiens
ctgccgcagccctgcagagg

SEQ ID NO: 4817123 - DNA, 14 bp, Homo sapiens
ctgccgcctcacct

SEQ ID NO: 4817124 - DNA, 15 bp, Homo sapiens
ctgccgcctcacctt

SEQ ID NO: 4817125 - DNA, 18 bp, Homo sapiens
ctgccgctgccgctgcac

SEQ ID NO: 4817126 - DNA, 18 bp, Homo sapiens
ctgccgctgctctcccag

SEQ ID NO: 4817127 - DNA, 13 bp, Homo sapiens
ctgccgctgcttg

SEQ ID NO: 4817128 - DNA, 15 bp, Homo sapiens
ctgccggtcccccat

SEQ ID NO: 4817129 - DNA, 13 bp, Homo sapiens
ctgccgtaagtta

SEQ ID NO: 4817130 - DNA, 20 bp, Homo sapiens
ctgcctacccacgtgcctgc

SEQ ID NO: 4817131 - DNA, 17 bp, Homo sapiens
ctgcctccaagtcatgg

SEQ ID NO: 4817132 - DNA, 21 bp, Homo sapiens
ctgcctccaagtcatgggaga

SEQ ID NO: 4817133 - DNA, 15 bp, Homo sapiens
ctgcctccggccctg

SEQ ID NO: 4817134 - DNA, 17 bp, Homo sapiens
ctgcctccggccctgcc

SEQ ID NO: 4817135 - DNA, 19 bp, Homo sapiens
ctgcctccggccctgcccc

SEQ ID NO: 4817136 - DNA, 20 bp, Homo sapiens
ctgcctccgggcctcggcct

SEQ ID NO: 4817137 - DNA, 21 bp, Homo sapiens
ctgcctccgggcctcggcctg

SEQ ID NO: 4817138 - DNA, 22 bp, Homo sapiens
ctgcctccgggcctcggcctgg

SEQ ID NO: 4817139 - DNA, 16 bp, Homo sapiens
ctgcctctcacacaca

SEQ ID NO: 4817140 - DNA, 17 bp, Homo sapiens
ctgcctctctcatggct

SEQ ID NO: 4817141 - DNA, 12 bp, Homo sapiens
ctgcctctgcca

SEQ ID NO: 4817142 - DNA, 14 bp, Homo sapiens
ctgcctctgccaca

SEQ ID NO: 4817143 - DNA, 21 bp, Homo sapiens
ctgcctctgccacactctgac

SEQ ID NO: 4817144 - DNA, 17 bp, Homo sapiens
ctgcctctgccttagag

SEQ ID NO: 4817145 - DNA, 14 bp, Homo sapiens
ctgcctgcagagca

SEQ ID NO: 4817146 - DNA, 15 bp, Homo sapiens
ctgcctgccatgtgt

SEQ ID NO: 4817147 - DNA, 16 bp, Homo sapiens
ctgcctgccatgtgtg

SEQ ID NO: 4817148 - DNA, 18 bp, Homo sapiens
ctgcctgcccgcacagca

SEQ ID NO: 4817149 - DNA, 20 bp, Homo sapiens
ctgcctgcccgcacagcagc

SEQ ID NO: 4817150 - DNA, 23 bp, Homo sapiens
ctgcctgcccgcacagcagcctg

SEQ ID NO: 4817151 - DNA, 12 bp, Homo sapiens
ctgcctgcctcc

SEQ ID NO: 4817152 - DNA, 15 bp, Homo sapiens
ctgcctgcctccggc

SEQ ID NO: 4817153 - DNA, 20 bp, Homo sapiens
ctgcctggcgggcagcccct

SEQ ID NO: 4817154 - DNA, 21 bp, Homo sapiens
ctgcctggcgggcagcccctg

SEQ ID NO: 4817155 - DNA, 14 bp, Homo sapiens
ctgcctgttgggcc

SEQ ID NO: 4817156 - DNA, 18 bp, Homo sapiens
ctgcctgttgggccagga

SEQ ID NO: 4817157 - DNA, 22 bp, Homo sapiens
ctgcctgttgggccaggagcct

SEQ ID NO: 4817158 - DNA, 23 bp, Homo sapiens
ctgcctgttgggccaggagcctc

SEQ ID NO: 4817159 - DNA, 16 bp, Homo sapiens
ctgccttagaggagcc

SEQ ID NO: 4817160 - DNA, 15 bp, Homo sapiens
ctgccttatattatt

SEQ ID NO: 4817161 - DNA, 12 bp, Homo sapiens
ctgcgccccagc

SEQ ID NO: 4817162 - DNA, 15 bp, Homo sapiens
ctgcgccccagcgac

SEQ ID NO: 4817163 - DNA, 14 bp, Homo sapiens
ctgcgccccccagt

SEQ ID NO: 4817164 - DNA, 17 bp, Homo sapiens
ctgcgccccccagtgga

SEQ ID NO: 4817165 - DNA, 17 bp, Homo sapiens
ctgatctctcgtgattg

SEQ ID NO: 4817166 - DNA, 16 bp, Homo sapiens
ctgatgagacaacaca

SEQ ID NO: 4817167 - DNA, 18 bp, Homo sapiens
ctgatgagacaacacaca

SEQ ID NO: 4817168 - DNA, 16 bp, Homo sapiens
ctgatgaggcatttta

SEQ ID NO: 4817169 - DNA, 21 bp, Homo sapiens
ctgatgaggcattttactatg

SEQ ID NO: 4817170 - DNA, 15 bp, Homo sapiens
ctgatggagaaggaa

SEQ ID NO: 4817171 - DNA, 16 bp, Homo sapiens
ctgatggagaaggaag

SEQ ID NO: 4817172 - DNA, 22 bp, Homo sapiens
ctgatggcacttttgagctcct

SEQ ID NO: 4817173 - DNA, 18 bp, Homo sapiens
ctgatgggtatcatgctt

SEQ ID NO: 4817174 - DNA, 21 bp, Homo sapiens
ctgatgggtatcatgcttcta

SEQ ID NO: 4817175 - DNA, 17 bp, Homo sapiens
ctgatgggtcctgctgc

SEQ ID NO: 4817176 - DNA, 15 bp, Homo sapiens
ctgatggttgctttg

SEQ ID NO: 4817177 - DNA, 24 bp, Homo sapiens
ctgatggttgctttgagcccacag

SEQ ID NO: 4817178 - DNA, 22 bp, Homo sapiens
ctgatgtcaatgctatggactg

SEQ ID NO: 4817179 - DNA, 19 bp, Homo sapiens
ctgattattacaacaagca

SEQ ID NO: 4817180 - DNA, 22 bp, Homo sapiens
ctgattattacaacaagcaaac

SEQ ID NO: 4817181 - DNA, 14 bp, Homo sapiens
ctgattggaaaata

SEQ ID NO: 4817182 - DNA, 22 bp, Homo sapiens
ctgattggaaaataataaaaga

SEQ ID NO: 4817183 - DNA, 23 bp, Homo sapiens
ctgattggaaaataataaaagaa

SEQ ID NO: 4817184 - DNA, 16 bp, Homo sapiens
ctgattggacctggcc

SEQ ID NO: 4817185 - DNA, 17 bp, Homo sapiens
ctgattgtctgaaattt

SEQ ID NO: 4817186 - DNA, 22 bp, Homo sapiens
ctgatttactaacagtaactgc

SEQ ID NO: 4817187 - DNA, 19 bp, Homo sapiens
ctgatttattctggtgtct

SEQ ID NO: 4817188 - DNA, 17 bp, Homo sapiens
ctgatttattttgtatg

SEQ ID NO: 4817189 - DNA, 22 bp, Homo sapiens
ctgcaaagagttatatgacttc

SEQ ID NO: 4817190 - DNA, 19 bp, Homo sapiens
ctgcaaatagaaaacagga

SEQ ID NO: 4817191 - DNA, 12 bp, Homo sapiens
ctgcaacactgg

SEQ ID NO: 4817192 - DNA, 13 bp, Homo sapiens
ctgcaacactgga

SEQ ID NO: 4817193 - DNA, 17 bp, Homo sapiens
ctgcaataacagtttta

SEQ ID NO: 4817194 - DNA, 21 bp, Homo sapiens
ctgcaataacagttttaagat

SEQ ID NO: 4817195 - DNA, 13 bp, Homo sapiens
ctgcaatgggaga

SEQ ID NO: 4817196 - DNA, 20 bp, Homo sapiens
ctgcacacacctgcctgcag

SEQ ID NO: 4817197 - DNA, 22 bp, Homo sapiens
ctgcacagtagtgttgggtgga

SEQ ID NO: 4817198 - DNA, 16 bp, Homo sapiens
ctgcacatacagatgg

SEQ ID NO: 4817199 - DNA, 17 bp, Homo sapiens
ctgcaccagcaggtgcc

SEQ ID NO: 4817200 - DNA, 15 bp, Homo sapiens
ctgcacccacccctg

SEQ ID NO: 4817201 - DNA, 17 bp, Homo sapiens
ctgcacccacccctgcc

SEQ ID NO: 4817202 - DNA, 19 bp, Homo sapiens
ctgcaccctccacaggagc

SEQ ID NO: 4817203 - DNA, 20 bp, Homo sapiens
ctgcaccctccacaggagcc

SEQ ID NO: 4817204 - DNA, 13 bp, Homo sapiens
ctgcaccctctgc

SEQ ID NO: 4817205 - DNA, 16 bp, Homo sapiens
ctgcaccctctgctat

SEQ ID NO: 4817206 - DNA, 23 bp, Homo sapiens
ctgcaccctctgctatgtctgtg

SEQ ID NO: 4817207 - DNA, 18 bp, Homo sapiens
ctgcacctgcttctcagc

SEQ ID NO: 4817208 - DNA, 16 bp, Homo sapiens
ctgcactcctgtctct

SEQ ID NO: 4817209 - DNA, 21 bp, Homo sapiens
ctgcactcctgtctcttggga

SEQ ID NO: 4817210 - DNA, 12 bp, Homo sapiens
ctgcactgaaaa

SEQ ID NO: 4817211 - DNA, 13 bp, Homo sapiens
ctgcactgccctc

SEQ ID NO: 4817212 - DNA, 15 bp, Homo sapiens
ctgcactgccctccg

SEQ ID NO: 4817213 - DNA, 14 bp, Homo sapiens
ctgcagatcccgca

SEQ ID NO: 4817214 - DNA, 15 bp, Homo sapiens
ctgcagccccctgct

SEQ ID NO: 4817215 - DNA, 16 bp, Homo sapiens
ctgcagccccctgctt

SEQ ID NO: 4817216 - DNA, 20 bp, Homo sapiens
ctgcagccccctgcttctcc

SEQ ID NO: 4817217 - DNA, 18 bp, Homo sapiens
ctgcagcccgatgtccct

SEQ ID NO: 4817218 - DNA, 13 bp, Homo sapiens
ctgcagcctgagc

SEQ ID NO: 4817219 - DNA, 17 bp, Homo sapiens
ctgcagctaatttgtga

SEQ ID NO: 4817220 - DNA, 18 bp, Homo sapiens
ctgcagctaatttgtgaa

SEQ ID NO: 4817221 - DNA, 15 bp, Homo sapiens
ctgcagctgcaccag

SEQ ID NO: 4817222 - DNA, 19 bp, Homo sapiens
ctgcagctgcaccagcagg

SEQ ID NO: 4817223 - DNA, 20 bp, Homo sapiens
ctgcaggaatcaaaaattga

SEQ ID NO: 4817224 - DNA, 18 bp, Homo sapiens
ctgcagggacagttgggt

SEQ ID NO: 4817225 - DNA, 17 bp, Homo sapiens
ctgcaggttggacccca

SEQ ID NO: 4817226 - DNA, 19 bp, Homo sapiens
ctgcaggttggaccccaga

SEQ ID NO: 4817227 - DNA, 15 bp, Homo sapiens
ctgcagtcagactga

SEQ ID NO: 4817228 - DNA, 15 bp, Homo sapiens
ctgcagtcagcacag

SEQ ID NO: 4817229 - DNA, 20 bp, Homo sapiens
ctgcagtcctcggcagctcc

SEQ ID NO: 4817230 - DNA, 22 bp, Homo sapiens
ctgcagtcctcggcagctccgg

SEQ ID NO: 4817231 - DNA, 15 bp, Homo sapiens
ctgcagtctgtggag

SEQ ID NO: 4817232 - DNA, 22 bp, Homo sapiens
ctgcagtctgtggagcgtcctt

SEQ ID NO: 4817233 - DNA, 21 bp, Homo sapiens
ctgcataagattatatacaaa

SEQ ID NO: 4817234 - DNA, 23 bp, Homo sapiens
ctgcataagattatatacaaagc

SEQ ID NO: 4817235 - DNA, 14 bp, Homo sapiens
ctgcatccctccac

SEQ ID NO: 4817236 - DNA, 18 bp, Homo sapiens
ctgcatccctccacccca

SEQ ID NO: 4817237 - DNA, 15 bp, Homo sapiens
ctgcatcccttggcc

SEQ ID NO: 4817238 - DNA, 23 bp, Homo sapiens
ctgcatcccttggcccctctctg

SEQ ID NO: 4817239 - DNA, 12 bp, Homo sapiens
ctgcatcctcag

SEQ ID NO: 4817240 - DNA, 18 bp, Homo sapiens
ctgcatcctcagccccag

SEQ ID NO: 4817241 - DNA, 19 bp, Homo sapiens
ctgcatcctcagccccagg

SEQ ID NO: 4817242 - DNA, 22 bp, Homo sapiens
ctgcatcctcagccccagggcc

SEQ ID NO: 4817243 - DNA, 21 bp, Homo sapiens
ctgcatgtcggggcccctgcg

SEQ ID NO: 4817244 - DNA, 14 bp, Homo sapiens
ctgccaactttcca

SEQ ID NO: 4817245 - DNA, 16 bp, Homo sapiens
ctgccaactttccaga

SEQ ID NO: 4817246 - DNA, 21 bp, Homo sapiens
ctgccacaatgtgatatgtgt

SEQ ID NO: 4817247 - DNA, 18 bp, Homo sapiens
ctgccacactctgacgca

SEQ ID NO: 4817248 - DNA, 12 bp, Homo sapiens
ctgccacccacc

SEQ ID NO: 4817249 - DNA, 16 bp, Homo sapiens
ctgccacccaccccaa

SEQ ID NO: 4817250 - DNA, 17 bp, Homo sapiens
ctgccacccaccccaag

SEQ ID NO: 4817251 - DNA, 23 bp, Homo sapiens
ctgccacccaccccaagctgctg

SEQ ID NO: 4817252 - DNA, 11 bp, Homo sapiens
ctgccaccctc

SEQ ID NO: 4817253 - DNA, 18 bp, Homo sapiens
ctgccaccctctgctgca

SEQ ID NO: 4817254 - DNA, 19 bp, Homo sapiens
ctgccaccctctgctgcac

SEQ ID NO: 4817255 - DNA, 21 bp, Homo sapiens
ctgccaccctctgctgcacag

SEQ ID NO: 4817256 - DNA, 13 bp, Homo sapiens
ctgccagccttcc

SEQ ID NO: 4817257 - DNA, 13 bp, Homo sapiens
ctgccaggaagcc

SEQ ID NO: 4817258 - DNA, 16 bp, Homo sapiens
ctgccaggaagccagc

SEQ ID NO: 4817259 - DNA, 19 bp, Homo sapiens
ctgccaggaagccagcagg

SEQ ID NO: 4817260 - DNA, 20 bp, Homo sapiens
ctgccaggaagccagcaggc

SEQ ID NO: 4817261 - DNA, 21 bp, Homo sapiens
ctgccaggaagccagcaggct

SEQ ID NO: 4817262 - DNA, 23 bp, Homo sapiens
ctgccaggctcccactgcccctg

SEQ ID NO: 4817263 - DNA, 15 bp, Homo sapiens
ctgccagggcagtgc

SEQ ID NO: 4817264 - DNA, 13 bp, Homo sapiens
ctgccatgtaggc

SEQ ID NO: 4817265 - DNA, 20 bp, Homo sapiens
ctgccatgtaggctaagaaa

SEQ ID NO: 4817266 - DNA, 13 bp, Homo sapiens
ctgccatttcatg

SEQ ID NO: 4817267 - DNA, 19 bp, Homo sapiens
ctgcccaatttcacagagt

SEQ ID NO: 4817268 - DNA, 22 bp, Homo sapiens
ctgcccaatttcacagagtaca

SEQ ID NO: 4817269 - DNA, 14 bp, Homo sapiens
ctgcccaccctggg

SEQ ID NO: 4817270 - DNA, 17 bp, Homo sapiens
ctgcccaccctgggcct

SEQ ID NO: 4817271 - DNA, 13 bp, Homo sapiens
ctgcccacctgcc

SEQ ID NO: 4817272 - DNA, 22 bp, Homo sapiens
ctgcccacgtcccgggcactgt

SEQ ID NO: 4817273 - DNA, 20 bp, Homo sapiens
ctgcccaggcagtctttgct

SEQ ID NO: 4817274 - DNA, 17 bp, Homo sapiens
ctgccccacacaggcct

SEQ ID NO: 4817275 - DNA, 20 bp, Homo sapiens
ctgccccacacaggcctggc

SEQ ID NO: 4817276 - DNA, 12 bp, Homo sapiens
ctgccccagaga

SEQ ID NO: 4817277 - DNA, 19 bp, Homo sapiens
ctgccccagagaagcctca

SEQ ID NO: 4817278 - DNA, 18 bp, Homo sapiens
ctgccccaggctcaggct

SEQ ID NO: 4817279 - DNA, 13 bp, Homo sapiens
ctgcccccacaga

SEQ ID NO: 4817280 - DNA, 17 bp, Homo sapiens
ctgcccccacagatcca

SEQ ID NO: 4817281 - DNA, 12 bp, Homo sapiens
ctgccccccttc

SEQ ID NO: 4817282 - DNA, 22 bp, Homo sapiens
ctgccccccttcccacccctat

SEQ ID NO: 4817283 - DNA, 19 bp, Homo sapiens
ctgcccctccgtccccagg

SEQ ID NO: 4817284 - DNA, 18 bp, Homo sapiens
ctgcccctcttccctggc

SEQ ID NO: 4817285 - DNA, 17 bp, Homo sapiens
ctgcccctggcagcccc

SEQ ID NO: 4817286 - DNA, 22 bp, Homo sapiens
ctgccccttgaccccacacgcc

SEQ ID NO: 4817287 - DNA, 22 bp, Homo sapiens
ctgcccgcacaccctcactctg

SEQ ID NO: 4817288 - DNA, 15 bp, Homo sapiens
ctgcccgcacagcag

SEQ ID NO: 4817289 - DNA, 22 bp, Homo sapiens
cttctatgtccaacagagtgga

SEQ ID NO: 4817290 - DNA, 19 bp, Homo sapiens
cttctcacagcacatgctg

SEQ ID NO: 4817291 - DNA, 22 bp, Homo sapiens
cttctcagccttggttcctgat

SEQ ID NO: 4817292 - DNA, 15 bp, Homo sapiens
cttctcagctccact

SEQ ID NO: 4817293 - DNA, 22 bp, Homo sapiens
cttctcagctccactctgaagt

SEQ ID NO: 4817294 - DNA, 21 bp, Homo sapiens
cttctccccctcagctctccc

SEQ ID NO: 4817295 - DNA, 12 bp, Homo sapiens
cttctcccctcc

SEQ ID NO: 4817296 - DNA, 17 bp, Homo sapiens
cttctcccctccagacc

SEQ ID NO: 4817297 - DNA, 22 bp, Homo sapiens
cttctcccctccagacccctac

SEQ ID NO: 4817298 - DNA, 20 bp, Homo sapiens
cttctcccgccattggcctt

SEQ ID NO: 4817299 - DNA, 16 bp, Homo sapiens
cttctcctgcagtctg

SEQ ID NO: 4817300 - DNA, 17 bp, Homo sapiens
cttctcctgcagtctgt

SEQ ID NO: 4817301 - DNA, 13 bp, Homo sapiens
cttctccttaacc

SEQ ID NO: 4817302 - DNA, 18 bp, Homo sapiens
cttctctttggggctcct

SEQ ID NO: 4817303 - DNA, 23 bp, Homo sapiens
cttctgaacttggcgctgcccct

SEQ ID NO: 4817304 - DNA, 17 bp, Homo sapiens
cttctgaactttggaag

SEQ ID NO: 4817305 - DNA, 18 bp, Homo sapiens
cttctgcagtcagactga

SEQ ID NO: 4817306 - DNA, 14 bp, Homo sapiens
cttctgccaaggcc

SEQ ID NO: 4817307 - DNA, 12 bp, Homo sapiens
cttctgctgccc

SEQ ID NO: 4817308 - DNA, 14 bp, Homo sapiens
cttctgctgccctg

SEQ ID NO: 4817309 - DNA, 15 bp, Homo sapiens
cttctgctgccctga

SEQ ID NO: 4817310 - DNA, 21 bp, Homo sapiens
cttctggaggtggggagggcc

SEQ ID NO: 4817311 - DNA, 16 bp, Homo sapiens
cttctggccgctgcag

SEQ ID NO: 4817312 - DNA, 11 bp, Homo sapiens
cttctggcctt

SEQ ID NO: 4817313 - DNA, 14 bp, Homo sapiens
cttctggctgctgc

SEQ ID NO: 4817314 - DNA, 16 bp, Homo sapiens
cttctggctgctgcag

SEQ ID NO: 4817315 - DNA, 23 bp, Homo sapiens
cttctgggacaggcaccatgctg

SEQ ID NO: 4817316 - DNA, 23 bp, Homo sapiens
cttctgggcgccggttccacgtg

SEQ ID NO: 4817317 - DNA, 14 bp, Homo sapiens
cttctgtaatattt

SEQ ID NO: 4817318 - DNA, 19 bp, Homo sapiens
cttctgtgcatctggcctg

SEQ ID NO: 4817319 - DNA, 13 bp, Homo sapiens
cttctgtgggttt

SEQ ID NO: 4817320 - DNA, 14 bp, Homo sapiens
cttctgtgggtttc

SEQ ID NO: 4817321 - DNA, 21 bp, Homo sapiens
cttctgtgggtttctaaagct

SEQ ID NO: 4817322 - DNA, 22 bp, Homo sapiens
cttcttacgaacgccacggccg

SEQ ID NO: 4817323 - DNA, 22 bp, Homo sapiens
cttcttccccaaggcactgagc

SEQ ID NO: 4817324 - DNA, 18 bp, Homo sapiens
ctggaaaaaaaaaaatat

SEQ ID NO: 4817325 - DNA, 23 bp, Homo sapiens
ctggaaaactgccacaagcacaa

SEQ ID NO: 4817326 - DNA, 22 bp, Homo sapiens
ctggaaagcacgccggcctgcg

SEQ ID NO: 4817327 - DNA, 17 bp, Homo sapiens
ctggaaatttgtgtgct

SEQ ID NO: 4817328 - DNA, 19 bp, Homo sapiens
ctggaactctatctgggcc

SEQ ID NO: 4817329 - DNA, 14 bp, Homo sapiens
ctggaagagggagg

SEQ ID NO: 4817330 - DNA, 16 bp, Homo sapiens
ctggaaggtcacgctg

SEQ ID NO: 4817331 - DNA, 19 bp, Homo sapiens
ctggaataagaagcaaata

SEQ ID NO: 4817332 - DNA, 21 bp, Homo sapiens
ctggaataagaagcaaataaa

SEQ ID NO: 4817333 - DNA, 23 bp, Homo sapiens
ctggaattgggctccgtggtggc

SEQ ID NO: 4817334 - DNA, 21 bp, Homo sapiens
ctggacagatgggtgtcccct

SEQ ID NO: 4817335 - DNA, 18 bp, Homo sapiens
ctggacagtgagagcagg

SEQ ID NO: 4817336 - DNA, 14 bp, Homo sapiens
ctggacatattccc

SEQ ID NO: 4817337 - DNA, 15 bp, Homo sapiens
ctggaccaactgctt

SEQ ID NO: 4817338 - DNA, 16 bp, Homo sapiens
ctggaccgagtggacc

SEQ ID NO: 4817339 - DNA, 14 bp, Homo sapiens
ctggacctgaccag

SEQ ID NO: 4817340 - DNA, 19 bp, Homo sapiens
ctggacgatagcttggagg

SEQ ID NO: 4817341 - DNA, 13 bp, Homo sapiens
ctggactgggtgg

SEQ ID NO: 4817342 - DNA, 14 bp, Homo sapiens
ctggactgggtggg

SEQ ID NO: 4817343 - DNA, 20 bp, Homo sapiens
ctggagaccctgcgcccctg

SEQ ID NO: 4817344 - DNA, 22 bp, Homo sapiens
ctggagaccctgcgcccctgcc

SEQ ID NO: 4817345 - DNA, 17 bp, Homo sapiens
ctggagccccatcgcct

SEQ ID NO: 4817346 - DNA, 19 bp, Homo sapiens
ctggagccccatcgcctgg

SEQ ID NO: 4817347 - DNA, 12 bp, Homo sapiens
ctggagccccta

SEQ ID NO: 4817348 - DNA, 23 bp, Homo sapiens
ctggagcccgcctgcgcccccca

SEQ ID NO: 4817349 - DNA, 16 bp, Homo sapiens
ctggagcctgagtcag

SEQ ID NO: 4817350 - DNA, 14 bp, Homo sapiens
ctggaggagaagga

SEQ ID NO: 4817351 - DNA, 12 bp, Homo sapiens
ctggaggctgga

SEQ ID NO: 4817352 - DNA, 21 bp, Homo sapiens
ctggaggtgaggtcaggtgcc

SEQ ID NO: 4817353 - DNA, 17 bp, Homo sapiens
ctggaggtggggagggc

SEQ ID NO: 4817354 - DNA, 20 bp, Homo sapiens
ctggaggtggggagggcctc

SEQ ID NO: 4817355 - DNA, 13 bp, Homo sapiens
ctggagtctgaag

SEQ ID NO: 4817356 - DNA, 19 bp, Homo sapiens
ctggagtctgaaggagagg

SEQ ID NO: 4817357 - DNA, 20 bp, Homo sapiens
ctggagtctgaaggagagga

SEQ ID NO: 4817358 - DNA, 16 bp, Homo sapiens
ctggagttctggttcc

SEQ ID NO: 4817359 - DNA, 14 bp, Homo sapiens
ctggataatttgta

SEQ ID NO: 4817360 - DNA, 12 bp, Homo sapiens
ctggatcagtaa

SEQ ID NO: 4817361 - DNA, 19 bp, Homo sapiens
ctggatggatctgctccat

SEQ ID NO: 4817362 - DNA, 20 bp, Homo sapiens
ctggatggatctgctccatg

SEQ ID NO: 4817363 - DNA, 13 bp, Homo sapiens
ctggatgtgcatc

SEQ ID NO: 4817364 - DNA, 16 bp, Homo sapiens
ctggatgtgcatctgg

SEQ ID NO: 4817365 - DNA, 21 bp, Homo sapiens
ctggatgtgcatctggcctat

SEQ ID NO: 4817366 - DNA, 22 bp, Homo sapiens
ctggatgtgcatctggcctatg

SEQ ID NO: 4817367 - DNA, 16 bp, Homo sapiens
ctggatgtgctttcat

SEQ ID NO: 4817368 - DNA, 17 bp, Homo sapiens
ctggattcaaatttatt

SEQ ID NO: 4817369 - DNA, 21 bp, Homo sapiens
ctggattccagagcactgctc

SEQ ID NO: 4817370 - DNA, 21 bp, Homo sapiens
ctggattcccgtggctttgtg

SEQ ID NO: 4817371 - DNA, 13 bp, Homo sapiens
ctggcacccactg

SEQ ID NO: 4817372 - DNA, 18 bp, Homo sapiens
ctggcactccagaacaaa

SEQ ID NO: 4817373 - DNA, 17 bp, Homo sapiens
ctggcagagttgaagac

SEQ ID NO: 4817374 - DNA, 18 bp, Homo sapiens
ctggcagagttgaagaca

SEQ ID NO: 4817375 - DNA, 20 bp, Homo sapiens
ctggcagagttgaagacaga

SEQ ID NO: 4817376 - DNA, 22 bp, Homo sapiens
ctggcagagttgaagacagagc

SEQ ID NO: 4817377 - DNA, 18 bp, Homo sapiens
ctgggtcaccttcctggg

SEQ ID NO: 4817378 - DNA, 22 bp, Homo sapiens
ctgggtcaccttcctgggcagc

SEQ ID NO: 4817379 - DNA, 17 bp, Homo sapiens
ctgggtccccctcctgc

SEQ ID NO: 4817380 - DNA, 18 bp, Homo sapiens
ctgggtccccctcctgca

SEQ ID NO: 4817381 - DNA, 19 bp, Homo sapiens
ctgggtccccctcctgcac

SEQ ID NO: 4817382 - DNA, 15 bp, Homo sapiens
ctgggtcctcccagc

SEQ ID NO: 4817383 - DNA, 19 bp, Homo sapiens
ctgggtcctcccagctgac

SEQ ID NO: 4817384 - DNA, 15 bp, Homo sapiens
ctgggtcctcggccc

SEQ ID NO: 4817385 - DNA, 18 bp, Homo sapiens
ctgggtcctcggccctgt

SEQ ID NO: 4817386 - DNA, 21 bp, Homo sapiens
ctgggtcctcggccctgtagc

SEQ ID NO: 4817387 - DNA, 17 bp, Homo sapiens
ctgggtcgcccctcctc

SEQ ID NO: 4817388 - DNA, 18 bp, Homo sapiens
ctgggtcgcccctcctcg

SEQ ID NO: 4817389 - DNA, 14 bp, Homo sapiens
ctgggtgggcccca

SEQ ID NO: 4817390 - DNA, 14 bp, Homo sapiens
ctgggtgggccctg

SEQ ID NO: 4817391 - DNA, 13 bp, Homo sapiens
ctgggtgtggcct

SEQ ID NO: 4817392 - DNA, 18 bp, Homo sapiens
ctgggtgtggcctggctt

SEQ ID NO: 4817393 - DNA, 20 bp, Homo sapiens
ctgggtgtggcctggcttct

SEQ ID NO: 4817394 - DNA, 19 bp, Homo sapiens
ctgggtttgggcagtggag

SEQ ID NO: 4817395 - DNA, 22 bp, Homo sapiens
ctgggtttgggcagtggagagg

SEQ ID NO: 4817396 - DNA, 13 bp, Homo sapiens
ctggtaagttgga

SEQ ID NO: 4817397 - DNA, 11 bp, Homo sapiens
ctggtattaaa

SEQ ID NO: 4817398 - DNA, 12 bp, Homo sapiens
ctggtattaaat

SEQ ID NO: 4817399 - DNA, 19 bp, Homo sapiens
ctggtcaataaaccactgt

SEQ ID NO: 4817400 - DNA, 18 bp, Homo sapiens
ctggtcagtgaagcccag

SEQ ID NO: 4817401 - DNA, 23 bp, Homo sapiens
ctggtcagtgaagcccaggagga

SEQ ID NO: 4817402 - DNA, 13 bp, Homo sapiens
ctggtccacacac

SEQ ID NO: 4817403 - DNA, 14 bp, Homo sapiens
ctggtcctgcactg

SEQ ID NO: 4817404 - DNA, 16 bp, Homo sapiens
ctggtccttagtaaat

SEQ ID NO: 4817405 - DNA, 14 bp, Homo sapiens
ctggtctggagccc

SEQ ID NO: 4817406 - DNA, 12 bp, Homo sapiens
ctggtctgtgca

SEQ ID NO: 4817407 - DNA, 21 bp, Homo sapiens
ctggtgcgtgtggccctgtgg

SEQ ID NO: 4817408 - DNA, 22 bp, Homo sapiens
ctggtgcgtgtggccctgtggg

SEQ ID NO: 4817409 - DNA, 12 bp, Homo sapiens
ctggtggcacca

SEQ ID NO: 4817410 - DNA, 13 bp, Homo sapiens
ctggtggcaccag

SEQ ID NO: 4817411 - DNA, 22 bp, Homo sapiens
ctggtggccagtatcctggatt

SEQ ID NO: 4817412 - DNA, 15 bp, Homo sapiens
ctggtggccctgcgg

SEQ ID NO: 4817413 - DNA, 17 bp, Homo sapiens
ctggttatttaaaatgt

SEQ ID NO: 4817414 - DNA, 16 bp, Homo sapiens
ctggttttctctgatg

SEQ ID NO: 4817415 - DNA, 16 bp, Homo sapiens
ctggtttttctgttcc

SEQ ID NO: 4817416 - DNA, 13 bp, Homo sapiens
ctgtaaaacttta

SEQ ID NO: 4817417 - DNA, 20 bp, Homo sapiens
ctgtaaaactttattttata

SEQ ID NO: 4817418 - DNA, 20 bp, Homo sapiens
ctgtaaaatacatggtatct

SEQ ID NO: 4817419 - DNA, 17 bp, Homo sapiens
ctgtaaataaaaatagc

SEQ ID NO: 4817420 - DNA, 18 bp, Homo sapiens
ctgtaaataaaaatagct

SEQ ID NO: 4817421 - DNA, 21 bp, Homo sapiens
ctgtaacatcactatccatgc

SEQ ID NO: 4817422 - DNA, 22 bp, Homo sapiens
ctgtaacatcactatccatgca

SEQ ID NO: 4817423 - DNA, 18 bp, Homo sapiens
ctgtaatagcctcacctt

SEQ ID NO: 4817424 - DNA, 22 bp, Homo sapiens
ctgtaatatttacaatgtatta

SEQ ID NO: 4817425 - DNA, 15 bp, Homo sapiens
ctgtaattttgtagt

SEQ ID NO: 4817426 - DNA, 19 bp, Homo sapiens
ctgtaattttgtagtagtt

SEQ ID NO: 4817427 - DNA, 22 bp, Homo sapiens
ctgtacagattgctgcttctgc

SEQ ID NO: 4817428 - DNA, 15 bp, Homo sapiens
ctgtaccggccactg

SEQ ID NO: 4817429 - DNA, 17 bp, Homo sapiens
ctgtacgaggcttctct

SEQ ID NO: 4817430 - DNA, 19 bp, Homo sapiens
ctgtacgaggcttctctaa

SEQ ID NO: 4817431 - DNA, 13 bp, Homo sapiens
ctgtacgcgcaga

SEQ ID NO: 4817432 - DNA, 15 bp, Homo sapiens
ctgtactatctagtg

SEQ ID NO: 4817433 - DNA, 19 bp, Homo sapiens
ctgtactatctagtgtcta

SEQ ID NO: 4817434 - DNA, 18 bp, Homo sapiens
ctgtacttcagttctcat

SEQ ID NO: 4817435 - DNA, 14 bp, Homo sapiens
ctgtactttcccag

SEQ ID NO: 4817436 - DNA, 15 bp, Homo sapiens
ctgtactttcccagg

SEQ ID NO: 4817437 - DNA, 18 bp, Homo sapiens
ctgtactttcccaggttg

SEQ ID NO: 4817438 - DNA, 15 bp, Homo sapiens
ctgtagacatctgtc

SEQ ID NO: 4817439 - DNA, 14 bp, Homo sapiens
ctgtagccctggcc

SEQ ID NO: 4817440 - DNA, 16 bp, Homo sapiens
ctgtagcctggtctgt

SEQ ID NO: 4817441 - DNA, 23 bp, Homo sapiens
ctgtagggatgaaataaacccca

SEQ ID NO: 4817442 - DNA, 17 bp, Homo sapiens
ctgtagtaattgttaca

SEQ ID NO: 4817443 - DNA, 20 bp, Homo sapiens
ctgtataaggtaataaaact

SEQ ID NO: 4817444 - DNA, 19 bp, Homo sapiens
ctgtatacaaacaggtgct

SEQ ID NO: 4817445 - DNA, 13 bp, Homo sapiens
ctgtatatagatg

SEQ ID NO: 4817446 - DNA, 18 bp, Homo sapiens
ctgtatatagatgtctgt

SEQ ID NO: 4817447 - DNA, 16 bp, Homo sapiens
ctgtatatcagctcta

SEQ ID NO: 4817448 - DNA, 19 bp, Homo sapiens
ctgtatatttgtatgatat

SEQ ID NO: 4817449 - DNA, 20 bp, Homo sapiens
ctgtatgatttaggcttcta

SEQ ID NO: 4817450 - DNA, 21 bp, Homo sapiens
ctgtatgatttaggcttctat

SEQ ID NO: 4817451 - DNA, 21 bp, Homo sapiens
gactctttattgtctgtaaat

SEQ ID NO: 4817452 - DNA, 22 bp, Homo sapiens
gactctttattgtctgtaaatc

SEQ ID NO: 4817453 - DNA, 11 bp, Homo sapiens
gactgaagaaa

SEQ ID NO: 4817454 - DNA, 22 bp, Homo sapiens
gactgcaggttggaccccagag

SEQ ID NO: 4817455 - DNA, 20 bp, Homo sapiens
gactgcattttactgtacag

SEQ ID NO: 4817456 - DNA, 13 bp, Homo sapiens
gactgcctctgcc

SEQ ID NO: 4817457 - DNA, 14 bp, Homo sapiens
gactgcctctgcca

SEQ ID NO: 4817458 - DNA, 15 bp, Homo sapiens
gactgcctctgccac

SEQ ID NO: 4817459 - DNA, 14 bp, Homo sapiens
gactgcgctggacg

SEQ ID NO: 4817460 - DNA, 18 bp, Homo sapiens
gactgctcaggctcccca

SEQ ID NO: 4817461 - DNA, 19 bp, Homo sapiens
gactgctcaggctccccaa

SEQ ID NO: 4817462 - DNA, 20 bp, Homo sapiens
gactgctcaggctccccaag

SEQ ID NO: 4817463 - DNA, 21 bp, Homo sapiens
gactggcccacccctcttccc

SEQ ID NO: 4817464 - DNA, 19 bp, Homo sapiens
gactggtcccccatgggct

SEQ ID NO: 4817465 - DNA, 23 bp, Homo sapiens
gactggtcccccatgggctgctg

SEQ ID NO: 4817466 - DNA, 19 bp, Homo sapiens
gactgtcccaccgggagcc

SEQ ID NO: 4817467 - DNA, 23 bp, Homo sapiens
gactgtcccaccgggagcctccc

SEQ ID NO: 4817468 - DNA, 18 bp, Homo sapiens
gactgtcttcaaccctgc

SEQ ID NO: 4817469 - DNA, 20 bp, Homo sapiens
gactgtcttcaaccctgccc

SEQ ID NO: 4817470 - DNA, 22 bp, Homo sapiens
gactgttctaactagtaatctt

SEQ ID NO: 4817471 - DNA, 19 bp, Homo sapiens
gactgttctcttactgccg

SEQ ID NO: 4817472 - DNA, 20 bp, Homo sapiens
gacttattgattaagtatat

SEQ ID NO: 4817473 - DNA, 19 bp, Homo sapiens
gacttcaaaatattgagca

SEQ ID NO: 4817474 - DNA, 18 bp, Homo sapiens
gacttcacaaaatgcaag

SEQ ID NO: 4817475 - DNA, 19 bp, Homo sapiens
gacttcagactctctcctc

SEQ ID NO: 4817476 - DNA, 20 bp, Homo sapiens
gacttcatccctctggggct

SEQ ID NO: 4817477 - DNA, 13 bp, Homo sapiens
gacttcccagctg

SEQ ID NO: 4817478 - DNA, 21 bp, Homo sapiens
gacttcccagctggcagcgcc

SEQ ID NO: 4817479 - DNA, 23 bp, Homo sapiens
gacttcccagctggcagcgcctc

SEQ ID NO: 4817480 - DNA, 21 bp, Homo sapiens
gacttcctattaatttattaa

SEQ ID NO: 4817481 - DNA, 16 bp, Homo sapiens
gacttcgctattccca

SEQ ID NO: 4817482 - DNA, 18 bp, Homo sapiens
gacttcgctattcccagg

SEQ ID NO: 4817483 - DNA, 19 bp, Homo sapiens
gacttcgctattcccaggc

SEQ ID NO: 4817484 - DNA, 17 bp, Homo sapiens
gacttctaaaataaatg

SEQ ID NO: 4817485 - DNA, 18 bp, Homo sapiens
gacttctaaaataaatgt

SEQ ID NO: 4817486 - DNA, 19 bp, Homo sapiens
gacttctaaaataaatgtt

SEQ ID NO: 4817487 - DNA, 18 bp, Homo sapiens
gacttctttactaacact

SEQ ID NO: 4817488 - DNA, 14 bp, Homo sapiens
gacttgccactgcc

SEQ ID NO: 4817489 - DNA, 22 bp, Homo sapiens
gacttggatgtcatatcttctt

SEQ ID NO: 4817490 - DNA, 21 bp, Homo sapiens
gacttggtgattacctgaaag

SEQ ID NO: 4817491 - DNA, 17 bp, Homo sapiens
gactttaattcttctct

SEQ ID NO: 4817492 - DNA, 14 bp, Homo sapiens
gactttgcaggagt

SEQ ID NO: 4817493 - DNA, 18 bp, Homo sapiens
gactttgcaggagttcct

SEQ ID NO: 4817494 - DNA, 14 bp, Homo sapiens
gactttggaattct

SEQ ID NO: 4817495 - DNA, 23 bp, Homo sapiens
gacttttctttcagccaagaatt

SEQ ID NO: 4817496 - DNA, 24 bp, Homo sapiens
gagaaaaaaaaagccactaaggtc

SEQ ID NO: 4817497 - DNA, 13 bp, Homo sapiens
gagaaaaagccct

SEQ ID NO: 4817498 - DNA, 16 bp, Homo sapiens
gagaaaatgctttctc

SEQ ID NO: 4817499 - DNA, 22 bp, Homo sapiens
gagaaaatgctttctcatgcat

SEQ ID NO: 4817500 - DNA, 21 bp, Homo sapiens
gagaaaatggacgtgttatga

SEQ ID NO: 4817501 - DNA, 17 bp, Homo sapiens
gagaaacttaaagaaca

SEQ ID NO: 4817502 - DNA, 20 bp, Homo sapiens
gagaaagcatattgactttt

SEQ ID NO: 4817503 - DNA, 14 bp, Homo sapiens
gagaaattcttgtt

SEQ ID NO: 4817504 - DNA, 16 bp, Homo sapiens
gagaaattgtgccaaa

SEQ ID NO: 4817505 - DNA, 13 bp, Homo sapiens
gagaacatggcca

SEQ ID NO: 4817506 - DNA, 18 bp, Homo sapiens
gagaactgtgaatatgtg

SEQ ID NO: 4817507 - DNA, 21 bp, Homo sapiens
gagaactgtgaatatgtgtaa

SEQ ID NO: 4817508 - DNA, 22 bp, Homo sapiens
gagaactgtgaatatgtgtaac

SEQ ID NO: 4817509 - DNA, 14 bp, Homo sapiens
gagaagagaatgca

SEQ ID NO: 4817510 - DNA, 15 bp, Homo sapiens
gagaagcaccccacc

SEQ ID NO: 4817511 - DNA, 20 bp, Homo sapiens
gagaagccacgctgtcctct

SEQ ID NO: 4817512 - DNA, 11 bp, Homo sapiens
gagaagccata

SEQ ID NO: 4817513 - DNA, 12 bp, Homo sapiens
gagaagccataa

SEQ ID NO: 4817514 - DNA, 19 bp, Homo sapiens
gagaagcctcagtccctcc

SEQ ID NO: 4817515 - DNA, 19 bp, Homo sapiens
gagaaggccccagggcagc

SEQ ID NO: 4817516 - DNA, 18 bp, Homo sapiens
gagaaggcctgcccccct

SEQ ID NO: 4817517 - DNA, 22 bp, Homo sapiens
gagaaggcctgccccccttccc

SEQ ID NO: 4817518 - DNA, 23 bp, Homo sapiens
gagaaggcctgccccccttccca

SEQ ID NO: 4817519 - DNA, 18 bp, Homo sapiens
gagaataagaataataat

SEQ ID NO: 4817520 - DNA, 13 bp, Homo sapiens
gagaatggctctg

SEQ ID NO: 4817521 - DNA, 14 bp, Homo sapiens
gagaatggctctgg

SEQ ID NO: 4817522 - DNA, 17 bp, Homo sapiens
gagaattactgtttgaa

SEQ ID NO: 4817523 - DNA, 18 bp, Homo sapiens
gagaattgaggggaggtg

SEQ ID NO: 4817524 - DNA, 22 bp, Homo sapiens
gagaattgtgcgacttcacaaa

SEQ ID NO: 4817525 - DNA, 14 bp, Homo sapiens
gagacaacacacac

SEQ ID NO: 4817526 - DNA, 15 bp, Homo sapiens
gagacaacacacaca

SEQ ID NO: 4817527 - DNA, 22 bp, Homo sapiens
gagacaacacacacacacacaa

SEQ ID NO: 4817528 - DNA, 20 bp, Homo sapiens
gagacaacttgctcctttcc

SEQ ID NO: 4817529 - DNA, 16 bp, Homo sapiens
gagacacagcgtccct

SEQ ID NO: 4817530 - DNA, 14 bp, Homo sapiens
gagacactgtcaag

SEQ ID NO: 4817531 - DNA, 20 bp, Homo sapiens
gagaccctgccaactttcca

SEQ ID NO: 4817532 - DNA, 20 bp, Homo sapiens
gagaccctgcgcccctgccc

SEQ ID NO: 4817533 - DNA, 22 bp, Homo sapiens
gagaccctgcgcccctgcccag

SEQ ID NO: 4817534 - DNA, 19 bp, Homo sapiens
gagacctcccccagggagg

SEQ ID NO: 4817535 - DNA, 13 bp, Homo sapiens
gagacctgctcca

SEQ ID NO: 4817536 - DNA, 13 bp, Homo sapiens
gagacggcagccc

SEQ ID NO: 4817537 - DNA, 14 bp, Homo sapiens
gagacggcagcccc

SEQ ID NO: 4817538 - DNA, 18 bp, Homo sapiens
gagacgggggcagagagg

SEQ ID NO: 4817539 - DNA, 22 bp, Homo sapiens
gagactatggagcctggcacag

SEQ ID NO: 4817540 - DNA, 15 bp, Homo sapiens
gagactatgtgtcat

SEQ ID NO: 4817541 - DNA, 15 bp, Homo sapiens
gagactctgaggtgt

SEQ ID NO: 4817542 - DNA, 11 bp, Homo sapiens
gagactgccca

SEQ ID NO: 4817543 - DNA, 12 bp, Homo sapiens
gagactgcccac

SEQ ID NO: 4817544 - DNA, 21 bp, Homo sapiens
gagactgcccaccctgggcct

SEQ ID NO: 4817545 - DNA, 19 bp, Homo sapiens
gagacttcctattaattta

SEQ ID NO: 4817546 - DNA, 21 bp, Homo sapiens
gagacttgcagttagactcaa

SEQ ID NO: 4817547 - DNA, 16 bp, Homo sapiens
gagagaagccacgctg

SEQ ID NO: 4817548 - DNA, 18 bp, Homo sapiens
gagagacaacttgctcct

SEQ ID NO: 4817549 - DNA, 15 bp, Homo sapiens
gagagaccctgccaa

SEQ ID NO: 4817550 - DNA, 14 bp, Homo sapiens
gagagagcaatctt

SEQ ID NO: 4817551 - DNA, 18 bp, Homo sapiens
gagagatatatctgaaaa

SEQ ID NO: 4817552 - DNA, 16 bp, Homo sapiens
gagagcagggctgggc

SEQ ID NO: 4817553 - DNA, 17 bp, Homo sapiens
gagagcccctggggcct

SEQ ID NO: 4817554 - DNA, 20 bp, Homo sapiens
gagagcctttggtgaataac

SEQ ID NO: 4817555 - DNA, 18 bp, Homo sapiens
gagagcgccacccgcccg

SEQ ID NO: 4817556 - DNA, 15 bp, Homo sapiens
gagagcggcttcccc

SEQ ID NO: 4817557 - DNA, 23 bp, Homo sapiens
gagaggaactccttggcctagcc

SEQ ID NO: 4817558 - DNA, 15 bp, Homo sapiens
gagaggaggtgtgga

SEQ ID NO: 4817559 - DNA, 12 bp, Homo sapiens
gagaggcggcct

SEQ ID NO: 4817560 - DNA, 13 bp, Homo sapiens
gagagggctgagc

SEQ ID NO: 4817561 - DNA, 14 bp, Homo sapiens
gagagggctgagcc

SEQ ID NO: 4817562 - DNA, 20 bp, Homo sapiens
gagagggctgagcccctcct

SEQ ID NO: 4817563 - DNA, 22 bp, Homo sapiens
gagagggctgagcccctcctct

SEQ ID NO: 4817564 - DNA, 15 bp, Homo sapiens
gagaggggacttgga

SEQ ID NO: 4817565 - DNA, 14 bp, Homo sapiens
cttgtgcatgcaaa

SEQ ID NO: 4817566 - DNA, 15 bp, Homo sapiens
cttgtgcatgcaaaa

SEQ ID NO: 4817567 - DNA, 20 bp, Homo sapiens
cttgtgcatgcaaaaatgaa

SEQ ID NO: 4817568 - DNA, 21 bp, Homo sapiens
cttgtgcatgcaaaaatgaat

SEQ ID NO: 4817569 - DNA, 18 bp, Homo sapiens
cttgtgtatcctgacagc

SEQ ID NO: 4817570 - DNA, 18 bp, Homo sapiens
cttgtgtgtatgtctatg

SEQ ID NO: 4817571 - DNA, 20 bp, Homo sapiens
cttgtgtgtttattgtcaaa

SEQ ID NO: 4817572 - DNA, 20 bp, Homo sapiens
cttgttaatttcattccaaa

SEQ ID NO: 4817573 - DNA, 21 bp, Homo sapiens
cttgttaatttcattccaaac

SEQ ID NO: 4817574 - DNA, 19 bp, Homo sapiens
cttgttatggtagaaaaat

SEQ ID NO: 4817575 - DNA, 15 bp, Homo sapiens
cttgttatgttgtaa

SEQ ID NO: 4817576 - DNA, 22 bp, Homo sapiens
cttgttcagtcacttgtttgtg

SEQ ID NO: 4817577 - DNA, 18 bp, Homo sapiens
cttgttgtattcctgcct

SEQ ID NO: 4817578 - DNA, 22 bp, Homo sapiens
cttgttgtattcctgcctttga

SEQ ID NO: 4817579 - DNA, 15 bp, Homo sapiens
cttgttgttcatata

SEQ ID NO: 4817580 - DNA, 21 bp, Homo sapiens
cttgtttaccaaagaagagtt

SEQ ID NO: 4817581 - DNA, 21 bp, Homo sapiens
cttgtttgcctttaggcagga

SEQ ID NO: 4817582 - DNA, 23 bp, Homo sapiens
ctttaaaatgattcacttttatt

SEQ ID NO: 4817583 - DNA, 14 bp, Homo sapiens
ctttaaattatatg

SEQ ID NO: 4817584 - DNA, 14 bp, Homo sapiens
ctttaccatgctca

SEQ ID NO: 4817585 - DNA, 13 bp, Homo sapiens
ctttagaatatta

SEQ ID NO: 4817586 - DNA, 17 bp, Homo sapiens
ctttagtattatattaa

SEQ ID NO: 4817587 - DNA, 13 bp, Homo sapiens
ctttataaataaa

SEQ ID NO: 4817588 - DNA, 13 bp, Homo sapiens
ctttataatggct

SEQ ID NO: 4817589 - DNA, 19 bp, Homo sapiens
ctttatcatgtgtttctgt

SEQ ID NO: 4817590 - DNA, 16 bp, Homo sapiens
ctttatctatgggaga

SEQ ID NO: 4817591 - DNA, 13 bp, Homo sapiens
ctttatctgggct

SEQ ID NO: 4817592 - DNA, 14 bp, Homo sapiens
ctttatgatttcat

SEQ ID NO: 4817593 - DNA, 14 bp, Homo sapiens
ctttatgtattctc

SEQ ID NO: 4817594 - DNA, 23 bp, Homo sapiens
ctttattagtgaagtatgcacta

SEQ ID NO: 4817595 - DNA, 11 bp, Homo sapiens
gaatgaatgtc

SEQ ID NO: 4817596 - DNA, 18 bp, Homo sapiens
gaatgaatgtcagtgtga

SEQ ID NO: 4817597 - DNA, 22 bp, Homo sapiens
gaatgaatgtcagtgtgactga

SEQ ID NO: 4817598 - DNA, 23 bp, Homo sapiens
gaatgacaggaacccatcactgt

SEQ ID NO: 4817599 - DNA, 12 bp, Homo sapiens
gaatgagaaatc

SEQ ID NO: 4817600 - DNA, 16 bp, Homo sapiens
gaatgagaaatcatgt

SEQ ID NO: 4817601 - DNA, 17 bp, Homo sapiens
gaatgagaaatcatgtt

SEQ ID NO: 4817602 - DNA, 12 bp, Homo sapiens
gaatgagaagta

SEQ ID NO: 4817603 - DNA, 16 bp, Homo sapiens
gaatgagcattctgca

SEQ ID NO: 4817604 - DNA, 18 bp, Homo sapiens
gaatgcagtataaaatgt

SEQ ID NO: 4817605 - DNA, 15 bp, Homo sapiens
gaatgcttaaatgat

SEQ ID NO: 4817606 - DNA, 14 bp, Homo sapiens
gaatggctctggct

SEQ ID NO: 4817607 - DNA, 23 bp, Homo sapiens
gaatgggccaagccagggttcca

SEQ ID NO: 4817608 - DNA, 19 bp, Homo sapiens
gaatggtgggctccagagt

SEQ ID NO: 4817609 - DNA, 11 bp, Homo sapiens
gaatgtatgta

SEQ ID NO: 4817610 - DNA, 13 bp, Homo sapiens
gaatgtcagtgtg

SEQ ID NO: 4817611 - DNA, 14 bp, Homo sapiens
gaatgtcagtgtga

SEQ ID NO: 4817612 - DNA, 14 bp, Homo sapiens
gaatgtcatttgct

SEQ ID NO: 4817613 - DNA, 23 bp, Homo sapiens
gaatgtcatttgctaatgaattt

SEQ ID NO: 4817614 - DNA, 22 bp, Homo sapiens
gaatgtgaaaaaaaaaagtaat

SEQ ID NO: 4817615 - DNA, 23 bp, Homo sapiens
gaatgtgaaaaaaaaaagtaatt

SEQ ID NO: 4817616 - DNA, 15 bp, Homo sapiens
gaatgtttcatttgc

SEQ ID NO: 4817617 - DNA, 22 bp, Homo sapiens
gaatgtttcatttgcacaagta

SEQ ID NO: 4817618 - DNA, 18 bp, Homo sapiens
gaattactgtttgaaact

SEQ ID NO: 4817619 - DNA, 22 bp, Homo sapiens
gaattagccaaccaggctacag

SEQ ID NO: 4817620 - DNA, 19 bp, Homo sapiens
gaattcacccctcccacct

SEQ ID NO: 4817621 - DNA, 23 bp, Homo sapiens
gaattcagtagcattttaatagt

SEQ ID NO: 4817622 - DNA, 21 bp, Homo sapiens
gaattcatgatgctagttctt

SEQ ID NO: 4817623 - DNA, 22 bp, Homo sapiens
gaattccacctggaaagccagg

SEQ ID NO: 4817624 - DNA, 19 bp, Homo sapiens
gaattctaagattgtacat

SEQ ID NO: 4817625 - DNA, 20 bp, Homo sapiens
gaattctaagattgtacata

SEQ ID NO: 4817626 - DNA, 18 bp, Homo sapiens
gaattgaaccgtcaatgt

SEQ ID NO: 4817627 - DNA, 22 bp, Homo sapiens
gaattgtaaggaatgattaatt

SEQ ID NO: 4817628 - DNA, 21 bp, Homo sapiens
gaatttagaggataaataata

SEQ ID NO: 4817629 - DNA, 15 bp, Homo sapiens
gaatttcccaaagca

SEQ ID NO: 4817630 - DNA, 18 bp, Homo sapiens
gaattttatttctctcag

SEQ ID NO: 4817631 - DNA, 19 bp, Homo sapiens
gaattttggctgtgtctcc

SEQ ID NO: 4817632 - DNA, 17 bp, Homo sapiens
gacaaaggccttaacaa

SEQ ID NO: 4817633 - DNA, 14 bp, Homo sapiens
gacaaattttaatt

SEQ ID NO: 4817634 - DNA, 23 bp, Homo sapiens
gacaacaaaagggaaaaaagcaa

SEQ ID NO: 4817635 - DNA, 20 bp, Homo sapiens
gacaacacacacacacacaa

SEQ ID NO: 4817636 - DNA, 19 bp, Homo sapiens
gacaacttgctcctttcca

SEQ ID NO: 4817637 - DNA, 13 bp, Homo sapiens
gacaagcaattag

SEQ ID NO: 4817638 - DNA, 17 bp, Homo sapiens
gacaagcaattagaagc

SEQ ID NO: 4817639 - DNA, 13 bp, Homo sapiens
gacaagccaggcc

SEQ ID NO: 4817640 - DNA, 18 bp, Homo sapiens
gacaagccaggccctctc

SEQ ID NO: 4817641 - DNA, 12 bp, Homo sapiens
gacaagggctga

SEQ ID NO: 4817642 - DNA, 21 bp, Homo sapiens
gacaagggctgacctgcctct

SEQ ID NO: 4817643 - DNA, 16 bp, Homo sapiens
gacaatgacccagtgg

SEQ ID NO: 4817644 - DNA, 21 bp, Homo sapiens
gacaatgagtggaatactaaa

SEQ ID NO: 4817645 - DNA, 13 bp, Homo sapiens
gacaatgtggaat

SEQ ID NO: 4817646 - DNA, 22 bp, Homo sapiens
gacacaagccttcggcgcctta

SEQ ID NO: 4817647 - DNA, 15 bp, Homo sapiens
gacacacatatacat

SEQ ID NO: 4817648 - DNA, 16 bp, Homo sapiens
gacacacatatacatt

SEQ ID NO: 4817649 - DNA, 20 bp, Homo sapiens
gacacacatatacattattt

SEQ ID NO: 4817650 - DNA, 21 bp, Homo sapiens
gacacagaggacggcttcccc

SEQ ID NO: 4817651 - DNA, 19 bp, Homo sapiens
gacacagcccagagactga

SEQ ID NO: 4817652 - DNA, 21 bp, Homo sapiens
gacacagcgtccctagcagtg

SEQ ID NO: 4817653 - DNA, 12 bp, Homo sapiens
gacacaggctgc

SEQ ID NO: 4817654 - DNA, 15 bp, Homo sapiens
gacacaggctgccgc

SEQ ID NO: 4817655 - DNA, 16 bp, Homo sapiens
gacacagtattgactt

SEQ ID NO: 4817656 - DNA, 18 bp, Homo sapiens
gacaccaccactgtgtcc

SEQ ID NO: 4817657 - DNA, 14 bp, Homo sapiens
gacaccatcaccac

SEQ ID NO: 4817658 - DNA, 22 bp, Homo sapiens
gacacctagactctaaaactat

SEQ ID NO: 4817659 - DNA, 16 bp, Homo sapiens
gacaccttcccagctg

SEQ ID NO: 4817660 - DNA, 13 bp, Homo sapiens
gacactgaaataa

SEQ ID NO: 4817661 - DNA, 18 bp, Homo sapiens
gacactgatgggtcctgc

SEQ ID NO: 4817662 - DNA, 19 bp, Homo sapiens
gacactgatgggtcctgct

SEQ ID NO: 4817663 - DNA, 23 bp, Homo sapiens
gacactgatgggtcctgctgctc

SEQ ID NO: 4817664 - DNA, 20 bp, Homo sapiens
gacactggaagggtccggct

SEQ ID NO: 4817665 - DNA, 18 bp, Homo sapiens
gacactgtctgctgcccc

SEQ ID NO: 4817666 - DNA, 18 bp, Homo sapiens
gacagaaccaacgggtct

SEQ ID NO: 4817667 - DNA, 16 bp, Homo sapiens
gacagagatggcagag

SEQ ID NO: 4817668 - DNA, 18 bp, Homo sapiens
gacagagatggcagagcc

SEQ ID NO: 4817669 - DNA, 17 bp, Homo sapiens
gacagagtggatctgga

SEQ ID NO: 4817670 - DNA, 13 bp, Homo sapiens
gacagatcttgag

SEQ ID NO: 4817671 - DNA, 15 bp, Homo sapiens
gacagatcttgagca

SEQ ID NO: 4817672 - DNA, 16 bp, Homo sapiens
gacagatgggtgtccc

SEQ ID NO: 4817673 - DNA, 20 bp, Homo sapiens
gacagcaaaaccattgcttc

SEQ ID NO: 4817674 - DNA, 14 bp, Homo sapiens
gacagcagctggac

SEQ ID NO: 4817675 - DNA, 21 bp, Homo sapiens
gacagcctccaccttgagcac

SEQ ID NO: 4817676 - DNA, 19 bp, Homo sapiens
gacagcgccatgtgtgtca

SEQ ID NO: 4817677 - DNA, 12 bp, Homo sapiens
gacagcggcccc

SEQ ID NO: 4817678 - DNA, 16 bp, Homo sapiens
gacagcggccccgcgg

SEQ ID NO: 4817679 - DNA, 21 bp, Homo sapiens
gacagcggccccgcggagccc

SEQ ID NO: 4817680 - DNA, 18 bp, Homo sapiens
gacagcggcccggcccac

SEQ ID NO: 4817681 - DNA, 22 bp, Homo sapiens
gacagcggcccggcccacgcag

SEQ ID NO: 4817682 - DNA, 10 bp, Homo sapiens
gacagctctt

SEQ ID NO: 4817683 - DNA, 15 bp, Homo sapiens
gacagctgtgctgta

SEQ ID NO: 4817684 - DNA, 17 bp, Homo sapiens
gacaggaaagccctccc

SEQ ID NO: 4817685 - DNA, 20 bp, Homo sapiens
gacaggaaagccctccccct

SEQ ID NO: 4817686 - DNA, 17 bp, Homo sapiens
gacaggaacccatcact

SEQ ID NO: 4817687 - DNA, 22 bp, Homo sapiens
gacaggaacccatcactgtgtc

SEQ ID NO: 4817688 - DNA, 23 bp, Homo sapiens
gacaggaacccatcactgtgtct

SEQ ID NO: 4817689 - DNA, 18 bp, Homo sapiens
gacaggattgtctgctgc

SEQ ID NO: 4817690 - DNA, 19 bp, Homo sapiens
gacaggattgtctgctgcc

SEQ ID NO: 4817691 - DNA, 14 bp, Homo sapiens
gacagggagctggg

SEQ ID NO: 4817692 - DNA, 14 bp, Homo sapiens
gacagggcgtcctc

SEQ ID NO: 4817693 - DNA, 23 bp, Homo sapiens
gacagggtggggcttagaatggg

SEQ ID NO: 4817694 - DNA, 14 bp, Homo sapiens
gacagttaagagaa

SEQ ID NO: 4817695 - DNA, 14 bp, Homo sapiens
gacagttgggtgtg

SEQ ID NO: 4817696 - DNA, 17 bp, Homo sapiens
gacatacgaaacacaaa

SEQ ID NO: 4817697 - DNA, 15 bp, Homo sapiens
gacatattcccatgg

SEQ ID NO: 4817698 - DNA, 20 bp, Homo sapiens
gacatcagaggttctttgag

SEQ ID NO: 4817699 - DNA, 14 bp, Homo sapiens
gacatccacatgca

SEQ ID NO: 4817700 - DNA, 20 bp, Homo sapiens
gacatccacatgcacatgta

SEQ ID NO: 4817701 - DNA, 22 bp, Homo sapiens
gacatccacatgcacatgtatt

SEQ ID NO: 4817702 - DNA, 22 bp, Homo sapiens
ggccctgtagccctggcccggt

SEQ ID NO: 4817703 - DNA, 18 bp, Homo sapiens
ggccctgtcactgtccag

SEQ ID NO: 4817704 - DNA, 12 bp, Homo sapiens
ggccctgtggga

SEQ ID NO: 4817705 - DNA, 20 bp, Homo sapiens
ggcccttcccaacctcccct

SEQ ID NO: 4817706 - DNA, 13 bp, Homo sapiens
ggcccttccttca

SEQ ID NO: 4817707 - DNA, 14 bp, Homo sapiens
ggccgagggaaatg

SEQ ID NO: 4817708 - DNA, 15 bp, Homo sapiens
ggccgcaacttccca

SEQ ID NO: 4817709 - DNA, 18 bp, Homo sapiens
ggccgcaacttcccaggc

SEQ ID NO: 4817710 - DNA, 14 bp, Homo sapiens
ggccgcagggcgct

SEQ ID NO: 4817711 - DNA, 16 bp, Homo sapiens
ggccgcagggcgctcc

SEQ ID NO: 4817712 - DNA, 21 bp, Homo sapiens
ggccgccgaagggcagccccg

SEQ ID NO: 4817713 - DNA, 13 bp, Homo sapiens
ggccgcctcctcc

SEQ ID NO: 4817714 - DNA, 16 bp, Homo sapiens
ggccgcctcctccaga

SEQ ID NO: 4817715 - DNA, 18 bp, Homo sapiens
ggccgcctcctccagact

SEQ ID NO: 4817716 - DNA, 14 bp, Homo sapiens
ggccgctctccgcc

SEQ ID NO: 4817717 - DNA, 16 bp, Homo sapiens
ggccgctctccgcccc

SEQ ID NO: 4817718 - DNA, 23 bp, Homo sapiens
ggccgctgcagtcagcacagaga

SEQ ID NO: 4817719 - DNA, 20 bp, Homo sapiens
ggccggcccacgtcctgggt

SEQ ID NO: 4817720 - DNA, 20 bp, Homo sapiens
ggccgggcaggtcctgccca

SEQ ID NO: 4817721 - DNA, 19 bp, Homo sapiens
ggccgtccctgacttccca

SEQ ID NO: 4817722 - DNA, 15 bp, Homo sapiens
ggccgtgcagggcca

SEQ ID NO: 4817723 - DNA, 16 bp, Homo sapiens
ggcctaatccacctgg

SEQ ID NO: 4817724 - DNA, 14 bp, Homo sapiens
ggcctaccacagct

SEQ ID NO: 4817725 - DNA, 18 bp, Homo sapiens
ggcctaccacagctgcct

SEQ ID NO: 4817726 - DNA, 21 bp, Homo sapiens
ggcctaccacagctgcctccg

SEQ ID NO: 4817727 - DNA, 18 bp, Homo sapiens
ggcctactggggatcaga

SEQ ID NO: 4817728 - DNA, 16 bp, Homo sapiens
ggcctagcccaccctg

SEQ ID NO: 4817729 - DNA, 17 bp, Homo sapiens
ggcctagcccaccctgc

SEQ ID NO: 4817730 - DNA, 18 bp, Homo sapiens
ggcctagcccaccctgct

SEQ ID NO: 4817731 - DNA, 20 bp, Homo sapiens
ggcctatgaccctgtgcctg

SEQ ID NO: 4817732 - DNA, 16 bp, Homo sapiens
ggcctcacctggcttc

SEQ ID NO: 4817733 - DNA, 13 bp, Homo sapiens
ggcctcagccctc

SEQ ID NO: 4817734 - DNA, 15 bp, Homo sapiens
ggcctcagccctcag

SEQ ID NO: 4817735 - DNA, 22 bp, Homo sapiens
ggcctcagggaccaaggagatg

SEQ ID NO: 4817736 - DNA, 15 bp, Homo sapiens
ggcctcccagccacc

SEQ ID NO: 4817737 - DNA, 17 bp, Homo sapiens
ggcctcccagccacccg

SEQ ID NO: 4817738 - DNA, 10 bp, Homo sapiens
ggcctccccg

SEQ ID NO: 4817739 - DNA, 17 bp, Homo sapiens
ggcctcctagcctctcc

SEQ ID NO: 4817740 - DNA, 23 bp, Homo sapiens
ggcctcctcttcaccccggcagg

SEQ ID NO: 4817741 - DNA, 15 bp, Homo sapiens
ggcctcggcctggct

SEQ ID NO: 4817742 - DNA, 20 bp, Homo sapiens
ggcctcggcctggcttcacc

SEQ ID NO: 4817743 - DNA, 20 bp, Homo sapiens
ggcctcgtgccatgatctgt

SEQ ID NO: 4817744 - DNA, 14 bp, Homo sapiens
ggcctgagaagagt

SEQ ID NO: 4817745 - DNA, 15 bp, Homo sapiens
ggcctgagggaagcc

SEQ ID NO: 4817746 - DNA, 17 bp, Homo sapiens
ggcctgagggaagccca

SEQ ID NO: 4817747 - DNA, 13 bp, Homo sapiens
ggcctgatggcca

SEQ ID NO: 4817748 - DNA, 14 bp, Homo sapiens
ggcctgatggccag

SEQ ID NO: 4817749 - DNA, 17 bp, Homo sapiens
ggcctgatggccaggcc

SEQ ID NO: 4817750 - DNA, 19 bp, Homo sapiens
ggcctgatggccaggcctc

SEQ ID NO: 4817751 - DNA, 21 bp, Homo sapiens
ggcctgcagaccctgccaggg

SEQ ID NO: 4817752 - DNA, 13 bp, Homo sapiens
ggcctgcccccct

SEQ ID NO: 4817753 - DNA, 20 bp, Homo sapiens
ggcctgcggggttccctgcg

SEQ ID NO: 4817754 - DNA, 10 bp, Homo sapiens
ggcctggccc

SEQ ID NO: 4817755 - DNA, 15 bp, Homo sapiens
ggcctggcccagcca

SEQ ID NO: 4817756 - DNA, 16 bp, Homo sapiens
ggcctggcccagccag

SEQ ID NO: 4817757 - DNA, 17 bp, Homo sapiens
ggcctggcccagccagc

SEQ ID NO: 4817758 - DNA, 19 bp, Homo sapiens
ggcctggcccagccagcag

SEQ ID NO: 4817759 - DNA, 14 bp, Homo sapiens
ggaaggggcctggg

SEQ ID NO: 4817760 - DNA, 18 bp, Homo sapiens
ggaaggggcgctcctccc

SEQ ID NO: 4817761 - DNA, 20 bp, Homo sapiens
ggaaggtgatgggggcatgg

SEQ ID NO: 4817762 - DNA, 14 bp, Homo sapiens
ggaagtaattttct

SEQ ID NO: 4817763 - DNA, 19 bp, Homo sapiens
ggaagtaattttcttctca

SEQ ID NO: 4817764 - DNA, 12 bp, Homo sapiens
ggaagtactgga

SEQ ID NO: 4817765 - DNA, 16 bp, Homo sapiens
ggaagtactggagaaa

SEQ ID NO: 4817766 - DNA, 18 bp, Homo sapiens
ggaagtcaggagccagca

SEQ ID NO: 4817767 - DNA, 19 bp, Homo sapiens
ggaagtcaggagccagcag

SEQ ID NO: 4817768 - DNA, 15 bp, Homo sapiens
ggaagtcatcctgca

SEQ ID NO: 4817769 - DNA, 14 bp, Homo sapiens
ggaagtgaccaagg

SEQ ID NO: 4817770 - DNA, 19 bp, Homo sapiens
ggaatcacagccaataaac

SEQ ID NO: 4817771 - DNA, 19 bp, Homo sapiens
ggaatcaggattccttctt

SEQ ID NO: 4817772 - DNA, 19 bp, Homo sapiens
ggaatccatatcagctctg

SEQ ID NO: 4817773 - DNA, 19 bp, Homo sapiens
ggaatgaatgtcagtgtga

SEQ ID NO: 4817774 - DNA, 11 bp, Homo sapiens
ggaatgctcaa

SEQ ID NO: 4817775 - DNA, 17 bp, Homo sapiens
ggaatgctcaatgtgct

SEQ ID NO: 4817776 - DNA, 20 bp, Homo sapiens
ggaatggggtgggagccaca

SEQ ID NO: 4817777 - DNA, 19 bp, Homo sapiens
ggaattattagcaccagct

SEQ ID NO: 4817778 - DNA, 22 bp, Homo sapiens
ggaattccacctggaaagccag

SEQ ID NO: 4817779 - DNA, 19 bp, Homo sapiens
ggacactacacgtttcaac

SEQ ID NO: 4817780 - DNA, 22 bp, Homo sapiens
ggacactgatgggtcctgctgc

SEQ ID NO: 4817781 - DNA, 23 bp, Homo sapiens
ggacagaaccaacgggtctgtgg

SEQ ID NO: 4817782 - DNA, 14 bp, Homo sapiens
ggacagacacagag

SEQ ID NO: 4817783 - DNA, 15 bp, Homo sapiens
ggacagcggcccggc

SEQ ID NO: 4817784 - DNA, 17 bp, Homo sapiens
ggacagcggcccggccc

SEQ ID NO: 4817785 - DNA, 13 bp, Homo sapiens
ggacaggacttgt

SEQ ID NO: 4817786 - DNA, 18 bp, Homo sapiens
ggacaggattgtctgctg

SEQ ID NO: 4817787 - DNA, 19 bp, Homo sapiens
ggacaggattgtctgctgc

SEQ ID NO: 4817788 - DNA, 22 bp, Homo sapiens
ggacaggattgtctgctgcctc

SEQ ID NO: 4817789 - DNA, 24 bp, Homo sapiens
ggacaggattgtctgctgcctcca

SEQ ID NO: 4817790 - DNA, 13 bp, Homo sapiens
ggacagtgttcaa

SEQ ID NO: 4817791 - DNA, 15 bp, Homo sapiens
ggacagttcacaccc

SEQ ID NO: 4817792 - DNA, 17 bp, Homo sapiens
ggacagttcacaccctg

SEQ ID NO: 4817793 - DNA, 21 bp, Homo sapiens
ggacatgagagtagggccctg

SEQ ID NO: 4817794 - DNA, 23 bp, Homo sapiens
ggacatgagagtagggccctgac

SEQ ID NO: 4817795 - DNA, 18 bp, Homo sapiens
ggaccaaggagatgggga

SEQ ID NO: 4817796 - DNA, 12 bp, Homo sapiens
ggaccaccctgc

SEQ ID NO: 4817797 - DNA, 13 bp, Homo sapiens
ggaccagagctgc

SEQ ID NO: 4817798 - DNA, 19 bp, Homo sapiens
ggaccagagctgccacctg

SEQ ID NO: 4817799 - DNA, 22 bp, Homo sapiens
ggaccccagatacctgtgagga

SEQ ID NO: 4817800 - DNA, 15 bp, Homo sapiens
ggaccccattctggg

SEQ ID NO: 4817801 - DNA, 19 bp, Homo sapiens
ggaccccattctgggactg

SEQ ID NO: 4817802 - DNA, 21 bp, Homo sapiens
ggacccccccagtccgccccg

SEQ ID NO: 4817803 - DNA, 14 bp, Homo sapiens
ggaccctcccaggt

SEQ ID NO: 4817804 - DNA, 17 bp, Homo sapiens
ggaccggagcggctgag

SEQ ID NO: 4817805 - DNA, 19 bp, Homo sapiens
ggaccggagcggctgagga

SEQ ID NO: 4817806 - DNA, 21 bp, Homo sapiens
ggacctactcctccccctcct

SEQ ID NO: 4817807 - DNA, 12 bp, Homo sapiens
ggacctcaggcc

SEQ ID NO: 4817808 - DNA, 20 bp, Homo sapiens
ggacctctactttccaggct

SEQ ID NO: 4817809 - DNA, 18 bp, Homo sapiens
ggaccttgcttccttctc

SEQ ID NO: 4817810 - DNA, 21 bp, Homo sapiens
ggacctttgcactttgccatc

SEQ ID NO: 4817811 - DNA, 20 bp, Homo sapiens
ggacgacccggggcgggctg

SEQ ID NO: 4817812 - DNA, 22 bp, Homo sapiens
ggacgagcagagcgcagccccc

SEQ ID NO: 4817813 - DNA, 23 bp, Homo sapiens
ggacgagtgagctaccaggaaga

SEQ ID NO: 4817814 - DNA, 11 bp, Homo sapiens
ggacgcccctt

SEQ ID NO: 4817815 - DNA, 13 bp, Homo sapiens
ggacggaagtggc

SEQ ID NO: 4817816 - DNA, 19 bp, Homo sapiens
ggacggggcccgccccagg

SEQ ID NO: 4817817 - DNA, 13 bp, Homo sapiens
ggactccaggggc

SEQ ID NO: 4817818 - DNA, 20 bp, Homo sapiens
ggactcgcgagagggtgccg

SEQ ID NO: 4817819 - DNA, 18 bp, Homo sapiens
ggactgaccgaagggacg

SEQ ID NO: 4817820 - DNA, 13 bp, Homo sapiens
ggactgagcctgg

SEQ ID NO: 4817821 - DNA, 13 bp, Homo sapiens
ggactgcctctgc

SEQ ID NO: 4817822 - DNA, 22 bp, Homo sapiens
ggactgcctctgccacactctg

SEQ ID NO: 4817823 - DNA, 12 bp, Homo sapiens
ggactgctcagg

SEQ ID NO: 4817824 - DNA, 16 bp, Homo sapiens
ggactgctcaggctcc

SEQ ID NO: 4817825 - DNA, 23 bp, Homo sapiens
ggactgctcaggctccccaagac

SEQ ID NO: 4817826 - DNA, 20 bp, Homo sapiens
ggactgtcttcaaccctgcc

SEQ ID NO: 4817827 - DNA, 13 bp, Homo sapiens
ggacttaatttag

SEQ ID NO: 4817828 - DNA, 14 bp, Homo sapiens
ggacttctgcagct

SEQ ID NO: 4817829 - DNA, 14 bp, Homo sapiens
ggagaaaagccaga

SEQ ID NO: 4817830 - DNA, 15 bp, Homo sapiens
ggagaaaagccagat

SEQ ID NO: 4817831 - DNA, 19 bp, Homo sapiens
ggagaaaatggacgtgtta

SEQ ID NO: 4817832 - DNA, 19 bp, Homo sapiens
ggagaagaggggtatagga

SEQ ID NO: 4817833 - DNA, 19 bp, Homo sapiens
ggagaccctgcgcccctgc

SEQ ID NO: 4817834 - DNA, 15 bp, Homo sapiens
ggagactatgtgtca

SEQ ID NO: 4817835 - DNA, 15 bp, Homo sapiens
ggagactgagcttga

SEQ ID NO: 4817836 - DNA, 14 bp, Homo sapiens
ggagagacacagcg

SEQ ID NO: 4817837 - DNA, 15 bp, Homo sapiens
ggagagcgccacccg

SEQ ID NO: 4817838 - DNA, 16 bp, Homo sapiens
ggagaggaactccttg

SEQ ID NO: 4817839 - DNA, 21 bp, Homo sapiens
ggagaggcggcctcgtgccat

SEQ ID NO: 4817840 - DNA, 16 bp, Homo sapiens
ggagatgaggctggat

SEQ ID NO: 4817841 - DNA, 22 bp, Homo sapiens
ggagcaaataccttagctccct

SEQ ID NO: 4817842 - DNA, 20 bp, Homo sapiens
ggagcaaatatctaaataat

SEQ ID NO: 4817843 - DNA, 14 bp, Homo sapiens
ggagcaaggctgct

SEQ ID NO: 4817844 - DNA, 15 bp, Homo sapiens
ggagcaaggctgcta

SEQ ID NO: 4817845 - DNA, 21 bp, Homo sapiens
ggagcacacatccaagaggga

SEQ ID NO: 4817846 - DNA, 22 bp, Homo sapiens
ggagcacacatccaagagggac

SEQ ID NO: 4817847 - DNA, 12 bp, Homo sapiens
ggagcacagcca

SEQ ID NO: 4817848 - DNA, 14 bp, Homo sapiens
ggagcacagccata

SEQ ID NO: 4817849 - DNA, 12 bp, Homo sapiens
ggagcaccccca

SEQ ID NO: 4817850 - DNA, 13 bp, Homo sapiens
ggagcacccccag

SEQ ID NO: 4817851 - DNA, 16 bp, Homo sapiens
ggagcacccccagcct

SEQ ID NO: 4817852 - DNA, 17 bp, Homo sapiens
ggagcacccccagcctc

SEQ ID NO: 4817853 - DNA, 20 bp, Homo sapiens
ggagcacccccagcctcccc

SEQ ID NO: 4817854 - DNA, 22 bp, Homo sapiens
ggagcacccccagcctccccca

SEQ ID NO: 4817855 - DNA, 22 bp, Homo sapiens
ggagcactagaatgagaaatca

SEQ ID NO: 4817856 - DNA, 19 bp, Homo sapiens
ggagcagagacggcagccc

SEQ ID NO: 4817857 - DNA, 21 bp, Homo sapiens
ggagcagagacggcagcccca

SEQ ID NO: 4817858 - DNA, 19 bp, Homo sapiens
ggagcagagctgatggaga

SEQ ID NO: 4817859 - DNA, 12 bp, Homo sapiens
ggagccagcagg

SEQ ID NO: 4817860 - DNA, 21 bp, Homo sapiens
ggagccagcagggcgggccag

SEQ ID NO: 4817861 - DNA, 23 bp, Homo sapiens
ggagccagcagggcgggccagga

SEQ ID NO: 4817862 - DNA, 16 bp, Homo sapiens
ggagccccatcgcctg

SEQ ID NO: 4817863 - DNA, 16 bp, Homo sapiens
ggagcccccgcccctc

SEQ ID NO: 4817864 - DNA, 17 bp, Homo sapiens
ggagcccccgcccctcc

SEQ ID NO: 4817865 - DNA, 16 bp, Homo sapiens
ggagcccgcctgcgcc

SEQ ID NO: 4817866 - DNA, 19 bp, Homo sapiens
ggagcccgcctgcgccccc

SEQ ID NO: 4817867 - DNA, 17 bp, Homo sapiens
ggagcctccccctcaga

SEQ ID NO: 4817868 - DNA, 20 bp, Homo sapiens
ggagcctgagtcagggccca

SEQ ID NO: 4817869 - DNA, 21 bp, Homo sapiens
ggagcctgagtcagggcccag

SEQ ID NO: 4817870 - DNA, 16 bp, Homo sapiens
ggagcctggcacagga

SEQ ID NO: 4817871 - DNA, 20 bp, Homo sapiens
ggagcctggcacaggactga

SEQ ID NO: 4817872 - DNA, 13 bp, Homo sapiens
ggagcggctgagg

SEQ ID NO: 4817873 - DNA, 15 bp, Homo sapiens
ggagcggctgaggac

SEQ ID NO: 4817874 - DNA, 23 bp, Homo sapiens
ggagcggctgaggacggggcaga

SEQ ID NO: 4817875 - DNA, 23 bp, Homo sapiens
ggagcgggggctaactggcccca

SEQ ID NO: 4817876 - DNA, 14 bp, Homo sapiens
ggagctcacaccgc

SEQ ID NO: 4817877 - DNA, 11 bp, Homo sapiens
ggagctccagt

SEQ ID NO: 4817878 - DNA, 15 bp, Homo sapiens
ggagctccagtttct

SEQ ID NO: 4817879 - DNA, 13 bp, Homo sapiens
ggaggacccctgc

SEQ ID NO: 4817880 - DNA, 16 bp, Homo sapiens
ggaggactgttctaac

SEQ ID NO: 4817881 - DNA, 15 bp, Homo sapiens
ggaggagcaccccca

SEQ ID NO: 4817882 - DNA, 18 bp, Homo sapiens
ggaggagcacccccagcc

SEQ ID NO: 4817883 - DNA, 19 bp, Homo sapiens
ggaggagcacccccagcct

SEQ ID NO: 4817884 - DNA, 21 bp, Homo sapiens
gcttcattaaaacaagagacc

SEQ ID NO: 4817885 - DNA, 13 bp, Homo sapiens
gcttccagctcag

SEQ ID NO: 4817886 - DNA, 17 bp, Homo sapiens
gcttccagctcagtccc

SEQ ID NO: 4817887 - DNA, 21 bp, Homo sapiens
gcttccatggtggtttcagaa

SEQ ID NO: 4817888 - DNA, 23 bp, Homo sapiens
gcttcccacctccctgcccaggc

SEQ ID NO: 4817889 - DNA, 18 bp, Homo sapiens
gcttcccaggaccctggg

SEQ ID NO: 4817890 - DNA, 22 bp, Homo sapiens
gcttcccatcaccggaggagct

SEQ ID NO: 4817891 - DNA, 18 bp, Homo sapiens
gcttcccatctgaagagt

SEQ ID NO: 4817892 - DNA, 17 bp, Homo sapiens
gcttcccatgtctttct

SEQ ID NO: 4817893 - DNA, 20 bp, Homo sapiens
gcttccccatcgccttctgg

SEQ ID NO: 4817894 - DNA, 20 bp, Homo sapiens
gcttccccattgccttctgg

SEQ ID NO: 4817895 - DNA, 18 bp, Homo sapiens
gcttccctgaacactcat

SEQ ID NO: 4817896 - DNA, 21 bp, Homo sapiens
gcttcgtttgcctccagaacc

SEQ ID NO: 4817897 - DNA, 22 bp, Homo sapiens
gcttcgtttgcctccagaacct

SEQ ID NO: 4817898 - DNA, 21 bp, Homo sapiens
gcttctaagggatccagagac

SEQ ID NO: 4817899 - DNA, 22 bp, Homo sapiens
gcttctaagggatccagagacc

SEQ ID NO: 4817900 - DNA, 20 bp, Homo sapiens
gcttctaatatttattgctt

SEQ ID NO: 4817901 - DNA, 13 bp, Homo sapiens
gcttctcacactg

SEQ ID NO: 4817902 - DNA, 23 bp, Homo sapiens
gcttctccctggggaggacccct

SEQ ID NO: 4817903 - DNA, 22 bp, Homo sapiens
gcttctctgccggtggggccag

SEQ ID NO: 4817904 - DNA, 21 bp, Homo sapiens
gcttcttacgaacgccacggc

SEQ ID NO: 4817905 - DNA, 13 bp, Homo sapiens
gcttgaccctgaa

SEQ ID NO: 4817906 - DNA, 22 bp, Homo sapiens
gcttgacctttaagagaaatga

SEQ ID NO: 4817907 - DNA, 15 bp, Homo sapiens
gcttgagtggacagc

SEQ ID NO: 4817908 - DNA, 18 bp, Homo sapiens
gcttgagtggacagcagc

SEQ ID NO: 4817909 - DNA, 16 bp, Homo sapiens
gcttgatatcccaagt

SEQ ID NO: 4817910 - DNA, 20 bp, Homo sapiens
gcttgattctaaaggggaca

SEQ ID NO: 4817911 - DNA, 20 bp, Homo sapiens
gcttgctggaaaactgccac

SEQ ID NO: 4817912 - DNA, 21 bp, Homo sapiens
gcttgctggaaaactgccaca

SEQ ID NO: 4817913 - DNA, 21 bp, Homo sapiens
gcttggaacatttgggagact

SEQ ID NO: 4817914 - DNA, 22 bp, Homo sapiens
gcttggactacctataaatgga

SEQ ID NO: 4817915 - DNA, 11 bp, Homo sapiens
gcttggagcag

SEQ ID NO: 4817916 - DNA, 14 bp, Homo sapiens
gcttggagtgccac

SEQ ID NO: 4817917 - DNA, 15 bp, Homo sapiens
gcttggctccatgct

SEQ ID NO: 4817918 - DNA, 20 bp, Homo sapiens
gcttgggagagcccctgggg

SEQ ID NO: 4817919 - DNA, 21 bp, Homo sapiens
gcttgggagagcccctggggc

SEQ ID NO: 4817920 - DNA, 17 bp, Homo sapiens
gcttggggaccagagct

SEQ ID NO: 4817921 - DNA, 18 bp, Homo sapiens
gcttggggaccagagctg

SEQ ID NO: 4817922 - DNA, 20 bp, Homo sapiens
gcttggggaccagagctgcc

SEQ ID NO: 4817923 - DNA, 20 bp, Homo sapiens
gcttggggtagagaggacag

SEQ ID NO: 4817924 - DNA, 21 bp, Homo sapiens
gcttgtccaacaactccagga

SEQ ID NO: 4817925 - DNA, 19 bp, Homo sapiens
gcttgtgtaatttcctgct

SEQ ID NO: 4817926 - DNA, 20 bp, Homo sapiens
gcttgtttaaggttcttgct

SEQ ID NO: 4817927 - DNA, 21 bp, Homo sapiens
gctttataataaactgtttaa

SEQ ID NO: 4817928 - DNA, 16 bp, Homo sapiens
gctttatccacattgt

SEQ ID NO: 4817929 - DNA, 22 bp, Homo sapiens
gctttcatgaccactgggcctg

SEQ ID NO: 4817930 - DNA, 23 bp, Homo sapiens
gctttcatgaccactgggcctgc

SEQ ID NO: 4817931 - DNA, 24 bp, Homo sapiens
gctttccgcgtggttctgccactt

SEQ ID NO: 4817932 - DNA, 21 bp, Homo sapiens
gctttctattggcatggattt

SEQ ID NO: 4817933 - DNA, 14 bp, Homo sapiens
gctttctgatacat

SEQ ID NO: 4817934 - DNA, 19 bp, Homo sapiens
gctttgagcccacaggagc

SEQ ID NO: 4817935 - DNA, 22 bp, Homo sapiens
gctttgagcccacaggagctcc

SEQ ID NO: 4817936 - DNA, 13 bp, Homo sapiens
gctttgtgcttat

SEQ ID NO: 4817937 - DNA, 17 bp, Homo sapiens
gcttttctgcaattcaa

SEQ ID NO: 4817938 - DNA, 14 bp, Homo sapiens
gcttttgatggcta

SEQ ID NO: 4817939 - DNA, 17 bp, Homo sapiens
gcttttgatggctatgt

SEQ ID NO: 4817940 - DNA, 20 bp, Homo sapiens
gcttttgatggctatgtttt

SEQ ID NO: 4817941 - DNA, 19 bp, Homo sapiens
gcttttggtgtttgagtgt

SEQ ID NO: 4817942 - DNA, 14 bp, Homo sapiens
ggaaaaaaactttt

SEQ ID NO: 4817943 - DNA, 19 bp, Homo sapiens
ggaaaaagatattgtatta

SEQ ID NO: 4817944 - DNA, 12 bp, Homo sapiens
ggaaaacctcag

SEQ ID NO: 4817945 - DNA, 15 bp, Homo sapiens
ggaaaacgatttaat

SEQ ID NO: 4817946 - DNA, 14 bp, Homo sapiens
ggaaaactgccaca

SEQ ID NO: 4817947 - DNA, 23 bp, Homo sapiens
ggaaacttcctataccggagctc

SEQ ID NO: 4817948 - DNA, 15 bp, Homo sapiens
ggaaagatcccaagt

SEQ ID NO: 4817949 - DNA, 19 bp, Homo sapiens
ggaaagcagcctggccaac

SEQ ID NO: 4817950 - DNA, 13 bp, Homo sapiens
ggaaaggcagggc

SEQ ID NO: 4817951 - DNA, 18 bp, Homo sapiens
ggaaaggccggtgggaag

SEQ ID NO: 4817952 - DNA, 13 bp, Homo sapiens
ggaaataaatcta

SEQ ID NO: 4817953 - DNA, 18 bp, Homo sapiens
ggaaatagttccattcta

SEQ ID NO: 4817954 - DNA, 13 bp, Homo sapiens
ggaaatcaattta

SEQ ID NO: 4817955 - DNA, 21 bp, Homo sapiens
gccctgttccgcctcactggg

SEQ ID NO: 4817956 - DNA, 22 bp, Homo sapiens
gccctgttccgcctcactgggt

SEQ ID NO: 4817957 - DNA, 17 bp, Homo sapiens
gcccttaaaataatgat

SEQ ID NO: 4817958 - DNA, 16 bp, Homo sapiens
gcccttacctgccagg

SEQ ID NO: 4817959 - DNA, 14 bp, Homo sapiens
gcccttcccaacct

SEQ ID NO: 4817960 - DNA, 21 bp, Homo sapiens
gcccttccctgacactgtctg

SEQ ID NO: 4817961 - DNA, 11 bp, Homo sapiens
gcccttccttc

SEQ ID NO: 4817962 - DNA, 19 bp, Homo sapiens
gcccttccttcacccacca

SEQ ID NO: 4817963 - DNA, 13 bp, Homo sapiens
gccctttccttgc

SEQ ID NO: 4817964 - DNA, 18 bp, Homo sapiens
gccgaagggcagccccgc

SEQ ID NO: 4817965 - DNA, 17 bp, Homo sapiens
gccgcaacttcccaggc

SEQ ID NO: 4817966 - DNA, 19 bp, Homo sapiens
gccgcagaggcccgaggca

SEQ ID NO: 4817967 - DNA, 16 bp, Homo sapiens
gccgcagccctgcaga

SEQ ID NO: 4817968 - DNA, 19 bp, Homo sapiens
gccgcagccctgcagaggg

SEQ ID NO: 4817969 - DNA, 20 bp, Homo sapiens
gccgcagggcgctccggcag

SEQ ID NO: 4817970 - DNA, 23 bp, Homo sapiens
gccgccctgggctgtctgtcacc

SEQ ID NO: 4817971 - DNA, 23 bp, Homo sapiens
gccgccgaagggcagccccgcga

SEQ ID NO: 4817972 - DNA, 16 bp, Homo sapiens
gccgcctccctcaccc

SEQ ID NO: 4817973 - DNA, 19 bp, Homo sapiens
gccgcctccctcacccggc

SEQ ID NO: 4817974 - DNA, 17 bp, Homo sapiens
gccgcctcctccagact

SEQ ID NO: 4817975 - DNA, 22 bp, Homo sapiens
gccgcctcgggccgcctcctcc

SEQ ID NO: 4817976 - DNA, 16 bp, Homo sapiens
gccgcgctctgcccct

SEQ ID NO: 4817977 - DNA, 18 bp, Homo sapiens
gccgcgctctgcccctcc

SEQ ID NO: 4817978 - DNA, 16 bp, Homo sapiens
gccgctgccgctgcac

SEQ ID NO: 4817979 - DNA, 21 bp, Homo sapiens
gccgctgggagaaaagccaga

SEQ ID NO: 4817980 - DNA, 20 bp, Homo sapiens
gccgcttctcctgcagtctg

SEQ ID NO: 4817981 - DNA, 16 bp, Homo sapiens
gccggcccacgtcctg

SEQ ID NO: 4817982 - DNA, 20 bp, Homo sapiens
gccggcccacgtcctgggtg

SEQ ID NO: 4817983 - DNA, 15 bp, Homo sapiens
gccggcgccccggac

SEQ ID NO: 4817984 - DNA, 12 bp, Homo sapiens
gccggctggccg

SEQ ID NO: 4817985 - DNA, 16 bp, Homo sapiens
gccggctggccggtcc

SEQ ID NO: 4817986 - DNA, 19 bp, Homo sapiens
gccgggcaggtcctgccca

SEQ ID NO: 4817987 - DNA, 20 bp, Homo sapiens
gccgggccccatggtcacag

SEQ ID NO: 4817988 - DNA, 19 bp, Homo sapiens
gccgggctggggaggcctg

SEQ ID NO: 4817989 - DNA, 13 bp, Homo sapiens
gccggggctggcc

SEQ ID NO: 4817990 - DNA, 15 bp, Homo sapiens
gccggggctggccct

SEQ ID NO: 4817991 - DNA, 16 bp, Homo sapiens
gccggggtgtggaatc

SEQ ID NO: 4817992 - DNA, 23 bp, Homo sapiens
gccggtccaccccgtcccggccc

SEQ ID NO: 4817993 - DNA, 15 bp, Homo sapiens
gccggtcccccatgc

SEQ ID NO: 4817994 - DNA, 19 bp, Homo sapiens
gccgtccctgacttcccag

SEQ ID NO: 4817995 - DNA, 22 bp, Homo sapiens
gccgtccctgacttcccagctg

SEQ ID NO: 4817996 - DNA, 14 bp, Homo sapiens
gccgtgcagggcca

SEQ ID NO: 4817997 - DNA, 18 bp, Homo sapiens
gccgtgggggttgaggca

SEQ ID NO: 4817998 - DNA, 17 bp, Homo sapiens
gcctaatattcatgctg

SEQ ID NO: 4817999 - DNA, 22 bp, Homo sapiens
gcctaatctcatacctctgacc

SEQ ID NO: 4818000 - DNA, 16 bp, Homo sapiens
gcctaccacagctgcc

SEQ ID NO: 4818001 - DNA, 18 bp, Homo sapiens
gcctaccacagctgcctc

SEQ ID NO: 4818002 - DNA, 22 bp, Homo sapiens
gcctaccacagctgcctccggg

SEQ ID NO: 4818003 - DNA, 16 bp, Homo sapiens
gcctatatttataaac

SEQ ID NO: 4818004 - DNA, 15 bp, Homo sapiens
gcctatggaaagggt

SEQ ID NO: 4818005 - DNA, 22 bp, Homo sapiens
gcctatggaaagggtgtggctt

SEQ ID NO: 4818006 - DNA, 13 bp, Homo sapiens
gcctattgtaata

SEQ ID NO: 4818007 - DNA, 18 bp, Homo sapiens
gcctcaagtcggtgggcc

SEQ ID NO: 4818008 - DNA, 13 bp, Homo sapiens
gcctcacctggct

SEQ ID NO: 4818009 - DNA, 14 bp, Homo sapiens
gcctcacctggctt

SEQ ID NO: 4818010 - DNA, 13 bp, Homo sapiens
gcctcactgggtg

SEQ ID NO: 4818011 - DNA, 15 bp, Homo sapiens
gcctcagccctcaga

SEQ ID NO: 4818012 - DNA, 21 bp, Homo sapiens
gcctcagtccctccctcctgg

SEQ ID NO: 4818013 - DNA, 16 bp, Homo sapiens
gcctcattttgcttcc

SEQ ID NO: 4818014 - DNA, 19 bp, Homo sapiens
gcctcattttgcttcccat

SEQ ID NO: 4818015 - DNA, 21 bp, Homo sapiens
gcctcattttgcttcccatct

SEQ ID NO: 4818016 - DNA, 17 bp, Homo sapiens
gcctccaagtcatggga

SEQ ID NO: 4818017 - DNA, 19 bp, Homo sapiens
gcctccaagtcatgggaga

SEQ ID NO: 4818018 - DNA, 19 bp, Homo sapiens
gcctccaccttgagcacta

SEQ ID NO: 4818019 - DNA, 20 bp, Homo sapiens
gcctccaggaccttgcttcc

SEQ ID NO: 4818020 - DNA, 10 bp, Homo sapiens
gcctccatcc

SEQ ID NO: 4818021 - DNA, 12 bp, Homo sapiens
gcctccatccac

SEQ ID NO: 4818022 - DNA, 21 bp, Homo sapiens
gcctccatccacacacagcag

SEQ ID NO: 4818023 - DNA, 11 bp, Homo sapiens
gcctcccaagc

SEQ ID NO: 4818024 - DNA, 12 bp, Homo sapiens
gcctcccaagct

SEQ ID NO: 4818025 - DNA, 12 bp, Homo sapiens
gcctcccagcca

SEQ ID NO: 4818026 - DNA, 14 bp, Homo sapiens
gcctcccagccacc

SEQ ID NO: 4818027 - DNA, 14 bp, Homo sapiens
gcctcccccaggct

SEQ ID NO: 4818028 - DNA, 15 bp, Homo sapiens
gcctcccccaggctg

SEQ ID NO: 4818029 - DNA, 22 bp, Homo sapiens
gcctcccgcatgctgcctgcct

SEQ ID NO: 4818030 - DNA, 18 bp, Homo sapiens
gcctcccggggtgcccgt

SEQ ID NO: 4818031 - DNA, 21 bp, Homo sapiens
gcctcccgtccgtccgcccgc

SEQ ID NO: 4818032 - DNA, 18 bp, Homo sapiens
gcctccggccctgcccca

SEQ ID NO: 4818033 - DNA, 20 bp, Homo sapiens
gcctccgggcctcggcctgg

SEQ ID NO: 4818034 - DNA, 13 bp, Homo sapiens
gcctcctccagac

SEQ ID NO: 4818035 - DNA, 12 bp, Homo sapiens
gcctcctcctgc

SEQ ID NO: 4818036 - DNA, 13 bp, Homo sapiens
gcctcctcctgca

SEQ ID NO: 4818037 - DNA, 14 bp, Homo sapiens
gcctcctcctgcat

SEQ ID NO: 4818038 - DNA, 15 bp, Homo sapiens
gcctcctcctgcatg

SEQ ID NO: 4818039 - DNA, 16 bp, Homo sapiens
gcctcctcctgcatgt

SEQ ID NO: 4818040 - DNA, 13 bp, Homo sapiens
gcctcctcttcac

SEQ ID NO: 4818041 - DNA, 21 bp, Homo sapiens
gcctcctcttcaccccggcag

SEQ ID NO: 4818042 - DNA, 12 bp, Homo sapiens
gcctcctggcca

SEQ ID NO: 4818043 - DNA, 13 bp, Homo sapiens
gcctcctggccag

SEQ ID NO: 4818044 - DNA, 21 bp, Homo sapiens
gcctcgggccgcctcctccag

SEQ ID NO: 4818045 - DNA, 13 bp, Homo sapiens
gcctcgtgccatg

SEQ ID NO: 4818046 - DNA, 19 bp, Homo sapiens
gcctcgtgccatgatctgt

SEQ ID NO: 4818047 - DNA, 13 bp, Homo sapiens
gcctctcacacac

SEQ ID NO: 4818048 - DNA, 16 bp, Homo sapiens
gcctctctcaggccaa

SEQ ID NO: 4818049 - DNA, 14 bp, Homo sapiens
gcctctctggaaga

SEQ ID NO: 4818050 - DNA, 17 bp, Homo sapiens
gcctctctggaagaggg

SEQ ID NO: 4818051 - DNA, 18 bp, Homo sapiens
gcctctgaagttggacag

SEQ ID NO: 4818052 - DNA, 19 bp, Homo sapiens
gcctctgaagttggacagc

SEQ ID NO: 4818053 - DNA, 17 bp, Homo sapiens
gcctctgatatgggact

SEQ ID NO: 4818054 - DNA, 18 bp, Homo sapiens
gcctctgatatgggactg

SEQ ID NO: 4818055 - DNA, 23 bp, Homo sapiens
gcctctgatatgggactgagcct

SEQ ID NO: 4818056 - DNA, 19 bp, Homo sapiens
gcctctgccacactctgac

SEQ ID NO: 4818057 - DNA, 10 bp, Homo sapiens
gcctctgcct

SEQ ID NO: 4818058 - DNA, 19 bp, Homo sapiens
gcctctgccttagaggagc

SEQ ID NO: 4818059 - DNA, 14 bp, Homo sapiens
gcctctgtcctggc

SEQ ID NO: 4818060 - DNA, 22 bp, Homo sapiens
gcctcttaaaaattatctttaa

SEQ ID NO: 4818061 - DNA, 13 bp, Homo sapiens
gcctctttaaatt

SEQ ID NO: 4818062 - DNA, 16 bp, Homo sapiens
gcctctttaaattatg

SEQ ID NO: 4818063 - DNA, 22 bp, Homo sapiens
gcctgacacaatggtagctctg

SEQ ID NO: 4818064 - DNA, 19 bp, Homo sapiens
gcctgagaattgaggggag

SEQ ID NO: 4818065 - DNA, 14 bp, Homo sapiens
gcctgagaccacgg

SEQ ID NO: 4818066 - DNA, 13 bp, Homo sapiens
gcctgagccacag

SEQ ID NO: 4818067 - DNA, 17 bp, Homo sapiens
gcctgagccacagtggg

SEQ ID NO: 4818068 - DNA, 15 bp, Homo sapiens
gcctgagctccaccc

SEQ ID NO: 4818069 - DNA, 23 bp, Homo sapiens
gcctgagctccaccctcccctct

SEQ ID NO: 4818070 - DNA, 16 bp, Homo sapiens
gcctgagggaagccca

SEQ ID NO: 4818071 - DNA, 19 bp, Homo sapiens
gcctgagggaagcccaccc

SEQ ID NO: 4818072 - DNA, 21 bp, Homo sapiens
gcctgagggaagcccacccgc

SEQ ID NO: 4818073 - DNA, 12 bp, Homo sapiens
gcctgcacacac

SEQ ID NO: 4818074 - DNA, 16 bp, Homo sapiens
gcctgcagcccagaac

SEQ ID NO: 4818075 - DNA, 21 bp, Homo sapiens
gcctgccccccttcccacccc

SEQ ID NO: 4818076 - DNA, 17 bp, Homo sapiens
gcctgcccgcacagcag

SEQ ID NO: 4818077 - DNA, 13 bp, Homo sapiens
gcctgcccgcccg

SEQ ID NO: 4818078 - DNA, 15 bp, Homo sapiens
gcctgcccgcccgcc

SEQ ID NO: 4818079 - DNA, 18 bp, Homo sapiens
gcctgcctccggccctgc

SEQ ID NO: 4818080 - DNA, 22 bp, Homo sapiens
gcagctccaacctggaggctgg

SEQ ID NO: 4818081 - DNA, 22 bp, Homo sapiens
gcagctgcagttagcacagagg

SEQ ID NO: 4818082 - DNA, 22 bp, Homo sapiens
gcagcttgggagagcccctggg

SEQ ID NO: 4818083 - DNA, 16 bp, Homo sapiens
gcaggaaccgaggact

SEQ ID NO: 4818084 - DNA, 22 bp, Homo sapiens
gcaggaaccgaggactccaggg

SEQ ID NO: 4818085 - DNA, 17 bp, Homo sapiens
gcaggaagacttccagc

SEQ ID NO: 4818086 - DNA, 15 bp, Homo sapiens
gcaggaaggcctggg

SEQ ID NO: 4818087 - DNA, 16 bp, Homo sapiens
gcaggaagtcaggagc

SEQ ID NO: 4818088 - DNA, 19 bp, Homo sapiens
gcaggagtgggctctgagc

SEQ ID NO: 4818089 - DNA, 17 bp, Homo sapiens
gcaggagttcctttccc

SEQ ID NO: 4818090 - DNA, 23 bp, Homo sapiens
gcaggcaagacaccttcccagct

SEQ ID NO: 4818091 - DNA, 12 bp, Homo sapiens
gcaggccctgca

SEQ ID NO: 4818092 - DNA, 14 bp, Homo sapiens
gcaggccctgcagt

SEQ ID NO: 4818093 - DNA, 16 bp, Homo sapiens
gcaggcctcccaagct

SEQ ID NO: 4818094 - DNA, 17 bp, Homo sapiens
gcaggcgcgcaccgccc

SEQ ID NO: 4818095 - DNA, 14 bp, Homo sapiens
gcaggctctcaggc

SEQ ID NO: 4818096 - DNA, 15 bp, Homo sapiens
gcaggctctcaggcc

SEQ ID NO: 4818097 - DNA, 16 bp, Homo sapiens
gcaggctctcaggcca

SEQ ID NO: 4818098 - DNA, 20 bp, Homo sapiens
gcaggcttcgtttgcctcca

SEQ ID NO: 4818099 - DNA, 22 bp, Homo sapiens
gcaggcttcgtttgcctccaga

SEQ ID NO: 4818100 - DNA, 21 bp, Homo sapiens
gcagggagggaaacccgggga

SEQ ID NO: 4818101 - DNA, 16 bp, Homo sapiens
gcagggaggtcaggcc

SEQ ID NO: 4818102 - DNA, 18 bp, Homo sapiens
gcagggaggtcaggccct

SEQ ID NO: 4818103 - DNA, 22 bp, Homo sapiens
gcagggcaaatgacatgcactg

SEQ ID NO: 4818104 - DNA, 17 bp, Homo sapiens
gcagggcccccacagga

SEQ ID NO: 4818105 - DNA, 21 bp, Homo sapiens
gcagggccctggggtctctga

SEQ ID NO: 4818106 - DNA, 13 bp, Homo sapiens
gcagggccgcagg

SEQ ID NO: 4818107 - DNA, 17 bp, Homo sapiens
gcagggccgcagggcgc

SEQ ID NO: 4818108 - DNA, 21 bp, Homo sapiens
gcagggcgctccggcagaggc

SEQ ID NO: 4818109 - DNA, 14 bp, Homo sapiens
gcaggggaaagatt

SEQ ID NO: 4818110 - DNA, 13 bp, Homo sapiens
gcaggggcccctc

SEQ ID NO: 4818111 - DNA, 16 bp, Homo sapiens
gcaggggcccctcctc

SEQ ID NO: 4818112 - DNA, 13 bp, Homo sapiens
gcaggggggttgg

SEQ ID NO: 4818113 - DNA, 23 bp, Homo sapiens
gcagggttctagaaggggcgagg

SEQ ID NO: 4818114 - DNA, 15 bp, Homo sapiens
gcaggtcctgcccat

SEQ ID NO: 4818115 - DNA, 16 bp, Homo sapiens
gcaggtcctgcccatg

SEQ ID NO: 4818116 - DNA, 17 bp, Homo sapiens
gcaggtgaccagaatga

SEQ ID NO: 4818117 - DNA, 22 bp, Homo sapiens
gcaggtggggttttcacttcct

SEQ ID NO: 4818118 - DNA, 19 bp, Homo sapiens
gcaggttggaccccagaga

SEQ ID NO: 4818119 - DNA, 16 bp, Homo sapiens
gcagtacatcttgtgc

SEQ ID NO: 4818120 - DNA, 19 bp, Homo sapiens
gcagtacatcttgtgcatg

SEQ ID NO: 4818121 - DNA, 13 bp, Homo sapiens
gcagtacatggga

SEQ ID NO: 4818122 - DNA, 17 bp, Homo sapiens
gcagtatgtacaggctg

SEQ ID NO: 4818123 - DNA, 16 bp, Homo sapiens
gcagtcagcacagaga

SEQ ID NO: 4818124 - DNA, 19 bp, Homo sapiens
gcagtcagcacagagagcg

SEQ ID NO: 4818125 - DNA, 14 bp, Homo sapiens
gcagtcagcggaga

SEQ ID NO: 4818126 - DNA, 20 bp, Homo sapiens
gcagtcagcggagaggaccc

SEQ ID NO: 4818127 - DNA, 15 bp, Homo sapiens
gcagtcatcaacaaa

SEQ ID NO: 4818128 - DNA, 17 bp, Homo sapiens
gcagtcctcggcagctc

SEQ ID NO: 4818129 - DNA, 14 bp, Homo sapiens
gcagtctccgctcc

SEQ ID NO: 4818130 - DNA, 18 bp, Homo sapiens
gcagtctccgctcccgca

SEQ ID NO: 4818131 - DNA, 22 bp, Homo sapiens
gcagtctgtggagcgtccttgt

SEQ ID NO: 4818132 - DNA, 21 bp, Homo sapiens
gcagtctttgctcagtggatc

SEQ ID NO: 4818133 - DNA, 15 bp, Homo sapiens
gcagtgcatgctgtc

SEQ ID NO: 4818134 - DNA, 16 bp, Homo sapiens
gcagtgcatgctgtcc

SEQ ID NO: 4818135 - DNA, 18 bp, Homo sapiens
gcagtggcgcgatctcag

SEQ ID NO: 4818136 - DNA, 22 bp, Homo sapiens
gcagtggcgtgatctcagctca

SEQ ID NO: 4818137 - DNA, 12 bp, Homo sapiens
gcagtggggagc

SEQ ID NO: 4818138 - DNA, 19 bp, Homo sapiens
gcagtgtcctgtgctttct

SEQ ID NO: 4818139 - DNA, 22 bp, Homo sapiens
gcagtgttcgcttggctccatg

SEQ ID NO: 4818140 - DNA, 14 bp, Homo sapiens
gcagttaccgagga

SEQ ID NO: 4818141 - DNA, 17 bp, Homo sapiens
gcagttagactcaaaga

SEQ ID NO: 4818142 - DNA, 16 bp, Homo sapiens
gcagttagcacagagg

SEQ ID NO: 4818143 - DNA, 15 bp, Homo sapiens
gcagttctgcaaata

SEQ ID NO: 4818144 - DNA, 19 bp, Homo sapiens
gcagttctgcaaatagaaa

SEQ ID NO: 4818145 - DNA, 16 bp, Homo sapiens
gcagttgcaataaact

SEQ ID NO: 4818146 - DNA, 12 bp, Homo sapiens
gcagtttcagat

SEQ ID NO: 4818147 - DNA, 17 bp, Homo sapiens
gcagtttcagataaatc

SEQ ID NO: 4818148 - DNA, 19 bp, Homo sapiens
gcagtttcagataaatcat

SEQ ID NO: 4818149 - DNA, 21 bp, Homo sapiens
gcagtttcagataaatcatgg

SEQ ID NO: 4818150 - DNA, 22 bp, Homo sapiens
gcagtttcagataaatcatggg

SEQ ID NO: 4818151 - DNA, 17 bp, Homo sapiens
gcagtttggtatgaaac

SEQ ID NO: 4818152 - DNA, 20 bp, Homo sapiens
gcagtttggtatgaaacaaa

SEQ ID NO: 4818153 - DNA, 16 bp, Homo sapiens
gcataagattatatac

SEQ ID NO: 4818154 - DNA, 16 bp, Homo sapiens
gcataatggtaaatct

SEQ ID NO: 4818155 - DNA, 14 bp, Homo sapiens
gcatactctccagg

SEQ ID NO: 4818156 - DNA, 21 bp, Homo sapiens
gcatactgatgagacaacaca

SEQ ID NO: 4818157 - DNA, 16 bp, Homo sapiens
gcatagacaagtgttt

SEQ ID NO: 4818158 - DNA, 12 bp, Homo sapiens
gcataggctggg

SEQ ID NO: 4818159 - DNA, 20 bp, Homo sapiens
gcataggctggggacacagg

SEQ ID NO: 4818160 - DNA, 20 bp, Homo sapiens
gcatagtgtgctcggacaca

SEQ ID NO: 4818161 - DNA, 20 bp, Homo sapiens
gcatagttctgcaataacag

SEQ ID NO: 4818162 - DNA, 21 bp, Homo sapiens
gcatagttctgcaataacagt

SEQ ID NO: 4818163 - DNA, 16 bp, Homo sapiens
gcatataaatgtttat

SEQ ID NO: 4818164 - DNA, 18 bp, Homo sapiens
gcatataaggctaaatgt

SEQ ID NO: 4818165 - DNA, 19 bp, Homo sapiens
gcatataaggctaaatgta

SEQ ID NO: 4818166 - DNA, 20 bp, Homo sapiens
gcatatggcaacgttcatgt

SEQ ID NO: 4818167 - DNA, 22 bp, Homo sapiens
gcatatggcaacgttcatgttc

SEQ ID NO: 4818168 - DNA, 20 bp, Homo sapiens
gcatattgataataaaattc

SEQ ID NO: 4818169 - DNA, 13 bp, Homo sapiens
gcatcagcaagac

SEQ ID NO: 4818170 - DNA, 15 bp, Homo sapiens
gcatcatctcagctc

SEQ ID NO: 4818171 - DNA, 15 bp, Homo sapiens
gcatccccagtgcca

SEQ ID NO: 4818172 - DNA, 14 bp, Homo sapiens
gcatccctccaccc

SEQ ID NO: 4818173 - DNA, 18 bp, Homo sapiens
gcatcccttggcccctct

SEQ ID NO: 4818174 - DNA, 14 bp, Homo sapiens
gcatccgagcccct

SEQ ID NO: 4818175 - DNA, 21 bp, Homo sapiens
gcatcctatcgatctggaaag

SEQ ID NO: 4818176 - DNA, 16 bp, Homo sapiens
gcatcctcagccccag

SEQ ID NO: 4818177 - DNA, 13 bp, Homo sapiens
gcatcctggaaat

SEQ ID NO: 4818178 - DNA, 22 bp, Homo sapiens
gcatctctccccatatataaat

SEQ ID NO: 4818179 - DNA, 14 bp, Homo sapiens
gcatctgctcttct

SEQ ID NO: 4818180 - DNA, 21 bp, Homo sapiens
gcatctggcctatgaccctgt

SEQ ID NO: 4818181 - DNA, 22 bp, Homo sapiens
gcatctggcctatgaccctgtg

SEQ ID NO: 4818182 - DNA, 12 bp, Homo sapiens
gcatctggcctg

SEQ ID NO: 4818183 - DNA, 14 bp, Homo sapiens
gcatctggcctggg

SEQ ID NO: 4818184 - DNA, 19 bp, Homo sapiens
gccctgagctactgcttct

SEQ ID NO: 4818185 - DNA, 16 bp, Homo sapiens
gccctgcagagggcac

SEQ ID NO: 4818186 - DNA, 23 bp, Homo sapiens
gccctgcccagagtatgggcact

SEQ ID NO: 4818187 - DNA, 13 bp, Homo sapiens
gccctgccccaca

SEQ ID NO: 4818188 - DNA, 15 bp, Homo sapiens
gccctgccccacaca

SEQ ID NO: 4818189 - DNA, 16 bp, Homo sapiens
gccctgccccacacag

SEQ ID NO: 4818190 - DNA, 21 bp, Homo sapiens
gccctgccctcactccactcc

SEQ ID NO: 4818191 - DNA, 15 bp, Homo sapiens
gccctgccctccccc

SEQ ID NO: 4818192 - DNA, 17 bp, Homo sapiens
gccctgccctcccccac

SEQ ID NO: 4818193 - DNA, 15 bp, Homo sapiens
gccctgccctgagga

SEQ ID NO: 4818194 - DNA, 13 bp, Homo sapiens
gccctgctcaggc

SEQ ID NO: 4818195 - DNA, 18 bp, Homo sapiens
gccctggcctaccacagc

SEQ ID NO: 4818196 - DNA, 19 bp, Homo sapiens
gccctggcctaccacagct

SEQ ID NO: 4818197 - DNA, 20 bp, Homo sapiens
gccctggcctaccacagctg

SEQ ID NO: 4818198 - DNA, 13 bp, Homo sapiens
gccctggctcttt

SEQ ID NO: 4818199 - DNA, 17 bp, Homo sapiens
gccctggctctttagaa

SEQ ID NO: 4818200 - DNA, 12 bp, Homo sapiens
gccctgggcctc

SEQ ID NO: 4818201 - DNA, 13 bp, Homo sapiens
gccctgggcctca

SEQ ID NO: 4818202 - DNA, 15 bp, Homo sapiens
gccctgggcctcagt

SEQ ID NO: 4818203 - DNA, 23 bp, Homo sapiens
gccctgggctgtctgtcaccagc

SEQ ID NO: 4818204 - DNA, 14 bp, Homo sapiens
gccctggggcaggg

SEQ ID NO: 4818205 - DNA, 15 bp, Homo sapiens
gccctggggcagggt

SEQ ID NO: 4818206 - DNA, 16 bp, Homo sapiens
gccctggggtctctga

SEQ ID NO: 4818207 - DNA, 18 bp, Homo sapiens
gccctggggtctctgagc

SEQ ID NO: 4818208 - DNA, 20 bp, Homo sapiens
gccctggggtctctgagcag

SEQ ID NO: 4818209 - DNA, 15 bp, Homo sapiens
gccctgtagccctgg

SEQ ID NO: 4818210 - DNA, 17 bp, Homo sapiens
gccctgtagccctggcc

SEQ ID NO: 4818211 - DNA, 13 bp, Homo sapiens
gccctgtagctcc

SEQ ID NO: 4818212 - DNA, 17 bp, Homo sapiens
gccctgtcactgtccag

SEQ ID NO: 4818213 - DNA, 16 bp, Homo sapiens
gccctgtgccctctca

SEQ ID NO: 4818214 - DNA, 17 bp, Homo sapiens
gccctgtgggagtccac

SEQ ID NO: 4818215 - DNA, 18 bp, Homo sapiens
gccctgtgggagtccact

SEQ ID NO: 4818216 - DNA, 23 bp, Homo sapiens
gccctgtgggagtccactttcct

SEQ ID NO: 4818217 - DNA, 19 bp, Homo sapiens
gcacatgctggccagcctg

SEQ ID NO: 4818218 - DNA, 21 bp, Homo sapiens
gcacatgctggccagcctggg

SEQ ID NO: 4818219 - DNA, 22 bp, Homo sapiens
gcacatgctggccagcctgggg

SEQ ID NO: 4818220 - DNA, 23 bp, Homo sapiens
gcacatgctggccagcctggggc

SEQ ID NO: 4818221 - DNA, 15 bp, Homo sapiens
gcacatgtattctgt

SEQ ID NO: 4818222 - DNA, 21 bp, Homo sapiens
gcacattaggaacagagtata

SEQ ID NO: 4818223 - DNA, 13 bp, Homo sapiens
gcacattattgta

SEQ ID NO: 4818224 - DNA, 19 bp, Homo sapiens
gcacattcatcctcacatg

SEQ ID NO: 4818225 - DNA, 18 bp, Homo sapiens
gcacatttgttaatgatt

SEQ ID NO: 4818226 - DNA, 23 bp, Homo sapiens
gcacatttgttaatgattcttgt

SEQ ID NO: 4818227 - DNA, 21 bp, Homo sapiens
gcaccaaagatgcagccgcct

SEQ ID NO: 4818228 - DNA, 14 bp, Homo sapiens
gagatgaggctgga

SEQ ID NO: 4818229 - DNA, 14 bp, Homo sapiens
gagatgcagctgga

SEQ ID NO: 4818230 - DNA, 21 bp, Homo sapiens
gagatgcatctgtggcctggg

SEQ ID NO: 4818231 - DNA, 14 bp, Homo sapiens
gagatggcagagcc

SEQ ID NO: 4818232 - DNA, 18 bp, Homo sapiens
gagatggtgccccctggg

SEQ ID NO: 4818233 - DNA, 12 bp, Homo sapiens
gagattcagact

SEQ ID NO: 4818234 - DNA, 14 bp, Homo sapiens
gagattcccaagcc

SEQ ID NO: 4818235 - DNA, 14 bp, Homo sapiens
gagattgctctggg

SEQ ID NO: 4818236 - DNA, 19 bp, Homo sapiens
gagattggaaaaaattaga

SEQ ID NO: 4818237 - DNA, 21 bp, Homo sapiens
gagattggatcaagtattact

SEQ ID NO: 4818238 - DNA, 16 bp, Homo sapiens
gagatttgtatttata

SEQ ID NO: 4818239 - DNA, 20 bp, Homo sapiens
gagcaaagatggcttccgtg

SEQ ID NO: 4818240 - DNA, 21 bp, Homo sapiens
gagcaaggctgctaagtggaa

SEQ ID NO: 4818241 - DNA, 18 bp, Homo sapiens
gagcacaatattaagtgt

SEQ ID NO: 4818242 - DNA, 24 bp, Homo sapiens
gagcacacatccaagagggactcc

SEQ ID NO: 4818243 - DNA, 17 bp, Homo sapiens
gagcaccacggggtcgg

SEQ ID NO: 4818244 - DNA, 16 bp, Homo sapiens
gagcacccccagcctc

SEQ ID NO: 4818245 - DNA, 18 bp, Homo sapiens
gagcacccccagcctccc

SEQ ID NO: 4818246 - DNA, 22 bp, Homo sapiens
gagcacccccagcctcccccag

SEQ ID NO: 4818247 - DNA, 17 bp, Homo sapiens
gagcaccgaatattgag

SEQ ID NO: 4818248 - DNA, 22 bp, Homo sapiens
gagcactagaatgagaaatcat

SEQ ID NO: 4818249 - DNA, 13 bp, Homo sapiens
gagcagacagggc

SEQ ID NO: 4818250 - DNA, 11 bp, Homo sapiens
gagcagagacg

SEQ ID NO: 4818251 - DNA, 19 bp, Homo sapiens
gagcagagacggcagcccc

SEQ ID NO: 4818252 - DNA, 21 bp, Homo sapiens
gagcagagacggcagccccat

SEQ ID NO: 4818253 - DNA, 24 bp, Homo sapiens
gagcagagacggcagccccatcct

SEQ ID NO: 4818254 - DNA, 18 bp, Homo sapiens
gagcagagcgcagccccc

SEQ ID NO: 4818255 - DNA, 19 bp, Homo sapiens
gagcagggctgggcgcctc

SEQ ID NO: 4818256 - DNA, 20 bp, Homo sapiens
gagcagttgttatattcatt

SEQ ID NO: 4818257 - DNA, 19 bp, Homo sapiens
gagcataatggtaaatctt

SEQ ID NO: 4818258 - DNA, 21 bp, Homo sapiens
gagcatggccgcaacttccca

SEQ ID NO: 4818259 - DNA, 22 bp, Homo sapiens
gagcatggccgcaacttcccag

SEQ ID NO: 4818260 - DNA, 19 bp, Homo sapiens
gagcattctggggtggggc

SEQ ID NO: 4818261 - DNA, 18 bp, Homo sapiens
gagccaataaagctcaca

SEQ ID NO: 4818262 - DNA, 20 bp, Homo sapiens
gagccaataaagctcacact

SEQ ID NO: 4818263 - DNA, 24 bp, Homo sapiens
gagccacagtggggcccatggccc

SEQ ID NO: 4818264 - DNA, 12 bp, Homo sapiens
gagccagcaggg

SEQ ID NO: 4818265 - DNA, 18 bp, Homo sapiens
gagcccacggctaagagg

SEQ ID NO: 4818266 - DNA, 23 bp, Homo sapiens
gagcccacggctaagaggctgct

SEQ ID NO: 4818267 - DNA, 18 bp, Homo sapiens
gagccccccgtgttcaca

SEQ ID NO: 4818268 - DNA, 18 bp, Homo sapiens
gagcccccgcccctcccc

SEQ ID NO: 4818269 - DNA, 14 bp, Homo sapiens
gagccccctgcacc

SEQ ID NO: 4818270 - DNA, 19 bp, Homo sapiens
gagccccctgcacccaccc

SEQ ID NO: 4818271 - DNA, 12 bp, Homo sapiens
gagccccggagc

SEQ ID NO: 4818272 - DNA, 18 bp, Homo sapiens
gagcccctatcctgcacc

SEQ ID NO: 4818273 - DNA, 20 bp, Homo sapiens
gagcccctccctcctgtgtt

SEQ ID NO: 4818274 - DNA, 13 bp, Homo sapiens
gagcccctcctct

SEQ ID NO: 4818275 - DNA, 14 bp, Homo sapiens
gagcccctcctctc

SEQ ID NO: 4818276 - DNA, 13 bp, Homo sapiens
gagcccctgtttc

SEQ ID NO: 4818277 - DNA, 16 bp, Homo sapiens
gagcccgcccacctgg

SEQ ID NO: 4818278 - DNA, 17 bp, Homo sapiens
gagcccgcccacctggg

SEQ ID NO: 4818279 - DNA, 18 bp, Homo sapiens
gagcccgcccacctgggc

SEQ ID NO: 4818280 - DNA, 12 bp, Homo sapiens
gagccctgccct

SEQ ID NO: 4818281 - DNA, 13 bp, Homo sapiens
gagccctgccctc

SEQ ID NO: 4818282 - DNA, 17 bp, Homo sapiens
gagccctgccctcactc

SEQ ID NO: 4818283 - DNA, 13 bp, Homo sapiens
gagccgcagaggc

SEQ ID NO: 4818284 - DNA, 15 bp, Homo sapiens
gagccgcagaggccc

SEQ ID NO: 4818285 - DNA, 13 bp, Homo sapiens
gagccgcaggggc

SEQ ID NO: 4818286 - DNA, 15 bp, Homo sapiens
gagccgtcagcctgt

SEQ ID NO: 4818287 - DNA, 16 bp, Homo sapiens
gagcctatggaaaggg

SEQ ID NO: 4818288 - DNA, 15 bp, Homo sapiens
gagcctccccctcag

SEQ ID NO: 4818289 - DNA, 15 bp, Homo sapiens
gagcctgagtcaggg

SEQ ID NO: 4818290 - DNA, 17 bp, Homo sapiens
gagcctgagtcagggcc

SEQ ID NO: 4818291 - DNA, 21 bp, Homo sapiens
gagcctgagtcagggcccaga

SEQ ID NO: 4818292 - DNA, 22 bp, Homo sapiens
gagcctgagtcagggcccagag

SEQ ID NO: 4818293 - DNA, 17 bp, Homo sapiens
gagcctggcccatagaa

SEQ ID NO: 4818294 - DNA, 16 bp, Homo sapiens
gagcctgtctctccct

SEQ ID NO: 4818295 - DNA, 16 bp, Homo sapiens
gagcctgttttaaaaa

SEQ ID NO: 4818296 - DNA, 18 bp, Homo sapiens
gagcctttggtgaataac

SEQ ID NO: 4818297 - DNA, 12 bp, Homo sapiens
gagcgccacccg

SEQ ID NO: 4818298 - DNA, 13 bp, Homo sapiens
gagcgccacccgc

SEQ ID NO: 4818299 - DNA, 16 bp, Homo sapiens
gagcgccacccgcccg

SEQ ID NO: 4818300 - DNA, 23 bp, Homo sapiens
gagcgccacccgcccgcccccgc

SEQ ID NO: 4818301 - DNA, 21 bp, Homo sapiens
gagcgccccgcccccacccct

SEQ ID NO: 4818302 - DNA, 13 bp, Homo sapiens
gagcggctgagga

SEQ ID NO: 4818303 - DNA, 23 bp, Homo sapiens
gagcggctgaggacggggcagag

SEQ ID NO: 4818304 - DNA, 21 bp, Homo sapiens
gagcggcttccccatcgcctt

SEQ ID NO: 4818305 - DNA, 22 bp, Homo sapiens
gagcgggggctaactggcccca

SEQ ID NO: 4818306 - DNA, 15 bp, Homo sapiens
gagcgtccaggtgat

SEQ ID NO: 4818307 - DNA, 23 bp, Homo sapiens
gagctatgatatgtgcttgtgtg

SEQ ID NO: 4818308 - DNA, 14 bp, Homo sapiens
gagctcacaccgca

SEQ ID NO: 4818309 - DNA, 15 bp, Homo sapiens
gagctcacaccgcac

SEQ ID NO: 4818310 - DNA, 23 bp, Homo sapiens
gagctcacaccgcaccgggctgg

SEQ ID NO: 4818311 - DNA, 16 bp, Homo sapiens
gagctcaggagaaggc

SEQ ID NO: 4818312 - DNA, 20 bp, Homo sapiens
gagctcaggccctggtgagg

SEQ ID NO: 4818313 - DNA, 14 bp, Homo sapiens
gagctccaccctcc

SEQ ID NO: 4818314 - DNA, 18 bp, Homo sapiens
gagctccaccctcccctc

SEQ ID NO: 4818315 - DNA, 22 bp, Homo sapiens
gagctccagtttctcttaagct

SEQ ID NO: 4818316 - DNA, 19 bp, Homo sapiens
gagctccctcgctgtatga

SEQ ID NO: 4818317 - DNA, 19 bp, Homo sapiens
gagctccctttttgaattg

SEQ ID NO: 4818318 - DNA, 14 bp, Homo sapiens
gagctcctaagctg

SEQ ID NO: 4818319 - DNA, 14 bp, Homo sapiens
gagctctggctttc

SEQ ID NO: 4818320 - DNA, 18 bp, Homo sapiens
gagctctgtagcctggtc

SEQ ID NO: 4818321 - DNA, 21 bp, Homo sapiens
gagctctgtagcctggtctgt

SEQ ID NO: 4818322 - DNA, 23 bp, Homo sapiens
gagctctgtagcctggtctgtgc

SEQ ID NO: 4818323 - DNA, 19 bp, Homo sapiens
gagctgatggagaaggaag

SEQ ID NO: 4818324 - DNA, 22 bp, Homo sapiens
gagctggggaatcccctcgctt

SEQ ID NO: 4818325 - DNA, 20 bp, Homo sapiens
gagctgttttggatgaatgc

SEQ ID NO: 4818326 - DNA, 19 bp, Homo sapiens
gagcttgattctaaagggg

SEQ ID NO: 4818327 - DNA, 14 bp, Homo sapiens
gaggaacccccatg

SEQ ID NO: 4818328 - DNA, 18 bp, Homo sapiens
gaggaacctctgatttat

SEQ ID NO: 4818329 - DNA, 15 bp, Homo sapiens
gaggaactccttggc

SEQ ID NO: 4818330 - DNA, 16 bp, Homo sapiens
gaggaactccttggcc

SEQ ID NO: 4818331 - DNA, 21 bp, Homo sapiens
gaggaaggcatgcctggacaa

SEQ ID NO: 4818332 - DNA, 14 bp, Homo sapiens
gaggacagcttccc

SEQ ID NO: 4818333 - DNA, 14 bp, Homo sapiens
gaggacagggaggg

SEQ ID NO: 4818334 - DNA, 13 bp, Homo sapiens
gaggacagggccc

SEQ ID NO: 4818335 - DNA, 23 bp, Homo sapiens
gaggaccccattctgggactgct

SEQ ID NO: 4818336 - DNA, 13 bp, Homo sapiens
gaggaccctccca

SEQ ID NO: 4818337 - DNA, 14 bp, Homo sapiens
gaggacctgggggg

SEQ ID NO: 4818338 - DNA, 22 bp, Homo sapiens
gaggacggggcagagctgagtc

SEQ ID NO: 4818339 - DNA, 23 bp, Homo sapiens
gaggacgtcatcggaggctgggc

SEQ ID NO: 4818340 - DNA, 16 bp, Homo sapiens
gaggactccaggggct

SEQ ID NO: 4818341 - DNA, 13 bp, Homo sapiens
gaggactgttcta

SEQ ID NO: 4818342 - DNA, 15 bp, Homo sapiens
gaggagaggctgctg

SEQ ID NO: 4818343 - DNA, 21 bp, Homo sapiens
gaggagcaaacaggaaaatga

SEQ ID NO: 4818344 - DNA, 14 bp, Homo sapiens
gaggagcaccccca

SEQ ID NO: 4818345 - DNA, 20 bp, Homo sapiens
gaggagcacccccagcctcc

SEQ ID NO: 4818346 - DNA, 21 bp, Homo sapiens
gaggagcacccccagcctccc

SEQ ID NO: 4818347 - DNA, 11 bp, Homo sapiens
gcaccagcttg

SEQ ID NO: 4818348 - DNA, 14 bp, Homo sapiens
gcaccatctctcct

SEQ ID NO: 4818349 - DNA, 14 bp, Homo sapiens
gcacccaccactct

SEQ ID NO: 4818350 - DNA, 19 bp, Homo sapiens
gcacccagcccaaccggga

SEQ ID NO: 4818351 - DNA, 22 bp, Homo sapiens
gcaccccaccacacacaccctt

SEQ ID NO: 4818352 - DNA, 17 bp, Homo sapiens
gcacccccagcctcccc

SEQ ID NO: 4818353 - DNA, 18 bp, Homo sapiens
gcacccccagcctccccc

SEQ ID NO: 4818354 - DNA, 18 bp, Homo sapiens
gcaccccgatgtggacct

SEQ ID NO: 4818355 - DNA, 15 bp, Homo sapiens
gcaccctccacagga

SEQ ID NO: 4818356 - DNA, 17 bp, Homo sapiens
gcaccctccacaggagc

SEQ ID NO: 4818357 - DNA, 15 bp, Homo sapiens
gcaccctctcctggg

SEQ ID NO: 4818358 - DNA, 16 bp, Homo sapiens
gcaccctctcctgggg

SEQ ID NO: 4818359 - DNA, 22 bp, Homo sapiens
gcaccctctcctgggggtggca

SEQ ID NO: 4818360 - DNA, 20 bp, Homo sapiens
gcaccctctgctatgtctgt

SEQ ID NO: 4818361 - DNA, 23 bp, Homo sapiens
gcaccgccagagtgtcctgctac

SEQ ID NO: 4818362 - DNA, 17 bp, Homo sapiens
gcaccgcccacccacac

SEQ ID NO: 4818363 - DNA, 14 bp, Homo sapiens
gcaccgggctggcc

SEQ ID NO: 4818364 - DNA, 15 bp, Homo sapiens
gcaccgggctggcct

SEQ ID NO: 4818365 - DNA, 17 bp, Homo sapiens
gcaccgtggtgtgaggc

SEQ ID NO: 4818366 - DNA, 19 bp, Homo sapiens
gcaccgtggtgtgaggccc

SEQ ID NO: 4818367 - DNA, 18 bp, Homo sapiens
gcacctcctccgtgggca

SEQ ID NO: 4818368 - DNA, 22 bp, Homo sapiens
gcacctcctccgtgggcagctc

SEQ ID NO: 4818369 - DNA, 14 bp, Homo sapiens
gcacctgccccagg

SEQ ID NO: 4818370 - DNA, 13 bp, Homo sapiens
gcaccttgggcac

SEQ ID NO: 4818371 - DNA, 21 bp, Homo sapiens
gcaccttgggcacgggagagc

SEQ ID NO: 4818372 - DNA, 22 bp, Homo sapiens
gcacgggagagcgccacccgcc

SEQ ID NO: 4818373 - DNA, 19 bp, Homo sapiens
gcactaaggccgtgtctct

SEQ ID NO: 4818374 - DNA, 22 bp, Homo sapiens
gcactacatctgatatcaggaa

SEQ ID NO: 4818375 - DNA, 15 bp, Homo sapiens
gcactagccttccca

SEQ ID NO: 4818376 - DNA, 16 bp, Homo sapiens
gcactagccttcccag

SEQ ID NO: 4818377 - DNA, 18 bp, Homo sapiens
gcactatatacatcacgt

SEQ ID NO: 4818378 - DNA, 17 bp, Homo sapiens
gcactcaggagcacagc

SEQ ID NO: 4818379 - DNA, 16 bp, Homo sapiens
gcactcccagggcccg

SEQ ID NO: 4818380 - DNA, 13 bp, Homo sapiens
gcactcctgtctc

SEQ ID NO: 4818381 - DNA, 22 bp, Homo sapiens
gcactctagggtgaaccaagct

SEQ ID NO: 4818382 - DNA, 15 bp, Homo sapiens
gcactgacccttcca

SEQ ID NO: 4818383 - DNA, 17 bp, Homo sapiens
gcactgacccttccaga

SEQ ID NO: 4818384 - DNA, 16 bp, Homo sapiens
gcactgagcgcctgca

SEQ ID NO: 4818385 - DNA, 11 bp, Homo sapiens
gcactgccctc

SEQ ID NO: 4818386 - DNA, 15 bp, Homo sapiens
gcactgccctccgcc

SEQ ID NO: 4818387 - DNA, 20 bp, Homo sapiens
gcactgccctccgcccttcc

SEQ ID NO: 4818388 - DNA, 17 bp, Homo sapiens
gcactggccttctgatg

SEQ ID NO: 4818389 - DNA, 19 bp, Homo sapiens
gcactggtttgtttctcaa

SEQ ID NO: 4818390 - DNA, 15 bp, Homo sapiens
gcactgtcatgccca

SEQ ID NO: 4818391 - DNA, 17 bp, Homo sapiens
gcactgtcatgcccagc

SEQ ID NO: 4818392 - DNA, 19 bp, Homo sapiens
gcactgtcatgcccagctt

SEQ ID NO: 4818393 - DNA, 13 bp, Homo sapiens
gcactgtttcttc

SEQ ID NO: 4818394 - DNA, 19 bp, Homo sapiens
gcactgttttattttaatt

SEQ ID NO: 4818395 - DNA, 15 bp, Homo sapiens
gcacttcaagcaaag

SEQ ID NO: 4818396 - DNA, 23 bp, Homo sapiens
gcacttggagcgtttttgctggc

SEQ ID NO: 4818397 - DNA, 16 bp, Homo sapiens
gcactttgggaggctg

SEQ ID NO: 4818398 - DNA, 17 bp, Homo sapiens
gcacttttgagctccta

SEQ ID NO: 4818399 - DNA, 19 bp, Homo sapiens
gcagaaatgtggatgctct

SEQ ID NO: 4818400 - DNA, 13 bp, Homo sapiens
gcagaaggaagac

SEQ ID NO: 4818401 - DNA, 12 bp, Homo sapiens
gcagaaggaagg

SEQ ID NO: 4818402 - DNA, 13 bp, Homo sapiens
gcagaaggaaggc

SEQ ID NO: 4818403 - DNA, 18 bp, Homo sapiens
gcagaatgagatgattta

SEQ ID NO: 4818404 - DNA, 21 bp, Homo sapiens
gcagaatggtgggctccagag

SEQ ID NO: 4818405 - DNA, 14 bp, Homo sapiens
gcagaccagagagc

SEQ ID NO: 4818406 - DNA, 14 bp, Homo sapiens
gcagaccctgccag

SEQ ID NO: 4818407 - DNA, 13 bp, Homo sapiens
gcagactttctac

SEQ ID NO: 4818408 - DNA, 16 bp, Homo sapiens
gcagagaactcataaa

SEQ ID NO: 4818409 - DNA, 22 bp, Homo sapiens
gcagagacgaggtgtcttcctt

SEQ ID NO: 4818410 - DNA, 15 bp, Homo sapiens
gcagagacggcagcc

SEQ ID NO: 4818411 - DNA, 16 bp, Homo sapiens
gcagagacggcagccc

SEQ ID NO: 4818412 - DNA, 14 bp, Homo sapiens
gcagagatgtatta

SEQ ID NO: 4818413 - DNA, 18 bp, Homo sapiens
gcagagccagtcttcctc

SEQ ID NO: 4818414 - DNA, 22 bp, Homo sapiens
gcagagccatccaccctgagga

SEQ ID NO: 4818415 - DNA, 15 bp, Homo sapiens
gcagagccccggagc

SEQ ID NO: 4818416 - DNA, 17 bp, Homo sapiens
gcagagccccggagcac

SEQ ID NO: 4818417 - DNA, 15 bp, Homo sapiens
gcagagcccgcccac

SEQ ID NO: 4818418 - DNA, 13 bp, Homo sapiens
gcagagcgcagcc

SEQ ID NO: 4818419 - DNA, 18 bp, Homo sapiens
gcagagctgatggagaag

SEQ ID NO: 4818420 - DNA, 22 bp, Homo sapiens
gcagagctgatggagaaggaag

SEQ ID NO: 4818421 - DNA, 23 bp, Homo sapiens
gcagagctgatggagaaggaagg

SEQ ID NO: 4818422 - DNA, 18 bp, Homo sapiens
gcagaggaaagcaaagga

SEQ ID NO: 4818423 - DNA, 11 bp, Homo sapiens
gcagaggcagg

SEQ ID NO: 4818424 - DNA, 14 bp, Homo sapiens
gcagaggcccgagg

SEQ ID NO: 4818425 - DNA, 15 bp, Homo sapiens
gcagaggtggggtgc

SEQ ID NO: 4818426 - DNA, 18 bp, Homo sapiens
gcagaggtggggtgctgg

SEQ ID NO: 4818427 - DNA, 15 bp, Homo sapiens
gcagagtcaagctga

SEQ ID NO: 4818428 - DNA, 16 bp, Homo sapiens
gcagagtcaagctgat

SEQ ID NO: 4818429 - DNA, 17 bp, Homo sapiens
gcagagttgaagacaga

SEQ ID NO: 4818430 - DNA, 20 bp, Homo sapiens
gcagagttgaagacagagct

SEQ ID NO: 4818431 - DNA, 21 bp, Homo sapiens
gcagatcaacagacctaagaa

SEQ ID NO: 4818432 - DNA, 16 bp, Homo sapiens
gcagatctagccaggc

SEQ ID NO: 4818433 - DNA, 19 bp, Homo sapiens
gcagatctagccaggcctc

SEQ ID NO: 4818434 - DNA, 14 bp, Homo sapiens
gcagcaacaggacc

SEQ ID NO: 4818435 - DNA, 15 bp, Homo sapiens
gcagcaacaggacca

SEQ ID NO: 4818436 - DNA, 20 bp, Homo sapiens
gcagcaacaggaccaggagc

SEQ ID NO: 4818437 - DNA, 14 bp, Homo sapiens
gcagcacagctact

SEQ ID NO: 4818438 - DNA, 22 bp, Homo sapiens
gcagcacagctactcagatctg

SEQ ID NO: 4818439 - DNA, 18 bp, Homo sapiens
gcagcaccagcctgagcc

SEQ ID NO: 4818440 - DNA, 20 bp, Homo sapiens
gcagcaccagcctgagccac

SEQ ID NO: 4818441 - DNA, 13 bp, Homo sapiens
gcagcaccctccc

SEQ ID NO: 4818442 - DNA, 20 bp, Homo sapiens
gcagcaccctcccccgcagc

SEQ ID NO: 4818443 - DNA, 20 bp, Homo sapiens
gcagcagctagaaagagaaa

SEQ ID NO: 4818444 - DNA, 18 bp, Homo sapiens
gcagcaggggaaagatta

SEQ ID NO: 4818445 - DNA, 19 bp, Homo sapiens
gcagcccagaacgggcctc

SEQ ID NO: 4818446 - DNA, 21 bp, Homo sapiens
gcagcccagaacgggcctccc

SEQ ID NO: 4818447 - DNA, 13 bp, Homo sapiens
gcagcccagagag

SEQ ID NO: 4818448 - DNA, 22 bp, Homo sapiens
gcagcccagagagaccctgcca

SEQ ID NO: 4818449 - DNA, 17 bp, Homo sapiens
gcagccccatccttccc

SEQ ID NO: 4818450 - DNA, 18 bp, Homo sapiens
gcagccccatccttcccg

SEQ ID NO: 4818451 - DNA, 21 bp, Homo sapiens
gcagccccccacgcttctgga

SEQ ID NO: 4818452 - DNA, 16 bp, Homo sapiens
gcagccccccagcact

SEQ ID NO: 4818453 - DNA, 17 bp, Homo sapiens
gcagccccgcgaccacc

SEQ ID NO: 4818454 - DNA, 19 bp, Homo sapiens
gcagccccgcgaccacccc

SEQ ID NO: 4818455 - DNA, 23 bp, Homo sapiens
gcagccccgcgaccacccctgtg

SEQ ID NO: 4818456 - DNA, 20 bp, Homo sapiens
taaatgtcccaaataaattt

SEQ ID NO: 4818457 - DNA, 15 bp, Homo sapiens
taaatgtctataaat

SEQ ID NO: 4818458 - DNA, 22 bp, Homo sapiens
taaggggaattaacaattgcca

SEQ ID NO: 4818459 - DNA, 16 bp, Homo sapiens
gttctgcaataacagt

SEQ ID NO: 4818460 - DNA, 20 bp, Homo sapiens
gttctgcaataacagtttta

SEQ ID NO: 4818461 - DNA, 15 bp, Homo sapiens
gttctgcactgaaaa

SEQ ID NO: 4818462 - DNA, 15 bp, Homo sapiens
gttctgccacttagg

SEQ ID NO: 4818463 - DNA, 23 bp, Homo sapiens
gttctggcagagttgaagacaga

SEQ ID NO: 4818464 - DNA, 19 bp, Homo sapiens
gttctgggttaacagtaaa

SEQ ID NO: 4818465 - DNA, 20 bp, Homo sapiens
gttctgggttaacagtaaat

SEQ ID NO: 4818466 - DNA, 18 bp, Homo sapiens
gttcttcctcttacctgt

SEQ ID NO: 4818467 - DNA, 16 bp, Homo sapiens
gttcttgagcagctga

SEQ ID NO: 4818468 - DNA, 14 bp, Homo sapiens
gttcttgcaataag

SEQ ID NO: 4818469 - DNA, 15 bp, Homo sapiens
gttcttgcagcagag

SEQ ID NO: 4818470 - DNA, 13 bp, Homo sapiens
taaaactttattt

SEQ ID NO: 4818471 - DNA, 17 bp, Homo sapiens
taaaactttattttata

SEQ ID NO: 4818472 - DNA, 22 bp, Homo sapiens
taaaagagaccacccatatcat

SEQ ID NO: 4818473 - DNA, 14 bp, Homo sapiens
taaaaggaggacag

SEQ ID NO: 4818474 - DNA, 15 bp, Homo sapiens
taaaagtgatgtgat

SEQ ID NO: 4818475 - DNA, 15 bp, Homo sapiens
taaaataaataatct

SEQ ID NO: 4818476 - DNA, 13 bp, Homo sapiens
taaaataaatgtt

SEQ ID NO: 4818477 - DNA, 15 bp, Homo sapiens
taaaataatgattta

SEQ ID NO: 4818478 - DNA, 21 bp, Homo sapiens
taaaatactattggacagaca

SEQ ID NO: 4818479 - DNA, 18 bp, Homo sapiens
taaaatatacaaacatgt

SEQ ID NO: 4818480 - DNA, 20 bp, Homo sapiens
taaaatatacaaacatgtgg

SEQ ID NO: 4818481 - DNA, 18 bp, Homo sapiens
taaaatatagtgttgtgt

SEQ ID NO: 4818482 - DNA, 19 bp, Homo sapiens
taaaatattttcttaatta

SEQ ID NO: 4818483 - DNA, 14 bp, Homo sapiens
taaaatcacaaact

SEQ ID NO: 4818484 - DNA, 23 bp, Homo sapiens
taaaatcacaaactcatccatta

SEQ ID NO: 4818485 - DNA, 17 bp, Homo sapiens
taaaatctcctaaatgc

SEQ ID NO: 4818486 - DNA, 14 bp, Homo sapiens
taaaatgattcact

SEQ ID NO: 4818487 - DNA, 12 bp, Homo sapiens
taaaatgcaaat

SEQ ID NO: 4818488 - DNA, 17 bp, Homo sapiens
taaaatgctgttctcaa

SEQ ID NO: 4818489 - DNA, 14 bp, Homo sapiens
taaaatgtaaaaac

SEQ ID NO: 4818490 - DNA, 13 bp, Homo sapiens
taaaatgtttatt

SEQ ID NO: 4818491 - DNA, 12 bp, Homo sapiens
taaaattagtga

SEQ ID NO: 4818492 - DNA, 17 bp, Homo sapiens
taaaattagtgagattt

SEQ ID NO: 4818493 - DNA, 16 bp, Homo sapiens
taaaattatactgtgt

SEQ ID NO: 4818494 - DNA, 20 bp, Homo sapiens
taaaattatactgtgtgtga

SEQ ID NO: 4818495 - DNA, 15 bp, Homo sapiens
taaaattcattccat

SEQ ID NO: 4818496 - DNA, 16 bp, Homo sapiens
taaaattcattccatt

SEQ ID NO: 4818497 - DNA, 16 bp, Homo sapiens
taaaattggttaatga

SEQ ID NO: 4818498 - DNA, 18 bp, Homo sapiens
taaaattggttaatgaaa

SEQ ID NO: 4818499 - DNA, 19 bp, Homo sapiens
taaaattggttaatgaaaa

SEQ ID NO: 4818500 - DNA, 20 bp, Homo sapiens
taaaattggttaatgaaaaa

SEQ ID NO: 4818501 - DNA, 21 bp, Homo sapiens
taaaattggttaatgaaaaat

SEQ ID NO: 4818502 - DNA, 15 bp, Homo sapiens
taaacaaaaactttc

SEQ ID NO: 4818503 - DNA, 17 bp, Homo sapiens
taaacaaaaactttcca

SEQ ID NO: 4818504 - DNA, 23 bp, Homo sapiens
taaacaaaaactttccatgacag

SEQ ID NO: 4818505 - DNA, 20 bp, Homo sapiens
taaacaaaatttatgtcatt

SEQ ID NO: 4818506 - DNA, 24 bp, Homo sapiens
taaacaatttattttattttagca

SEQ ID NO: 4818507 - DNA, 22 bp, Homo sapiens
taaacacagtaagataggttct

SEQ ID NO: 4818508 - DNA, 18 bp, Homo sapiens
taaacacttctccttaac

SEQ ID NO: 4818509 - DNA, 13 bp, Homo sapiens
taaacagctgctt

SEQ ID NO: 4818510 - DNA, 19 bp, Homo sapiens
taaacatagtggtatttta

SEQ ID NO: 4818511 - DNA, 23 bp, Homo sapiens
taaacatagtggtattttaacat

SEQ ID NO: 4818512 - DNA, 15 bp, Homo sapiens
taaacatttccctgc

SEQ ID NO: 4818513 - DNA, 17 bp, Homo sapiens
taaaccactgttcctgc

SEQ ID NO: 4818514 - DNA, 14 bp, Homo sapiens
taaaccatgaaaag

SEQ ID NO: 4818515 - DNA, 14 bp, Homo sapiens
taaacccaaataaa

SEQ ID NO: 4818516 - DNA, 14 bp, Homo sapiens
taaacccacataaa

SEQ ID NO: 4818517 - DNA, 16 bp, Homo sapiens
taaacccacataaaca

SEQ ID NO: 4818518 - DNA, 16 bp, Homo sapiens
taaaccggatcctgtt

SEQ ID NO: 4818519 - DNA, 18 bp, Homo sapiens
taaaccggatcctgttgc

SEQ ID NO: 4818520 - DNA, 23 bp, Homo sapiens
taaacctatctgtattggcagca

SEQ ID NO: 4818521 - DNA, 19 bp, Homo sapiens
taaacctgttcctgactgt

SEQ ID NO: 4818522 - DNA, 21 bp, Homo sapiens
taaacctgttcctgactgttc

SEQ ID NO: 4818523 - DNA, 19 bp, Homo sapiens
taaaccttaatatttcttc

SEQ ID NO: 4818524 - DNA, 13 bp, Homo sapiens
taaactcagtcaa

SEQ ID NO: 4818525 - DNA, 17 bp, Homo sapiens
taaactgggaaatgaga

SEQ ID NO: 4818526 - DNA, 13 bp, Homo sapiens
taaactgtgagat

SEQ ID NO: 4818527 - DNA, 18 bp, Homo sapiens
taaactgtgagataaata

SEQ ID NO: 4818528 - DNA, 18 bp, Homo sapiens
taaacttctactgagcaa

SEQ ID NO: 4818529 - DNA, 13 bp, Homo sapiens
taaacttgtactt

SEQ ID NO: 4818530 - DNA, 12 bp, Homo sapiens
taaactttgtca

SEQ ID NO: 4818531 - DNA, 13 bp, Homo sapiens
taaactttgtcac

SEQ ID NO: 4818532 - DNA, 22 bp, Homo sapiens
taaacttttaccacttgctgca

SEQ ID NO: 4818533 - DNA, 16 bp, Homo sapiens
taaagaaaggcagaga

SEQ ID NO: 4818534 - DNA, 20 bp, Homo sapiens
taaagaaaggcagagattgg

SEQ ID NO: 4818535 - DNA, 21 bp, Homo sapiens
taaagaacagctaacaataaa

SEQ ID NO: 4818536 - DNA, 18 bp, Homo sapiens
taaagaccatttagtcct

SEQ ID NO: 4818537 - DNA, 18 bp, Homo sapiens
taaagaggcgtcttgtat

SEQ ID NO: 4818538 - DNA, 23 bp, Homo sapiens
taaagaggcgtcttgtattttct

SEQ ID NO: 4818539 - DNA, 14 bp, Homo sapiens
taaagcaatcttgg

SEQ ID NO: 4818540 - DNA, 14 bp, Homo sapiens
taaagggaagccct

SEQ ID NO: 4818541 - DNA, 16 bp, Homo sapiens
taaagggaagccctga

SEQ ID NO: 4818542 - DNA, 21 bp, Homo sapiens
taaaggggacagatcttgagc

SEQ ID NO: 4818543 - DNA, 14 bp, Homo sapiens
taaaggtgatgaat

SEQ ID NO: 4818544 - DNA, 19 bp, Homo sapiens
taaaggtgatgaatttacc

SEQ ID NO: 4818545 - DNA, 22 bp, Homo sapiens
taaaggttactgtttttatcct

SEQ ID NO: 4818546 - DNA, 14 bp, Homo sapiens
taaaggttctatga

SEQ ID NO: 4818547 - DNA, 16 bp, Homo sapiens
taaaggttctatgata

SEQ ID NO: 4818548 - DNA, 17 bp, Homo sapiens
taaaggttctatgatat

SEQ ID NO: 4818549 - DNA, 15 bp, Homo sapiens
taaaggtttattttt

SEQ ID NO: 4818550 - DNA, 20 bp, Homo sapiens
taaagtaataactgttagaa

SEQ ID NO: 4818551 - DNA, 23 bp, Homo sapiens
taaagtattccaccttaaattaa

SEQ ID NO: 4818552 - DNA, 19 bp, Homo sapiens
taaagtcaggccattcagt

SEQ ID NO: 4818553 - DNA, 17 bp, Homo sapiens
taaagtgagaaaactgt

SEQ ID NO: 4818554 - DNA, 18 bp, Homo sapiens
taaagtgagaaaactgtg

SEQ ID NO: 4818555 - DNA, 17 bp, Homo sapiens
taaataaaaatagctat

SEQ ID NO: 4818556 - DNA, 14 bp, Homo sapiens
taaataaaataacc

SEQ ID NO: 4818557 - DNA, 20 bp, Homo sapiens
taaataataaaggttctatg

SEQ ID NO: 4818558 - DNA, 19 bp, Homo sapiens
taaataatcatacacagaa

SEQ ID NO: 4818559 - DNA, 18 bp, Homo sapiens
taaataatgattcaatgt

SEQ ID NO: 4818560 - DNA, 18 bp, Homo sapiens
taaataatgcttaacata

SEQ ID NO: 4818561 - DNA, 21 bp, Homo sapiens
taaatagatttttagattcct

SEQ ID NO: 4818562 - DNA, 17 bp, Homo sapiens
taaatagcatctgctct

SEQ ID NO: 4818563 - DNA, 13 bp, Homo sapiens
taaatatatgtat

SEQ ID NO: 4818564 - DNA, 20 bp, Homo sapiens
taaatatcattatagcatgt

SEQ ID NO: 4818565 - DNA, 21 bp, Homo sapiens
taaatatcattatagcatgta

SEQ ID NO: 4818566 - DNA, 16 bp, Homo sapiens
taaatatctagtgcta

SEQ ID NO: 4818567 - DNA, 17 bp, Homo sapiens
taaatatctagtgctaa

SEQ ID NO: 4818568 - DNA, 21 bp, Homo sapiens
taaatatctagtgctaaacct

SEQ ID NO: 4818569 - DNA, 24 bp, Homo sapiens
taaatatctagtgctaaacctatc

SEQ ID NO: 4818570 - DNA, 14 bp, Homo sapiens
taaatattgctgtc

SEQ ID NO: 4818571 - DNA, 15 bp, Homo sapiens
taaatattgctgtct

SEQ ID NO: 4818572 - DNA, 21 bp, Homo sapiens
taaatattgctgtctgaaaaa

SEQ ID NO: 4818573 - DNA, 14 bp, Homo sapiens
taaatcataatcat

SEQ ID NO: 4818574 - DNA, 14 bp, Homo sapiens
taaatctaaatata

SEQ ID NO: 4818575 - DNA, 15 bp, Homo sapiens
taaatctaaatataa

SEQ ID NO: 4818576 - DNA, 16 bp, Homo sapiens
taaatctaaattaact

SEQ ID NO: 4818577 - DNA, 17 bp, Homo sapiens
taaatctacaaactttt

SEQ ID NO: 4818578 - DNA, 21 bp, Homo sapiens
taaatctacaaacttttataa

SEQ ID NO: 4818579 - DNA, 14 bp, Homo sapiens
taaatctatctcta

SEQ ID NO: 4818580 - DNA, 15 bp, Homo sapiens
taaatctatctctat

SEQ ID NO: 4818581 - DNA, 17 bp, Homo sapiens
taaatctatctctatat

SEQ ID NO: 4818582 - DNA, 13 bp, Homo sapiens
taaatgaaatact

SEQ ID NO: 4818583 - DNA, 17 bp, Homo sapiens
taaatgaatgaaatata

SEQ ID NO: 4818584 - DNA, 22 bp, Homo sapiens
taaatgaatgaaatataaactg

SEQ ID NO: 4818585 - DNA, 17 bp, Homo sapiens
taaatgacttattgatt

SEQ ID NO: 4818586 - DNA, 18 bp, Homo sapiens
taaatgagcttaatgtct

SEQ ID NO: 4818587 - DNA, 23 bp, Homo sapiens
taaatgagcttaatgtctttgtg

SEQ ID NO: 4818588 - DNA, 15 bp, Homo sapiens
taaatgatttaaatt

SEQ ID NO: 4818589 - DNA, 20 bp, Homo sapiens
taaatgctgctttggggata

SEQ ID NO: 4818590 - DNA, 15 bp, Homo sapiens
taaatggacttgctt

SEQ ID NO: 4818591 - DNA, 17 bp, Homo sapiens
taaatggacttgcttct

SEQ ID NO: 4818592 - DNA, 21 bp, Homo sapiens
taaatgtactacatttgcatg

SEQ ID NO: 4818593 - DNA, 21 bp, Homo sapiens
taaatgtagcttcagtcatta

SEQ ID NO: 4818594 - DNA, 23 bp, Homo sapiens
taaatgtagcttcagtcattaaa

SEQ ID NO: 4818595 - DNA, 15 bp, Homo sapiens
ggctgagcccctcct

SEQ ID NO: 4818596 - DNA, 18 bp, Homo sapiens
ggctgagcccctcctctc

SEQ ID NO: 4818597 - DNA, 22 bp, Homo sapiens
ggctgaggacggggcagagctg

SEQ ID NO: 4818598 - DNA, 15 bp, Homo sapiens
ggctgcagccccctg

SEQ ID NO: 4818599 - DNA, 19 bp, Homo sapiens
ggctgcagccccctgcttc

SEQ ID NO: 4818600 - DNA, 22 bp, Homo sapiens
ggctgcatcctcagccccaggg

SEQ ID NO: 4818601 - DNA, 21 bp, Homo sapiens
ggctgcatgatttttgccctg

SEQ ID NO: 4818602 - DNA, 19 bp, Homo sapiens
ggctgccaatgggagctca

SEQ ID NO: 4818603 - DNA, 20 bp, Homo sapiens
ggctgccaatgggagctcat

SEQ ID NO: 4818604 - DNA, 21 bp, Homo sapiens
ggctgccaatgggagctcatg

SEQ ID NO: 4818605 - DNA, 13 bp, Homo sapiens
ggctgcccagcgg

SEQ ID NO: 4818606 - DNA, 17 bp, Homo sapiens
ggctgctaagtggaaga

SEQ ID NO: 4818607 - DNA, 19 bp, Homo sapiens
ggctgcttctccacctccc

SEQ ID NO: 4818608 - DNA, 16 bp, Homo sapiens
ggctggaccaactgct

SEQ ID NO: 4818609 - DNA, 14 bp, Homo sapiens
ggctggagccccat

SEQ ID NO: 4818610 - DNA, 20 bp, Homo sapiens
ggctggagtgcagtggcgcg

SEQ ID NO: 4818611 - DNA, 19 bp, Homo sapiens
ggctggataggagaggaaa

SEQ ID NO: 4818612 - DNA, 23 bp, Homo sapiens
ggctggatgtgcatctggcctat

SEQ ID NO: 4818613 - DNA, 16 bp, Homo sapiens
ggctggatgtgctttc

SEQ ID NO: 4818614 - DNA, 10 bp, Homo sapiens
ggctggccct

SEQ ID NO: 4818615 - DNA, 21 bp, Homo sapiens
ggctggccctgccctccccca

SEQ ID NO: 4818616 - DNA, 16 bp, Homo sapiens
ggctggccggtccacc

SEQ ID NO: 4818617 - DNA, 14 bp, Homo sapiens
ggctgggcagagga

SEQ ID NO: 4818618 - DNA, 19 bp, Homo sapiens
ggctgggcagaggaaagca

SEQ ID NO: 4818619 - DNA, 14 bp, Homo sapiens
ggctgggcagggcc

SEQ ID NO: 4818620 - DNA, 21 bp, Homo sapiens
ggctgggccccccagctcagg

SEQ ID NO: 4818621 - DNA, 14 bp, Homo sapiens
ggctgggcgcctct

SEQ ID NO: 4818622 - DNA, 20 bp, Homo sapiens
ggctggggaggcctgcctgg

SEQ ID NO: 4818623 - DNA, 19 bp, Homo sapiens
ggctgggtttgggcagtgg

SEQ ID NO: 4818624 - DNA, 17 bp, Homo sapiens
ggctgtatttttagaga

SEQ ID NO: 4818625 - DNA, 18 bp, Homo sapiens
ggctgtcaaatccatgtg

SEQ ID NO: 4818626 - DNA, 14 bp, Homo sapiens
ggctgtcccctgca

SEQ ID NO: 4818627 - DNA, 13 bp, Homo sapiens
ggctgtctgtcac

SEQ ID NO: 4818628 - DNA, 12 bp, Homo sapiens
ggctgtgaggac

SEQ ID NO: 4818629 - DNA, 15 bp, Homo sapiens
ggctgtggcccctcc

SEQ ID NO: 4818630 - DNA, 17 bp, Homo sapiens
ggctgtggcccctcctt

SEQ ID NO: 4818631 - DNA, 15 bp, Homo sapiens
ggctgttctgcactg

SEQ ID NO: 4818632 - DNA, 17 bp, Homo sapiens
ggctgttctgcactgaa

SEQ ID NO: 4818633 - DNA, 15 bp, Homo sapiens
ggcttccagctcagt

SEQ ID NO: 4818634 - DNA, 19 bp, Homo sapiens
ggcttccagctcagtccca

SEQ ID NO: 4818635 - DNA, 23 bp, Homo sapiens
ggcttccagctcagtcccacagc

SEQ ID NO: 4818636 - DNA, 13 bp, Homo sapiens
ggcttcccaggac

SEQ ID NO: 4818637 - DNA, 14 bp, Homo sapiens
ggcttcccaggacc

SEQ ID NO: 4818638 - DNA, 15 bp, Homo sapiens
ggcttctccccctca

SEQ ID NO: 4818639 - DNA, 15 bp, Homo sapiens
ggcttggagcagaga

SEQ ID NO: 4818640 - DNA, 17 bp, Homo sapiens
ggcttggggaccagagc

SEQ ID NO: 4818641 - DNA, 19 bp, Homo sapiens
ggcttggggaccagagctg

SEQ ID NO: 4818642 - DNA, 15 bp, Homo sapiens
ggcttggggtagaga

SEQ ID NO: 4818643 - DNA, 18 bp, Homo sapiens
ggcttggggtagagagga

SEQ ID NO: 4818644 - DNA, 19 bp, Homo sapiens
ggcttggggtagagaggac

SEQ ID NO: 4818645 - DNA, 20 bp, Homo sapiens
ggcttggggtagagaggaca

SEQ ID NO: 4818646 - DNA, 22 bp, Homo sapiens
ggctttatgcaggattctcttt

SEQ ID NO: 4818647 - DNA, 17 bp, Homo sapiens
gtgctgtgggcagcacc

SEQ ID NO: 4818648 - DNA, 19 bp, Homo sapiens
gtgctgtgggcagcaccct

SEQ ID NO: 4818649 - DNA, 20 bp, Homo sapiens
gtgctgtgggcagcaccctc

SEQ ID NO: 4818650 - DNA, 15 bp, Homo sapiens
gtgctgttgattctt

SEQ ID NO: 4818651 - DNA, 21 bp, Homo sapiens
gtgcttcacacaaagtgaaat

SEQ ID NO: 4818652 - DNA, 22 bp, Homo sapiens
gtgcttctcacactggaggagc

SEQ ID NO: 4818653 - DNA, 16 bp, Homo sapiens
gtgcttgtgtgtatgt

SEQ ID NO: 4818654 - DNA, 19 bp, Homo sapiens
gtgctttcatgtttaagaa

SEQ ID NO: 4818655 - DNA, 23 bp, Homo sapiens
gtgctttcatgtttaagaaatga

SEQ ID NO: 4818656 - DNA, 22 bp, Homo sapiens
gtggaagacagagatggcagag

SEQ ID NO: 4818657 - DNA, 23 bp, Homo sapiens
gtggaagacagagatggcagagc

SEQ ID NO: 4818658 - DNA, 21 bp, Homo sapiens
gtggaattattagcaccagct

SEQ ID NO: 4818659 - DNA, 20 bp, Homo sapiens
gtggacaatgagtggaatac

SEQ ID NO: 4818660 - DNA, 13 bp, Homo sapiens
gtggacagcagct

SEQ ID NO: 4818661 - DNA, 15 bp, Homo sapiens
gtggacagcagctgg

SEQ ID NO: 4818662 - DNA, 15 bp, Homo sapiens
gtggaccacgacctc

SEQ ID NO: 4818663 - DNA, 21 bp, Homo sapiens
gtggaccagttccctcagccc

SEQ ID NO: 4818664 - DNA, 14 bp, Homo sapiens
gtggactgtatttc

SEQ ID NO: 4818665 - DNA, 11 bp, Homo sapiens
gtggagaagtg

SEQ ID NO: 4818666 - DNA, 21 bp, Homo sapiens
gtggagacttggatgtcatat

SEQ ID NO: 4818667 - DNA, 20 bp, Homo sapiens
gtggatgaaaaaaagggaaa

SEQ ID NO: 4818668 - DNA, 14 bp, Homo sapiens
gtggatgtcccttc

SEQ ID NO: 4818669 - DNA, 13 bp, Homo sapiens
gtggcaactgtgg

SEQ ID NO: 4818670 - DNA, 15 bp, Homo sapiens
gtggcacccaccact

SEQ ID NO: 4818671 - DNA, 19 bp, Homo sapiens
gtggcagcgcccagcctgg

SEQ ID NO: 4818672 - DNA, 21 bp, Homo sapiens
gtggcattggggggccgggca

SEQ ID NO: 4818673 - DNA, 15 bp, Homo sapiens
gtggcatttgcaggt

SEQ ID NO: 4818674 - DNA, 18 bp, Homo sapiens
gtggccagcccgcagagg

SEQ ID NO: 4818675 - DNA, 22 bp, Homo sapiens
gtggccatccctgggcccctcc

SEQ ID NO: 4818676 - DNA, 12 bp, Homo sapiens
gtggcccctcct

SEQ ID NO: 4818677 - DNA, 18 bp, Homo sapiens
gtggcccctccttctccc

SEQ ID NO: 4818678 - DNA, 21 bp, Homo sapiens
gtggccctgccctctccttcc

SEQ ID NO: 4818679 - DNA, 13 bp, Homo sapiens
gtggccctgtggg

SEQ ID NO: 4818680 - DNA, 13 bp, Homo sapiens
gtggcctcagccc

SEQ ID NO: 4818681 - DNA, 15 bp, Homo sapiens
gtggcctcagccctc

SEQ ID NO: 4818682 - DNA, 17 bp, Homo sapiens
gtggcctcagccctcag

SEQ ID NO: 4818683 - DNA, 15 bp, Homo sapiens
gtggcctgagaagag

SEQ ID NO: 4818684 - DNA, 14 bp, Homo sapiens
gtggcctgggtcct

SEQ ID NO: 4818685 - DNA, 15 bp, Homo sapiens
gtggcctgggtcctc

SEQ ID NO: 4818686 - DNA, 21 bp, Homo sapiens
gtggcctgggtcctcggccct

SEQ ID NO: 4818687 - DNA, 15 bp, Homo sapiens
gtggccttagaaaac

SEQ ID NO: 4818688 - DNA, 18 bp, Homo sapiens
gtggccttgagtctctga

SEQ ID NO: 4818689 - DNA, 17 bp, Homo sapiens
gtggctctaactccttg

SEQ ID NO: 4818690 - DNA, 23 bp, Homo sapiens
gtggctgatttactaacagtaac

SEQ ID NO: 4818691 - DNA, 19 bp, Homo sapiens
gtggctgtcaaatccatgt

SEQ ID NO: 4818692 - DNA, 15 bp, Homo sapiens
gtggcttaaacattt

SEQ ID NO: 4818693 - DNA, 18 bp, Homo sapiens
gtggcttcccatgtcttt

SEQ ID NO: 4818694 - DNA, 13 bp, Homo sapiens
gtggcttcttcaa

SEQ ID NO: 4818695 - DNA, 18 bp, Homo sapiens
gtggcttggaacatttgg

SEQ ID NO: 4818696 - DNA, 14 bp, Homo sapiens
gtggctttgtgctt

SEQ ID NO: 4818697 - DNA, 21 bp, Homo sapiens
gtgggaagaaacaaacccgtt

SEQ ID NO: 4818698 - DNA, 20 bp, Homo sapiens
gtgggaagagggcaggggct

SEQ ID NO: 4818699 - DNA, 18 bp, Homo sapiens
gtgggactggcccacccc

SEQ ID NO: 4818700 - DNA, 12 bp, Homo sapiens
gtgggagtccac

SEQ ID NO: 4818701 - DNA, 18 bp, Homo sapiens
gtgggagtccactttcct

SEQ ID NO: 4818702 - DNA, 22 bp, Homo sapiens
gtgggagtccactttcctctct

SEQ ID NO: 4818703 - DNA, 21 bp, Homo sapiens
gtgggatcttacccacttccc

SEQ ID NO: 4818704 - DNA, 17 bp, Homo sapiens
gtgggattcaggaatgg

SEQ ID NO: 4818705 - DNA, 16 bp, Homo sapiens
gtgggcagcaccctcc

SEQ ID NO: 4818706 - DNA, 14 bp, Homo sapiens
gtgggcccaaggcc

SEQ ID NO: 4818707 - DNA, 12 bp, Homo sapiens
gtgggctcacac

SEQ ID NO: 4818708 - DNA, 13 bp, Homo sapiens
gtgggctcacacc

SEQ ID NO: 4818709 - DNA, 22 bp, Homo sapiens
gtgggctcacaccggcactgtg

SEQ ID NO: 4818710 - DNA, 13 bp, Homo sapiens
gtgggctccagag

SEQ ID NO: 4818711 - DNA, 14 bp, Homo sapiens
gtgggctctgagca

SEQ ID NO: 4818712 - DNA, 22 bp, Homo sapiens
gtggggacagaggatttctgct

SEQ ID NO: 4818713 - DNA, 15 bp, Homo sapiens
gtggggagcgggggc

SEQ ID NO: 4818714 - DNA, 17 bp, Homo sapiens
gtggggcccatggcccc

SEQ ID NO: 4818715 - DNA, 19 bp, Homo sapiens
gtggggcccatggccccag

SEQ ID NO: 4818716 - DNA, 21 bp, Homo sapiens
gtggggcccatggccccagct

SEQ ID NO: 4818717 - DNA, 14 bp, Homo sapiens
gtggggctgcatcc

SEQ ID NO: 4818718 - DNA, 24 bp, Homo sapiens
gtggggcttagaatggggcttcca

SEQ ID NO: 4818719 - DNA, 13 bp, Homo sapiens
gtggggcttggcg

SEQ ID NO: 4818720 - DNA, 17 bp, Homo sapiens
gtgggtcaactccaagg

SEQ ID NO: 4818721 - DNA, 17 bp, Homo sapiens
gtgggtccaggagatga

SEQ ID NO: 4818722 - DNA, 21 bp, Homo sapiens
gtgggtcttggattggtacca

SEQ ID NO: 4818723 - DNA, 23 bp, Homo sapiens
gtgggtttctaaagctgccagcc

SEQ ID NO: 4818724 - DNA, 17 bp, Homo sapiens
gtggtaagagatatgct

SEQ ID NO: 4818725 - DNA, 23 bp, Homo sapiens
gtggtattttaacatagcagctg

SEQ ID NO: 4818726 - DNA, 18 bp, Homo sapiens
gtggtcagcgattcctgc

SEQ ID NO: 4818727 - DNA, 18 bp, Homo sapiens
gtggtccagggtccagcc

SEQ ID NO: 4818728 - DNA, 20 bp, Homo sapiens
gtggtccagggtccagccct

SEQ ID NO: 4818729 - DNA, 12 bp, Homo sapiens
gtggtctgtgtg

SEQ ID NO: 4818730 - DNA, 15 bp, Homo sapiens
gtggtctgtgtgtga

SEQ ID NO: 4818731 - DNA, 18 bp, Homo sapiens
gtggtgaaggggctggtg

SEQ ID NO: 4818732 - DNA, 21 bp, Homo sapiens
gtggtgaggttgtgctgcctg

SEQ ID NO: 4818733 - DNA, 15 bp, Homo sapiens
gtggttatatttcaa

SEQ ID NO: 4818734 - DNA, 18 bp, Homo sapiens
gtggttcgggggaaatag

SEQ ID NO: 4818735 - DNA, 14 bp, Homo sapiens
gtggttctgccact

SEQ ID NO: 4818736 - DNA, 22 bp, Homo sapiens
gtggttggaggcctggtctgga

SEQ ID NO: 4818737 - DNA, 16 bp, Homo sapiens
gtggtttcagaaaggg

SEQ ID NO: 4818738 - DNA, 19 bp, Homo sapiens
gtgtaactttattggtctt

SEQ ID NO: 4818739 - DNA, 21 bp, Homo sapiens
gtgtaagacacgtgcaacaga

SEQ ID NO: 4818740 - DNA, 17 bp, Homo sapiens
gtgtacatttatgtgtg

SEQ ID NO: 4818741 - DNA, 18 bp, Homo sapiens
gtgtacatttatgtgtga

SEQ ID NO: 4818742 - DNA, 14 bp, Homo sapiens
gtgtagctgtcctc

SEQ ID NO: 4818743 - DNA, 16 bp, Homo sapiens
gtgtaggaaatctgaa

SEQ ID NO: 4818744 - DNA, 14 bp, Homo sapiens
gtgtatacatatgt

SEQ ID NO: 4818745 - DNA, 17 bp, Homo sapiens
gtgtatacatatgtatg

SEQ ID NO: 4818746 - DNA, 18 bp, Homo sapiens
gtgtatacatatgtatgt

SEQ ID NO: 4818747 - DNA, 21 bp, Homo sapiens
gtgtatacatatgtatgtgtg

SEQ ID NO: 4818748 - DNA, 14 bp, Homo sapiens
gtgtatcagtgttt

SEQ ID NO: 4818749 - DNA, 16 bp, Homo sapiens
gtgtatcctgacagcg

SEQ ID NO: 4818750 - DNA, 12 bp, Homo sapiens
gtgtatgcatac

SEQ ID NO: 4818751 - DNA, 13 bp, Homo sapiens
gtgtatgcataca

SEQ ID NO: 4818752 - DNA, 17 bp, Homo sapiens
gtgtatgtatacacaca

SEQ ID NO: 4818753 - DNA, 13 bp, Homo sapiens
gtgtatgtctatg

SEQ ID NO: 4818754 - DNA, 18 bp, Homo sapiens
gtgtatgtctatgtgtat

SEQ ID NO: 4818755 - DNA, 23 bp, Homo sapiens
gtgtatttctattttgcagcagt

SEQ ID NO: 4818756 - DNA, 19 bp, Homo sapiens
gtgtatttttgtaattcct

SEQ ID NO: 4818757 - DNA, 10 bp, Homo sapiens
gtgtcacagt

SEQ ID NO: 4818758 - DNA, 23 bp, Homo sapiens
gtgtcacagttcttggtgactgt

SEQ ID NO: 4818759 - DNA, 18 bp, Homo sapiens
gtgtcacgtgaccctgtg

SEQ ID NO: 4818760 - DNA, 12 bp, Homo sapiens
gtgtcccagtgt

SEQ ID NO: 4818761 - DNA, 19 bp, Homo sapiens
gtgtcccagtgtctggccc

SEQ ID NO: 4818762 - DNA, 20 bp, Homo sapiens
gtgtcccagtgtctggccca

SEQ ID NO: 4818763 - DNA, 20 bp, Homo sapiens
gtgtcccctcactctgtcag

SEQ ID NO: 4818764 - DNA, 14 bp, Homo sapiens
gtgtcctctgtccg

SEQ ID NO: 4818765 - DNA, 16 bp, Homo sapiens
gtgtcctgtgctttct

SEQ ID NO: 4818766 - DNA, 22 bp, Homo sapiens
gtgtcctgtgctttctgcatgc

SEQ ID NO: 4818767 - DNA, 17 bp, Homo sapiens
gtgtctggtccacacac

SEQ ID NO: 4818768 - DNA, 14 bp, Homo sapiens
ggcccagccatggc

SEQ ID NO: 4818769 - DNA, 15 bp, Homo sapiens
ggcccagccatggct

SEQ ID NO: 4818770 - DNA, 18 bp, Homo sapiens
ggcccagccatggctgga

SEQ ID NO: 4818771 - DNA, 17 bp, Homo sapiens
ggcccagcctggcccca

SEQ ID NO: 4818772 - DNA, 23 bp, Homo sapiens
ggcccagcctggccccaaatgtt

SEQ ID NO: 4818773 - DNA, 22 bp, Homo sapiens
ggcccagggggaagatgccaag

SEQ ID NO: 4818774 - DNA, 19 bp, Homo sapiens
ggcccagtgcaatctgtcc

SEQ ID NO: 4818775 - DNA, 19 bp, Homo sapiens
ggcccatagaaacatgaca

SEQ ID NO: 4818776 - DNA, 13 bp, Homo sapiens
ggcccatggcccc

SEQ ID NO: 4818777 - DNA, 16 bp, Homo sapiens
ggcccatggccccagc

SEQ ID NO: 4818778 - DNA, 17 bp, Homo sapiens
ggcccatggccccagct

SEQ ID NO: 4818779 - DNA, 18 bp, Homo sapiens
ggcccatggccccagctg

SEQ ID NO: 4818780 - DNA, 12 bp, Homo sapiens
ggccccagctcc

SEQ ID NO: 4818781 - DNA, 12 bp, Homo sapiens
ggccccagctgg

SEQ ID NO: 4818782 - DNA, 14 bp, Homo sapiens
ggccccagctggct

SEQ ID NO: 4818783 - DNA, 18 bp, Homo sapiens
ggccccagctggctgggt

SEQ ID NO: 4818784 - DNA, 22 bp, Homo sapiens
ggccccaggcggaggggcttgg

SEQ ID NO: 4818785 - DNA, 23 bp, Homo sapiens
ggcccccacaggagcgtgtccta

SEQ ID NO: 4818786 - DNA, 17 bp, Homo sapiens
ggccccccagctcaggg

SEQ ID NO: 4818787 - DNA, 18 bp, Homo sapiens
ggcccccggaggcgccca

SEQ ID NO: 4818788 - DNA, 18 bp, Homo sapiens
ggccccctcgcgcccctg

SEQ ID NO: 4818789 - DNA, 18 bp, Homo sapiens
ggccccgcggagcccccg

SEQ ID NO: 4818790 - DNA, 23 bp, Homo sapiens
ggcccctccacgcctcctggcca

SEQ ID NO: 4818791 - DNA, 14 bp, Homo sapiens
ggcccctcctccag

SEQ ID NO: 4818792 - DNA, 23 bp, Homo sapiens
ggcccctccttctcccctccaga

SEQ ID NO: 4818793 - DNA, 12 bp, Homo sapiens
ggcccctgggat

SEQ ID NO: 4818794 - DNA, 12 bp, Homo sapiens
ggccccttccca

SEQ ID NO: 4818795 - DNA, 13 bp, Homo sapiens
ggccccttcccac

SEQ ID NO: 4818796 - DNA, 18 bp, Homo sapiens
ggccccttcccacgtccc

SEQ ID NO: 4818797 - DNA, 15 bp, Homo sapiens
ggcccgagcgcgtgc

SEQ ID NO: 4818798 - DNA, 21 bp, Homo sapiens
ggcccgagcgcgtgccttccc

SEQ ID NO: 4818799 - DNA, 17 bp, Homo sapiens
ggcccgcactcaggagc

SEQ ID NO: 4818800 - DNA, 15 bp, Homo sapiens
ggcccgccccaggcc

SEQ ID NO: 4818801 - DNA, 20 bp, Homo sapiens
ggcccggagatgcatctgtg

SEQ ID NO: 4818802 - DNA, 16 bp, Homo sapiens
ggcccggcccacgcag

SEQ ID NO: 4818803 - DNA, 17 bp, Homo sapiens
ggcccggcccacgcaga

SEQ ID NO: 4818804 - DNA, 20 bp, Homo sapiens
ggcccggcccacgcagagcc

SEQ ID NO: 4818805 - DNA, 22 bp, Homo sapiens
ggcccgggaggaggatccgggc

SEQ ID NO: 4818806 - DNA, 17 bp, Homo sapiens
ggcccgtgcgcagccgc

SEQ ID NO: 4818807 - DNA, 20 bp, Homo sapiens
ggcccgtgcgcagccgcgct

SEQ ID NO: 4818808 - DNA, 14 bp, Homo sapiens
ggccctaggcatac

SEQ ID NO: 4818809 - DNA, 22 bp, Homo sapiens
ggccctaggcatactctccagg

SEQ ID NO: 4818810 - DNA, 19 bp, Homo sapiens
ggccctccctgactccctg

SEQ ID NO: 4818811 - DNA, 14 bp, Homo sapiens
ggccctctctgcag

SEQ ID NO: 4818812 - DNA, 17 bp, Homo sapiens
ggccctgaaatggcctg

SEQ ID NO: 4818813 - DNA, 12 bp, Homo sapiens
ggccctgacagg

SEQ ID NO: 4818814 - DNA, 23 bp, Homo sapiens
ggccctgcagtgttcgcttggct

SEQ ID NO: 4818815 - DNA, 12 bp, Homo sapiens
ggccctgcccca

SEQ ID NO: 4818816 - DNA, 17 bp, Homo sapiens
ggccctgccccacacag

SEQ ID NO: 4818817 - DNA, 20 bp, Homo sapiens
ggccctgccccacacaggcc

SEQ ID NO: 4818818 - DNA, 13 bp, Homo sapiens
ggccctgccctcc

SEQ ID NO: 4818819 - DNA, 23 bp, Homo sapiens
ggccctgccctcccccacggccg

SEQ ID NO: 4818820 - DNA, 14 bp, Homo sapiens
ggccctgccctgag

SEQ ID NO: 4818821 - DNA, 18 bp, Homo sapiens
ggccctgccctgaggaag

SEQ ID NO: 4818822 - DNA, 19 bp, Homo sapiens
ggccctgccctgaggaagg

SEQ ID NO: 4818823 - DNA, 13 bp, Homo sapiens
ggccctgctcagg

SEQ ID NO: 4818824 - DNA, 16 bp, Homo sapiens
ggccctgctcaggcct

SEQ ID NO: 4818825 - DNA, 22 bp, Homo sapiens
ggccctgctcaggcctcacctg

SEQ ID NO: 4818826 - DNA, 24 bp, Homo sapiens
ggccctgctcaggcctcacctggc

SEQ ID NO: 4818827 - DNA, 15 bp, Homo sapiens
ggccctgggcctcag

SEQ ID NO: 4818828 - DNA, 17 bp, Homo sapiens
ggccctggggtctctga

SEQ ID NO: 4818829 - DNA, 15 bp, Homo sapiens
ggccctgtagccctg

SEQ ID NO: 4818830 - DNA, 18 bp, Homo sapiens
ggccctgtagccctggcc

SEQ ID NO: 4818831 - DNA, 11 bp, Homo sapiens
tcaaaatgtgc

SEQ ID NO: 4818832 - DNA, 14 bp, Homo sapiens
tcaaacaaatcatt

SEQ ID NO: 4818833 - DNA, 16 bp, Homo sapiens
tcaaacaaatcatttt

SEQ ID NO: 4818834 - DNA, 18 bp, Homo sapiens
tcaaacaaatcattttga

SEQ ID NO: 4818835 - DNA, 23 bp, Homo sapiens
tcaaacaaatcattttgatgtat

SEQ ID NO: 4818836 - DNA, 13 bp, Homo sapiens
tcaaacactgctt

SEQ ID NO: 4818837 - DNA, 23 bp, Homo sapiens
tcaaacagggacactacaaacat

SEQ ID NO: 4818838 - DNA, 15 bp, Homo sapiens
tcaaacagtgtggct

SEQ ID NO: 4818839 - DNA, 14 bp, Homo sapiens
tcaaacctggcaga

SEQ ID NO: 4818840 - DNA, 15 bp, Homo sapiens
tcaaacgaaatggct

SEQ ID NO: 4818841 - DNA, 20 bp, Homo sapiens
tcaaagaggccagtactttg

SEQ ID NO: 4818842 - DNA, 20 bp, Homo sapiens
tcaaagccctccctgtctgt

SEQ ID NO: 4818843 - DNA, 12 bp, Homo sapiens
tcaaagtatata

SEQ ID NO: 4818844 - DNA, 19 bp, Homo sapiens
tcaaataaaaattctagat

SEQ ID NO: 4818845 - DNA, 15 bp, Homo sapiens
tcaaataaccctgaa

SEQ ID NO: 4818846 - DNA, 15 bp, Homo sapiens
tcaaatggtattttt

SEQ ID NO: 4818847 - DNA, 21 bp, Homo sapiens
tcaaatggtattttttgtgaa

SEQ ID NO: 4818848 - DNA, 22 bp, Homo sapiens
tcaaatggtattttttgtgaat

SEQ ID NO: 4818849 - DNA, 14 bp, Homo sapiens
tcaaatgtgtaact

SEQ ID NO: 4818850 - DNA, 19 bp, Homo sapiens
tcaaattctgattattaca

SEQ ID NO: 4818851 - DNA, 18 bp, Homo sapiens
tcaaatttatttccaatg

SEQ ID NO: 4818852 - DNA, 16 bp, Homo sapiens
tcaaatttttctggga

SEQ ID NO: 4818853 - DNA, 23 bp, Homo sapiens
tcaacatcaattgggttttgatc

SEQ ID NO: 4818854 - DNA, 19 bp, Homo sapiens
tcaacatgtgctcgctctg

SEQ ID NO: 4818855 - DNA, 17 bp, Homo sapiens
tcaacatttgctttttg

SEQ ID NO: 4818856 - DNA, 18 bp, Homo sapiens
tcaaccacacctaaatta

SEQ ID NO: 4818857 - DNA, 20 bp, Homo sapiens
tcaacctgaattaaagtcta

SEQ ID NO: 4818858 - DNA, 17 bp, Homo sapiens
tattattactgttctta

SEQ ID NO: 4818859 - DNA, 14 bp, Homo sapiens
tattattattatat

SEQ ID NO: 4818860 - DNA, 17 bp, Homo sapiens
tattattttaaaaattg

SEQ ID NO: 4818861 - DNA, 18 bp, Homo sapiens
tattattttctgtaattc

SEQ ID NO: 4818862 - DNA, 15 bp, Homo sapiens
tattcaaaaattata

SEQ ID NO: 4818863 - DNA, 17 bp, Homo sapiens
tattcaaaaattatatt

SEQ ID NO: 4818864 - DNA, 16 bp, Homo sapiens
tattcaaagagaaaac

SEQ ID NO: 4818865 - DNA, 21 bp, Homo sapiens
tattcaaagtatatacagagc

SEQ ID NO: 4818866 - DNA, 19 bp, Homo sapiens
tattcagagatgtaccatg

SEQ ID NO: 4818867 - DNA, 17 bp, Homo sapiens
tattcatagtagaactt

SEQ ID NO: 4818868 - DNA, 15 bp, Homo sapiens
tattcatgctgcctg

SEQ ID NO: 4818869 - DNA, 18 bp, Homo sapiens
tattcatgctgcctgcca

SEQ ID NO: 4818870 - DNA, 21 bp, Homo sapiens
tattcattacatcctctgctt

SEQ ID NO: 4818871 - DNA, 22 bp, Homo sapiens
tattccaccttaaattaaacaa

SEQ ID NO: 4818872 - DNA, 11 bp, Homo sapiens
tattcccaggc

SEQ ID NO: 4818873 - DNA, 15 bp, Homo sapiens
tattcccaggcaggg

SEQ ID NO: 4818874 - DNA, 23 bp, Homo sapiens
tattcccagggccgcttctcctg

SEQ ID NO: 4818875 - DNA, 17 bp, Homo sapiens
tattccttggcccagca

SEQ ID NO: 4818876 - DNA, 16 bp, Homo sapiens
tattcgtaagttctgt

SEQ ID NO: 4818877 - DNA, 21 bp, Homo sapiens
tattctcagaacaccaagtaa

SEQ ID NO: 4818878 - DNA, 22 bp, Homo sapiens
tattctcagaacaccaagtaaa

SEQ ID NO: 4818879 - DNA, 23 bp, Homo sapiens
tattctcagaacaccaagtaaat

SEQ ID NO: 4818880 - DNA, 23 bp, Homo sapiens
tattctccagaaaaatcaatcat

SEQ ID NO: 4818881 - DNA, 15 bp, Homo sapiens
tataatgtgaaatgt

SEQ ID NO: 4818882 - DNA, 19 bp, Homo sapiens
tataatgtgaaatgtaact

SEQ ID NO: 4818883 - DNA, 18 bp, Homo sapiens
tataattttaaaattgca

SEQ ID NO: 4818884 - DNA, 16 bp, Homo sapiens
tatacaaacaggtgct

SEQ ID NO: 4818885 - DNA, 17 bp, Homo sapiens
tatacaaacaggtgcta

SEQ ID NO: 4818886 - DNA, 22 bp, Homo sapiens
tatacaaagctgtcactcacaa

SEQ ID NO: 4818887 - DNA, 18 bp, Homo sapiens
tatacaaccttcatttaa

SEQ ID NO: 4818888 - DNA, 20 bp, Homo sapiens
tatacaaccttcatttaaaa

SEQ ID NO: 4818889 - DNA, 12 bp, Homo sapiens
tatacacacaca

SEQ ID NO: 4818890 - DNA, 14 bp, Homo sapiens
tatacacacacaca

SEQ ID NO: 4818891 - DNA, 15 bp, Homo sapiens
tatacactttacatt

SEQ ID NO: 4818892 - DNA, 19 bp, Homo sapiens
tatacagagcctgttttaa

SEQ ID NO: 4818893 - DNA, 14 bp, Homo sapiens
tatacatacctctc

SEQ ID NO: 4818894 - DNA, 18 bp, Homo sapiens
tatacatacctctctcta

SEQ ID NO: 4818895 - DNA, 18 bp, Homo sapiens
tatacatatacacaaaga

SEQ ID NO: 4818896 - DNA, 13 bp, Homo sapiens
tatacatatgtat

SEQ ID NO: 4818897 - DNA, 16 bp, Homo sapiens
tatacatatgtatgtg

SEQ ID NO: 4818898 - DNA, 18 bp, Homo sapiens
tactcaagatactggact

SEQ ID NO: 4818899 - DNA, 14 bp, Homo sapiens
tactcagatctgca

SEQ ID NO: 4818900 - DNA, 16 bp, Homo sapiens
tactcaggctttctat

SEQ ID NO: 4818901 - DNA, 15 bp, Homo sapiens
tactcattagaatta

SEQ ID NO: 4818902 - DNA, 16 bp, Homo sapiens
tactcccattaggtag

SEQ ID NO: 4818903 - DNA, 13 bp, Homo sapiens
tactcctcagacg

SEQ ID NO: 4818904 - DNA, 17 bp, Homo sapiens
tactctgagtcctcatt

SEQ ID NO: 4818905 - DNA, 20 bp, Homo sapiens
tactgatgagacaacacaca

SEQ ID NO: 4818906 - DNA, 22 bp, Homo sapiens
tactgatttggccgttttgtga

SEQ ID NO: 4818907 - DNA, 21 bp, Homo sapiens
tactgccacggtcctttgagt

SEQ ID NO: 4818908 - DNA, 22 bp, Homo sapiens
tccccctcagctctccctcaca

SEQ ID NO: 4818909 - DNA, 13 bp, Homo sapiens
tccccctcctgca

SEQ ID NO: 4818910 - DNA, 14 bp, Homo sapiens
tccccctcctgcac

SEQ ID NO: 4818911 - DNA, 16 bp, Homo sapiens
tccccctcctgcacgc

SEQ ID NO: 4818912 - DNA, 11 bp, Homo sapiens
tcccccttccc

SEQ ID NO: 4818913 - DNA, 15 bp, Homo sapiens
tcccccttcccctgc

SEQ ID NO: 4818914 - DNA, 15 bp, Homo sapiens
tccccgcccgccctc

SEQ ID NO: 4818915 - DNA, 18 bp, Homo sapiens
tccccgcccgccctcctc

SEQ ID NO: 4818916 - DNA, 19 bp, Homo sapiens
tccccgcccgccctcctct

SEQ ID NO: 4818917 - DNA, 18 bp, Homo sapiens
tccccggacgcatgcagg

SEQ ID NO: 4818918 - DNA, 16 bp, Homo sapiens
tccccggacgctggct

SEQ ID NO: 4818919 - DNA, 19 bp, Homo sapiens
tccccgtgctcacagtagc

SEQ ID NO: 4818920 - DNA, 13 bp, Homo sapiens
tcccctccagacc

SEQ ID NO: 4818921 - DNA, 15 bp, Homo sapiens
tcccctcgcttcata

SEQ ID NO: 4818922 - DNA, 11 bp, Homo sapiens
tcccctctcat

SEQ ID NO: 4818923 - DNA, 18 bp, Homo sapiens
tcccctctcatacataaa

SEQ ID NO: 4818924 - DNA, 17 bp, Homo sapiens
tcccctctcctgagcct

SEQ ID NO: 4818925 - DNA, 20 bp, Homo sapiens
tcccctctcctgcatccctc

SEQ ID NO: 4818926 - DNA, 20 bp, Homo sapiens
tcccctctgccggtccccca

SEQ ID NO: 4818927 - DNA, 19 bp, Homo sapiens
tcccctgaggacctttctg

SEQ ID NO: 4818928 - DNA, 20 bp, Homo sapiens
tcccctgcgccctccctccc

SEQ ID NO: 4818929 - DNA, 23 bp, Homo sapiens
tcccctgtccccgcactgggctt

SEQ ID NO: 4818930 - DNA, 18 bp, Homo sapiens
tcccctgtggtttgttat

SEQ ID NO: 4818931 - DNA, 17 bp, Homo sapiens
tcccgcagcaccagcct

SEQ ID NO: 4818932 - DNA, 22 bp, Homo sapiens
tcccgcagcaccagcctgagcc

SEQ ID NO: 4818933 - DNA, 21 bp, Homo sapiens
tcccgcagcgggcgcgggaca

SEQ ID NO: 4818934 - DNA, 22 bp, Homo sapiens
tcccgcagcgggcgcgggacag

SEQ ID NO: 4818935 - DNA, 18 bp, Homo sapiens
tcccgccgcctcgggccg

SEQ ID NO: 4818936 - DNA, 15 bp, Homo sapiens
tcccgtccgtccgcc

SEQ ID NO: 4818937 - DNA, 19 bp, Homo sapiens
tcccgtgccctgtttccaa

SEQ ID NO: 4818938 - DNA, 19 bp, Homo sapiens
tcccgtggctttgtgctta

SEQ ID NO: 4818939 - DNA, 21 bp, Homo sapiens
tcccgtgtcgtaacagcagga

SEQ ID NO: 4818940 - DNA, 14 bp, Homo sapiens
tccctaattctctt

SEQ ID NO: 4818941 - DNA, 21 bp, Homo sapiens
tccctaattctcttcgctgtg

SEQ ID NO: 4818942 - DNA, 18 bp, Homo sapiens
tccctaccctcttctcag

SEQ ID NO: 4818943 - DNA, 15 bp, Homo sapiens
tccctagcagtgaac

SEQ ID NO: 4818944 - DNA, 16 bp, Homo sapiens
tccctagcagtgaact

SEQ ID NO: 4818945 - DNA, 14 bp, Homo sapiens
tccctcatgcagat

SEQ ID NO: 4818946 - DNA, 22 bp, Homo sapiens
tccctccacacctccacccgtc

SEQ ID NO: 4818947 - DNA, 16 bp, Homo sapiens
tccctccaccccagtc

SEQ ID NO: 4818948 - DNA, 20 bp, Homo sapiens
tccctccaccccagtccccg

SEQ ID NO: 4818949 - DNA, 13 bp, Homo sapiens
tccctccactcct

SEQ ID NO: 4818950 - DNA, 15 bp, Homo sapiens
tccctccactcctcc

SEQ ID NO: 4818951 - DNA, 12 bp, Homo sapiens
tccctccctcca

SEQ ID NO: 4818952 - DNA, 13 bp, Homo sapiens
tccctccctccac

SEQ ID NO: 4818953 - DNA, 14 bp, Homo sapiens
tccctccctccaca

SEQ ID NO: 4818954 - DNA, 14 bp, Homo sapiens
tccctccctcctgg

SEQ ID NO: 4818955 - DNA, 20 bp, Homo sapiens
tccctccgaacgctgctcca

SEQ ID NO: 4818956 - DNA, 17 bp, Homo sapiens
tccctcctggctcacag

SEQ ID NO: 4818957 - DNA, 19 bp, Homo sapiens
tccctcctggctcacagcc

SEQ ID NO: 4818958 - DNA, 15 bp, Homo sapiens
tccctcgagctctgt

SEQ ID NO: 4818959 - DNA, 16 bp, Homo sapiens
tccctcggtcagcacc

SEQ ID NO: 4818960 - DNA, 17 bp, Homo sapiens
tccctcggtcagcaccg

SEQ ID NO: 4818961 - DNA, 18 bp, Homo sapiens
tccctcggtcagcaccgt

SEQ ID NO: 4818962 - DNA, 19 bp, Homo sapiens
tccctctggcactccagaa

SEQ ID NO: 4818963 - DNA, 17 bp, Homo sapiens
tccctctggggctgttc

SEQ ID NO: 4818964 - DNA, 21 bp, Homo sapiens
tccctgagggcccttcccaac

SEQ ID NO: 4818965 - DNA, 12 bp, Homo sapiens
tccctgcaaggt

SEQ ID NO: 4818966 - DNA, 21 bp, Homo sapiens
tccctgcagctttgaggctgg

SEQ ID NO: 4818967 - DNA, 16 bp, Homo sapiens
tccctgcccaggccgg

SEQ ID NO: 4818968 - DNA, 15 bp, Homo sapiens
tccctgcgcgcagct

SEQ ID NO: 4818969 - DNA, 14 bp, Homo sapiens
tccctggagttcct

SEQ ID NO: 4818970 - DNA, 15 bp, Homo sapiens
tccctgggcccctcc

SEQ ID NO: 4818971 - DNA, 17 bp, Homo sapiens
tccctgggcccctccac

SEQ ID NO: 4818972 - DNA, 19 bp, Homo sapiens
tccctgggcccctccacgc

SEQ ID NO: 4818973 - DNA, 18 bp, Homo sapiens
tccctggggaggacccct

SEQ ID NO: 4818974 - DNA, 14 bp, Homo sapiens
tccctgtcccctga

SEQ ID NO: 4818975 - DNA, 22 bp, Homo sapiens
tccctgtctgtctgtctctctt

SEQ ID NO: 4818976 - DNA, 17 bp, Homo sapiens
tccctgtgggctcacac

SEQ ID NO: 4818977 - DNA, 11 bp, Homo sapiens
tccctgtgggg

SEQ ID NO: 4818978 - DNA, 13 bp, Homo sapiens
ttgttattaaatg

SEQ ID NO: 4818979 - DNA, 14 bp, Homo sapiens
ttgttctgggttaa

SEQ ID NO: 4818980 - DNA, 15 bp, Homo sapiens
ttgttctgtgcaaca

SEQ ID NO: 4818981 - DNA, 19 bp, Homo sapiens
ttgttcttgtaaaactgtg

SEQ ID NO: 4818982 - DNA, 19 bp, Homo sapiens
ttgttgatattggttctat

SEQ ID NO: 4818983 - DNA, 14 bp, Homo sapiens
ttgttgtattcctg

SEQ ID NO: 4818984 - DNA, 17 bp, Homo sapiens
ttgttgtattcctgcct

SEQ ID NO: 4818985 - DNA, 14 bp, Homo sapiens
ttgttgtccctgca

SEQ ID NO: 4818986 - DNA, 13 bp, Homo sapiens
ttgtttaaaagca

SEQ ID NO: 4818987 - DNA, 14 bp, Homo sapiens
ttgtttaagaatca

SEQ ID NO: 4818988 - DNA, 19 bp, Homo sapiens
ttgtttaagaatcatggat

SEQ ID NO: 4818989 - DNA, 13 bp, Homo sapiens
ttgtttaattgta

SEQ ID NO: 4818990 - DNA, 16 bp, Homo sapiens
ttgttttataaatgga

SEQ ID NO: 4818991 - DNA, 15 bp, Homo sapiens
ttgttttggctgctc

SEQ ID NO: 4818992 - DNA, 21 bp, Homo sapiens
ttgttttgggttttcttccct

SEQ ID NO: 4818993 - DNA, 17 bp, Homo sapiens
ttgttttttcattgtgt

SEQ ID NO: 4818994 - DNA, 16 bp, Homo sapiens
ttgttttttctttata

SEQ ID NO: 4818995 - DNA, 23 bp, Homo sapiens
tttaaaaaaataatataaatgaa

SEQ ID NO: 4818996 - DNA, 19 bp, Homo sapiens
tttaaaaaatacagtatta

SEQ ID NO: 4818997 - DNA, 17 bp, Homo sapiens
tttaaaaagttgcacat

SEQ ID NO: 4818998 - DNA, 13 bp, Homo sapiens
tttaaaacaagct

SEQ ID NO: 4818999 - DNA, 19 bp, Homo sapiens
tttaaaacaagctgatagt

SEQ ID NO: 4819000 - DNA, 18 bp, Homo sapiens
tttaaaacatgctgtctt

SEQ ID NO: 4819001 - DNA, 18 bp, Homo sapiens
tttaaaatctcctaaatg

SEQ ID NO: 4819002 - DNA, 14 bp, Homo sapiens
tttaaaatggcatt

SEQ ID NO: 4819003 - DNA, 16 bp, Homo sapiens
tttaaacaaaatttat

SEQ ID NO: 4819004 - DNA, 22 bp, Homo sapiens
tttaaacaacgatttctccatt

SEQ ID NO: 4819005 - DNA, 21 bp, Homo sapiens
tttaaagaagtccatgtgata

SEQ ID NO: 4819006 - DNA, 12 bp, Homo sapiens
tttaaatgtcta

SEQ ID NO: 4819007 - DNA, 21 bp, Homo sapiens
tttaaattatatgatatgcat

SEQ ID NO: 4819008 - DNA, 14 bp, Homo sapiens
tttaaatttaagta

SEQ ID NO: 4819009 - DNA, 14 bp, Homo sapiens
tttaaatttgttat

SEQ ID NO: 4819010 - DNA, 16 bp, Homo sapiens
tttaactagcacttta

SEQ ID NO: 4819011 - DNA, 16 bp, Homo sapiens
tttaagaaatgagaaa

SEQ ID NO: 4819012 - DNA, 16 bp, Homo sapiens
tttaagaatcatggat

SEQ ID NO: 4819013 - DNA, 14 bp, Homo sapiens
tttaagagatttta

SEQ ID NO: 4819014 - DNA, 15 bp, Homo sapiens
tttaagagattttat

SEQ ID NO: 4819015 - DNA, 13 bp, Homo sapiens
tttaagcatttta

SEQ ID NO: 4819016 - DNA, 21 bp, Homo sapiens
tttaagccaatataatgggct

SEQ ID NO: 4819017 - DNA, 19 bp, Homo sapiens
tttaagcgaggcagaatgg

SEQ ID NO: 4819018 - DNA, 19 bp, Homo sapiens
tttaagtgttctgtggctg

SEQ ID NO: 4819019 - DNA, 12 bp, Homo sapiens
tttaatctcttg

SEQ ID NO: 4819020 - DNA, 11 bp, Homo sapiens
tttaatgcaaa

SEQ ID NO: 4819021 - DNA, 12 bp, Homo sapiens
tttaatgcaaat

SEQ ID NO: 4819022 - DNA, 22 bp, Homo sapiens
tttaattcttaccgaaatgaaa

SEQ ID NO: 4819023 - DNA, 14 bp, Homo sapiens
tttaattgtataaa

SEQ ID NO: 4819024 - DNA, 21 bp, Homo sapiens
tttaattgtataaaacagtgt

SEQ ID NO: 4819025 - DNA, 15 bp, Homo sapiens
tttacaaagaaacaa

SEQ ID NO: 4819026 - DNA, 23 bp, Homo sapiens
tttacaaatgatttcgtgactgt

SEQ ID NO: 4819027 - DNA, 17 bp, Homo sapiens
tttacagtgaagaaagc

SEQ ID NO: 4819028 - DNA, 19 bp, Homo sapiens
tttacatatagctttgcaa

SEQ ID NO: 4819029 - DNA, 13 bp, Homo sapiens
tttaccagaagtt

SEQ ID NO: 4819030 - DNA, 18 bp, Homo sapiens
tttacctgaagtctttgt

SEQ ID NO: 4819031 - DNA, 16 bp, Homo sapiens
tttaccttcagcagtt

SEQ ID NO: 4819032 - DNA, 13 bp, Homo sapiens
tttactcattatc

SEQ ID NO: 4819033 - DNA, 18 bp, Homo sapiens
tttactcggcgtgctcct

SEQ ID NO: 4819034 - DNA, 16 bp, Homo sapiens
tttactgcaatgtctg

SEQ ID NO: 4819035 - DNA, 13 bp, Homo sapiens
tttactgtctgta

SEQ ID NO: 4819036 - DNA, 18 bp, Homo sapiens
tttacttgaatagtattg

SEQ ID NO: 4819037 - DNA, 19 bp, Homo sapiens
tttagaatcaagtctgtga

SEQ ID NO: 4819038 - DNA, 23 bp, Homo sapiens
tttagactaagggcaggaagact

SEQ ID NO: 4819039 - DNA, 13 bp, Homo sapiens
tttagagaagcca

SEQ ID NO: 4819040 - DNA, 15 bp, Homo sapiens
tttagagaagccata

SEQ ID NO: 4819041 - DNA, 20 bp, Homo sapiens
tttagattcctacttaaaca

SEQ ID NO: 4819042 - DNA, 21 bp, Homo sapiens
tttagattcctacttaaacaa

SEQ ID NO: 4819043 - DNA, 19 bp, Homo sapiens
tttagcacagtatttaaca

SEQ ID NO: 4819044 - DNA, 14 bp, Homo sapiens
tttagcagttctgc

SEQ ID NO: 4819045 - DNA, 21 bp, Homo sapiens
tttagcagttctgcaaataga

SEQ ID NO: 4819046 - DNA, 23 bp, Homo sapiens
tttagcagttctgcaaatagaaa

SEQ ID NO: 4819047 - DNA, 17 bp, Homo sapiens
tttagcatgagttctgc

SEQ ID NO: 4819048 - DNA, 14 bp, Homo sapiens
tttagctattactg

SEQ ID NO: 4819049 - DNA, 16 bp, Homo sapiens
tttagctgtatcaaac

SEQ ID NO: 4819050 - DNA, 14 bp, Homo sapiens
tttaggaatgctca

SEQ ID NO: 4819051 - DNA, 16 bp, Homo sapiens
tttaggaatgctcaat

SEQ ID NO: 4819052 - DNA, 13 bp, Homo sapiens
tttagtaaaatta

SEQ ID NO: 4819053 - DNA, 22 bp, Homo sapiens
tttagtaaaattatctgttcta

SEQ ID NO: 4819054 - DNA, 19 bp, Homo sapiens
tttagtagctgataaagaa

SEQ ID NO: 4819055 - DNA, 21 bp, Homo sapiens
tttagtagctgataaagaaac

SEQ ID NO: 4819056 - DNA, 16 bp, Homo sapiens
tttagtcctcaccttc

SEQ ID NO: 4819057 - DNA, 21 bp, Homo sapiens
tttataaatgaagatgcattt

SEQ ID NO: 4819058 - DNA, 16 bp, Homo sapiens
tttataaatgttttaa

SEQ ID NO: 4819059 - DNA, 17 bp, Homo sapiens
tttataaattaaatata

SEQ ID NO: 4819060 - DNA, 13 bp, Homo sapiens
tttataacaattg

SEQ ID NO: 4819061 - DNA, 14 bp, Homo sapiens
tttataacaattga

SEQ ID NO: 4819062 - DNA, 21 bp, Homo sapiens
tttatagaataatgtgggaag

SEQ ID NO: 4819063 - DNA, 12 bp, Homo sapiens
tttatataataa

SEQ ID NO: 4819064 - DNA, 23 bp, Homo sapiens
tttatattcagagatgtaccatg

SEQ ID NO: 4819065 - DNA, 17 bp, Homo sapiens
tttatattgtttttata

SEQ ID NO: 4819066 - DNA, 18 bp, Homo sapiens
tttatattgtttttatat

SEQ ID NO: 4819067 - DNA, 15 bp, Homo sapiens
tttatccacattgta

SEQ ID NO: 4819068 - DNA, 18 bp, Homo sapiens
tttatccacattgtagcc

SEQ ID NO: 4819069 - DNA, 23 bp, Homo sapiens
tttatcctttattttaaatgatc

SEQ ID NO: 4819070 - DNA, 16 bp, Homo sapiens
tttatcgccattccag

SEQ ID NO: 4819071 - DNA, 20 bp, Homo sapiens
tttatcgccattccaggggc

SEQ ID NO: 4819072 - DNA, 21 bp, Homo sapiens
tttatcgccattccaggggcc

SEQ ID NO: 4819073 - DNA, 22 bp, Homo sapiens
tttatctgtgttgtctctctaa

SEQ ID NO: 4819074 - DNA, 12 bp, Homo sapiens
tttatcttgaca

SEQ ID NO: 4819075 - DNA, 17 bp, Homo sapiens
tttatgagacttcctat

SEQ ID NO: 4819076 - DNA, 19 bp, Homo sapiens
tttatgcatgagaactaaa

SEQ ID NO: 4819077 - DNA, 23 bp, Homo sapiens
tttatgcatgagaactaaataga

SEQ ID NO: 4819078 - DNA, 15 bp, Homo sapiens
tttatgtttaaaatg

SEQ ID NO: 4819079 - DNA, 14 bp, Homo sapiens
tttattaggttaag

SEQ ID NO: 4819080 - DNA, 19 bp, Homo sapiens
tttattaggttaagtctca

SEQ ID NO: 4819081 - DNA, 14 bp, Homo sapiens
tttattagtgaagt

SEQ ID NO: 4819082 - DNA, 17 bp, Homo sapiens
tttattattattactgt

SEQ ID NO: 4819083 - DNA, 13 bp, Homo sapiens
tttattattttca

SEQ ID NO: 4819084 - DNA, 22 bp, Homo sapiens
tttattctcagaacaccaagta

SEQ ID NO: 4819085 - DNA, 21 bp, Homo sapiens
tttattctgtcaatgaaaagc

SEQ ID NO: 4819086 - DNA, 18 bp, Homo sapiens
tttattgtaatcataaat

SEQ ID NO: 4819087 - DNA, 16 bp, Homo sapiens
tttattgtcaaagtgg

SEQ ID NO: 4819088 - DNA, 22 bp, Homo sapiens
tttatttattaaacttcagcaa

SEQ ID NO: 4819089 - DNA, 20 bp, Homo sapiens
tttatttccaatgtttcaag

SEQ ID NO: 4819090 - DNA, 12 bp, Homo sapiens
tttatttctatc

SEQ ID NO: 4819091 - DNA, 14 bp, Homo sapiens
tttatttgtttact

SEQ ID NO: 4819092 - DNA, 15 bp, Homo sapiens
tttattttgtatgaa

SEQ ID NO: 4819093 - DNA, 16 bp, Homo sapiens
tttattttttgtaact

SEQ ID NO: 4819094 - DNA, 20 bp, Homo sapiens
tttattttttgtaactcttt

SEQ ID NO: 4819095 - DNA, 17 bp, Homo sapiens
tttcaacagtttcaaaa

SEQ ID NO: 4819096 - DNA, 22 bp, Homo sapiens
tttcaaggcacattgaaatact

SEQ ID NO: 4819097 - DNA, 22 bp, Homo sapiens
tttcaagttgcagtcagaagat

SEQ ID NO: 4819098 - DNA, 15 bp, Homo sapiens
tttcaatccacagta

SEQ ID NO: 4819099 - DNA, 23 bp, Homo sapiens
tttcaatccacagtattgttctt

SEQ ID NO: 4819100 - DNA, 21 bp, Homo sapiens
tttcaatgattgtttaattgt

SEQ ID NO: 4819101 - DNA, 15 bp, Homo sapiens
tttcaatgcaatgca

SEQ ID NO: 4819102 - DNA, 16 bp, Homo sapiens
tttcaatgcaatgcat

SEQ ID NO: 4819103 - DNA, 21 bp, Homo sapiens
ttcattcgtgggcctgctgct

SEQ ID NO: 4819104 - DNA, 22 bp, Homo sapiens
ttcattctggtccttagtaaat

SEQ ID NO: 4819105 - DNA, 21 bp, Homo sapiens
ttcatttacaacttccagatt

SEQ ID NO: 4819106 - DNA, 19 bp, Homo sapiens
ttcatttaggtgaggaagc

SEQ ID NO: 4819107 - DNA, 15 bp, Homo sapiens
ttccaaaaggaagca

SEQ ID NO: 4819108 - DNA, 17 bp, Homo sapiens
ttccaaaagtactagca

SEQ ID NO: 4819109 - DNA, 21 bp, Homo sapiens
ttccaaaagtactagcaataa

SEQ ID NO: 4819110 - DNA, 12 bp, Homo sapiens
ttccaagtgtgt

SEQ ID NO: 4819111 - DNA, 18 bp, Homo sapiens
ttccaagtgtgtgtgcaa

SEQ ID NO: 4819112 - DNA, 19 bp, Homo sapiens
ttccaatgccaattcatct

SEQ ID NO: 4819113 - DNA, 21 bp, Homo sapiens
ttccacaagagcccaggcctc

SEQ ID NO: 4819114 - DNA, 19 bp, Homo sapiens
ttccacaattttgtctcta

SEQ ID NO: 4819115 - DNA, 15 bp, Homo sapiens
ttccacatgctctga

SEQ ID NO: 4819116 - DNA, 16 bp, Homo sapiens
ttccacatgctctgag

SEQ ID NO: 4819117 - DNA, 17 bp, Homo sapiens
ttccaccctgccctggc

SEQ ID NO: 4819118 - DNA, 18 bp, Homo sapiens
ttccaccctgccctggcc

SEQ ID NO: 4819119 - DNA, 14 bp, Homo sapiens
ttccacctggaaag

SEQ ID NO: 4819120 - DNA, 20 bp, Homo sapiens
ttccacctggaaagccaggt

SEQ ID NO: 4819121 - DNA, 13 bp, Homo sapiens
ttccaccttaaat

SEQ ID NO: 4819122 - DNA, 16 bp, Homo sapiens
ttccaccttaaattaa

SEQ ID NO: 4819123 - DNA, 17 bp, Homo sapiens
ttccaccttaaattaaa

SEQ ID NO: 4819124 - DNA, 13 bp, Homo sapiens
ttccactgcctct

SEQ ID NO: 4819125 - DNA, 15 bp, Homo sapiens
ttccactgcctctgc

SEQ ID NO: 4819126 - DNA, 10 bp, Homo sapiens
ttccagacag

SEQ ID NO: 4819127 - DNA, 23 bp, Homo sapiens
ttccagacttcgctattcccagg

SEQ ID NO: 4819128 - DNA, 18 bp, Homo sapiens
ttccagagcactgctcca

SEQ ID NO: 4819129 - DNA, 24 bp, Homo sapiens
ttccagcaaaatatatgtttggct

SEQ ID NO: 4819130 - DNA, 13 bp, Homo sapiens
ttccagctttctc

SEQ ID NO: 4819131 - DNA, 15 bp, Homo sapiens
ttccagggaaccaga

SEQ ID NO: 4819132 - DNA, 14 bp, Homo sapiens
ttccagggcaatca

SEQ ID NO: 4819133 - DNA, 16 bp, Homo sapiens
ttccagtccaattttc

SEQ ID NO: 4819134 - DNA, 22 bp, Homo sapiens
ttccagtgcagtagtgccaaaa

SEQ ID NO: 4819135 - DNA, 21 bp, Homo sapiens
ttccatcaaagccctccctgt

SEQ ID NO: 4819136 - DNA, 12 bp, Homo sapiens
ttccatcagctt

SEQ ID NO: 4819137 - DNA, 17 bp, Homo sapiens
ttccatcagctttataa

SEQ ID NO: 4819138 - DNA, 12 bp, Homo sapiens
ttccatccacca

SEQ ID NO: 4819139 - DNA, 18 bp, Homo sapiens
ttccatgactgcatttta

SEQ ID NO: 4819140 - DNA, 16 bp, Homo sapiens
ttccatggcacactgc

SEQ ID NO: 4819141 - DNA, 12 bp, Homo sapiens
ttccatttgctg

SEQ ID NO: 4819142 - DNA, 13 bp, Homo sapiens
ttccatttgctga

SEQ ID NO: 4819143 - DNA, 20 bp, Homo sapiens
ttccatttggattttaaaca

SEQ ID NO: 4819144 - DNA, 16 bp, Homo sapiens
ttcccaacctcccctg

SEQ ID NO: 4819145 - DNA, 14 bp, Homo sapiens
ttcccaaggcagct

SEQ ID NO: 4819146 - DNA, 19 bp, Homo sapiens
ttcccaaggcagctggatt

SEQ ID NO: 4819147 - DNA, 16 bp, Homo sapiens
ttcccaagtcctcgcc

SEQ ID NO: 4819148 - DNA, 20 bp, Homo sapiens
ttcccaagtcctcgcccccc

SEQ ID NO: 4819149 - DNA, 23 bp, Homo sapiens
ttcccaagtcctcgccccccgcc

SEQ ID NO: 4819150 - DNA, 20 bp, Homo sapiens
ttcccaatcagcactgaaaa

SEQ ID NO: 4819151 - DNA, 18 bp, Homo sapiens
ttcccagcaaagttttca

SEQ ID NO: 4819152 - DNA, 13 bp, Homo sapiens
ttcccagctggca

SEQ ID NO: 4819153 - DNA, 18 bp, Homo sapiens
ttcccagctggcagcgcc

SEQ ID NO: 4819154 - DNA, 22 bp, Homo sapiens
ttcccagctggcagcgcctccc

SEQ ID NO: 4819155 - DNA, 14 bp, Homo sapiens
ttcccagcttcccg

SEQ ID NO: 4819156 - DNA, 12 bp, Homo sapiens
ttcccaggcagg

SEQ ID NO: 4819157 - DNA, 13 bp, Homo sapiens
ttcccaggcaggg

SEQ ID NO: 4819158 - DNA, 21 bp, Homo sapiens
ttccccagaccgatccttccc

SEQ ID NO: 4819159 - DNA, 23 bp, Homo sapiens
ttccccatcgccttctggctgct

SEQ ID NO: 4819160 - DNA, 10 bp, Homo sapiens
ttcccccttc

SEQ ID NO: 4819161 - DNA, 12 bp, Homo sapiens
ttcccccttccc

SEQ ID NO: 4819162 - DNA, 17 bp, Homo sapiens
ttcccccttcccctgcg

SEQ ID NO: 4819163 - DNA, 20 bp, Homo sapiens
ttcccctctcatacataaaa

SEQ ID NO: 4819164 - DNA, 22 bp, Homo sapiens
ttcccgcagcaccagcctgagc

SEQ ID NO: 4819165 - DNA, 22 bp, Homo sapiens
ttcccgccgccccccctatctc

SEQ ID NO: 4819166 - DNA, 22 bp, Homo sapiens
ttcccgggaacgcttgctctta

SEQ ID NO: 4819167 - DNA, 18 bp, Homo sapiens
ttccctagcttattttgt

SEQ ID NO: 4819168 - DNA, 17 bp, Homo sapiens
ttccctagttctttgca

SEQ ID NO: 4819169 - DNA, 15 bp, Homo sapiens
ttccctgaacactca

SEQ ID NO: 4819170 - DNA, 19 bp, Homo sapiens
ttcccttccactgcctctg

SEQ ID NO: 4819171 - DNA, 15 bp, Homo sapiens
ttcccttcccttcca

SEQ ID NO: 4819172 - DNA, 21 bp, Homo sapiens
ttcccttcttttcctgggtgc

SEQ ID NO: 4819173 - DNA, 17 bp, Homo sapiens
ttcccttgattcaaata

SEQ ID NO: 4819174 - DNA, 18 bp, Homo sapiens
ttccctttacagctctcc

SEQ ID NO: 4819175 - DNA, 19 bp, Homo sapiens
ttccctttacagctctcct

SEQ ID NO: 4819176 - DNA, 21 bp, Homo sapiens
ttccgaagaccttctgaagat

SEQ ID NO: 4819177 - DNA, 12 bp, Homo sapiens
ttccgcctcact

SEQ ID NO: 4819178 - DNA, 21 bp, Homo sapiens
ttccgtgagagtcatctcaaa

SEQ ID NO: 4819179 - DNA, 16 bp, Homo sapiens
ttccgttcatctgagg

SEQ ID NO: 4819180 - DNA, 19 bp, Homo sapiens
ttccgttcatctgaggagt

SEQ ID NO: 4819181 - DNA, 15 bp, Homo sapiens
ttcctaatcctctag

SEQ ID NO: 4819182 - DNA, 15 bp, Homo sapiens
ttcctaattcctgta

SEQ ID NO: 4819183 - DNA, 14 bp, Homo sapiens
ttcctacttaaaca

SEQ ID NO: 4819184 - DNA, 16 bp, Homo sapiens
ttcctacttaaacaaa

SEQ ID NO: 4819185 - DNA, 14 bp, Homo sapiens
ttcctagagaactg

SEQ ID NO: 4819186 - DNA, 22 bp, Homo sapiens
ttcctcatcagtgtcattttct

SEQ ID NO: 4819187 - DNA, 17 bp, Homo sapiens
ttcctcatctccatgct

SEQ ID NO: 4819188 - DNA, 19 bp, Homo sapiens
ttcctcatctccatgctct

SEQ ID NO: 4819189 - DNA, 22 bp, Homo sapiens
ttcctccagcccagtcttacat

SEQ ID NO: 4819190 - DNA, 15 bp, Homo sapiens
ttcctcccctggaag

SEQ ID NO: 4819191 - DNA, 23 bp, Homo sapiens
ttcctcccctggaagttgtcctt

SEQ ID NO: 4819192 - DNA, 14 bp, Homo sapiens
ttcctctcctctct

SEQ ID NO: 4819193 - DNA, 22 bp, Homo sapiens
ttcctctctctctctctctctg

SEQ ID NO: 4819194 - DNA, 23 bp, Homo sapiens
ttcctctctctctctctctctgt

SEQ ID NO: 4819195 - DNA, 20 bp, Homo sapiens
ttcctcttaatgtctcaaaa

SEQ ID NO: 4819196 - DNA, 16 bp, Homo sapiens
ttcctcttacctgtaa

SEQ ID NO: 4819197 - DNA, 15 bp, Homo sapiens
ttcctgaactcccag

SEQ ID NO: 4819198 - DNA, 12 bp, Homo sapiens
ttcctgaccctc

SEQ ID NO: 4819199 - DNA, 13 bp, Homo sapiens
ttcctgaccctca

SEQ ID NO: 4819200 - DNA, 12 bp, Homo sapiens
ttcctgactgtt

SEQ ID NO: 4819201 - DNA, 17 bp, Homo sapiens
ttcctgactgttctctt

SEQ ID NO: 4819202 - DNA, 17 bp, Homo sapiens
ttcctgaggtcatctgt

SEQ ID NO: 4819203 - DNA, 17 bp, Homo sapiens
ttcctgatcaaggtgct

SEQ ID NO: 4819204 - DNA, 19 bp, Homo sapiens
ttcctgatcaaggtgctct

SEQ ID NO: 4819205 - DNA, 23 bp, Homo sapiens
ttatctgttctatggaccaaatg

SEQ ID NO: 4819206 - DNA, 22 bp, Homo sapiens
ttatcttaaacccacataaaca

SEQ ID NO: 4819207 - DNA, 12 bp, Homo sapiens
ttatctttaaaa

SEQ ID NO: 4819208 - DNA, 14 bp, Homo sapiens
ttatgaaatgccag

SEQ ID NO: 4819209 - DNA, 15 bp, Homo sapiens
ttatgaaatgccaga

SEQ ID NO: 4819210 - DNA, 16 bp, Homo sapiens
ttatgaaatgccagac

SEQ ID NO: 4819211 - DNA, 16 bp, Homo sapiens
ttatgagatactttgc

SEQ ID NO: 4819212 - DNA, 14 bp, Homo sapiens
ttatgatttcatga

SEQ ID NO: 4819213 - DNA, 19 bp, Homo sapiens
ttatgcatgagaactaaat

SEQ ID NO: 4819214 - DNA, 20 bp, Homo sapiens
ttatgcatgagaactaaata

SEQ ID NO: 4819215 - DNA, 14 bp, Homo sapiens
ttatgcttcttgga

SEQ ID NO: 4819216 - DNA, 18 bp, Homo sapiens
ttatgggaatgccttttc

SEQ ID NO: 4819217 - DNA, 13 bp, Homo sapiens
ttatggtagaaaa

SEQ ID NO: 4819218 - DNA, 15 bp, Homo sapiens
ttatggtgatactcc

SEQ ID NO: 4819219 - DNA, 16 bp, Homo sapiens
ttatgtaagtttctaa

SEQ ID NO: 4819220 - DNA, 18 bp, Homo sapiens
ttatgtaagtttctaaga

SEQ ID NO: 4819221 - DNA, 14 bp, Homo sapiens
ttatgtattctctt

SEQ ID NO: 4819222 - DNA, 15 bp, Homo sapiens
ttatgtcaaatggat

SEQ ID NO: 4819223 - DNA, 14 bp, Homo sapiens
ttatgtcattttca

SEQ ID NO: 4819224 - DNA, 13 bp, Homo sapiens
ttatgtctcttgt

SEQ ID NO: 4819225 - DNA, 21 bp, Homo sapiens
ttatgtgctattaatatttgt

SEQ ID NO: 4819226 - DNA, 20 bp, Homo sapiens
ttatgtttaaaatggcattt

SEQ ID NO: 4819227 - DNA, 15 bp, Homo sapiens
ttattaaatgtagct

SEQ ID NO: 4819228 - DNA, 15 bp, Homo sapiens
ttattacaacaagca

SEQ ID NO: 4819229 - DNA, 21 bp, Homo sapiens
ttattacaacaagcaaactga

SEQ ID NO: 4819230 - DNA, 18 bp, Homo sapiens
ttattactttaaattata

SEQ ID NO: 4819231 - DNA, 21 bp, Homo sapiens
ttattactttaaattatatga

SEQ ID NO: 4819232 - DNA, 20 bp, Homo sapiens
ttattagtgaagtatgcact

SEQ ID NO: 4819233 - DNA, 15 bp, Homo sapiens
ttattatagtctgta

SEQ ID NO: 4819234 - DNA, 22 bp, Homo sapiens
ttattatagtctgtacttcagt

SEQ ID NO: 4819235 - DNA, 14 bp, Homo sapiens
ttattcaaagagaa

SEQ ID NO: 4819236 - DNA, 13 bp, Homo sapiens
ttattcaataact

SEQ ID NO: 4819237 - DNA, 16 bp, Homo sapiens
ttattcctaattcctg

SEQ ID NO: 4819238 - DNA, 22 bp, Homo sapiens
ttattcttccaagttcattcat

SEQ ID NO: 4819239 - DNA, 19 bp, Homo sapiens
ttattgccaggaaaggaga

SEQ ID NO: 4819240 - DNA, 13 bp, Homo sapiens
ttattgtctgtaa

SEQ ID NO: 4819241 - DNA, 17 bp, Homo sapiens
ttatttacaagaagaac

SEQ ID NO: 4819242 - DNA, 15 bp, Homo sapiens
ttatttagtaaaatt

SEQ ID NO: 4819243 - DNA, 19 bp, Homo sapiens
ttatttagtaaaattatct

SEQ ID NO: 4819244 - DNA, 16 bp, Homo sapiens
ttatttatatatgaag

SEQ ID NO: 4819245 - DNA, 16 bp, Homo sapiens
ttatttcaatgtaatt

SEQ ID NO: 4819246 - DNA, 24 bp, Homo sapiens
ttatttcaatgtaattaaactgtt

SEQ ID NO: 4819247 - DNA, 14 bp, Homo sapiens
ttatttcatccagt

SEQ ID NO: 4819248 - DNA, 12 bp, Homo sapiens
ttatttccatat

SEQ ID NO: 4819249 - DNA, 13 bp, Homo sapiens
ttatttccatatt

SEQ ID NO: 4819250 - DNA, 16 bp, Homo sapiens
ttatttccatattaaa

SEQ ID NO: 4819251 - DNA, 22 bp, Homo sapiens
ttatttccatattaaaatcaca

SEQ ID NO: 4819252 - DNA, 13 bp, Homo sapiens
ttatttctgtata

SEQ ID NO: 4819253 - DNA, 14 bp, Homo sapiens
ttatttctgtatat

SEQ ID NO: 4819254 - DNA, 13 bp, Homo sapiens
ttatttgatctgg

SEQ ID NO: 4819255 - DNA, 18 bp, Homo sapiens
ttattttaaatgatctgt

SEQ ID NO: 4819256 - DNA, 23 bp, Homo sapiens
ttattttataattttaaaattgc

SEQ ID NO: 4819257 - DNA, 18 bp, Homo sapiens
ttattttattttagcagt

SEQ ID NO: 4819258 - DNA, 13 bp, Homo sapiens
ttattttctatat

SEQ ID NO: 4819259 - DNA, 14 bp, Homo sapiens
ttattttgtacgtg

SEQ ID NO: 4819260 - DNA, 21 bp, Homo sapiens
ttattttgtacgtgttattat

SEQ ID NO: 4819261 - DNA, 14 bp, Homo sapiens
ttatttttctgtta

SEQ ID NO: 4819262 - DNA, 14 bp, Homo sapiens
ttattttttgtaac

SEQ ID NO: 4819263 - DNA, 17 bp, Homo sapiens
ttcaaaaattatatttt

SEQ ID NO: 4819264 - DNA, 17 bp, Homo sapiens
ttcaaaataaaatatca

SEQ ID NO: 4819265 - DNA, 16 bp, Homo sapiens
ttcaaaatattgagca

SEQ ID NO: 4819266 - DNA, 12 bp, Homo sapiens
ttcaaagtatat

SEQ ID NO: 4819267 - DNA, 14 bp, Homo sapiens
ttcaaatgcatttt

SEQ ID NO: 4819268 - DNA, 13 bp, Homo sapiens
ttcaaatgtgtaa

SEQ ID NO: 4819269 - DNA, 15 bp, Homo sapiens
ttcaaattctgatta

SEQ ID NO: 4819270 - DNA, 20 bp, Homo sapiens
ttcaaccacacctaaattaa

SEQ ID NO: 4819271 - DNA, 16 bp, Homo sapiens
ttcaaccattgaaggg

SEQ ID NO: 4819272 - DNA, 20 bp, Homo sapiens
ttcaagcaaagacagtttct

SEQ ID NO: 4819273 - DNA, 14 bp, Homo sapiens
ttcaagcaatcctc

SEQ ID NO: 4819274 - DNA, 18 bp, Homo sapiens
ttcaagcattgctaaagt

SEQ ID NO: 4819275 - DNA, 16 bp, Homo sapiens
ttcaaggcacattgaa

SEQ ID NO: 4819276 - DNA, 22 bp, Homo sapiens
ttcaaggcacattgaaatactt

SEQ ID NO: 4819277 - DNA, 18 bp, Homo sapiens
ttcaagtgcttctccagc

SEQ ID NO: 4819278 - DNA, 13 bp, Homo sapiens
ttcaatccccata

SEQ ID NO: 4819279 - DNA, 12 bp, Homo sapiens
ttcaatgcaatg

SEQ ID NO: 4819280 - DNA, 13 bp, Homo sapiens
ttcaatgcaatgc

SEQ ID NO: 4819281 - DNA, 16 bp, Homo sapiens
ttcaatgcaatgcatc

SEQ ID NO: 4819282 - DNA, 20 bp, Homo sapiens
ttcaatgcaatgcatctgaa

SEQ ID NO: 4819283 - DNA, 19 bp, Homo sapiens
ttcaatgggtaaataaatg

SEQ ID NO: 4819284 - DNA, 21 bp, Homo sapiens
ttcaatgggtaaataaatgct

SEQ ID NO: 4819285 - DNA, 15 bp, Homo sapiens
ttcaatgtaattaaa

SEQ ID NO: 4819286 - DNA, 21 bp, Homo sapiens
ttcaattaatggaaaactgtt

SEQ ID NO: 4819287 - DNA, 15 bp, Homo sapiens
ttcacaactttgctt

SEQ ID NO: 4819288 - DNA, 18 bp, Homo sapiens
ttcacacaaagtgaaatt

SEQ ID NO: 4819289 - DNA, 21 bp, Homo sapiens
ttcacacaaagtgaaattagt

SEQ ID NO: 4819290 - DNA, 14 bp, Homo sapiens
ttcacacacacaca

SEQ ID NO: 4819291 - DNA, 12 bp, Homo sapiens
ttcacaccctgc

SEQ ID NO: 4819292 - DNA, 15 bp, Homo sapiens
ttcacaccctgcaag

SEQ ID NO: 4819293 - DNA, 13 bp, Homo sapiens
ttcacagagtaca

SEQ ID NO: 4819294 - DNA, 15 bp, Homo sapiens
ttcacagagtacaaa

SEQ ID NO: 4819295 - DNA, 15 bp, Homo sapiens
ttcacattcctgacc

SEQ ID NO: 4819296 - DNA, 19 bp, Homo sapiens
ttcaccaacaacagtcagc

SEQ ID NO: 4819297 - DNA, 13 bp, Homo sapiens
ttcaccaggaaga

SEQ ID NO: 4819298 - DNA, 23 bp, Homo sapiens
ttcaccccatccctccttaagag

SEQ ID NO: 4819299 - DNA, 18 bp, Homo sapiens
ttcaccccggcaggccct

SEQ ID NO: 4819300 - DNA, 13 bp, Homo sapiens
ttcacccttttct

SEQ ID NO: 4819301 - DNA, 16 bp, Homo sapiens
ttcaccgcattccagg

SEQ ID NO: 4819302 - DNA, 16 bp, Homo sapiens
ttcacctgtaaaactt

SEQ ID NO: 4819303 - DNA, 15 bp, Homo sapiens
ttcaccttctgtgca

SEQ ID NO: 4819304 - DNA, 21 bp, Homo sapiens
ttcaccttctgtgcatctggc

SEQ ID NO: 4819305 - DNA, 15 bp, Homo sapiens
ttcacgtggtcctaa

SEQ ID NO: 4819306 - DNA, 20 bp, Homo sapiens
ttcactgtcttactcaagat

SEQ ID NO: 4819307 - DNA, 15 bp, Homo sapiens
ttcacttaaaatcaa

SEQ ID NO: 4819308 - DNA, 18 bp, Homo sapiens
ttcacttaaactttgtca

SEQ ID NO: 4819309 - DNA, 15 bp, Homo sapiens
ttcacttcttaagga

SEQ ID NO: 4819310 - DNA, 22 bp, Homo sapiens
ttcacttcttaaggacagtgtt

SEQ ID NO: 4819311 - DNA, 19 bp, Homo sapiens
ttcagaaagggcagcccct

SEQ ID NO: 4819312 - DNA, 20 bp, Homo sapiens
ttcagaaagggcagcccctc

SEQ ID NO: 4819313 - DNA, 22 bp, Homo sapiens
ttcagaaagggcagcccctccc

SEQ ID NO: 4819314 - DNA, 24 bp, Homo sapiens
ttcagactctctcctctctctccc

SEQ ID NO: 4819315 - DNA, 20 bp, Homo sapiens
ttcagatccttccaaactct

SEQ ID NO: 4819316 - DNA, 19 bp, Homo sapiens
ttcagcaaccctacagtat

SEQ ID NO: 4819317 - DNA, 23 bp, Homo sapiens
ttcagcaaccctacagtatataa

SEQ ID NO: 4819318 - DNA, 14 bp, Homo sapiens
ttcagccaagaatt

SEQ ID NO: 4819319 - DNA, 17 bp, Homo sapiens
ttcagtagctccttggt

SEQ ID NO: 4819320 - DNA, 13 bp, Homo sapiens
ttcagtcattaaa

SEQ ID NO: 4819321 - DNA, 21 bp, Homo sapiens
ttcagtctatgctgtgtgcag

SEQ ID NO: 4819322 - DNA, 16 bp, Homo sapiens
ttcagtgccaaaaaca

SEQ ID NO: 4819323 - DNA, 19 bp, Homo sapiens
ttcagttctcatcttgtaa

SEQ ID NO: 4819324 - DNA, 14 bp, Homo sapiens
ttcagttgacacat

SEQ ID NO: 4819325 - DNA, 18 bp, Homo sapiens
ttcagtttctaaaattga

SEQ ID NO: 4819326 - DNA, 19 bp, Homo sapiens
ttcagtttctaaaattgag

SEQ ID NO: 4819327 - DNA, 13 bp, Homo sapiens
ttcataatgactt

SEQ ID NO: 4819328 - DNA, 20 bp, Homo sapiens
ttaaaaaagatggatttgac

SEQ ID NO: 4819329 - DNA, 19 bp, Homo sapiens
ttaaaaaatacagtattat

SEQ ID NO: 4819330 - DNA, 14 bp, Homo sapiens
ttaaaaaatagttg

SEQ ID NO: 4819331 - DNA, 16 bp, Homo sapiens
ttaaaaagacactttt

SEQ ID NO: 4819332 - DNA, 20 bp, Homo sapiens
ttaaaaagccaagtgtcctg

SEQ ID NO: 4819333 - DNA, 13 bp, Homo sapiens
ttaaaaattatag

SEQ ID NO: 4819334 - DNA, 13 bp, Homo sapiens
ttaaaaattgcat

SEQ ID NO: 4819335 - DNA, 15 bp, Homo sapiens
ttaaaacaagagacc

SEQ ID NO: 4819336 - DNA, 14 bp, Homo sapiens
ttaaaacaagctga

SEQ ID NO: 4819337 - DNA, 16 bp, Homo sapiens
ttaaaacaagctgata

SEQ ID NO: 4819338 - DNA, 12 bp, Homo sapiens
ttaaaagcatat

SEQ ID NO: 4819339 - DNA, 21 bp, Homo sapiens
tgtaaagatattgtatctcct

SEQ ID NO: 4819340 - DNA, 15 bp, Homo sapiens
tgtaaaggtaggtgc

SEQ ID NO: 4819341 - DNA, 14 bp, Homo sapiens
tgtgttttgtccaa

SEQ ID NO: 4819342 - DNA, 15 bp, Homo sapiens
tgttaaataaggcct

SEQ ID NO: 4819343 - DNA, 15 bp, Homo sapiens
tgttaaatctacaaa

SEQ ID NO: 4819344 - DNA, 18 bp, Homo sapiens
tgttaaatgagcttaatg

SEQ ID NO: 4819345 - DNA, 23 bp, Homo sapiens
tgttaacaatgcctattgtaata

SEQ ID NO: 4819346 - DNA, 20 bp, Homo sapiens
tgttaacttatgtctcttgt

SEQ ID NO: 4819347 - DNA, 15 bp, Homo sapiens
tgttaagggaagctg

SEQ ID NO: 4819348 - DNA, 16 bp, Homo sapiens
tgttaagggaagctga

SEQ ID NO: 4819349 - DNA, 14 bp, Homo sapiens
tccagaatttccca

SEQ ID NO: 4819350 - DNA, 15 bp, Homo sapiens
tccagacaagccctg

SEQ ID NO: 4819351 - DNA, 20 bp, Homo sapiens
tccagacagagtggatctgg

SEQ ID NO: 4819352 - DNA, 16 bp, Homo sapiens
tccagacagggtgggg

SEQ ID NO: 4819353 - DNA, 19 bp, Homo sapiens
tccagacatacgaaacaca

SEQ ID NO: 4819354 - DNA, 11 bp, Homo sapiens
tccagacccct

SEQ ID NO: 4819355 - DNA, 23 bp, Homo sapiens
tccagactcgagagggctgagcc

SEQ ID NO: 4819356 - DNA, 14 bp, Homo sapiens
tccagacttcgcta

SEQ ID NO: 4819357 - DNA, 15 bp, Homo sapiens
tccagagacctgctc

SEQ ID NO: 4819358 - DNA, 22 bp, Homo sapiens
tccagagacctgctccagatcc

SEQ ID NO: 4819359 - DNA, 20 bp, Homo sapiens
tccagagagaagcaccccac

SEQ ID NO: 4819360 - DNA, 21 bp, Homo sapiens
tccagagagaagcaccccacc

SEQ ID NO: 4819361 - DNA, 22 bp, Homo sapiens
tccagagagaagcaccccacca

SEQ ID NO: 4819362 - DNA, 15 bp, Homo sapiens
tccagagcctgggcg

SEQ ID NO: 4819363 - DNA, 23 bp, Homo sapiens
tccagatcctctttccccactga

SEQ ID NO: 4819364 - DNA, 17 bp, Homo sapiens
tccagattattttctat

SEQ ID NO: 4819365 - DNA, 11 bp, Homo sapiens
tccagcaaaat

SEQ ID NO: 4819366 - DNA, 11 bp, Homo sapiens
tccagccctcc

SEQ ID NO: 4819367 - DNA, 12 bp, Homo sapiens
tccagccctccg

SEQ ID NO: 4819368 - DNA, 14 bp, Homo sapiens
tccagccctgggca

SEQ ID NO: 4819369 - DNA, 12 bp, Homo sapiens
tccagctcagtc

SEQ ID NO: 4819370 - DNA, 22 bp, Homo sapiens
tccagctgattttaactttttt

SEQ ID NO: 4819371 - DNA, 13 bp, Homo sapiens
tccagctttctct

SEQ ID NO: 4819372 - DNA, 17 bp, Homo sapiens
tccagctttctctttgt

SEQ ID NO: 4819373 - DNA, 15 bp, Homo sapiens
tccaggaaaactgtt

SEQ ID NO: 4819374 - DNA, 10 bp, Homo sapiens
tccaggagat

SEQ ID NO: 4819375 - DNA, 17 bp, Homo sapiens
tccaggattgtccacaa

SEQ ID NO: 4819376 - DNA, 18 bp, Homo sapiens
tccaggcccagcctggcc

SEQ ID NO: 4819377 - DNA, 22 bp, Homo sapiens
tccaggccccatcagcatccca

SEQ ID NO: 4819378 - DNA, 16 bp, Homo sapiens
tccagggaaccagagc

SEQ ID NO: 4819379 - DNA, 20 bp, Homo sapiens
tccaggggctgcagccccct

SEQ ID NO: 4819380 - DNA, 14 bp, Homo sapiens
tccaggtcacaggc

SEQ ID NO: 4819381 - DNA, 16 bp, Homo sapiens
tccaggtcacaggcat

SEQ ID NO: 4819382 - DNA, 23 bp, Homo sapiens
tccaggtcacaggcatccgctgc

SEQ ID NO: 4819383 - DNA, 17 bp, Homo sapiens
tccaggttccatccacc

SEQ ID NO: 4819384 - DNA, 21 bp, Homo sapiens
tccaggttccatccaccacct

SEQ ID NO: 4819385 - DNA, 12 bp, Homo sapiens
tccaggttcctc

SEQ ID NO: 4819386 - DNA, 18 bp, Homo sapiens
tccagtaaggaatgatat

SEQ ID NO: 4819387 - DNA, 21 bp, Homo sapiens
tccagtataaattacatgcat

SEQ ID NO: 4819388 - DNA, 14 bp, Homo sapiens
tccagtatcttgaa

SEQ ID NO: 4819389 - DNA, 15 bp, Homo sapiens
tccagtatcttgaag

SEQ ID NO: 4819390 - DNA, 19 bp, Homo sapiens
tgctgtccctgtgggctca

SEQ ID NO: 4819391 - DNA, 21 bp, Homo sapiens
tgctgtccctgtgggctcaca

SEQ ID NO: 4819392 - DNA, 15 bp, Homo sapiens
tgctgtcccttttcc

SEQ ID NO: 4819393 - DNA, 23 bp, Homo sapiens
tgctgtcgggcaagatagctcct

SEQ ID NO: 4819394 - DNA, 18 bp, Homo sapiens
tgctgtctgtgtgaggct

SEQ ID NO: 4819395 - DNA, 16 bp, Homo sapiens
tgctgtgaaacagtgt

SEQ ID NO: 4819396 - DNA, 15 bp, Homo sapiens
tgctgtgaaatgact

SEQ ID NO: 4819397 - DNA, 18 bp, Homo sapiens
tgctgtgggcagcaccct

SEQ ID NO: 4819398 - DNA, 15 bp, Homo sapiens
tgctgttctcaatca

SEQ ID NO: 4819399 - DNA, 16 bp, Homo sapiens
tgctgttctcaatcat

SEQ ID NO: 4819400 - DNA, 21 bp, Homo sapiens
tgctgttctcaatcattgtca

SEQ ID NO: 4819401 - DNA, 17 bp, Homo sapiens
tgctgttgattctttca

SEQ ID NO: 4819402 - DNA, 18 bp, Homo sapiens
tgctgttgattctttcaa

SEQ ID NO: 4819403 - DNA, 16 bp, Homo sapiens
tgctgtttatatatat

SEQ ID NO: 4819404 - DNA, 17 bp, Homo sapiens
tgcttaaataaaaatta

SEQ ID NO: 4819405 - DNA, 13 bp, Homo sapiens
tgcttaacataaa

SEQ ID NO: 4819406 - DNA, 21 bp, Homo sapiens
tgcttaacataaacttgtact

SEQ ID NO: 4819407 - DNA, 18 bp, Homo sapiens
tggagcagagacggcagc

SEQ ID NO: 4819408 - DNA, 21 bp, Homo sapiens
tggagcagagacggcagcccc

SEQ ID NO: 4819409 - DNA, 22 bp, Homo sapiens
tggagcagagacggcagcccca

SEQ ID NO: 4819410 - DNA, 14 bp, Homo sapiens
tggagccccatcgc

SEQ ID NO: 4819411 - DNA, 19 bp, Homo sapiens
tggagccccatcgcctggg

SEQ ID NO: 4819412 - DNA, 23 bp, Homo sapiens
tggagcccgcctgcgccccccag

SEQ ID NO: 4819413 - DNA, 22 bp, Homo sapiens
tggagcctgagtcagggcccag

SEQ ID NO: 4819414 - DNA, 14 bp, Homo sapiens
tggagcgtccttgt

SEQ ID NO: 4819415 - DNA, 16 bp, Homo sapiens
tggagcgtccttgtcc

SEQ ID NO: 4819416 - DNA, 21 bp, Homo sapiens
tggagcgtccttgtccccgcc

SEQ ID NO: 4819417 - DNA, 15 bp, Homo sapiens
tggaggatggacgag

SEQ ID NO: 4819418 - DNA, 17 bp, Homo sapiens
tggaggatggacgagtg

SEQ ID NO: 4819419 - DNA, 23 bp, Homo sapiens
tggaggctggaccaactgctttg

SEQ ID NO: 4819420 - DNA, 22 bp, Homo sapiens
tggccttaactggccctcgggc

SEQ ID NO: 4819421 - DNA, 16 bp, Homo sapiens
tggccttgagtctctg

SEQ ID NO: 4819422 - DNA, 16 bp, Homo sapiens
tggccttgcctccagg

SEQ ID NO: 4819423 - DNA, 16 bp, Homo sapiens
tggcgagtccagacac

SEQ ID NO: 4819424 - DNA, 20 bp, Homo sapiens
tggcgccccgggccgcgagc

SEQ ID NO: 4819425 - DNA, 18 bp, Homo sapiens
tggcgcgtgtgtggccta

SEQ ID NO: 4819426 - DNA, 15 bp, Homo sapiens
tggcgggcagcccct

SEQ ID NO: 4819427 - DNA, 15 bp, Homo sapiens
tggctagtctgtgcc

SEQ ID NO: 4819428 - DNA, 22 bp, Homo sapiens
tggctattgtccttgtgtatcc

SEQ ID NO: 4819429 - DNA, 20 bp, Homo sapiens
tggctcacagccaccacctg

SEQ ID NO: 4819430 - DNA, 16 bp, Homo sapiens
tggctcccagcagagg

SEQ ID NO: 4819431 - DNA, 16 bp, Homo sapiens
tggctcccttacttta

SEQ ID NO: 4819432 - DNA, 14 bp, Homo sapiens
tggctcctcaccac

SEQ ID NO: 4819433 - DNA, 18 bp, Homo sapiens
tggctgaagaaacacagc

SEQ ID NO: 4819434 - DNA, 20 bp, Homo sapiens
tggctgaagaaacacagcat

SEQ ID NO: 4819435 - DNA, 18 bp, Homo sapiens
tggctgagagggtgtggg

SEQ ID NO: 4819436 - DNA, 17 bp, Homo sapiens
tggctgattggaaaata

SEQ ID NO: 4819437 - DNA, 19 bp, Homo sapiens
tggctgattggaaaataat

SEQ ID NO: 4819438 - DNA, 23 bp, Homo sapiens
tggctgattggaaaataataaaa

SEQ ID NO: 4819439 - DNA, 21 bp, Homo sapiens
tggctgatttactaacagtaa

SEQ ID NO: 4819440 - DNA, 13 bp, Homo sapiens
tggctgccaagag

SEQ ID NO: 4819441 - DNA, 20 bp, Homo sapiens
tggctgccaatgggagctca

SEQ ID NO: 4819442 - DNA, 16 bp, Homo sapiens
tggctgctctccatct

SEQ ID NO: 4819443 - DNA, 20 bp, Homo sapiens
tggctgctctccatctcttg

SEQ ID NO: 4819444 - DNA, 16 bp, Homo sapiens
tggctggagccccatc

SEQ ID NO: 4819445 - DNA, 18 bp, Homo sapiens
tggctggatgtgcatctg

SEQ ID NO: 4819446 - DNA, 16 bp, Homo sapiens
tggctgggtcgcccct

SEQ ID NO: 4819447 - DNA, 22 bp, Homo sapiens
tggctgggtttgggcagtggag

SEQ ID NO: 4819448 - DNA, 17 bp, Homo sapiens
tggctgtatttttagag

SEQ ID NO: 4819449 - DNA, 18 bp, Homo sapiens
tggctgtatttttagaga

SEQ ID NO: 4819450 - DNA, 18 bp, Homo sapiens
tggctgtcaaatccatgt

SEQ ID NO: 4819451 - DNA, 18 bp, Homo sapiens
tggctgtggcccctcctt

SEQ ID NO: 4819452 - DNA, 18 bp, Homo sapiens
tggcttagcgttctgttt

SEQ ID NO: 4819453 - DNA, 20 bp, Homo sapiens
tggcttcaccgcattccagg

SEQ ID NO: 4819454 - DNA, 22 bp, Homo sapiens
tggcttcaccgcattccagggg

SEQ ID NO: 4819455 - DNA, 11 bp, Homo sapiens
tggcttcctcc

SEQ ID NO: 4819456 - DNA, 16 bp, Homo sapiens
tggcttggcattgacc

SEQ ID NO: 4819457 - DNA, 12 bp, Homo sapiens
tggcttgtaggg

SEQ ID NO: 4819458 - DNA, 22 bp, Homo sapiens
tggctttccacatccccaccct

SEQ ID NO: 4819459 - DNA, 12 bp, Homo sapiens
tggctttgtgct

SEQ ID NO: 4819460 - DNA, 16 bp, Homo sapiens
tggcttttaaacctgt

SEQ ID NO: 4819461 - DNA, 19 bp, Homo sapiens
tggcttttaaacctgttcc

SEQ ID NO: 4819462 - DNA, 21 bp, Homo sapiens
tggcttttaaacctgttcctg

SEQ ID NO: 4819463 - DNA, 12 bp, Homo sapiens
tggcttttaagc

SEQ ID NO: 4819464 - DNA, 14 bp, Homo sapiens
tggcttttaagcca

SEQ ID NO: 4819465 - DNA, 21 bp, Homo sapiens
tgggaaaggaggcatgcctct

SEQ ID NO: 4819466 - DNA, 20 bp, Homo sapiens
tgggaaaggcagggccctga

SEQ ID NO: 4819467 - DNA, 23 bp, Homo sapiens
tgggaaatgctgatttaaacttc

SEQ ID NO: 4819468 - DNA, 17 bp, Homo sapiens
tgggaaattcttgcact

SEQ ID NO: 4819469 - DNA, 16 bp, Homo sapiens
tgggaactctgacaag

SEQ ID NO: 4819470 - DNA, 14 bp, Homo sapiens
tgggaagaaacaaa

SEQ ID NO: 4819471 - DNA, 21 bp, Homo sapiens
tgggaagcagtttcagataaa

SEQ ID NO: 4819472 - DNA, 21 bp, Homo sapiens
tgggaatgaatgtcagtgtga

SEQ ID NO: 4819473 - DNA, 15 bp, Homo sapiens
tgggacagccactgg

SEQ ID NO: 4819474 - DNA, 18 bp, Homo sapiens
tgggacaggcaccatgct

SEQ ID NO: 4819475 - DNA, 19 bp, Homo sapiens
tgggacaggcaccatgctg

SEQ ID NO: 4819476 - DNA, 20 bp, Homo sapiens
tgggactgagcctggcccat

SEQ ID NO: 4819477 - DNA, 16 bp, Homo sapiens
tgggactgctcaggct

SEQ ID NO: 4819478 - DNA, 22 bp, Homo sapiens
tgggagaaccaaaaagaggcta

SEQ ID NO: 4819479 - DNA, 13 bp, Homo sapiens
tgggagaagaggg

SEQ ID NO: 4819480 - DNA, 15 bp, Homo sapiens
tgggagaagaggggt

SEQ ID NO: 4819481 - DNA, 23 bp, Homo sapiens
tgggagagcccctggggcctaga

SEQ ID NO: 4819482 - DNA, 16 bp, Homo sapiens
tgggagatgcagctgg

SEQ ID NO: 4819483 - DNA, 17 bp, Homo sapiens
tgggagatgcagctgga

SEQ ID NO: 4819484 - DNA, 13 bp, Homo sapiens
tgggagccacagg

SEQ ID NO: 4819485 - DNA, 18 bp, Homo sapiens
tgggagccagagcctctg

SEQ ID NO: 4819486 - DNA, 20 bp, Homo sapiens
tgggagccgtcagcctgtga

SEQ ID NO: 4819487 - DNA, 14 bp, Homo sapiens
tgggagtccacttt

SEQ ID NO: 4819488 - DNA, 23 bp, Homo sapiens
tgggagtccactttcctctctct

SEQ ID NO: 4819489 - DNA, 14 bp, Homo sapiens
tgggatccagagag

SEQ ID NO: 4819490 - DNA, 18 bp, Homo sapiens
tgggatccagagagaagc

SEQ ID NO: 4819491 - DNA, 18 bp, Homo sapiens
tgggattcaggaatgggc

SEQ ID NO: 4819492 - DNA, 23 bp, Homo sapiens
tgggcacatagcataggctgggg

SEQ ID NO: 4819493 - DNA, 16 bp, Homo sapiens
tgggcagaaggaagac

SEQ ID NO: 4819494 - DNA, 13 bp, Homo sapiens
tgggcagcaccct

SEQ ID NO: 4819495 - DNA, 22 bp, Homo sapiens
tgggcagctggggggctgtcct

SEQ ID NO: 4819496 - DNA, 12 bp, Homo sapiens
tgggcagggccg

SEQ ID NO: 4819497 - DNA, 16 bp, Homo sapiens
tgggcagggccgcagg

SEQ ID NO: 4819498 - DNA, 18 bp, Homo sapiens
tgggcagggccgcagggc

SEQ ID NO: 4819499 - DNA, 21 bp, Homo sapiens
tgggcagggccgcagggcgct

SEQ ID NO: 4819500 - DNA, 22 bp, Homo sapiens
tgggcagggccgcagggcgctc

SEQ ID NO: 4819501 - DNA, 13 bp, Homo sapiens
tgggcagtggaga

SEQ ID NO: 4819502 - DNA, 21 bp, Homo sapiens
tgggcatggtaccagccctgg

SEQ ID NO: 4819503 - DNA, 11 bp, Homo sapiens
tgggcattgct

SEQ ID NO: 4819504 - DNA, 13 bp, Homo sapiens
tgggccaagccag

SEQ ID NO: 4819505 - DNA, 22 bp, Homo sapiens
tgggccaagccagggttccaga

SEQ ID NO: 4819506 - DNA, 18 bp, Homo sapiens
tgggccccctctcttacc

SEQ ID NO: 4819507 - DNA, 13 bp, Homo sapiens
tgggcccctggga

SEQ ID NO: 4819508 - DNA, 18 bp, Homo sapiens
tgggccctaggcatactc

SEQ ID NO: 4819509 - DNA, 22 bp, Homo sapiens
tgggcctgctgctctctaagaa

SEQ ID NO: 4819510 - DNA, 19 bp, Homo sapiens
tgggcgcctctgtcctggc

SEQ ID NO: 4819511 - DNA, 22 bp, Homo sapiens
tgggcgcctctgtcctggcccg

SEQ ID NO: 4819512 - DNA, 17 bp, Homo sapiens
tgggcgggccatttcac

SEQ ID NO: 4819513 - DNA, 13 bp, Homo sapiens
tgggctcacaccg

SEQ ID NO: 4819514 - DNA, 12 bp, Homo sapiens
tgggctccagag

SEQ ID NO: 4819515 - DNA, 13 bp, Homo sapiens
tgggctccagagt

SEQ ID NO: 4819516 - DNA, 17 bp, Homo sapiens
tgggctggcacccactg

SEQ ID NO: 4819517 - DNA, 20 bp, Homo sapiens
tgggctggcacccactggag

SEQ ID NO: 4819518 - DNA, 12 bp, Homo sapiens
tgggctgtctgt

SEQ ID NO: 4819519 - DNA, 14 bp, Homo sapiens
tgggctgtctgtca

SEQ ID NO: 4819520 - DNA, 12 bp, Homo sapiens
tgggctgtgagg

SEQ ID NO: 4819521 - DNA, 16 bp, Homo sapiens
tgggctgtgaggacag

SEQ ID NO: 4819522 - DNA, 17 bp, Homo sapiens
tgggctgtgaggacagg

SEQ ID NO: 4819523 - DNA, 23 bp, Homo sapiens
tgggcttaataagtcactgacat

SEQ ID NO: 4819524 - DNA, 22 bp, Homo sapiens
tgggcttcatcctcctcagatc

SEQ ID NO: 4819525 - DNA, 19 bp, Homo sapiens
tgggcttggggaccagagc

SEQ ID NO: 4819526 - DNA, 17 bp, Homo sapiens
tggggaaggggcctggg

SEQ ID NO: 4819527 - DNA, 18 bp, Homo sapiens
tggggaaggggcctgggc

SEQ ID NO: 4819528 - DNA, 19 bp, Homo sapiens
tggggaaggggcctgggct

SEQ ID NO: 4819529 - DNA, 23 bp, Homo sapiens
tggggaaggggcctgggctgtga

SEQ ID NO: 4819530 - DNA, 23 bp, Homo sapiens
tggggacacaggatcctggcctg

SEQ ID NO: 4819531 - DNA, 18 bp, Homo sapiens
tggggaccagagctgcca

SEQ ID NO: 4819532 - DNA, 14 bp, Homo sapiens
tggggacctcaggc

SEQ ID NO: 4819533 - DNA, 23 bp, Homo sapiens
tggggacctcaggcctgggggct

SEQ ID NO: 4819534 - DNA, 16 bp, Homo sapiens
tggggacttcccggga

SEQ ID NO: 4819535 - DNA, 22 bp, Homo sapiens
tggggagaggaactccttggcc

SEQ ID NO: 4819536 - DNA, 18 bp, Homo sapiens
tggggagggcctctggac

SEQ ID NO: 4819537 - DNA, 11 bp, Homo sapiens
tggggcagggt

SEQ ID NO: 4819538 - DNA, 16 bp, Homo sapiens
tggggcagggtggggg

SEQ ID NO: 4819539 - DNA, 15 bp, Homo sapiens
tggggcccatggccc

SEQ ID NO: 4819540 - DNA, 23 bp, Homo sapiens
tggggcccatggccccagctggc

SEQ ID NO: 4819541 - DNA, 13 bp, Homo sapiens
aaaaaaaaatatg

SEQ ID NO: 4819542 - DNA, 13 bp, Homo sapiens
aaaaaaaatatga

SEQ ID NO: 4819543 - DNA, 13 bp, Homo sapiens
aaaaaactggaaa

SEQ ID NO: 4819544 - DNA, 15 bp, Homo sapiens
aaaaaactggaaaca

SEQ ID NO: 4819545 - DNA, 10 bp, Homo sapiens
aaaaaatata

SEQ ID NO: 4819546 - DNA, 12 bp, Homo sapiens
aaaaaatgaata

SEQ ID NO: 4819547 - DNA, 15 bp, Homo sapiens
aaaaaatgcgtatat

SEQ ID NO: 4819548 - DNA, 12 bp, Homo sapiens
aaaaagaaaact

SEQ ID NO: 4819549 - DNA, 23 bp, Homo sapiens
aaaaagcaggaaagatcccaagt

SEQ ID NO: 4819550 - DNA, 18 bp, Homo sapiens
aaaaataaaaacataaaa

SEQ ID NO: 4819551 - DNA, 16 bp, Homo sapiens
aaaaataatataaatg

SEQ ID NO: 4819552 - DNA, 20 bp, Homo sapiens
aaaaataatataaatgaatg

SEQ ID NO: 4819553 - DNA, 12 bp, Homo sapiens
aaaaatacagta

SEQ ID NO: 4819554 - DNA, 13 bp, Homo sapiens
aaaaatatatgta

SEQ ID NO: 4819555 - DNA, 15 bp, Homo sapiens
aaaaatattctccat

SEQ ID NO: 4819556 - DNA, 19 bp, Homo sapiens
aaaaatcatcaaagtgttt

SEQ ID NO: 4819557 - DNA, 19 bp, Homo sapiens
aaaaatgaaatttaagcac

SEQ ID NO: 4819558 - DNA, 11 bp, Homo sapiens
aaaaatgaatt

SEQ ID NO: 4819559 - DNA, 18 bp, Homo sapiens
aaaaatgccatcaaatga

SEQ ID NO: 4819560 - DNA, 14 bp, Homo sapiens
aaaaattaattctt

SEQ ID NO: 4819561 - DNA, 14 bp, Homo sapiens
aaaaattatatttt

SEQ ID NO: 4819562 - DNA, 19 bp, Homo sapiens
aaaaattgaagagagatat

SEQ ID NO: 4819563 - DNA, 12 bp, Homo sapiens
aaaaatttaaga

SEQ ID NO: 4819564 - DNA, 13 bp, Homo sapiens
aaaaatttcacga

SEQ ID NO: 4819565 - DNA, 21 bp, Homo sapiens
aaaaatttgacattgtcagaa

SEQ ID NO: 4819566 - DNA, 22 bp, Homo sapiens
aaaaatttgacattgtcagaat

SEQ ID NO: 4819567 - DNA, 22 bp, Homo sapiens
aaaacaagagaccacttcctta

SEQ ID NO: 4819568 - DNA, 18 bp, Homo sapiens
aaaacacaagactgtcat

SEQ ID NO: 4819569 - DNA, 18 bp, Homo sapiens
aaaacagaccagcatagt

SEQ ID NO: 4819570 - DNA, 17 bp, Homo sapiens
aaaacagatttgttcat

SEQ ID NO: 4819571 - DNA, 17 bp, Homo sapiens
aaaacagtgtttccagt

SEQ ID NO: 4819572 - DNA, 12 bp, Homo sapiens
aaaaccagagag

SEQ ID NO: 4819573 - DNA, 24 bp, Homo sapiens
aaaacccttggtctgtgttctcaa

SEQ ID NO: 4819574 - DNA, 16 bp, Homo sapiens
aaaacgatttaattta

SEQ ID NO: 4819575 - DNA, 14 bp, Homo sapiens
aaaactactgcctt

SEQ ID NO: 4819576 - DNA, 21 bp, Homo sapiens
aaaactcctgttttcacacct

SEQ ID NO: 4819577 - DNA, 16 bp, Homo sapiens
aaaactgccacaagca

SEQ ID NO: 4819578 - DNA, 19 bp, Homo sapiens
aaaactgtgacattccaca

SEQ ID NO: 4819579 - DNA, 21 bp, Homo sapiens
aaaactgtgacattccacaga

SEQ ID NO: 4819580 - DNA, 19 bp, Homo sapiens
aaaactgtgaccaagtata

SEQ ID NO: 4819581 - DNA, 16 bp, Homo sapiens
aaaacttctcatttat

SEQ ID NO: 4819582 - DNA, 15 bp, Homo sapiens
aaaactttattttat

SEQ ID NO: 4819583 - DNA, 20 bp, Homo sapiens
aaaactttattttatataat

SEQ ID NO: 4819584 - DNA, 12 bp, Homo sapiens
aaaactttccat

SEQ ID NO: 4819585 - DNA, 15 bp, Homo sapiens
aaaactttccatgac

SEQ ID NO: 4819586 - DNA, 17 bp, Homo sapiens
aaaactttccatgacag

SEQ ID NO: 4819587 - DNA, 15 bp, Homo sapiens
aaaacttttataaat

SEQ ID NO: 4819588 - DNA, 18 bp, Homo sapiens
aaaacttttataaattaa

SEQ ID NO: 4819589 - DNA, 22 bp, Homo sapiens
aaaacttttataaattaaatat

SEQ ID NO: 4819590 - DNA, 19 bp, Homo sapiens
aaaagaccatgcattcaga

SEQ ID NO: 4819591 - DNA, 21 bp, Homo sapiens
aaaagagaccacccatatcat

SEQ ID NO: 4819592 - DNA, 15 bp, Homo sapiens
aaaagatattgtatt

SEQ ID NO: 4819593 - DNA, 23 bp, Homo sapiens
aaaagatattgtattatcatata

SEQ ID NO: 4819594 - DNA, 18 bp, Homo sapiens
aaaagcccatgcttaaat

SEQ ID NO: 4819595 - DNA, 18 bp, Homo sapiens
aaaagcctgcatcgggga

SEQ ID NO: 4819596 - DNA, 16 bp, Homo sapiens
aaaagctatcttcatg

SEQ ID NO: 4819597 - DNA, 22 bp, Homo sapiens
aaaaggctggatgtgctttcat

SEQ ID NO: 4819598 - DNA, 20 bp, Homo sapiens
aaaagtatattcaaaaatta

SEQ ID NO: 4819599 - DNA, 15 bp, Homo sapiens
aaaagtcagatgttt

SEQ ID NO: 4819600 - DNA, 19 bp, Homo sapiens
aaaagtcttaggtgaacaa

SEQ ID NO: 4819601 - DNA, 19 bp, Homo sapiens
aaaagtgatgtgatttatg

SEQ ID NO: 4819602 - DNA, 21 bp, Homo sapiens
aaaagtgatgtgatttatgca

SEQ ID NO: 4819603 - DNA, 15 bp, Homo sapiens
aaaagtgcaacttga

SEQ ID NO: 4819604 - DNA, 18 bp, Homo sapiens
aaaagtgtttttacatat

SEQ ID NO: 4819605 - DNA, 14 bp, Homo sapiens
aaaagttgcacatt

SEQ ID NO: 4819606 - DNA, 12 bp, Homo sapiens
aaaagttttcaa

SEQ ID NO: 4819607 - DNA, 14 bp, Homo sapiens
aaaataaaaccaga

SEQ ID NO: 4819608 - DNA, 13 bp, Homo sapiens
aaaataaatgttt

SEQ ID NO: 4819609 - DNA, 19 bp, Homo sapiens
aaaataaatgttttggaat

SEQ ID NO: 4819610 - DNA, 13 bp, Homo sapiens
aaaataatctgaa

SEQ ID NO: 4819611 - DNA, 14 bp, Homo sapiens
aaaataatgattta

SEQ ID NO: 4819612 - DNA, 19 bp, Homo sapiens
aaaatacagtattatttag

SEQ ID NO: 4819613 - DNA, 15 bp, Homo sapiens
aaaatacatactata

SEQ ID NO: 4819614 - DNA, 18 bp, Homo sapiens
aaaatactattggacaga

SEQ ID NO: 4819615 - DNA, 12 bp, Homo sapiens
aaaatacttctt

SEQ ID NO: 4819616 - DNA, 22 bp, Homo sapiens
aaaatagtcatgtttctgcagt

SEQ ID NO: 4819617 - DNA, 16 bp, Homo sapiens
aaaatatatgtaatat

SEQ ID NO: 4819618 - DNA, 20 bp, Homo sapiens
aaaatatatgtaatatatac

SEQ ID NO: 4819619 - DNA, 15 bp, Homo sapiens
aaaatattctgtcat

SEQ ID NO: 4819620 - DNA, 16 bp, Homo sapiens
aaaatattctgtcatt

SEQ ID NO: 4819621 - DNA, 20 bp, Homo sapiens
aaaatattgtttaatgcaaa

SEQ ID NO: 4819622 - DNA, 16 bp, Homo sapiens
aaaatatttataaatg

SEQ ID NO: 4819623 - DNA, 12 bp, Homo sapiens
aaaatattttct

SEQ ID NO: 4819624 - DNA, 19 bp, Homo sapiens
aaaatattttcttaattat

SEQ ID NO: 4819625 - DNA, 11 bp, Homo sapiens
aaaatctccta

SEQ ID NO: 4819626 - DNA, 20 bp, Homo sapiens
aaaatgaactaactgccatg

SEQ ID NO: 4819627 - DNA, 19 bp, Homo sapiens
aaaatgagaatctgtgcag

SEQ ID NO: 4819628 - DNA, 13 bp, Homo sapiens
aaaatgattgtct

SEQ ID NO: 4819629 - DNA, 17 bp, Homo sapiens
aaaatgccatcaaatga

SEQ ID NO: 4819630 - DNA, 16 bp, Homo sapiens
aaaatgctgttctcaa

SEQ ID NO: 4819631 - DNA, 21 bp, Homo sapiens
aaaatgctgttctcaatcatt

SEQ ID NO: 4819632 - DNA, 20 bp, Homo sapiens
aaaatgcttgaccctgaaat

SEQ ID NO: 4819633 - DNA, 13 bp, Homo sapiens
aaaatgctttctc

SEQ ID NO: 4819634 - DNA, 17 bp, Homo sapiens
aaaatggatgacaaaga

SEQ ID NO: 4819635 - DNA, 12 bp, Homo sapiens
aaaatggcattt

SEQ ID NO: 4819636 - DNA, 16 bp, Homo sapiens
aaaatggcatttagca

SEQ ID NO: 4819637 - DNA, 15 bp, Homo sapiens
aaaatggctgaagaa

SEQ ID NO: 4819638 - DNA, 23 bp, Homo sapiens
aaaatggtgttttcatgtaaata

SEQ ID NO: 4819639 - DNA, 20 bp, Homo sapiens
aaaatgtcaatttttaactt

SEQ ID NO: 4819640 - DNA, 15 bp, Homo sapiens
aaaatgtgtgcttgg

SEQ ID NO: 4819641 - DNA, 19 bp, Homo sapiens
aaaatgtgtgcttggaaaa

SEQ ID NO: 4819642 - DNA, 23 bp, Homo sapiens
aaaatgttcattctatgacaata

SEQ ID NO: 4819643 - DNA, 18 bp, Homo sapiens
aaaatgtttatttttgct

SEQ ID NO: 4819644 - DNA, 16 bp, Homo sapiens
aaaattaattctttat

SEQ ID NO: 4819645 - DNA, 23 bp, Homo sapiens
aaaattagtgagatttgtattta

SEQ ID NO: 4819646 - DNA, 12 bp, Homo sapiens
aaaattatctgt

SEQ ID NO: 4819647 - DNA, 13 bp, Homo sapiens
aaaattatctgtt

SEQ ID NO: 4819648 - DNA, 16 bp, Homo sapiens
aaaattatctgttcta

SEQ ID NO: 4819649 - DNA, 14 bp, Homo sapiens
aaaattatctttaa

SEQ ID NO: 4819650 - DNA, 16 bp, Homo sapiens
aaaattatctttaaaa

SEQ ID NO: 4819651 - DNA, 18 bp, Homo sapiens
aaaattattaaaaattat

SEQ ID NO: 4819652 - DNA, 19 bp, Homo sapiens
aaaattattaaaaattata

SEQ ID NO: 4819653 - DNA, 15 bp, Homo sapiens
aaaattcattccatt

SEQ ID NO: 4819654 - DNA, 18 bp, Homo sapiens
aaaattgcagcagttgct

SEQ ID NO: 4819655 - DNA, 16 bp, Homo sapiens
aaaattggttaatgaa

SEQ ID NO: 4819656 - DNA, 20 bp, Homo sapiens
aaaatttatgtcattttcag

SEQ ID NO: 4819657 - DNA, 20 bp, Homo sapiens
aaaattttcttctttaattt

SEQ ID NO: 4819658 - DNA, 14 bp, Homo sapiens
aaacaaaaactttc

SEQ ID NO: 4819659 - DNA, 15 bp, Homo sapiens
aaacaaaaactttcc

SEQ ID NO: 4819660 - DNA, 18 bp, Homo sapiens
aaacaaaaactttccatg

SEQ ID NO: 4819661 - DNA, 23 bp, Homo sapiens
aaacaaaaactttccatgacagt

SEQ ID NO: 4819662 - DNA, 22 bp, Homo sapiens
aaacaaaatccttgccttcaaa

SEQ ID NO: 4819663 - DNA, 17 bp, Homo sapiens
aaacaaatatttcactt

SEQ ID NO: 4819664 - DNA, 17 bp, Homo sapiens
aaacaaatcattttgat

SEQ ID NO: 4819665 - DNA, 15 bp, Homo sapiens
aaacaaattccttcc

SEQ ID NO: 4819666 - DNA, 13 bp, Homo sapiens
aaacaacagcaac

SEQ ID NO: 4819667 - DNA, 21 bp, Homo sapiens
aaacaacctgccacaatgtga

SEQ ID NO: 4819668 - DNA, 21 bp, Homo sapiens
aaacaagtctcattagctctc

SEQ ID NO: 4819669 - DNA, 13 bp, Homo sapiens
aaacaatttattt

SEQ ID NO: 4819670 - DNA, 16 bp, Homo sapiens
aaacaatttattttat

SEQ ID NO: 4819671 - DNA, 18 bp, Homo sapiens
aaacacaaaacaaatcct

SEQ ID NO: 4819672 - DNA, 17 bp, Homo sapiens
aaacacacagtgaccaa

SEQ ID NO: 4819673 - DNA, 18 bp, Homo sapiens
aaacacatagattcacct

SEQ ID NO: 4819674 - DNA, 16 bp, Homo sapiens
aaacacggagtttcca

SEQ ID NO: 4819675 - DNA, 13 bp, Homo sapiens
aaacactgtgtat

SEQ ID NO: 4819676 - DNA, 18 bp, Homo sapiens
aaacacttcattgaaaat

SEQ ID NO: 4819677 - DNA, 14 bp, Homo sapiens
aaacagaaaaacaa

SEQ ID NO: 4819678 - DNA, 15 bp, Homo sapiens
aaacagaaaaacaaa

SEQ ID NO: 4819679 - DNA, 17 bp, Homo sapiens
aaacagatttgttcatt

SEQ ID NO: 4819680 - DNA, 14 bp, Homo sapiens
aaacaggaaaaaaa

SEQ ID NO: 4819681 - DNA, 23 bp, Homo sapiens
aaacagtgtggcttaaacatttt

SEQ ID NO: 4819682 - DNA, 14 bp, Homo sapiens
aaacagtgtttcca

SEQ ID NO: 4819683 - DNA, 13 bp, Homo sapiens
aaacagtttaaca

SEQ ID NO: 4819684 - DNA, 18 bp, Homo sapiens
aaacataaaatatacaaa

SEQ ID NO: 4819685 - DNA, 18 bp, Homo sapiens
aaacatagtggtatttta

SEQ ID NO: 4819686 - DNA, 19 bp, Homo sapiens
aaacatagtggtattttaa

SEQ ID NO: 4819687 - DNA, 18 bp, Homo sapiens
aaacatctcatcatgtct

SEQ ID NO: 4819688 - DNA, 23 bp, Homo sapiens
aaacatctcatcatgtctattgt

SEQ ID NO: 4819689 - DNA, 13 bp, Homo sapiens
aaacatctgattt

SEQ ID NO: 4819690 - DNA, 13 bp, Homo sapiens
aaacatgacactg

SEQ ID NO: 4819691 - DNA, 16 bp, Homo sapiens
aaacatttccctgctg

SEQ ID NO: 4819692 - DNA, 20 bp, Homo sapiens
aaacatttccctgctgagtg

SEQ ID NO: 4819693 - DNA, 15 bp, Homo sapiens
aaaccaactctctac

SEQ ID NO: 4819694 - DNA, 16 bp, Homo sapiens
aaaccaatttgttctg

SEQ ID NO: 4819695 - DNA, 21 bp, Homo sapiens
aaaccacaactgacacaggaa

SEQ ID NO: 4819696 - DNA, 12 bp, Homo sapiens
aaaccagaaaga

SEQ ID NO: 4819697 - DNA, 15 bp, Homo sapiens
aaaccaggctgcagg

SEQ ID NO: 4819698 - DNA, 18 bp, Homo sapiens
aaaccatctggcctggcc

SEQ ID NO: 4819699 - DNA, 17 bp, Homo sapiens
aaaccattgcttcacta

SEQ ID NO: 4819700 - DNA, 15 bp, Homo sapiens
aaacccacataaaca

SEQ ID NO: 4819701 - DNA, 19 bp, Homo sapiens
aaacccggggaactggttt

SEQ ID NO: 4819702 - DNA, 17 bp, Homo sapiens
aaaccgacgacaaatct

SEQ ID NO: 4819703 - DNA, 11 bp, Homo sapiens
aaacctacctt

SEQ ID NO: 4819704 - DNA, 21 bp, Homo sapiens
aaacctgaggccaaatattga

SEQ ID NO: 4819705 - DNA, 16 bp, Homo sapiens
aaacctgtgctttcat

SEQ ID NO: 4819706 - DNA, 16 bp, Homo sapiens
aaacctgttcctgact

SEQ ID NO: 4819707 - DNA, 18 bp, Homo sapiens
aaacctgttcctgactgt

SEQ ID NO: 4819708 - DNA, 24 bp, Homo sapiens
aaacctgttcctgactgttctctt

SEQ ID NO: 4819709 - DNA, 13 bp, Homo sapiens
aaaccttaatatt

SEQ ID NO: 4819710 - DNA, 14 bp, Homo sapiens
aaaccttaatattt

SEQ ID NO: 4819711 - DNA, 19 bp, Homo sapiens
aaaccttcttttcaatgca

SEQ ID NO: 4819712 - DNA, 19 bp, Homo sapiens
aaacctttggctacacaat

SEQ ID NO: 4819713 - DNA, 21 bp, Homo sapiens
aaactaccaccctcgctgcca

SEQ ID NO: 4819714 - DNA, 13 bp, Homo sapiens
aaactactgcctt

SEQ ID NO: 4819715 - DNA, 17 bp, Homo sapiens
aaactcaaaatctggga

SEQ ID NO: 4819716 - DNA, 18 bp, Homo sapiens
aaactcttagagaataag

SEQ ID NO: 4819717 - DNA, 16 bp, Homo sapiens
aaactgagaccaagtc

SEQ ID NO: 4819718 - DNA, 11 bp, Homo sapiens
aaactgcattt

SEQ ID NO: 4819719 - DNA, 14 bp, Homo sapiens
aaactggaaacatc

SEQ ID NO: 4819720 - DNA, 15 bp, Homo sapiens
aaactggaaacatct

SEQ ID NO: 4819721 - DNA, 21 bp, Homo sapiens
aaactgggtgttcaaggccct

SEQ ID NO: 4819722 - DNA, 12 bp, Homo sapiens
aaactgtattta

SEQ ID NO: 4819723 - DNA, 18 bp, Homo sapiens
aaactgtatttacttgtt

SEQ ID NO: 4819724 - DNA, 18 bp, Homo sapiens
aaactgtgagataaatat

SEQ ID NO: 4819725 - DNA, 20 bp, Homo sapiens
aaactgtttatggtattttc

SEQ ID NO: 4819726 - DNA, 12 bp, Homo sapiens
aaacttcagcaa

SEQ ID NO: 4819727 - DNA, 16 bp, Homo sapiens
aaacttcagcaaccct

SEQ ID NO: 4819728 - DNA, 12 bp, Homo sapiens
aaacttctcatt

SEQ ID NO: 4819729 - DNA, 19 bp, Homo sapiens
aaacttctcatttatgtta

SEQ ID NO: 4819730 - DNA, 20 bp, Homo sapiens
aaacttctcatttatgttat

SEQ ID NO: 4819731 - DNA, 19 bp, Homo sapiens
aaacttgtgtatgatccaa

SEQ ID NO: 4819732 - DNA, 14 bp, Homo sapiens
aaactttattttat

SEQ ID NO: 4819733 - DNA, 12 bp, Homo sapiens
aaactttgtcac

SEQ ID NO: 4819734 - DNA, 16 bp, Homo sapiens
aaactttgtcacttct

SEQ ID NO: 4819735 - DNA, 13 bp, Homo sapiens
aaacttttataaa

SEQ ID NO: 4819736 - DNA, 15 bp, Homo sapiens
aaacttttataaatg

SEQ ID NO: 4819737 - DNA, 19 bp, Homo sapiens
aaacttttataaattaaat

SEQ ID NO: 4819738 - DNA, 13 bp, Homo sapiens
aaacttttcaagg

SEQ ID NO: 4819739 - DNA, 22 bp, Homo sapiens
aaagaaattagggctctaattt

SEQ ID NO: 4819740 - DNA, 15 bp, Homo sapiens
aaagaacagctaaca

SEQ ID NO: 4819741 - DNA, 21 bp, Homo sapiens
aaagaaccaggaggcctggga

SEQ ID NO: 4819742 - DNA, 20 bp, Homo sapiens
aaagaacccccctccccaag

SEQ ID NO: 4819743 - DNA, 15 bp, Homo sapiens
aaagaacggaagaag

SEQ ID NO: 4819744 - DNA, 19 bp, Homo sapiens
aaagaacggaagaagagat

SEQ ID NO: 4819745 - DNA, 19 bp, Homo sapiens
aaagaagagtttacagaca

SEQ ID NO: 4819746 - DNA, 15 bp, Homo sapiens
aaagaagtccatgtg

SEQ ID NO: 4819747 - DNA, 21 bp, Homo sapiens
aaagaatccctgttcattgta

SEQ ID NO: 4819748 - DNA, 14 bp, Homo sapiens
aaagacagtttctt

SEQ ID NO: 4819749 - DNA, 17 bp, Homo sapiens
aaagaccatgcattcag

SEQ ID NO: 4819750 - DNA, 23 bp, Homo sapiens
aaagaccatgcattcagatctga

SEQ ID NO: 4819751 - DNA, 17 bp, Homo sapiens
aaagaccctaggtgctc

SEQ ID NO: 4819752 - DNA, 18 bp, Homo sapiens
aaagagaaaacatctcat

SEQ ID NO: 4819753 - DNA, 18 bp, Homo sapiens
aaagagctgttttggatg

SEQ ID NO: 4819754 - DNA, 18 bp, Homo sapiens
aaagaggcgtcttgtatt

SEQ ID NO: 4819755 - DNA, 22 bp, Homo sapiens
aaagagttatatgacttcttgt

SEQ ID NO: 4819756 - DNA, 18 bp, Homo sapiens
aaagatattgtatctcct

SEQ ID NO: 4819757 - DNA, 14 bp, Homo sapiens
aaagatctcctgtg

SEQ ID NO: 4819758 - DNA, 16 bp, Homo sapiens
aaagatgcagccgcct

SEQ ID NO: 4819759 - DNA, 20 bp, Homo sapiens
aaagcaaaccttaatttgaa

SEQ ID NO: 4819760 - DNA, 15 bp, Homo sapiens
aaagcacctcttgaa

SEQ ID NO: 4819761 - DNA, 17 bp, Homo sapiens
aaagcactggccttgcc

SEQ ID NO: 4819762 - DNA, 20 bp, Homo sapiens
aaagcaggaaagatcccaag

SEQ ID NO: 4819763 - DNA, 21 bp, Homo sapiens
aaagcagtatgtacaggctga

SEQ ID NO: 4819764 - DNA, 13 bp, Homo sapiens
aaagcagtgcatg

SEQ ID NO: 4819765 - DNA, 16 bp, Homo sapiens
aaagcatatataaaac

SEQ ID NO: 4819766 - DNA, 13 bp, Homo sapiens
aaagcatgctcag

SEQ ID NO: 4819767 - DNA, 20 bp, Homo sapiens
aaagccacataaccagcggg

SEQ ID NO: 4819768 - DNA, 17 bp, Homo sapiens
aaagccctcccccttcc

SEQ ID NO: 4819769 - DNA, 17 bp, Homo sapiens
aaagccctccctgtctg

SEQ ID NO: 4819770 - DNA, 16 bp, Homo sapiens
aaagcccttctcaaga

SEQ ID NO: 4819771 - DNA, 17 bp, Homo sapiens
aaagcctgtgttactga

SEQ ID NO: 4819772 - DNA, 18 bp, Homo sapiens
aaagctagaggagattgc

SEQ ID NO: 4819773 - DNA, 19 bp, Homo sapiens
aaagctgctttccatggca

SEQ ID NO: 4819774 - DNA, 12 bp, Homo sapiens
aaaggaaacctt

SEQ ID NO: 4819775 - DNA, 14 bp, Homo sapiens
aaaggaaacctttt

SEQ ID NO: 4819776 - DNA, 21 bp, Homo sapiens
aaaggaaagttctattatctg

SEQ ID NO: 4819777 - DNA, 14 bp, Homo sapiens
aaaggacagctcag

SEQ ID NO: 4819778 - DNA, 14 bp, Homo sapiens
aaaggagagtactt

SEQ ID NO: 4819779 - DNA, 16 bp, Homo sapiens
aaaggaggcatgcctc

SEQ ID NO: 4819780 - DNA, 20 bp, Homo sapiens
aaaggatgcccaaagatgca

SEQ ID NO: 4819781 - DNA, 19 bp, Homo sapiens
aaaggcttgagtctggata

SEQ ID NO: 4819782 - DNA, 17 bp, Homo sapiens
aaagggcagcccctccc

SEQ ID NO: 4819783 - DNA, 23 bp, Homo sapiens
aaagggtcaggttagggctcctg

SEQ ID NO: 4819784 - DNA, 15 bp, Homo sapiens
aaaggtagactttta

SEQ ID NO: 4819785 - DNA, 21 bp, Homo sapiens
aaaggtagcttacctgacaca

SEQ ID NO: 4819786 - DNA, 14 bp, Homo sapiens
aaaggtaggtgcat

SEQ ID NO: 4819787 - DNA, 18 bp, Homo sapiens
aaaggtgatgaatttacc

SEQ ID NO: 4819788 - DNA, 15 bp, Homo sapiens
aaaggtgattgtcac

SEQ ID NO: 4819789 - DNA, 22 bp, Homo sapiens
aaaggttcttcatccctttcca

SEQ ID NO: 4819790 - DNA, 18 bp, Homo sapiens
aaagtaataactgttaga

SEQ ID NO: 4819791 - DNA, 14 bp, Homo sapiens
aaagtactagcaat

SEQ ID NO: 4819792 - DNA, 12 bp, Homo sapiens
aaagtagtactt

SEQ ID NO: 4819793 - DNA, 19 bp, Homo sapiens
aaagtagtacttcttctgt

SEQ ID NO: 4819794 - DNA, 20 bp, Homo sapiens
aaagtagtacttcttctgta

SEQ ID NO: 4819795 - DNA, 21 bp, Homo sapiens
aaagtagtacttcttctgtaa

SEQ ID NO: 4819796 - DNA, 13 bp, Homo sapiens
aaagtatattcaa

SEQ ID NO: 4819797 - DNA, 18 bp, Homo sapiens
aaagtattccaccttaaa

SEQ ID NO: 4819798 - DNA, 20 bp, Homo sapiens
aaagtcaagtctacctgcct

SEQ ID NO: 4819799 - DNA, 18 bp, Homo sapiens
aaagtctcaatgaaatag

SEQ ID NO: 4819800 - DNA, 18 bp, Homo sapiens
aaagtcttgaatgttgaa

SEQ ID NO: 4819801 - DNA, 12 bp, Homo sapiens
aaagtgaaatta

SEQ ID NO: 4819802 - DNA, 23 bp, Homo sapiens
aaagtgaccaggctcacaactgt

SEQ ID NO: 4819803 - DNA, 19 bp, Homo sapiens
aaagtgattccttcttgct

SEQ ID NO: 4819804 - DNA, 15 bp, Homo sapiens
aaagtgcacacacac

SEQ ID NO: 4819805 - DNA, 20 bp, Homo sapiens
aaagtgtttaattgtataaa

SEQ ID NO: 4819806 - DNA, 18 bp, Homo sapiens
aaagtgtttttacatata

SEQ ID NO: 4819807 - DNA, 12 bp, Homo sapiens
aaagttaaaaag

SEQ ID NO: 4819808 - DNA, 19 bp, Homo sapiens
aaagttctattatctgggt

SEQ ID NO: 4819809 - DNA, 12 bp, Homo sapiens
aaagttttcaga

SEQ ID NO: 4819810 - DNA, 22 bp, Homo sapiens
aaagttttcagattgtaaaggt

SEQ ID NO: 4819811 - DNA, 13 bp, Homo sapiens
aaagttttgccta

SEQ ID NO: 4819812 - DNA, 13 bp, Homo sapiens
aaataaaaatatt

SEQ ID NO: 4819813 - DNA, 16 bp, Homo sapiens
aaataaaaatattctc

SEQ ID NO: 4819814 - DNA, 20 bp, Homo sapiens
aaataaaaatattctccatg

SEQ ID NO: 4819815 - DNA, 17 bp, Homo sapiens
aaataaaaccagaaaga

SEQ ID NO: 4819816 - DNA, 11 bp, Homo sapiens
aaataaaagaa

SEQ ID NO: 4819817 - DNA, 21 bp, Homo sapiens
aaataaacacatagattcacc

SEQ ID NO: 4819818 - DNA, 23 bp, Homo sapiens
aaataaacacatagattcacctg

SEQ ID NO: 4819819 - DNA, 11 bp, Homo sapiens
aaataaatgtt

SEQ ID NO: 4819820 - DNA, 13 bp, Homo sapiens
aaataaccctgaa

SEQ ID NO: 4819821 - DNA, 18 bp, Homo sapiens
aaataatcatacacagaa

SEQ ID NO: 4819822 - DNA, 12 bp, Homo sapiens
aaataatctgaa

SEQ ID NO: 4819823 - DNA, 17 bp, Homo sapiens
aaataatgattcaatgt

SEQ ID NO: 4819824 - DNA, 12 bp, Homo sapiens
aaataatgattt

SEQ ID NO: 4819825 - DNA, 13 bp, Homo sapiens
aaataatgattta

SEQ ID NO: 4819826 - DNA, 23 bp, Homo sapiens
aaatacattattgaaaagcaaat

SEQ ID NO: 4819827 - DNA, 16 bp, Homo sapiens
aaatacctattcaaga

SEQ ID NO: 4819828 - DNA, 23 bp, Homo sapiens
aaataccttagctcccttgagct

SEQ ID NO: 4819829 - DNA, 22 bp, Homo sapiens
aaatacttgaaaacttctcatt

SEQ ID NO: 4819830 - DNA, 13 bp, Homo sapiens
aaatacttgacaa

SEQ ID NO: 4819831 - DNA, 14 bp, Homo sapiens
aaatagcttttcac

SEQ ID NO: 4819832 - DNA, 20 bp, Homo sapiens
aaatagcttttcacttctta

SEQ ID NO: 4819833 - DNA, 21 bp, Homo sapiens
aaatagcttttcacttcttaa

SEQ ID NO: 4819834 - DNA, 18 bp, Homo sapiens
aaatagggcaaagaatca

SEQ ID NO: 4819835 - DNA, 16 bp, Homo sapiens
aaatagtcatgtttct

SEQ ID NO: 4819836 - DNA, 18 bp, Homo sapiens
aaatagtgtgtccatgca

SEQ ID NO: 4819837 - DNA, 21 bp, Homo sapiens
aaatagtgttctttttaaaaa

SEQ ID NO: 4819838 - DNA, 17 bp, Homo sapiens
aaatataaactgtgaga

SEQ ID NO: 4819839 - DNA, 14 bp, Homo sapiens
aaatataaacttgt

SEQ ID NO: 4819840 - DNA, 20 bp, Homo sapiens
aaatataaacttgtgtatga

SEQ ID NO: 4819841 - DNA, 17 bp, Homo sapiens
aaatataacatgaaagt

SEQ ID NO: 4819842 - DNA, 14 bp, Homo sapiens
aaatatacaaacat

SEQ ID NO: 4819843 - DNA, 20 bp, Homo sapiens
aaatatacaaacatgtggca

SEQ ID NO: 4819844 - DNA, 19 bp, Homo sapiens
aaatatacaactttggaat

SEQ ID NO: 4819845 - DNA, 16 bp, Homo sapiens
aaatatactcatttgg

SEQ ID NO: 4819846 - DNA, 18 bp, Homo sapiens
aaatatagtgttgtgtta

SEQ ID NO: 4819847 - DNA, 21 bp, Homo sapiens
aaatatagtgttgtgttacaa

SEQ ID NO: 4819848 - DNA, 13 bp, Homo sapiens
aaatatatatata

SEQ ID NO: 4819849 - DNA, 15 bp, Homo sapiens
aaatatatgtatgta

SEQ ID NO: 4819850 - DNA, 14 bp, Homo sapiens
aaatatcattatag

SEQ ID NO: 4819851 - DNA, 15 bp, Homo sapiens
aaatatctatttatc

SEQ ID NO: 4819852 - DNA, 17 bp, Homo sapiens
aaatatctctatttaat

SEQ ID NO: 4819853 - DNA, 17 bp, Homo sapiens
aaatatgagattggaaa

SEQ ID NO: 4819854 - DNA, 16 bp, Homo sapiens
aaatatgtgtacacat

SEQ ID NO: 4819855 - DNA, 12 bp, Homo sapiens
aaatattctgtc

SEQ ID NO: 4819856 - DNA, 13 bp, Homo sapiens
aaatattctgtca

SEQ ID NO: 4819857 - DNA, 19 bp, Homo sapiens
aaatattgctattgtttat

SEQ ID NO: 4819858 - DNA, 19 bp, Homo sapiens
aaatattgtttaatgcaaa

SEQ ID NO: 4819859 - DNA, 20 bp, Homo sapiens
aaatattgtttaatgcaaat

SEQ ID NO: 4819860 - DNA, 16 bp, Homo sapiens
aaatatttgcttattt

SEQ ID NO: 4819861 - DNA, 13 bp, Homo sapiens
aaatattttctac

SEQ ID NO: 4819862 - DNA, 16 bp, Homo sapiens
aaatattttctacttt

SEQ ID NO: 4819863 - DNA, 17 bp, Homo sapiens
aaatattttctacttta

SEQ ID NO: 4819864 - DNA, 21 bp, Homo sapiens
aaatattttctactttaaatt

SEQ ID NO: 4819865 - DNA, 22 bp, Homo sapiens
aaatattttctactttaaattg

SEQ ID NO: 4819866 - DNA, 16 bp, Homo sapiens
aaatattttcttaatt

SEQ ID NO: 4819867 - DNA, 19 bp, Homo sapiens
aaatattttcttaattatg

SEQ ID NO: 4819868 - DNA, 12 bp, Homo sapiens
aaatcaaggtga

SEQ ID NO: 4819869 - DNA, 13 bp, Homo sapiens
aaatcaatttaaa

SEQ ID NO: 4819870 - DNA, 22 bp, Homo sapiens
aaatcacaaactcatccattaa

SEQ ID NO: 4819871 - DNA, 17 bp, Homo sapiens
aaatcacagatttccaa

SEQ ID NO: 4819872 - DNA, 21 bp, Homo sapiens
aaatcacagatttccaaaagt

SEQ ID NO: 4819873 - DNA, 22 bp, Homo sapiens
aaatcatatttacctgtgaatc

SEQ ID NO: 4819874 - DNA, 14 bp, Homo sapiens
aaatcatcaaagtg

SEQ ID NO: 4819875 - DNA, 14 bp, Homo sapiens
aaatcatgggcatt

SEQ ID NO: 4819876 - DNA, 14 bp, Homo sapiens
aaatcattttgatg

SEQ ID NO: 4819877 - DNA, 17 bp, Homo sapiens
aaatcattttgatgtat

SEQ ID NO: 4819878 - DNA, 20 bp, Homo sapiens
aaatcattttgatgtattat

SEQ ID NO: 4819879 - DNA, 18 bp, Homo sapiens
aaatccacaccagtccac

SEQ ID NO: 4819880 - DNA, 16 bp, Homo sapiens
aaatccataccccctg

SEQ ID NO: 4819881 - DNA, 18 bp, Homo sapiens
aaatcctgttacttaaat

SEQ ID NO: 4819882 - DNA, 17 bp, Homo sapiens
aaatccttgccttcaaa

SEQ ID NO: 4819883 - DNA, 22 bp, Homo sapiens
aaatctaaattaacttctattt

SEQ ID NO: 4819884 - DNA, 15 bp, Homo sapiens
aaatctaacattatt

SEQ ID NO: 4819885 - DNA, 14 bp, Homo sapiens
aaatctatctctat

SEQ ID NO: 4819886 - DNA, 14 bp, Homo sapiens
aaatctgaagcctt

SEQ ID NO: 4819887 - DNA, 15 bp, Homo sapiens
aaatctgtattgcta

SEQ ID NO: 4819888 - DNA, 20 bp, Homo sapiens
aaatcttacccttcaatgtt

SEQ ID NO: 4819889 - DNA, 14 bp, Homo sapiens
aaatgaaaatggct

SEQ ID NO: 4819890 - DNA, 16 bp, Homo sapiens
aaatgaactaactgcc

SEQ ID NO: 4819891 - DNA, 19 bp, Homo sapiens
aaatgaactaactgccatg

SEQ ID NO: 4819892 - DNA, 21 bp, Homo sapiens
aaatgaataatgcctttgtaa

SEQ ID NO: 4819893 - DNA, 21 bp, Homo sapiens
aaatgaatagtacatgcagaa

SEQ ID NO: 4819894 - DNA, 13 bp, Homo sapiens
aaatgataaggtt

SEQ ID NO: 4819895 - DNA, 17 bp, Homo sapiens
aaatgatatgtctttaa

SEQ ID NO: 4819896 - DNA, 19 bp, Homo sapiens
aaatgatatgtctttaaaa

SEQ ID NO: 4819897 - DNA, 19 bp, Homo sapiens
aaatgatctgtactatcta

SEQ ID NO: 4819898 - DNA, 22 bp, Homo sapiens
aaatgattcacttttattgtat

SEQ ID NO: 4819899 - DNA, 17 bp, Homo sapiens
aaatgcaaacactgtgt

SEQ ID NO: 4819900 - DNA, 13 bp, Homo sapiens
aaatgcagtgtat

SEQ ID NO: 4819901 - DNA, 18 bp, Homo sapiens
aaatgccaagactctatg

SEQ ID NO: 4819902 - DNA, 18 bp, Homo sapiens
aaatgctaaatgcaaaca

SEQ ID NO: 4819903 - DNA, 13 bp, Homo sapiens
aaatgctgctttg

SEQ ID NO: 4819904 - DNA, 11 bp, Homo sapiens
aaatgctttct

SEQ ID NO: 4819905 - DNA, 12 bp, Homo sapiens
aaatgctttctc

SEQ ID NO: 4819906 - DNA, 17 bp, Homo sapiens
aaatggaagtggcaata

SEQ ID NO: 4819907 - DNA, 17 bp, Homo sapiens
aaatggatagattgttt

SEQ ID NO: 4819908 - DNA, 19 bp, Homo sapiens
aaatggatgacaaagaaaa

SEQ ID NO: 4819909 - DNA, 14 bp, Homo sapiens
aaatggatgtaata

SEQ ID NO: 4819910 - DNA, 23 bp, Homo sapiens
aaatggcatttagcacagtattt

SEQ ID NO: 4819911 - DNA, 21 bp, Homo sapiens
aaatggcctgtccctagggct

SEQ ID NO: 4819912 - DNA, 15 bp, Homo sapiens
aaatggctgaagaaa

SEQ ID NO: 4819913 - DNA, 22 bp, Homo sapiens
aaatggctgaagaaacacagca

SEQ ID NO: 4819914 - DNA, 23 bp, Homo sapiens
aaatggctgaagaaacacagcat

SEQ ID NO: 4819915 - DNA, 14 bp, Homo sapiens
aaatggctttccac

SEQ ID NO: 4819916 - DNA, 23 bp, Homo sapiens
aaatgtaaaatatttataaatga

SEQ ID NO: 4819917 - DNA, 13 bp, Homo sapiens
aaatgtaactgtc

SEQ ID NO: 4819918 - DNA, 21 bp, Homo sapiens
aaatgtaactgtccgtagtat

SEQ ID NO: 4819919 - DNA, 18 bp, Homo sapiens
aaatgtactacatttgca

SEQ ID NO: 4819920 - DNA, 21 bp, Homo sapiens
aaatgtactacatttgcatgc

SEQ ID NO: 4819921 - DNA, 16 bp, Homo sapiens
aaatgtctataaatgg

SEQ ID NO: 4819922 - DNA, 16 bp, Homo sapiens
aaatgtggatgctctt

SEQ ID NO: 4819923 - DNA, 14 bp, Homo sapiens
aaatgtgtgtatgt

SEQ ID NO: 4819924 - DNA, 21 bp, Homo sapiens
aaatgtttatattgtttttat

SEQ ID NO: 4819925 - DNA, 13 bp, Homo sapiens
aaatgtttatttt

SEQ ID NO: 4819926 - DNA, 15 bp, Homo sapiens
aaatgtttatttttg

SEQ ID NO: 4819927 - DNA, 20 bp, Homo sapiens
aaatgttttacaatggctgg

SEQ ID NO: 4819928 - DNA, 13 bp, Homo sapiens
aaattaaacaatt

SEQ ID NO: 4819929 - DNA, 15 bp, Homo sapiens
aaattaaacaattta

SEQ ID NO: 4819930 - DNA, 18 bp, Homo sapiens
aaattacatgcatgagca

SEQ ID NO: 4819931 - DNA, 16 bp, Homo sapiens
aaattagatgactgaa

SEQ ID NO: 4819932 - DNA, 19 bp, Homo sapiens
aaattagggctctaatttc

SEQ ID NO: 4819933 - DNA, 20 bp, Homo sapiens
aaattagggctctaatttcc

SEQ ID NO: 4819934 - DNA, 13 bp, Homo sapiens
aaattagtatttt

SEQ ID NO: 4819935 - DNA, 16 bp, Homo sapiens
aaattagtattttgag

SEQ ID NO: 4819936 - DNA, 15 bp, Homo sapiens
aaattagtgagattt

SEQ ID NO: 4819937 - DNA, 19 bp, Homo sapiens
aaattagtgagatttgtat

SEQ ID NO: 4819938 - DNA, 19 bp, Homo sapiens
aaattagtgttttcattct

SEQ ID NO: 4819939 - DNA, 15 bp, Homo sapiens
aaattataatgcatc

SEQ ID NO: 4819940 - DNA, 17 bp, Homo sapiens
aaattatatgatatgca

SEQ ID NO: 4819941 - DNA, 21 bp, Homo sapiens
aaattatatgatatgcatgta

SEQ ID NO: 4819942 - DNA, 12 bp, Homo sapiens
aaattatctgtt

SEQ ID NO: 4819943 - DNA, 15 bp, Homo sapiens
aaattatctgttcta

SEQ ID NO: 4819944 - DNA, 18 bp, Homo sapiens
aaattatctgttctatgg

SEQ ID NO: 4819945 - DNA, 15 bp, Homo sapiens
aaattatctttaaaa

SEQ ID NO: 4819946 - DNA, 19 bp, Homo sapiens
aaattatgtcaaatggatg

SEQ ID NO: 4819947 - DNA, 12 bp, Homo sapiens
aaattattactt

SEQ ID NO: 4819948 - DNA, 13 bp, Homo sapiens
aaattattacttt

SEQ ID NO: 4819949 - DNA, 17 bp, Homo sapiens
aaattattactttaaat

SEQ ID NO: 4819950 - DNA, 17 bp, Homo sapiens
aaattatttctaaaaca

SEQ ID NO: 4819951 - DNA, 21 bp, Homo sapiens
aaattatttctaaaacattaa

SEQ ID NO: 4819952 - DNA, 13 bp, Homo sapiens
aaattattttatg

SEQ ID NO: 4819953 - DNA, 14 bp, Homo sapiens
aaattattttatgt

SEQ ID NO: 4819954 - DNA, 17 bp, Homo sapiens
aaattcagtggacattt

SEQ ID NO: 4819955 - DNA, 20 bp, Homo sapiens
aaattcagtggacatttgtt

SEQ ID NO: 4819956 - DNA, 13 bp, Homo sapiens
aaattcattccat

SEQ ID NO: 4819957 - DNA, 16 bp, Homo sapiens
aaattcctaattctat

SEQ ID NO: 4819958 - DNA, 14 bp, Homo sapiens
aaattcctgttgtc

SEQ ID NO: 4819959 - DNA, 14 bp, Homo sapiens
aaattctagattac

SEQ ID NO: 4819960 - DNA, 13 bp, Homo sapiens
aaattctgattat

SEQ ID NO: 4819961 - DNA, 23 bp, Homo sapiens
aaattcttctccactttctagcc

SEQ ID NO: 4819962 - DNA, 12 bp, Homo sapiens
aaattgaagaga

SEQ ID NO: 4819963 - DNA, 13 bp, Homo sapiens
aaattgactgtac

SEQ ID NO: 4819964 - DNA, 18 bp, Homo sapiens
aaattgcagcagttgcta

SEQ ID NO: 4819965 - DNA, 11 bp, Homo sapiens
aaattgctgag

SEQ ID NO: 4819966 - DNA, 15 bp, Homo sapiens
aaattgctgagatgt

SEQ ID NO: 4819967 - DNA, 14 bp, Homo sapiens
aaattggtgtttct

SEQ ID NO: 4819968 - DNA, 18 bp, Homo sapiens
aaattggttaatgaaaaa

SEQ ID NO: 4819969 - DNA, 20 bp, Homo sapiens
aaattggttaatgaaaaatc

SEQ ID NO: 4819970 - DNA, 18 bp, Homo sapiens
aaattgtgccaaagatag

SEQ ID NO: 4819971 - DNA, 12 bp, Homo sapiens
aaattgtggatg

SEQ ID NO: 4819972 - DNA, 21 bp, Homo sapiens
aaattgtggatgaagacccta

SEQ ID NO: 4819973 - DNA, 22 bp, Homo sapiens
aaattgtttggcttcctcctga

SEQ ID NO: 4819974 - DNA, 11 bp, Homo sapiens
aaatttaagag

SEQ ID NO: 4819975 - DNA, 17 bp, Homo sapiens
aaatttatgtcattttc

SEQ ID NO: 4819976 - DNA, 15 bp, Homo sapiens
aaatttatttccaat

SEQ ID NO: 4819977 - DNA, 22 bp, Homo sapiens
aaatttgacattgtcagaatgt

SEQ ID NO: 4819978 - DNA, 12 bp, Homo sapiens
aaatttgccaag

SEQ ID NO: 4819979 - DNA, 23 bp, Homo sapiens
aaatttgggacctgcttcattca

SEQ ID NO: 4819980 - DNA, 13 bp, Homo sapiens
aaatttgtgtgct

SEQ ID NO: 4819981 - DNA, 15 bp, Homo sapiens
aaattttatctcagt

SEQ ID NO: 4819982 - DNA, 20 bp, Homo sapiens
aaattttatctcttcttcct

SEQ ID NO: 4819983 - DNA, 12 bp, Homo sapiens
aaattttattga

SEQ ID NO: 4819984 - DNA, 16 bp, Homo sapiens
aaattttattgaatat

SEQ ID NO: 4819985 - DNA, 15 bp, Homo sapiens
aaattttctagaata

SEQ ID NO: 4819986 - DNA, 13 bp, Homo sapiens
aaatttttactca

SEQ ID NO: 4819987 - DNA, 22 bp, Homo sapiens
aaatttttactcaggctttcta

SEQ ID NO: 4819988 - DNA, 15 bp, Homo sapiens
aaatttttttccaga

SEQ ID NO: 4819989 - DNA, 17 bp, Homo sapiens
aacaaaaaaaagaaaga

SEQ ID NO: 4819990 - DNA, 12 bp, Homo sapiens
aacaaaaacttt

SEQ ID NO: 4819991 - DNA, 15 bp, Homo sapiens
aacaaaaactttcca

SEQ ID NO: 4819992 - DNA, 16 bp, Homo sapiens
aacaaaaactttccat

SEQ ID NO: 4819993 - DNA, 21 bp, Homo sapiens
aacaaaaactttccatgacag

SEQ ID NO: 4819994 - DNA, 12 bp, Homo sapiens
aacaaaatttat

SEQ ID NO: 4819995 - DNA, 21 bp, Homo sapiens
aacaaaatttatgtcattttc

SEQ ID NO: 4819996 - DNA, 22 bp, Homo sapiens
aacaaacctgtttctgcagcca

SEQ ID NO: 4819997 - DNA, 15 bp, Homo sapiens
aacaaactcaaaatg

SEQ ID NO: 4819998 - DNA, 13 bp, Homo sapiens
aacaaagaaatat

SEQ ID NO: 4819999 - DNA, 16 bp, Homo sapiens
aacaaagcatgctcag

SEQ ID NO: 4820000 - DNA, 13 bp, Homo sapiens
aacaaataagtca

SEQ ID NO: 4820001 - DNA, 11 bp, Homo sapiens
aacaaatatac

SEQ ID NO: 4820002 - DNA, 12 bp, Homo sapiens
aacaaatcattt

SEQ ID NO: 4820003 - DNA, 17 bp, Homo sapiens
aacaaatcattttgatg

SEQ ID NO: 4820004 - DNA, 18 bp, Homo sapiens
aacaacagtcagccagct

SEQ ID NO: 4820005 - DNA, 20 bp, Homo sapiens
aacaacagtcttcatttttt

SEQ ID NO: 4820006 - DNA, 14 bp, Homo sapiens
aacaacctgccaca

SEQ ID NO: 4820007 - DNA, 21 bp, Homo sapiens
aacaactccaggaaaactgtt

SEQ ID NO: 4820008 - DNA, 15 bp, Homo sapiens
aacaacttactaaat

SEQ ID NO: 4820009 - DNA, 14 bp, Homo sapiens
aacaagaagaattt

SEQ ID NO: 4820010 - DNA, 14 bp, Homo sapiens
aacaagagaccact

SEQ ID NO: 4820011 - DNA, 14 bp, Homo sapiens
aacaaggaaggaca

SEQ ID NO: 4820012 - DNA, 15 bp, Homo sapiens
aacaaggaaggacat

SEQ ID NO: 4820013 - DNA, 21 bp, Homo sapiens
aacaaggcaaggctgtcaatt

SEQ ID NO: 4820014 - DNA, 16 bp, Homo sapiens
aacaatgccttgttgt

SEQ ID NO: 4820015 - DNA, 13 bp, Homo sapiens
aacaatggtaaca

SEQ ID NO: 4820016 - DNA, 15 bp, Homo sapiens
aacaattaattgtct

SEQ ID NO: 4820017 - DNA, 20 bp, Homo sapiens
aacaattcaaagaatcacct

SEQ ID NO: 4820018 - DNA, 13 bp, Homo sapiens
aacaattgatttt

SEQ ID NO: 4820019 - DNA, 23 bp, Homo sapiens
aacacaagtagatgcctgaactt

SEQ ID NO: 4820020 - DNA, 15 bp, Homo sapiens
aacacacacacacac

SEQ ID NO: 4820021 - DNA, 16 bp, Homo sapiens
aacacagcatgcattt

SEQ ID NO: 4820022 - DNA, 22 bp, Homo sapiens
aacacatagattcacctgtaaa

SEQ ID NO: 4820023 - DNA, 21 bp, Homo sapiens
aacacatttcctttaccctcc

SEQ ID NO: 4820024 - DNA, 15 bp, Homo sapiens
aacaccactttgtct

SEQ ID NO: 4820025 - DNA, 16 bp, Homo sapiens
aacaccagcaacatta

SEQ ID NO: 4820026 - DNA, 21 bp, Homo sapiens
aacaccagcaacattataatg

SEQ ID NO: 4820027 - DNA, 19 bp, Homo sapiens
aacacggagtttccatttg

SEQ ID NO: 4820028 - DNA, 13 bp, Homo sapiens
aacactattctcc

SEQ ID NO: 4820029 - DNA, 16 bp, Homo sapiens
aacactattctccaga

SEQ ID NO: 4820030 - DNA, 18 bp, Homo sapiens
aacactattctccagaaa

SEQ ID NO: 4820031 - DNA, 15 bp, Homo sapiens
aacactcgtgtgcat

SEQ ID NO: 4820032 - DNA, 15 bp, Homo sapiens
aacactgccaaacat

SEQ ID NO: 4820033 - DNA, 20 bp, Homo sapiens
aacactgcttaaggaaaaga

SEQ ID NO: 4820034 - DNA, 14 bp, Homo sapiens
aacagaccagcata

SEQ ID NO: 4820035 - DNA, 23 bp, Homo sapiens
aacagatcacatgcccctcttag

SEQ ID NO: 4820036 - DNA, 17 bp, Homo sapiens
aacagcaacaacaacag

SEQ ID NO: 4820037 - DNA, 12 bp, Homo sapiens
aacagcaggagc

SEQ ID NO: 4820038 - DNA, 14 bp, Homo sapiens
aacagctgtattat

SEQ ID NO: 4820039 - DNA, 15 bp, Homo sapiens
aacaggaaaaaaact

SEQ ID NO: 4820040 - DNA, 17 bp, Homo sapiens
aacaggaaaaaaacttt

SEQ ID NO: 4820041 - DNA, 22 bp, Homo sapiens
aacaggaaaaaaacttttataa

SEQ ID NO: 4820042 - DNA, 18 bp, Homo sapiens
aacaggaccaggagccag

SEQ ID NO: 4820043 - DNA, 19 bp, Homo sapiens
aacaggcattgcactaaaa

SEQ ID NO: 4820044 - DNA, 13 bp, Homo sapiens
aacagggcaaaat

SEQ ID NO: 4820045 - DNA, 13 bp, Homo sapiens
aacagtaactgcc

SEQ ID NO: 4820046 - DNA, 23 bp, Homo sapiens
aacagtcagccagcttggtggtt

SEQ ID NO: 4820047 - DNA, 12 bp, Homo sapiens
aacagtgtggct

SEQ ID NO: 4820048 - DNA, 21 bp, Homo sapiens
aacagtgtggcttaaacattt

SEQ ID NO: 4820049 - DNA, 15 bp, Homo sapiens
aacagtgtttccagt

SEQ ID NO: 4820050 - DNA, 23 bp, Homo sapiens
aacagtgtttccagtgacacaac

SEQ ID NO: 4820051 - DNA, 17 bp, Homo sapiens
aacagttaagacaacag

SEQ ID NO: 4820052 - DNA, 17 bp, Homo sapiens
aacagttccataccaag

SEQ ID NO: 4820053 - DNA, 13 bp, Homo sapiens
aacagttttaaga

SEQ ID NO: 4820054 - DNA, 16 bp, Homo sapiens
aacataaacttgtact

SEQ ID NO: 4820055 - DNA, 14 bp, Homo sapiens
aacataagctagaa

SEQ ID NO: 4820056 - DNA, 22 bp, Homo sapiens
aacataagctagaaaaattaga

SEQ ID NO: 4820057 - DNA, 17 bp, Homo sapiens
aacataatgatactgaa

SEQ ID NO: 4820058 - DNA, 16 bp, Homo sapiens
aacatagtggtatttt

SEQ ID NO: 4820059 - DNA, 22 bp, Homo sapiens
aacatagtggtattttaacata

SEQ ID NO: 4820060 - DNA, 15 bp, Homo sapiens
aacatggaagtacta

SEQ ID NO: 4820061 - DNA, 22 bp, Homo sapiens
aacatggccaatagtcatatgt

SEQ ID NO: 4820062 - DNA, 15 bp, Homo sapiens
aacatgtgaaagata

SEQ ID NO: 4820063 - DNA, 19 bp, Homo sapiens
aacattaatccacatgttt

SEQ ID NO: 4820064 - DNA, 17 bp, Homo sapiens
aacattattacttttcc

SEQ ID NO: 4820065 - DNA, 19 bp, Homo sapiens
aacattctatctactgatt

SEQ ID NO: 4820066 - DNA, 22 bp, Homo sapiens
aacattgtccccaatgaatata

SEQ ID NO: 4820067 - DNA, 14 bp, Homo sapiens
aacatttatctttg

SEQ ID NO: 4820068 - DNA, 20 bp, Homo sapiens
aacattttttgtttcttggt

SEQ ID NO: 4820069 - DNA, 17 bp, Homo sapiens
aaccaacgggtctgtgg

SEQ ID NO: 4820070 - DNA, 22 bp, Homo sapiens
aaccaattgtgagaattactgt

SEQ ID NO: 4820071 - DNA, 15 bp, Homo sapiens
aaccaatttgttctg

SEQ ID NO: 4820072 - DNA, 16 bp, Homo sapiens
aaccaatttgttctgt

SEQ ID NO: 4820073 - DNA, 15 bp, Homo sapiens
aaccacaaattcatg

SEQ ID NO: 4820074 - DNA, 17 bp, Homo sapiens
aaccacaactgacacag

SEQ ID NO: 4820075 - DNA, 15 bp, Homo sapiens
aaccagagagaaaga

SEQ ID NO: 4820076 - DNA, 18 bp, Homo sapiens
aaccagctattggaacag

SEQ ID NO: 4820077 - DNA, 17 bp, Homo sapiens
aaccagctcaggctact

SEQ ID NO: 4820078 - DNA, 15 bp, Homo sapiens
aaccagtctgaagtt

SEQ ID NO: 4820079 - DNA, 22 bp, Homo sapiens
aaccagtctgaagtttcattta

SEQ ID NO: 4820080 - DNA, 15 bp, Homo sapiens
aaccataaaataaat

SEQ ID NO: 4820081 - DNA, 16 bp, Homo sapiens
aaccataaaataaata

SEQ ID NO: 4820082 - DNA, 16 bp, Homo sapiens
aaccatctggcctggc

SEQ ID NO: 4820083 - DNA, 16 bp, Homo sapiens
aaccatgaaaagtttt

SEQ ID NO: 4820084 - DNA, 19 bp, Homo sapiens
aaccatgaaaagttttcaa

SEQ ID NO: 4820085 - DNA, 12 bp, Homo sapiens
aacccaaacttc

SEQ ID NO: 4820086 - DNA, 16 bp, Homo sapiens
aacccaaataaatgtg

SEQ ID NO: 4820087 - DNA, 14 bp, Homo sapiens
aacccacataaaca

SEQ ID NO: 4820088 - DNA, 11 bp, Homo sapiens
aacccagtgtt

SEQ ID NO: 4820089 - DNA, 12 bp, Homo sapiens
aacccagtgttc

SEQ ID NO: 4820090 - DNA, 17 bp, Homo sapiens
aacccatcactgtgtct

SEQ ID NO: 4820091 - DNA, 22 bp, Homo sapiens
aacccatgagcgtccaggtgat

SEQ ID NO: 4820092 - DNA, 15 bp, Homo sapiens
aaccccaacgcacag

SEQ ID NO: 4820093 - DNA, 11 bp, Homo sapiens
aacccccacct

SEQ ID NO: 4820094 - DNA, 22 bp, Homo sapiens
aacccccctccccaaggaagaa

SEQ ID NO: 4820095 - DNA, 15 bp, Homo sapiens
aaccctacagtatat

SEQ ID NO: 4820096 - DNA, 15 bp, Homo sapiens
aaccctgaatcagag

SEQ ID NO: 4820097 - DNA, 14 bp, Homo sapiens
aaccctgccctgca

SEQ ID NO: 4820098 - DNA, 22 bp, Homo sapiens
aaccctgcttctgctgccctga

SEQ ID NO: 4820099 - DNA, 14 bp, Homo sapiens
aaccctggtgacca

SEQ ID NO: 4820100 - DNA, 14 bp, Homo sapiens
aacccttcttttaa

SEQ ID NO: 4820101 - DNA, 13 bp, Homo sapiens
aaccgtcaatgtg

SEQ ID NO: 4820102 - DNA, 16 bp, Homo sapiens
aacctatctgtattgg

SEQ ID NO: 4820103 - DNA, 11 bp, Homo sapiens
aacctcaaact

SEQ ID NO: 4820104 - DNA, 23 bp, Homo sapiens
aacctcactatggtatgctggcc

SEQ ID NO: 4820105 - DNA, 19 bp, Homo sapiens
aacctcagttggcctctgc

SEQ ID NO: 4820106 - DNA, 19 bp, Homo sapiens
aacctcccctggtcctgca

SEQ ID NO: 4820107 - DNA, 17 bp, Homo sapiens
aacctcttagcttttct

SEQ ID NO: 4820108 - DNA, 14 bp, Homo sapiens
aacctgaggccaaa

SEQ ID NO: 4820109 - DNA, 18 bp, Homo sapiens
aacctgaggccaaatatt

SEQ ID NO: 4820110 - DNA, 15 bp, Homo sapiens
aacctgccacaatgt

SEQ ID NO: 4820111 - DNA, 16 bp, Homo sapiens
aacctgccacaatgtg

SEQ ID NO: 4820112 - DNA, 23 bp, Homo sapiens
aacctggaggctggaccaactgc

SEQ ID NO: 4820113 - DNA, 15 bp, Homo sapiens
aacctggcagatggg

SEQ ID NO: 4820114 - DNA, 18 bp, Homo sapiens
aacctgggttgttgcaga

SEQ ID NO: 4820115 - DNA, 19 bp, Homo sapiens
aacctggtaattatcctca

SEQ ID NO: 4820116 - DNA, 16 bp, Homo sapiens
aacctggtggcaccag

SEQ ID NO: 4820117 - DNA, 14 bp, Homo sapiens
aacctgttcctgac

SEQ ID NO: 4820118 - DNA, 12 bp, Homo sapiens
aaccttaatatt

SEQ ID NO: 4820119 - DNA, 18 bp, Homo sapiens
aaccttaatttgaaataa

SEQ ID NO: 4820120 - DNA, 16 bp, Homo sapiens
aaccttcttttcaatg

SEQ ID NO: 4820121 - DNA, 18 bp, Homo sapiens
aaccttcttttcaatgca

SEQ ID NO: 4820122 - DNA, 21 bp, Homo sapiens
aaccttttaaaaaaataatat

SEQ ID NO: 4820123 - DNA, 15 bp, Homo sapiens
aacgatttaatttat

SEQ ID NO: 4820124 - DNA, 17 bp, Homo sapiens
aacgcacaacatgcaca

SEQ ID NO: 4820125 - DNA, 19 bp, Homo sapiens
aacgcttgctcttaagtac

SEQ ID NO: 4820126 - DNA, 20 bp, Homo sapiens
aacgggtctgtgggactggc

SEQ ID NO: 4820127 - DNA, 20 bp, Homo sapiens
aactaaatagatttttagat

SEQ ID NO: 4820128 - DNA, 14 bp, Homo sapiens
aactaactgccatg

SEQ ID NO: 4820129 - DNA, 15 bp, Homo sapiens
aactaactgccatgt

SEQ ID NO: 4820130 - DNA, 15 bp, Homo sapiens
aactaagttgtattt

SEQ ID NO: 4820131 - DNA, 13 bp, Homo sapiens
aactaatgtaaat

SEQ ID NO: 4820132 - DNA, 21 bp, Homo sapiens
aactaatttgctctgtggtaa

SEQ ID NO: 4820133 - DNA, 13 bp, Homo sapiens
aactaccaccctc

SEQ ID NO: 4820134 - DNA, 22 bp, Homo sapiens
aactaccaccctcgctgccacc

SEQ ID NO: 4820135 - DNA, 12 bp, Homo sapiens
aactagagcacg

SEQ ID NO: 4820136 - DNA, 15 bp, Homo sapiens
aactagagtatgtgt

SEQ ID NO: 4820137 - DNA, 16 bp, Homo sapiens
aactagagtatgtgta

SEQ ID NO: 4820138 - DNA, 12 bp, Homo sapiens
aactagatctcc

SEQ ID NO: 4820139 - DNA, 19 bp, Homo sapiens
aactagatctcctgtaatt

SEQ ID NO: 4820140 - DNA, 22 bp, Homo sapiens
aactagcaaaaggatgatttaa

SEQ ID NO: 4820141 - DNA, 17 bp, Homo sapiens
aactcacagactgctgt

SEQ ID NO: 4820142 - DNA, 21 bp, Homo sapiens
aactcacagactgctgtctta

SEQ ID NO: 4820143 - DNA, 12 bp, Homo sapiens
aactccaaggca

SEQ ID NO: 4820144 - DNA, 13 bp, Homo sapiens
aactccaaggcaa

SEQ ID NO: 4820145 - DNA, 17 bp, Homo sapiens
aactccaaggcaaatgt

SEQ ID NO: 4820146 - DNA, 12 bp, Homo sapiens
aactccttacag

SEQ ID NO: 4820147 - DNA, 11 bp, Homo sapiens
aactccttggc

SEQ ID NO: 4820148 - DNA, 21 bp, Homo sapiens
aactcgaatcactcatttatt

SEQ ID NO: 4820149 - DNA, 20 bp, Homo sapiens
aactcgggattacagaaaca

SEQ ID NO: 4820150 - DNA, 18 bp, Homo sapiens
aactcgggcactccctaa

SEQ ID NO: 4820151 - DNA, 19 bp, Homo sapiens
aactcgggcactccctaag

SEQ ID NO: 4820152 - DNA, 15 bp, Homo sapiens
aactctgacaagggc

SEQ ID NO: 4820153 - DNA, 19 bp, Homo sapiens
aactctgcatagacaaagg

SEQ ID NO: 4820154 - DNA, 23 bp, Homo sapiens
aactctggccttggttcctccag

SEQ ID NO: 4820155 - DNA, 22 bp, Homo sapiens
aactctgtacgaggcttctcta

SEQ ID NO: 4820156 - DNA, 23 bp, Homo sapiens
aactctgtacgaggcttctctaa

SEQ ID NO: 4820157 - DNA, 16 bp, Homo sapiens
aactcttcaaggtctg

SEQ ID NO: 4820158 - DNA, 15 bp, Homo sapiens
aactctttggctatt

SEQ ID NO: 4820159 - DNA, 13 bp, Homo sapiens
aactgaagcagag

SEQ ID NO: 4820160 - DNA, 15 bp, Homo sapiens
aactgaagcagagtc

SEQ ID NO: 4820161 - DNA, 12 bp, Homo sapiens
aactgagaccaa

SEQ ID NO: 4820162 - DNA, 16 bp, Homo sapiens
aactgagaccaagtct

SEQ ID NO: 4820163 - DNA, 23 bp, Homo sapiens
aactgatgggtatcatgcttcta

SEQ ID NO: 4820164 - DNA, 14 bp, Homo sapiens
aactgccacaagca

SEQ ID NO: 4820165 - DNA, 18 bp, Homo sapiens
aactgccacaagcacaat

SEQ ID NO: 4820166 - DNA, 13 bp, Homo sapiens
aactgccatgtag

SEQ ID NO: 4820167 - DNA, 15 bp, Homo sapiens
aactgccatgtaggc

SEQ ID NO: 4820168 - DNA, 18 bp, Homo sapiens
aactgcccattgtaactt

SEQ ID NO: 4820169 - DNA, 16 bp, Homo sapiens
aactggaaacatctga

SEQ ID NO: 4820170 - DNA, 23 bp, Homo sapiens
aactggaaacatctgatttctga

SEQ ID NO: 4820171 - DNA, 18 bp, Homo sapiens
aactggaaggctttattc

SEQ ID NO: 4820172 - DNA, 14 bp, Homo sapiens
aactggaataagaa

SEQ ID NO: 4820173 - DNA, 14 bp, Homo sapiens
aactggccccagct

SEQ ID NO: 4820174 - DNA, 20 bp, Homo sapiens
aactggttatttaaaatgta

SEQ ID NO: 4820175 - DNA, 15 bp, Homo sapiens
aactgtaaaatactt

SEQ ID NO: 4820176 - DNA, 17 bp, Homo sapiens
aactgtattgaaaaaat

SEQ ID NO: 4820177 - DNA, 21 bp, Homo sapiens
aactgtattgaaaaaatattg

SEQ ID NO: 4820178 - DNA, 11 bp, Homo sapiens
aactgtattta

SEQ ID NO: 4820179 - DNA, 17 bp, Homo sapiens
aactgtatttacttgtt

SEQ ID NO: 4820180 - DNA, 16 bp, Homo sapiens
aactgtgaatatgtgt

SEQ ID NO: 4820181 - DNA, 13 bp, Homo sapiens
aactgtgagataa

SEQ ID NO: 4820182 - DNA, 19 bp, Homo sapiens
aactgttaacccagtgttc

SEQ ID NO: 4820183 - DNA, 17 bp, Homo sapiens
aactgttggataataac

SEQ ID NO: 4820184 - DNA, 16 bp, Homo sapiens
aactgtttttgaagaa

SEQ ID NO: 4820185 - DNA, 20 bp, Homo sapiens
aacttactatggtatatatt

SEQ ID NO: 4820186 - DNA, 16 bp, Homo sapiens
aacttatctccagcca

SEQ ID NO: 4820187 - DNA, 17 bp, Homo sapiens
aacttatctccagccaa

SEQ ID NO: 4820188 - DNA, 18 bp, Homo sapiens
aacttattttgattgttt

SEQ ID NO: 4820189 - DNA, 11 bp, Homo sapiens
aacttcagcaa

SEQ ID NO: 4820190 - DNA, 12 bp, Homo sapiens
aacttcaggaaa

SEQ ID NO: 4820191 - DNA, 13 bp, Homo sapiens
aacttcccaggcc

SEQ ID NO: 4820192 - DNA, 14 bp, Homo sapiens
aacttctactgagc

SEQ ID NO: 4820193 - DNA, 11 bp, Homo sapiens
aacttctcatt

SEQ ID NO: 4820194 - DNA, 23 bp, Homo sapiens
aacttgagggacgactttcttta

SEQ ID NO: 4820195 - DNA, 16 bp, Homo sapiens
aacttgctcctttcca

SEQ ID NO: 4820196 - DNA, 14 bp, Homo sapiens
aacttgctgtgaaa

SEQ ID NO: 4820197 - DNA, 17 bp, Homo sapiens
aacttggtgcttattga

SEQ ID NO: 4820198 - DNA, 20 bp, Homo sapiens
aacttggtgcttattgatat

SEQ ID NO: 4820199 - DNA, 15 bp, Homo sapiens
aactttcacctcaga

SEQ ID NO: 4820200 - DNA, 22 bp, Homo sapiens
aactttcactataatgtgaaat

SEQ ID NO: 4820201 - DNA, 14 bp, Homo sapiens
aactttccatgaca

SEQ ID NO: 4820202 - DNA, 15 bp, Homo sapiens
aactttccatgacag

SEQ ID NO: 4820203 - DNA, 20 bp, Homo sapiens
aactttccatgacagtagca

SEQ ID NO: 4820204 - DNA, 21 bp, Homo sapiens
aactttccatgacagtagcat

SEQ ID NO: 4820205 - DNA, 11 bp, Homo sapiens
aactttgtcac

SEQ ID NO: 4820206 - DNA, 18 bp, Homo sapiens
aacttttataaatgtttt

SEQ ID NO: 4820207 - DNA, 19 bp, Homo sapiens
aacttttataaattaaata

SEQ ID NO: 4820208 - DNA, 22 bp, Homo sapiens
aacttttataaattaaatatat

SEQ ID NO: 4820209 - DNA, 16 bp, Homo sapiens
aacttttttttagtat

SEQ ID NO: 4820210 - DNA, 16 bp, Homo sapiens
aagaaaaaaaaaatga

SEQ ID NO: 4820211 - DNA, 20 bp, Homo sapiens
aagaaaaaaaaaatgattgt

SEQ ID NO: 4820212 - DNA, 13 bp, Homo sapiens
aagaaacaaaccc

SEQ ID NO: 4820213 - DNA, 20 bp, Homo sapiens
aagaaacacagcatgcattt

SEQ ID NO: 4820214 - DNA, 12 bp, Homo sapiens
aagaaacattta

SEQ ID NO: 4820215 - DNA, 15 bp, Homo sapiens
aagaaacatttatct

SEQ ID NO: 4820216 - DNA, 16 bp, Homo sapiens
aagaaagaacggaaga

SEQ ID NO: 4820217 - DNA, 14 bp, Homo sapiens
aagaaagatgctga

SEQ ID NO: 4820218 - DNA, 13 bp, Homo sapiens
aagaaaggcagag

SEQ ID NO: 4820219 - DNA, 12 bp, Homo sapiens
aagaaatatctg

SEQ ID NO: 4820220 - DNA, 17 bp, Homo sapiens
aagaaatatctgtgaaa

SEQ ID NO: 4820221 - DNA, 19 bp, Homo sapiens
aagaaatatctgtgaaata

SEQ ID NO: 4820222 - DNA, 12 bp, Homo sapiens
aagaaatgagaa

SEQ ID NO: 4820223 - DNA, 13 bp, Homo sapiens
aagaaatgagaaa

SEQ ID NO: 4820224 - DNA, 15 bp, Homo sapiens
aagaaatgagaaatt

SEQ ID NO: 4820225 - DNA, 17 bp, Homo sapiens
aagaacaaaaccccaga

SEQ ID NO: 4820226 - DNA, 19 bp, Homo sapiens
aagaacagctaacaataaa

SEQ ID NO: 4820227 - DNA, 20 bp, Homo sapiens
aagaacagctaacaataaag

SEQ ID NO: 4820228 - DNA, 14 bp, Homo sapiens
aagaacccccctcc

SEQ ID NO: 4820229 - DNA, 17 bp, Homo sapiens
aagaacccccctcccca

SEQ ID NO: 4820230 - DNA, 12 bp, Homo sapiens
aagaagaatata

SEQ ID NO: 4820231 - DNA, 17 bp, Homo sapiens
aagaagatagttgtaaa

SEQ ID NO: 4820232 - DNA, 16 bp, Homo sapiens
aagaagcaaataaata

SEQ ID NO: 4820233 - DNA, 20 bp, Homo sapiens
aagaaggcacaggtgtaaat

SEQ ID NO: 4820234 - DNA, 21 bp, Homo sapiens
aagaaggcacaggtgtaaata

SEQ ID NO: 4820235 - DNA, 17 bp, Homo sapiens
aagaaggcccgggagga

SEQ ID NO: 4820236 - DNA, 15 bp, Homo sapiens
aagaagggaaattca

SEQ ID NO: 4820237 - DNA, 21 bp, Homo sapiens
aagaagggaaattcacactgt

SEQ ID NO: 4820238 - DNA, 21 bp, Homo sapiens
aagaagtccatgtgataattg

SEQ ID NO: 4820239 - DNA, 15 bp, Homo sapiens
aagaatagcttatct

SEQ ID NO: 4820240 - DNA, 13 bp, Homo sapiens
aagaatataaata

SEQ ID NO: 4820241 - DNA, 11 bp, Homo sapiens
aagaatattgt

SEQ ID NO: 4820242 - DNA, 12 bp, Homo sapiens
aagaatattgtt

SEQ ID NO: 4820243 - DNA, 15 bp, Homo sapiens
aagaatccctgttca

SEQ ID NO: 4820244 - DNA, 18 bp, Homo sapiens
aagaattaatgacaacaa

SEQ ID NO: 4820245 - DNA, 11 bp, Homo sapiens
aagaattcagt

SEQ ID NO: 4820246 - DNA, 23 bp, Homo sapiens
aagaattcatgatgctagttctt

SEQ ID NO: 4820247 - DNA, 20 bp, Homo sapiens
aagaattctccaaaacaatt

SEQ ID NO: 4820248 - DNA, 18 bp, Homo sapiens
aagacaaatgcagtgtat

SEQ ID NO: 4820249 - DNA, 20 bp, Homo sapiens
aagacaaatgcagtgtattt

SEQ ID NO: 4820250 - DNA, 14 bp, Homo sapiens
aagacaacaggcat

SEQ ID NO: 4820251 - DNA, 18 bp, Homo sapiens
aagacagagatggcagag

SEQ ID NO: 4820252 - DNA, 19 bp, Homo sapiens
aagacattcaccaacaaca

SEQ ID NO: 4820253 - DNA, 16 bp, Homo sapiens
aagaccatgcattcag

SEQ ID NO: 4820254 - DNA, 18 bp, Homo sapiens
aagaccccaggaagtcat

SEQ ID NO: 4820255 - DNA, 19 bp, Homo sapiens
aagaccctatctcccacaa

SEQ ID NO: 4820256 - DNA, 20 bp, Homo sapiens
aagaccttctgaagatctca

SEQ ID NO: 4820257 - DNA, 16 bp, Homo sapiens
aagacggatccacagt

SEQ ID NO: 4820258 - DNA, 13 bp, Homo sapiens
aagactcaatcat

SEQ ID NO: 4820259 - DNA, 16 bp, Homo sapiens
aagactggtattctct

SEQ ID NO: 4820260 - DNA, 13 bp, Homo sapiens
aagacttccagct

SEQ ID NO: 4820261 - DNA, 22 bp, Homo sapiens
aagagaaaatgctttctcatgc

SEQ ID NO: 4820262 - DNA, 21 bp, Homo sapiens
aagagaaacactaatggccaa

SEQ ID NO: 4820263 - DNA, 15 bp, Homo sapiens
aagagatcaggaaga

SEQ ID NO: 4820264 - DNA, 22 bp, Homo sapiens
aagagatcaggaagagaaggag

SEQ ID NO: 4820265 - DNA, 19 bp, Homo sapiens
aagagcatgtaagaaataa

SEQ ID NO: 4820266 - DNA, 12 bp, Homo sapiens
aagagcccaggc

SEQ ID NO: 4820267 - DNA, 15 bp, Homo sapiens
aagagctagagaaat

SEQ ID NO: 4820268 - DNA, 18 bp, Homo sapiens
aagagctgctgtatttga

SEQ ID NO: 4820269 - DNA, 17 bp, Homo sapiens
aagagctgttttggatg

SEQ ID NO: 4820270 - DNA, 23 bp, Homo sapiens
aagagctgttttggatgaatgca

SEQ ID NO: 4820271 - DNA, 12 bp, Homo sapiens
aagaggctgctg

SEQ ID NO: 4820272 - DNA, 16 bp, Homo sapiens
aagagggaactaagca

SEQ ID NO: 4820273 - DNA, 19 bp, Homo sapiens
aagaggggtataggacaag

SEQ ID NO: 4820274 - DNA, 13 bp, Homo sapiens
aagagtaaatata

SEQ ID NO: 4820275 - DNA, 22 bp, Homo sapiens
aagagtaagcacctttagaata

SEQ ID NO: 4820276 - DNA, 22 bp, Homo sapiens
aagagtcgagtgatatggcttg

SEQ ID NO: 4820277 - DNA, 17 bp, Homo sapiens
aagagtgatgggaaaga

SEQ ID NO: 4820278 - DNA, 15 bp, Homo sapiens
aagagtggaaatggg

SEQ ID NO: 4820279 - DNA, 12 bp, Homo sapiens
aagatagctcct

SEQ ID NO: 4820280 - DNA, 15 bp, Homo sapiens
aagataggtatggaa

SEQ ID NO: 4820281 - DNA, 13 bp, Homo sapiens
aagatattattta

SEQ ID NO: 4820282 - DNA, 23 bp, Homo sapiens
aagatattatttatcgaaagtaa

SEQ ID NO: 4820283 - DNA, 21 bp, Homo sapiens
aagatattgtatctcctttaa

SEQ ID NO: 4820284 - DNA, 15 bp, Homo sapiens
aagatattgtattat

SEQ ID NO: 4820285 - DNA, 17 bp, Homo sapiens
aagatattgtattatca

SEQ ID NO: 4820286 - DNA, 16 bp, Homo sapiens
aagatcccaagtcaaa

SEQ ID NO: 4820287 - DNA, 16 bp, Homo sapiens
aagatctcctgtgcac

SEQ ID NO: 4820288 - DNA, 14 bp, Homo sapiens
aagatctctttcta

SEQ ID NO: 4820289 - DNA, 15 bp, Homo sapiens
aagatctctttctaa

SEQ ID NO: 4820290 - DNA, 11 bp, Homo sapiens
aagatcttgcc

SEQ ID NO: 4820291 - DNA, 17 bp, Homo sapiens
aagatctttttttaagt

SEQ ID NO: 4820292 - DNA, 12 bp, Homo sapiens
aagatgcagccg

SEQ ID NO: 4820293 - DNA, 19 bp, Homo sapiens
aagatgcattttaaatgtc

SEQ ID NO: 4820294 - DNA, 14 bp, Homo sapiens
aagatgctgctgag

SEQ ID NO: 4820295 - DNA, 17 bp, Homo sapiens
aagatgggtgattatga

SEQ ID NO: 4820296 - DNA, 15 bp, Homo sapiens
aagatgtgtcttcaa

SEQ ID NO: 4820297 - DNA, 17 bp, Homo sapiens
aagatgtgtcttcaatt

SEQ ID NO: 4820298 - DNA, 19 bp, Homo sapiens
aagatgtgtcttcaatttg

SEQ ID NO: 4820299 - DNA, 17 bp, Homo sapiens
aagattaaaattagtga

SEQ ID NO: 4820300 - DNA, 14 bp, Homo sapiens
aagattaattaaaa

SEQ ID NO: 4820301 - DNA, 17 bp, Homo sapiens
aagattccattttggaa

SEQ ID NO: 4820302 - DNA, 12 bp, Homo sapiens
aagatttattat

SEQ ID NO: 4820303 - DNA, 18 bp, Homo sapiens
aagcaaaccttaatttga

SEQ ID NO: 4820304 - DNA, 15 bp, Homo sapiens
aagcaaactgaaatt

SEQ ID NO: 4820305 - DNA, 16 bp, Homo sapiens
aagcaaactgaaatta

SEQ ID NO: 4820306 - DNA, 18 bp, Homo sapiens
aagcaaactgaaattagt

SEQ ID NO: 4820307 - DNA, 20 bp, Homo sapiens
aagcaaactgaaattagtgt

SEQ ID NO: 4820308 - DNA, 15 bp, Homo sapiens
aagcaaagacagttt

SEQ ID NO: 4820309 - DNA, 18 bp, Homo sapiens
aagcaaagacagtttctt

SEQ ID NO: 4820310 - DNA, 21 bp, Homo sapiens
aagcaaatctgtataaatgtg

SEQ ID NO: 4820311 - DNA, 16 bp, Homo sapiens
aagcaagctctcttgc

SEQ ID NO: 4820312 - DNA, 13 bp, Homo sapiens
aagcaattctaag

SEQ ID NO: 4820313 - DNA, 14 bp, Homo sapiens
aagcaattctaagt

SEQ ID NO: 4820314 - DNA, 20 bp, Homo sapiens
aagcacaaaaaatttaagag

SEQ ID NO: 4820315 - DNA, 14 bp, Homo sapiens
aagcacatgcctct

SEQ ID NO: 4820316 - DNA, 20 bp, Homo sapiens
aagcacatgcctctctcagg

SEQ ID NO: 4820317 - DNA, 21 bp, Homo sapiens
aagcacattattgtagagaaa

SEQ ID NO: 4820318 - DNA, 18 bp, Homo sapiens
aagcacctcttgaagaac

SEQ ID NO: 4820319 - DNA, 14 bp, Homo sapiens
aagcacctttagaa

SEQ ID NO: 4820320 - DNA, 17 bp, Homo sapiens
aagcactagccttccca

SEQ ID NO: 4820321 - DNA, 13 bp, Homo sapiens
aagcactggcctt

SEQ ID NO: 4820322 - DNA, 21 bp, Homo sapiens
aagcactggccttgcctccag

SEQ ID NO: 4820323 - DNA, 11 bp, Homo sapiens
aagcagaatga

SEQ ID NO: 4820324 - DNA, 19 bp, Homo sapiens
aagcagaatgagatgattt

SEQ ID NO: 4820325 - DNA, 23 bp, Homo sapiens
aagcagaatgagatgatttaatt

SEQ ID NO: 4820326 - DNA, 22 bp, Homo sapiens
aagcagagccagtcttcctcct

SEQ ID NO: 4820327 - DNA, 22 bp, Homo sapiens
aagcagcagctagaaagagaaa

SEQ ID NO: 4820328 - DNA, 16 bp, Homo sapiens
aagcaggctcaacata

SEQ ID NO: 4820329 - DNA, 17 bp, Homo sapiens
aagcaggctcaacataa

SEQ ID NO: 4820330 - DNA, 16 bp, Homo sapiens
aagcagtacatcttgt

SEQ ID NO: 4820331 - DNA, 18 bp, Homo sapiens
aagcagtacatcttgtgc

SEQ ID NO: 4820332 - DNA, 22 bp, Homo sapiens
aagcagtacatcttgtgcatgc

SEQ ID NO: 4820333 - DNA, 17 bp, Homo sapiens
aagcagtcagcggagag

SEQ ID NO: 4820334 - DNA, 15 bp, Homo sapiens
aagcagtgcatgctg

SEQ ID NO: 4820335 - DNA, 19 bp, Homo sapiens
aagcagtgcgtgtgaaaca

SEQ ID NO: 4820336 - DNA, 14 bp, Homo sapiens
aagcagtttcagat

SEQ ID NO: 4820337 - DNA, 17 bp, Homo sapiens
aagcatatataaaacaa

SEQ ID NO: 4820338 - DNA, 21 bp, Homo sapiens
aagcatatataaaacaaaaca

SEQ ID NO: 4820339 - DNA, 13 bp, Homo sapiens
aagcatattgact

SEQ ID NO: 4820340 - DNA, 19 bp, Homo sapiens
aagcatccaaggaacttca

SEQ ID NO: 4820341 - DNA, 12 bp, Homo sapiens
aagcatgctcag

SEQ ID NO: 4820342 - DNA, 11 bp, Homo sapiens
aagcatggact

SEQ ID NO: 4820343 - DNA, 14 bp, Homo sapiens
aagcattgctaaag

SEQ ID NO: 4820344 - DNA, 22 bp, Homo sapiens
aagccaaaaaccttagctccct

SEQ ID NO: 4820345 - DNA, 14 bp, Homo sapiens
aagccaagtgtcct

SEQ ID NO: 4820346 - DNA, 15 bp, Homo sapiens
aagccaagtgtcctg

SEQ ID NO: 4820347 - DNA, 15 bp, Homo sapiens
aagccacataaccag

SEQ ID NO: 4820348 - DNA, 22 bp, Homo sapiens
aagccacgctgtcctctcgagc

SEQ ID NO: 4820349 - DNA, 15 bp, Homo sapiens
aagccagcaggctct

SEQ ID NO: 4820350 - DNA, 23 bp, Homo sapiens
aagccagcaggctctcaggccag

SEQ ID NO: 4820351 - DNA, 17 bp, Homo sapiens
aagccagctctgagcag

SEQ ID NO: 4820352 - DNA, 11 bp, Homo sapiens
aagccaggaga

SEQ ID NO: 4820353 - DNA, 12 bp, Homo sapiens
aagccaggagac

SEQ ID NO: 4820354 - DNA, 17 bp, Homo sapiens
aagccagggttccagac

SEQ ID NO: 4820355 - DNA, 18 bp, Homo sapiens
aagccatagccccaggcc

SEQ ID NO: 4820356 - DNA, 10 bp, Homo sapiens
aagcccaccc

SEQ ID NO: 4820357 - DNA, 13 bp, Homo sapiens
aagcccacccgcc

SEQ ID NO: 4820358 - DNA, 20 bp, Homo sapiens
aagcccagcctatctctctt

SEQ ID NO: 4820359 - DNA, 14 bp, Homo sapiens
aagccctggggcag

SEQ ID NO: 4820360 - DNA, 16 bp, Homo sapiens
aagccgtgttttatga

SEQ ID NO: 4820361 - DNA, 14 bp, Homo sapiens
aagcctcagtccct

SEQ ID NO: 4820362 - DNA, 18 bp, Homo sapiens
aagcctgggcagaaatgt

SEQ ID NO: 4820363 - DNA, 21 bp, Homo sapiens
aagcgacctaaacagctgctt

SEQ ID NO: 4820364 - DNA, 12 bp, Homo sapiens
aagcgtggtgga

SEQ ID NO: 4820365 - DNA, 14 bp, Homo sapiens
aagctatttaagtg

SEQ ID NO: 4820366 - DNA, 16 bp, Homo sapiens
aagctcacttgcttta

SEQ ID NO: 4820367 - DNA, 16 bp, Homo sapiens
aagctcatagcacatg

SEQ ID NO: 4820368 - DNA, 13 bp, Homo sapiens
aagctccagtagc

SEQ ID NO: 4820369 - DNA, 13 bp, Homo sapiens
aagctccagtgct

SEQ ID NO: 4820370 - DNA, 16 bp, Homo sapiens
aagctccagtgcttta

SEQ ID NO: 4820371 - DNA, 22 bp, Homo sapiens
aagctctcttgccgaggagcca

SEQ ID NO: 4820372 - DNA, 19 bp, Homo sapiens
aagctcttcattgcactgc

SEQ ID NO: 4820373 - DNA, 21 bp, Homo sapiens
aagctgaatcagacagtggat

SEQ ID NO: 4820374 - DNA, 21 bp, Homo sapiens
aagctgagcccctccctcctg

SEQ ID NO: 4820375 - DNA, 22 bp, Homo sapiens
aagctgatagtgtttcgttaag

SEQ ID NO: 4820376 - DNA, 18 bp, Homo sapiens
aagctgatgaagttaagc

SEQ ID NO: 4820377 - DNA, 17 bp, Homo sapiens
aagctgatggacatgag

SEQ ID NO: 4820378 - DNA, 22 bp, Homo sapiens
aagctgccagccgagatagcca

SEQ ID NO: 4820379 - DNA, 17 bp, Homo sapiens
aagctgccagccttccc

SEQ ID NO: 4820380 - DNA, 20 bp, Homo sapiens
aagctgcccaatttcacaga

SEQ ID NO: 4820381 - DNA, 17 bp, Homo sapiens
aagctggagtgcagtgg

SEQ ID NO: 4820382 - DNA, 12 bp, Homo sapiens
aagctgttccac

SEQ ID NO: 4820383 - DNA, 19 bp, Homo sapiens
aagcttcatatatgctttg

SEQ ID NO: 4820384 - DNA, 20 bp, Homo sapiens
aaggaaaagagaaacactaa

SEQ ID NO: 4820385 - DNA, 18 bp, Homo sapiens
aaggaacttcatgcttga

SEQ ID NO: 4820386 - DNA, 13 bp, Homo sapiens
aaggaagcacatg

SEQ ID NO: 4820387 - DNA, 23 bp, Homo sapiens
aaggaatgattaattaaaacaca

SEQ ID NO: 4820388 - DNA, 13 bp, Homo sapiens
aaggacactgatg

SEQ ID NO: 4820389 - DNA, 17 bp, Homo sapiens
aaggacagtgttcaaat

SEQ ID NO: 4820390 - DNA, 22 bp, Homo sapiens
aaggacagtgttcaaattctga

SEQ ID NO: 4820391 - DNA, 19 bp, Homo sapiens
aaggaccgtggccctgccc

SEQ ID NO: 4820392 - DNA, 14 bp, Homo sapiens
aaggactgaagaaa

SEQ ID NO: 4820393 - DNA, 14 bp, Homo sapiens
aaggacttggtgat

SEQ ID NO: 4820394 - DNA, 21 bp, Homo sapiens
aaggagcaaataccttagctc

SEQ ID NO: 4820395 - DNA, 16 bp, Homo sapiens
aaggaggcatgcctct

SEQ ID NO: 4820396 - DNA, 15 bp, Homo sapiens
aaggatgttctagca

SEQ ID NO: 4820397 - DNA, 19 bp, Homo sapiens
aaggatttattctcagaac

SEQ ID NO: 4820398 - DNA, 17 bp, Homo sapiens
aaggcaaatgtccaagc

SEQ ID NO: 4820399 - DNA, 19 bp, Homo sapiens
aaggcacattgaaatactt

SEQ ID NO: 4820400 - DNA, 13 bp, Homo sapiens
aaggcactgagcg

SEQ ID NO: 4820401 - DNA, 21 bp, Homo sapiens
aaggcagggccctgaaatggc

SEQ ID NO: 4820402 - DNA, 15 bp, Homo sapiens
aaggcagtgcagtgc

SEQ ID NO: 4820403 - DNA, 17 bp, Homo sapiens
aaggcatctaagacatt

SEQ ID NO: 4820404 - DNA, 23 bp, Homo sapiens
aaggcatgcctggacaaaccctt

SEQ ID NO: 4820405 - DNA, 18 bp, Homo sapiens
aaggccaaaggaagcaca

SEQ ID NO: 4820406 - DNA, 15 bp, Homo sapiens
aaggctaaatgtaaa

SEQ ID NO: 4820407 - DNA, 20 bp, Homo sapiens
aaggctgcagctaatttgtg

SEQ ID NO: 4820408 - DNA, 13 bp, Homo sapiens
aaggcttctccac

SEQ ID NO: 4820409 - DNA, 21 bp, Homo sapiens
aagggaaaaaagcaactttcc

SEQ ID NO: 4820410 - DNA, 14 bp, Homo sapiens
aagggaaatcaatt

SEQ ID NO: 4820411 - DNA, 17 bp, Homo sapiens
aagggaagtgaccaagg

SEQ ID NO: 4820412 - DNA, 23 bp, Homo sapiens
aagggacatgtctttggcttcag

SEQ ID NO: 4820413 - DNA, 14 bp, Homo sapiens
aagggaccccagat

SEQ ID NO: 4820414 - DNA, 22 bp, Homo sapiens
aagggacggggcccgccccagg

SEQ ID NO: 4820415 - DNA, 23 bp, Homo sapiens
aagggacggggcccgccccaggc

SEQ ID NO: 4820416 - DNA, 22 bp, Homo sapiens
aagggactccagaagcagcagc

SEQ ID NO: 4820417 - DNA, 23 bp, Homo sapiens
aagggaggggaagagagaggcct

SEQ ID NO: 4820418 - DNA, 16 bp, Homo sapiens
aagggatccagagacc

SEQ ID NO: 4820419 - DNA, 16 bp, Homo sapiens
aagggatgtatttgta

SEQ ID NO: 4820420 - DNA, 13 bp, Homo sapiens
aagggcagccccg

SEQ ID NO: 4820421 - DNA, 14 bp, Homo sapiens
aagggcaggaagac

SEQ ID NO: 4820422 - DNA, 15 bp, Homo sapiens
aagggcaggagctca

SEQ ID NO: 4820423 - DNA, 18 bp, Homo sapiens
aagggcgctgagggcagg

SEQ ID NO: 4820424 - DNA, 17 bp, Homo sapiens
aagggctgacctgcctc

SEQ ID NO: 4820425 - DNA, 13 bp, Homo sapiens
aaggggaaaacct

SEQ ID NO: 4820426 - DNA, 17 bp, Homo sapiens
aaggggaaaacctcagt

SEQ ID NO: 4820427 - DNA, 16 bp, Homo sapiens
aaggggatctaaaagg

SEQ ID NO: 4820428 - DNA, 13 bp, Homo sapiens
aaggggccagacc

SEQ ID NO: 4820429 - DNA, 19 bp, Homo sapiens
aaggggccaggaaggggac

SEQ ID NO: 4820430 - DNA, 14 bp, Homo sapiens
aaggggcctgggct

SEQ ID NO: 4820431 - DNA, 20 bp, Homo sapiens
aaggggcctgggctgtgagg

SEQ ID NO: 4820432 - DNA, 16 bp, Homo sapiens
aaggggcgcgcgcccc

SEQ ID NO: 4820433 - DNA, 11 bp, Homo sapiens
aaggggctggt

SEQ ID NO: 4820434 - DNA, 15 bp, Homo sapiens
aagggggatgcaggc

SEQ ID NO: 4820435 - DNA, 22 bp, Homo sapiens
aaggtcagtgttataaaatctg

SEQ ID NO: 4820436 - DNA, 20 bp, Homo sapiens
aaggtctcatttgatattgt

SEQ ID NO: 4820437 - DNA, 21 bp, Homo sapiens
aaggtgcacctgccccaggct

SEQ ID NO: 4820438 - DNA, 14 bp, Homo sapiens
aaggtggcatagcc

SEQ ID NO: 4820439 - DNA, 14 bp, Homo sapiens
aaggtggtcttgga

SEQ ID NO: 4820440 - DNA, 21 bp, Homo sapiens
aaggtggtcttggagaggagg

SEQ ID NO: 4820441 - DNA, 23 bp, Homo sapiens
aaggtggtcttggagaggaggtg

SEQ ID NO: 4820442 - DNA, 17 bp, Homo sapiens
aaggttcttcatccctt

SEQ ID NO: 4820443 - DNA, 13 bp, Homo sapiens
aaggttgtacata

SEQ ID NO: 4820444 - DNA, 15 bp, Homo sapiens
aaggttgtacatagt

SEQ ID NO: 4820445 - DNA, 18 bp, Homo sapiens
aaggtttaaaactagtta

SEQ ID NO: 4820446 - DNA, 17 bp, Homo sapiens
aaggtttatttttctgt

SEQ ID NO: 4820447 - DNA, 17 bp, Homo sapiens
aaggtttcactgttcat

SEQ ID NO: 4820448 - DNA, 14 bp, Homo sapiens
aagtaaatctatct

SEQ ID NO: 4820449 - DNA, 16 bp, Homo sapiens
aagtaaatctatctct

SEQ ID NO: 4820450 - DNA, 13 bp, Homo sapiens
aagtaaattattt

SEQ ID NO: 4820451 - DNA, 21 bp, Homo sapiens
aagtaaattttctttaagtca

SEQ ID NO: 4820452 - DNA, 20 bp, Homo sapiens
aagtaacctctacaggcatt

SEQ ID NO: 4820453 - DNA, 15 bp, Homo sapiens
aagtaagttctgaaa

SEQ ID NO: 4820454 - DNA, 12 bp, Homo sapiens
aagtaattttct

SEQ ID NO: 4820455 - DNA, 23 bp, Homo sapiens
aagtacagggcagaaccaagaac

SEQ ID NO: 4820456 - DNA, 13 bp, Homo sapiens
aagtaccagaagc

SEQ ID NO: 4820457 - DNA, 14 bp, Homo sapiens
aagtactataattt

SEQ ID NO: 4820458 - DNA, 15 bp, Homo sapiens
aagtactggagaaaa

SEQ ID NO: 4820459 - DNA, 21 bp, Homo sapiens
aagtactggtaagattgttat

SEQ ID NO: 4820460 - DNA, 14 bp, Homo sapiens
aagtagatttcatg

SEQ ID NO: 4820461 - DNA, 18 bp, Homo sapiens
aagtagtacttcttctgt

SEQ ID NO: 4820462 - DNA, 23 bp, Homo sapiens
aagtagtgtctggatcagtaaaa

SEQ ID NO: 4820463 - DNA, 13 bp, Homo sapiens
aagtatatacaga

SEQ ID NO: 4820464 - DNA, 16 bp, Homo sapiens
aagtatatacagagcc

SEQ ID NO: 4820465 - DNA, 18 bp, Homo sapiens
aagtatattcaaaaatta

SEQ ID NO: 4820466 - DNA, 16 bp, Homo sapiens
aagtattccaccttaa

SEQ ID NO: 4820467 - DNA, 19 bp, Homo sapiens
aagtattccaccttaaatt

SEQ ID NO: 4820468 - DNA, 21 bp, Homo sapiens
aagtattccaccttaaattaa

SEQ ID NO: 4820469 - DNA, 15 bp, Homo sapiens
aagtattccttggcc

SEQ ID NO: 4820470 - DNA, 22 bp, Homo sapiens
aagtattcctttcctgatcact

SEQ ID NO: 4820471 - DNA, 18 bp, Homo sapiens
aagtattttatctgtgtt

SEQ ID NO: 4820472 - DNA, 16 bp, Homo sapiens
aagtcaaacagtgtgg

SEQ ID NO: 4820473 - DNA, 12 bp, Homo sapiens
aagtcaagtcta

SEQ ID NO: 4820474 - DNA, 15 bp, Homo sapiens
aagtcaggagccagc

SEQ ID NO: 4820475 - DNA, 17 bp, Homo sapiens
aagtcaggagccagcag

SEQ ID NO: 4820476 - DNA, 15 bp, Homo sapiens
aagtcccgaggcagc

SEQ ID NO: 4820477 - DNA, 16 bp, Homo sapiens
aagtcccgaggcagca

SEQ ID NO: 4820478 - DNA, 20 bp, Homo sapiens
aagtcccgtgccctgtttcc

SEQ ID NO: 4820479 - DNA, 16 bp, Homo sapiens
aagtcctcgccccccg

SEQ ID NO: 4820480 - DNA, 16 bp, Homo sapiens
aagtcggttaaaatgg

SEQ ID NO: 4820481 - DNA, 15 bp, Homo sapiens
aagtctcctgtatca

SEQ ID NO: 4820482 - DNA, 15 bp, Homo sapiens
aagtcttactgtttt

SEQ ID NO: 4820483 - DNA, 13 bp, Homo sapiens
aagtgaaattagt

SEQ ID NO: 4820484 - DNA, 20 bp, Homo sapiens
aagtgaaattagtattttga

SEQ ID NO: 4820485 - DNA, 12 bp, Homo sapiens
aagtgaccagca

SEQ ID NO: 4820486 - DNA, 14 bp, Homo sapiens
aagtgagaaaactg

SEQ ID NO: 4820487 - DNA, 15 bp, Homo sapiens
aagtgagatgtttgg

SEQ ID NO: 4820488 - DNA, 16 bp, Homo sapiens
aagtgaggatgaaaaa

SEQ ID NO: 4820489 - DNA, 16 bp, Homo sapiens
aagtgatgatggatga

SEQ ID NO: 4820490 - DNA, 21 bp, Homo sapiens
aagtgatgtgatttatgcatt

SEQ ID NO: 4820491 - DNA, 22 bp, Homo sapiens
aagtgatgtgatttatgcattt

SEQ ID NO: 4820492 - DNA, 15 bp, Homo sapiens
aagtgattgacattt

SEQ ID NO: 4820493 - DNA, 12 bp, Homo sapiens
aagtgcatgtta

SEQ ID NO: 4820494 - DNA, 16 bp, Homo sapiens
aagtgcatgttaaaat

SEQ ID NO: 4820495 - DNA, 22 bp, Homo sapiens
aagtgcatgttaaaataattat

SEQ ID NO: 4820496 - DNA, 17 bp, Homo sapiens
aagtggaaggataatga

SEQ ID NO: 4820497 - DNA, 21 bp, Homo sapiens
aagtggaaggataatgagatg

SEQ ID NO: 4820498 - DNA, 15 bp, Homo sapiens
aagtggactgtattt

SEQ ID NO: 4820499 - DNA, 19 bp, Homo sapiens
aagtgggattcaggaatgg

SEQ ID NO: 4820500 - DNA, 23 bp, Homo sapiens
aagtgtattggtttctgtttgaa

SEQ ID NO: 4820501 - DNA, 16 bp, Homo sapiens
aagtgtgtgtgcaatg

SEQ ID NO: 4820502 - DNA, 11 bp, Homo sapiens
aagtgtgttct

SEQ ID NO: 4820503 - DNA, 12 bp, Homo sapiens
aagtgtgttctg

SEQ ID NO: 4820504 - DNA, 20 bp, Homo sapiens
aagtgttctgtggctgattt

SEQ ID NO: 4820505 - DNA, 20 bp, Homo sapiens
aagtgttggccatcatttca

SEQ ID NO: 4820506 - DNA, 23 bp, Homo sapiens
aagtgttgtacaattactgtgag

SEQ ID NO: 4820507 - DNA, 22 bp, Homo sapiens
aagtgtttctagtaacagtatt

SEQ ID NO: 4820508 - DNA, 17 bp, Homo sapiens
aagttataccagcaaaa

SEQ ID NO: 4820509 - DNA, 15 bp, Homo sapiens
aagttattaacattt

SEQ ID NO: 4820510 - DNA, 16 bp, Homo sapiens
aagttctattatctgg

SEQ ID NO: 4820511 - DNA, 18 bp, Homo sapiens
aagttctgaaaactgttt

SEQ ID NO: 4820512 - DNA, 19 bp, Homo sapiens
aagttctgaaaactgttta

SEQ ID NO: 4820513 - DNA, 14 bp, Homo sapiens
aagttgaatgataa

SEQ ID NO: 4820514 - DNA, 19 bp, Homo sapiens
aagttgaatgataatagct

SEQ ID NO: 4820515 - DNA, 16 bp, Homo sapiens
aagttgcagtcagaag

SEQ ID NO: 4820516 - DNA, 19 bp, Homo sapiens
aagttgccacattgcttca

SEQ ID NO: 4820517 - DNA, 22 bp, Homo sapiens
aagttgccacattgcttcatta

SEQ ID NO: 4820518 - DNA, 17 bp, Homo sapiens
aagttgtgatctgttgt

SEQ ID NO: 4820519 - DNA, 17 bp, Homo sapiens
aagtttattttctattt

SEQ ID NO: 4820520 - DNA, 19 bp, Homo sapiens
aagtttctgccgcagccct

SEQ ID NO: 4820521 - DNA, 16 bp, Homo sapiens
aagttttacttgatta

SEQ ID NO: 4820522 - DNA, 13 bp, Homo sapiens
aagttttcagatt

SEQ ID NO: 4820523 - DNA, 17 bp, Homo sapiens
aagttttctcttttaag

SEQ ID NO: 4820524 - DNA, 20 bp, Homo sapiens
aagttttgatacttgtaact

SEQ ID NO: 4820525 - DNA, 15 bp, Homo sapiens
aagtttttggtaatg

SEQ ID NO: 4820526 - DNA, 12 bp, Homo sapiens
aataaaacatta

SEQ ID NO: 4820527 - DNA, 13 bp, Homo sapiens
aataaaaccagaa

SEQ ID NO: 4820528 - DNA, 16 bp, Homo sapiens
aataaaattcattcca

SEQ ID NO: 4820529 - DNA, 12 bp, Homo sapiens
aataaacacaga

SEQ ID NO: 4820530 - DNA, 17 bp, Homo sapiens
aataaagagtaaatata

SEQ ID NO: 4820531 - DNA, 15 bp, Homo sapiens
aataaaggttctatg

SEQ ID NO: 4820532 - DNA, 11 bp, Homo sapiens
aataaagtatt

SEQ ID NO: 4820533 - DNA, 15 bp, Homo sapiens
aataaagtattccac

SEQ ID NO: 4820534 - DNA, 14 bp, Homo sapiens
aataaataagtaaa

SEQ ID NO: 4820535 - DNA, 13 bp, Homo sapiens
aataaatgctgct

SEQ ID NO: 4820536 - DNA, 15 bp, Homo sapiens
aataaatgctgcttt

SEQ ID NO: 4820537 - DNA, 18 bp, Homo sapiens
aataaatgtgtaaatgtg

SEQ ID NO: 4820538 - DNA, 13 bp, Homo sapiens
aataaatgttttg

SEQ ID NO: 4820539 - DNA, 21 bp, Homo sapiens
aataaattaaataaaataacc

SEQ ID NO: 4820540 - DNA, 21 bp, Homo sapiens
aataacaacagtttttatgtt

SEQ ID NO: 4820541 - DNA, 15 bp, Homo sapiens
aataaccctgaatca

SEQ ID NO: 4820542 - DNA, 18 bp, Homo sapiens
aataaccctgaatcagag

SEQ ID NO: 4820543 - DNA, 18 bp, Homo sapiens
aataactagatctcctgt

SEQ ID NO: 4820544 - DNA, 13 bp, Homo sapiens
aataactgtgact

SEQ ID NO: 4820545 - DNA, 14 bp, Homo sapiens
aataactgttagaa

SEQ ID NO: 4820546 - DNA, 13 bp, Homo sapiens
aataagatattac

SEQ ID NO: 4820547 - DNA, 19 bp, Homo sapiens
aataaggatttattctcag

SEQ ID NO: 4820548 - DNA, 14 bp, Homo sapiens
aataagtaaataca

SEQ ID NO: 4820549 - DNA, 16 bp, Homo sapiens
aataagttgaatgata

SEQ ID NO: 4820550 - DNA, 12 bp, Homo sapiens
aataataaaaga

SEQ ID NO: 4820551 - DNA, 16 bp, Homo sapiens
aataataaaagaatca

SEQ ID NO: 4820552 - DNA, 13 bp, Homo sapiens
aataataaaggtt

SEQ ID NO: 4820553 - DNA, 20 bp, Homo sapiens
aataataaaggttctatgat

SEQ ID NO: 4820554 - DNA, 21 bp, Homo sapiens
aataataaaggttctatgata

SEQ ID NO: 4820555 - DNA, 15 bp, Homo sapiens
aataatgattcaatg

SEQ ID NO: 4820556 - DNA, 11 bp, Homo sapiens
aataatgattt

SEQ ID NO: 4820557 - DNA, 23 bp, Homo sapiens
aataatgcttaacataaacttgt

SEQ ID NO: 4820558 - DNA, 12 bp, Homo sapiens
aataattaaaac

SEQ ID NO: 4820559 - DNA, 20 bp, Homo sapiens
aatacagtattatttagtaa

SEQ ID NO: 4820560 - DNA, 23 bp, Homo sapiens
aatacatactatagattctttat

SEQ ID NO: 4820561 - DNA, 12 bp, Homo sapiens
aatacatgcctt

SEQ ID NO: 4820562 - DNA, 15 bp, Homo sapiens
aatactaataaaata

SEQ ID NO: 4820563 - DNA, 18 bp, Homo sapiens
aatactgtattgttacag

SEQ ID NO: 4820564 - DNA, 19 bp, Homo sapiens
aatacttgacaacattttt

SEQ ID NO: 4820565 - DNA, 12 bp, Homo sapiens
aatactttgtat

SEQ ID NO: 4820566 - DNA, 17 bp, Homo sapiens
aatactttgtatacaag

SEQ ID NO: 4820567 - DNA, 18 bp, Homo sapiens
aatagaaagtcagatgac

SEQ ID NO: 4820568 - DNA, 19 bp, Homo sapiens
aatagatcacggcatgttt

SEQ ID NO: 4820569 - DNA, 15 bp, Homo sapiens
aatagatttttagat

SEQ ID NO: 4820570 - DNA, 18 bp, Homo sapiens
aatagatttttagattcc

SEQ ID NO: 4820571 - DNA, 15 bp, Homo sapiens
aatagcatctgctct

SEQ ID NO: 4820572 - DNA, 22 bp, Homo sapiens
aatagctataaatagtgaaaat

SEQ ID NO: 4820573 - DNA, 19 bp, Homo sapiens
aatagctcacagcacattt

SEQ ID NO: 4820574 - DNA, 21 bp, Homo sapiens
aatagctcacagcacatttgt

SEQ ID NO: 4820575 - DNA, 22 bp, Homo sapiens
aatagctcacagcacatttgtt

SEQ ID NO: 4820576 - DNA, 20 bp, Homo sapiens
aatagcttttcacttcttaa

SEQ ID NO: 4820577 - DNA, 23 bp, Homo sapiens
aatagtaaataatgattcaatgt

SEQ ID NO: 4820578 - DNA, 17 bp, Homo sapiens
aatagtacatgcagaaa

SEQ ID NO: 4820579 - DNA, 16 bp, Homo sapiens
aatagtcatatgtgaa

SEQ ID NO: 4820580 - DNA, 18 bp, Homo sapiens
aatagtcatatgtgaaga

SEQ ID NO: 4820581 - DNA, 15 bp, Homo sapiens
aatagtcatgtttct

SEQ ID NO: 4820582 - DNA, 16 bp, Homo sapiens
aatagtctgccacaag

SEQ ID NO: 4820583 - DNA, 21 bp, Homo sapiens
aatagtgaaaattttattgaa

SEQ ID NO: 4820584 - DNA, 20 bp, Homo sapiens
aatagtgttgaggaggggag

SEQ ID NO: 4820585 - DNA, 16 bp, Homo sapiens
aatataaaaacatttt

SEQ ID NO: 4820586 - DNA, 17 bp, Homo sapiens
aatataaaaacattttt

SEQ ID NO: 4820587 - DNA, 16 bp, Homo sapiens
aatataaaaataatta

SEQ ID NO: 4820588 - DNA, 17 bp, Homo sapiens
aatataaaaataattaa

SEQ ID NO: 4820589 - DNA, 12 bp, Homo sapiens
aatataaactgt

SEQ ID NO: 4820590 - DNA, 14 bp, Homo sapiens
aatataaactgtga

SEQ ID NO: 4820591 - DNA, 15 bp, Homo sapiens
aatataaactgtgag

SEQ ID NO: 4820592 - DNA, 12 bp, Homo sapiens
aatataaacttg

SEQ ID NO: 4820593 - DNA, 17 bp, Homo sapiens
aatataaacttgtgtat

SEQ ID NO: 4820594 - DNA, 17 bp, Homo sapiens
aatataaatcacagatt

SEQ ID NO: 4820595 - DNA, 22 bp, Homo sapiens
aatataaatcacagatttccaa

SEQ ID NO: 4820596 - DNA, 16 bp, Homo sapiens
aatataaatgtgtgta

SEQ ID NO: 4820597 - DNA, 20 bp, Homo sapiens
aatataaatgtgtgtatgtg

SEQ ID NO: 4820598 - DNA, 13 bp, Homo sapiens
aatataagacaag

SEQ ID NO: 4820599 - DNA, 20 bp, Homo sapiens
aatataatggcctcttaaaa

SEQ ID NO: 4820600 - DNA, 19 bp, Homo sapiens
aatataatgggctgcaaaa

SEQ ID NO: 4820601 - DNA, 15 bp, Homo sapiens
aatatacaaacatgt

SEQ ID NO: 4820602 - DNA, 20 bp, Homo sapiens
aatatactcattagaattac

SEQ ID NO: 4820603 - DNA, 16 bp, Homo sapiens
aatatactcatttgga

SEQ ID NO: 4820604 - DNA, 21 bp, Homo sapiens
aatatagaaaaaaacattcta

SEQ ID NO: 4820605 - DNA, 18 bp, Homo sapiens
aatatagggtttgtttgc

SEQ ID NO: 4820606 - DNA, 13 bp, Homo sapiens
aatatatgtaata

SEQ ID NO: 4820607 - DNA, 14 bp, Homo sapiens
aatatatgtaatat

SEQ ID NO: 4820608 - DNA, 16 bp, Homo sapiens
aatatcactcattaat

SEQ ID NO: 4820609 - DNA, 17 bp, Homo sapiens
aatatcactcattaatt

SEQ ID NO: 4820610 - DNA, 16 bp, Homo sapiens
aatatcagttacagtg

SEQ ID NO: 4820611 - DNA, 16 bp, Homo sapiens
aatatcattatagcat

SEQ ID NO: 4820612 - DNA, 18 bp, Homo sapiens
aatatcattttcctggga

SEQ ID NO: 4820613 - DNA, 19 bp, Homo sapiens
aatatcattttcctgggag

SEQ ID NO: 4820614 - DNA, 15 bp, Homo sapiens
aatatctaaataatg

SEQ ID NO: 4820615 - DNA, 14 bp, Homo sapiens
aatatctagtgcta

SEQ ID NO: 4820616 - DNA, 18 bp, Homo sapiens
aatatctagtgctaaacc

SEQ ID NO: 4820617 - DNA, 16 bp, Homo sapiens
aatatctctatttaat

SEQ ID NO: 4820618 - DNA, 19 bp, Homo sapiens
aatatctgtgaaatatcat

SEQ ID NO: 4820619 - DNA, 17 bp, Homo sapiens
aatatctgtgaaggact

SEQ ID NO: 4820620 - DNA, 17 bp, Homo sapiens
aatatcttgaagaatat

SEQ ID NO: 4820621 - DNA, 18 bp, Homo sapiens
aatatcttgaagaatatt

SEQ ID NO: 4820622 - DNA, 17 bp, Homo sapiens
aatatcttttcttctcc

SEQ ID NO: 4820623 - DNA, 21 bp, Homo sapiens
aatatgattctcctctcccaa

SEQ ID NO: 4820624 - DNA, 15 bp, Homo sapiens
aatatggacaaagaa

SEQ ID NO: 4820625 - DNA, 14 bp, Homo sapiens
aatatgtgtaactt

SEQ ID NO: 4820626 - DNA, 15 bp, Homo sapiens
aatatgtgtaacttt

SEQ ID NO: 4820627 - DNA, 20 bp, Homo sapiens
aatattaaaaattaattctt

SEQ ID NO: 4820628 - DNA, 21 bp, Homo sapiens
aatattaagcacattattgta

SEQ ID NO: 4820629 - DNA, 14 bp, Homo sapiens
aatattatacttct

SEQ ID NO: 4820630 - DNA, 21 bp, Homo sapiens
aatattatacttctttattca

SEQ ID NO: 4820631 - DNA, 19 bp, Homo sapiens
aatattcatagtagaactt

SEQ ID NO: 4820632 - DNA, 18 bp, Homo sapiens
aatattcatgctgcctgc

SEQ ID NO: 4820633 - DNA, 10 bp, Homo sapiens
aatattctgt

SEQ ID NO: 4820634 - DNA, 18 bp, Homo sapiens
aatattgatctgtattaa

SEQ ID NO: 4820635 - DNA, 11 bp, Homo sapiens
aatattgcttg

SEQ ID NO: 4820636 - DNA, 15 bp, Homo sapiens
aatattgtattgtta

SEQ ID NO: 4820637 - DNA, 19 bp, Homo sapiens
aatattgtttaatgcaaat

SEQ ID NO: 4820638 - DNA, 17 bp, Homo sapiens
aatatttacaatgtatt

SEQ ID NO: 4820639 - DNA, 19 bp, Homo sapiens
aatatttacaatgtattaa

SEQ ID NO: 4820640 - DNA, 13 bp, Homo sapiens
aatatttattgct

SEQ ID NO: 4820641 - DNA, 14 bp, Homo sapiens
aatatttattgctt

SEQ ID NO: 4820642 - DNA, 23 bp, Homo sapiens
aatatttattgctttataaataa

SEQ ID NO: 4820643 - DNA, 15 bp, Homo sapiens
aatatttcttcaaat

SEQ ID NO: 4820644 - DNA, 16 bp, Homo sapiens
aatatttgcttattta

SEQ ID NO: 4820645 - DNA, 17 bp, Homo sapiens
aatattttcattataca

SEQ ID NO: 4820646 - DNA, 16 bp, Homo sapiens
aatattttcttaatta

SEQ ID NO: 4820647 - DNA, 19 bp, Homo sapiens
aatattttcttaattatgg

SEQ ID NO: 4820648 - DNA, 14 bp, Homo sapiens
aatattttgctgct

SEQ ID NO: 4820649 - DNA, 20 bp, Homo sapiens
aatattttgctgctgaattt

SEQ ID NO: 4820650 - DNA, 13 bp, Homo sapiens
aatcaaaaaatta

SEQ ID NO: 4820651 - DNA, 14 bp, Homo sapiens
aatcaaaaattgaa

SEQ ID NO: 4820652 - DNA, 17 bp, Homo sapiens
aatcaaaaattgaagag

SEQ ID NO: 4820653 - DNA, 18 bp, Homo sapiens
aatcaagtctgtgaaagt

SEQ ID NO: 4820654 - DNA, 20 bp, Homo sapiens
aatcaagtctgtgaaagtct

SEQ ID NO: 4820655 - DNA, 15 bp, Homo sapiens
aatcaatactttgaa

SEQ ID NO: 4820656 - DNA, 16 bp, Homo sapiens
aatcaatctggcttct

SEQ ID NO: 4820657 - DNA, 21 bp, Homo sapiens
aatcaatctggcttctgcatt

SEQ ID NO: 4820658 - DNA, 23 bp, Homo sapiens
aatcaatgttcacgcaacttgaa

SEQ ID NO: 4820659 - DNA, 16 bp, Homo sapiens
aatcacaaaagtatat

SEQ ID NO: 4820660 - DNA, 14 bp, Homo sapiens
aatcagtaatctgt

SEQ ID NO: 4820661 - DNA, 20 bp, Homo sapiens
aatcatatgggatactgctg

SEQ ID NO: 4820662 - DNA, 15 bp, Homo sapiens
aatcatctattgagt

SEQ ID NO: 4820663 - DNA, 21 bp, Homo sapiens
aatcatgcctacattagtgag

SEQ ID NO: 4820664 - DNA, 12 bp, Homo sapiens
aatcatggattt

SEQ ID NO: 4820665 - DNA, 13 bp, Homo sapiens
aatcatgggcatt

SEQ ID NO: 4820666 - DNA, 19 bp, Homo sapiens
aatcatgggcattgctgga

SEQ ID NO: 4820667 - DNA, 13 bp, Homo sapiens
aatcattgtacag

SEQ ID NO: 4820668 - DNA, 15 bp, Homo sapiens
aatcattgtacagtt

SEQ ID NO: 4820669 - DNA, 17 bp, Homo sapiens
aatcatttccagcaaaa

SEQ ID NO: 4820670 - DNA, 16 bp, Homo sapiens
aatcattttgatgtat

SEQ ID NO: 4820671 - DNA, 15 bp, Homo sapiens
aatccaatagtctgc

SEQ ID NO: 4820672 - DNA, 13 bp, Homo sapiens
aatccacacatca

SEQ ID NO: 4820673 - DNA, 12 bp, Homo sapiens
aatccagccttc

SEQ ID NO: 4820674 - DNA, 21 bp, Homo sapiens
aatccagccttcttcccccag

SEQ ID NO: 4820675 - DNA, 20 bp, Homo sapiens
aatccataccccctgcccca

SEQ ID NO: 4820676 - DNA, 13 bp, Homo sapiens
aatccatcgattt

SEQ ID NO: 4820677 - DNA, 15 bp, Homo sapiens
aatccatgtgtcccc

SEQ ID NO: 4820678 - DNA, 24 bp, Homo sapiens
aatccatgtgtcccccctgtggtc

SEQ ID NO: 4820679 - DNA, 21 bp, Homo sapiens
aatccccgtgctcacagtagc

SEQ ID NO: 4820680 - DNA, 17 bp, Homo sapiens
aatcccctaactgattt

SEQ ID NO: 4820681 - DNA, 22 bp, Homo sapiens
aatccctcttcctccaaagcct

SEQ ID NO: 4820682 - DNA, 17 bp, Homo sapiens
aatccctgttcattgta

SEQ ID NO: 4820683 - DNA, 16 bp, Homo sapiens
aatcctgttacttaaa

SEQ ID NO: 4820684 - DNA, 16 bp, Homo sapiens
aatccttgccttcaaa

SEQ ID NO: 4820685 - DNA, 22 bp, Homo sapiens
aatcgaggtgtgggccagagat

SEQ ID NO: 4820686 - DNA, 20 bp, Homo sapiens
aatcgatgggggatgcttca

SEQ ID NO: 4820687 - DNA, 21 bp, Homo sapiens
aatcgatgggggatgcttcat

SEQ ID NO: 4820688 - DNA, 19 bp, Homo sapiens
aatcgtacattgtgccctg

SEQ ID NO: 4820689 - DNA, 13 bp, Homo sapiens
aatctaaatataa

SEQ ID NO: 4820690 - DNA, 14 bp, Homo sapiens
aatctaacattatt

SEQ ID NO: 4820691 - DNA, 21 bp, Homo sapiens
aatctacttaaccctgacaaa

SEQ ID NO: 4820692 - DNA, 19 bp, Homo sapiens
aatctaggcgaaagtaatg

SEQ ID NO: 4820693 - DNA, 23 bp, Homo sapiens
aatctcaaaagatctcctgtgca

SEQ ID NO: 4820694 - DNA, 14 bp, Homo sapiens
aatctcactgtatt

SEQ ID NO: 4820695 - DNA, 11 bp, Homo sapiens
aatctcagcac

SEQ ID NO: 4820696 - DNA, 19 bp, Homo sapiens
aatctcagcactttgtttc

SEQ ID NO: 4820697 - DNA, 19 bp, Homo sapiens
aatctcatacctctgacca

SEQ ID NO: 4820698 - DNA, 18 bp, Homo sapiens
aatctctcaaaatgtgcc

SEQ ID NO: 4820699 - DNA, 19 bp, Homo sapiens
aatctctcaaaatgtgccg

SEQ ID NO: 4820700 - DNA, 22 bp, Homo sapiens
aatctctcaaaatgtgccgtct

SEQ ID NO: 4820701 - DNA, 12 bp, Homo sapiens
aatctgaagcct

SEQ ID NO: 4820702 - DNA, 14 bp, Homo sapiens
aatctggcttctgc

SEQ ID NO: 4820703 - DNA, 21 bp, Homo sapiens
aatctgtataaatgtgaaatt

SEQ ID NO: 4820704 - DNA, 20 bp, Homo sapiens
aatctgtataatactttgta

SEQ ID NO: 4820705 - DNA, 19 bp, Homo sapiens
aatctgtccagacaagccc

SEQ ID NO: 4820706 - DNA, 19 bp, Homo sapiens
aatctgtcgcatttcatca

SEQ ID NO: 4820707 - DNA, 22 bp, Homo sapiens
aatcttacccttcaatgttaaa

SEQ ID NO: 4820708 - DNA, 15 bp, Homo sapiens
aatcttgctgtgaaa

SEQ ID NO: 4820709 - DNA, 17 bp, Homo sapiens
aatctttcggtctcctt

SEQ ID NO: 4820710 - DNA, 16 bp, Homo sapiens
aatctttgtgacagga

SEQ ID NO: 4820711 - DNA, 22 bp, Homo sapiens
aatctttgtgacaggaaagccc

SEQ ID NO: 4820712 - DNA, 17 bp, Homo sapiens
aatgaaaaatctgaatt

SEQ ID NO: 4820713 - DNA, 13 bp, Homo sapiens
aatgaaatatttg

SEQ ID NO: 4820714 - DNA, 21 bp, Homo sapiens
aatgaaatatttgcttattta

SEQ ID NO: 4820715 - DNA, 17 bp, Homo sapiens
aatgaactaactgccat

SEQ ID NO: 4820716 - DNA, 14 bp, Homo sapiens
aatgaagcaaacac

SEQ ID NO: 4820717 - DNA, 18 bp, Homo sapiens
aatgaagcaaacacacag

SEQ ID NO: 4820718 - DNA, 19 bp, Homo sapiens
aatgaataatgcctttgta

SEQ ID NO: 4820719 - DNA, 18 bp, Homo sapiens
aatgaatgaaatataaac

SEQ ID NO: 4820720 - DNA, 23 bp, Homo sapiens
aatgaatgaaatataaactgtga

SEQ ID NO: 4820721 - DNA, 14 bp, Homo sapiens
aatgaatgtcagtg

SEQ ID NO: 4820722 - DNA, 15 bp, Homo sapiens
aatgaatgtcagtgt

SEQ ID NO: 4820723 - DNA, 14 bp, Homo sapiens
aatgaattcacccc

SEQ ID NO: 4820724 - DNA, 12 bp, Homo sapiens
aatgaattttaa

SEQ ID NO: 4820725 - DNA, 18 bp, Homo sapiens
aatgaattttaaaagcat

SEQ ID NO: 4820726 - DNA, 16 bp, Homo sapiens
aatgacactggaaggg

SEQ ID NO: 4820727 - DNA, 16 bp, Homo sapiens
aatgacatgcactgac

SEQ ID NO: 4820728 - DNA, 21 bp, Homo sapiens
aatgacttacttagaatttat

SEQ ID NO: 4820729 - DNA, 21 bp, Homo sapiens
aatgagatcccagagttattt

SEQ ID NO: 4820730 - DNA, 16 bp, Homo sapiens
aatgagcattctgcag

SEQ ID NO: 4820731 - DNA, 16 bp, Homo sapiens
aatgataatagctcac

SEQ ID NO: 4820732 - DNA, 18 bp, Homo sapiens
aatgatatgtctttaaaa

SEQ ID NO: 4820733 - DNA, 16 bp, Homo sapiens
aatgatattgctgaag

SEQ ID NO: 4820734 - DNA, 20 bp, Homo sapiens
aatgatgccatgaggaacaa

SEQ ID NO: 4820735 - DNA, 15 bp, Homo sapiens
aatgattcaatgtga

SEQ ID NO: 4820736 - DNA, 17 bp, Homo sapiens
aatgattcaatgtgaat

SEQ ID NO: 4820737 - DNA, 19 bp, Homo sapiens
aatgattcacttttattgt

SEQ ID NO: 4820738 - DNA, 14 bp, Homo sapiens
aatgatttaaattt

SEQ ID NO: 4820739 - DNA, 16 bp, Homo sapiens
aatgcaaatattgcta

SEQ ID NO: 4820740 - DNA, 14 bp, Homo sapiens
aatgcaatgcatct

SEQ ID NO: 4820741 - DNA, 17 bp, Homo sapiens
aatgcaatgcatctgaa

SEQ ID NO: 4820742 - DNA, 19 bp, Homo sapiens
aatgcagtataaaatgtaa

SEQ ID NO: 4820743 - DNA, 23 bp, Homo sapiens
aatgcagtgtatttaatgtttgt

SEQ ID NO: 4820744 - DNA, 18 bp, Homo sapiens
aatgcatctgaaagtttt

SEQ ID NO: 4820745 - DNA, 14 bp, Homo sapiens
aatgccaagactct

SEQ ID NO: 4820746 - DNA, 19 bp, Homo sapiens
aatgccaagactctatgct

SEQ ID NO: 4820747 - DNA, 21 bp, Homo sapiens
aatgccagacttctaaaataa

SEQ ID NO: 4820748 - DNA, 15 bp, Homo sapiens
aatgcctattgtaat

SEQ ID NO: 4820749 - DNA, 18 bp, Homo sapiens
aatgccttgttgtattcc

SEQ ID NO: 4820750 - DNA, 13 bp, Homo sapiens
aatgcctttgtaa

SEQ ID NO: 4820751 - DNA, 23 bp, Homo sapiens
aatgcctttgtaaccacaacttt

SEQ ID NO: 4820752 - DNA, 18 bp, Homo sapiens
aatgcgctcttcaccagg

SEQ ID NO: 4820753 - DNA, 14 bp, Homo sapiens
aatgctaaatgcaa

SEQ ID NO: 4820754 - DNA, 20 bp, Homo sapiens
aatgctacaaaatgtgtgct

SEQ ID NO: 4820755 - DNA, 15 bp, Homo sapiens
aatgctatggactgc

SEQ ID NO: 4820756 - DNA, 16 bp, Homo sapiens
aatgctatggactgca

SEQ ID NO: 4820757 - DNA, 14 bp, Homo sapiens
aatgctatttgtgt

SEQ ID NO: 4820758 - DNA, 16 bp, Homo sapiens
aatgctcaatgtgctg

SEQ ID NO: 4820759 - DNA, 13 bp, Homo sapiens
aatgctgatttaa

SEQ ID NO: 4820760 - DNA, 12 bp, Homo sapiens
aatgctgctttg

SEQ ID NO: 4820761 - DNA, 13 bp, Homo sapiens
aatgctgctttgg

SEQ ID NO: 4820762 - DNA, 19 bp, Homo sapiens
aatgctgttctcaatcatt

SEQ ID NO: 4820763 - DNA, 16 bp, Homo sapiens
aatgcttaacataaac

SEQ ID NO: 4820764 - DNA, 18 bp, Homo sapiens
aatgcttaacataaactt

SEQ ID NO: 4820765 - DNA, 11 bp, Homo sapiens
aatgctttctc

SEQ ID NO: 4820766 - DNA, 12 bp, Homo sapiens
aatgctttctca

SEQ ID NO: 4820767 - DNA, 14 bp, Homo sapiens
aatgctttctcatg

SEQ ID NO: 4820768 - DNA, 21 bp, Homo sapiens
aatgctttctcatgcatagac

SEQ ID NO: 4820769 - DNA, 12 bp, Homo sapiens
aatgcttttcta

SEQ ID NO: 4820770 - DNA, 17 bp, Homo sapiens
aatggaaaactgttaag

SEQ ID NO: 4820771 - DNA, 16 bp, Homo sapiens
aatggaagagagaaag

SEQ ID NO: 4820772 - DNA, 21 bp, Homo sapiens
aatggacgtgttatgactcca

SEQ ID NO: 4820773 - DNA, 14 bp, Homo sapiens
aatggacttgcttc

SEQ ID NO: 4820774 - DNA, 17 bp, Homo sapiens
aatggatatgaaagaga

SEQ ID NO: 4820775 - DNA, 19 bp, Homo sapiens
aatggatatgaaagagaaa

SEQ ID NO: 4820776 - DNA, 18 bp, Homo sapiens
aatggatgacaaagaaaa

SEQ ID NO: 4820777 - DNA, 15 bp, Homo sapiens
aatggatgtaatata

SEQ ID NO: 4820778 - DNA, 16 bp, Homo sapiens
aatggcatttagcaca

SEQ ID NO: 4820779 - DNA, 18 bp, Homo sapiens
aatggcatttagcacagt

SEQ ID NO: 4820780 - DNA, 19 bp, Homo sapiens
aatggcctcttaaaaatta

SEQ ID NO: 4820781 - DNA, 19 bp, Homo sapiens
aatggcctggtaggtctgg

SEQ ID NO: 4820782 - DNA, 19 bp, Homo sapiens
aatggcctgtccctagggc

SEQ ID NO: 4820783 - DNA, 14 bp, Homo sapiens
aatggctattaaca

SEQ ID NO: 4820784 - DNA, 12 bp, Homo sapiens
aatggctctggg

SEQ ID NO: 4820785 - DNA, 21 bp, Homo sapiens
aatggctctgggctatatgcc

SEQ ID NO: 4820786 - DNA, 22 bp, Homo sapiens
aatggctgaagaaacacagcat

SEQ ID NO: 4820787 - DNA, 22 bp, Homo sapiens
aatggctgggtttgggcagtgg

SEQ ID NO: 4820788 - DNA, 21 bp, Homo sapiens
aatgggctgcaaaatgaagac

SEQ ID NO: 4820789 - DNA, 23 bp, Homo sapiens
aatgggctgcaaaatgaagacac

SEQ ID NO: 4820790 - DNA, 17 bp, Homo sapiens
aatggggaactccccca

SEQ ID NO: 4820791 - DNA, 20 bp, Homo sapiens
aatggggaactcccccagag

SEQ ID NO: 4820792 - DNA, 19 bp, Homo sapiens
aatggggaagattagaaag

SEQ ID NO: 4820793 - DNA, 23 bp, Homo sapiens
aatgggtaaataaatgctgcttt

SEQ ID NO: 4820794 - DNA, 13 bp, Homo sapiens
aatggtaaatctt

SEQ ID NO: 4820795 - DNA, 17 bp, Homo sapiens
aatggtattttttgtga

SEQ ID NO: 4820796 - DNA, 19 bp, Homo sapiens
aatggtattttttgtgaat

SEQ ID NO: 4820797 - DNA, 22 bp, Homo sapiens
aatggtgaactgtcattacaga

SEQ ID NO: 4820798 - DNA, 21 bp, Homo sapiens
aatggtgtcataactagagca

SEQ ID NO: 4820799 - DNA, 17 bp, Homo sapiens
aatggttgcaaagtgtt

SEQ ID NO: 4820800 - DNA, 22 bp, Homo sapiens
aatggttttcttgtgtgtttat

SEQ ID NO: 4820801 - DNA, 15 bp, Homo sapiens
aatgtaaaatattta

SEQ ID NO: 4820802 - DNA, 18 bp, Homo sapiens
aatgtaacttaattataa

SEQ ID NO: 4820803 - DNA, 18 bp, Homo sapiens
aatgtactacatttgcat

SEQ ID NO: 4820804 - DNA, 17 bp, Homo sapiens
aatgtagggcagaatag

SEQ ID NO: 4820805 - DNA, 22 bp, Homo sapiens
aatgtatcccttctcacagcac

SEQ ID NO: 4820806 - DNA, 12 bp, Homo sapiens
aatgtatcttat

SEQ ID NO: 4820807 - DNA, 15 bp, Homo sapiens
aatgtcagtgtgact

SEQ ID NO: 4820808 - DNA, 17 bp, Homo sapiens
aatgtcagtgtgactga

SEQ ID NO: 4820809 - DNA, 23 bp, Homo sapiens
aatgtcataaagtgagaaaactg

SEQ ID NO: 4820810 - DNA, 14 bp, Homo sapiens
aatgtcatttgcta

SEQ ID NO: 4820811 - DNA, 16 bp, Homo sapiens
aatgtcatttgctaat

SEQ ID NO: 4820812 - DNA, 20 bp, Homo sapiens
aatgtccaggtcacaggcat

SEQ ID NO: 4820813 - DNA, 14 bp, Homo sapiens
aatgtcctcagagg

SEQ ID NO: 4820814 - DNA, 23 bp, Homo sapiens
aatgtctataaatggtgtcataa

SEQ ID NO: 4820815 - DNA, 21 bp, Homo sapiens
aatgtgatatgtgtaatatca

SEQ ID NO: 4820816 - DNA, 22 bp, Homo sapiens
aatgtgccgtctttggttcctc

SEQ ID NO: 4820817 - DNA, 14 bp, Homo sapiens
aatgtgctgcaaag

SEQ ID NO: 4820818 - DNA, 15 bp, Homo sapiens
aatgtgctgcaaaga

SEQ ID NO: 4820819 - DNA, 18 bp, Homo sapiens
aatgtgctgttgattctt

SEQ ID NO: 4820820 - DNA, 21 bp, Homo sapiens
aatgtgctgttgattctttca

SEQ ID NO: 4820821 - DNA, 21 bp, Homo sapiens
aatgtggaattacataacagg

SEQ ID NO: 4820822 - DNA, 15 bp, Homo sapiens
aatgtggatgctctt

SEQ ID NO: 4820823 - DNA, 19 bp, Homo sapiens
aatgtgtgggcccaaggcc

SEQ ID NO: 4820824 - DNA, 22 bp, Homo sapiens
aatgttaaggacttctgcagct

SEQ ID NO: 4820825 - DNA, 10 bp, Homo sapiens
aatgttcatt

SEQ ID NO: 4820826 - DNA, 17 bp, Homo sapiens
aatgttccgttcatctg

SEQ ID NO: 4820827 - DNA, 21 bp, Homo sapiens
aatgttccgttcatctgagga

SEQ ID NO: 4820828 - DNA, 16 bp, Homo sapiens
aatgttgaagaactca

SEQ ID NO: 4820829 - DNA, 23 bp, Homo sapiens
aatgttggctagtctgtgcctca

SEQ ID NO: 4820830 - DNA, 18 bp, Homo sapiens
aatgttgtcctgtgtcat

SEQ ID NO: 4820831 - DNA, 17 bp, Homo sapiens
aatgtttatttttgctc

SEQ ID NO: 4820832 - DNA, 15 bp, Homo sapiens
aatgttttaaagaag

SEQ ID NO: 4820833 - DNA, 18 bp, Homo sapiens
aatgttttggaattcaat

SEQ ID NO: 4820834 - DNA, 11 bp, Homo sapiens
aattaaaaaat

SEQ ID NO: 4820835 - DNA, 20 bp, Homo sapiens
aattaaacaaattccttccc

SEQ ID NO: 4820836 - DNA, 15 bp, Homo sapiens
aattaaactgatggg

SEQ ID NO: 4820837 - DNA, 11 bp, Homo sapiens
aattaaagtct

SEQ ID NO: 4820838 - DNA, 12 bp, Homo sapiens
aattaaagtcta

SEQ ID NO: 4820839 - DNA, 17 bp, Homo sapiens
aattaaataaaataacc

SEQ ID NO: 4820840 - DNA, 19 bp, Homo sapiens
aattaaatatatgtatgta

SEQ ID NO: 4820841 - DNA, 12 bp, Homo sapiens
aattaacaaatt

SEQ ID NO: 4820842 - DNA, 23 bp, Homo sapiens
aattaactccgtttccaaataca

SEQ ID NO: 4820843 - DNA, 18 bp, Homo sapiens
aattaacttctattttca

SEQ ID NO: 4820844 - DNA, 13 bp, Homo sapiens
aattaatggaaaa

SEQ ID NO: 4820845 - DNA, 13 bp, Homo sapiens
aattacataacag

SEQ ID NO: 4820846 - DNA, 12 bp, Homo sapiens
aattacatgcat

SEQ ID NO: 4820847 - DNA, 17 bp, Homo sapiens
aattacatgcatgagca

SEQ ID NO: 4820848 - DNA, 16 bp, Homo sapiens
aattaccatttgttaa

SEQ ID NO: 4820849 - DNA, 23 bp, Homo sapiens
aattaccatttgttaatatcact

SEQ ID NO: 4820850 - DNA, 20 bp, Homo sapiens
aattactgtgagaactgtga

SEQ ID NO: 4820851 - DNA, 20 bp, Homo sapiens
aattagatccattaatttaa

SEQ ID NO: 4820852 - DNA, 18 bp, Homo sapiens
aattagggctctaatttc

SEQ ID NO: 4820853 - DNA, 19 bp, Homo sapiens
aattagggctctaatttcc

SEQ ID NO: 4820854 - DNA, 20 bp, Homo sapiens
aattagggctctaatttcct

SEQ ID NO: 4820855 - DNA, 18 bp, Homo sapiens
aattagtgagatttgtat

SEQ ID NO: 4820856 - DNA, 22 bp, Homo sapiens
aattagtgtccaactccaagtg

SEQ ID NO: 4820857 - DNA, 20 bp, Homo sapiens
aattagtgttttcattctgg

SEQ ID NO: 4820858 - DNA, 15 bp, Homo sapiens
aattataatgcatct

SEQ ID NO: 4820859 - DNA, 16 bp, Homo sapiens
aattatactgtgtgtg

SEQ ID NO: 4820860 - DNA, 22 bp, Homo sapiens
aattatatcagagtatgtcagt

SEQ ID NO: 4820861 - DNA, 18 bp, Homo sapiens
aattatatgaagcagaat

SEQ ID NO: 4820862 - DNA, 19 bp, Homo sapiens
aattatatgaagcagaatg

SEQ ID NO: 4820863 - DNA, 17 bp, Homo sapiens
aattatatgatatgcat

SEQ ID NO: 4820864 - DNA, 18 bp, Homo sapiens
aattatatgatatgcatg

SEQ ID NO: 4820865 - DNA, 19 bp, Homo sapiens
aattatatgatatgcatgt

SEQ ID NO: 4820866 - DNA, 13 bp, Homo sapiens
aattatattttga

SEQ ID NO: 4820867 - DNA, 22 bp, Homo sapiens
aattatcaaaaaacagaaaaac

SEQ ID NO: 4820868 - DNA, 19 bp, Homo sapiens
aattatcaagtctgttttg

SEQ ID NO: 4820869 - DNA, 13 bp, Homo sapiens
aattatcattgtt

SEQ ID NO: 4820870 - DNA, 20 bp, Homo sapiens
aattatcctcaagttgtgtg

SEQ ID NO: 4820871 - DNA, 17 bp, Homo sapiens
aattatctgttctatgg

SEQ ID NO: 4820872 - DNA, 19 bp, Homo sapiens
aattatctgttctatggac

SEQ ID NO: 4820873 - DNA, 18 bp, Homo sapiens
aattatgtcaaatggatg

SEQ ID NO: 4820874 - DNA, 19 bp, Homo sapiens
aattatgttgaaaagagta

SEQ ID NO: 4820875 - DNA, 18 bp, Homo sapiens
aattattaaaaattatag

SEQ ID NO: 4820876 - DNA, 17 bp, Homo sapiens
aattattaagctgtttg

SEQ ID NO: 4820877 - DNA, 14 bp, Homo sapiens
aattattaatgaat

SEQ ID NO: 4820878 - DNA, 13 bp, Homo sapiens
aattattacttta

SEQ ID NO: 4820879 - DNA, 15 bp, Homo sapiens
aattattactttaaa

SEQ ID NO: 4820880 - DNA, 23 bp, Homo sapiens
aattattactttaaattatatga

SEQ ID NO: 4820881 - DNA, 20 bp, Homo sapiens
aattattgggcttaatataa

SEQ ID NO: 4820882 - DNA, 20 bp, Homo sapiens
aattatttctaaaacattaa

SEQ ID NO: 4820883 - DNA, 15 bp, Homo sapiens
aattcacaaagttaa

SEQ ID NO: 4820884 - DNA, 16 bp, Homo sapiens
aattcattcatactta

SEQ ID NO: 4820885 - DNA, 13 bp, Homo sapiens
aattcattccatt

SEQ ID NO: 4820886 - DNA, 15 bp, Homo sapiens
aattcattccatttg

SEQ ID NO: 4820887 - DNA, 20 bp, Homo sapiens
aattccacctggaaagccag

SEQ ID NO: 4820888 - DNA, 13 bp, Homo sapiens
aattcctaattct

SEQ ID NO: 4820889 - DNA, 14 bp, Homo sapiens
aattcctcctgtct

SEQ ID NO: 4820890 - DNA, 21 bp, Homo sapiens
aattccttagtataatattaa

SEQ ID NO: 4820891 - DNA, 21 bp, Homo sapiens
aattctaagattgtacatatg

SEQ ID NO: 4820892 - DNA, 13 bp, Homo sapiens
aattctataagag

SEQ ID NO: 4820893 - DNA, 15 bp, Homo sapiens
aattctgaaggggaa

SEQ ID NO: 4820894 - DNA, 23 bp, Homo sapiens
aattctgaaggggaaaacctcag

SEQ ID NO: 4820895 - DNA, 13 bp, Homo sapiens
aattcttaaatat

SEQ ID NO: 4820896 - DNA, 18 bp, Homo sapiens
aattcttaccgaaatgaa

SEQ ID NO: 4820897 - DNA, 13 bp, Homo sapiens
aattcttacctca

SEQ ID NO: 4820898 - DNA, 15 bp, Homo sapiens
aattcttacctcatt

SEQ ID NO: 4820899 - DNA, 20 bp, Homo sapiens
aattcttacctcatttgcat

SEQ ID NO: 4820900 - DNA, 21 bp, Homo sapiens
aattcttacctcatttgcatc

SEQ ID NO: 4820901 - DNA, 23 bp, Homo sapiens
aattcttacctcatttgcatcct

SEQ ID NO: 4820902 - DNA, 19 bp, Homo sapiens
aattctttatcacatgttg

SEQ ID NO: 4820903 - DNA, 16 bp, Homo sapiens
aattgaaatacctatt

SEQ ID NO: 4820904 - DNA, 20 bp, Homo sapiens
aattgaaccgtcaatgtgaa

SEQ ID NO: 4820905 - DNA, 17 bp, Homo sapiens
aattgaagagagatata

SEQ ID NO: 4820906 - DNA, 15 bp, Homo sapiens
aattgagagatgttt

SEQ ID NO: 4820907 - DNA, 18 bp, Homo sapiens
aattgaggggaggtggcc

SEQ ID NO: 4820908 - DNA, 19 bp, Homo sapiens
aattgaggggaggtggcca

SEQ ID NO: 4820909 - DNA, 21 bp, Homo sapiens
aattgatttttaaacagcagg

SEQ ID NO: 4820910 - DNA, 17 bp, Homo sapiens
aattgcagcagttgcta

SEQ ID NO: 4820911 - DNA, 17 bp, Homo sapiens
aattgcatttttacctt

SEQ ID NO: 4820912 - DNA, 14 bp, Homo sapiens
aattgctgagatgt

SEQ ID NO: 4820913 - DNA, 16 bp, Homo sapiens
aattggttaatgaaaa

SEQ ID NO: 4820914 - DNA, 21 bp, Homo sapiens
aattgtaaaggtgatgaattt

SEQ ID NO: 4820915 - DNA, 23 bp, Homo sapiens
aattgtacccttcttgtctctct

SEQ ID NO: 4820916 - DNA, 13 bp, Homo sapiens
aattgtcatgact

SEQ ID NO: 4820917 - DNA, 20 bp, Homo sapiens
aattgtgagaattactgttt

SEQ ID NO: 4820918 - DNA, 15 bp, Homo sapiens
aattgtgccaaagat

SEQ ID NO: 4820919 - DNA, 22 bp, Homo sapiens
aattgtgccaaagatagcagaa

SEQ ID NO: 4820920 - DNA, 21 bp, Homo sapiens
aattgtgcgacttcacaaaat

SEQ ID NO: 4820921 - DNA, 14 bp, Homo sapiens
aattgttacaattt

SEQ ID NO: 4820922 - DNA, 17 bp, Homo sapiens
aattgttatgtaaacat

SEQ ID NO: 4820923 - DNA, 22 bp, Homo sapiens
aattgttatgtaaacatcataa

SEQ ID NO: 4820924 - DNA, 15 bp, Homo sapiens
aattgtttaaaagca

SEQ ID NO: 4820925 - DNA, 14 bp, Homo sapiens
aattgtttcttgac

SEQ ID NO: 4820926 - DNA, 17 bp, Homo sapiens
aattgtttggcttcctc

SEQ ID NO: 4820927 - DNA, 13 bp, Homo sapiens
aatttaaaatata

SEQ ID NO: 4820928 - DNA, 14 bp, Homo sapiens
aatttaagcacaaa

SEQ ID NO: 4820929 - DNA, 20 bp, Homo sapiens
aatttaagcacaaaaaattt

SEQ ID NO: 4820930 - DNA, 20 bp, Homo sapiens
aatttacaaacctctcagca

SEQ ID NO: 4820931 - DNA, 19 bp, Homo sapiens
aatttataacaattgattt

SEQ ID NO: 4820932 - DNA, 15 bp, Homo sapiens
aatttatctgtgaat

SEQ ID NO: 4820933 - DNA, 16 bp, Homo sapiens
aatttatgatataata

SEQ ID NO: 4820934 - DNA, 19 bp, Homo sapiens
aatttatgtcattttcaga

SEQ ID NO: 4820935 - DNA, 20 bp, Homo sapiens
aatttatttatgggatcctg

SEQ ID NO: 4820936 - DNA, 17 bp, Homo sapiens
aatttatttcatccagt

SEQ ID NO: 4820937 - DNA, 22 bp, Homo sapiens
aatttattttattttagcagtt

SEQ ID NO: 4820938 - DNA, 12 bp, Homo sapiens
aatttcaaagaa

SEQ ID NO: 4820939 - DNA, 14 bp, Homo sapiens
aatttcattccaaa

SEQ ID NO: 4820940 - DNA, 12 bp, Homo sapiens
aatttcctgctc

SEQ ID NO: 4820941 - DNA, 11 bp, Homo sapiens
aatttcctgtg

SEQ ID NO: 4820942 - DNA, 13 bp, Homo sapiens
aatttcctgtgag

SEQ ID NO: 4820943 - DNA, 15 bp, Homo sapiens
aatttcctgtgagga

SEQ ID NO: 4820944 - DNA, 23 bp, Homo sapiens
aatttctcagcgggagtctcctc

SEQ ID NO: 4820945 - DNA, 16 bp, Homo sapiens
aatttgaaaatgataa

SEQ ID NO: 4820946 - DNA, 18 bp, Homo sapiens
aatttgaagaattaatga

SEQ ID NO: 4820947 - DNA, 17 bp, Homo sapiens
aatttgaagacttcaaa

SEQ ID NO: 4820948 - DNA, 18 bp, Homo sapiens
aatttgaagacttcaaaa

SEQ ID NO: 4820949 - DNA, 15 bp, Homo sapiens
aatttgacattgtca

SEQ ID NO: 4820950 - DNA, 23 bp, Homo sapiens
aatttgctctgtggtaagagata

SEQ ID NO: 4820951 - DNA, 19 bp, Homo sapiens
aatttgggacctgcttcat

SEQ ID NO: 4820952 - DNA, 19 bp, Homo sapiens
aatttggggctacttatat

SEQ ID NO: 4820953 - DNA, 20 bp, Homo sapiens
aatttgtcgggttctcccat

SEQ ID NO: 4820954 - DNA, 12 bp, Homo sapiens
aatttgtgtgct

SEQ ID NO: 4820955 - DNA, 15 bp, Homo sapiens
aatttgtgtgcttca

SEQ ID NO: 4820956 - DNA, 19 bp, Homo sapiens
aatttgtgtgcttcacaca

SEQ ID NO: 4820957 - DNA, 15 bp, Homo sapiens
aatttgtttgtgctt

SEQ ID NO: 4820958 - DNA, 17 bp, Homo sapiens
aatttgtttgtgcttct

SEQ ID NO: 4820959 - DNA, 16 bp, Homo sapiens
aattttaaaagcatat

SEQ ID NO: 4820960 - DNA, 19 bp, Homo sapiens
aattttaaaagcatatata

SEQ ID NO: 4820961 - DNA, 22 bp, Homo sapiens
aattttaaaagcatatataaaa

SEQ ID NO: 4820962 - DNA, 15 bp, Homo sapiens
aattttaaaattgca

SEQ ID NO: 4820963 - DNA, 13 bp, Homo sapiens
aattttattgctg

SEQ ID NO: 4820964 - DNA, 12 bp, Homo sapiens
aattttcacaat

SEQ ID NO: 4820965 - DNA, 16 bp, Homo sapiens
aattttctagaatact

SEQ ID NO: 4820966 - DNA, 19 bp, Homo sapiens
aattttctagaatactaat

SEQ ID NO: 4820967 - DNA, 19 bp, Homo sapiens
aattttcttctcattcttc

SEQ ID NO: 4820968 - DNA, 12 bp, Homo sapiens
aattttcttctt

SEQ ID NO: 4820969 - DNA, 14 bp, Homo sapiens
aattttcttcttta

SEQ ID NO: 4820970 - DNA, 14 bp, Homo sapiens
aattttggaagaat

SEQ ID NO: 4820971 - DNA, 14 bp, Homo sapiens
aattttgtctctag

SEQ ID NO: 4820972 - DNA, 13 bp, Homo sapiens
aatttttactcag

SEQ ID NO: 4820973 - DNA, 17 bp, Homo sapiens
aatttttactcaggctt

SEQ ID NO: 4820974 - DNA, 22 bp, Homo sapiens
aatttttactcaggctttctat

SEQ ID NO: 4820975 - DNA, 21 bp, Homo sapiens
acaaaaaaaagaaagaaaaaa

SEQ ID NO: 4820976 - DNA, 15 bp, Homo sapiens
acaaaaactttccat

SEQ ID NO: 4820977 - DNA, 18 bp, Homo sapiens
acaaaacaacagcaacaa

SEQ ID NO: 4820978 - DNA, 23 bp, Homo sapiens
acaaaaggctggatgtgctttca

SEQ ID NO: 4820979 - DNA, 19 bp, Homo sapiens
acaaaagggaaaaaagcaa

SEQ ID NO: 4820980 - DNA, 23 bp, Homo sapiens
acaaaagtctcaatgttccattc

SEQ ID NO: 4820981 - DNA, 14 bp, Homo sapiens
acaaaatagttgta

SEQ ID NO: 4820982 - DNA, 23 bp, Homo sapiens
acaaaatataaatcacagatttc

SEQ ID NO: 4820983 - DNA, 18 bp, Homo sapiens
acaaacaacctgccacaa

SEQ ID NO: 4820984 - DNA, 16 bp, Homo sapiens
acaaaccacaactgac

SEQ ID NO: 4820985 - DNA, 23 bp, Homo sapiens
acaaaccacaactgacacaggaa

SEQ ID NO: 4820986 - DNA, 17 bp, Homo sapiens
acaaacctctatatgtt

SEQ ID NO: 4820987 - DNA, 18 bp, Homo sapiens
acaaacctctatatgttg

SEQ ID NO: 4820988 - DNA, 15 bp, Homo sapiens
acaaactcaaaatct

SEQ ID NO: 4820989 - DNA, 16 bp, Homo sapiens
acaaacttttataaat

SEQ ID NO: 4820990 - DNA, 18 bp, Homo sapiens
acaaacttttataaatgt

SEQ ID NO: 4820991 - DNA, 18 bp, Homo sapiens
acaaagaaacaaaatata

SEQ ID NO: 4820992 - DNA, 16 bp, Homo sapiens
acaaagcatgctcagt

SEQ ID NO: 4820993 - DNA, 21 bp, Homo sapiens
acaaagcgtggtggacatgca

SEQ ID NO: 4820994 - DNA, 16 bp, Homo sapiens
acaaagctatttaagt

SEQ ID NO: 4820995 - DNA, 15 bp, Homo sapiens
acaaaggccttaaca

SEQ ID NO: 4820996 - DNA, 23 bp, Homo sapiens
acaaataagttcccatttccttg

SEQ ID NO: 4820997 - DNA, 14 bp, Homo sapiens
acaaatatactcat

SEQ ID NO: 4820998 - DNA, 18 bp, Homo sapiens
acaaatatactcatttgg

SEQ ID NO: 4820999 - DNA, 20 bp, Homo sapiens
acaaatatactcatttggat

SEQ ID NO: 4821000 - DNA, 21 bp, Homo sapiens
acaaatatactcatttggata

SEQ ID NO: 4821001 - DNA, 21 bp, Homo sapiens
acaaatatgattctcctctcc

SEQ ID NO: 4821002 - DNA, 13 bp, Homo sapiens
acaaatatttcac

SEQ ID NO: 4821003 - DNA, 12 bp, Homo sapiens
acaaatcagtaa

SEQ ID NO: 4821004 - DNA, 18 bp, Homo sapiens
acaaatcattttgatgta

SEQ ID NO: 4821005 - DNA, 16 bp, Homo sapiens
acaaatctcactgtat

SEQ ID NO: 4821006 - DNA, 23 bp, Homo sapiens
acaaatgatttcgtgactgtagt

SEQ ID NO: 4821007 - DNA, 15 bp, Homo sapiens
acaaatgcagtgtat

SEQ ID NO: 4821008 - DNA, 16 bp, Homo sapiens
acaaatgcagtgtatt

SEQ ID NO: 4821009 - DNA, 14 bp, Homo sapiens
acaaatttttactc

SEQ ID NO: 4821010 - DNA, 22 bp, Homo sapiens
acaaatttttactcaggctttc

SEQ ID NO: 4821011 - DNA, 19 bp, Homo sapiens
acaacaaagcatgctcagt

SEQ ID NO: 4821012 - DNA, 15 bp, Homo sapiens
acaacaacaaaatga

SEQ ID NO: 4821013 - DNA, 15 bp, Homo sapiens
acaacaacaaagcat

SEQ ID NO: 4821014 - DNA, 22 bp, Homo sapiens
acaacaatttaggaatgctcaa

SEQ ID NO: 4821015 - DNA, 23 bp, Homo sapiens
acaacacacacacacacaaaaca

SEQ ID NO: 4821016 - DNA, 12 bp, Homo sapiens
acaacagcaaca

SEQ ID NO: 4821017 - DNA, 18 bp, Homo sapiens
acaacagtcagccagctt

SEQ ID NO: 4821018 - DNA, 21 bp, Homo sapiens
acaaccacatttctggccatt

SEQ ID NO: 4821019 - DNA, 19 bp, Homo sapiens
acaacgatttctccattaa

SEQ ID NO: 4821020 - DNA, 18 bp, Homo sapiens
acaactaacaatgccttg

SEQ ID NO: 4821021 - DNA, 20 bp, Homo sapiens
acaactccaggaaaactgtt

SEQ ID NO: 4821022 - DNA, 21 bp, Homo sapiens
acaactccaggaaaactgttt

SEQ ID NO: 4821023 - DNA, 15 bp, Homo sapiens
acaacttgctccttt

SEQ ID NO: 4821024 - DNA, 22 bp, Homo sapiens
acaactttcactataatgtgaa

SEQ ID NO: 4821025 - DNA, 10 bp, Homo sapiens
acaagaaatt

SEQ ID NO: 4821026 - DNA, 16 bp, Homo sapiens
acaagactgtcattag

SEQ ID NO: 4821027 - DNA, 22 bp, Homo sapiens
acaagagaccacttccttaaca

SEQ ID NO: 4821028 - DNA, 23 bp, Homo sapiens
acaagagaccacttccttaacag

SEQ ID NO: 4821029 - DNA, 17 bp, Homo sapiens
acaagccacgttgcaga

SEQ ID NO: 4821030 - DNA, 14 bp, Homo sapiens
acaagccaggccct

SEQ ID NO: 4821031 - DNA, 20 bp, Homo sapiens
acaagccctgcttgctggaa

SEQ ID NO: 4821032 - DNA, 15 bp, Homo sapiens
acaagctacatatgt

SEQ ID NO: 4821033 - DNA, 17 bp, Homo sapiens
acaagctacatatgtag

SEQ ID NO: 4821034 - DNA, 13 bp, Homo sapiens
acaagctgatagt

SEQ ID NO: 4821035 - DNA, 15 bp, Homo sapiens
acaagctgatagtgt

SEQ ID NO: 4821036 - DNA, 12 bp, Homo sapiens
acaaggcaaggc

SEQ ID NO: 4821037 - DNA, 14 bp, Homo sapiens
acaaggcaaggctg

SEQ ID NO: 4821038 - DNA, 15 bp, Homo sapiens
acaaggcaaggctgt

SEQ ID NO: 4821039 - DNA, 19 bp, Homo sapiens
acaaggcaaggctgtcaat

SEQ ID NO: 4821040 - DNA, 15 bp, Homo sapiens
acaaggggtggaagg

SEQ ID NO: 4821041 - DNA, 21 bp, Homo sapiens
acaaggggtggaagggcagga

SEQ ID NO: 4821042 - DNA, 22 bp, Homo sapiens
acaaggggtggaagggcaggag

SEQ ID NO: 4821043 - DNA, 22 bp, Homo sapiens
acaaggttgctggcatttgctg

SEQ ID NO: 4821044 - DNA, 14 bp, Homo sapiens
acaagtgtttctag

SEQ ID NO: 4821045 - DNA, 14 bp, Homo sapiens
acaataaaagacat

SEQ ID NO: 4821046 - DNA, 12 bp, Homo sapiens
acaataagtgtt

SEQ ID NO: 4821047 - DNA, 19 bp, Homo sapiens
acaatactttgtgtctttt

SEQ ID NO: 4821048 - DNA, 20 bp, Homo sapiens
acaatatcattttcctggga

SEQ ID NO: 4821049 - DNA, 15 bp, Homo sapiens
acaatcatctattga

SEQ ID NO: 4821050 - DNA, 16 bp, Homo sapiens
acaatgcctattgtaa

SEQ ID NO: 4821051 - DNA, 22 bp, Homo sapiens
acaatgccttgttgtattcctg

SEQ ID NO: 4821052 - DNA, 16 bp, Homo sapiens
acaatggctgggtttg

SEQ ID NO: 4821053 - DNA, 14 bp, Homo sapiens
acaatggtagctct

SEQ ID NO: 4821054 - DNA, 19 bp, Homo sapiens
acaatggtagctctgaagg

SEQ ID NO: 4821055 - DNA, 20 bp, Homo sapiens
acaatgtgatatgtgtaata

SEQ ID NO: 4821056 - DNA, 21 bp, Homo sapiens
acaattactgtgagaactgtg

SEQ ID NO: 4821057 - DNA, 19 bp, Homo sapiens
acaattatttttgctctgc

SEQ ID NO: 4821058 - DNA, 13 bp, Homo sapiens
acaattctttgtt

SEQ ID NO: 4821059 - DNA, 21 bp, Homo sapiens
acaattttctatttaaaaaat

SEQ ID NO: 4821060 - DNA, 21 bp, Homo sapiens
acacaaatattgcttggacta

SEQ ID NO: 4821061 - DNA, 17 bp, Homo sapiens
acacaacggcagtgaag

SEQ ID NO: 4821062 - DNA, 22 bp, Homo sapiens
acacaactgtggataaattttg

SEQ ID NO: 4821063 - DNA, 20 bp, Homo sapiens
acacacaaatattgcttgga

SEQ ID NO: 4821064 - DNA, 22 bp, Homo sapiens
acacacaaatattgcttggact

SEQ ID NO: 4821065 - DNA, 13 bp, Homo sapiens
acacacacaaaac

SEQ ID NO: 4821066 - DNA, 14 bp, Homo sapiens
acacacacaaaaca

SEQ ID NO: 4821067 - DNA, 22 bp, Homo sapiens
acacacacccttccccactccc

SEQ ID NO: 4821068 - DNA, 14 bp, Homo sapiens
acacacagcagctc

SEQ ID NO: 4821069 - DNA, 15 bp, Homo sapiens
acacacagcagctcc

SEQ ID NO: 4821070 - DNA, 17 bp, Homo sapiens
acacacctgagaatgtg

SEQ ID NO: 4821071 - DNA, 17 bp, Homo sapiens
acacacgcgtccacata

SEQ ID NO: 4821072 - DNA, 22 bp, Homo sapiens
acacacgcgtccacatacactg

SEQ ID NO: 4821073 - DNA, 20 bp, Homo sapiens
acacacggggcacccagccc

SEQ ID NO: 4821074 - DNA, 22 bp, Homo sapiens
acacacggggcacccagcccaa

SEQ ID NO: 4821075 - DNA, 20 bp, Homo sapiens
acacagaggacagcttcccc

SEQ ID NO: 4821076 - DNA, 15 bp, Homo sapiens
acacagattatttgt

SEQ ID NO: 4821077 - DNA, 12 bp, Homo sapiens
acacagcagctc

SEQ ID NO: 4821078 - DNA, 12 bp, Homo sapiens
acacagcccgag

SEQ ID NO: 4821079 - DNA, 18 bp, Homo sapiens
acacagcgtccctagcag

SEQ ID NO: 4821080 - DNA, 18 bp, Homo sapiens
acacaggcctggcccagc

SEQ ID NO: 4821081 - DNA, 14 bp, Homo sapiens
acacagttttgtct

SEQ ID NO: 4821082 - DNA, 14 bp, Homo sapiens
acacataacacaca

SEQ ID NO: 4821083 - DNA, 15 bp, Homo sapiens
acacataacacacat

SEQ ID NO: 4821084 - DNA, 16 bp, Homo sapiens
acacataacacacatc

SEQ ID NO: 4821085 - DNA, 20 bp, Homo sapiens
acacatagattaatggcact

SEQ ID NO: 4821086 - DNA, 21 bp, Homo sapiens
acacatataaacacagtaaga

SEQ ID NO: 4821087 - DNA, 15 bp, Homo sapiens
acacattatcttctg

SEQ ID NO: 4821088 - DNA, 14 bp, Homo sapiens
acacattgcacaca

SEQ ID NO: 4821089 - DNA, 23 bp, Homo sapiens
acacattgcacacacagtctgtt

SEQ ID NO: 4821090 - DNA, 18 bp, Homo sapiens
acacattgtgttaactta

SEQ ID NO: 4821091 - DNA, 18 bp, Homo sapiens
acaccaaattgctgagat

SEQ ID NO: 4821092 - DNA, 19 bp, Homo sapiens
acaccaaattgctgagatg

SEQ ID NO: 4821093 - DNA, 20 bp, Homo sapiens
acaccaaattgctgagatgt

SEQ ID NO: 4821094 - DNA, 19 bp, Homo sapiens
acaccaccactgtgtccca

SEQ ID NO: 4821095 - DNA, 20 bp, Homo sapiens
acaccagagtgtatgcatac

SEQ ID NO: 4821096 - DNA, 16 bp, Homo sapiens
acaccagcaacattat

SEQ ID NO: 4821097 - DNA, 19 bp, Homo sapiens
acaccccctttccatctgt

SEQ ID NO: 4821098 - DNA, 17 bp, Homo sapiens
acaccctcactctgcca

SEQ ID NO: 4821099 - DNA, 11 bp, Homo sapiens
acacccttccc

SEQ ID NO: 4821100 - DNA, 13 bp, Homo sapiens
acacccttcccca

SEQ ID NO: 4821101 - DNA, 19 bp, Homo sapiens
acacccttccccactcccg

SEQ ID NO: 4821102 - DNA, 21 bp, Homo sapiens
acaccgcaccgggctggcctg

SEQ ID NO: 4821103 - DNA, 13 bp, Homo sapiens
acacctaaattaa

SEQ ID NO: 4821104 - DNA, 20 bp, Homo sapiens
acacctcaactaaatccaaa

SEQ ID NO: 4821105 - DNA, 14 bp, Homo sapiens
acacctcccttcat

SEQ ID NO: 4821106 - DNA, 18 bp, Homo sapiens
acacctgccgctgcttga

SEQ ID NO: 4821107 - DNA, 16 bp, Homo sapiens
acacctgcctgcagag

SEQ ID NO: 4821108 - DNA, 22 bp, Homo sapiens
acaccttacaaagccagctctg

SEQ ID NO: 4821109 - DNA, 14 bp, Homo sapiens
acaccttcccagct

SEQ ID NO: 4821110 - DNA, 18 bp, Homo sapiens
acacgccggggctggccc

SEQ ID NO: 4821111 - DNA, 19 bp, Homo sapiens
acacgccggggctggccct

SEQ ID NO: 4821112 - DNA, 22 bp, Homo sapiens
acacgccggggctggccctgcc

SEQ ID NO: 4821113 - DNA, 19 bp, Homo sapiens
acacgcgtccacatacact

SEQ ID NO: 4821114 - DNA, 22 bp, Homo sapiens
acactaatgaggaaactgcact

SEQ ID NO: 4821115 - DNA, 13 bp, Homo sapiens
acactaatggcca

SEQ ID NO: 4821116 - DNA, 14 bp, Homo sapiens
acactcaccattta

SEQ ID NO: 4821117 - DNA, 15 bp, Homo sapiens
acactgcaccctcca

SEQ ID NO: 4821118 - DNA, 17 bp, Homo sapiens
acactgccaaacatcag

SEQ ID NO: 4821119 - DNA, 18 bp, Homo sapiens
acactggccggcccacgt

SEQ ID NO: 4821120 - DNA, 15 bp, Homo sapiens
acactgtactgcaat

SEQ ID NO: 4821121 - DNA, 22 bp, Homo sapiens
acactgtgaactaatgacaagt

SEQ ID NO: 4821122 - DNA, 17 bp, Homo sapiens
acacttcacctccttct

SEQ ID NO: 4821123 - DNA, 18 bp, Homo sapiens
acacttcacctccttctg

SEQ ID NO: 4821124 - DNA, 20 bp, Homo sapiens
acacttcacctccttctgca

SEQ ID NO: 4821125 - DNA, 22 bp, Homo sapiens
acacttgggctggcacccactg

SEQ ID NO: 4821126 - DNA, 23 bp, Homo sapiens
acacttgggtaattaaaaataaa

SEQ ID NO: 4821127 - DNA, 15 bp, Homo sapiens
acagaaaaacaaaaa

SEQ ID NO: 4821128 - DNA, 18 bp, Homo sapiens
acagaaaattcttctcca

SEQ ID NO: 4821129 - DNA, 21 bp, Homo sapiens
acagaaccaacgggtctgtgg

SEQ ID NO: 4821130 - DNA, 15 bp, Homo sapiens
acagaaccagcactc

SEQ ID NO: 4821131 - DNA, 16 bp, Homo sapiens
acagaaccagcactcc

SEQ ID NO: 4821132 - DNA, 19 bp, Homo sapiens
acagaaccagcactcccag

SEQ ID NO: 4821133 - DNA, 20 bp, Homo sapiens
acagaaccagcactcccagg

SEQ ID NO: 4821134 - DNA, 22 bp, Homo sapiens
acagaaccagcactcccagggc

SEQ ID NO: 4821135 - DNA, 23 bp, Homo sapiens
acagaagggagtgaaaacctctt

SEQ ID NO: 4821136 - DNA, 21 bp, Homo sapiens
acagaagtggaaggataatga

SEQ ID NO: 4821137 - DNA, 22 bp, Homo sapiens
acagaagtggaaggataatgag

SEQ ID NO: 4821138 - DNA, 14 bp, Homo sapiens
acagacagaatata

SEQ ID NO: 4821139 - DNA, 16 bp, Homo sapiens
acagaccagcatagtt

SEQ ID NO: 4821140 - DNA, 22 bp, Homo sapiens
acagacctccagattattttct

SEQ ID NO: 4821141 - DNA, 23 bp, Homo sapiens
acagacctcggctgtgtggggag

SEQ ID NO: 4821142 - DNA, 13 bp, Homo sapiens
acagactgcctta

SEQ ID NO: 4821143 - DNA, 14 bp, Homo sapiens
acagactgccttat

SEQ ID NO: 4821144 - DNA, 18 bp, Homo sapiens
acagactgccttatatta

SEQ ID NO: 4821145 - DNA, 14 bp, Homo sapiens
acagactgctgtct

SEQ ID NO: 4821146 - DNA, 23 bp, Homo sapiens
acagagagacaacttgctccttt

SEQ ID NO: 4821147 - DNA, 15 bp, Homo sapiens
acagagatggcagag

SEQ ID NO: 4821148 - DNA, 16 bp, Homo sapiens
acagagcctgttttaa

SEQ ID NO: 4821149 - DNA, 15 bp, Homo sapiens
acagaggatttctgc

SEQ ID NO: 4821150 - DNA, 13 bp, Homo sapiens
acagagtatatat

SEQ ID NO: 4821151 - DNA, 15 bp, Homo sapiens
acagagtatatatgt

SEQ ID NO: 4821152 - DNA, 16 bp, Homo sapiens
acagagtatatatgta

SEQ ID NO: 4821153 - DNA, 21 bp, Homo sapiens
acagatcctccgcggaggccc

SEQ ID NO: 4821154 - DNA, 14 bp, Homo sapiens
acagatgggtgtcc

SEQ ID NO: 4821155 - DNA, 20 bp, Homo sapiens
acagatttccaaaagtacta

SEQ ID NO: 4821156 - DNA, 15 bp, Homo sapiens
acagcaaaaccattg

SEQ ID NO: 4821157 - DNA, 20 bp, Homo sapiens
acagcaaaaccattgcttca

SEQ ID NO: 4821158 - DNA, 22 bp, Homo sapiens
acagcaaaaccattgcttcact

SEQ ID NO: 4821159 - DNA, 17 bp, Homo sapiens
acagcacatgctggcca

SEQ ID NO: 4821160 - DNA, 18 bp, Homo sapiens
acagcacatgctggccag

SEQ ID NO: 4821161 - DNA, 16 bp, Homo sapiens
acagcagcctctgaag

SEQ ID NO: 4821162 - DNA, 18 bp, Homo sapiens
acagcagcctctgaagtt

SEQ ID NO: 4821163 - DNA, 11 bp, Homo sapiens
acagcagcctg

SEQ ID NO: 4821164 - DNA, 18 bp, Homo sapiens
acagcagcctgcttccca

SEQ ID NO: 4821165 - DNA, 15 bp, Homo sapiens
acagcagctccaacc

SEQ ID NO: 4821166 - DNA, 12 bp, Homo sapiens
acagcagctgga

SEQ ID NO: 4821167 - DNA, 14 bp, Homo sapiens
acagcagctggact

SEQ ID NO: 4821168 - DNA, 17 bp, Homo sapiens
acagcaggagcatggcc

SEQ ID NO: 4821169 - DNA, 13 bp, Homo sapiens
acagcatgcattt

SEQ ID NO: 4821170 - DNA, 15 bp, Homo sapiens
acagcatgcatttag

SEQ ID NO: 4821171 - DNA, 22 bp, Homo sapiens
acagcatgtgctcagccccaga

SEQ ID NO: 4821172 - DNA, 21 bp, Homo sapiens
acagcatgtgttaatcttaat

SEQ ID NO: 4821173 - DNA, 18 bp, Homo sapiens
acagccaccacctggatg

SEQ ID NO: 4821174 - DNA, 17 bp, Homo sapiens
acagccatagcagacgg

SEQ ID NO: 4821175 - DNA, 15 bp, Homo sapiens
acagccatgattctt

SEQ ID NO: 4821176 - DNA, 17 bp, Homo sapiens
acagcccagagactgaa

SEQ ID NO: 4821177 - DNA, 22 bp, Homo sapiens
acagcccaggcggtcactgccc

SEQ ID NO: 4821178 - DNA, 19 bp, Homo sapiens
acagccccttgcttctaag

SEQ ID NO: 4821179 - DNA, 22 bp, Homo sapiens
acagccccttgcttctaaggga

SEQ ID NO: 4821180 - DNA, 21 bp, Homo sapiens
acagcctgcacacacctgcct

SEQ ID NO: 4821181 - DNA, 20 bp, Homo sapiens
acagcctttgcgctctgggt

SEQ ID NO: 4821182 - DNA, 18 bp, Homo sapiens
acagcgccatgtgtgtca

SEQ ID NO: 4821183 - DNA, 13 bp, Homo sapiens
acagcggccccgc

SEQ ID NO: 4821184 - DNA, 14 bp, Homo sapiens
acagcggcccggcc

SEQ ID NO: 4821185 - DNA, 19 bp, Homo sapiens
acagcggcccggcccacgc

SEQ ID NO: 4821186 - DNA, 23 bp, Homo sapiens
acagcgtccctagcagtgaacta

SEQ ID NO: 4821187 - DNA, 13 bp, Homo sapiens
acagctaacatgg

SEQ ID NO: 4821188 - DNA, 20 bp, Homo sapiens
acagctaaggccttgccagc

SEQ ID NO: 4821189 - DNA, 23 bp, Homo sapiens
acagctaggttaataggaggaca

SEQ ID NO: 4821190 - DNA, 17 bp, Homo sapiens
acagctctcctccagcc

SEQ ID NO: 4821191 - DNA, 21 bp, Homo sapiens
acagctctcctccagccctgg

SEQ ID NO: 4821192 - DNA, 22 bp, Homo sapiens
acagctctcctccagccctggg

SEQ ID NO: 4821193 - DNA, 23 bp, Homo sapiens
acagctctcctccagccctgggc

SEQ ID NO: 4821194 - DNA, 19 bp, Homo sapiens
acagctgaaagacagtaaa

SEQ ID NO: 4821195 - DNA, 23 bp, Homo sapiens
acagctgagcacccagctctgtc

SEQ ID NO: 4821196 - DNA, 13 bp, Homo sapiens
acagctgcctccg

SEQ ID NO: 4821197 - DNA, 22 bp, Homo sapiens
acaggaaaaaaacttttataaa

SEQ ID NO: 4821198 - DNA, 18 bp, Homo sapiens
acaggaacccatcactgt

SEQ ID NO: 4821199 - DNA, 19 bp, Homo sapiens
acaggaacccatcactgtg

SEQ ID NO: 4821200 - DNA, 23 bp, Homo sapiens
acaggaacccatcactgtgtctc

SEQ ID NO: 4821201 - DNA, 16 bp, Homo sapiens
acaggactgattctgg

SEQ ID NO: 4821202 - DNA, 23 bp, Homo sapiens
acaggactgattctgggatgctc

SEQ ID NO: 4821203 - DNA, 19 bp, Homo sapiens
acaggagctccctttttga

SEQ ID NO: 4821204 - DNA, 21 bp, Homo sapiens
acaggagctccctttttgaat

SEQ ID NO: 4821205 - DNA, 16 bp, Homo sapiens
acaggattgtctgctg

SEQ ID NO: 4821206 - DNA, 15 bp, Homo sapiens
acaggcaccatgctg

SEQ ID NO: 4821207 - DNA, 12 bp, Homo sapiens
acaggcctggcc

SEQ ID NO: 4821208 - DNA, 14 bp, Homo sapiens
acaggcctggccca

SEQ ID NO: 4821209 - DNA, 19 bp, Homo sapiens
acaggcctggcccagccag

SEQ ID NO: 4821210 - DNA, 21 bp, Homo sapiens
acaggcctggcccagccagca

SEQ ID NO: 4821211 - DNA, 19 bp, Homo sapiens
acaggccttcctcctctca

SEQ ID NO: 4821212 - DNA, 20 bp, Homo sapiens
acagggacacagtctggtgc

SEQ ID NO: 4821213 - DNA, 20 bp, Homo sapiens
acagggagggaacagacctc

SEQ ID NO: 4821214 - DNA, 15 bp, Homo sapiens
acagggcgtcctctc

SEQ ID NO: 4821215 - DNA, 16 bp, Homo sapiens
acaggggaggctgaga

SEQ ID NO: 4821216 - DNA, 16 bp, Homo sapiens
acagggtggcacccac

SEQ ID NO: 4821217 - DNA, 22 bp, Homo sapiens
acagggtggcacccaccactct

SEQ ID NO: 4821218 - DNA, 16 bp, Homo sapiens
acagggtgttggaaga

SEQ ID NO: 4821219 - DNA, 13 bp, Homo sapiens
acaggtgtaaata

SEQ ID NO: 4821220 - DNA, 16 bp, Homo sapiens
acaggttttatgagac

SEQ ID NO: 4821221 - DNA, 17 bp, Homo sapiens
acagtaaagaccattta

SEQ ID NO: 4821222 - DNA, 13 bp, Homo sapiens
acagtaaatatac

SEQ ID NO: 4821223 - DNA, 22 bp, Homo sapiens
acagtaagataggttctgcttt

SEQ ID NO: 4821224 - DNA, 22 bp, Homo sapiens
acagtaatctttcggtctcctt

SEQ ID NO: 4821225 - DNA, 20 bp, Homo sapiens
acagtacatgtttattatgt

SEQ ID NO: 4821226 - DNA, 22 bp, Homo sapiens
acagtagcatactgatgagaca

SEQ ID NO: 4821227 - DNA, 14 bp, Homo sapiens
acagtatataagct

SEQ ID NO: 4821228 - DNA, 13 bp, Homo sapiens
acagtatatttta

SEQ ID NO: 4821229 - DNA, 23 bp, Homo sapiens
acagtatattttatttcaatgta

SEQ ID NO: 4821230 - DNA, 14 bp, Homo sapiens
acagtattatttag

SEQ ID NO: 4821231 - DNA, 13 bp, Homo sapiens
acagtatttaaca

SEQ ID NO: 4821232 - DNA, 14 bp, Homo sapiens
acagtatttaacat

SEQ ID NO: 4821233 - DNA, 18 bp, Homo sapiens
acagtatttaacattctt

SEQ ID NO: 4821234 - DNA, 13 bp, Homo sapiens
acagtatttccat

SEQ ID NO: 4821235 - DNA, 13 bp, Homo sapiens
acagtcctggtta

SEQ ID NO: 4821236 - DNA, 14 bp, Homo sapiens
acagtcttcatttt

SEQ ID NO: 4821237 - DNA, 16 bp, Homo sapiens
acagtgaacagcttca

SEQ ID NO: 4821238 - DNA, 14 bp, Homo sapiens
acagtgacccttcc

SEQ ID NO: 4821239 - DNA, 17 bp, Homo sapiens
acagtggcaagctacca

SEQ ID NO: 4821240 - DNA, 19 bp, Homo sapiens
acagtgggaactctgacaa

SEQ ID NO: 4821241 - DNA, 21 bp, Homo sapiens
acagtgggaactctgacaagg

SEQ ID NO: 4821242 - DNA, 22 bp, Homo sapiens
acagtggggcccatggccccag

SEQ ID NO: 4821243 - DNA, 23 bp, Homo sapiens
acagtggggcccatggccccagc

SEQ ID NO: 4821244 - DNA, 20 bp, Homo sapiens
acagtggttgttttttcatt

SEQ ID NO: 4821245 - DNA, 19 bp, Homo sapiens
acagtgtggcttaaacatt

SEQ ID NO: 4821246 - DNA, 13 bp, Homo sapiens
acagtgttcaaat

SEQ ID NO: 4821247 - DNA, 15 bp, Homo sapiens
acagtgttcaaattc

SEQ ID NO: 4821248 - DNA, 18 bp, Homo sapiens
acagtgttcaaattctga

SEQ ID NO: 4821249 - DNA, 21 bp, Homo sapiens
acagtgttcaaattctgatta

SEQ ID NO: 4821250 - DNA, 14 bp, Homo sapiens
acagtgtttccagt

SEQ ID NO: 4821251 - DNA, 15 bp, Homo sapiens
acagttacttacaca

SEQ ID NO: 4821252 - DNA, 17 bp, Homo sapiens
acagttcacaccctgca

SEQ ID NO: 4821253 - DNA, 19 bp, Homo sapiens
acagttcacaccctgcaag

SEQ ID NO: 4821254 - DNA, 23 bp, Homo sapiens
acagttccacaattttgtctcta

SEQ ID NO: 4821255 - DNA, 18 bp, Homo sapiens
acagttctacagaaaaac

SEQ ID NO: 4821256 - DNA, 20 bp, Homo sapiens
acagttggccgattagaagg

SEQ ID NO: 4821257 - DNA, 20 bp, Homo sapiens
acagtttaacagaaaaatga

SEQ ID NO: 4821258 - DNA, 13 bp, Homo sapiens
acagtttcttgca

SEQ ID NO: 4821259 - DNA, 16 bp, Homo sapiens
acagtttgtgaggacc

SEQ ID NO: 4821260 - DNA, 20 bp, Homo sapiens
acataaacacttctccttaa

SEQ ID NO: 4821261 - DNA, 21 bp, Homo sapiens
acataaacacttctccttaac

SEQ ID NO: 4821262 - DNA, 19 bp, Homo sapiens
acataaagtaataactgtt

SEQ ID NO: 4821263 - DNA, 24 bp, Homo sapiens
acataaagtaataactgttagaat

SEQ ID NO: 4821264 - DNA, 13 bp, Homo sapiens
acataacacacat

SEQ ID NO: 4821265 - DNA, 17 bp, Homo sapiens
acataagctagaaaaat

SEQ ID NO: 4821266 - DNA, 20 bp, Homo sapiens
acataagctagaaaaattag

SEQ ID NO: 4821267 - DNA, 14 bp, Homo sapiens
acataagttttctc

SEQ ID NO: 4821268 - DNA, 17 bp, Homo sapiens
acatactatagattctt

SEQ ID NO: 4821269 - DNA, 14 bp, Homo sapiens
acatagattaatgg

SEQ ID NO: 4821270 - DNA, 17 bp, Homo sapiens
acatagattcacctgta

SEQ ID NO: 4821271 - DNA, 16 bp, Homo sapiens
acatagtggtatttta

SEQ ID NO: 4821272 - DNA, 18 bp, Homo sapiens
acatagtggtattttaac

SEQ ID NO: 4821273 - DNA, 15 bp, Homo sapiens
acatagtggtcattt

SEQ ID NO: 4821274 - DNA, 16 bp, Homo sapiens
acatataaacacagta

SEQ ID NO: 4821275 - DNA, 19 bp, Homo sapiens
acatatacattatttctgt

SEQ ID NO: 4821276 - DNA, 18 bp, Homo sapiens
acatatcaagtcccgagg

SEQ ID NO: 4821277 - DNA, 16 bp, Homo sapiens
acatatcattcagaat

SEQ ID NO: 4821278 - DNA, 16 bp, Homo sapiens
acatatgtatgtgtga

SEQ ID NO: 4821279 - DNA, 21 bp, Homo sapiens
acatcaattgggttttgatct

SEQ ID NO: 4821280 - DNA, 20 bp, Homo sapiens
acatcagagtgtatttttgt

SEQ ID NO: 4821281 - DNA, 15 bp, Homo sapiens
acatcagtaatgtat

SEQ ID NO: 4821282 - DNA, 14 bp, Homo sapiens
acatccacatgcac

SEQ ID NO: 4821283 - DNA, 18 bp, Homo sapiens
acatccacatgcacatgt

SEQ ID NO: 4821284 - DNA, 15 bp, Homo sapiens
acatctctgactttc

SEQ ID NO: 4821285 - DNA, 13 bp, Homo sapiens
acatctctgtaaa

SEQ ID NO: 4821286 - DNA, 14 bp, Homo sapiens
acatctgaaatcta

SEQ ID NO: 4821287 - DNA, 12 bp, Homo sapiens
acatctgatatc

SEQ ID NO: 4821288 - DNA, 19 bp, Homo sapiens
acatctgatttctgaacta

SEQ ID NO: 4821289 - DNA, 21 bp, Homo sapiens
acatctgtacatgactgtata

SEQ ID NO: 4821290 - DNA, 18 bp, Homo sapiens
acatctgtatatcagctc

SEQ ID NO: 4821291 - DNA, 13 bp, Homo sapiens
acatcttgtgcat

SEQ ID NO: 4821292 - DNA, 15 bp, Homo sapiens
acatcttgtgcatgc

SEQ ID NO: 4821293 - DNA, 16 bp, Homo sapiens
acatcttttaactgcc

SEQ ID NO: 4821294 - DNA, 11 bp, Homo sapiens
acatgacactg

SEQ ID NO: 4821295 - DNA, 14 bp, Homo sapiens
acatgacatccaca

SEQ ID NO: 4821296 - DNA, 23 bp, Homo sapiens
acatgactctttattgtctgtaa

SEQ ID NO: 4821297 - DNA, 15 bp, Homo sapiens
acatgagtaaagcag

SEQ ID NO: 4821298 - DNA, 15 bp, Homo sapiens
acatgcacatgtatt

SEQ ID NO: 4821299 - DNA, 19 bp, Homo sapiens
acatgcacatgtattctgt

SEQ ID NO: 4821300 - DNA, 13 bp, Homo sapiens
acatgcactgacc

SEQ ID NO: 4821301 - DNA, 15 bp, Homo sapiens
acatgcagaaattga

SEQ ID NO: 4821302 - DNA, 20 bp, Homo sapiens
acatgcagaaattgacctga

SEQ ID NO: 4821303 - DNA, 15 bp, Homo sapiens
acatgcatgagcacc

SEQ ID NO: 4821304 - DNA, 21 bp, Homo sapiens
acatgcccctcttagaagaaa

SEQ ID NO: 4821305 - DNA, 19 bp, Homo sapiens
acatgcctctctcaggcca

SEQ ID NO: 4821306 - DNA, 20 bp, Homo sapiens
acatgcctctctcaggccaa

SEQ ID NO: 4821307 - DNA, 14 bp, Homo sapiens
acatggattcagtt

SEQ ID NO: 4821308 - DNA, 19 bp, Homo sapiens
acatggattgattaaaagc

SEQ ID NO: 4821309 - DNA, 15 bp, Homo sapiens
acatggccgctgccc

SEQ ID NO: 4821310 - DNA, 15 bp, Homo sapiens
acatgtattctgttg

SEQ ID NO: 4821311 - DNA, 23 bp, Homo sapiens
acatgtctttggcttcagaattg

SEQ ID NO: 4821312 - DNA, 21 bp, Homo sapiens
acatgtgctcgctctgcatga

SEQ ID NO: 4821313 - DNA, 19 bp, Homo sapiens
acatgttttacaaagaaac

SEQ ID NO: 4821314 - DNA, 13 bp, Homo sapiens
acattaacaggca

SEQ ID NO: 4821315 - DNA, 22 bp, Homo sapiens
acattaagtattccttggccca

SEQ ID NO: 4821316 - DNA, 14 bp, Homo sapiens
acattagacacaca

SEQ ID NO: 4821317 - DNA, 19 bp, Homo sapiens
acattaggaacagagtata

SEQ ID NO: 4821318 - DNA, 16 bp, Homo sapiens
acattagtgagattta

SEQ ID NO: 4821319 - DNA, 18 bp, Homo sapiens
acattatttctgtatata

SEQ ID NO: 4821320 - DNA, 16 bp, Homo sapiens
acattcatcctcacat

SEQ ID NO: 4821321 - DNA, 13 bp, Homo sapiens
acattcctgaccc

SEQ ID NO: 4821322 - DNA, 18 bp, Homo sapiens
acattctatttcaacttc

SEQ ID NO: 4821323 - DNA, 15 bp, Homo sapiens
acattcttgctctgc

SEQ ID NO: 4821324 - DNA, 15 bp, Homo sapiens
acattgaaactgtat

SEQ ID NO: 4821325 - DNA, 20 bp, Homo sapiens
acattgaaactgtatttact

SEQ ID NO: 4821326 - DNA, 21 bp, Homo sapiens
acattgcttcattaaaacaag

SEQ ID NO: 4821327 - DNA, 22 bp, Homo sapiens
acattgcttcattaaaacaaga

SEQ ID NO: 4821328 - DNA, 16 bp, Homo sapiens
acattgtcagaatgtt

SEQ ID NO: 4821329 - DNA, 24 bp, Homo sapiens
acattgtccccaatgaatatactc

SEQ ID NO: 4821330 - DNA, 18 bp, Homo sapiens
acattgtgccctgtagct

SEQ ID NO: 4821331 - DNA, 22 bp, Homo sapiens
acattgtgccctgtagctcctt

SEQ ID NO: 4821332 - DNA, 14 bp, Homo sapiens
acatttatctttgt

SEQ ID NO: 4821333 - DNA, 17 bp, Homo sapiens
acatttgaacagggcaa

SEQ ID NO: 4821334 - DNA, 15 bp, Homo sapiens
acatttgcatgcctt

SEQ ID NO: 4821335 - DNA, 18 bp, Homo sapiens
acatttgttaatgattct

SEQ ID NO: 4821336 - DNA, 21 bp, Homo sapiens
acattttttgtttcttggtgt

SEQ ID NO: 4821337 - DNA, 21 bp, Homo sapiens
accaaaatttggggtatttat

SEQ ID NO: 4821338 - DNA, 21 bp, Homo sapiens
accaaatataaacttgtgtat

SEQ ID NO: 4821339 - DNA, 17 bp, Homo sapiens
accaaattgctgagatg

SEQ ID NO: 4821340 - DNA, 20 bp, Homo sapiens
accaaccactgcgaccacaa

SEQ ID NO: 4821341 - DNA, 20 bp, Homo sapiens
accaagggaagtgaccaagg

SEQ ID NO: 4821342 - DNA, 19 bp, Homo sapiens
accaaggtgaagatggcct

SEQ ID NO: 4821343 - DNA, 17 bp, Homo sapiens
accaagtaaatctatct

SEQ ID NO: 4821344 - DNA, 23 bp, Homo sapiens
accaattgtgagaattactgttt

SEQ ID NO: 4821345 - DNA, 17 bp, Homo sapiens
accaatttgttctgtgc

SEQ ID NO: 4821346 - DNA, 13 bp, Homo sapiens
accacaactgaca

SEQ ID NO: 4821347 - DNA, 16 bp, Homo sapiens
accacagctgcagcca

SEQ ID NO: 4821348 - DNA, 13 bp, Homo sapiens
accacagctgcct

SEQ ID NO: 4821349 - DNA, 14 bp, Homo sapiens
accacagctgcctc

SEQ ID NO: 4821350 - DNA, 19 bp, Homo sapiens
accacatgcgctcctggct

SEQ ID NO: 4821351 - DNA, 21 bp, Homo sapiens
accacatgcgctcctggcttt

SEQ ID NO: 4821352 - DNA, 20 bp, Homo sapiens
accaccactgtgtcccagtg

SEQ ID NO: 4821353 - DNA, 13 bp, Homo sapiens
accacccctgtgc

SEQ ID NO: 4821354 - DNA, 17 bp, Homo sapiens
accaccctcgctgccac

SEQ ID NO: 4821355 - DNA, 15 bp, Homo sapiens
accaccctgccaagg

SEQ ID NO: 4821356 - DNA, 17 bp, Homo sapiens
accaccgcgcccctctg

SEQ ID NO: 4821357 - DNA, 18 bp, Homo sapiens
accaccgcgcccctctgc

SEQ ID NO: 4821358 - DNA, 15 bp, Homo sapiens
accacgacctcgtcc

SEQ ID NO: 4821359 - DNA, 22 bp, Homo sapiens
accacgcagagaggggaggtgg

SEQ ID NO: 4821360 - DNA, 12 bp, Homo sapiens
accacgcccctg

SEQ ID NO: 4821361 - DNA, 13 bp, Homo sapiens
accacgcctggct

SEQ ID NO: 4821362 - DNA, 19 bp, Homo sapiens
accacggggtcgggggagg

SEQ ID NO: 4821363 - DNA, 23 bp, Homo sapiens
accacggggtcgggggaggagca

SEQ ID NO: 4821364 - DNA, 13 bp, Homo sapiens
accactgggcctg

SEQ ID NO: 4821365 - DNA, 14 bp, Homo sapiens
accactgggcctgc

SEQ ID NO: 4821366 - DNA, 13 bp, Homo sapiens
accactgtgtccc

SEQ ID NO: 4821367 - DNA, 18 bp, Homo sapiens
accactgtgtcccagtgt

SEQ ID NO: 4821368 - DNA, 22 bp, Homo sapiens
accactttccttttctattcct

SEQ ID NO: 4821369 - DNA, 18 bp, Homo sapiens
accagaagtttaaatctt

SEQ ID NO: 4821370 - DNA, 16 bp, Homo sapiens
accagactgcaggttg

SEQ ID NO: 4821371 - DNA, 21 bp, Homo sapiens
accagagcctatggaaagggt

SEQ ID NO: 4821372 - DNA, 18 bp, Homo sapiens
accagagcgatgtgttct

SEQ ID NO: 4821373 - DNA, 12 bp, Homo sapiens
accagagctgcc

SEQ ID NO: 4821374 - DNA, 13 bp, Homo sapiens
accagagctgcca

SEQ ID NO: 4821375 - DNA, 23 bp, Homo sapiens
accagcactcccagggcccgagc

SEQ ID NO: 4821376 - DNA, 17 bp, Homo sapiens
accagcataccagttct

SEQ ID NO: 4821377 - DNA, 16 bp, Homo sapiens
accagcatagttctgc

SEQ ID NO: 4821378 - DNA, 11 bp, Homo sapiens
accagccctgg

SEQ ID NO: 4821379 - DNA, 15 bp, Homo sapiens
accagccctggggct

SEQ ID NO: 4821380 - DNA, 14 bp, Homo sapiens
accagcctgagcca

SEQ ID NO: 4821381 - DNA, 23 bp, Homo sapiens
accagcctgagccacagtggggc

SEQ ID NO: 4821382 - DNA, 20 bp, Homo sapiens
accagctgccaaaatcgtag

SEQ ID NO: 4821383 - DNA, 23 bp, Homo sapiens
accagcttgcttctctgccggtg

SEQ ID NO: 4821384 - DNA, 23 bp, Homo sapiens
accaggaagaaggcccgggagga

SEQ ID NO: 4821385 - DNA, 11 bp, Homo sapiens
accaggagcca

SEQ ID NO: 4821386 - DNA, 12 bp, Homo sapiens
accaggagccag

SEQ ID NO: 4821387 - DNA, 13 bp, Homo sapiens
accaggctgcagg

SEQ ID NO: 4821388 - DNA, 20 bp, Homo sapiens
accaggctgcaggtggggtt

SEQ ID NO: 4821389 - DNA, 13 bp, Homo sapiens
accagttcttgca

SEQ ID NO: 4821390 - DNA, 16 bp, Homo sapiens
accataaaataaataa

SEQ ID NO: 4821391 - DNA, 22 bp, Homo sapiens
accatcaccagaattaatttta

SEQ ID NO: 4821392 - DNA, 15 bp, Homo sapiens
accatccatccctgg

SEQ ID NO: 4821393 - DNA, 19 bp, Homo sapiens
accatccatccctggtgaa

SEQ ID NO: 4821394 - DNA, 13 bp, Homo sapiens
accatcccactga

SEQ ID NO: 4821395 - DNA, 21 bp, Homo sapiens
accatcttgggattcctcccc

SEQ ID NO: 4821396 - DNA, 20 bp, Homo sapiens
accatgatcacttatcagtt

SEQ ID NO: 4821397 - DNA, 14 bp, Homo sapiens
accatgctgggccg

SEQ ID NO: 4821398 - DNA, 20 bp, Homo sapiens
accatggccagctaattttt

SEQ ID NO: 4821399 - DNA, 14 bp, Homo sapiens
accatgttgccaat

SEQ ID NO: 4821400 - DNA, 13 bp, Homo sapiens
accattgcttcac

SEQ ID NO: 4821401 - DNA, 20 bp, Homo sapiens
accattgcttcactacccat

SEQ ID NO: 4821402 - DNA, 15 bp, Homo sapiens
accatttaatcattt

SEQ ID NO: 4821403 - DNA, 15 bp, Homo sapiens
accatttgttaatat

SEQ ID NO: 4821404 - DNA, 22 bp, Homo sapiens
accattttgaaatattcacaag

SEQ ID NO: 4821405 - DNA, 23 bp, Homo sapiens
accattttgctgtcccttttcct

SEQ ID NO: 4821406 - DNA, 18 bp, Homo sapiens
acccaaaacacacaattt

SEQ ID NO: 4821407 - DNA, 16 bp, Homo sapiens
acccaaagcatggact

SEQ ID NO: 4821408 - DNA, 21 bp, Homo sapiens
acccaaataaatgtgtaaatg

SEQ ID NO: 4821409 - DNA, 22 bp, Homo sapiens
acccaattaagtcctactttac

SEQ ID NO: 4821410 - DNA, 23 bp, Homo sapiens
acccacaccccgtctgccccttg

SEQ ID NO: 4821411 - DNA, 18 bp, Homo sapiens
acccaccactctcaggac

SEQ ID NO: 4821412 - DNA, 14 bp, Homo sapiens
acccaccccaaact

SEQ ID NO: 4821413 - DNA, 16 bp, Homo sapiens
acccacccctgcccag

SEQ ID NO: 4821414 - DNA, 15 bp, Homo sapiens
acccacttccctgca

SEQ ID NO: 4821415 - DNA, 19 bp, Homo sapiens
acccacttccctgcaaggt

SEQ ID NO: 4821416 - DNA, 15 bp, Homo sapiens
acccatcactgtgtc

SEQ ID NO: 4821417 - DNA, 14 bp, Homo sapiens
acccatgagcgtcc

SEQ ID NO: 4821418 - DNA, 15 bp, Homo sapiens
acccatgcatggcct

SEQ ID NO: 4821419 - DNA, 18 bp, Homo sapiens
acccatgcatggcctccc

SEQ ID NO: 4821420 - DNA, 24 bp, Homo sapiens
acccatgtaaataccagactgcag

SEQ ID NO: 4821421 - DNA, 16 bp, Homo sapiens
accccaaacttccagg

SEQ ID NO: 4821422 - DNA, 16 bp, Homo sapiens
accccaacgcacagga

SEQ ID NO: 4821423 - DNA, 17 bp, Homo sapiens
accccaacgcacaggaa

SEQ ID NO: 4821424 - DNA, 19 bp, Homo sapiens
accccacacgccggggctg

SEQ ID NO: 4821425 - DNA, 13 bp, Homo sapiens
accccaccacaca

SEQ ID NO: 4821426 - DNA, 17 bp, Homo sapiens
accccaccctgtctgca

SEQ ID NO: 4821427 - DNA, 20 bp, Homo sapiens
accccagatacctgtgagga

SEQ ID NO: 4821428 - DNA, 22 bp, Homo sapiens
accccaggatgcatgcagggcc

SEQ ID NO: 4821429 - DNA, 15 bp, Homo sapiens
accccagtccccggg

SEQ ID NO: 4821430 - DNA, 22 bp, Homo sapiens
accccagtccccgggaaaggcc

SEQ ID NO: 4821431 - DNA, 18 bp, Homo sapiens
accccatccctccttaag

SEQ ID NO: 4821432 - DNA, 14 bp, Homo sapiens
accccatcctcaca

SEQ ID NO: 4821433 - DNA, 13 bp, Homo sapiens
acccccacctccc

SEQ ID NO: 4821434 - DNA, 16 bp, Homo sapiens
acccccacctcccggt

SEQ ID NO: 4821435 - DNA, 17 bp, Homo sapiens
acccccacctccctgca

SEQ ID NO: 4821436 - DNA, 17 bp, Homo sapiens
acccccagcctccccca

SEQ ID NO: 4821437 - DNA, 21 bp, Homo sapiens
acccccccagtccgccccgtg

SEQ ID NO: 4821438 - DNA, 17 bp, Homo sapiens
accccccgacctggctg

SEQ ID NO: 4821439 - DNA, 17 bp, Homo sapiens
accccggcaggccctgc

SEQ ID NO: 4821440 - DNA, 18 bp, Homo sapiens
accccggcaggccctgca

SEQ ID NO: 4821441 - DNA, 15 bp, Homo sapiens
accccgtcccggccc

SEQ ID NO: 4821442 - DNA, 20 bp, Homo sapiens
accccgtcccggccccgcgc

SEQ ID NO: 4821443 - DNA, 17 bp, Homo sapiens
accccgtccctttccct

SEQ ID NO: 4821444 - DNA, 21 bp, Homo sapiens
accccgtccctttccctgcat

SEQ ID NO: 4821445 - DNA, 16 bp, Homo sapiens
accccgtctgcccctt

SEQ ID NO: 4821446 - DNA, 16 bp, Homo sapiens
accccgttcccagcgc

SEQ ID NO: 4821447 - DNA, 18 bp, Homo sapiens
accccgttgttgtccctg

SEQ ID NO: 4821448 - DNA, 20 bp, Homo sapiens
accccgttgttgtccctgca

SEQ ID NO: 4821449 - DNA, 21 bp, Homo sapiens
accccgttgttgtccctgcag

SEQ ID NO: 4821450 - DNA, 20 bp, Homo sapiens
acccctaatcgccctgagct

SEQ ID NO: 4821451 - DNA, 15 bp, Homo sapiens
acccctaccctttcc

SEQ ID NO: 4821452 - DNA, 15 bp, Homo sapiens
acccctcaagccagg

SEQ ID NO: 4821453 - DNA, 18 bp, Homo sapiens
acccctcaagccaggaga

SEQ ID NO: 4821454 - DNA, 20 bp, Homo sapiens
acccctcaagccaggagacc

SEQ ID NO: 4821455 - DNA, 18 bp, Homo sapiens
acccctcccacctctttc

SEQ ID NO: 4821456 - DNA, 18 bp, Homo sapiens
acccctcttcccccttcc

SEQ ID NO: 4821457 - DNA, 17 bp, Homo sapiens
acccctgccctcggcca

SEQ ID NO: 4821458 - DNA, 16 bp, Homo sapiens
acccctgggggaggct

SEQ ID NO: 4821459 - DNA, 20 bp, Homo sapiens
acccctgggggaggcttcca

SEQ ID NO: 4821460 - DNA, 21 bp, Homo sapiens
acccctgggggaggcttccag

SEQ ID NO: 4821461 - DNA, 13 bp, Homo sapiens
acccgccccagag

SEQ ID NO: 4821462 - DNA, 18 bp, Homo sapiens
acccgccccagagactgc

SEQ ID NO: 4821463 - DNA, 22 bp, Homo sapiens
acccgccccagagactgcccac

SEQ ID NO: 4821464 - DNA, 17 bp, Homo sapiens
acccggatctccaggcc

SEQ ID NO: 4821465 - DNA, 22 bp, Homo sapiens
acccggatctccaggcccagcc

SEQ ID NO: 4821466 - DNA, 18 bp, Homo sapiens
acccggctgactcagtgc

SEQ ID NO: 4821467 - DNA, 13 bp, Homo sapiens
acccgtgttctcc

SEQ ID NO: 4821468 - DNA, 21 bp, Homo sapiens
accctacagtatataagcttt

SEQ ID NO: 4821469 - DNA, 17 bp, Homo sapiens
accctaggtctccaccc

SEQ ID NO: 4821470 - DNA, 19 bp, Homo sapiens
accctaggtctccacccct

SEQ ID NO: 4821471 - DNA, 22 bp, Homo sapiens
accctaggtctccacccctcaa

SEQ ID NO: 4821472 - DNA, 17 bp, Homo sapiens
accctagtgatttttgg

SEQ ID NO: 4821473 - DNA, 12 bp, Homo sapiens
accctatctccc

SEQ ID NO: 4821474 - DNA, 19 bp, Homo sapiens
accctcagaatattaagca

SEQ ID NO: 4821475 - DNA, 17 bp, Homo sapiens
accctcagttattttgt

SEQ ID NO: 4821476 - DNA, 20 bp, Homo sapiens
accctccaccgcagaaggaa

SEQ ID NO: 4821477 - DNA, 21 bp, Homo sapiens
accctccaccgcagaaggaag

SEQ ID NO: 4821478 - DNA, 11 bp, Homo sapiens
accctcccagg

SEQ ID NO: 4821479 - DNA, 13 bp, Homo sapiens
accctcccccgca

SEQ ID NO: 4821480 - DNA, 15 bp, Homo sapiens
accctcccctctcct

SEQ ID NO: 4821481 - DNA, 16 bp, Homo sapiens
accctcccctctcctg

SEQ ID NO: 4821482 - DNA, 13 bp, Homo sapiens
accctcccctctt

SEQ ID NO: 4821483 - DNA, 10 bp, Homo sapiens
accctccctg

SEQ ID NO: 4821484 - DNA, 13 bp, Homo sapiens
accctccctgtcc

SEQ ID NO: 4821485 - DNA, 14 bp, Homo sapiens
accctctcctgggg

SEQ ID NO: 4821486 - DNA, 15 bp, Homo sapiens
accctctcctggggg

SEQ ID NO: 4821487 - DNA, 13 bp, Homo sapiens
accctctgctgca

SEQ ID NO: 4821488 - DNA, 15 bp, Homo sapiens
accctctgctgcaca

SEQ ID NO: 4821489 - DNA, 20 bp, Homo sapiens
accctcttctcagctccact

SEQ ID NO: 4821490 - DNA, 13 bp, Homo sapiens
accctgaatcaga

SEQ ID NO: 4821491 - DNA, 15 bp, Homo sapiens
accctgaatcagagg

SEQ ID NO: 4821492 - DNA, 17 bp, Homo sapiens
accctgaggagtgatgg

SEQ ID NO: 4821493 - DNA, 15 bp, Homo sapiens
accctgccaccctct

SEQ ID NO: 4821494 - DNA, 20 bp, Homo sapiens
accctgccaccctctgctgc

SEQ ID NO: 4821495 - DNA, 16 bp, Homo sapiens
accctgccagggggtt

SEQ ID NO: 4821496 - DNA, 14 bp, Homo sapiens
accctgccctggcc

SEQ ID NO: 4821497 - DNA, 15 bp, Homo sapiens
accctgccctggcct

SEQ ID NO: 4821498 - DNA, 16 bp, Homo sapiens
accctgccctggccta

SEQ ID NO: 4821499 - DNA, 17 bp, Homo sapiens
accctgccctggcctac

SEQ ID NO: 4821500 - DNA, 13 bp, Homo sapiens
accctgcgcccct

SEQ ID NO: 4821501 - DNA, 17 bp, Homo sapiens
accctgcgcccctgccc

SEQ ID NO: 4821502 - DNA, 19 bp, Homo sapiens
accctgcgcccctgcccag

SEQ ID NO: 4821503 - DNA, 14 bp, Homo sapiens
accctgctgccttc

SEQ ID NO: 4821504 - DNA, 20 bp, Homo sapiens
accctgcttctgctgccctg

SEQ ID NO: 4821505 - DNA, 21 bp, Homo sapiens
accctgcttctgctgccctga

SEQ ID NO: 4821506 - DNA, 17 bp, Homo sapiens
accctggacagtgccta

SEQ ID NO: 4821507 - DNA, 15 bp, Homo sapiens
accctgggcctcccg

SEQ ID NO: 4821508 - DNA, 21 bp, Homo sapiens
acccttcccaatcagcactga

SEQ ID NO: 4821509 - DNA, 10 bp, Homo sapiens
acccttcccc

SEQ ID NO: 4821510 - DNA, 14 bp, Homo sapiens
acccttccccactc

SEQ ID NO: 4821511 - DNA, 16 bp, Homo sapiens
acccttccccactccc

SEQ ID NO: 4821512 - DNA, 17 bp, Homo sapiens
acccttccccactcccg

SEQ ID NO: 4821513 - DNA, 14 bp, Homo sapiens
acccttcttgtctc

SEQ ID NO: 4821514 - DNA, 15 bp, Homo sapiens
acccttgactgttat

SEQ ID NO: 4821515 - DNA, 23 bp, Homo sapiens
accctttcttttgaatcaatctg

SEQ ID NO: 4821516 - DNA, 20 bp, Homo sapiens
accgaactcgggattacaga

SEQ ID NO: 4821517 - DNA, 22 bp, Homo sapiens
accgaactcgggattacagaaa

SEQ ID NO: 4821518 - DNA, 13 bp, Homo sapiens
accgacgcccctc

SEQ ID NO: 4821519 - DNA, 14 bp, Homo sapiens
accgaggactccag

SEQ ID NO: 4821520 - DNA, 16 bp, Homo sapiens
accgaggactccaggg

SEQ ID NO: 4821521 - DNA, 15 bp, Homo sapiens
accgcaatatgggag

SEQ ID NO: 4821522 - DNA, 15 bp, Homo sapiens
accgcaccgggctgg

SEQ ID NO: 4821523 - DNA, 18 bp, Homo sapiens
accgcaccgggctggcct

SEQ ID NO: 4821524 - DNA, 14 bp, Homo sapiens
accgcagaaggaag

SEQ ID NO: 4821525 - DNA, 16 bp, Homo sapiens
accgccagagtgtcct

SEQ ID NO: 4821526 - DNA, 19 bp, Homo sapiens
accgccagagtgtcctgct

SEQ ID NO: 4821527 - DNA, 17 bp, Homo sapiens
accgcccaacccccacc

SEQ ID NO: 4821528 - DNA, 12 bp, Homo sapiens
accgcccaccca

SEQ ID NO: 4821529 - DNA, 21 bp, Homo sapiens
accgcccacccagcagcgccc

SEQ ID NO: 4821530 - DNA, 12 bp, Homo sapiens
accgccccaggc

SEQ ID NO: 4821531 - DNA, 20 bp, Homo sapiens
accgcgcccctctgcgcccc

SEQ ID NO: 4821532 - DNA, 23 bp, Homo sapiens
accgcgcccctctgcgccccagc

SEQ ID NO: 4821533 - DNA, 20 bp, Homo sapiens
accggacgcatgcagggccc

SEQ ID NO: 4821534 - DNA, 19 bp, Homo sapiens
accggacgctggagaccct

SEQ ID NO: 4821535 - DNA, 14 bp, Homo sapiens
accggcactgtgca

SEQ ID NO: 4821536 - DNA, 16 bp, Homo sapiens
accggcccgccacctt

SEQ ID NO: 4821537 - DNA, 18 bp, Homo sapiens
accgggactacagaagtg

SEQ ID NO: 4821538 - DNA, 13 bp, Homo sapiens
accgggcttcctc

SEQ ID NO: 4821539 - DNA, 19 bp, Homo sapiens
accgggtggcagcgcccag

SEQ ID NO: 4821540 - DNA, 20 bp, Homo sapiens
accgggtggcagcgcccagc

SEQ ID NO: 4821541 - DNA, 12 bp, Homo sapiens
accgtcaatgtg

SEQ ID NO: 4821542 - DNA, 22 bp, Homo sapiens
accgtgagcaggaaggcctggg

SEQ ID NO: 4821543 - DNA, 14 bp, Homo sapiens
accgtgaggccaga

SEQ ID NO: 4821544 - DNA, 18 bp, Homo sapiens
accgtggtgtcctctgtc

SEQ ID NO: 4821545 - DNA, 21 bp, Homo sapiens
accgtggtgtgaggcccccgg

SEQ ID NO: 4821546 - DNA, 17 bp, Homo sapiens
acctaaacagctgcttt

SEQ ID NO: 4821547 - DNA, 19 bp, Homo sapiens
acctaaagggaagccctga

SEQ ID NO: 4821548 - DNA, 20 bp, Homo sapiens
acctaaataaacacatagat

SEQ ID NO: 4821549 - DNA, 16 bp, Homo sapiens
acctaaattaacaaat

SEQ ID NO: 4821550 - DNA, 19 bp, Homo sapiens
acctaagagccacaataag

SEQ ID NO: 4821551 - DNA, 22 bp, Homo sapiens
acctaccctggaccgagtggac

SEQ ID NO: 4821552 - DNA, 16 bp, Homo sapiens
acctactcctccccct

SEQ ID NO: 4821553 - DNA, 19 bp, Homo sapiens
acctactcctccccctcct

SEQ ID NO: 4821554 - DNA, 23 bp, Homo sapiens
acctacttatttcagattcacct

SEQ ID NO: 4821555 - DNA, 15 bp, Homo sapiens
acctataaatggact

SEQ ID NO: 4821556 - DNA, 21 bp, Homo sapiens
acctatctgtattggcagcac

SEQ ID NO: 4821557 - DNA, 13 bp, Homo sapiens
acctatgaagttt

SEQ ID NO: 4821558 - DNA, 22 bp, Homo sapiens
acctattgctgtaaataaaaat

SEQ ID NO: 4821559 - DNA, 12 bp, Homo sapiens
acctcaaactgg

SEQ ID NO: 4821560 - DNA, 16 bp, Homo sapiens
acctcaacaagaagaa

SEQ ID NO: 4821561 - DNA, 17 bp, Homo sapiens
acctcaacaagaagaat

SEQ ID NO: 4821562 - DNA, 14 bp, Homo sapiens
acctcacagtgacc

SEQ ID NO: 4821563 - DNA, 21 bp, Homo sapiens
acctcacagtgacccttccca

SEQ ID NO: 4821564 - DNA, 23 bp, Homo sapiens
acctcacttgtggcagcttccct

SEQ ID NO: 4821565 - DNA, 11 bp, Homo sapiens
acctcaggcct

SEQ ID NO: 4821566 - DNA, 12 bp, Homo sapiens
acctcaggcctg

SEQ ID NO: 4821567 - DNA, 22 bp, Homo sapiens
acctcaggcctgggggctgggc

SEQ ID NO: 4821568 - DNA, 16 bp, Homo sapiens
acctcagttggcctct

SEQ ID NO: 4821569 - DNA, 20 bp, Homo sapiens
acctcagttggcctctgccc

SEQ ID NO: 4821570 - DNA, 23 bp, Homo sapiens
acctcagttggcctctgcccctc

SEQ ID NO: 4821571 - DNA, 14 bp, Homo sapiens
acctcatttgcatc

SEQ ID NO: 4821572 - DNA, 22 bp, Homo sapiens
acctcccccaaaccctgcttct

SEQ ID NO: 4821573 - DNA, 12 bp, Homo sapiens
acctcccccagg

SEQ ID NO: 4821574 - DNA, 15 bp, Homo sapiens
acctcccccagggag

SEQ ID NO: 4821575 - DNA, 16 bp, Homo sapiens
acctcccctggtcctg

SEQ ID NO: 4821576 - DNA, 12 bp, Homo sapiens
acctccctgccc

SEQ ID NO: 4821577 - DNA, 13 bp, Homo sapiens
acctccctgccca

SEQ ID NO: 4821578 - DNA, 12 bp, Homo sapiens
acctccttctgc

SEQ ID NO: 4821579 - DNA, 20 bp, Homo sapiens
acctccttctgcagtcagac

SEQ ID NO: 4821580 - DNA, 21 bp, Homo sapiens
acctccttctgcagtcagact

SEQ ID NO: 4821581 - DNA, 23 bp, Homo sapiens
acctcgagtggcgagtccagaca

SEQ ID NO: 4821582 - DNA, 18 bp, Homo sapiens
acctcggccgaggcctgc

SEQ ID NO: 4821583 - DNA, 14 bp, Homo sapiens
acctctacaggcat

SEQ ID NO: 4821584 - DNA, 14 bp, Homo sapiens
acctctactttcca

SEQ ID NO: 4821585 - DNA, 16 bp, Homo sapiens
acctctctgtcatgtg

SEQ ID NO: 4821586 - DNA, 17 bp, Homo sapiens
acctctgatttattttg

SEQ ID NO: 4821587 - DNA, 23 bp, Homo sapiens
acctctgatttattttgtatgaa

SEQ ID NO: 4821588 - DNA, 16 bp, Homo sapiens
acctgaaagcccttct

SEQ ID NO: 4821589 - DNA, 18 bp, Homo sapiens
acctgaattaaagtctac

SEQ ID NO: 4821590 - DNA, 19 bp, Homo sapiens
acctgaattattaatgaat

SEQ ID NO: 4821591 - DNA, 19 bp, Homo sapiens
acctgaattttggctgtgt

SEQ ID NO: 4821592 - DNA, 12 bp, Homo sapiens
acctgacacaag

SEQ ID NO: 4821593 - DNA, 14 bp, Homo sapiens
acctgacacctgcc

SEQ ID NO: 4821594 - DNA, 18 bp, Homo sapiens
acctgacacctgccgctg

SEQ ID NO: 4821595 - DNA, 13 bp, Homo sapiens
acctgagaatgtg

SEQ ID NO: 4821596 - DNA, 13 bp, Homo sapiens
acctgaggccaaa

SEQ ID NO: 4821597 - DNA, 18 bp, Homo sapiens
acctgatacctgcctggg

SEQ ID NO: 4821598 - DNA, 21 bp, Homo sapiens
acctgatacctgcctgggaca

SEQ ID NO: 4821599 - DNA, 14 bp, Homo sapiens
acctgccaggaagc

SEQ ID NO: 4821600 - DNA, 15 bp, Homo sapiens
acctgccaggaagcc

SEQ ID NO: 4821601 - DNA, 23 bp, Homo sapiens
acctgccaggaagccagcaggct

SEQ ID NO: 4821602 - DNA, 11 bp, Homo sapiens
acctgccaggc

SEQ ID NO: 4821603 - DNA, 22 bp, Homo sapiens
acctgcccagttagcccggcca

SEQ ID NO: 4821604 - DNA, 15 bp, Homo sapiens
acctgcccctcaact

SEQ ID NO: 4821605 - DNA, 23 bp, Homo sapiens
acctgcccctcaactctcctcca

SEQ ID NO: 4821606 - DNA, 12 bp, Homo sapiens
acctgccgctgc

SEQ ID NO: 4821607 - DNA, 21 bp, Homo sapiens
acctgccgtaagttactggct

SEQ ID NO: 4821608 - DNA, 11 bp, Homo sapiens
acctgcctctc

SEQ ID NO: 4821609 - DNA, 19 bp, Homo sapiens
acctgcctctcacacacat

SEQ ID NO: 4821610 - DNA, 14 bp, Homo sapiens
acctggaggctgga

SEQ ID NO: 4821611 - DNA, 22 bp, Homo sapiens
acctggaggctggaccaactgc

SEQ ID NO: 4821612 - DNA, 24 bp, Homo sapiens
acctggatggatctgctccatgca

SEQ ID NO: 4821613 - DNA, 18 bp, Homo sapiens
acctggcgggctggtgac

SEQ ID NO: 4821614 - DNA, 15 bp, Homo sapiens
acctggcttcccagg

SEQ ID NO: 4821615 - DNA, 17 bp, Homo sapiens
acctggcttcccaggac

SEQ ID NO: 4821616 - DNA, 22 bp, Homo sapiens
acctggcttcccaggaccctgg

SEQ ID NO: 4821617 - DNA, 17 bp, Homo sapiens
acctgggccctaggcat

SEQ ID NO: 4821618 - DNA, 14 bp, Homo sapiens
acctggtaattatc

SEQ ID NO: 4821619 - DNA, 12 bp, Homo sapiens
acctggtggcac

SEQ ID NO: 4821620 - DNA, 13 bp, Homo sapiens
acctggtggccct

SEQ ID NO: 4821621 - DNA, 15 bp, Homo sapiens
acctggtggccctgc

SEQ ID NO: 4821622 - DNA, 20 bp, Homo sapiens
acctgtaaaactttatttta

SEQ ID NO: 4821623 - DNA, 16 bp, Homo sapiens
acctgtaggtctatga

SEQ ID NO: 4821624 - DNA, 14 bp, Homo sapiens
acctgtgaggactg

SEQ ID NO: 4821625 - DNA, 13 bp, Homo sapiens
acctgtgctttca

SEQ ID NO: 4821626 - DNA, 13 bp, Homo sapiens
accttaaattaaa

SEQ ID NO: 4821627 - DNA, 16 bp, Homo sapiens
accttaaattaaacaa

SEQ ID NO: 4821628 - DNA, 17 bp, Homo sapiens
accttaaattaaacaat

SEQ ID NO: 4821629 - DNA, 15 bp, Homo sapiens
accttaatatttctt

SEQ ID NO: 4821630 - DNA, 14 bp, Homo sapiens
accttacaaccaca

SEQ ID NO: 4821631 - DNA, 21 bp, Homo sapiens
accttacaaccacatttctgg

SEQ ID NO: 4821632 - DNA, 13 bp, Homo sapiens
accttagctccct

SEQ ID NO: 4821633 - DNA, 19 bp, Homo sapiens
accttagctccctcccgca

SEQ ID NO: 4821634 - DNA, 16 bp, Homo sapiens
accttatagagcacaa

SEQ ID NO: 4821635 - DNA, 17 bp, Homo sapiens
accttatagagcacaat

SEQ ID NO: 4821636 - DNA, 15 bp, Homo sapiens
accttcatttaaaaa

SEQ ID NO: 4821637 - DNA, 15 bp, Homo sapiens
accttccaggacccc

SEQ ID NO: 4821638 - DNA, 17 bp, Homo sapiens
accttccagtcaggatg

SEQ ID NO: 4821639 - DNA, 22 bp, Homo sapiens
accttccatctcaacctacctc

SEQ ID NO: 4821640 - DNA, 13 bp, Homo sapiens
accttccctccaa

SEQ ID NO: 4821641 - DNA, 16 bp, Homo sapiens
accttcctctggggct

SEQ ID NO: 4821642 - DNA, 12 bp, Homo sapiens
accttcctgggc

SEQ ID NO: 4821643 - DNA, 21 bp, Homo sapiens
accttcctgggcagcccagag

SEQ ID NO: 4821644 - DNA, 22 bp, Homo sapiens
accttccttgaaatttctcagc

SEQ ID NO: 4821645 - DNA, 20 bp, Homo sapiens
accttctaatccatgtgctg

SEQ ID NO: 4821646 - DNA, 23 bp, Homo sapiens
accttctaatccatgtgctgctg

SEQ ID NO: 4821647 - DNA, 12 bp, Homo sapiens
accttctgaaga

SEQ ID NO: 4821648 - DNA, 19 bp, Homo sapiens
accttctgccaaggccagc

SEQ ID NO: 4821649 - DNA, 23 bp, Homo sapiens
accttctgccaaggccagcccac

SEQ ID NO: 4821650 - DNA, 14 bp, Homo sapiens
accttcttttcaat

SEQ ID NO: 4821651 - DNA, 18 bp, Homo sapiens
accttcttttcaatgcaa

SEQ ID NO: 4821652 - DNA, 16 bp, Homo sapiens
accttgcttccttctc

SEQ ID NO: 4821653 - DNA, 22 bp, Homo sapiens
accttgtacagaaccagcactc

SEQ ID NO: 4821654 - DNA, 15 bp, Homo sapiens
acctttaagagaaat

SEQ ID NO: 4821655 - DNA, 13 bp, Homo sapiens
acctttagaatat

SEQ ID NO: 4821656 - DNA, 14 bp, Homo sapiens
acctttatttatta

SEQ ID NO: 4821657 - DNA, 21 bp, Homo sapiens
acctttccgctgtcgccccag

SEQ ID NO: 4821658 - DNA, 18 bp, Homo sapiens
acctttctggcttttaag

SEQ ID NO: 4821659 - DNA, 24 bp, Homo sapiens
acctttgtctcacgattccagtgc

SEQ ID NO: 4821660 - DNA, 20 bp, Homo sapiens
accttttaaaaaaataatat

SEQ ID NO: 4821661 - DNA, 22 bp, Homo sapiens
accttttaaaaaaataatataa

SEQ ID NO: 4821662 - DNA, 19 bp, Homo sapiens
acgaaacacaaaccacaac

SEQ ID NO: 4821663 - DNA, 14 bp, Homo sapiens
acgactttctttaa

SEQ ID NO: 4821664 - DNA, 17 bp, Homo sapiens
acgactttctttaacat

SEQ ID NO: 4821665 - DNA, 20 bp, Homo sapiens
acgagcagagcgcagccccc

SEQ ID NO: 4821666 - DNA, 22 bp, Homo sapiens
acgagtgtagtcccggaggcct

SEQ ID NO: 4821667 - DNA, 22 bp, Homo sapiens
acgatccccatggaacagccct

SEQ ID NO: 4821668 - DNA, 14 bp, Homo sapiens
acgatttaatttat

SEQ ID NO: 4821669 - DNA, 12 bp, Homo sapiens
acgatttctcca

SEQ ID NO: 4821670 - DNA, 17 bp, Homo sapiens
acgcacaacatgcacat

SEQ ID NO: 4821671 - DNA, 18 bp, Homo sapiens
acgcacaacatgcacatt

SEQ ID NO: 4821672 - DNA, 12 bp, Homo sapiens
acgcagagcccc

SEQ ID NO: 4821673 - DNA, 15 bp, Homo sapiens
acgcagagccccgga

SEQ ID NO: 4821674 - DNA, 18 bp, Homo sapiens
acgcagagccccggagca

SEQ ID NO: 4821675 - DNA, 22 bp, Homo sapiens
acgcagccccccacgcttctgg

SEQ ID NO: 4821676 - DNA, 18 bp, Homo sapiens
acgcatgaagaacagtgc

SEQ ID NO: 4821677 - DNA, 17 bp, Homo sapiens
acgccacggccgtgttc

SEQ ID NO: 4821678 - DNA, 17 bp, Homo sapiens
acgcccagcccccaccc

SEQ ID NO: 4821679 - DNA, 23 bp, Homo sapiens
acgcccccgcccccgccccgctg

SEQ ID NO: 4821680 - DNA, 13 bp, Homo sapiens
acgcccctgcctg

SEQ ID NO: 4821681 - DNA, 17 bp, Homo sapiens
acgcccctttctcttgc

SEQ ID NO: 4821682 - DNA, 22 bp, Homo sapiens
acgccgatataagccatagccc

SEQ ID NO: 4821683 - DNA, 19 bp, Homo sapiens
acgccggggctggccctgc

SEQ ID NO: 4821684 - DNA, 20 bp, Homo sapiens
acgccggggctggccctgcc

SEQ ID NO: 4821685 - DNA, 15 bp, Homo sapiens
acgcctcctggccag

SEQ ID NO: 4821686 - DNA, 16 bp, Homo sapiens
acgcggccgctctccg

SEQ ID NO: 4821687 - DNA, 17 bp, Homo sapiens
acgcgtccacatacact

SEQ ID NO: 4821688 - DNA, 21 bp, Homo sapiens
acgcgtccacatacactgcat

SEQ ID NO: 4821689 - DNA, 23 bp, Homo sapiens
acgctgaatgagaagtaaattat

SEQ ID NO: 4821690 - DNA, 17 bp, Homo sapiens
acgctgctccatgcaca

SEQ ID NO: 4821691 - DNA, 14 bp, Homo sapiens
acgctgtcctctcg

SEQ ID NO: 4821692 - DNA, 22 bp, Homo sapiens
acggaagaagagatcaggaaga

SEQ ID NO: 4821693 - DNA, 21 bp, Homo sapiens
acggagtttccatttggattt

SEQ ID NO: 4821694 - DNA, 12 bp, Homo sapiens
acggccctgcaa

SEQ ID NO: 4821695 - DNA, 21 bp, Homo sapiens
acggccgtccctgacttccca

SEQ ID NO: 4821696 - DNA, 23 bp, Homo sapiens
acggccgtccctgacttcccagc

SEQ ID NO: 4821697 - DNA, 23 bp, Homo sapiens
acggcctgagaggagcgtgtcct

SEQ ID NO: 4821698 - DNA, 16 bp, Homo sapiens
acggctaagaggctgc

SEQ ID NO: 4821699 - DNA, 17 bp, Homo sapiens
acggctaagaggctgct

SEQ ID NO: 4821700 - DNA, 17 bp, Homo sapiens
acgggacagcggcccgg

SEQ ID NO: 4821701 - DNA, 22 bp, Homo sapiens
acgggcccgctcaacctctcag

SEQ ID NO: 4821702 - DNA, 23 bp, Homo sapiens
acgggcccgctcaacctctcaga

SEQ ID NO: 4821703 - DNA, 19 bp, Homo sapiens
acggggcacccagcccaac

SEQ ID NO: 4821704 - DNA, 14 bp, Homo sapiens
acggggcagagctg

SEQ ID NO: 4821705 - DNA, 15 bp, Homo sapiens
acggggcagagctga

SEQ ID NO: 4821706 - DNA, 14 bp, Homo sapiens
acgggggctgcttc

SEQ ID NO: 4821707 - DNA, 15 bp, Homo sapiens
acgggggctgcttct

SEQ ID NO: 4821708 - DNA, 12 bp, Homo sapiens
acgggtctgtgg

SEQ ID NO: 4821709 - DNA, 18 bp, Homo sapiens
acggtattatgcttcttg

SEQ ID NO: 4821710 - DNA, 16 bp, Homo sapiens
acgtactcctcagacg

SEQ ID NO: 4821711 - DNA, 21 bp, Homo sapiens
acgtccctcgagctctgtagc

SEQ ID NO: 4821712 - DNA, 12 bp, Homo sapiens
acgtcctgggtg

SEQ ID NO: 4821713 - DNA, 23 bp, Homo sapiens
acgtctagctatgctgtatctgt

SEQ ID NO: 4821714 - DNA, 18 bp, Homo sapiens
acgtctgtgagtctgtcc

SEQ ID NO: 4821715 - DNA, 12 bp, Homo sapiens
acgtgaccctgt

SEQ ID NO: 4821716 - DNA, 21 bp, Homo sapiens
acgtgcaatttgtttgtgctt

SEQ ID NO: 4821717 - DNA, 15 bp, Homo sapiens
acgtgcccatttcac

SEQ ID NO: 4821718 - DNA, 22 bp, Homo sapiens
acgtgctcttctgttctcaaat

SEQ ID NO: 4821719 - DNA, 20 bp, Homo sapiens
acgtggccgctgctgtgaca

SEQ ID NO: 4821720 - DNA, 23 bp, Homo sapiens
acgtgggagttcagctgcttctc

SEQ ID NO: 4821721 - DNA, 12 bp, Homo sapiens
acgtgtgaggat

SEQ ID NO: 4821722 - DNA, 21 bp, Homo sapiens
acgttgcagaaaaagagcttc

SEQ ID NO: 4821723 - DNA, 18 bp, Homo sapiens
actaaacttggtgcttat

SEQ ID NO: 4821724 - DNA, 22 bp, Homo sapiens
actaaacttggtgcttattgat

SEQ ID NO: 4821725 - DNA, 18 bp, Homo sapiens
actaaatagatttttaga

SEQ ID NO: 4821726 - DNA, 17 bp, Homo sapiens
actaaccccaacgcaca

SEQ ID NO: 4821727 - DNA, 11 bp, Homo sapiens
actaactgagg

SEQ ID NO: 4821728 - DNA, 15 bp, Homo sapiens
actaacttattttga

SEQ ID NO: 4821729 - DNA, 23 bp, Homo sapiens
actaagggcaggaagacttccag

SEQ ID NO: 4821730 - DNA, 19 bp, Homo sapiens
actaagtggaacgttctct

SEQ ID NO: 4821731 - DNA, 12 bp, Homo sapiens
actaataaaata

SEQ ID NO: 4821732 - DNA, 21 bp, Homo sapiens
actaataaaatacatactata

SEQ ID NO: 4821733 - DNA, 16 bp, Homo sapiens
actaattaaaaaatag

SEQ ID NO: 4821734 - DNA, 15 bp, Homo sapiens
actaatttgctctgt

SEQ ID NO: 4821735 - DNA, 23 bp, Homo sapiens
actaattttgcatgcgtatttat

SEQ ID NO: 4821736 - DNA, 21 bp, Homo sapiens
actacaaacatggggagccat

SEQ ID NO: 4821737 - DNA, 13 bp, Homo sapiens
actacagaagtgg

SEQ ID NO: 4821738 - DNA, 21 bp, Homo sapiens
actacagaagtggaaggataa

SEQ ID NO: 4821739 - DNA, 20 bp, Homo sapiens
actacaggcacacaccacca

SEQ ID NO: 4821740 - DNA, 16 bp, Homo sapiens
actacaggttttatga

SEQ ID NO: 4821741 - DNA, 17 bp, Homo sapiens
actacaggttttatgag

SEQ ID NO: 4821742 - DNA, 12 bp, Homo sapiens
actacatttgca

SEQ ID NO: 4821743 - DNA, 16 bp, Homo sapiens
actacatttgcatgcc

SEQ ID NO: 4821744 - DNA, 13 bp, Homo sapiens
actacctataaat

SEQ ID NO: 4821745 - DNA, 15 bp, Homo sapiens
actacctataaatgg

SEQ ID NO: 4821746 - DNA, 18 bp, Homo sapiens
actactgggactcttcag

SEQ ID NO: 4821747 - DNA, 16 bp, Homo sapiens
actagaatgagaaatc

SEQ ID NO: 4821748 - DNA, 17 bp, Homo sapiens
actagaatgagaaatca

SEQ ID NO: 4821749 - DNA, 16 bp, Homo sapiens
actagagatattttgt

SEQ ID NO: 4821750 - DNA, 17 bp, Homo sapiens
actagagatattttgta

SEQ ID NO: 4821751 - DNA, 23 bp, Homo sapiens
actagagcacgggcgttatgtaa

SEQ ID NO: 4821752 - DNA, 15 bp, Homo sapiens
actagcaataagttg

SEQ ID NO: 4821753 - DNA, 20 bp, Homo sapiens
actagccctctttctctctg

SEQ ID NO: 4821754 - DNA, 21 bp, Homo sapiens
actagccctctttctctctgt

SEQ ID NO: 4821755 - DNA, 22 bp, Homo sapiens
actagccctctttctctctgtg

SEQ ID NO: 4821756 - DNA, 19 bp, Homo sapiens
actagccttcccagcttcc

SEQ ID NO: 4821757 - DNA, 15 bp, Homo sapiens
actaggtgcccagtc

SEQ ID NO: 4821758 - DNA, 13 bp, Homo sapiens
actagtaatcttg

SEQ ID NO: 4821759 - DNA, 19 bp, Homo sapiens
actagtgtttggctcacct

SEQ ID NO: 4821760 - DNA, 21 bp, Homo sapiens
actataatgtgaaatgtaact

SEQ ID NO: 4821761 - DNA, 23 bp, Homo sapiens
actataatttacctgaagtcttt

SEQ ID NO: 4821762 - DNA, 23 bp, Homo sapiens
actatcagcagcggcagcagcag

SEQ ID NO: 4821763 - DNA, 17 bp, Homo sapiens
actatccatgcaccaaa

SEQ ID NO: 4821764 - DNA, 15 bp, Homo sapiens
actatgcctgttgat

SEQ ID NO: 4821765 - DNA, 16 bp, Homo sapiens
actatggctgtatttt

SEQ ID NO: 4821766 - DNA, 17 bp, Homo sapiens
actatggctgtattttt

SEQ ID NO: 4821767 - DNA, 18 bp, Homo sapiens
actatggtaaataactgt

SEQ ID NO: 4821768 - DNA, 20 bp, Homo sapiens
actatggtatatattttgaa

SEQ ID NO: 4821769 - DNA, 18 bp, Homo sapiens
actatggtatgctggcca

SEQ ID NO: 4821770 - DNA, 19 bp, Homo sapiens
actatggtatgctggccag

SEQ ID NO: 4821771 - DNA, 18 bp, Homo sapiens
actatttattaaaaccat

SEQ ID NO: 4821772 - DNA, 13 bp, Homo sapiens
actatttcaccat

SEQ ID NO: 4821773 - DNA, 16 bp, Homo sapiens
actatttctttcatca

SEQ ID NO: 4821774 - DNA, 20 bp, Homo sapiens
actcaccgacccgacactct

SEQ ID NO: 4821775 - DNA, 22 bp, Homo sapiens
actcaccgacccgacactctca

SEQ ID NO: 4821776 - DNA, 19 bp, Homo sapiens
actcacctgcccctcaact

SEQ ID NO: 4821777 - DNA, 16 bp, Homo sapiens
actcaggagcacagcc

SEQ ID NO: 4821778 - DNA, 15 bp, Homo sapiens
actcaggcagcctgt

SEQ ID NO: 4821779 - DNA, 16 bp, Homo sapiens
actcaggcagtgcagt

SEQ ID NO: 4821780 - DNA, 20 bp, Homo sapiens
actcagtaacacagtgcagt

SEQ ID NO: 4821781 - DNA, 15 bp, Homo sapiens
actcagtcagcccag

SEQ ID NO: 4821782 - DNA, 18 bp, Homo sapiens
actcagtcagcccagtgg

SEQ ID NO: 4821783 - DNA, 22 bp, Homo sapiens
actcagtgcagggacagcctgc

SEQ ID NO: 4821784 - DNA, 20 bp, Homo sapiens
actcagttaggcagtgcagt

SEQ ID NO: 4821785 - DNA, 17 bp, Homo sapiens
actcatccagaactgtc

SEQ ID NO: 4821786 - DNA, 13 bp, Homo sapiens
actcatgtgattt

SEQ ID NO: 4821787 - DNA, 14 bp, Homo sapiens
actcatgttaattg

SEQ ID NO: 4821788 - DNA, 16 bp, Homo sapiens
actcatttatttccat

SEQ ID NO: 4821789 - DNA, 20 bp, Homo sapiens
actccaagccctggggcagg

SEQ ID NO: 4821790 - DNA, 21 bp, Homo sapiens
actccaagccctggggcaggg

SEQ ID NO: 4821791 - DNA, 20 bp, Homo sapiens
actccaaggcaaatgtccaa

SEQ ID NO: 4821792 - DNA, 15 bp, Homo sapiens
actccagaatttccc

SEQ ID NO: 4821793 - DNA, 17 bp, Homo sapiens
actccagaatttcccaa

SEQ ID NO: 4821794 - DNA, 18 bp, Homo sapiens
actccaggaaaactgttt

SEQ ID NO: 4821795 - DNA, 20 bp, Homo sapiens
actccagtgactgctgcctc

SEQ ID NO: 4821796 - DNA, 19 bp, Homo sapiens
actccagtgttcccttctg

SEQ ID NO: 4821797 - DNA, 18 bp, Homo sapiens
actccattactaaagaca

SEQ ID NO: 4821798 - DNA, 11 bp, Homo sapiens
actcccagggc

SEQ ID NO: 4821799 - DNA, 12 bp, Homo sapiens
actcccagggcc

SEQ ID NO: 4821800 - DNA, 15 bp, Homo sapiens
actcccccagaggtg

SEQ ID NO: 4821801 - DNA, 17 bp, Homo sapiens
actcccccagaggtgga

SEQ ID NO: 4821802 - DNA, 22 bp, Homo sapiens
actccccgcccgccctcctctg

SEQ ID NO: 4821803 - DNA, 23 bp, Homo sapiens
actccccgcccgccctcctctgc

SEQ ID NO: 4821804 - DNA, 19 bp, Homo sapiens
actccctccctttctcttt

SEQ ID NO: 4821805 - DNA, 21 bp, Homo sapiens
actcccttccttatgcatact

SEQ ID NO: 4821806 - DNA, 19 bp, Homo sapiens
actcctcccaactctggcc

SEQ ID NO: 4821807 - DNA, 18 bp, Homo sapiens
actcctgacctcaagtga

SEQ ID NO: 4821808 - DNA, 12 bp, Homo sapiens
actcctgtgtgt

SEQ ID NO: 4821809 - DNA, 14 bp, Homo sapiens
actcctgtgtgtgg

SEQ ID NO: 4821810 - DNA, 11 bp, Homo sapiens
actccttggcc

SEQ ID NO: 4821811 - DNA, 12 bp, Homo sapiens
actccttggcct

SEQ ID NO: 4821812 - DNA, 19 bp, Homo sapiens
actcgagagggctgagccc

SEQ ID NO: 4821813 - DNA, 23 bp, Homo sapiens
actcgagagggctgagcccctcc

SEQ ID NO: 4821814 - DNA, 14 bp, Homo sapiens
actcgccacctgcc

SEQ ID NO: 4821815 - DNA, 19 bp, Homo sapiens
actcgcttagctgaaacct

SEQ ID NO: 4821816 - DNA, 22 bp, Homo sapiens
actcgtgtgcatgagaatgtca

SEQ ID NO: 4821817 - DNA, 23 bp, Homo sapiens
actcgtgtgcatgagaatgtcat

SEQ ID NO: 4821818 - DNA, 14 bp, Homo sapiens
actctaactgtata

SEQ ID NO: 4821819 - DNA, 22 bp, Homo sapiens
actctaagaaatggctttccac

SEQ ID NO: 4821820 - DNA, 12 bp, Homo sapiens
actctatgctct

SEQ ID NO: 4821821 - DNA, 13 bp, Homo sapiens
actctatgctctg

SEQ ID NO: 4821822 - DNA, 23 bp, Homo sapiens
actctcaccccccgacctggctg

SEQ ID NO: 4821823 - DNA, 22 bp, Homo sapiens
actctcaggaccaccctgccaa

SEQ ID NO: 4821824 - DNA, 14 bp, Homo sapiens
actctcctccagag

SEQ ID NO: 4821825 - DNA, 17 bp, Homo sapiens
actctcctccagagtca

SEQ ID NO: 4821826 - DNA, 20 bp, Homo sapiens
actctctactacacaggcct

SEQ ID NO: 4821827 - DNA, 22 bp, Homo sapiens
actctctagtgcaggaaaaggc

SEQ ID NO: 4821828 - DNA, 15 bp, Homo sapiens
actctctcctctctc

SEQ ID NO: 4821829 - DNA, 20 bp, Homo sapiens
actctctcctctctctccct

SEQ ID NO: 4821830 - DNA, 14 bp, Homo sapiens
actctcttcttact

SEQ ID NO: 4821831 - DNA, 20 bp, Homo sapiens
actctcttcttactgtattt

SEQ ID NO: 4821832 - DNA, 18 bp, Homo sapiens
actctgacaagggctgac

SEQ ID NO: 4821833 - DNA, 17 bp, Homo sapiens
actctgcatagacaaag

SEQ ID NO: 4821834 - DNA, 18 bp, Homo sapiens
actctgcatagacaaagg

SEQ ID NO: 4821835 - DNA, 11 bp, Homo sapiens
actctgccagg

SEQ ID NO: 4821836 - DNA, 20 bp, Homo sapiens
actctgccagggcagtgcta

SEQ ID NO: 4821837 - DNA, 21 bp, Homo sapiens
actctgtcagccagccgccct

SEQ ID NO: 4821838 - DNA, 20 bp, Homo sapiens
actcttaaatatacaacttt

SEQ ID NO: 4821839 - DNA, 22 bp, Homo sapiens
actcttccctctcgctcccctc

SEQ ID NO: 4821840 - DNA, 15 bp, Homo sapiens
actctttattgtctg

SEQ ID NO: 4821841 - DNA, 15 bp, Homo sapiens
actctttggctattg

SEQ ID NO: 4821842 - DNA, 22 bp, Homo sapiens
actctttggctattgtccttgt

SEQ ID NO: 4821843 - DNA, 18 bp, Homo sapiens
actcttttgagcagtaaa

SEQ ID NO: 4821844 - DNA, 20 bp, Homo sapiens
actgaaaaggttcttcatcc

SEQ ID NO: 4821845 - DNA, 19 bp, Homo sapiens
actgaaaataccatcaggc

SEQ ID NO: 4821846 - DNA, 19 bp, Homo sapiens
actgaaattagtgttttca

SEQ ID NO: 4821847 - DNA, 20 bp, Homo sapiens
actgaaattagtgttttcat

SEQ ID NO: 4821848 - DNA, 16 bp, Homo sapiens
actgaagaaaatcctt

SEQ ID NO: 4821849 - DNA, 16 bp, Homo sapiens
actgaagcagagtcaa

SEQ ID NO: 4821850 - DNA, 22 bp, Homo sapiens
actgacagcctccaccttgagc

SEQ ID NO: 4821851 - DNA, 13 bp, Homo sapiens
actgacccttcca

SEQ ID NO: 4821852 - DNA, 15 bp, Homo sapiens
actgacccttccaga

SEQ ID NO: 4821853 - DNA, 17 bp, Homo sapiens
actgacccttccagaca

SEQ ID NO: 4821854 - DNA, 20 bp, Homo sapiens
actgagatagcttagtgtct

SEQ ID NO: 4821855 - DNA, 15 bp, Homo sapiens
actgaggagctagtg

SEQ ID NO: 4821856 - DNA, 16 bp, Homo sapiens
actgatatcacgggcc

SEQ ID NO: 4821857 - DNA, 22 bp, Homo sapiens
actgatatcacgggcccgctca

SEQ ID NO: 4821858 - DNA, 21 bp, Homo sapiens
actgatgagacaacacacaca

SEQ ID NO: 4821859 - DNA, 21 bp, Homo sapiens
actgatgggtcctgctgctcg

SEQ ID NO: 4821860 - DNA, 15 bp, Homo sapiens
actgatggttgcttt

SEQ ID NO: 4821861 - DNA, 22 bp, Homo sapiens
actgatggttgctttgagccca

SEQ ID NO: 4821862 - DNA, 20 bp, Homo sapiens
actgattctgggatgctcct

SEQ ID NO: 4821863 - DNA, 22 bp, Homo sapiens
actgcaacccatgagcgtccag

SEQ ID NO: 4821864 - DNA, 20 bp, Homo sapiens
actgcaacctccacctcgca

SEQ ID NO: 4821865 - DNA, 20 bp, Homo sapiens
actgcaccctccacaggagc

SEQ ID NO: 4821866 - DNA, 22 bp, Homo sapiens
actgcagttatttaccagaagt

SEQ ID NO: 4821867 - DNA, 18 bp, Homo sapiens
actgcattcgttgctcca

SEQ ID NO: 4821868 - DNA, 14 bp, Homo sapiens
actgccacaagcac

SEQ ID NO: 4821869 - DNA, 17 bp, Homo sapiens
actgccactaaaatcca

SEQ ID NO: 4821870 - DNA, 19 bp, Homo sapiens
actgccactaaaatccacc

SEQ ID NO: 4821871 - DNA, 21 bp, Homo sapiens
actgccataacttgtttgtaa

SEQ ID NO: 4821872 - DNA, 12 bp, Homo sapiens
actgccattttt

SEQ ID NO: 4821873 - DNA, 11 bp, Homo sapiens
actgcccaccc

SEQ ID NO: 4821874 - DNA, 13 bp, Homo sapiens
actgcccaccctg

SEQ ID NO: 4821875 - DNA, 19 bp, Homo sapiens
actgcccacctgccaggct

SEQ ID NO: 4821876 - DNA, 16 bp, Homo sapiens
actgcccattgtaact

SEQ ID NO: 4821877 - DNA, 22 bp, Homo sapiens
actgcccctgcacctgcttctc

SEQ ID NO: 4821878 - DNA, 13 bp, Homo sapiens
actgcctctgcct

SEQ ID NO: 4821879 - DNA, 18 bp, Homo sapiens
actgcctctgccttagag

SEQ ID NO: 4821880 - DNA, 13 bp, Homo sapiens
actgcctttcaaa

SEQ ID NO: 4821881 - DNA, 21 bp, Homo sapiens
actgcctttcaaagtgcacac

SEQ ID NO: 4821882 - DNA, 18 bp, Homo sapiens
actgctcaggctccccaa

SEQ ID NO: 4821883 - DNA, 17 bp, Homo sapiens
actgctgcttaaaatgc

SEQ ID NO: 4821884 - DNA, 12 bp, Homo sapiens
actgctttgtag

SEQ ID NO: 4821885 - DNA, 21 bp, Homo sapiens
actgctttttccttagcttaa

SEQ ID NO: 4821886 - DNA, 21 bp, Homo sapiens
actggaaacaaggaaggacat

SEQ ID NO: 4821887 - DNA, 16 bp, Homo sapiens
actggaaacatctgat

SEQ ID NO: 4821888 - DNA, 20 bp, Homo sapiens
actggaaggctttattcttc

SEQ ID NO: 4821889 - DNA, 22 bp, Homo sapiens
actggaattttatttctctcag

SEQ ID NO: 4821890 - DNA, 14 bp, Homo sapiens
actggagaaaatgg

SEQ ID NO: 4821891 - DNA, 14 bp, Homo sapiens
actggaggagcaca

SEQ ID NO: 4821892 - DNA, 14 bp, Homo sapiens
actggatagtgagt

SEQ ID NO: 4821893 - DNA, 15 bp, Homo sapiens
actggcccacccctc

SEQ ID NO: 4821894 - DNA, 12 bp, Homo sapiens
actggccccagg

SEQ ID NO: 4821895 - DNA, 16 bp, Homo sapiens
actggccccaggcgga

SEQ ID NO: 4821896 - DNA, 13 bp, Homo sapiens
actggccctcggg

SEQ ID NO: 4821897 - DNA, 23 bp, Homo sapiens
actggccggcccacgtcctgggt

SEQ ID NO: 4821898 - DNA, 19 bp, Homo sapiens
actggccttctgatgaaat

SEQ ID NO: 4821899 - DNA, 21 bp, Homo sapiens
actggccttgcctccaggacc

SEQ ID NO: 4821900 - DNA, 24 bp, Homo sapiens
actggctttgggtagtgccatggc

SEQ ID NO: 4821901 - DNA, 22 bp, Homo sapiens
actgggcttggggaccagagct

SEQ ID NO: 4821902 - DNA, 13 bp, Homo sapiens
actggggggcagg

SEQ ID NO: 4821903 - DNA, 18 bp, Homo sapiens
actggggggcaggcctcc

SEQ ID NO: 4821904 - DNA, 19 bp, Homo sapiens
actgggtgggccccacagt

SEQ ID NO: 4821905 - DNA, 16 bp, Homo sapiens
actggtaagattgtta

SEQ ID NO: 4821906 - DNA, 17 bp, Homo sapiens
actggtaagattgttat

SEQ ID NO: 4821907 - DNA, 18 bp, Homo sapiens
actggtcccccatgggct

SEQ ID NO: 4821908 - DNA, 20 bp, Homo sapiens
actggtcccccatgggctgc

SEQ ID NO: 4821909 - DNA, 18 bp, Homo sapiens
actgtactttcccaggtt

SEQ ID NO: 4821910 - DNA, 22 bp, Homo sapiens
actgtagtttttgttcaccttc

SEQ ID NO: 4821911 - DNA, 20 bp, Homo sapiens
actgtattaaagatgcaggt

SEQ ID NO: 4821912 - DNA, 23 bp, Homo sapiens
actgtattaaagatgcaggtttt

SEQ ID NO: 4821913 - DNA, 17 bp, Homo sapiens
actgtcattagaattga

SEQ ID NO: 4821914 - DNA, 22 bp, Homo sapiens
actgtcccggagctcaggccct

SEQ ID NO: 4821915 - DNA, 23 bp, Homo sapiens
actgtcccggagctcaggccctg

SEQ ID NO: 4821916 - DNA, 16 bp, Homo sapiens
actgtcttactcaaga

SEQ ID NO: 4821917 - DNA, 16 bp, Homo sapiens
actgtcttcaaccctg

SEQ ID NO: 4821918 - DNA, 19 bp, Homo sapiens
actgtcttcaaccctgccc

SEQ ID NO: 4821919 - DNA, 22 bp, Homo sapiens
actgtcttcaaccctgccctgc

SEQ ID NO: 4821920 - DNA, 15 bp, Homo sapiens
actgtgaatatgtgt

SEQ ID NO: 4821921 - DNA, 17 bp, Homo sapiens
actgtgacacagctgag

SEQ ID NO: 4821922 - DNA, 16 bp, Homo sapiens
actgtgagaactgtga

SEQ ID NO: 4821923 - DNA, 16 bp, Homo sapiens
actgtgcagttgctgt

SEQ ID NO: 4821924 - DNA, 17 bp, Homo sapiens
actgtgcgttttagagt

SEQ ID NO: 4821925 - DNA, 20 bp, Homo sapiens
actgtgcgttttagagtatg

SEQ ID NO: 4821926 - DNA, 21 bp, Homo sapiens
actgtggataaattttggaag

SEQ ID NO: 4821927 - DNA, 22 bp, Homo sapiens
actgtggggtttttaatctctt

SEQ ID NO: 4821928 - DNA, 18 bp, Homo sapiens
actgtgggtccctgcgtc

SEQ ID NO: 4821929 - DNA, 12 bp, Homo sapiens
actgtgtcccag

SEQ ID NO: 4821930 - DNA, 16 bp, Homo sapiens
actgtgtcccagtgtc

SEQ ID NO: 4821931 - DNA, 15 bp, Homo sapiens
actgttacagtaatg

SEQ ID NO: 4821932 - DNA, 16 bp, Homo sapiens
actgttacagtaatgt

SEQ ID NO: 4821933 - DNA, 20 bp, Homo sapiens
actgttacagtaatgtcata

SEQ ID NO: 4821934 - DNA, 12 bp, Homo sapiens
actgttatctcg

SEQ ID NO: 4821935 - DNA, 22 bp, Homo sapiens
actgttcccagcaaagttttca

SEQ ID NO: 4821936 - DNA, 20 bp, Homo sapiens
actgttggctgattggaaaa

SEQ ID NO: 4821937 - DNA, 19 bp, Homo sapiens
actgtttatggtattttcg

SEQ ID NO: 4821938 - DNA, 13 bp, Homo sapiens
actgttttgtgcg

SEQ ID NO: 4821939 - DNA, 16 bp, Homo sapiens
actgtttttgaagaag

SEQ ID NO: 4821940 - DNA, 22 bp, Homo sapiens
actgtttttgaagaagggaaat

SEQ ID NO: 4821941 - DNA, 13 bp, Homo sapiens
acttaaacaaaaa

SEQ ID NO: 4821942 - DNA, 17 bp, Homo sapiens
acttaaacctgtgcttt

SEQ ID NO: 4821943 - DNA, 15 bp, Homo sapiens
acttaaactttgtca

SEQ ID NO: 4821944 - DNA, 16 bp, Homo sapiens
acttaaactttgtcac

SEQ ID NO: 4821945 - DNA, 23 bp, Homo sapiens
acttaaagaacagctaacaataa

SEQ ID NO: 4821946 - DNA, 14 bp, Homo sapiens
acttaacagatcac

SEQ ID NO: 4821947 - DNA, 13 bp, Homo sapiens
acttaatttagca

SEQ ID NO: 4821948 - DNA, 18 bp, Homo sapiens
acttacacacctgagaat

SEQ ID NO: 4821949 - DNA, 21 bp, Homo sapiens
acttacacacctgagaatgtg

SEQ ID NO: 4821950 - DNA, 13 bp, Homo sapiens
acttacactgaaa

SEQ ID NO: 4821951 - DNA, 14 bp, Homo sapiens
acttagaagatgtt

SEQ ID NO: 4821952 - DNA, 22 bp, Homo sapiens
acttatattctgcagaaaatta

SEQ ID NO: 4821953 - DNA, 14 bp, Homo sapiens
acttatctccagcc

SEQ ID NO: 4821954 - DNA, 16 bp, Homo sapiens
acttcaaaatattgag

SEQ ID NO: 4821955 - DNA, 22 bp, Homo sapiens
acttcaagcaaagacagtttct

SEQ ID NO: 4821956 - DNA, 23 bp, Homo sapiens
acttcaagcaaagacagtttctt

SEQ ID NO: 4821957 - DNA, 17 bp, Homo sapiens
acttcacctccttctgc

SEQ ID NO: 4821958 - DNA, 19 bp, Homo sapiens
acttcagactctctcctct

SEQ ID NO: 4821959 - DNA, 15 bp, Homo sapiens
acttcagttctcatc

SEQ ID NO: 4821960 - DNA, 16 bp, Homo sapiens
acttcatccctctggg

SEQ ID NO: 4821961 - DNA, 22 bp, Homo sapiens
acttccagatttgagctgcctg

SEQ ID NO: 4821962 - DNA, 19 bp, Homo sapiens
acttccaggttccatccac

SEQ ID NO: 4821963 - DNA, 11 bp, Homo sapiens
acttccatttg

SEQ ID NO: 4821964 - DNA, 12 bp, Homo sapiens
acttccatttgg

SEQ ID NO: 4821965 - DNA, 20 bp, Homo sapiens
acttccatttggaatcatat

SEQ ID NO: 4821966 - DNA, 15 bp, Homo sapiens
acttcccaaggaaag

SEQ ID NO: 4821967 - DNA, 13 bp, Homo sapiens
acttcccagctgg

SEQ ID NO: 4821968 - DNA, 14 bp, Homo sapiens
acttcccagctggc

SEQ ID NO: 4821969 - DNA, 15 bp, Homo sapiens
acttcccagctggca

SEQ ID NO: 4821970 - DNA, 16 bp, Homo sapiens
acttcccagctggcag

SEQ ID NO: 4821971 - DNA, 12 bp, Homo sapiens
acttcccaggcc

SEQ ID NO: 4821972 - DNA, 17 bp, Homo sapiens
acttccccatctgtgtg

SEQ ID NO: 4821973 - DNA, 14 bp, Homo sapiens
acttccctgcaagg

SEQ ID NO: 4821974 - DNA, 22 bp, Homo sapiens
acttcctattaatttattaaat

SEQ ID NO: 4821975 - DNA, 12 bp, Homo sapiens
acttccttaaca

SEQ ID NO: 4821976 - DNA, 19 bp, Homo sapiens
acttcgctattcccaggca

SEQ ID NO: 4821977 - DNA, 17 bp, Homo sapiens
acttctatttatttatt

SEQ ID NO: 4821978 - DNA, 16 bp, Homo sapiens
acttctccttaacccc

SEQ ID NO: 4821979 - DNA, 18 bp, Homo sapiens
acttctgaactttggaag

SEQ ID NO: 4821980 - DNA, 20 bp, Homo sapiens
acttctgttatcagggccca

SEQ ID NO: 4821981 - DNA, 12 bp, Homo sapiens
acttcttcatcc

SEQ ID NO: 4821982 - DNA, 17 bp, Homo sapiens
acttcttcatccataga

SEQ ID NO: 4821983 - DNA, 18 bp, Homo sapiens
acttcttcatccatagac

SEQ ID NO: 4821984 - DNA, 14 bp, Homo sapiens
acttcttgttcatg

SEQ ID NO: 4821985 - DNA, 23 bp, Homo sapiens
acttcttgttcatgttttgctaa

SEQ ID NO: 4821986 - DNA, 20 bp, Homo sapiens
acttctttactaacactggc

SEQ ID NO: 4821987 - DNA, 17 bp, Homo sapiens
acttgaaattatatctg

SEQ ID NO: 4821988 - DNA, 18 bp, Homo sapiens
acttgaatagtattgtgt

SEQ ID NO: 4821989 - DNA, 16 bp, Homo sapiens
acttgagatgatttcc

SEQ ID NO: 4821990 - DNA, 20 bp, Homo sapiens
acttgagggacgactttctt

SEQ ID NO: 4821991 - DNA, 13 bp, Homo sapiens
acttgatgtctga

SEQ ID NO: 4821992 - DNA, 22 bp, Homo sapiens
acttgattaaggactacagaat

SEQ ID NO: 4821993 - DNA, 16 bp, Homo sapiens
acttgccactgccata

SEQ ID NO: 4821994 - DNA, 20 bp, Homo sapiens
acttgccctgaccatgcatt

SEQ ID NO: 4821995 - DNA, 21 bp, Homo sapiens
acttgctcctttccatcagct

SEQ ID NO: 4821996 - DNA, 16 bp, Homo sapiens
acttgctgtgaaatga

SEQ ID NO: 4821997 - DNA, 14 bp, Homo sapiens
acttgctgtgactt

SEQ ID NO: 4821998 - DNA, 23 bp, Homo sapiens
acttggaatttgcttagccttta

SEQ ID NO: 4821999 - DNA, 21 bp, Homo sapiens
acttggataggagcttccaga

SEQ ID NO: 4822000 - DNA, 12 bp, Homo sapiens
acttggggaagg

SEQ ID NO: 4822001 - DNA, 22 bp, Homo sapiens
acttggggaaggggcctgggct

SEQ ID NO: 4822002 - DNA, 20 bp, Homo sapiens
acttggtgattacctgaaag

SEQ ID NO: 4822003 - DNA, 11 bp, Homo sapiens
acttgtaactt

SEQ ID NO: 4822004 - DNA, 19 bp, Homo sapiens
acttgtacttacactgaaa

SEQ ID NO: 4822005 - DNA, 23 bp, Homo sapiens
acttgtacttacactgaaatcca

SEQ ID NO: 4822006 - DNA, 14 bp, Homo sapiens
acttgtattggaag

SEQ ID NO: 4822007 - DNA, 15 bp, Homo sapiens
acttgtgttcaatct

SEQ ID NO: 4822008 - DNA, 19 bp, Homo sapiens
acttgttatgttgtaatat

SEQ ID NO: 4822009 - DNA, 16 bp, Homo sapiens
actttaaattatatga

SEQ ID NO: 4822010 - DNA, 21 bp, Homo sapiens
actttattttatataataaag

SEQ ID NO: 4822011 - DNA, 15 bp, Homo sapiens
actttcagattgtat

SEQ ID NO: 4822012 - DNA, 13 bp, Homo sapiens
actttccaacttt

SEQ ID NO: 4822013 - DNA, 13 bp, Homo sapiens
actttccagcagg

SEQ ID NO: 4822014 - DNA, 14 bp, Homo sapiens
actttccatgacag

SEQ ID NO: 4822015 - DNA, 12 bp, Homo sapiens
actttcccacac

SEQ ID NO: 4822016 - DNA, 16 bp, Homo sapiens
actttcccacactgtg

SEQ ID NO: 4822017 - DNA, 14 bp, Homo sapiens
actttcctctctct

SEQ ID NO: 4822018 - DNA, 13 bp, Homo sapiens
actttctacatgc

SEQ ID NO: 4822019 - DNA, 14 bp, Homo sapiens
actttcttcaaaat

SEQ ID NO: 4822020 - DNA, 22 bp, Homo sapiens
actttgacacttttcatatcat

SEQ ID NO: 4822021 - DNA, 23 bp, Homo sapiens
actttgacacttttcatatcatt

SEQ ID NO: 4822022 - DNA, 18 bp, Homo sapiens
actttgcaggagttcctt

SEQ ID NO: 4822023 - DNA, 16 bp, Homo sapiens
actttgcattgtctgt

SEQ ID NO: 4822024 - DNA, 13 bp, Homo sapiens
actttggaagttt

SEQ ID NO: 4822025 - DNA, 15 bp, Homo sapiens
actttggaatttgaa

SEQ ID NO: 4822026 - DNA, 16 bp, Homo sapiens
actttggatcaggaaa

SEQ ID NO: 4822027 - DNA, 18 bp, Homo sapiens
actttggccacagcccca

SEQ ID NO: 4822028 - DNA, 16 bp, Homo sapiens
actttgtatacaagta

SEQ ID NO: 4822029 - DNA, 15 bp, Homo sapiens
acttttataaatgtt

SEQ ID NO: 4822030 - DNA, 23 bp, Homo sapiens
acttttataaatgttttaaagaa

SEQ ID NO: 4822031 - DNA, 21 bp, Homo sapiens
acttttataaattaaatatat

SEQ ID NO: 4822032 - DNA, 23 bp, Homo sapiens
acttttttataaattataatgca

SEQ ID NO: 4822033 - DNA, 18 bp, Homo sapiens
acttttttcctgtcaata

SEQ ID NO: 4822034 - DNA, 21 bp, Homo sapiens
acttttttcctgtcaatatat

SEQ ID NO: 4822035 - DNA, 18 bp, Homo sapiens
agaaaaaaaaaatgattg

SEQ ID NO: 4822036 - DNA, 14 bp, Homo sapiens
agaaaaaaaaatat

SEQ ID NO: 4822037 - DNA, 22 bp, Homo sapiens
agaaaaaaacattctatctact

SEQ ID NO: 4822038 - DNA, 19 bp, Homo sapiens
agaaaaaactggaaacatc

SEQ ID NO: 4822039 - DNA, 20 bp, Homo sapiens
agaaaacagaccagcatagt

SEQ ID NO: 4822040 - DNA, 20 bp, Homo sapiens
agaaaacaggaaaaaaactt

SEQ ID NO: 4822041 - DNA, 16 bp, Homo sapiens
agaaaaccagtggaag

SEQ ID NO: 4822042 - DNA, 21 bp, Homo sapiens
agaaaagaatccctgttcatt

SEQ ID NO: 4822043 - DNA, 21 bp, Homo sapiens
agaaaagattaaaattagtga

SEQ ID NO: 4822044 - DNA, 22 bp, Homo sapiens
agaaaagccagatgacagggag

SEQ ID NO: 4822045 - DNA, 22 bp, Homo sapiens
agaaaatgctttctcatgcata

SEQ ID NO: 4822046 - DNA, 23 bp, Homo sapiens
agaaaatggaagacagctcttat

SEQ ID NO: 4822047 - DNA, 13 bp, Homo sapiens
agaaacaatttct

SEQ ID NO: 4822048 - DNA, 16 bp, Homo sapiens
agaaacacagcatgca

SEQ ID NO: 4822049 - DNA, 18 bp, Homo sapiens
agaaacacagcatgcatt

SEQ ID NO: 4822050 - DNA, 24 bp, Homo sapiens
agaaacacagcatgcatttagcat

SEQ ID NO: 4822051 - DNA, 18 bp, Homo sapiens
agaaacacggagtttcca

SEQ ID NO: 4822052 - DNA, 15 bp, Homo sapiens
agaaacagtttaaca

SEQ ID NO: 4822053 - DNA, 12 bp, Homo sapiens
agaaacatgaca

SEQ ID NO: 4822054 - DNA, 14 bp, Homo sapiens
agaaacatgacact

SEQ ID NO: 4822055 - DNA, 14 bp, Homo sapiens
agaaacccctgaca

SEQ ID NO: 4822056 - DNA, 13 bp, Homo sapiens
agaaactttggaa

SEQ ID NO: 4822057 - DNA, 22 bp, Homo sapiens
agaaactttggaagttttactt

SEQ ID NO: 4822058 - DNA, 10 bp, Homo sapiens
agaaagaaaa

SEQ ID NO: 4822059 - DNA, 15 bp, Homo sapiens
agaaagcatattgac

SEQ ID NO: 4822060 - DNA, 16 bp, Homo sapiens
agaaagcatattgact

SEQ ID NO: 4822061 - DNA, 14 bp, Homo sapiens
agaaaggaaacctt

SEQ ID NO: 4822062 - DNA, 22 bp, Homo sapiens
agaaagggagaaggattctttt

SEQ ID NO: 4822063 - DNA, 14 bp, Homo sapiens
agaaataaacctta

SEQ ID NO: 4822064 - DNA, 16 bp, Homo sapiens
agaaataaaccttaat

SEQ ID NO: 4822065 - DNA, 23 bp, Homo sapiens
agaaataaaccttaatatttctt

SEQ ID NO: 4822066 - DNA, 19 bp, Homo sapiens
agaaataatgtcaaaaata

SEQ ID NO: 4822067 - DNA, 12 bp, Homo sapiens
agaaatatctgt

SEQ ID NO: 4822068 - DNA, 15 bp, Homo sapiens
agaaatatctgtgaa

SEQ ID NO: 4822069 - DNA, 17 bp, Homo sapiens
agaaatatctgtgaaat

SEQ ID NO: 4822070 - DNA, 22 bp, Homo sapiens
agaaatcccctaactgatttcc

SEQ ID NO: 4822071 - DNA, 14 bp, Homo sapiens
agaaatgagaaatt

SEQ ID NO: 4822072 - DNA, 16 bp, Homo sapiens
agaaatgagaaattgt

SEQ ID NO: 4822073 - DNA, 14 bp, Homo sapiens
agaaatgtgctgca

SEQ ID NO: 4822074 - DNA, 19 bp, Homo sapiens
agaaattagggctctaatt

SEQ ID NO: 4822075 - DNA, 21 bp, Homo sapiens
agaaattagggctctaatttc

SEQ ID NO: 4822076 - DNA, 22 bp, Homo sapiens
agaaattagggctctaatttcc

SEQ ID NO: 4822077 - DNA, 14 bp, Homo sapiens
agaaattgtgccaa

SEQ ID NO: 4822078 - DNA, 16 bp, Homo sapiens
agaaattgtgccaaag

SEQ ID NO: 4822079 - DNA, 19 bp, Homo sapiens
agaaattgtgccaaagata

SEQ ID NO: 4822080 - DNA, 23 bp, Homo sapiens
agaaatttattcttatcttagga

SEQ ID NO: 4822081 - DNA, 19 bp, Homo sapiens
agaacaaacctctatatgt

SEQ ID NO: 4822082 - DNA, 22 bp, Homo sapiens
agaacaacaacaaagcatgctc

SEQ ID NO: 4822083 - DNA, 17 bp, Homo sapiens
agaacaccaagtaaatc

SEQ ID NO: 4822084 - DNA, 17 bp, Homo sapiens
agaaccaaaaagaggct

SEQ ID NO: 4822085 - DNA, 19 bp, Homo sapiens
agaaccaacgggtctgtgg

SEQ ID NO: 4822086 - DNA, 14 bp, Homo sapiens
agaaccagcactcc

SEQ ID NO: 4822087 - DNA, 20 bp, Homo sapiens
agaaccagcactcccagggc

SEQ ID NO: 4822088 - DNA, 22 bp, Homo sapiens
agaaccagcactcccagggccc

SEQ ID NO: 4822089 - DNA, 13 bp, Homo sapiens
agaacccccctcc

SEQ ID NO: 4822090 - DNA, 14 bp, Homo sapiens
agaacccccctccc

SEQ ID NO: 4822091 - DNA, 22 bp, Homo sapiens
agaacccccctccccaaggaag

SEQ ID NO: 4822092 - DNA, 13 bp, Homo sapiens
agaacctgcgcac

SEQ ID NO: 4822093 - DNA, 13 bp, Homo sapiens
agaaccttctaat

SEQ ID NO: 4822094 - DNA, 13 bp, Homo sapiens
agaacctttgtca

SEQ ID NO: 4822095 - DNA, 14 bp, Homo sapiens
agaacctttgtcaa

SEQ ID NO: 4822096 - DNA, 14 bp, Homo sapiens
agaacgcatgcagg

SEQ ID NO: 4822097 - DNA, 18 bp, Homo sapiens
agaacgcatgcagggccc

SEQ ID NO: 4822098 - DNA, 12 bp, Homo sapiens
agaacggaagaa

SEQ ID NO: 4822099 - DNA, 16 bp, Homo sapiens
agaacgggcctccccg

SEQ ID NO: 4822100 - DNA, 19 bp, Homo sapiens
agaacgggcctccccgggg

SEQ ID NO: 4822101 - DNA, 20 bp, Homo sapiens
agaactaaatagatttttag

SEQ ID NO: 4822102 - DNA, 17 bp, Homo sapiens
agaactcctttctaagg

SEQ ID NO: 4822103 - DNA, 22 bp, Homo sapiens
agaactgtgaatatgtgtaact

SEQ ID NO: 4822104 - DNA, 16 bp, Homo sapiens
agaagaaaatggatga

SEQ ID NO: 4822105 - DNA, 23 bp, Homo sapiens
agaagaaaatggatgacaaagaa

SEQ ID NO: 4822106 - DNA, 16 bp, Homo sapiens
agaagaaagaacggaa

SEQ ID NO: 4822107 - DNA, 15 bp, Homo sapiens
agaagaatataaata

SEQ ID NO: 4822108 - DNA, 14 bp, Homo sapiens
agaagaatattgta

SEQ ID NO: 4822109 - DNA, 23 bp, Homo sapiens
agaagagaatgcacaaacagagg

SEQ ID NO: 4822110 - DNA, 14 bp, Homo sapiens
agaagatagttgta

SEQ ID NO: 4822111 - DNA, 17 bp, Homo sapiens
agaagatctttcttaat

SEQ ID NO: 4822112 - DNA, 18 bp, Homo sapiens
agaagatctttcttaata

SEQ ID NO: 4822113 - DNA, 14 bp, Homo sapiens
agaagcagcagcta

SEQ ID NO: 4822114 - DNA, 20 bp, Homo sapiens
agaagcagcagctagaaaga

SEQ ID NO: 4822115 - DNA, 18 bp, Homo sapiens
agaagccacgctgtcctc

SEQ ID NO: 4822116 - DNA, 21 bp, Homo sapiens
agaagccggcggagctctggc

SEQ ID NO: 4822117 - DNA, 21 bp, Homo sapiens
agaaggaaggcagggaggagg

SEQ ID NO: 4822118 - DNA, 23 bp, Homo sapiens
agaaggattcttttttcaatgta

SEQ ID NO: 4822119 - DNA, 13 bp, Homo sapiens
agaaggccccagg

SEQ ID NO: 4822120 - DNA, 16 bp, Homo sapiens
agaaggccccagggca

SEQ ID NO: 4822121 - DNA, 13 bp, Homo sapiens
agaagggagtgaa

SEQ ID NO: 4822122 - DNA, 13 bp, Homo sapiens
agaaggggcgagg

SEQ ID NO: 4822123 - DNA, 23 bp, Homo sapiens
agaagtagtgtctggatcagtaa

SEQ ID NO: 4822124 - DNA, 16 bp, Homo sapiens
agaagtatgtcagtta

SEQ ID NO: 4822125 - DNA, 23 bp, Homo sapiens
agaagtccatgtgataattgtaa

SEQ ID NO: 4822126 - DNA, 16 bp, Homo sapiens
agaagtgaaaaagact

SEQ ID NO: 4822127 - DNA, 20 bp, Homo sapiens
agaagtggaaggataatgag

SEQ ID NO: 4822128 - DNA, 17 bp, Homo sapiens
agaagtgggattcagga

SEQ ID NO: 4822129 - DNA, 13 bp, Homo sapiens
agaagtgtgttct

SEQ ID NO: 4822130 - DNA, 14 bp, Homo sapiens
agaagtgtgttctg

SEQ ID NO: 4822131 - DNA, 21 bp, Homo sapiens
agaagtttctgccgcagccct

SEQ ID NO: 4822132 - DNA, 19 bp, Homo sapiens
agaataaaccggatcctgt

SEQ ID NO: 4822133 - DNA, 14 bp, Homo sapiens
agaatattaaaaat

SEQ ID NO: 4822134 - DNA, 15 bp, Homo sapiens
agaatattaagcaca

SEQ ID NO: 4822135 - DNA, 19 bp, Homo sapiens
agaatcacctaattaattt

SEQ ID NO: 4822136 - DNA, 13 bp, Homo sapiens
agaatcatggatt

SEQ ID NO: 4822137 - DNA, 15 bp, Homo sapiens
agaatccctgttcat

SEQ ID NO: 4822138 - DNA, 20 bp, Homo sapiens
agaatctgtgcagtcatcaa

SEQ ID NO: 4822139 - DNA, 15 bp, Homo sapiens
agaatgagaaatcat

SEQ ID NO: 4822140 - DNA, 18 bp, Homo sapiens
agaatgagaaatcatgtt

SEQ ID NO: 4822141 - DNA, 15 bp, Homo sapiens
agaatgagatgattt

SEQ ID NO: 4822142 - DNA, 20 bp, Homo sapiens
agaatgagatgatttaattc

SEQ ID NO: 4822143 - DNA, 13 bp, Homo sapiens
agaatggtgggct

SEQ ID NO: 4822144 - DNA, 12 bp, Homo sapiens
agaatgtgaaaa

SEQ ID NO: 4822145 - DNA, 13 bp, Homo sapiens
agaatgtgaaaaa

SEQ ID NO: 4822146 - DNA, 21 bp, Homo sapiens
agaatgtgcaaagcagtatgt

SEQ ID NO: 4822147 - DNA, 19 bp, Homo sapiens
agaattaccatttgttaat

SEQ ID NO: 4822148 - DNA, 22 bp, Homo sapiens
agaattaccatttgttaatatc

SEQ ID NO: 4822149 - DNA, 16 bp, Homo sapiens
agaattactgtttgaa

SEQ ID NO: 4822150 - DNA, 22 bp, Homo sapiens
agaattaggtaatggatatgaa

SEQ ID NO: 4822151 - DNA, 13 bp, Homo sapiens
agaattcattcat

SEQ ID NO: 4822152 - DNA, 18 bp, Homo sapiens
agaattcattcatactta

SEQ ID NO: 4822153 - DNA, 16 bp, Homo sapiens
agaattctaagattgt

SEQ ID NO: 4822154 - DNA, 20 bp, Homo sapiens
agaattgaaccgtcaatgtg

SEQ ID NO: 4822155 - DNA, 16 bp, Homo sapiens
agaattgaggggaggt

SEQ ID NO: 4822156 - DNA, 19 bp, Homo sapiens
agaatttgaagacttcaaa

SEQ ID NO: 4822157 - DNA, 12 bp, Homo sapiens
agacaaaggcct

SEQ ID NO: 4822158 - DNA, 12 bp, Homo sapiens
agacaaatgcag

SEQ ID NO: 4822159 - DNA, 18 bp, Homo sapiens
agacaagtctagtggaac

SEQ ID NO: 4822160 - DNA, 21 bp, Homo sapiens
agacaagtctagtggaaccaa

SEQ ID NO: 4822161 - DNA, 19 bp, Homo sapiens
agacaatgacactggaagg

SEQ ID NO: 4822162 - DNA, 22 bp, Homo sapiens
agacaatgtggaattacataac

SEQ ID NO: 4822163 - DNA, 14 bp, Homo sapiens
agacacaagccttc

SEQ ID NO: 4822164 - DNA, 18 bp, Homo sapiens
agacacagcccagagact

SEQ ID NO: 4822165 - DNA, 18 bp, Homo sapiens
agacacagcgtccctagc

SEQ ID NO: 4822166 - DNA, 19 bp, Homo sapiens
agacacagtattgacttct

SEQ ID NO: 4822167 - DNA, 18 bp, Homo sapiens
agacaccagagtgtatgc

SEQ ID NO: 4822168 - DNA, 22 bp, Homo sapiens
agacaccagagtgtatgcatac

SEQ ID NO: 4822169 - DNA, 16 bp, Homo sapiens
agacaccttcccagct

SEQ ID NO: 4822170 - DNA, 19 bp, Homo sapiens
agacaccttcccagctgct

SEQ ID NO: 4822171 - DNA, 20 bp, Homo sapiens
agacagaatctcagtctgtc

SEQ ID NO: 4822172 - DNA, 20 bp, Homo sapiens
agacagacggacgggacagc

SEQ ID NO: 4822173 - DNA, 18 bp, Homo sapiens
agacagagatggcagagc

SEQ ID NO: 4822174 - DNA, 19 bp, Homo sapiens
agacagagatggcagagcc

SEQ ID NO: 4822175 - DNA, 13 bp, Homo sapiens
agacagagtggat

SEQ ID NO: 4822176 - DNA, 16 bp, Homo sapiens
agacagagtggatctg

SEQ ID NO: 4822177 - DNA, 19 bp, Homo sapiens
agacagagtggatctggag

SEQ ID NO: 4822178 - DNA, 16 bp, Homo sapiens
agacagcatgtgttaa

SEQ ID NO: 4822179 - DNA, 17 bp, Homo sapiens
agacagggtggggctta

SEQ ID NO: 4822180 - DNA, 16 bp, Homo sapiens
agacagtttcttgcaa

SEQ ID NO: 4822181 - DNA, 22 bp, Homo sapiens
agaccacatgcgctcctggctt

SEQ ID NO: 4822182 - DNA, 17 bp, Homo sapiens
agaccaccgcgcccctc

SEQ ID NO: 4822183 - DNA, 14 bp, Homo sapiens
agaccacgcccctg

SEQ ID NO: 4822184 - DNA, 18 bp, Homo sapiens
agaccacgcccctgcctg

SEQ ID NO: 4822185 - DNA, 19 bp, Homo sapiens
agaccacgcccctgcctga

SEQ ID NO: 4822186 - DNA, 13 bp, Homo sapiens
agaccatgcattc

SEQ ID NO: 4822187 - DNA, 16 bp, Homo sapiens
agaccatgcattcaga

SEQ ID NO: 4822188 - DNA, 18 bp, Homo sapiens
agaccatgcattcagatc

SEQ ID NO: 4822189 - DNA, 19 bp, Homo sapiens
agacccctaccctttccca

SEQ ID NO: 4822190 - DNA, 14 bp, Homo sapiens
agacccctggggga

SEQ ID NO: 4822191 - DNA, 16 bp, Homo sapiens
agaccctaggtgctca

SEQ ID NO: 4822192 - DNA, 20 bp, Homo sapiens
agaccctgcgcccctgccca

SEQ ID NO: 4822193 - DNA, 21 bp, Homo sapiens
agaccctgcgcccctgcccag

SEQ ID NO: 4822194 - DNA, 14 bp, Homo sapiens
agaccgtgagcgcc

SEQ ID NO: 4822195 - DNA, 21 bp, Homo sapiens
agaccgtggtgtcctctgtcc

SEQ ID NO: 4822196 - DNA, 15 bp, Homo sapiens
agacctccagattat

SEQ ID NO: 4822197 - DNA, 18 bp, Homo sapiens
agacctcctgatgtcttg

SEQ ID NO: 4822198 - DNA, 16 bp, Homo sapiens
agacctgctccagatc

SEQ ID NO: 4822199 - DNA, 17 bp, Homo sapiens
agacctgctccagatcc

SEQ ID NO: 4822200 - DNA, 22 bp, Homo sapiens
agaccttacaaccacatttctg

SEQ ID NO: 4822201 - DNA, 20 bp, Homo sapiens
agacgcaagaggtttcagca

SEQ ID NO: 4822202 - DNA, 16 bp, Homo sapiens
agacgctgccgctgcc

SEQ ID NO: 4822203 - DNA, 16 bp, Homo sapiens
agacggatccacagta

SEQ ID NO: 4822204 - DNA, 16 bp, Homo sapiens
agacgggctgagagga

SEQ ID NO: 4822205 - DNA, 13 bp, Homo sapiens
agacgtggtgctt

SEQ ID NO: 4822206 - DNA, 18 bp, Homo sapiens
agactaacttattttgat

SEQ ID NO: 4822207 - DNA, 23 bp, Homo sapiens
agactaatgaatgcaaaaagata

SEQ ID NO: 4822208 - DNA, 18 bp, Homo sapiens
agactactggcctctgtg

SEQ ID NO: 4822209 - DNA, 15 bp, Homo sapiens
agactatggagcctg

SEQ ID NO: 4822210 - DNA, 20 bp, Homo sapiens
agactatgtgtcatgatttc

SEQ ID NO: 4822211 - DNA, 12 bp, Homo sapiens
agactcaatcat

SEQ ID NO: 4822212 - DNA, 20 bp, Homo sapiens
agactcgagagggctgagcc

SEQ ID NO: 4822213 - DNA, 19 bp, Homo sapiens
agactctagatgtttagat

SEQ ID NO: 4822214 - DNA, 14 bp, Homo sapiens
agactctctcctct

SEQ ID NO: 4822215 - DNA, 18 bp, Homo sapiens
agactgcaggttggaccc

SEQ ID NO: 4822216 - DNA, 11 bp, Homo sapiens
agactgcccac

SEQ ID NO: 4822217 - DNA, 15 bp, Homo sapiens
agactgcccaccctg

SEQ ID NO: 4822218 - DNA, 18 bp, Homo sapiens
agactgcccaccctgggc

SEQ ID NO: 4822219 - DNA, 18 bp, Homo sapiens
agactgccttatattatt

SEQ ID NO: 4822220 - DNA, 16 bp, Homo sapiens
agactgctgtcttact

SEQ ID NO: 4822221 - DNA, 16 bp, Homo sapiens
agactgctttgagaaa

SEQ ID NO: 4822222 - DNA, 21 bp, Homo sapiens
agactggtattctctttgcct

SEQ ID NO: 4822223 - DNA, 17 bp, Homo sapiens
agacttcaaaatattga

SEQ ID NO: 4822224 - DNA, 16 bp, Homo sapiens
agacttccagctttct

SEQ ID NO: 4822225 - DNA, 17 bp, Homo sapiens
agacttccagctttctc

SEQ ID NO: 4822226 - DNA, 20 bp, Homo sapiens
agacttcctattaatttatt

SEQ ID NO: 4822227 - DNA, 23 bp, Homo sapiens
agacttcctattaatttattaaa

SEQ ID NO: 4822228 - DNA, 18 bp, Homo sapiens
agacttcgctattcccag

SEQ ID NO: 4822229 - DNA, 20 bp, Homo sapiens
agacttcgctattcccaggc

SEQ ID NO: 4822230 - DNA, 21 bp, Homo sapiens
agacttcgctattcccaggca

SEQ ID NO: 4822231 - DNA, 23 bp, Homo sapiens
agacttcgctattcccaggcagg

SEQ ID NO: 4822232 - DNA, 16 bp, Homo sapiens
agacttctaaaataaa

SEQ ID NO: 4822233 - DNA, 14 bp, Homo sapiens
agacttctaaatca

SEQ ID NO: 4822234 - DNA, 20 bp, Homo sapiens
agacttgacgcagcccccca

SEQ ID NO: 4822235 - DNA, 13 bp, Homo sapiens
agacttttctttg

SEQ ID NO: 4822236 - DNA, 17 bp, Homo sapiens
agagaaaaaaaaatatg

SEQ ID NO: 4822237 - DNA, 17 bp, Homo sapiens
agagaaaaagccctctt

SEQ ID NO: 4822238 - DNA, 17 bp, Homo sapiens
agagaaaatgctttctc

SEQ ID NO: 4822239 - DNA, 19 bp, Homo sapiens
agagaaagcatattgactt

SEQ ID NO: 4822240 - DNA, 14 bp, Homo sapiens
agagaaaggagggc

SEQ ID NO: 4822241 - DNA, 13 bp, Homo sapiens
agagaaggagcag

SEQ ID NO: 4822242 - DNA, 21 bp, Homo sapiens
agagaccaccgcgcccctctg

SEQ ID NO: 4822243 - DNA, 13 bp, Homo sapiens
agagaccacttcc

SEQ ID NO: 4822244 - DNA, 17 bp, Homo sapiens
agagacctgctccagat

SEQ ID NO: 4822245 - DNA, 21 bp, Homo sapiens
agagacggcagccccatcctt

SEQ ID NO: 4822246 - DNA, 22 bp, Homo sapiens
agagactatggagcctggcaca

SEQ ID NO: 4822247 - DNA, 12 bp, Homo sapiens
agagactgccca

SEQ ID NO: 4822248 - DNA, 15 bp, Homo sapiens
agagactgcccaccc

SEQ ID NO: 4822249 - DNA, 22 bp, Homo sapiens
agagactggaggcatttctttt

SEQ ID NO: 4822250 - DNA, 21 bp, Homo sapiens
agagagacaacttgctccttt

SEQ ID NO: 4822251 - DNA, 15 bp, Homo sapiens
agagagaggcctggg

SEQ ID NO: 4822252 - DNA, 22 bp, Homo sapiens
agagagatatatctgaaaactg

SEQ ID NO: 4822253 - DNA, 12 bp, Homo sapiens
agagagctcaag

SEQ ID NO: 4822254 - DNA, 23 bp, Homo sapiens
agagagctcaagtttcagagtca

SEQ ID NO: 4822255 - DNA, 14 bp, Homo sapiens
agagatattttgta

SEQ ID NO: 4822256 - DNA, 20 bp, Homo sapiens
agagatcaggaagagaagga

SEQ ID NO: 4822257 - DNA, 22 bp, Homo sapiens
agagatggacagttcacaccct

SEQ ID NO: 4822258 - DNA, 20 bp, Homo sapiens
agagatgtaccatgttaaag

SEQ ID NO: 4822259 - DNA, 15 bp, Homo sapiens
agagatgttttcaag

SEQ ID NO: 4822260 - DNA, 17 bp, Homo sapiens
agagatgttttgttgat

SEQ ID NO: 4822261 - DNA, 13 bp, Homo sapiens
agagattaatttg

SEQ ID NO: 4822262 - DNA, 13 bp, Homo sapiens
agagattgggggg

SEQ ID NO: 4822263 - DNA, 16 bp, Homo sapiens
agagattttatgttta

SEQ ID NO: 4822264 - DNA, 16 bp, Homo sapiens
agagcaatcttgctgt

SEQ ID NO: 4822265 - DNA, 12 bp, Homo sapiens
agagcactgctc

SEQ ID NO: 4822266 - DNA, 21 bp, Homo sapiens
agagccatccaccctgaggag

SEQ ID NO: 4822267 - DNA, 14 bp, Homo sapiens
agagcccaggcctc

SEQ ID NO: 4822268 - DNA, 16 bp, Homo sapiens
agagccccggagcacc

SEQ ID NO: 4822269 - DNA, 17 bp, Homo sapiens
agagccccggagcacca

SEQ ID NO: 4822270 - DNA, 16 bp, Homo sapiens
agagcccctggggcct

SEQ ID NO: 4822271 - DNA, 19 bp, Homo sapiens
agagcccctggggcctaga

SEQ ID NO: 4822272 - DNA, 23 bp, Homo sapiens
agagccctctgctgctttccaac

SEQ ID NO: 4822273 - DNA, 14 bp, Homo sapiens
agagcctgttttaa

SEQ ID NO: 4822274 - DNA, 17 bp, Homo sapiens
agagcctgttttaaaaa

SEQ ID NO: 4822275 - DNA, 19 bp, Homo sapiens
agagcctttggtgaataac

SEQ ID NO: 4822276 - DNA, 13 bp, Homo sapiens
agagcgcagcccc

SEQ ID NO: 4822277 - DNA, 14 bp, Homo sapiens
agagcgcagccccc

SEQ ID NO: 4822278 - DNA, 16 bp, Homo sapiens
agagctatgcacacca

SEQ ID NO: 4822279 - DNA, 22 bp, Homo sapiens
agagctatgcacaccaaattgc

SEQ ID NO: 4822280 - DNA, 17 bp, Homo sapiens
agagctcaggagaaggc

SEQ ID NO: 4822281 - DNA, 20 bp, Homo sapiens
agagctcaggagaaggcctg

SEQ ID NO: 4822282 - DNA, 14 bp, Homo sapiens
agagctccccatgg

SEQ ID NO: 4822283 - DNA, 16 bp, Homo sapiens
agagctgatggagaag

SEQ ID NO: 4822284 - DNA, 17 bp, Homo sapiens
agagctgatggagaagg

SEQ ID NO: 4822285 - DNA, 18 bp, Homo sapiens
agagctgatggagaagga

SEQ ID NO: 4822286 - DNA, 17 bp, Homo sapiens
agagctgttttggatga

SEQ ID NO: 4822287 - DNA, 21 bp, Homo sapiens
agagctgttttggatgaatgc

SEQ ID NO: 4822288 - DNA, 19 bp, Homo sapiens
agagcttcagaggtggccc

SEQ ID NO: 4822289 - DNA, 23 bp, Homo sapiens
agagcttcccctaacctgggttg

SEQ ID NO: 4822290 - DNA, 19 bp, Homo sapiens
agaggaactccttggccta

SEQ ID NO: 4822291 - DNA, 14 bp, Homo sapiens
agaggaataagaat

SEQ ID NO: 4822292 - DNA, 16 bp, Homo sapiens
agaggagagaggaccc

SEQ ID NO: 4822293 - DNA, 16 bp, Homo sapiens
agaggataaataataa

SEQ ID NO: 4822294 - DNA, 17 bp, Homo sapiens
agaggataaataataaa

SEQ ID NO: 4822295 - DNA, 15 bp, Homo sapiens
agaggcagggccctg

SEQ ID NO: 4822296 - DNA, 19 bp, Homo sapiens
agaggcccgaggcaccgga

SEQ ID NO: 4822297 - DNA, 14 bp, Homo sapiens
agaggcgtcttgta

SEQ ID NO: 4822298 - DNA, 20 bp, Homo sapiens
agagggcaggggctgcatcc

SEQ ID NO: 4822299 - DNA, 17 bp, Homo sapiens
agagggctgagcccctc

SEQ ID NO: 4822300 - DNA, 18 bp, Homo sapiens
agagggctgagcccctcc

SEQ ID NO: 4822301 - DNA, 19 bp, Homo sapiens
agagggctgagcccctcct

SEQ ID NO: 4822302 - DNA, 19 bp, Homo sapiens
agaggggacaagccaggcc

SEQ ID NO: 4822303 - DNA, 14 bp, Homo sapiens
agaggggcgctgcc

SEQ ID NO: 4822304 - DNA, 17 bp, Homo sapiens
agaggggtataggacaa

SEQ ID NO: 4822305 - DNA, 15 bp, Homo sapiens
agagggtccctaggt

SEQ ID NO: 4822306 - DNA, 21 bp, Homo sapiens
agaggtatcttactttcctct

SEQ ID NO: 4822307 - DNA, 20 bp, Homo sapiens
agaggtggggtgctggggct

SEQ ID NO: 4822308 - DNA, 17 bp, Homo sapiens
agagtaaaaccaaaggt

SEQ ID NO: 4822309 - DNA, 17 bp, Homo sapiens
agagtactttggtttct

SEQ ID NO: 4822310 - DNA, 16 bp, Homo sapiens
agagtatatatgtaca

SEQ ID NO: 4822311 - DNA, 20 bp, Homo sapiens
agagtatatatgtacagtta

SEQ ID NO: 4822312 - DNA, 17 bp, Homo sapiens
agagtatgcaagaagaa

SEQ ID NO: 4822313 - DNA, 18 bp, Homo sapiens
agagtatggtgctgggtc

SEQ ID NO: 4822314 - DNA, 11 bp, Homo sapiens
agagtatgtgt

SEQ ID NO: 4822315 - DNA, 13 bp, Homo sapiens
agagtatgtgtat

SEQ ID NO: 4822316 - DNA, 16 bp, Homo sapiens
agagtatgtgtatgta

SEQ ID NO: 4822317 - DNA, 15 bp, Homo sapiens
agagtcactggaaca

SEQ ID NO: 4822318 - DNA, 22 bp, Homo sapiens
agagtcagaagtttctgccgca

SEQ ID NO: 4822319 - DNA, 19 bp, Homo sapiens
agagtcaggagaaacccct

SEQ ID NO: 4822320 - DNA, 16 bp, Homo sapiens
agagtggatctggagt

SEQ ID NO: 4822321 - DNA, 15 bp, Homo sapiens
agagtgtatgcatac

SEQ ID NO: 4822322 - DNA, 17 bp, Homo sapiens
agagtgtatgcatacaa

SEQ ID NO: 4822323 - DNA, 18 bp, Homo sapiens
agagtgtcctgctacctt

SEQ ID NO: 4822324 - DNA, 14 bp, Homo sapiens
agagttgaagacag

SEQ ID NO: 4822325 - DNA, 21 bp, Homo sapiens
agataaacacagctgctttct

SEQ ID NO: 4822326 - DNA, 14 bp, Homo sapiens
agataaatatcatt

SEQ ID NO: 4822327 - DNA, 16 bp, Homo sapiens
agataaatatcattat

SEQ ID NO: 4822328 - DNA, 13 bp, Homo sapiens
agataaatcatgg

SEQ ID NO: 4822329 - DNA, 17 bp, Homo sapiens
agataaatcatgggcat

SEQ ID NO: 4822330 - DNA, 15 bp, Homo sapiens
agataattaaatgaa

SEQ ID NO: 4822331 - DNA, 20 bp, Homo sapiens
agataattaaatgaaatact

SEQ ID NO: 4822332 - DNA, 13 bp, Homo sapiens
agatacctgtgag

SEQ ID NO: 4822333 - DNA, 16 bp, Homo sapiens
agatacctgtgaggac

SEQ ID NO: 4822334 - DNA, 14 bp, Homo sapiens
agatactttgcatt

SEQ ID NO: 4822335 - DNA, 16 bp, Homo sapiens
agatactttgcattgt

SEQ ID NO: 4822336 - DNA, 17 bp, Homo sapiens
agataggttctgctttc

SEQ ID NO: 4822337 - DNA, 17 bp, Homo sapiens
agatagttgtaaagata

SEQ ID NO: 4822338 - DNA, 15 bp, Homo sapiens
agatatatctgaaaa

SEQ ID NO: 4822339 - DNA, 20 bp, Homo sapiens
agatatatctgaaaactgga

SEQ ID NO: 4822340 - DNA, 20 bp, Homo sapiens
agatattgtatctcctttaa

SEQ ID NO: 4822341 - DNA, 12 bp, Homo sapiens
agatattgtatt

SEQ ID NO: 4822342 - DNA, 20 bp, Homo sapiens
agatattgtattatcatata

SEQ ID NO: 4822343 - DNA, 21 bp, Homo sapiens
agatattgtattatcatatat

SEQ ID NO: 4822344 - DNA, 15 bp, Homo sapiens
agatattttgtaaaa

SEQ ID NO: 4822345 - DNA, 15 bp, Homo sapiens
agatcacatgcccct

SEQ ID NO: 4822346 - DNA, 20 bp, Homo sapiens
agatcaggtcagagcccagg

SEQ ID NO: 4822347 - DNA, 21 bp, Homo sapiens
agatcaggtcagagcccagga

SEQ ID NO: 4822348 - DNA, 20 bp, Homo sapiens
agatccatccttttgcttca

SEQ ID NO: 4822349 - DNA, 22 bp, Homo sapiens
agatccatccttttgcttcatc

SEQ ID NO: 4822350 - DNA, 15 bp, Homo sapiens
agatccattaattta

SEQ ID NO: 4822351 - DNA, 15 bp, Homo sapiens
agatccatttaaaac

SEQ ID NO: 4822352 - DNA, 16 bp, Homo sapiens
agatccatttaaaaca

SEQ ID NO: 4822353 - DNA, 17 bp, Homo sapiens
agatcccagagttattt

SEQ ID NO: 4822354 - DNA, 13 bp, Homo sapiens
agatcctgtgatt

SEQ ID NO: 4822355 - DNA, 14 bp, Homo sapiens
agatctagccaggc

SEQ ID NO: 4822356 - DNA, 13 bp, Homo sapiens
agatctcctgtaa

SEQ ID NO: 4822357 - DNA, 15 bp, Homo sapiens
agatctcctgtaatt

SEQ ID NO: 4822358 - DNA, 16 bp, Homo sapiens
agatctcctgtaattt

SEQ ID NO: 4822359 - DNA, 20 bp, Homo sapiens
agatctcctgtaattttgta

SEQ ID NO: 4822360 - DNA, 20 bp, Homo sapiens
agatctgaagtagtgtgagt

SEQ ID NO: 4822361 - DNA, 16 bp, Homo sapiens
agatctgcactcctgt

SEQ ID NO: 4822362 - DNA, 17 bp, Homo sapiens
agatcttgagcaaggca

SEQ ID NO: 4822363 - DNA, 17 bp, Homo sapiens
agatcttgcctctttcc

SEQ ID NO: 4822364 - DNA, 18 bp, Homo sapiens
agatctttttttaagtgt

SEQ ID NO: 4822365 - DNA, 19 bp, Homo sapiens
agatctttttttaagtgtt

SEQ ID NO: 4822366 - DNA, 17 bp, Homo sapiens
agatgagaaaacaggct

SEQ ID NO: 4822367 - DNA, 18 bp, Homo sapiens
agatgaggctccttagtt

SEQ ID NO: 4822368 - DNA, 16 bp, Homo sapiens
agatgaggttgagcta

SEQ ID NO: 4822369 - DNA, 22 bp, Homo sapiens
agatgaggttgagctatgatat

SEQ ID NO: 4822370 - DNA, 22 bp, Homo sapiens
agatgatctctccacggtagca

SEQ ID NO: 4822371 - DNA, 15 bp, Homo sapiens
agatgatttaattct

SEQ ID NO: 4822372 - DNA, 13 bp, Homo sapiens
agatgcatctgtg

SEQ ID NO: 4822373 - DNA, 20 bp, Homo sapiens
agatgcatctgtggcctggg

SEQ ID NO: 4822374 - DNA, 21 bp, Homo sapiens
agatgcatctgtggcctgggg

SEQ ID NO: 4822375 - DNA, 14 bp, Homo sapiens
agatgcattttaaa

SEQ ID NO: 4822376 - DNA, 18 bp, Homo sapiens
agatggatttgacacact

SEQ ID NO: 4822377 - DNA, 22 bp, Homo sapiens
agatggcttccgtgagacacaa

SEQ ID NO: 4822378 - DNA, 19 bp, Homo sapiens
agatgggcaaggcctttgg

SEQ ID NO: 4822379 - DNA, 20 bp, Homo sapiens
agatggggagggcgcttttg

SEQ ID NO: 4822380 - DNA, 19 bp, Homo sapiens
agatggtcatatttaaaca

SEQ ID NO: 4822381 - DNA, 19 bp, Homo sapiens
agatggtgccccctggggg

SEQ ID NO: 4822382 - DNA, 18 bp, Homo sapiens
agatggtgtcctgcatgt

SEQ ID NO: 4822383 - DNA, 17 bp, Homo sapiens
agatgtaagaagctaaa

SEQ ID NO: 4822384 - DNA, 15 bp, Homo sapiens
agatgtaatacacca

SEQ ID NO: 4822385 - DNA, 14 bp, Homo sapiens
agatgtaggaaccg

SEQ ID NO: 4822386 - DNA, 20 bp, Homo sapiens
agatgtaggaaccgatctgc

SEQ ID NO: 4822387 - DNA, 14 bp, Homo sapiens
agatgtctgtgtat

SEQ ID NO: 4822388 - DNA, 15 bp, Homo sapiens
agatgtctgtgtata

SEQ ID NO: 4822389 - DNA, 17 bp, Homo sapiens
agatgtctgtgtataca

SEQ ID NO: 4822390 - DNA, 19 bp, Homo sapiens
agatgtctgtgtatacata

SEQ ID NO: 4822391 - DNA, 22 bp, Homo sapiens
agatgtgtatcagtgtttatgt

SEQ ID NO: 4822392 - DNA, 17 bp, Homo sapiens
agatgtgtcttcaattt

SEQ ID NO: 4822393 - DNA, 18 bp, Homo sapiens
agatgtttggcaagaaat

SEQ ID NO: 4822394 - DNA, 14 bp, Homo sapiens
agatgttttcaagt

SEQ ID NO: 4822395 - DNA, 20 bp, Homo sapiens
agattaaaaccagagagaaa

SEQ ID NO: 4822396 - DNA, 16 bp, Homo sapiens
agattaaaattagtga

SEQ ID NO: 4822397 - DNA, 17 bp, Homo sapiens
agattatatacaaagct

SEQ ID NO: 4822398 - DNA, 14 bp, Homo sapiens
agattatttacaag

SEQ ID NO: 4822399 - DNA, 11 bp, Homo sapiens
agattcaattt

SEQ ID NO: 4822400 - DNA, 15 bp, Homo sapiens
agattcacctgtaaa

SEQ ID NO: 4822401 - DNA, 20 bp, Homo sapiens
agattcacctgtaaaacttt

SEQ ID NO: 4822402 - DNA, 13 bp, Homo sapiens
agattcacctttt

SEQ ID NO: 4822403 - DNA, 17 bp, Homo sapiens
agattcactttgacact

SEQ ID NO: 4822404 - DNA, 14 bp, Homo sapiens
agattcagactgct

SEQ ID NO: 4822405 - DNA, 18 bp, Homo sapiens
agattcctacttaaacaa

SEQ ID NO: 4822406 - DNA, 19 bp, Homo sapiens
agattcctacttaaacaaa

SEQ ID NO: 4822407 - DNA, 17 bp, Homo sapiens
agattctattaaaagcc

SEQ ID NO: 4822408 - DNA, 15 bp, Homo sapiens
agattgctgcttctg

SEQ ID NO: 4822409 - DNA, 18 bp, Homo sapiens
agattggaaaaaattaga

SEQ ID NO: 4822410 - DNA, 13 bp, Homo sapiens
agattggaaggaa

SEQ ID NO: 4822411 - DNA, 17 bp, Homo sapiens
agattggatcaagtatt

SEQ ID NO: 4822412 - DNA, 22 bp, Homo sapiens
agattggatcaagtattactaa

SEQ ID NO: 4822413 - DNA, 15 bp, Homo sapiens
agattgtaaaggtag

SEQ ID NO: 4822414 - DNA, 20 bp, Homo sapiens
agattgtaaaggtaggtgca

SEQ ID NO: 4822415 - DNA, 21 bp, Homo sapiens
agattgtaaaggtaggtgcat

SEQ ID NO: 4822416 - DNA, 13 bp, Homo sapiens
agattgtgtaaat

SEQ ID NO: 4822417 - DNA, 17 bp, Homo sapiens
agattgttattaaatgt

SEQ ID NO: 4822418 - DNA, 18 bp, Homo sapiens
agatttagggttctatat

SEQ ID NO: 4822419 - DNA, 15 bp, Homo sapiens
agatttgtatttata

SEQ ID NO: 4822420 - DNA, 16 bp, Homo sapiens
agatttgtatttatat

SEQ ID NO: 4822421 - DNA, 13 bp, Homo sapiens
agatttgttcatt

SEQ ID NO: 4822422 - DNA, 14 bp, Homo sapiens
agattttatgttta

SEQ ID NO: 4822423 - DNA, 13 bp, Homo sapiens
agatttttagatt

SEQ ID NO: 4822424 - DNA, 16 bp, Homo sapiens
agatttttagattcct

SEQ ID NO: 4822425 - DNA, 20 bp, Homo sapiens
agcaaaaccattgcttcact

SEQ ID NO: 4822426 - DNA, 22 bp, Homo sapiens
agcaaaaccattgcttcactac

SEQ ID NO: 4822427 - DNA, 13 bp, Homo sapiens
agcaaacacacag

SEQ ID NO: 4822428 - DNA, 17 bp, Homo sapiens
agcaaactgaaattagt

SEQ ID NO: 4822429 - DNA, 21 bp, Homo sapiens
agcaaactgaaattagtgttt

SEQ ID NO: 4822430 - DNA, 19 bp, Homo sapiens
agcaaactgaagcccacag

SEQ ID NO: 4822431 - DNA, 20 bp, Homo sapiens
agcaaaggagattggaagga

SEQ ID NO: 4822432 - DNA, 22 bp, Homo sapiens
agcaaagtagtacttcttctgt

SEQ ID NO: 4822433 - DNA, 15 bp, Homo sapiens
agcaaatcgtacatt

SEQ ID NO: 4822434 - DNA, 17 bp, Homo sapiens
agcaaatcgtacattgt

SEQ ID NO: 4822435 - DNA, 18 bp, Homo sapiens
agcaaattccaatacatt

SEQ ID NO: 4822436 - DNA, 14 bp, Homo sapiens
agcaacaggaccag

SEQ ID NO: 4822437 - DNA, 22 bp, Homo sapiens
agcaacaggaccaggagccagg

SEQ ID NO: 4822438 - DNA, 16 bp, Homo sapiens
agcaaccctacagtat

SEQ ID NO: 4822439 - DNA, 19 bp, Homo sapiens
agcaaccctacagtatata

SEQ ID NO: 4822440 - DNA, 15 bp, Homo sapiens
agcaactgttagctg

SEQ ID NO: 4822441 - DNA, 17 bp, Homo sapiens
agcaactttccaacttt

SEQ ID NO: 4822442 - DNA, 20 bp, Homo sapiens
agcaagacaatgacactgga

SEQ ID NO: 4822443 - DNA, 20 bp, Homo sapiens
agcaaggcaagaagtgggat

SEQ ID NO: 4822444 - DNA, 22 bp, Homo sapiens
agcaaggcaagaagtgggattc

SEQ ID NO: 4822445 - DNA, 21 bp, Homo sapiens
agcaaggctgctaagtggaag

SEQ ID NO: 4822446 - DNA, 22 bp, Homo sapiens
agcaaggctgctaagtggaaga

SEQ ID NO: 4822447 - DNA, 16 bp, Homo sapiens
agcaataagttgaatg

SEQ ID NO: 4822448 - DNA, 12 bp, Homo sapiens
agcaatatgtca

SEQ ID NO: 4822449 - DNA, 21 bp, Homo sapiens
agcaatccttaaaaagaccat

SEQ ID NO: 4822450 - DNA, 14 bp, Homo sapiens
agcaatgcctgcct

SEQ ID NO: 4822451 - DNA, 19 bp, Homo sapiens
agcacaaccatgttcttga

SEQ ID NO: 4822452 - DNA, 16 bp, Homo sapiens
agcacagagagcggct

SEQ ID NO: 4822453 - DNA, 13 bp, Homo sapiens
agcacagccatag

SEQ ID NO: 4822454 - DNA, 18 bp, Homo sapiens
agcacagctactcagatc

SEQ ID NO: 4822455 - DNA, 12 bp, Homo sapiens
agcacagtattt

SEQ ID NO: 4822456 - DNA, 15 bp, Homo sapiens
agcacagtatttaac

SEQ ID NO: 4822457 - DNA, 17 bp, Homo sapiens
agcacagtatttaacat

SEQ ID NO: 4822458 - DNA, 20 bp, Homo sapiens
agcacagtatttaacattct

SEQ ID NO: 4822459 - DNA, 23 bp, Homo sapiens
agcacatgcctctctcaggccaa

SEQ ID NO: 4822460 - DNA, 19 bp, Homo sapiens
agcacatgctggccagcct

SEQ ID NO: 4822461 - DNA, 20 bp, Homo sapiens
agcacatgctggccagcctg

SEQ ID NO: 4822462 - DNA, 16 bp, Homo sapiens
agcacatgttttacaa

SEQ ID NO: 4822463 - DNA, 19 bp, Homo sapiens
agcacatgttttacaaaga

SEQ ID NO: 4822464 - DNA, 19 bp, Homo sapiens
agcacatttgttaatgatt

SEQ ID NO: 4822465 - DNA, 21 bp, Homo sapiens
agcacatttgttaatgattct

SEQ ID NO: 4822466 - DNA, 16 bp, Homo sapiens
agcaccatctctcctc

SEQ ID NO: 4822467 - DNA, 17 bp, Homo sapiens
agcacccccagcctccc

SEQ ID NO: 4822468 - DNA, 18 bp, Homo sapiens
agcacccccagcctcccc

SEQ ID NO: 4822469 - DNA, 20 bp, Homo sapiens
agcacccccagcctccccca

SEQ ID NO: 4822470 - DNA, 12 bp, Homo sapiens
agcaccctctcc

SEQ ID NO: 4822471 - DNA, 13 bp, Homo sapiens
agcaccctctcct

SEQ ID NO: 4822472 - DNA, 19 bp, Homo sapiens
agcaccctctcctgggggt

SEQ ID NO: 4822473 - DNA, 18 bp, Homo sapiens
agcaccgaatattgagca

SEQ ID NO: 4822474 - DNA, 16 bp, Homo sapiens
agcaccgtggtgtgag

SEQ ID NO: 4822475 - DNA, 17 bp, Homo sapiens
agcaccgtggtgtgagg

SEQ ID NO: 4822476 - DNA, 19 bp, Homo sapiens
agcaccgtggtgtgaggcc

SEQ ID NO: 4822477 - DNA, 20 bp, Homo sapiens
agcaccgtggtgtgaggccc

SEQ ID NO: 4822478 - DNA, 12 bp, Homo sapiens
agcacctcctcc

SEQ ID NO: 4822479 - DNA, 17 bp, Homo sapiens
agcacctcctccgtggg

SEQ ID NO: 4822480 - DNA, 16 bp, Homo sapiens
agcactagaatgagaa

SEQ ID NO: 4822481 - DNA, 17 bp, Homo sapiens
agcactagccttcccag

SEQ ID NO: 4822482 - DNA, 22 bp, Homo sapiens
agcactagccttcccagcttcc

SEQ ID NO: 4822483 - DNA, 15 bp, Homo sapiens
agcactcccagggcc

SEQ ID NO: 4822484 - DNA, 19 bp, Homo sapiens
agcactcccagggcccgag

SEQ ID NO: 4822485 - DNA, 11 bp, Homo sapiens
agcactgaaaa

SEQ ID NO: 4822486 - DNA, 13 bp, Homo sapiens
agcactggccttg

SEQ ID NO: 4822487 - DNA, 14 bp, Homo sapiens
agcactggccttgc

SEQ ID NO: 4822488 - DNA, 16 bp, Homo sapiens
agcactggccttgcct

SEQ ID NO: 4822489 - DNA, 20 bp, Homo sapiens
agcactggccttgcctccag

SEQ ID NO: 4822490 - DNA, 21 bp, Homo sapiens
agcactggccttgcctccagg

SEQ ID NO: 4822491 - DNA, 17 bp, Homo sapiens
agcagacggggggctgc

SEQ ID NO: 4822492 - DNA, 16 bp, Homo sapiens
agcagagacggcagcc

SEQ ID NO: 4822493 - DNA, 18 bp, Homo sapiens
agcagagcgcagccccca

SEQ ID NO: 4822494 - DNA, 19 bp, Homo sapiens
agcagagcgcagcccccac

SEQ ID NO: 4822495 - DNA, 22 bp, Homo sapiens
agcagagctgatggagaaggaa

SEQ ID NO: 4822496 - DNA, 22 bp, Homo sapiens
agcagcctgcttcccacctccc

SEQ ID NO: 4822497 - DNA, 17 bp, Homo sapiens
agcagctagaaagagaa

SEQ ID NO: 4822498 - DNA, 18 bp, Homo sapiens
agcagctagaaagagaaa

SEQ ID NO: 4822499 - DNA, 18 bp, Homo sapiens
agcagctccaacctggag

SEQ ID NO: 4822500 - DNA, 13 bp, Homo sapiens
agcagctggactg

SEQ ID NO: 4822501 - DNA, 14 bp, Homo sapiens
agcagctggactgg

SEQ ID NO: 4822502 - DNA, 17 bp, Homo sapiens
agcagctggactgggtg

SEQ ID NO: 4822503 - DNA, 12 bp, Homo sapiens
agcaggaaatag

SEQ ID NO: 4822504 - DNA, 14 bp, Homo sapiens
agcaggaaggcctg

SEQ ID NO: 4822505 - DNA, 21 bp, Homo sapiens
agcaggcggtggggagagatg

SEQ ID NO: 4822506 - DNA, 20 bp, Homo sapiens
agcagggcgggccaggagaa

SEQ ID NO: 4822507 - DNA, 15 bp, Homo sapiens
agcagggctgggcgc

SEQ ID NO: 4822508 - DNA, 19 bp, Homo sapiens
agcagggctgggcgcctct

SEQ ID NO: 4822509 - DNA, 20 bp, Homo sapiens
agcaggggggttgggttcca

SEQ ID NO: 4822510 - DNA, 19 bp, Homo sapiens
agcaggttctctcctgtga

SEQ ID NO: 4822511 - DNA, 12 bp, Homo sapiens
agcagtacatct

SEQ ID NO: 4822512 - DNA, 16 bp, Homo sapiens
agcagtacatcttgtg

SEQ ID NO: 4822513 - DNA, 11 bp, Homo sapiens
agcagtacatg

SEQ ID NO: 4822514 - DNA, 19 bp, Homo sapiens
agcagtaccatcccactga

SEQ ID NO: 4822515 - DNA, 19 bp, Homo sapiens
agcagtgcatgctgtccct

SEQ ID NO: 4822516 - DNA, 19 bp, Homo sapiens
agcagttaccgaggagcta

SEQ ID NO: 4822517 - DNA, 21 bp, Homo sapiens
agcagttgcaataaactcagt

SEQ ID NO: 4822518 - DNA, 12 bp, Homo sapiens
agcagttgctag

SEQ ID NO: 4822519 - DNA, 22 bp, Homo sapiens
agcagttgctagcaacaactta

SEQ ID NO: 4822520 - DNA, 13 bp, Homo sapiens
agcagtttcagat

SEQ ID NO: 4822521 - DNA, 16 bp, Homo sapiens
agcagtttcagataaa

SEQ ID NO: 4822522 - DNA, 17 bp, Homo sapiens
agcagtttgtgatctgt

SEQ ID NO: 4822523 - DNA, 22 bp, Homo sapiens
agcatactgatgagacaacaca

SEQ ID NO: 4822524 - DNA, 15 bp, Homo sapiens
agcatagttctgcaa

SEQ ID NO: 4822525 - DNA, 12 bp, Homo sapiens
agcatataaatg

SEQ ID NO: 4822526 - DNA, 15 bp, Homo sapiens
agcatataaatgttt

SEQ ID NO: 4822527 - DNA, 18 bp, Homo sapiens
agcatataaatgtttata

SEQ ID NO: 4822528 - DNA, 12 bp, Homo sapiens
agcatatataaa

SEQ ID NO: 4822529 - DNA, 16 bp, Homo sapiens
agcatatataaaacaa

SEQ ID NO: 4822530 - DNA, 13 bp, Homo sapiens
agcatcagcaaga

SEQ ID NO: 4822531 - DNA, 14 bp, Homo sapiens
agcatcagcaagac

SEQ ID NO: 4822532 - DNA, 13 bp, Homo sapiens
agcatctgctctt

SEQ ID NO: 4822533 - DNA, 14 bp, Homo sapiens
agcatgagttctgc

SEQ ID NO: 4822534 - DNA, 19 bp, Homo sapiens
agcatgagttctgcacata

SEQ ID NO: 4822535 - DNA, 23 bp, Homo sapiens
agcatgcatttagcatgagttct

SEQ ID NO: 4822536 - DNA, 17 bp, Homo sapiens
agcatgccaatttctct

SEQ ID NO: 4822537 - DNA, 19 bp, Homo sapiens
agcatgcccaaatataaca

SEQ ID NO: 4822538 - DNA, 15 bp, Homo sapiens
agcatgctccctcat

SEQ ID NO: 4822539 - DNA, 21 bp, Homo sapiens
agcatgctccctcatgcagat

SEQ ID NO: 4822540 - DNA, 15 bp, Homo sapiens
agcatgtcctatccc

SEQ ID NO: 4822541 - DNA, 17 bp, Homo sapiens
agcatgtgttaatctta

SEQ ID NO: 4822542 - DNA, 13 bp, Homo sapiens
agcattcccaatt

SEQ ID NO: 4822543 - DNA, 16 bp, Homo sapiens
agcattgaaataataa

SEQ ID NO: 4822544 - DNA, 17 bp, Homo sapiens
agcatttgactttctgt

SEQ ID NO: 4822545 - DNA, 21 bp, Homo sapiens
agcatttgactttctgtctgt

SEQ ID NO: 4822546 - DNA, 20 bp, Homo sapiens
agcattttaatagtttctaa

SEQ ID NO: 4822547 - DNA, 17 bp, Homo sapiens
agcattttactgtctgt

SEQ ID NO: 4822548 - DNA, 19 bp, Homo sapiens
agcattttactgtctgtaa

SEQ ID NO: 4822549 - DNA, 17 bp, Homo sapiens
agccaaagagaaaagat

SEQ ID NO: 4822550 - DNA, 21 bp, Homo sapiens
agccaaagagaaaagattaaa

SEQ ID NO: 4822551 - DNA, 16 bp, Homo sapiens
agccaacttaaacctg

SEQ ID NO: 4822552 - DNA, 21 bp, Homo sapiens
agccaacttaaacctgtgctt

SEQ ID NO: 4822553 - DNA, 20 bp, Homo sapiens
agccaaggccaaaggaagca

SEQ ID NO: 4822554 - DNA, 22 bp, Homo sapiens
agccaaggccaaaggaagcaca

SEQ ID NO: 4822555 - DNA, 15 bp, Homo sapiens
agccaatttcaaaga

SEQ ID NO: 4822556 - DNA, 16 bp, Homo sapiens
agccacagtggggccc

SEQ ID NO: 4822557 - DNA, 23 bp, Homo sapiens
agccaccacctggatggatctgc

SEQ ID NO: 4822558 - DNA, 24 bp, Homo sapiens
agccacccggatctccaggcccag

SEQ ID NO: 4822559 - DNA, 10 bp, Homo sapiens
agccagagga

SEQ ID NO: 4822560 - DNA, 18 bp, Homo sapiens
agccagaggagagaggac

SEQ ID NO: 4822561 - DNA, 18 bp, Homo sapiens
agccagatgacagggagc

SEQ ID NO: 4822562 - DNA, 18 bp, Homo sapiens
agccagcaggctctcagg

SEQ ID NO: 4822563 - DNA, 19 bp, Homo sapiens
agccagcaggctctcaggc

SEQ ID NO: 4822564 - DNA, 21 bp, Homo sapiens
agccagcagggcgggccagga

SEQ ID NO: 4822565 - DNA, 20 bp, Homo sapiens
agccagcaggttctctcctg

SEQ ID NO: 4822566 - DNA, 18 bp, Homo sapiens
agccagctgcaggaatca

SEQ ID NO: 4822567 - DNA, 14 bp, Homo sapiens
agccagcttggtgg

SEQ ID NO: 4822568 - DNA, 17 bp, Homo sapiens
agccagcttggtggtta

SEQ ID NO: 4822569 - DNA, 11 bp, Homo sapiens
agccaggcctc

SEQ ID NO: 4822570 - DNA, 13 bp, Homo sapiens
agccaggcctccc

SEQ ID NO: 4822571 - DNA, 15 bp, Homo sapiens
agccaggcctcccgc

SEQ ID NO: 4822572 - DNA, 19 bp, Homo sapiens
agccagggttccagacagg

SEQ ID NO: 4822573 - DNA, 22 bp, Homo sapiens
agccatagccccaggcccgccc

SEQ ID NO: 4822574 - DNA, 13 bp, Homo sapiens
agccatccaccct

SEQ ID NO: 4822575 - DNA, 20 bp, Homo sapiens
agccatccaccctgaggagt

SEQ ID NO: 4822576 - DNA, 20 bp, Homo sapiens
agccattgcttctccctcac

SEQ ID NO: 4822577 - DNA, 21 bp, Homo sapiens
agcccaacatggggcccctct

SEQ ID NO: 4822578 - DNA, 16 bp, Homo sapiens
agcccacagtatattt

SEQ ID NO: 4822579 - DNA, 20 bp, Homo sapiens
agcccacagtatattttatt

SEQ ID NO: 4822580 - DNA, 21 bp, Homo sapiens
agcccacccgccccagagact

SEQ ID NO: 4822581 - DNA, 23 bp, Homo sapiens
agcccacccgccccagagactgc

SEQ ID NO: 4822582 - DNA, 14 bp, Homo sapiens
agcccaccctgctg

SEQ ID NO: 4822583 - DNA, 20 bp, Homo sapiens
agcccactaactgaggagct

SEQ ID NO: 4822584 - DNA, 15 bp, Homo sapiens
agcccagaacgggcc

SEQ ID NO: 4822585 - DNA, 14 bp, Homo sapiens
agcccagagagacc

SEQ ID NO: 4822586 - DNA, 17 bp, Homo sapiens
agcccagagagaccctg

SEQ ID NO: 4822587 - DNA, 22 bp, Homo sapiens
agcccagcctatctctcttctg

SEQ ID NO: 4822588 - DNA, 19 bp, Homo sapiens
agcccaggcctcctacagc

SEQ ID NO: 4822589 - DNA, 14 bp, Homo sapiens
agcccattaaaata

SEQ ID NO: 4822590 - DNA, 15 bp, Homo sapiens
agccccagggccctg

SEQ ID NO: 4822591 - DNA, 17 bp, Homo sapiens
agccccagggccctgct

SEQ ID NO: 4822592 - DNA, 18 bp, Homo sapiens
agccccagggccctgctc

SEQ ID NO: 4822593 - DNA, 20 bp, Homo sapiens
agccccagggccctgctcag

SEQ ID NO: 4822594 - DNA, 20 bp, Homo sapiens
agccccatccttcccgcagc

SEQ ID NO: 4822595 - DNA, 12 bp, Homo sapiens
agcccccacccc

SEQ ID NO: 4822596 - DNA, 20 bp, Homo sapiens
agccccccacgcttctggag

SEQ ID NO: 4822597 - DNA, 13 bp, Homo sapiens
agccccccagcac

SEQ ID NO: 4822598 - DNA, 16 bp, Homo sapiens
agcccccgcccctccc

SEQ ID NO: 4822599 - DNA, 18 bp, Homo sapiens
agcccccgcccctccccc

SEQ ID NO: 4822600 - DNA, 12 bp, Homo sapiens
agccccctgcac

SEQ ID NO: 4822601 - DNA, 15 bp, Homo sapiens
agccccctgcaccca

SEQ ID NO: 4822602 - DNA, 13 bp, Homo sapiens
agccccctgcttc

SEQ ID NO: 4822603 - DNA, 16 bp, Homo sapiens
agccccctgcttctcc

SEQ ID NO: 4822604 - DNA, 17 bp, Homo sapiens
agccccctgcttctccc

SEQ ID NO: 4822605 - DNA, 15 bp, Homo sapiens
agccccgcgaccacc

SEQ ID NO: 4822606 - DNA, 17 bp, Homo sapiens
agccccgcgaccacccc

SEQ ID NO: 4822607 - DNA, 21 bp, Homo sapiens
agccccgcgaccacccctgtg

SEQ ID NO: 4822608 - DNA, 22 bp, Homo sapiens
agccccgcgaccacccctgtgc

SEQ ID NO: 4822609 - DNA, 21 bp, Homo sapiens
agcccctatcctgcaccctct

SEQ ID NO: 4822610 - DNA, 21 bp, Homo sapiens
agcccctccccatggtgcagt

SEQ ID NO: 4822611 - DNA, 14 bp, Homo sapiens
agcccctcctctcc

SEQ ID NO: 4822612 - DNA, 21 bp, Homo sapiens
agcccctgctggaccaaggtg

SEQ ID NO: 4822613 - DNA, 17 bp, Homo sapiens
agcccctggggcctaga

SEQ ID NO: 4822614 - DNA, 14 bp, Homo sapiens
agcccgcagaggtg

SEQ ID NO: 4822615 - DNA, 10 bp, Homo sapiens
agcccggcca

SEQ ID NO: 4822616 - DNA, 15 bp, Homo sapiens
agcccggccaaggac

SEQ ID NO: 4822617 - DNA, 18 bp, Homo sapiens
agccctaagtaaatctaa

SEQ ID NO: 4822618 - DNA, 13 bp, Homo sapiens
agccctcagaaca

SEQ ID NO: 4822619 - DNA, 12 bp, Homo sapiens
agccctccccct

SEQ ID NO: 4822620 - DNA, 16 bp, Homo sapiens
agccctcccccttccc

SEQ ID NO: 4822621 - DNA, 21 bp, Homo sapiens
agccctcccccttccccttct

SEQ ID NO: 4822622 - DNA, 19 bp, Homo sapiens
agccctccgccagccctgt

SEQ ID NO: 4822623 - DNA, 12 bp, Homo sapiens
agccctctccct

SEQ ID NO: 4822624 - DNA, 14 bp, Homo sapiens
agccctctccctca

SEQ ID NO: 4822625 - DNA, 17 bp, Homo sapiens
agccctctccctcagtc

SEQ ID NO: 4822626 - DNA, 13 bp, Homo sapiens
agccctctttctc

SEQ ID NO: 4822627 - DNA, 17 bp, Homo sapiens
agccctctttctctctg

SEQ ID NO: 4822628 - DNA, 23 bp, Homo sapiens
agccctctttctctctgtgtggc

SEQ ID NO: 4822629 - DNA, 14 bp, Homo sapiens
agccctgcagaggg

SEQ ID NO: 4822630 - DNA, 19 bp, Homo sapiens
agccctgcagagggcacag

SEQ ID NO: 4822631 - DNA, 15 bp, Homo sapiens
agccctgccctcact

SEQ ID NO: 4822632 - DNA, 18 bp, Homo sapiens
agccctgccctcactcca

SEQ ID NO: 4822633 - DNA, 20 bp, Homo sapiens
agccctgccctcactccact

SEQ ID NO: 4822634 - DNA, 13 bp, Homo sapiens
agccctgcttgct

SEQ ID NO: 4822635 - DNA, 18 bp, Homo sapiens
agccctggcccggtccca

SEQ ID NO: 4822636 - DNA, 21 bp, Homo sapiens
agccctggcccggtcccagtc

SEQ ID NO: 4822637 - DNA, 12 bp, Homo sapiens
agccctgggcac

SEQ ID NO: 4822638 - DNA, 23 bp, Homo sapiens
agccctgggcacatagcataggc

SEQ ID NO: 4822639 - DNA, 16 bp, Homo sapiens
agccctggggcagggt

SEQ ID NO: 4822640 - DNA, 17 bp, Homo sapiens
agccctggggcagggtg

SEQ ID NO: 4822641 - DNA, 12 bp, Homo sapiens
agccctggggct

SEQ ID NO: 4822642 - DNA, 14 bp, Homo sapiens
agccctggggctgg

SEQ ID NO: 4822643 - DNA, 15 bp, Homo sapiens
agccctggggctggg

SEQ ID NO: 4822644 - DNA, 19 bp, Homo sapiens
agccctgttccgcctcact

SEQ ID NO: 4822645 - DNA, 20 bp, Homo sapiens
agccctgttccgcctcactg

SEQ ID NO: 4822646 - DNA, 12 bp, Homo sapiens
agccgcagaggc

SEQ ID NO: 4822647 - DNA, 19 bp, Homo sapiens
agccgcgctctgcccctcc

SEQ ID NO: 4822648 - DNA, 19 bp, Homo sapiens
agccggcggagctctggct

SEQ ID NO: 4822649 - DNA, 16 bp, Homo sapiens
agccgggccccatggt

SEQ ID NO: 4822650 - DNA, 12 bp, Homo sapiens
agccgtgtttta

SEQ ID NO: 4822651 - DNA, 22 bp, Homo sapiens
agcctaatattcatgctgcctg

SEQ ID NO: 4822652 - DNA, 17 bp, Homo sapiens
agcctcactgatatatt

SEQ ID NO: 4822653 - DNA, 23 bp, Homo sapiens
agcctcagtccctccctcctggc

SEQ ID NO: 4822654 - DNA, 24 bp, Homo sapiens
agcctcagtccctccctcctggct

SEQ ID NO: 4822655 - DNA, 17 bp, Homo sapiens
agcctccaccttgagca

SEQ ID NO: 4822656 - DNA, 14 bp, Homo sapiens
agcctcccccaggc

SEQ ID NO: 4822657 - DNA, 16 bp, Homo sapiens
agcctcccccaggctg

SEQ ID NO: 4822658 - DNA, 15 bp, Homo sapiens
agcctccccctcaga

SEQ ID NO: 4822659 - DNA, 14 bp, Homo sapiens
agcctgagccacag

SEQ ID NO: 4822660 - DNA, 19 bp, Homo sapiens
agcctgagccacagtgggg

SEQ ID NO: 4822661 - DNA, 13 bp, Homo sapiens
agcctgagctcca

SEQ ID NO: 4822662 - DNA, 17 bp, Homo sapiens
agcctgagctccaccct

SEQ ID NO: 4822663 - DNA, 12 bp, Homo sapiens
agcctgcacaca

SEQ ID NO: 4822664 - DNA, 17 bp, Homo sapiens
agcctgcacacacctgc

SEQ ID NO: 4822665 - DNA, 21 bp, Homo sapiens
agcctgcacacacctgcctgc

SEQ ID NO: 4822666 - DNA, 19 bp, Homo sapiens
agcctgcttcccacctccc

SEQ ID NO: 4822667 - DNA, 16 bp, Homo sapiens
agcctggcacaggact

SEQ ID NO: 4822668 - DNA, 14 bp, Homo sapiens
agcctggccccaag

SEQ ID NO: 4822669 - DNA, 20 bp, Homo sapiens
agcctgggcagaaatgtgct

SEQ ID NO: 4822670 - DNA, 16 bp, Homo sapiens
agcctggggcctggca

SEQ ID NO: 4822671 - DNA, 14 bp, Homo sapiens
agcctggtctgtgc

SEQ ID NO: 4822672 - DNA, 17 bp, Homo sapiens
agcctggtctgtgcatt

SEQ ID NO: 4822673 - DNA, 13 bp, Homo sapiens
agcctgtctctcc

SEQ ID NO: 4822674 - DNA, 14 bp, Homo sapiens
agcctgtctctccc

SEQ ID NO: 4822675 - DNA, 17 bp, Homo sapiens
agcctgtgttactgatt

SEQ ID NO: 4822676 - DNA, 21 bp, Homo sapiens
agccttaagtcttactgtttt

SEQ ID NO: 4822677 - DNA, 15 bp, Homo sapiens
agccttattaaaata

SEQ ID NO: 4822678 - DNA, 21 bp, Homo sapiens
agccttattaaaatattttct

SEQ ID NO: 4822679 - DNA, 14 bp, Homo sapiens
agccttggttcctg

SEQ ID NO: 4822680 - DNA, 15 bp, Homo sapiens
agccttggttcctga

SEQ ID NO: 4822681 - DNA, 19 bp, Homo sapiens
agcctttggtgaataacct

SEQ ID NO: 4822682 - DNA, 15 bp, Homo sapiens
agccttttcctgagg

SEQ ID NO: 4822683 - DNA, 15 bp, Homo sapiens
agcgacacaggctgc

SEQ ID NO: 4822684 - DNA, 19 bp, Homo sapiens
agcgaggcagaatggtggg

SEQ ID NO: 4822685 - DNA, 21 bp, Homo sapiens
agcgaggcagaatggtgggct

SEQ ID NO: 4822686 - DNA, 12 bp, Homo sapiens
agcgcagccccc

SEQ ID NO: 4822687 - DNA, 19 bp, Homo sapiens
agcgcatggcgccccgggc

SEQ ID NO: 4822688 - DNA, 14 bp, Homo sapiens
agcgccacccgccc

SEQ ID NO: 4822689 - DNA, 21 bp, Homo sapiens
agcgccaccgtgggagaggag

SEQ ID NO: 4822690 - DNA, 20 bp, Homo sapiens
agcgcccgaggccagggccg

SEQ ID NO: 4822691 - DNA, 18 bp, Homo sapiens
agcgccctctacctccta

SEQ ID NO: 4822692 - DNA, 18 bp, Homo sapiens
agcgcctcccgccgcctc

SEQ ID NO: 4822693 - DNA, 15 bp, Homo sapiens
agcgctatccacaga

SEQ ID NO: 4822694 - DNA, 16 bp, Homo sapiens
agcggagaaaggaagg

SEQ ID NO: 4822695 - DNA, 20 bp, Homo sapiens
agcggagaaaggaagggctg

SEQ ID NO: 4822696 - DNA, 14 bp, Homo sapiens
agcggcccggccca

SEQ ID NO: 4822697 - DNA, 15 bp, Homo sapiens
agcggcccggcccac

SEQ ID NO: 4822698 - DNA, 15 bp, Homo sapiens
agcggctcttcctgg

SEQ ID NO: 4822699 - DNA, 22 bp, Homo sapiens
agcggcttccccattgccttct

SEQ ID NO: 4822700 - DNA, 23 bp, Homo sapiens
agcgggggctaactggccccagg

SEQ ID NO: 4822701 - DNA, 20 bp, Homo sapiens
agcgtccaggtgatccccca

SEQ ID NO: 4822702 - DNA, 17 bp, Homo sapiens
agcgtccctagcagtga

SEQ ID NO: 4822703 - DNA, 16 bp, Homo sapiens
agcgtccttgtccccg

SEQ ID NO: 4822704 - DNA, 23 bp, Homo sapiens
agcgtggtggacatgcacagcta

SEQ ID NO: 4822705 - DNA, 14 bp, Homo sapiens
agctaaaattttta

SEQ ID NO: 4822706 - DNA, 15 bp, Homo sapiens
agctaatttgtgaaa

SEQ ID NO: 4822707 - DNA, 17 bp, Homo sapiens
agctaatttgtgaaagt

SEQ ID NO: 4822708 - DNA, 22 bp, Homo sapiens
agctaccaactaagttgtattt

SEQ ID NO: 4822709 - DNA, 14 bp, Homo sapiens
agctaccaggaaga

SEQ ID NO: 4822710 - DNA, 13 bp, Homo sapiens
agctagaaagaga

SEQ ID NO: 4822711 - DNA, 21 bp, Homo sapiens
agctagaaagagaaaaagccc

SEQ ID NO: 4822712 - DNA, 18 bp, Homo sapiens
agctagacgagcaggctt

SEQ ID NO: 4822713 - DNA, 18 bp, Homo sapiens
agctagtgttaatccaga

SEQ ID NO: 4822714 - DNA, 19 bp, Homo sapiens
agctagtgttaatccagag

SEQ ID NO: 4822715 - DNA, 18 bp, Homo sapiens
agctagttagagactcgc

SEQ ID NO: 4822716 - DNA, 14 bp, Homo sapiens
agctagttagctca

SEQ ID NO: 4822717 - DNA, 19 bp, Homo sapiens
agctagtttaaaattatta

SEQ ID NO: 4822718 - DNA, 22 bp, Homo sapiens
agctagtttaaaattattaaaa

SEQ ID NO: 4822719 - DNA, 15 bp, Homo sapiens
agctataaaagccca

SEQ ID NO: 4822720 - DNA, 21 bp, Homo sapiens
agctatatatatatatatatg

SEQ ID NO: 4822721 - DNA, 18 bp, Homo sapiens
agctatctgtcatctctc

SEQ ID NO: 4822722 - DNA, 15 bp, Homo sapiens
agctatcttcatgta

SEQ ID NO: 4822723 - DNA, 17 bp, Homo sapiens
agctatgcacaccaaat

SEQ ID NO: 4822724 - DNA, 22 bp, Homo sapiens
agctatgcacaccaaattgctg

SEQ ID NO: 4822725 - DNA, 18 bp, Homo sapiens
agctatgcgcaatgtggc

SEQ ID NO: 4822726 - DNA, 22 bp, Homo sapiens
agctatgtcactaccctcctgt

SEQ ID NO: 4822727 - DNA, 14 bp, Homo sapiens
agctcaaggctgca

SEQ ID NO: 4822728 - DNA, 14 bp, Homo sapiens
agctcacacttggg

SEQ ID NO: 4822729 - DNA, 19 bp, Homo sapiens
agctcacacttgggctggc

SEQ ID NO: 4822730 - DNA, 15 bp, Homo sapiens
agctcacagcacatt

SEQ ID NO: 4822731 - DNA, 17 bp, Homo sapiens
agctcacagcacatttg

SEQ ID NO: 4822732 - DNA, 19 bp, Homo sapiens
agctcactgcaacctccac

SEQ ID NO: 4822733 - DNA, 17 bp, Homo sapiens
agctcagaggagaggag

SEQ ID NO: 4822734 - DNA, 14 bp, Homo sapiens
agctcaggagaagg

SEQ ID NO: 4822735 - DNA, 15 bp, Homo sapiens
agctcaggagaaggc

SEQ ID NO: 4822736 - DNA, 18 bp, Homo sapiens
agctcaggagaaggcctg

SEQ ID NO: 4822737 - DNA, 14 bp, Homo sapiens
agctcagtcccaca

SEQ ID NO: 4822738 - DNA, 17 bp, Homo sapiens
agctcatagcacatgtt

SEQ ID NO: 4822739 - DNA, 21 bp, Homo sapiens
agctcatttcggggtcaggtg

SEQ ID NO: 4822740 - DNA, 23 bp, Homo sapiens
agctccaacctggaggctggacc

SEQ ID NO: 4822741 - DNA, 17 bp, Homo sapiens
agctccaccctcccctc

SEQ ID NO: 4822742 - DNA, 13 bp, Homo sapiens
agctccactctga

SEQ ID NO: 4822743 - DNA, 19 bp, Homo sapiens
agctccactctgaagtccc

SEQ ID NO: 4822744 - DNA, 13 bp, Homo sapiens
agctccagtagct

SEQ ID NO: 4822745 - DNA, 16 bp, Homo sapiens
agctccagtagctccg

SEQ ID NO: 4822746 - DNA, 16 bp, Homo sapiens
agctccagtttctctt

SEQ ID NO: 4822747 - DNA, 18 bp, Homo sapiens
agctccctttttgaattg

SEQ ID NO: 4822748 - DNA, 19 bp, Homo sapiens
agctccctttttgaattgt

SEQ ID NO: 4822749 - DNA, 13 bp, Homo sapiens
agctccttagcta

SEQ ID NO: 4822750 - DNA, 15 bp, Homo sapiens
agctccttcatgctt

SEQ ID NO: 4822751 - DNA, 16 bp, Homo sapiens
agctccttcatgcttt

SEQ ID NO: 4822752 - DNA, 17 bp, Homo sapiens
agctccttcatgctttt

SEQ ID NO: 4822753 - DNA, 22 bp, Homo sapiens
agctccttcatgcttttctcat

SEQ ID NO: 4822754 - DNA, 15 bp, Homo sapiens
agctccttggttttg

SEQ ID NO: 4822755 - DNA, 21 bp, Homo sapiens
agctccttggttttgcctctt

SEQ ID NO: 4822756 - DNA, 18 bp, Homo sapiens
agctcgtgtgcttagaaa

SEQ ID NO: 4822757 - DNA, 21 bp, Homo sapiens
agctctaaagcagagatgtat

SEQ ID NO: 4822758 - DNA, 21 bp, Homo sapiens
agctctcctccagccctgggc

SEQ ID NO: 4822759 - DNA, 23 bp, Homo sapiens
agctctcctccagccctgggcac

SEQ ID NO: 4822760 - DNA, 16 bp, Homo sapiens
agctctcttgccgagg

SEQ ID NO: 4822761 - DNA, 15 bp, Homo sapiens
agctctgaagggagg

SEQ ID NO: 4822762 - DNA, 18 bp, Homo sapiens
agctctgaagggagggga

SEQ ID NO: 4822763 - DNA, 12 bp, Homo sapiens
agctctggcttt

SEQ ID NO: 4822764 - DNA, 18 bp, Homo sapiens
agctctgtagcctggtct

SEQ ID NO: 4822765 - DNA, 20 bp, Homo sapiens
agctctgtagcctggtctgt

SEQ ID NO: 4822766 - DNA, 23 bp, Homo sapiens
agctctgtagcctggtctgtgca

SEQ ID NO: 4822767 - DNA, 20 bp, Homo sapiens
agctcttcattgcactgcag

SEQ ID NO: 4822768 - DNA, 16 bp, Homo sapiens
agctcttggcaggagt

SEQ ID NO: 4822769 - DNA, 20 bp, Homo sapiens
agctgagcccctccctcctg

SEQ ID NO: 4822770 - DNA, 14 bp, Homo sapiens
agctgagctggcct

SEQ ID NO: 4822771 - DNA, 17 bp, Homo sapiens
agctgagtcggctgggc

SEQ ID NO: 4822772 - DNA, 20 bp, Homo sapiens
agctgagtcggctgggcagg

SEQ ID NO: 4822773 - DNA, 22 bp, Homo sapiens
agctgagtcggctgggcagggc

SEQ ID NO: 4822774 - DNA, 15 bp, Homo sapiens
agctgatggagaagg

SEQ ID NO: 4822775 - DNA, 16 bp, Homo sapiens
agctgatggagaagga

SEQ ID NO: 4822776 - DNA, 11 bp, Homo sapiens
agctgcagctt

SEQ ID NO: 4822777 - DNA, 23 bp, Homo sapiens
agctgcaggaatcaaaaattgaa

SEQ ID NO: 4822778 - DNA, 18 bp, Homo sapiens
agctgcagttagcacaga

SEQ ID NO: 4822779 - DNA, 20 bp, Homo sapiens
agctgcagttagcacagagg

SEQ ID NO: 4822780 - DNA, 20 bp, Homo sapiens
agctgccagccgagatagcc

SEQ ID NO: 4822781 - DNA, 22 bp, Homo sapiens
agctgcctccgggcctcggcct

SEQ ID NO: 4822782 - DNA, 23 bp, Homo sapiens
agctgcctccgggcctcggcctg

SEQ ID NO: 4822783 - DNA, 17 bp, Homo sapiens
agctgcctgaaaatcaa

SEQ ID NO: 4822784 - DNA, 19 bp, Homo sapiens
agctgcctgaaaatcaaga

SEQ ID NO: 4822785 - DNA, 12 bp, Homo sapiens
agctgctcctag

SEQ ID NO: 4822786 - DNA, 18 bp, Homo sapiens
agctgctctccttcactc

SEQ ID NO: 4822787 - DNA, 23 bp, Homo sapiens
agctggactgggtgggccccaca

SEQ ID NO: 4822788 - DNA, 13 bp, Homo sapiens
agctggcagcgcc

SEQ ID NO: 4822789 - DNA, 16 bp, Homo sapiens
agctggcagcgcctcc

SEQ ID NO: 4822790 - DNA, 17 bp, Homo sapiens
agctggcagcgcctccc

SEQ ID NO: 4822791 - DNA, 20 bp, Homo sapiens
agctggcagcgcctcccgcc

SEQ ID NO: 4822792 - DNA, 19 bp, Homo sapiens
agctggcgcgtgtgtggcc

SEQ ID NO: 4822793 - DNA, 20 bp, Homo sapiens
agctggcgcgtgtgtggcct

SEQ ID NO: 4822794 - DNA, 23 bp, Homo sapiens
agctggctgggtcgcccctcctc

SEQ ID NO: 4822795 - DNA, 21 bp, Homo sapiens
agctgggcatggtaccagccc

SEQ ID NO: 4822796 - DNA, 20 bp, Homo sapiens
agctggggaatcccctcgct

SEQ ID NO: 4822797 - DNA, 20 bp, Homo sapiens
agctggggtggggacctcag

SEQ ID NO: 4822798 - DNA, 23 bp, Homo sapiens
agctggggtggggacctcaggcc

SEQ ID NO: 4822799 - DNA, 12 bp, Homo sapiens
agctggttttct

SEQ ID NO: 4822800 - DNA, 20 bp, Homo sapiens
agctgtaccggccactgcaa

SEQ ID NO: 4822801 - DNA, 12 bp, Homo sapiens
agctgtgatttt

SEQ ID NO: 4822802 - DNA, 17 bp, Homo sapiens
agctgttctaatggatt

SEQ ID NO: 4822803 - DNA, 14 bp, Homo sapiens
agctgttttggatg

SEQ ID NO: 4822804 - DNA, 19 bp, Homo sapiens
agctgttttggatgaatgc

SEQ ID NO: 4822805 - DNA, 19 bp, Homo sapiens
agcttaagaagtatccctg

SEQ ID NO: 4822806 - DNA, 14 bp, Homo sapiens
agcttaatgtcttt

SEQ ID NO: 4822807 - DNA, 20 bp, Homo sapiens
agcttaatgtctttgtgttt

SEQ ID NO: 4822808 - DNA, 15 bp, Homo sapiens
agcttcaaagttggc

SEQ ID NO: 4822809 - DNA, 19 bp, Homo sapiens
agcttcagtcattaaatta

SEQ ID NO: 4822810 - DNA, 14 bp, Homo sapiens
agcttcccaacaat

SEQ ID NO: 4822811 - DNA, 18 bp, Homo sapiens
agcttcccaacaatactt

SEQ ID NO: 4822812 - DNA, 20 bp, Homo sapiens
agcttcttgctgccaggccc

SEQ ID NO: 4822813 - DNA, 22 bp, Homo sapiens
agcttgaccgtgaggccagaga

SEQ ID NO: 4822814 - DNA, 19 bp, Homo sapiens
agcttggagtgccacgtgg

SEQ ID NO: 4822815 - DNA, 18 bp, Homo sapiens
agctttataataaactgt

SEQ ID NO: 4822816 - DNA, 12 bp, Homo sapiens
agctttcctggg

SEQ ID NO: 4822817 - DNA, 20 bp, Homo sapiens
agctttctctttgttcttca

SEQ ID NO: 4822818 - DNA, 15 bp, Homo sapiens
agcttttcacttctt

SEQ ID NO: 4822819 - DNA, 14 bp, Homo sapiens
aggaaaagaaaaga

SEQ ID NO: 4822820 - DNA, 22 bp, Homo sapiens
aggaaaaggctgcagctaattt

SEQ ID NO: 4822821 - DNA, 22 bp, Homo sapiens
aggaaaattttcttctttaatt

SEQ ID NO: 4822822 - DNA, 12 bp, Homo sapiens
aggaaagaggct

SEQ ID NO: 4822823 - DNA, 16 bp, Homo sapiens
aggaaagatcccaagt

SEQ ID NO: 4822824 - DNA, 19 bp, Homo sapiens
aggaaagcaaaggagattg

SEQ ID NO: 4822825 - DNA, 15 bp, Homo sapiens
aggaaagttctatta

SEQ ID NO: 4822826 - DNA, 19 bp, Homo sapiens
aggaaagttctattatctg

SEQ ID NO: 4822827 - DNA, 14 bp, Homo sapiens
aggaaatagtgttc

SEQ ID NO: 4822828 - DNA, 12 bp, Homo sapiens
aggaacaaggca

SEQ ID NO: 4822829 - DNA, 17 bp, Homo sapiens
aggaacaaggcaaggct

SEQ ID NO: 4822830 - DNA, 16 bp, Homo sapiens
aggaacctcaaactgg

SEQ ID NO: 4822831 - DNA, 17 bp, Homo sapiens
aggaacctctgatttat

SEQ ID NO: 4822832 - DNA, 18 bp, Homo sapiens
aggaacctctgatttatt

SEQ ID NO: 4822833 - DNA, 21 bp, Homo sapiens
aggaagacttccagctttctc

SEQ ID NO: 4822834 - DNA, 22 bp, Homo sapiens
aggaagcacatgcctctctcag

SEQ ID NO: 4822835 - DNA, 22 bp, Homo sapiens
aggaagccagcaggctctcagg

SEQ ID NO: 4822836 - DNA, 21 bp, Homo sapiens
aggaaggaggggaagctgcag

SEQ ID NO: 4822837 - DNA, 18 bp, Homo sapiens
aggaaggcagggaggagg

SEQ ID NO: 4822838 - DNA, 22 bp, Homo sapiens
aggaaggcagggaggaggcaga

SEQ ID NO: 4822839 - DNA, 13 bp, Homo sapiens
aggaaggcctggg

SEQ ID NO: 4822840 - DNA, 17 bp, Homo sapiens
aggaagtaattttcttc

SEQ ID NO: 4822841 - DNA, 15 bp, Homo sapiens
aggaagtactggaga

SEQ ID NO: 4822842 - DNA, 14 bp, Homo sapiens
aggaagtcaggagc

SEQ ID NO: 4822843 - DNA, 15 bp, Homo sapiens
aggaagtcaggagcc

SEQ ID NO: 4822844 - DNA, 16 bp, Homo sapiens
aggaagtcaggagcca

SEQ ID NO: 4822845 - DNA, 18 bp, Homo sapiens
aggaagtcaggagccagc

SEQ ID NO: 4822846 - DNA, 20 bp, Homo sapiens
aggaagtcaggagccagcag

SEQ ID NO: 4822847 - DNA, 21 bp, Homo sapiens
aggaagtcaggagccagcagg

SEQ ID NO: 4822848 - DNA, 22 bp, Homo sapiens
aggaagtcaggagccagcaggg

SEQ ID NO: 4822849 - DNA, 16 bp, Homo sapiens
aggaagtcatcctgca

SEQ ID NO: 4822850 - DNA, 12 bp, Homo sapiens
aggaataagaat

SEQ ID NO: 4822851 - DNA, 12 bp, Homo sapiens
aggaatgctcaa

SEQ ID NO: 4822852 - DNA, 17 bp, Homo sapiens
aggaatgctcaatgtgc

SEQ ID NO: 4822853 - DNA, 18 bp, Homo sapiens
aggaatgctcaatgtgct

SEQ ID NO: 4822854 - DNA, 19 bp, Homo sapiens
aggaatgggccaagccagg

SEQ ID NO: 4822855 - DNA, 15 bp, Homo sapiens
aggaattctcacagg

SEQ ID NO: 4822856 - DNA, 16 bp, Homo sapiens
aggacaaggggtggaa

SEQ ID NO: 4822857 - DNA, 22 bp, Homo sapiens
aggacaaggggtggaagggcag

SEQ ID NO: 4822858 - DNA, 21 bp, Homo sapiens
aggacactgatgggtcctgct

SEQ ID NO: 4822859 - DNA, 19 bp, Homo sapiens
aggacagtgttcaaattct

SEQ ID NO: 4822860 - DNA, 16 bp, Homo sapiens
aggacatctctgtaaa

SEQ ID NO: 4822861 - DNA, 15 bp, Homo sapiens
aggaccaccctgcca

SEQ ID NO: 4822862 - DNA, 15 bp, Homo sapiens
aggaccaggagccag

SEQ ID NO: 4822863 - DNA, 16 bp, Homo sapiens
aggaccaggagccagg

SEQ ID NO: 4822864 - DNA, 17 bp, Homo sapiens
aggaccaggagccaggt

SEQ ID NO: 4822865 - DNA, 17 bp, Homo sapiens
aggaccccattctggga

SEQ ID NO: 4822866 - DNA, 21 bp, Homo sapiens
aggacccccccagtccgcccc

SEQ ID NO: 4822867 - DNA, 15 bp, Homo sapiens
aggacccctgccctc

SEQ ID NO: 4822868 - DNA, 14 bp, Homo sapiens
aggaccctcccagg

SEQ ID NO: 4822869 - DNA, 23 bp, Homo sapiens
aggaccctgggtcaccttcctgg

SEQ ID NO: 4822870 - DNA, 17 bp, Homo sapiens
aggaccgtggccctgcc

SEQ ID NO: 4822871 - DNA, 23 bp, Homo sapiens
aggaccgtggccctgccctctcc

SEQ ID NO: 4822872 - DNA, 16 bp, Homo sapiens
aggacctttctgagga

SEQ ID NO: 4822873 - DNA, 14 bp, Homo sapiens
aggacgcatgcagg

SEQ ID NO: 4822874 - DNA, 16 bp, Homo sapiens
aggacgcatgcagggc

SEQ ID NO: 4822875 - DNA, 11 bp, Homo sapiens
aggactacaga

SEQ ID NO: 4822876 - DNA, 15 bp, Homo sapiens
aggactacagaattg

SEQ ID NO: 4822877 - DNA, 16 bp, Homo sapiens
aggactacagaattgg

SEQ ID NO: 4822878 - DNA, 12 bp, Homo sapiens
aggactccaggg

SEQ ID NO: 4822879 - DNA, 14 bp, Homo sapiens
aggactgaagaaaa

SEQ ID NO: 4822880 - DNA, 22 bp, Homo sapiens
aggactgttggctgattggaaa

SEQ ID NO: 4822881 - DNA, 14 bp, Homo sapiens
aggagaaggaggaa

SEQ ID NO: 4822882 - DNA, 14 bp, Homo sapiens
aggagaaggcctgc

SEQ ID NO: 4822883 - DNA, 14 bp, Homo sapiens
aggagaggctgctg

SEQ ID NO: 4822884 - DNA, 16 bp, Homo sapiens
aggagattgctctggg

SEQ ID NO: 4822885 - DNA, 13 bp, Homo sapiens
aggagcacagcca

SEQ ID NO: 4822886 - DNA, 20 bp, Homo sapiens
aggagcacagccatagcaga

SEQ ID NO: 4822887 - DNA, 18 bp, Homo sapiens
aggagcacccccagcctc

SEQ ID NO: 4822888 - DNA, 21 bp, Homo sapiens
aggagcacccccagcctcccc

SEQ ID NO: 4822889 - DNA, 22 bp, Homo sapiens
aggagcacccccagcctccccc

SEQ ID NO: 4822890 - DNA, 19 bp, Homo sapiens
aggagccaggcaacttcag

SEQ ID NO: 4822891 - DNA, 16 bp, Homo sapiens
aggaggggaagctgca

SEQ ID NO: 4822892 - DNA, 19 bp, Homo sapiens
aggaggggagcaaggctgc

SEQ ID NO: 4822893 - DNA, 20 bp, Homo sapiens
aggaggggagcaaggctgct

SEQ ID NO: 4822894 - DNA, 15 bp, Homo sapiens
aggaggtctctaaga

SEQ ID NO: 4822895 - DNA, 17 bp, Homo sapiens
aggaggtgtggagtgga

SEQ ID NO: 4822896 - DNA, 21 bp, Homo sapiens
aggaggtgtggagtggagggg

SEQ ID NO: 4822897 - DNA, 16 bp, Homo sapiens
aggagtgatgggcaag

SEQ ID NO: 4822898 - DNA, 21 bp, Homo sapiens
aggagtgatgggcaaggggcc

SEQ ID NO: 4822899 - DNA, 23 bp, Homo sapiens
aggagtgatgggcaaggggccag

SEQ ID NO: 4822900 - DNA, 20 bp, Homo sapiens
aggataaattaatgagtttt

SEQ ID NO: 4822901 - DNA, 19 bp, Homo sapiens
aggataatgagatgtaata

SEQ ID NO: 4822902 - DNA, 13 bp, Homo sapiens
aggataccttcca

SEQ ID NO: 4822903 - DNA, 13 bp, Homo sapiens
aggatcctggcct

SEQ ID NO: 4822904 - DNA, 22 bp, Homo sapiens
aggatgaacatcttttaactgc

SEQ ID NO: 4822905 - DNA, 22 bp, Homo sapiens
aggatgaaggggccagaccacg

SEQ ID NO: 4822906 - DNA, 23 bp, Homo sapiens
aggatgacggtattatgcttctt

SEQ ID NO: 4822907 - DNA, 19 bp, Homo sapiens
aggatgcatgcagggcccc

SEQ ID NO: 4822908 - DNA, 19 bp, Homo sapiens
aggatgcccaaagatgcag

SEQ ID NO: 4822909 - DNA, 16 bp, Homo sapiens
aggatgtggatggagg

SEQ ID NO: 4822910 - DNA, 19 bp, Homo sapiens
aggattcttttttcaatgt

SEQ ID NO: 4822911 - DNA, 20 bp, Homo sapiens
aggattgtccacaaatgtcc

SEQ ID NO: 4822912 - DNA, 22 bp, Homo sapiens
aggattgtctgctgcctccaag

SEQ ID NO: 4822913 - DNA, 14 bp, Homo sapiens
aggatttctgctta

SEQ ID NO: 4822914 - DNA, 21 bp, Homo sapiens
aggcaaaccaatttgttctgt

SEQ ID NO: 4822915 - DNA, 11 bp, Homo sapiens
aggcaaatgtc

SEQ ID NO: 4822916 - DNA, 12 bp, Homo sapiens
aggcaaatgtcc

SEQ ID NO: 4822917 - DNA, 13 bp, Homo sapiens
aggcaaatgtcca

SEQ ID NO: 4822918 - DNA, 20 bp, Homo sapiens
aggcaacttttcatttttgc

SEQ ID NO: 4822919 - DNA, 16 bp, Homo sapiens
aggcaaggctgtcaat

SEQ ID NO: 4822920 - DNA, 19 bp, Homo sapiens
aggcaatagtgttgaggag

SEQ ID NO: 4822921 - DNA, 16 bp, Homo sapiens
aggcacacagcagccc

SEQ ID NO: 4822922 - DNA, 23 bp, Homo sapiens
aggcacacagcagccccccagca

SEQ ID NO: 4822923 - DNA, 19 bp, Homo sapiens
aggcacattgaaatacttg

SEQ ID NO: 4822924 - DNA, 21 bp, Homo sapiens
aggcaccgccagagtgtcctg

SEQ ID NO: 4822925 - DNA, 21 bp, Homo sapiens
aggcaccggacgctggagacc

SEQ ID NO: 4822926 - DNA, 13 bp, Homo sapiens
aggcactgagcgc

SEQ ID NO: 4822927 - DNA, 14 bp, Homo sapiens
aggcagaatggtgg

SEQ ID NO: 4822928 - DNA, 23 bp, Homo sapiens
aggcagactttctacatgcaaat

SEQ ID NO: 4822929 - DNA, 13 bp, Homo sapiens
aggcagagaagaa

SEQ ID NO: 4822930 - DNA, 23 bp, Homo sapiens
aggcagagattgggggggcttgg

SEQ ID NO: 4822931 - DNA, 14 bp, Homo sapiens
aggcagcaacagga

SEQ ID NO: 4822932 - DNA, 15 bp, Homo sapiens
aggcagcaacaggac

SEQ ID NO: 4822933 - DNA, 16 bp, Homo sapiens
aggcagcctgcagacc

SEQ ID NO: 4822934 - DNA, 17 bp, Homo sapiens
aggcagctgcctgctct

SEQ ID NO: 4822935 - DNA, 11 bp, Homo sapiens
aggcagggagg

SEQ ID NO: 4822936 - DNA, 22 bp, Homo sapiens
aggcagggaggaggcagagaag

SEQ ID NO: 4822937 - DNA, 14 bp, Homo sapiens
aggcagggccctgg

SEQ ID NO: 4822938 - DNA, 15 bp, Homo sapiens
aggcagtctttgctc

SEQ ID NO: 4822939 - DNA, 18 bp, Homo sapiens
aggcagttcaaagcagga

SEQ ID NO: 4822940 - DNA, 15 bp, Homo sapiens
aggcatgcctctgat

SEQ ID NO: 4822941 - DNA, 22 bp, Homo sapiens
aggcattgcactaaaagtgatg

SEQ ID NO: 4822942 - DNA, 14 bp, Homo sapiens
aggccaaaggaagc

SEQ ID NO: 4822943 - DNA, 16 bp, Homo sapiens
aggccaaaggaagcac

SEQ ID NO: 4822944 - DNA, 18 bp, Homo sapiens
aggccaaaggaagcacat

SEQ ID NO: 4822945 - DNA, 16 bp, Homo sapiens
aggccaaatattgatc

SEQ ID NO: 4822946 - DNA, 23 bp, Homo sapiens
aggccaaatattgatctgtatta

SEQ ID NO: 4822947 - DNA, 21 bp, Homo sapiens
aggccaagaaagaaaccagac

SEQ ID NO: 4822948 - DNA, 21 bp, Homo sapiens
aggccaagagtttgagaccaa

SEQ ID NO: 4822949 - DNA, 12 bp, Homo sapiens
aggccaccccca

SEQ ID NO: 4822950 - DNA, 12 bp, Homo sapiens
aggccagctgct

SEQ ID NO: 4822951 - DNA, 12 bp, Homo sapiens
aggccagggccg

SEQ ID NO: 4822952 - DNA, 19 bp, Homo sapiens
aggccagtactttgccatc

SEQ ID NO: 4822953 - DNA, 23 bp, Homo sapiens
aggccattcagtctatgctgtgt

SEQ ID NO: 4822954 - DNA, 13 bp, Homo sapiens
aggcccacaggag

SEQ ID NO: 4822955 - DNA, 16 bp, Homo sapiens
aggcccccacctctgt

SEQ ID NO: 4822956 - DNA, 20 bp, Homo sapiens
aggcccccacctctgtgacc

SEQ ID NO: 4822957 - DNA, 19 bp, Homo sapiens
aggcccccggaggcgccca

SEQ ID NO: 4822958 - DNA, 22 bp, Homo sapiens
aggcccccggaggcgcccacct

SEQ ID NO: 4822959 - DNA, 23 bp, Homo sapiens
aggccccttcccacgtccctcga

SEQ ID NO: 4822960 - DNA, 17 bp, Homo sapiens
aggcccgccctgcccgc

SEQ ID NO: 4822961 - DNA, 10 bp, Homo sapiens
aggccctccc

SEQ ID NO: 4822962 - DNA, 17 bp, Homo sapiens
aggccctccctgactcc

SEQ ID NO: 4822963 - DNA, 23 bp, Homo sapiens
aggccctccctgactccctgtgg

SEQ ID NO: 4822964 - DNA, 14 bp, Homo sapiens
aggccgcaagggga

SEQ ID NO: 4822965 - DNA, 14 bp, Homo sapiens
aggccggtgggaag

SEQ ID NO: 4822966 - DNA, 13 bp, Homo sapiens
aggccgtgtctct

SEQ ID NO: 4822967 - DNA, 14 bp, Homo sapiens
aggccgtgtctctg

SEQ ID NO: 4822968 - DNA, 16 bp, Homo sapiens
aggccgtgtctctgag

SEQ ID NO: 4822969 - DNA, 21 bp, Homo sapiens
aggcctcacctggcttcccag

SEQ ID NO: 4822970 - DNA, 22 bp, Homo sapiens
aggcctcacctggcttcccagg

SEQ ID NO: 4822971 - DNA, 23 bp, Homo sapiens
aggcctcacctggcttcccagga

SEQ ID NO: 4822972 - DNA, 18 bp, Homo sapiens
aggcctcagggaccaagg

SEQ ID NO: 4822973 - DNA, 13 bp, Homo sapiens
aggcctcccaagc

SEQ ID NO: 4822974 - DNA, 14 bp, Homo sapiens
aggcctcccaagct

SEQ ID NO: 4822975 - DNA, 21 bp, Homo sapiens
aggcctcccaagctgatggac

SEQ ID NO: 4822976 - DNA, 17 bp, Homo sapiens
aggcctcccgcatgctg

SEQ ID NO: 4822977 - DNA, 22 bp, Homo sapiens
aggcctcccgcatgctgcctgc

SEQ ID NO: 4822978 - DNA, 21 bp, Homo sapiens
aggcctgagggaagcccaccc

SEQ ID NO: 4822979 - DNA, 16 bp, Homo sapiens
aggcctggcccagcca

SEQ ID NO: 4822980 - DNA, 17 bp, Homo sapiens
aggcctggcccagccag

SEQ ID NO: 4822981 - DNA, 18 bp, Homo sapiens
aggcctggctctggagcc

SEQ ID NO: 4822982 - DNA, 19 bp, Homo sapiens
aggcctggctctggagccc

SEQ ID NO: 4822983 - DNA, 20 bp, Homo sapiens
aggcctgggagatgcagctg

SEQ ID NO: 4822984 - DNA, 23 bp, Homo sapiens
aggcctgggggctgggcagagga

SEQ ID NO: 4822985 - DNA, 12 bp, Homo sapiens
aggcctgggtgg

SEQ ID NO: 4822986 - DNA, 23 bp, Homo sapiens
aggcctgggtgtgacctgacacc

SEQ ID NO: 4822987 - DNA, 12 bp, Homo sapiens
aggcctggtctg

SEQ ID NO: 4822988 - DNA, 22 bp, Homo sapiens
aggcctggtctggagcccctat

SEQ ID NO: 4822989 - DNA, 23 bp, Homo sapiens
aggcctggtctggagcccctatc

SEQ ID NO: 4822990 - DNA, 17 bp, Homo sapiens
aggccttcctcctctca

SEQ ID NO: 4822991 - DNA, 18 bp, Homo sapiens
aggcgcccacctgcccag

SEQ ID NO: 4822992 - DNA, 23 bp, Homo sapiens
aggcgccgcctcgcccccgggcc

SEQ ID NO: 4822993 - DNA, 15 bp, Homo sapiens
aggcgcgcaccgccc

SEQ ID NO: 4822994 - DNA, 23 bp, Homo sapiens
aggcgtgggatccagagagaagc

SEQ ID NO: 4822995 - DNA, 15 bp, Homo sapiens
aggctaagaaagaaa

SEQ ID NO: 4822996 - DNA, 22 bp, Homo sapiens
aggctagtccggacccacctca

SEQ ID NO: 4822997 - DNA, 14 bp, Homo sapiens
aggctcaggctgcc

SEQ ID NO: 4822998 - DNA, 20 bp, Homo sapiens
aggctcccactgcccctgca

SEQ ID NO: 4822999 - DNA, 14 bp, Homo sapiens
aggctccccaagac

SEQ ID NO: 4823000 - DNA, 11 bp, Homo sapiens
aggctctcagg

SEQ ID NO: 4823001 - DNA, 14 bp, Homo sapiens
aggctctcaggcca

SEQ ID NO: 4823002 - DNA, 20 bp, Homo sapiens
aggctctcaggccagctgct

SEQ ID NO: 4823003 - DNA, 22 bp, Homo sapiens
aggctgactcttactaaccacc

SEQ ID NO: 4823004 - DNA, 16 bp, Homo sapiens
aggctgagacacagcc

SEQ ID NO: 4823005 - DNA, 17 bp, Homo sapiens
aggctgagttttctctt

SEQ ID NO: 4823006 - DNA, 22 bp, Homo sapiens
aggctgatgccgtgcgggctaa

SEQ ID NO: 4823007 - DNA, 11 bp, Homo sapiens
aggctgcccag

SEQ ID NO: 4823008 - DNA, 21 bp, Homo sapiens
aggctgcccagcggctcttcc

SEQ ID NO: 4823009 - DNA, 22 bp, Homo sapiens
aggctgccccaggggcactgtg

SEQ ID NO: 4823010 - DNA, 18 bp, Homo sapiens
aggctgccgctgctctcc

SEQ ID NO: 4823011 - DNA, 22 bp, Homo sapiens
aggctgccgctgctctcccagg

SEQ ID NO: 4823012 - DNA, 14 bp, Homo sapiens
aggctgcgcctgcc

SEQ ID NO: 4823013 - DNA, 18 bp, Homo sapiens
aggctgctaagtggaaga

SEQ ID NO: 4823014 - DNA, 24 bp, Homo sapiens
aggctgctaagtggaagacagaga

SEQ ID NO: 4823015 - DNA, 13 bp, Homo sapiens
aggctgctgtcac

SEQ ID NO: 4823016 - DNA, 17 bp, Homo sapiens
aggctggaccaactgct

SEQ ID NO: 4823017 - DNA, 20 bp, Homo sapiens
aggctggataggagaggaaa

SEQ ID NO: 4823018 - DNA, 18 bp, Homo sapiens
aggctggatgtgctttca

SEQ ID NO: 4823019 - DNA, 18 bp, Homo sapiens
aggctggcggggtctgct

SEQ ID NO: 4823020 - DNA, 15 bp, Homo sapiens
aggctggggacacag

SEQ ID NO: 4823021 - DNA, 22 bp, Homo sapiens
aggctggggacacaggatcctg

SEQ ID NO: 4823022 - DNA, 12 bp, Homo sapiens
aggctgtcaatt

SEQ ID NO: 4823023 - DNA, 17 bp, Homo sapiens
aggcttccagctcagtc

SEQ ID NO: 4823024 - DNA, 22 bp, Homo sapiens
aggctttattcttccaagttca

SEQ ID NO: 4823025 - DNA, 11 bp, Homo sapiens
agggaaacctt

SEQ ID NO: 4823026 - DNA, 23 bp, Homo sapiens
agggaaatcaatttaaaggaaag

SEQ ID NO: 4823027 - DNA, 14 bp, Homo sapiens
agggaaatccaact

SEQ ID NO: 4823028 - DNA, 19 bp, Homo sapiens
agggaaatccaactccagg

SEQ ID NO: 4823029 - DNA, 15 bp, Homo sapiens
agggaaatgctgttg

SEQ ID NO: 4823030 - DNA, 16 bp, Homo sapiens
agggaacaaattttca

SEQ ID NO: 4823031 - DNA, 19 bp, Homo sapiens
agggaagcactgcctccct

SEQ ID NO: 4823032 - DNA, 15 bp, Homo sapiens
agggaagcagtgcgt

SEQ ID NO: 4823033 - DNA, 17 bp, Homo sapiens
agggaagcccacccgcc

SEQ ID NO: 4823034 - DNA, 18 bp, Homo sapiens
agggaagcccacccgccc

SEQ ID NO: 4823035 - DNA, 20 bp, Homo sapiens
agggaagcccacccgcccca

SEQ ID NO: 4823036 - DNA, 22 bp, Homo sapiens
agggaagcccacccgccccaga

SEQ ID NO: 4823037 - DNA, 23 bp, Homo sapiens
agggaagcccacccgccccagag

SEQ ID NO: 4823038 - DNA, 13 bp, Homo sapiens
agggaagctgata

SEQ ID NO: 4823039 - DNA, 20 bp, Homo sapiens
agggaatccatatcagctct

SEQ ID NO: 4823040 - DNA, 21 bp, Homo sapiens
agggaatccatatcagctctg

SEQ ID NO: 4823041 - DNA, 23 bp, Homo sapiens
agggacagttgggtgtgagaata

SEQ ID NO: 4823042 - DNA, 23 bp, Homo sapiens
agggaccccagatacctgtgagg

SEQ ID NO: 4823043 - DNA, 15 bp, Homo sapiens
agggaccctccacca

SEQ ID NO: 4823044 - DNA, 15 bp, Homo sapiens
agggacgagcagagc

SEQ ID NO: 4823045 - DNA, 22 bp, Homo sapiens
agggactccaagccctggggca

SEQ ID NO: 4823046 - DNA, 19 bp, Homo sapiens
agggactccagaagcagca

SEQ ID NO: 4823047 - DNA, 18 bp, Homo sapiens
agggactgcctctgccac

SEQ ID NO: 4823048 - DNA, 19 bp, Homo sapiens
agggagggaaacccgggga

SEQ ID NO: 4823049 - DNA, 14 bp, Homo sapiens
agggatccagagac

SEQ ID NO: 4823050 - DNA, 20 bp, Homo sapiens
agggatccagagacctgctc

SEQ ID NO: 4823051 - DNA, 22 bp, Homo sapiens
agggatccagagacctgctcca

SEQ ID NO: 4823052 - DNA, 22 bp, Homo sapiens
agggatgaaatgccaagactct

SEQ ID NO: 4823053 - DNA, 23 bp, Homo sapiens
agggatgctatctcgctagccat

SEQ ID NO: 4823054 - DNA, 20 bp, Homo sapiens
agggatgggggatgggccag

SEQ ID NO: 4823055 - DNA, 12 bp, Homo sapiens
agggatgtattt

SEQ ID NO: 4823056 - DNA, 14 bp, Homo sapiens
agggatgtatttgt

SEQ ID NO: 4823057 - DNA, 18 bp, Homo sapiens
agggcaaaccaggctgca

SEQ ID NO: 4823058 - DNA, 23 bp, Homo sapiens
agggcaaatgacatgcactgacc

SEQ ID NO: 4823059 - DNA, 23 bp, Homo sapiens
agggcagaaccaagaacataaac

SEQ ID NO: 4823060 - DNA, 15 bp, Homo sapiens
agggcagcccctccc

SEQ ID NO: 4823061 - DNA, 19 bp, Homo sapiens
agggcaggaagacttccag

SEQ ID NO: 4823062 - DNA, 18 bp, Homo sapiens
agggcagggttctagaag

SEQ ID NO: 4823063 - DNA, 19 bp, Homo sapiens
agggcagggttctagaagg

SEQ ID NO: 4823064 - DNA, 22 bp, Homo sapiens
agggcagggttctagaaggggc

SEQ ID NO: 4823065 - DNA, 12 bp, Homo sapiens
agggcccaggag

SEQ ID NO: 4823066 - DNA, 17 bp, Homo sapiens
agggcccccacaggagc

SEQ ID NO: 4823067 - DNA, 18 bp, Homo sapiens
agggcccccggctcggcc

SEQ ID NO: 4823068 - DNA, 18 bp, Homo sapiens
agggccctgctcaggcct

SEQ ID NO: 4823069 - DNA, 22 bp, Homo sapiens
agggccctggggtctctgagca

SEQ ID NO: 4823070 - DNA, 23 bp, Homo sapiens
agggccctggggtctctgagcag

SEQ ID NO: 4823071 - DNA, 20 bp, Homo sapiens
agggcccttcccaacctccc

SEQ ID NO: 4823072 - DNA, 16 bp, Homo sapiens
agggccgcagggcgct

SEQ ID NO: 4823073 - DNA, 15 bp, Homo sapiens
agggcctctggacag

SEQ ID NO: 4823074 - DNA, 19 bp, Homo sapiens
agggcgcaggaaccgagga

SEQ ID NO: 4823075 - DNA, 16 bp, Homo sapiens
agggcgctccggcaga

SEQ ID NO: 4823076 - DNA, 23 bp, Homo sapiens
agggcgctccggcagaggcaggg

SEQ ID NO: 4823077 - DNA, 15 bp, Homo sapiens
agggcgggccaggag

SEQ ID NO: 4823078 - DNA, 14 bp, Homo sapiens
agggctgacaaggc

SEQ ID NO: 4823079 - DNA, 15 bp, Homo sapiens
agggctgacctgcct

SEQ ID NO: 4823080 - DNA, 17 bp, Homo sapiens
agggctgacctgcctct

SEQ ID NO: 4823081 - DNA, 19 bp, Homo sapiens
agggctgacctgcctctca

SEQ ID NO: 4823082 - DNA, 20 bp, Homo sapiens
aggggaagagagaggcctgg

SEQ ID NO: 4823083 - DNA, 12 bp, Homo sapiens
aggggaagctgc

SEQ ID NO: 4823084 - DNA, 14 bp, Homo sapiens
aggggaagctgcag

SEQ ID NO: 4823085 - DNA, 15 bp, Homo sapiens
aggggaagctgcagc

SEQ ID NO: 4823086 - DNA, 22 bp, Homo sapiens
aggggaggtggccagcccgcag

SEQ ID NO: 4823087 - DNA, 20 bp, Homo sapiens
aggggatctaaaaggaggac

SEQ ID NO: 4823088 - DNA, 13 bp, Homo sapiens
aggggcaggtgaa

SEQ ID NO: 4823089 - DNA, 16 bp, Homo sapiens
aggggccagaccacgc

SEQ ID NO: 4823090 - DNA, 19 bp, Homo sapiens
aggggccaggaaggggaca

SEQ ID NO: 4823091 - DNA, 14 bp, Homo sapiens
aggggcccctcctc

SEQ ID NO: 4823092 - DNA, 18 bp, Homo sapiens
aggggcccctcctccaga

SEQ ID NO: 4823093 - DNA, 15 bp, Homo sapiens
aggggccctgtcact

SEQ ID NO: 4823094 - DNA, 23 bp, Homo sapiens
aggggccctgtcactgtccagag

SEQ ID NO: 4823095 - DNA, 13 bp, Homo sapiens
aggggcctgggct

SEQ ID NO: 4823096 - DNA, 14 bp, Homo sapiens
aggggcctgggctg

SEQ ID NO: 4823097 - DNA, 15 bp, Homo sapiens
aggggcctgggctgt

SEQ ID NO: 4823098 - DNA, 18 bp, Homo sapiens
aggggcctgggctgtgag

SEQ ID NO: 4823099 - DNA, 20 bp, Homo sapiens
aggggcgctgcccccacaga

SEQ ID NO: 4823100 - DNA, 19 bp, Homo sapiens
aggggctgcagccccctgc

SEQ ID NO: 4823101 - DNA, 20 bp, Homo sapiens
aggggctgcagccccctgct

SEQ ID NO: 4823102 - DNA, 21 bp, Homo sapiens
aggggctgcagccccctgctt

SEQ ID NO: 4823103 - DNA, 19 bp, Homo sapiens
aggggctgcatcctcagcc

SEQ ID NO: 4823104 - DNA, 15 bp, Homo sapiens
aggggcttggagcag

SEQ ID NO: 4823105 - DNA, 19 bp, Homo sapiens
agggggaagatgccaaggg

SEQ ID NO: 4823106 - DNA, 21 bp, Homo sapiens
aggggggttgggttccagaca

SEQ ID NO: 4823107 - DNA, 21 bp, Homo sapiens
agggggtcagttgggccccca

SEQ ID NO: 4823108 - DNA, 13 bp, Homo sapiens
aggggtcagcagg

SEQ ID NO: 4823109 - DNA, 15 bp, Homo sapiens
aggggtggaagggca

SEQ ID NO: 4823110 - DNA, 20 bp, Homo sapiens
aggggtggaagggcaggagc

SEQ ID NO: 4823111 - DNA, 23 bp, Homo sapiens
aggggtggaagggcaggagctca

SEQ ID NO: 4823112 - DNA, 17 bp, Homo sapiens
aggggtgggggagaatg

SEQ ID NO: 4823113 - DNA, 12 bp, Homo sapiens
agggtccagccc

SEQ ID NO: 4823114 - DNA, 19 bp, Homo sapiens
agggtccctaattctcttc

SEQ ID NO: 4823115 - DNA, 18 bp, Homo sapiens
agggtcctgggggctgct

SEQ ID NO: 4823116 - DNA, 16 bp, Homo sapiens
agggtctgtcccgggt

SEQ ID NO: 4823117 - DNA, 13 bp, Homo sapiens
agggtgaggcgtg

SEQ ID NO: 4823118 - DNA, 14 bp, Homo sapiens
agggtgaggcgtgg

SEQ ID NO: 4823119 - DNA, 18 bp, Homo sapiens
agggtgcaggcgcgcacc

SEQ ID NO: 4823120 - DNA, 13 bp, Homo sapiens
agggtggcaccca

SEQ ID NO: 4823121 - DNA, 14 bp, Homo sapiens
agggtgtggcttgg

SEQ ID NO: 4823122 - DNA, 17 bp, Homo sapiens
agggtgtgggtgccctg

SEQ ID NO: 4823123 - DNA, 19 bp, Homo sapiens
agggtgtgggtgccctgtt

SEQ ID NO: 4823124 - DNA, 20 bp, Homo sapiens
agggttccagacagggtggg

SEQ ID NO: 4823125 - DNA, 22 bp, Homo sapiens
agggttctagaaggggcgaggc

SEQ ID NO: 4823126 - DNA, 18 bp, Homo sapiens
agggttctatatttactg

SEQ ID NO: 4823127 - DNA, 19 bp, Homo sapiens
agggtttagccgggcccca

SEQ ID NO: 4823128 - DNA, 14 bp, Homo sapiens
aggtaatggatatg

SEQ ID NO: 4823129 - DNA, 22 bp, Homo sapiens
aggtacgaaaagaggggaagag

SEQ ID NO: 4823130 - DNA, 21 bp, Homo sapiens
aggtacggtgagactctgagg

SEQ ID NO: 4823131 - DNA, 16 bp, Homo sapiens
aggtcagagcccagga

SEQ ID NO: 4823132 - DNA, 12 bp, Homo sapiens
aggtcaggccct

SEQ ID NO: 4823133 - DNA, 14 bp, Homo sapiens
aggtcatctgtaaa

SEQ ID NO: 4823134 - DNA, 16 bp, Homo sapiens
aggtcatctgtaaaat

SEQ ID NO: 4823135 - DNA, 20 bp, Homo sapiens
aggtcatctgtaaaatagtc

SEQ ID NO: 4823136 - DNA, 21 bp, Homo sapiens
aggtccaccccgttgttgtcc

SEQ ID NO: 4823137 - DNA, 22 bp, Homo sapiens
aggtcccctggcccttccttca

SEQ ID NO: 4823138 - DNA, 23 bp, Homo sapiens
aggtcccctggcccttccttcac

SEQ ID NO: 4823139 - DNA, 15 bp, Homo sapiens
aggtcctgcccatgt

SEQ ID NO: 4823140 - DNA, 21 bp, Homo sapiens
aggtcctgtcctggctcccag

SEQ ID NO: 4823141 - DNA, 22 bp, Homo sapiens
aggtcctgtcctggctcccagg

SEQ ID NO: 4823142 - DNA, 13 bp, Homo sapiens
aggtctccacccc

SEQ ID NO: 4823143 - DNA, 12 bp, Homo sapiens
aggtctcccaca

SEQ ID NO: 4823144 - DNA, 13 bp, Homo sapiens
aggtctgttgaag

SEQ ID NO: 4823145 - DNA, 21 bp, Homo sapiens
aggtctgttgaagtgcatgtt

SEQ ID NO: 4823146 - DNA, 18 bp, Homo sapiens
aggtcttgagtttcattt

SEQ ID NO: 4823147 - DNA, 21 bp, Homo sapiens
aggtcttgagtttcatttttc

SEQ ID NO: 4823148 - DNA, 11 bp, Homo sapiens
aggtgaataac

SEQ ID NO: 4823149 - DNA, 20 bp, Homo sapiens
aggtgcacctgccccaggct

SEQ ID NO: 4823150 - DNA, 22 bp, Homo sapiens
aggtgcatgccttcataaatta

SEQ ID NO: 4823151 - DNA, 16 bp, Homo sapiens
aggtgcccagtcttga

SEQ ID NO: 4823152 - DNA, 18 bp, Homo sapiens
aggtgcccagtcttgagt

SEQ ID NO: 4823153 - DNA, 18 bp, Homo sapiens
aggtgcctcaagagaagg

SEQ ID NO: 4823154 - DNA, 23 bp, Homo sapiens
aggtgcctcccagccctgcccag

SEQ ID NO: 4823155 - DNA, 17 bp, Homo sapiens
aggtgctcttctcattt

SEQ ID NO: 4823156 - DNA, 22 bp, Homo sapiens
aggtggatactggggggcaggc

SEQ ID NO: 4823157 - DNA, 15 bp, Homo sapiens
aggtggattcatgtc

SEQ ID NO: 4823158 - DNA, 15 bp, Homo sapiens
aggtggcatttgcag

SEQ ID NO: 4823159 - DNA, 16 bp, Homo sapiens
aggtggcatttgcagg

SEQ ID NO: 4823160 - DNA, 21 bp, Homo sapiens
aggtggggagggcctctggac

SEQ ID NO: 4823161 - DNA, 19 bp, Homo sapiens
aggtggggtgctggggctg

SEQ ID NO: 4823162 - DNA, 20 bp, Homo sapiens
aggtggggtgctggggctgc

SEQ ID NO: 4823163 - DNA, 13 bp, Homo sapiens
aggtgggtcttgg

SEQ ID NO: 4823164 - DNA, 17 bp, Homo sapiens
aggtggtcttggagagg

SEQ ID NO: 4823165 - DNA, 20 bp, Homo sapiens
aggtggtcttggagaggagg

SEQ ID NO: 4823166 - DNA, 21 bp, Homo sapiens
aggtggtcttggagaggaggt

SEQ ID NO: 4823167 - DNA, 14 bp, Homo sapiens
aggtgtaaatatag

SEQ ID NO: 4823168 - DNA, 17 bp, Homo sapiens
aggtgtgggccagagat

SEQ ID NO: 4823169 - DNA, 14 bp, Homo sapiens
aggtgttgtccgtg

SEQ ID NO: 4823170 - DNA, 13 bp, Homo sapiens
aggttaaggggat

SEQ ID NO: 4823171 - DNA, 19 bp, Homo sapiens
aggttaaggggatctaaaa

SEQ ID NO: 4823172 - DNA, 12 bp, Homo sapiens
aggttaagtctc

SEQ ID NO: 4823173 - DNA, 20 bp, Homo sapiens
aggttagaaataatgtcaaa

SEQ ID NO: 4823174 - DNA, 23 bp, Homo sapiens
aggttagaaataatgtcaaaaat

SEQ ID NO: 4823175 - DNA, 15 bp, Homo sapiens
aggttcacccagcgc

SEQ ID NO: 4823176 - DNA, 14 bp, Homo sapiens
aggttctatgatat

SEQ ID NO: 4823177 - DNA, 16 bp, Homo sapiens
aggttctatgatatac

SEQ ID NO: 4823178 - DNA, 19 bp, Homo sapiens
aggttcttcatccctttcc

SEQ ID NO: 4823179 - DNA, 13 bp, Homo sapiens
aggttcttgctgc

SEQ ID NO: 4823180 - DNA, 18 bp, Homo sapiens
aggttgagctatgatatg

SEQ ID NO: 4823181 - DNA, 20 bp, Homo sapiens
aggtttaagtagatttcatg

SEQ ID NO: 4823182 - DNA, 22 bp, Homo sapiens
aggtttagaatcaagtctgtga

SEQ ID NO: 4823183 - DNA, 20 bp, Homo sapiens
aggtttcactgtgttggcca

SEQ ID NO: 4823184 - DNA, 13 bp, Homo sapiens
aggtttcagcatt

SEQ ID NO: 4823185 - DNA, 11 bp, Homo sapiens
aggttttcctg

SEQ ID NO: 4823186 - DNA, 21 bp, Homo sapiens
agtaaaacagatttgttcatt

SEQ ID NO: 4823187 - DNA, 18 bp, Homo sapiens
agtaaaattatactgtgt

SEQ ID NO: 4823188 - DNA, 21 bp, Homo sapiens
agtaaaattatactgtgtgtg

SEQ ID NO: 4823189 - DNA, 23 bp, Homo sapiens
agtaaaattatctgttctatgga

SEQ ID NO: 4823190 - DNA, 14 bp, Homo sapiens
agtaaatatacact

SEQ ID NO: 4823191 - DNA, 15 bp, Homo sapiens
agtaaatatacactt

SEQ ID NO: 4823192 - DNA, 16 bp, Homo sapiens
agtaaatctatctcta

SEQ ID NO: 4823193 - DNA, 13 bp, Homo sapiens
agtaaatgtcttc

SEQ ID NO: 4823194 - DNA, 19 bp, Homo sapiens
agtaaattcctaattctat

SEQ ID NO: 4823195 - DNA, 20 bp, Homo sapiens
agtaacctctacaggcattt

SEQ ID NO: 4823196 - DNA, 18 bp, Homo sapiens
agtaagcacctttagaat

SEQ ID NO: 4823197 - DNA, 20 bp, Homo sapiens
agtaagcacctttagaatat

SEQ ID NO: 4823198 - DNA, 19 bp, Homo sapiens
agtaagttctgaaaactgt

SEQ ID NO: 4823199 - DNA, 20 bp, Homo sapiens
agtaagttctgaaaactgtt

SEQ ID NO: 4823200 - DNA, 15 bp, Homo sapiens
agtaataactgttag

SEQ ID NO: 4823201 - DNA, 23 bp, Homo sapiens
agtaatctgtataatactttgta

SEQ ID NO: 4823202 - DNA, 13 bp, Homo sapiens
agtaattaaaaag

SEQ ID NO: 4823203 - DNA, 15 bp, Homo sapiens
agtaattgttacaat

SEQ ID NO: 4823204 - DNA, 17 bp, Homo sapiens
agtaattgttacaattt

SEQ ID NO: 4823205 - DNA, 14 bp, Homo sapiens
agtacatcttgtgc

SEQ ID NO: 4823206 - DNA, 13 bp, Homo sapiens
agtacatgcagaa

SEQ ID NO: 4823207 - DNA, 15 bp, Homo sapiens
agtaccatcccactg

SEQ ID NO: 4823208 - DNA, 18 bp, Homo sapiens
agtaccatcccactgata

SEQ ID NO: 4823209 - DNA, 19 bp, Homo sapiens
agtactagagatattttgt

SEQ ID NO: 4823210 - DNA, 16 bp, Homo sapiens
agtactagcaataagt

SEQ ID NO: 4823211 - DNA, 14 bp, Homo sapiens
agtactataattta

SEQ ID NO: 4823212 - DNA, 15 bp, Homo sapiens
agtactggagaaaat

SEQ ID NO: 4823213 - DNA, 20 bp, Homo sapiens
agtactggtaagattgttat

SEQ ID NO: 4823214 - DNA, 13 bp, Homo sapiens
agtagaatctcag

SEQ ID NO: 4823215 - DNA, 20 bp, Homo sapiens
agtagctccgcgtgtctcat

SEQ ID NO: 4823216 - DNA, 14 bp, Homo sapiens
agtagctgataaag

SEQ ID NO: 4823217 - DNA, 16 bp, Homo sapiens
agtagctgataaagaa

SEQ ID NO: 4823218 - DNA, 15 bp, Homo sapiens
agtaggtctgcacac

SEQ ID NO: 4823219 - DNA, 17 bp, Homo sapiens
agtagtacttaatagta

SEQ ID NO: 4823220 - DNA, 18 bp, Homo sapiens
agtagtacttcttctgta

SEQ ID NO: 4823221 - DNA, 21 bp, Homo sapiens
agtagtacttcttctgtaata

SEQ ID NO: 4823222 - DNA, 22 bp, Homo sapiens
agtagtacttcttctgtaatat

SEQ ID NO: 4823223 - DNA, 23 bp, Homo sapiens
agtagtgccaaaaggccccttcc

SEQ ID NO: 4823224 - DNA, 13 bp, Homo sapiens
agtagtgtgagtg

SEQ ID NO: 4823225 - DNA, 23 bp, Homo sapiens
agtagtgttgggtggaggatgga

SEQ ID NO: 4823226 - DNA, 17 bp, Homo sapiens
agtataactaatttgct

SEQ ID NO: 4823227 - DNA, 23 bp, Homo sapiens
agtataactaatttgctctgtgg

SEQ ID NO: 4823228 - DNA, 21 bp, Homo sapiens
agtataatattaaggcttact

SEQ ID NO: 4823229 - DNA, 22 bp, Homo sapiens
agtatacacatcataaacaaag

SEQ ID NO: 4823230 - DNA, 23 bp, Homo sapiens
agtatagataaatccaatagtct

SEQ ID NO: 4823231 - DNA, 19 bp, Homo sapiens
agtatatagccttaagtct

SEQ ID NO: 4823232 - DNA, 20 bp, Homo sapiens
agtatattttatttcaatgt

SEQ ID NO: 4823233 - DNA, 18 bp, Homo sapiens
agtatcagagatgtccat

SEQ ID NO: 4823234 - DNA, 23 bp, Homo sapiens
agtatcagagatgtccattttta

SEQ ID NO: 4823235 - DNA, 21 bp, Homo sapiens
agtatctcatcaacaaagaaa

SEQ ID NO: 4823236 - DNA, 15 bp, Homo sapiens
agtatcttgaagact

SEQ ID NO: 4823237 - DNA, 16 bp, Homo sapiens
agtatgcaagaagaat

SEQ ID NO: 4823238 - DNA, 19 bp, Homo sapiens
agtatgcaagaagaatata

SEQ ID NO: 4823239 - DNA, 18 bp, Homo sapiens
agtatgcactatatacat

SEQ ID NO: 4823240 - DNA, 21 bp, Homo sapiens
agtatgtcagtccaataaatt

SEQ ID NO: 4823241 - DNA, 22 bp, Homo sapiens
agtatgtcagtccaataaatta

SEQ ID NO: 4823242 - DNA, 11 bp, Homo sapiens
agtatgtgtat

SEQ ID NO: 4823243 - DNA, 17 bp, Homo sapiens
agtattactaaattgac

SEQ ID NO: 4823244 - DNA, 21 bp, Homo sapiens
agtattactaaattgaccttt

SEQ ID NO: 4823245 - DNA, 14 bp, Homo sapiens
agtattatttagta

SEQ ID NO: 4823246 - DNA, 21 bp, Homo sapiens
agtattccaccttaaattaaa

SEQ ID NO: 4823247 - DNA, 22 bp, Homo sapiens
agtattccaccttaaattaaac

SEQ ID NO: 4823248 - DNA, 17 bp, Homo sapiens
agtattccttggcccag

SEQ ID NO: 4823249 - DNA, 18 bp, Homo sapiens
agtattccttggcccagc

SEQ ID NO: 4823250 - DNA, 21 bp, Homo sapiens
agtattccttggcccagcagc

SEQ ID NO: 4823251 - DNA, 12 bp, Homo sapiens
agtattctgtag

SEQ ID NO: 4823252 - DNA, 18 bp, Homo sapiens
agtattgacttctttttg

SEQ ID NO: 4823253 - DNA, 19 bp, Homo sapiens
agtattgagacactgtcaa

SEQ ID NO: 4823254 - DNA, 23 bp, Homo sapiens
agtattgttcttgtaaaactgtg

SEQ ID NO: 4823255 - DNA, 17 bp, Homo sapiens
agtatttcagatgcttt

SEQ ID NO: 4823256 - DNA, 16 bp, Homo sapiens
agtattttatctgtgt

SEQ ID NO: 4823257 - DNA, 13 bp, Homo sapiens
agtattttgagcc

SEQ ID NO: 4823258 - DNA, 16 bp, Homo sapiens
agtcaaaataatctga

SEQ ID NO: 4823259 - DNA, 19 bp, Homo sapiens
agtcaagacggatccacag

SEQ ID NO: 4823260 - DNA, 21 bp, Homo sapiens
agtcaagacggatccacagta

SEQ ID NO: 4823261 - DNA, 15 bp, Homo sapiens
agtcaagtgtgcctg

SEQ ID NO: 4823262 - DNA, 18 bp, Homo sapiens
agtcaagtgtgcctgcta

SEQ ID NO: 4823263 - DNA, 15 bp, Homo sapiens
agtcaatcaaacagg

SEQ ID NO: 4823264 - DNA, 20 bp, Homo sapiens
agtcaccttccaggacccct

SEQ ID NO: 4823265 - DNA, 21 bp, Homo sapiens
agtcagaagatctttcttaat

SEQ ID NO: 4823266 - DNA, 21 bp, Homo sapiens
agtcagatgtttgagcagtgg

SEQ ID NO: 4823267 - DNA, 13 bp, Homo sapiens
agtcagcacagag

SEQ ID NO: 4823268 - DNA, 12 bp, Homo sapiens
agtcagccagct

SEQ ID NO: 4823269 - DNA, 19 bp, Homo sapiens
agtcagctccgagtggctc

SEQ ID NO: 4823270 - DNA, 14 bp, Homo sapiens
agtcaggagccagc

SEQ ID NO: 4823271 - DNA, 16 bp, Homo sapiens
agtcaggagccagcag

SEQ ID NO: 4823272 - DNA, 14 bp, Homo sapiens
agtcagggcccaga

SEQ ID NO: 4823273 - DNA, 20 bp, Homo sapiens
agtcagggcccagaggctga

SEQ ID NO: 4823274 - DNA, 15 bp, Homo sapiens
agtcatatgtgaaga

SEQ ID NO: 4823275 - DNA, 16 bp, Homo sapiens
agtcatctcaaacact

SEQ ID NO: 4823276 - DNA, 22 bp, Homo sapiens
agtcatctcaaacactgcttaa

SEQ ID NO: 4823277 - DNA, 18 bp, Homo sapiens
agtcattaaattactata

SEQ ID NO: 4823278 - DNA, 23 bp, Homo sapiens
agtcattaaattactatagcaaa

SEQ ID NO: 4823279 - DNA, 14 bp, Homo sapiens
agtccaattttcct

SEQ ID NO: 4823280 - DNA, 15 bp, Homo sapiens
agtccactttcctct

SEQ ID NO: 4823281 - DNA, 15 bp, Homo sapiens
agtccatgtgataat

SEQ ID NO: 4823282 - DNA, 15 bp, Homo sapiens
agtccatttttgagt

SEQ ID NO: 4823283 - DNA, 19 bp, Homo sapiens
agtccatttttgagtaaaa

SEQ ID NO: 4823284 - DNA, 13 bp, Homo sapiens
agtcccacagccc

SEQ ID NO: 4823285 - DNA, 21 bp, Homo sapiens
agtcccacagccccttgcttc

SEQ ID NO: 4823286 - DNA, 21 bp, Homo sapiens
agtcccccctcccacctccag

SEQ ID NO: 4823287 - DNA, 18 bp, Homo sapiens
agtcccgaggcagcaaca

SEQ ID NO: 4823288 - DNA, 18 bp, Homo sapiens
agtccctccctcctggct

SEQ ID NO: 4823289 - DNA, 20 bp, Homo sapiens
agtccctccctcctggctca

SEQ ID NO: 4823290 - DNA, 17 bp, Homo sapiens
agtcccttcctgtcctg

SEQ ID NO: 4823291 - DNA, 20 bp, Homo sapiens
agtcccttcctgtcctgctc

SEQ ID NO: 4823292 - DNA, 22 bp, Homo sapiens
agtcccttcctgtcctgctcac

SEQ ID NO: 4823293 - DNA, 16 bp, Homo sapiens
agtccgaggcctggct

SEQ ID NO: 4823294 - DNA, 21 bp, Homo sapiens
agtccgaggcctggctctgga

SEQ ID NO: 4823295 - DNA, 21 bp, Homo sapiens
agtccgccccgtgctcctctg

SEQ ID NO: 4823296 - DNA, 14 bp, Homo sapiens
agtccggtgccttc

SEQ ID NO: 4823297 - DNA, 15 bp, Homo sapiens
agtccggtgccttcc

SEQ ID NO: 4823298 - DNA, 16 bp, Homo sapiens
agtccggtgccttcca

SEQ ID NO: 4823299 - DNA, 21 bp, Homo sapiens
agtccggtgccttccaccctg

SEQ ID NO: 4823300 - DNA, 21 bp, Homo sapiens
agtcctggcatgggaatgaat

SEQ ID NO: 4823301 - DNA, 19 bp, Homo sapiens
agtcctgggattacaggtg

SEQ ID NO: 4823302 - DNA, 17 bp, Homo sapiens
agtcgatattcccaggg

SEQ ID NO: 4823303 - DNA, 14 bp, Homo sapiens
agtcggctgggcag

SEQ ID NO: 4823304 - DNA, 20 bp, Homo sapiens
agtcggctgggcagggccgc

SEQ ID NO: 4823305 - DNA, 12 bp, Homo sapiens
agtctacactgc

SEQ ID NO: 4823306 - DNA, 19 bp, Homo sapiens
agtctatctggtattaaat

SEQ ID NO: 4823307 - DNA, 23 bp, Homo sapiens
agtctatctggtattaaatgcca

SEQ ID NO: 4823308 - DNA, 13 bp, Homo sapiens
agtctattgtctc

SEQ ID NO: 4823309 - DNA, 17 bp, Homo sapiens
agtctcaatgttccatt

SEQ ID NO: 4823310 - DNA, 15 bp, Homo sapiens
agtctcattgccaag

SEQ ID NO: 4823311 - DNA, 22 bp, Homo sapiens
agtctccacgtgtttcgggcca

SEQ ID NO: 4823312 - DNA, 18 bp, Homo sapiens
agtctcctcactgccact

SEQ ID NO: 4823313 - DNA, 16 bp, Homo sapiens
agtctgaaggagagga

SEQ ID NO: 4823314 - DNA, 18 bp, Homo sapiens
agtctgaagtttcattta

SEQ ID NO: 4823315 - DNA, 19 bp, Homo sapiens
agtctgagtagttatgaat

SEQ ID NO: 4823316 - DNA, 22 bp, Homo sapiens
agtctgcagctattcacacaca

SEQ ID NO: 4823317 - DNA, 23 bp, Homo sapiens
agtctgcagctattcacacacac

SEQ ID NO: 4823318 - DNA, 18 bp, Homo sapiens
agtctgtacttcagttct

SEQ ID NO: 4823319 - DNA, 22 bp, Homo sapiens
agtctgtacttcagttctcatc

SEQ ID NO: 4823320 - DNA, 19 bp, Homo sapiens
agtctgtgaataaagccac

SEQ ID NO: 4823321 - DNA, 16 bp, Homo sapiens
agtctgtgcctcagtg

SEQ ID NO: 4823322 - DNA, 15 bp, Homo sapiens
agtcttactgttttg

SEQ ID NO: 4823323 - DNA, 19 bp, Homo sapiens
agtcttactgttttgtgcg

SEQ ID NO: 4823324 - DNA, 16 bp, Homo sapiens
agtcttgttgttcata

SEQ ID NO: 4823325 - DNA, 18 bp, Homo sapiens
agtctttagctattactg

SEQ ID NO: 4823326 - DNA, 16 bp, Homo sapiens
agtctttgctcagtgg

SEQ ID NO: 4823327 - DNA, 11 bp, Homo sapiens
agtcttttgtc

SEQ ID NO: 4823328 - DNA, 19 bp, Homo sapiens
agtgaaaaagacttcaaat

SEQ ID NO: 4823329 - DNA, 15 bp, Homo sapiens
agtgaagcccaggag

SEQ ID NO: 4823330 - DNA, 17 bp, Homo sapiens
agtgaagcccaggagga

SEQ ID NO: 4823331 - DNA, 23 bp, Homo sapiens
agtgaagtatgcactaatcaata

SEQ ID NO: 4823332 - DNA, 15 bp, Homo sapiens
agtgaatataaatgt

SEQ ID NO: 4823333 - DNA, 19 bp, Homo sapiens
agtgaatataaatgtacta

SEQ ID NO: 4823334 - DNA, 22 bp, Homo sapiens
agtgaccagcataccagttctt

SEQ ID NO: 4823335 - DNA, 23 bp, Homo sapiens
agtgaccagcataccagttcttg

SEQ ID NO: 4823336 - DNA, 21 bp, Homo sapiens
agtgaccaggctcacaactgt

SEQ ID NO: 4823337 - DNA, 17 bp, Homo sapiens
agtgactctggctgcca

SEQ ID NO: 4823338 - DNA, 14 bp, Homo sapiens
agtgagaaattttt

SEQ ID NO: 4823339 - DNA, 19 bp, Homo sapiens
agtgagagcagggctgggc

SEQ ID NO: 4823340 - DNA, 21 bp, Homo sapiens
agtgagatgtttggcaagaaa

SEQ ID NO: 4823341 - DNA, 23 bp, Homo sapiens
agtgagatgtttggcaagaaatc

SEQ ID NO: 4823342 - DNA, 17 bp, Homo sapiens
agtgagatttgtattta

SEQ ID NO: 4823343 - DNA, 16 bp, Homo sapiens
agtgagctaccaggaa

SEQ ID NO: 4823344 - DNA, 17 bp, Homo sapiens
agtgagctaccaggaag

SEQ ID NO: 4823345 - DNA, 13 bp, Homo sapiens
agtgagctgggca

SEQ ID NO: 4823346 - DNA, 16 bp, Homo sapiens
agtgagtgtggcttag

SEQ ID NO: 4823347 - DNA, 15 bp, Homo sapiens
agtgatatggcttgt

SEQ ID NO: 4823348 - DNA, 17 bp, Homo sapiens
agtgatctgcccgcctc

SEQ ID NO: 4823349 - DNA, 14 bp, Homo sapiens
agtgatgggcaagg

SEQ ID NO: 4823350 - DNA, 19 bp, Homo sapiens
agtgatgggcaaggggcca

SEQ ID NO: 4823351 - DNA, 20 bp, Homo sapiens
agtgatgtgatttatgcatt

SEQ ID NO: 4823352 - DNA, 22 bp, Homo sapiens
agtgattgacattttgtagcta

SEQ ID NO: 4823353 - DNA, 13 bp, Homo sapiens
agtgatttgtaaa

SEQ ID NO: 4823354 - DNA, 17 bp, Homo sapiens
agtgatttgtaaaacag

SEQ ID NO: 4823355 - DNA, 19 bp, Homo sapiens
agtgcaatctgtccagaca

SEQ ID NO: 4823356 - DNA, 22 bp, Homo sapiens
agtgcaggaaaaggctgcagct

SEQ ID NO: 4823357 - DNA, 18 bp, Homo sapiens
agtgcagtagtgccaaaa

SEQ ID NO: 4823358 - DNA, 14 bp, Homo sapiens
agtgcatgctgtcc

SEQ ID NO: 4823359 - DNA, 14 bp, Homo sapiens
agtgcatgtcacat

SEQ ID NO: 4823360 - DNA, 16 bp, Homo sapiens
agtgcatgttaaaata

SEQ ID NO: 4823361 - DNA, 14 bp, Homo sapiens
agtgccaaaaacaa

SEQ ID NO: 4823362 - DNA, 16 bp, Homo sapiens
agtgccaaaaggcccc

SEQ ID NO: 4823363 - DNA, 19 bp, Homo sapiens
agtgccaaaaggccccttc

SEQ ID NO: 4823364 - DNA, 17 bp, Homo sapiens
agtgccacatggccgct

SEQ ID NO: 4823365 - DNA, 18 bp, Homo sapiens
agtgccacgtggccgctg

SEQ ID NO: 4823366 - DNA, 15 bp, Homo sapiens
agtgccatggccagg

SEQ ID NO: 4823367 - DNA, 18 bp, Homo sapiens
agtgctaaacctatctgt

SEQ ID NO: 4823368 - DNA, 23 bp, Homo sapiens
agtgctagtgagctgggcatggt

SEQ ID NO: 4823369 - DNA, 19 bp, Homo sapiens
agtgctatctcatgacaac

SEQ ID NO: 4823370 - DNA, 19 bp, Homo sapiens
agtgctgagtctgtgaata

SEQ ID NO: 4823371 - DNA, 14 bp, Homo sapiens
agtggaagacagag

SEQ ID NO: 4823372 - DNA, 15 bp, Homo sapiens
agtggaagacagaga

SEQ ID NO: 4823373 - DNA, 17 bp, Homo sapiens
agtggaagacagagatg

SEQ ID NO: 4823374 - DNA, 21 bp, Homo sapiens
agtggaagagctgctgtattt

SEQ ID NO: 4823375 - DNA, 13 bp, Homo sapiens
agtggacagcagc

SEQ ID NO: 4823376 - DNA, 14 bp, Homo sapiens
agtggacagcagct

SEQ ID NO: 4823377 - DNA, 20 bp, Homo sapiens
agtggacagcagctggactg

SEQ ID NO: 4823378 - DNA, 21 bp, Homo sapiens
agtggactcttccctctcgct

SEQ ID NO: 4823379 - DNA, 14 bp, Homo sapiens
agtggagaggggac

SEQ ID NO: 4823380 - DNA, 18 bp, Homo sapiens
agtggaggggtcagcagg

SEQ ID NO: 4823381 - DNA, 20 bp, Homo sapiens
agtggcatcatctcagctca

SEQ ID NO: 4823382 - DNA, 18 bp, Homo sapiens
agtggcctacaaatcagt

SEQ ID NO: 4823383 - DNA, 22 bp, Homo sapiens
agtggcctacaaatcagtaatt

SEQ ID NO: 4823384 - DNA, 16 bp, Homo sapiens
agtggcctgagaagag

SEQ ID NO: 4823385 - DNA, 18 bp, Homo sapiens
agtggcgagtccagacac

SEQ ID NO: 4823386 - DNA, 22 bp, Homo sapiens
agtggcgagtccagacaccatc

SEQ ID NO: 4823387 - DNA, 18 bp, Homo sapiens
agtggggacgggggctgc

SEQ ID NO: 4823388 - DNA, 18 bp, Homo sapiens
agtggggcccatggcccc

SEQ ID NO: 4823389 - DNA, 19 bp, Homo sapiens
agtggggcccatggcccca

SEQ ID NO: 4823390 - DNA, 21 bp, Homo sapiens
agtggtcagcgattcctgcca

SEQ ID NO: 4823391 - DNA, 20 bp, Homo sapiens
agtggtcatttggtggctct

SEQ ID NO: 4823392 - DNA, 15 bp, Homo sapiens
agtggtggaggtggg

SEQ ID NO: 4823393 - DNA, 21 bp, Homo sapiens
agtggttcctaatcctctagg

SEQ ID NO: 4823394 - DNA, 23 bp, Homo sapiens
agtggttcgggggaaatagttcc

SEQ ID NO: 4823395 - DNA, 22 bp, Homo sapiens
agtggtttccacatgctctgag

SEQ ID NO: 4823396 - DNA, 14 bp, Homo sapiens
agtgtagattttat

SEQ ID NO: 4823397 - DNA, 15 bp, Homo sapiens
agtgtagattttata

SEQ ID NO: 4823398 - DNA, 16 bp, Homo sapiens
agtgtagtcccggagg

SEQ ID NO: 4823399 - DNA, 12 bp, Homo sapiens
agtgtatgcata

SEQ ID NO: 4823400 - DNA, 15 bp, Homo sapiens
agtgtatgtatacac

SEQ ID NO: 4823401 - DNA, 18 bp, Homo sapiens
agtgtatttaatgtttgt

SEQ ID NO: 4823402 - DNA, 19 bp, Homo sapiens
agtgtatttaatgtttgta

SEQ ID NO: 4823403 - DNA, 16 bp, Homo sapiens
agtgtattttctgtgt

SEQ ID NO: 4823404 - DNA, 16 bp, Homo sapiens
agtgtatttttgtaat

SEQ ID NO: 4823405 - DNA, 20 bp, Homo sapiens
agtgtcaccagctgccaaaa

SEQ ID NO: 4823406 - DNA, 23 bp, Homo sapiens
agtgtcacttttttcctgtcaat

SEQ ID NO: 4823407 - DNA, 17 bp, Homo sapiens
agtgtcattttctgtta

SEQ ID NO: 4823408 - DNA, 20 bp, Homo sapiens
agtgtcctgctacctttgtc

SEQ ID NO: 4823409 - DNA, 14 bp, Homo sapiens
agtgtctggcccag

SEQ ID NO: 4823410 - DNA, 14 bp, Homo sapiens
agtgtgaatataaa

SEQ ID NO: 4823411 - DNA, 17 bp, Homo sapiens
agtgtgagtgttagaaa

SEQ ID NO: 4823412 - DNA, 15 bp, Homo sapiens
agtgtgatgcaggaa

SEQ ID NO: 4823413 - DNA, 20 bp, Homo sapiens
agtgtgcctgctatccagcc

SEQ ID NO: 4823414 - DNA, 17 bp, Homo sapiens
agtgtgctcggacacag

SEQ ID NO: 4823415 - DNA, 17 bp, Homo sapiens
agtgtgtacttcttcat

SEQ ID NO: 4823416 - DNA, 21 bp, Homo sapiens
agtgtgtagaaacacagccta

SEQ ID NO: 4823417 - DNA, 20 bp, Homo sapiens
agtgtgtcttagtgtgtgca

SEQ ID NO: 4823418 - DNA, 14 bp, Homo sapiens
agtgtgttctgatg

SEQ ID NO: 4823419 - DNA, 15 bp, Homo sapiens
agtgttagaggatcc

SEQ ID NO: 4823420 - DNA, 15 bp, Homo sapiens
agtgttataaaatct

SEQ ID NO: 4823421 - DNA, 23 bp, Homo sapiens
agtgttataaaatctgtattgct

SEQ ID NO: 4823422 - DNA, 13 bp, Homo sapiens
agtgttctgtggc

SEQ ID NO: 4823423 - DNA, 17 bp, Homo sapiens
agtgttgaggaggggag

SEQ ID NO: 4823424 - DNA, 19 bp, Homo sapiens
agtgttggccatcatttca

SEQ ID NO: 4823425 - DNA, 13 bp, Homo sapiens
agtgttgtacaat

SEQ ID NO: 4823426 - DNA, 21 bp, Homo sapiens
agtgttgtacaattactgtga

SEQ ID NO: 4823427 - DNA, 18 bp, Homo sapiens
agtgttgtcttattccta

SEQ ID NO: 4823428 - DNA, 18 bp, Homo sapiens
agtgtttaattgtataaa

SEQ ID NO: 4823429 - DNA, 12 bp, Homo sapiens
agtgtttccagt

SEQ ID NO: 4823430 - DNA, 18 bp, Homo sapiens
agtgtttccagtgacaca

SEQ ID NO: 4823431 - DNA, 17 bp, Homo sapiens
agtgtttcgttaagcag

SEQ ID NO: 4823432 - DNA, 19 bp, Homo sapiens
agtgtttcgttaagcagta

SEQ ID NO: 4823433 - DNA, 22 bp, Homo sapiens
agtgtttctagtaacagtattt

SEQ ID NO: 4823434 - DNA, 14 bp, Homo sapiens
agtgttttcattct

SEQ ID NO: 4823435 - DNA, 21 bp, Homo sapiens
agttaaaaaaaaaacagcctg

SEQ ID NO: 4823436 - DNA, 18 bp, Homo sapiens
agttaaaggttactgttt

SEQ ID NO: 4823437 - DNA, 15 bp, Homo sapiens
agttaagacaacagg

SEQ ID NO: 4823438 - DNA, 24 bp, Homo sapiens
agttaagcacaaccatgttcttga

SEQ ID NO: 4823439 - DNA, 19 bp, Homo sapiens
agttaaggaccgtggccct

SEQ ID NO: 4823440 - DNA, 13 bp, Homo sapiens
agttaatgtgcca

SEQ ID NO: 4823441 - DNA, 19 bp, Homo sapiens
agttacagtggcagtattg

SEQ ID NO: 4823442 - DNA, 22 bp, Homo sapiens
agttacagtggcagtattgaca

SEQ ID NO: 4823443 - DNA, 16 bp, Homo sapiens
agttacttacacacct

SEQ ID NO: 4823444 - DNA, 23 bp, Homo sapiens
agttagactcaaagaagtactgt

SEQ ID NO: 4823445 - DNA, 17 bp, Homo sapiens
agttagattcactttga

SEQ ID NO: 4823446 - DNA, 14 bp, Homo sapiens
agttagcaggaaat

SEQ ID NO: 4823447 - DNA, 16 bp, Homo sapiens
agttagcccggccaag

SEQ ID NO: 4823448 - DNA, 19 bp, Homo sapiens
agttagcccggccaaggac

SEQ ID NO: 4823449 - DNA, 15 bp, Homo sapiens
agttataccagcaaa

SEQ ID NO: 4823450 - DNA, 11 bp, Homo sapiens
agttatttacc

SEQ ID NO: 4823451 - DNA, 20 bp, Homo sapiens
agttatttaccagaagttta

SEQ ID NO: 4823452 - DNA, 18 bp, Homo sapiens
agttatttgatctggtgc

SEQ ID NO: 4823453 - DNA, 17 bp, Homo sapiens
agttattttgtgtcctt

SEQ ID NO: 4823454 - DNA, 21 bp, Homo sapiens
agttcaacctggtggcaccag

SEQ ID NO: 4823455 - DNA, 22 bp, Homo sapiens
agttcaacctggtggcaccaga

SEQ ID NO: 4823456 - DNA, 15 bp, Homo sapiens
agttcagcaaaactg

SEQ ID NO: 4823457 - DNA, 15 bp, Homo sapiens
agttcagctgcttct

SEQ ID NO: 4823458 - DNA, 16 bp, Homo sapiens
agttcagctgcttctc

SEQ ID NO: 4823459 - DNA, 23 bp, Homo sapiens
agttccacaattttgtctctagt

SEQ ID NO: 4823460 - DNA, 14 bp, Homo sapiens
agttccataccaag

SEQ ID NO: 4823461 - DNA, 15 bp, Homo sapiens
agttccattctatga

SEQ ID NO: 4823462 - DNA, 16 bp, Homo sapiens
agttccctcagccctc

SEQ ID NO: 4823463 - DNA, 16 bp, Homo sapiens
agttctctccttcttc

SEQ ID NO: 4823464 - DNA, 19 bp, Homo sapiens
agttctgaaaactgtttat

SEQ ID NO: 4823465 - DNA, 18 bp, Homo sapiens
agttctgcaaatagaaaa

SEQ ID NO: 4823466 - DNA, 20 bp, Homo sapiens
agttctgcaaatagaaaaca

SEQ ID NO: 4823467 - DNA, 17 bp, Homo sapiens
agttctgcaataacagt

SEQ ID NO: 4823468 - DNA, 19 bp, Homo sapiens
agttctgcacatacagatg

SEQ ID NO: 4823469 - DNA, 14 bp, Homo sapiens
agttcttgcaataa

SEQ ID NO: 4823470 - DNA, 21 bp, Homo sapiens
agttcttggtgactgtcccac

SEQ ID NO: 4823471 - DNA, 17 bp, Homo sapiens
agttgaagacagagcta

SEQ ID NO: 4823472 - DNA, 17 bp, Homo sapiens
agttgaagggaaatcaa

SEQ ID NO: 4823473 - DNA, 20 bp, Homo sapiens
agttgacttcaaatgtgtaa

SEQ ID NO: 4823474 - DNA, 23 bp, Homo sapiens
agttgatgaccaatctctgtgac

SEQ ID NO: 4823475 - DNA, 18 bp, Homo sapiens
agttgctagcaacaactt

SEQ ID NO: 4823476 - DNA, 19 bp, Homo sapiens
agttgctagcaacaactta

SEQ ID NO: 4823477 - DNA, 22 bp, Homo sapiens
agttgtaaagatattgtatctc

SEQ ID NO: 4823478 - DNA, 21 bp, Homo sapiens
agttgtaacattctatttcaa

SEQ ID NO: 4823479 - DNA, 18 bp, Homo sapiens
agttgtattttaataaag

SEQ ID NO: 4823480 - DNA, 11 bp, Homo sapiens
agttgtgtgct

SEQ ID NO: 4823481 - DNA, 17 bp, Homo sapiens
agtttaaaattattaaa

SEQ ID NO: 4823482 - DNA, 20 bp, Homo sapiens
agtttaaatctttgttaaaa

SEQ ID NO: 4823483 - DNA, 17 bp, Homo sapiens
agtttattatagtctgt

SEQ ID NO: 4823484 - DNA, 14 bp, Homo sapiens
agtttcaacatgaa

SEQ ID NO: 4823485 - DNA, 16 bp, Homo sapiens
agtttcagataaatca

SEQ ID NO: 4823486 - DNA, 17 bp, Homo sapiens
agtttcagataaatcat

SEQ ID NO: 4823487 - DNA, 13 bp, Homo sapiens
agtttcatttatg

SEQ ID NO: 4823488 - DNA, 20 bp, Homo sapiens
agtttcatttttcattttct

SEQ ID NO: 4823489 - DNA, 22 bp, Homo sapiens
agtttcatttttcattttctct

SEQ ID NO: 4823490 - DNA, 15 bp, Homo sapiens
agtttccagctgctc

SEQ ID NO: 4823491 - DNA, 13 bp, Homo sapiens
agtttctaaaatt

SEQ ID NO: 4823492 - DNA, 21 bp, Homo sapiens
agtttctcttaagctgcccaa

SEQ ID NO: 4823493 - DNA, 19 bp, Homo sapiens
agtttctgccgcagccctg

SEQ ID NO: 4823494 - DNA, 19 bp, Homo sapiens
agtttcttgcaagctccag

SEQ ID NO: 4823495 - DNA, 15 bp, Homo sapiens
agtttgctaatgttt

SEQ ID NO: 4823496 - DNA, 17 bp, Homo sapiens
agtttggtatgaaacaa

SEQ ID NO: 4823497 - DNA, 16 bp, Homo sapiens
agtttgtgaagtgatt

SEQ ID NO: 4823498 - DNA, 15 bp, Homo sapiens
agtttgttctccggg

SEQ ID NO: 4823499 - DNA, 19 bp, Homo sapiens
ataaaaaagaaaacttgtg

SEQ ID NO: 4823500 - DNA, 21 bp, Homo sapiens
ataaaaaagaaaacttgtgtt

SEQ ID NO: 4823501 - DNA, 13 bp, Homo sapiens
ataaaaaatatat

SEQ ID NO: 4823502 - DNA, 14 bp, Homo sapiens
ataaaaaatatatg

SEQ ID NO: 4823503 - DNA, 22 bp, Homo sapiens
ataaaaaatatatgtaatatat

SEQ ID NO: 4823504 - DNA, 13 bp, Homo sapiens
ataaaaataatta

SEQ ID NO: 4823505 - DNA, 19 bp, Homo sapiens
ataaaacagtgtttccagt

SEQ ID NO: 4823506 - DNA, 21 bp, Homo sapiens
ataaaacagtgtttccagtga

SEQ ID NO: 4823507 - DNA, 12 bp, Homo sapiens
ataaaatacata

SEQ ID NO: 4823508 - DNA, 15 bp, Homo sapiens
ataaaatcttcaact

SEQ ID NO: 4823509 - DNA, 23 bp, Homo sapiens
ataaaatcttcaactaatttttg

SEQ ID NO: 4823510 - DNA, 13 bp, Homo sapiens
ataaaatgtttat

SEQ ID NO: 4823511 - DNA, 16 bp, Homo sapiens
ataaaattcattccat

SEQ ID NO: 4823512 - DNA, 17 bp, Homo sapiens
ataaaattcattccatt

SEQ ID NO: 4823513 - DNA, 18 bp, Homo sapiens
ataaacacagattatttg

SEQ ID NO: 4823514 - DNA, 15 bp, Homo sapiens
ataaacacatagatt

SEQ ID NO: 4823515 - DNA, 12 bp, Homo sapiens
ataaacacttct

SEQ ID NO: 4823516 - DNA, 16 bp, Homo sapiens
ataaactgtgagataa

SEQ ID NO: 4823517 - DNA, 15 bp, Homo sapiens
ataaacttgtgtatg

SEQ ID NO: 4823518 - DNA, 14 bp, Homo sapiens
ataaagaaaccttt

SEQ ID NO: 4823519 - DNA, 15 bp, Homo sapiens
ataaagaaacctttt

SEQ ID NO: 4823520 - DNA, 18 bp, Homo sapiens
ataaagcactgtttggat

SEQ ID NO: 4823521 - DNA, 19 bp, Homo sapiens
ataaaggttctatgatata

SEQ ID NO: 4823522 - DNA, 23 bp, Homo sapiens
ataaagtattccaccttaaatta

SEQ ID NO: 4823523 - DNA, 14 bp, Homo sapiens
ataaataaaaatat

SEQ ID NO: 4823524 - DNA, 16 bp, Homo sapiens
ataaataaaagaaaga

SEQ ID NO: 4823525 - DNA, 15 bp, Homo sapiens
ataaatagtaaataa

SEQ ID NO: 4823526 - DNA, 22 bp, Homo sapiens
ataaatatctatttatctgtct

SEQ ID NO: 4823527 - DNA, 19 bp, Homo sapiens
ataaatcacagatttccaa

SEQ ID NO: 4823528 - DNA, 14 bp, Homo sapiens
ataaatcatgggca

SEQ ID NO: 4823529 - DNA, 16 bp, Homo sapiens
ataaatcatgggcatt

SEQ ID NO: 4823530 - DNA, 24 bp, Homo sapiens
ataaatccaatagtctgccacaag

SEQ ID NO: 4823531 - DNA, 12 bp, Homo sapiens
ataaatctaaat

SEQ ID NO: 4823532 - DNA, 13 bp, Homo sapiens
ataaatctaaata

SEQ ID NO: 4823533 - DNA, 18 bp, Homo sapiens
ataaatgaatgaaatata

SEQ ID NO: 4823534 - DNA, 12 bp, Homo sapiens
ataaatgctgct

SEQ ID NO: 4823535 - DNA, 12 bp, Homo sapiens
ataaatggactt

SEQ ID NO: 4823536 - DNA, 17 bp, Homo sapiens
ataaatggacttgcttc

SEQ ID NO: 4823537 - DNA, 21 bp, Homo sapiens
ataaatggacttgcttcttgt

SEQ ID NO: 4823538 - DNA, 15 bp, Homo sapiens
ataaatggaggtaca

SEQ ID NO: 4823539 - DNA, 15 bp, Homo sapiens
ataaatgtactacat

SEQ ID NO: 4823540 - DNA, 21 bp, Homo sapiens
ataaatgtactacatttgcat

SEQ ID NO: 4823541 - DNA, 22 bp, Homo sapiens
ataaatgtactacatttgcatg

SEQ ID NO: 4823542 - DNA, 15 bp, Homo sapiens
ataaatgttttaaag

SEQ ID NO: 4823543 - DNA, 14 bp, Homo sapiens
ataaatgttttgga

SEQ ID NO: 4823544 - DNA, 11 bp, Homo sapiens
ataaattaaat

SEQ ID NO: 4823545 - DNA, 12 bp, Homo sapiens
ataaattaaata

SEQ ID NO: 4823546 - DNA, 22 bp, Homo sapiens
ataaattaatgagttttatcca

SEQ ID NO: 4823547 - DNA, 13 bp, Homo sapiens
ataaattacatgc

SEQ ID NO: 4823548 - DNA, 15 bp, Homo sapiens
ataaattacatgcat

SEQ ID NO: 4823549 - DNA, 13 bp, Homo sapiens
ataaattataatg

SEQ ID NO: 4823550 - DNA, 13 bp, Homo sapiens
ataaattattact

SEQ ID NO: 4823551 - DNA, 15 bp, Homo sapiens
ataaattattacttt

SEQ ID NO: 4823552 - DNA, 19 bp, Homo sapiens
ataaattatttctaaaaca

SEQ ID NO: 4823553 - DNA, 13 bp, Homo sapiens
ataaattttatct

SEQ ID NO: 4823554 - DNA, 18 bp, Homo sapiens
ataaattttggaagaatt

SEQ ID NO: 4823555 - DNA, 11 bp, Homo sapiens
ataacaacaat

SEQ ID NO: 4823556 - DNA, 12 bp, Homo sapiens
ataacaacaatt

SEQ ID NO: 4823557 - DNA, 13 bp, Homo sapiens
ataacagtggcaa

SEQ ID NO: 4823558 - DNA, 22 bp, Homo sapiens
ataacataagctagaaaaatta

SEQ ID NO: 4823559 - DNA, 21 bp, Homo sapiens
ataactagagtatgtgtatgt

SEQ ID NO: 4823560 - DNA, 22 bp, Homo sapiens
ataactagagtatgtgtatgta

SEQ ID NO: 4823561 - DNA, 16 bp, Homo sapiens
ataactagatctcctg

SEQ ID NO: 4823562 - DNA, 19 bp, Homo sapiens
ataactagatctcctgtaa

SEQ ID NO: 4823563 - DNA, 18 bp, Homo sapiens
ataactggatattcttta

SEQ ID NO: 4823564 - DNA, 11 bp, Homo sapiens
ataagaaaaat

SEQ ID NO: 4823565 - DNA, 14 bp, Homo sapiens
ataagaaacagttt

SEQ ID NO: 4823566 - DNA, 16 bp, Homo sapiens
ataagaaacagtttaa

SEQ ID NO: 4823567 - DNA, 18 bp, Homo sapiens
ataagaaacagtttaaca

SEQ ID NO: 4823568 - DNA, 23 bp, Homo sapiens
ataagaaccttttgagtgcctta

SEQ ID NO: 4823569 - DNA, 18 bp, Homo sapiens
ataagacaagtctgagta

SEQ ID NO: 4823570 - DNA, 21 bp, Homo sapiens
ataagagggaacaaattttca

SEQ ID NO: 4823571 - DNA, 20 bp, Homo sapiens
ataagatattaccctcagaa

SEQ ID NO: 4823572 - DNA, 19 bp, Homo sapiens
ataagccatagccccaggc

SEQ ID NO: 4823573 - DNA, 16 bp, Homo sapiens
ataaggcctcatcctc

SEQ ID NO: 4823574 - DNA, 15 bp, Homo sapiens
ataaggctaaatgta

SEQ ID NO: 4823575 - DNA, 16 bp, Homo sapiens
ataaggctaaatgtaa

SEQ ID NO: 4823576 - DNA, 13 bp, Homo sapiens
ataaggtttagaa

SEQ ID NO: 4823577 - DNA, 19 bp, Homo sapiens
ataaggtttagaatgacag

SEQ ID NO: 4823578 - DNA, 15 bp, Homo sapiens
ataagtaaatacatt

SEQ ID NO: 4823579 - DNA, 20 bp, Homo sapiens
ataagtaaatgtcttcatgt

SEQ ID NO: 4823580 - DNA, 13 bp, Homo sapiens
ataagtgctcagt

SEQ ID NO: 4823581 - DNA, 18 bp, Homo sapiens
ataagttcccatttcctt

SEQ ID NO: 4823582 - DNA, 14 bp, Homo sapiens
ataagttttctctt

SEQ ID NO: 4823583 - DNA, 17 bp, Homo sapiens
ataagttttctctttta

SEQ ID NO: 4823584 - DNA, 19 bp, Homo sapiens
ataagttttctcttttaag

SEQ ID NO: 4823585 - DNA, 11 bp, Homo sapiens
ataataaaaga

SEQ ID NO: 4823586 - DNA, 12 bp, Homo sapiens
ataataaaagaa

SEQ ID NO: 4823587 - DNA, 21 bp, Homo sapiens
ataataaaattcattccattt

SEQ ID NO: 4823588 - DNA, 14 bp, Homo sapiens
ataataaaggttct

SEQ ID NO: 4823589 - DNA, 23 bp, Homo sapiens
ataataaaggttctatgatatac

SEQ ID NO: 4823590 - DNA, 17 bp, Homo sapiens
ataataactagatctcc

SEQ ID NO: 4823591 - DNA, 19 bp, Homo sapiens
ataatactttgtatacaag

SEQ ID NO: 4823592 - DNA, 22 bp, Homo sapiens
ataatagctcacagcacatttg

SEQ ID NO: 4823593 - DNA, 13 bp, Homo sapiens
ataatataaatga

SEQ ID NO: 4823594 - DNA, 19 bp, Homo sapiens
ataatataaatgaatgaaa

SEQ ID NO: 4823595 - DNA, 17 bp, Homo sapiens
ataatatcctgaataac

SEQ ID NO: 4823596 - DNA, 19 bp, Homo sapiens
ataatatcttgaagaatat

SEQ ID NO: 4823597 - DNA, 22 bp, Homo sapiens
ataatatcttgaagaatattgt

SEQ ID NO: 4823598 - DNA, 14 bp, Homo sapiens
ataatatttaggca

SEQ ID NO: 4823599 - DNA, 19 bp, Homo sapiens
ataatcagaatggaagaga

SEQ ID NO: 4823600 - DNA, 11 bp, Homo sapiens
ataatctcatc

SEQ ID NO: 4823601 - DNA, 14 bp, Homo sapiens
ataatctgaaatga

SEQ ID NO: 4823602 - DNA, 16 bp, Homo sapiens
ataatctgaaatgaca

SEQ ID NO: 4823603 - DNA, 15 bp, Homo sapiens
ataatgatactgaat

SEQ ID NO: 4823604 - DNA, 16 bp, Homo sapiens
ataatgattcaatgtg

SEQ ID NO: 4823605 - DNA, 18 bp, Homo sapiens
ataatgattcaatgtgaa

SEQ ID NO: 4823606 - DNA, 19 bp, Homo sapiens
ataatgattcaatgtgaat

SEQ ID NO: 4823607 - DNA, 17 bp, Homo sapiens
ataatgcttaacataaa

SEQ ID NO: 4823608 - DNA, 20 bp, Homo sapiens
ataatgcttaacataaactt

SEQ ID NO: 4823609 - DNA, 22 bp, Homo sapiens
ataatgcttaacataaacttgt

SEQ ID NO: 4823610 - DNA, 21 bp, Homo sapiens
ataatgcttctttcctcttaa

SEQ ID NO: 4823611 - DNA, 16 bp, Homo sapiens
ataatggcctcttaaa

SEQ ID NO: 4823612 - DNA, 23 bp, Homo sapiens
ataatggcctcttaaaaattatc

SEQ ID NO: 4823613 - DNA, 15 bp, Homo sapiens
ataatggtaaatctt

SEQ ID NO: 4823614 - DNA, 12 bp, Homo sapiens
ataatgtgaaat

SEQ ID NO: 4823615 - DNA, 19 bp, Homo sapiens
ataatgtgggaagaaacaa

SEQ ID NO: 4823616 - DNA, 15 bp, Homo sapiens
ataatgttagtagca

SEQ ID NO: 4823617 - DNA, 12 bp, Homo sapiens
ataattaaaaca

SEQ ID NO: 4823618 - DNA, 21 bp, Homo sapiens
ataattagatccattaattta

SEQ ID NO: 4823619 - DNA, 16 bp, Homo sapiens
ataattgtaaaggtga

SEQ ID NO: 4823620 - DNA, 21 bp, Homo sapiens
ataattgtaaaggtgatgaat

SEQ ID NO: 4823621 - DNA, 23 bp, Homo sapiens
ataattgtaaaggtgatgaattt

SEQ ID NO: 4823622 - DNA, 21 bp, Homo sapiens
ataattgtcatgactttcaga

SEQ ID NO: 4823623 - DNA, 11 bp, Homo sapiens
ataattttaaa

SEQ ID NO: 4823624 - DNA, 12 bp, Homo sapiens
atacaaacaggt

SEQ ID NO: 4823625 - DNA, 13 bp, Homo sapiens
atacaaacaggtg

SEQ ID NO: 4823626 - DNA, 18 bp, Homo sapiens
atacaaatctcactgtat

SEQ ID NO: 4823627 - DNA, 20 bp, Homo sapiens
atacaaatctcactgtatta

SEQ ID NO: 4823628 - DNA, 17 bp, Homo sapiens
atacaactttggaattt

SEQ ID NO: 4823629 - DNA, 19 bp, Homo sapiens
atacacagaaatcctaaca

SEQ ID NO: 4823630 - DNA, 19 bp, Homo sapiens
atacacagttccacaattt

SEQ ID NO: 4823631 - DNA, 16 bp, Homo sapiens
atacaccaaatagctt

SEQ ID NO: 4823632 - DNA, 22 bp, Homo sapiens
atacagatggtgtcctgcatgt

SEQ ID NO: 4823633 - DNA, 15 bp, Homo sapiens
atacagtctctattt

SEQ ID NO: 4823634 - DNA, 16 bp, Homo sapiens
atacagtctctatttg

SEQ ID NO: 4823635 - DNA, 19 bp, Homo sapiens
atacagtctctatttgatt

SEQ ID NO: 4823636 - DNA, 21 bp, Homo sapiens
atacagtctctatttgatttg

SEQ ID NO: 4823637 - DNA, 23 bp, Homo sapiens
atacagtctctatttgatttgca

SEQ ID NO: 4823638 - DNA, 20 bp, Homo sapiens
atacagtctctgagaactgg

SEQ ID NO: 4823639 - DNA, 21 bp, Homo sapiens
atacatactatagattcttta

SEQ ID NO: 4823640 - DNA, 13 bp, Homo sapiens
atacatatgtatg

SEQ ID NO: 4823641 - DNA, 22 bp, Homo sapiens
atacatatgtatgtgtgagtgt

SEQ ID NO: 4823642 - DNA, 19 bp, Homo sapiens
atacatgatgatttcagaa

SEQ ID NO: 4823643 - DNA, 15 bp, Homo sapiens
atacatgtatagtga

SEQ ID NO: 4823644 - DNA, 18 bp, Homo sapiens
atacattagacacacata

SEQ ID NO: 4823645 - DNA, 18 bp, Homo sapiens
atacattatttctgtata

SEQ ID NO: 4823646 - DNA, 21 bp, Homo sapiens
atacattatttctgtatatag

SEQ ID NO: 4823647 - DNA, 15 bp, Homo sapiens
ataccagactgcagg

SEQ ID NO: 4823648 - DNA, 16 bp, Homo sapiens
ataccagactgcaggt

SEQ ID NO: 4823649 - DNA, 12 bp, Homo sapiens
ataccagcaaaa

SEQ ID NO: 4823650 - DNA, 15 bp, Homo sapiens
ataccagcaaaagtg

SEQ ID NO: 4823651 - DNA, 14 bp, Homo sapiens
ataccagttcttgc

SEQ ID NO: 4823652 - DNA, 21 bp, Homo sapiens
ataccccctgccccagagaag

SEQ ID NO: 4823653 - DNA, 18 bp, Homo sapiens
ataccctaggtctccacc

SEQ ID NO: 4823654 - DNA, 19 bp, Homo sapiens
ataccctaggtctccaccc

SEQ ID NO: 4823655 - DNA, 20 bp, Homo sapiens
ataccctaggtctccacccc

SEQ ID NO: 4823656 - DNA, 15 bp, Homo sapiens
atacctgtgaggact

SEQ ID NO: 4823657 - DNA, 22 bp, Homo sapiens
ataccttctgatgaagttgtac

SEQ ID NO: 4823658 - DNA, 20 bp, Homo sapiens
atacgtgcccatttcacaca

SEQ ID NO: 4823659 - DNA, 18 bp, Homo sapiens
atacgtttttcagtttca

SEQ ID NO: 4823660 - DNA, 14 bp, Homo sapiens
atactaataaaata

SEQ ID NO: 4823661 - DNA, 17 bp, Homo sapiens
atactaataaaatacat

SEQ ID NO: 4823662 - DNA, 13 bp, Homo sapiens
atactatagattc

SEQ ID NO: 4823663 - DNA, 16 bp, Homo sapiens
atactatttattaaaa

SEQ ID NO: 4823664 - DNA, 23 bp, Homo sapiens
atactcattagaattaccatttg

SEQ ID NO: 4823665 - DNA, 22 bp, Homo sapiens
atactccaaggtggcatagcca

SEQ ID NO: 4823666 - DNA, 16 bp, Homo sapiens
atactccttaaaaatg

SEQ ID NO: 4823667 - DNA, 12 bp, Homo sapiens
atactctccagg

SEQ ID NO: 4823668 - DNA, 21 bp, Homo sapiens
atactgatgagacaacacaca

SEQ ID NO: 4823669 - DNA, 16 bp, Homo sapiens
atactggggggcaggc

SEQ ID NO: 4823670 - DNA, 23 bp, Homo sapiens
atactggggggcaggcctcccaa

SEQ ID NO: 4823671 - DNA, 16 bp, Homo sapiens
atacttgaatattata

SEQ ID NO: 4823672 - DNA, 20 bp, Homo sapiens
atacttgctccttgaataag

SEQ ID NO: 4823673 - DNA, 14 bp, Homo sapiens
atacttggtcctta

SEQ ID NO: 4823674 - DNA, 21 bp, Homo sapiens
atactttgaacacaaagcctg

SEQ ID NO: 4823675 - DNA, 18 bp, Homo sapiens
atactttgcattgtctgt

SEQ ID NO: 4823676 - DNA, 14 bp, Homo sapiens
atactttgtgtctt

SEQ ID NO: 4823677 - DNA, 15 bp, Homo sapiens
atactttgtgtcttt

SEQ ID NO: 4823678 - DNA, 16 bp, Homo sapiens
atactttgtgtctttt

SEQ ID NO: 4823679 - DNA, 13 bp, Homo sapiens
atagaaacatgac

SEQ ID NO: 4823680 - DNA, 16 bp, Homo sapiens
atagaaacatgacact

SEQ ID NO: 4823681 - DNA, 20 bp, Homo sapiens
atagaagaaggactgaagaa

SEQ ID NO: 4823682 - DNA, 21 bp, Homo sapiens
atagaagaaggactgaagaaa

SEQ ID NO: 4823683 - DNA, 22 bp, Homo sapiens
atagaagttaaaggttactgtt

SEQ ID NO: 4823684 - DNA, 15 bp, Homo sapiens
atagacaaaggcctt

SEQ ID NO: 4823685 - DNA, 11 bp, Homo sapiens
atagacacagt

SEQ ID NO: 4823686 - DNA, 19 bp, Homo sapiens
atagacacagtattgactt

SEQ ID NO: 4823687 - DNA, 17 bp, Homo sapiens
atagagacttctaaatc

SEQ ID NO: 4823688 - DNA, 17 bp, Homo sapiens
atagataccattttgaa

SEQ ID NO: 4823689 - DNA, 18 bp, Homo sapiens
atagataccattttgaaa

SEQ ID NO: 4823690 - DNA, 22 bp, Homo sapiens
atagataccattttgaaatatt

SEQ ID NO: 4823691 - DNA, 18 bp, Homo sapiens
atagatcacggcatgttt

SEQ ID NO: 4823692 - DNA, 18 bp, Homo sapiens
atagatgtctgtgtatac

SEQ ID NO: 4823693 - DNA, 19 bp, Homo sapiens
atagatgtctgtgtataca

SEQ ID NO: 4823694 - DNA, 12 bp, Homo sapiens
atagcacatgtt

SEQ ID NO: 4823695 - DNA, 22 bp, Homo sapiens
atagcactggtttgtttctcaa

SEQ ID NO: 4823696 - DNA, 12 bp, Homo sapiens
atagcagaagag

SEQ ID NO: 4823697 - DNA, 16 bp, Homo sapiens
atagcataggctgggg

SEQ ID NO: 4823698 - DNA, 13 bp, Homo sapiens
atagccccaggcc

SEQ ID NO: 4823699 - DNA, 14 bp, Homo sapiens
atagccccaggccc

SEQ ID NO: 4823700 - DNA, 17 bp, Homo sapiens
atagcctcaccttccct

SEQ ID NO: 4823701 - DNA, 14 bp, Homo sapiens
atagctcacagcac

SEQ ID NO: 4823702 - DNA, 20 bp, Homo sapiens
atagctttagagaagccata

SEQ ID NO: 4823703 - DNA, 21 bp, Homo sapiens
atagctttagagaagccataa

SEQ ID NO: 4823704 - DNA, 17 bp, Homo sapiens
atagcttttcacttctt

SEQ ID NO: 4823705 - DNA, 22 bp, Homo sapiens
atagcttttggtgtttgagtgt

SEQ ID NO: 4823706 - DNA, 16 bp, Homo sapiens
ataggaaataaatcta

SEQ ID NO: 4823707 - DNA, 17 bp, Homo sapiens
ataggaaataaatctaa

SEQ ID NO: 4823708 - DNA, 13 bp, Homo sapiens
ataggaagacaca

SEQ ID NO: 4823709 - DNA, 13 bp, Homo sapiens
ataggagaggaaa

SEQ ID NO: 4823710 - DNA, 20 bp, Homo sapiens
ataggagcttccagatgggt

SEQ ID NO: 4823711 - DNA, 17 bp, Homo sapiens
ataggataaattaatga

SEQ ID NO: 4823712 - DNA, 23 bp, Homo sapiens
ataggcttgtgtaatttcctgct

SEQ ID NO: 4823713 - DNA, 18 bp, Homo sapiens
ataggggcaaaaatttga

SEQ ID NO: 4823714 - DNA, 23 bp, Homo sapiens
ataggtttgggggacgcccagcc

SEQ ID NO: 4823715 - DNA, 23 bp, Homo sapiens
atagtaaataatgattcaatgtg

SEQ ID NO: 4823716 - DNA, 22 bp, Homo sapiens
atagtactagagatattttgta

SEQ ID NO: 4823717 - DNA, 19 bp, Homo sapiens
atagtagcagagtcattgt

SEQ ID NO: 4823718 - DNA, 20 bp, Homo sapiens
atagtagcagagtcattgtt

SEQ ID NO: 4823719 - DNA, 18 bp, Homo sapiens
atagtcaatcaaacaggg

SEQ ID NO: 4823720 - DNA, 17 bp, Homo sapiens
atagtcatatgtgaaga

SEQ ID NO: 4823721 - DNA, 20 bp, Homo sapiens
atagtcatgtttctgcagta

SEQ ID NO: 4823722 - DNA, 19 bp, Homo sapiens
atagtggtattttaacata

SEQ ID NO: 4823723 - DNA, 17 bp, Homo sapiens
atagtggtcatttggtg

SEQ ID NO: 4823724 - DNA, 19 bp, Homo sapiens
atagtgtgctcggacacag

SEQ ID NO: 4823725 - DNA, 23 bp, Homo sapiens
atagtgttgtgttacaataagtg

SEQ ID NO: 4823726 - DNA, 22 bp, Homo sapiens
atagttctgcaataacagtttt

SEQ ID NO: 4823727 - DNA, 22 bp, Homo sapiens
atagtttattatagtctgtact

SEQ ID NO: 4823728 - DNA, 13 bp, Homo sapiens
atagtttctaaac

SEQ ID NO: 4823729 - DNA, 13 bp, Homo sapiens
atataaaaaatat

SEQ ID NO: 4823730 - DNA, 16 bp, Homo sapiens
atataaaaaatatatg

SEQ ID NO: 4823731 - DNA, 19 bp, Homo sapiens
atataaaaaatatatgtaa

SEQ ID NO: 4823732 - DNA, 15 bp, Homo sapiens
atataaaacaaaaca

SEQ ID NO: 4823733 - DNA, 14 bp, Homo sapiens
atataaactgtgag

SEQ ID NO: 4823734 - DNA, 16 bp, Homo sapiens
atataaactgtgagat

SEQ ID NO: 4823735 - DNA, 23 bp, Homo sapiens
atataaacttgtgtatgatccaa

SEQ ID NO: 4823736 - DNA, 20 bp, Homo sapiens
atataaatcacagatttcca

SEQ ID NO: 4823737 - DNA, 15 bp, Homo sapiens
atataaatgaatgaa

SEQ ID NO: 4823738 - DNA, 17 bp, Homo sapiens
atataaatgtactacat

SEQ ID NO: 4823739 - DNA, 11 bp, Homo sapiens
atataaatgtg

SEQ ID NO: 4823740 - DNA, 12 bp, Homo sapiens
atataaatgtgt

SEQ ID NO: 4823741 - DNA, 16 bp, Homo sapiens
atataaatgtttatat

SEQ ID NO: 4823742 - DNA, 21 bp, Homo sapiens
atataaatgtttatattgttt

SEQ ID NO: 4823743 - DNA, 17 bp, Homo sapiens
atataaattattacttt

SEQ ID NO: 4823744 - DNA, 17 bp, Homo sapiens
atataacatgaaagtca

SEQ ID NO: 4823745 - DNA, 14 bp, Homo sapiens
atataactttagaa

SEQ ID NO: 4823746 - DNA, 15 bp, Homo sapiens
atataactttagaaa

SEQ ID NO: 4823747 - DNA, 12 bp, Homo sapiens
atataagccata

SEQ ID NO: 4823748 - DNA, 12 bp, Homo sapiens
atataagctttt

SEQ ID NO: 4823749 - DNA, 15 bp, Homo sapiens
atataataaagtatt

SEQ ID NO: 4823750 - DNA, 17 bp, Homo sapiens
atataataaagtattcc

SEQ ID NO: 4823751 - DNA, 22 bp, Homo sapiens
atataatttgccagacagagat

SEQ ID NO: 4823752 - DNA, 22 bp, Homo sapiens
atatacaactttggaatttgaa

SEQ ID NO: 4823753 - DNA, 20 bp, Homo sapiens
atatacacaaagatattatt

SEQ ID NO: 4823754 - DNA, 18 bp, Homo sapiens
atatacagacctccagat

SEQ ID NO: 4823755 - DNA, 15 bp, Homo sapiens
atatacagagcctgt

SEQ ID NO: 4823756 - DNA, 17 bp, Homo sapiens
atatacatattcaaagt

SEQ ID NO: 4823757 - DNA, 14 bp, Homo sapiens
atatacatgtatag

SEQ ID NO: 4823758 - DNA, 18 bp, Homo sapiens
atatacattatttctgta

SEQ ID NO: 4823759 - DNA, 16 bp, Homo sapiens
atatactcatttggat

SEQ ID NO: 4823760 - DNA, 14 bp, Homo sapiens
atatactccttaaa

SEQ ID NO: 4823761 - DNA, 14 bp, Homo sapiens
atatagatgtctgt

SEQ ID NO: 4823762 - DNA, 20 bp, Homo sapiens
atatagatgtctgtgtatac

SEQ ID NO: 4823763 - DNA, 17 bp, Homo sapiens
atataggggcaaaaatt

SEQ ID NO: 4823764 - DNA, 18 bp, Homo sapiens
atatagtgttgtgttaca

SEQ ID NO: 4823765 - DNA, 21 bp, Homo sapiens
atatataaaacaaaacaaaca

SEQ ID NO: 4823766 - DNA, 16 bp, Homo sapiens
atatatacatattcaa

SEQ ID NO: 4823767 - DNA, 12 bp, Homo sapiens
atatatacatgt

SEQ ID NO: 4823768 - DNA, 14 bp, Homo sapiens
atatatacatgtat

SEQ ID NO: 4823769 - DNA, 17 bp, Homo sapiens
atatatacatgtatagt

SEQ ID NO: 4823770 - DNA, 14 bp, Homo sapiens
atatatgtaatata

SEQ ID NO: 4823771 - DNA, 11 bp, Homo sapiens
atatatgtatg

SEQ ID NO: 4823772 - DNA, 19 bp, Homo sapiens
atatatgtatgtaaaaatg

SEQ ID NO: 4823773 - DNA, 17 bp, Homo sapiens
atatattatatatacat

SEQ ID NO: 4823774 - DNA, 18 bp, Homo sapiens
atatattatatatacatt

SEQ ID NO: 4823775 - DNA, 19 bp, Homo sapiens
atatatttattattttcat

SEQ ID NO: 4823776 - DNA, 18 bp, Homo sapiens
atatattttgaaaggaga

SEQ ID NO: 4823777 - DNA, 17 bp, Homo sapiens
atatcactcattaatta

SEQ ID NO: 4823778 - DNA, 15 bp, Homo sapiens
atatcagcagacact

SEQ ID NO: 4823779 - DNA, 23 bp, Homo sapiens
atatcagctctaaagcagagatg

SEQ ID NO: 4823780 - DNA, 20 bp, Homo sapiens
atatcagctctgcataagat

SEQ ID NO: 4823781 - DNA, 20 bp, Homo sapiens
atatcaggaaatatctgtga

SEQ ID NO: 4823782 - DNA, 13 bp, Homo sapiens
atatcattatagc

SEQ ID NO: 4823783 - DNA, 17 bp, Homo sapiens
atatcattatagcatgt

SEQ ID NO: 4823784 - DNA, 17 bp, Homo sapiens
atatcatttcataaaaa

SEQ ID NO: 4823785 - DNA, 12 bp, Homo sapiens
atatcatttctt

SEQ ID NO: 4823786 - DNA, 16 bp, Homo sapiens
atatctagtgctaaac

SEQ ID NO: 4823787 - DNA, 21 bp, Homo sapiens
atatctagtgctaaacctatc

SEQ ID NO: 4823788 - DNA, 23 bp, Homo sapiens
atatctagtgctaaacctatctg

SEQ ID NO: 4823789 - DNA, 22 bp, Homo sapiens
atatctctatttaattttgaca

SEQ ID NO: 4823790 - DNA, 11 bp, Homo sapiens
atatctgaaaa

SEQ ID NO: 4823791 - DNA, 17 bp, Homo sapiens
atatctgtttgcttcta

SEQ ID NO: 4823792 - DNA, 14 bp, Homo sapiens
atatcttcatttct

SEQ ID NO: 4823793 - DNA, 18 bp, Homo sapiens
atatcttcgttagtaatc

SEQ ID NO: 4823794 - DNA, 12 bp, Homo sapiens
atatcttgaaga

SEQ ID NO: 4823795 - DNA, 13 bp, Homo sapiens
atatcttgaagaa

SEQ ID NO: 4823796 - DNA, 17 bp, Homo sapiens
atatcttgaagaatatt

SEQ ID NO: 4823797 - DNA, 15 bp, Homo sapiens
atatgaaaaatgaga

SEQ ID NO: 4823798 - DNA, 16 bp, Homo sapiens
atatgaaagagaaaat

SEQ ID NO: 4823799 - DNA, 19 bp, Homo sapiens
atatgaaagagaaaatgct

SEQ ID NO: 4823800 - DNA, 18 bp, Homo sapiens
atatgaagtaagttctga

SEQ ID NO: 4823801 - DNA, 19 bp, Homo sapiens
atatgacttcttgttcatg

SEQ ID NO: 4823802 - DNA, 19 bp, Homo sapiens
atatgagaaatataaaaat

SEQ ID NO: 4823803 - DNA, 22 bp, Homo sapiens
atatgagatgtagcaaattcca

SEQ ID NO: 4823804 - DNA, 18 bp, Homo sapiens
atatgagattggaaaaaa

SEQ ID NO: 4823805 - DNA, 12 bp, Homo sapiens
atatgatatgca

SEQ ID NO: 4823806 - DNA, 15 bp, Homo sapiens
atatgatatgcatgt

SEQ ID NO: 4823807 - DNA, 16 bp, Homo sapiens
atatgatatgcatgta

SEQ ID NO: 4823808 - DNA, 23 bp, Homo sapiens
atatgatatgcatgtagcatata

SEQ ID NO: 4823809 - DNA, 21 bp, Homo sapiens
atatgattaaattatcattgt

SEQ ID NO: 4823810 - DNA, 18 bp, Homo sapiens
atatgattctcctctccc

SEQ ID NO: 4823811 - DNA, 20 bp, Homo sapiens
atatgcatgtagcatataaa

SEQ ID NO: 4823812 - DNA, 21 bp, Homo sapiens
atatgcatgtagcatataaat

SEQ ID NO: 4823813 - DNA, 11 bp, Homo sapiens
atatgctcttt

SEQ ID NO: 4823814 - DNA, 12 bp, Homo sapiens
atatggaacctt

SEQ ID NO: 4823815 - DNA, 19 bp, Homo sapiens
atatggcaacgttcatgtt

SEQ ID NO: 4823816 - DNA, 22 bp, Homo sapiens
atatggcaacgttcatgttcat

SEQ ID NO: 4823817 - DNA, 18 bp, Homo sapiens
atatgtaatatatacata

SEQ ID NO: 4823818 - DNA, 23 bp, Homo sapiens
atatgtatatctgtgtaagacac

SEQ ID NO: 4823819 - DNA, 19 bp, Homo sapiens
atatgtatgtgtgagtgta

SEQ ID NO: 4823820 - DNA, 12 bp, Homo sapiens
atatgtgcccct

SEQ ID NO: 4823821 - DNA, 20 bp, Homo sapiens
atatgtgcttgtgtgtatgt

SEQ ID NO: 4823822 - DNA, 16 bp, Homo sapiens
atatgtggagttcatc

SEQ ID NO: 4823823 - DNA, 20 bp, Homo sapiens
atatgtggagttcatcttga

SEQ ID NO: 4823824 - DNA, 20 bp, Homo sapiens
atatgtgtaatatcatttca

SEQ ID NO: 4823825 - DNA, 15 bp, Homo sapiens
atatgttgctgaaac

SEQ ID NO: 4823826 - DNA, 13 bp, Homo sapiens
atatgtttaatat

SEQ ID NO: 4823827 - DNA, 15 bp, Homo sapiens
atatgtttggctgaa

SEQ ID NO: 4823828 - DNA, 14 bp, Homo sapiens
atattaaaaattaa

SEQ ID NO: 4823829 - DNA, 21 bp, Homo sapiens
atattaaaaattaattcttta

SEQ ID NO: 4823830 - DNA, 12 bp, Homo sapiens
atattaaaatca

SEQ ID NO: 4823831 - DNA, 12 bp, Homo sapiens
atattaagcaca

SEQ ID NO: 4823832 - DNA, 17 bp, Homo sapiens
atattagagtgccctta

SEQ ID NO: 4823833 - DNA, 20 bp, Homo sapiens
atattagagtgcccttaaaa

SEQ ID NO: 4823834 - DNA, 15 bp, Homo sapiens
atattataagttgac

SEQ ID NO: 4823835 - DNA, 21 bp, Homo sapiens
atattataagttgacctttat

SEQ ID NO: 4823836 - DNA, 13 bp, Homo sapiens
atattatatatac

SEQ ID NO: 4823837 - DNA, 15 bp, Homo sapiens
atattatatatacat

SEQ ID NO: 4823838 - DNA, 18 bp, Homo sapiens
atattatatatacattag

SEQ ID NO: 4823839 - DNA, 13 bp, Homo sapiens
atattattttctg

SEQ ID NO: 4823840 - DNA, 15 bp, Homo sapiens
atattattttctgta

SEQ ID NO: 4823841 - DNA, 18 bp, Homo sapiens
atattattttctgtaatt

SEQ ID NO: 4823842 - DNA, 21 bp, Homo sapiens
atattattttctgtaattctt

SEQ ID NO: 4823843 - DNA, 16 bp, Homo sapiens
atattcaaagtatata

SEQ ID NO: 4823844 - DNA, 17 bp, Homo sapiens
atattcaggaaatgttc

SEQ ID NO: 4823845 - DNA, 19 bp, Homo sapiens
atattcatagtagaacttt

SEQ ID NO: 4823846 - DNA, 15 bp, Homo sapiens
atattcatgctgcct

SEQ ID NO: 4823847 - DNA, 20 bp, Homo sapiens
atattccaggtttaagtaga

SEQ ID NO: 4823848 - DNA, 17 bp, Homo sapiens
atattctgtcattggtt

SEQ ID NO: 4823849 - DNA, 18 bp, Homo sapiens
atattgagcaatatgtca

SEQ ID NO: 4823850 - DNA, 20 bp, Homo sapiens
atattgagcaatatgtcagt

SEQ ID NO: 4823851 - DNA, 17 bp, Homo sapiens
atattgataataaaatt

SEQ ID NO: 4823852 - DNA, 22 bp, Homo sapiens
atattgataataaaattcattc

SEQ ID NO: 4823853 - DNA, 14 bp, Homo sapiens
atattgatctgtat

SEQ ID NO: 4823854 - DNA, 18 bp, Homo sapiens
atattgatgtaactgtgt

SEQ ID NO: 4823855 - DNA, 17 bp, Homo sapiens
atattgctgtctgaaaa

SEQ ID NO: 4823856 - DNA, 17 bp, Homo sapiens
atattggttctatttat

SEQ ID NO: 4823857 - DNA, 12 bp, Homo sapiens
atattgtatctc

SEQ ID NO: 4823858 - DNA, 20 bp, Homo sapiens
atattgtattatcatatatg

SEQ ID NO: 4823859 - DNA, 21 bp, Homo sapiens
atattgtattatcatatatgc

SEQ ID NO: 4823860 - DNA, 21 bp, Homo sapiens
atattgtgtaggaaatctgaa

SEQ ID NO: 4823861 - DNA, 18 bp, Homo sapiens
atatttatcatatttaat

SEQ ID NO: 4823862 - DNA, 17 bp, Homo sapiens
atatttattattttcat

SEQ ID NO: 4823863 - DNA, 13 bp, Homo sapiens
atatttcttcaaa

SEQ ID NO: 4823864 - DNA, 15 bp, Homo sapiens
atatttgcttattta

SEQ ID NO: 4823865 - DNA, 19 bp, Homo sapiens
atattttatttcaatgtaa

SEQ ID NO: 4823866 - DNA, 12 bp, Homo sapiens
atattttgaaag

SEQ ID NO: 4823867 - DNA, 13 bp, Homo sapiens
atattttgctgct

SEQ ID NO: 4823868 - DNA, 19 bp, Homo sapiens
atattttgctgctgaattt

SEQ ID NO: 4823869 - DNA, 19 bp, Homo sapiens
atattttgtaaaatgtatt

SEQ ID NO: 4823870 - DNA, 14 bp, Homo sapiens
atcaaaaaacagaa

SEQ ID NO: 4823871 - DNA, 18 bp, Homo sapiens
atcaaaaaacagaaaaac

SEQ ID NO: 4823872 - DNA, 19 bp, Homo sapiens
atcaaaaattgaagagaga

SEQ ID NO: 4823873 - DNA, 12 bp, Homo sapiens
atcaaagccctc

SEQ ID NO: 4823874 - DNA, 13 bp, Homo sapiens
atcaaagtgttta

SEQ ID NO: 4823875 - DNA, 14 bp, Homo sapiens
atcaaagtgtttaa

SEQ ID NO: 4823876 - DNA, 19 bp, Homo sapiens
atcaaagtgtttaattgta

SEQ ID NO: 4823877 - DNA, 21 bp, Homo sapiens
atcaaagtgtttaattgtata

SEQ ID NO: 4823878 - DNA, 15 bp, Homo sapiens
atcaaatttttctgg

SEQ ID NO: 4823879 - DNA, 21 bp, Homo sapiens
atcaacaaaagggagaacatg

SEQ ID NO: 4823880 - DNA, 18 bp, Homo sapiens
atcaacagacctaagaaa

SEQ ID NO: 4823881 - DNA, 15 bp, Homo sapiens
atcaactagtatttg

SEQ ID NO: 4823882 - DNA, 13 bp, Homo sapiens
atcaactcatgtt

SEQ ID NO: 4823883 - DNA, 22 bp, Homo sapiens
atcaagatcaaagaaccaggag

SEQ ID NO: 4823884 - DNA, 21 bp, Homo sapiens
atcaagatgggtgattatgaa

SEQ ID NO: 4823885 - DNA, 22 bp, Homo sapiens
atcaagatgggtgattatgaaa

SEQ ID NO: 4823886 - DNA, 21 bp, Homo sapiens
atcaagatgtgacatgtttta

SEQ ID NO: 4823887 - DNA, 14 bp, Homo sapiens
atcaagattaatta

SEQ ID NO: 4823888 - DNA, 18 bp, Homo sapiens
atcaaggtgctcttctca

SEQ ID NO: 4823889 - DNA, 12 bp, Homo sapiens
atcaagtattac

SEQ ID NO: 4823890 - DNA, 16 bp, Homo sapiens
atcaagtcccgaggca

SEQ ID NO: 4823891 - DNA, 17 bp, Homo sapiens
atcaagtcccgaggcag

SEQ ID NO: 4823892 - DNA, 22 bp, Homo sapiens
atcaagtcccgaggcagcaaca

SEQ ID NO: 4823893 - DNA, 13 bp, Homo sapiens
atcaagtctgtga

SEQ ID NO: 4823894 - DNA, 16 bp, Homo sapiens
atcaatcattgtacag

SEQ ID NO: 4823895 - DNA, 19 bp, Homo sapiens
atcaatcattgtacagttt

SEQ ID NO: 4823896 - DNA, 21 bp, Homo sapiens
atcaatcattttctagccctc

SEQ ID NO: 4823897 - DNA, 21 bp, Homo sapiens
atcaatctggcttctgcatta

SEQ ID NO: 4823898 - DNA, 22 bp, Homo sapiens
atcaatgttcacgcaacttgaa

SEQ ID NO: 4823899 - DNA, 14 bp, Homo sapiens
atcaatttaaagga

SEQ ID NO: 4823900 - DNA, 21 bp, Homo sapiens
atcacacccagcccatgtggc

SEQ ID NO: 4823901 - DNA, 15 bp, Homo sapiens
atcaccacgcagaga

SEQ ID NO: 4823902 - DNA, 16 bp, Homo sapiens
atcaccgattcttcct

SEQ ID NO: 4823903 - DNA, 14 bp, Homo sapiens
atcaccggaggagc

SEQ ID NO: 4823904 - DNA, 16 bp, Homo sapiens
atcacctgaattatta

SEQ ID NO: 4823905 - DNA, 15 bp, Homo sapiens
atcactatgcatttt

SEQ ID NO: 4823906 - DNA, 18 bp, Homo sapiens
atcactcatttatttcca

SEQ ID NO: 4823907 - DNA, 14 bp, Homo sapiens
atcactgaaatccc

SEQ ID NO: 4823908 - DNA, 16 bp, Homo sapiens
atcactgcacctcttt

SEQ ID NO: 4823909 - DNA, 14 bp, Homo sapiens
atcagaaagttggc

SEQ ID NO: 4823910 - DNA, 23 bp, Homo sapiens
atcagaattgaaccgtcaatgtg

SEQ ID NO: 4823911 - DNA, 13 bp, Homo sapiens
atcagaggcagag

SEQ ID NO: 4823912 - DNA, 15 bp, Homo sapiens
atcagaggtatctta

SEQ ID NO: 4823913 - DNA, 19 bp, Homo sapiens
atcagcagcggcagcagca

SEQ ID NO: 4823914 - DNA, 22 bp, Homo sapiens
atcagctctgcataagattata

SEQ ID NO: 4823915 - DNA, 18 bp, Homo sapiens
atcagctttataataaac

SEQ ID NO: 4823916 - DNA, 20 bp, Homo sapiens
atcagctttataataaactg

SEQ ID NO: 4823917 - DNA, 23 bp, Homo sapiens
atcagctttataataaactgttt

SEQ ID NO: 4823918 - DNA, 17 bp, Homo sapiens
atcaggaagagaaggag

SEQ ID NO: 4823919 - DNA, 15 bp, Homo sapiens
atcaggattccttct

SEQ ID NO: 4823920 - DNA, 18 bp, Homo sapiens
atcaggtaaactgatgct

SEQ ID NO: 4823921 - DNA, 17 bp, Homo sapiens
atcaggtcagagcccag

SEQ ID NO: 4823922 - DNA, 17 bp, Homo sapiens
atcagtaaaattatact

SEQ ID NO: 4823923 - DNA, 22 bp, Homo sapiens
atcagtcctagaatgtttcatt

SEQ ID NO: 4823924 - DNA, 22 bp, Homo sapiens
atcagtctttgtcaatgctcta

SEQ ID NO: 4823925 - DNA, 23 bp, Homo sapiens
atcagtctttgtcaatgctctaa

SEQ ID NO: 4823926 - DNA, 14 bp, Homo sapiens
atcagtgaatataa

SEQ ID NO: 4823927 - DNA, 15 bp, Homo sapiens
atcagtgaatataaa

SEQ ID NO: 4823928 - DNA, 22 bp, Homo sapiens
atcagtgaatataaatgtacta

SEQ ID NO: 4823929 - DNA, 17 bp, Homo sapiens
atcagttacagtggcag

SEQ ID NO: 4823930 - DNA, 22 bp, Homo sapiens
atcagttacagtggcagtattg

SEQ ID NO: 4823931 - DNA, 13 bp, Homo sapiens
atcatatatgctt

SEQ ID NO: 4823932 - DNA, 13 bp, Homo sapiens
atcatatctgtat

SEQ ID NO: 4823933 - DNA, 18 bp, Homo sapiens
atcatcaccgattcttcc

SEQ ID NO: 4823934 - DNA, 20 bp, Homo sapiens
atcatcaccgattcttcctt

SEQ ID NO: 4823935 - DNA, 22 bp, Homo sapiens
atcatcaccgattcttccttgc

SEQ ID NO: 4823936 - DNA, 22 bp, Homo sapiens
atcatcacgtatgttatacaac

SEQ ID NO: 4823937 - DNA, 19 bp, Homo sapiens
atcatctattgagtgtaca

SEQ ID NO: 4823938 - DNA, 13 bp, Homo sapiens
atcatctccaaat

SEQ ID NO: 4823939 - DNA, 14 bp, Homo sapiens
atcatctccaaatc

SEQ ID NO: 4823940 - DNA, 21 bp, Homo sapiens
atcatgcctacattagtgaga

SEQ ID NO: 4823941 - DNA, 21 bp, Homo sapiens
atcatggatttattttttgta

SEQ ID NO: 4823942 - DNA, 23 bp, Homo sapiens
atcatggatttattttttgtaac

SEQ ID NO: 4823943 - DNA, 20 bp, Homo sapiens
atcatgggcattgctggact

SEQ ID NO: 4823944 - DNA, 16 bp, Homo sapiens
atcatgtctattgtcc

SEQ ID NO: 4823945 - DNA, 17 bp, Homo sapiens
atcatgtctattgtcca

SEQ ID NO: 4823946 - DNA, 15 bp, Homo sapiens
atcatgtgtttctgt

SEQ ID NO: 4823947 - DNA, 19 bp, Homo sapiens
atcattatagcatgtaata

SEQ ID NO: 4823948 - DNA, 20 bp, Homo sapiens
atcattatagcatgtaatat

SEQ ID NO: 4823949 - DNA, 20 bp, Homo sapiens
atcattgagaaataaagcac

SEQ ID NO: 4823950 - DNA, 11 bp, Homo sapiens
atcattgctta

SEQ ID NO: 4823951 - DNA, 19 bp, Homo sapiens
atcattggtatctgatatc

SEQ ID NO: 4823952 - DNA, 22 bp, Homo sapiens
atcattggtatctgatatctgt

SEQ ID NO: 4823953 - DNA, 13 bp, Homo sapiens
atcattgtacagt

SEQ ID NO: 4823954 - DNA, 15 bp, Homo sapiens
atcattgtacagttt

SEQ ID NO: 4823955 - DNA, 21 bp, Homo sapiens
atcattgtttgtcctttatgt

SEQ ID NO: 4823956 - DNA, 13 bp, Homo sapiens
atcatttccagca

SEQ ID NO: 4823957 - DNA, 14 bp, Homo sapiens
atcattttccaatt

SEQ ID NO: 4823958 - DNA, 18 bp, Homo sapiens
atcattttccaattaatt

SEQ ID NO: 4823959 - DNA, 13 bp, Homo sapiens
atcattttcctgg

SEQ ID NO: 4823960 - DNA, 14 bp, Homo sapiens
atcattttcctggg

SEQ ID NO: 4823961 - DNA, 17 bp, Homo sapiens
atcattttcctgggagt

SEQ ID NO: 4823962 - DNA, 17 bp, Homo sapiens
atcattttgatgtatta

SEQ ID NO: 4823963 - DNA, 18 bp, Homo sapiens
atcatttttatcccgcca

SEQ ID NO: 4823964 - DNA, 19 bp, Homo sapiens
atccaaaatagtcatgttt

SEQ ID NO: 4823965 - DNA, 18 bp, Homo sapiens
atccaacccatgcatggc

SEQ ID NO: 4823966 - DNA, 19 bp, Homo sapiens
atccaactatttctttcat

SEQ ID NO: 4823967 - DNA, 13 bp, Homo sapiens
atccacacacagc

SEQ ID NO: 4823968 - DNA, 14 bp, Homo sapiens
atccacacacagca

SEQ ID NO: 4823969 - DNA, 17 bp, Homo sapiens
atccacacacagcagct

SEQ ID NO: 4823970 - DNA, 13 bp, Homo sapiens
atccacagtattg

SEQ ID NO: 4823971 - DNA, 17 bp, Homo sapiens
atccacagtattgttct

SEQ ID NO: 4823972 - DNA, 13 bp, Homo sapiens
atccacatgcaca

SEQ ID NO: 4823973 - DNA, 17 bp, Homo sapiens
atccacctgccttggct

SEQ ID NO: 4823974 - DNA, 16 bp, Homo sapiens
atccactaggtgccca

SEQ ID NO: 4823975 - DNA, 18 bp, Homo sapiens
atccactctgcaggaaat

SEQ ID NO: 4823976 - DNA, 14 bp, Homo sapiens
atccagagacctgc

SEQ ID NO: 4823977 - DNA, 22 bp, Homo sapiens
atccagagacctgctccagatc

SEQ ID NO: 4823978 - DNA, 20 bp, Homo sapiens
atccagagagaagcacccca

SEQ ID NO: 4823979 - DNA, 15 bp, Homo sapiens
atccagccttcttcc

SEQ ID NO: 4823980 - DNA, 13 bp, Homo sapiens
atccataccccct

SEQ ID NO: 4823981 - DNA, 15 bp, Homo sapiens
atccatagacacagt

SEQ ID NO: 4823982 - DNA, 16 bp, Homo sapiens
atccatatcagctctg

SEQ ID NO: 4823983 - DNA, 17 bp, Homo sapiens
atccatccttttgcttc

SEQ ID NO: 4823984 - DNA, 19 bp, Homo sapiens
atccatcggtttatactat

SEQ ID NO: 4823985 - DNA, 19 bp, Homo sapiens
atccatgtgctgctgtggc

SEQ ID NO: 4823986 - DNA, 24 bp, Homo sapiens
atccatgtgtcccccctgtggtct

SEQ ID NO: 4823987 - DNA, 13 bp, Homo sapiens
atcccaagtcaaa

SEQ ID NO: 4823988 - DNA, 19 bp, Homo sapiens
atcccaagtcaaacagtgt

SEQ ID NO: 4823989 - DNA, 21 bp, Homo sapiens
atcccactgatatcacgggcc

SEQ ID NO: 4823990 - DNA, 16 bp, Homo sapiens
atcccatatgcctggg

SEQ ID NO: 4823991 - DNA, 16 bp, Homo sapiens
atccccagtgccagct

SEQ ID NO: 4823992 - DNA, 20 bp, Homo sapiens
atccccatggaacagccctg

SEQ ID NO: 4823993 - DNA, 22 bp, Homo sapiens
atcccccaaacagcatgtgctc

SEQ ID NO: 4823994 - DNA, 22 bp, Homo sapiens
atcccctcgcttcataggcaga

SEQ ID NO: 4823995 - DNA, 19 bp, Homo sapiens
atccctcttcctccaaagc

SEQ ID NO: 4823996 - DNA, 22 bp, Homo sapiens
atccctcttcctccaaagcctg

SEQ ID NO: 4823997 - DNA, 19 bp, Homo sapiens
atccctggacgcatgcagg

SEQ ID NO: 4823998 - DNA, 17 bp, Homo sapiens
atccctgggcccctcca

SEQ ID NO: 4823999 - DNA, 13 bp, Homo sapiens
atccctgttcatt

SEQ ID NO: 4824000 - DNA, 16 bp, Homo sapiens
atccctgttcattgta

SEQ ID NO: 4824001 - DNA, 13 bp, Homo sapiens
atcccttggcccc

SEQ ID NO: 4824002 - DNA, 15 bp, Homo sapiens
atcccttggcccctc

SEQ ID NO: 4824003 - DNA, 18 bp, Homo sapiens
atcccttggcccctctct

SEQ ID NO: 4824004 - DNA, 12 bp, Homo sapiens
atccgagcccct

SEQ ID NO: 4824005 - DNA, 15 bp, Homo sapiens
atccgagcccctgtt

SEQ ID NO: 4824006 - DNA, 13 bp, Homo sapiens
atccgtctctgtc

SEQ ID NO: 4824007 - DNA, 14 bp, Homo sapiens
atccgtctctgtcc

SEQ ID NO: 4824008 - DNA, 15 bp, Homo sapiens
atccgtctctgtccg

SEQ ID NO: 4824009 - DNA, 15 bp, Homo sapiens
atcctcacacagatt

SEQ ID NO: 4824010 - DNA, 16 bp, Homo sapiens
atcctcacatgtggca

SEQ ID NO: 4824011 - DNA, 22 bp, Homo sapiens
atcctcactgagaaggccccag

SEQ ID NO: 4824012 - DNA, 13 bp, Homo sapiens
atcctcagcccca

SEQ ID NO: 4824013 - DNA, 16 bp, Homo sapiens
atcctcagccccaggg

SEQ ID NO: 4824014 - DNA, 17 bp, Homo sapiens
atcctcagccccagggc

SEQ ID NO: 4824015 - DNA, 20 bp, Homo sapiens
atcctcccacttcagcctcc

SEQ ID NO: 4824016 - DNA, 18 bp, Homo sapiens
atcctccgcggaggcccc

SEQ ID NO: 4824017 - DNA, 22 bp, Homo sapiens
atcctccgcggaggcccctgag

SEQ ID NO: 4824018 - DNA, 24 bp, Homo sapiens
atcctctgcttgtcattctgctaa

SEQ ID NO: 4824019 - DNA, 20 bp, Homo sapiens
atcctgacagcgccatgtgt

SEQ ID NO: 4824020 - DNA, 15 bp, Homo sapiens
atcctgcaccctctg

SEQ ID NO: 4824021 - DNA, 16 bp, Homo sapiens
atcctggaaatttgtg

SEQ ID NO: 4824022 - DNA, 23 bp, Homo sapiens
atcctgtaaggtctgtaaatcag

SEQ ID NO: 4824023 - DNA, 19 bp, Homo sapiens
atcctgttaggggaaaata

SEQ ID NO: 4824024 - DNA, 23 bp, Homo sapiens
atccttaaaaagaccatgcattc

SEQ ID NO: 4824025 - DNA, 17 bp, Homo sapiens
atccttcccgcagcacc

SEQ ID NO: 4824026 - DNA, 21 bp, Homo sapiens
atccttcccgcagcaccagcc

SEQ ID NO: 4824027 - DNA, 23 bp, Homo sapiens
atccttcccgcagcaccagcctg

SEQ ID NO: 4824028 - DNA, 15 bp, Homo sapiens
atccttggcaccaaa

SEQ ID NO: 4824029 - DNA, 20 bp, Homo sapiens
atcctttacaagatggagaa

SEQ ID NO: 4824030 - DNA, 15 bp, Homo sapiens
atcgatttgtattaa

SEQ ID NO: 4824031 - DNA, 16 bp, Homo sapiens
atcgcagacgcaagag

SEQ ID NO: 4824032 - DNA, 14 bp, Homo sapiens
atcgccattccagg

SEQ ID NO: 4824033 - DNA, 19 bp, Homo sapiens
atcgccctgagctactgct

SEQ ID NO: 4824034 - DNA, 21 bp, Homo sapiens
atcgcctgggacgcccctttc

SEQ ID NO: 4824035 - DNA, 21 bp, Homo sapiens
atcggaggctgggcccctggg

SEQ ID NO: 4824036 - DNA, 13 bp, Homo sapiens
atcggcctcctct

SEQ ID NO: 4824037 - DNA, 21 bp, Homo sapiens
atcggcctcctcttcaccccg

SEQ ID NO: 4824038 - DNA, 18 bp, Homo sapiens
atcgtttcacatctgtat

SEQ ID NO: 4824039 - DNA, 16 bp, Homo sapiens
atctaagacattcacc

SEQ ID NO: 4824040 - DNA, 14 bp, Homo sapiens
atctacaaactttt

SEQ ID NO: 4824041 - DNA, 19 bp, Homo sapiens
atctacacatataaacaca

SEQ ID NO: 4824042 - DNA, 21 bp, Homo sapiens
atctacacatataaacacagt

SEQ ID NO: 4824043 - DNA, 22 bp, Homo sapiens
atctacacatataaacacagta

SEQ ID NO: 4824044 - DNA, 14 bp, Homo sapiens
atctactagaacct

SEQ ID NO: 4824045 - DNA, 19 bp, Homo sapiens
atctactagaaccttctaa

SEQ ID NO: 4824046 - DNA, 20 bp, Homo sapiens
atctagagctatgcacacca

SEQ ID NO: 4824047 - DNA, 19 bp, Homo sapiens
atctagccaggcctcccgc

SEQ ID NO: 4824048 - DNA, 20 bp, Homo sapiens
atctagccaggcctcccgca

SEQ ID NO: 4824049 - DNA, 20 bp, Homo sapiens
atctagtaggtctgcacaca

SEQ ID NO: 4824050 - DNA, 12 bp, Homo sapiens
atctagtgctaa

SEQ ID NO: 4824051 - DNA, 18 bp, Homo sapiens
atctagtgctaaacctat

SEQ ID NO: 4824052 - DNA, 23 bp, Homo sapiens
atctagtgctaaacctatctgta

SEQ ID NO: 4824053 - DNA, 19 bp, Homo sapiens
atctatctatatatacata

SEQ ID NO: 4824054 - DNA, 17 bp, Homo sapiens
atctatctctatataaa

SEQ ID NO: 4824055 - DNA, 19 bp, Homo sapiens
atctatgggaaatctaggc

SEQ ID NO: 4824056 - DNA, 18 bp, Homo sapiens
atctatttatctgtctga

SEQ ID NO: 4824057 - DNA, 21 bp, Homo sapiens
atctcaaaagatctcctgtgc

SEQ ID NO: 4824058 - DNA, 14 bp, Homo sapiens
atctcaacctacct

SEQ ID NO: 4824059 - DNA, 18 bp, Homo sapiens
atctcacagatcttcaac

SEQ ID NO: 4824060 - DNA, 19 bp, Homo sapiens
atctcactgtattaaagat

SEQ ID NO: 4824061 - DNA, 17 bp, Homo sapiens
atctcagcatcctggaa

SEQ ID NO: 4824062 - DNA, 19 bp, Homo sapiens
atctcagcatcctggaaat

SEQ ID NO: 4824063 - DNA, 23 bp, Homo sapiens
atctcagcatcctggaaatttgt

SEQ ID NO: 4824064 - DNA, 11 bp, Homo sapiens
atctcagctca

SEQ ID NO: 4824065 - DNA, 15 bp, Homo sapiens
atctcagctcactac

SEQ ID NO: 4824066 - DNA, 16 bp, Homo sapiens
atctcatcaacaaaga

SEQ ID NO: 4824067 - DNA, 16 bp, Homo sapiens
atctccaaatcttgcc

SEQ ID NO: 4824068 - DNA, 19 bp, Homo sapiens
atctccagccaatttcaaa

SEQ ID NO: 4824069 - DNA, 11 bp, Homo sapiens
atctccaggcc

SEQ ID NO: 4824070 - DNA, 20 bp, Homo sapiens
atctccaggcccagcctggc

SEQ ID NO: 4824071 - DNA, 22 bp, Homo sapiens
atctccatgctctttcaccctg

SEQ ID NO: 4824072 - DNA, 19 bp, Homo sapiens
atctcctgtaattttgtag

SEQ ID NO: 4824073 - DNA, 17 bp, Homo sapiens
atctctaaaatgctgtt

SEQ ID NO: 4824074 - DNA, 22 bp, Homo sapiens
atctctaaaatgctgttctcaa

SEQ ID NO: 4824075 - DNA, 23 bp, Homo sapiens
atctctaaaatgctgttctcaat

SEQ ID NO: 4824076 - DNA, 23 bp, Homo sapiens
atctctatataaaaaatatatgt

SEQ ID NO: 4824077 - DNA, 14 bp, Homo sapiens
atctctcaaaatgt

SEQ ID NO: 4824078 - DNA, 20 bp, Homo sapiens
atctctccccatatataaat

SEQ ID NO: 4824079 - DNA, 13 bp, Homo sapiens
atctctcctgctc

SEQ ID NO: 4824080 - DNA, 20 bp, Homo sapiens
atctctctggggccctgggc

SEQ ID NO: 4824081 - DNA, 22 bp, Homo sapiens
atctctgtgactcgcttagctg

SEQ ID NO: 4824082 - DNA, 21 bp, Homo sapiens
atctcttaagacagcatgtgt

SEQ ID NO: 4824083 - DNA, 22 bp, Homo sapiens
atctcttaagacagcatgtgtt

SEQ ID NO: 4824084 - DNA, 14 bp, Homo sapiens
atctcttcttcctt

SEQ ID NO: 4824085 - DNA, 17 bp, Homo sapiens
atctcttgtaccagccc

SEQ ID NO: 4824086 - DNA, 15 bp, Homo sapiens
atctctttctaaaga

SEQ ID NO: 4824087 - DNA, 13 bp, Homo sapiens
atctgaaaactgg

SEQ ID NO: 4824088 - DNA, 20 bp, Homo sapiens
atctgaactcacagactgct

SEQ ID NO: 4824089 - DNA, 13 bp, Homo sapiens
atctgaagagtgg

SEQ ID NO: 4824090 - DNA, 14 bp, Homo sapiens
atctgaagagtgga

SEQ ID NO: 4824091 - DNA, 19 bp, Homo sapiens
atctgaagtagtgtgagtg

SEQ ID NO: 4824092 - DNA, 13 bp, Homo sapiens
atctgaatttcta

SEQ ID NO: 4824093 - DNA, 15 bp, Homo sapiens
atctgaatttctaaa

SEQ ID NO: 4824094 - DNA, 13 bp, Homo sapiens
atctgatatcagg

SEQ ID NO: 4824095 - DNA, 16 bp, Homo sapiens
atctgatgatgttctg

SEQ ID NO: 4824096 - DNA, 19 bp, Homo sapiens
atctgatgatgttctgaaa

SEQ ID NO: 4824097 - DNA, 16 bp, Homo sapiens
atctgctccatgcaga

SEQ ID NO: 4824098 - DNA, 15 bp, Homo sapiens
atctggattccagag

SEQ ID NO: 4824099 - DNA, 20 bp, Homo sapiens
atctggcctatgaccctgtg

SEQ ID NO: 4824100 - DNA, 13 bp, Homo sapiens
atctggcctggcc

SEQ ID NO: 4824101 - DNA, 15 bp, Homo sapiens
atctggcctggcctg

SEQ ID NO: 4824102 - DNA, 22 bp, Homo sapiens
atctggcctggcctggccctgc

SEQ ID NO: 4824103 - DNA, 16 bp, Homo sapiens
atctggcctgggggct

SEQ ID NO: 4824104 - DNA, 15 bp, Homo sapiens
atctggcttctgcat

SEQ ID NO: 4824105 - DNA, 14 bp, Homo sapiens
atctggtgatttct

SEQ ID NO: 4824106 - DNA, 18 bp, Homo sapiens
atctggtgcgtgtggccc

SEQ ID NO: 4824107 - DNA, 22 bp, Homo sapiens
atctggtgcgtgtggccctgtg

SEQ ID NO: 4824108 - DNA, 20 bp, Homo sapiens
atctgtataatactttgtat

SEQ ID NO: 4824109 - DNA, 17 bp, Homo sapiens
atctgtatatcagctct

SEQ ID NO: 4824110 - DNA, 17 bp, Homo sapiens
atctgtattaagctcca

SEQ ID NO: 4824111 - DNA, 17 bp, Homo sapiens
atctgtattggcagcac

SEQ ID NO: 4824112 - DNA, 19 bp, Homo sapiens
atctgtattggcagcacag

SEQ ID NO: 4824113 - DNA, 15 bp, Homo sapiens
atctgtcgcatttca

SEQ ID NO: 4824114 - DNA, 16 bp, Homo sapiens
atctgtcgcatttcat

SEQ ID NO: 4824115 - DNA, 19 bp, Homo sapiens
atctgtcgcatttcatcaa

SEQ ID NO: 4824116 - DNA, 14 bp, Homo sapiens
atctgtctgagccc

SEQ ID NO: 4824117 - DNA, 16 bp, Homo sapiens
atctgtctgagccctg

SEQ ID NO: 4824118 - DNA, 17 bp, Homo sapiens
atctgtctgagccctgc

SEQ ID NO: 4824119 - DNA, 14 bp, Homo sapiens
atctgtctttatga

SEQ ID NO: 4824120 - DNA, 16 bp, Homo sapiens
atctgtgaaatatcat

SEQ ID NO: 4824121 - DNA, 19 bp, Homo sapiens
atctgtgaatcctttgtac

SEQ ID NO: 4824122 - DNA, 17 bp, Homo sapiens
atctgttctatggacca

SEQ ID NO: 4824123 - DNA, 12 bp, Homo sapiens
atctgttgtaat

SEQ ID NO: 4824124 - DNA, 15 bp, Homo sapiens
atctgttgtaatatc

SEQ ID NO: 4824125 - DNA, 14 bp, Homo sapiens
atctgtttgcttct

SEQ ID NO: 4824126 - DNA, 16 bp, Homo sapiens
atctgtttgcttctaa

SEQ ID NO: 4824127 - DNA, 16 bp, Homo sapiens
atcttaaacccacata

SEQ ID NO: 4824128 - DNA, 20 bp, Homo sapiens
atcttaaacccacataaaca

SEQ ID NO: 4824129 - DNA, 23 bp, Homo sapiens
atcttaaacccacataaacactt

SEQ ID NO: 4824130 - DNA, 21 bp, Homo sapiens
atcttacccttcaatgttaaa

SEQ ID NO: 4824131 - DNA, 22 bp, Homo sapiens
atcttacccttcaatgttaaat

SEQ ID NO: 4824132 - DNA, 23 bp, Homo sapiens
atcttacccttcaatgttaaatc

SEQ ID NO: 4824133 - DNA, 12 bp, Homo sapiens
atcttatttata

SEQ ID NO: 4824134 - DNA, 14 bp, Homo sapiens
atcttcatgtaaat

SEQ ID NO: 4824135 - DNA, 18 bp, Homo sapiens
atcttcatgtaaattgac

SEQ ID NO: 4824136 - DNA, 17 bp, Homo sapiens
atcttccatatgctctt

SEQ ID NO: 4824137 - DNA, 19 bp, Homo sapiens
atcttcgttagtaatctgt

SEQ ID NO: 4824138 - DNA, 12 bp, Homo sapiens
atcttgaagaat

SEQ ID NO: 4824139 - DNA, 14 bp, Homo sapiens
atcttgaagaatat

SEQ ID NO: 4824140 - DNA, 14 bp, Homo sapiens
atcttgaagggccc

SEQ ID NO: 4824141 - DNA, 14 bp, Homo sapiens
atcttgtgcatgca

SEQ ID NO: 4824142 - DNA, 15 bp, Homo sapiens
atcttgtgcatgcaa

SEQ ID NO: 4824143 - DNA, 17 bp, Homo sapiens
atcttgtgcatgcaaaa

SEQ ID NO: 4824144 - DNA, 16 bp, Homo sapiens
atctttcggtctcctt

SEQ ID NO: 4824145 - DNA, 13 bp, Homo sapiens
atctttgttaaaa

SEQ ID NO: 4824146 - DNA, 17 bp, Homo sapiens
atctttgttaaaatata

SEQ ID NO: 4824147 - DNA, 13 bp, Homo sapiens
atcttttaactgc

SEQ ID NO: 4824148 - DNA, 16 bp, Homo sapiens
atctttttttaagtgt

SEQ ID NO: 4824149 - DNA, 12 bp, Homo sapiens
atgaaaagtttt

SEQ ID NO: 4824150 - DNA, 23 bp, Homo sapiens
atgaaaatggctgaagaaacaca

SEQ ID NO: 4824151 - DNA, 15 bp, Homo sapiens
atgaaacaaatatac

SEQ ID NO: 4824152 - DNA, 12 bp, Homo sapiens
atgaaagagaaa

SEQ ID NO: 4824153 - DNA, 13 bp, Homo sapiens
atgaaagagaaaa

SEQ ID NO: 4824154 - DNA, 16 bp, Homo sapiens
atgaaagtcagtttaa

SEQ ID NO: 4824155 - DNA, 15 bp, Homo sapiens
atgaaatataaactg

SEQ ID NO: 4824156 - DNA, 18 bp, Homo sapiens
atgaaatataaactgtga

SEQ ID NO: 4824157 - DNA, 20 bp, Homo sapiens
atgaaatataaactgtgaga

SEQ ID NO: 4824158 - DNA, 14 bp, Homo sapiens
atgaaatgccaaga

SEQ ID NO: 4824159 - DNA, 22 bp, Homo sapiens
atgaaatgccagacttctaaaa

SEQ ID NO: 4824160 - DNA, 14 bp, Homo sapiens
atgaaatttaagca

SEQ ID NO: 4824161 - DNA, 18 bp, Homo sapiens
atgaaatttaagcacaaa

SEQ ID NO: 4824162 - DNA, 15 bp, Homo sapiens
atgaacatgttttag

SEQ ID NO: 4824163 - DNA, 20 bp, Homo sapiens
atgaaccgcaatatgggagg

SEQ ID NO: 4824164 - DNA, 18 bp, Homo sapiens
atgaacgcacaacatgca

SEQ ID NO: 4824165 - DNA, 21 bp, Homo sapiens
atgaacgcacaacatgcacat

SEQ ID NO: 4824166 - DNA, 17 bp, Homo sapiens
atgaactaactgccatg

SEQ ID NO: 4824167 - DNA, 22 bp, Homo sapiens
atgaactcaggtttccggctac

SEQ ID NO: 4824168 - DNA, 15 bp, Homo sapiens
atgaagaacataaaa

SEQ ID NO: 4824169 - DNA, 20 bp, Homo sapiens
atgaagacaccagagtgtat

SEQ ID NO: 4824170 - DNA, 18 bp, Homo sapiens
atgaagatgcattttaaa

SEQ ID NO: 4824171 - DNA, 23 bp, Homo sapiens
atgaagcaaacacacagactctg

SEQ ID NO: 4824172 - DNA, 19 bp, Homo sapiens
atgaaggggccagaccacg

SEQ ID NO: 4824173 - DNA, 20 bp, Homo sapiens
atgaatacgtaaactgcgta

SEQ ID NO: 4824174 - DNA, 21 bp, Homo sapiens
atgaatcaatgtgctccttca

SEQ ID NO: 4824175 - DNA, 20 bp, Homo sapiens
atgaatccatcgatttgtat

SEQ ID NO: 4824176 - DNA, 21 bp, Homo sapiens
atgaatgaaatataaactgtg

SEQ ID NO: 4824177 - DNA, 18 bp, Homo sapiens
atgaatgagcattctgca

SEQ ID NO: 4824178 - DNA, 16 bp, Homo sapiens
atgaatgcagtataaa

SEQ ID NO: 4824179 - DNA, 17 bp, Homo sapiens
atgaatgcccaggaagt

SEQ ID NO: 4824180 - DNA, 18 bp, Homo sapiens
atgaatgtcagtgtgact

SEQ ID NO: 4824181 - DNA, 13 bp, Homo sapiens
atgaatttaccat

SEQ ID NO: 4824182 - DNA, 16 bp, Homo sapiens
atgaattttaaaagca

SEQ ID NO: 4824183 - DNA, 21 bp, Homo sapiens
atgaattttaaaagcatatat

SEQ ID NO: 4824184 - DNA, 23 bp, Homo sapiens
atgacaataaattttatctcagt

SEQ ID NO: 4824185 - DNA, 12 bp, Homo sapiens
atgacactgacc

SEQ ID NO: 4824186 - DNA, 12 bp, Homo sapiens
atgacagggagc

SEQ ID NO: 4824187 - DNA, 15 bp, Homo sapiens
atgacagtagcatac

SEQ ID NO: 4824188 - DNA, 21 bp, Homo sapiens
atgaccactgggcctgctagt

SEQ ID NO: 4824189 - DNA, 16 bp, Homo sapiens
atgaccctgtgcctgt

SEQ ID NO: 4824190 - DNA, 23 bp, Homo sapiens
atgaccctgtgcctgtgtttcat

SEQ ID NO: 4824191 - DNA, 16 bp, Homo sapiens
atgacggtattatgct

SEQ ID NO: 4824192 - DNA, 17 bp, Homo sapiens
atgacggtattatgctt

SEQ ID NO: 4824193 - DNA, 17 bp, Homo sapiens
atgactaatccttaata

SEQ ID NO: 4824194 - DNA, 18 bp, Homo sapiens
atgactctttattgtctg

SEQ ID NO: 4824195 - DNA, 15 bp, Homo sapiens
atgactggaaacaag

SEQ ID NO: 4824196 - DNA, 20 bp, Homo sapiens
atgactttcagattgtatct

SEQ ID NO: 4824197 - DNA, 12 bp, Homo sapiens
atgagaaaaaac

SEQ ID NO: 4824198 - DNA, 12 bp, Homo sapiens
atgagaaatcat

SEQ ID NO: 4824199 - DNA, 18 bp, Homo sapiens
atgagaaattgtgccaaa

SEQ ID NO: 4824200 - DNA, 17 bp, Homo sapiens
atgagaatgtcatttgc

SEQ ID NO: 4824201 - DNA, 15 bp, Homo sapiens
atgagacctccccca

SEQ ID NO: 4824202 - DNA, 17 bp, Homo sapiens
atgagacctcccccagg

SEQ ID NO: 4824203 - DNA, 23 bp, Homo sapiens
atgagacctcccccagggagggg

SEQ ID NO: 4824204 - DNA, 22 bp, Homo sapiens
atgagacttatggagtgtgcct

SEQ ID NO: 4824205 - DNA, 15 bp, Homo sapiens
atgagagtagggccc

SEQ ID NO: 4824206 - DNA, 17 bp, Homo sapiens
atgagagtagggccctg

SEQ ID NO: 4824207 - DNA, 18 bp, Homo sapiens
atgagagtagggccctga

SEQ ID NO: 4824208 - DNA, 14 bp, Homo sapiens
atgagatgatttaa

SEQ ID NO: 4824209 - DNA, 18 bp, Homo sapiens
atgagatgatttaattct

SEQ ID NO: 4824210 - DNA, 13 bp, Homo sapiens
atgagatgtaata

SEQ ID NO: 4824211 - DNA, 18 bp, Homo sapiens
atgagatgtaatacacca

SEQ ID NO: 4824212 - DNA, 12 bp, Homo sapiens
atgagattggaa

SEQ ID NO: 4824213 - DNA, 19 bp, Homo sapiens
atgagattggaaaaaatta

SEQ ID NO: 4824214 - DNA, 15 bp, Homo sapiens
atgagcacctttctg

SEQ ID NO: 4824215 - DNA, 20 bp, Homo sapiens
atgaggcacgcctgccttct

SEQ ID NO: 4824216 - DNA, 12 bp, Homo sapiens
atgaggcatttt

SEQ ID NO: 4824217 - DNA, 13 bp, Homo sapiens
atgagtttatggg

SEQ ID NO: 4824218 - DNA, 20 bp, Homo sapiens
atgagtttccagctaagcct

SEQ ID NO: 4824219 - DNA, 13 bp, Homo sapiens
atgataatagctc

SEQ ID NO: 4824220 - DNA, 11 bp, Homo sapiens
atgatatgcat

SEQ ID NO: 4824221 - DNA, 13 bp, Homo sapiens
atgatatgcatgt

SEQ ID NO: 4824222 - DNA, 14 bp, Homo sapiens
atgatatgcatgta

SEQ ID NO: 4824223 - DNA, 13 bp, Homo sapiens
atgatatgtgctt

SEQ ID NO: 4824224 - DNA, 23 bp, Homo sapiens
atgatatgtgcttgtgtgtatgt

SEQ ID NO: 4824225 - DNA, 17 bp, Homo sapiens
atgatattttaaaatct

SEQ ID NO: 4824226 - DNA, 16 bp, Homo sapiens
atgatcaaggagggag

SEQ ID NO: 4824227 - DNA, 23 bp, Homo sapiens
atgatctctccacggtagcactt

SEQ ID NO: 4824228 - DNA, 17 bp, Homo sapiens
atgatggatgagaaaaa

SEQ ID NO: 4824229 - DNA, 17 bp, Homo sapiens
atgatgttattttgtac

SEQ ID NO: 4824230 - DNA, 19 bp, Homo sapiens
atgattagacaatgtggaa

SEQ ID NO: 4824231 - DNA, 21 bp, Homo sapiens
atgattcaatcattttgggaa

SEQ ID NO: 4824232 - DNA, 12 bp, Homo sapiens
atgattcaatgt

SEQ ID NO: 4824233 - DNA, 13 bp, Homo sapiens
atgattcaatgtg

SEQ ID NO: 4824234 - DNA, 15 bp, Homo sapiens
atgattcaatgtgaa

SEQ ID NO: 4824235 - DNA, 17 bp, Homo sapiens
atgattcacttttattg

SEQ ID NO: 4824236 - DNA, 18 bp, Homo sapiens
atgattcacttttattgt

SEQ ID NO: 4824237 - DNA, 21 bp, Homo sapiens
atgattcacttttattgtata

SEQ ID NO: 4824238 - DNA, 16 bp, Homo sapiens
atgattctcctctccc

SEQ ID NO: 4824239 - DNA, 15 bp, Homo sapiens
atgattgagagcagc

SEQ ID NO: 4824240 - DNA, 21 bp, Homo sapiens
atgattgagagcagcctcttg

SEQ ID NO: 4824241 - DNA, 12 bp, Homo sapiens
atgattgtctaa

SEQ ID NO: 4824242 - DNA, 22 bp, Homo sapiens
atgattgtctaaccaattgtga

SEQ ID NO: 4824243 - DNA, 17 bp, Homo sapiens
atgatttaagcatttta

SEQ ID NO: 4824244 - DNA, 15 bp, Homo sapiens
atgatttactcatta

SEQ ID NO: 4824245 - DNA, 16 bp, Homo sapiens
atgatttcaatgattg

SEQ ID NO: 4824246 - DNA, 14 bp, Homo sapiens
atgatttcagaaac

SEQ ID NO: 4824247 - DNA, 13 bp, Homo sapiens
atgatttcatgat

SEQ ID NO: 4824248 - DNA, 17 bp, Homo sapiens
atgatttcgtgactgta

SEQ ID NO: 4824249 - DNA, 16 bp, Homo sapiens
atgatttttgccctgc

SEQ ID NO: 4824250 - DNA, 17 bp, Homo sapiens
atgcaaaaatgaattca

SEQ ID NO: 4824251 - DNA, 16 bp, Homo sapiens
atgcaaacactgtgta

SEQ ID NO: 4824252 - DNA, 20 bp, Homo sapiens
atgcaaacactgtgtattta

SEQ ID NO: 4824253 - DNA, 19 bp, Homo sapiens
atgcaaggacaagcaatta

SEQ ID NO: 4824254 - DNA, 15 bp, Homo sapiens
atgcaataaagagta

SEQ ID NO: 4824255 - DNA, 13 bp, Homo sapiens
atgcaatgcatct

SEQ ID NO: 4824256 - DNA, 16 bp, Homo sapiens
atgcaatgcatctgaa

SEQ ID NO: 4824257 - DNA, 22 bp, Homo sapiens
atgcaatgcatctgaaagtttt

SEQ ID NO: 4824258 - DNA, 22 bp, Homo sapiens
atgcacaccaaattgctgagat

SEQ ID NO: 4824259 - DNA, 15 bp, Homo sapiens
atgcacatgtattct

SEQ ID NO: 4824260 - DNA, 17 bp, Homo sapiens
atgcacattcatcctca

SEQ ID NO: 4824261 - DNA, 19 bp, Homo sapiens
atgcacattcatcctcaca

SEQ ID NO: 4824262 - DNA, 11 bp, Homo sapiens
atgcaccaaac

SEQ ID NO: 4824263 - DNA, 20 bp, Homo sapiens
atgcactaatcaatactttg

SEQ ID NO: 4824264 - DNA, 21 bp, Homo sapiens
atgcactaatcaatactttga

SEQ ID NO: 4824265 - DNA, 21 bp, Homo sapiens
atgcagatctagccaggcctc

SEQ ID NO: 4824266 - DNA, 22 bp, Homo sapiens
atgcaggaagaccacatgcgct

SEQ ID NO: 4824267 - DNA, 18 bp, Homo sapiens
atgcagggcccccacagg

SEQ ID NO: 4824268 - DNA, 19 bp, Homo sapiens
atgcagtataaaatgtaaa

SEQ ID NO: 4824269 - DNA, 14 bp, Homo sapiens
atgcagtgtattta

SEQ ID NO: 4824270 - DNA, 13 bp, Homo sapiens
atgcatacaaatc

SEQ ID NO: 4824271 - DNA, 22 bp, Homo sapiens
atgcatacaaatctcactgtat

SEQ ID NO: 4824272 - DNA, 18 bp, Homo sapiens
atgcatactgagatagct

SEQ ID NO: 4824273 - DNA, 13 bp, Homo sapiens
atgcatagacaag

SEQ ID NO: 4824274 - DNA, 17 bp, Homo sapiens
atgcatagacaagtgtt

SEQ ID NO: 4824275 - DNA, 16 bp, Homo sapiens
atgcatgagaactaaa

SEQ ID NO: 4824276 - DNA, 20 bp, Homo sapiens
atgcatgagaactaaataga

SEQ ID NO: 4824277 - DNA, 19 bp, Homo sapiens
atgcatggcctcccagcca

SEQ ID NO: 4824278 - DNA, 15 bp, Homo sapiens
atgcatgtagcatat

SEQ ID NO: 4824279 - DNA, 13 bp, Homo sapiens
atgcatttagcat

SEQ ID NO: 4824280 - DNA, 17 bp, Homo sapiens
atgcatttagcatgagt

SEQ ID NO: 4824281 - DNA, 12 bp, Homo sapiens
atgcatttatgc

SEQ ID NO: 4824282 - DNA, 19 bp, Homo sapiens
atgcatttatgcatgagaa

SEQ ID NO: 4824283 - DNA, 16 bp, Homo sapiens
atgcattttaaatgtc

SEQ ID NO: 4824284 - DNA, 16 bp, Homo sapiens
atgccaatgtccaggt

SEQ ID NO: 4824285 - DNA, 14 bp, Homo sapiens
atgccaccacccac

SEQ ID NO: 4824286 - DNA, 20 bp, Homo sapiens
atgccagtccagatgtgcct

SEQ ID NO: 4824287 - DNA, 20 bp, Homo sapiens
atgccatgtatgttgcatga

SEQ ID NO: 4824288 - DNA, 19 bp, Homo sapiens
atgcccagcttggagtgcc

SEQ ID NO: 4824289 - DNA, 20 bp, Homo sapiens
atgcccagcttggagtgcca

SEQ ID NO: 4824290 - DNA, 13 bp, Homo sapiens
atgccgtttcctt

SEQ ID NO: 4824291 - DNA, 16 bp, Homo sapiens
atgcctcattttattc

SEQ ID NO: 4824292 - DNA, 12 bp, Homo sapiens
atgcctgttgat

SEQ ID NO: 4824293 - DNA, 21 bp, Homo sapiens
atgcctgttgatctatgggaa

SEQ ID NO: 4824294 - DNA, 19 bp, Homo sapiens
atgcctttctagcaattgc

SEQ ID NO: 4824295 - DNA, 13 bp, Homo sapiens
atgccttttgggt

SEQ ID NO: 4824296 - DNA, 13 bp, Homo sapiens
atgcgctcctggc

SEQ ID NO: 4824297 - DNA, 18 bp, Homo sapiens
atgcgctcttcaccagga

SEQ ID NO: 4824298 - DNA, 19 bp, Homo sapiens
atgcgctcttcaccaggaa

SEQ ID NO: 4824299 - DNA, 21 bp, Homo sapiens
atgcgctcttcaccaggaaga

SEQ ID NO: 4824300 - DNA, 16 bp, Homo sapiens
atgctacaaaatgtgt

SEQ ID NO: 4824301 - DNA, 18 bp, Homo sapiens
atgctacaaaatgtgtgc

SEQ ID NO: 4824302 - DNA, 13 bp, Homo sapiens
atgctcaatgtgc

SEQ ID NO: 4824303 - DNA, 15 bp, Homo sapiens
atgctcaatgtgctg

SEQ ID NO: 4824304 - DNA, 16 bp, Homo sapiens
atgctcaatgtgctgt

SEQ ID NO: 4824305 - DNA, 16 bp, Homo sapiens
atgctcctcactgccc

SEQ ID NO: 4824306 - DNA, 23 bp, Homo sapiens
atgctctgagaagaggagccctc

SEQ ID NO: 4824307 - DNA, 18 bp, Homo sapiens
atgctctttcaccctgcc

SEQ ID NO: 4824308 - DNA, 13 bp, Homo sapiens
atgctgcctgcct

SEQ ID NO: 4824309 - DNA, 22 bp, Homo sapiens
atgctgcctgcctccggccctg

SEQ ID NO: 4824310 - DNA, 22 bp, Homo sapiens
atgctgctgagcacatctcttc

SEQ ID NO: 4824311 - DNA, 12 bp, Homo sapiens
atgctgctttgg

SEQ ID NO: 4824312 - DNA, 19 bp, Homo sapiens
atgctgctttggggatatt

SEQ ID NO: 4824313 - DNA, 18 bp, Homo sapiens
atgctggccagcaccctc

SEQ ID NO: 4824314 - DNA, 20 bp, Homo sapiens
atgctggccagcaccctctc

SEQ ID NO: 4824315 - DNA, 23 bp, Homo sapiens
atgctggccagcctggggcctgg

SEQ ID NO: 4824316 - DNA, 14 bp, Homo sapiens
atgctgtatctgtg

SEQ ID NO: 4824317 - DNA, 14 bp, Homo sapiens
atgctgtgtgcaga

SEQ ID NO: 4824318 - DNA, 15 bp, Homo sapiens
atgctgttctcaatc

SEQ ID NO: 4824319 - DNA, 18 bp, Homo sapiens
atgcttaaataaaaatta

SEQ ID NO: 4824320 - DNA, 22 bp, Homo sapiens
atgcttaacataaacttgtact

SEQ ID NO: 4824321 - DNA, 13 bp, Homo sapiens
atgcttagagcat

SEQ ID NO: 4824322 - DNA, 10 bp, Homo sapiens
atgctttctc

SEQ ID NO: 4824323 - DNA, 13 bp, Homo sapiens
atgcttttctcat

SEQ ID NO: 4824324 - DNA, 16 bp, Homo sapiens
atgcttttctcatggt

SEQ ID NO: 4824325 - DNA, 15 bp, Homo sapiens
atgcttttttgcaat

SEQ ID NO: 4824326 - DNA, 17 bp, Homo sapiens
atgcttttttgcaataa

SEQ ID NO: 4824327 - DNA, 14 bp, Homo sapiens
atggaaaaatgcca

SEQ ID NO: 4824328 - DNA, 13 bp, Homo sapiens
atggaaaactgtt

SEQ ID NO: 4824329 - DNA, 20 bp, Homo sapiens
atggaaaactgttaagggaa

SEQ ID NO: 4824330 - DNA, 16 bp, Homo sapiens
atggaaagggtgtggc

SEQ ID NO: 4824331 - DNA, 18 bp, Homo sapiens
atggaaaggtcctgctgt

SEQ ID NO: 4824332 - DNA, 15 bp, Homo sapiens
atggaacagccctgc

SEQ ID NO: 4824333 - DNA, 15 bp, Homo sapiens
atggaaccttccctc

SEQ ID NO: 4824334 - DNA, 17 bp, Homo sapiens
atggaagacagctctta

SEQ ID NO: 4824335 - DNA, 19 bp, Homo sapiens
atggaagggccttctccac

SEQ ID NO: 4824336 - DNA, 18 bp, Homo sapiens
atggaatcacagccaata

SEQ ID NO: 4824337 - DNA, 23 bp, Homo sapiens
atggacatgagagtagggccctg

SEQ ID NO: 4824338 - DNA, 15 bp, Homo sapiens
atggaccaaatgtaa

SEQ ID NO: 4824339 - DNA, 19 bp, Homo sapiens
atggaccaaatgtaaaata

SEQ ID NO: 4824340 - DNA, 21 bp, Homo sapiens
atggactaaccccaacgcaca

SEQ ID NO: 4824341 - DNA, 17 bp, Homo sapiens
atggacttgcttcttgt

SEQ ID NO: 4824342 - DNA, 18 bp, Homo sapiens
atggacttgcttcttgtg

SEQ ID NO: 4824343 - DNA, 14 bp, Homo sapiens
atggagaaggaagg

SEQ ID NO: 4824344 - DNA, 18 bp, Homo sapiens
atggagaggcggcctcgt

SEQ ID NO: 4824345 - DNA, 19 bp, Homo sapiens
atggagcagtacatgggaa

SEQ ID NO: 4824346 - DNA, 14 bp, Homo sapiens
atggaggaggaaga

SEQ ID NO: 4824347 - DNA, 23 bp, Homo sapiens
atggagtgtgcctctctctccca

SEQ ID NO: 4824348 - DNA, 13 bp, Homo sapiens
atggatcttgctg

SEQ ID NO: 4824349 - DNA, 16 bp, Homo sapiens
atggatgacaaagaaa

SEQ ID NO: 4824350 - DNA, 15 bp, Homo sapiens
atggatgtaatatag

SEQ ID NO: 4824351 - DNA, 16 bp, Homo sapiens
atggattcacttctat

SEQ ID NO: 4824352 - DNA, 18 bp, Homo sapiens
atggattcacttctattt

SEQ ID NO: 4824353 - DNA, 19 bp, Homo sapiens
atggattcagtttctaaaa

SEQ ID NO: 4824354 - DNA, 18 bp, Homo sapiens
atggattcccctggacat

SEQ ID NO: 4824355 - DNA, 18 bp, Homo sapiens
atggatttgacacactca

SEQ ID NO: 4824356 - DNA, 20 bp, Homo sapiens
atggcatattgataataaaa

SEQ ID NO: 4824357 - DNA, 21 bp, Homo sapiens
atggcatattgataataaaat

SEQ ID NO: 4824358 - DNA, 19 bp, Homo sapiens
atggcatgtgaaaagtaaa

SEQ ID NO: 4824359 - DNA, 20 bp, Homo sapiens
atggcatttagcacagtatt

SEQ ID NO: 4824360 - DNA, 15 bp, Homo sapiens
atggccaagtgtaca

SEQ ID NO: 4824361 - DNA, 17 bp, Homo sapiens
atggccaagtgtacatt

SEQ ID NO: 4824362 - DNA, 13 bp, Homo sapiens
atggccaggagtg

SEQ ID NO: 4824363 - DNA, 15 bp, Homo sapiens
atggccaggagtggg

SEQ ID NO: 4824364 - DNA, 18 bp, Homo sapiens
atggccaggcctcaggga

SEQ ID NO: 4824365 - DNA, 17 bp, Homo sapiens
atggccccagctggctg

SEQ ID NO: 4824366 - DNA, 22 bp, Homo sapiens
atggccgcaacttcccaggccg

SEQ ID NO: 4824367 - DNA, 13 bp, Homo sapiens
atggccgctgccc

SEQ ID NO: 4824368 - DNA, 15 bp, Homo sapiens
atggccgctgcccac

SEQ ID NO: 4824369 - DNA, 15 bp, Homo sapiens
atggcctcccagcca

SEQ ID NO: 4824370 - DNA, 21 bp, Homo sapiens
atggctctgggctatatgcct

SEQ ID NO: 4824371 - DNA, 16 bp, Homo sapiens
atggctgggtttgggc

SEQ ID NO: 4824372 - DNA, 13 bp, Homo sapiens
atggctgtatttt

SEQ ID NO: 4824373 - DNA, 17 bp, Homo sapiens
atggctgttatctgtct

SEQ ID NO: 4824374 - DNA, 20 bp, Homo sapiens
atggcttgggctggagtggg

SEQ ID NO: 4824375 - DNA, 19 bp, Homo sapiens
atggcttgtagggtgaggc

SEQ ID NO: 4824376 - DNA, 23 bp, Homo sapiens
atgggaaaggaggcatgcctctg

SEQ ID NO: 4824377 - DNA, 21 bp, Homo sapiens
atgggaatgaatgtcagtgtg

SEQ ID NO: 4824378 - DNA, 23 bp, Homo sapiens
atgggagcaaatatctaaataat

SEQ ID NO: 4824379 - DNA, 13 bp, Homo sapiens
atgggagctcatg

SEQ ID NO: 4824380 - DNA, 18 bp, Homo sapiens
atgggaggaacaaagaca

SEQ ID NO: 4824381 - DNA, 14 bp, Homo sapiens
atgggcaaggggcc

SEQ ID NO: 4824382 - DNA, 17 bp, Homo sapiens
atgggcaaggggccagg

SEQ ID NO: 4824383 - DNA, 19 bp, Homo sapiens
atgggcaaggggccaggaa

SEQ ID NO: 4824384 - DNA, 13 bp, Homo sapiens
atgggcagctggg

SEQ ID NO: 4824385 - DNA, 15 bp, Homo sapiens
atgggcagctggggg

SEQ ID NO: 4824386 - DNA, 17 bp, Homo sapiens
atgggctgcaaaatgaa

SEQ ID NO: 4824387 - DNA, 16 bp, Homo sapiens
atggggaactccccca

SEQ ID NO: 4824388 - DNA, 18 bp, Homo sapiens
atggggaactcccccaga

SEQ ID NO: 4824389 - DNA, 16 bp, Homo sapiens
atggggagaggaactc

SEQ ID NO: 4824390 - DNA, 19 bp, Homo sapiens
atggggctgacagcactaa

SEQ ID NO: 4824391 - DNA, 20 bp, Homo sapiens
atggggtgggagccacaggg

SEQ ID NO: 4824392 - DNA, 13 bp, Homo sapiens
atgggtaaataaa

SEQ ID NO: 4824393 - DNA, 15 bp, Homo sapiens
atgggtaaataaatg

SEQ ID NO: 4824394 - DNA, 17 bp, Homo sapiens
atgggtaaataaatgct

SEQ ID NO: 4824395 - DNA, 16 bp, Homo sapiens
atgggtgtcccctggt

SEQ ID NO: 4824396 - DNA, 19 bp, Homo sapiens
atgggtgtcccctggtgcc

SEQ ID NO: 4824397 - DNA, 20 bp, Homo sapiens
atgggtgtcccctggtgccc

SEQ ID NO: 4824398 - DNA, 21 bp, Homo sapiens
atgggttttgttaggggtggg

SEQ ID NO: 4824399 - DNA, 14 bp, Homo sapiens
atggtaaataactg

SEQ ID NO: 4824400 - DNA, 15 bp, Homo sapiens
atggtaaataactgt

SEQ ID NO: 4824401 - DNA, 18 bp, Homo sapiens
atggtagaaaaatttcac

SEQ ID NO: 4824402 - DNA, 21 bp, Homo sapiens
atggtagaaactttggaagtt

SEQ ID NO: 4824403 - DNA, 23 bp, Homo sapiens
atggtagaaattttatctcttct

SEQ ID NO: 4824404 - DNA, 15 bp, Homo sapiens
atggtagctctgaag

SEQ ID NO: 4824405 - DNA, 17 bp, Homo sapiens
atggtatgctggccagc

SEQ ID NO: 4824406 - DNA, 23 bp, Homo sapiens
atggtatgctggccagcaccctc

SEQ ID NO: 4824407 - DNA, 20 bp, Homo sapiens
atggtattttcgtgcatttg

SEQ ID NO: 4824408 - DNA, 22 bp, Homo sapiens
atggtattttcgtgcatttgtg

SEQ ID NO: 4824409 - DNA, 22 bp, Homo sapiens
atggtattttttgtgaatggtt

SEQ ID NO: 4824410 - DNA, 14 bp, Homo sapiens
atggtcacagaccc

SEQ ID NO: 4824411 - DNA, 16 bp, Homo sapiens
atggtcacagacccct

SEQ ID NO: 4824412 - DNA, 20 bp, Homo sapiens
atggtcacagacccctgggg

SEQ ID NO: 4824413 - DNA, 20 bp, Homo sapiens
atggtgaactgaagcagagt

SEQ ID NO: 4824414 - DNA, 17 bp, Homo sapiens
atggtgcagtgaagaaa

SEQ ID NO: 4824415 - DNA, 13 bp, Homo sapiens
atggtgccccctg

SEQ ID NO: 4824416 - DNA, 16 bp, Homo sapiens
atggtgctgggtcctt

SEQ ID NO: 4824417 - DNA, 20 bp, Homo sapiens
atggtgggctccagagtagg

SEQ ID NO: 4824418 - DNA, 21 bp, Homo sapiens
atggtggtttcagaaagggca

SEQ ID NO: 4824419 - DNA, 15 bp, Homo sapiens
atggttgcaaagtgt

SEQ ID NO: 4824420 - DNA, 18 bp, Homo sapiens
atggttggttagtgcatg

SEQ ID NO: 4824421 - DNA, 14 bp, Homo sapiens
atggttttcttgtg

SEQ ID NO: 4824422 - DNA, 20 bp, Homo sapiens
atggtttttatttctcgggt

SEQ ID NO: 4824423 - DNA, 18 bp, Homo sapiens
atgtaaaaaccctgctaa

SEQ ID NO: 4824424 - DNA, 16 bp, Homo sapiens
atgtaaaatatttata

SEQ ID NO: 4824425 - DNA, 18 bp, Homo sapiens
atgtaaataggtttctaa

SEQ ID NO: 4824426 - DNA, 17 bp, Homo sapiens
atgtaaatattgctgtc

SEQ ID NO: 4824427 - DNA, 18 bp, Homo sapiens
atgtaaattgactgtact

SEQ ID NO: 4824428 - DNA, 19 bp, Homo sapiens
atgtaagtttctaagaatt

SEQ ID NO: 4824429 - DNA, 17 bp, Homo sapiens
atgtaatatatacatat

SEQ ID NO: 4824430 - DNA, 14 bp, Homo sapiens
atgtaatattaaat

SEQ ID NO: 4824431 - DNA, 18 bp, Homo sapiens
atgtaattaaactgttaa

SEQ ID NO: 4824432 - DNA, 17 bp, Homo sapiens
atgtacaggctgagaca

SEQ ID NO: 4824433 - DNA, 18 bp, Homo sapiens
atgtacaggctgagacac

SEQ ID NO: 4824434 - DNA, 19 bp, Homo sapiens
atgtacaggctgagacaca

SEQ ID NO: 4824435 - DNA, 13 bp, Homo sapiens
atgtactgtattg

SEQ ID NO: 4824436 - DNA, 18 bp, Homo sapiens
atgtagcaaattccaata

SEQ ID NO: 4824437 - DNA, 20 bp, Homo sapiens
atgtagcttcagtcattaaa

SEQ ID NO: 4824438 - DNA, 22 bp, Homo sapiens
atgtagggcagaatagctgata

SEQ ID NO: 4824439 - DNA, 12 bp, Homo sapiens
atgtatacacac

SEQ ID NO: 4824440 - DNA, 15 bp, Homo sapiens
atgtatacacacaca

SEQ ID NO: 4824441 - DNA, 19 bp, Homo sapiens
atgtatagtgagtgtggct

SEQ ID NO: 4824442 - DNA, 18 bp, Homo sapiens
atgtatatctgtgtaaga

SEQ ID NO: 4824443 - DNA, 22 bp, Homo sapiens
atgtatatctgtgtaagacacg

SEQ ID NO: 4824444 - DNA, 16 bp, Homo sapiens
atgtatctgaaagtca

SEQ ID NO: 4824445 - DNA, 13 bp, Homo sapiens
atgtatcttattt

SEQ ID NO: 4824446 - DNA, 17 bp, Homo sapiens
atgtatcttatttatat

SEQ ID NO: 4824447 - DNA, 19 bp, Homo sapiens
atgtatcttatttatatat

SEQ ID NO: 4824448 - DNA, 20 bp, Homo sapiens
atgtatcttatttatatatg

SEQ ID NO: 4824449 - DNA, 21 bp, Homo sapiens
atgtatcttatttatatatga

SEQ ID NO: 4824450 - DNA, 22 bp, Homo sapiens
atgtatcttatttatatatgaa

SEQ ID NO: 4824451 - DNA, 22 bp, Homo sapiens
atgtatgccatgtatgttgcat

SEQ ID NO: 4824452 - DNA, 18 bp, Homo sapiens
atgtatgtgtgagtgtat

SEQ ID NO: 4824453 - DNA, 23 bp, Homo sapiens
atgtatgtgtgagtgtatgtata

SEQ ID NO: 4824454 - DNA, 15 bp, Homo sapiens
atgtatgttgcatga

SEQ ID NO: 4824455 - DNA, 21 bp, Homo sapiens
atgtattaagcccacagtata

SEQ ID NO: 4824456 - DNA, 14 bp, Homo sapiens
atgtattatggtga

SEQ ID NO: 4824457 - DNA, 20 bp, Homo sapiens
atgtattatgtcctgtgaga

SEQ ID NO: 4824458 - DNA, 13 bp, Homo sapiens
atgtatttgtagt

SEQ ID NO: 4824459 - DNA, 21 bp, Homo sapiens
atgtatttgtagtgttattgc

SEQ ID NO: 4824460 - DNA, 17 bp, Homo sapiens
atgtcaaaaatatttag

SEQ ID NO: 4824461 - DNA, 23 bp, Homo sapiens
atgtcaaaaatatttaggaattt

SEQ ID NO: 4824462 - DNA, 22 bp, Homo sapiens
atgtcaatgctatggactgcac

SEQ ID NO: 4824463 - DNA, 21 bp, Homo sapiens
atgtcacatgacatccacatg

SEQ ID NO: 4824464 - DNA, 12 bp, Homo sapiens
atgtcagtgtga

SEQ ID NO: 4824465 - DNA, 23 bp, Homo sapiens
atgtcataaagtgagaaaactgt

SEQ ID NO: 4824466 - DNA, 15 bp, Homo sapiens
atgtcatttgctaat

SEQ ID NO: 4824467 - DNA, 19 bp, Homo sapiens
atgtcatttgctaatgaat

SEQ ID NO: 4824468 - DNA, 19 bp, Homo sapiens
atgtccaaacttaacagat

SEQ ID NO: 4824469 - DNA, 21 bp, Homo sapiens
atgtccaaacttaacagatca

SEQ ID NO: 4824470 - DNA, 18 bp, Homo sapiens
atgtccaacagagtggac

SEQ ID NO: 4824471 - DNA, 19 bp, Homo sapiens
atgtccaagcatcagcaag

SEQ ID NO: 4824472 - DNA, 22 bp, Homo sapiens
atgtccaagcatcagcaagaca

SEQ ID NO: 4824473 - DNA, 12 bp, Homo sapiens
atgtcccaaata

SEQ ID NO: 4824474 - DNA, 14 bp, Homo sapiens
atgtcctatccctg

SEQ ID NO: 4824475 - DNA, 14 bp, Homo sapiens
atgtcctcagaggg

SEQ ID NO: 4824476 - DNA, 19 bp, Homo sapiens
atgtcctgtgagatgtgta

SEQ ID NO: 4824477 - DNA, 20 bp, Homo sapiens
atgtcctgtgagatgtgtat

SEQ ID NO: 4824478 - DNA, 13 bp, Homo sapiens
atgtctataaatg

SEQ ID NO: 4824479 - DNA, 16 bp, Homo sapiens
atgtctataaatggtg

SEQ ID NO: 4824480 - DNA, 15 bp, Homo sapiens
atgtctatgtgtata

SEQ ID NO: 4824481 - DNA, 20 bp, Homo sapiens
atgtctatgtgtatatatta

SEQ ID NO: 4824482 - DNA, 14 bp, Homo sapiens
atgtctcaaaataa

SEQ ID NO: 4824483 - DNA, 13 bp, Homo sapiens
atgtctcatgttt

SEQ ID NO: 4824484 - DNA, 20 bp, Homo sapiens
atgtctgtccctaaacatag

SEQ ID NO: 4824485 - DNA, 21 bp, Homo sapiens
atgtctgtccctaaacatagt

SEQ ID NO: 4824486 - DNA, 16 bp, Homo sapiens
atgtctgtgtatacat

SEQ ID NO: 4824487 - DNA, 19 bp, Homo sapiens
atgtcttcatgttgatgtg

SEQ ID NO: 4824488 - DNA, 16 bp, Homo sapiens
atgtcttcttgggggc

SEQ ID NO: 4824489 - DNA, 19 bp, Homo sapiens
atgtctttggcttcagaat

SEQ ID NO: 4824490 - DNA, 18 bp, Homo sapiens
atgtgaaaagtaaaacag

SEQ ID NO: 4824491 - DNA, 19 bp, Homo sapiens
atgtgaaataaagagttct

SEQ ID NO: 4824492 - DNA, 16 bp, Homo sapiens
atgtgagaaagcagat

SEQ ID NO: 4824493 - DNA, 13 bp, Homo sapiens
atgtgagaccatt

SEQ ID NO: 4824494 - DNA, 18 bp, Homo sapiens
atgtgatatgtgtaatat

SEQ ID NO: 4824495 - DNA, 16 bp, Homo sapiens
atgtgatttatgcatt

SEQ ID NO: 4824496 - DNA, 23 bp, Homo sapiens
atgtgcatctggcctatgaccct

SEQ ID NO: 4824497 - DNA, 14 bp, Homo sapiens
atgtgccccttccc

SEQ ID NO: 4824498 - DNA, 13 bp, Homo sapiens
atgtgctattaat

SEQ ID NO: 4824499 - DNA, 20 bp, Homo sapiens
atgtgctcagccccagacct

SEQ ID NO: 4824500 - DNA, 16 bp, Homo sapiens
atgtgctgctgtggca

SEQ ID NO: 4824501 - DNA, 19 bp, Homo sapiens
atgtgctgttgattctttc

SEQ ID NO: 4824502 - DNA, 20 bp, Homo sapiens
atgtgctgttgattctttca

SEQ ID NO: 4824503 - DNA, 20 bp, Homo sapiens
atgtgcttgtgtgtatgtct

SEQ ID NO: 4824504 - DNA, 14 bp, Homo sapiens
atgtggaattacat

SEQ ID NO: 4824505 - DNA, 18 bp, Homo sapiens
atgtggatggaggtgatg

SEQ ID NO: 4824506 - DNA, 18 bp, Homo sapiens
atgtgggaagaaacaaac

SEQ ID NO: 4824507 - DNA, 18 bp, Homo sapiens
atgtggtggcaataaatg

SEQ ID NO: 4824508 - DNA, 19 bp, Homo sapiens
atgtgtaaatgtggacaca

SEQ ID NO: 4824509 - DNA, 16 bp, Homo sapiens
atgtgtaacttctaga

SEQ ID NO: 4824510 - DNA, 18 bp, Homo sapiens
atgtgtaatatcatttca

SEQ ID NO: 4824511 - DNA, 18 bp, Homo sapiens
atgtgtatatattatata

SEQ ID NO: 4824512 - DNA, 23 bp, Homo sapiens
atgtgtcatgatttcaatgattg

SEQ ID NO: 4824513 - DNA, 17 bp, Homo sapiens
atgtgtcccccctgtgg

SEQ ID NO: 4824514 - DNA, 20 bp, Homo sapiens
atgtgtcccccctgtggtct

SEQ ID NO: 4824515 - DNA, 21 bp, Homo sapiens
atgtgtcccccctgtggtctg

SEQ ID NO: 4824516 - DNA, 22 bp, Homo sapiens
atgtgtcccccctgtggtctgt

SEQ ID NO: 4824517 - DNA, 18 bp, Homo sapiens
atgtgtcccctcactctg

SEQ ID NO: 4824518 - DNA, 14 bp, Homo sapiens
atgtgtgagtgtat

SEQ ID NO: 4824519 - DNA, 18 bp, Homo sapiens
atgtgtgagtgtatgtat

SEQ ID NO: 4824520 - DNA, 23 bp, Homo sapiens
atgtgtgtcagcccatgtcaatc

SEQ ID NO: 4824521 - DNA, 13 bp, Homo sapiens
atgtgttaatctt

SEQ ID NO: 4824522 - DNA, 20 bp, Homo sapiens
atgtgttaatcttaatgtat

SEQ ID NO: 4824523 - DNA, 22 bp, Homo sapiens
atgtgttaatcttaatgtatat

SEQ ID NO: 4824524 - DNA, 14 bp, Homo sapiens
atgtgttctttgta

SEQ ID NO: 4824525 - DNA, 12 bp, Homo sapiens
atgttaaagagg

SEQ ID NO: 4824526 - DNA, 14 bp, Homo sapiens
atgttaaatctaca

SEQ ID NO: 4824527 - DNA, 19 bp, Homo sapiens
atgttaaatctacaaactt

SEQ ID NO: 4824528 - DNA, 16 bp, Homo sapiens
atgttattcaataact

SEQ ID NO: 4824529 - DNA, 16 bp, Homo sapiens
atgttatttatgatgt

SEQ ID NO: 4824530 - DNA, 14 bp, Homo sapiens
atgttatttctctg

SEQ ID NO: 4824531 - DNA, 20 bp, Homo sapiens
atgttattttgtacgtgtta

SEQ ID NO: 4824532 - DNA, 13 bp, Homo sapiens
atgttatttttgg

SEQ ID NO: 4824533 - DNA, 17 bp, Homo sapiens
atgttcacgcaacttga

SEQ ID NO: 4824534 - DNA, 17 bp, Homo sapiens
atgttccgttcatctga

SEQ ID NO: 4824535 - DNA, 18 bp, Homo sapiens
atgttccgttcatctgag

SEQ ID NO: 4824536 - DNA, 14 bp, Homo sapiens
atgttctgaaatgg

SEQ ID NO: 4824537 - DNA, 19 bp, Homo sapiens
atgttctgacagcatttca

SEQ ID NO: 4824538 - DNA, 18 bp, Homo sapiens
atgttcttgagcagctga

SEQ ID NO: 4824539 - DNA, 12 bp, Homo sapiens
atgttcttgcag

SEQ ID NO: 4824540 - DNA, 16 bp, Homo sapiens
atgttgtcctgtgtca

SEQ ID NO: 4824541 - DNA, 23 bp, Homo sapiens
atgttgtcctgtgtcatctgtca

SEQ ID NO: 4824542 - DNA, 19 bp, Homo sapiens
atgttgttcaaatgcattt

SEQ ID NO: 4824543 - DNA, 15 bp, Homo sapiens
atgtttaaaatggca

SEQ ID NO: 4824544 - DNA, 22 bp, Homo sapiens
atgtttaaaatggcatttagca

SEQ ID NO: 4824545 - DNA, 21 bp, Homo sapiens
atgtttagtagctgataaaga

SEQ ID NO: 4824546 - DNA, 18 bp, Homo sapiens
atgtttatattgttttta

SEQ ID NO: 4824547 - DNA, 20 bp, Homo sapiens
atgtttctgcagtattctgt

SEQ ID NO: 4824548 - DNA, 19 bp, Homo sapiens
atgttttaaagaagtccat

SEQ ID NO: 4824549 - DNA, 12 bp, Homo sapiens
atgttttgctaa

SEQ ID NO: 4824550 - DNA, 14 bp, Homo sapiens
atgttttgctaatg

SEQ ID NO: 4824551 - DNA, 17 bp, Homo sapiens
atgttttggagagagca

SEQ ID NO: 4824552 - DNA, 15 bp, Homo sapiens
attaaaaagacactt

SEQ ID NO: 4824553 - DNA, 15 bp, Homo sapiens
attaaaaagttaatc

SEQ ID NO: 4824554 - DNA, 17 bp, Homo sapiens
attaaaaagttaatctt

SEQ ID NO: 4824555 - DNA, 22 bp, Homo sapiens
attaaaaatatacaatttcttg

SEQ ID NO: 4824556 - DNA, 13 bp, Homo sapiens
attaaaacaaaat

SEQ ID NO: 4824557 - DNA, 21 bp, Homo sapiens
attaaaacaagagaccacttc

SEQ ID NO: 4824558 - DNA, 15 bp, Homo sapiens
attaaaatagttaca

SEQ ID NO: 4824559 - DNA, 19 bp, Homo sapiens
attaaaatattttcttaat

SEQ ID NO: 4824560 - DNA, 13 bp, Homo sapiens
attaaaattagtg

SEQ ID NO: 4824561 - DNA, 16 bp, Homo sapiens
attaaaattagtgaga

SEQ ID NO: 4824562 - DNA, 11 bp, Homo sapiens
attaaacaatt

SEQ ID NO: 4824563 - DNA, 16 bp, Homo sapiens
attaaacaatttattt

SEQ ID NO: 4824564 - DNA, 17 bp, Homo sapiens
attaaacaatttatttt

SEQ ID NO: 4824565 - DNA, 17 bp, Homo sapiens
attaaactgggaaatga

SEQ ID NO: 4824566 - DNA, 13 bp, Homo sapiens
attaaactgttaa

SEQ ID NO: 4824567 - DNA, 12 bp, Homo sapiens
attaaacttcag

SEQ ID NO: 4824568 - DNA, 13 bp, Homo sapiens
attaaacttcagc

SEQ ID NO: 4824569 - DNA, 16 bp, Homo sapiens
attaaacttctactga

SEQ ID NO: 4824570 - DNA, 13 bp, Homo sapiens
attaaagatgcag

SEQ ID NO: 4824571 - DNA, 15 bp, Homo sapiens
attaaagatgcaggt

SEQ ID NO: 4824572 - DNA, 22 bp, Homo sapiens
attaaagtctacactgcctttg

SEQ ID NO: 4824573 - DNA, 17 bp, Homo sapiens
attaaatgaaatacttg

SEQ ID NO: 4824574 - DNA, 22 bp, Homo sapiens
attaaatgtagcttcagtcatt

SEQ ID NO: 4824575 - DNA, 16 bp, Homo sapiens
attaaattatcattgt

SEQ ID NO: 4824576 - DNA, 13 bp, Homo sapiens
attaaatttatta

SEQ ID NO: 4824577 - DNA, 16 bp, Homo sapiens
attaacaattaattgt

SEQ ID NO: 4824578 - DNA, 12 bp, Homo sapiens
attaagaaaccc

SEQ ID NO: 4824579 - DNA, 11 bp, Homo sapiens
attaagaaact

SEQ ID NO: 4824580 - DNA, 19 bp, Homo sapiens
attaagcccacagtatatt

SEQ ID NO: 4824581 - DNA, 23 bp, Homo sapiens
attaagctccagtgctttatcca

SEQ ID NO: 4824582 - DNA, 20 bp, Homo sapiens
attaagctgtttgaaggaaa

SEQ ID NO: 4824583 - DNA, 21 bp, Homo sapiens
attaagtattccttggcccag

SEQ ID NO: 4824584 - DNA, 17 bp, Homo sapiens
attaagttataccagca

SEQ ID NO: 4824585 - DNA, 12 bp, Homo sapiens
attaatatttgt

SEQ ID NO: 4824586 - DNA, 17 bp, Homo sapiens
attaatccacatgtttc

SEQ ID NO: 4824587 - DNA, 18 bp, Homo sapiens
attaatccacatgtttca

SEQ ID NO: 4824588 - DNA, 19 bp, Homo sapiens
attaatggaaaactgttaa

SEQ ID NO: 4824589 - DNA, 15 bp, Homo sapiens
attaatggcactgat

SEQ ID NO: 4824590 - DNA, 15 bp, Homo sapiens
attaatgtagataaa

SEQ ID NO: 4824591 - DNA, 17 bp, Homo sapiens
attaattctttatcaca

SEQ ID NO: 4824592 - DNA, 22 bp, Homo sapiens
attaattctttatcacatgttg

SEQ ID NO: 4824593 - DNA, 11 bp, Homo sapiens
attaattgagg

SEQ ID NO: 4824594 - DNA, 12 bp, Homo sapiens
attaattgtctt

SEQ ID NO: 4824595 - DNA, 14 bp, Homo sapiens
attaatttaaatga

SEQ ID NO: 4824596 - DNA, 20 bp, Homo sapiens
attaatttctgccatttcat

SEQ ID NO: 4824597 - DNA, 13 bp, Homo sapiens
attacagaaacac

SEQ ID NO: 4824598 - DNA, 20 bp, Homo sapiens
attacataacaggcattgca

SEQ ID NO: 4824599 - DNA, 19 bp, Homo sapiens
attactggatctcttaaga

SEQ ID NO: 4824600 - DNA, 13 bp, Homo sapiens
attactgtgagaa

SEQ ID NO: 4824601 - DNA, 20 bp, Homo sapiens
attactgtgagaactgtgaa

SEQ ID NO: 4824602 - DNA, 15 bp, Homo sapiens
attactgttcttatt

SEQ ID NO: 4824603 - DNA, 21 bp, Homo sapiens
attactgtttgaaacttttca

SEQ ID NO: 4824604 - DNA, 15 bp, Homo sapiens
attactttaaattat

SEQ ID NO: 4824605 - DNA, 18 bp, Homo sapiens
attactttaaattatatg

SEQ ID NO: 4824606 - DNA, 17 bp, Homo sapiens
attagaattaccatttg

SEQ ID NO: 4824607 - DNA, 21 bp, Homo sapiens
attagaattaccatttgttaa

SEQ ID NO: 4824608 - DNA, 19 bp, Homo sapiens
attagacaatgtggaatta

SEQ ID NO: 4824609 - DNA, 22 bp, Homo sapiens
attagacacacatatacattat

SEQ ID NO: 4824610 - DNA, 21 bp, Homo sapiens
attagagtgcccttaaaataa

SEQ ID NO: 4824611 - DNA, 18 bp, Homo sapiens
attagatccattaattta

SEQ ID NO: 4824612 - DNA, 18 bp, Homo sapiens
attagatgactgaatttc

SEQ ID NO: 4824613 - DNA, 15 bp, Homo sapiens
attagcaccagcttg

SEQ ID NO: 4824614 - DNA, 22 bp, Homo sapiens
attagctgtgatttttgttgat

SEQ ID NO: 4824615 - DNA, 23 bp, Homo sapiens
attaggaacagagtatatatgta

SEQ ID NO: 4824616 - DNA, 12 bp, Homo sapiens
attagtaagatc

SEQ ID NO: 4824617 - DNA, 14 bp, Homo sapiens
attagtatcctgtt

SEQ ID NO: 4824618 - DNA, 12 bp, Homo sapiens
attagtattttg

SEQ ID NO: 4824619 - DNA, 14 bp, Homo sapiens
attagtattttgag

SEQ ID NO: 4824620 - DNA, 15 bp, Homo sapiens
attagtgagatttgt

SEQ ID NO: 4824621 - DNA, 18 bp, Homo sapiens
attataagctatgtcact

SEQ ID NO: 4824622 - DNA, 19 bp, Homo sapiens
attataagctatgtcacta

SEQ ID NO: 4824623 - DNA, 11 bp, Homo sapiens
attataagttg

SEQ ID NO: 4824624 - DNA, 17 bp, Homo sapiens
attataagttgaccttt

SEQ ID NO: 4824625 - DNA, 16 bp, Homo sapiens
attataatgcatctaa

SEQ ID NO: 4824626 - DNA, 12 bp, Homo sapiens
attatagcatgt

SEQ ID NO: 4824627 - DNA, 14 bp, Homo sapiens
attatagtctgtac

SEQ ID NO: 4824628 - DNA, 17 bp, Homo sapiens
attatatacaaagctgt

SEQ ID NO: 4824629 - DNA, 11 bp, Homo sapiens
attatatataa

SEQ ID NO: 4824630 - DNA, 18 bp, Homo sapiens
attatatcagactgcttt

SEQ ID NO: 4824631 - DNA, 19 bp, Homo sapiens
attatatgaagcagaatga

SEQ ID NO: 4824632 - DNA, 22 bp, Homo sapiens
attatattaatataaaaacatt

SEQ ID NO: 4824633 - DNA, 13 bp, Homo sapiens
attatattttgaa

SEQ ID NO: 4824634 - DNA, 14 bp, Homo sapiens
attatcagtgaata

SEQ ID NO: 4824635 - DNA, 18 bp, Homo sapiens
attatcagtgaatataaa

SEQ ID NO: 4824636 - DNA, 19 bp, Homo sapiens
attatcagtgaatataaat

SEQ ID NO: 4824637 - DNA, 19 bp, Homo sapiens
attatcatatatgcttttt

SEQ ID NO: 4824638 - DNA, 22 bp, Homo sapiens
attatcatatatgcttttttgc

SEQ ID NO: 4824639 - DNA, 13 bp, Homo sapiens
attatctctttct

SEQ ID NO: 4824640 - DNA, 17 bp, Homo sapiens
attatctgggttttaga

SEQ ID NO: 4824641 - DNA, 23 bp, Homo sapiens
attatctgggttttagaaattct

SEQ ID NO: 4824642 - DNA, 15 bp, Homo sapiens
attatctgttctatg

SEQ ID NO: 4824643 - DNA, 13 bp, Homo sapiens
attatcttaaacc

SEQ ID NO: 4824644 - DNA, 22 bp, Homo sapiens
attatcttaaacccacataaac

SEQ ID NO: 4824645 - DNA, 16 bp, Homo sapiens
attatgaaatgccaga

SEQ ID NO: 4824646 - DNA, 15 bp, Homo sapiens
attatgacgtgcaca

SEQ ID NO: 4824647 - DNA, 21 bp, Homo sapiens
attatgacgtgcacaaacctt

SEQ ID NO: 4824648 - DNA, 22 bp, Homo sapiens
attatgacgtgcacaaaccttc

SEQ ID NO: 4824649 - DNA, 13 bp, Homo sapiens
attatgttgttca

SEQ ID NO: 4824650 - DNA, 18 bp, Homo sapiens
attattaaaaattataga

SEQ ID NO: 4824651 - DNA, 16 bp, Homo sapiens
attattacaacaagca

SEQ ID NO: 4824652 - DNA, 14 bp, Homo sapiens
attattactttaaa

SEQ ID NO: 4824653 - DNA, 17 bp, Homo sapiens
attattactttaaatta

SEQ ID NO: 4824654 - DNA, 12 bp, Homo sapiens
attattactttt

SEQ ID NO: 4824655 - DNA, 13 bp, Homo sapiens
attattatattgt

SEQ ID NO: 4824656 - DNA, 15 bp, Homo sapiens
attattatattgttt

SEQ ID NO: 4824657 - DNA, 14 bp, Homo sapiens
attattattactgt

SEQ ID NO: 4824658 - DNA, 18 bp, Homo sapiens
attattgggcttaatata

SEQ ID NO: 4824659 - DNA, 14 bp, Homo sapiens
attatttaactaat

SEQ ID NO: 4824660 - DNA, 14 bp, Homo sapiens
attatttagtaaaa

SEQ ID NO: 4824661 - DNA, 15 bp, Homo sapiens
attatttagtaaaat

SEQ ID NO: 4824662 - DNA, 19 bp, Homo sapiens
attatttatcgaaagtaaa

SEQ ID NO: 4824663 - DNA, 18 bp, Homo sapiens
attattttctatatttgg

SEQ ID NO: 4824664 - DNA, 14 bp, Homo sapiens
attattttctgtaa

SEQ ID NO: 4824665 - DNA, 13 bp, Homo sapiens
attcaaagagaaa

SEQ ID NO: 4824666 - DNA, 13 bp, Homo sapiens
attcaaatttatt

SEQ ID NO: 4824667 - DNA, 18 bp, Homo sapiens
attcaacaggttttcctg

SEQ ID NO: 4824668 - DNA, 21 bp, Homo sapiens
attcaactttccaaataaaag

SEQ ID NO: 4824669 - DNA, 18 bp, Homo sapiens
attcaagaagatagttgt

SEQ ID NO: 4824670 - DNA, 21 bp, Homo sapiens
attcaagaagatagttgtaaa

SEQ ID NO: 4824671 - DNA, 22 bp, Homo sapiens
attcaataactattgctgcttt

SEQ ID NO: 4824672 - DNA, 21 bp, Homo sapiens
attcaatgggtaaataaatgc

SEQ ID NO: 4824673 - DNA, 17 bp, Homo sapiens
attcaatgtgaatttta

SEQ ID NO: 4824674 - DNA, 13 bp, Homo sapiens
attcacactgtgc

SEQ ID NO: 4824675 - DNA, 12 bp, Homo sapiens
attcacccctcc

SEQ ID NO: 4824676 - DNA, 23 bp, Homo sapiens
attcacccctcccacctctttct

SEQ ID NO: 4824677 - DNA, 14 bp, Homo sapiens
attcacctgtaaaa

SEQ ID NO: 4824678 - DNA, 15 bp, Homo sapiens
attcacttttattgt

SEQ ID NO: 4824679 - DNA, 17 bp, Homo sapiens
attcacttttattgtat

SEQ ID NO: 4824680 - DNA, 23 bp, Homo sapiens
attcagaatgtgcaaagcagtat

SEQ ID NO: 4824681 - DNA, 17 bp, Homo sapiens
attcagagatgtaccat

SEQ ID NO: 4824682 - DNA, 20 bp, Homo sapiens
attcagagatgtaccatgtt

SEQ ID NO: 4824683 - DNA, 21 bp, Homo sapiens
attcagagatgtaccatgtta

SEQ ID NO: 4824684 - DNA, 14 bp, Homo sapiens
attcagatctgaag

SEQ ID NO: 4824685 - DNA, 16 bp, Homo sapiens
attcagatctgaagta

SEQ ID NO: 4824686 - DNA, 13 bp, Homo sapiens
attcaggaaatgt

SEQ ID NO: 4824687 - DNA, 16 bp, Homo sapiens
attcaggaaatgttca

SEQ ID NO: 4824688 - DNA, 14 bp, Homo sapiens
attcaggaatgggc

SEQ ID NO: 4824689 - DNA, 16 bp, Homo sapiens
attcagtctatgctgt

SEQ ID NO: 4824690 - DNA, 18 bp, Homo sapiens
attcagtctatgctgtgt

SEQ ID NO: 4824691 - DNA, 21 bp, Homo sapiens
attcagtctatgctgtgtgca

SEQ ID NO: 4824692 - DNA, 17 bp, Homo sapiens
attcagtggacatttgt

SEQ ID NO: 4824693 - DNA, 22 bp, Homo sapiens
attcagtggacatttgttctgg

SEQ ID NO: 4824694 - DNA, 21 bp, Homo sapiens
attcagttgttagtgtgtctt

SEQ ID NO: 4824695 - DNA, 13 bp, Homo sapiens
attcagtttctaa

SEQ ID NO: 4824696 - DNA, 20 bp, Homo sapiens
attcagtttctaaaattgag

SEQ ID NO: 4824697 - DNA, 14 bp, Homo sapiens
attcatactcaaag

SEQ ID NO: 4824698 - DNA, 14 bp, Homo sapiens
attcatacttaaaa

SEQ ID NO: 4824699 - DNA, 11 bp, Homo sapiens
attcatcctca

SEQ ID NO: 4824700 - DNA, 15 bp, Homo sapiens
attcatcctcacatg

SEQ ID NO: 4824701 - DNA, 18 bp, Homo sapiens
attcatgatgctagttct

SEQ ID NO: 4824702 - DNA, 19 bp, Homo sapiens
attcatgctgcctgccatg

SEQ ID NO: 4824703 - DNA, 20 bp, Homo sapiens
attcatgctgcctgccatgt

SEQ ID NO: 4824704 - DNA, 15 bp, Homo sapiens
attcattacatcctc

SEQ ID NO: 4824705 - DNA, 21 bp, Homo sapiens
attcattacatcctctgcttg

SEQ ID NO: 4824706 - DNA, 12 bp, Homo sapiens
attccaatacat

SEQ ID NO: 4824707 - DNA, 20 bp, Homo sapiens
attccaatacattattggac

SEQ ID NO: 4824708 - DNA, 20 bp, Homo sapiens
attccaatacattgaacaca

SEQ ID NO: 4824709 - DNA, 21 bp, Homo sapiens
attccacagagttactgccac

SEQ ID NO: 4824710 - DNA, 17 bp, Homo sapiens
attccagagcactgctc

SEQ ID NO: 4824711 - DNA, 16 bp, Homo sapiens
attccaggtttaagta

SEQ ID NO: 4824712 - DNA, 13 bp, Homo sapiens
attccagtccaat

SEQ ID NO: 4824713 - DNA, 19 bp, Homo sapiens
attccagtccaattttcct

SEQ ID NO: 4824714 - DNA, 20 bp, Homo sapiens
attccagtccaattttccta

SEQ ID NO: 4824715 - DNA, 20 bp, Homo sapiens
attccagtgcagtagtgcca

SEQ ID NO: 4824716 - DNA, 22 bp, Homo sapiens
attccagtgcagtagtgccaaa

SEQ ID NO: 4824717 - DNA, 16 bp, Homo sapiens
attccagtgtattttc

SEQ ID NO: 4824718 - DNA, 17 bp, Homo sapiens
attccatggatcttgct

SEQ ID NO: 4824719 - DNA, 16 bp, Homo sapiens
attccatttgctgatt

SEQ ID NO: 4824720 - DNA, 13 bp, Homo sapiens
attccattttgga

SEQ ID NO: 4824721 - DNA, 21 bp, Homo sapiens
attcccagggccgcttctcct

SEQ ID NO: 4824722 - DNA, 21 bp, Homo sapiens
attcccatggtagactgtgac

SEQ ID NO: 4824723 - DNA, 22 bp, Homo sapiens
attcccatggtagactgtgaca

SEQ ID NO: 4824724 - DNA, 20 bp, Homo sapiens
attcctaattcctgtatgtt

SEQ ID NO: 4824725 - DNA, 23 bp, Homo sapiens
attcctaattctatgattaaact

SEQ ID NO: 4824726 - DNA, 13 bp, Homo sapiens
attcctacttaaa

SEQ ID NO: 4824727 - DNA, 19 bp, Homo sapiens
attcctacttaaacaaaaa

SEQ ID NO: 4824728 - DNA, 14 bp, Homo sapiens
attcctcccctgga

SEQ ID NO: 4824729 - DNA, 16 bp, Homo sapiens
attcctctaagatctt

SEQ ID NO: 4824730 - DNA, 20 bp, Homo sapiens
attcctctaagatcttgcct

SEQ ID NO: 4824731 - DNA, 17 bp, Homo sapiens
attcctgaccctcactt

SEQ ID NO: 4824732 - DNA, 18 bp, Homo sapiens
attcctgaccctcacttt

SEQ ID NO: 4824733 - DNA, 15 bp, Homo sapiens
attcctgcctttgat

SEQ ID NO: 4824734 - DNA, 14 bp, Homo sapiens
attccttctggcct

SEQ ID NO: 4824735 - DNA, 22 bp, Homo sapiens
attccttctggcctttcctctc

SEQ ID NO: 4824736 - DNA, 15 bp, Homo sapiens
attccttcttcccca

SEQ ID NO: 4824737 - DNA, 18 bp, Homo sapiens
attccttcttgctcagtc

SEQ ID NO: 4824738 - DNA, 23 bp, Homo sapiens
attccttcttgctcagtccctct

SEQ ID NO: 4824739 - DNA, 14 bp, Homo sapiens
attccttggcccag

SEQ ID NO: 4824740 - DNA, 16 bp, Homo sapiens
attccttggcccagca

SEQ ID NO: 4824741 - DNA, 18 bp, Homo sapiens
attccttggcccagcagc

SEQ ID NO: 4824742 - DNA, 14 bp, Homo sapiens
attcgtaagttctg

SEQ ID NO: 4824743 - DNA, 17 bp, Homo sapiens
attctaagtgagatgtt

SEQ ID NO: 4824744 - DNA, 22 bp, Homo sapiens
attctaagtgagatgtttggca

SEQ ID NO: 4824745 - DNA, 22 bp, Homo sapiens
attctagagggatccaccgcca

SEQ ID NO: 4824746 - DNA, 15 bp, Homo sapiens
attctataagagaca

SEQ ID NO: 4824747 - DNA, 20 bp, Homo sapiens
attctataagagacaaagtt

SEQ ID NO: 4824748 - DNA, 22 bp, Homo sapiens
attctatgattaaactgggaaa

SEQ ID NO: 4824749 - DNA, 20 bp, Homo sapiens
attctcacaggttcacccag

SEQ ID NO: 4824750 - DNA, 18 bp, Homo sapiens
attctcagaacaccaagt

SEQ ID NO: 4824751 - DNA, 21 bp, Homo sapiens
attctccaggggtttacagtg

SEQ ID NO: 4824752 - DNA, 20 bp, Homo sapiens
attctcctgcctcagcctcc

SEQ ID NO: 4824753 - DNA, 15 bp, Homo sapiens
attctcttcgctgtg

SEQ ID NO: 4824754 - DNA, 19 bp, Homo sapiens
attctcttcgctgtgatgc

SEQ ID NO: 4824755 - DNA, 12 bp, Homo sapiens
attctcttctca

SEQ ID NO: 4824756 - DNA, 19 bp, Homo sapiens
attctctttcaattctgtg

SEQ ID NO: 4824757 - DNA, 11 bp, Homo sapiens
attctgcagcc

SEQ ID NO: 4824758 - DNA, 20 bp, Homo sapiens
attctgctaatttatgaaga

SEQ ID NO: 4824759 - DNA, 16 bp, Homo sapiens
attctggggtggggct

SEQ ID NO: 4824760 - DNA, 19 bp, Homo sapiens
attctggtccttagtaaat

SEQ ID NO: 4824761 - DNA, 17 bp, Homo sapiens
attctgtcaatgaaaag

SEQ ID NO: 4824762 - DNA, 22 bp, Homo sapiens
attctgtcattggttacaaatt

SEQ ID NO: 4824763 - DNA, 15 bp, Homo sapiens
attctgttggccagc

SEQ ID NO: 4824764 - DNA, 21 bp, Homo sapiens
attctgtttatgttcttgcag

SEQ ID NO: 4824765 - DNA, 18 bp, Homo sapiens
attcttacctcatttgca

SEQ ID NO: 4824766 - DNA, 19 bp, Homo sapiens
attcttacctcatttgcat

SEQ ID NO: 4824767 - DNA, 17 bp, Homo sapiens
attcttattttataatt

SEQ ID NO: 4824768 - DNA, 17 bp, Homo sapiens
attcttccttgccacaa

SEQ ID NO: 4824769 - DNA, 15 bp, Homo sapiens
attcttctcctttgt

SEQ ID NO: 4824770 - DNA, 12 bp, Homo sapiens
attcttgcactg

SEQ ID NO: 4824771 - DNA, 13 bp, Homo sapiens
attcttgcactgt

SEQ ID NO: 4824772 - DNA, 16 bp, Homo sapiens
attcttgcactgtatc

SEQ ID NO: 4824773 - DNA, 17 bp, Homo sapiens
attcttgcactgtatcc

SEQ ID NO: 4824774 - DNA, 21 bp, Homo sapiens
attcttgtgtcatcaagtagt

SEQ ID NO: 4824775 - DNA, 15 bp, Homo sapiens
attcttttaaatctc

SEQ ID NO: 4824776 - DNA, 19 bp, Homo sapiens
attcttttttcaatgtact

SEQ ID NO: 4824777 - DNA, 18 bp, Homo sapiens
attgaaactgtatttact

SEQ ID NO: 4824778 - DNA, 20 bp, Homo sapiens
attgaaactgtatttacttg

SEQ ID NO: 4824779 - DNA, 16 bp, Homo sapiens
attgaatctctaaaat

SEQ ID NO: 4824780 - DNA, 23 bp, Homo sapiens
attgaattattgggcttaatata

SEQ ID NO: 4824781 - DNA, 12 bp, Homo sapiens
attgacaagttt

SEQ ID NO: 4824782 - DNA, 18 bp, Homo sapiens
attgacaataagaaacag

SEQ ID NO: 4824783 - DNA, 20 bp, Homo sapiens
attgacctttaggtattaca

SEQ ID NO: 4824784 - DNA, 21 bp, Homo sapiens
attgacgacctacatctgaaa

SEQ ID NO: 4824785 - DNA, 15 bp, Homo sapiens
attgacgtctagcta

SEQ ID NO: 4824786 - DNA, 23 bp, Homo sapiens
attgacgtctagctatgctgtat

SEQ ID NO: 4824787 - DNA, 20 bp, Homo sapiens
attgagcagaattcattcat

SEQ ID NO: 4824788 - DNA, 17 bp, Homo sapiens
attgaggggaggtggcc

SEQ ID NO: 4824789 - DNA, 18 bp, Homo sapiens
attgaggggaggtggcca

SEQ ID NO: 4824790 - DNA, 22 bp, Homo sapiens
attgagtcattttatatatgaa

SEQ ID NO: 4824791 - DNA, 13 bp, Homo sapiens
attgagtgtacat

SEQ ID NO: 4824792 - DNA, 19 bp, Homo sapiens
attgagttcttcctgtaat

SEQ ID NO: 4824793 - DNA, 21 bp, Homo sapiens
attgataagaaccttttgagt

SEQ ID NO: 4824794 - DNA, 12 bp, Homo sapiens
attgatctcttt

SEQ ID NO: 4824795 - DNA, 13 bp, Homo sapiens
attgatctgtatt

SEQ ID NO: 4824796 - DNA, 18 bp, Homo sapiens
attgattaagtatatcta

SEQ ID NO: 4824797 - DNA, 15 bp, Homo sapiens
attgattgtatatag

SEQ ID NO: 4824798 - DNA, 19 bp, Homo sapiens
attgattttccccctaatt

SEQ ID NO: 4824799 - DNA, 18 bp, Homo sapiens
attgcactaaaagtgatg

SEQ ID NO: 4824800 - DNA, 22 bp, Homo sapiens
attgcactgcagttatttacca

SEQ ID NO: 4824801 - DNA, 17 bp, Homo sapiens
attgccaaggcatcccc

SEQ ID NO: 4824802 - DNA, 19 bp, Homo sapiens
attgcccatgatataactt

SEQ ID NO: 4824803 - DNA, 23 bp, Homo sapiens
attgccttatattggatcaggaa

SEQ ID NO: 4824804 - DNA, 20 bp, Homo sapiens
attgctcctgctcagatctt

SEQ ID NO: 4824805 - DNA, 22 bp, Homo sapiens
attgctgtaaataaaaatagct

SEQ ID NO: 4824806 - DNA, 21 bp, Homo sapiens
attgctgtctgaaaaagtgtt

SEQ ID NO: 4824807 - DNA, 15 bp, Homo sapiens
attgcttgagcatgc

SEQ ID NO: 4824808 - DNA, 17 bp, Homo sapiens
attgcttggactaccta

SEQ ID NO: 4824809 - DNA, 14 bp, Homo sapiens
attgctttctttca

SEQ ID NO: 4824810 - DNA, 19 bp, Homo sapiens
attggaaaataataaaaga

SEQ ID NO: 4824811 - DNA, 20 bp, Homo sapiens
attggaaaataataaaagaa

SEQ ID NO: 4824812 - DNA, 14 bp, Homo sapiens
attggatcaggaac

SEQ ID NO: 4824813 - DNA, 21 bp, Homo sapiens
attggcagcacagctactcag

SEQ ID NO: 4824814 - DNA, 23 bp, Homo sapiens
attggcatctctccccatatata

SEQ ID NO: 4824815 - DNA, 19 bp, Homo sapiens
attggccttaactggccct

SEQ ID NO: 4824816 - DNA, 23 bp, Homo sapiens
attgggcccttagaatgtgaaaa

SEQ ID NO: 4824817 - DNA, 15 bp, Homo sapiens
attgggggggcttgg

SEQ ID NO: 4824818 - DNA, 16 bp, Homo sapiens
attgggggggcttggg

SEQ ID NO: 4824819 - DNA, 21 bp, Homo sapiens
attggtcttgccctattataa

SEQ ID NO: 4824820 - DNA, 14 bp, Homo sapiens
attggttaatgaaa

SEQ ID NO: 4824821 - DNA, 19 bp, Homo sapiens
attgtaaaggtaggtgcat

SEQ ID NO: 4824822 - DNA, 22 bp, Homo sapiens
attgtaaaggtgatgaatttac

SEQ ID NO: 4824823 - DNA, 15 bp, Homo sapiens
attgtaaggaatgat

SEQ ID NO: 4824824 - DNA, 14 bp, Homo sapiens
attgtaatcataaa

SEQ ID NO: 4824825 - DNA, 17 bp, Homo sapiens
attgtacagtttgttta

SEQ ID NO: 4824826 - DNA, 18 bp, Homo sapiens
attgtacagtttgtttac

SEQ ID NO: 4824827 - DNA, 21 bp, Homo sapiens
attgtacagtttgtttacaca

SEQ ID NO: 4824828 - DNA, 15 bp, Homo sapiens
attgtacatatggaa

SEQ ID NO: 4824829 - DNA, 19 bp, Homo sapiens
attgtacatatggaaatcc

SEQ ID NO: 4824830 - DNA, 14 bp, Homo sapiens
attgtagagaaaaa

SEQ ID NO: 4824831 - DNA, 15 bp, Homo sapiens
attgtataaaacagt

SEQ ID NO: 4824832 - DNA, 13 bp, Homo sapiens
attgtatcttcat

SEQ ID NO: 4824833 - DNA, 15 bp, Homo sapiens
attgtattatcatat

SEQ ID NO: 4824834 - DNA, 17 bp, Homo sapiens
attgtattatcatatat

SEQ ID NO: 4824835 - DNA, 14 bp, Homo sapiens
attgtccaccttct

SEQ ID NO: 4824836 - DNA, 13 bp, Homo sapiens
attgtccattcca

SEQ ID NO: 4824837 - DNA, 14 bp, Homo sapiens
attgtccttgtgta

SEQ ID NO: 4824838 - DNA, 16 bp, Homo sapiens
attgtctgaaattttc

SEQ ID NO: 4824839 - DNA, 18 bp, Homo sapiens
attgtctgctgcctccaa

SEQ ID NO: 4824840 - DNA, 23 bp, Homo sapiens
attgtgaatgttgtcctgtgtca

SEQ ID NO: 4824841 - DNA, 19 bp, Homo sapiens
attgtgagaattactgttt

SEQ ID NO: 4824842 - DNA, 15 bp, Homo sapiens
attgtgccaaagata

SEQ ID NO: 4824843 - DNA, 16 bp, Homo sapiens
attgtgccaaagatag

SEQ ID NO: 4824844 - DNA, 18 bp, Homo sapiens
attgtgtggagaagtgtg

SEQ ID NO: 4824845 - DNA, 13 bp, Homo sapiens
attgttaaaacct

SEQ ID NO: 4824846 - DNA, 14 bp, Homo sapiens
attgttaaatgata

SEQ ID NO: 4824847 - DNA, 18 bp, Homo sapiens
attgttaaatgataaggt

SEQ ID NO: 4824848 - DNA, 13 bp, Homo sapiens
attgttattaaat

SEQ ID NO: 4824849 - DNA, 22 bp, Homo sapiens
attgttcaaagaacccccctcc

SEQ ID NO: 4824850 - DNA, 12 bp, Homo sapiens
attgttcctccc

SEQ ID NO: 4824851 - DNA, 13 bp, Homo sapiens
attgttcctcccc

SEQ ID NO: 4824852 - DNA, 20 bp, Homo sapiens
attgttcttgtaaaactgtg

SEQ ID NO: 4824853 - DNA, 22 bp, Homo sapiens
attgttcttgtaaaactgtgac

SEQ ID NO: 4824854 - DNA, 13 bp, Homo sapiens
attgtttaagaat

SEQ ID NO: 4824855 - DNA, 16 bp, Homo sapiens
attgtttaagaatcat

SEQ ID NO: 4824856 - DNA, 17 bp, Homo sapiens
attgtttaagaatcatg

SEQ ID NO: 4824857 - DNA, 19 bp, Homo sapiens
attgtttaagaatcatgga

SEQ ID NO: 4824858 - DNA, 19 bp, Homo sapiens
attgtttgatgaataaaat

SEQ ID NO: 4824859 - DNA, 18 bp, Homo sapiens
attgtttgtcctttatgt

SEQ ID NO: 4824860 - DNA, 15 bp, Homo sapiens
attgttttagagact

SEQ ID NO: 4824861 - DNA, 16 bp, Homo sapiens
attgttttataaatgg

SEQ ID NO: 4824862 - DNA, 23 bp, Homo sapiens
attgtttttagaaatttattctt

SEQ ID NO: 4824863 - DNA, 15 bp, Homo sapiens
attgtttttatatat

SEQ ID NO: 4824864 - DNA, 20 bp, Homo sapiens
atttaaaaaatgaatagtac

SEQ ID NO: 4824865 - DNA, 14 bp, Homo sapiens
atttaaaacaagct

SEQ ID NO: 4824866 - DNA, 18 bp, Homo sapiens
atttaaaacaagctgata

SEQ ID NO: 4824867 - DNA, 13 bp, Homo sapiens
atttaaaagatcc

SEQ ID NO: 4824868 - DNA, 15 bp, Homo sapiens
atttaaaggaaagtt

SEQ ID NO: 4824869 - DNA, 17 bp, Homo sapiens
atttaactagcacttta

SEQ ID NO: 4824870 - DNA, 13 bp, Homo sapiens
atttaagcacaaa

SEQ ID NO: 4824871 - DNA, 18 bp, Homo sapiens
atttaagtggactgtatt

SEQ ID NO: 4824872 - DNA, 23 bp, Homo sapiens
atttaagtggactgtatttcggc

SEQ ID NO: 4824873 - DNA, 21 bp, Homo sapiens
atttaatgagttttatcttga

SEQ ID NO: 4824874 - DNA, 20 bp, Homo sapiens
atttaatgtttgtaagcaat

SEQ ID NO: 4824875 - DNA, 13 bp, Homo sapiens
atttacaatgtat

SEQ ID NO: 4824876 - DNA, 17 bp, Homo sapiens
atttaccagaagtttaa

SEQ ID NO: 4824877 - DNA, 19 bp, Homo sapiens
atttaccagaagtttaaat

SEQ ID NO: 4824878 - DNA, 17 bp, Homo sapiens
atttaccatcaaacaaa

SEQ ID NO: 4824879 - DNA, 23 bp, Homo sapiens
atttaccatcaaacaaatcattt

SEQ ID NO: 4824880 - DNA, 14 bp, Homo sapiens
atttactaacagta

SEQ ID NO: 4824881 - DNA, 19 bp, Homo sapiens
atttactaacagtaactgc

SEQ ID NO: 4824882 - DNA, 16 bp, Homo sapiens
atttactgtttataat

SEQ ID NO: 4824883 - DNA, 21 bp, Homo sapiens
atttacttgttatgttgtaat

SEQ ID NO: 4824884 - DNA, 17 bp, Homo sapiens
atttagaggataaataa

SEQ ID NO: 4824885 - DNA, 22 bp, Homo sapiens
atttagcacagtatttaacatt

SEQ ID NO: 4824886 - DNA, 19 bp, Homo sapiens
atttagctgtatcaaacta

SEQ ID NO: 4824887 - DNA, 21 bp, Homo sapiens
atttagggttctatatttact

SEQ ID NO: 4824888 - DNA, 22 bp, Homo sapiens
atttagggttctatatttactg

SEQ ID NO: 4824889 - DNA, 16 bp, Homo sapiens
atttagtaaaattatc

SEQ ID NO: 4824890 - DNA, 18 bp, Homo sapiens
atttataacaattgattt

SEQ ID NO: 4824891 - DNA, 13 bp, Homo sapiens
atttatattagag

SEQ ID NO: 4824892 - DNA, 19 bp, Homo sapiens
atttatattcagagatgta

SEQ ID NO: 4824893 - DNA, 16 bp, Homo sapiens
atttatcatatttaat

SEQ ID NO: 4824894 - DNA, 17 bp, Homo sapiens
atttatcatatttaata

SEQ ID NO: 4824895 - DNA, 16 bp, Homo sapiens
atttatgaagatagtt

SEQ ID NO: 4824896 - DNA, 22 bp, Homo sapiens
atttatgatgcagcagatgttg

SEQ ID NO: 4824897 - DNA, 15 bp, Homo sapiens
atttatgatgttatt

SEQ ID NO: 4824898 - DNA, 22 bp, Homo sapiens
atttatgcatgagaactaaata

SEQ ID NO: 4824899 - DNA, 16 bp, Homo sapiens
atttatgtcattttca

SEQ ID NO: 4824900 - DNA, 12 bp, Homo sapiens
atttattaaatt

SEQ ID NO: 4824901 - DNA, 22 bp, Homo sapiens
atttattaaatttattaaatgt

SEQ ID NO: 4824902 - DNA, 14 bp, Homo sapiens
atttattctaatta

SEQ ID NO: 4824903 - DNA, 13 bp, Homo sapiens
atttattctcaga

SEQ ID NO: 4824904 - DNA, 14 bp, Homo sapiens
atttattctcagaa

SEQ ID NO: 4824905 - DNA, 15 bp, Homo sapiens
atttattcttatctt

SEQ ID NO: 4824906 - DNA, 13 bp, Homo sapiens
atttattgcttta

SEQ ID NO: 4824907 - DNA, 14 bp, Homo sapiens
atttattgctttat

SEQ ID NO: 4824908 - DNA, 13 bp, Homo sapiens
atttattgtatat

SEQ ID NO: 4824909 - DNA, 16 bp, Homo sapiens
atttattgtatatatg

SEQ ID NO: 4824910 - DNA, 15 bp, Homo sapiens
atttatttattatta

SEQ ID NO: 4824911 - DNA, 19 bp, Homo sapiens
atttatttccaatgtttca

SEQ ID NO: 4824912 - DNA, 14 bp, Homo sapiens
atttatttccatat

SEQ ID NO: 4824913 - DNA, 20 bp, Homo sapiens
atttatttccatattaaaat

SEQ ID NO: 4824914 - DNA, 16 bp, Homo sapiens
atttattttgtatgaa

SEQ ID NO: 4824915 - DNA, 20 bp, Homo sapiens
atttattttgtatgaaatat

SEQ ID NO: 4824916 - DNA, 19 bp, Homo sapiens
atttattttttgtaactct

SEQ ID NO: 4824917 - DNA, 21 bp, Homo sapiens
atttattttttgtaactcttt

SEQ ID NO: 4824918 - DNA, 20 bp, Homo sapiens
atttcaaagaaaacagacca

SEQ ID NO: 4824919 - DNA, 19 bp, Homo sapiens
atttcaaccacacctaaat

SEQ ID NO: 4824920 - DNA, 13 bp, Homo sapiens
atttcaatgtaat

SEQ ID NO: 4824921 - DNA, 16 bp, Homo sapiens
atttcaatgtaattaa

SEQ ID NO: 4824922 - DNA, 13 bp, Homo sapiens
atttcacacaact

SEQ ID NO: 4824923 - DNA, 20 bp, Homo sapiens
atttcacacaactgtggata

SEQ ID NO: 4824924 - DNA, 16 bp, Homo sapiens
atttcagatgctttag

SEQ ID NO: 4824925 - DNA, 18 bp, Homo sapiens
atttcagctgtgagcttt

SEQ ID NO: 4824926 - DNA, 12 bp, Homo sapiens
atttcataaaaa

SEQ ID NO: 4824927 - DNA, 19 bp, Homo sapiens
atttcatccagtttgttct

SEQ ID NO: 4824928 - DNA, 23 bp, Homo sapiens
atttcatccagtttgttctccgg

SEQ ID NO: 4824929 - DNA, 17 bp, Homo sapiens
atttcatgattagacaa

SEQ ID NO: 4824930 - DNA, 23 bp, Homo sapiens
atttcatgattagacaatgtgga

SEQ ID NO: 4824931 - DNA, 21 bp, Homo sapiens
atttcatgtccataaaagaga

SEQ ID NO: 4824932 - DNA, 14 bp, Homo sapiens
atttccaatgtttc

SEQ ID NO: 4824933 - DNA, 13 bp, Homo sapiens
atttccagcaaaa

SEQ ID NO: 4824934 - DNA, 13 bp, Homo sapiens
atttccatattaa

SEQ ID NO: 4824935 - DNA, 14 bp, Homo sapiens
atttccatattaaa

SEQ ID NO: 4824936 - DNA, 14 bp, Homo sapiens
atttcccaaagcag

SEQ ID NO: 4824937 - DNA, 19 bp, Homo sapiens
atttcccaaagcagtgcat

SEQ ID NO: 4824938 - DNA, 22 bp, Homo sapiens
atttccgaagaccttctgaaga

SEQ ID NO: 4824939 - DNA, 14 bp, Homo sapiens
atttcctgctcctc

SEQ ID NO: 4824940 - DNA, 15 bp, Homo sapiens
atttcctgtgaggat

SEQ ID NO: 4824941 - DNA, 14 bp, Homo sapiens
atttcggctatgtc

SEQ ID NO: 4824942 - DNA, 19 bp, Homo sapiens
atttctacacagtgggaac

SEQ ID NO: 4824943 - DNA, 21 bp, Homo sapiens
atttctcagcgggagtctcct

SEQ ID NO: 4824944 - DNA, 13 bp, Homo sapiens
atttctccattaa

SEQ ID NO: 4824945 - DNA, 19 bp, Homo sapiens
atttctctggggtctgtga

SEQ ID NO: 4824946 - DNA, 15 bp, Homo sapiens
atttctcttaagtac

SEQ ID NO: 4824947 - DNA, 13 bp, Homo sapiens
atttctgtatata

SEQ ID NO: 4824948 - DNA, 22 bp, Homo sapiens
atttctgtatatagatgtctgt

SEQ ID NO: 4824949 - DNA, 18 bp, Homo sapiens
atttctgtgtcctgtttt

SEQ ID NO: 4824950 - DNA, 21 bp, Homo sapiens
atttctttttaggctctgaga

SEQ ID NO: 4824951 - DNA, 17 bp, Homo sapiens
atttgaagacttcaaaa

SEQ ID NO: 4824952 - DNA, 14 bp, Homo sapiens
atttgacacactca

SEQ ID NO: 4824953 - DNA, 17 bp, Homo sapiens
atttgacattgtcagaa

SEQ ID NO: 4824954 - DNA, 19 bp, Homo sapiens
atttgacattgtcagaatg

SEQ ID NO: 4824955 - DNA, 20 bp, Homo sapiens
atttgacattgtcagaatgt

SEQ ID NO: 4824956 - DNA, 23 bp, Homo sapiens
atttgacattgtcagaatgttgt

SEQ ID NO: 4824957 - DNA, 15 bp, Homo sapiens
atttgactgttattt

SEQ ID NO: 4824958 - DNA, 18 bp, Homo sapiens
atttgactttctgtctgt

SEQ ID NO: 4824959 - DNA, 14 bp, Homo sapiens
atttgagagaagcc

SEQ ID NO: 4824960 - DNA, 15 bp, Homo sapiens
atttgaggaaactca

SEQ ID NO: 4824961 - DNA, 18 bp, Homo sapiens
atttgatatacagacctc

SEQ ID NO: 4824962 - DNA, 20 bp, Homo sapiens
atttgatatacagacctcca

SEQ ID NO: 4824963 - DNA, 23 bp, Homo sapiens
atttgatatacagacctccagat

SEQ ID NO: 4824964 - DNA, 20 bp, Homo sapiens
atttgatctggtgcgtgtgg

SEQ ID NO: 4824965 - DNA, 18 bp, Homo sapiens
atttgcaacactgccaaa

SEQ ID NO: 4824966 - DNA, 22 bp, Homo sapiens
atttgcgtccgcacgcggccgc

SEQ ID NO: 4824967 - DNA, 16 bp, Homo sapiens
atttgctaatgaattt

SEQ ID NO: 4824968 - DNA, 19 bp, Homo sapiens
atttgctgaataacaacaa

SEQ ID NO: 4824969 - DNA, 20 bp, Homo sapiens
atttgctgaataacaacaat

SEQ ID NO: 4824970 - DNA, 21 bp, Homo sapiens
atttgctgaataacaacaatt

SEQ ID NO: 4824971 - DNA, 14 bp, Homo sapiens
atttggaatcatat

SEQ ID NO: 4824972 - DNA, 15 bp, Homo sapiens
atttggaatcatatg

SEQ ID NO: 4824973 - DNA, 15 bp, Homo sapiens
atttggattcacagc

SEQ ID NO: 4824974 - DNA, 21 bp, Homo sapiens
atttgggacctgcttcattca

SEQ ID NO: 4824975 - DNA, 15 bp, Homo sapiens
atttggggtatttat

SEQ ID NO: 4824976 - DNA, 15 bp, Homo sapiens
atttggggtgatttc

SEQ ID NO: 4824977 - DNA, 15 bp, Homo sapiens
atttgtaatgtatct

SEQ ID NO: 4824978 - DNA, 22 bp, Homo sapiens
atttgtaatgtatcttatttat

SEQ ID NO: 4824979 - DNA, 14 bp, Homo sapiens
atttgtataaaatg

SEQ ID NO: 4824980 - DNA, 16 bp, Homo sapiens
atttgtattaatgtag

SEQ ID NO: 4824981 - DNA, 16 bp, Homo sapiens
atttgtatttatatta

SEQ ID NO: 4824982 - DNA, 20 bp, Homo sapiens
atttgtgagccaaagagaaa

SEQ ID NO: 4824983 - DNA, 16 bp, Homo sapiens
atttgtgtaactgaaa

SEQ ID NO: 4824984 - DNA, 18 bp, Homo sapiens
atttgtgtgcttcacaca

SEQ ID NO: 4824985 - DNA, 23 bp, Homo sapiens
atttgttctgggttaacagtaaa

SEQ ID NO: 4824986 - DNA, 18 bp, Homo sapiens
attttaaacaaaatttat

SEQ ID NO: 4824987 - DNA, 22 bp, Homo sapiens
attttaaagttaaacattttta

SEQ ID NO: 4824988 - DNA, 22 bp, Homo sapiens
attttaatagtttctaaaccat

SEQ ID NO: 4824989 - DNA, 16 bp, Homo sapiens
attttaatgtaattga

SEQ ID NO: 4824990 - DNA, 22 bp, Homo sapiens
attttactatgcctgttgatct

SEQ ID NO: 4824991 - DNA, 13 bp, Homo sapiens
attttatgtttaa

SEQ ID NO: 4824992 - DNA, 17 bp, Homo sapiens
attttatgtttaaaatg

SEQ ID NO: 4824993 - DNA, 16 bp, Homo sapiens
attttatttcaatgta

SEQ ID NO: 4824994 - DNA, 22 bp, Homo sapiens
attttcaaagattgttggcagt

SEQ ID NO: 4824995 - DNA, 14 bp, Homo sapiens
attttcaaaggctt

SEQ ID NO: 4824996 - DNA, 19 bp, Homo sapiens
attttccaattaattatca

SEQ ID NO: 4824997 - DNA, 17 bp, Homo sapiens
attttccagggcaatca

SEQ ID NO: 4824998 - DNA, 22 bp, Homo sapiens
attttccagggcaatcaatgtt

SEQ ID NO: 4824999 - DNA, 14 bp, Homo sapiens
attttcgtgcattt

SEQ ID NO: 4825000 - DNA, 14 bp, Homo sapiens
attttctagaatac

SEQ ID NO: 4825001 - DNA, 21 bp, Homo sapiens
attttctagaatactaataaa

SEQ ID NO: 4825002 - DNA, 23 bp, Homo sapiens
attttctagaatactaataaaat

SEQ ID NO: 4825003 - DNA, 14 bp, Homo sapiens
attttctctcctcg

SEQ ID NO: 4825004 - DNA, 18 bp, Homo sapiens
attttctgagtagcatat

SEQ ID NO: 4825005 - DNA, 16 bp, Homo sapiens
attttctgtaattctt

SEQ ID NO: 4825006 - DNA, 19 bp, Homo sapiens
attttctgtaattcttctc

SEQ ID NO: 4825007 - DNA, 21 bp, Homo sapiens
attttctgtaattcttctcct

SEQ ID NO: 4825008 - DNA, 15 bp, Homo sapiens
attttcttcccattt

SEQ ID NO: 4825009 - DNA, 18 bp, Homo sapiens
attttcttcccatttgta

SEQ ID NO: 4825010 - DNA, 14 bp, Homo sapiens
attttcttctcatt

SEQ ID NO: 4825011 - DNA, 15 bp, Homo sapiens
attttcttctcattc

SEQ ID NO: 4825012 - DNA, 17 bp, Homo sapiens
attttcttctcattctt

SEQ ID NO: 4825013 - DNA, 13 bp, Homo sapiens
attttcttcttta

SEQ ID NO: 4825014 - DNA, 22 bp, Homo sapiens
attttctttaaccagtctgaag

SEQ ID NO: 4825015 - DNA, 20 bp, Homo sapiens
attttgaagtgagaaaatga

SEQ ID NO: 4825016 - DNA, 22 bp, Homo sapiens
attttgagacaccaataaaagt

SEQ ID NO: 4825017 - DNA, 23 bp, Homo sapiens
attttgagacaccaataaaagtt

SEQ ID NO: 4825018 - DNA, 19 bp, Homo sapiens
attttgatgtattattata

SEQ ID NO: 4825019 - DNA, 17 bp, Homo sapiens
attttgattgtttgatg

SEQ ID NO: 4825020 - DNA, 18 bp, Homo sapiens
attttgattgtttgatga

SEQ ID NO: 4825021 - DNA, 21 bp, Homo sapiens
attttgctgtcccttttcctt

SEQ ID NO: 4825022 - DNA, 13 bp, Homo sapiens
attttgcttccca

SEQ ID NO: 4825023 - DNA, 14 bp, Homo sapiens
attttgcttcccat

SEQ ID NO: 4825024 - DNA, 22 bp, Homo sapiens
attttgcttcccatctgaagag

SEQ ID NO: 4825025 - DNA, 16 bp, Homo sapiens
attttggaagaattca

SEQ ID NO: 4825026 - DNA, 23 bp, Homo sapiens
attttgggaaattcttgcactgt

SEQ ID NO: 4825027 - DNA, 17 bp, Homo sapiens
attttgtaaaatgtatt

SEQ ID NO: 4825028 - DNA, 21 bp, Homo sapiens
attttgtacgtgttattatta

SEQ ID NO: 4825029 - DNA, 23 bp, Homo sapiens
attttgtagtagttgatgaccaa

SEQ ID NO: 4825030 - DNA, 14 bp, Homo sapiens
attttgtatgaaat

SEQ ID NO: 4825031 - DNA, 20 bp, Homo sapiens
attttgtctgcttagtatct

SEQ ID NO: 4825032 - DNA, 23 bp, Homo sapiens
atttttactcaggctttctattg

SEQ ID NO: 4825033 - DNA, 13 bp, Homo sapiens
atttttagagatt

SEQ ID NO: 4825034 - DNA, 18 bp, Homo sapiens
atttttattaatttgtaa

SEQ ID NO: 4825035 - DNA, 17 bp, Homo sapiens
atttttatttgtattag

SEQ ID NO: 4825036 - DNA, 19 bp, Homo sapiens
atttttcaatagcgtgtgt

SEQ ID NO: 4825037 - DNA, 21 bp, Homo sapiens
atttttctcacctagctgctc

SEQ ID NO: 4825038 - DNA, 19 bp, Homo sapiens
atttttgtaatataagaca

SEQ ID NO: 4825039 - DNA, 16 bp, Homo sapiens
attttttgtaactctt

SEQ ID NO: 4825040 - DNA, 13 bp, Homo sapiens
attttttgtctgt

SEQ ID NO: 4825041 - DNA, 14 bp, Homo sapiens
attttttgtctgtg

SEQ ID NO: 4825042 - DNA, 13 bp, Homo sapiens
atttttttccaga

SEQ ID NO: 4825043 - DNA, 22 bp, Homo sapiens
attttttttaattgaaaagaag

SEQ ID NO: 4825044 - DNA, 15 bp, Homo sapiens
attttttttcttcca

SEQ ID NO: 4825045 - DNA, 15 bp, Homo sapiens
caaaaaacagaaaaa

SEQ ID NO: 4825046 - DNA, 14 bp, Homo sapiens
caaaaatcatcaaa

SEQ ID NO: 4825047 - DNA, 10 bp, Homo sapiens
caaaacaaca

SEQ ID NO: 4825048 - DNA, 13 bp, Homo sapiens
caaaaccccagaa

SEQ ID NO: 4825049 - DNA, 15 bp, Homo sapiens
caaaagagatgaaag

SEQ ID NO: 4825050 - DNA, 14 bp, Homo sapiens
caaaaggatgattt

SEQ ID NO: 4825051 - DNA, 21 bp, Homo sapiens
caaaaggatgatttaacatta

SEQ ID NO: 4825052 - DNA, 12 bp, Homo sapiens
caaaaggcccct

SEQ ID NO: 4825053 - DNA, 15 bp, Homo sapiens
caaaaggccccttcc

SEQ ID NO: 4825054 - DNA, 17 bp, Homo sapiens
caaaaggccccttccca

SEQ ID NO: 4825055 - DNA, 18 bp, Homo sapiens
caaaagggaaaaaagcaa

SEQ ID NO: 4825056 - DNA, 15 bp, Homo sapiens
caaaagggagaacat

SEQ ID NO: 4825057 - DNA, 23 bp, Homo sapiens
caaaagggagaacatggccaata

SEQ ID NO: 4825058 - DNA, 20 bp, Homo sapiens
caaaagtactagcaataagt

SEQ ID NO: 4825059 - DNA, 15 bp, Homo sapiens
caaaatagtcatgtt

SEQ ID NO: 4825060 - DNA, 13 bp, Homo sapiens
caaaatataaatc

SEQ ID NO: 4825061 - DNA, 15 bp, Homo sapiens
caaaatatatgtttg

SEQ ID NO: 4825062 - DNA, 22 bp, Homo sapiens
caaaatgaactaactgccatgt

SEQ ID NO: 4825063 - DNA, 16 bp, Homo sapiens
caaaatgaagacacca

SEQ ID NO: 4825064 - DNA, 21 bp, Homo sapiens
caaaatgcatacgtattgtta

SEQ ID NO: 4825065 - DNA, 18 bp, Homo sapiens
caaaatttatgtcatttt

SEQ ID NO: 4825066 - DNA, 13 bp, Homo sapiens
caaacaaatcatt

SEQ ID NO: 4825067 - DNA, 17 bp, Homo sapiens
caaacaaatcattttga

SEQ ID NO: 4825068 - DNA, 21 bp, Homo sapiens
caaacaaatcattttgatgta

SEQ ID NO: 4825069 - DNA, 15 bp, Homo sapiens
caaacagaggccgcc

SEQ ID NO: 4825070 - DNA, 13 bp, Homo sapiens
caaacagcatgtg

SEQ ID NO: 4825071 - DNA, 16 bp, Homo sapiens
caaacaggtgctaaca

SEQ ID NO: 4825072 - DNA, 19 bp, Homo sapiens
caaacatgtggcaacctgt

SEQ ID NO: 4825073 - DNA, 22 bp, Homo sapiens
caaacatgtggcaacctgttct

SEQ ID NO: 4825074 - DNA, 14 bp, Homo sapiens
caaaccaggctgca

SEQ ID NO: 4825075 - DNA, 15 bp, Homo sapiens
caaaccaggctgcag

SEQ ID NO: 4825076 - DNA, 16 bp, Homo sapiens
caaaccaggctgcagg

SEQ ID NO: 4825077 - DNA, 17 bp, Homo sapiens
caaaccaggctgcaggt

SEQ ID NO: 4825078 - DNA, 11 bp, Homo sapiens
caaaccctgct

SEQ ID NO: 4825079 - DNA, 15 bp, Homo sapiens
caaaccctgcttctg

SEQ ID NO: 4825080 - DNA, 14 bp, Homo sapiens
caaacccttcagtg

SEQ ID NO: 4825081 - DNA, 13 bp, Homo sapiens
caaacctaagttg

SEQ ID NO: 4825082 - DNA, 13 bp, Homo sapiens
caaaccttctttt

SEQ ID NO: 4825083 - DNA, 23 bp, Homo sapiens
caaactgaaattagtgttttcat

SEQ ID NO: 4825084 - DNA, 17 bp, Homo sapiens
caaactggttatttaaa

SEQ ID NO: 4825085 - DNA, 15 bp, Homo sapiens
caaacttttataaat

SEQ ID NO: 4825086 - DNA, 16 bp, Homo sapiens
caaacttttataaatg

SEQ ID NO: 4825087 - DNA, 17 bp, Homo sapiens
caaacttttataaatgt

SEQ ID NO: 4825088 - DNA, 12 bp, Homo sapiens
caaagaaaatga

SEQ ID NO: 4825089 - DNA, 14 bp, Homo sapiens
caaagaacccccct

SEQ ID NO: 4825090 - DNA, 14 bp, Homo sapiens
caaagaaggcacag

SEQ ID NO: 4825091 - DNA, 21 bp, Homo sapiens
caaagaaggcacaggtgtaaa

SEQ ID NO: 4825092 - DNA, 22 bp, Homo sapiens
caaagaaggcacaggtgtaaat

SEQ ID NO: 4825093 - DNA, 17 bp, Homo sapiens
caaagaggccagtactt

SEQ ID NO: 4825094 - DNA, 23 bp, Homo sapiens
caaagatgcagccgccttccttg

SEQ ID NO: 4825095 - DNA, 17 bp, Homo sapiens
caaagattgttggcagt

SEQ ID NO: 4825096 - DNA, 14 bp, Homo sapiens
caaagcactggcct

SEQ ID NO: 4825097 - DNA, 15 bp, Homo sapiens
caaagcactggcctt

SEQ ID NO: 4825098 - DNA, 16 bp, Homo sapiens
caaagcactggccttg

SEQ ID NO: 4825099 - DNA, 21 bp, Homo sapiens
caaagcactggccttgcctcc

SEQ ID NO: 4825100 - DNA, 14 bp, Homo sapiens
caaagcatgctcag

SEQ ID NO: 4825101 - DNA, 16 bp, Homo sapiens
caaagcatgctcagta

SEQ ID NO: 4825102 - DNA, 20 bp, Homo sapiens
caaagcatttgactttctgt

SEQ ID NO: 4825103 - DNA, 18 bp, Homo sapiens
caaagctgtcactcacaa

SEQ ID NO: 4825104 - DNA, 12 bp, Homo sapiens
caaaggaagcac

SEQ ID NO: 4825105 - DNA, 13 bp, Homo sapiens
caaaggaagcaca

SEQ ID NO: 4825106 - DNA, 14 bp, Homo sapiens
caaaggaagcacat

SEQ ID NO: 4825107 - DNA, 16 bp, Homo sapiens
caaaggttgtacatag

SEQ ID NO: 4825108 - DNA, 20 bp, Homo sapiens
caaagtcagaacaaattcag

SEQ ID NO: 4825109 - DNA, 16 bp, Homo sapiens
caaagtgcacacacac

SEQ ID NO: 4825110 - DNA, 21 bp, Homo sapiens
caaagtgttgtcttattccta

SEQ ID NO: 4825111 - DNA, 22 bp, Homo sapiens
caaagtttggaagtacataaag

SEQ ID NO: 4825112 - DNA, 15 bp, Homo sapiens
caaataaatgtgtaa

SEQ ID NO: 4825113 - DNA, 17 bp, Homo sapiens
caaataaatgtgtaaat

SEQ ID NO: 4825114 - DNA, 14 bp, Homo sapiens
caaataaatttata

SEQ ID NO: 4825115 - DNA, 14 bp, Homo sapiens
caaataagtcaaaa

SEQ ID NO: 4825116 - DNA, 22 bp, Homo sapiens
caaataagtcaaaataatctga

SEQ ID NO: 4825117 - DNA, 18 bp, Homo sapiens
caaataccttagctccct

SEQ ID NO: 4825118 - DNA, 17 bp, Homo sapiens
caaatagcttttcactt

SEQ ID NO: 4825119 - DNA, 21 bp, Homo sapiens
caaatagcttttcacttctta

SEQ ID NO: 4825120 - DNA, 22 bp, Homo sapiens
caaatagcttttcacttcttaa

SEQ ID NO: 4825121 - DNA, 16 bp, Homo sapiens
caaatagggcaaagaa

SEQ ID NO: 4825122 - DNA, 12 bp, Homo sapiens
caaatataaact

SEQ ID NO: 4825123 - DNA, 12 bp, Homo sapiens
caaatataacat

SEQ ID NO: 4825124 - DNA, 21 bp, Homo sapiens
caaatataacatgaaagtcaa

SEQ ID NO: 4825125 - DNA, 19 bp, Homo sapiens
caaatatactcatttggat

SEQ ID NO: 4825126 - DNA, 16 bp, Homo sapiens
caaatatctaaataat

SEQ ID NO: 4825127 - DNA, 22 bp, Homo sapiens
caaatatgattctcctctccca

SEQ ID NO: 4825128 - DNA, 19 bp, Homo sapiens
caaatattgatctgtatta

SEQ ID NO: 4825129 - DNA, 18 bp, Homo sapiens
caaatattgctattgttt

SEQ ID NO: 4825130 - DNA, 22 bp, Homo sapiens
caaatatttcacttaaactttg

SEQ ID NO: 4825131 - DNA, 23 bp, Homo sapiens
caaatccaacgcttttcccacct

SEQ ID NO: 4825132 - DNA, 15 bp, Homo sapiens
caaatccatgtgtcc

SEQ ID NO: 4825133 - DNA, 19 bp, Homo sapiens
caaatcgtacattgtgccc

SEQ ID NO: 4825134 - DNA, 21 bp, Homo sapiens
caaatcgtacattgtgccctg

SEQ ID NO: 4825135 - DNA, 14 bp, Homo sapiens
caaatctcactgta

SEQ ID NO: 4825136 - DNA, 17 bp, Homo sapiens
caaatctcactgtatta

SEQ ID NO: 4825137 - DNA, 21 bp, Homo sapiens
caaatgacatgcactgaccct

SEQ ID NO: 4825138 - DNA, 16 bp, Homo sapiens
caaatgatttcgtgac

SEQ ID NO: 4825139 - DNA, 14 bp, Homo sapiens
caaatgctaaatgc

SEQ ID NO: 4825140 - DNA, 15 bp, Homo sapiens
caaatgctactcagt

SEQ ID NO: 4825141 - DNA, 16 bp, Homo sapiens
caaatgctactcagta

SEQ ID NO: 4825142 - DNA, 16 bp, Homo sapiens
caaatggatgtaatat

SEQ ID NO: 4825143 - DNA, 14 bp, Homo sapiens
caaatgtaaaatat

SEQ ID NO: 4825144 - DNA, 12 bp, Homo sapiens
caaatgtccaag

SEQ ID NO: 4825145 - DNA, 14 bp, Homo sapiens
caaatgtccaagca

SEQ ID NO: 4825146 - DNA, 17 bp, Homo sapiens
caaatgtgtaactttat

SEQ ID NO: 4825147 - DNA, 21 bp, Homo sapiens
caaatgttattcaataactat

SEQ ID NO: 4825148 - DNA, 21 bp, Homo sapiens
caaattcagtggacatttgtt

SEQ ID NO: 4825149 - DNA, 18 bp, Homo sapiens
caaattctgattattaca

SEQ ID NO: 4825150 - DNA, 16 bp, Homo sapiens
caaattgctgagatgt

SEQ ID NO: 4825151 - DNA, 15 bp, Homo sapiens
caaattggtgtttct

SEQ ID NO: 4825152 - DNA, 22 bp, Homo sapiens
caaattgtcttttgtcatgtgg

SEQ ID NO: 4825153 - DNA, 19 bp, Homo sapiens
caacaaactcaaaatgtgg

SEQ ID NO: 4825154 - DNA, 14 bp, Homo sapiens
caacaaagaaatat

SEQ ID NO: 4825155 - DNA, 13 bp, Homo sapiens
caacaacagaaca

SEQ ID NO: 4825156 - DNA, 19 bp, Homo sapiens
caacaactccaggaaaact

SEQ ID NO: 4825157 - DNA, 15 bp, Homo sapiens
caacaacttactaaa

SEQ ID NO: 4825158 - DNA, 18 bp, Homo sapiens
caacaagaagaatttgaa

SEQ ID NO: 4825159 - DNA, 20 bp, Homo sapiens
caacaatttaggaatgctca

SEQ ID NO: 4825160 - DNA, 13 bp, Homo sapiens
caacacacacaca

SEQ ID NO: 4825161 - DNA, 18 bp, Homo sapiens
caacacacacacacacaa

SEQ ID NO: 4825162 - DNA, 18 bp, Homo sapiens
caacacattgaaactgta

SEQ ID NO: 4825163 - DNA, 19 bp, Homo sapiens
caacacattgaaactgtat

SEQ ID NO: 4825164 - DNA, 20 bp, Homo sapiens
caacaccttgtttccctctc

SEQ ID NO: 4825165 - DNA, 14 bp, Homo sapiens
caacagaacaacaa

SEQ ID NO: 4825166 - DNA, 16 bp, Homo sapiens
caacagacctaagaaa

SEQ ID NO: 4825167 - DNA, 15 bp, Homo sapiens
caacagactgcctta

SEQ ID NO: 4825168 - DNA, 20 bp, Homo sapiens
caacagactgccttatatta

SEQ ID NO: 4825169 - DNA, 23 bp, Homo sapiens
caacagactgccttatattattt

SEQ ID NO: 4825170 - DNA, 13 bp, Homo sapiens
caacagagtggac

SEQ ID NO: 4825171 - DNA, 16 bp, Homo sapiens
caacagcaacaacaac

SEQ ID NO: 4825172 - DNA, 15 bp, Homo sapiens
caacaggaccaggag

SEQ ID NO: 4825173 - DNA, 16 bp, Homo sapiens
caacaggaccaggagc

SEQ ID NO: 4825174 - DNA, 17 bp, Homo sapiens
caacaggaccaggagcc

SEQ ID NO: 4825175 - DNA, 20 bp, Homo sapiens
caacaggaccaggagccagg

SEQ ID NO: 4825176 - DNA, 22 bp, Homo sapiens
caacaggctgttctgcactgaa

SEQ ID NO: 4825177 - DNA, 14 bp, Homo sapiens
caacagtcagccag

SEQ ID NO: 4825178 - DNA, 16 bp, Homo sapiens
caacagtcagccagct

SEQ ID NO: 4825179 - DNA, 21 bp, Homo sapiens
caacagtgaacagcttcactt

SEQ ID NO: 4825180 - DNA, 21 bp, Homo sapiens
caacagttggccgattagaag

SEQ ID NO: 4825181 - DNA, 14 bp, Homo sapiens
caacataatgatac

SEQ ID NO: 4825182 - DNA, 19 bp, Homo sapiens
caacatgcacattcatcct

SEQ ID NO: 4825183 - DNA, 22 bp, Homo sapiens
caacatgcacattcatcctcac

SEQ ID NO: 4825184 - DNA, 13 bp, Homo sapiens
caacatgtgatgt

SEQ ID NO: 4825185 - DNA, 19 bp, Homo sapiens
caacattcccccaacatta

SEQ ID NO: 4825186 - DNA, 14 bp, Homo sapiens
caacatttgctttt

SEQ ID NO: 4825187 - DNA, 22 bp, Homo sapiens
caacccaggtgttgtccgtgtc

SEQ ID NO: 4825188 - DNA, 16 bp, Homo sapiens
caacccatgagcgtcc

SEQ ID NO: 4825189 - DNA, 13 bp, Homo sapiens
caacccatgcatg

SEQ ID NO: 4825190 - DNA, 15 bp, Homo sapiens
caacccatgcatggc

SEQ ID NO: 4825191 - DNA, 17 bp, Homo sapiens
caacccatgcatggcct

SEQ ID NO: 4825192 - DNA, 19 bp, Homo sapiens
caacccatgcatggcctcc

SEQ ID NO: 4825193 - DNA, 20 bp, Homo sapiens
caacccatgcatggcctccc

SEQ ID NO: 4825194 - DNA, 17 bp, Homo sapiens
caacccccacctcccgg

SEQ ID NO: 4825195 - DNA, 16 bp, Homo sapiens
caaccctacagtatat

SEQ ID NO: 4825196 - DNA, 18 bp, Homo sapiens
caaccctgccctgcacct

SEQ ID NO: 4825197 - DNA, 17 bp, Homo sapiens
caaccgggaaaggcatc

SEQ ID NO: 4825198 - DNA, 19 bp, Homo sapiens
caacctcccctggtcctgc

SEQ ID NO: 4825199 - DNA, 21 bp, Homo sapiens
caacctcccctggtcctgcac

SEQ ID NO: 4825200 - DNA, 20 bp, Homo sapiens
caacctgaattaaagtctac

SEQ ID NO: 4825201 - DNA, 15 bp, Homo sapiens
caacctggaggctgg

SEQ ID NO: 4825202 - DNA, 18 bp, Homo sapiens
caacctggaggctggacc

SEQ ID NO: 4825203 - DNA, 23 bp, Homo sapiens
caacctggaggctggaccaactg

SEQ ID NO: 4825204 - DNA, 18 bp, Homo sapiens
caacctggtggcaccaga

SEQ ID NO: 4825205 - DNA, 17 bp, Homo sapiens
caacgatttctccatta

SEQ ID NO: 4825206 - DNA, 14 bp, Homo sapiens
caacggcagtgaag

SEQ ID NO: 4825207 - DNA, 15 bp, Homo sapiens
caacgggtctgtggg

SEQ ID NO: 4825208 - DNA, 16 bp, Homo sapiens
caactaagttgtattt

SEQ ID NO: 4825209 - DNA, 15 bp, Homo sapiens
caactatttctttca

SEQ ID NO: 4825210 - DNA, 14 bp, Homo sapiens
caactctcctccag

SEQ ID NO: 4825211 - DNA, 14 bp, Homo sapiens
caactgacacagga

SEQ ID NO: 4825212 - DNA, 15 bp, Homo sapiens
caactgacacaggaa

SEQ ID NO: 4825213 - DNA, 15 bp, Homo sapiens
caactgactgactta

SEQ ID NO: 4825214 - DNA, 23 bp, Homo sapiens
caactgcatcaagatgtgacatg

SEQ ID NO: 4825215 - DNA, 23 bp, Homo sapiens
caactgctttgttttggctgctc

SEQ ID NO: 4825216 - DNA, 20 bp, Homo sapiens
caactgtggataaattttgg

SEQ ID NO: 4825217 - DNA, 22 bp, Homo sapiens
caactgtggataaattttggaa

SEQ ID NO: 4825218 - DNA, 15 bp, Homo sapiens
caactgtttttgaag

SEQ ID NO: 4825219 - DNA, 19 bp, Homo sapiens
caacttaaacctgtgcttt

SEQ ID NO: 4825220 - DNA, 23 bp, Homo sapiens
caacttaaacctgtgctttcatg

SEQ ID NO: 4825221 - DNA, 17 bp, Homo sapiens
caacttacatatgtctt

SEQ ID NO: 4825222 - DNA, 15 bp, Homo sapiens
caacttcccaggccg

SEQ ID NO: 4825223 - DNA, 16 bp, Homo sapiens
caacttcccaggccga

SEQ ID NO: 4825224 - DNA, 15 bp, Homo sapiens
caactttccagactt

SEQ ID NO: 4825225 - DNA, 17 bp, Homo sapiens
caactttggaatttgaa

SEQ ID NO: 4825226 - DNA, 19 bp, Homo sapiens
caagaaaaccagtggaaga

SEQ ID NO: 4825227 - DNA, 17 bp, Homo sapiens
caagaaggatgattcaa

SEQ ID NO: 4825228 - DNA, 14 bp, Homo sapiens
caagaagtgggatt

SEQ ID NO: 4825229 - DNA, 16 bp, Homo sapiens
caagaagtttcttcag

SEQ ID NO: 4825230 - DNA, 19 bp, Homo sapiens
caagaatggaattttctga

SEQ ID NO: 4825231 - DNA, 19 bp, Homo sapiens
caagaattctccaaaacaa

SEQ ID NO: 4825232 - DNA, 17 bp, Homo sapiens
caagacaccttcccagc

SEQ ID NO: 4825233 - DNA, 18 bp, Homo sapiens
caagacaccttcccagct

SEQ ID NO: 4825234 - DNA, 16 bp, Homo sapiens
caagacggatccacag

SEQ ID NO: 4825235 - DNA, 17 bp, Homo sapiens
caagacttttctttgaa

SEQ ID NO: 4825236 - DNA, 18 bp, Homo sapiens
caagacttttctttgaag

SEQ ID NO: 4825237 - DNA, 16 bp, Homo sapiens
caagagaccacttcct

SEQ ID NO: 4825238 - DNA, 19 bp, Homo sapiens
caagagaccacttccttaa

SEQ ID NO: 4825239 - DNA, 21 bp, Homo sapiens
caagagaccacttccttaaca

SEQ ID NO: 4825240 - DNA, 15 bp, Homo sapiens
caagagcccaggcct

SEQ ID NO: 4825241 - DNA, 17 bp, Homo sapiens
caagagcccaggcctcc

SEQ ID NO: 4825242 - DNA, 16 bp, Homo sapiens
caagagctcaggagaa

SEQ ID NO: 4825243 - DNA, 22 bp, Homo sapiens
caagaggaataagaatggagca

SEQ ID NO: 4825244 - DNA, 19 bp, Homo sapiens
caagagtgatgggaaagac

SEQ ID NO: 4825245 - DNA, 22 bp, Homo sapiens
caagatagctccttcatgcttt

SEQ ID NO: 4825246 - DNA, 23 bp, Homo sapiens
caagatgggtgattatgaaatgc

SEQ ID NO: 4825247 - DNA, 21 bp, Homo sapiens
caagattaagttataccagca

SEQ ID NO: 4825248 - DNA, 23 bp, Homo sapiens
caagattaagttataccagcaaa

SEQ ID NO: 4825249 - DNA, 13 bp, Homo sapiens
caagcaaactgaa

SEQ ID NO: 4825250 - DNA, 16 bp, Homo sapiens
caagcaaagacagttt

SEQ ID NO: 4825251 - DNA, 22 bp, Homo sapiens
caagcaaagacagtttcttgca

SEQ ID NO: 4825252 - DNA, 15 bp, Homo sapiens
caagcaagctctctt

SEQ ID NO: 4825253 - DNA, 22 bp, Homo sapiens
caagcacttcaggcctatgttt

SEQ ID NO: 4825254 - DNA, 14 bp, Homo sapiens
caagccaggagacc

SEQ ID NO: 4825255 - DNA, 18 bp, Homo sapiens
caagccagggttccagac

SEQ ID NO: 4825256 - DNA, 19 bp, Homo sapiens
caagccagggttccagaca

SEQ ID NO: 4825257 - DNA, 22 bp, Homo sapiens
caagccctgcttgctggaaaac

SEQ ID NO: 4825258 - DNA, 15 bp, Homo sapiens
caagccctggggcag

SEQ ID NO: 4825259 - DNA, 17 bp, Homo sapiens
caagcgacacaggctgc

SEQ ID NO: 4825260 - DNA, 21 bp, Homo sapiens
caagcgacctaaacagctgct

SEQ ID NO: 4825261 - DNA, 18 bp, Homo sapiens
caagctataaaagcccat

SEQ ID NO: 4825262 - DNA, 14 bp, Homo sapiens
caagctccagtagc

SEQ ID NO: 4825263 - DNA, 21 bp, Homo sapiens
caagctgctgccgcctcacct

SEQ ID NO: 4825264 - DNA, 18 bp, Homo sapiens
caaggaagggatgtattt

SEQ ID NO: 4825265 - DNA, 14 bp, Homo sapiens
caaggacactgatg

SEQ ID NO: 4825266 - DNA, 17 bp, Homo sapiens
caaggatacccggtggc

SEQ ID NO: 4825267 - DNA, 20 bp, Homo sapiens
caaggatacccggtggcttc

SEQ ID NO: 4825268 - DNA, 22 bp, Homo sapiens
caaggatacccggtggcttctg

SEQ ID NO: 4825269 - DNA, 13 bp, Homo sapiens
caaggcaaatgtc

SEQ ID NO: 4825270 - DNA, 16 bp, Homo sapiens
caaggcaaatgtccaa

SEQ ID NO: 4825271 - DNA, 18 bp, Homo sapiens
caaggcaaatgtccaagc

SEQ ID NO: 4825272 - DNA, 18 bp, Homo sapiens
caaggcaaggctgtcaat

SEQ ID NO: 4825273 - DNA, 18 bp, Homo sapiens
caaggcacattgaaatac

SEQ ID NO: 4825274 - DNA, 14 bp, Homo sapiens
caaggcactgagcg

SEQ ID NO: 4825275 - DNA, 20 bp, Homo sapiens
caaggcactgagcgcctgca

SEQ ID NO: 4825276 - DNA, 20 bp, Homo sapiens
caaggccagcccacacagcc

SEQ ID NO: 4825277 - DNA, 22 bp, Homo sapiens
caaggcccccacctctgtgacc

SEQ ID NO: 4825278 - DNA, 20 bp, Homo sapiens
caaggctgctaagtggaaga

SEQ ID NO: 4825279 - DNA, 13 bp, Homo sapiens
caaggctgtcaat

SEQ ID NO: 4825280 - DNA, 15 bp, Homo sapiens
caaggggccaggaag

SEQ ID NO: 4825281 - DNA, 18 bp, Homo sapiens
caaggggcgcgcgccccc

SEQ ID NO: 4825282 - DNA, 20 bp, Homo sapiens
caaggggtggaagggcagga

SEQ ID NO: 4825283 - DNA, 14 bp, Homo sapiens
caaggtctgctttt

SEQ ID NO: 4825284 - DNA, 15 bp, Homo sapiens
caaggtggtcttgga

SEQ ID NO: 4825285 - DNA, 21 bp, Homo sapiens
caaggtggtcttggagaggag

SEQ ID NO: 4825286 - DNA, 18 bp, Homo sapiens
caagtaaatctatctcta

SEQ ID NO: 4825287 - DNA, 22 bp, Homo sapiens
caagtaaatctatctctatata

SEQ ID NO: 4825288 - DNA, 18 bp, Homo sapiens
caagtagatgcctgaact

SEQ ID NO: 4825289 - DNA, 17 bp, Homo sapiens
caagtattactaaattg

SEQ ID NO: 4825290 - DNA, 19 bp, Homo sapiens
caagtattactaaattgac

SEQ ID NO: 4825291 - DNA, 20 bp, Homo sapiens
caagtattttatctgtgttg

SEQ ID NO: 4825292 - DNA, 19 bp, Homo sapiens
caagtcaaacagtgtggct

SEQ ID NO: 4825293 - DNA, 17 bp, Homo sapiens
caagtcatgggagaaga

SEQ ID NO: 4825294 - DNA, 19 bp, Homo sapiens
caagtcatgggagaagagg

SEQ ID NO: 4825295 - DNA, 16 bp, Homo sapiens
caagtcccgaggcagc

SEQ ID NO: 4825296 - DNA, 15 bp, Homo sapiens
caagtcctcgccccc

SEQ ID NO: 4825297 - DNA, 19 bp, Homo sapiens
caagtctctctaagacaaa

SEQ ID NO: 4825298 - DNA, 20 bp, Homo sapiens
caagtctctctaagacaaat

SEQ ID NO: 4825299 - DNA, 17 bp, Homo sapiens
caagtgacgaaaacatt

SEQ ID NO: 4825300 - DNA, 21 bp, Homo sapiens
caagtggtttccacatgctct

SEQ ID NO: 4825301 - DNA, 12 bp, Homo sapiens
caagtgtacatt

SEQ ID NO: 4825302 - DNA, 14 bp, Homo sapiens
caagtgtacatttg

SEQ ID NO: 4825303 - DNA, 15 bp, Homo sapiens
caagtgtacatttga

SEQ ID NO: 4825304 - DNA, 12 bp, Homo sapiens
caagtgtcctgc

SEQ ID NO: 4825305 - DNA, 16 bp, Homo sapiens
caagtgtgcctgctat

SEQ ID NO: 4825306 - DNA, 23 bp, Homo sapiens
caagttgccacattgcttcatta

SEQ ID NO: 4825307 - DNA, 21 bp, Homo sapiens
caagttgtgtgctattcgtaa

SEQ ID NO: 4825308 - DNA, 15 bp, Homo sapiens
caagtttcagagtca

SEQ ID NO: 4825309 - DNA, 20 bp, Homo sapiens
caataaagagtaaatatact

SEQ ID NO: 4825310 - DNA, 15 bp, Homo sapiens
caataaagctcacac

SEQ ID NO: 4825311 - DNA, 18 bp, Homo sapiens
caataaattttatctcag

SEQ ID NO: 4825312 - DNA, 19 bp, Homo sapiens
caataaattttatctcagt

SEQ ID NO: 4825313 - DNA, 14 bp, Homo sapiens
caataacagtttta

SEQ ID NO: 4825314 - DNA, 20 bp, Homo sapiens
caataagaaacagtttaaca

SEQ ID NO: 4825315 - DNA, 21 bp, Homo sapiens
caataagaaacagtttaacag

SEQ ID NO: 4825316 - DNA, 20 bp, Homo sapiens
caataagatattaccctcag

SEQ ID NO: 4825317 - DNA, 19 bp, Homo sapiens
caataaggatttattctca

SEQ ID NO: 4825318 - DNA, 21 bp, Homo sapiens
caataaggatttattctcaga

SEQ ID NO: 4825319 - DNA, 17 bp, Homo sapiens
caatactttgtgtcttt

SEQ ID NO: 4825320 - DNA, 14 bp, Homo sapiens
caataggcttagtg

SEQ ID NO: 4825321 - DNA, 22 bp, Homo sapiens
caatagtgttgaggaggggagc

SEQ ID NO: 4825322 - DNA, 23 bp, Homo sapiens
caatatcttcgttagtaatctgt

SEQ ID NO: 4825323 - DNA, 21 bp, Homo sapiens
caatattaagtgttgtacaat

SEQ ID NO: 4825324 - DNA, 22 bp, Homo sapiens
caatattaagtgttgtacaatt

SEQ ID NO: 4825325 - DNA, 22 bp, Homo sapiens
caatcactaaatatctagtgct

SEQ ID NO: 4825326 - DNA, 17 bp, Homo sapiens
caatcagcactgaaaat

SEQ ID NO: 4825327 - DNA, 14 bp, Homo sapiens
caatcattgtacag

SEQ ID NO: 4825328 - DNA, 16 bp, Homo sapiens
caatcattgtcagaga

SEQ ID NO: 4825329 - DNA, 13 bp, Homo sapiens
caatcattttcta

SEQ ID NO: 4825330 - DNA, 20 bp, Homo sapiens
caatccccataatgcttctt

SEQ ID NO: 4825331 - DNA, 15 bp, Homo sapiens
caatctctgtgactc

SEQ ID NO: 4825332 - DNA, 17 bp, Homo sapiens
caatcttgctgtgaaac

SEQ ID NO: 4825333 - DNA, 22 bp, Homo sapiens
caatcttgctgtgaaacagtgt

SEQ ID NO: 4825334 - DNA, 14 bp, Homo sapiens
caatgcaatgcatc

SEQ ID NO: 4825335 - DNA, 17 bp, Homo sapiens
caatgcaatgcatctga

SEQ ID NO: 4825336 - DNA, 17 bp, Homo sapiens
caatgccaattcatctc

SEQ ID NO: 4825337 - DNA, 22 bp, Homo sapiens
caatgctatggactgcacaaaa

SEQ ID NO: 4825338 - DNA, 19 bp, Homo sapiens
caatgggtaaataaatgct

SEQ ID NO: 4825339 - DNA, 15 bp, Homo sapiens
caatggtaattataa

SEQ ID NO: 4825340 - DNA, 19 bp, Homo sapiens
caatggtagctctgaaggg

SEQ ID NO: 4825341 - DNA, 19 bp, Homo sapiens
caatggtgtagctgtcctc

SEQ ID NO: 4825342 - DNA, 20 bp, Homo sapiens
caatgtccaggtcacaggca

SEQ ID NO: 4825343 - DNA, 23 bp, Homo sapiens
caatgtgctgttgattctttcaa

SEQ ID NO: 4825344 - DNA, 20 bp, Homo sapiens
caatgtggaattacataaca

SEQ ID NO: 4825345 - DNA, 14 bp, Homo sapiens
caatgttaaatcta

SEQ ID NO: 4825346 - DNA, 21 bp, Homo sapiens
caatgttaaatctacaaactt

SEQ ID NO: 4825347 - DNA, 15 bp, Homo sapiens
caatgttaaattaat

SEQ ID NO: 4825348 - DNA, 22 bp, Homo sapiens
caatgttccgttcatctgagga

SEQ ID NO: 4825349 - DNA, 22 bp, Homo sapiens
caatgttggctagtctgtgcct

SEQ ID NO: 4825350 - DNA, 17 bp, Homo sapiens
caattaatggaaaactg

SEQ ID NO: 4825351 - DNA, 16 bp, Homo sapiens
caattacaggaagtac

SEQ ID NO: 4825352 - DNA, 17 bp, Homo sapiens
caattacaggaagtact

SEQ ID NO: 4825353 - DNA, 17 bp, Homo sapiens
caattactactttgtta

SEQ ID NO: 4825354 - DNA, 18 bp, Homo sapiens
caattactgtgagaactg

SEQ ID NO: 4825355 - DNA, 23 bp, Homo sapiens
caattactgtgagaactgtgaat

SEQ ID NO: 4825356 - DNA, 18 bp, Homo sapiens
caattatcaaaaaacaga

SEQ ID NO: 4825357 - DNA, 22 bp, Homo sapiens
caattatcaaaaaacagaaaaa

SEQ ID NO: 4825358 - DNA, 19 bp, Homo sapiens
caattcaactttttatttt

SEQ ID NO: 4825359 - DNA, 19 bp, Homo sapiens
caattccagggaaccagag

SEQ ID NO: 4825360 - DNA, 21 bp, Homo sapiens
caattgatctctttttatcgc

SEQ ID NO: 4825361 - DNA, 15 bp, Homo sapiens
caattgcttgagcat

SEQ ID NO: 4825362 - DNA, 18 bp, Homo sapiens
caattgtgagaattactg

SEQ ID NO: 4825363 - DNA, 19 bp, Homo sapiens
caattgtgagaattactgt

SEQ ID NO: 4825364 - DNA, 16 bp, Homo sapiens
caattgtttaagaatc

SEQ ID NO: 4825365 - DNA, 19 bp, Homo sapiens
caattgtttaagaatcatg

SEQ ID NO: 4825366 - DNA, 15 bp, Homo sapiens
caatttaaaggaaag

SEQ ID NO: 4825367 - DNA, 22 bp, Homo sapiens
caatttaaaggaaagttctatt

SEQ ID NO: 4825368 - DNA, 23 bp, Homo sapiens
caatttaaaggaaagttctatta

SEQ ID NO: 4825369 - DNA, 19 bp, Homo sapiens
caatttcaaagaaaacaga

SEQ ID NO: 4825370 - DNA, 15 bp, Homo sapiens
caatttcacagagta

SEQ ID NO: 4825371 - DNA, 12 bp, Homo sapiens
caatttgttctg

SEQ ID NO: 4825372 - DNA, 16 bp, Homo sapiens
caatttgtttgtgctt

SEQ ID NO: 4825373 - DNA, 19 bp, Homo sapiens
caatttgtttgtgcttcta

SEQ ID NO: 4825374 - DNA, 15 bp, Homo sapiens
caattttcctaagtt

SEQ ID NO: 4825375 - DNA, 19 bp, Homo sapiens
caattttctttaaccagtc

SEQ ID NO: 4825376 - DNA, 13 bp, Homo sapiens
cacaaaaaattta

SEQ ID NO: 4825377 - DNA, 11 bp, Homo sapiens
cacaaaacaac

SEQ ID NO: 4825378 - DNA, 12 bp, Homo sapiens
cacaaaatgcaa

SEQ ID NO: 4825379 - DNA, 11 bp, Homo sapiens
cacaaaccttc

SEQ ID NO: 4825380 - DNA, 21 bp, Homo sapiens
cacaaaccttcttttcaatgc

SEQ ID NO: 4825381 - DNA, 23 bp, Homo sapiens
cacaaagtgaaattagtattttg

SEQ ID NO: 4825382 - DNA, 17 bp, Homo sapiens
cacaaatgtcctcagag

SEQ ID NO: 4825383 - DNA, 15 bp, Homo sapiens
cacaacatgcacatt

SEQ ID NO: 4825384 - DNA, 17 bp, Homo sapiens
cacaaccatgttcttga

SEQ ID NO: 4825385 - DNA, 13 bp, Homo sapiens
cacaactaacaat

SEQ ID NO: 4825386 - DNA, 16 bp, Homo sapiens
cacaactaacaatgcc

SEQ ID NO: 4825387 - DNA, 15 bp, Homo sapiens
cacaactgacacagg

SEQ ID NO: 4825388 - DNA, 18 bp, Homo sapiens
cacaactgacacaggaaa

SEQ ID NO: 4825389 - DNA, 19 bp, Homo sapiens
cacaactgtggataaattt

SEQ ID NO: 4825390 - DNA, 20 bp, Homo sapiens
cacaactgtggataaatttt

SEQ ID NO: 4825391 - DNA, 20 bp, Homo sapiens
cacaactgtttttgaagaag

SEQ ID NO: 4825392 - DNA, 16 bp, Homo sapiens
cacaagagcccaggcc

SEQ ID NO: 4825393 - DNA, 17 bp, Homo sapiens
cacaagagcccaggcct

SEQ ID NO: 4825394 - DNA, 19 bp, Homo sapiens
cacaagcacaattgatctc

SEQ ID NO: 4825395 - DNA, 23 bp, Homo sapiens
cacaatcactaaatatctagtgc

SEQ ID NO: 4825396 - DNA, 13 bp, Homo sapiens
cacaatggcaagc

SEQ ID NO: 4825397 - DNA, 21 bp, Homo sapiens
cacaatggtagctctgaaggg

SEQ ID NO: 4825398 - DNA, 13 bp, Homo sapiens
cacaattttgtct

SEQ ID NO: 4825399 - DNA, 16 bp, Homo sapiens
cacaattttgtctcta

SEQ ID NO: 4825400 - DNA, 15 bp, Homo sapiens
cacacaaaacaacag

SEQ ID NO: 4825401 - DNA, 17 bp, Homo sapiens
cacacaaagtgaaatta

SEQ ID NO: 4825402 - DNA, 22 bp, Homo sapiens
cacacaaatattgcttggacta

SEQ ID NO: 4825403 - DNA, 19 bp, Homo sapiens
cacacacaaaacaacagca

SEQ ID NO: 4825404 - DNA, 11 bp, Homo sapiens
cacacacacaa

SEQ ID NO: 4825405 - DNA, 13 bp, Homo sapiens
cacacacacaaaa

SEQ ID NO: 4825406 - DNA, 15 bp, Homo sapiens
cacacacacaaaaca

SEQ ID NO: 4825407 - DNA, 14 bp, Homo sapiens
cacacacacacaca

SEQ ID NO: 4825408 - DNA, 15 bp, Homo sapiens
cacacacacacacac

SEQ ID NO: 4825409 - DNA, 14 bp, Homo sapiens
cacacacagcagct

SEQ ID NO: 4825410 - DNA, 16 bp, Homo sapiens
cacacacagcagctcc

SEQ ID NO: 4825411 - DNA, 15 bp, Homo sapiens
cacacacctgcctgc

SEQ ID NO: 4825412 - DNA, 21 bp, Homo sapiens
cacacacgcgtccacatacac

SEQ ID NO: 4825413 - DNA, 13 bp, Homo sapiens
cacacagcagccc

SEQ ID NO: 4825414 - DNA, 23 bp, Homo sapiens
cacacagcagccccccagcacta

SEQ ID NO: 4825415 - DNA, 13 bp, Homo sapiens
cacacagcagctc

SEQ ID NO: 4825416 - DNA, 22 bp, Homo sapiens
cacacatagattaatggcactg

SEQ ID NO: 4825417 - DNA, 23 bp, Homo sapiens
cacacatagattaatggcactga

SEQ ID NO: 4825418 - DNA, 22 bp, Homo sapiens
cacacatatacattatttctgt

SEQ ID NO: 4825419 - DNA, 17 bp, Homo sapiens
cacacattctgtataat

SEQ ID NO: 4825420 - DNA, 18 bp, Homo sapiens
cacaccccgtctgcccct

SEQ ID NO: 4825421 - DNA, 19 bp, Homo sapiens
cacaccccgtctgcccctt

SEQ ID NO: 4825422 - DNA, 18 bp, Homo sapiens
cacaccctcactctgcca

SEQ ID NO: 4825423 - DNA, 19 bp, Homo sapiens
cacaccgcaccgggctggc

SEQ ID NO: 4825424 - DNA, 15 bp, Homo sapiens
cacaccggcactgtg

SEQ ID NO: 4825425 - DNA, 20 bp, Homo sapiens
cacacctaaattaacaaatt

SEQ ID NO: 4825426 - DNA, 13 bp, Homo sapiens
cacacctccaccc

SEQ ID NO: 4825427 - DNA, 15 bp, Homo sapiens
cacacctccacccgt

SEQ ID NO: 4825428 - DNA, 13 bp, Homo sapiens
cacacctcccttc

SEQ ID NO: 4825429 - DNA, 13 bp, Homo sapiens
cacacctgcctgc

SEQ ID NO: 4825430 - DNA, 17 bp, Homo sapiens
cacaccttacaaagcca

SEQ ID NO: 4825431 - DNA, 12 bp, Homo sapiens
cacacgccaccc

SEQ ID NO: 4825432 - DNA, 15 bp, Homo sapiens
cacacgccggggctg

SEQ ID NO: 4825433 - DNA, 22 bp, Homo sapiens
cacacggggcacccagcccaac

SEQ ID NO: 4825434 - DNA, 18 bp, Homo sapiens
cacactgccctctgccac

SEQ ID NO: 4825435 - DNA, 19 bp, Homo sapiens
cacactgccctctgccact

SEQ ID NO: 4825436 - DNA, 21 bp, Homo sapiens
cacacttgacatcaactgcat

SEQ ID NO: 4825437 - DNA, 13 bp, Homo sapiens
cacacttgggctg

SEQ ID NO: 4825438 - DNA, 17 bp, Homo sapiens
cacacttgggctggcac

SEQ ID NO: 4825439 - DNA, 18 bp, Homo sapiens
cacagaaaatggaagaca

SEQ ID NO: 4825440 - DNA, 22 bp, Homo sapiens
cacagaaaatggaagacagctc

SEQ ID NO: 4825441 - DNA, 12 bp, Homo sapiens
cacagactctgt

SEQ ID NO: 4825442 - DNA, 19 bp, Homo sapiens
cacagactgctgtcttact

SEQ ID NO: 4825443 - DNA, 13 bp, Homo sapiens
cacagagtacaaa

SEQ ID NO: 4825444 - DNA, 19 bp, Homo sapiens
cacagatgggcaaggcctt

SEQ ID NO: 4825445 - DNA, 14 bp, Homo sapiens
cacagcacatgctg

SEQ ID NO: 4825446 - DNA, 21 bp, Homo sapiens
cacagcacatgctggccagcc

SEQ ID NO: 4825447 - DNA, 11 bp, Homo sapiens
cacagcacatt

SEQ ID NO: 4825448 - DNA, 11 bp, Homo sapiens
cacagcagccc

SEQ ID NO: 4825449 - DNA, 14 bp, Homo sapiens
cacagcagcctgct

SEQ ID NO: 4825450 - DNA, 13 bp, Homo sapiens
cacagcagctcca

SEQ ID NO: 4825451 - DNA, 23 bp, Homo sapiens
cacagcagctccaacctggaggc

SEQ ID NO: 4825452 - DNA, 18 bp, Homo sapiens
cacagcatgcatttagca

SEQ ID NO: 4825453 - DNA, 16 bp, Homo sapiens
cacagccaccacctgg

SEQ ID NO: 4825454 - DNA, 17 bp, Homo sapiens
cacagccaccacctgga

SEQ ID NO: 4825455 - DNA, 11 bp, Homo sapiens
cacagccagaa

SEQ ID NO: 4825456 - DNA, 21 bp, Homo sapiens
cacagccccaaacaagcgcca

SEQ ID NO: 4825457 - DNA, 21 bp, Homo sapiens
cacagcctttgcgctctgggt

SEQ ID NO: 4825458 - DNA, 15 bp, Homo sapiens
cacagcgtccctagc

SEQ ID NO: 4825459 - DNA, 13 bp, Homo sapiens
cacagctactcag

SEQ ID NO: 4825460 - DNA, 21 bp, Homo sapiens
cacagctactcagatctgcac

SEQ ID NO: 4825461 - DNA, 13 bp, Homo sapiens
cacagctgcctcc

SEQ ID NO: 4825462 - DNA, 16 bp, Homo sapiens
cacaggaaaagaattt

SEQ ID NO: 4825463 - DNA, 12 bp, Homo sapiens
cacaggaaaagg

SEQ ID NO: 4825464 - DNA, 13 bp, Homo sapiens
cacaggaccgttt

SEQ ID NO: 4825465 - DNA, 16 bp, Homo sapiens
cacaggagcgtgtcct

SEQ ID NO: 4825466 - DNA, 18 bp, Homo sapiens
cacaggagcgtgtcctat

SEQ ID NO: 4825467 - DNA, 21 bp, Homo sapiens
cacaggagctccctttttgaa

SEQ ID NO: 4825468 - DNA, 13 bp, Homo sapiens
cacaggcctggcc

SEQ ID NO: 4825469 - DNA, 17 bp, Homo sapiens
cacaggcctggcccagc

SEQ ID NO: 4825470 - DNA, 22 bp, Homo sapiens
cacaggcctggcccagccagca

SEQ ID NO: 4825471 - DNA, 23 bp, Homo sapiens
cacaggcctggcccagccagcag

SEQ ID NO: 4825472 - DNA, 18 bp, Homo sapiens
cacaggggaaaagaggag

SEQ ID NO: 4825473 - DNA, 14 bp, Homo sapiens
cacaggtgtaaata

SEQ ID NO: 4825474 - DNA, 22 bp, Homo sapiens
cacagtaatctttcggtctcct

SEQ ID NO: 4825475 - DNA, 23 bp, Homo sapiens
cacagtaatctttcggtctcctt

SEQ ID NO: 4825476 - DNA, 19 bp, Homo sapiens
cacagtagtgttgggtgga

SEQ ID NO: 4825477 - DNA, 22 bp, Homo sapiens
cacagtagtgttgggtggagga

SEQ ID NO: 4825478 - DNA, 13 bp, Homo sapiens
cacagtatatttt

SEQ ID NO: 4825479 - DNA, 19 bp, Homo sapiens
cacagtatattttatttca

SEQ ID NO: 4825480 - DNA, 15 bp, Homo sapiens
cacagtattgttctt

SEQ ID NO: 4825481 - DNA, 13 bp, Homo sapiens
cacagtatttaac

SEQ ID NO: 4825482 - DNA, 11 bp, Homo sapiens
cacagtgaccc

SEQ ID NO: 4825483 - DNA, 16 bp, Homo sapiens
cacagtgacccttccc

SEQ ID NO: 4825484 - DNA, 20 bp, Homo sapiens
cacagtgggcggcttccctg

SEQ ID NO: 4825485 - DNA, 16 bp, Homo sapiens
cacagtggtccagggt

SEQ ID NO: 4825486 - DNA, 19 bp, Homo sapiens
cacagttccacaattttgt

SEQ ID NO: 4825487 - DNA, 14 bp, Homo sapiens
cacagttctctcct

SEQ ID NO: 4825488 - DNA, 21 bp, Homo sapiens
cacataaacacttctccttaa

SEQ ID NO: 4825489 - DNA, 21 bp, Homo sapiens
cacataccaactcaacttttt

SEQ ID NO: 4825490 - DNA, 13 bp, Homo sapiens
cacatagattaat

SEQ ID NO: 4825491 - DNA, 14 bp, Homo sapiens
cacatagattcacc

SEQ ID NO: 4825492 - DNA, 14 bp, Homo sapiens
cacatagcataggc

SEQ ID NO: 4825493 - DNA, 14 bp, Homo sapiens
cacatataaacaca

SEQ ID NO: 4825494 - DNA, 19 bp, Homo sapiens
cacatatacattatttctg

SEQ ID NO: 4825495 - DNA, 19 bp, Homo sapiens
cacatcataaacaaagagt

SEQ ID NO: 4825496 - DNA, 14 bp, Homo sapiens
cacatctcttcatg

SEQ ID NO: 4825497 - DNA, 12 bp, Homo sapiens
cacatctgtata

SEQ ID NO: 4825498 - DNA, 20 bp, Homo sapiens
cacatctgtatatcagctct

SEQ ID NO: 4825499 - DNA, 20 bp, Homo sapiens
cacatgacagtggttatatt

SEQ ID NO: 4825500 - DNA, 14 bp, Homo sapiens
cacatgacatccac

SEQ ID NO: 4825501 - DNA, 17 bp, Homo sapiens
cacatgacatccacatg

SEQ ID NO: 4825502 - DNA, 20 bp, Homo sapiens
cacatgacatccacatgcac

SEQ ID NO: 4825503 - DNA, 24 bp, Homo sapiens
cacatgacatccacatgcacatgt

SEQ ID NO: 4825504 - DNA, 19 bp, Homo sapiens
cacatgcccctcttagaag

SEQ ID NO: 4825505 - DNA, 22 bp, Homo sapiens
cacatgcccctcttagaagaaa

SEQ ID NO: 4825506 - DNA, 22 bp, Homo sapiens
cacatgcccttggtgacagctg

SEQ ID NO: 4825507 - DNA, 19 bp, Homo sapiens
cacatgcctctctcaggcc

SEQ ID NO: 4825508 - DNA, 18 bp, Homo sapiens
cacatgcgctcctggctt

SEQ ID NO: 4825509 - DNA, 13 bp, Homo sapiens
cacatgctggcca

SEQ ID NO: 4825510 - DNA, 15 bp, Homo sapiens
cacatgctggccagc

SEQ ID NO: 4825511 - DNA, 18 bp, Homo sapiens
cacatgctggccagcctg

SEQ ID NO: 4825512 - DNA, 17 bp, Homo sapiens
cacatggaaggtgatgg

SEQ ID NO: 4825513 - DNA, 23 bp, Homo sapiens
cacatggccgctgcccacgtccc

SEQ ID NO: 4825514 - DNA, 16 bp, Homo sapiens
cacatgtattctgttg

SEQ ID NO: 4825515 - DNA, 22 bp, Homo sapiens
cacatgtattctgttggccagc

SEQ ID NO: 4825516 - DNA, 13 bp, Homo sapiens
cacatgttttaca

SEQ ID NO: 4825517 - DNA, 21 bp, Homo sapiens
cacattaggaacagagtatat

SEQ ID NO: 4825518 - DNA, 16 bp, Homo sapiens
cacattcatcctcaca

SEQ ID NO: 4825519 - DNA, 14 bp, Homo sapiens
cacattcctgaccc

SEQ ID NO: 4825520 - DNA, 20 bp, Homo sapiens
cacattcctgaccctcactt

SEQ ID NO: 4825521 - DNA, 15 bp, Homo sapiens
cacattgaaactgta

SEQ ID NO: 4825522 - DNA, 23 bp, Homo sapiens
cacattgaaactgtatttacttg

SEQ ID NO: 4825523 - DNA, 13 bp, Homo sapiens
cacattgcacaca

SEQ ID NO: 4825524 - DNA, 17 bp, Homo sapiens
cacattgcacacacagt

SEQ ID NO: 4825525 - DNA, 17 bp, Homo sapiens
cacattgcttcattaaa

SEQ ID NO: 4825526 - DNA, 22 bp, Homo sapiens
cacattgcttcattaaaacaag

SEQ ID NO: 4825527 - DNA, 15 bp, Homo sapiens
cacatttgttaatga

SEQ ID NO: 4825528 - DNA, 17 bp, Homo sapiens
caccaagtaaatctatc

SEQ ID NO: 4825529 - DNA, 21 bp, Homo sapiens
caccaagtaaatctatctcta

SEQ ID NO: 4825530 - DNA, 17 bp, Homo sapiens
caccacaaccctgttgc

SEQ ID NO: 4825531 - DNA, 14 bp, Homo sapiens
caccacaactaaca

SEQ ID NO: 4825532 - DNA, 23 bp, Homo sapiens
caccacaactaacaatgccttgt

SEQ ID NO: 4825533 - DNA, 20 bp, Homo sapiens
caccacacacacccttcccc

SEQ ID NO: 4825534 - DNA, 17 bp, Homo sapiens
caccacagaagcttgta

SEQ ID NO: 4825535 - DNA, 12 bp, Homo sapiens
caccacccaccc

SEQ ID NO: 4825536 - DNA, 14 bp, Homo sapiens
caccacctctttgg

SEQ ID NO: 4825537 - DNA, 21 bp, Homo sapiens
caccacctggatggatctgct

SEQ ID NO: 4825538 - DNA, 23 bp, Homo sapiens
caccacggggtcgggggaggagc

SEQ ID NO: 4825539 - DNA, 13 bp, Homo sapiens
caccactctcagg

SEQ ID NO: 4825540 - DNA, 24 bp, Homo sapiens
caccactctcaggaccaccctgcc

SEQ ID NO: 4825541 - DNA, 12 bp, Homo sapiens
caccactgtgtc

SEQ ID NO: 4825542 - DNA, 14 bp, Homo sapiens
caccactgtgtccc

SEQ ID NO: 4825543 - DNA, 23 bp, Homo sapiens
caccactgtgtcccagtgtctgg

SEQ ID NO: 4825544 - DNA, 23 bp, Homo sapiens
caccagatgcaacctcactatgg

SEQ ID NO: 4825545 - DNA, 17 bp, Homo sapiens
caccaggaagaaggccc

SEQ ID NO: 4825546 - DNA, 19 bp, Homo sapiens
caccaggaagaaggcccgg

SEQ ID NO: 4825547 - DNA, 14 bp, Homo sapiens
caccagggactgca

SEQ ID NO: 4825548 - DNA, 16 bp, Homo sapiens
caccagggactgcagc

SEQ ID NO: 4825549 - DNA, 23 bp, Homo sapiens
caccagggtttagtttgcattta

SEQ ID NO: 4825550 - DNA, 16 bp, Homo sapiens
caccagtccacgccgg

SEQ ID NO: 4825551 - DNA, 16 bp, Homo sapiens
caccatttcccctgtg

SEQ ID NO: 4825552 - DNA, 17 bp, Homo sapiens
caccatttcccctgtgg

SEQ ID NO: 4825553 - DNA, 18 bp, Homo sapiens
caccatttcccctgtggt

SEQ ID NO: 4825554 - DNA, 18 bp, Homo sapiens
cacccaaagcatggacta

SEQ ID NO: 4825555 - DNA, 19 bp, Homo sapiens
cacccacaccccgtctgcc

SEQ ID NO: 4825556 - DNA, 16 bp, Homo sapiens
cacccaccacccccat

SEQ ID NO: 4825557 - DNA, 13 bp, Homo sapiens
cacccaccactct

SEQ ID NO: 4825558 - DNA, 12 bp, Homo sapiens
cacccacccctg

SEQ ID NO: 4825559 - DNA, 16 bp, Homo sapiens
cacccactagccctct

SEQ ID NO: 4825560 - DNA, 23 bp, Homo sapiens
cacccagcccactaactgaggag

SEQ ID NO: 4825561 - DNA, 13 bp, Homo sapiens
cacccatatcatg

SEQ ID NO: 4825562 - DNA, 15 bp, Homo sapiens
caccccaagctgctg

SEQ ID NO: 4825563 - DNA, 13 bp, Homo sapiens
caccccacacttg

SEQ ID NO: 4825564 - DNA, 16 bp, Homo sapiens
caccccagtccccggg

SEQ ID NO: 4825565 - DNA, 18 bp, Homo sapiens
caccccccgacctggctg

SEQ ID NO: 4825566 - DNA, 14 bp, Homo sapiens
caccccgctgcctg

SEQ ID NO: 4825567 - DNA, 16 bp, Homo sapiens
caccccgctgcctggc

SEQ ID NO: 4825568 - DNA, 14 bp, Homo sapiens
caccccggcaggcc

SEQ ID NO: 4825569 - DNA, 20 bp, Homo sapiens
caccccggcaggccctgcag

SEQ ID NO: 4825570 - DNA, 18 bp, Homo sapiens
caccccgtcccggccccg

SEQ ID NO: 4825571 - DNA, 14 bp, Homo sapiens
caccccgttcccag

SEQ ID NO: 4825572 - DNA, 16 bp, Homo sapiens
caccccgttcccagcg

SEQ ID NO: 4825573 - DNA, 16 bp, Homo sapiens
cacccctacagcctgc

SEQ ID NO: 4825574 - DNA, 20 bp, Homo sapiens
cacccctacagcctgcacac

SEQ ID NO: 4825575 - DNA, 12 bp, Homo sapiens
cacccctcccac

SEQ ID NO: 4825576 - DNA, 21 bp, Homo sapiens
cacccctcccacctctttctt

SEQ ID NO: 4825577 - DNA, 22 bp, Homo sapiens
cacccctcccacctctttcttc

SEQ ID NO: 4825578 - DNA, 18 bp, Homo sapiens
cacccctcttcccccttc

SEQ ID NO: 4825579 - DNA, 19 bp, Homo sapiens
cacccctgaactggcccca

SEQ ID NO: 4825580 - DNA, 14 bp, Homo sapiens
cacccctgcccagg

SEQ ID NO: 4825581 - DNA, 11 bp, Homo sapiens
cacccgcccca

SEQ ID NO: 4825582 - DNA, 12 bp, Homo sapiens
cacccgccccag

SEQ ID NO: 4825583 - DNA, 15 bp, Homo sapiens
cacccgccccagaga

SEQ ID NO: 4825584 - DNA, 17 bp, Homo sapiens
cacccgccccagagact

SEQ ID NO: 4825585 - DNA, 18 bp, Homo sapiens
cacccgccccagagactg

SEQ ID NO: 4825586 - DNA, 14 bp, Homo sapiens
cacccgcccgcccc

SEQ ID NO: 4825587 - DNA, 17 bp, Homo sapiens
cacccgcccgcccccgc

SEQ ID NO: 4825588 - DNA, 18 bp, Homo sapiens
cacccgcccgcccccgcc

SEQ ID NO: 4825589 - DNA, 15 bp, Homo sapiens
cacccggatctccag

SEQ ID NO: 4825590 - DNA, 20 bp, Homo sapiens
cacccggatctccaggccca

SEQ ID NO: 4825591 - DNA, 22 bp, Homo sapiens
cacccggatctccaggcccagc

SEQ ID NO: 4825592 - DNA, 18 bp, Homo sapiens
cacccgtgttctcctcca

SEQ ID NO: 4825593 - DNA, 17 bp, Homo sapiens
caccctcactctgccag

SEQ ID NO: 4825594 - DNA, 16 bp, Homo sapiens
caccctccacaggagc

SEQ ID NO: 4825595 - DNA, 13 bp, Homo sapiens
caccctcccctct

SEQ ID NO: 4825596 - DNA, 15 bp, Homo sapiens
caccctcgctgccac

SEQ ID NO: 4825597 - DNA, 15 bp, Homo sapiens
caccctctcctgggg

SEQ ID NO: 4825598 - DNA, 18 bp, Homo sapiens
caccctctgctgcacagt

SEQ ID NO: 4825599 - DNA, 13 bp, Homo sapiens
caccctctgtcct

SEQ ID NO: 4825600 - DNA, 22 bp, Homo sapiens
caccctctgtccttcccccagc

SEQ ID NO: 4825601 - DNA, 12 bp, Homo sapiens
caccctgccaag

SEQ ID NO: 4825602 - DNA, 15 bp, Homo sapiens
caccctgccaaggca

SEQ ID NO: 4825603 - DNA, 15 bp, Homo sapiens
caccctgccaccctc

SEQ ID NO: 4825604 - DNA, 18 bp, Homo sapiens
caccctgccaccctctgc

SEQ ID NO: 4825605 - DNA, 16 bp, Homo sapiens
caccctgccctggcct

SEQ ID NO: 4825606 - DNA, 15 bp, Homo sapiens
caccctgctgccttc

SEQ ID NO: 4825607 - DNA, 16 bp, Homo sapiens
caccctgggcctcccg

SEQ ID NO: 4825608 - DNA, 19 bp, Homo sapiens
cacccttagcctccagcac

SEQ ID NO: 4825609 - DNA, 14 bp, Homo sapiens
cacccttccccact

SEQ ID NO: 4825610 - DNA, 19 bp, Homo sapiens
cacccttgaaaactctcag

SEQ ID NO: 4825611 - DNA, 21 bp, Homo sapiens
cacccttgaaaactctcagtc

SEQ ID NO: 4825612 - DNA, 15 bp, Homo sapiens
caccgattcttcctt

SEQ ID NO: 4825613 - DNA, 18 bp, Homo sapiens
caccgcaccgggctggcc

SEQ ID NO: 4825614 - DNA, 14 bp, Homo sapiens
caccgcattccagg

SEQ ID NO: 4825615 - DNA, 19 bp, Homo sapiens
caccgcattccaggggctg

SEQ ID NO: 4825616 - DNA, 20 bp, Homo sapiens
caccgcccaacccccacctc

SEQ ID NO: 4825617 - DNA, 13 bp, Homo sapiens
caccgcccaccca

SEQ ID NO: 4825618 - DNA, 16 bp, Homo sapiens
caccgcccacccacac

SEQ ID NO: 4825619 - DNA, 22 bp, Homo sapiens
caccggacgctggagaccctgc

SEQ ID NO: 4825620 - DNA, 15 bp, Homo sapiens
caccggcactgtgca

SEQ ID NO: 4825621 - DNA, 15 bp, Homo sapiens
caccgggagcctccc

SEQ ID NO: 4825622 - DNA, 17 bp, Homo sapiens
caccgggagcctccccc

SEQ ID NO: 4825623 - DNA, 19 bp, Homo sapiens
caccgggagcctccccctc

SEQ ID NO: 4825624 - DNA, 18 bp, Homo sapiens
caccgtgacattccagca

SEQ ID NO: 4825625 - DNA, 18 bp, Homo sapiens
cacctaaagggaagccct

SEQ ID NO: 4825626 - DNA, 15 bp, Homo sapiens
cacctaattaatttc

SEQ ID NO: 4825627 - DNA, 18 bp, Homo sapiens
cacctcaccccgttacag

SEQ ID NO: 4825628 - DNA, 11 bp, Homo sapiens
cacctccaccc

SEQ ID NO: 4825629 - DNA, 12 bp, Homo sapiens
cacctccacccg

SEQ ID NO: 4825630 - DNA, 15 bp, Homo sapiens
cacctccacccgtcc

SEQ ID NO: 4825631 - DNA, 22 bp, Homo sapiens
cacctccagtccccctatcctt

SEQ ID NO: 4825632 - DNA, 18 bp, Homo sapiens
cacctcccccaaaccctg

SEQ ID NO: 4825633 - DNA, 20 bp, Homo sapiens
cacctcccccaaaccctgct

SEQ ID NO: 4825634 - DNA, 13 bp, Homo sapiens
cacctccctgccc

SEQ ID NO: 4825635 - DNA, 14 bp, Homo sapiens
cacctccctgccca

SEQ ID NO: 4825636 - DNA, 23 bp, Homo sapiens
cacctcccttcatcccagggtat

SEQ ID NO: 4825637 - DNA, 22 bp, Homo sapiens
cacctccttctgcagtcagact

SEQ ID NO: 4825638 - DNA, 13 bp, Homo sapiens
cacctctgtgacc

SEQ ID NO: 4825639 - DNA, 15 bp, Homo sapiens
cacctgaataaggga

SEQ ID NO: 4825640 - DNA, 17 bp, Homo sapiens
cacctgccaggctgcag

SEQ ID NO: 4825641 - DNA, 21 bp, Homo sapiens
cacctgccaggctgcagggac

SEQ ID NO: 4825642 - DNA, 12 bp, Homo sapiens
cacctgcccagt

SEQ ID NO: 4825643 - DNA, 21 bp, Homo sapiens
cacctgcccagttagcccggc

SEQ ID NO: 4825644 - DNA, 22 bp, Homo sapiens
cacctgcccagttagcccggcc

SEQ ID NO: 4825645 - DNA, 14 bp, Homo sapiens
cacctgccccaggc

SEQ ID NO: 4825646 - DNA, 16 bp, Homo sapiens
cacctgcccctcaact

SEQ ID NO: 4825647 - DNA, 17 bp, Homo sapiens
cacctgccgctgcttga

SEQ ID NO: 4825648 - DNA, 17 bp, Homo sapiens
cacctgcctgcagagca

SEQ ID NO: 4825649 - DNA, 15 bp, Homo sapiens
cacctgcttctcagc

SEQ ID NO: 4825650 - DNA, 15 bp, Homo sapiens
cacctggaaagccag

SEQ ID NO: 4825651 - DNA, 18 bp, Homo sapiens
cacctggatggatctgct

SEQ ID NO: 4825652 - DNA, 20 bp, Homo sapiens
cacctggatggatctgctcc

SEQ ID NO: 4825653 - DNA, 21 bp, Homo sapiens
cacctggatggatctgctcca

SEQ ID NO: 4825654 - DNA, 17 bp, Homo sapiens
cacctggcttcccagga

SEQ ID NO: 4825655 - DNA, 22 bp, Homo sapiens
cacctggcttcccaggaccctg

SEQ ID NO: 4825656 - DNA, 14 bp, Homo sapiens
cacctggtggccct

SEQ ID NO: 4825657 - DNA, 16 bp, Homo sapiens
cacctggtggccctgc

SEQ ID NO: 4825658 - DNA, 17 bp, Homo sapiens
cacctggtggccctgcg

SEQ ID NO: 4825659 - DNA, 13 bp, Homo sapiens
cacctgtaaaact

SEQ ID NO: 4825660 - DNA, 17 bp, Homo sapiens
cacctgtaaaactttat

SEQ ID NO: 4825661 - DNA, 15 bp, Homo sapiens
caccttaaattaaac

SEQ ID NO: 4825662 - DNA, 15 bp, Homo sapiens
caccttacaaagcca

SEQ ID NO: 4825663 - DNA, 19 bp, Homo sapiens
caccttcccagctgctcct

SEQ ID NO: 4825664 - DNA, 24 bp, Homo sapiens
caccttcccctgaggacctttctg

SEQ ID NO: 4825665 - DNA, 12 bp, Homo sapiens
caccttcctggg

SEQ ID NO: 4825666 - DNA, 13 bp, Homo sapiens
caccttcctgggc

SEQ ID NO: 4825667 - DNA, 19 bp, Homo sapiens
caccttcctgggcagccca

SEQ ID NO: 4825668 - DNA, 20 bp, Homo sapiens
caccttcctgggcagcccag

SEQ ID NO: 4825669 - DNA, 22 bp, Homo sapiens
caccttcctgggcagcccagag

SEQ ID NO: 4825670 - DNA, 23 bp, Homo sapiens
caccttcctgggcagcccagaga

SEQ ID NO: 4825671 - DNA, 17 bp, Homo sapiens
caccttctgccaaggcc

SEQ ID NO: 4825672 - DNA, 23 bp, Homo sapiens
caccttctgtgcatctggcctgg

SEQ ID NO: 4825673 - DNA, 13 bp, Homo sapiens
caccttctgtttt

SEQ ID NO: 4825674 - DNA, 20 bp, Homo sapiens
caccttgagcactattctaa

SEQ ID NO: 4825675 - DNA, 23 bp, Homo sapiens
caccttgggcacgggagagcgcc

SEQ ID NO: 4825676 - DNA, 14 bp, Homo sapiens
cacctttagaatat

SEQ ID NO: 4825677 - DNA, 13 bp, Homo sapiens
cacctttctggct

SEQ ID NO: 4825678 - DNA, 14 bp, Homo sapiens
cacctttgaagaag

SEQ ID NO: 4825679 - DNA, 18 bp, Homo sapiens
cacgagtgtagtcccgga

SEQ ID NO: 4825680 - DNA, 22 bp, Homo sapiens
cacgagtgtagtcccggaggcc

SEQ ID NO: 4825681 - DNA, 21 bp, Homo sapiens
cacgattccaacccaggtctg

SEQ ID NO: 4825682 - DNA, 16 bp, Homo sapiens
cacgcagagccccgga

SEQ ID NO: 4825683 - DNA, 18 bp, Homo sapiens
cacgcagagccccggagc

SEQ ID NO: 4825684 - DNA, 22 bp, Homo sapiens
cacgccgatataagccatagcc

SEQ ID NO: 4825685 - DNA, 17 bp, Homo sapiens
cacgccggggctggccc

SEQ ID NO: 4825686 - DNA, 11 bp, Homo sapiens
cacgcctccat

SEQ ID NO: 4825687 - DNA, 13 bp, Homo sapiens
cacgcctcctggc

SEQ ID NO: 4825688 - DNA, 14 bp, Homo sapiens
cacgcctcctggcc

SEQ ID NO: 4825689 - DNA, 16 bp, Homo sapiens
cacgcctcctggccag

SEQ ID NO: 4825690 - DNA, 18 bp, Homo sapiens
cacgcctcctggccagac

SEQ ID NO: 4825691 - DNA, 15 bp, Homo sapiens
cacgcggctgctgct

SEQ ID NO: 4825692 - DNA, 14 bp, Homo sapiens
cacgcgtccacata

SEQ ID NO: 4825693 - DNA, 17 bp, Homo sapiens
cacgcgtccacatacac

SEQ ID NO: 4825694 - DNA, 14 bp, Homo sapiens
cacgctgtcctctc

SEQ ID NO: 4825695 - DNA, 22 bp, Homo sapiens
cacgctgtcctctcgagcccag

SEQ ID NO: 4825696 - DNA, 16 bp, Homo sapiens
cacggagtttccattt

SEQ ID NO: 4825697 - DNA, 21 bp, Homo sapiens
cacggcgtccctgagggccct

SEQ ID NO: 4825698 - DNA, 21 bp, Homo sapiens
cacgggagagcgccacccgcc

SEQ ID NO: 4825699 - DNA, 14 bp, Homo sapiens
cacgggcccgctca

SEQ ID NO: 4825700 - DNA, 22 bp, Homo sapiens
cacggggtcgggggaggagcac

SEQ ID NO: 4825701 - DNA, 19 bp, Homo sapiens
cacggtccaatccagcctt

SEQ ID NO: 4825702 - DNA, 21 bp, Homo sapiens
cacggtccaatccagccttct

SEQ ID NO: 4825703 - DNA, 14 bp, Homo sapiens
cacgtcccgggcac

SEQ ID NO: 4825704 - DNA, 13 bp, Homo sapiens
cacgtcctgggtg

SEQ ID NO: 4825705 - DNA, 14 bp, Homo sapiens
cacgtcctgggtgc

SEQ ID NO: 4825706 - DNA, 14 bp, Homo sapiens
cacgtgaccctgtg

SEQ ID NO: 4825707 - DNA, 18 bp, Homo sapiens
cacgtgaccctgtgcccc

SEQ ID NO: 4825708 - DNA, 19 bp, Homo sapiens
cacgtggtcctaatcttct

SEQ ID NO: 4825709 - DNA, 18 bp, Homo sapiens
cactaaaagtgatgtgat

SEQ ID NO: 4825710 - DNA, 17 bp, Homo sapiens
cactaaaatccacccag

SEQ ID NO: 4825711 - DNA, 21 bp, Homo sapiens
cactaaggccgtgtctctgag

SEQ ID NO: 4825712 - DNA, 18 bp, Homo sapiens
cactaatggccaagtgta

SEQ ID NO: 4825713 - DNA, 14 bp, Homo sapiens
cactaattagtgtc

SEQ ID NO: 4825714 - DNA, 12 bp, Homo sapiens
cactacaaacat

SEQ ID NO: 4825715 - DNA, 22 bp, Homo sapiens
cactacccatcggtgtccattt

SEQ ID NO: 4825716 - DNA, 13 bp, Homo sapiens
cactagaatgaga

SEQ ID NO: 4825717 - DNA, 21 bp, Homo sapiens
cactagccctctttctctctg

SEQ ID NO: 4825718 - DNA, 22 bp, Homo sapiens
cactagccctctttctctctgt

SEQ ID NO: 4825719 - DNA, 19 bp, Homo sapiens
cactagccttcccagcttc

SEQ ID NO: 4825720 - DNA, 17 bp, Homo sapiens
cactataatgtgaaatg

SEQ ID NO: 4825721 - DNA, 18 bp, Homo sapiens
cactatccatgcaccaaa

SEQ ID NO: 4825722 - DNA, 12 bp, Homo sapiens
cactatgcattt

SEQ ID NO: 4825723 - DNA, 15 bp, Homo sapiens
cactatgcattttaa

SEQ ID NO: 4825724 - DNA, 12 bp, Homo sapiens
cactcaccattt

SEQ ID NO: 4825725 - DNA, 16 bp, Homo sapiens
cactcatttatttcca

SEQ ID NO: 4825726 - DNA, 13 bp, Homo sapiens
cactcccagggcc

SEQ ID NO: 4825727 - DNA, 18 bp, Homo sapiens
cactcccagggcccgagc

SEQ ID NO: 4825728 - DNA, 19 bp, Homo sapiens
cactctgaagtcccttcct

SEQ ID NO: 4825729 - DNA, 20 bp, Homo sapiens
cactctgaagtcccttcctg

SEQ ID NO: 4825730 - DNA, 15 bp, Homo sapiens
cactctgacagtatt

SEQ ID NO: 4825731 - DNA, 13 bp, Homo sapiens
cactctgaccggg

SEQ ID NO: 4825732 - DNA, 16 bp, Homo sapiens
cactctgtcagccagc

SEQ ID NO: 4825733 - DNA, 17 bp, Homo sapiens
cactctgtcagccagcc

SEQ ID NO: 4825734 - DNA, 22 bp, Homo sapiens
cactctgtcagccagccgccct

SEQ ID NO: 4825735 - DNA, 23 bp, Homo sapiens
cactctgtcagccagccgccctg

SEQ ID NO: 4825736 - DNA, 21 bp, Homo sapiens
cactgaaaaggttcttcatcc

SEQ ID NO: 4825737 - DNA, 23 bp, Homo sapiens
cactgaaataaccgtaaaggttt

SEQ ID NO: 4825738 - DNA, 16 bp, Homo sapiens
cactgagaaggcccca

SEQ ID NO: 4825739 - DNA, 17 bp, Homo sapiens
cactgagaaggccccag

SEQ ID NO: 4825740 - DNA, 19 bp, Homo sapiens
cactgatatcacgggcccg

SEQ ID NO: 4825741 - DNA, 21 bp, Homo sapiens
cactgatatcacgggcccgct

SEQ ID NO: 4825742 - DNA, 22 bp, Homo sapiens
cactgatatcacgggcccgctc

SEQ ID NO: 4825743 - DNA, 20 bp, Homo sapiens
cactgatgggtcctgctgct

SEQ ID NO: 4825744 - DNA, 21 bp, Homo sapiens
cactgatgggtcctgctgctc

SEQ ID NO: 4825745 - DNA, 17 bp, Homo sapiens
cactgcaacccatgagc

SEQ ID NO: 4825746 - DNA, 13 bp, Homo sapiens
cactgcaacctcc

SEQ ID NO: 4825747 - DNA, 19 bp, Homo sapiens
cactgcaacctccacctcg

SEQ ID NO: 4825748 - DNA, 21 bp, Homo sapiens
cactgcaccctccacaggagc

SEQ ID NO: 4825749 - DNA, 22 bp, Homo sapiens
cactgcaccctccacaggagcc

SEQ ID NO: 4825750 - DNA, 17 bp, Homo sapiens
cactgccataacttgtt

SEQ ID NO: 4825751 - DNA, 17 bp, Homo sapiens
cactgcccacctgccag

SEQ ID NO: 4825752 - DNA, 19 bp, Homo sapiens
cactgcccacctgccaggc

SEQ ID NO: 4825753 - DNA, 15 bp, Homo sapiens
cactgcccgcacacc

SEQ ID NO: 4825754 - DNA, 20 bp, Homo sapiens
cactgccctccgcccttccc

SEQ ID NO: 4825755 - DNA, 21 bp, Homo sapiens
cactgccctccgcccttccct

SEQ ID NO: 4825756 - DNA, 15 bp, Homo sapiens
cactgcctctgcctt

SEQ ID NO: 4825757 - DNA, 15 bp, Homo sapiens
cactgctttttcctt

SEQ ID NO: 4825758 - DNA, 17 bp, Homo sapiens
cactgctttttccttag

SEQ ID NO: 4825759 - DNA, 18 bp, Homo sapiens
cactggaagggtccggct

SEQ ID NO: 4825760 - DNA, 15 bp, Homo sapiens
cactggagcgtgtac

SEQ ID NO: 4825761 - DNA, 21 bp, Homo sapiens
cactggccttctgatgaaatg

SEQ ID NO: 4825762 - DNA, 18 bp, Homo sapiens
cactggccttgcctccag

SEQ ID NO: 4825763 - DNA, 20 bp, Homo sapiens
cactggccttgcctccagga

SEQ ID NO: 4825764 - DNA, 13 bp, Homo sapiens
cactgggcctgct

SEQ ID NO: 4825765 - DNA, 23 bp, Homo sapiens
cactgggcttggggaccagagct

SEQ ID NO: 4825766 - DNA, 12 bp, Homo sapiens
cactgtgtccca

SEQ ID NO: 4825767 - DNA, 13 bp, Homo sapiens
cactgtgtcccag

SEQ ID NO: 4825768 - DNA, 19 bp, Homo sapiens
cactgtgtcccagtgtctg

SEQ ID NO: 4825769 - DNA, 15 bp, Homo sapiens
cactgtttggatatg

SEQ ID NO: 4825770 - DNA, 13 bp, Homo sapiens
cacttaaaatcaa

SEQ ID NO: 4825771 - DNA, 16 bp, Homo sapiens
cacttaaactttgtca

SEQ ID NO: 4825772 - DNA, 14 bp, Homo sapiens
cacttagaagatgt

SEQ ID NO: 4825773 - DNA, 23 bp, Homo sapiens
cacttagggagtgtgccttgggc

SEQ ID NO: 4825774 - DNA, 17 bp, Homo sapiens
cacttcacctccttctg

SEQ ID NO: 4825775 - DNA, 17 bp, Homo sapiens
cacttccccatctgtgt

SEQ ID NO: 4825776 - DNA, 12 bp, Homo sapiens
cacttccttaac

SEQ ID NO: 4825777 - DNA, 15 bp, Homo sapiens
cacttccttaacagc

SEQ ID NO: 4825778 - DNA, 17 bp, Homo sapiens
cacttctatttatttat

SEQ ID NO: 4825779 - DNA, 19 bp, Homo sapiens
cacttctatttatttatta

SEQ ID NO: 4825780 - DNA, 12 bp, Homo sapiens
cacttctctaga

SEQ ID NO: 4825781 - DNA, 14 bp, Homo sapiens
cacttcttaaggac

SEQ ID NO: 4825782 - DNA, 20 bp, Homo sapiens
cacttcttaaggacagtgtt

SEQ ID NO: 4825783 - DNA, 23 bp, Homo sapiens
cacttcttaaggacagtgttcaa

SEQ ID NO: 4825784 - DNA, 16 bp, Homo sapiens
cacttgacatcaactg

SEQ ID NO: 4825785 - DNA, 15 bp, Homo sapiens
cacttgagatgattt

SEQ ID NO: 4825786 - DNA, 15 bp, Homo sapiens
cacttgatgtctgag

SEQ ID NO: 4825787 - DNA, 15 bp, Homo sapiens
cacttgggctggcac

SEQ ID NO: 4825788 - DNA, 19 bp, Homo sapiens
cacttgggctggcacccac

SEQ ID NO: 4825789 - DNA, 19 bp, Homo sapiens
cacttgtggcagcttccct

SEQ ID NO: 4825790 - DNA, 16 bp, Homo sapiens
cactttacattcttgc

SEQ ID NO: 4825791 - DNA, 21 bp, Homo sapiens
cactttagaggcttgatcatg

SEQ ID NO: 4825792 - DNA, 13 bp, Homo sapiens
cactttggccaca

SEQ ID NO: 4825793 - DNA, 22 bp, Homo sapiens
cactttgtttcatattctcaga

SEQ ID NO: 4825794 - DNA, 19 bp, Homo sapiens
cacttttattgtataatta

SEQ ID NO: 4825795 - DNA, 18 bp, Homo sapiens
cacttttcatatcatttc

SEQ ID NO: 4825796 - DNA, 18 bp, Homo sapiens
cacttttttcctgtcaat

SEQ ID NO: 4825797 - DNA, 22 bp, Homo sapiens
cagaaaaacaatggtaacattt

SEQ ID NO: 4825798 - DNA, 19 bp, Homo sapiens
cagaaaaatcaatcatttt

SEQ ID NO: 4825799 - DNA, 18 bp, Homo sapiens
cagaaaaatgaaatttaa

SEQ ID NO: 4825800 - DNA, 11 bp, Homo sapiens
cagaaaagcac

SEQ ID NO: 4825801 - DNA, 16 bp, Homo sapiens
cagaaaagcacctctt

SEQ ID NO: 4825802 - DNA, 20 bp, Homo sapiens
cagaaaatggaagacagctc

SEQ ID NO: 4825803 - DNA, 22 bp, Homo sapiens
cagaaaatggaagacagctctt

SEQ ID NO: 4825804 - DNA, 18 bp, Homo sapiens
cagaaagggcagcccctc

SEQ ID NO: 4825805 - DNA, 20 bp, Homo sapiens
cagaaagggcagcccctccc

SEQ ID NO: 4825806 - DNA, 19 bp, Homo sapiens
cagaaatgtgctgcaaaga

SEQ ID NO: 4825807 - DNA, 19 bp, Homo sapiens
cagaaatgtggatgctctt

SEQ ID NO: 4825808 - DNA, 14 bp, Homo sapiens
cagaacaacaacaa

SEQ ID NO: 4825809 - DNA, 21 bp, Homo sapiens
cagaaccaacgggtctgtggg

SEQ ID NO: 4825810 - DNA, 13 bp, Homo sapiens
cagaaccagcact

SEQ ID NO: 4825811 - DNA, 14 bp, Homo sapiens
cagaaccagcactc

SEQ ID NO: 4825812 - DNA, 16 bp, Homo sapiens
cagaaccagcactccc

SEQ ID NO: 4825813 - DNA, 18 bp, Homo sapiens
cagaaccagcactcccag

SEQ ID NO: 4825814 - DNA, 15 bp, Homo sapiens
cagaacgcatgcagg

SEQ ID NO: 4825815 - DNA, 17 bp, Homo sapiens
cagaactgtcttagtca

SEQ ID NO: 4825816 - DNA, 22 bp, Homo sapiens
cagaagcagcagctagaaagag

SEQ ID NO: 4825817 - DNA, 20 bp, Homo sapiens
cagaagcccattaaaatagt

SEQ ID NO: 4825818 - DNA, 22 bp, Homo sapiens
cagaagccggcggagctctggc

SEQ ID NO: 4825819 - DNA, 13 bp, Homo sapiens
cagaagcttgtat

SEQ ID NO: 4825820 - DNA, 11 bp, Homo sapiens
cagaaggaagg

SEQ ID NO: 4825821 - DNA, 22 bp, Homo sapiens
cagaagtttctgccgcagccct

SEQ ID NO: 4825822 - DNA, 16 bp, Homo sapiens
cagaatgagatgattt

SEQ ID NO: 4825823 - DNA, 23 bp, Homo sapiens
cagaatgagatgatttaattctt

SEQ ID NO: 4825824 - DNA, 15 bp, Homo sapiens
cagaatgaggcacat

SEQ ID NO: 4825825 - DNA, 23 bp, Homo sapiens
cagaatgttgtgttggtatttac

SEQ ID NO: 4825826 - DNA, 21 bp, Homo sapiens
cagaattgaaccgtcaatgtg

SEQ ID NO: 4825827 - DNA, 23 bp, Homo sapiens
cagaattgggcccttagaatgtg

SEQ ID NO: 4825828 - DNA, 18 bp, Homo sapiens
cagaatttcccaaagcag

SEQ ID NO: 4825829 - DNA, 20 bp, Homo sapiens
cagaatttcccaaagcagtg

SEQ ID NO: 4825830 - DNA, 22 bp, Homo sapiens
cagacaaagcgtggtggacatg

SEQ ID NO: 4825831 - DNA, 14 bp, Homo sapiens
cagacaagccctgc

SEQ ID NO: 4825832 - DNA, 17 bp, Homo sapiens
cagacaagccctgcttg

SEQ ID NO: 4825833 - DNA, 16 bp, Homo sapiens
cagacacacggggcac

SEQ ID NO: 4825834 - DNA, 23 bp, Homo sapiens
cagacacacggggcacccagccc

SEQ ID NO: 4825835 - DNA, 11 bp, Homo sapiens
cagacacagag

SEQ ID NO: 4825836 - DNA, 15 bp, Homo sapiens
cagacagacagacag

SEQ ID NO: 4825837 - DNA, 17 bp, Homo sapiens
cagacagagatcagaat

SEQ ID NO: 4825838 - DNA, 16 bp, Homo sapiens
cagacagggcgtcctc

SEQ ID NO: 4825839 - DNA, 21 bp, Homo sapiens
cagaccccaccctgtctgcag

SEQ ID NO: 4825840 - DNA, 15 bp, Homo sapiens
cagacccctaccctt

SEQ ID NO: 4825841 - DNA, 15 bp, Homo sapiens
cagacccctggggga

SEQ ID NO: 4825842 - DNA, 23 bp, Homo sapiens
cagacccctgggggaggcttcca

SEQ ID NO: 4825843 - DNA, 24 bp, Homo sapiens
cagacccctgggggaggcttccag

SEQ ID NO: 4825844 - DNA, 23 bp, Homo sapiens
cagaccggggtggagtcagggct

SEQ ID NO: 4825845 - DNA, 20 bp, Homo sapiens
cagacctcactgctttgtag

SEQ ID NO: 4825846 - DNA, 20 bp, Homo sapiens
cagacgcggaaaccgggtgg

SEQ ID NO: 4825847 - DNA, 13 bp, Homo sapiens
cagacggggggct

SEQ ID NO: 4825848 - DNA, 19 bp, Homo sapiens
cagacgtggtgcttctcac

SEQ ID NO: 4825849 - DNA, 17 bp, Homo sapiens
cagactcgagagggctg

SEQ ID NO: 4825850 - DNA, 20 bp, Homo sapiens
cagactcgagagggctgagc

SEQ ID NO: 4825851 - DNA, 22 bp, Homo sapiens
cagactgccttatattattttc

SEQ ID NO: 4825852 - DNA, 20 bp, Homo sapiens
cagactgctgtcttactaat

SEQ ID NO: 4825853 - DNA, 20 bp, Homo sapiens
cagacttcgctattcccagg

SEQ ID NO: 4825854 - DNA, 19 bp, Homo sapiens
cagacttctaaaataaatg

SEQ ID NO: 4825855 - DNA, 22 bp, Homo sapiens
cagagaaccccccgcaatgtgc

SEQ ID NO: 4825856 - DNA, 13 bp, Homo sapiens
cagagaagaaaga

SEQ ID NO: 4825857 - DNA, 17 bp, Homo sapiens
cagagacacaagccttc

SEQ ID NO: 4825858 - DNA, 16 bp, Homo sapiens
cagagaccaccgcgcc

SEQ ID NO: 4825859 - DNA, 17 bp, Homo sapiens
cagagaccaccgcgccc

SEQ ID NO: 4825860 - DNA, 17 bp, Homo sapiens
cagagaccgtgagcgcc

SEQ ID NO: 4825861 - DNA, 14 bp, Homo sapiens
cagagacctgctcc

SEQ ID NO: 4825862 - DNA, 16 bp, Homo sapiens
cagagacctgctccag

SEQ ID NO: 4825863 - DNA, 19 bp, Homo sapiens
cagagacctgctccagatc

SEQ ID NO: 4825864 - DNA, 20 bp, Homo sapiens
cagagacctgctccagatcc

SEQ ID NO: 4825865 - DNA, 21 bp, Homo sapiens
cagagacctgctccagatcct

SEQ ID NO: 4825866 - DNA, 14 bp, Homo sapiens
cagagacggcagcc

SEQ ID NO: 4825867 - DNA, 15 bp, Homo sapiens
cagagacggcagccc

SEQ ID NO: 4825868 - DNA, 18 bp, Homo sapiens
cagagacggcagccccat

SEQ ID NO: 4825869 - DNA, 10 bp, Homo sapiens
cagagactgc

SEQ ID NO: 4825870 - DNA, 13 bp, Homo sapiens
cagagactgccca

SEQ ID NO: 4825871 - DNA, 14 bp, Homo sapiens
cagagactgcccac

SEQ ID NO: 4825872 - DNA, 16 bp, Homo sapiens
cagagactgcccaccc

SEQ ID NO: 4825873 - DNA, 20 bp, Homo sapiens
cagagactgcccaccctggg

SEQ ID NO: 4825874 - DNA, 21 bp, Homo sapiens
cagagactgcccaccctgggc

SEQ ID NO: 4825875 - DNA, 20 bp, Homo sapiens
cagagaggttaaggtgggta

SEQ ID NO: 4825876 - DNA, 20 bp, Homo sapiens
cagagatggtcatatttaaa

SEQ ID NO: 4825877 - DNA, 20 bp, Homo sapiens
cagagattgggggggcttgg

SEQ ID NO: 4825878 - DNA, 21 bp, Homo sapiens
cagagattgggggggcttggg

SEQ ID NO: 4825879 - DNA, 17 bp, Homo sapiens
cagagcaagaccccatc

SEQ ID NO: 4825880 - DNA, 13 bp, Homo sapiens
cagagcactgctc

SEQ ID NO: 4825881 - DNA, 22 bp, Homo sapiens
cagagcagatcagtctttgtca

SEQ ID NO: 4825882 - DNA, 18 bp, Homo sapiens
cagagcaggaaatgagag

SEQ ID NO: 4825883 - DNA, 21 bp, Homo sapiens
cagagccatccaccctgagga

SEQ ID NO: 4825884 - DNA, 13 bp, Homo sapiens
cagagcctgggcg

SEQ ID NO: 4825885 - DNA, 16 bp, Homo sapiens
cagagcctgttttaaa

SEQ ID NO: 4825886 - DNA, 23 bp, Homo sapiens
cagagcgatgtgttctttgtacc

SEQ ID NO: 4825887 - DNA, 20 bp, Homo sapiens
cagagctgatggagaaggaa

SEQ ID NO: 4825888 - DNA, 21 bp, Homo sapiens
cagagctgatggagaaggaag

SEQ ID NO: 4825889 - DNA, 13 bp, Homo sapiens
cagagctgccacc

SEQ ID NO: 4825890 - DNA, 16 bp, Homo sapiens
cagagctgctggaggt

SEQ ID NO: 4825891 - DNA, 19 bp, Homo sapiens
cagaggaaagcaaaggaga

SEQ ID NO: 4825892 - DNA, 13 bp, Homo sapiens
cagaggagagagg

SEQ ID NO: 4825893 - DNA, 15 bp, Homo sapiens
cagaggagagaggac

SEQ ID NO: 4825894 - DNA, 19 bp, Homo sapiens
cagaggagagaggaccccc

SEQ ID NO: 4825895 - DNA, 13 bp, Homo sapiens
cagaggagaggag

SEQ ID NO: 4825896 - DNA, 22 bp, Homo sapiens
cagaggagaggagcaaacagga

SEQ ID NO: 4825897 - DNA, 12 bp, Homo sapiens
cagaggatggct

SEQ ID NO: 4825898 - DNA, 16 bp, Homo sapiens
cagagggtccctaggt

SEQ ID NO: 4825899 - DNA, 17 bp, Homo sapiens
cagagggttgtgatttt

SEQ ID NO: 4825900 - DNA, 20 bp, Homo sapiens
cagagtacaaaatagttgta

SEQ ID NO: 4825901 - DNA, 16 bp, Homo sapiens
cagagtaggtgggtct

SEQ ID NO: 4825902 - DNA, 17 bp, Homo sapiens
cagagtaggtgggtctt

SEQ ID NO: 4825903 - DNA, 21 bp, Homo sapiens
cagagtaggtgggtcttggat

SEQ ID NO: 4825904 - DNA, 21 bp, Homo sapiens
cagagtatacaagtgtttcta

SEQ ID NO: 4825905 - DNA, 23 bp, Homo sapiens
cagagtatatatgtacagttata

SEQ ID NO: 4825906 - DNA, 14 bp, Homo sapiens
cagagtcattgtta

SEQ ID NO: 4825907 - DNA, 16 bp, Homo sapiens
cagagtgatttgtaaa

SEQ ID NO: 4825908 - DNA, 12 bp, Homo sapiens
cagagtggactc

SEQ ID NO: 4825909 - DNA, 20 bp, Homo sapiens
cagagtggatctggagtctg

SEQ ID NO: 4825910 - DNA, 12 bp, Homo sapiens
cagagtgtatgc

SEQ ID NO: 4825911 - DNA, 13 bp, Homo sapiens
cagagtgtatgca

SEQ ID NO: 4825912 - DNA, 13 bp, Homo sapiens
cagagtgtcctgc

SEQ ID NO: 4825913 - DNA, 14 bp, Homo sapiens
cagagtgtcctgct

SEQ ID NO: 4825914 - DNA, 18 bp, Homo sapiens
cagagttgaagacagagc

SEQ ID NO: 4825915 - DNA, 19 bp, Homo sapiens
cagagttgaagacagagct

SEQ ID NO: 4825916 - DNA, 22 bp, Homo sapiens
cagagttgaagacagagctaca

SEQ ID NO: 4825917 - DNA, 15 bp, Homo sapiens
cagataaatcatggg

SEQ ID NO: 4825918 - DNA, 19 bp, Homo sapiens
cagatccctcggtcagcac

SEQ ID NO: 4825919 - DNA, 23 bp, Homo sapiens
cagatcctccgcggaggcccctg

SEQ ID NO: 4825920 - DNA, 13 bp, Homo sapiens
cagatcctctttc

SEQ ID NO: 4825921 - DNA, 18 bp, Homo sapiens
cagatccttccaaactct

SEQ ID NO: 4825922 - DNA, 13 bp, Homo sapiens
cagatctagccag

SEQ ID NO: 4825923 - DNA, 14 bp, Homo sapiens
cagatctagccagg

SEQ ID NO: 4825924 - DNA, 22 bp, Homo sapiens
cagatctagccaggcctcccgc

SEQ ID NO: 4825925 - DNA, 20 bp, Homo sapiens
cagatctgcactcctgtctc

SEQ ID NO: 4825926 - DNA, 15 bp, Homo sapiens
cagatgacagggagc

SEQ ID NO: 4825927 - DNA, 18 bp, Homo sapiens
cagatgatctctccacgg

SEQ ID NO: 4825928 - DNA, 18 bp, Homo sapiens
cagatgatgggagtggga

SEQ ID NO: 4825929 - DNA, 13 bp, Homo sapiens
cagatgcaacctc

SEQ ID NO: 4825930 - DNA, 21 bp, Homo sapiens
cagatgggcaaggcctttggc

SEQ ID NO: 4825931 - DNA, 15 bp, Homo sapiens
cagatgggggcctct

SEQ ID NO: 4825932 - DNA, 23 bp, Homo sapiens
cagatgggttttgttaggggtgg

SEQ ID NO: 4825933 - DNA, 21 bp, Homo sapiens
cagatggtgtcctgcatgtat

SEQ ID NO: 4825934 - DNA, 23 bp, Homo sapiens
cagattattttctatatttggat

SEQ ID NO: 4825935 - DNA, 13 bp, Homo sapiens
cagattcaatttt

SEQ ID NO: 4825936 - DNA, 18 bp, Homo sapiens
cagattgtaaaggtaggt

SEQ ID NO: 4825937 - DNA, 15 bp, Homo sapiens
cagattgtatctgaa

SEQ ID NO: 4825938 - DNA, 13 bp, Homo sapiens
cagatttccaaaa

SEQ ID NO: 4825939 - DNA, 16 bp, Homo sapiens
cagatttccaaaagta

SEQ ID NO: 4825940 - DNA, 12 bp, Homo sapiens
cagcaaaaccat

SEQ ID NO: 4825941 - DNA, 13 bp, Homo sapiens
cagcaaaaccatt

SEQ ID NO: 4825942 - DNA, 20 bp, Homo sapiens
cagcaaaaccattgcttcac

SEQ ID NO: 4825943 - DNA, 13 bp, Homo sapiens
cagcaaaatatat

SEQ ID NO: 4825944 - DNA, 12 bp, Homo sapiens
cagcaacaacaa

SEQ ID NO: 4825945 - DNA, 14 bp, Homo sapiens
cagcaacaacaaca

SEQ ID NO: 4825946 - DNA, 17 bp, Homo sapiens
cagcaacaacaacagaa

SEQ ID NO: 4825947 - DNA, 14 bp, Homo sapiens
cagcaacacctgcc

SEQ ID NO: 4825948 - DNA, 22 bp, Homo sapiens
cagcaacattataatggccctg

SEQ ID NO: 4825949 - DNA, 21 bp, Homo sapiens
cagcacaaagcactggccttg

SEQ ID NO: 4825950 - DNA, 16 bp, Homo sapiens
cagcacacattgtgtt

SEQ ID NO: 4825951 - DNA, 22 bp, Homo sapiens
cagcacatgctggccagcctgg

SEQ ID NO: 4825952 - DNA, 13 bp, Homo sapiens
cagcaccagcctg

SEQ ID NO: 4825953 - DNA, 14 bp, Homo sapiens
cagcaccagcctga

SEQ ID NO: 4825954 - DNA, 19 bp, Homo sapiens
cagcaccatctctcctcct

SEQ ID NO: 4825955 - DNA, 12 bp, Homo sapiens
cagcaccctccc

SEQ ID NO: 4825956 - DNA, 14 bp, Homo sapiens
cagcaccctccccc

SEQ ID NO: 4825957 - DNA, 18 bp, Homo sapiens
cagcaccctcccccgcag

SEQ ID NO: 4825958 - DNA, 14 bp, Homo sapiens
cagcaccctctcct

SEQ ID NO: 4825959 - DNA, 17 bp, Homo sapiens
cagcaccctctcctggg

SEQ ID NO: 4825960 - DNA, 19 bp, Homo sapiens
cagcaccctctcctggggg

SEQ ID NO: 4825961 - DNA, 23 bp, Homo sapiens
cagcaccgtggtgtgaggccccc

SEQ ID NO: 4825962 - DNA, 13 bp, Homo sapiens
cagcacctcctcc

SEQ ID NO: 4825963 - DNA, 17 bp, Homo sapiens
cagcacctcctccgtgg

SEQ ID NO: 4825964 - DNA, 23 bp, Homo sapiens
cagcacctcctccgtgggcagct

SEQ ID NO: 4825965 - DNA, 14 bp, Homo sapiens
cagcactaaacttg

SEQ ID NO: 4825966 - DNA, 16 bp, Homo sapiens
cagcactaaggccgtg

SEQ ID NO: 4825967 - DNA, 12 bp, Homo sapiens
cagcactcccag

SEQ ID NO: 4825968 - DNA, 13 bp, Homo sapiens
cagcactcccagg

SEQ ID NO: 4825969 - DNA, 12 bp, Homo sapiens
cagcagcccccc

SEQ ID NO: 4825970 - DNA, 13 bp, Homo sapiens
cagcagcccccca

SEQ ID NO: 4825971 - DNA, 16 bp, Homo sapiens
cagcagccccccagca

SEQ ID NO: 4825972 - DNA, 17 bp, Homo sapiens
cagcagccccccagcac

SEQ ID NO: 4825973 - DNA, 13 bp, Homo sapiens
cagcagcggccca

SEQ ID NO: 4825974 - DNA, 18 bp, Homo sapiens
cagcagctagaaagagaa

SEQ ID NO: 4825975 - DNA, 11 bp, Homo sapiens
cagcagctcac

SEQ ID NO: 4825976 - DNA, 14 bp, Homo sapiens
cagcagctcaccat

SEQ ID NO: 4825977 - DNA, 15 bp, Homo sapiens
cagcagctccaacct

SEQ ID NO: 4825978 - DNA, 17 bp, Homo sapiens
cagcagctccaacctgg

SEQ ID NO: 4825979 - DNA, 20 bp, Homo sapiens
cagcagctccaacctggagg

SEQ ID NO: 4825980 - DNA, 12 bp, Homo sapiens
cagcagctggac

SEQ ID NO: 4825981 - DNA, 22 bp, Homo sapiens
cagcagctggactgggtgggcc

SEQ ID NO: 4825982 - DNA, 17 bp, Homo sapiens
cagcaggctctcaggcc

SEQ ID NO: 4825983 - DNA, 18 bp, Homo sapiens
cagcaggctctcaggcca

SEQ ID NO: 4825984 - DNA, 19 bp, Homo sapiens
cagcaggctctcaggccag

SEQ ID NO: 4825985 - DNA, 20 bp, Homo sapiens
cagcaggctctcaggccagc

SEQ ID NO: 4825986 - DNA, 21 bp, Homo sapiens
cagcaggttctctcctgtgag

SEQ ID NO: 4825987 - DNA, 22 bp, Homo sapiens
cagcagtaccatcccactgata

SEQ ID NO: 4825988 - DNA, 13 bp, Homo sapiens
cagcagttgctag

SEQ ID NO: 4825989 - DNA, 21 bp, Homo sapiens
cagcagttgctagcaacaact

SEQ ID NO: 4825990 - DNA, 23 bp, Homo sapiens
cagcataccagttcttgcaataa

SEQ ID NO: 4825991 - DNA, 16 bp, Homo sapiens
cagcatagttctgcaa

SEQ ID NO: 4825992 - DNA, 18 bp, Homo sapiens
cagcatcgtgtgggtccc

SEQ ID NO: 4825993 - DNA, 19 bp, Homo sapiens
cagcatcgtgtgggtccct

SEQ ID NO: 4825994 - DNA, 19 bp, Homo sapiens
cagcatgcatttagcatga

SEQ ID NO: 4825995 - DNA, 22 bp, Homo sapiens
cagcatgcatttagcatgagtt

SEQ ID NO: 4825996 - DNA, 22 bp, Homo sapiens
cagcatgtgctcagccccagac

SEQ ID NO: 4825997 - DNA, 16 bp, Homo sapiens
cagccaatttcaaaga

SEQ ID NO: 4825998 - DNA, 20 bp, Homo sapiens
cagccaatttcaaagaaaac

SEQ ID NO: 4825999 - DNA, 20 bp, Homo sapiens
cagccagaaactgaactggc

SEQ ID NO: 4826000 - DNA, 24 bp, Homo sapiens
cagccagcaggttctctcctgtga

SEQ ID NO: 4826001 - DNA, 17 bp, Homo sapiens
cagccagccgccctggg

SEQ ID NO: 4826002 - DNA, 18 bp, Homo sapiens
cagccagccgccctgggc

SEQ ID NO: 4826003 - DNA, 15 bp, Homo sapiens
cagccagcttggtgg

SEQ ID NO: 4826004 - DNA, 23 bp, Homo sapiens
cagccagcttggtggttatgtcc

SEQ ID NO: 4826005 - DNA, 14 bp, Homo sapiens
cagccatggctgga

SEQ ID NO: 4826006 - DNA, 22 bp, Homo sapiens
cagccatggctggatgtgcatc

SEQ ID NO: 4826007 - DNA, 22 bp, Homo sapiens
cagcccagagagaccctgccaa

SEQ ID NO: 4826008 - DNA, 20 bp, Homo sapiens
cagcccagtggaggaggggg

SEQ ID NO: 4826009 - DNA, 18 bp, Homo sapiens
cagcccatgtcaatcaag

SEQ ID NO: 4826010 - DNA, 12 bp, Homo sapiens
cagccccagggc

SEQ ID NO: 4826011 - DNA, 16 bp, Homo sapiens
cagccccagggccctg

SEQ ID NO: 4826012 - DNA, 18 bp, Homo sapiens
cagccccagggccctgct

SEQ ID NO: 4826013 - DNA, 21 bp, Homo sapiens
cagccccagggccctgctcag

SEQ ID NO: 4826014 - DNA, 21 bp, Homo sapiens
cagccccatcccaaacccttc

SEQ ID NO: 4826015 - DNA, 12 bp, Homo sapiens
cagccccatcct

SEQ ID NO: 4826016 - DNA, 17 bp, Homo sapiens
cagccccatccttcccg

SEQ ID NO: 4826017 - DNA, 13 bp, Homo sapiens
cagcccccacccc

SEQ ID NO: 4826018 - DNA, 14 bp, Homo sapiens
cagcccccaccccc

SEQ ID NO: 4826019 - DNA, 15 bp, Homo sapiens
cagcccccacccccg

SEQ ID NO: 4826020 - DNA, 14 bp, Homo sapiens
cagccccctgcttc

SEQ ID NO: 4826021 - DNA, 16 bp, Homo sapiens
cagccccgcgaccacc

SEQ ID NO: 4826022 - DNA, 19 bp, Homo sapiens
cagccccgcgaccacccct

SEQ ID NO: 4826023 - DNA, 20 bp, Homo sapiens
cagccccgcgaccacccctg

SEQ ID NO: 4826024 - DNA, 17 bp, Homo sapiens
cagcccctgctggacca

SEQ ID NO: 4826025 - DNA, 21 bp, Homo sapiens
cagcccctgttctggcagagt

SEQ ID NO: 4826026 - DNA, 20 bp, Homo sapiens
cagccccttgcttctaaggg

SEQ ID NO: 4826027 - DNA, 22 bp, Homo sapiens
cagccccttgcttctaagggat

SEQ ID NO: 4826028 - DNA, 20 bp, Homo sapiens
cagcccgatgtccctgtccc

SEQ ID NO: 4826029 - DNA, 15 bp, Homo sapiens
cagcccgcagaggtg

SEQ ID NO: 4826030 - DNA, 12 bp, Homo sapiens
cagccctgcacg

SEQ ID NO: 4826031 - DNA, 18 bp, Homo sapiens
cagccctgcagagggcac

SEQ ID NO: 4826032 - DNA, 13 bp, Homo sapiens
cagccctgcccag

SEQ ID NO: 4826033 - DNA, 14 bp, Homo sapiens
cagccctggggctg

SEQ ID NO: 4826034 - DNA, 20 bp, Homo sapiens
cagccgagatagccaaggcc

SEQ ID NO: 4826035 - DNA, 21 bp, Homo sapiens
cagccgagatagccaaggcca

SEQ ID NO: 4826036 - DNA, 13 bp, Homo sapiens
cagccgccctggg

SEQ ID NO: 4826037 - DNA, 14 bp, Homo sapiens
cagccgccctgggc

SEQ ID NO: 4826038 - DNA, 14 bp, Homo sapiens
cagccgccttcctt

SEQ ID NO: 4826039 - DNA, 22 bp, Homo sapiens
cagccgccttccttgaccttcc

SEQ ID NO: 4826040 - DNA, 17 bp, Homo sapiens
cagccgcgctctgcccc

SEQ ID NO: 4826041 - DNA, 20 bp, Homo sapiens
cagcctctgaagttggacag

SEQ ID NO: 4826042 - DNA, 12 bp, Homo sapiens
cagcctcttgaa

SEQ ID NO: 4826043 - DNA, 12 bp, Homo sapiens
cagcctgagcca

SEQ ID NO: 4826044 - DNA, 11 bp, Homo sapiens
cagcctgagct

SEQ ID NO: 4826045 - DNA, 12 bp, Homo sapiens
cagcctgagctc

SEQ ID NO: 4826046 - DNA, 15 bp, Homo sapiens
cagcctgagctccac

SEQ ID NO: 4826047 - DNA, 16 bp, Homo sapiens
cagcctgagctccacc

SEQ ID NO: 4826048 - DNA, 17 bp, Homo sapiens
cagcctgagctccaccc

SEQ ID NO: 4826049 - DNA, 13 bp, Homo sapiens
cagcctgcacaca

SEQ ID NO: 4826050 - DNA, 21 bp, Homo sapiens
cagcctgcacacacctgcctg

SEQ ID NO: 4826051 - DNA, 15 bp, Homo sapiens
cagcctgcacagtgg

SEQ ID NO: 4826052 - DNA, 15 bp, Homo sapiens
cagcctggccccaaa

SEQ ID NO: 4826053 - DNA, 18 bp, Homo sapiens
cagcctggccccaaatgt

SEQ ID NO: 4826054 - DNA, 15 bp, Homo sapiens
cagcctggggcctgg

SEQ ID NO: 4826055 - DNA, 16 bp, Homo sapiens
cagcctggggcctggc

SEQ ID NO: 4826056 - DNA, 19 bp, Homo sapiens
cagcctggggcctggcagg

SEQ ID NO: 4826057 - DNA, 22 bp, Homo sapiens
cagcctggggcctggcagggag

SEQ ID NO: 4826058 - DNA, 15 bp, Homo sapiens
cagcctgtgggtcct

SEQ ID NO: 4826059 - DNA, 16 bp, Homo sapiens
cagccttaaatccttt

SEQ ID NO: 4826060 - DNA, 16 bp, Homo sapiens
cagccttggttcctga

SEQ ID NO: 4826061 - DNA, 16 bp, Homo sapiens
cagcgacgcggcccgc

SEQ ID NO: 4826062 - DNA, 18 bp, Homo sapiens
cagcgacgcggcccgcgg

SEQ ID NO: 4826063 - DNA, 16 bp, Homo sapiens
cagcgattcctgccaa

SEQ ID NO: 4826064 - DNA, 20 bp, Homo sapiens
cagcgattcctgccaagtag

SEQ ID NO: 4826065 - DNA, 23 bp, Homo sapiens
cagcgattcctgccaagtagggt

SEQ ID NO: 4826066 - DNA, 12 bp, Homo sapiens
cagcgcctcccg

SEQ ID NO: 4826067 - DNA, 15 bp, Homo sapiens
cagcgcctcccgccg

SEQ ID NO: 4826068 - DNA, 15 bp, Homo sapiens
cagcggcagcagcag

SEQ ID NO: 4826069 - DNA, 19 bp, Homo sapiens
cagcggccccgcggagccc

SEQ ID NO: 4826070 - DNA, 20 bp, Homo sapiens
cagcggccccgcggagcccc

SEQ ID NO: 4826071 - DNA, 21 bp, Homo sapiens
cagcggccccgcggagccccc

SEQ ID NO: 4826072 - DNA, 18 bp, Homo sapiens
cagcggcccggcccacgc

SEQ ID NO: 4826073 - DNA, 20 bp, Homo sapiens
cagcggcccggcccacgcag

SEQ ID NO: 4826074 - DNA, 22 bp, Homo sapiens
cagcggcccggcccacgcagag

SEQ ID NO: 4826075 - DNA, 18 bp, Homo sapiens
cagcgggcgcgggacagg

SEQ ID NO: 4826076 - DNA, 23 bp, Homo sapiens
cagcgggcgcgggacaggacttg

SEQ ID NO: 4826077 - DNA, 22 bp, Homo sapiens
cagcgtaacggagggtgaagag

SEQ ID NO: 4826078 - DNA, 17 bp, Homo sapiens
cagcgtccctagcagtg

SEQ ID NO: 4826079 - DNA, 15 bp, Homo sapiens
cagcgtggggctaac

SEQ ID NO: 4826080 - DNA, 19 bp, Homo sapiens
cagctaacatggaagtact

SEQ ID NO: 4826081 - DNA, 20 bp, Homo sapiens
cagctaacatggaagtacta

SEQ ID NO: 4826082 - DNA, 19 bp, Homo sapiens
cagctaagcctgatgatgg

SEQ ID NO: 4826083 - DNA, 15 bp, Homo sapiens
cagctaatttgtgaa

SEQ ID NO: 4826084 - DNA, 16 bp, Homo sapiens
cagctaatttgtgaaa

SEQ ID NO: 4826085 - DNA, 21 bp, Homo sapiens
cagctactcagatctgcactc

SEQ ID NO: 4826086 - DNA, 13 bp, Homo sapiens
cagctcactgcaa

SEQ ID NO: 4826087 - DNA, 15 bp, Homo sapiens
cagctcaggggcagc

SEQ ID NO: 4826088 - DNA, 17 bp, Homo sapiens
cagctcagtcccacagc

SEQ ID NO: 4826089 - DNA, 14 bp, Homo sapiens
cagctccaacctgg

SEQ ID NO: 4826090 - DNA, 20 bp, Homo sapiens
cagctccaacctggaggctg

SEQ ID NO: 4826091 - DNA, 22 bp, Homo sapiens
cagctccaacctggaggctgga

SEQ ID NO: 4826092 - DNA, 17 bp, Homo sapiens
cagctccactctgaagt

SEQ ID NO: 4826093 - DNA, 12 bp, Homo sapiens
cagctccccaag

SEQ ID NO: 4826094 - DNA, 19 bp, Homo sapiens
cagctccggaaggacacag

SEQ ID NO: 4826095 - DNA, 15 bp, Homo sapiens
cagctcctcgggtgg

SEQ ID NO: 4826096 - DNA, 12 bp, Homo sapiens
cagctctaaagc

SEQ ID NO: 4826097 - DNA, 19 bp, Homo sapiens
cagctgcagttagcacaga

SEQ ID NO: 4826098 - DNA, 22 bp, Homo sapiens
cagctgcagttagcacagagga

SEQ ID NO: 4826099 - DNA, 12 bp, Homo sapiens
cagctgcctccg

SEQ ID NO: 4826100 - DNA, 18 bp, Homo sapiens
cagctgcctccgggcctc

SEQ ID NO: 4826101 - DNA, 22 bp, Homo sapiens
cagctgcctccgggcctcggcc

SEQ ID NO: 4826102 - DNA, 11 bp, Homo sapiens
cagctgcttct

SEQ ID NO: 4826103 - DNA, 12 bp, Homo sapiens
cagctgctttat

SEQ ID NO: 4826104 - DNA, 15 bp, Homo sapiens
cagctgctttcttct

SEQ ID NO: 4826105 - DNA, 22 bp, Homo sapiens
cagctggactgggtgggcccca

SEQ ID NO: 4826106 - DNA, 14 bp, Homo sapiens
cagctggcagcgcc

SEQ ID NO: 4826107 - DNA, 18 bp, Homo sapiens
cagctggcagcgcctccc

SEQ ID NO: 4826108 - DNA, 21 bp, Homo sapiens
cagctggcgcgtgtgtggcct

SEQ ID NO: 4826109 - DNA, 19 bp, Homo sapiens
cagctggggggctgtcctg

SEQ ID NO: 4826110 - DNA, 23 bp, Homo sapiens
cagctggggtggggacctcaggc

SEQ ID NO: 4826111 - DNA, 17 bp, Homo sapiens
cagctgtaccggccact

SEQ ID NO: 4826112 - DNA, 14 bp, Homo sapiens
cagctgtctgtggc

SEQ ID NO: 4826113 - DNA, 16 bp, Homo sapiens
cagcttcacttaaaat

SEQ ID NO: 4826114 - DNA, 22 bp, Homo sapiens
cagcttcacttaaaatcaaatt

SEQ ID NO: 4826115 - DNA, 18 bp, Homo sapiens
cagcttgaccgtgaggcc

SEQ ID NO: 4826116 - DNA, 17 bp, Homo sapiens
cagctttataataaact

SEQ ID NO: 4826117 - DNA, 20 bp, Homo sapiens
cagctttataataaactgtt

SEQ ID NO: 4826118 - DNA, 21 bp, Homo sapiens
cagctttatggagatataatt

SEQ ID NO: 4826119 - DNA, 20 bp, Homo sapiens
cagctttctctttgttcttc

SEQ ID NO: 4826120 - DNA, 15 bp, Homo sapiens
cagctttgaggctgg

SEQ ID NO: 4826121 - DNA, 22 bp, Homo sapiens
cagctttgggatctatatacat

SEQ ID NO: 4826122 - DNA, 14 bp, Homo sapiens
caggaaaaaaactt

SEQ ID NO: 4826123 - DNA, 22 bp, Homo sapiens
caggaaaaggtagcttacctga

SEQ ID NO: 4826124 - DNA, 13 bp, Homo sapiens
caggaaaccaaca

SEQ ID NO: 4826125 - DNA, 15 bp, Homo sapiens
caggaaagccctccc

SEQ ID NO: 4826126 - DNA, 19 bp, Homo sapiens
caggaaagccctccccctt

SEQ ID NO: 4826127 - DNA, 23 bp, Homo sapiens
caggaaatatctgtgaaggactt

SEQ ID NO: 4826128 - DNA, 18 bp, Homo sapiens
caggaacccatcactgtg

SEQ ID NO: 4826129 - DNA, 20 bp, Homo sapiens
caggaacccatcactgtgtc

SEQ ID NO: 4826130 - DNA, 13 bp, Homo sapiens
caggaaccgagga

SEQ ID NO: 4826131 - DNA, 16 bp, Homo sapiens
caggaaccgaggactc

SEQ ID NO: 4826132 - DNA, 18 bp, Homo sapiens
caggaaccgaggactcca

SEQ ID NO: 4826133 - DNA, 15 bp, Homo sapiens
caggaagagaaggag

SEQ ID NO: 4826134 - DNA, 17 bp, Homo sapiens
caggaagagaaggagca

SEQ ID NO: 4826135 - DNA, 21 bp, Homo sapiens
caggaagaggggcgctgcccc

SEQ ID NO: 4826136 - DNA, 16 bp, Homo sapiens
caggaagccagcaggc

SEQ ID NO: 4826137 - DNA, 19 bp, Homo sapiens
caggaagccagcaggctct

SEQ ID NO: 4826138 - DNA, 13 bp, Homo sapiens
caggaaggcctgg

SEQ ID NO: 4826139 - DNA, 18 bp, Homo sapiens
caggaaggcctgggtgga

SEQ ID NO: 4826140 - DNA, 12 bp, Homo sapiens
caggaaggggac

SEQ ID NO: 4826141 - DNA, 23 bp, Homo sapiens
caggaaggggacaggattgtctg

SEQ ID NO: 4826142 - DNA, 17 bp, Homo sapiens
caggaagtaattttctt

SEQ ID NO: 4826143 - DNA, 18 bp, Homo sapiens
caggaagtactggagaaa

SEQ ID NO: 4826144 - DNA, 20 bp, Homo sapiens
caggaagtactggagaaaat

SEQ ID NO: 4826145 - DNA, 16 bp, Homo sapiens
caggaagtcaggagcc

SEQ ID NO: 4826146 - DNA, 20 bp, Homo sapiens
caggaagtcaggagccagca

SEQ ID NO: 4826147 - DNA, 15 bp, Homo sapiens
caggaatgggccaag

SEQ ID NO: 4826148 - DNA, 15 bp, Homo sapiens
caggaccaccctgcc

SEQ ID NO: 4826149 - DNA, 16 bp, Homo sapiens
caggaccaccctgcca

SEQ ID NO: 4826150 - DNA, 18 bp, Homo sapiens
caggaccaccctgccaag

SEQ ID NO: 4826151 - DNA, 19 bp, Homo sapiens
caggaccaccctgccaagg

SEQ ID NO: 4826152 - DNA, 15 bp, Homo sapiens
caggaccctgggtca

SEQ ID NO: 4826153 - DNA, 18 bp, Homo sapiens
caggaccctgggtcacct

SEQ ID NO: 4826154 - DNA, 19 bp, Homo sapiens
caggaccctgggtcacctt

SEQ ID NO: 4826155 - DNA, 16 bp, Homo sapiens
caggaccttgcttcct

SEQ ID NO: 4826156 - DNA, 16 bp, Homo sapiens
caggacgcatgcaggg

SEQ ID NO: 4826157 - DNA, 19 bp, Homo sapiens
caggacgcatgcagggccc

SEQ ID NO: 4826158 - DNA, 14 bp, Homo sapiens
caggagaaggcctg

SEQ ID NO: 4826159 - DNA, 20 bp, Homo sapiens
caggagagattatttacaag

SEQ ID NO: 4826160 - DNA, 17 bp, Homo sapiens
caggagatgaggctgga

SEQ ID NO: 4826161 - DNA, 22 bp, Homo sapiens
caggagccagcagggcgggcca

SEQ ID NO: 4826162 - DNA, 23 bp, Homo sapiens
caggagccagcagggcgggccag

SEQ ID NO: 4826163 - DNA, 19 bp, Homo sapiens
caggagccgcagaggcccg

SEQ ID NO: 4826164 - DNA, 16 bp, Homo sapiens
caggagcgtgtactac

SEQ ID NO: 4826165 - DNA, 13 bp, Homo sapiens
caggagctcacac

SEQ ID NO: 4826166 - DNA, 13 bp, Homo sapiens
caggaggacctgg

SEQ ID NO: 4826167 - DNA, 18 bp, Homo sapiens
caggaggcaagcaagctc

SEQ ID NO: 4826168 - DNA, 15 bp, Homo sapiens
caggagggtctatgg

SEQ ID NO: 4826169 - DNA, 13 bp, Homo sapiens
caggagttccttt

SEQ ID NO: 4826170 - DNA, 14 bp, Homo sapiens
caggatatcacctg

SEQ ID NO: 4826171 - DNA, 19 bp, Homo sapiens
caggatatcacctgaatta

SEQ ID NO: 4826172 - DNA, 14 bp, Homo sapiens
caggatcctggcct

SEQ ID NO: 4826173 - DNA, 17 bp, Homo sapiens
caggatgaaggggccag

SEQ ID NO: 4826174 - DNA, 19 bp, Homo sapiens
caggatgaaggggccagac

SEQ ID NO: 4826175 - DNA, 21 bp, Homo sapiens
caggatgaggaacctcaaact

SEQ ID NO: 4826176 - DNA, 19 bp, Homo sapiens
caggatgcatgcagggccc

SEQ ID NO: 4826177 - DNA, 21 bp, Homo sapiens
caggattgtccacaaatgtcc

SEQ ID NO: 4826178 - DNA, 19 bp, Homo sapiens
caggattgtctgctgcctc

SEQ ID NO: 4826179 - DNA, 21 bp, Homo sapiens
caggcaacttcagtcctggga

SEQ ID NO: 4826180 - DNA, 23 bp, Homo sapiens
caggcaatagtgttgaggagggg

SEQ ID NO: 4826181 - DNA, 15 bp, Homo sapiens
caggcacacagcagc

SEQ ID NO: 4826182 - DNA, 19 bp, Homo sapiens
caggcaccatgctgggccg

SEQ ID NO: 4826183 - DNA, 20 bp, Homo sapiens
caggcagcctgtgggtcctt

SEQ ID NO: 4826184 - DNA, 21 bp, Homo sapiens
caggcattgcactaaaagtga

SEQ ID NO: 4826185 - DNA, 17 bp, Homo sapiens
caggccagctgcttggg

SEQ ID NO: 4826186 - DNA, 19 bp, Homo sapiens
caggccagctgcttgggct

SEQ ID NO: 4826187 - DNA, 16 bp, Homo sapiens
caggccatcaccacag

SEQ ID NO: 4826188 - DNA, 19 bp, Homo sapiens
caggccatcaccacagctg

SEQ ID NO: 4826189 - DNA, 14 bp, Homo sapiens
caggccattcagtc

SEQ ID NO: 4826190 - DNA, 19 bp, Homo sapiens
caggcccagcctggcccca

SEQ ID NO: 4826191 - DNA, 12 bp, Homo sapiens
caggcccgccct

SEQ ID NO: 4826192 - DNA, 16 bp, Homo sapiens
caggccctccctgact

SEQ ID NO: 4826193 - DNA, 15 bp, Homo sapiens
caggccctgcagtgt

SEQ ID NO: 4826194 - DNA, 16 bp, Homo sapiens
caggccctgcagtgtt

SEQ ID NO: 4826195 - DNA, 21 bp, Homo sapiens
caggccggccagcctcaccct

SEQ ID NO: 4826196 - DNA, 21 bp, Homo sapiens
caggcctcacctggcttccca

SEQ ID NO: 4826197 - DNA, 22 bp, Homo sapiens
caggcctcacctggcttcccag

SEQ ID NO: 4826198 - DNA, 15 bp, Homo sapiens
caggcctcccgcatg

SEQ ID NO: 4826199 - DNA, 23 bp, Homo sapiens
caggcctcccgcatgctgcctgc

SEQ ID NO: 4826200 - DNA, 12 bp, Homo sapiens
caggcctggccc

SEQ ID NO: 4826201 - DNA, 13 bp, Homo sapiens
caggcctggccca

SEQ ID NO: 4826202 - DNA, 14 bp, Homo sapiens
caggcctggcccag

SEQ ID NO: 4826203 - DNA, 19 bp, Homo sapiens
caggcctggcccagccagc

SEQ ID NO: 4826204 - DNA, 20 bp, Homo sapiens
caggcctggcccagccagca

SEQ ID NO: 4826205 - DNA, 23 bp, Homo sapiens
caggcctggcccagccagcaggt

SEQ ID NO: 4826206 - DNA, 13 bp, Homo sapiens
caggcgccgcctc

SEQ ID NO: 4826207 - DNA, 16 bp, Homo sapiens
caggcgccgcctcgcc

SEQ ID NO: 4826208 - DNA, 13 bp, Homo sapiens
caggcgcgcaccg

SEQ ID NO: 4826209 - DNA, 15 bp, Homo sapiens
caggcgcgcaccgcc

SEQ ID NO: 4826210 - DNA, 16 bp, Homo sapiens
caggcgcgcaccgccc

SEQ ID NO: 4826211 - DNA, 17 bp, Homo sapiens
caggcgcgcaccgccca

SEQ ID NO: 4826212 - DNA, 19 bp, Homo sapiens
caggcgcgcaccgcccaac

SEQ ID NO: 4826213 - DNA, 17 bp, Homo sapiens
caggcggaggggcttgg

SEQ ID NO: 4826214 - DNA, 20 bp, Homo sapiens
caggcggaggggcttggagc

SEQ ID NO: 4826215 - DNA, 21 bp, Homo sapiens
caggcggaggggcttggagca

SEQ ID NO: 4826216 - DNA, 14 bp, Homo sapiens
caggctaaagtgat

SEQ ID NO: 4826217 - DNA, 15 bp, Homo sapiens
caggctcaggctgcc

SEQ ID NO: 4826218 - DNA, 13 bp, Homo sapiens
caggctccccaag

SEQ ID NO: 4826219 - DNA, 18 bp, Homo sapiens
caggctccccaagacttg

SEQ ID NO: 4826220 - DNA, 16 bp, Homo sapiens
caggctctcaggccag

SEQ ID NO: 4826221 - DNA, 20 bp, Homo sapiens
caggctctcaggccagctgc

SEQ ID NO: 4826222 - DNA, 21 bp, Homo sapiens
caggctctcaggccagctgct

SEQ ID NO: 4826223 - DNA, 19 bp, Homo sapiens
caggctctcttgtattctt

SEQ ID NO: 4826224 - DNA, 21 bp, Homo sapiens
caggctgagacacagcccaga

SEQ ID NO: 4826225 - DNA, 23 bp, Homo sapiens
caggctgccgctgctctcccagg

SEQ ID NO: 4826226 - DNA, 14 bp, Homo sapiens
caggctgcgcctgc

SEQ ID NO: 4826227 - DNA, 17 bp, Homo sapiens
caggctgcgcctgcccg

SEQ ID NO: 4826228 - DNA, 19 bp, Homo sapiens
caggctgcgcctgcccgcc

SEQ ID NO: 4826229 - DNA, 20 bp, Homo sapiens
caggctgcgcctgcccgccc

SEQ ID NO: 4826230 - DNA, 21 bp, Homo sapiens
caggctgcgcctgcccgcccg

SEQ ID NO: 4826231 - DNA, 16 bp, Homo sapiens
caggctggagtgcagt

SEQ ID NO: 4826232 - DNA, 17 bp, Homo sapiens
caggctgttctgcactg

SEQ ID NO: 4826233 - DNA, 18 bp, Homo sapiens
caggctgttctgcactga

SEQ ID NO: 4826234 - DNA, 20 bp, Homo sapiens
caggctgttctgcactgaaa

SEQ ID NO: 4826235 - DNA, 14 bp, Homo sapiens
caggctttctattg

SEQ ID NO: 4826236 - DNA, 20 bp, Homo sapiens
cagggacagcctgcacagtg

SEQ ID NO: 4826237 - DNA, 15 bp, Homo sapiens
cagggactgcagctg

SEQ ID NO: 4826238 - DNA, 21 bp, Homo sapiens
cagggaggaggcagagaagaa

SEQ ID NO: 4826239 - DNA, 19 bp, Homo sapiens
cagggagggaacagacctc

SEQ ID NO: 4826240 - DNA, 17 bp, Homo sapiens
cagggaggtcaggccct

SEQ ID NO: 4826241 - DNA, 18 bp, Homo sapiens
cagggaggtcaggccctg

SEQ ID NO: 4826242 - DNA, 20 bp, Homo sapiens
cagggaggtcaggccctgga

SEQ ID NO: 4826243 - DNA, 13 bp, Homo sapiens
cagggatggggga

SEQ ID NO: 4826244 - DNA, 17 bp, Homo sapiens
cagggatgggggatggg

SEQ ID NO: 4826245 - DNA, 14 bp, Homo sapiens
cagggcaaatgaca

SEQ ID NO: 4826246 - DNA, 20 bp, Homo sapiens
cagggcaaatgacatgcact

SEQ ID NO: 4826247 - DNA, 22 bp, Homo sapiens
cagggcagtgctagtgagctgg

SEQ ID NO: 4826248 - DNA, 16 bp, Homo sapiens
cagggccagtcatggc

SEQ ID NO: 4826249 - DNA, 18 bp, Homo sapiens
cagggcccaaataacagt

SEQ ID NO: 4826250 - DNA, 15 bp, Homo sapiens
cagggcccccacagg

SEQ ID NO: 4826251 - DNA, 19 bp, Homo sapiens
cagggcccgagcgcgtgcc

SEQ ID NO: 4826252 - DNA, 17 bp, Homo sapiens
cagggccctggggtctc

SEQ ID NO: 4826253 - DNA, 24 bp, Homo sapiens
cagggccctggggtctctgagcag

SEQ ID NO: 4826254 - DNA, 19 bp, Homo sapiens
cagggccgcagggcgctcc

SEQ ID NO: 4826255 - DNA, 20 bp, Homo sapiens
cagggccgcagggcgctccg

SEQ ID NO: 4826256 - DNA, 23 bp, Homo sapiens
cagggccgccgaagggcagcccc

SEQ ID NO: 4826257 - DNA, 17 bp, Homo sapiens
cagggccgcttctcctg

SEQ ID NO: 4826258 - DNA, 19 bp, Homo sapiens
cagggccttggcccagggg

SEQ ID NO: 4826259 - DNA, 14 bp, Homo sapiens
cagggcgctccggc

SEQ ID NO: 4826260 - DNA, 15 bp, Homo sapiens
cagggcgctccggca

SEQ ID NO: 4826261 - DNA, 18 bp, Homo sapiens
cagggcgctccggcagag

SEQ ID NO: 4826262 - DNA, 13 bp, Homo sapiens
cagggcgggccag

SEQ ID NO: 4826263 - DNA, 15 bp, Homo sapiens
cagggcgggccagga

SEQ ID NO: 4826264 - DNA, 16 bp, Homo sapiens
cagggcgggccaggag

SEQ ID NO: 4826265 - DNA, 23 bp, Homo sapiens
cagggctgggcgcctctgtcctg

SEQ ID NO: 4826266 - DNA, 13 bp, Homo sapiens
cagggctgtgctt

SEQ ID NO: 4826267 - DNA, 14 bp, Homo sapiens
caggggaaaagagg

SEQ ID NO: 4826268 - DNA, 16 bp, Homo sapiens
caggggaaaagaggag

SEQ ID NO: 4826269 - DNA, 13 bp, Homo sapiens
caggggaggctga

SEQ ID NO: 4826270 - DNA, 19 bp, Homo sapiens
caggggagggtagagcgga

SEQ ID NO: 4826271 - DNA, 19 bp, Homo sapiens
caggggccgtgcagggcca

SEQ ID NO: 4826272 - DNA, 19 bp, Homo sapiens
caggggctgcagccccctg

SEQ ID NO: 4826273 - DNA, 21 bp, Homo sapiens
caggggctgcagccccctgct

SEQ ID NO: 4826274 - DNA, 21 bp, Homo sapiens
caggggctgcatcctcagccc

SEQ ID NO: 4826275 - DNA, 14 bp, Homo sapiens
caggggctggggac

SEQ ID NO: 4826276 - DNA, 22 bp, Homo sapiens
caggggggttgggttccagaca

SEQ ID NO: 4826277 - DNA, 22 bp, Homo sapiens
cagggtccagccctccgccagc

SEQ ID NO: 4826278 - DNA, 18 bp, Homo sapiens
cagggtggcacccaccac

SEQ ID NO: 4826279 - DNA, 15 bp, Homo sapiens
cagggtgttggaaga

SEQ ID NO: 4826280 - DNA, 21 bp, Homo sapiens
cagggttaaagaaaggcagag

SEQ ID NO: 4826281 - DNA, 21 bp, Homo sapiens
cagggttctagaaggggcgag

SEQ ID NO: 4826282 - DNA, 19 bp, Homo sapiens
cagggtttacccagtggga

SEQ ID NO: 4826283 - DNA, 21 bp, Homo sapiens
caggtatctgatgatgttctg

SEQ ID NO: 4826284 - DNA, 22 bp, Homo sapiens
caggtatctgatgatgttctga

SEQ ID NO: 4826285 - DNA, 21 bp, Homo sapiens
caggtattttcatcaagtagc

SEQ ID NO: 4826286 - DNA, 13 bp, Homo sapiens
caggtcacaggca

SEQ ID NO: 4826287 - DNA, 16 bp, Homo sapiens
caggtcccctggccct

SEQ ID NO: 4826288 - DNA, 20 bp, Homo sapiens
caggtcccctggcccttcct

SEQ ID NO: 4826289 - DNA, 22 bp, Homo sapiens
caggtcccctggcccttccttc

SEQ ID NO: 4826290 - DNA, 17 bp, Homo sapiens
caggtcctactggggaa

SEQ ID NO: 4826291 - DNA, 22 bp, Homo sapiens
caggtcctactggggaaacttc

SEQ ID NO: 4826292 - DNA, 12 bp, Homo sapiens
caggtcctgccc

SEQ ID NO: 4826293 - DNA, 21 bp, Homo sapiens
caggtgaaatccacaccagtc

SEQ ID NO: 4826294 - DNA, 16 bp, Homo sapiens
caggtgaccagaatga

SEQ ID NO: 4826295 - DNA, 17 bp, Homo sapiens
caggtgctcaaaatgca

SEQ ID NO: 4826296 - DNA, 15 bp, Homo sapiens
caggtggcatttgca

SEQ ID NO: 4826297 - DNA, 16 bp, Homo sapiens
caggtggcatttgcag

SEQ ID NO: 4826298 - DNA, 21 bp, Homo sapiens
caggtgtaaatatagtagcag

SEQ ID NO: 4826299 - DNA, 20 bp, Homo sapiens
caggtgtcctgactgtccta

SEQ ID NO: 4826300 - DNA, 21 bp, Homo sapiens
caggtgtcctgactgtcctac

SEQ ID NO: 4826301 - DNA, 17 bp, Homo sapiens
caggtgttttccttcac

SEQ ID NO: 4826302 - DNA, 19 bp, Homo sapiens
caggttccatccaccacct

SEQ ID NO: 4826303 - DNA, 22 bp, Homo sapiens
caggttccatccaccaccttgc

SEQ ID NO: 4826304 - DNA, 15 bp, Homo sapiens
caggttgactaagaa

SEQ ID NO: 4826305 - DNA, 13 bp, Homo sapiens
caggttggacccc

SEQ ID NO: 4826306 - DNA, 17 bp, Homo sapiens
caggttggaccccagag

SEQ ID NO: 4826307 - DNA, 21 bp, Homo sapiens
caggttttatgagacttccta

SEQ ID NO: 4826308 - DNA, 13 bp, Homo sapiens
caggttttctaat

SEQ ID NO: 4826309 - DNA, 20 bp, Homo sapiens
cagtaaatatacactttaca

SEQ ID NO: 4826310 - DNA, 17 bp, Homo sapiens
cagtaaatccacagtga

SEQ ID NO: 4826311 - DNA, 14 bp, Homo sapiens
cagtaaatgtatat

SEQ ID NO: 4826312 - DNA, 17 bp, Homo sapiens
cagtaaatgtatattga

SEQ ID NO: 4826313 - DNA, 22 bp, Homo sapiens
cagtaatctttcggtctcctta

SEQ ID NO: 4826314 - DNA, 20 bp, Homo sapiens
cagtacaataaataaaagaa

SEQ ID NO: 4826315 - DNA, 14 bp, Homo sapiens
cagtacaattcttt

SEQ ID NO: 4826316 - DNA, 17 bp, Homo sapiens
cagtacaattctttgtt

SEQ ID NO: 4826317 - DNA, 20 bp, Homo sapiens
cagtacaattctttgttgct

SEQ ID NO: 4826318 - DNA, 15 bp, Homo sapiens
cagtacatcttgtgc

SEQ ID NO: 4826319 - DNA, 17 bp, Homo sapiens
cagtacatcttgtgcat

SEQ ID NO: 4826320 - DNA, 19 bp, Homo sapiens
cagtacatcttgtgcatgc

SEQ ID NO: 4826321 - DNA, 20 bp, Homo sapiens
cagtacatcttgtgcatgca

SEQ ID NO: 4826322 - DNA, 15 bp, Homo sapiens
cagtacatgggaaag

SEQ ID NO: 4826323 - DNA, 15 bp, Homo sapiens
cagtaccatcccact

SEQ ID NO: 4826324 - DNA, 17 bp, Homo sapiens
cagtaccatcccactga

SEQ ID NO: 4826325 - DNA, 18 bp, Homo sapiens
cagtagctccgcgtgtct

SEQ ID NO: 4826326 - DNA, 13 bp, Homo sapiens
cagtagtgccaaa

SEQ ID NO: 4826327 - DNA, 21 bp, Homo sapiens
cagtagtgccaaaaggcccct

SEQ ID NO: 4826328 - DNA, 17 bp, Homo sapiens
cagtagtgcctgtgatc

SEQ ID NO: 4826329 - DNA, 20 bp, Homo sapiens
cagtagtgttgggtggagga

SEQ ID NO: 4826330 - DNA, 18 bp, Homo sapiens
cagtataaattacatgca

SEQ ID NO: 4826331 - DNA, 18 bp, Homo sapiens
cagtatagataaatccaa

SEQ ID NO: 4826332 - DNA, 15 bp, Homo sapiens
cagtatataagcttt

SEQ ID NO: 4826333 - DNA, 16 bp, Homo sapiens
cagtatattttatttc

SEQ ID NO: 4826334 - DNA, 19 bp, Homo sapiens
cagtatattttatttcaat

SEQ ID NO: 4826335 - DNA, 19 bp, Homo sapiens
cagtattatttagtaaaat

SEQ ID NO: 4826336 - DNA, 11 bp, Homo sapiens
cagtattctgt

SEQ ID NO: 4826337 - DNA, 13 bp, Homo sapiens
cagtattctgtag

SEQ ID NO: 4826338 - DNA, 14 bp, Homo sapiens
cagtattctgtagc

SEQ ID NO: 4826339 - DNA, 19 bp, Homo sapiens
cagtattgacaataagaaa

SEQ ID NO: 4826340 - DNA, 13 bp, Homo sapiens
cagtattgagaca

SEQ ID NO: 4826341 - DNA, 13 bp, Homo sapiens
cagtattgttctt

SEQ ID NO: 4826342 - DNA, 22 bp, Homo sapiens
cagtattgttcttgtaaaactg
